United States Patent 8,969,254 (OLIGONUCLEOTIDE ARRAY FOR TISSUE TYPING) - sequence listing, part 4

SEQ ID NO: 72842 - DNA, 31 bp, Artificial Sequence
  Description of Artificial Sequence: Synthetic oligonucleotide
ggacagacacttctataaccaggaggagtcc

SEQ ID NO: 72843 - DNA, 31 bp, Artificial Sequence
  Description of Artificial Sequence: Synthetic oligonucleotide
gacagacacttctataaccaggaggagtccg

SEQ ID NO: 72844 - DNA, 32 bp, Artificial Sequence
  Description of Artificial Sequence: Synthetic oligonucleotide
acagacacttctataaccaggaggagtccgtg

SEQ ID NO: 72845 - DNA, 31 bp, Artificial Sequence
  Description of Artificial Sequence: Synthetic oligonucleotide
cagacacttctataaccaggaggagtccgtg

SEQ ID NO: 72846 - DNA, 31 bp, Artificial Sequence
  Description of Artificial Sequence: Synthetic oligonucleotide
agacacttctataaccaggaggagtccgtgc

SEQ ID NO: 72847 - DNA, 30 bp, Artificial Sequence
  Description of Artificial Sequence: Synthetic oligonucleotide
gacacttctataaccaggaggagtccgtgc

SEQ ID NO: 72848 - DNA, 30 bp, Artificial Sequence
  Description of Artificial Sequence: Synthetic oligonucleotide
acacttctataaccaggaggagtccgtgcg

SEQ ID NO: 72849 - DNA, 29 bp, Artificial Sequence
  Description of Artificial Sequence: Synthetic oligonucleotide
cacttctataaccaggaggagtccgtgcg

SEQ ID NO: 72850 - DNA, 21 bp, Artificial Sequence
  Description of Artificial Sequence: Synthetic oligonucleotide
acgtgggggagttccgggcgg

SEQ ID NO: 72851 - DNA, 20 bp, Artificial Sequence
  Description of Artificial Sequence: Synthetic oligonucleotide
cgtgggggagttccgggcgg

SEQ ID NO: 72852 - DNA, 20 bp, Artificial Sequence
  Description of Artificial Sequence: Synthetic oligonucleotide
gtgggggagttccgggcggc

SEQ ID NO: 72853 - DNA, 21 bp, Artificial Sequence
  Description of Artificial Sequence: Synthetic oligonucleotide
tgggggagttccgggcggcga

SEQ ID NO: 72854 - DNA, 20 bp, Artificial Sequence
  Description of Artificial Sequence: Synthetic oligonucleotide
gggggagttccgggcggcga

SEQ ID NO: 72855 - DNA, 20 bp, Artificial Sequence
  Description of Artificial Sequence: Synthetic oligonucleotide
ggggagttccgggcggcgac

SEQ ID NO: 72856 - DNA, 20 bp, Artificial Sequence
  Description of Artificial Sequence: Synthetic oligonucleotide
gggagttccgggcggcgacg

SEQ ID NO: 72857 - DNA, 21 bp, Artificial Sequence
  Description of Artificial Sequence: Synthetic oligonucleotide
ggagttccgggcggcgacgga

SEQ ID NO: 72858 - DNA, 21 bp, Artificial Sequence
  Description of Artificial Sequence: Synthetic oligonucleotide
gagttccgggcggcgacggag

SEQ ID NO: 72859 - DNA, 22 bp, Artificial Sequence
  Description of Artificial Sequence: Synthetic oligonucleotide
agttccgggcggcgacggagct

SEQ ID NO: 72860 - DNA, 21 bp, Artificial Sequence
  Description of Artificial Sequence: Synthetic oligonucleotide
gttccgggcggcgacggagct

SEQ ID NO: 72861 - DNA, 21 bp, Artificial Sequence
  Description of Artificial Sequence: Synthetic oligonucleotide
ttccgggcggcgacggagctg

SEQ ID NO: 72862 - DNA, 20 bp, Artificial Sequence
  Description of Artificial Sequence: Synthetic oligonucleotide
tccgggcggcgacggagctg

SEQ ID NO: 72863 - DNA, 20 bp, Artificial Sequence
  Description of Artificial Sequence: Synthetic oligonucleotide
ccgggcggcgacggagctgt

SEQ ID NO: 72864 - DNA, 20 bp, Artificial Sequence
  Description of Artificial Sequence: Synthetic oligonucleotide
cgggcggcgacggagctggt

SEQ ID NO: 72865 - DNA, 20 bp, Artificial Sequence
  Description of Artificial Sequence: Synthetic oligonucleotide
gggcggcgacggagctgggt

SEQ ID NO: 72866 - DNA, 20 bp, Artificial Sequence
  Description of Artificial Sequence: Synthetic oligonucleotide
ggcggcgacggagctggggt

SEQ ID NO: 72867 - DNA, 20 bp, Artificial Sequence
  Description of Artificial Sequence: Synthetic oligonucleotide
gcggcgacggagctggggct

SEQ ID NO: 72868 - DNA, 20 bp, Artificial Sequence
  Description of Artificial Sequence: Synthetic oligonucleotide
cggcgacggagctggggcgt

SEQ ID NO: 72869 - DNA, 20 bp, Artificial Sequence
  Description of Artificial Sequence: Synthetic oligonucleotide
ggcgacggagctggggcggt

SEQ ID NO: 72870 - DNA, 20 bp, Artificial Sequence
  Description of Artificial Sequence: Synthetic oligonucleotide
gcgacggagctggggcggct

SEQ ID NO: 72871 - DNA, 20 bp, Artificial Sequence
  Description of Artificial Sequence: Synthetic oligonucleotide
cgacggagctggggcggcct

SEQ ID NO: 72872 - DNA, 31 bp, Artificial Sequence
  Description of Artificial Sequence: Synthetic oligonucleotide
tgacgctgagtactggaacagccagaagaac

SEQ ID NO: 72873 - DNA, 30 bp, Artificial Sequence
  Description of Artificial Sequence: Synthetic oligonucleotide
gacgctgagtactggaacagccagaagaac

SEQ ID NO: 72874 - DNA, 32 bp, Artificial Sequence
  Description of Artificial Sequence: Synthetic oligonucleotide
acgctgagtactggaacagccagaagaacatc

SEQ ID NO: 72875 - DNA, 31 bp, Artificial Sequence
  Description of Artificial Sequence: Synthetic oligonucleotide
cgctgagtactggaacagccagaagaacatc

SEQ ID NO: 72876 - DNA, 31 bp, Artificial Sequence
  Description of Artificial Sequence: Synthetic oligonucleotide
gctgagtactggaacagccagaagaacatcc

SEQ ID NO: 72877 - DNA, 32 bp, Artificial Sequence
  Description of Artificial Sequence: Synthetic oligonucleotide
ctgagtactggaacagccagaagaacatcctg

SEQ ID NO: 72878 - DNA, 32 bp, Artificial Sequence
  Description of Artificial Sequence: Synthetic oligonucleotide
tgagtactggaacagccagaagaacatcctgg

SEQ ID NO: 72879 - DNA, 31 bp, Artificial Sequence
  Description of Artificial Sequence: Synthetic oligonucleotide
gagtactggaacagccagaagaacatcctgg

SEQ ID NO: 72880 - DNA, 32 bp, Artificial Sequence
  Description of Artificial Sequence: Synthetic oligonucleotide
agtactggaacagccagaagaacatcctggag

SEQ ID NO: 72881 - DNA, 31 bp, Artificial Sequence
  Description of Artificial Sequence: Synthetic oligonucleotide
gtactggaacagccagaagaacatcctggag

SEQ ID NO: 72882 - DNA, 31 bp, Artificial Sequence
  Description of Artificial Sequence: Synthetic oligonucleotide
tactggaacagccagaagaacatcctggagc

SEQ ID NO: 72883 - DNA, 30 bp, Artificial Sequence
  Description of Artificial Sequence: Synthetic oligonucleotide
actggaacagccagaagaacatcctggagc

SEQ ID NO: 72884 - DNA, 29 bp, Artificial Sequence
  Description of Artificial Sequence: Synthetic oligonucleotide
ctggaacagccagaagaacatcctggagc

SEQ ID NO: 72885 - DNA, 30 bp, Artificial Sequence
  Description of Artificial Sequence: Synthetic oligonucleotide
tggaacagccagaagaacatcctggagcag

SEQ ID NO: 72886 - DNA, 29 bp, Artificial Sequence
  Description of Artificial Sequence: Synthetic oligonucleotide
ggaacagccagaagaacatcctggagcag

SEQ ID NO: 72887 - DNA, 29 bp, Artificial Sequence
  Description of Artificial Sequence: Synthetic oligonucleotide
gaacagccagaagaacatcctggagcagg

SEQ ID NO: 72888 - DNA, 29 bp, Artificial Sequence
  Description of Artificial Sequence: Synthetic oligonucleotide
aacagccagaagaacatcctggagcaggc

SEQ ID NO: 72889 - DNA, 28 bp, Artificial Sequence
  Description of Artificial Sequence: Synthetic oligonucleotide
acagccagaagaacatcctggagcaggc

SEQ ID NO: 72890 - DNA, 27 bp, Artificial Sequence
  Description of Artificial Sequence: Synthetic oligonucleotide
cagccagaagaacatcctggagcaggc

SEQ ID NO: 72891 - DNA, 27 bp, Artificial Sequence
  Description of Artificial Sequence: Synthetic oligonucleotide
agccagaagaacatcctggagcaggcg

SEQ ID NO: 72892 - DNA, 26 bp, Artificial Sequence
  Description of Artificial Sequence: Synthetic oligonucleotide
gccagaagaacatcctggagcaggcg

SEQ ID NO: 72893 - DNA, 26 bp, Artificial Sequence
  Description of Artificial Sequence: Synthetic oligonucleotide
ccagaagaacatcctggagcaggcgc

SEQ ID NO: 72894 - DNA, 26 bp, Artificial Sequence
  Description of Artificial Sequence: Synthetic oligonucleotide
cagaagaacatcctggagcaggcgcg

SEQ ID NO: 72895 - DNA, 26 bp, Artificial Sequence
  Description of Artificial Sequence: Synthetic oligonucleotide
agaagaacatcctggagcaggcgcgg

SEQ ID NO: 72896 - DNA, 25 bp, Artificial Sequence
  Description of Artificial Sequence: Synthetic oligonucleotide
gaagaacatcctggagcaggcgcgg

SEQ ID NO: 72897 - DNA, 25 bp, Artificial Sequence
  Description of Artificial Sequence: Synthetic oligonucleotide
aagaacatcctggagcaggcgcggg

SEQ ID NO: 72898 - DNA, 24 bp, Artificial Sequence
  Description of Artificial Sequence: Synthetic oligonucleotide
agaacatcctggagcaggcgcggg

SEQ ID NO: 72899 - DNA, 23 bp, Artificial Sequence
  Description of Artificial Sequence: Synthetic oligonucleotide
gaacatcctggagcaggcgcggg

SEQ ID NO: 72900 - DNA, 23 bp, Artificial Sequence
  Description of Artificial Sequence: Synthetic oligonucleotide
aacatcctggagcaggcgcgggc

SEQ ID NO: 72901 - DNA, 26 bp, Artificial Sequence
  Description of Artificial Sequence: Synthetic oligonucleotide
ttcgacagcgacgtgggggagttcca

SEQ ID NO: 72902 - DNA, 25 bp, Artificial Sequence
  Description of Artificial Sequence: Synthetic oligonucleotide
tcgacagcgacgtgggggagttcca

SEQ ID NO: 72903 - DNA, 24 bp, Artificial Sequence
  Description of Artificial Sequence: Synthetic oligonucleotide
cgacagcgacgtgggggagttcca

SEQ ID NO: 72904 - DNA, 24 bp, Artificial Sequence
  Description of Artificial Sequence: Synthetic oligonucleotide
gacagcgacgtgggggagttccag

SEQ ID NO: 72905 - DNA, 24 bp, Artificial Sequence
  Description of Artificial Sequence: Synthetic oligonucleotide
acagcgacgtgggggagttccagg

SEQ ID NO: 72906 - DNA, 23 bp, Artificial Sequence
  Description of Artificial Sequence: Synthetic oligonucleotide
cagcgacgtgggggagttccagg

SEQ ID NO: 72907 - DNA, 23 bp, Artificial Sequence
  Description of Artificial Sequence: Synthetic oligonucleotide
agcgacgtgggggagttccaggc

SEQ ID NO: 72908 - DNA, 22 bp, Artificial Sequence
  Description of Artificial Sequence: Synthetic oligonucleotide
gcgacgtgggggagttccaggc

SEQ ID NO: 72909 - DNA, 22 bp, Artificial Sequence
  Description of Artificial Sequence: Synthetic oligonucleotide
cgacgtgggggagttccaggcg

SEQ ID NO: 72910 - DNA, 23 bp, Artificial Sequence
  Description of Artificial Sequence: Synthetic oligonucleotide
gacgtgggggagttccaggcggt

SEQ ID NO: 72911 - DNA, 24 bp, Artificial Sequence
  Description of Artificial Sequence: Synthetic oligonucleotide
acgtgggggagttccaggcggtga

SEQ ID NO: 72912 - DNA, 23 bp, Artificial Sequence
  Description of Artificial Sequence: Synthetic oligonucleotide
cgtgggggagttccaggcggtga

SEQ ID NO: 72913 - DNA, 23 bp, Artificial Sequence
  Description of Artificial Sequence: Synthetic oligonucleotide
gtgggggagttccaggcggtgac

SEQ ID NO: 72914 - DNA, 23 bp, Artificial Sequence
  Description of Artificial Sequence: Synthetic oligonucleotide
tgggggagttccaggcggtgacg

SEQ ID NO: 72915 - DNA, 22 bp, Artificial Sequence
  Description of Artificial Sequence: Synthetic oligonucleotide
gggggagttccaggcggtgacg

SEQ ID NO: 72916 - DNA, 23 bp, Artificial Sequence
  Description of Artificial Sequence: Synthetic oligonucleotide
ggggagttccaggcggtgacgga

SEQ ID NO: 72917 - DNA, 23 bp, Artificial Sequence
  Description of Artificial Sequence: Synthetic oligonucleotide
gggagttccaggcggtgacggag

SEQ ID NO: 72918 - DNA, 24 bp, Artificial Sequence
  Description of Artificial Sequence: Synthetic oligonucleotide
ggagttccaggcggtgacggagct

SEQ ID NO: 72919 - DNA, 24 bp, Artificial Sequence
  Description of Artificial Sequence: Synthetic oligonucleotide
gagttccaggcggtgacggagctg

SEQ ID NO: 72920 - DNA, 24 bp, Artificial Sequence
  Description of Artificial Sequence: Synthetic oligonucleotide
agttccaggcggtgacggagctgg

SEQ ID NO: 72921 - DNA, 23 bp, Artificial Sequence
  Description of Artificial Sequence: Synthetic oligonucleotide
gttccaggcggtgacggagctgg

SEQ ID NO: 72922 - DNA, 23 bp, Artificial Sequence
  Description of Artificial Sequence: Synthetic oligonucleotide
ttccaggcggtgacggagctggg

SEQ ID NO: 72923 - DNA, 22 bp, Artificial Sequence
  Description of Artificial Sequence: Synthetic oligonucleotide
tccaggcggtgacggagctggg

SEQ ID NO: 72924 - DNA, 27 bp, Artificial Sequence
  Description of Artificial Sequence: Synthetic oligonucleotide
ctgacgctgagtactggaacagccagg

SEQ ID NO: 72925 - DNA, 28 bp, Artificial Sequence
  Description of Artificial Sequence: Synthetic oligonucleotide
tgacgctgagtactggaacagccaggac

SEQ ID NO: 72926 - DNA, 27 bp, Artificial Sequence
  Description of Artificial Sequence: Synthetic oligonucleotide
gacgctgagtactggaacagccaggac

SEQ ID NO: 72927 - DNA, 29 bp, Artificial Sequence
  Description of Artificial Sequence: Synthetic oligonucleotide
acgctgagtactggaacagccaggacatc

SEQ ID NO: 72928 - DNA, 28 bp, Artificial Sequence
  Description of Artificial Sequence: Synthetic oligonucleotide
cgctgagtactggaacagccaggacatc

SEQ ID NO: 72929 - DNA, 28 bp, Artificial Sequence
  Description of Artificial Sequence: Synthetic oligonucleotide
gctgagtactggaacagccaggacatcc

SEQ ID NO: 72930 - DNA, 29 bp, Artificial Sequence
  Description of Artificial Sequence: Synthetic oligonucleotide
ctgagtactggaacagccaggacatcctg

SEQ ID NO: 72931 - DNA, 29 bp, Artificial Sequence
  Description of Artificial Sequence: Synthetic oligonucleotide
tgagtactggaacagccaggacatcctgg

SEQ ID NO: 72932 - DNA, 28 bp, Artificial Sequence
  Description of Artificial Sequence: Synthetic oligonucleotide
gagtactggaacagccaggacatcctgg

SEQ ID NO: 72933 - DNA, 29 bp, Artificial Sequence
  Description of Artificial Sequence: Synthetic oligonucleotide
agtactggaacagccaggacatcctggag

SEQ ID NO: 72934 - DNA, 28 bp, Artificial Sequence
  Description of Artificial Sequence: Synthetic oligonucleotide
gtactggaacagccaggacatcctggag

SEQ ID NO: 72935 - DNA, 28 bp, Artificial Sequence
  Description of Artificial Sequence: Synthetic oligonucleotide
tactggaacagccaggacatcctggagc

SEQ ID NO: 72936 - DNA, 27 bp, Artificial Sequence
  Description of Artificial Sequence: Synthetic oligonucleotide
actggaacagccaggacatcctggagc

SEQ ID NO: 72937 - DNA, 27 bp, Artificial Sequence
  Description of Artificial Sequence: Synthetic oligonucleotide
ctggaacagccaggacatcctggagca

SEQ ID NO: 72938 - DNA, 27 bp, Artificial Sequence
  Description of Artificial Sequence: Synthetic oligonucleotide
tggaacagccaggacatcctggagcag

SEQ ID NO: 72939 - DNA, 26 bp, Artificial Sequence
  Description of Artificial Sequence: Synthetic oligonucleotide
ggaacagccaggacatcctggagcag

SEQ ID NO: 72940 - DNA, 26 bp, Artificial Sequence
  Description of Artificial Sequence: Synthetic oligonucleotide
gaacagccaggacatcctggagcagg

SEQ ID NO: 72941 - DNA, 26 bp, Artificial Sequence
  Description of Artificial Sequence: Synthetic oligonucleotide
aacagccaggacatcctggagcaggc

SEQ ID NO: 72942 - DNA, 25 bp, Artificial Sequence
  Description of Artificial Sequence: Synthetic oligonucleotide
acagccaggacatcctggagcaggc

SEQ ID NO: 72943 - DNA, 24 bp, Artificial Sequence
  Description of Artificial Sequence: Synthetic oligonucleotide
cagccaggacatcctggagcaggc

SEQ ID NO: 72944 - DNA, 24 bp, Artificial Sequence
  Description of Artificial Sequence: Synthetic oligonucleotide
agccaggacatcctggagcaggcg

SEQ ID NO: 72945 - DNA, 23 bp, Artificial Sequence
  Description of Artificial Sequence: Synthetic oligonucleotide
gccaggacatcctggagcaggcg

SEQ ID NO: 72946 - DNA, 23 bp, Artificial Sequence
  Description of Artificial Sequence: Synthetic oligonucleotide
ccaggacatcctggagcaggcgc

SEQ ID NO: 72947 - DNA, 23 bp, Artificial Sequence
  Description of Artificial Sequence: Synthetic oligonucleotide
caggacatcctggagcaggcgcg

SEQ ID NO: 72948 - DNA, 33 bp, Artificial Sequence
  Description of Artificial Sequence: Synthetic oligonucleotide
gcagcctaagagggagtgtcatttcttcaatgc

SEQ ID NO: 72949 - DNA, 33 bp, Artificial Sequence
  Description of Artificial Sequence: Synthetic oligonucleotide
cagcctaagagggagtgtcatttcttcaatgcg

SEQ ID NO: 72950 - DNA, 34 bp, Artificial Sequence
  Description of Artificial Sequence: Synthetic oligonucleotide
agcctaagagggagtgtcatttcttcaatgcgac

SEQ ID NO: 72951 - DNA, 33 bp, Artificial Sequence
  Description of Artificial Sequence: Synthetic oligonucleotide
gcctaagagggagtgtcatttcttcaatgcgac

SEQ ID NO: 72952 - DNA, 33 bp, Artificial Sequence
  Description of Artificial Sequence: Synthetic oligonucleotide
cctaagagggagtgtcatttcttcaatgcgacg

SEQ ID NO: 72953 - DNA, 33 bp, Artificial Sequence
  Description of Artificial Sequence: Synthetic oligonucleotide
ctaagagggagtgtcatttcttcaatgcgacgg

SEQ ID NO: 72954 - DNA, 34 bp, Artificial Sequence
  Description of Artificial Sequence: Synthetic oligonucleotide
taagagggagtgtcatttcttcaatgcgacggag

SEQ ID NO: 72955 - DNA, 33 bp, Artificial Sequence
  Description of Artificial Sequence: Synthetic oligonucleotide
aagagggagtgtcatttcttcaatgcgacggag

SEQ ID NO: 72956 - DNA, 32 bp, Artificial Sequence
  Description of Artificial Sequence: Synthetic oligonucleotide
agagggagtgtcatttcttcaatgcgacggag

SEQ ID NO: 72957 - DNA, 31 bp, Artificial Sequence
  Description of Artificial Sequence: Synthetic oligonucleotide
gagggagtgtcatttcttcaatgcgacggag

SEQ ID NO: 72958 - DNA, 31 bp, Artificial Sequence
  Description of Artificial Sequence: Synthetic oligonucleotide
agggagtgtcatttcttcaatgcgacggagc

SEQ ID NO: 72959 - DNA, 30 bp, Artificial Sequence
  Description of Artificial Sequence: Synthetic oligonucleotide
gggagtgtcatttcttcaatgcgacggagc

SEQ ID NO: 72960 - DNA, 30 bp, Artificial Sequence
  Description of Artificial Sequence: Synthetic oligonucleotide
ggagtgtcatttcttcaatgcgacggagcg

SEQ ID NO: 72961 - DNA, 30 bp, Artificial Sequence
  Description of Artificial Sequence: Synthetic oligonucleotide
gagtgtcatttcttcaatgcgacggagcgg

SEQ ID NO: 72962 - DNA, 30 bp, Artificial Sequence
  Description of Artificial Sequence: Synthetic oligonucleotide
agtgtcatttcttcaatgcgacggagcggg

SEQ ID NO: 72963 - DNA, 29 bp, Artificial Sequence
  Description of Artificial Sequence: Synthetic oligonucleotide
gtgtcatttcttcaatgcgacggagcggg

SEQ ID NO: 72964 - DNA, 30 bp, Artificial Sequence
  Description of Artificial Sequence: Synthetic oligonucleotide
tgtcatttcttcaatgcgacggagcgggtg

SEQ ID NO: 72965 - DNA, 29 bp, Artificial Sequence
  Description of Artificial Sequence: Synthetic oligonucleotide
gtcatttcttcaatgcgacggagcgggtg

SEQ ID NO: 72966 - DNA, 29 bp, Artificial Sequence
  Description of Artificial Sequence: Synthetic oligonucleotide
tcatttcttcaatgcgacggagcgggtgc

SEQ ID NO: 72967 - DNA, 28 bp, Artificial Sequence
  Description of Artificial Sequence: Synthetic oligonucleotide
catttcttcaatgcgacggagcgggtgc

SEQ ID NO: 72968 - DNA, 28 bp, Artificial Sequence
  Description of Artificial Sequence: Synthetic oligonucleotide
atttcttcaatgcgacggagcgggtgcg

SEQ ID NO: 72969 - DNA, 27 bp, Artificial Sequence
  Description of Artificial Sequence: Synthetic oligonucleotide
tttcttcaatgcgacggagcgggtgcg

SEQ ID NO: 72970 - DNA, 26 bp, Artificial Sequence
  Description of Artificial Sequence: Synthetic oligonucleotide
ttcttcaatgcgacggagcgggtgcg

SEQ ID NO: 72971 - DNA, 25 bp, Artificial Sequence
  Description of Artificial Sequence: Synthetic oligonucleotide
tcttcaatgcgacggagcgggtgcg

SEQ ID NO: 72972 - DNA, 24 bp, Artificial Sequence
  Description of Artificial Sequence: Synthetic oligonucleotide
cttcaatgcgacggagcgggtgcg

SEQ ID NO: 72973 - DNA, 26 bp, Artificial Sequence
  Description of Artificial Sequence: Synthetic oligonucleotide
ttcaatgcgacggagcgggtgcggtt

SEQ ID NO: 72974 - DNA, 25 bp, Artificial Sequence
  Description of Artificial Sequence: Synthetic oligonucleotide
tcaatgcgacggagcgggtgcggtt

SEQ ID NO: 72975 - DNA, 24 bp, Artificial Sequence
  Description of Artificial Sequence: Synthetic oligonucleotide
caatgcgacggagcgggtgcggtt

SEQ ID NO: 72976 - DNA, 24 bp, Artificial Sequence
  Description of Artificial Sequence: Synthetic oligonucleotide
aatgcgacggagcgggtgcggttc

SEQ ID NO: 72977 - DNA, 23 bp, Artificial Sequence
  Description of Artificial Sequence: Synthetic oligonucleotide
atgcgacggagcgggtgcggttc

SEQ ID NO: 72978 - DNA, 22 bp, Artificial Sequence
  Description of Artificial Sequence: Synthetic oligonucleotide
tgcgacggagcgggtgcggttc

SEQ ID NO: 72979 - DNA, 21 bp, Artificial Sequence
  Description of Artificial Sequence: Synthetic oligonucleotide
gcgacggagcgggtgcggttc

SEQ ID NO: 72980 - DNA, 22 bp, Artificial Sequence
  Description of Artificial Sequence: Synthetic oligonucleotide
cgacggagcgggtgcggttcct

SEQ ID NO: 72981 - DNA, 26 bp, Artificial Sequence
  Description of Artificial Sequence: Synthetic oligonucleotide
cgcttcgacagcgacgtgagggagtt

SEQ ID NO: 72982 - DNA, 26 bp, Artificial Sequence
  Description of Artificial Sequence: Synthetic oligonucleotide
gcttcgacagcgacgtgagggagttc

SEQ ID NO: 72983 - DNA, 26 bp, Artificial Sequence
  Description of Artificial Sequence: Synthetic oligonucleotide
cttcgacagcgacgtgagggagttcc

SEQ ID NO: 72984 - DNA, 26 bp, Artificial Sequence
  Description of Artificial Sequence: Synthetic oligonucleotide
ttcgacagcgacgtgagggagttccg

SEQ ID NO: 72985 - DNA, 25 bp, Artificial Sequence
  Description of Artificial Sequence: Synthetic oligonucleotide
tcgacagcgacgtgagggagttccg

SEQ ID NO: 72986 - DNA, 24 bp, Artificial Sequence
  Description of Artificial Sequence: Synthetic oligonucleotide
cgacagcgacgtgagggagttccg

SEQ ID NO: 72987 - DNA, 24 bp, Artificial Sequence
  Description of Artificial Sequence: Synthetic oligonucleotide
gacagcgacgtgagggagttccgg

SEQ ID NO: 72988 - DNA, 24 bp, Artificial Sequence
  Description of Artificial Sequence: Synthetic oligonucleotide
acagcgacgtgagggagttccggg

SEQ ID NO: 72989 - DNA, 23 bp, Artificial Sequence
  Description of Artificial Sequence: Synthetic oligonucleotide
cagcgacgtgagggagttccggg

SEQ ID NO: 72990 - DNA, 23 bp, Artificial Sequence
  Description of Artificial Sequence: Synthetic oligonucleotide
agcgacgtgagggagttccgggc

SEQ ID NO: 72991 - DNA, 22 bp, Artificial Sequence
  Description of Artificial Sequence: Synthetic oligonucleotide
gcgacgtgagggagttccgggc

SEQ ID NO: 72992 - DNA, 22 bp, Artificial Sequence
  Description of Artificial Sequence: Synthetic oligonucleotide
cgacgtgagggagttccgggcg

SEQ ID NO: 72993 - DNA, 23 bp, Artificial Sequence
  Description of Artificial Sequence: Synthetic oligonucleotide
gacgtgagggagttccgggcggt

SEQ ID NO: 72994 - DNA, 24 bp, Artificial Sequence
  Description of Artificial Sequence: Synthetic oligonucleotide
acgtgagggagttccgggcggtga

SEQ ID NO: 72995 - DNA, 23 bp, Artificial Sequence
  Description of Artificial Sequence: Synthetic oligonucleotide
cgtgagggagttccgggcggtga

SEQ ID NO: 72996 - DNA, 23 bp, Artificial Sequence
  Description of Artificial Sequence: Synthetic oligonucleotide
gtgagggagttccgggcggtgac

SEQ ID NO: 72997 - DNA, 23 bp, Artificial Sequence
  Description of Artificial Sequence: Synthetic oligonucleotide
tgagggagttccgggcggtgacg

SEQ ID NO: 72998 - DNA, 22 bp, Artificial Sequence
  Description of Artificial Sequence: Synthetic oligonucleotide
gagggagttccgggcggtgacg

SEQ ID NO: 72999 - DNA, 23 bp, Artificial Sequence
  Description of Artificial Sequence: Synthetic oligonucleotide
agggagttccgggcggtgacgga

SEQ ID NO: 73000 - DNA, 26 bp, Artificial Sequence
  Description of Artificial Sequence: Synthetic oligonucleotide
aaggacatcctggaagacaggcgcgg

SEQ ID NO: 73001 - DNA, 25 bp, Artificial Sequence
  Description of Artificial Sequence: Synthetic oligonucleotide
aggacatcctggaagacaggcgcgg

SEQ ID NO: 73002 - DNA, 24 bp, Artificial Sequence
  Description of Artificial Sequence: Synthetic oligonucleotide
ggacatcctggaagacaggcgcgg

SEQ ID NO: 73003 - DNA, 24 bp, Artificial Sequence
  Description of Artificial Sequence: Synthetic oligonucleotide
gacatcctggaagacaggcgcggg

SEQ ID NO: 73004 - DNA, 24 bp, Artificial Sequence
  Description of Artificial Sequence: Synthetic oligonucleotide
acatcctggaagacaggcgcgggc

SEQ ID NO: 73005 - DNA, 23 bp, Artificial Sequence
  Description of Artificial Sequence: Synthetic oligonucleotide
catcctggaagacaggcgcgggc

SEQ ID NO: 73006 - DNA, 23 bp, Artificial Sequence
  Description of Artificial Sequence: Synthetic oligonucleotide
atcctggaagacaggcgcgggcc

SEQ ID NO: 73007 - DNA, 22 bp, Artificial Sequence
  Description of Artificial Sequence: Synthetic oligonucleotide
tcctggaagacaggcgcgggcc

SEQ ID NO: 73008 - DNA, 21 bp, Artificial Sequence
  Description of Artificial Sequence: Synthetic oligonucleotide
cctggaagacaggcgcgggcc

SEQ ID NO: 73009 - DNA, 21 bp, Artificial Sequence
  Description of Artificial Sequence: Synthetic oligonucleotide
ctggaagacaggcgcgggccg

SEQ ID NO: 73010 - DNA, 21 bp, Artificial Sequence
  Description of Artificial Sequence: Synthetic oligonucleotide
tggaagacaggcgcgggccgc

SEQ ID NO: 73011 - DNA, 20 bp, Artificial Sequence
  Description of Artificial Sequence: Synthetic oligonucleotide
ggaagacaggcgcgggccgc

SEQ ID NO: 73012 - DNA, 20 bp, Artificial Sequence
  Description of Artificial Sequence: Synthetic oligonucleotide
gaagacaggcgcgggccgcg

SEQ ID NO: 73013 - DNA, 21 bp, Artificial Sequence
  Description of Artificial Sequence: Synthetic oligonucleotide
aagacaggcgcgggccgcggt

SEQ ID NO: 73014 - DNA, 20 bp, Artificial Sequence
  Description of Artificial Sequence: Synthetic oligonucleotide
agacaggcgcgggccgcggt

SEQ ID NO: 73015 - DNA, 20 bp, Artificial Sequence
  Description of Artificial Sequence: Synthetic oligonucleotide
gacaggcgcgggccgcggtt

SEQ ID NO: 73016 - DNA, 20 bp, Artificial Sequence
  Description of Artificial Sequence: Synthetic oligonucleotide
acaggcgcgggccgcggtgt

SEQ ID NO: 73017 - DNA, 26 bp, Artificial Sequence
  Description of Artificial Sequence: Synthetic oligonucleotide
cagccagaaggacatcctggaggagg

SEQ ID NO: 73018 - DNA, 26 bp, Artificial Sequence
  Description of Artificial Sequence: Synthetic oligonucleotide
agccagaaggacatcctggaggaggc

SEQ ID NO: 73019 - DNA, 25 bp, Artificial Sequence
  Description of Artificial Sequence: Synthetic oligonucleotide
gccagaaggacatcctggaggaggc

SEQ ID NO: 73020 - DNA, 25 bp, Artificial Sequence
  Description of Artificial Sequence: Synthetic oligonucleotide
ccagaaggacatcctggaggaggcg

SEQ ID NO: 73021 - DNA, 25 bp, Artificial Sequence
  Description of Artificial Sequence: Synthetic oligonucleotide
cagaaggacatcctggaggaggcgc

SEQ ID NO: 73022 - DNA, 25 bp, Artificial Sequence
  Description of Artificial Sequence: Synthetic oligonucleotide
agaaggacatcctggaggaggcgcg

SEQ ID NO: 73023 - DNA, 24 bp, Artificial Sequence
  Description of Artificial Sequence: Synthetic oligonucleotide
gaaggacatcctggaggaggcgcg

SEQ ID NO: 73024 - DNA, 24 bp, Artificial Sequence
  Description of Artificial Sequence: Synthetic oligonucleotide
aaggacatcctggaggaggcgcgg

SEQ ID NO: 73025 - DNA, 23 bp, Artificial Sequence
  Description of Artificial Sequence: Synthetic oligonucleotide
aggacatcctggaggaggcgcgg

SEQ ID NO: 73026 - DNA, 22 bp, Artificial Sequence
  Description of Artificial Sequence: Synthetic oligonucleotide
ggacatcctggaggaggcgcgg

SEQ ID NO: 73027 - DNA, 22 bp, Artificial Sequence
  Description of Artificial Sequence: Synthetic oligonucleotide
gacatcctggaggaggcgcggg

SEQ ID NO: 73028 - DNA, 22 bp, Artificial Sequence
  Description of Artificial Sequence: Synthetic oligonucleotide
acatcctggaggaggcgcgggc

SEQ ID NO: 73029 - DNA, 21 bp, Artificial Sequence
  Description of Artificial Sequence: Synthetic oligonucleotide
catcctggaggaggcgcgggc

SEQ ID NO: 73030 - DNA, 21 bp, Artificial Sequence
  Description of Artificial Sequence: Synthetic oligonucleotide
atcctggaggaggcgcgggcc

SEQ ID NO: 73031 - DNA, 20 bp, Artificial Sequence
  Description of Artificial Sequence: Synthetic oligonucleotide
tcctggaggaggcgcgggcc

SEQ ID NO: 73032 - DNA, 20 bp, Artificial Sequence
  Description of Artificial Sequence: Synthetic oligonucleotide
cctggaggaggcgcgggcct

SEQ ID NO: 73033 - DNA, 20 bp, Artificial Sequence
  Description of Artificial Sequence: Synthetic oligonucleotide
ctggaggaggcgcgggccgt

SEQ ID NO: 73034 - DNA, 20 bp, Artificial Sequence
  Description of Artificial Sequence: Synthetic oligonucleotide
tggaggaggcgcgggccgct

SEQ ID NO: 73035 - DNA, 20 bp, Artificial Sequence
  Description of Artificial Sequence: Synthetic oligonucleotide
ggaggaggcgcgggccgctt

SEQ ID NO: 73036 - DNA, 20 bp, Artificial Sequence
  Description of Artificial Sequence: Synthetic oligonucleotide
gaggaggcgcgggccgcgtt

SEQ ID NO: 73037 - DNA, 20 bp, Artificial Sequence
  Description of Artificial Sequence: Synthetic oligonucleotide
aggaggcgcgggccgcggtt

SEQ ID NO: 73038 - DNA, 20 bp, Artificial Sequence
  Description of Artificial Sequence: Synthetic oligonucleotide
ggaggcgcgggccgcggttt

SEQ ID NO: 73039 - DNA, 20 bp, Artificial Sequence
  Description of Artificial Sequence: Synthetic oligonucleotide
gaggcgcgggccgcggtgtt

SEQ ID NO: 73040 - DNA, 27 bp, Artificial Sequence
  Description of Artificial Sequence: Synthetic oligonucleotide
caggtttcctgtggcagcctaagaggg

SEQ ID NO: 73041 - DNA, 28 bp, Artificial Sequence
  Description of Artificial Sequence: Synthetic oligonucleotide
aggtttcctgtggcagcctaagagggag

SEQ ID NO: 73042 - DNA, 27 bp, Artificial Sequence
  Description of Artificial Sequence: Synthetic oligonucleotide
ggtttcctgtggcagcctaagagggag

SEQ ID NO: 73043 - DNA, 32 bp, Artificial Sequence
  Description of Artificial Sequence: Synthetic oligonucleotide
acacctactgcagacacaactacagggttgtg

SEQ ID NO: 73044 - DNA, 31 bp, Artificial Sequence
  Description of Artificial Sequence: Synthetic oligonucleotide
cacctactgcagacacaactacagggttgtg

SEQ ID NO: 73045 - DNA, 31 bp, Artificial Sequence
  Description of Artificial Sequence: Synthetic oligonucleotide
acctactgcagacacaactacagggttgtgg

SEQ ID NO: 73046 - DNA, 30 bp, Artificial Sequence
  Description of Artificial Sequence: Synthetic oligonucleotide
cctactgcagacacaactacagggttgtgg

SEQ ID NO: 73047 - DNA, 31 bp, Artificial Sequence
  Description of Artificial Sequence: Synthetic oligonucleotide
ctactgcagacacaactacagggttgtggag

SEQ ID NO: 73048 - DNA, 32 bp, Artificial Sequence
  Description of Artificial Sequence: Synthetic oligonucleotide
tactgcagacacaactacagggttgtggagag

SEQ ID NO: 73049 - DNA, 31 bp, Artificial Sequence
  Description of Artificial Sequence: Synthetic oligonucleotide
actgcagacacaactacagggttgtggagag

SEQ ID NO: 73050 - DNA, 30 bp, Artificial Sequence
  Description of Artificial Sequence: Synthetic oligonucleotide
ctgcagacacaactacagggttgtggagag

SEQ ID NO: 73051 - DNA, 30 bp, Artificial Sequence
  Description of Artificial Sequence: Synthetic oligonucleotide
tgcagacacaactacagggttgtggagagc

SEQ ID NO: 73052 - DNA, 29 bp, Artificial Sequence
  Description of Artificial Sequence: Synthetic oligonucleotide
gcagacacaactacagggttgtggagagc

SEQ ID NO: 73053 - DNA, 31 bp, Artificial Sequence
  Description of Artificial Sequence: Synthetic oligonucleotide
cagacacaactacagggttgtggagagcttc

SEQ ID NO: 73054 - DNA, 32 bp, Artificial Sequence
  Description of Artificial Sequence: Synthetic oligonucleotide
agacacaactacagggttgtggagagcttcac

SEQ ID NO: 73055 - DNA, 31 bp, Artificial Sequence
  Description of Artificial Sequence: Synthetic oligonucleotide
gacacaactacagggttgtggagagcttcac

SEQ ID NO: 73056 - DNA, 32 bp, Artificial Sequence
  Description of Artificial Sequence: Synthetic oligonucleotide
acacaactacagggttgtggagagcttcacag

SEQ ID NO: 73057 - DNA, 31 bp, Artificial Sequence
  Description of Artificial Sequence: Synthetic oligonucleotide
cacaactacagggttgtggagagcttcacag

SEQ ID NO: 73058 - DNA, 32 bp, Artificial Sequence
  Description of Artificial Sequence: Synthetic oligonucleotide
acaactacagggttgtggagagcttcacagtg

SEQ ID NO: 73059 - DNA, 31 bp, Artificial Sequence
  Description of Artificial Sequence: Synthetic oligonucleotide
caactacagggttgtggagagcttcacagtg

SEQ ID NO: 73060 - DNA, 31 bp, Artificial Sequence
  Description of Artificial Sequence: Synthetic oligonucleotide
aactacagggttgtggagagcttcacagtgc

SEQ ID NO: 73061 - DNA, 30 bp, Artificial Sequence
  Description of Artificial Sequence: Synthetic oligonucleotide
actacagggttgtggagagcttcacagtgc

SEQ ID NO: 73062 - DNA, 29 bp, Artificial Sequence
  Description of Artificial Sequence: Synthetic oligonucleotide
ctacagggttgtggagagcttcacagtgc

SEQ ID NO: 73063 - DNA, 30 bp, Artificial Sequence
  Description of Artificial Sequence: Synthetic oligonucleotide
tacagggttgtggagagcttcacagtgcag

SEQ ID NO: 73064 - DNA, 29 bp, Artificial Sequence
  Description of Artificial Sequence: Synthetic oligonucleotide
acagggttgtggagagcttcacagtgcag

SEQ ID NO: 73065 - DNA, 28 bp, Artificial Sequence
  Description of Artificial Sequence: Synthetic oligonucleotide
cagggttgtggagagcttcacagtgcag

SEQ ID NO: 73066 - DNA, 28 bp, Artificial Sequence
  Description of Artificial Sequence: Synthetic oligonucleotide
agggttgtggagagcttcacagtgcagc

SEQ ID NO: 73067 - DNA, 21 bp, Artificial Sequence
  Description of Artificial Sequence: Synthetic oligonucleotide
ggcggtgacggagctggggct

SEQ ID NO: 73068 - DNA, 21 bp, Artificial Sequence
  Description of Artificial Sequence: Synthetic oligonucleotide
gcggtgacggagctggggctg

SEQ ID NO: 73069 - DNA, 21 bp, Artificial Sequence
  Description of Artificial Sequence: Synthetic oligonucleotide
cggtgacggagctggggctgc

SEQ ID NO: 73070 - DNA, 22 bp, Artificial Sequence
  Description of Artificial Sequence: Synthetic oligonucleotide
ggtgacggagctggggctgcct

SEQ ID NO: 73071 - DNA, 23 bp, Artificial Sequence
  Description of Artificial Sequence: Synthetic oligonucleotide
gtgacggagctggggctgcctga

SEQ ID NO: 73072 - DNA, 23 bp, Artificial Sequence
  Description of Artificial Sequence: Synthetic oligonucleotide
tgacggagctggggctgcctgac

SEQ ID NO: 73073 - DNA, 22 bp, Artificial Sequence
  Description of Artificial Sequence: Synthetic oligonucleotide
gacggagctggggctgcctgac

SEQ ID NO: 73074 - DNA, 22 bp, Artificial Sequence
  Description of Artificial Sequence: Synthetic oligonucleotide
acggagctggggctgcctgacg

SEQ ID NO: 73075 - DNA, 21 bp, Artificial Sequence
  Description of Artificial Sequence: Synthetic oligonucleotide
cggagctggggctgcctgacg

SEQ ID NO: 73076 - DNA, 22 bp, Artificial Sequence
  Description of Artificial Sequence: Synthetic oligonucleotide
ggagctggggctgcctgacgct

SEQ ID NO: 73077 - DNA, 23 bp, Artificial Sequence
  Description of Artificial Sequence: Synthetic oligonucleotide
gagctggggctgcctgacgctga

SEQ ID NO: 73078 - DNA, 25 bp, Artificial Sequence
  Description of Artificial Sequence: Synthetic oligonucleotide
agctggggctgcctgacgctgagta

SEQ ID NO: 73079 - DNA, 24 bp, Artificial Sequence
  Description of Artificial Sequence: Synthetic oligonucleotide
gctggggctgcctgacgctgagta

SEQ ID NO: 73080 - DNA, 25 bp, Artificial Sequence
  Description of Artificial Sequence: Synthetic oligonucleotide
ctggggctgcctgacgctgagtact

SEQ ID NO: 73081 - DNA, 25 bp, Artificial Sequence
  Description of Artificial Sequence: Synthetic oligonucleotide
tggggctgcctgacgctgagtactg

SEQ ID NO: 73082 - DNA, 24 bp, Artificial Sequence
  Description of Artificial Sequence: Synthetic oligonucleotide
ggggctgcctgacgctgagtactg

SEQ ID NO: 73083 - DNA, 26 bp, Artificial Sequence
  Description of Artificial Sequence: Synthetic oligonucleotide
gggctgcctgacgctgagtactggaa

SEQ ID NO: 73084 - DNA, 27 bp, Artificial Sequence
  Description of Artificial Sequence: Synthetic oligonucleotide
ggctgcctgacgctgagtactggaaca

SEQ ID NO: 73085 - DNA, 27 bp, Artificial Sequence
  Description of Artificial Sequence: Synthetic oligonucleotide
gctgcctgacgctgagtactggaacag

SEQ ID NO: 73086 - DNA, 27 bp, Artificial Sequence
  Description of Artificial Sequence: Synthetic oligonucleotide
ctgcctgacgctgagtactggaacagc

SEQ ID NO: 73087 - DNA, 27 bp, Artificial Sequence
  Description of Artificial Sequence: Synthetic oligonucleotide
tgcctgacgctgagtactggaacagcc

SEQ ID NO: 73088 - DNA, 33 bp, Artificial Sequence
  Description of Artificial Sequence: Synthetic oligonucleotide
cgggtgcagttcctggacagatacttctataac

SEQ ID NO: 73089 - DNA, 33 bp, Artificial Sequence
  Description of Artificial Sequence: Synthetic oligonucleotide
gggtgcagttcctggacagatacttctataacc

SEQ ID NO: 73090 - DNA, 34 bp, Artificial Sequence
  Description of Artificial Sequence: Synthetic oligonucleotide
ggtgcagttcctggacagatacttctataaccag

SEQ ID NO: 73091 - DNA, 34 bp, Artificial Sequence
  Description of Artificial Sequence: Synthetic oligonucleotide
gtgcagttcctggacagatacttctataaccagg

SEQ ID NO: 73092 - DNA, 35 bp, Artificial Sequence
  Description of Artificial Sequence: Synthetic oligonucleotide
tgcagttcctggacagatacttctataaccaggag

SEQ ID NO: 73093 - DNA, 34 bp, Artificial Sequence
  Description of Artificial Sequence: Synthetic oligonucleotide
gcagttcctggacagatacttctataaccaggag

SEQ ID NO: 73094 - DNA, 34 bp, Artificial Sequence
  Description of Artificial Sequence: Synthetic oligonucleotide
cagttcctggacagatacttctataaccaggagg

SEQ ID NO: 73095 - DNA, 35 bp, Artificial Sequence
  Description of Artificial Sequence: Synthetic oligonucleotide
agttcctggacagatacttctataaccaggaggag

SEQ ID NO: 73096 - DNA, 34 bp, Artificial Sequence
  Description of Artificial Sequence: Synthetic oligonucleotide
agcctaagagggagtgtcatttcttcaatgggtc

SEQ ID NO: 73097 - DNA, 33 bp, Artificial Sequence
  Description of Artificial Sequence: Synthetic oligonucleotide
gcctaagagggagtgtcatttcttcaatgggtc

SEQ ID NO: 73098 - DNA, 33 bp, Artificial Sequence
  Description of Artificial Sequence: Synthetic oligonucleotide
cctaagagggagtgtcatttcttcaatgggtcg

SEQ ID NO: 73099 - DNA, 33 bp, Artificial Sequence
  Description of Artificial Sequence: Synthetic oligonucleotide
ctaagagggagtgtcatttcttcaatgggtcgg

SEQ ID NO: 73100 - DNA, 34 bp, Artificial Sequence
  Description of Artificial Sequence: Synthetic oligonucleotide
taagagggagtgtcatttcttcaatgggtcggag

SEQ ID NO: 73101 - DNA, 33 bp, Artificial Sequence
  Description of Artificial Sequence: Synthetic oligonucleotide
aagagggagtgtcatttcttcaatgggtcggag

SEQ ID NO: 73102 - DNA, 32 bp, Artificial Sequence
  Description of Artificial Sequence: Synthetic oligonucleotide
agagggagtgtcatttcttcaatgggtcggag

SEQ ID NO: 73103 - DNA, 31 bp, Artificial Sequence
  Description of Artificial Sequence: Synthetic oligonucleotide
gagggagtgtcatttcttcaatgggtcggag

SEQ ID NO: 73104 - DNA, 31 bp, Artificial Sequence
  Description of Artificial Sequence: Synthetic oligonucleotide
agggagtgtcatttcttcaatgggtcggagc

SEQ ID NO: 73105 - DNA, 30 bp, Artificial Sequence
  Description of Artificial Sequence: Synthetic oligonucleotide
gggagtgtcatttcttcaatgggtcggagc

SEQ ID NO: 73106 - DNA, 30 bp, Artificial Sequence
  Description of Artificial Sequence: Synthetic oligonucleotide
ggagtgtcatttcttcaatgggtcggagcg

SEQ ID NO: 73107 - DNA, 30 bp, Artificial Sequence
  Description of Artificial Sequence: Synthetic oligonucleotide
gagtgtcatttcttcaatgggtcggagcgg

SEQ ID NO: 73108 - DNA, 30 bp, Artificial Sequence
  Description of Artificial Sequence: Synthetic oligonucleotide
agtgtcatttcttcaatgggtcggagcggg

SEQ ID NO: 73109 - DNA, 29 bp, Artificial Sequence
  Description of Artificial Sequence: Synthetic oligonucleotide
gtgtcatttcttcaatgggtcggagcggg

SEQ ID NO: 73110 - DNA, 30 bp, Artificial Sequence
  Description of Artificial Sequence: Synthetic oligonucleotide
tgtcatttcttcaatgggtcggagcgggtg

SEQ ID NO: 73111 - DNA, 29 bp, Artificial Sequence
  Description of Artificial Sequence: Synthetic oligonucleotide
gtcatttcttcaatgggtcggagcgggtg

SEQ ID NO: 73112 - DNA, 29 bp, Artificial Sequence
  Description of Artificial Sequence: Synthetic oligonucleotide
tcatttcttcaatgggtcggagcgggtgc

SEQ ID NO: 73113 - DNA, 28 bp, Artificial Sequence
  Description of Artificial Sequence: Synthetic oligonucleotide
catttcttcaatgggtcggagcgggtgc

SEQ ID NO: 73114 - DNA, 28 bp, Artificial Sequence
  Description of Artificial Sequence: Synthetic oligonucleotide
atttcttcaatgggtcggagcgggtgcg

SEQ ID NO: 73115 - DNA, 27 bp, Artificial Sequence
  Description of Artificial Sequence: Synthetic oligonucleotide
tttcttcaatgggtcggagcgggtgcg

SEQ ID NO: 73116 - DNA, 26 bp, Artificial Sequence
  Description of Artificial Sequence: Synthetic oligonucleotide
ttcttcaatgggtcggagcgggtgcg

SEQ ID NO: 73117 - DNA, 25 bp, Artificial Sequence
  Description of Artificial Sequence: Synthetic oligonucleotide
tcttcaatgggtcggagcgggtgcg

SEQ ID NO: 73118 - DNA, 24 bp, Artificial Sequence
  Description of Artificial Sequence: Synthetic oligonucleotide
cttcaatgggtcggagcgggtgcg

SEQ ID NO: 73119 - DNA, 26 bp, Artificial Sequence
  Description of Artificial Sequence: Synthetic oligonucleotide
ttcaatgggtcggagcgggtgcggtt

SEQ ID NO: 73120 - DNA, 25 bp, Artificial Sequence
  Description of Artificial Sequence: Synthetic oligonucleotide
tcaatgggtcggagcgggtgcggtt

SEQ ID NO: 73121 - DNA, 24 bp, Artificial Sequence
  Description of Artificial Sequence: Synthetic oligonucleotide
caatgggtcggagcgggtgcggtt

SEQ ID NO: 73122 - DNA, 24 bp, Artificial Sequence
  Description of Artificial Sequence: Synthetic oligonucleotide
aatgggtcggagcgggtgcggttc

SEQ ID NO: 73123 - DNA, 23 bp, Artificial Sequence
  Description of Artificial Sequence: Synthetic oligonucleotide
atgggtcggagcgggtgcggttc

SEQ ID NO: 73124 - DNA, 22 bp, Artificial Sequence
  Description of Artificial Sequence: Synthetic oligonucleotide
tgggtcggagcgggtgcggttc

SEQ ID NO: 73125 - DNA, 21 bp, Artificial Sequence
  Description of Artificial Sequence: Synthetic oligonucleotide
gggtcggagcgggtgcggttc

SEQ ID NO: 73126 - DNA, 22 bp, Artificial Sequence
  Description of Artificial Sequence: Synthetic oligonucleotide
ggtcggagcgggtgcggttcct

SEQ ID NO: 73127 - DNA, 22 bp, Artificial Sequence
  Description of Artificial Sequence: Synthetic oligonucleotide
gtcggagcgggtgcggttcctg

SEQ ID NO: 73128 - DNA, 23 bp, Artificial Sequence
  Description of Artificial Sequence: Synthetic oligonucleotide
tcggagcgggtgcggttcctgga

SEQ ID NO: 73129 - DNA, 29 bp, Artificial Sequence
  Description of Artificial Sequence: Synthetic oligonucleotide
cacgtttcctgtggcagcctaagaaggag

SEQ ID NO: 73130 - DNA, 30 bp, Artificial Sequence
  Description of Artificial Sequence: Synthetic oligonucleotide
acgtttcctgtggcagcctaagaaggagtg

SEQ ID NO: 73131 - DNA, 29 bp, Artificial Sequence
  Description of Artificial Sequence: Synthetic oligonucleotide
cgtttcctgtggcagcctaagaaggagtg

SEQ ID NO: 73132 - DNA, 30 bp, Artificial Sequence
  Description of Artificial Sequence: Synthetic oligonucleotide
gtttcctgtggcagcctaagaaggagtgtc

SEQ ID NO: 73133 - DNA, 34 bp, Artificial Sequence
  Description of Artificial Sequence: Synthetic oligonucleotide
tttcctgtggcagcctaagaaggagtgtcatttc

SEQ ID NO: 73134 - DNA, 33 bp, Artificial Sequence
  Description of Artificial Sequence: Synthetic oligonucleotide
ttcctgtggcagcctaagaaggagtgtcatttc

SEQ ID NO: 73135 - DNA, 32 bp, Artificial Sequence
  Description of Artificial Sequence: Synthetic oligonucleotide
tcctgtggcagcctaagaaggagtgtcatttc

SEQ ID NO: 73136 - DNA, 31 bp, Artificial Sequence
  Description of Artificial Sequence: Synthetic oligonucleotide
cctgtggcagcctaagaaggagtgtcatttc

SEQ ID NO: 73137 - DNA, 33 bp, Artificial Sequence
  Description of Artificial Sequence: Synthetic oligonucleotide
ctgtggcagcctaagaaggagtgtcatttcttc

SEQ ID NO: 73138 - DNA, 36 bp, Artificial Sequence
  Description of Artificial Sequence: Synthetic oligonucleotide
tgtggcagcctaagaaggagtgtcatttcttcaatg

SEQ ID NO: 73139 - DNA, 35 bp, Artificial Sequence
  Description of Artificial Sequence: Synthetic oligonucleotide
gtggcagcctaagaaggagtgtcatttcttcaatg

SEQ ID NO: 73140 - DNA, 35 bp, Artificial Sequence
  Description of Artificial Sequence: Synthetic oligonucleotide
tggcagcctaagaaggagtgtcatttcttcaatgg

SEQ ID NO: 73141 - DNA, 34 bp, Artificial Sequence
  Description of Artificial Sequence: Synthetic oligonucleotide
ggcagcctaagaaggagtgtcatttcttcaatgg

SEQ ID NO: 73142 - DNA, 34 bp, Artificial Sequence
  Description of Artificial Sequence: Synthetic oligonucleotide
gcagcctaagaaggagtgtcatttcttcaatggg

SEQ ID NO: 73143 - DNA, 35 bp, Artificial Sequence
  Description of Artificial Sequence: Synthetic oligonucleotide
cagcctaagaaggagtgtcatttcttcaatgggac

SEQ ID NO: 73144 - DNA, 35 bp, Artificial Sequence
  Description of Artificial Sequence: Synthetic oligonucleotide
agcctaagaaggagtgtcatttcttcaatgggacg

SEQ ID NO: 73145 - DNA, 34 bp, Artificial Sequence
  Description of Artificial Sequence: Synthetic oligonucleotide
gcctaagaaggagtgtcatttcttcaatgggacg

SEQ ID NO: 73146 - DNA, 34 bp, Artificial Sequence
  Description of Artificial Sequence: Synthetic oligonucleotide
cctaagaaggagtgtcatttcttcaatgggacgg

SEQ ID NO: 73147 - DNA, 35 bp, Artificial Sequence
  Description of Artificial Sequence: Synthetic oligonucleotide
ctaagaaggagtgtcatttcttcaatgggacggag

SEQ ID NO: 73148 - DNA, 35 bp, Artificial Sequence
  Description of Artificial Sequence: Synthetic oligonucleotide
taagaaggagtgtcatttcttcaatgggacggagc

SEQ ID NO: 73149 - DNA, 34 bp, Artificial Sequence
  Description of Artificial Sequence: Synthetic oligonucleotide
aagaaggagtgtcatttcttcaatgggacggagc

SEQ ID NO: 73150 - DNA, 33 bp, Artificial Sequence
  Description of Artificial Sequence: Synthetic oligonucleotide
agaaggagtgtcatttcttcaatgggacggagc

SEQ ID NO: 73151 - DNA, 32 bp, Artificial Sequence
  Description of Artificial Sequence: Synthetic oligonucleotide
gaaggagtgtcatttcttcaatgggacggagc

SEQ ID NO: 73152 - DNA, 32 bp, Artificial Sequence
  Description of Artificial Sequence: Synthetic oligonucleotide
aaggagtgtcatttcttcaatgggacggagcg

SEQ ID NO: 73153 - DNA, 31 bp, Artificial Sequence
  Description of Artificial Sequence: Synthetic oligonucleotide
aggagtgtcatttcttcaatgggacggagcg

SEQ ID NO: 73154 - DNA, 21 bp, Artificial Sequence
  Description of Artificial Sequence: Synthetic oligonucleotide
gagctggggcggcctgtcgct

SEQ ID NO: 73155 - DNA, 22 bp, Artificial Sequence
  Description of Artificial Sequence: Synthetic oligonucleotide
agctggggcggcctgtcgctga

SEQ ID NO: 73156 - DNA, 21 bp, Artificial Sequence
  Description of Artificial Sequence: Synthetic oligonucleotide
gctggggcggcctgtcgctga

SEQ ID NO: 73157 - DNA, 23 bp, Artificial Sequence
  Description of Artificial Sequence: Synthetic oligonucleotide
ctggggcggcctgtcgctgagta

SEQ ID NO: 73158 - DNA, 24 bp, Artificial Sequence
  Description of Artificial Sequence: Synthetic oligonucleotide
tggggcggcctgtcgctgagtact

SEQ ID NO: 73159 - DNA, 23 bp, Artificial Sequence
  Description of Artificial Sequence: Synthetic oligonucleotide
ggggcggcctgtcgctgagtact

SEQ ID NO: 73160 - DNA, 23 bp, Artificial Sequence
  Description of Artificial Sequence: Synthetic oligonucleotide
gggcggcctgtcgctgagtactg

SEQ ID NO: 73161 - DNA, 25 bp, Artificial Sequence
  Description of Artificial Sequence: Synthetic oligonucleotide
ggcggcctgtcgctgagtactggaa

SEQ ID NO: 73162 - DNA, 26 bp, Artificial Sequence
  Description of Artificial Sequence: Synthetic oligonucleotide
gcggcctgtcgctgagtactggaaca

SEQ ID NO: 73163 - DNA, 26 bp, Artificial Sequence
  Description of Artificial Sequence: Synthetic oligonucleotide
cggcctgtcgctgagtactggaacag

SEQ ID NO: 73164 - DNA, 26 bp, Artificial Sequence
  Description of Artificial Sequence: Synthetic oligonucleotide
ggcctgtcgctgagtactggaacagc

SEQ ID NO: 73165 - DNA, 27 bp, Artificial Sequence
  Description of Artificial Sequence: Synthetic oligonucleotide
gcctgtcgctgagtactggaacagcca

SEQ ID NO: 73166 - DNA, 27 bp, Artificial Sequence
  Description of Artificial Sequence: Synthetic oligonucleotide
cctgtcgctgagtactggaacagccag

SEQ ID NO: 73167 - DNA, 29 bp, Artificial Sequence
  Description of Artificial Sequence: Synthetic oligonucleotide
ctgtcgctgagtactggaacagccagaag

SEQ ID NO: 73168 - DNA, 29 bp, Artificial Sequence
  Description of Artificial Sequence: Synthetic oligonucleotide
tgtcgctgagtactggaacagccagaagg

SEQ ID NO: 73169 - DNA, 28 bp, Artificial Sequence
  Description of Artificial Sequence: Synthetic oligonucleotide
gtcgctgagtactggaacagccagaagg

SEQ ID NO: 73170 - DNA, 29 bp, Artificial Sequence
  Description of Artificial Sequence: Synthetic oligonucleotide
tcgctgagtactggaacagccagaaggac

SEQ ID NO: 73171 - DNA, 21 bp, Artificial Sequence
  Description of Artificial Sequence: Synthetic oligonucleotide
gagctggggcggcctgaggct

SEQ ID NO: 73172 - DNA, 22 bp, Artificial Sequence
  Description of Artificial Sequence: Synthetic oligonucleotide
agctggggcggcctgaggctga

SEQ ID NO: 73173 - DNA, 21 bp, Artificial Sequence
  Description of Artificial Sequence: Synthetic oligonucleotide
gctggggcggcctgaggctga

SEQ ID NO: 73174 - DNA, 23 bp, Artificial Sequence
  Description of Artificial Sequence: Synthetic oligonucleotide
ctggggcggcctgaggctgagta

SEQ ID NO: 73175 - DNA, 24 bp, Artificial Sequence
  Description of Artificial Sequence: Synthetic oligonucleotide
tggggcggcctgaggctgagtact

SEQ ID NO: 73176 - DNA, 23 bp, Artificial Sequence
  Description of Artificial Sequence: Synthetic oligonucleotide
ggggcggcctgaggctgagtact

SEQ ID NO: 73177 - DNA, 23 bp, Artificial Sequence
  Description of Artificial Sequence: Synthetic oligonucleotide
gggcggcctgaggctgagtactg

SEQ ID NO: 73178 - DNA, 25 bp, Artificial Sequence
  Description of Artificial Sequence: Synthetic oligonucleotide
ggcggcctgaggctgagtactggaa

SEQ ID NO: 73179 - DNA, 26 bp, Artificial Sequence
  Description of Artificial Sequence: Synthetic oligonucleotide
gcggcctgaggctgagtactggaaca

SEQ ID NO: 73180 - DNA, 26 bp, Artificial Sequence
  Description of Artificial Sequence: Synthetic oligonucleotide
cggcctgaggctgagtactggaacag

SEQ ID NO: 73181 - DNA, 26 bp, Artificial Sequence
  Description of Artificial Sequence: Synthetic oligonucleotide
ggcctgaggctgagtactggaacagc

SEQ ID NO: 73182 - DNA, 27 bp, Artificial Sequence
  Description of Artificial Sequence: Synthetic oligonucleotide
gcctgaggctgagtactggaacagcca

SEQ ID NO: 73183 - DNA, 27 bp, Artificial Sequence
  Description of Artificial Sequence: Synthetic oligonucleotide
cctgaggctgagtactggaacagccag

SEQ ID NO: 73184 - DNA, 29 bp, Artificial Sequence
  Description of Artificial Sequence: Synthetic oligonucleotide
ctgaggctgagtactggaacagccagaag

SEQ ID NO: 73185 - DNA, 29 bp, Artificial Sequence
  Description of Artificial Sequence: Synthetic oligonucleotide
tgaggctgagtactggaacagccagaagg

SEQ ID NO: 73186 - DNA, 28 bp, Artificial Sequence
  Description of Artificial Sequence: Synthetic oligonucleotide
gaggctgagtactggaacagccagaagg

SEQ ID NO: 73187 - DNA, 29 bp, Artificial Sequence
  Description of Artificial Sequence: Synthetic oligonucleotide
aggctgagtactggaacagccagaaggac

SEQ ID NO: 73188 - DNA, 28 bp, Artificial Sequence
  Description of Artificial Sequence: Synthetic oligonucleotide
ggctgagtactggaacagccagaaggac

SEQ ID NO: 73189 - DNA, 35 bp, Artificial Sequence
  Description of Artificial Sequence: Synthetic oligonucleotide
ttcctggacagatacttctataaccaggaggagac

SEQ ID NO: 73190 - DNA, 34 bp, Artificial Sequence
  Description of Artificial Sequence: Synthetic oligonucleotide
tcctggacagatacttctataaccaggaggagac

SEQ ID NO: 73191 - DNA, 33 bp, Artificial Sequence
  Description of Artificial Sequence: Synthetic oligonucleotide
cctggacagatacttctataaccaggaggagac

SEQ ID NO: 73192 - DNA, 33 bp, Artificial Sequence
  Description of Artificial Sequence: Synthetic oligonucleotide
ctggacagatacttctataaccaggaggagacc

SEQ ID NO: 73193 - DNA, 33 bp, Artificial Sequence
  Description of Artificial Sequence: Synthetic oligonucleotide
tggacagatacttctataaccaggaggagaccg

SEQ ID NO: 73194 - DNA, 32 bp, Artificial Sequence
  Description of Artificial Sequence: Synthetic oligonucleotide
ggacagatacttctataaccaggaggagaccg

SEQ ID NO: 73195 - DNA, 33 bp, Artificial Sequence
  Description of Artificial Sequence: Synthetic oligonucleotide
gacagatacttctataaccaggaggagaccgtg

SEQ ID NO: 73196 - DNA, 33 bp, Artificial Sequence
  Description of Artificial Sequence: Synthetic oligonucleotide
acagatacttctataaccaggaggagaccgtgc

SEQ ID NO: 73197 - DNA, 32 bp, Artificial Sequence
  Description of Artificial Sequence: Synthetic oligonucleotide
cagatacttctataaccaggaggagaccgtgc

SEQ ID NO: 73198 - DNA, 32 bp, Artificial Sequence
  Description of Artificial Sequence: Synthetic oligonucleotide
agatacttctataaccaggaggagaccgtgcg

SEQ ID NO: 73199 - DNA, 31 bp, Artificial Sequence
  Description of Artificial Sequence: Synthetic oligonucleotide
gatacttctataaccaggaggagaccgtgcg

SEQ ID NO: 73200 - DNA, 31 bp, Artificial Sequence
  Description of Artificial Sequence: Synthetic oligonucleotide
atacttctataaccaggaggagaccgtgcgc

SEQ ID NO: 73201 - DNA, 30 bp, Artificial Sequence
  Description of Artificial Sequence: Synthetic oligonucleotide
tacttctataaccaggaggagaccgtgcgc

SEQ ID NO: 73202 - DNA, 29 bp, Artificial Sequence
  Description of Artificial Sequence: Synthetic oligonucleotide
acttctataaccaggaggagaccgtgcgc

SEQ ID NO: 73203 - DNA, 28 bp, Artificial Sequence
  Description of Artificial Sequence: Synthetic oligonucleotide
cttctataaccaggaggagaccgtgcgc

SEQ ID NO: 73204 - DNA, 30 bp, Artificial Sequence
  Description of Artificial Sequence: Synthetic oligonucleotide
ttctataaccaggaggagaccgtgcgcttc

SEQ ID NO: 73205 - DNA, 29 bp, Artificial Sequence
  Description of Artificial Sequence: Synthetic oligonucleotide
tctataaccaggaggagaccgtgcgcttc

SEQ ID NO: 73206 - DNA, 28 bp, Artificial Sequence
  Description of Artificial Sequence: Synthetic oligonucleotide
ctataaccaggaggagaccgtgcgcttc

SEQ ID NO: 73207 - DNA, 28 bp, Artificial Sequence
  Description of Artificial Sequence: Synthetic oligonucleotide
tataaccaggaggagaccgtgcgcttcg

SEQ ID NO: 73208 - DNA, 27 bp, Artificial Sequence
  Description of Artificial Sequence: Synthetic oligonucleotide
ataaccaggaggagaccgtgcgcttcg

SEQ ID NO: 73209 - DNA, 27 bp, Artificial Sequence
  Description of Artificial Sequence: Synthetic oligonucleotide
taaccaggaggagaccgtgcgcttcga

SEQ ID NO: 73210 - DNA, 26 bp, Artificial Sequence
  Description of Artificial Sequence: Synthetic oligonucleotide
aaccaggaggagaccgtgcgcttcga

SEQ ID NO: 73211 - DNA, 25 bp, Artificial Sequence
  Description of Artificial Sequence: Synthetic oligonucleotide
accaggaggagaccgtgcgcttcga

SEQ ID NO: 73212 - DNA, 24 bp, Artificial Sequence
  Description of Artificial Sequence: Synthetic oligonucleotide
ccaggaggagaccgtgcgcttcga

SEQ ID NO: 73213 - DNA, 25 bp, Artificial Sequence
  Description of Artificial Sequence: Synthetic oligonucleotide
caggaggagaccgtgcgcttcgaca

SEQ ID NO: 73214 - DNA, 25 bp, Artificial Sequence
  Description of Artificial Sequence: Synthetic oligonucleotide
aggaggagaccgtgcgcttcgacag

SEQ ID NO: 73215 - DNA, 24 bp, Artificial Sequence
  Description of Artificial Sequence: Synthetic oligonucleotide
ggaggagaccgtgcgcttcgacag

SEQ ID NO: 73216 - DNA, 24 bp, Artificial Sequence
  Description of Artificial Sequence: Synthetic oligonucleotide
gaggagaccgtgcgcttcgacagc

SEQ ID NO: 73217 - DNA, 25 bp, Artificial Sequence
  Description of Artificial Sequence: Synthetic oligonucleotide
aggagaccgtgcgcttcgacagcga

SEQ ID NO: 73218 - DNA, 24 bp, Artificial Sequence
  Description of Artificial Sequence: Synthetic oligonucleotide
ggagaccgtgcgcttcgacagcga

SEQ ID NO: 73219 - DNA, 24 bp, Artificial Sequence
  Description of Artificial Sequence: Synthetic oligonucleotide
gagaccgtgcgcttcgacagcgac

SEQ ID NO: 73220 - DNA, 25 bp, Artificial Sequence
  Description of Artificial Sequence: Synthetic oligonucleotide
agaccgtgcgcttcgacagcgacgt

SEQ ID NO: 73221 - DNA, 24 bp, Artificial Sequence
  Description of Artificial Sequence: Synthetic oligonucleotide
gaccgtgcgcttcgacagcgacgt

SEQ ID NO: 73222 - DNA, 24 bp, Artificial Sequence
  Description of Artificial Sequence: Synthetic oligonucleotide
accgtgcgcttcgacagcgacgtg

SEQ ID NO: 73223 - DNA, 28 bp, Artificial Sequence
  Description of Artificial Sequence: Synthetic oligonucleotide
gtttcctgtggcagcctaagagggagag

SEQ ID NO: 73224 - DNA, 29 bp, Artificial Sequence
  Description of Artificial Sequence: Synthetic oligonucleotide
tttcctgtggcagcctaagagggagagtc

SEQ ID NO: 73225 - DNA, 28 bp, Artificial Sequence
  Description of Artificial Sequence: Synthetic oligonucleotide
ttcctgtggcagcctaagagggagagtc

SEQ ID NO: 73226 - DNA, 27 bp, Artificial Sequence
  Description of Artificial Sequence: Synthetic oligonucleotide
tcctgtggcagcctaagagggagagtc

SEQ ID NO: 73227 - DNA, 27 bp, Artificial Sequence
  Description of Artificial Sequence: Synthetic oligonucleotide
cctgtggcagcctaagagggagagtca

SEQ ID NO: 73228 - DNA, 30 bp, Artificial Sequence
  Description of Artificial Sequence: Synthetic oligonucleotide
ctgtggcagcctaagagggagagtcatttc

SEQ ID NO: 73229 - DNA, 32 bp, Artificial Sequence
  Description of Artificial Sequence: Synthetic oligonucleotide
tgtggcagcctaagagggagagtcatttcttc

SEQ ID NO: 73230 - DNA, 31 bp, Artificial Sequence
  Description of Artificial Sequence: Synthetic oligonucleotide
gtggcagcctaagagggagagtcatttcttc

SEQ ID NO: 73231 - DNA, 34 bp, Artificial Sequence
  Description of Artificial Sequence: Synthetic oligonucleotide
tggcagcctaagagggagagtcatttcttcaatg

SEQ ID NO: 73232 - DNA, 33 bp, Artificial Sequence
  Description of Artificial Sequence: Synthetic oligonucleotide
ggcagcctaagagggagagtcatttcttcaatg

SEQ ID NO: 73233 - DNA, 33 bp, Artificial Sequence
  Description of Artificial Sequence: Synthetic oligonucleotide
gcagcctaagagggagagtcatttcttcaatgg

SEQ ID NO: 73234 - DNA, 33 bp, Artificial Sequence
  Description of Artificial Sequence: Synthetic oligonucleotide
cagcctaagagggagagtcatttcttcaatggg

SEQ ID NO: 73235 - DNA, 34 bp, Artificial Sequence
  Description of Artificial Sequence: Synthetic oligonucleotide
agcctaagagggagagtcatttcttcaatgggac

SEQ ID NO: 73236 - DNA, 33 bp, Artificial Sequence
  Description of Artificial Sequence: Synthetic oligonucleotide
gcctaagagggagagtcatttcttcaatgggac

SEQ ID NO: 73237 - DNA, 33 bp, Artificial Sequence
  Description of Artificial Sequence: Synthetic oligonucleotide
cctaagagggagagtcatttcttcaatgggacg

SEQ ID NO: 73238 - DNA, 33 bp, Artificial Sequence
  Description of Artificial Sequence: Synthetic oligonucleotide
ctaagagggagagtcatttcttcaatgggacgg

SEQ ID NO: 73239 - DNA, 34 bp, Artificial Sequence
  Description of Artificial Sequence: Synthetic oligonucleotide
taagagggagagtcatttcttcaatgggacggag

SEQ ID NO: 73240 - DNA, 33 bp, Artificial Sequence
  Description of Artificial Sequence: Synthetic oligonucleotide
aagagggagagtcatttcttcaatgggacggag

SEQ ID NO: 73241 - DNA, 32 bp, Artificial Sequence
  Description of Artificial Sequence: Synthetic oligonucleotide
agagggagagtcatttcttcaatgggacggag

SEQ ID NO: 73242 - DNA, 31 bp, Artificial Sequence
  Description of Artificial Sequence: Synthetic oligonucleotide
gagggagagtcatttcttcaatgggacggag

SEQ ID NO: 73243 - DNA, 31 bp, Artificial Sequence
  Description of Artificial Sequence: Synthetic oligonucleotide
agggagagtcatttcttcaatgggacggagc

SEQ ID NO: 73244 - DNA, 30 bp, Artificial Sequence
  Description of Artificial Sequence: Synthetic oligonucleotide
gggagagtcatttcttcaatgggacggagc

SEQ ID NO: 73245 - DNA, 30 bp, Artificial Sequence
  Description of Artificial Sequence: Synthetic oligonucleotide
ggagagtcatttcttcaatgggacggagcg

SEQ ID NO: 73246 - DNA, 30 bp, Artificial Sequence
  Description of Artificial Sequence: Synthetic oligonucleotide
gagagtcatttcttcaatgggacggagcgg

SEQ ID NO: 73247 - DNA, 30 bp, Artificial Sequence
  Description of Artificial Sequence: Synthetic oligonucleotide
agagtcatttcttcaatgggacggagcggg

SEQ ID NO: 73248 - DNA, 29 bp, Artificial Sequence
  Description of Artificial Sequence: Synthetic oligonucleotide
gagtcatttcttcaatgggacggagcggg

SEQ ID NO: 73249 - DNA, 30 bp, Artificial Sequence
  Description of Artificial Sequence: Synthetic oligonucleotide
agtcatttcttcaatgggacggagcgggtg

SEQ ID NO: 73250 - DNA, 24 bp, Artificial Sequence
  Description of Artificial Sequence: Synthetic oligonucleotide
ccgcggtggacacctactgcagac

SEQ ID NO: 73251 - DNA, 24 bp, Artificial Sequence
  Description of Artificial Sequence: Synthetic oligonucleotide
cgcggtggacacctactgcagacg

SEQ ID NO: 73252 - DNA, 26 bp, Artificial Sequence
  Description of Artificial Sequence: Synthetic oligonucleotide
gcggtggacacctactgcagacgcaa

SEQ ID NO: 73253 - DNA, 27 bp, Artificial Sequence
  Description of Artificial Sequence: Synthetic oligonucleotide
cggtggacacctactgcagacgcaact

SEQ ID NO: 73254 - DNA, 28 bp, Artificial Sequence
  Description of Artificial Sequence: Synthetic oligonucleotide
ggtggacacctactgcagacgcaactac

SEQ ID NO: 73255 - DNA, 28 bp, Artificial Sequence
  Description of Artificial Sequence: Synthetic oligonucleotide
gtggacacctactgcagacgcaactacg

SEQ ID NO: 73256 - DNA, 28 bp, Artificial Sequence
  Description of Artificial Sequence: Synthetic oligonucleotide
tggacacctactgcagacgcaactacgg

SEQ ID NO: 73257 - DNA, 27 bp, Artificial Sequence
  Description of Artificial Sequence: Synthetic oligonucleotide
ggacacctactgcagacgcaactacgg

SEQ ID NO: 73258 - DNA, 27 bp, Artificial Sequence
  Description of Artificial Sequence: Synthetic oligonucleotide
gacacctactgcagacgcaactacggg

SEQ ID NO: 73259 - DNA, 27 bp, Artificial Sequence
  Description of Artificial Sequence: Synthetic oligonucleotide
acacctactgcagacgcaactacgggg

SEQ ID NO: 73260 - DNA, 27 bp, Artificial Sequence
  Description of Artificial Sequence: Synthetic oligonucleotide
cacctactgcagacgcaactacggggt

SEQ ID NO: 73261 - DNA, 28 bp, Artificial Sequence
  Description of Artificial Sequence: Synthetic oligonucleotide
acctactgcagacgcaactacggggttg

SEQ ID NO: 73262 - DNA, 27 bp, Artificial Sequence
  Description of Artificial Sequence: Synthetic oligonucleotide
cctactgcagacgcaactacggggttg

SEQ ID NO: 73263 - DNA, 28 bp, Artificial Sequence
  Description of Artificial Sequence: Synthetic oligonucleotide
ctactgcagacgcaactacggggttgtg

SEQ ID NO: 73264 - DNA, 28 bp, Artificial Sequence
  Description of Artificial Sequence: Synthetic oligonucleotide
tactgcagacgcaactacggggttgtgg

SEQ ID NO: 73265 - DNA, 27 bp, Artificial Sequence
  Description of Artificial Sequence: Synthetic oligonucleotide
actgcagacgcaactacggggttgtgg

SEQ ID NO: 73266 - DNA, 27 bp, Artificial Sequence
  Description of Artificial Sequence: Synthetic oligonucleotide
ctgcagacgcaactacggggttgtgga

SEQ ID NO: 73267 - DNA, 27 bp, Artificial Sequence
  Description of Artificial Sequence: Synthetic oligonucleotide
tgcagacgcaactacggggttgtggag

SEQ ID NO: 73268 - DNA, 27 bp, Artificial Sequence
  Description of Artificial Sequence: Synthetic oligonucleotide
gcagacgcaactacggggttgtggaga

SEQ ID NO: 73269 - DNA, 27 bp, Artificial Sequence
  Description of Artificial Sequence: Synthetic oligonucleotide
cagacgcaactacggggttgtggagag

SEQ ID NO: 73270 - DNA, 27 bp, Artificial Sequence
  Description of Artificial Sequence: Synthetic oligonucleotide
agacgcaactacggggttgtggagagc

SEQ ID NO: 73271 - DNA, 27 bp, Artificial Sequence
  Description of Artificial Sequence: Synthetic oligonucleotide
gacgcaactacggggttgtggagagct

SEQ ID NO: 73272 - DNA, 28 bp, Artificial Sequence
  Description of Artificial Sequence: Synthetic oligonucleotide
acgcaactacggggttgtggagagcttc

SEQ ID NO: 73273 - DNA, 27 bp, Artificial Sequence
  Description of Artificial Sequence: Synthetic oligonucleotide
cgcaactacggggttgtggagagcttc

SEQ ID NO: 73274 - DNA, 28 bp, Artificial Sequence
  Description of Artificial Sequence: Synthetic oligonucleotide
gcaactacggggttgtggagagcttcac

SEQ ID NO: 73275 - DNA, 20 bp, Artificial Sequence
  Description of Artificial Sequence: Synthetic oligonucleotide
gcgcgggccgcggtggacaa

SEQ ID NO: 73276 - DNA, 22 bp, Artificial Sequence
  Description of Artificial Sequence: Synthetic oligonucleotide
cgcgggccgcggtggacaacta

SEQ ID NO: 73277 - DNA, 22 bp, Artificial Sequence
  Description of Artificial Sequence: Synthetic oligonucleotide
acggagctggggcggcctgaca

SEQ ID NO: 73278 - DNA, 21 bp, Artificial Sequence
  Description of Artificial Sequence: Synthetic oligonucleotide
cggagctggggcggcctgaca

SEQ ID NO: 73279 - DNA, 22 bp, Artificial Sequence
  Description of Artificial Sequence: Synthetic oligonucleotide
ggagctggggcggcctgacact

SEQ ID NO: 73280 - DNA, 23 bp, Artificial Sequence
  Description of Artificial Sequence: Synthetic oligonucleotide
gagctggggcggcctgacactga

SEQ ID NO: 73281 - DNA, 25 bp, Artificial Sequence
  Description of Artificial Sequence: Synthetic oligonucleotide
agctggggcggcctgacactgagta

SEQ ID NO: 73282 - DNA, 24 bp, Artificial Sequence
  Description of Artificial Sequence: Synthetic oligonucleotide
gctggggcggcctgacactgagta

SEQ ID NO: 73283 - DNA, 25 bp, Artificial Sequence
  Description of Artificial Sequence: Synthetic oligonucleotide
ctggggcggcctgacactgagtact

SEQ ID NO: 73284 - DNA, 25 bp, Artificial Sequence
  Description of Artificial Sequence: Synthetic oligonucleotide
tggggcggcctgacactgagtactg

SEQ ID NO: 73285 - DNA, 24 bp, Artificial Sequence
  Description of Artificial Sequence: Synthetic oligonucleotide
ggggcggcctgacactgagtactg

SEQ ID NO: 73286 - DNA, 26 bp, Artificial Sequence
  Description of Artificial Sequence: Synthetic oligonucleotide
gggcggcctgacactgagtactggaa

SEQ ID NO: 73287 - DNA, 27 bp, Artificial Sequence
  Description of Artificial Sequence: Synthetic oligonucleotide
ggcggcctgacactgagtactggaaca

SEQ ID NO: 73288 - DNA, 27 bp, Artificial Sequence
  Description of Artificial Sequence: Synthetic oligonucleotide
gcggcctgacactgagtactggaacag

SEQ ID NO: 73289 - DNA, 27 bp, Artificial Sequence
  Description of Artificial Sequence: Synthetic oligonucleotide
cggcctgacactgagtactggaacagc

SEQ ID NO: 73290 - DNA, 27 bp, Artificial Sequence
  Description of Artificial Sequence: Synthetic oligonucleotide
ggcctgacactgagtactggaacagcc

SEQ ID NO: 73291 - DNA, 28 bp, Artificial Sequence
  Description of Artificial Sequence: Synthetic oligonucleotide
gcctgacactgagtactggaacagccag

SEQ ID NO: 73292 - DNA, 30 bp, Artificial Sequence
  Description of Artificial Sequence: Synthetic oligonucleotide
cctgacactgagtactggaacagccagaag

SEQ ID NO: 73293 - DNA, 30 bp, Artificial Sequence
  Description of Artificial Sequence: Synthetic oligonucleotide
ctgacactgagtactggaacagccagaagg

SEQ ID NO: 73294 - DNA, 31 bp, Artificial Sequence
  Description of Artificial Sequence: Synthetic oligonucleotide
tgacactgagtactggaacagccagaaggac

SEQ ID NO: 73295 - DNA, 30 bp, Artificial Sequence
  Description of Artificial Sequence: Synthetic oligonucleotide
gacactgagtactggaacagccagaaggac

SEQ ID NO: 73296 - DNA, 32 bp, Artificial Sequence
  Description of Artificial Sequence: Synthetic oligonucleotide
acactgagtactggaacagccagaaggacatc

SEQ ID NO: 73297 - DNA, 31 bp, Artificial Sequence
  Description of Artificial Sequence: Synthetic oligonucleotide
cactgagtactggaacagccagaaggacatc

SEQ ID NO: 73298 - DNA, 31 bp, Artificial Sequence
  Description of Artificial Sequence: Synthetic oligonucleotide
actgagtactggaacagccagaaggacatcc

SEQ ID NO: 73299 - DNA, 30 bp, Artificial Sequence
  Description of Artificial Sequence: Synthetic oligonucleotide
gtttcctgtggcagcctaagagggagtatc

SEQ ID NO: 73300 - DNA, 34 bp, Artificial Sequence
  Description of Artificial Sequence: Synthetic oligonucleotide
tttcctgtggcagcctaagagggagtatcatttc

SEQ ID NO: 73301 - DNA, 33 bp, Artificial Sequence
  Description of Artificial Sequence: Synthetic oligonucleotide
ttcctgtggcagcctaagagggagtatcatttc

SEQ ID NO: 73302 - DNA, 32 bp, Artificial Sequence
  Description of Artificial Sequence: Synthetic oligonucleotide
tcctgtggcagcctaagagggagtatcatttc

SEQ ID NO: 73303 - DNA, 31 bp, Artificial Sequence
  Description of Artificial Sequence: Synthetic oligonucleotide
cctgtggcagcctaagagggagtatcatttc

SEQ ID NO: 73304 - DNA, 33 bp, Artificial Sequence
  Description of Artificial Sequence: Synthetic oligonucleotide
ctgtggcagcctaagagggagtatcatttcttc

SEQ ID NO: 73305 - DNA, 36 bp, Artificial Sequence
  Description of Artificial Sequence: Synthetic oligonucleotide
tgtggcagcctaagagggagtatcatttcttcaatg

SEQ ID NO: 73306 - DNA, 35 bp, Artificial Sequence
  Description of Artificial Sequence: Synthetic oligonucleotide
gtggcagcctaagagggagtatcatttcttcaatg

SEQ ID NO: 73307 - DNA, 35 bp, Artificial Sequence
  Description of Artificial Sequence: Synthetic oligonucleotide
tggcagcctaagagggagtatcatttcttcaatgg

SEQ ID NO: 73308 - DNA, 34 bp, Artificial Sequence
  Description of Artificial Sequence: Synthetic oligonucleotide
ggcagcctaagagggagtatcatttcttcaatgg

SEQ ID NO: 73309 - DNA, 34 bp, Artificial Sequence
  Description of Artificial Sequence: Synthetic oligonucleotide
gcagcctaagagggagtatcatttcttcaatggg

SEQ ID NO: 73310 - DNA, 35 bp, Artificial Sequence
  Description of Artificial Sequence: Synthetic oligonucleotide
cagcctaagagggagtatcatttcttcaatgggac

SEQ ID NO: 73311 - DNA, 35 bp, Artificial Sequence
  Description of Artificial Sequence: Synthetic oligonucleotide
agcctaagagggagtatcatttcttcaatgggacg

SEQ ID NO: 73312 - DNA, 34 bp, Artificial Sequence
  Description of Artificial Sequence: Synthetic oligonucleotide
gcctaagagggagtatcatttcttcaatgggacg

SEQ ID NO: 73313 - DNA, 34 bp, Artificial Sequence
  Description of Artificial Sequence: Synthetic oligonucleotide
cctaagagggagtatcatttcttcaatgggacgg

SEQ ID NO: 73314 - DNA, 35 bp, Artificial Sequence
  Description of Artificial Sequence: Synthetic oligonucleotide
ctaagagggagtatcatttcttcaatgggacggag

SEQ ID NO: 73315 - DNA, 35 bp, Artificial Sequence
  Description of Artificial Sequence: Synthetic oligonucleotide
taagagggagtatcatttcttcaatgggacggagc

SEQ ID NO: 73316 - DNA, 34 bp, Artificial Sequence
  Description of Artificial Sequence: Synthetic oligonucleotide
aagagggagtatcatttcttcaatgggacggagc

SEQ ID NO: 73317 - DNA, 33 bp, Artificial Sequence
  Description of Artificial Sequence: Synthetic oligonucleotide
agagggagtatcatttcttcaatgggacggagc

SEQ ID NO: 73318 - DNA, 32 bp, Artificial Sequence
  Description of Artificial Sequence: Synthetic oligonucleotide
gagggagtatcatttcttcaatgggacggagc

SEQ ID NO: 73319 - DNA, 32 bp, Artificial Sequence
  Description of Artificial Sequence: Synthetic oligonucleotide
agggagtatcatttcttcaatgggacggagcg

SEQ ID NO: 73320 - DNA, 31 bp, Artificial Sequence
  Description of Artificial Sequence: Synthetic oligonucleotide
gggagtatcatttcttcaatgggacggagcg

SEQ ID NO: 73321 - DNA, 31 bp, Artificial Sequence
  Description of Artificial Sequence: Synthetic oligonucleotide
ggagtatcatttcttcaatgggacggagcgg

SEQ ID NO: 73322 - DNA, 31 bp, Artificial Sequence
  Description of Artificial Sequence: Synthetic oligonucleotide
gagtatcatttcttcaatgggacggagcggg

SEQ ID NO: 73323 - DNA, 32 bp, Artificial Sequence
  Description of Artificial Sequence: Synthetic oligonucleotide
agtatcatttcttcaatgggacggagcgggtg

SEQ ID NO: 73324 - DNA, 31 bp, Artificial Sequence
  Description of Artificial Sequence: Synthetic oligonucleotide
gtatcatttcttcaatgggacggagcgggtg

SEQ ID NO: 73325 - DNA, 31 bp, Artificial Sequence
  Description of Artificial Sequence: Synthetic oligonucleotide
tatcatttcttcaatgggacggagcgggtgc

SEQ ID NO: 73326 - DNA, 30 bp, Artificial Sequence
  Description of Artificial Sequence: Synthetic oligonucleotide
atcatttcttcaatgggacggagcgggtgc

SEQ ID NO: 73327 - DNA, 26 bp, Artificial Sequence
  Description of Artificial Sequence: Synthetic oligonucleotide
gcggcctgacgctgagtactggaaga

SEQ ID NO: 73328 - DNA, 26 bp, Artificial Sequence
  Description of Artificial Sequence: Synthetic oligonucleotide
cggcctgacgctgagtactggaagag

SEQ ID NO: 73329 - DNA, 26 bp, Artificial Sequence
  Description of Artificial Sequence: Synthetic oligonucleotide
ggcctgacgctgagtactggaagagc

SEQ ID NO: 73330 - DNA, 27 bp, Artificial Sequence
  Description of Artificial Sequence: Synthetic oligonucleotide
gcctgacgctgagtactggaagagcca

SEQ ID NO: 73331 - DNA, 27 bp, Artificial Sequence
  Description of Artificial Sequence: Synthetic oligonucleotide
cctgacgctgagtactggaagagccag

SEQ ID NO: 73332 - DNA, 29 bp, Artificial Sequence
  Description of Artificial Sequence: Synthetic oligonucleotide
ctgacgctgagtactggaagagccagaag

SEQ ID NO: 73333 - DNA, 29 bp, Artificial Sequence
  Description of Artificial Sequence: Synthetic oligonucleotide
tgacgctgagtactggaagagccagaagg

SEQ ID NO: 73334 - DNA, 28 bp, Artificial Sequence
  Description of Artificial Sequence: Synthetic oligonucleotide
gacgctgagtactggaagagccagaagg

SEQ ID NO: 73335 - DNA, 29 bp, Artificial Sequence
  Description of Artificial Sequence: Synthetic oligonucleotide
acgctgagtactggaagagccagaaggac

SEQ ID NO: 73336 - DNA, 28 bp, Artificial Sequence
  Description of Artificial Sequence: Synthetic oligonucleotide
cgctgagtactggaagagccagaaggac

SEQ ID NO: 73337 - DNA, 30 bp, Artificial Sequence
  Description of Artificial Sequence: Synthetic oligonucleotide
gctgagtactggaagagccagaaggacatc

SEQ ID NO: 73338 - DNA, 30 bp, Artificial Sequence
  Description of Artificial Sequence: Synthetic oligonucleotide
ctgagtactggaagagccagaaggacatcc

SEQ ID NO: 73339 - DNA, 31 bp, Artificial Sequence
  Description of Artificial Sequence: Synthetic oligonucleotide
tgagtactggaagagccagaaggacatcctg

SEQ ID NO: 73340 - DNA, 30 bp, Artificial Sequence
  Description of Artificial Sequence: Synthetic oligonucleotide
gagtactggaagagccagaaggacatcctg

SEQ ID NO: 73341 - DNA, 30 bp, Artificial Sequence
  Description of Artificial Sequence: Synthetic oligonucleotide
agtactggaagagccagaaggacatcctgg

SEQ ID NO: 73342 - DNA, 29 bp, Artificial Sequence
  Description of Artificial Sequence: Synthetic oligonucleotide
gtactggaagagccagaaggacatcctgg

SEQ ID NO: 73343 - DNA, 30 bp, Artificial Sequence
  Description of Artificial Sequence: Synthetic oligonucleotide
tactggaagagccagaaggacatcctggag

SEQ ID NO: 73344 - DNA, 29 bp, Artificial Sequence
  Description of Artificial Sequence: Synthetic oligonucleotide
actggaagagccagaaggacatcctggag

SEQ ID NO: 73345 - DNA, 28 bp, Artificial Sequence
  Description of Artificial Sequence: Synthetic oligonucleotide
ctggaagagccagaaggacatcctggag

SEQ ID NO: 73346 - DNA, 28 bp, Artificial Sequence
  Description of Artificial Sequence: Synthetic oligonucleotide
tggaagagccagaaggacatcctggagc

SEQ ID NO: 73347 - DNA, 27 bp, Artificial Sequence
  Description of Artificial Sequence: Synthetic oligonucleotide
ggaagagccagaaggacatcctggagc

SEQ ID NO: 73348 - DNA, 28 bp, Artificial Sequence
  Description of Artificial Sequence: Synthetic oligonucleotide
gaagagccagaaggacatcctggagcag

SEQ ID NO: 73349 - DNA, 28 bp, Artificial Sequence
  Description of Artificial Sequence: Synthetic oligonucleotide
aagagccagaaggacatcctggagcagg

SEQ ID NO: 73350 - DNA, 27 bp, Artificial Sequence
  Description of Artificial Sequence: Synthetic oligonucleotide
agagccagaaggacatcctggagcagg

SEQ ID NO: 73351 - DNA, 26 bp, Artificial Sequence
  Description of Artificial Sequence: Synthetic oligonucleotide
gagccagaaggacatcctggagcagg

SEQ ID NO: 73352 - DNA, 31 bp, Artificial Sequence
  Description of Artificial Sequence: Synthetic oligonucleotide
ggagtgtcatttcttcaatgggacggagcag

SEQ ID NO: 73353 - DNA, 31 bp, Artificial Sequence
  Description of Artificial Sequence: Synthetic oligonucleotide
gagtgtcatttcttcaatgggacggagcagg

SEQ ID NO: 73354 - DNA, 32 bp, Artificial Sequence
  Description of Artificial Sequence: Synthetic oligonucleotide
agtgtcatttcttcaatgggacggagcaggtg

SEQ ID NO: 73355 - DNA, 31 bp, Artificial Sequence
  Description of Artificial Sequence: Synthetic oligonucleotide
gtgtcatttcttcaatgggacggagcaggtg

SEQ ID NO: 73356 - DNA, 31 bp, Artificial Sequence
  Description of Artificial Sequence: Synthetic oligonucleotide
tgtcatttcttcaatgggacggagcaggtgc

SEQ ID NO: 73357 - DNA, 30 bp, Artificial Sequence
  Description of Artificial Sequence: Synthetic oligonucleotide
gtcatttcttcaatgggacggagcaggtgc

SEQ ID NO: 73358 - DNA, 30 bp, Artificial Sequence
  Description of Artificial Sequence: Synthetic oligonucleotide
tcatttcttcaatgggacggagcaggtgcg

SEQ ID NO: 73359 - DNA, 29 bp, Artificial Sequence
  Description of Artificial Sequence: Synthetic oligonucleotide
catttcttcaatgggacggagcaggtgcg

SEQ ID NO: 73360 - DNA, 29 bp, Artificial Sequence
  Description of Artificial Sequence: Synthetic oligonucleotide
atttcttcaatgggacggagcaggtgcgg

SEQ ID NO: 73361 - DNA, 28 bp, Artificial Sequence
  Description of Artificial Sequence: Synthetic oligonucleotide
tttcttcaatgggacggagcaggtgcgg

SEQ ID NO: 73362 - DNA, 27 bp, Artificial Sequence
  Description of Artificial Sequence: Synthetic oligonucleotide
ttcttcaatgggacggagcaggtgcgg

SEQ ID NO: 73363 - DNA, 27 bp, Artificial Sequence
  Description of Artificial Sequence: Synthetic oligonucleotide
tcttcaatgggacggagcaggtgcggt

SEQ ID NO: 73364 - DNA, 27 bp, Artificial Sequence
  Description of Artificial Sequence: Synthetic oligonucleotide
cttcaatgggacggagcaggtgcggtt

SEQ ID NO: 73365 - DNA, 27 bp, Artificial Sequence
  Description of Artificial Sequence: Synthetic oligonucleotide
ttcaatgggacggagcaggtgcggttc

SEQ ID NO: 73366 - DNA, 26 bp, Artificial Sequence
  Description of Artificial Sequence: Synthetic oligonucleotide
tcaatgggacggagcaggtgcggttc

SEQ ID NO: 73367 - DNA, 25 bp, Artificial Sequence
  Description of Artificial Sequence: Synthetic oligonucleotide
caatgggacggagcaggtgcggttc

SEQ ID NO: 73368 - DNA, 26 bp, Artificial Sequence
  Description of Artificial Sequence: Synthetic oligonucleotide
aatgggacggagcaggtgcggttcct

SEQ ID NO: 73369 - DNA, 25 bp, Artificial Sequence
  Description of Artificial Sequence: Synthetic oligonucleotide
atgggacggagcaggtgcggttcct

SEQ ID NO: 73370 - DNA, 24 bp, Artificial Sequence
  Description of Artificial Sequence: Synthetic oligonucleotide
tgggacggagcaggtgcggttcct

SEQ ID NO: 73371 - DNA, 23 bp, Artificial Sequence
  Description of Artificial Sequence: Synthetic oligonucleotide
gggacggagcaggtgcggttcct

SEQ ID NO: 73372 - DNA, 23 bp, Artificial Sequence
  Description of Artificial Sequence: Synthetic oligonucleotide
ggacggagcaggtgcggttcctg

SEQ ID NO: 73373 - DNA, 24 bp, Artificial Sequence
  Description of Artificial Sequence: Synthetic oligonucleotide
gacggagcaggtgcggttcctgga

SEQ ID NO: 73374 - DNA, 25 bp, Artificial Sequence
  Description of Artificial Sequence: Synthetic oligonucleotide
acggagcaggtgcggttcctggaca

SEQ ID NO: 73375 - DNA, 24 bp, Artificial Sequence
  Description of Artificial Sequence: Synthetic oligonucleotide
cggagcaggtgcggttcctggaca

SEQ ID NO: 73376 - DNA, 27 bp, Artificial Sequence
  Description of Artificial Sequence: Synthetic oligonucleotide
ggagcaggtgcggttcctggacagata

SEQ ID NO: 73377 - DNA, 27 bp, Artificial Sequence
  Description of Artificial Sequence: Synthetic oligonucleotide
gagcaggtgcggttcctggacagatac

SEQ ID NO: 73378 - DNA, 29 bp, Artificial Sequence
  Description of Artificial Sequence: Synthetic oligonucleotide
agcaggtgcggttcctggacagatacttc

SEQ ID NO: 73379 - DNA, 28 bp, Artificial Sequence
  Description of Artificial Sequence: Synthetic oligonucleotide
gcaggtgcggttcctggacagatacttc

SEQ ID NO: 73380 - DNA, 33 bp, Artificial Sequence
  Description of Artificial Sequence: Synthetic oligonucleotide
caggtgcggttcctggacagatacttctataac

SEQ ID NO: 73381 - DNA, 33 bp, Artificial Sequence
  Description of Artificial Sequence: Synthetic oligonucleotide
aggtgcggttcctggacagatacttctataacc

SEQ ID NO: 73382 - DNA, 32 bp, Artificial Sequence
  Description of Artificial Sequence: Synthetic oligonucleotide
tggcagcctaagagggagtgtcatttcttcag

SEQ ID NO: 73383 - DNA, 31 bp, Artificial Sequence
  Description of Artificial Sequence: Synthetic oligonucleotide
ggcagcctaagagggagtgtcatttcttcag

SEQ ID NO: 73384 - DNA, 32 bp, Artificial Sequence
  Description of Artificial Sequence: Synthetic oligonucleotide
gcagcctaagagggagtgtcatttcttcagtg

SEQ ID NO: 73385 - DNA, 32 bp, Artificial Sequence
  Description of Artificial Sequence: Synthetic oligonucleotide
cagcctaagagggagtgtcatttcttcagtgg

SEQ ID NO: 73386 - DNA, 32 bp, Artificial Sequence
  Description of Artificial Sequence: Synthetic oligonucleotide
agcctaagagggagtgtcatttcttcagtggg

SEQ ID NO: 73387 - DNA, 31 bp, Artificial Sequence
  Description of Artificial Sequence: Synthetic oligonucleotide
gcctaagagggagtgtcatttcttcagtggg

SEQ ID NO: 73388 - DNA, 32 bp, Artificial Sequence
  Description of Artificial Sequence: Synthetic oligonucleotide
cctaagagggagtgtcatttcttcagtgggac

SEQ ID NO: 73389 - DNA, 32 bp, Artificial Sequence
  Description of Artificial Sequence: Synthetic oligonucleotide
ctaagagggagtgtcatttcttcagtgggacg

SEQ ID NO: 73390 - DNA, 32 bp, Artificial Sequence
  Description of Artificial Sequence: Synthetic oligonucleotide
taagagggagtgtcatttcttcagtgggacgg

SEQ ID NO: 73391 - DNA, 31 bp, Artificial Sequence
  Description of Artificial Sequence: Synthetic oligonucleotide
aagagggagtgtcatttcttcagtgggacgg

SEQ ID NO: 73392 - DNA, 30 bp, Artificial Sequence
  Description of Artificial Sequence: Synthetic oligonucleotide
agagggagtgtcatttcttcagtgggacgg

SEQ ID NO: 73393 - DNA, 29 bp, Artificial Sequence
  Description of Artificial Sequence: Synthetic oligonucleotide
gagggagtgtcatttcttcagtgggacgg

SEQ ID NO: 73394 - DNA, 30 bp, Artificial Sequence
  Description of Artificial Sequence: Synthetic oligonucleotide
agggagtgtcatttcttcagtgggacggag

SEQ ID NO: 73395 - DNA, 29 bp, Artificial Sequence
  Description of Artificial Sequence: Synthetic oligonucleotide
gggagtgtcatttcttcagtgggacggag

SEQ ID NO: 73396 - DNA, 29 bp, Artificial Sequence
  Description of Artificial Sequence: Synthetic oligonucleotide
ggagtgtcatttcttcagtgggacggagc

SEQ ID NO: 73397 - DNA, 23 bp, Artificial Sequence
  Description of Artificial Sequence: Synthetic oligonucleotide
gacatcctggagcaggcgcgggt

SEQ ID NO: 73398 - DNA, 23 bp, Artificial Sequence
  Description of Artificial Sequence: Synthetic oligonucleotide
acatcctggagcaggcgcgggtc

SEQ ID NO: 73399 - DNA, 22 bp, Artificial Sequence
  Description of Artificial Sequence: Synthetic oligonucleotide
catcctggagcaggcgcgggtc

SEQ ID NO: 73400 - DNA, 22 bp, Artificial Sequence
  Description of Artificial Sequence: Synthetic oligonucleotide
atcctggagcaggcgcgggtcg

SEQ ID NO: 73401 - DNA, 21 bp, Artificial Sequence
  Description of Artificial Sequence: Synthetic oligonucleotide
tcctggagcaggcgcgggtcg

SEQ ID NO: 73402 - DNA, 20 bp, Artificial Sequence
  Description of Artificial Sequence: Synthetic oligonucleotide
cctggagcaggcgcgggtcg

SEQ ID NO: 73403 - DNA, 20 bp, Artificial Sequence
  Description of Artificial Sequence: Synthetic oligonucleotide
ctggagcaggcgcgggtcgc

SEQ ID NO: 73404 - DNA, 20 bp, Artificial Sequence
  Description of Artificial Sequence: Synthetic oligonucleotide
tggagcaggcgcgggtcgcg

SEQ ID NO: 73405 - DNA, 20 bp, Artificial Sequence
  Description of Artificial Sequence: Synthetic oligonucleotide
ggagcaggcgcgggtcgcgt

SEQ ID NO: 73406 - DNA, 20 bp, Artificial Sequence
  Description of Artificial Sequence: Synthetic oligonucleotide
gagcaggcgcgggtcgcggt

SEQ ID NO: 73407 - DNA, 20 bp, Artificial Sequence
  Description of Artificial Sequence: Synthetic oligonucleotide
agcaggcgcgggtcgcggtg

SEQ ID NO: 73408 - DNA, 20 bp, Artificial Sequence
  Description of Artificial Sequence: Synthetic oligonucleotide
gcaggcgcgggtcgcggtgt

SEQ ID NO: 73409 - DNA, 20 bp, Artificial Sequence
  Description of Artificial Sequence: Synthetic oligonucleotide
caggcgcgggtcgcggtgga

SEQ ID NO: 73410 - DNA, 21 bp, Artificial Sequence
  Description of Artificial Sequence: Synthetic oligonucleotide
aggcgcgggtcgcggtggaca

SEQ ID NO: 73411 - DNA, 20 bp, Artificial Sequence
  Description of Artificial Sequence: Synthetic oligonucleotide
ggcgcgggtcgcggtggaca

SEQ ID NO: 73412 - DNA, 20 bp, Artificial Sequence
  Description of Artificial Sequence: Synthetic oligonucleotide
gcgcgggtcgcggtggacac

SEQ ID NO: 73413 - DNA, 22 bp, Artificial Sequence
  Description of Artificial Sequence: Synthetic oligonucleotide
cgcgggtcgcggtggacaccta

SEQ ID NO: 73414 - DNA, 23 bp, Artificial Sequence
  Description of Artificial Sequence: Synthetic oligonucleotide
gcgggtcgcggtggacacctact

SEQ ID NO: 73415 - DNA, 23 bp, Artificial Sequence
  Description of Artificial Sequence: Synthetic oligonucleotide
cgggtcgcggtggacacctactg

SEQ ID NO: 73416 - DNA, 24 bp, Artificial Sequence
  Description of Artificial Sequence: Synthetic oligonucleotide
gggtcgcggtggacacctactgca

SEQ ID NO: 73417 - DNA, 25 bp, Artificial Sequence
  Description of Artificial Sequence: Synthetic oligonucleotide
ggtcgcggtggacacctactgcaga

SEQ ID NO: 73418 - DNA, 26 bp, Artificial Sequence
  Description of Artificial Sequence: Synthetic oligonucleotide
gtcgcggtggacacctactgcagaca

SEQ ID NO: 73419 - DNA, 27 bp, Artificial Sequence
  Description of Artificial Sequence: Synthetic oligonucleotide
tcgcggtggacacctactgcagacaca

SEQ ID NO: 73420 - DNA, 21 bp, Artificial Sequence
  Description of Artificial Sequence: Synthetic oligonucleotide
gggcggtgacggagctggggt

SEQ ID NO: 73421 - DNA, 21 bp, Artificial Sequence
  Description of Artificial Sequence: Synthetic oligonucleotide
ggcggtgacggagctggggtg

SEQ ID NO: 73422 - DNA, 21 bp, Artificial Sequence
  Description of Artificial Sequence: Synthetic oligonucleotide
gcggtgacggagctggggtgg

SEQ ID NO: 73423 - DNA, 21 bp, Artificial Sequence
  Description of Artificial Sequence: Synthetic oligonucleotide
cggtgacggagctggggtggc

SEQ ID NO: 73424 - DNA, 22 bp, Artificial Sequence
  Description of Artificial Sequence: Synthetic oligonucleotide
ggtgacggagctggggtggcct

SEQ ID NO: 73425 - DNA, 23 bp, Artificial Sequence
  Description of Artificial Sequence: Synthetic oligonucleotide
gtgacggagctggggtggcctga

SEQ ID NO: 73426 - DNA, 23 bp, Artificial Sequence
  Description of Artificial Sequence: Synthetic oligonucleotide
tgacggagctggggtggcctgac

SEQ ID NO: 73427 - DNA, 22 bp, Artificial Sequence
  Description of Artificial Sequence: Synthetic oligonucleotide
gacggagctggggtggcctgac

SEQ ID NO: 73428 - DNA, 22 bp, Artificial Sequence
  Description of Artificial Sequence: Synthetic oligonucleotide
acggagctggggtggcctgacg

SEQ ID NO: 73429 - DNA, 21 bp, Artificial Sequence
  Description of Artificial Sequence: Synthetic oligonucleotide
cggagctggggtggcctgacg

SEQ ID NO: 73430 - DNA, 21 bp, Artificial Sequence
  Description of Artificial Sequence: Synthetic oligonucleotide
ggagctggggtggcctgacgc

SEQ ID NO: 73431 - DNA, 21 bp, Artificial Sequence
  Description of Artificial Sequence: Synthetic oligonucleotide
gagctggggtggcctgacgcc

SEQ ID NO: 73432 - DNA, 22 bp, Artificial Sequence
  Description of Artificial Sequence: Synthetic oligonucleotide
agctggggtggcctgacgccga

SEQ ID NO: 73433 - DNA, 21 bp, Artificial Sequence
  Description of Artificial Sequence: Synthetic oligonucleotide
gctggggtggcctgacgccga

SEQ ID NO: 73434 - DNA, 23 bp, Artificial Sequence
  Description of Artificial Sequence: Synthetic oligonucleotide
ctggggtggcctgacgccgagta

SEQ ID NO: 73435 - DNA, 24 bp, Artificial Sequence
  Description of Artificial Sequence: Synthetic oligonucleotide
tggggtggcctgacgccgagtact

SEQ ID NO: 73436 - DNA, 23 bp, Artificial Sequence
  Description of Artificial Sequence: Synthetic oligonucleotide
ggggtggcctgacgccgagtact

SEQ ID NO: 73437 - DNA, 23 bp, Artificial Sequence
  Description of Artificial Sequence: Synthetic oligonucleotide
gggtggcctgacgccgagtactg

SEQ ID NO: 73438 - DNA, 25 bp, Artificial Sequence
  Description of Artificial Sequence: Synthetic oligonucleotide
ggtggcctgacgccgagtactggaa

SEQ ID NO: 73439 - DNA, 26 bp, Artificial Sequence
  Description of Artificial Sequence: Synthetic oligonucleotide
gtggcctgacgccgagtactggaaca

SEQ ID NO: 73440 - DNA, 26 bp, Artificial Sequence
  Description of Artificial Sequence: Synthetic oligonucleotide
tggcctgacgccgagtactggaacag

SEQ ID NO: 73441 - DNA, 25 bp, Artificial Sequence
  Description of Artificial Sequence: Synthetic oligonucleotide
cagaaggacatcctggagcaggcgg

SEQ ID NO: 73442 - DNA, 25 bp, Artificial Sequence
  Description of Artificial Sequence: Synthetic oligonucleotide
agaaggacatcctggagcaggcggg

SEQ ID NO: 73443 - DNA, 24 bp, Artificial Sequence
  Description of Artificial Sequence: Synthetic oligonucleotide
gaaggacatcctggagcaggcggg

SEQ ID NO: 73444 - DNA, 24 bp, Artificial Sequence
  Description of Artificial Sequence: Synthetic oligonucleotide
aaggacatcctggagcaggcgggg

SEQ ID NO: 73445 - DNA, 23 bp, Artificial Sequence
  Description of Artificial Sequence: Synthetic oligonucleotide
aggacatcctggagcaggcgggg

SEQ ID NO: 73446 - DNA, 22 bp, Artificial Sequence
  Description of Artificial Sequence: Synthetic oligonucleotide
ggacatcctggagcaggcgggg

SEQ ID NO: 73447 - DNA, 22 bp, Artificial Sequence
  Description of Artificial Sequence: Synthetic oligonucleotide
gacatcctggagcaggcggggg

SEQ ID NO: 73448 - DNA, 22 bp, Artificial Sequence
  Description of Artificial Sequence: Synthetic oligonucleotide
acatcctggagcaggcgggggc

SEQ ID NO: 73449 - DNA, 21 bp, Artificial Sequence
  Description of Artificial Sequence: Synthetic oligonucleotide
catcctggagcaggcgggggc

SEQ ID NO: 73450 - DNA, 21 bp, Artificial Sequence
  Description of Artificial Sequence: Synthetic oligonucleotide
atcctggagcaggcgggggcc

SEQ ID NO: 73451 - DNA, 20 bp, Artificial Sequence
  Description of Artificial Sequence: Synthetic oligonucleotide
tcctggagcaggcgggggcc

SEQ ID NO: 73452 - DNA, 20 bp, Artificial Sequence
  Description of Artificial Sequence: Synthetic oligonucleotide
cctggagcaggcgggggcct

SEQ ID NO: 73453 - DNA, 20 bp, Artificial Sequence
  Description of Artificial Sequence: Synthetic oligonucleotide
ctggagcaggcgggggccgt

SEQ ID NO: 73454 - DNA, 20 bp, Artificial Sequence
  Description of Artificial Sequence: Synthetic oligonucleotide
tggagcaggcgggggccgct

SEQ ID NO: 73455 - DNA, 20 bp, Artificial Sequence
  Description of Artificial Sequence: Synthetic oligonucleotide
ggagcaggcgggggccgctt

SEQ ID NO: 73456 - DNA, 20 bp, Artificial Sequence
  Description of Artificial Sequence: Synthetic oligonucleotide
gagcaggcgggggccgcgtt

SEQ ID NO: 73457 - DNA, 20 bp, Artificial Sequence
  Description of Artificial Sequence: Synthetic oligonucleotide
agcaggcgggggccgcggtt

SEQ ID NO: 73458 - DNA, 20 bp, Artificial Sequence
  Description of Artificial Sequence: Synthetic oligonucleotide
gcaggcgggggccgcggttt

SEQ ID NO: 73459 - DNA, 20 bp, Artificial Sequence
  Description of Artificial Sequence: Synthetic oligonucleotide
caggcgggggccgcggtgtt

SEQ ID NO: 73460 - DNA, 20 bp, Artificial Sequence
  Description of Artificial Sequence: Synthetic oligonucleotide
aggcgggggccgcggtggat

SEQ ID NO: 73461 - DNA, 20 bp, Artificial Sequence
  Description of Artificial Sequence: Synthetic oligonucleotide
ggcgggggccgcggtggatt

SEQ ID NO: 73462 - DNA, 20 bp, Artificial Sequence
  Description of Artificial Sequence: Synthetic oligonucleotide
gcgggggccgcggtggacat

SEQ ID NO: 73463 - DNA, 20 bp, Artificial Sequence
  Description of Artificial Sequence: Synthetic oligonucleotide
cgggggccgcggtggacact

SEQ ID NO: 73464 - DNA, 21 bp, Artificial Sequence
  Description of Artificial Sequence: Synthetic oligonucleotide
gggggccgcggtggacaccta

SEQ ID NO: 73465 - DNA, 22 bp, Artificial Sequence
  Description of Artificial Sequence: Synthetic oligonucleotide
ggggccgcggtggacacctact

SEQ ID NO: 73466 - DNA, 22 bp, Artificial Sequence
  Description of Artificial Sequence: Synthetic oligonucleotide
tgagggagctggggcggcctga

SEQ ID NO: 73467 - DNA, 21 bp, Artificial Sequence
  Description of Artificial Sequence: Synthetic oligonucleotide
gagggagctggggcggcctga

SEQ ID NO: 73468 - DNA, 21 bp, Artificial Sequence
  Description of Artificial Sequence: Synthetic oligonucleotide
agggagctggggcggcctgac

SEQ ID NO: 73469 - DNA, 20 bp, Artificial Sequence
  Description of Artificial Sequence: Synthetic oligonucleotide
gggagctggggcggcctgac

SEQ ID NO: 73470 - DNA, 29 bp, Artificial Sequence
  Description of Artificial Sequence: Synthetic oligonucleotide
gctgagtactggaacagccagaaggacac

SEQ ID NO: 73471 - DNA, 29 bp, Artificial Sequence
  Description of Artificial Sequence: Synthetic oligonucleotide
ctgagtactggaacagccagaaggacacc

SEQ ID NO: 73472 - DNA, 29 bp, Artificial Sequence
  Description of Artificial Sequence: Synthetic oligonucleotide
tgagtactggaacagccagaaggacaccc

SEQ ID NO: 73473 - DNA, 28 bp, Artificial Sequence
  Description of Artificial Sequence: Synthetic oligonucleotide
gagtactggaacagccagaaggacaccc

SEQ ID NO: 73474 - DNA, 29 bp, Artificial Sequence
  Description of Artificial Sequence: Synthetic oligonucleotide
agtactggaacagccagaaggacaccctg

SEQ ID NO: 73475 - DNA, 28 bp, Artificial Sequence
  Description of Artificial Sequence: Synthetic oligonucleotide
gtactggaacagccagaaggacaccctg

SEQ ID NO: 73476 - DNA, 28 bp, Artificial Sequence
  Description of Artificial Sequence: Synthetic oligonucleotide
tactggaacagccagaaggacaccctgg

SEQ ID NO: 73477 - DNA, 27 bp, Artificial Sequence
  Description of Artificial Sequence: Synthetic oligonucleotide
actggaacagccagaaggacaccctgg

SEQ ID NO: 73478 - DNA, 27 bp, Artificial Sequence
  Description of Artificial Sequence: Synthetic oligonucleotide
ctggaacagccagaaggacaccctgga

SEQ ID NO: 73479 - DNA, 27 bp, Artificial Sequence
  Description of Artificial Sequence: Synthetic oligonucleotide
tggaacagccagaaggacaccctggag

SEQ ID NO: 73480 - DNA, 26 bp, Artificial Sequence
  Description of Artificial Sequence: Synthetic oligonucleotide
ggaacagccagaaggacaccctggag

SEQ ID NO: 73481 - DNA, 27 bp, Artificial Sequence
  Description of Artificial Sequence: Synthetic oligonucleotide
gaacagccagaaggacaccctggagca

SEQ ID NO: 73482 - DNA, 27 bp, Artificial Sequence
  Description of Artificial Sequence: Synthetic oligonucleotide
aacagccagaaggacaccctggagcag

SEQ ID NO: 73483 - DNA, 26 bp, Artificial Sequence
  Description of Artificial Sequence: Synthetic oligonucleotide
acagccagaaggacaccctggagcag

SEQ ID NO: 73484 - DNA, 25 bp, Artificial Sequence
  Description of Artificial Sequence: Synthetic oligonucleotide
cagccagaaggacaccctggagcag

SEQ ID NO: 73485 - DNA, 25 bp, Artificial Sequence
  Description of Artificial Sequence: Synthetic oligonucleotide
agccagaaggacaccctggagcagg

SEQ ID NO: 73486 - DNA, 24 bp, Artificial Sequence
  Description of Artificial Sequence: Synthetic oligonucleotide
gccagaaggacaccctggagcagg

SEQ ID NO: 73487 - DNA, 24 bp, Artificial Sequence
  Description of Artificial Sequence: Synthetic oligonucleotide
ccagaaggacaccctggagcaggc

SEQ ID NO: 73488 - DNA, 24 bp, Artificial Sequence
  Description of Artificial Sequence: Synthetic oligonucleotide
cagaaggacaccctggagcaggcg

SEQ ID NO: 73489 - DNA, 24 bp, Artificial Sequence
  Description of Artificial Sequence: Synthetic oligonucleotide
agaaggacaccctggagcaggcgc

SEQ ID NO: 73490 - DNA, 23 bp, Artificial Sequence
  Description of Artificial Sequence: Synthetic oligonucleotide
gaaggacaccctggagcaggcgc

SEQ ID NO: 73491 - DNA, 23 bp, Artificial Sequence
  Description of Artificial Sequence: Synthetic oligonucleotide
aaggacaccctggagcaggcgcg

SEQ ID NO: 73492 - DNA, 22 bp, Artificial Sequence
  Description of Artificial Sequence: Synthetic oligonucleotide
aggacaccctggagcaggcgcg

SEQ ID NO: 73493 - DNA, 21 bp, Artificial Sequence
  Description of Artificial Sequence: Synthetic oligonucleotide
ggacaccctggagcaggcgcg

SEQ ID NO: 73494 - DNA, 21 bp, Artificial Sequence
  Description of Artificial Sequence: Synthetic oligonucleotide
gacaccctggagcaggcgcgg

SEQ ID NO: 73495 - DNA, 21 bp, Artificial Sequence
  Description of Artificial Sequence: Synthetic oligonucleotide
acaccctggagcaggcgcggg

SEQ ID NO: 73496 - DNA, 20 bp, Artificial Sequence
  Description of Artificial Sequence: Synthetic oligonucleotide
caccctggagcaggcgcggg

SEQ ID NO: 73497 - DNA, 20 bp, Artificial Sequence
  Description of Artificial Sequence: Synthetic oligonucleotide
accctggagcaggcgcgggc

SEQ ID NO: 73498 - DNA, 20 bp, Artificial Sequence
  Description of Artificial Sequence: Synthetic oligonucleotide
ccctggagcaggcgcgggct

SEQ ID NO: 73499 - DNA, 24 bp, Artificial Sequence
  Description of Artificial Sequence: Synthetic oligonucleotide
gctggggacacccgaccacgtttc

SEQ ID NO: 73500 - DNA, 28 bp, Artificial Sequence
  Description of Artificial Sequence: Synthetic oligonucleotide
agccagaaggacttcctggaagacaggg

SEQ ID NO: 73501 - DNA, 27 bp, Artificial Sequence
  Description of Artificial Sequence: Synthetic oligonucleotide
gccagaaggacttcctggaagacaggg

SEQ ID NO: 73502 - DNA, 27 bp, Artificial Sequence
  Description of Artificial Sequence: Synthetic oligonucleotide
ccagaaggacttcctggaagacagggc

SEQ ID NO: 73503 - DNA, 27 bp, Artificial Sequence
  Description of Artificial Sequence: Synthetic oligonucleotide
cagaaggacttcctggaagacagggcc

SEQ ID NO: 73504 - DNA, 27 bp, Artificial Sequence
  Description of Artificial Sequence: Synthetic oligonucleotide
agaaggacttcctggaagacagggccg

SEQ ID NO: 73505 - DNA, 26 bp, Artificial Sequence
  Description of Artificial Sequence: Synthetic oligonucleotide
gaaggacttcctggaagacagggccg

SEQ ID NO: 73506 - DNA, 26 bp, Artificial Sequence
  Description of Artificial Sequence: Synthetic oligonucleotide
aaggacttcctggaagacagggccgc

SEQ ID NO: 73507 - DNA, 25 bp, Artificial Sequence
  Description of Artificial Sequence: Synthetic oligonucleotide
aggacttcctggaagacagggccgc

SEQ ID NO: 73508 - DNA, 24 bp, Artificial Sequence
  Description of Artificial Sequence: Synthetic oligonucleotide
ggacttcctggaagacagggccgc

SEQ ID NO: 73509 - DNA, 24 bp, Artificial Sequence
  Description of Artificial Sequence: Synthetic oligonucleotide
gacttcctggaagacagggccgcc

SEQ ID NO: 73510 - DNA, 24 bp, Artificial Sequence
  Description of Artificial Sequence: Synthetic oligonucleotide
acttcctggaagacagggccgccg

SEQ ID NO: 73511 - DNA, 23 bp, Artificial Sequence
  Description of Artificial Sequence: Synthetic oligonucleotide
cttcctggaagacagggccgccg

SEQ ID NO: 73512 - DNA, 23 bp, Artificial Sequence
  Description of Artificial Sequence: Synthetic oligonucleotide
ttcctggaagacagggccgccgc

SEQ ID NO: 73513 - DNA, 22 bp, Artificial Sequence
  Description of Artificial Sequence: Synthetic oligonucleotide
tcctggaagacagggccgccgc

SEQ ID NO: 73514 - DNA, 21 bp, Artificial Sequence
  Description of Artificial Sequence: Synthetic oligonucleotide
cctggaagacagggccgccgc

SEQ ID NO: 73515 - DNA, 21 bp, Artificial Sequence
  Description of Artificial Sequence: Synthetic oligonucleotide
ctggaagacagggccgccgcg

SEQ ID NO: 73516 - DNA, 22 bp, Artificial Sequence
  Description of Artificial Sequence: Synthetic oligonucleotide
tggaagacagggccgccgcggt

SEQ ID NO: 73517 - DNA, 21 bp, Artificial Sequence
  Description of Artificial Sequence: Synthetic oligonucleotide
ggaagacagggccgccgcggt

SEQ ID NO: 73518 - DNA, 21 bp, Artificial Sequence
  Description of Artificial Sequence: Synthetic oligonucleotide
gaagacagggccgccgcggtg

SEQ ID NO: 73519 - DNA, 22 bp, Artificial Sequence
  Description of Artificial Sequence: Synthetic oligonucleotide
aagacagggccgccgcggtgga

SEQ ID NO: 73520 - DNA, 21 bp, Artificial Sequence
  Description of Artificial Sequence: Synthetic oligonucleotide
agacagggccgccgcggtgga

SEQ ID NO: 73521 - DNA, 20 bp, Artificial Sequence
  Description of Artificial Sequence: Synthetic oligonucleotide
gacagggccgccgcggtgga

SEQ ID NO: 73522 - DNA, 21 bp, Artificial Sequence
  Description of Artificial Sequence: Synthetic oligonucleotide
acagggccgccgcggtggaca

SEQ ID NO: 73523 - DNA, 20 bp, Artificial Sequence
  Description of Artificial Sequence: Synthetic oligonucleotide
cagggccgccgcggtggaca

SEQ ID NO: 73524 - DNA, 20 bp, Artificial Sequence
  Description of Artificial Sequence: Synthetic oligonucleotide
agggccgccgcggtggacac

SEQ ID NO: 73525 - DNA, 20 bp, Artificial Sequence
  Description of Artificial Sequence: Synthetic oligonucleotide
gggccgccgcggtggacact

SEQ ID NO: 73526 - DNA, 21 bp, Artificial Sequence
  Description of Artificial Sequence: Synthetic oligonucleotide
ggccgccgcggtggacaccta

SEQ ID NO: 73527 - DNA, 22 bp, Artificial Sequence
  Description of Artificial Sequence: Synthetic oligonucleotide
gccgccgcggtggacacctact

SEQ ID NO: 73528 - DNA, 22 bp, Artificial Sequence
  Description of Artificial Sequence: Synthetic oligonucleotide
ccgccgcggtggacacctactg

SEQ ID NO: 73529 - DNA, 25 bp, Artificial Sequence
  Description of Artificial Sequence: Synthetic oligonucleotide
cttcacggtgcagcggcgagtccaa

SEQ ID NO: 73530 - DNA, 25 bp, Artificial Sequence
  Description of Artificial Sequence: Synthetic oligonucleotide
ttcacggtgcagcggcgagtccaac

SEQ ID NO: 73531 - DNA, 24 bp, Artificial Sequence
  Description of Artificial Sequence: Synthetic oligonucleotide
tcacggtgcagcggcgagtccaac

SEQ ID NO: 73532 - DNA, 23 bp, Artificial Sequence
  Description of Artificial Sequence: Synthetic oligonucleotide
cacggtgcagcggcgagtccaac

SEQ ID NO: 73533 - DNA, 26 bp, Artificial Sequence
  Description of Artificial Sequence: Synthetic oligonucleotide
acggtgcagcggcgagtccaacctaa

SEQ ID NO: 73534 - DNA, 25 bp, Artificial Sequence
  Description of Artificial Sequence: Synthetic oligonucleotide
cggtgcagcggcgagtccaacctaa

SEQ ID NO: 73535 - DNA, 25 bp, Artificial Sequence
  Description of Artificial Sequence: Synthetic oligonucleotide
ggtgcagcggcgagtccaacctaag

SEQ ID NO: 73536 - DNA, 26 bp, Artificial Sequence
  Description of Artificial Sequence: Synthetic oligonucleotide
agaaggacatcctggaggacaggcgc

SEQ ID NO: 73537 - DNA, 25 bp, Artificial Sequence
  Description of Artificial Sequence: Synthetic oligonucleotide
gaaggacatcctggaggacaggcgc

SEQ ID NO: 73538 - DNA, 25 bp, Artificial Sequence
  Description of Artificial Sequence: Synthetic oligonucleotide
aaggacatcctggaggacaggcgcg

SEQ ID NO: 73539 - DNA, 24 bp, Artificial Sequence
  Description of Artificial Sequence: Synthetic oligonucleotide
aggacatcctggaggacaggcgcg

SEQ ID NO: 73540 - DNA, 23 bp, Artificial Sequence
  Description of Artificial Sequence: Synthetic oligonucleotide
ggacatcctggaggacaggcgcg

SEQ ID NO: 73541 - DNA, 23 bp, Artificial Sequence
  Description of Artificial Sequence: Synthetic oligonucleotide
gacatcctggaggacaggcgcgc

SEQ ID NO: 73542 - DNA, 23 bp, Artificial Sequence
  Description of Artificial Sequence: Synthetic oligonucleotide
acatcctggaggacaggcgcgcc

SEQ ID NO: 73543 - DNA, 22 bp, Artificial Sequence
  Description of Artificial Sequence: Synthetic oligonucleotide
catcctggaggacaggcgcgcc

SEQ ID NO: 73544 - DNA, 22 bp, Artificial Sequence
  Description of Artificial Sequence: Synthetic oligonucleotide
atcctggaggacaggcgcgccg

SEQ ID NO: 73545 - DNA, 21 bp, Artificial Sequence
  Description of Artificial Sequence: Synthetic oligonucleotide
tcctggaggacaggcgcgccg

SEQ ID NO: 73546 - DNA, 20 bp, Artificial Sequence
  Description of Artificial Sequence: Synthetic oligonucleotide
cctggaggacaggcgcgccg

SEQ ID NO: 73547 - DNA, 20 bp, Artificial Sequence
  Description of Artificial Sequence: Synthetic oligonucleotide
ctggaggacaggcgcgccgc

SEQ ID NO: 73548 - DNA, 20 bp, Artificial Sequence
  Description of Artificial Sequence: Synthetic oligonucleotide
tggaggacaggcgcgccgcg

SEQ ID NO: 73549 - DNA, 20 bp, Artificial Sequence
  Description of Artificial Sequence: Synthetic oligonucleotide
ggaggacaggcgcgccgcgt

SEQ ID NO: 73550 - DNA, 20 bp, Artificial Sequence
  Description of Artificial Sequence: Synthetic oligonucleotide
gaggacaggcgcgccgcggt

SEQ ID NO: 73551 - DNA, 20 bp, Artificial Sequence
  Description of Artificial Sequence: Synthetic oligonucleotide
aggacaggcgcgccgcggtg

SEQ ID NO: 73552 - DNA, 20 bp, Artificial Sequence
  Description of Artificial Sequence: Synthetic oligonucleotide
ggacaggcgcgccgcggtgt

SEQ ID NO: 73553 - DNA, 21 bp, Artificial Sequence
  Description of Artificial Sequence: Synthetic oligonucleotide
ggacggagcgggtgcggttcc

SEQ ID NO: 73554 - DNA, 21 bp, Artificial Sequence
  Description of Artificial Sequence: Synthetic oligonucleotide
gacggagcgggtgcggttccc

SEQ ID NO: 73555 - DNA, 21 bp, Artificial Sequence
  Description of Artificial Sequence: Synthetic oligonucleotide
acggagcgggtgcggttcccg

SEQ ID NO: 73556 - DNA, 20 bp, Artificial Sequence
  Description of Artificial Sequence: Synthetic oligonucleotide
cggagcgggtgcggttcccg

SEQ ID NO: 73557 - DNA, 21 bp, Artificial Sequence
  Description of Artificial Sequence: Synthetic oligonucleotide
ggagcgggtgcggttcccgga

SEQ ID NO: 73558 - DNA, 22 bp, Artificial Sequence
  Description of Artificial Sequence: Synthetic oligonucleotide
gagcgggtgcggttcccggaca

SEQ ID NO: 73559 - DNA, 25 bp, Artificial Sequence
  Description of Artificial Sequence: Synthetic oligonucleotide
agcgggtgcggttcccggacagata

SEQ ID NO: 73560 - DNA, 24 bp, Artificial Sequence
  Description of Artificial Sequence: Synthetic oligonucleotide
gcgggtgcggttcccggacagata

SEQ ID NO: 73561 - DNA, 26 bp, Artificial Sequence
  Description of Artificial Sequence: Synthetic oligonucleotide
cgggtgcggttcccggacagatactt

SEQ ID NO: 73562 - DNA, 27 bp, Artificial Sequence
  Description of Artificial Sequence: Synthetic oligonucleotide
gggtgcggttcccggacagatacttct

SEQ ID NO: 73563 - DNA, 31 bp, Artificial Sequence
  Description of Artificial Sequence: Synthetic oligonucleotide
ggtgcggttcccggacagatacttctataac

SEQ ID NO: 73564 - DNA, 31 bp, Artificial Sequence
  Description of Artificial Sequence: Synthetic oligonucleotide
gtgcggttcccggacagatacttctataacc

SEQ ID NO: 73565 - DNA, 32 bp, Artificial Sequence
  Description of Artificial Sequence: Synthetic oligonucleotide
tgcggttcccggacagatacttctataaccag

SEQ ID NO: 73566 - DNA, 31 bp, Artificial Sequence
  Description of Artificial Sequence: Synthetic oligonucleotide
gcggttcccggacagatacttctataaccag

SEQ ID NO: 73567 - DNA, 31 bp, Artificial Sequence
  Description of Artificial Sequence: Synthetic oligonucleotide
cggttcccggacagatacttctataaccagg

SEQ ID NO: 73568 - DNA, 32 bp, Artificial Sequence
  Description of Artificial Sequence: Synthetic oligonucleotide
ggttcccggacagatacttctataaccaggag

SEQ ID NO: 73569 - DNA, 32 bp, Artificial Sequence
  Description of Artificial Sequence: Synthetic oligonucleotide
gttcccggacagatacttctataaccaggagg

SEQ ID NO: 73570 - DNA, 33 bp, Artificial Sequence
  Description of Artificial Sequence: Synthetic oligonucleotide
ttcccggacagatacttctataaccaggaggag

SEQ ID NO: 73571 - DNA, 32 bp, Artificial Sequence
  Description of Artificial Sequence: Synthetic oligonucleotide
tcccggacagatacttctataaccaggaggag

SEQ ID NO: 73572 - DNA, 31 bp, Artificial Sequence
  Description of Artificial Sequence: Synthetic oligonucleotide
cccggacagatacttctataaccaggaggag

SEQ ID NO: 73573 - DNA, 32 bp, Artificial Sequence
  Description of Artificial Sequence: Synthetic oligonucleotide
ccggacagatacttctataaccaggaggagtc

SEQ ID NO: 73574 - DNA, 32 bp, Artificial Sequence
  Description of Artificial Sequence: Synthetic oligonucleotide
cggacagatacttctataaccaggaggagtcc

SEQ ID NO: 73575 - DNA, 29 bp, Artificial Sequence
  Description of Artificial Sequence: Synthetic oligonucleotide
cacgtttcctgtggcagcctaagaggaag

SEQ ID NO: 73576 - DNA, 30 bp, Artificial Sequence
  Description of Artificial Sequence: Synthetic oligonucleotide
acgtttcctgtggcagcctaagaggaagtg

SEQ ID NO: 73577 - DNA, 29 bp, Artificial Sequence
  Description of Artificial Sequence: Synthetic oligonucleotide
cgtttcctgtggcagcctaagaggaagtg

SEQ ID NO: 73578 - DNA, 30 bp, Artificial Sequence
  Description of Artificial Sequence: Synthetic oligonucleotide
gtttcctgtggcagcctaagaggaagtgtc

SEQ ID NO: 73579 - DNA, 34 bp, Artificial Sequence
  Description of Artificial Sequence: Synthetic oligonucleotide
tttcctgtggcagcctaagaggaagtgtcatttc

SEQ ID NO: 73580 - DNA, 33 bp, Artificial Sequence
  Description of Artificial Sequence: Synthetic oligonucleotide
ttcctgtggcagcctaagaggaagtgtcatttc

SEQ ID NO: 73581 - DNA, 32 bp, Artificial Sequence
  Description of Artificial Sequence: Synthetic oligonucleotide
tcctgtggcagcctaagaggaagtgtcatttc

SEQ ID NO: 73582 - DNA, 31 bp, Artificial Sequence
  Description of Artificial Sequence: Synthetic oligonucleotide
cctgtggcagcctaagaggaagtgtcatttc

SEQ ID NO: 73583 - DNA, 33 bp, Artificial Sequence
  Description of Artificial Sequence: Synthetic oligonucleotide
ctgtggcagcctaagaggaagtgtcatttcttc

SEQ ID NO: 73584 - DNA, 36 bp, Artificial Sequence
  Description of Artificial Sequence: Synthetic oligonucleotide
tgtggcagcctaagaggaagtgtcatttcttcaatg

SEQ ID NO: 73585 - DNA, 35 bp, Artificial Sequence
  Description of Artificial Sequence: Synthetic oligonucleotide
gtggcagcctaagaggaagtgtcatttcttcaatg

SEQ ID NO: 73586 - DNA, 35 bp, Artificial Sequence
  Description of Artificial Sequence: Synthetic oligonucleotide
tggcagcctaagaggaagtgtcatttcttcaatgg

SEQ ID NO: 73587 - DNA, 34 bp, Artificial Sequence
  Description of Artificial Sequence: Synthetic oligonucleotide
ggcagcctaagaggaagtgtcatttcttcaatgg

SEQ ID NO: 73588 - DNA, 34 bp, Artificial Sequence
  Description of Artificial Sequence: Synthetic oligonucleotide
gcagcctaagaggaagtgtcatttcttcaatggg

SEQ ID NO: 73589 - DNA, 35 bp, Artificial Sequence
  Description of Artificial Sequence: Synthetic oligonucleotide
cagcctaagaggaagtgtcatttcttcaatgggac

SEQ ID NO: 73590 - DNA, 35 bp, Artificial Sequence
  Description of Artificial Sequence: Synthetic oligonucleotide
agcctaagaggaagtgtcatttcttcaatgggacg

SEQ ID NO: 73591 - DNA, 34 bp, Artificial Sequence
  Description of Artificial Sequence: Synthetic oligonucleotide
gcctaagaggaagtgtcatttcttcaatgggacg

SEQ ID NO: 73592 - DNA, 34 bp, Artificial Sequence
  Description of Artificial Sequence: Synthetic oligonucleotide
cctaagaggaagtgtcatttcttcaatgggacgg

SEQ ID NO: 73593 - DNA, 35 bp, Artificial Sequence
  Description of Artificial Sequence: Synthetic oligonucleotide
ctaagaggaagtgtcatttcttcaatgggacggag

SEQ ID NO: 73594 - DNA, 35 bp, Artificial Sequence
  Description of Artificial Sequence: Synthetic oligonucleotide
taagaggaagtgtcatttcttcaatgggacggagc

SEQ ID NO: 73595 - DNA, 34 bp, Artificial Sequence
  Description of Artificial Sequence: Synthetic oligonucleotide
aagaggaagtgtcatttcttcaatgggacggagc

SEQ ID NO: 73596 - DNA, 33 bp, Artificial Sequence
  Description of Artificial Sequence: Synthetic oligonucleotide
agaggaagtgtcatttcttcaatgggacggagc

SEQ ID NO: 73597 - DNA, 32 bp, Artificial Sequence
  Description of Artificial Sequence: Synthetic oligonucleotide
gaggaagtgtcatttcttcaatgggacggagc

SEQ ID NO: 73598 - DNA, 32 bp, Artificial Sequence
  Description of Artificial Sequence: Synthetic oligonucleotide
aggaagtgtcatttcttcaatgggacggagcg

SEQ ID NO: 73599 - DNA, 31 bp, Artificial Sequence
  Description of Artificial Sequence: Synthetic oligonucleotide
ggaagtgtcatttcttcaatgggacggagcg

SEQ ID NO: 73600 - DNA, 31 bp, Artificial Sequence
  Description of Artificial Sequence: Synthetic oligonucleotide
gaagtgtcatttcttcaatgggacggagcgg

SEQ ID NO: 73601 - DNA, 31 bp, Artificial Sequence
  Description of Artificial Sequence: Synthetic oligonucleotide
aagtgtcatttcttcaatgggacggagcggg

SEQ ID NO: 73602 - DNA, 23 bp, Artificial Sequence
  Description of Artificial Sequence: Synthetic oligonucleotide
ggggagtaccgggcggtgacgta

SEQ ID NO: 73603 - DNA, 23 bp, Artificial Sequence
  Description of Artificial Sequence: Synthetic oligonucleotide
gggagtaccgggcggtgacgtag

SEQ ID NO: 73604 - DNA, 24 bp, Artificial Sequence
  Description of Artificial Sequence: Synthetic oligonucleotide
ggagtaccgggcggtgacgtagct

SEQ ID NO: 73605 - DNA, 24 bp, Artificial Sequence
  Description of Artificial Sequence: Synthetic oligonucleotide
gagtaccgggcggtgacgtagctg

SEQ ID NO: 73606 - DNA, 24 bp, Artificial Sequence
  Description of Artificial Sequence: Synthetic oligonucleotide
agtaccgggcggtgacgtagctgg

SEQ ID NO: 73607 - DNA, 23 bp, Artificial Sequence
  Description of Artificial Sequence: Synthetic oligonucleotide
gtaccgggcggtgacgtagctgg

SEQ ID NO: 73608 - DNA, 23 bp, Artificial Sequence
  Description of Artificial Sequence: Synthetic oligonucleotide
taccgggcggtgacgtagctggg

SEQ ID NO: 73609 - DNA, 22 bp, Artificial Sequence
  Description of Artificial Sequence: Synthetic oligonucleotide
accgggcggtgacgtagctggg

SEQ ID NO: 73610 - DNA, 21 bp, Artificial Sequence
  Description of Artificial Sequence: Synthetic oligonucleotide
ccgggcggtgacgtagctggg

SEQ ID NO: 73611 - DNA, 21 bp, Artificial Sequence
  Description of Artificial Sequence: Synthetic oligonucleotide
cgggcggtgacgtagctgggg

SEQ ID NO: 73612 - DNA, 21 bp, Artificial Sequence
  Description of Artificial Sequence: Synthetic oligonucleotide
gggcggtgacgtagctggggc

SEQ ID NO: 73613 - DNA, 21 bp, Artificial Sequence
  Description of Artificial Sequence: Synthetic oligonucleotide
ggcggtgacgtagctggggcg

SEQ ID NO: 73614 - DNA, 21 bp, Artificial Sequence
  Description of Artificial Sequence: Synthetic oligonucleotide
gcggtgacgtagctggggcgg

SEQ ID NO: 73615 - DNA, 21 bp, Artificial Sequence
  Description of Artificial Sequence: Synthetic oligonucleotide
cggtgacgtagctggggcggc

SEQ ID NO: 73616 - DNA, 22 bp, Artificial Sequence
  Description of Artificial Sequence: Synthetic oligonucleotide
ggtgacgtagctggggcggcct

SEQ ID NO: 73617 - DNA, 23 bp, Artificial Sequence
  Description of Artificial Sequence: Synthetic oligonucleotide
gtgacgtagctggggcggcctga

SEQ ID NO: 73618 - DNA, 23 bp, Artificial Sequence
  Description of Artificial Sequence: Synthetic oligonucleotide
tgacgtagctggggcggcctgac

SEQ ID NO: 73619 - DNA, 22 bp, Artificial Sequence
  Description of Artificial Sequence: Synthetic oligonucleotide
gacgtagctggggcggcctgac

SEQ ID NO: 73620 - DNA, 22 bp, Artificial Sequence
  Description of Artificial Sequence: Synthetic oligonucleotide
acgtagctggggcggcctgacg

SEQ ID NO: 73621 - DNA, 21 bp, Artificial Sequence
  Description of Artificial Sequence: Synthetic oligonucleotide
cgtagctggggcggcctgacg

SEQ ID NO: 73622 - DNA, 22 bp, Artificial Sequence
  Description of Artificial Sequence: Synthetic oligonucleotide
gtagctggggcggcctgacgct

SEQ ID NO: 73623 - DNA, 23 bp, Artificial Sequence
  Description of Artificial Sequence: Synthetic oligonucleotide
tagctggggcggcctgacgctga

SEQ ID NO: 73624 - DNA, 23 bp, Artificial Sequence
  Description of Artificial Sequence: Synthetic oligonucleotide
tgacggagctggggcggcctgaa

SEQ ID NO: 73625 - DNA, 22 bp, Artificial Sequence
  Description of Artificial Sequence: Synthetic oligonucleotide
gacggagctggggcggcctgaa

SEQ ID NO: 73626 - DNA, 22 bp, Artificial Sequence
  Description of Artificial Sequence: Synthetic oligonucleotide
acggagctggggcggcctgaag

SEQ ID NO: 73627 - DNA, 21 bp, Artificial Sequence
  Description of Artificial Sequence: Synthetic oligonucleotide
cggagctggggcggcctgaag

SEQ ID NO: 73628 - DNA, 22 bp, Artificial Sequence
  Description of Artificial Sequence: Synthetic oligonucleotide
ggagctggggcggcctgaagct

SEQ ID NO: 73629 - DNA, 23 bp, Artificial Sequence
  Description of Artificial Sequence: Synthetic oligonucleotide
gagctggggcggcctgaagctga

SEQ ID NO: 73630 - DNA, 25 bp, Artificial Sequence
  Description of Artificial Sequence: Synthetic oligonucleotide
agctggggcggcctgaagctgagta

SEQ ID NO: 73631 - DNA, 24 bp, Artificial Sequence
  Description of Artificial Sequence: Synthetic oligonucleotide
gctggggcggcctgaagctgagta

SEQ ID NO: 73632 - DNA, 25 bp, Artificial Sequence
  Description of Artificial Sequence: Synthetic oligonucleotide
ctggggcggcctgaagctgagtact

SEQ ID NO: 73633 - DNA, 25 bp, Artificial Sequence
  Description of Artificial Sequence: Synthetic oligonucleotide
tggggcggcctgaagctgagtactg

SEQ ID NO: 73634 - DNA, 24 bp, Artificial Sequence
  Description of Artificial Sequence: Synthetic oligonucleotide
ggggcggcctgaagctgagtactg

SEQ ID NO: 73635 - DNA, 26 bp, Artificial Sequence
  Description of Artificial Sequence: Synthetic oligonucleotide
gggcggcctgaagctgagtactggaa

SEQ ID NO: 73636 - DNA, 27 bp, Artificial Sequence
  Description of Artificial Sequence: Synthetic oligonucleotide
ggcggcctgaagctgagtactggaaca

SEQ ID NO: 73637 - DNA, 27 bp, Artificial Sequence
  Description of Artificial Sequence: Synthetic oligonucleotide
gcggcctgaagctgagtactggaacag

SEQ ID NO: 73638 - DNA, 27 bp, Artificial Sequence
  Description of Artificial Sequence: Synthetic oligonucleotide
cggcctgaagctgagtactggaacagc

SEQ ID NO: 73639 - DNA, 27 bp, Artificial Sequence
  Description of Artificial Sequence: Synthetic oligonucleotide
ggcctgaagctgagtactggaacagcc

SEQ ID NO: 73640 - DNA, 28 bp, Artificial Sequence
  Description of Artificial Sequence: Synthetic oligonucleotide
gcctgaagctgagtactggaacagccag

SEQ ID NO: 73641 - DNA, 30 bp, Artificial Sequence
  Description of Artificial Sequence: Synthetic oligonucleotide
cctgaagctgagtactggaacagccagaag

SEQ ID NO: 73642 - DNA, 30 bp, Artificial Sequence
  Description of Artificial Sequence: Synthetic oligonucleotide
ctgaagctgagtactggaacagccagaagg

SEQ ID NO: 73643 - DNA, 31 bp, Artificial Sequence
  Description of Artificial Sequence: Synthetic oligonucleotide
tgaagctgagtactggaacagccagaaggac

SEQ ID NO: 73644 - DNA, 30 bp, Artificial Sequence
  Description of Artificial Sequence: Synthetic oligonucleotide
gaagctgagtactggaacagccagaaggac

SEQ ID NO: 73645 - DNA, 30 bp, Artificial Sequence
  Description of Artificial Sequence: Synthetic oligonucleotide
aagctgagtactggaacagccagaaggacc

SEQ ID NO: 73646 - DNA, 29 bp, Artificial Sequence
  Description of Artificial Sequence: Synthetic oligonucleotide
agctgagtactggaacagccagaaggacc

SEQ ID NO: 73647 - DNA, 27 bp, Artificial Sequence
  Description of Artificial Sequence: Synthetic oligonucleotide
tgtgtctgaagctccctggaggctcca

SEQ ID NO: 73648 - DNA, 26 bp, Artificial Sequence
  Description of Artificial Sequence: Synthetic oligonucleotide
gtgtctgaagctccctggaggctcca

SEQ ID NO: 73649 - DNA, 26 bp, Artificial Sequence
  Description of Artificial Sequence: Synthetic oligonucleotide
tgtctgaagctccctggaggctccag

SEQ ID NO: 73650 - DNA, 25 bp, Artificial Sequence
  Description of Artificial Sequence: Synthetic oligonucleotide
gtctgaagctccctggaggctccag

SEQ ID NO: 73651 - DNA, 27 bp, Artificial Sequence
  Description of Artificial Sequence: Synthetic oligonucleotide
tctgaagctccctggaggctccagctt

SEQ ID NO: 73652 - DNA, 26 bp, Artificial Sequence
  Description of Artificial Sequence: Synthetic oligonucleotide
ctgaagctccctggaggctccagctt

SEQ ID NO: 73653 - DNA, 26 bp, Artificial Sequence
  Description of Artificial Sequence: Synthetic oligonucleotide
tgaagctccctggaggctccagcttg

SEQ ID NO: 73654 - DNA, 25 bp, Artificial Sequence
  Description of Artificial Sequence: Synthetic oligonucleotide
gaagctccctggaggctccagcttg

SEQ ID NO: 73655 - DNA, 25 bp, Artificial Sequence
  Description of Artificial Sequence: Synthetic oligonucleotide
aagctccctggaggctccagcttgg

SEQ ID NO: 73656 - DNA, 24 bp, Artificial Sequence
  Description of Artificial Sequence: Synthetic oligonucleotide
agctccctggaggctccagcttgg

SEQ ID NO: 73657 - DNA, 23 bp, Artificial Sequence
  Description of Artificial Sequence: Synthetic oligonucleotide
gctccctggaggctccagcttgg

SEQ ID NO: 73658 - DNA, 24 bp, Artificial Sequence
  Description of Artificial Sequence: Synthetic oligonucleotide
ctccctggaggctccagcttggca

SEQ ID NO: 73659 - DNA, 24 bp, Artificial Sequence
  Description of Artificial Sequence: Synthetic oligonucleotide
tccctggaggctccagcttggcag

SEQ ID NO: 73660 - DNA, 23 bp, Artificial Sequence
  Description of Artificial Sequence: Synthetic oligonucleotide
ccctggaggctccagcttggcag

SEQ ID NO: 73661 - DNA, 23 bp, Artificial Sequence
  Description of Artificial Sequence: Synthetic oligonucleotide
cctggaggctccagcttggcagc

SEQ ID NO: 73662 - DNA, 25 bp, Artificial Sequence
  Description of Artificial Sequence: Synthetic oligonucleotide
ctggaggctccagcttggcagcgtt

SEQ ID NO: 73663 - DNA, 26 bp, Artificial Sequence
  Description of Artificial Sequence: Synthetic oligonucleotide
tggaggctccagcttggcagcgttga

SEQ ID NO: 73664 - DNA, 25 bp, Artificial Sequence
  Description of Artificial Sequence: Synthetic oligonucleotide
ggaggctccagcttggcagcgttga

SEQ ID NO: 73665 - DNA, 26 bp, Artificial Sequence
  Description of Artificial Sequence: Synthetic oligonucleotide
gaggctccagcttggcagcgttgaca

SEQ ID NO: 73666 - DNA, 27 bp, Artificial Sequence
  Description of Artificial Sequence: Synthetic oligonucleotide
aggctccagcttggcagcgttgacagt

SEQ ID NO: 73667 - DNA, 26 bp, Artificial Sequence
  Description of Artificial Sequence: Synthetic oligonucleotide
ggctccagcttggcagcgttgacagt

SEQ ID NO: 73668 - DNA, 27 bp, Artificial Sequence
  Description of Artificial Sequence: Synthetic oligonucleotide
gctccagcttggcagcgttgacagtga

SEQ ID NO: 73669 - DNA, 27 bp, Artificial Sequence
  Description of Artificial Sequence: Synthetic oligonucleotide
ctccagcttggcagcgttgacagtgac

SEQ ID NO: 73670 - DNA, 28 bp, Artificial Sequence
  Description of Artificial Sequence: Synthetic oligonucleotide
tccagcttggcagcgttgacagtgacac

SEQ ID NO: 73671 - DNA, 27 bp, Artificial Sequence
  Description of Artificial Sequence: Synthetic oligonucleotide
ccagcttggcagcgttgacagtgacac

SEQ ID NO: 73672 - DNA, 28 bp, Artificial Sequence
  Description of Artificial Sequence: Synthetic oligonucleotide
cagcttggcagcgttgacagtgacactg

SEQ ID NO: 73673 - DNA, 30 bp, Artificial Sequence
  Description of Artificial Sequence: Synthetic oligonucleotide
agcttggcagcgttgacagtgacactgatg

SEQ ID NO: 73674 - DNA, 29 bp, Artificial Sequence
  Description of Artificial Sequence: Synthetic oligonucleotide
gcttggcagcgttgacagtgacactgatg

SEQ ID NO: 73675 - DNA, 29 bp, Artificial Sequence
  Description of Artificial Sequence: Synthetic oligonucleotide
cttggcagcgttgacagtgacactgatgg

SEQ ID NO: 73676 - DNA, 30 bp, Artificial Sequence
  Description of Artificial Sequence: Synthetic oligonucleotide
ttggcagcgttgacagtgacactgatggtg

SEQ ID NO: 73677 - DNA, 29 bp, Artificial Sequence
  Description of Artificial Sequence: Synthetic oligonucleotide
tggcagcgttgacagtgacactgatggtg

SEQ ID NO: 73678 - DNA, 28 bp, Artificial Sequence
  Description of Artificial Sequence: Synthetic oligonucleotide
ggcagcgttgacagtgacactgatggtg

SEQ ID NO: 73679 - DNA, 28 bp, Artificial Sequence
  Description of Artificial Sequence: Synthetic oligonucleotide
gcagcgttgacagtgacactgatggtgc

SEQ ID NO: 73680 - DNA, 29 bp, Artificial Sequence
  Description of Artificial Sequence: Synthetic oligonucleotide
cagcgttgacagtgacactgatggtgctg

SEQ ID NO: 73681 - DNA, 30 bp, Artificial Sequence
  Description of Artificial Sequence: Synthetic oligonucleotide
agcgttgacagtgacactgatggtgctgag

SEQ ID NO: 73682 - DNA, 29 bp, Artificial Sequence
  Description of Artificial Sequence: Synthetic oligonucleotide
gcgttgacagtgacactgatggtgctgag

SEQ ID NO: 73683 - DNA, 29 bp, Artificial Sequence
  Description of Artificial Sequence: Synthetic oligonucleotide
cgttgacagtgacactgatggtgctgagc

SEQ ID NO: 73684 - DNA, 30 bp, Artificial Sequence
  Description of Artificial Sequence: Synthetic oligonucleotide
gttgacagtgacactgatggtgctgagctc

SEQ ID NO: 73685 - DNA, 30 bp, Artificial Sequence
  Description of Artificial Sequence: Synthetic oligonucleotide
ttgacagtgacactgatggtgctgagctcc

SEQ ID NO: 73686 - DNA, 27 bp, Artificial Sequence
  Description of Artificial Sequence: Synthetic oligonucleotide
agtgacactgatggtgctgagctcccg

SEQ ID NO: 73687 - DNA, 27 bp, Artificial Sequence
  Description of Artificial Sequence: Synthetic oligonucleotide
gtgacactgatggtgctgagctcccga

SEQ ID NO: 73688 - DNA, 27 bp, Artificial Sequence
  Description of Artificial Sequence: Synthetic oligonucleotide
tgacactgatggtgctgagctcccgac

SEQ ID NO: 73689 - DNA, 27 bp, Artificial Sequence
  Description of Artificial Sequence: Synthetic oligonucleotide
gacactgatggtgctgagctcccgact

SEQ ID NO: 73690 - DNA, 27 bp, Artificial Sequence
  Description of Artificial Sequence: Synthetic oligonucleotide
acactgatggtgctgagctcccgactg

SEQ ID NO: 73691 - DNA, 26 bp, Artificial Sequence
  Description of Artificial Sequence: Synthetic oligonucleotide
cactgatggtgctgagctcccgactg

SEQ ID NO: 73692 - DNA, 26 bp, Artificial Sequence
  Description of Artificial Sequence: Synthetic oligonucleotide
actgatggtgctgagctcccgactgg

SEQ ID NO: 73693 - DNA, 25 bp, Artificial Sequence
  Description of Artificial Sequence: Synthetic oligonucleotide
ctgatggtgctgagctcccgactgg

SEQ ID NO: 73694 - DNA, 27 bp, Artificial Sequence
  Description of Artificial Sequence: Synthetic oligonucleotide
tgatggtgctgagctcccgactggctt

SEQ ID NO: 73695 - DNA, 27 bp, Artificial Sequence
  Description of Artificial Sequence: Synthetic oligonucleotide
gatggtgctgagctcccgactggcttt

SEQ ID NO: 73696 - DNA, 27 bp, Artificial Sequence
  Description of Artificial Sequence: Synthetic oligonucleotide
atggtgctgagctcccgactggctttc

SEQ ID NO: 73697 - DNA, 26 bp, Artificial Sequence
  Description of Artificial Sequence: Synthetic oligonucleotide
tggtgctgagctcccgactggctttc

SEQ ID NO: 73698 - DNA, 25 bp, Artificial Sequence
  Description of Artificial Sequence: Synthetic oligonucleotide
ggtgctgagctcccgactggctttc

SEQ ID NO: 73699 - DNA, 25 bp, Artificial Sequence
  Description of Artificial Sequence: Synthetic oligonucleotide
gtgctgagctcccgactggctttcg

SEQ ID NO: 73700 - DNA, 26 bp, Artificial Sequence
  Description of Artificial Sequence: Synthetic oligonucleotide
tgctgagctcccgactggctttcgct

SEQ ID NO: 73701 - DNA, 25 bp, Artificial Sequence
  Description of Artificial Sequence: Synthetic oligonucleotide
gctgagctcccgactggctttcgct

SEQ ID NO: 73702 - DNA, 25 bp, Artificial Sequence
  Description of Artificial Sequence: Synthetic oligonucleotide
ctgagctcccgactggctttcgctg

SEQ ID NO: 73703 - DNA, 25 bp, Artificial Sequence
  Description of Artificial Sequence: Synthetic oligonucleotide
tgagctcccgactggctttcgctgg

SEQ ID NO: 73704 - DNA, 24 bp, Artificial Sequence
  Description of Artificial Sequence: Synthetic oligonucleotide
gagctcccgactggctttcgctgg

SEQ ID NO: 73705 - DNA, 24 bp, Artificial Sequence
  Description of Artificial Sequence: Synthetic oligonucleotide
agctcccgactggctttcgctggg

SEQ ID NO: 73706 - DNA, 23 bp, Artificial Sequence
  Description of Artificial Sequence: Synthetic oligonucleotide
gctcccgactggctttcgctggg

SEQ ID NO: 73707 - DNA, 24 bp, Artificial Sequence
  Description of Artificial Sequence: Synthetic oligonucleotide
ctcccgactggctttcgctgggga

SEQ ID NO: 73708 - DNA, 25 bp, Artificial Sequence
  Description of Artificial Sequence: Synthetic oligonucleotide
tcccgactggctttcgctggggaca

SEQ ID NO: 73709 - DNA, 24 bp, Artificial Sequence
  Description of Artificial Sequence: Synthetic oligonucleotide
cccgactggctttcgctggggaca

SEQ ID NO: 73710 - DNA, 24 bp, Artificial Sequence
  Description of Artificial Sequence: Synthetic oligonucleotide
ccgactggctttcgctggggacac

SEQ ID NO: 73711 - DNA, 24 bp, Artificial Sequence
  Description of Artificial Sequence: Synthetic oligonucleotide
cgactggctttcgctggggacacc

SEQ ID NO: 73712 - DNA, 24 bp, Artificial Sequence
  Description of Artificial Sequence: Synthetic oligonucleotide
gactggctttcgctggggacaccc

SEQ ID NO: 73713 - DNA, 25 bp, Artificial Sequence
  Description of Artificial Sequence: Synthetic oligonucleotide
actggctttcgctggggacacccga

SEQ ID NO: 73714 - DNA, 24 bp, Artificial Sequence
  Description of Artificial Sequence: Synthetic oligonucleotide
ctggctttcgctggggacacccga

SEQ ID NO: 73715 - DNA, 24 bp, Artificial Sequence
  Description of Artificial Sequence: Synthetic oligonucleotide
tggctttcgctggggacacccgac

SEQ ID NO: 73716 - DNA, 23 bp, Artificial Sequence
  Description of Artificial Sequence: Synthetic oligonucleotide
ggctttcgctggggacacccgac

SEQ ID NO: 73717 - DNA, 24 bp, Artificial Sequence
  Description of Artificial Sequence: Synthetic oligonucleotide
gctttcgctggggacacccgacca

SEQ ID NO: 73718 - DNA, 24 bp, Artificial Sequence
  Description of Artificial Sequence: Synthetic oligonucleotide
ctttcgctggggacacccgaccac

SEQ ID NO: 73719 - DNA, 27 bp, Artificial Sequence
  Description of Artificial Sequence: Synthetic oligonucleotide
tttcgctggggacacccgaccacgttt

SEQ ID NO: 73720 - DNA, 26 bp, Artificial Sequence
  Description of Artificial Sequence: Synthetic oligonucleotide
ttcgctggggacacccgaccacgttt

SEQ ID NO: 73721 - DNA, 25 bp, Artificial Sequence
  Description of Artificial Sequence: Synthetic oligonucleotide
tcgctggggacacccgaccacgttt

SEQ ID NO: 73722 - DNA, 24 bp, Artificial Sequence
  Description of Artificial Sequence: Synthetic oligonucleotide
cgctggggacacccgaccacgttt

SEQ ID NO: 73723 - DNA, 27 bp, Artificial Sequence
  Description of Artificial Sequence: Synthetic oligonucleotide
ggacacccgaccacgtttcttggagct

SEQ ID NO: 73724 - DNA, 27 bp, Artificial Sequence
  Description of Artificial Sequence: Synthetic oligonucleotide
gacacccgaccacgtttcttggagctg

SEQ ID NO: 73725 - DNA, 27 bp, Artificial Sequence
  Description of Artificial Sequence: Synthetic oligonucleotide
acacccgaccacgtttcttggagctgc

SEQ ID NO: 73726 - DNA, 26 bp, Artificial Sequence
  Description of Artificial Sequence: Synthetic oligonucleotide
cacccgaccacgtttcttggagctgc

SEQ ID NO: 73727 - DNA, 27 bp, Artificial Sequence
  Description of Artificial Sequence: Synthetic oligonucleotide
acccgaccacgtttcttggagctgcgt

SEQ ID NO: 73728 - DNA, 27 bp, Artificial Sequence
  Description of Artificial Sequence: Synthetic oligonucleotide
cccgaccacgtttcttggagctgcgta

SEQ ID NO: 73729 - DNA, 28 bp, Artificial Sequence
  Description of Artificial Sequence: Synthetic oligonucleotide
ccgaccacgtttcttggagctgcgtaag

SEQ ID NO: 73730 - DNA, 29 bp, Artificial Sequence
  Description of Artificial Sequence: Synthetic oligonucleotide
cgaccacgtttcttggagctgcgtaagtc

SEQ ID NO: 73731 - DNA, 26 bp, Artificial Sequence
  Description of Artificial Sequence: Synthetic oligonucleotide
acagtgcagcggcgagtccatcctca

SEQ ID NO: 73732 - DNA, 25 bp, Artificial Sequence
  Description of Artificial Sequence: Synthetic oligonucleotide
cagtgcagcggcgagtccatcctca

SEQ ID NO: 73733 - DNA, 25 bp, Artificial Sequence
  Description of Artificial Sequence: Synthetic oligonucleotide
agtgcagcggcgagtccatcctcag

SEQ ID NO: 73734 - DNA, 24 bp, Artificial Sequence
  Description of Artificial Sequence: Synthetic oligonucleotide
gtgcagcggcgagtccatcctcag

SEQ ID NO: 73735 - DNA, 25 bp, Artificial Sequence
  Description of Artificial Sequence: Synthetic oligonucleotide
tgcagcggcgagtccatcctcaggt

SEQ ID NO: 73736 - DNA, 24 bp, Artificial Sequence
  Description of Artificial Sequence: Synthetic oligonucleotide
gcagcggcgagtccatcctcaggt

SEQ ID NO: 73737 - DNA, 25 bp, Artificial Sequence
  Description of Artificial Sequence: Synthetic oligonucleotide
cagcggcgagtccatcctcaggtga

SEQ ID NO: 73738 - DNA, 26 bp, Artificial Sequence
  Description of Artificial Sequence: Synthetic oligonucleotide
agcggcgagtccatcctcaggtgact

SEQ ID NO: 73739 - DNA, 25 bp, Artificial Sequence
  Description of Artificial Sequence: Synthetic oligonucleotide
gcggcgagtccatcctcaggtgact

SEQ ID NO: 73740 - DNA, 26 bp, Artificial Sequence
  Description of Artificial Sequence: Synthetic oligonucleotide
cggcgagtccatcctcaggtgactgt

SEQ ID NO: 73741 - DNA, 27 bp, Artificial Sequence
  Description of Artificial Sequence: Synthetic oligonucleotide
ggcgagtccatcctcaggtgactgtgt

SEQ ID NO: 73742 - DNA, 29 bp, Artificial Sequence
  Description of Artificial Sequence: Synthetic oligonucleotide
gcgagtccatcctcaggtgactgtgtatc

SEQ ID NO: 73743 - DNA, 29 bp, Artificial Sequence
  Description of Artificial Sequence: Synthetic oligonucleotide
cgagtccatcctcaggtgactgtgtatcc

SEQ ID NO: 73744 - DNA, 30 bp, Artificial Sequence
  Description of Artificial Sequence: Synthetic oligonucleotide
gagtccatcctcaggtgactgtgtatcctg

SEQ ID NO: 73745 - DNA, 30 bp, Artificial Sequence
  Description of Artificial Sequence: Synthetic oligonucleotide
agtccatcctcaggtgactgtgtatcctgc

SEQ ID NO: 73746 - DNA, 29 bp, Artificial Sequence
  Description of Artificial Sequence: Synthetic oligonucleotide
gtccatcctcaggtgactgtgtatcctgc

SEQ ID NO: 73747 - DNA, 32 bp, Artificial Sequence
  Description of Artificial Sequence: Synthetic oligonucleotide
tccatcctcaggtgactgtgtatcctgcaaag

SEQ ID NO: 73748 - DNA, 31 bp, Artificial Sequence
  Description of Artificial Sequence: Synthetic oligonucleotide
ccatcctcaggtgactgtgtatcctgcaaag

SEQ ID NO: 73749 - DNA, 32 bp, Artificial Sequence
  Description of Artificial Sequence: Synthetic oligonucleotide
catcctcaggtgactgtgtatcctgcaaagac

SEQ ID NO: 73750 - DNA, 32 bp, Artificial Sequence
  Description of Artificial Sequence: Synthetic oligonucleotide
atcctcaggtgactgtgtatcctgcaaagacc

SEQ ID NO: 73751 - DNA, 31 bp, Artificial Sequence
  Description of Artificial Sequence: Synthetic oligonucleotide
tcctcaggtgactgtgtatcctgcaaagacc

SEQ ID NO: 73752 - DNA, 30 bp, Artificial Sequence
  Description of Artificial Sequence: Synthetic oligonucleotide
cctcaggtgactgtgtatcctgcaaagacc

SEQ ID NO: 73753 - DNA, 30 bp, Artificial Sequence
  Description of Artificial Sequence: Synthetic oligonucleotide
ctcaggtgactgtgtatcctgcaaagaccc

SEQ ID NO: 73754 - DNA, 31 bp, Artificial Sequence
  Description of Artificial Sequence: Synthetic oligonucleotide
tcaggtgactgtgtatcctgcaaagacccag

SEQ ID NO: 73755 - DNA, 30 bp, Artificial Sequence
  Description of Artificial Sequence: Synthetic oligonucleotide
caggtgactgtgtatcctgcaaagacccag

SEQ ID NO: 73756 - DNA, 26 bp, Artificial Sequence
  Description of Artificial Sequence: Synthetic oligonucleotide
gaagagaaggctggggtggtgtccac

SEQ ID NO: 73757 - DNA, 26 bp, Artificial Sequence
  Description of Artificial Sequence: Synthetic oligonucleotide
aagagaaggctggggtggtgtccacg

SEQ ID NO: 73758 - DNA, 25 bp, Artificial Sequence
  Description of Artificial Sequence: Synthetic oligonucleotide
agagaaggctggggtggtgtccacg

SEQ ID NO: 73759 - DNA, 24 bp, Artificial Sequence
  Description of Artificial Sequence: Synthetic oligonucleotide
gagaaggctggggtggtgtccacg

SEQ ID NO: 73760 - DNA, 24 bp, Artificial Sequence
  Description of Artificial Sequence: Synthetic oligonucleotide
agaaggctggggtggtgtccacgg

SEQ ID NO: 73761 - DNA, 23 bp, Artificial Sequence
  Description of Artificial Sequence: Synthetic oligonucleotide
gaaggctggggtggtgtccacgg

SEQ ID NO: 73762 - DNA, 23 bp, Artificial Sequence
  Description of Artificial Sequence: Synthetic oligonucleotide
aaggctggggtggtgtccacggg

SEQ ID NO: 73763 - DNA, 22 bp, Artificial Sequence
  Description of Artificial Sequence: Synthetic oligonucleotide
aggctggggtggtgtccacggg

SEQ ID NO: 73764 - DNA, 21 bp, Artificial Sequence
  Description of Artificial Sequence: Synthetic oligonucleotide
ggctggggtggtgtccacggg

SEQ ID NO: 73765 - DNA, 21 bp, Artificial Sequence
  Description of Artificial Sequence: Synthetic oligonucleotide
gctggggtggtgtccacgggc

SEQ ID NO: 73766 - DNA, 28 bp, Artificial Sequence
  Description of Artificial Sequence: Synthetic oligonucleotide
tggaccttccagaccctggtgatgctag

SEQ ID NO: 73767 - DNA, 27 bp, Artificial Sequence
  Description of Artificial Sequence: Synthetic oligonucleotide
ggaccttccagaccctggtgatgctag

SEQ ID NO: 73768 - DNA, 30 bp, Artificial Sequence
  Description of Artificial Sequence: Synthetic oligonucleotide
gaccttccagaccctggtgatgctagaaac

SEQ ID NO: 73769 - DNA, 31 bp, Artificial Sequence
  Description of Artificial Sequence: Synthetic oligonucleotide
accttccagaccctggtgatgctagaaacag

SEQ ID NO: 73770 - DNA, 30 bp, Artificial Sequence
  Description of Artificial Sequence: Synthetic oligonucleotide
ccttccagaccctggtgatgctagaaacag

SEQ ID NO: 73771 - DNA, 32 bp, Artificial Sequence
  Description of Artificial Sequence: Synthetic oligonucleotide
cttccagaccctggtgatgctagaaacagttc

SEQ ID NO: 73772 - DNA, 32 bp, Artificial Sequence
  Description of Artificial Sequence: Synthetic oligonucleotide
ttccagaccctggtgatgctagaaacagttcc

SEQ ID NO: 73773 - DNA, 31 bp, Artificial Sequence
  Description of Artificial Sequence: Synthetic oligonucleotide
tccagaccctggtgatgctagaaacagttcc

SEQ ID NO: 73774 - DNA, 30 bp, Artificial Sequence
  Description of Artificial Sequence: Synthetic oligonucleotide
ccagaccctggtgatgctagaaacagttcc

SEQ ID NO: 73775 - DNA, 31 bp, Artificial Sequence
  Description of Artificial Sequence: Synthetic oligonucleotide
cagaccctggtgatgctagaaacagttcctc

SEQ ID NO: 73776 - DNA, 31 bp, Artificial Sequence
  Description of Artificial Sequence: Synthetic oligonucleotide
agaccctggtgatgctagaaacagttcctcg

SEQ ID NO: 73777 - DNA, 30 bp, Artificial Sequence
  Description of Artificial Sequence: Synthetic oligonucleotide
gaccctggtgatgctagaaacagttcctcg

SEQ ID NO: 73778 - DNA, 30 bp, Artificial Sequence
  Description of Artificial Sequence: Synthetic oligonucleotide
accctggtgatgctagaaacagttcctcgg

SEQ ID NO: 73779 - DNA, 29 bp, Artificial Sequence
  Description of Artificial Sequence: Synthetic oligonucleotide
ccctggtgatgctagaaacagttcctcgg

SEQ ID NO: 73780 - DNA, 30 bp, Artificial Sequence
  Description of Artificial Sequence: Synthetic oligonucleotide
cctggtgatgctagaaacagttcctcggag

SEQ ID NO: 73781 - DNA, 31 bp, Artificial Sequence
  Description of Artificial Sequence: Synthetic oligonucleotide
ctggtgatgctagaaacagttcctcggagtg

SEQ ID NO: 73782 - DNA, 31 bp, Artificial Sequence
  Description of Artificial Sequence: Synthetic oligonucleotide
tggtgatgctagaaacagttcctcggagtgg

SEQ ID NO: 73783 - DNA, 30 bp, Artificial Sequence
  Description of Artificial Sequence: Synthetic oligonucleotide
ggtgatgctagaaacagttcctcggagtgg

SEQ ID NO: 73784 - DNA, 31 bp, Artificial Sequence
  Description of Artificial Sequence: Synthetic oligonucleotide
gtgatgctagaaacagttcctcggagtggag

SEQ ID NO: 73785 - DNA, 32 bp, Artificial Sequence
  Description of Artificial Sequence: Synthetic oligonucleotide
tgatgctagaaacagttcctcggagtggagag

SEQ ID NO: 73786 - DNA, 31 bp, Artificial Sequence
  Description of Artificial Sequence: Synthetic oligonucleotide
gatgctagaaacagttcctcggagtggagag

SEQ ID NO: 73787 - DNA, 31 bp, Artificial Sequence
  Description of Artificial Sequence: Synthetic oligonucleotide
atgctagaaacagttcctcggagtggagagg

SEQ ID NO: 73788 - DNA, 30 bp, Artificial Sequence
  Description of Artificial Sequence: Synthetic oligonucleotide
tgctagaaacagttcctcggagtggagagg

SEQ ID NO: 73789 - DNA, 29 bp, Artificial Sequence
  Description of Artificial Sequence: Synthetic oligonucleotide
gctagaaacagttcctcggagtggagagg

SEQ ID NO: 73790 - DNA, 33 bp, Artificial Sequence
  Description of Artificial Sequence: Synthetic oligonucleotide
ctagaaacagttcctcggagtggagaggtttac

SEQ ID NO: 73791 - DNA, 34 bp, Artificial Sequence
  Description of Artificial Sequence: Synthetic oligonucleotide
tagaaacagttcctcggagtggagaggtttacac

SEQ ID NO: 73792 - DNA, 33 bp, Artificial Sequence
  Description of Artificial Sequence: Synthetic oligonucleotide
agaaacagttcctcggagtggagaggtttacac

SEQ ID NO: 73793 - DNA, 34 bp, Artificial Sequence
  Description of Artificial Sequence: Synthetic oligonucleotide
aaacagttcctcggagtggagaggtttacacttg

SEQ ID NO: 73794 - DNA, 33 bp, Artificial Sequence
  Description of Artificial Sequence: Synthetic oligonucleotide
aacagttcctcggagtggagaggtttacacttg

SEQ ID NO: 73795 - DNA, 32 bp, Artificial Sequence
  Description of Artificial Sequence: Synthetic oligonucleotide
acagttcctcggagtggagaggtttacacttg

SEQ ID NO: 73796 - DNA, 31 bp, Artificial Sequence
  Description of Artificial Sequence: Synthetic oligonucleotide
cagttcctcggagtggagaggtttacacttg

SEQ ID NO: 73797 - DNA, 31 bp, Artificial Sequence
  Description of Artificial Sequence: Synthetic oligonucleotide
agttcctcggagtggagaggtttacacttgc

SEQ ID NO: 73798 - DNA, 30 bp, Artificial Sequence
  Description of Artificial Sequence: Synthetic oligonucleotide
gttcctcggagtggagaggtttacacttgc

SEQ ID NO: 73799 - DNA, 30 bp, Artificial Sequence
  Description of Artificial Sequence: Synthetic oligonucleotide
ttcctcggagtggagaggtttacacttgcc

SEQ ID NO: 73800 - DNA, 29 bp, Artificial Sequence
  Description of Artificial Sequence: Synthetic oligonucleotide
tcctcggagtggagaggtttacacttgcc

SEQ ID NO: 73801 - DNA, 28 bp, Artificial Sequence
  Description of Artificial Sequence: Synthetic oligonucleotide
cctcggagtggagaggtttacacttgcc

SEQ ID NO: 73802 - DNA, 30 bp, Artificial Sequence
  Description of Artificial Sequence: Synthetic oligonucleotide
ctcggagtggagaggtttacacttgccaag

SEQ ID NO: 73803 - DNA, 31 bp, Artificial Sequence
  Description of Artificial Sequence: Synthetic oligonucleotide
tcggagtggagaggtttacacttgccaagtg

SEQ ID NO: 73804 - DNA, 30 bp, Artificial Sequence
  Description of Artificial Sequence: Synthetic oligonucleotide
cggagtggagaggtttacacttgccaagtg

SEQ ID NO: 73805 - DNA, 30 bp, Artificial Sequence
  Description of Artificial Sequence: Synthetic oligonucleotide
ggagtggagaggtttacacttgccaagtgg

SEQ ID NO: 73806 - DNA, 31 bp, Artificial Sequence
  Description of Artificial Sequence: Synthetic oligonucleotide
gagtggagaggtttacacttgccaagtggag

SEQ ID NO: 73807 - DNA, 31 bp, Artificial Sequence
  Description of Artificial Sequence: Synthetic oligonucleotide
agtggagaggtttacacttgccaagtggagc

SEQ ID NO: 73808 - DNA, 30 bp, Artificial Sequence
  Description of Artificial Sequence: Synthetic oligonucleotide
gtggagaggtttacacttgccaagtggagc

SEQ ID NO: 73809 - DNA, 31 bp, Artificial Sequence
  Description of Artificial Sequence: Synthetic oligonucleotide
tggagaggtttacacttgccaagtggagcac

SEQ ID NO: 73810 - DNA, 30 bp, Artificial Sequence
  Description of Artificial Sequence: Synthetic oligonucleotide
ggagaggtttacacttgccaagtggagcac

SEQ ID NO: 73811 - DNA, 30 bp, Artificial Sequence
  Description of Artificial Sequence: Synthetic oligonucleotide
gagaggtttacacttgccaagtggagcacc

SEQ ID NO: 73812 - DNA, 30 bp, Artificial Sequence
  Description of Artificial Sequence: Synthetic oligonucleotide
agaggtttacacttgccaagtggagcaccc

SEQ ID NO: 73813 - DNA, 29 bp, Artificial Sequence
  Description of Artificial Sequence: Synthetic oligonucleotide
gaggtttacacttgccaagtggagcaccc

SEQ ID NO: 73814 - DNA, 31 bp, Artificial Sequence
  Description of Artificial Sequence: Synthetic oligonucleotide
aggtttacacttgccaagtggagcacccaag

SEQ ID NO: 73815 - DNA, 30 bp, Artificial Sequence
  Description of Artificial Sequence: Synthetic oligonucleotide
ggtttacacttgccaagtggagcacccaag

SEQ ID NO: 73816 - DNA, 30 bp, Artificial Sequence
  Description of Artificial Sequence: Synthetic oligonucleotide
gtttacacttgccaagtggagcacccaagc

SEQ ID NO: 73817 - DNA, 30 bp, Artificial Sequence
  Description of Artificial Sequence: Synthetic oligonucleotide
tttacacttgccaagtggagcacccaagcg

SEQ ID NO: 73818 - DNA, 29 bp, Artificial Sequence
  Description of Artificial Sequence: Synthetic oligonucleotide
ttacacttgccaagtggagcacccaagcg

SEQ ID NO: 73819 - DNA, 28 bp, Artificial Sequence
  Description of Artificial Sequence: Synthetic oligonucleotide
tacacttgccaagtggagcacccaagcg

SEQ ID NO: 73820 - DNA, 27 bp, Artificial Sequence
  Description of Artificial Sequence: Synthetic oligonucleotide
acacttgccaagtggagcacccaagcg

SEQ ID NO: 73821 - DNA, 27 bp, Artificial Sequence
  Description of Artificial Sequence: Synthetic oligonucleotide
cacttgccaagtggagcacccaagcgt

SEQ ID NO: 73822 - DNA, 29 bp, Artificial Sequence
  Description of Artificial Sequence: Synthetic oligonucleotide
acttgccaagtggagcacccaagcgtaac

SEQ ID NO: 73823 - DNA, 28 bp, Artificial Sequence
  Description of Artificial Sequence: Synthetic oligonucleotide
cttgccaagtggagcacccaagcgtaac

SEQ ID NO: 73824 - DNA, 28 bp, Artificial Sequence
  Description of Artificial Sequence: Synthetic oligonucleotide
ttgccaagtggagcacccaagcgtaacg

SEQ ID NO: 73825 - DNA, 27 bp, Artificial Sequence
  Description of Artificial Sequence: Synthetic oligonucleotide
tgccaagtggagcacccaagcgtaacg

SEQ ID NO: 73826 - DNA, 27 bp, Artificial Sequence
  Description of Artificial Sequence: Synthetic oligonucleotide
gccaagtggagcacccaagcgtaacga

SEQ ID NO: 73827 - DNA, 27 bp, Artificial Sequence
  Description of Artificial Sequence: Synthetic oligonucleotide
ccaagtggagcacccaagcgtaacgag

SEQ ID NO: 73828 - DNA, 27 bp, Artificial Sequence
  Description of Artificial Sequence: Synthetic oligonucleotide
caagtggagcacccaagcgtaacgagc

SEQ ID NO: 73829 - DNA, 27 bp, Artificial Sequence
  Description of Artificial Sequence: Synthetic oligonucleotide
aagtggagcacccaagcgtaacgagcg

SEQ ID NO: 73830 - DNA, 26 bp, Artificial Sequence
  Description of Artificial Sequence: Synthetic oligonucleotide
agtggagcacccaagcgtaacgagcg

SEQ ID NO: 73831 - DNA, 25 bp, Artificial Sequence
  Description of Artificial Sequence: Synthetic oligonucleotide
gtggagcacccaagcgtaacgagcg

SEQ ID NO: 73832 - DNA, 26 bp, Artificial Sequence
  Description of Artificial Sequence: Synthetic oligonucleotide
tggagcacccaagcgtaacgagcgct

SEQ ID NO: 73833 - DNA, 25 bp, Artificial Sequence
  Description of Artificial Sequence: Synthetic oligonucleotide
ggagcacccaagcgtaacgagcgct

SEQ ID NO: 73834 - DNA, 26 bp, Artificial Sequence
  Description of Artificial Sequence: Synthetic oligonucleotide
gagcacccaagcgtaacgagcgctct

SEQ ID NO: 73835 - DNA, 27 bp, Artificial Sequence
  Description of Artificial Sequence: Synthetic oligonucleotide
agcacccaagcgtaacgagcgctctca

SEQ ID NO: 73836 - DNA, 26 bp, Artificial Sequence
  Description of Artificial Sequence: Synthetic oligonucleotide
gcacccaagcgtaacgagcgctctca

SEQ ID NO: 73837 - DNA, 27 bp, Artificial Sequence
  Description of Artificial Sequence: Synthetic oligonucleotide
cacccaagcgtaacgagcgctctcaca

SEQ ID NO: 73838 - DNA, 27 bp, Artificial Sequence
  Description of Artificial Sequence: Synthetic oligonucleotide
acccaagcgtaacgagcgctctcacag

SEQ ID NO: 73839 - DNA, 27 bp, Artificial Sequence
  Description of Artificial Sequence: Synthetic oligonucleotide
cccaagcgtaacgagcgctctcacagt

SEQ ID NO: 73840 - DNA, 27 bp, Artificial Sequence
  Description of Artificial Sequence: Synthetic oligonucleotide
ccaagcgtaacgagcgctctcacagtg

SEQ ID NO: 73841 - DNA, 27 bp, Artificial Sequence
  Description of Artificial Sequence: Synthetic oligonucleotide
caagcgtaacgagcgctctcacagtgg

SEQ ID NO: 73842 - DNA, 30 bp, Artificial Sequence
  Description of Artificial Sequence: Synthetic oligonucleotide
aagcgtaacgagcgctctcacagtggaatg

SEQ ID NO: 73843 - DNA, 29 bp, Artificial Sequence
  Description of Artificial Sequence: Synthetic oligonucleotide
agcgtaacgagcgctctcacagtggaatg

SEQ ID NO: 73844 - DNA, 28 bp, Artificial Sequence
  Description of Artificial Sequence: Synthetic oligonucleotide
gcgtaacgagcgctctcacagtggaatg

SEQ ID NO: 73845 - DNA, 28 bp, Artificial Sequence
  Description of Artificial Sequence: Synthetic oligonucleotide
cgtaacgagcgctctcacagtggaatgg

SEQ ID NO: 73846 - DNA, 29 bp, Artificial Sequence
  Description of Artificial Sequence: Synthetic oligonucleotide
gtaacgagcgctctcacagtggaatggag

SEQ ID NO: 73847 - DNA, 30 bp, Artificial Sequence
  Description of Artificial Sequence: Synthetic oligonucleotide
taacgagcgctctcacagtggaatggagag

SEQ ID NO: 73848 - DNA, 29 bp, Artificial Sequence
  Description of Artificial Sequence: Synthetic oligonucleotide
aacgagcgctctcacagtggaatggagag

SEQ ID NO: 73849 - DNA, 28 bp, Artificial Sequence
  Description of Artificial Sequence: Synthetic oligonucleotide
acgagcgctctcacagtggaatggagag

SEQ ID NO: 73850 - DNA, 27 bp, Artificial Sequence
  Description of Artificial Sequence: Synthetic oligonucleotide
cgagcgctctcacagtggaatggagag

SEQ ID NO: 73851 - DNA, 27 bp, Artificial Sequence
  Description of Artificial Sequence: Synthetic oligonucleotide
gagcgctctcacagtggaatggagagc

SEQ ID NO: 73852 - DNA, 28 bp, Artificial Sequence
  Description of Artificial Sequence: Synthetic oligonucleotide
agcgctctcacagtggaatggagagcac

SEQ ID NO: 73853 - DNA, 27 bp, Artificial Sequence
  Description of Artificial Sequence: Synthetic oligonucleotide
gcgctctcacagtggaatggagagcac

SEQ ID NO: 73854 - DNA, 27 bp, Artificial Sequence
  Description of Artificial Sequence: Synthetic oligonucleotide
cgctctcacagtggaatggagagcacg

SEQ ID NO: 73855 - DNA, 27 bp, Artificial Sequence
  Description of Artificial Sequence: Synthetic oligonucleotide
gctctcacagtggaatggagagcacgg

SEQ ID NO: 73856 - DNA, 22 bp, Artificial Sequence
  Description of Artificial Sequence: Synthetic oligonucleotide
ctggggcggcctgttgccgagt

SEQ ID NO: 73857 - DNA, 22 bp, Artificial Sequence
  Description of Artificial Sequence: Synthetic oligonucleotide
tggggcggcctgttgccgagtc

SEQ ID NO: 73858 - DNA, 21 bp, Artificial Sequence
  Description of Artificial Sequence: Synthetic oligonucleotide
ggggcggcctgttgccgagtc

SEQ ID NO: 73859 - DNA, 22 bp, Artificial Sequence
  Description of Artificial Sequence: Synthetic oligonucleotide
gggcggcctgttgccgagtcct

SEQ ID NO: 73860 - DNA, 22 bp, Artificial Sequence
  Description of Artificial Sequence: Synthetic oligonucleotide
ggcggcctgttgccgagtcctg

SEQ ID NO: 73861 - DNA, 24 bp, Artificial Sequence
  Description of Artificial Sequence: Synthetic oligonucleotide
gcggcctgttgccgagtcctggaa

SEQ ID NO: 73862 - DNA, 25 bp, Artificial Sequence
  Description of Artificial Sequence: Synthetic oligonucleotide
cggcctgttgccgagtcctggaaca

SEQ ID NO: 73863 - DNA, 25 bp, Artificial Sequence
  Description of Artificial Sequence: Synthetic oligonucleotide
ggcctgttgccgagtcctggaacag

SEQ ID NO: 73864 - DNA, 25 bp, Artificial Sequence
  Description of Artificial Sequence: Synthetic oligonucleotide
gcctgttgccgagtcctggaacagc

SEQ ID NO: 73865 - DNA, 26 bp, Artificial Sequence
  Description of Artificial Sequence: Synthetic oligonucleotide
cctgttgccgagtcctggaacagcca

SEQ ID NO: 73866 - DNA, 27 bp, Artificial Sequence
  Description of Artificial Sequence: Synthetic oligonucleotide
ctgttgccgagtcctggaacagccaga

SEQ ID NO: 73867 - DNA, 28 bp, Artificial Sequence
  Description of Artificial Sequence: Synthetic oligonucleotide
tgttgccgagtcctggaacagccagaag

SEQ ID NO: 73868 - DNA, 27 bp, Artificial Sequence
  Description of Artificial Sequence: Synthetic oligonucleotide
gttgccgagtcctggaacagccagaag

SEQ ID NO: 73869 - DNA, 27 bp, Artificial Sequence
  Description of Artificial Sequence: Synthetic oligonucleotide
ttgccgagtcctggaacagccagaagg

SEQ ID NO: 73870 - DNA, 32 bp, Artificial Sequence
  Description of Artificial Sequence: Synthetic oligonucleotide
ggtggacaattactgcagacacaactacggag

SEQ ID NO: 73871 - DNA, 34 bp, Artificial Sequence
  Description of Artificial Sequence: Synthetic oligonucleotide
gtggacaattactgcagacacaactacggagttg

SEQ ID NO: 73872 - DNA, 34 bp, Artificial Sequence
  Description of Artificial Sequence: Synthetic oligonucleotide
tggacaattactgcagacacaactacggagttgg

SEQ ID NO: 73873 - DNA, 33 bp, Artificial Sequence
  Description of Artificial Sequence: Synthetic oligonucleotide
ggacaattactgcagacacaactacggagttgg

SEQ ID NO: 73874 - DNA, 34 bp, Artificial Sequence
  Description of Artificial Sequence: Synthetic oligonucleotide
gacaattactgcagacacaactacggagttggtg

SEQ ID NO: 73875 - DNA, 28 bp, Artificial Sequence
  Description of Artificial Sequence: Synthetic oligonucleotide
cgggtgcggtacctggacagatactttc

SEQ ID NO: 73876 - DNA, 32 bp, Artificial Sequence
  Description of Artificial Sequence: Synthetic oligonucleotide
gggtgcggtacctggacagatactttcataac

SEQ ID NO: 73877 - DNA, 32 bp, Artificial Sequence
  Description of Artificial Sequence: Synthetic oligonucleotide
ggtgcggtacctggacagatactttcataacc

SEQ ID NO: 73878 - DNA, 33 bp, Artificial Sequence
  Description of Artificial Sequence: Synthetic oligonucleotide
gtgcggtacctggacagatactttcataaccag

SEQ ID NO: 73879 - DNA, 33 bp, Artificial Sequence
  Description of Artificial Sequence: Synthetic oligonucleotide
tgcggtacctggacagatactttcataaccagg

SEQ ID NO: 73880 - DNA, 32 bp, Artificial Sequence
  Description of Artificial Sequence: Synthetic oligonucleotide
gcggtacctggacagatactttcataaccagg

SEQ ID NO: 73881 - DNA, 33 bp, Artificial Sequence
  Description of Artificial Sequence: Synthetic oligonucleotide
cggtacctggacagatactttcataaccaggag

SEQ ID NO: 73882 - DNA, 33 bp, Artificial Sequence
  Description of Artificial Sequence: Synthetic oligonucleotide
ggtacctggacagatactttcataaccaggagg

SEQ ID NO: 73883 - DNA, 34 bp, Artificial Sequence
  Description of Artificial Sequence: Synthetic oligonucleotide
gtacctggacagatactttcataaccaggaggag

SEQ ID NO: 73884 - DNA, 36 bp, Artificial Sequence
  Description of Artificial Sequence: Synthetic oligonucleotide
tacctggacagatactttcataaccaggaggagttc

SEQ ID NO: 73885 - DNA, 35 bp, Artificial Sequence
  Description of Artificial Sequence: Synthetic oligonucleotide
acctggacagatactttcataaccaggaggagttc

SEQ ID NO: 73886 - DNA, 34 bp, Artificial Sequence
  Description of Artificial Sequence: Synthetic oligonucleotide
cctggacagatactttcataaccaggaggagttc

SEQ ID NO: 73887 - DNA, 34 bp, Artificial Sequence
  Description of Artificial Sequence: Synthetic oligonucleotide
ctggacagatactttcataaccaggaggagttcc

SEQ ID NO: 73888 - DNA, 35 bp, Artificial Sequence
  Description of Artificial Sequence: Synthetic oligonucleotide
tggacagatactttcataaccaggaggagttcctg

SEQ ID NO: 73889 - DNA, 34 bp, Artificial Sequence
  Description of Artificial Sequence: Synthetic oligonucleotide
ggacagatactttcataaccaggaggagttcctg

SEQ ID NO: 73890 - DNA, 34 bp, Artificial Sequence
  Description of Artificial Sequence: Synthetic oligonucleotide
gacagatactttcataaccaggaggagttcctgc

SEQ ID NO: 73891 - DNA, 34 bp, Artificial Sequence
  Description of Artificial Sequence: Synthetic oligonucleotide
acagatactttcataaccaggaggagttcctgcg

SEQ ID NO: 73892 - DNA, 33 bp, Artificial Sequence
  Description of Artificial Sequence: Synthetic oligonucleotide
cagatactttcataaccaggaggagttcctgcg

SEQ ID NO: 73893 - DNA, 33 bp, Artificial Sequence
  Description of Artificial Sequence: Synthetic oligonucleotide
agatactttcataaccaggaggagttcctgcgc

SEQ ID NO: 73894 - DNA, 32 bp, Artificial Sequence
  Description of Artificial Sequence: Synthetic oligonucleotide
gatactttcataaccaggaggagttcctgcgc

SEQ ID NO: 73895 - DNA, 34 bp, Artificial Sequence
  Description of Artificial Sequence: Synthetic oligonucleotide
atactttcataaccaggaggagttcctgcgcttc

SEQ ID NO: 73896 - DNA, 33 bp, Artificial Sequence
  Description of Artificial Sequence: Synthetic oligonucleotide
tactttcataaccaggaggagttcctgcgcttc

SEQ ID NO: 73897 - DNA, 32 bp, Artificial Sequence
  Description of Artificial Sequence: Synthetic oligonucleotide
actttcataaccaggaggagttcctgcgcttc

SEQ ID NO: 73898 - DNA, 31 bp, Artificial Sequence
  Description of Artificial Sequence: Synthetic oligonucleotide
ctttcataaccaggaggagttcctgcgcttc

SEQ ID NO: 73899 - DNA, 31 bp, Artificial Sequence
  Description of Artificial Sequence: Synthetic oligonucleotide
tttcataaccaggaggagttcctgcgcttcg

SEQ ID NO: 73900 - DNA, 30 bp, Artificial Sequence
  Description of Artificial Sequence: Synthetic oligonucleotide
ttcataaccaggaggagttcctgcgcttcg

SEQ ID NO: 73901 - DNA, 29 bp, Artificial Sequence
  Description of Artificial Sequence: Synthetic oligonucleotide
tcataaccaggaggagttcctgcgcttcg

SEQ ID NO: 73902 - DNA, 28 bp, Artificial Sequence
  Description of Artificial Sequence: Synthetic oligonucleotide
acacccgaccacgtttcttggagctgtg

SEQ ID NO: 73903 - DNA, 27 bp, Artificial Sequence
  Description of Artificial Sequence: Synthetic oligonucleotide
cacccgaccacgtttcttggagctgtg

SEQ ID NO: 73904 - DNA, 30 bp, Artificial Sequence
  Description of Artificial Sequence: Synthetic oligonucleotide
acccgaccacgtttcttggagctgtgtaag

SEQ ID NO: 73905 - DNA, 29 bp, Artificial Sequence
  Description of Artificial Sequence: Synthetic oligonucleotide
cccgaccacgtttcttggagctgtgtaag

SEQ ID NO: 73906 - DNA, 30 bp, Artificial Sequence
  Description of Artificial Sequence: Synthetic oligonucleotide
ccgaccacgtttcttggagctgtgtaagtc

SEQ ID NO: 73907 - DNA, 31 bp, Artificial Sequence
  Description of Artificial Sequence: Synthetic oligonucleotide
cgaccacgtttcttggagctgtgtaagtctg

SEQ ID NO: 73908 - DNA, 32 bp, Artificial Sequence
  Description of Artificial Sequence: Synthetic oligonucleotide
gaccacgtttcttggagctgtgtaagtctgag

SEQ ID NO: 73909 - DNA, 33 bp, Artificial Sequence
  Description of Artificial Sequence: Synthetic oligonucleotide
accacgtttcttggagctgtgtaagtctgagtg

SEQ ID NO: 73910 - DNA, 32 bp, Artificial Sequence
  Description of Artificial Sequence: Synthetic oligonucleotide
ccacgtttcttggagctgtgtaagtctgagtg

SEQ ID NO: 73911 - DNA, 33 bp, Artificial Sequence
  Description of Artificial Sequence: Synthetic oligonucleotide
cacgtttcttggagctgtgtaagtctgagtgtc

SEQ ID NO: 73912 - DNA, 37 bp, Artificial Sequence
  Description of Artificial Sequence: Synthetic oligonucleotide
acgtttcttggagctgtgtaagtctgagtgtcatttc

SEQ ID NO: 73913 - DNA, 36 bp, Artificial Sequence
  Description of Artificial Sequence: Synthetic oligonucleotide
cgtttcttggagctgtgtaagtctgagtgtcatttc

SEQ ID NO: 73914 - DNA, 38 bp, Artificial Sequence
  Description of Artificial Sequence: Synthetic oligonucleotide
gtttcttggagctgtgtaagtctgagtgtcatttcttc

SEQ ID NO: 73915 - DNA, 41 bp, Artificial Sequence
  Description of Artificial Sequence: Synthetic oligonucleotide
tttcttggagctgtgtaagtctgagtgtcatttcttcaatg

SEQ ID NO: 73916 - DNA, 40 bp, Artificial Sequence
  Description of Artificial Sequence: Synthetic oligonucleotide
ttcttggagctgtgtaagtctgagtgtcatttcttcaatg

SEQ ID NO: 73917 - DNA, 39 bp, Artificial Sequence
  Description of Artificial Sequence: Synthetic oligonucleotide
tcttggagctgtgtaagtctgagtgtcatttcttcaatg

SEQ ID NO: 73918 - DNA, 38 bp, Artificial Sequence
  Description of Artificial Sequence: Synthetic oligonucleotide
cttggagctgtgtaagtctgagtgtcatttcttcaatg

SEQ ID NO: 73919 - DNA, 38 bp, Artificial Sequence
  Description of Artificial Sequence: Synthetic oligonucleotide
ttggagctgtgtaagtctgagtgtcatttcttcaatgg

SEQ ID NO: 73920 - DNA, 37 bp, Artificial Sequence
  Description of Artificial Sequence: Synthetic oligonucleotide
tggagctgtgtaagtctgagtgtcatttcttcaatgg

SEQ ID NO: 73921 - DNA, 36 bp, Artificial Sequence
  Description of Artificial Sequence: Synthetic oligonucleotide
ggagctgtgtaagtctgagtgtcatttcttcaatgg

SEQ ID NO: 73922 - DNA, 36 bp, Artificial Sequence
  Description of Artificial Sequence: Synthetic oligonucleotide
gagctgtgtaagtctgagtgtcatttcttcaatggg

SEQ ID NO: 73923 - DNA, 37 bp, Artificial Sequence
  Description of Artificial Sequence: Synthetic oligonucleotide
agctgtgtaagtctgagtgtcatttcttcaatgggac

SEQ ID NO: 73924 - DNA, 36 bp, Artificial Sequence
  Description of Artificial Sequence: Synthetic oligonucleotide
gctgtgtaagtctgagtgtcatttcttcaatgggac

SEQ ID NO: 73925 - DNA, 36 bp, Artificial Sequence
  Description of Artificial Sequence: Synthetic oligonucleotide
ctgtgtaagtctgagtgtcatttcttcaatgggacg

SEQ ID NO: 73926 - DNA, 36 bp, Artificial Sequence
  Description of Artificial Sequence: Synthetic oligonucleotide
tgtgtaagtctgagtgtcatttcttcaatgggacgg

SEQ ID NO: 73927 - DNA, 35 bp, Artificial Sequence
  Description of Artificial Sequence: Synthetic oligonucleotide
gtgtaagtctgagtgtcatttcttcaatgggacgg

SEQ ID NO: 73928 - DNA, 36 bp, Artificial Sequence
  Description of Artificial Sequence: Synthetic oligonucleotide
tgtaagtctgagtgtcatttcttcaatgggacggag

SEQ ID NO: 73929 - DNA, 23 bp, Artificial Sequence
  Description of Artificial Sequence: Synthetic oligonucleotide
ggagcgggtgcggtacctggaga

SEQ ID NO: 73930 - DNA, 26 bp, Artificial Sequence
  Description of Artificial Sequence: Synthetic oligonucleotide
gagcgggtgcggtacctggagagata

SEQ ID NO: 73931 - DNA, 27 bp, Artificial Sequence
  Description of Artificial Sequence: Synthetic oligonucleotide
agcgggtgcggtacctggagagatact

SEQ ID NO: 73932 - DNA, 27 bp, Artificial Sequence
  Description of Artificial Sequence: Synthetic oligonucleotide
gcgggtgcggtacctggagagatactt

SEQ ID NO: 73933 - DNA, 27 bp, Artificial Sequence
  Description of Artificial Sequence: Synthetic oligonucleotide
cgggtgcggtacctggagagatacttc

SEQ ID NO: 73934 - DNA, 27 bp, Artificial Sequence
  Description of Artificial Sequence: Synthetic oligonucleotide
gggtgcggtacctggagagatacttcc

SEQ ID NO: 73935 - DNA, 31 bp, Artificial Sequence
  Description of Artificial Sequence: Synthetic oligonucleotide
ggtgcggtacctggagagatacttccataac

SEQ ID NO: 73936 - DNA, 31 bp, Artificial Sequence
  Description of Artificial Sequence: Synthetic oligonucleotide
gtgcggtacctggagagatacttccataacc

SEQ ID NO: 73937 - DNA, 32 bp, Artificial Sequence
  Description of Artificial Sequence: Synthetic oligonucleotide
tgcggtacctggagagatacttccataaccag

SEQ ID NO: 73938 - DNA, 31 bp, Artificial Sequence
  Description of Artificial Sequence: Synthetic oligonucleotide
gcggtacctggagagatacttccataaccag

SEQ ID NO: 73939 - DNA, 31 bp, Artificial Sequence
  Description of Artificial Sequence: Synthetic oligonucleotide
cggtacctggagagatacttccataaccagg

SEQ ID NO: 73940 - DNA, 32 bp, Artificial Sequence
  Description of Artificial Sequence: Synthetic oligonucleotide
ggtacctggagagatacttccataaccaggag

SEQ ID NO: 73941 - DNA, 32 bp, Artificial Sequence
  Description of Artificial Sequence: Synthetic oligonucleotide
gtacctggagagatacttccataaccaggagg

SEQ ID NO: 73942 - DNA, 33 bp, Artificial Sequence
  Description of Artificial Sequence: Synthetic oligonucleotide
tacctggagagatacttccataaccaggaggag

SEQ ID NO: 73943 - DNA, 32 bp, Artificial Sequence
  Description of Artificial Sequence: Synthetic oligonucleotide
acctggagagatacttccataaccaggaggag

SEQ ID NO: 73944 - DNA, 29 bp, Artificial Sequence
  Description of Artificial Sequence: Synthetic oligonucleotide
cacgtttctcggagctgcgtaagtctgag

SEQ ID NO: 73945 - DNA, 30 bp, Artificial Sequence
  Description of Artificial Sequence: Synthetic oligonucleotide
acgtttctcggagctgcgtaagtctgagtg

SEQ ID NO: 73946 - DNA, 29 bp, Artificial Sequence
  Description of Artificial Sequence: Synthetic oligonucleotide
cgtttctcggagctgcgtaagtctgagtg

SEQ ID NO: 73947 - DNA, 30 bp, Artificial Sequence
  Description of Artificial Sequence: Synthetic oligonucleotide
gtttctcggagctgcgtaagtctgagtgtc

SEQ ID NO: 73948 - DNA, 34 bp, Artificial Sequence
  Description of Artificial Sequence: Synthetic oligonucleotide
tttctcggagctgcgtaagtctgagtgtcatttc

SEQ ID NO: 73949 - DNA, 33 bp, Artificial Sequence
  Description of Artificial Sequence: Synthetic oligonucleotide
ttctcggagctgcgtaagtctgagtgtcatttc

SEQ ID NO: 73950 - DNA, 32 bp, Artificial Sequence
  Description of Artificial Sequence: Synthetic oligonucleotide
tctcggagctgcgtaagtctgagtgtcatttc

SEQ ID NO: 73951 - DNA, 31 bp, Artificial Sequence
  Description of Artificial Sequence: Synthetic oligonucleotide
ctcggagctgcgtaagtctgagtgtcatttc

SEQ ID NO: 73952 - DNA, 33 bp, Artificial Sequence
  Description of Artificial Sequence: Synthetic oligonucleotide
tcggagctgcgtaagtctgagtgtcatttcttc

SEQ ID NO: 73953 - DNA, 32 bp, Artificial Sequence
  Description of Artificial Sequence: Synthetic oligonucleotide
cggagctgcgtaagtctgagtgtcatttcttc

SEQ ID NO: 73954 - DNA, 24 bp, Artificial Sequence
  Description of Artificial Sequence: Synthetic oligonucleotide
gacggagcgggtgcggtacctgaa

SEQ ID NO: 73955 - DNA, 25 bp, Artificial Sequence
  Description of Artificial Sequence: Synthetic oligonucleotide
acggagcgggtgcggtacctgaaca

SEQ ID NO: 73956 - DNA, 24 bp, Artificial Sequence
  Description of Artificial Sequence: Synthetic oligonucleotide
cggagcgggtgcggtacctgaaca

SEQ ID NO: 73957 - DNA, 27 bp, Artificial Sequence
  Description of Artificial Sequence: Synthetic oligonucleotide
ggagcgggtgcggtacctgaacagata

SEQ ID NO: 73958 - DNA, 27 bp, Artificial Sequence
  Description of Artificial Sequence: Synthetic oligonucleotide
gagcgggtgcggtacctgaacagatac

SEQ ID NO: 73959 - DNA, 29 bp, Artificial Sequence
  Description of Artificial Sequence: Synthetic oligonucleotide
agcgggtgcggtacctgaacagatacttc

SEQ ID NO: 73960 - DNA, 28 bp, Artificial Sequence
  Description of Artificial Sequence: Synthetic oligonucleotide
gcgggtgcggtacctgaacagatacttc

SEQ ID NO: 73961 - DNA, 28 bp, Artificial Sequence
  Description of Artificial Sequence: Synthetic oligonucleotide
cgggtgcggtacctgaacagatacttcc

SEQ ID NO: 73962 - DNA, 32 bp, Artificial Sequence
  Description of Artificial Sequence: Synthetic oligonucleotide
gggtgcggtacctgaacagatacttccataac

SEQ ID NO: 73963 - DNA, 32 bp, Artificial Sequence
  Description of Artificial Sequence: Synthetic oligonucleotide
ggtgcggtacctgaacagatacttccataacc

SEQ ID NO: 73964 - DNA, 33 bp, Artificial Sequence
  Description of Artificial Sequence: Synthetic oligonucleotide
gtgcggtacctgaacagatacttccataaccag

SEQ ID NO: 73965 - DNA, 33 bp, Artificial Sequence
  Description of Artificial Sequence: Synthetic oligonucleotide
tgcggtacctgaacagatacttccataaccagg

SEQ ID NO: 73966 - DNA, 32 bp, Artificial Sequence
  Description of Artificial Sequence: Synthetic oligonucleotide
gcggtacctgaacagatacttccataaccagg

SEQ ID NO: 73967 - DNA, 33 bp, Artificial Sequence
  Description of Artificial Sequence: Synthetic oligonucleotide
cggtacctgaacagatacttccataaccaggag

SEQ ID NO: 73968 - DNA, 33 bp, Artificial Sequence
  Description of Artificial Sequence: Synthetic oligonucleotide
ggtacctgaacagatacttccataaccaggagg

SEQ ID NO: 73969 - DNA, 34 bp, Artificial Sequence
  Description of Artificial Sequence: Synthetic oligonucleotide
gtacctgaacagatacttccataaccaggaggag

SEQ ID NO: 73970 - DNA, 36 bp, Artificial Sequence
  Description of Artificial Sequence: Synthetic oligonucleotide
tacctgaacagatacttccataaccaggaggagttc

SEQ ID NO: 73971 - DNA, 35 bp, Artificial Sequence
  Description of Artificial Sequence: Synthetic oligonucleotide
acctgaacagatacttccataaccaggaggagttc

SEQ ID NO: 73972 - DNA, 34 bp, Artificial Sequence
  Description of Artificial Sequence: Synthetic oligonucleotide
cctgaacagatacttccataaccaggaggagttc

SEQ ID NO: 73973 - DNA, 34 bp, Artificial Sequence
  Description of Artificial Sequence: Synthetic oligonucleotide
ctgaacagatacttccataaccaggaggagttcc

SEQ ID NO: 73974 - DNA, 35 bp, Artificial Sequence
  Description of Artificial Sequence: Synthetic oligonucleotide
tgaacagatacttccataaccaggaggagttcctg

SEQ ID NO: 73975 - DNA, 34 bp, Artificial Sequence
  Description of Artificial Sequence: Synthetic oligonucleotide
gaacagatacttccataaccaggaggagttcctg

SEQ ID NO: 73976 - DNA, 34 bp, Artificial Sequence
  Description of Artificial Sequence: Synthetic oligonucleotide
aacagatacttccataaccaggaggagttcctgc

SEQ ID NO: 73977 - DNA, 32 bp, Artificial Sequence
  Description of Artificial Sequence: Synthetic oligonucleotide
tggagagacacttccataaccaggaggagtac

SEQ ID NO: 73978 - DNA, 31 bp, Artificial Sequence
  Description of Artificial Sequence: Synthetic oligonucleotide
ggagagacacttccataaccaggaggagtac

SEQ ID NO: 73979 - DNA, 31 bp, Artificial Sequence
  Description of Artificial Sequence: Synthetic oligonucleotide
gagagacacttccataaccaggaggagtacg

SEQ ID NO: 73980 - DNA, 31 bp, Artificial Sequence
  Description of Artificial Sequence: Synthetic oligonucleotide
agagacacttccataaccaggaggagtacgc

SEQ ID NO: 73981 - DNA, 30 bp, Artificial Sequence
  Description of Artificial Sequence: Synthetic oligonucleotide
gagacacttccataaccaggaggagtacgc

SEQ ID NO: 73982 - DNA, 30 bp, Artificial Sequence
  Description of Artificial Sequence: Synthetic oligonucleotide
agacacttccataaccaggaggagtacgcg

SEQ ID NO: 73983 - DNA, 29 bp, Artificial Sequence
  Description of Artificial Sequence: Synthetic oligonucleotide
gacacttccataaccaggaggagtacgcg

SEQ ID NO: 73984 - DNA, 29 bp, Artificial Sequence
  Description of Artificial Sequence: Synthetic oligonucleotide
acacttccataaccaggaggagtacgcgc

SEQ ID NO: 73985 - DNA, 28 bp, Artificial Sequence
  Description of Artificial Sequence: Synthetic oligonucleotide
cacttccataaccaggaggagtacgcgc

SEQ ID NO: 73986 - DNA, 34 bp, Artificial Sequence
  Description of Artificial Sequence: Synthetic oligonucleotide
acagatacttccataaccaggaggagttcctgag

SEQ ID NO: 73987 - DNA, 33 bp, Artificial Sequence
  Description of Artificial Sequence: Synthetic oligonucleotide
cagatacttccataaccaggaggagttcctgag

SEQ ID NO: 73988 - DNA, 33 bp, Artificial Sequence
  Description of Artificial Sequence: Synthetic oligonucleotide
agatacttccataaccaggaggagttcctgagc

SEQ ID NO: 73989 - DNA, 32 bp, Artificial Sequence
  Description of Artificial Sequence: Synthetic oligonucleotide
gatacttccataaccaggaggagttcctgagc

SEQ ID NO: 73990 - DNA, 34 bp, Artificial Sequence
  Description of Artificial Sequence: Synthetic oligonucleotide
atacttccataaccaggaggagttcctgagcttc

SEQ ID NO: 73991 - DNA, 33 bp, Artificial Sequence
  Description of Artificial Sequence: Synthetic oligonucleotide
tacttccataaccaggaggagttcctgagcttc

SEQ ID NO: 73992 - DNA, 32 bp, Artificial Sequence
  Description of Artificial Sequence: Synthetic oligonucleotide
acttccataaccaggaggagttcctgagcttc

SEQ ID NO: 73993 - DNA, 31 bp, Artificial Sequence
  Description of Artificial Sequence: Synthetic oligonucleotide
cttccataaccaggaggagttcctgagcttc

SEQ ID NO: 73994 - DNA, 31 bp, Artificial Sequence
  Description of Artificial Sequence: Synthetic oligonucleotide
ttccataaccaggaggagttcctgagcttcg

SEQ ID NO: 73995 - DNA, 30 bp, Artificial Sequence
  Description of Artificial Sequence: Synthetic oligonucleotide
tccataaccaggaggagttcctgagcttcg

SEQ ID NO: 73996 - DNA, 29 bp, Artificial Sequence
  Description of Artificial Sequence: Synthetic oligonucleotide
ccataaccaggaggagttcctgagcttcg

SEQ ID NO: 73997 - DNA, 30 bp, Artificial Sequence
  Description of Artificial Sequence: Synthetic oligonucleotide
cataaccaggaggagttcctgagcttcgac

SEQ ID NO: 73998 - DNA, 31 bp, Artificial Sequence
  Description of Artificial Sequence: Synthetic oligonucleotide
ataaccaggaggagttcctgagcttcgacag

SEQ ID NO: 73999 - DNA, 30 bp, Artificial Sequence
  Description of Artificial Sequence: Synthetic oligonucleotide
taaccaggaggagttcctgagcttcgacag

SEQ ID NO: 74000 - DNA, 29 bp, Artificial Sequence
  Description of Artificial Sequence: Synthetic oligonucleotide
aaccaggaggagttcctgagcttcgacag

SEQ ID NO: 74001 - DNA, 28 bp, Artificial Sequence
  Description of Artificial Sequence: Synthetic oligonucleotide
accaggaggagttcctgagcttcgacag

SEQ ID NO: 74002 - DNA, 27 bp, Artificial Sequence
  Description of Artificial Sequence: Synthetic oligonucleotide
ccaggaggagttcctgagcttcgacag

SEQ ID NO: 74003 - DNA, 27 bp, Artificial Sequence
  Description of Artificial Sequence: Synthetic oligonucleotide
caggaggagttcctgagcttcgacagc

SEQ ID NO: 74004 - DNA, 27 bp, Artificial Sequence
  Description of Artificial Sequence: Synthetic oligonucleotide
aggaggagttcctgagcttcgacagcg

SEQ ID NO: 74005 - DNA, 27 bp, Artificial Sequence
  Description of Artificial Sequence: Synthetic oligonucleotide
ggaggagttcctgagcttcgacagcga

SEQ ID NO: 74006 - DNA, 27 bp, Artificial Sequence
  Description of Artificial Sequence: Synthetic oligonucleotide
gaggagttcctgagcttcgacagcgac

SEQ ID NO: 74007 - DNA, 27 bp, Artificial Sequence
  Description of Artificial Sequence: Synthetic oligonucleotide
aggagttcctgagcttcgacagcgacg

SEQ ID NO: 74008 - DNA, 27 bp, Artificial Sequence
  Description of Artificial Sequence: Synthetic oligonucleotide
ggagttcctgagcttcgacagcgacgt

SEQ ID NO: 74009 - DNA, 27 bp, Artificial Sequence
  Description of Artificial Sequence: Synthetic oligonucleotide
gagttcctgagcttcgacagcgacgtg

SEQ ID NO: 74010 - DNA, 27 bp, Artificial Sequence
  Description of Artificial Sequence: Synthetic oligonucleotide
agttcctgagcttcgacagcgacgtgg

SEQ ID NO: 74011 - DNA, 26 bp, Artificial Sequence
  Description of Artificial Sequence: Synthetic oligonucleotide
gttcctgagcttcgacagcgacgtgg

SEQ ID NO: 74012 - DNA, 26 bp, Artificial Sequence
  Description of Artificial Sequence: Synthetic oligonucleotide
ttcctgagcttcgacagcgacgtggg

SEQ ID NO: 74013 - DNA, 25 bp, Artificial Sequence
  Description of Artificial Sequence: Synthetic oligonucleotide
tcctgagcttcgacagcgacgtggg

SEQ ID NO: 74014 - DNA, 24 bp, Artificial Sequence
  Description of Artificial Sequence: Synthetic oligonucleotide
cctgagcttcgacagcgacgtggg

SEQ ID NO: 74015 - DNA, 24 bp, Artificial Sequence
  Description of Artificial Sequence: Synthetic oligonucleotide
ctgagcttcgacagcgacgtgggg

SEQ ID NO: 74016 - DNA, 25 bp, Artificial Sequence
  Description of Artificial Sequence: Synthetic oligonucleotide
tgagcttcgacagcgacgtggggga

SEQ ID NO: 74017 - DNA, 24 bp, Artificial Sequence
  Description of Artificial Sequence: Synthetic oligonucleotide
gagcttcgacagcgacgtggggga

SEQ ID NO: 74018 - DNA, 26 bp, Artificial Sequence
  Description of Artificial Sequence: Synthetic oligonucleotide
agcttcgacagcgacgtgggggagta

SEQ ID NO: 74019 - DNA, 27 bp, Artificial Sequence
  Description of Artificial Sequence: Synthetic oligonucleotide
ggagcgggtgcggtacctggacatata

SEQ ID NO: 74020 - DNA, 27 bp, Artificial Sequence
  Description of Artificial Sequence: Synthetic oligonucleotide
gagcgggtgcggtacctggacatatac

SEQ ID NO: 74021 - DNA, 29 bp, Artificial Sequence
  Description of Artificial Sequence: Synthetic oligonucleotide
agcgggtgcggtacctggacatatacttc

SEQ ID NO: 74022 - DNA, 28 bp, Artificial Sequence
  Description of Artificial Sequence: Synthetic oligonucleotide
gcgggtgcggtacctggacatatacttc

SEQ ID NO: 74023 - DNA, 28 bp, Artificial Sequence
  Description of Artificial Sequence: Synthetic oligonucleotide
cgggtgcggtacctggacatatacttcc

SEQ ID NO: 74024 - DNA, 32 bp, Artificial Sequence
  Description of Artificial Sequence: Synthetic oligonucleotide
gggtgcggtacctggacatatacttccataac

SEQ ID NO: 74025 - DNA, 32 bp, Artificial Sequence
  Description of Artificial Sequence: Synthetic oligonucleotide
ggtgcggtacctggacatatacttccataacc

SEQ ID NO: 74026 - DNA, 33 bp, Artificial Sequence
  Description of Artificial Sequence: Synthetic oligonucleotide
gtgcggtacctggacatatacttccataaccag

SEQ ID NO: 74027 - DNA, 33 bp, Artificial Sequence
  Description of Artificial Sequence: Synthetic oligonucleotide
tgcggtacctggacatatacttccataaccagg

SEQ ID NO: 74028 - DNA, 32 bp, Artificial Sequence
  Description of Artificial Sequence: Synthetic oligonucleotide
gcggtacctggacatatacttccataaccagg

SEQ ID NO: 74029 - DNA, 33 bp, Artificial Sequence
  Description of Artificial Sequence: Synthetic oligonucleotide
cggtacctggacatatacttccataaccaggag

SEQ ID NO: 74030 - DNA, 33 bp, Artificial Sequence
  Description of Artificial Sequence: Synthetic oligonucleotide
ggtacctggacatatacttccataaccaggagg

SEQ ID NO: 74031 - DNA, 34 bp, Artificial Sequence
  Description of Artificial Sequence: Synthetic oligonucleotide
gtacctggacatatacttccataaccaggaggag

SEQ ID NO: 74032 - DNA, 36 bp, Artificial Sequence
  Description of Artificial Sequence: Synthetic oligonucleotide
tacctggacatatacttccataaccaggaggagttc

SEQ ID NO: 74033 - DNA, 35 bp, Artificial Sequence
  Description of Artificial Sequence: Synthetic oligonucleotide
acctggacatatacttccataaccaggaggagttc

SEQ ID NO: 74034 - DNA, 34 bp, Artificial Sequence
  Description of Artificial Sequence: Synthetic oligonucleotide
cctggacatatacttccataaccaggaggagttc

SEQ ID NO: 74035 - DNA, 34 bp, Artificial Sequence
  Description of Artificial Sequence: Synthetic oligonucleotide
ctggacatatacttccataaccaggaggagttcc

SEQ ID NO: 74036 - DNA, 35 bp, Artificial Sequence
  Description of Artificial Sequence: Synthetic oligonucleotide
tggacatatacttccataaccaggaggagttcctg

SEQ ID NO: 74037 - DNA, 34 bp, Artificial Sequence
  Description of Artificial Sequence: Synthetic oligonucleotide
ggacatatacttccataaccaggaggagttcctg

SEQ ID NO: 74038 - DNA, 34 bp, Artificial Sequence
  Description of Artificial Sequence: Synthetic oligonucleotide
gacatatacttccataaccaggaggagttcctgc

SEQ ID NO: 74039 - DNA, 34 bp, Artificial Sequence
  Description of Artificial Sequence: Synthetic oligonucleotide
acatatacttccataaccaggaggagttcctgcg

SEQ ID NO: 74040 - DNA, 33 bp, Artificial Sequence
  Description of Artificial Sequence: Synthetic oligonucleotide
catatacttccataaccaggaggagttcctgcg

SEQ ID NO: 74041 - DNA, 33 bp, Artificial Sequence
  Description of Artificial Sequence: Synthetic oligonucleotide
atatacttccataaccaggaggagttcctgcgc

SEQ ID NO: 74042 - DNA, 32 bp, Artificial Sequence
  Description of Artificial Sequence: Synthetic oligonucleotide
tatacttccataaccaggaggagttcctgcgc

SEQ ID NO: 74043 - DNA, 31 bp, Artificial Sequence
  Description of Artificial Sequence: Synthetic oligonucleotide
cgggtggacaattactgcagacacaactacc

SEQ ID NO: 74044 - DNA, 31 bp, Artificial Sequence
  Description of Artificial Sequence: Synthetic oligonucleotide
gggtggacaattactgcagacacaactaccg

SEQ ID NO: 74045 - DNA, 31 bp, Artificial Sequence
  Description of Artificial Sequence: Synthetic oligonucleotide
ggtggacaattactgcagacacaactaccgg

SEQ ID NO: 74046 - DNA, 31 bp, Artificial Sequence
  Description of Artificial Sequence: Synthetic oligonucleotide
gtggacaattactgcagacacaactaccggg

SEQ ID NO: 74047 - DNA, 33 bp, Artificial Sequence
  Description of Artificial Sequence: Synthetic oligonucleotide
tggacaattactgcagacacaactaccgggttg

SEQ ID NO: 74048 - DNA, 32 bp, Artificial Sequence
  Description of Artificial Sequence: Synthetic oligonucleotide
ggacaattactgcagacacaactaccgggttg

SEQ ID NO: 74049 - DNA, 32 bp, Artificial Sequence
  Description of Artificial Sequence: Synthetic oligonucleotide
gacaattactgcagacacaactaccgggttgg

SEQ ID NO: 74050 - DNA, 33 bp, Artificial Sequence
  Description of Artificial Sequence: Synthetic oligonucleotide
acaattactgcagacacaactaccgggttggtg

SEQ ID NO: 74051 - DNA, 32 bp, Artificial Sequence
  Description of Artificial Sequence: Synthetic oligonucleotide
caattactgcagacacaactaccgggttggtg

SEQ ID NO: 74052 - DNA, 33 bp, Artificial Sequence
  Description of Artificial Sequence: Synthetic oligonucleotide
aattactgcagacacaactaccgggttggtgag

SEQ ID NO: 74053 - DNA, 32 bp, Artificial Sequence
  Description of Artificial Sequence: Synthetic oligonucleotide
attactgcagacacaactaccgggttggtgag

SEQ ID NO: 74054 - DNA, 31 bp, Artificial Sequence
  Description of Artificial Sequence: Synthetic oligonucleotide
ttactgcagacacaactaccgggttggtgag

SEQ ID NO: 74055 - DNA, 30 bp, Artificial Sequence
  Description of Artificial Sequence: Synthetic oligonucleotide
tactgcagacacaactaccgggttggtgag

SEQ ID NO: 74056 - DNA, 29 bp, Artificial Sequence
  Description of Artificial Sequence: Synthetic oligonucleotide
actgcagacacaactaccgggttggtgag

SEQ ID NO: 74057 - DNA, 28 bp, Artificial Sequence
  Description of Artificial Sequence: Synthetic oligonucleotide
ctgcagacacaactaccgggttggtgag

SEQ ID NO: 74058 - DNA, 29 bp, Artificial Sequence
  Description of Artificial Sequence: Synthetic oligonucleotide
tgcagacacaactaccgggttggtgagag

SEQ ID NO: 74059 - DNA, 28 bp, Artificial Sequence
  Description of Artificial Sequence: Synthetic oligonucleotide
gcagacacaactaccgggttggtgagag

SEQ ID NO: 74060 - DNA, 28 bp, Artificial Sequence
  Description of Artificial Sequence: Synthetic oligonucleotide
cagacacaactaccgggttggtgagagc

SEQ ID NO: 74061 - DNA, 30 bp, Artificial Sequence
  Description of Artificial Sequence: Synthetic oligonucleotide
agacacaactaccgggttggtgagagcttc

SEQ ID NO: 74062 - DNA, 29 bp, Artificial Sequence
  Description of Artificial Sequence: Synthetic oligonucleotide
gacacaactaccgggttggtgagagcttc

SEQ ID NO: 74063 - DNA, 30 bp, Artificial Sequence
  Description of Artificial Sequence: Synthetic oligonucleotide
acacaactaccgggttggtgagagcttcac

SEQ ID NO: 74064 - DNA, 29 bp, Artificial Sequence
  Description of Artificial Sequence: Synthetic oligonucleotide
cacaactaccgggttggtgagagcttcac

SEQ ID NO: 74065 - DNA, 30 bp, Artificial Sequence
  Description of Artificial Sequence: Synthetic oligonucleotide
acaactaccgggttggtgagagcttcacag

SEQ ID NO: 74066 - DNA, 29 bp, Artificial Sequence
  Description of Artificial Sequence: Synthetic oligonucleotide
caactaccgggttggtgagagcttcacag

SEQ ID NO: 74067 - DNA, 30 bp, Artificial Sequence
  Description of Artificial Sequence: Synthetic oligonucleotide
aactaccgggttggtgagagcttcacagtg

SEQ ID NO: 74068 - DNA, 29 bp, Artificial Sequence
  Description of Artificial Sequence: Synthetic oligonucleotide
actaccgggttggtgagagcttcacagtg

SEQ ID NO: 74069 - DNA, 28 bp, Artificial Sequence
  Description of Artificial Sequence: Synthetic oligonucleotide
ctaccgggttggtgagagcttcacagtg

SEQ ID NO: 74070 - DNA, 28 bp, Artificial Sequence
  Description of Artificial Sequence: Synthetic oligonucleotide
taccgggttggtgagagcttcacagtgc

SEQ ID NO: 74071 - DNA, 27 bp, Artificial Sequence
  Description of Artificial Sequence: Synthetic oligonucleotide
accgggttggtgagagcttcacagtgc

SEQ ID NO: 74072 - DNA, 27 bp, Artificial Sequence
  Description of Artificial Sequence: Synthetic oligonucleotide
ccgggttggtgagagcttcacagtgca

SEQ ID NO: 74073 - DNA, 27 bp, Artificial Sequence
  Description of Artificial Sequence: Synthetic oligonucleotide
cgggttggtgagagcttcacagtgcag

SEQ ID NO: 74074 - DNA, 31 bp, Artificial Sequence
  Description of Artificial Sequence: Synthetic oligonucleotide
ctggacagatacttccataaccaggaggagc

SEQ ID NO: 74075 - DNA, 32 bp, Artificial Sequence
  Description of Artificial Sequence: Synthetic oligonucleotide
tggacagatacttccataaccaggaggagctc

SEQ ID NO: 74076 - DNA, 31 bp, Artificial Sequence
  Description of Artificial Sequence: Synthetic oligonucleotide
ggacagatacttccataaccaggaggagctc

SEQ ID NO: 74077 - DNA, 31 bp, Artificial Sequence
  Description of Artificial Sequence: Synthetic oligonucleotide
gacagatacttccataaccaggaggagctcc

SEQ ID NO: 74078 - DNA, 32 bp, Artificial Sequence
  Description of Artificial Sequence: Synthetic oligonucleotide
acagatacttccataaccaggaggagctcctg

SEQ ID NO: 74079 - DNA, 31 bp, Artificial Sequence
  Description of Artificial Sequence: Synthetic oligonucleotide
cagatacttccataaccaggaggagctcctg

SEQ ID NO: 74080 - DNA, 31 bp, Artificial Sequence
  Description of Artificial Sequence: Synthetic oligonucleotide
agatacttccataaccaggaggagctcctgc

SEQ ID NO: 74081 - DNA, 30 bp, Artificial Sequence
  Description of Artificial Sequence: Synthetic oligonucleotide
gatacttccataaccaggaggagctcctgc

SEQ ID NO: 74082 - DNA, 30 bp, Artificial Sequence
  Description of Artificial Sequence: Synthetic oligonucleotide
atacttccataaccaggaggagctcctgcg

SEQ ID NO: 74083 - DNA, 29 bp, Artificial Sequence
  Description of Artificial Sequence: Synthetic oligonucleotide
tacttccataaccaggaggagctcctgcg

SEQ ID NO: 74084 - DNA, 27 bp, Artificial Sequence
  Description of Artificial Sequence: Synthetic oligonucleotide
cacccgaccacgtttcttggagctgct

SEQ ID NO: 74085 - DNA, 30 bp, Artificial Sequence
  Description of Artificial Sequence: Synthetic oligonucleotide
acccgaccacgtttcttggagctgcttaag

SEQ ID NO: 74086 - DNA, 29 bp, Artificial Sequence
  Description of Artificial Sequence: Synthetic oligonucleotide
cccgaccacgtttcttggagctgcttaag

SEQ ID NO: 74087 - DNA, 30 bp, Artificial Sequence
  Description of Artificial Sequence: Synthetic oligonucleotide
ccgaccacgtttcttggagctgcttaagtc

SEQ ID NO: 74088 - DNA, 31 bp, Artificial Sequence
  Description of Artificial Sequence: Synthetic oligonucleotide
cgaccacgtttcttggagctgcttaagtctg

SEQ ID NO: 74089 - DNA, 32 bp, Artificial Sequence
  Description of Artificial Sequence: Synthetic oligonucleotide
gaccacgtttcttggagctgcttaagtctgag

SEQ ID NO: 74090 - DNA, 33 bp, Artificial Sequence
  Description of Artificial Sequence: Synthetic oligonucleotide
accacgtttcttggagctgcttaagtctgagtg

SEQ ID NO: 74091 - DNA, 32 bp, Artificial Sequence
  Description of Artificial Sequence: Synthetic oligonucleotide
ccacgtttcttggagctgcttaagtctgagtg

SEQ ID NO: 74092 - DNA, 34 bp, Artificial Sequence
  Description of Artificial Sequence: Synthetic oligonucleotide
accttccagaccctggtgatgctagaaacatttc

SEQ ID NO: 74093 - DNA, 33 bp, Artificial Sequence
  Description of Artificial Sequence: Synthetic oligonucleotide
ccttccagaccctggtgatgctagaaacatttc

SEQ ID NO: 74094 - DNA, 33 bp, Artificial Sequence
  Description of Artificial Sequence: Synthetic oligonucleotide
cttccagaccctggtgatgctagaaacatttcc

SEQ ID NO: 74095 - DNA, 34 bp, Artificial Sequence
  Description of Artificial Sequence: Synthetic oligonucleotide
ttccagaccctggtgatgctagaaacatttcctc

SEQ ID NO: 74096 - DNA, 33 bp, Artificial Sequence
  Description of Artificial Sequence: Synthetic oligonucleotide
tccagaccctggtgatgctagaaacatttcctc

SEQ ID NO: 74097 - DNA, 32 bp, Artificial Sequence
  Description of Artificial Sequence: Synthetic oligonucleotide
ccagaccctggtgatgctagaaacatttcctc

SEQ ID NO: 74098 - DNA, 32 bp, Artificial Sequence
  Description of Artificial Sequence: Synthetic oligonucleotide
cagaccctggtgatgctagaaacatttcctcg

SEQ ID NO: 74099 - DNA, 32 bp, Artificial Sequence
  Description of Artificial Sequence: Synthetic oligonucleotide
agaccctggtgatgctagaaacatttcctcgg

SEQ ID NO: 74100 - DNA, 31 bp, Artificial Sequence
  Description of Artificial Sequence: Synthetic oligonucleotide
gaccctggtgatgctagaaacatttcctcgg

SEQ ID NO: 74101 - DNA, 32 bp, Artificial Sequence
  Description of Artificial Sequence: Synthetic oligonucleotide
accctggtgatgctagaaacatttcctcggag

SEQ ID NO: 74102 - DNA, 31 bp, Artificial Sequence
  Description of Artificial Sequence: Synthetic oligonucleotide
ccctggtgatgctagaaacatttcctcggag

SEQ ID NO: 74103 - DNA, 32 bp, Artificial Sequence
  Description of Artificial Sequence: Synthetic oligonucleotide
cctggtgatgctagaaacatttcctcggagtg

SEQ ID NO: 74104 - DNA, 32 bp, Artificial Sequence
  Description of Artificial Sequence: Synthetic oligonucleotide
ctggtgatgctagaaacatttcctcggagtgg

SEQ ID NO: 74105 - DNA, 33 bp, Artificial Sequence
  Description of Artificial Sequence: Synthetic oligonucleotide
tggtgatgctagaaacatttcctcggagtggag

SEQ ID NO: 74106 - DNA, 32 bp, Artificial Sequence
  Description of Artificial Sequence: Synthetic oligonucleotide
ggtgatgctagaaacatttcctcggagtggag

SEQ ID NO: 74107 - DNA, 33 bp, Artificial Sequence
  Description of Artificial Sequence: Synthetic oligonucleotide
gtgatgctagaaacatttcctcggagtggagag

SEQ ID NO: 74108 - DNA, 33 bp, Artificial Sequence
  Description of Artificial Sequence: Synthetic oligonucleotide
tgatgctagaaacatttcctcggagtggagagg

SEQ ID NO: 74109 - DNA, 32 bp, Artificial Sequence
  Description of Artificial Sequence: Synthetic oligonucleotide
gatgctagaaacatttcctcggagtggagagg

SEQ ID NO: 74110 - DNA, 36 bp, Artificial Sequence
  Description of Artificial Sequence: Synthetic oligonucleotide
atgctagaaacatttcctcggagtggagaggtttac

SEQ ID NO: 74111 - DNA, 35 bp, Artificial Sequence
  Description of Artificial Sequence: Synthetic oligonucleotide
tgctagaaacatttcctcggagtggagaggtttac

SEQ ID NO: 74112 - DNA, 34 bp, Artificial Sequence
  Description of Artificial Sequence: Synthetic oligonucleotide
gctagaaacatttcctcggagtggagaggtttac

SEQ ID NO: 74113 - DNA, 35 bp, Artificial Sequence
  Description of Artificial Sequence: Synthetic oligonucleotide
ctagaaacatttcctcggagtggagaggtttacac

SEQ ID NO: 74114 - DNA, 35 bp, Artificial Sequence
  Description of Artificial Sequence: Synthetic oligonucleotide
tagaaacatttcctcggagtggagaggtttacacc

SEQ ID NO: 74115 - DNA, 34 bp, Artificial Sequence
  Description of Artificial Sequence: Synthetic oligonucleotide
agaaacatttcctcggagtggagaggtttacacc

SEQ ID NO: 74116 - DNA, 33 bp, Artificial Sequence
  Description of Artificial Sequence: Synthetic oligonucleotide
gaaacatttcctcggagtggagaggtttacacc

SEQ ID NO: 74117 - DNA, 34 bp, Artificial Sequence
  Description of Artificial Sequence: Synthetic oligonucleotide
aaacatttcctcggagtggagaggtttacacctg

SEQ ID NO: 74118 - DNA, 33 bp, Artificial Sequence
  Description of Artificial Sequence: Synthetic oligonucleotide
aacatttcctcggagtggagaggtttacacctg

SEQ ID NO: 74119 - DNA, 32 bp, Artificial Sequence
  Description of Artificial Sequence: Synthetic oligonucleotide
acatttcctcggagtggagaggtttacacctg

SEQ ID NO: 74120 - DNA, 31 bp, Artificial Sequence
  Description of Artificial Sequence: Synthetic oligonucleotide
catttcctcggagtggagaggtttacacctg

SEQ ID NO: 74121 - DNA, 31 bp, Artificial Sequence
  Description of Artificial Sequence: Synthetic oligonucleotide
atttcctcggagtggagaggtttacacctgc

SEQ ID NO: 74122 - DNA, 30 bp, Artificial Sequence
  Description of Artificial Sequence: Synthetic oligonucleotide
tttcctcggagtggagaggtttacacctgc

SEQ ID NO: 74123 - DNA, 27 bp, Artificial Sequence
  Description of Artificial Sequence: Synthetic oligonucleotide
acctgccaagtggagcacccaagcgta

SEQ ID NO: 74124 - DNA, 27 bp, Artificial Sequence
  Description of Artificial Sequence: Synthetic oligonucleotide
cctgccaagtggagcacccaagcgtaa

SEQ ID NO: 74125 - DNA, 27 bp, Artificial Sequence
  Description of Artificial Sequence: Synthetic oligonucleotide
ctgccaagtggagcacccaagcgtaac

SEQ ID NO: 74126 - DNA, 27 bp, Artificial Sequence
  Description of Artificial Sequence: Synthetic oligonucleotide
aagtggagcacccaagcgtaacgagcc

SEQ ID NO: 74127 - DNA, 26 bp, Artificial Sequence
  Description of Artificial Sequence: Synthetic oligonucleotide
agtggagcacccaagcgtaacgagcc

SEQ ID NO: 74128 - DNA, 25 bp, Artificial Sequence
  Description of Artificial Sequence: Synthetic oligonucleotide
gtggagcacccaagcgtaacgagcc

SEQ ID NO: 74129 - DNA, 26 bp, Artificial Sequence
  Description of Artificial Sequence: Synthetic oligonucleotide
tggagcacccaagcgtaacgagccct

SEQ ID NO: 74130 - DNA, 25 bp, Artificial Sequence
  Description of Artificial Sequence: Synthetic oligonucleotide
ggagcacccaagcgtaacgagccct

SEQ ID NO: 74131 - DNA, 26 bp, Artificial Sequence
  Description of Artificial Sequence: Synthetic oligonucleotide
gagcacccaagcgtaacgagccctct

SEQ ID NO: 74132 - DNA, 27 bp, Artificial Sequence
  Description of Artificial Sequence: Synthetic oligonucleotide
agcacccaagcgtaacgagccctctca

SEQ ID NO: 74133 - DNA, 26 bp, Artificial Sequence
  Description of Artificial Sequence: Synthetic oligonucleotide
gcacccaagcgtaacgagccctctca

SEQ ID NO: 74134 - DNA, 27 bp, Artificial Sequence
  Description of Artificial Sequence: Synthetic oligonucleotide
cacccaagcgtaacgagccctctcaca

SEQ ID NO: 74135 - DNA, 27 bp, Artificial Sequence
  Description of Artificial Sequence: Synthetic oligonucleotide
acccaagcgtaacgagccctctcacag

SEQ ID NO: 74136 - DNA, 27 bp, Artificial Sequence
  Description of Artificial Sequence: Synthetic oligonucleotide
cccaagcgtaacgagccctctcacagt

SEQ ID NO: 74137 - DNA, 27 bp, Artificial Sequence
  Description of Artificial Sequence: Synthetic oligonucleotide
ccaagcgtaacgagccctctcacagtg

SEQ ID NO: 74138 - DNA, 27 bp, Artificial Sequence
  Description of Artificial Sequence: Synthetic oligonucleotide
caagcgtaacgagccctctcacagtgg

SEQ ID NO: 74139 - DNA, 30 bp, Artificial Sequence
  Description of Artificial Sequence: Synthetic oligonucleotide
aagcgtaacgagccctctcacagtggaatg

SEQ ID NO: 74140 - DNA, 29 bp, Artificial Sequence
  Description of Artificial Sequence: Synthetic oligonucleotide
agcgtaacgagccctctcacagtggaatg

SEQ ID NO: 74141 - DNA, 28 bp, Artificial Sequence
  Description of Artificial Sequence: Synthetic oligonucleotide
gcgtaacgagccctctcacagtggaatg

SEQ ID NO: 74142 - DNA, 28 bp, Artificial Sequence
  Description of Artificial Sequence: Synthetic oligonucleotide
cgtaacgagccctctcacagtggaatgg

SEQ ID NO: 74143 - DNA, 29 bp, Artificial Sequence
  Description of Artificial Sequence: Synthetic oligonucleotide
gtaacgagccctctcacagtggaatggag

SEQ ID NO: 74144 - DNA, 30 bp, Artificial Sequence
  Description of Artificial Sequence: Synthetic oligonucleotide
taacgagccctctcacagtggaatggagtg

SEQ ID NO: 74145 - DNA, 29 bp, Artificial Sequence
  Description of Artificial Sequence: Synthetic oligonucleotide
aacgagccctctcacagtggaatggagtg

SEQ ID NO: 74146 - DNA, 28 bp, Artificial Sequence
  Description of Artificial Sequence: Synthetic oligonucleotide
acgagccctctcacagtggaatggagtg

SEQ ID NO: 74147 - DNA, 27 bp, Artificial Sequence
  Description of Artificial Sequence: Synthetic oligonucleotide
cgagccctctcacagtggaatggagtg

SEQ ID NO: 74148 - DNA, 27 bp, Artificial Sequence
  Description of Artificial Sequence: Synthetic oligonucleotide
gagccctctcacagtggaatggagtgc

SEQ ID NO: 74149 - DNA, 26 bp, Artificial Sequence
  Description of Artificial Sequence: Synthetic oligonucleotide
cggggccaggtggacaattactgcag

SEQ ID NO: 74150 - DNA, 26 bp, Artificial Sequence
  Description of Artificial Sequence: Synthetic oligonucleotide
ggggccaggtggacaattactgcagg

SEQ ID NO: 74151 - DNA, 27 bp, Artificial Sequence
  Description of Artificial Sequence: Synthetic oligonucleotide
gggccaggtggacaattactgcaggca

SEQ ID NO: 74152 - DNA, 27 bp, Artificial Sequence
  Description of Artificial Sequence: Synthetic oligonucleotide
ggccaggtggacaattactgcaggcac

SEQ ID NO: 74153 - DNA, 29 bp, Artificial Sequence
  Description of Artificial Sequence: Synthetic oligonucleotide
gccaggtggacaattactgcaggcacaac

SEQ ID NO: 74154 - DNA, 31 bp, Artificial Sequence
  Description of Artificial Sequence: Synthetic oligonucleotide
ccaggtggacaattactgcaggcacaactac

SEQ ID NO: 74155 - DNA, 31 bp, Artificial Sequence
  Description of Artificial Sequence: Synthetic oligonucleotide
caggtggacaattactgcaggcacaactacg

SEQ ID NO: 74156 - DNA, 31 bp, Artificial Sequence
  Description of Artificial Sequence: Synthetic oligonucleotide
aggtggacaattactgcaggcacaactacgg

SEQ ID NO: 74157 - DNA, 30 bp, Artificial Sequence
  Description of Artificial Sequence: Synthetic oligonucleotide
ggtggacaattactgcaggcacaactacgg

SEQ ID NO: 74158 - DNA, 30 bp, Artificial Sequence
  Description of Artificial Sequence: Synthetic oligonucleotide
gtggacaattactgcaggcacaactacggg

SEQ ID NO: 74159 - DNA, 30 bp, Artificial Sequence
  Description of Artificial Sequence: Synthetic oligonucleotide
tggacaattactgcaggcacaactacgggg

SEQ ID NO: 74160 - DNA, 29 bp, Artificial Sequence
  Description of Artificial Sequence: Synthetic oligonucleotide
ggacaattactgcaggcacaactacgggg

SEQ ID NO: 74161 - DNA, 31 bp, Artificial Sequence
  Description of Artificial Sequence: Synthetic oligonucleotide
gacaattactgcaggcacaactacggggttg

SEQ ID NO: 74162 - DNA, 31 bp, Artificial Sequence
  Description of Artificial Sequence: Synthetic oligonucleotide
acaattactgcaggcacaactacggggttgg

SEQ ID NO: 74163 - DNA, 30 bp, Artificial Sequence
  Description of Artificial Sequence: Synthetic oligonucleotide
caattactgcaggcacaactacggggttgg

SEQ ID NO: 74164 - DNA, 31 bp, Artificial Sequence
  Description of Artificial Sequence: Synthetic oligonucleotide
aattactgcaggcacaactacggggttggtg

SEQ ID NO: 74165 - DNA, 30 bp, Artificial Sequence
  Description of Artificial Sequence: Synthetic oligonucleotide
attactgcaggcacaactacggggttggtg

SEQ ID NO: 74166 - DNA, 29 bp, Artificial Sequence
  Description of Artificial Sequence: Synthetic oligonucleotide
ttactgcaggcacaactacggggttggtg

SEQ ID NO: 74167 - DNA, 28 bp, Artificial Sequence
  Description of Artificial Sequence: Synthetic oligonucleotide
tactgcaggcacaactacggggttggtg

SEQ ID NO: 74168 - DNA, 27 bp, Artificial Sequence
  Description of Artificial Sequence: Synthetic oligonucleotide
actgcaggcacaactacggggttggtg

SEQ ID NO: 74169 - DNA, 27 bp, Artificial Sequence
  Description of Artificial Sequence: Synthetic oligonucleotide
ctgcaggcacaactacggggttggtga

SEQ ID NO: 74170 - DNA, 27 bp, Artificial Sequence
  Description of Artificial Sequence: Synthetic oligonucleotide
tgcaggcacaactacggggttggtgag

SEQ ID NO: 74171 - DNA, 27 bp, Artificial Sequence
  Description of Artificial Sequence: Synthetic oligonucleotide
gcaggcacaactacggggttggtgaga

SEQ ID NO: 74172 - DNA, 27 bp, Artificial Sequence
  Description of Artificial Sequence: Synthetic oligonucleotide
caggcacaactacggggttggtgagag

SEQ ID NO: 74173 - DNA, 27 bp, Artificial Sequence
  Description of Artificial Sequence: Synthetic oligonucleotide
aggcacaactacggggttggtgagagc

SEQ ID NO: 74174 - DNA, 27 bp, Artificial Sequence
  Description of Artificial Sequence: Synthetic oligonucleotide
ggcacaactacggggttggtgagagct

SEQ ID NO: 74175 - DNA, 28 bp, Artificial Sequence
  Description of Artificial Sequence: Synthetic oligonucleotide
gcacaactacggggttggtgagagcttc

SEQ ID NO: 74176 - DNA, 23 bp, Artificial Sequence
  Description of Artificial Sequence: Synthetic oligonucleotide
cgcgcttcgacagcgacgtgggt

SEQ ID NO: 74177 - DNA, 24 bp, Artificial Sequence
  Description of Artificial Sequence: Synthetic oligonucleotide
gcgcttcgacagcgacgtgggtga

SEQ ID NO: 74178 - DNA, 26 bp, Artificial Sequence
  Description of Artificial Sequence: Synthetic oligonucleotide
cgcttcgacagcgacgtgggtgagta

SEQ ID NO: 74179 - DNA, 26 bp, Artificial Sequence
  Description of Artificial Sequence: Synthetic oligonucleotide
gcttcgacagcgacgtgggtgagtac

SEQ ID NO: 74180 - DNA, 26 bp, Artificial Sequence
  Description of Artificial Sequence: Synthetic oligonucleotide
cttcgacagcgacgtgggtgagtacc

SEQ ID NO: 74181 - DNA, 26 bp, Artificial Sequence
  Description of Artificial Sequence: Synthetic oligonucleotide
ttcgacagcgacgtgggtgagtaccg

SEQ ID NO: 74182 - DNA, 25 bp, Artificial Sequence
  Description of Artificial Sequence: Synthetic oligonucleotide
tcgacagcgacgtgggtgagtaccg

SEQ ID NO: 74183 - DNA, 24 bp, Artificial Sequence
  Description of Artificial Sequence: Synthetic oligonucleotide
cgacagcgacgtgggtgagtaccg

SEQ ID NO: 74184 - DNA, 24 bp, Artificial Sequence
  Description of Artificial Sequence: Synthetic oligonucleotide
gacagcgacgtgggtgagtaccgg

SEQ ID NO: 74185 - DNA, 24 bp, Artificial Sequence
  Description of Artificial Sequence: Synthetic oligonucleotide
acagcgacgtgggtgagtaccggg

SEQ ID NO: 74186 - DNA, 23 bp, Artificial Sequence
  Description of Artificial Sequence: Synthetic oligonucleotide
cagcgacgtgggtgagtaccggg

SEQ ID NO: 74187 - DNA, 23 bp, Artificial Sequence
  Description of Artificial Sequence: Synthetic oligonucleotide
agcgacgtgggtgagtaccgggc

SEQ ID NO: 74188 - DNA, 22 bp, Artificial Sequence
  Description of Artificial Sequence: Synthetic oligonucleotide
gcgacgtgggtgagtaccgggc

SEQ ID NO: 74189 - DNA, 22 bp, Artificial Sequence
  Description of Artificial Sequence: Synthetic oligonucleotide
cgacgtgggtgagtaccgggcg

SEQ ID NO: 74190 - DNA, 23 bp, Artificial Sequence
  Description of Artificial Sequence: Synthetic oligonucleotide
gacgtgggtgagtaccgggcggt

SEQ ID NO: 74191 - DNA, 24 bp, Artificial Sequence
  Description of Artificial Sequence: Synthetic oligonucleotide
acgtgggtgagtaccgggcggtga

SEQ ID NO: 74192 - DNA, 23 bp, Artificial Sequence
  Description of Artificial Sequence: Synthetic oligonucleotide
cgtgggtgagtaccgggcggtga

SEQ ID NO: 74193 - DNA, 23 bp, Artificial Sequence
  Description of Artificial Sequence: Synthetic oligonucleotide
gtgggtgagtaccgggcggtgag

SEQ ID NO: 74194 - DNA, 23 bp, Artificial Sequence
  Description of Artificial Sequence: Synthetic oligonucleotide
tgggtgagtaccgggcggtgagg

SEQ ID NO: 74195 - DNA, 22 bp, Artificial Sequence
  Description of Artificial Sequence: Synthetic oligonucleotide
gggtgagtaccgggcggtgagg

SEQ ID NO: 74196 - DNA, 23 bp, Artificial Sequence
  Description of Artificial Sequence: Synthetic oligonucleotide
ggtgagtaccgggcggtgaggga

SEQ ID NO: 74197 - DNA, 23 bp, Artificial Sequence
  Description of Artificial Sequence: Synthetic oligonucleotide
gtgagtaccgggcggtgagggag

SEQ ID NO: 74198 - DNA, 24 bp, Artificial Sequence
  Description of Artificial Sequence: Synthetic oligonucleotide
tgagtaccgggcggtgagggagct

SEQ ID NO: 74199 - DNA, 31 bp, Artificial Sequence
  Description of Artificial Sequence: Synthetic oligonucleotide
tggagagacacttccataaccaggaggagtc

SEQ ID NO: 74200 - DNA, 30 bp, Artificial Sequence
  Description of Artificial Sequence: Synthetic oligonucleotide
ggagagacacttccataaccaggaggagtc

SEQ ID NO: 74201 - DNA, 30 bp, Artificial Sequence
  Description of Artificial Sequence: Synthetic oligonucleotide
gagagacacttccataaccaggaggagtcc

SEQ ID NO: 74202 - DNA, 30 bp, Artificial Sequence
  Description of Artificial Sequence: Synthetic oligonucleotide
agagacacttccataaccaggaggagtccg

SEQ ID NO: 74203 - DNA, 29 bp, Artificial Sequence
  Description of Artificial Sequence: Synthetic oligonucleotide
gagacacttccataaccaggaggagtccg

SEQ ID NO: 74204 - DNA, 30 bp, Artificial Sequence
  Description of Artificial Sequence: Synthetic oligonucleotide
agacacttccataaccaggaggagtccgtg

SEQ ID NO: 74205 - DNA, 29 bp, Artificial Sequence
  Description of Artificial Sequence: Synthetic oligonucleotide
gacacttccataaccaggaggagtccgtg

SEQ ID NO: 74206 - DNA, 29 bp, Artificial Sequence
  Description of Artificial Sequence: Synthetic oligonucleotide
acacttccataaccaggaggagtccgtgc

SEQ ID NO: 74207 - DNA, 28 bp, Artificial Sequence
  Description of Artificial Sequence: Synthetic oligonucleotide
cacttccataaccaggaggagtccgtgc

SEQ ID NO: 74208 - DNA, 33 bp, Artificial Sequence
  Description of Artificial Sequence: Synthetic oligonucleotide
ctggagagatacttccataaccaggaggagtac

SEQ ID NO: 74209 - DNA, 33 bp, Artificial Sequence
  Description of Artificial Sequence: Synthetic oligonucleotide
tggagagatacttccataaccaggaggagtacg

SEQ ID NO: 74210 - DNA, 32 bp, Artificial Sequence
  Description of Artificial Sequence: Synthetic oligonucleotide
ggagagatacttccataaccaggaggagtacg

SEQ ID NO: 74211 - DNA, 32 bp, Artificial Sequence
  Description of Artificial Sequence: Synthetic oligonucleotide
gagagatacttccataaccaggaggagtacgc

SEQ ID NO: 74212 - DNA, 32 bp, Artificial Sequence
  Description of Artificial Sequence: Synthetic oligonucleotide
agagatacttccataaccaggaggagtacgcg

SEQ ID NO: 74213 - DNA, 31 bp, Artificial Sequence
  Description of Artificial Sequence: Synthetic oligonucleotide
gagatacttccataaccaggaggagtacgcg

SEQ ID NO: 74214 - DNA, 32 bp, Artificial Sequence
  Description of Artificial Sequence: Synthetic oligonucleotide
tggagagacacttccataaccaggaggagaac

SEQ ID NO: 74215 - DNA, 31 bp, Artificial Sequence
  Description of Artificial Sequence: Synthetic oligonucleotide
ggagagacacttccataaccaggaggagaac

SEQ ID NO: 74216 - DNA, 31 bp, Artificial Sequence
  Description of Artificial Sequence: Synthetic oligonucleotide
gagagacacttccataaccaggaggagaacg

SEQ ID NO: 74217 - DNA, 31 bp, Artificial Sequence
  Description of Artificial Sequence: Synthetic oligonucleotide
agagacacttccataaccaggaggagaacgc

SEQ ID NO: 74218 - DNA, 30 bp, Artificial Sequence
  Description of Artificial Sequence: Synthetic oligonucleotide
gagacacttccataaccaggaggagaacgc

SEQ ID NO: 74219 - DNA, 30 bp, Artificial Sequence
  Description of Artificial Sequence: Synthetic oligonucleotide
agacacttccataaccaggaggagaacgcg

SEQ ID NO: 74220 - DNA, 29 bp, Artificial Sequence
  Description of Artificial Sequence: Synthetic oligonucleotide
gacacttccataaccaggaggagaacgcg

SEQ ID NO: 74221 - DNA, 29 bp, Artificial Sequence
  Description of Artificial Sequence: Synthetic oligonucleotide
acacttccataaccaggaggagaacgcgc

SEQ ID NO: 74222 - DNA, 28 bp, Artificial Sequence
  Description of Artificial Sequence: Synthetic oligonucleotide
cacttccataaccaggaggagaacgcgc

SEQ ID NO: 74223 - DNA, 22 bp, Artificial Sequence
  Description of Artificial Sequence: Synthetic oligonucleotide
tgagggagctggggcggcctgt

SEQ ID NO: 74224 - DNA, 21 bp, Artificial Sequence
  Description of Artificial Sequence: Synthetic oligonucleotide
gagggagctggggcggcctgt

SEQ ID NO: 74225 - DNA, 21 bp, Artificial Sequence
  Description of Artificial Sequence: Synthetic oligonucleotide
agggagctggggcggcctgtc

SEQ ID NO: 74226 - DNA, 20 bp, Artificial Sequence
  Description of Artificial Sequence: Synthetic oligonucleotide
gggagctggggcggcctgtc

SEQ ID NO: 74227 - DNA, 22 bp, Artificial Sequence
  Description of Artificial Sequence: Synthetic oligonucleotide
gtgagggagctggggcggccta

SEQ ID NO: 74228 - DNA, 22 bp, Artificial Sequence
  Description of Artificial Sequence: Synthetic oligonucleotide
tgagggagctggggcggcctag

SEQ ID NO: 74229 - DNA, 21 bp, Artificial Sequence
  Description of Artificial Sequence: Synthetic oligonucleotide
gagggagctggggcggcctag

SEQ ID NO: 74230 - DNA, 21 bp, Artificial Sequence
  Description of Artificial Sequence: Synthetic oligonucleotide
agggagctggggcggcctagc

SEQ ID NO: 74231 - DNA, 20 bp, Artificial Sequence
  Description of Artificial Sequence: Synthetic oligonucleotide
gggagctggggcggcctagc

SEQ ID NO: 74232 - DNA, 25 bp, Artificial Sequence
  Description of Artificial Sequence: Synthetic oligonucleotide
acatcctggagcagaagcggggcca

SEQ ID NO: 74233 - DNA, 24 bp, Artificial Sequence
  Description of Artificial Sequence: Synthetic oligonucleotide
catcctggagcagaagcggggcca

SEQ ID NO: 74234 - DNA, 24 bp, Artificial Sequence
  Description of Artificial Sequence: Synthetic oligonucleotide
atcctggagcagaagcggggccag

SEQ ID NO: 74235 - DNA, 33 bp, Artificial Sequence
  Description of Artificial Sequence: Synthetic oligonucleotide
cacgtttcttgcagctgcttaagtctgagtgtc

SEQ ID NO: 74236 - DNA, 37 bp, Artificial Sequence
  Description of Artificial Sequence: Synthetic oligonucleotide
acgtttcttgcagctgcttaagtctgagtgtcatttc

SEQ ID NO: 74237 - DNA, 36 bp, Artificial Sequence
  Description of Artificial Sequence: Synthetic oligonucleotide
cgtttcttgcagctgcttaagtctgagtgtcatttc

SEQ ID NO: 74238 - DNA, 38 bp, Artificial Sequence
  Description of Artificial Sequence: Synthetic oligonucleotide
gtttcttgcagctgcttaagtctgagtgtcatttcttc

SEQ ID NO: 74239 - DNA, 41 bp, Artificial Sequence
  Description of Artificial Sequence: Synthetic oligonucleotide
tttcttgcagctgcttaagtctgagtgtcatttcttcaatg

SEQ ID NO: 74240 - DNA, 40 bp, Artificial Sequence
  Description of Artificial Sequence: Synthetic oligonucleotide
ttcttgcagctgcttaagtctgagtgtcatttcttcaatg

SEQ ID NO: 74241 - DNA, 39 bp, Artificial Sequence
  Description of Artificial Sequence: Synthetic oligonucleotide
tcttgcagctgcttaagtctgagtgtcatttcttcaatg

SEQ ID NO: 74242 - DNA, 38 bp, Artificial Sequence
  Description of Artificial Sequence: Synthetic oligonucleotide
cttgcagctgcttaagtctgagtgtcatttcttcaatg

SEQ ID NO: 74243 - DNA, 38 bp, Artificial Sequence
  Description of Artificial Sequence: Synthetic oligonucleotide
ttgcagctgcttaagtctgagtgtcatttcttcaatgg

SEQ ID NO: 74244 - DNA, 37 bp, Artificial Sequence
  Description of Artificial Sequence: Synthetic oligonucleotide
tgcagctgcttaagtctgagtgtcatttcttcaatgg

SEQ ID NO: 74245 - DNA, 36 bp, Artificial Sequence
  Description of Artificial Sequence: Synthetic oligonucleotide
gcagctgcttaagtctgagtgtcatttcttcaatgg

SEQ ID NO: 74246 - DNA, 36 bp, Artificial Sequence
  Description of Artificial Sequence: Synthetic oligonucleotide
cagctgcttaagtctgagtgtcatttcttcaatggg

SEQ ID NO: 74247 - DNA, 24 bp, Artificial Sequence
  Description of Artificial Sequence: Synthetic oligonucleotide
ttcaatgggacggagcgggtgcgg

SEQ ID NO: 74248 - DNA, 23 bp, Artificial Sequence
  Description of Artificial Sequence: Synthetic oligonucleotide
tcaatgggacggagcgggtgcgg

SEQ ID NO: 74249 - DNA, 22 bp, Artificial Sequence
  Description of Artificial Sequence: Synthetic oligonucleotide
caatgggacggagcgggtgcgg

SEQ ID NO: 74250 - DNA, 23 bp, Artificial Sequence
  Description of Artificial Sequence: Synthetic oligonucleotide
aatgggacggagcgggtgcggct

SEQ ID NO: 74251 - DNA, 22 bp, Artificial Sequence
  Description of Artificial Sequence: Synthetic oligonucleotide
atgggacggagcgggtgcggct

SEQ ID NO: 74252 - DNA, 21 bp, Artificial Sequence
  Description of Artificial Sequence: Synthetic oligonucleotide
tgggacggagcgggtgcggct

SEQ ID NO: 74253 - DNA, 20 bp, Artificial Sequence
  Description of Artificial Sequence: Synthetic oligonucleotide
gggacggagcgggtgcggct

SEQ ID NO: 74254 - DNA, 20 bp, Artificial Sequence
  Description of Artificial Sequence: Synthetic oligonucleotide
ggacggagcgggtgcggctc

SEQ ID NO: 74255 - DNA, 21 bp, Artificial Sequence
  Description of Artificial Sequence: Synthetic oligonucleotide
gacggagcgggtgcggctcct

SEQ ID NO: 74256 - DNA, 21 bp, Artificial Sequence
  Description of Artificial Sequence: Synthetic oligonucleotide
acggagcgggtgcggctcctg

SEQ ID NO: 74257 - DNA, 20 bp, Artificial Sequence
  Description of Artificial Sequence: Synthetic oligonucleotide
cggagcgggtgcggctcctg

SEQ ID NO: 74258 - DNA, 21 bp, Artificial Sequence
  Description of Artificial Sequence: Synthetic oligonucleotide
ggagcgggtgcggctcctgga

SEQ ID NO: 74259 - DNA, 22 bp, Artificial Sequence
  Description of Artificial Sequence: Synthetic oligonucleotide
gagcgggtgcggctcctggaga

SEQ ID NO: 74260 - DNA, 23 bp, Artificial Sequence
  Description of Artificial Sequence: Synthetic oligonucleotide
agcgggtgcggctcctggagaga

SEQ ID NO: 74261 - DNA, 22 bp, Artificial Sequence
  Description of Artificial Sequence: Synthetic oligonucleotide
gcgggtgcggctcctggagaga

SEQ ID NO: 74262 - DNA, 23 bp, Artificial Sequence
  Description of Artificial Sequence: Synthetic oligonucleotide
cgggtgcggctcctggagagaca

SEQ ID NO: 74263 - DNA, 25 bp, Artificial Sequence
  Description of Artificial Sequence: Synthetic oligonucleotide
gggtgcggctcctggagagacactt

SEQ ID NO: 74264 - DNA, 25 bp, Artificial Sequence
  Description of Artificial Sequence: Synthetic oligonucleotide
ggtgcggctcctggagagacacttc

SEQ ID NO: 74265 - DNA, 27 bp, Artificial Sequence
  Description of Artificial Sequence: Synthetic oligonucleotide
gtgcggctcctggagagacacttccat

SEQ ID NO: 74266 - DNA, 29 bp, Artificial Sequence
  Description of Artificial Sequence: Synthetic oligonucleotide
tgcggctcctggagagacacttccataac

SEQ ID NO: 74267 - DNA, 28 bp, Artificial Sequence
  Description of Artificial Sequence: Synthetic oligonucleotide
gcggctcctggagagacacttccataac

SEQ ID NO: 74268 - DNA, 28 bp, Artificial Sequence
  Description of Artificial Sequence: Synthetic oligonucleotide
cggctcctggagagacacttccataacc

SEQ ID NO: 74269 - DNA, 29 bp, Artificial Sequence
  Description of Artificial Sequence: Synthetic oligonucleotide
ggctcctggagagacacttccataaccag

SEQ ID NO: 74270 - DNA, 29 bp, Artificial Sequence
  Description of Artificial Sequence: Synthetic oligonucleotide
gctcctggagagacacttccataaccagg

SEQ ID NO: 74271 - DNA, 30 bp, Artificial Sequence
  Description of Artificial Sequence: Synthetic oligonucleotide
ctcctggagagacacttccataaccaggag

SEQ ID NO: 74272 - DNA, 32 bp, Artificial Sequence
  Description of Artificial Sequence: Synthetic oligonucleotide
gacaattactgcagacacaactacggggttgc

SEQ ID NO: 74273 - DNA, 33 bp, Artificial Sequence
  Description of Artificial Sequence: Synthetic oligonucleotide
acaattactgcagacacaactacggggttgctg

SEQ ID NO: 74274 - DNA, 32 bp, Artificial Sequence
  Description of Artificial Sequence: Synthetic oligonucleotide
caattactgcagacacaactacggggttgctg

SEQ ID NO: 74275 - DNA, 33 bp, Artificial Sequence
  Description of Artificial Sequence: Synthetic oligonucleotide
aattactgcagacacaactacggggttgctgag

SEQ ID NO: 74276 - DNA, 32 bp, Artificial Sequence
  Description of Artificial Sequence: Synthetic oligonucleotide
attactgcagacacaactacggggttgctgag

SEQ ID NO: 74277 - DNA, 31 bp, Artificial Sequence
  Description of Artificial Sequence: Synthetic oligonucleotide
ttactgcagacacaactacggggttgctgag

SEQ ID NO: 74278 - DNA, 30 bp, Artificial Sequence
  Description of Artificial Sequence: Synthetic oligonucleotide
tactgcagacacaactacggggttgctgag

SEQ ID NO: 74279 - DNA, 29 bp, Artificial Sequence
  Description of Artificial Sequence: Synthetic oligonucleotide
actgcagacacaactacggggttgctgag

SEQ ID NO: 74280 - DNA, 28 bp, Artificial Sequence
  Description of Artificial Sequence: Synthetic oligonucleotide
ctgcagacacaactacggggttgctgag

SEQ ID NO: 74281 - DNA, 29 bp, Artificial Sequence
  Description of Artificial Sequence: Synthetic oligonucleotide
tgcagacacaactacggggttgctgagag

SEQ ID NO: 74282 - DNA, 28 bp, Artificial Sequence
  Description of Artificial Sequence: Synthetic oligonucleotide
gcagacacaactacggggttgctgagag

SEQ ID NO: 74283 - DNA, 28 bp, Artificial Sequence
  Description of Artificial Sequence: Synthetic oligonucleotide
cagacacaactacggggttgctgagagc

SEQ ID NO: 74284 - DNA, 30 bp, Artificial Sequence
  Description of Artificial Sequence: Synthetic oligonucleotide
agacacaactacggggttgctgagagcttc

SEQ ID NO: 74285 - DNA, 29 bp, Artificial Sequence
  Description of Artificial Sequence: Synthetic oligonucleotide
gacacaactacggggttgctgagagcttc

SEQ ID NO: 74286 - DNA, 30 bp, Artificial Sequence
  Description of Artificial Sequence: Synthetic oligonucleotide
acacaactacggggttgctgagagcttcac

SEQ ID NO: 74287 - DNA, 29 bp, Artificial Sequence
  Description of Artificial Sequence: Synthetic oligonucleotide
cacaactacggggttgctgagagcttcac

SEQ ID NO: 74288 - DNA, 30 bp, Artificial Sequence
  Description of Artificial Sequence: Synthetic oligonucleotide
acaactacggggttgctgagagcttcacag

SEQ ID NO: 74289 - DNA, 29 bp, Artificial Sequence
  Description of Artificial Sequence: Synthetic oligonucleotide
caactacggggttgctgagagcttcacag

SEQ ID NO: 74290 - DNA, 30 bp, Artificial Sequence
  Description of Artificial Sequence: Synthetic oligonucleotide
aactacggggttgctgagagcttcacagtg

SEQ ID NO: 74291 - DNA, 29 bp, Artificial Sequence
  Description of Artificial Sequence: Synthetic oligonucleotide
actacggggttgctgagagcttcacagtg

SEQ ID NO: 74292 - DNA, 28 bp, Artificial Sequence
  Description of Artificial Sequence: Synthetic oligonucleotide
ctacggggttgctgagagcttcacagtg

SEQ ID NO: 74293 - DNA, 28 bp, Artificial Sequence
  Description of Artificial Sequence: Synthetic oligonucleotide
tacggggttgctgagagcttcacagtgc

SEQ ID NO: 74294 - DNA, 27 bp, Artificial Sequence
  Description of Artificial Sequence: Synthetic oligonucleotide
acggggttgctgagagcttcacagtgc

SEQ ID NO: 74295 - DNA, 27 bp, Artificial Sequence
  Description of Artificial Sequence: Synthetic oligonucleotide
cggggttgctgagagcttcacagtgca

SEQ ID NO: 74296 - DNA, 27 bp, Artificial Sequence
  Description of Artificial Sequence: Synthetic oligonucleotide
ggggttgctgagagcttcacagtgcag

SEQ ID NO: 74297 - DNA, 27 bp, Artificial Sequence
  Description of Artificial Sequence: Synthetic oligonucleotide
gggttgctgagagcttcacagtgcagc

SEQ ID NO: 74298 - DNA, 27 bp, Artificial Sequence
  Description of Artificial Sequence: Synthetic oligonucleotide
ggttgctgagagcttcacagtgcagcg

SEQ ID NO: 74299 - DNA, 27 bp, Artificial Sequence
  Description of Artificial Sequence: Synthetic oligonucleotide
gttgctgagagcttcacagtgcagcgg

SEQ ID NO: 74300 - DNA, 27 bp, Artificial Sequence
  Description of Artificial Sequence: Synthetic oligonucleotide
ttgctgagagcttcacagtgcagcggc

SEQ ID NO: 74301 - DNA, 26 bp, Artificial Sequence
  Description of Artificial Sequence: Synthetic oligonucleotide
tgctgagagcttcacagtgcagcggc

SEQ ID NO: 74302 - DNA, 25 bp, Artificial Sequence
  Description of Artificial Sequence: Synthetic oligonucleotide
gctgagagcttcacagtgcagcggc

SEQ ID NO: 74303 - DNA, 26 bp, Artificial Sequence
  Description of Artificial Sequence: Synthetic oligonucleotide
ctgagagcttcacagtgcagcggcga

SEQ ID NO: 74304 - DNA, 32 bp, Artificial Sequence
  Description of Artificial Sequence: Synthetic oligonucleotide
agagacacttccataaccaggaggagaacgtg

SEQ ID NO: 74305 - DNA, 31 bp, Artificial Sequence
  Description of Artificial Sequence: Synthetic oligonucleotide
gagacacttccataaccaggaggagaacgtg

SEQ ID NO: 74306 - DNA, 31 bp, Artificial Sequence
  Description of Artificial Sequence: Synthetic oligonucleotide
agacacttccataaccaggaggagaacgtgc

SEQ ID NO: 74307 - DNA, 30 bp, Artificial Sequence
  Description of Artificial Sequence: Synthetic oligonucleotide
gacacttccataaccaggaggagaacgtgc

SEQ ID NO: 74308 - DNA, 30 bp, Artificial Sequence
  Description of Artificial Sequence: Synthetic oligonucleotide
acacttccataaccaggaggagaacgtgcg

SEQ ID NO: 74309 - DNA, 29 bp, Artificial Sequence
  Description of Artificial Sequence: Synthetic oligonucleotide
cacttccataaccaggaggagaacgtgcg

SEQ ID NO: 74310 - DNA, 21 bp, Artificial Sequence
  Description of Artificial Sequence: Synthetic oligonucleotide
ggcggtgagggagctggggct

SEQ ID NO: 74311 - DNA, 21 bp, Artificial Sequence
  Description of Artificial Sequence: Synthetic oligonucleotide
gcggtgagggagctggggctg

SEQ ID NO: 74312 - DNA, 21 bp, Artificial Sequence
  Description of Artificial Sequence: Synthetic oligonucleotide
cggtgagggagctggggctgc

SEQ ID NO: 74313 - DNA, 22 bp, Artificial Sequence
  Description of Artificial Sequence: Synthetic oligonucleotide
ggtgagggagctggggctgcct

SEQ ID NO: 74314 - DNA, 24 bp, Artificial Sequence
  Description of Artificial Sequence: Synthetic oligonucleotide
gtgagggagctggggctgcctgat

SEQ ID NO: 74315 - DNA, 24 bp, Artificial Sequence
  Description of Artificial Sequence: Synthetic oligonucleotide
tgagggagctggggctgcctgatg

SEQ ID NO: 74316 - DNA, 23 bp, Artificial Sequence
  Description of Artificial Sequence: Synthetic oligonucleotide
gagggagctggggctgcctgatg

SEQ ID NO: 74317 - DNA, 23 bp, Artificial Sequence
  Description of Artificial Sequence: Synthetic oligonucleotide
agggagctggggctgcctgatgc

SEQ ID NO: 74318 - DNA, 22 bp, Artificial Sequence
  Description of Artificial Sequence: Synthetic oligonucleotide
gggagctggggctgcctgatgc

SEQ ID NO: 74319 - DNA, 22 bp, Artificial Sequence
  Description of Artificial Sequence: Synthetic oligonucleotide
ggagctggggctgcctgatgcc

SEQ ID NO: 74320 - DNA, 23 bp, Artificial Sequence
  Description of Artificial Sequence: Synthetic oligonucleotide
gagctggggctgcctgatgccga

SEQ ID NO: 74321 - DNA, 25 bp, Artificial Sequence
  Description of Artificial Sequence: Synthetic oligonucleotide
agctggggctgcctgatgccgagta

SEQ ID NO: 74322 - DNA, 24 bp, Artificial Sequence
  Description of Artificial Sequence: Synthetic oligonucleotide
gctggggctgcctgatgccgagta

SEQ ID NO: 74323 - DNA, 25 bp, Artificial Sequence
  Description of Artificial Sequence: Synthetic oligonucleotide
ctggggctgcctgatgccgagtact

SEQ ID NO: 74324 - DNA, 25 bp, Artificial Sequence
  Description of Artificial Sequence: Synthetic oligonucleotide
tggggctgcctgatgccgagtactg

SEQ ID NO: 74325 - DNA, 24 bp, Artificial Sequence
  Description of Artificial Sequence: Synthetic oligonucleotide
ggggctgcctgatgccgagtactg

SEQ ID NO: 74326 - DNA, 26 bp, Artificial Sequence
  Description of Artificial Sequence: Synthetic oligonucleotide
gggctgcctgatgccgagtactggaa

SEQ ID NO: 74327 - DNA, 27 bp, Artificial Sequence
  Description of Artificial Sequence: Synthetic oligonucleotide
ggctgcctgatgccgagtactggaaca

SEQ ID NO: 74328 - DNA, 27 bp, Artificial Sequence
  Description of Artificial Sequence: Synthetic oligonucleotide
gctgcctgatgccgagtactggaacag

SEQ ID NO: 74329 - DNA, 27 bp, Artificial Sequence
  Description of Artificial Sequence: Synthetic oligonucleotide
ctgcctgatgccgagtactggaacagc

SEQ ID NO: 74330 - DNA, 27 bp, Artificial Sequence
  Description of Artificial Sequence: Synthetic oligonucleotide
tgcctgatgccgagtactggaacagcc

SEQ ID NO: 74331 - DNA, 27 bp, Artificial Sequence
  Description of Artificial Sequence: Synthetic oligonucleotide
gggtggtgtccacaggcctgatccata

SEQ ID NO: 74332 - DNA, 29 bp, Artificial Sequence
  Description of Artificial Sequence: Synthetic oligonucleotide
ggtggtgtccacaggcctgatccataatg

SEQ ID NO: 74333 - DNA, 29 bp, Artificial Sequence
  Description of Artificial Sequence: Synthetic oligonucleotide
gtggtgtccacaggcctgatccataatgg

SEQ ID NO: 74334 - DNA, 30 bp, Artificial Sequence
  Description of Artificial Sequence: Synthetic oligonucleotide
tggtgtccacaggcctgatccataatggag

SEQ ID NO: 74335 - DNA, 29 bp, Artificial Sequence
  Description of Artificial Sequence: Synthetic oligonucleotide
ggtgtccacaggcctgatccataatggag

SEQ ID NO: 74336 - DNA, 30 bp, Artificial Sequence
  Description of Artificial Sequence: Synthetic oligonucleotide
gtgtccacaggcctgatccataatggagac

SEQ ID NO: 74337 - DNA, 31 bp, Artificial Sequence
  Description of Artificial Sequence: Synthetic oligonucleotide
tgtccacaggcctgatccataatggagactg

SEQ ID NO: 74338 - DNA, 30 bp, Artificial Sequence
  Description of Artificial Sequence: Synthetic oligonucleotide
gtccacaggcctgatccataatggagactg

SEQ ID NO: 74339 - DNA, 30 bp, Artificial Sequence
  Description of Artificial Sequence: Synthetic oligonucleotide
tccacaggcctgatccataatggagactgg

SEQ ID NO: 74340 - DNA, 29 bp, Artificial Sequence
  Description of Artificial Sequence: Synthetic oligonucleotide
ccacaggcctgatccataatggagactgg

SEQ ID NO: 74341 - DNA, 30 bp, Artificial Sequence
  Description of Artificial Sequence: Synthetic oligonucleotide
cacaggcctgatccataatggagactggac

SEQ ID NO: 74342 - DNA, 30 bp, Artificial Sequence
  Description of Artificial Sequence: Synthetic oligonucleotide
acaggcctgatccataatggagactggacc

SEQ ID NO: 74343 - DNA, 29 bp, Artificial Sequence
  Description of Artificial Sequence: Synthetic oligonucleotide
caggcctgatccataatggagactggacc

SEQ ID NO: 74344 - DNA, 31 bp, Artificial Sequence
  Description of Artificial Sequence: Synthetic oligonucleotide
aggcctgatccataatggagactggaccttc

SEQ ID NO: 74345 - DNA, 30 bp, Artificial Sequence
  Description of Artificial Sequence: Synthetic oligonucleotide
ggcctgatccataatggagactggaccttc

SEQ ID NO: 74346 - DNA, 30 bp, Artificial Sequence
  Description of Artificial Sequence: Synthetic oligonucleotide
gcctgatccataatggagactggaccttcc

SEQ ID NO: 74347 - DNA, 31 bp, Artificial Sequence
  Description of Artificial Sequence: Synthetic oligonucleotide
cctgatccataatggagactggaccttccag

SEQ ID NO: 74348 - DNA, 32 bp, Artificial Sequence
  Description of Artificial Sequence: Synthetic oligonucleotide
ctgatccataatggagactggaccttccagac

SEQ ID NO: 74349 - DNA, 32 bp, Artificial Sequence
  Description of Artificial Sequence: Synthetic oligonucleotide
tgatccataatggagactggaccttccagacc

SEQ ID NO: 74350 - DNA, 31 bp, Artificial Sequence
  Description of Artificial Sequence: Synthetic oligonucleotide
gatccataatggagactggaccttccagacc

SEQ ID NO: 74351 - DNA, 31 bp, Artificial Sequence
  Description of Artificial Sequence: Synthetic oligonucleotide
atccataatggagactggaccttccagaccc

SEQ ID NO: 74352 - DNA, 30 bp, Artificial Sequence
  Description of Artificial Sequence: Synthetic oligonucleotide
tccataatggagactggaccttccagaccc

SEQ ID NO: 74353 - DNA, 29 bp, Artificial Sequence
  Description of Artificial Sequence: Synthetic oligonucleotide
ccataatggagactggaccttccagaccc

SEQ ID NO: 74354 - DNA, 30 bp, Artificial Sequence
  Description of Artificial Sequence: Synthetic oligonucleotide
cataatggagactggaccttccagaccctg

SEQ ID NO: 74355 - DNA, 30 bp, Artificial Sequence
  Description of Artificial Sequence: Synthetic oligonucleotide
ataatggagactggaccttccagaccctgg

SEQ ID NO: 74356 - DNA, 29 bp, Artificial Sequence
  Description of Artificial Sequence: Synthetic oligonucleotide
taatggagactggaccttccagaccctgg

SEQ ID NO: 74357 - DNA, 30 bp, Artificial Sequence
  Description of Artificial Sequence: Synthetic oligonucleotide
ttgccaagtggagcacccaagcgtaacaag

SEQ ID NO: 74358 - DNA, 29 bp, Artificial Sequence
  Description of Artificial Sequence: Synthetic oligonucleotide
tgccaagtggagcacccaagcgtaacaag

SEQ ID NO: 74359 - DNA, 28 bp, Artificial Sequence
  Description of Artificial Sequence: Synthetic oligonucleotide
gccaagtggagcacccaagcgtaacaag

SEQ ID NO: 74360 - DNA, 28 bp, Artificial Sequence
  Description of Artificial Sequence: Synthetic oligonucleotide
ccaagtggagcacccaagcgtaacaagc

SEQ ID NO: 74361 - DNA, 28 bp, Artificial Sequence
  Description of Artificial Sequence: Synthetic oligonucleotide
caagtggagcacccaagcgtaacaagcc

SEQ ID NO: 74362 - DNA, 28 bp, Artificial Sequence
  Description of Artificial Sequence: Synthetic oligonucleotide
aagtggagcacccaagcgtaacaagccc

SEQ ID NO: 74363 - DNA, 27 bp, Artificial Sequence
  Description of Artificial Sequence: Synthetic oligonucleotide
agtggagcacccaagcgtaacaagccc

SEQ ID NO: 74364 - DNA, 27 bp, Artificial Sequence
  Description of Artificial Sequence: Synthetic oligonucleotide
gtggagcacccaagcgtaacaagccct

SEQ ID NO: 74365 - DNA, 27 bp, Artificial Sequence
  Description of Artificial Sequence: Synthetic oligonucleotide
tggagcacccaagcgtaacaagccctc

SEQ ID NO: 74366 - DNA, 27 bp, Artificial Sequence
  Description of Artificial Sequence: Synthetic oligonucleotide
ggagcacccaagcgtaacaagccctct

SEQ ID NO: 74367 - DNA, 27 bp, Artificial Sequence
  Description of Artificial Sequence: Synthetic oligonucleotide
gagcacccaagcgtaacaagccctctc

SEQ ID NO: 74368 - DNA, 28 bp, Artificial Sequence
  Description of Artificial Sequence: Synthetic oligonucleotide
agcacccaagcgtaacaagccctctcac

SEQ ID NO: 74369 - DNA, 27 bp, Artificial Sequence
  Description of Artificial Sequence: Synthetic oligonucleotide
gcacccaagcgtaacaagccctctcac

SEQ ID NO: 74370 - DNA, 28 bp, Artificial Sequence
  Description of Artificial Sequence: Synthetic oligonucleotide
cacccaagcgtaacaagccctctcacag

SEQ ID NO: 74371 - DNA, 29 bp, Artificial Sequence
  Description of Artificial Sequence: Synthetic oligonucleotide
acccaagcgtaacaagccctctcacagtg

SEQ ID NO: 74372 - DNA, 28 bp, Artificial Sequence
  Description of Artificial Sequence: Synthetic oligonucleotide
cccaagcgtaacaagccctctcacagtg

SEQ ID NO: 74373 - DNA, 28 bp, Artificial Sequence
  Description of Artificial Sequence: Synthetic oligonucleotide
ccaagcgtaacaagccctctcacagtgg

SEQ ID NO: 74374 - DNA, 31 bp, Artificial Sequence
  Description of Artificial Sequence: Synthetic oligonucleotide
caagcgtaacaagccctctcacagtggaatg

SEQ ID NO: 74375 - DNA, 31 bp, Artificial Sequence
  Description of Artificial Sequence: Synthetic oligonucleotide
aagcgtaacaagccctctcacagtggaatgg

SEQ ID NO: 74376 - DNA, 30 bp, Artificial Sequence
  Description of Artificial Sequence: Synthetic oligonucleotide
agcgtaacaagccctctcacagtggaatgg

SEQ ID NO: 74377 - DNA, 29 bp, Artificial Sequence
  Description of Artificial Sequence: Synthetic oligonucleotide
gcgtaacaagccctctcacagtggaatgg

SEQ ID NO: 74378 - DNA, 30 bp, Artificial Sequence
  Description of Artificial Sequence: Synthetic oligonucleotide
cgtaacaagccctctcacagtggaatggag

SEQ ID NO: 74379 - DNA, 31 bp, Artificial Sequence
  Description of Artificial Sequence: Synthetic oligonucleotide
gtaacaagccctctcacagtggaatggagag

SEQ ID NO: 74380 - DNA, 31 bp, Artificial Sequence
  Description of Artificial Sequence: Synthetic oligonucleotide
taacaagccctctcacagtggaatggagagc

SEQ ID NO: 74381 - DNA, 30 bp, Artificial Sequence
  Description of Artificial Sequence: Synthetic oligonucleotide
aacaagccctctcacagtggaatggagagc

SEQ ID NO: 74382 - DNA, 32 bp, Artificial Sequence
  Description of Artificial Sequence: Synthetic oligonucleotide
aggtggacaattactgcagacacaactacggc

SEQ ID NO: 74383 - DNA, 31 bp, Artificial Sequence
  Description of Artificial Sequence: Synthetic oligonucleotide
ggtggacaattactgcagacacaactacggc

SEQ ID NO: 74384 - DNA, 31 bp, Artificial Sequence
  Description of Artificial Sequence: Synthetic oligonucleotide
gtggacaattactgcagacacaactacggcg

SEQ ID NO: 74385 - DNA, 33 bp, Artificial Sequence
  Description of Artificial Sequence: Synthetic oligonucleotide
tggacaattactgcagacacaactacggcgttg

SEQ ID NO: 74386 - DNA, 32 bp, Artificial Sequence
  Description of Artificial Sequence: Synthetic oligonucleotide
ggacaattactgcagacacaactacggcgttg

SEQ ID NO: 74387 - DNA, 33 bp, Artificial Sequence
  Description of Artificial Sequence: Synthetic oligonucleotide
gacaattactgcagacacaactacggcgttgtg

SEQ ID NO: 74388 - DNA, 33 bp, Artificial Sequence
  Description of Artificial Sequence: Synthetic oligonucleotide
acaattactgcagacacaactacggcgttgtgg

SEQ ID NO: 74389 - DNA, 32 bp, Artificial Sequence
  Description of Artificial Sequence: Synthetic oligonucleotide
caattactgcagacacaactacggcgttgtgg

SEQ ID NO: 74390 - DNA, 33 bp, Artificial Sequence
  Description of Artificial Sequence: Synthetic oligonucleotide
aattactgcagacacaactacggcgttgtggag

SEQ ID NO: 74391 - DNA, 32 bp, Artificial Sequence
  Description of Artificial Sequence: Synthetic oligonucleotide
attactgcagacacaactacggcgttgtggag

SEQ ID NO: 74392 - DNA, 31 bp, Artificial Sequence
  Description of Artificial Sequence: Synthetic oligonucleotide
ttactgcagacacaactacggcgttgtggag

SEQ ID NO: 74393 - DNA, 30 bp, Artificial Sequence
  Description of Artificial Sequence: Synthetic oligonucleotide
tactgcagacacaactacggcgttgtggag

SEQ ID NO: 74394 - DNA, 29 bp, Artificial Sequence
  Description of Artificial Sequence: Synthetic oligonucleotide
actgcagacacaactacggcgttgtggag

SEQ ID NO: 74395 - DNA, 28 bp, Artificial Sequence
  Description of Artificial Sequence: Synthetic oligonucleotide
ctgcagacacaactacggcgttgtggag

SEQ ID NO: 74396 - DNA, 29 bp, Artificial Sequence
  Description of Artificial Sequence: Synthetic oligonucleotide
tgcagacacaactacggcgttgtggagag

SEQ ID NO: 74397 - DNA, 28 bp, Artificial Sequence
  Description of Artificial Sequence: Synthetic oligonucleotide
gcagacacaactacggcgttgtggagag

SEQ ID NO: 74398 - DNA, 28 bp, Artificial Sequence
  Description of Artificial Sequence: Synthetic oligonucleotide
cagacacaactacggcgttgtggagagc

SEQ ID NO: 74399 - DNA, 30 bp, Artificial Sequence
  Description of Artificial Sequence: Synthetic oligonucleotide
agacacaactacggcgttgtggagagcttc

SEQ ID NO: 74400 - DNA, 29 bp, Artificial Sequence
  Description of Artificial Sequence: Synthetic oligonucleotide
gacacaactacggcgttgtggagagcttc

SEQ ID NO: 74401 - DNA, 30 bp, Artificial Sequence
  Description of Artificial Sequence: Synthetic oligonucleotide
acacaactacggcgttgtggagagcttcac

SEQ ID NO: 74402 - DNA, 29 bp, Artificial Sequence
  Description of Artificial Sequence: Synthetic oligonucleotide
cacaactacggcgttgtggagagcttcac

SEQ ID NO: 74403 - DNA, 30 bp, Artificial Sequence
  Description of Artificial Sequence: Synthetic oligonucleotide
acaactacggcgttgtggagagcttcacag

SEQ ID NO: 74404 - DNA, 29 bp, Artificial Sequence
  Description of Artificial Sequence: Synthetic oligonucleotide
caactacggcgttgtggagagcttcacag

SEQ ID NO: 74405 - DNA, 30 bp, Artificial Sequence
  Description of Artificial Sequence: Synthetic oligonucleotide
aactacggcgttgtggagagcttcacagtg

SEQ ID NO: 74406 - DNA, 29 bp, Artificial Sequence
  Description of Artificial Sequence: Synthetic oligonucleotide
actacggcgttgtggagagcttcacagtg

SEQ ID NO: 74407 - DNA, 28 bp, Artificial Sequence
  Description of Artificial Sequence: Synthetic oligonucleotide
ctacggcgttgtggagagcttcacagtg

SEQ ID NO: 74408 - DNA, 28 bp, Artificial Sequence
  Description of Artificial Sequence: Synthetic oligonucleotide
tacggcgttgtggagagcttcacagtgc

SEQ ID NO: 74409 - DNA, 27 bp, Artificial Sequence
  Description of Artificial Sequence: Synthetic oligonucleotide
acggcgttgtggagagcttcacagtgc

SEQ ID NO: 74410 - DNA, 27 bp, Artificial Sequence
  Description of Artificial Sequence: Synthetic oligonucleotide
cggcgttgtggagagcttcacagtgca

SEQ ID NO: 74411 - DNA, 27 bp, Artificial Sequence
  Description of Artificial Sequence: Synthetic oligonucleotide
ggcgttgtggagagcttcacagtgcag

SEQ ID NO: 74412 - DNA, 27 bp, Artificial Sequence
  Description of Artificial Sequence: Synthetic oligonucleotide
gcgttgtggagagcttcacagtgcagc

SEQ ID NO: 74413 - DNA, 27 bp, Artificial Sequence
  Description of Artificial Sequence: Synthetic oligonucleotide
cgttgtggagagcttcacagtgcagcg

SEQ ID NO: 74414 - DNA, 27 bp, Artificial Sequence
  Description of Artificial Sequence: Synthetic oligonucleotide
tgtctgaagctccctggaggctcctgt

SEQ ID NO: 74415 - DNA, 27 bp, Artificial Sequence
  Description of Artificial Sequence: Synthetic oligonucleotide
gtctgaagctccctggaggctcctgta

SEQ ID NO: 74416 - DNA, 28 bp, Artificial Sequence
  Description of Artificial Sequence: Synthetic oligonucleotide
tctgaagctccctggaggctcctgtatg

SEQ ID NO: 74417 - DNA, 27 bp, Artificial Sequence
  Description of Artificial Sequence: Synthetic oligonucleotide
ctgaagctccctggaggctcctgtatg

SEQ ID NO: 74418 - DNA, 27 bp, Artificial Sequence
  Description of Artificial Sequence: Synthetic oligonucleotide
tgaagctccctggaggctcctgtatgg

SEQ ID NO: 74419 - DNA, 26 bp, Artificial Sequence
  Description of Artificial Sequence: Synthetic oligonucleotide
gaagctccctggaggctcctgtatgg

SEQ ID NO: 74420 - DNA, 27 bp, Artificial Sequence
  Description of Artificial Sequence: Synthetic oligonucleotide
aagctccctggaggctcctgtatggca

SEQ ID NO: 74421 - DNA, 26 bp, Artificial Sequence
  Description of Artificial Sequence: Synthetic oligonucleotide
agctccctggaggctcctgtatggca

SEQ ID NO: 74422 - DNA, 25 bp, Artificial Sequence
  Description of Artificial Sequence: Synthetic oligonucleotide
gctccctggaggctcctgtatggca

SEQ ID NO: 74423 - DNA, 25 bp, Artificial Sequence
  Description of Artificial Sequence: Synthetic oligonucleotide
ctccctggaggctcctgtatggcag

SEQ ID NO: 74424 - DNA, 25 bp, Artificial Sequence
  Description of Artificial Sequence: Synthetic oligonucleotide
tccctggaggctcctgtatggcagc

SEQ ID NO: 74425 - DNA, 24 bp, Artificial Sequence
  Description of Artificial Sequence: Synthetic oligonucleotide
ccctggaggctcctgtatggcagc

SEQ ID NO: 74426 - DNA, 24 bp, Artificial Sequence
  Description of Artificial Sequence: Synthetic oligonucleotide
cctggaggctcctgtatggcagcg

SEQ ID NO: 74427 - DNA, 25 bp, Artificial Sequence
  Description of Artificial Sequence: Synthetic oligonucleotide
ctggaggctcctgtatggcagcgct

SEQ ID NO: 74428 - DNA, 26 bp, Artificial Sequence
  Description of Artificial Sequence: Synthetic oligonucleotide
tggaggctcctgtatggcagcgctga

SEQ ID NO: 74429 - DNA, 25 bp, Artificial Sequence
  Description of Artificial Sequence: Synthetic oligonucleotide
ggaggctcctgtatggcagcgctga

SEQ ID NO: 74430 - DNA, 26 bp, Artificial Sequence
  Description of Artificial Sequence: Synthetic oligonucleotide
gaggctcctgtatggcagcgctgaca

SEQ ID NO: 74431 - DNA, 27 bp, Artificial Sequence
  Description of Artificial Sequence: Synthetic oligonucleotide
aggctcctgtatggcagcgctgacagt

SEQ ID NO: 74432 - DNA, 26 bp, Artificial Sequence
  Description of Artificial Sequence: Synthetic oligonucleotide
ggctcctgtatggcagcgctgacagt

SEQ ID NO: 74433 - DNA, 27 bp, Artificial Sequence
  Description of Artificial Sequence: Synthetic oligonucleotide
gctcctgtatggcagcgctgacagtga

SEQ ID NO: 74434 - DNA, 27 bp, Artificial Sequence
  Description of Artificial Sequence: Synthetic oligonucleotide
ctcctgtatggcagcgctgacagtgac

SEQ ID NO: 74435 - DNA, 30 bp, Artificial Sequence
  Description of Artificial Sequence: Synthetic oligonucleotide
tcctgtatggcagcgctgacagtgacattg

SEQ ID NO: 74436 - DNA, 29 bp, Artificial Sequence
  Description of Artificial Sequence: Synthetic oligonucleotide
cctgtatggcagcgctgacagtgacattg

SEQ ID NO: 74437 - DNA, 30 bp, Artificial Sequence
  Description of Artificial Sequence: Synthetic oligonucleotide
ctgtatggcagcgctgacagtgacattgac

SEQ ID NO: 74438 - DNA, 30 bp, Artificial Sequence
  Description of Artificial Sequence: Synthetic oligonucleotide
tgtatggcagcgctgacagtgacattgacg

SEQ ID NO: 74439 - DNA, 29 bp, Artificial Sequence
  Description of Artificial Sequence: Synthetic oligonucleotide
gtatggcagcgctgacagtgacattgacg

SEQ ID NO: 74440 - DNA, 29 bp, Artificial Sequence
  Description of Artificial Sequence: Synthetic oligonucleotide
tatggcagcgctgacagtgacattgacgg

SEQ ID NO: 74441 - DNA, 28 bp, Artificial Sequence
  Description of Artificial Sequence: Synthetic oligonucleotide
atggcagcgctgacagtgacattgacgg

SEQ ID NO: 74442 - DNA, 27 bp, Artificial Sequence
  Description of Artificial Sequence: Synthetic oligonucleotide
tggcagcgctgacagtgacattgacgg

SEQ ID NO: 74443 - DNA, 27 bp, Artificial Sequence
  Description of Artificial Sequence: Synthetic oligonucleotide
ggcagcgctgacagtgacattgacggt

SEQ ID NO: 74444 - DNA, 27 bp, Artificial Sequence
  Description of Artificial Sequence: Synthetic oligonucleotide
gcagcgctgacagtgacattgacggtg

SEQ ID NO: 74445 - DNA, 27 bp, Artificial Sequence
  Description of Artificial Sequence: Synthetic oligonucleotide
cagcgctgacagtgacattgacggtgc

SEQ ID NO: 74446 - DNA, 28 bp, Artificial Sequence
  Description of Artificial Sequence: Synthetic oligonucleotide
agcgctgacagtgacattgacggtgctg

SEQ ID NO: 74447 - DNA, 27 bp, Artificial Sequence
  Description of Artificial Sequence: Synthetic oligonucleotide
gcgctgacagtgacattgacggtgctg

SEQ ID NO: 74448 - DNA, 28 bp, Artificial Sequence
  Description of Artificial Sequence: Synthetic oligonucleotide
cgctgacagtgacattgacggtgctgag

SEQ ID NO: 74449 - DNA, 28 bp, Artificial Sequence
  Description of Artificial Sequence: Synthetic oligonucleotide
gctgacagtgacattgacggtgctgagc

SEQ ID NO: 74450 - DNA, 29 bp, Artificial Sequence
  Description of Artificial Sequence: Synthetic oligonucleotide
ctgacagtgacattgacggtgctgagctc

SEQ ID NO: 74451 - DNA, 29 bp, Artificial Sequence
  Description of Artificial Sequence: Synthetic oligonucleotide
tgacagtgacattgacggtgctgagctcc

SEQ ID NO: 74452 - DNA, 28 bp, Artificial Sequence
  Description of Artificial Sequence: Synthetic oligonucleotide
gacagtgacattgacggtgctgagctcc

SEQ ID NO: 74453 - DNA, 28 bp, Artificial Sequence
  Description of Artificial Sequence: Synthetic oligonucleotide
acagtgacattgacggtgctgagctccc

SEQ ID NO: 74454 - DNA, 27 bp, Artificial Sequence
  Description of Artificial Sequence: Synthetic oligonucleotide
cagtgacattgacggtgctgagctccc

SEQ ID NO: 74455 - DNA, 27 bp, Artificial Sequence
  Description of Artificial Sequence: Synthetic oligonucleotide
agtgacattgacggtgctgagctcccc

SEQ ID NO: 74456 - DNA, 27 bp, Artificial Sequence
  Description of Artificial Sequence: Synthetic oligonucleotide
gtgacattgacggtgctgagctcccca

SEQ ID NO: 74457 - DNA, 27 bp, Artificial Sequence
  Description of Artificial Sequence: Synthetic oligonucleotide
tgacattgacggtgctgagctccccac

SEQ ID NO: 74458 - DNA, 27 bp, Artificial Sequence
  Description of Artificial Sequence: Synthetic oligonucleotide
gacattgacggtgctgagctccccact

SEQ ID NO: 74459 - DNA, 27 bp, Artificial Sequence
  Description of Artificial Sequence: Synthetic oligonucleotide
acattgacggtgctgagctccccactg

SEQ ID NO: 74460 - DNA, 26 bp, Artificial Sequence
  Description of Artificial Sequence: Synthetic oligonucleotide
cattgacggtgctgagctccccactg

SEQ ID NO: 74461 - DNA, 26 bp, Artificial Sequence
  Description of Artificial Sequence: Synthetic oligonucleotide
attgacggtgctgagctccccactgg

SEQ ID NO: 74462 - DNA, 25 bp, Artificial Sequence
  Description of Artificial Sequence: Synthetic oligonucleotide
ttgacggtgctgagctccccactgg

SEQ ID NO: 74463 - DNA, 24 bp, Artificial Sequence
  Description of Artificial Sequence: Synthetic oligonucleotide
tgacggtgctgagctccccactgg

SEQ ID NO: 74464 - DNA, 23 bp, Artificial Sequence
  Description of Artificial Sequence: Synthetic oligonucleotide
gacggtgctgagctccccactgg

SEQ ID NO: 74465 - DNA, 26 bp, Artificial Sequence
  Description of Artificial Sequence: Synthetic oligonucleotide
acggtgctgagctccccactggcttt

SEQ ID NO: 74466 - DNA, 25 bp, Artificial Sequence
  Description of Artificial Sequence: Synthetic oligonucleotide
cggtgctgagctccccactggcttt

SEQ ID NO: 74467 - DNA, 27 bp, Artificial Sequence
  Description of Artificial Sequence: Synthetic oligonucleotide
ctggggacacccaaccacgtttcttgg

SEQ ID NO: 74468 - DNA, 28 bp, Artificial Sequence
  Description of Artificial Sequence: Synthetic oligonucleotide
tggggacacccaaccacgtttcttggag

SEQ ID NO: 74469 - DNA, 27 bp, Artificial Sequence
  Description of Artificial Sequence: Synthetic oligonucleotide
ggggacacccaaccacgtttcttggag

SEQ ID NO: 74470 - DNA, 27 bp, Artificial Sequence
  Description of Artificial Sequence: Synthetic oligonucleotide
gggacacccaaccacgtttcttggagc

SEQ ID NO: 74471 - DNA, 28 bp, Artificial Sequence
  Description of Artificial Sequence: Synthetic oligonucleotide
ggacacccaaccacgtttcttggagcag

SEQ ID NO: 74472 - DNA, 28 bp, Artificial Sequence
  Description of Artificial Sequence: Synthetic oligonucleotide
gacacccaaccacgtttcttggagcagg

SEQ ID NO: 74473 - DNA, 28 bp, Artificial Sequence
  Description of Artificial Sequence: Synthetic oligonucleotide
acacccaaccacgtttcttggagcaggc

SEQ ID NO: 74474 - DNA, 27 bp, Artificial Sequence
  Description of Artificial Sequence: Synthetic oligonucleotide
cacccaaccacgtttcttggagcaggc

SEQ ID NO: 74475 - DNA, 30 bp, Artificial Sequence
  Description of Artificial Sequence: Synthetic oligonucleotide
acccaaccacgtttcttggagcaggctaag

SEQ ID NO: 74476 - DNA, 29 bp, Artificial Sequence
  Description of Artificial Sequence: Synthetic oligonucleotide
cccaaccacgtttcttggagcaggctaag

SEQ ID NO: 74477 - DNA, 30 bp, Artificial Sequence
  Description of Artificial Sequence: Synthetic oligonucleotide
ccaaccacgtttcttggagcaggctaagtg

SEQ ID NO: 74478 - DNA, 31 bp, Artificial Sequence
  Description of Artificial Sequence: Synthetic oligonucleotide
caaccacgtttcttggagcaggctaagtgtg

SEQ ID NO: 74479 - DNA, 32 bp, Artificial Sequence
  Description of Artificial Sequence: Synthetic oligonucleotide
aaccacgtttcttggagcaggctaagtgtgag

SEQ ID NO: 74480 - DNA, 31 bp, Artificial Sequence
  Description of Artificial Sequence: Synthetic oligonucleotide
accacgtttcttggagcaggctaagtgtgag

SEQ ID NO: 74481 - DNA, 30 bp, Artificial Sequence
  Description of Artificial Sequence: Synthetic oligonucleotide
ccacgtttcttggagcaggctaagtgtgag

SEQ ID NO: 74482 - DNA, 31 bp, Artificial Sequence
  Description of Artificial Sequence: Synthetic oligonucleotide
cacgtttcttggagcaggctaagtgtgagtg

SEQ ID NO: 74483 - DNA, 32 bp, Artificial Sequence
  Description of Artificial Sequence: Synthetic oligonucleotide
acgtttcttggagcaggctaagtgtgagtgtc

SEQ ID NO: 74484 - DNA, 31 bp, Artificial Sequence
  Description of Artificial Sequence: Synthetic oligonucleotide
cgtttcttggagcaggctaagtgtgagtgtc

SEQ ID NO: 74485 - DNA, 35 bp, Artificial Sequence
  Description of Artificial Sequence: Synthetic oligonucleotide
gtttcttggagcaggctaagtgtgagtgtcatttc

SEQ ID NO: 74486 - DNA, 35 bp, Artificial Sequence
  Description of Artificial Sequence: Synthetic oligonucleotide
tttcttggagcaggctaagtgtgagtgtcatttcc

SEQ ID NO: 74487 - DNA, 34 bp, Artificial Sequence
  Description of Artificial Sequence: Synthetic oligonucleotide
ttcttggagcaggctaagtgtgagtgtcatttcc

SEQ ID NO: 74488 - DNA, 33 bp, Artificial Sequence
  Description of Artificial Sequence: Synthetic oligonucleotide
tcttggagcaggctaagtgtgagtgtcatttcc

SEQ ID NO: 74489 - DNA, 32 bp, Artificial Sequence
  Description of Artificial Sequence: Synthetic oligonucleotide
cttggagcaggctaagtgtgagtgtcatttcc

SEQ ID NO: 74490 - DNA, 33 bp, Artificial Sequence
  Description of Artificial Sequence: Synthetic oligonucleotide
ttggagcaggctaagtgtgagtgtcatttcctc

SEQ ID NO: 74491 - DNA, 32 bp, Artificial Sequence
  Description of Artificial Sequence: Synthetic oligonucleotide
tggagcaggctaagtgtgagtgtcatttcctc

SEQ ID NO: 74492 - DNA, 31 bp, Artificial Sequence
  Description of Artificial Sequence: Synthetic oligonucleotide
ggagcaggctaagtgtgagtgtcatttcctc

SEQ ID NO: 74493 - DNA, 34 bp, Artificial Sequence
  Description of Artificial Sequence: Synthetic oligonucleotide
gagcaggctaagtgtgagtgtcatttcctcaatg

SEQ ID NO: 74494 - DNA, 34 bp, Artificial Sequence
  Description of Artificial Sequence: Synthetic oligonucleotide
agcaggctaagtgtgagtgtcatttcctcaatgg

SEQ ID NO: 74495 - DNA, 33 bp, Artificial Sequence
  Description of Artificial Sequence: Synthetic oligonucleotide
gcaggctaagtgtgagtgtcatttcctcaatgg

SEQ ID NO: 74496 - DNA, 33 bp, Artificial Sequence
  Description of Artificial Sequence: Synthetic oligonucleotide
caggctaagtgtgagtgtcatttcctcaatggg

SEQ ID NO: 74497 - DNA, 34 bp, Artificial Sequence
  Description of Artificial Sequence: Synthetic oligonucleotide
aggctaagtgtgagtgtcatttcctcaatgggac

SEQ ID NO: 74498 - DNA, 33 bp, Artificial Sequence
  Description of Artificial Sequence: Synthetic oligonucleotide
ggctaagtgtgagtgtcatttcctcaatgggac

SEQ ID NO: 74499 - DNA, 33 bp, Artificial Sequence
  Description of Artificial Sequence: Synthetic oligonucleotide
gctaagtgtgagtgtcatttcctcaatgggacg

SEQ ID NO: 74500 - DNA, 33 bp, Artificial Sequence
  Description of Artificial Sequence: Synthetic oligonucleotide
ctaagtgtgagtgtcatttcctcaatgggacgg

SEQ ID NO: 74501 - DNA, 34 bp, Artificial Sequence
  Description of Artificial Sequence: Synthetic oligonucleotide
taagtgtgagtgtcatttcctcaatgggacggag

SEQ ID NO: 74502 - DNA, 33 bp, Artificial Sequence
  Description of Artificial Sequence: Synthetic oligonucleotide
aagtgtgagtgtcatttcctcaatgggacggag

SEQ ID NO: 74503 - DNA, 32 bp, Artificial Sequence
  Description of Artificial Sequence: Synthetic oligonucleotide
agtgtgagtgtcatttcctcaatgggacggag

SEQ ID NO: 74504 - DNA, 31 bp, Artificial Sequence
  Description of Artificial Sequence: Synthetic oligonucleotide
gtgtgagtgtcatttcctcaatgggacggag

SEQ ID NO: 74505 - DNA, 31 bp, Artificial Sequence
  Description of Artificial Sequence: Synthetic oligonucleotide
tgtgagtgtcatttcctcaatgggacggagc

SEQ ID NO: 74506 - DNA, 30 bp, Artificial Sequence
  Description of Artificial Sequence: Synthetic oligonucleotide
gtgagtgtcatttcctcaatgggacggagc

SEQ ID NO: 74507 - DNA, 30 bp, Artificial Sequence
  Description of Artificial Sequence: Synthetic oligonucleotide
tgagtgtcatttcctcaatgggacggagcg

SEQ ID NO: 74508 - DNA, 29 bp, Artificial Sequence
  Description of Artificial Sequence: Synthetic oligonucleotide
gagtgtcatttcctcaatgggacggagcg

SEQ ID NO: 74509 - DNA, 30 bp, Artificial Sequence
  Description of Artificial Sequence: Synthetic oligonucleotide
agtgtcatttcctcaatgggacggagcgag

SEQ ID NO: 74510 - DNA, 29 bp, Artificial Sequence
  Description of Artificial Sequence: Synthetic oligonucleotide
gtgtcatttcctcaatgggacggagcgag

SEQ ID NO: 74511 - DNA, 30 bp, Artificial Sequence
  Description of Artificial Sequence: Synthetic oligonucleotide
tgtcatttcctcaatgggacggagcgagtg

SEQ ID NO: 74512 - DNA, 29 bp, Artificial Sequence
  Description of Artificial Sequence: Synthetic oligonucleotide
gtcatttcctcaatgggacggagcgagtg

SEQ ID NO: 74513 - DNA, 30 bp, Artificial Sequence
  Description of Artificial Sequence: Synthetic oligonucleotide
tcatttcctcaatgggacggagcgagtgtg

SEQ ID NO: 74514 - DNA, 29 bp, Artificial Sequence
  Description of Artificial Sequence: Synthetic oligonucleotide
catttcctcaatgggacggagcgagtgtg

SEQ ID NO: 74515 - DNA, 29 bp, Artificial Sequence
  Description of Artificial Sequence: Synthetic oligonucleotide
atttcctcaatgggacggagcgagtgtgg

SEQ ID NO: 74516 - DNA, 28 bp, Artificial Sequence
  Description of Artificial Sequence: Synthetic oligonucleotide
tttcctcaatgggacggagcgagtgtgg

SEQ ID NO: 74517 - DNA, 27 bp, Artificial Sequence
  Description of Artificial Sequence: Synthetic oligonucleotide
ttcctcaatgggacggagcgagtgtgg

SEQ ID NO: 74518 - DNA, 27 bp, Artificial Sequence
  Description of Artificial Sequence: Synthetic oligonucleotide
tcctcaatgggacggagcgagtgtgga

SEQ ID NO: 74519 - DNA, 27 bp, Artificial Sequence
  Description of Artificial Sequence: Synthetic oligonucleotide
cctcaatgggacggagcgagtgtggaa

SEQ ID NO: 74520 - DNA, 27 bp, Artificial Sequence
  Description of Artificial Sequence: Synthetic oligonucleotide
ctcaatgggacggagcgagtgtggaac

SEQ ID NO: 74521 - DNA, 27 bp, Artificial Sequence
  Description of Artificial Sequence: Synthetic oligonucleotide
tcaatgggacggagcgagtgtggaacc

SEQ ID NO: 74522 - DNA, 27 bp, Artificial Sequence
  Description of Artificial Sequence: Synthetic oligonucleotide
caatgggacggagcgagtgtggaacct

SEQ ID NO: 74523 - DNA, 27 bp, Artificial Sequence
  Description of Artificial Sequence: Synthetic oligonucleotide
aatgggacggagcgagtgtggaacctg

SEQ ID NO: 74524 - DNA, 27 bp, Artificial Sequence
  Description of Artificial Sequence: Synthetic oligonucleotide
atgggacggagcgagtgtggaacctga

SEQ ID NO: 74525 - DNA, 27 bp, Artificial Sequence
  Description of Artificial Sequence: Synthetic oligonucleotide
tgggacggagcgagtgtggaacctgat

SEQ ID NO: 74526 - DNA, 26 bp, Artificial Sequence
  Description of Artificial Sequence: Synthetic oligonucleotide
gggacggagcgagtgtggaacctgat

SEQ ID NO: 74527 - DNA, 27 bp, Artificial Sequence
  Description of Artificial Sequence: Synthetic oligonucleotide
ggacggagcgagtgtggaacctgatca

SEQ ID NO: 74528 - DNA, 27 bp, Artificial Sequence
  Description of Artificial Sequence: Synthetic oligonucleotide
gacggagcgagtgtggaacctgatcag

SEQ ID NO: 74529 - DNA, 30 bp, Artificial Sequence
  Description of Artificial Sequence: Synthetic oligonucleotide
acggagcgagtgtggaacctgatcagatac

SEQ ID NO: 74530 - DNA, 29 bp, Artificial Sequence
  Description of Artificial Sequence: Synthetic oligonucleotide
cggagcgagtgtggaacctgatcagatac

SEQ ID NO: 74531 - DNA, 31 bp, Artificial Sequence
  Description of Artificial Sequence: Synthetic oligonucleotide
ggagcgagtgtggaacctgatcagatacatc

SEQ ID NO: 74532 - DNA, 36 bp, Artificial Sequence
  Description of Artificial Sequence: Synthetic oligonucleotide
gagcgagtgtggaacctgatcagatacatctataac

SEQ ID NO: 74533 - DNA, 36 bp, Artificial Sequence
  Description of Artificial Sequence: Synthetic oligonucleotide
agcgagtgtggaacctgatcagatacatctataacc

SEQ ID NO: 74534 - DNA, 35 bp, Artificial Sequence
  Description of Artificial Sequence: Synthetic oligonucleotide
gcgagtgtggaacctgatcagatacatctataacc

SEQ ID NO: 74535 - DNA, 37 bp, Artificial Sequence
  Description of Artificial Sequence: Synthetic oligonucleotide
cgagtgtggaacctgatcagatacatctataaccaag

SEQ ID NO: 74536 - DNA, 38 bp, Artificial Sequence
  Description of Artificial Sequence: Synthetic oligonucleotide
gagtgtggaacctgatcagatacatctataaccaagag

SEQ ID NO: 74537 - DNA, 38 bp, Artificial Sequence
  Description of Artificial Sequence: Synthetic oligonucleotide
agtgtggaacctgatcagatacatctataaccaagagg

SEQ ID NO: 74538 - DNA, 37 bp, Artificial Sequence
  Description of Artificial Sequence: Synthetic oligonucleotide
gtgtggaacctgatcagatacatctataaccaagagg

SEQ ID NO: 74539 - DNA, 38 bp, Artificial Sequence
  Description of Artificial Sequence: Synthetic oligonucleotide
tgtggaacctgatcagatacatctataaccaagaggag

SEQ ID NO: 74540 - DNA, 37 bp, Artificial Sequence
  Description of Artificial Sequence: Synthetic oligonucleotide
gtggaacctgatcagatacatctataaccaagaggag

SEQ ID NO: 74541 - DNA, 39 bp, Artificial Sequence
  Description of Artificial Sequence: Synthetic oligonucleotide
tggaacctgatcagatacatctataaccaagaggagtac

SEQ ID NO: 74542 - DNA, 38 bp, Artificial Sequence
  Description of Artificial Sequence: Synthetic oligonucleotide
ggaacctgatcagatacatctataaccaagaggagtac

SEQ ID NO: 74543 - DNA, 38 bp, Artificial Sequence
  Description of Artificial Sequence: Synthetic oligonucleotide
gaacctgatcagatacatctataaccaagaggagtacg

SEQ ID NO: 74544 - DNA, 38 bp, Artificial Sequence
  Description of Artificial Sequence: Synthetic oligonucleotide
aacctgatcagatacatctataaccaagaggagtacgc

SEQ ID NO: 74545 - DNA, 37 bp, Artificial Sequence
  Description of Artificial Sequence: Synthetic oligonucleotide
acctgatcagatacatctataaccaagaggagtacgc

SEQ ID NO: 74546 - DNA, 36 bp, Artificial Sequence
  Description of Artificial Sequence: Synthetic oligonucleotide
cctgatcagatacatctataaccaagaggagtacgc

SEQ ID NO: 74547 - DNA, 36 bp, Artificial Sequence
  Description of Artificial Sequence: Synthetic oligonucleotide
ctgatcagatacatctataaccaagaggagtacgcg

SEQ ID NO: 74548 - DNA, 36 bp, Artificial Sequence
  Description of Artificial Sequence: Synthetic oligonucleotide
tgatcagatacatctataaccaagaggagtacgcgc

SEQ ID NO: 74549 - DNA, 35 bp, Artificial Sequence
  Description of Artificial Sequence: Synthetic oligonucleotide
gatcagatacatctataaccaagaggagtacgcgc

SEQ ID NO: 74550 - DNA, 35 bp, Artificial Sequence
  Description of Artificial Sequence: Synthetic oligonucleotide
atcagatacatctataaccaagaggagtacgcgcg

SEQ ID NO: 74551 - DNA, 34 bp, Artificial Sequence
  Description of Artificial Sequence: Synthetic oligonucleotide
tcagatacatctataaccaagaggagtacgcgcg

SEQ ID NO: 74552 - DNA, 33 bp, Artificial Sequence
  Description of Artificial Sequence: Synthetic oligonucleotide
cagatacatctataaccaagaggagtacgcgcg

SEQ ID NO: 74553 - DNA, 33 bp, Artificial Sequence
  Description of Artificial Sequence: Synthetic oligonucleotide
agatacatctataaccaagaggagtacgcgcgc

SEQ ID NO: 74554 - DNA, 32 bp, Artificial Sequence
  Description of Artificial Sequence: Synthetic oligonucleotide
gatacatctataaccaagaggagtacgcgcgc

SEQ ID NO: 74555 - DNA, 34 bp, Artificial Sequence
  Description of Artificial Sequence: Synthetic oligonucleotide
atacatctataaccaagaggagtacgcgcgctac

SEQ ID NO: 74556 - DNA, 33 bp, Artificial Sequence
  Description of Artificial Sequence: Synthetic oligonucleotide
tacatctataaccaagaggagtacgcgcgctac

SEQ ID NO: 74557 - DNA, 32 bp, Artificial Sequence
  Description of Artificial Sequence: Synthetic oligonucleotide
acatctataaccaagaggagtacgcgcgctac

SEQ ID NO: 74558 - DNA, 31 bp, Artificial Sequence
  Description of Artificial Sequence: Synthetic oligonucleotide
catctataaccaagaggagtacgcgcgctac

SEQ ID NO: 74559 - DNA, 33 bp, Artificial Sequence
  Description of Artificial Sequence: Synthetic oligonucleotide
atctataaccaagaggagtacgcgcgctacaac

SEQ ID NO: 74560 - DNA, 32 bp, Artificial Sequence
  Description of Artificial Sequence: Synthetic oligonucleotide
tctataaccaagaggagtacgcgcgctacaac

SEQ ID NO: 74561 - DNA, 31 bp, Artificial Sequence
  Description of Artificial Sequence: Synthetic oligonucleotide
ctataaccaagaggagtacgcgcgctacaac

SEQ ID NO: 74562 - DNA, 32 bp, Artificial Sequence
  Description of Artificial Sequence: Synthetic oligonucleotide
tataaccaagaggagtacgcgcgctacaacag

SEQ ID NO: 74563 - DNA, 31 bp, Artificial Sequence
  Description of Artificial Sequence: Synthetic oligonucleotide
ataaccaagaggagtacgcgcgctacaacag

SEQ ID NO: 74564 - DNA, 30 bp, Artificial Sequence
  Description of Artificial Sequence: Synthetic oligonucleotide
taaccaagaggagtacgcgcgctacaacag

SEQ ID NO: 74565 - DNA, 29 bp, Artificial Sequence
  Description of Artificial Sequence: Synthetic oligonucleotide
aaccaagaggagtacgcgcgctacaacag

SEQ ID NO: 74566 - DNA, 28 bp, Artificial Sequence
  Description of Artificial Sequence: Synthetic oligonucleotide
accaagaggagtacgcgcgctacaacag

SEQ ID NO: 74567 - DNA, 27 bp, Artificial Sequence
  Description of Artificial Sequence: Synthetic oligonucleotide
ccaagaggagtacgcgcgctacaacag

SEQ ID NO: 74568 - DNA, 28 bp, Artificial Sequence
  Description of Artificial Sequence: Synthetic oligonucleotide
caagaggagtacgcgcgctacaacagtg

SEQ ID NO: 74569 - DNA, 29 bp, Artificial Sequence
  Description of Artificial Sequence: Synthetic oligonucleotide
aagaggagtacgcgcgctacaacagtgac

SEQ ID NO: 74570 - DNA, 28 bp, Artificial Sequence
  Description of Artificial Sequence: Synthetic oligonucleotide
agaggagtacgcgcgctacaacagtgac

SEQ ID NO: 74571 - DNA, 27 bp, Artificial Sequence
  Description of Artificial Sequence: Synthetic oligonucleotide
gaggagtacgcgcgctacaacagtgac

SEQ ID NO: 74572 - DNA, 27 bp, Artificial Sequence
  Description of Artificial Sequence: Synthetic oligonucleotide
aggagtacgcgcgctacaacagtgacc

SEQ ID NO: 74573 - DNA, 27 bp, Artificial Sequence
  Description of Artificial Sequence: Synthetic oligonucleotide
ggagtacgcgcgctacaacagtgacct

SEQ ID NO: 74574 - DNA, 27 bp, Artificial Sequence
  Description of Artificial Sequence: Synthetic oligonucleotide
gagtacgcgcgctacaacagtgacctg

SEQ ID NO: 74575 - DNA, 27 bp, Artificial Sequence
  Description of Artificial Sequence: Synthetic oligonucleotide
agtacgcgcgctacaacagtgacctgg

SEQ ID NO: 74576 - DNA, 26 bp, Artificial Sequence
  Description of Artificial Sequence: Synthetic oligonucleotide
gtacgcgcgctacaacagtgacctgg

SEQ ID NO: 74577 - DNA, 26 bp, Artificial Sequence
  Description of Artificial Sequence: Synthetic oligonucleotide
tacgcgcgctacaacagtgacctggg

SEQ ID NO: 74578 - DNA, 25 bp, Artificial Sequence
  Description of Artificial Sequence: Synthetic oligonucleotide
acgcgcgctacaacagtgacctggg

SEQ ID NO: 74579 - DNA, 24 bp, Artificial Sequence
  Description of Artificial Sequence: Synthetic oligonucleotide
cgcgcgctacaacagtgacctggg

SEQ ID NO: 74580 - DNA, 24 bp, Artificial Sequence
  Description of Artificial Sequence: Synthetic oligonucleotide
gcgcgctacaacagtgacctgggg

SEQ ID NO: 74581 - DNA, 25 bp, Artificial Sequence
  Description of Artificial Sequence: Synthetic oligonucleotide
cgcgctacaacagtgacctggggga

SEQ ID NO: 74582 - DNA, 27 bp, Artificial Sequence
  Description of Artificial Sequence: Synthetic oligonucleotide
gcgctacaacagtgacctgggggagta

SEQ ID NO: 74583 - DNA, 27 bp, Artificial Sequence
  Description of Artificial Sequence: Synthetic oligonucleotide
cgctacaacagtgacctgggggagtac

SEQ ID NO: 74584 - DNA, 27 bp, Artificial Sequence
  Description of Artificial Sequence: Synthetic oligonucleotide
gctacaacagtgacctgggggagtacc

SEQ ID NO: 74585 - DNA, 28 bp, Artificial Sequence
  Description of Artificial Sequence: Synthetic oligonucleotide
ctacaacagtgacctgggggagtaccag

SEQ ID NO: 74586 - DNA, 28 bp, Artificial Sequence
  Description of Artificial Sequence: Synthetic oligonucleotide
tacaacagtgacctgggggagtaccagg

SEQ ID NO: 74587 - DNA, 27 bp, Artificial Sequence
  Description of Artificial Sequence: Synthetic oligonucleotide
acaacagtgacctgggggagtaccagg

SEQ ID NO: 74588 - DNA, 26 bp, Artificial Sequence
  Description of Artificial Sequence: Synthetic oligonucleotide
caacagtgacctgggggagtaccagg

SEQ ID NO: 74589 - DNA, 26 bp, Artificial Sequence
  Description of Artificial Sequence: Synthetic oligonucleotide
aacagtgacctgggggagtaccaggc

SEQ ID NO: 74590 - DNA, 25 bp, Artificial Sequence
  Description of Artificial Sequence: Synthetic oligonucleotide
acagtgacctgggggagtaccaggc

SEQ ID NO: 74591 - DNA, 24 bp, Artificial Sequence
  Description of Artificial Sequence: Synthetic oligonucleotide
cagtgacctgggggagtaccaggc

SEQ ID NO: 74592 - DNA, 24 bp, Artificial Sequence
  Description of Artificial Sequence: Synthetic oligonucleotide
agtgacctgggggagtaccaggcg

SEQ ID NO: 74593 - DNA, 23 bp, Artificial Sequence
  Description of Artificial Sequence: Synthetic oligonucleotide
gtgacctgggggagtaccaggcg

SEQ ID NO: 74594 - DNA, 24 bp, Artificial Sequence
  Description of Artificial Sequence: Synthetic oligonucleotide
tgacctgggggagtaccaggcggt

SEQ ID NO: 74595 - DNA, 23 bp, Artificial Sequence
  Description of Artificial Sequence: Synthetic oligonucleotide
gacctgggggagtaccaggcggt

SEQ ID NO: 74596 - DNA, 24 bp, Artificial Sequence
  Description of Artificial Sequence: Synthetic oligonucleotide
acctgggggagtaccaggcggtga

SEQ ID NO: 74597 - DNA, 23 bp, Artificial Sequence
  Description of Artificial Sequence: Synthetic oligonucleotide
cctgggggagtaccaggcggtga

SEQ ID NO: 74598 - DNA, 23 bp, Artificial Sequence
  Description of Artificial Sequence: Synthetic oligonucleotide
ctgggggagtaccaggcggtgac

SEQ ID NO: 74599 - DNA, 27 bp, Artificial Sequence
  Description of Artificial Sequence: Synthetic oligonucleotide
cggcgagtccaacctaaggtgactgtg

SEQ ID NO: 74600 - DNA, 30 bp, Artificial Sequence
  Description of Artificial Sequence: Synthetic oligonucleotide
ggcgagtccaacctaaggtgactgtgtatc

SEQ ID NO: 74601 - DNA, 30 bp, Artificial Sequence
  Description of Artificial Sequence: Synthetic oligonucleotide
gcgagtccaacctaaggtgactgtgtatcc

SEQ ID NO: 74602 - DNA, 32 bp, Artificial Sequence
  Description of Artificial Sequence: Synthetic oligonucleotide
cgagtccaacctaaggtgactgtgtatccttc

SEQ ID NO: 74603 - DNA, 35 bp, Artificial Sequence
  Description of Artificial Sequence: Synthetic oligonucleotide
gagtccaacctaaggtgactgtgtatccttcaaag

SEQ ID NO: 74604 - DNA, 36 bp, Artificial Sequence
  Description of Artificial Sequence: Synthetic oligonucleotide
agtccaacctaaggtgactgtgtatccttcaaagac

SEQ ID NO: 74605 - DNA, 35 bp, Artificial Sequence
  Description of Artificial Sequence: Synthetic oligonucleotide
gtccaacctaaggtgactgtgtatccttcaaagac

SEQ ID NO: 74606 - DNA, 35 bp, Artificial Sequence
  Description of Artificial Sequence: Synthetic oligonucleotide
tccaacctaaggtgactgtgtatccttcaaagacc

SEQ ID NO: 74607 - DNA, 34 bp, Artificial Sequence
  Description of Artificial Sequence: Synthetic oligonucleotide
ccaacctaaggtgactgtgtatccttcaaagacc

SEQ ID NO: 74608 - DNA, 30 bp, Artificial Sequence
  Description of Artificial Sequence: Synthetic oligonucleotide
cagcattgaagtcaggtggttccggaacag

SEQ ID NO: 74609 - DNA, 30 bp, Artificial Sequence
  Description of Artificial Sequence: Synthetic oligonucleotide
agcattgaagtcaggtggttccggaacagc

SEQ ID NO: 74610 - DNA, 29 bp, Artificial Sequence
  Description of Artificial Sequence: Synthetic oligonucleotide
gcattgaagtcaggtggttccggaacagc

SEQ ID NO: 74611 - DNA, 29 bp, Artificial Sequence
  Description of Artificial Sequence: Synthetic oligonucleotide
cattgaagtcaggtggttccggaacagcc

SEQ ID NO: 74612 - DNA, 30 bp, Artificial Sequence
  Description of Artificial Sequence: Synthetic oligonucleotide
attgaagtcaggtggttccggaacagccag

SEQ ID NO: 74613 - DNA, 29 bp, Artificial Sequence
  Description of Artificial Sequence: Synthetic oligonucleotide
ttgaagtcaggtggttccggaacagccag

SEQ ID NO: 74614 - DNA, 28 bp, Artificial Sequence
  Description of Artificial Sequence: Synthetic oligonucleotide
tgaagtcaggtggttccggaacagccag

SEQ ID NO: 74615 - DNA, 27 bp, Artificial Sequence
  Description of Artificial Sequence: Synthetic oligonucleotide
gaagtcaggtggttccggaacagccag

SEQ ID NO: 74616 - DNA, 27 bp, Artificial Sequence
  Description of Artificial Sequence: Synthetic oligonucleotide
aagtcaggtggttccggaacagccagg

SEQ ID NO: 74617 - DNA, 27 bp, Artificial Sequence
  Description of Artificial Sequence: Synthetic oligonucleotide
agtcaggtggttccggaacagccagga

SEQ ID NO: 74618 - DNA, 27 bp, Artificial Sequence
  Description of Artificial Sequence: Synthetic oligonucleotide
gtcaggtggttccggaacagccaggaa

SEQ ID NO: 74619 - DNA, 27 bp, Artificial Sequence
  Description of Artificial Sequence: Synthetic oligonucleotide
tcaggtggttccggaacagccaggaag

SEQ ID NO: 74620 - DNA, 27 bp, Artificial Sequence
  Description of Artificial Sequence: Synthetic oligonucleotide
caggtggttccggaacagccaggaaga

SEQ ID NO: 74621 - DNA, 27 bp, Artificial Sequence
  Description of Artificial Sequence: Synthetic oligonucleotide
aggtggttccggaacagccaggaagag

SEQ ID NO: 74622 - DNA, 27 bp, Artificial Sequence
  Description of Artificial Sequence: Synthetic oligonucleotide
ggtggttccggaacagccaggaagaga

SEQ ID NO: 74623 - DNA, 28 bp, Artificial Sequence
  Description of Artificial Sequence: Synthetic oligonucleotide
gtggttccggaacagccaggaagagaag

SEQ ID NO: 74624 - DNA, 28 bp, Artificial Sequence
  Description of Artificial Sequence: Synthetic oligonucleotide
tggttccggaacagccaggaagagaagg

SEQ ID NO: 74625 - DNA, 27 bp, Artificial Sequence
  Description of Artificial Sequence: Synthetic oligonucleotide
ggttccggaacagccaggaagagaagg

SEQ ID NO: 74626 - DNA, 27 bp, Artificial Sequence
  Description of Artificial Sequence: Synthetic oligonucleotide
gttccggaacagccaggaagagaaggc

SEQ ID NO: 74627 - DNA, 28 bp, Artificial Sequence
  Description of Artificial Sequence: Synthetic oligonucleotide
ttccggaacagccaggaagagaaggctg

SEQ ID NO: 74628 - DNA, 27 bp, Artificial Sequence
  Description of Artificial Sequence: Synthetic oligonucleotide
tccggaacagccaggaagagaaggctg

SEQ ID NO: 74629 - DNA, 26 bp, Artificial Sequence
  Description of Artificial Sequence: Synthetic oligonucleotide
ccggaacagccaggaagagaaggctg

SEQ ID NO: 74630 - DNA, 26 bp, Artificial Sequence
  Description of Artificial Sequence: Synthetic oligonucleotide
cggaacagccaggaagagaaggctgg

SEQ ID NO: 74631 - DNA, 26 bp, Artificial Sequence
  Description of Artificial Sequence: Synthetic oligonucleotide
ggaacagccaggaagagaaggctggg

SEQ ID NO: 74632 - DNA, 27 bp, Artificial Sequence
  Description of Artificial Sequence: Synthetic oligonucleotide
gaacagccaggaagagaaggctggggt

SEQ ID NO: 74633 - DNA, 27 bp, Artificial Sequence
  Description of Artificial Sequence: Synthetic oligonucleotide
aacagccaggaagagaaggctggggtg

SEQ ID NO: 74634 - DNA, 26 bp, Artificial Sequence
  Description of Artificial Sequence: Synthetic oligonucleotide
acagccaggaagagaaggctggggtg

SEQ ID NO: 74635 - DNA, 25 bp, Artificial Sequence
  Description of Artificial Sequence: Synthetic oligonucleotide
cagccaggaagagaaggctggggtg

SEQ ID NO: 74636 - DNA, 26 bp, Artificial Sequence
  Description of Artificial Sequence: Synthetic oligonucleotide
agccaggaagagaaggctggggtggt

SEQ ID NO: 74637 - DNA, 30 bp, Artificial Sequence
  Description of Artificial Sequence: Synthetic oligonucleotide
gagaggtttacacctgccaagtggagcatc

SEQ ID NO: 74638 - DNA, 30 bp, Artificial Sequence
  Description of Artificial Sequence: Synthetic oligonucleotide
agaggtttacacctgccaagtggagcatcc

SEQ ID NO: 74639 - DNA, 29 bp, Artificial Sequence
  Description of Artificial Sequence: Synthetic oligonucleotide
gaggtttacacctgccaagtggagcatcc

SEQ ID NO: 74640 - DNA, 31 bp, Artificial Sequence
  Description of Artificial Sequence: Synthetic oligonucleotide
aggtttacacctgccaagtggagcatccaag

SEQ ID NO: 74641 - DNA, 30 bp, Artificial Sequence
  Description of Artificial Sequence: Synthetic oligonucleotide
ggtttacacctgccaagtggagcatccaag

SEQ ID NO: 74642 - DNA, 30 bp, Artificial Sequence
  Description of Artificial Sequence: Synthetic oligonucleotide
gtttacacctgccaagtggagcatccaagc

SEQ ID NO: 74643 - DNA, 32 bp, Artificial Sequence
  Description of Artificial Sequence: Synthetic oligonucleotide
tttacacctgccaagtggagcatccaagcatg

SEQ ID NO: 74644 - DNA, 31 bp, Artificial Sequence
  Description of Artificial Sequence: Synthetic oligonucleotide
ttacacctgccaagtggagcatccaagcatg

SEQ ID NO: 74645 - DNA, 30 bp, Artificial Sequence
  Description of Artificial Sequence: Synthetic oligonucleotide
tacacctgccaagtggagcatccaagcatg

SEQ ID NO: 74646 - DNA, 29 bp, Artificial Sequence
  Description of Artificial Sequence: Synthetic oligonucleotide
acacctgccaagtggagcatccaagcatg

SEQ ID NO: 74647 - DNA, 28 bp, Artificial Sequence
  Description of Artificial Sequence: Synthetic oligonucleotide
cacctgccaagtggagcatccaagcatg

SEQ ID NO: 74648 - DNA, 30 bp, Artificial Sequence
  Description of Artificial Sequence: Synthetic oligonucleotide
acctgccaagtggagcatccaagcatgatg

SEQ ID NO: 74649 - DNA, 29 bp, Artificial Sequence
  Description of Artificial Sequence: Synthetic oligonucleotide
cctgccaagtggagcatccaagcatgatg

SEQ ID NO: 74650 - DNA, 30 bp, Artificial Sequence
  Description of Artificial Sequence: Synthetic oligonucleotide
ctgccaagtggagcatccaagcatgatgag

SEQ ID NO: 74651 - DNA, 30 bp, Artificial Sequence
  Description of Artificial Sequence: Synthetic oligonucleotide
tgccaagtggagcatccaagcatgatgagc

SEQ ID NO: 74652 - DNA, 29 bp, Artificial Sequence
  Description of Artificial Sequence: Synthetic oligonucleotide
gccaagtggagcatccaagcatgatgagc

SEQ ID NO: 74653 - DNA, 29 bp, Artificial Sequence
  Description of Artificial Sequence: Synthetic oligonucleotide
ccaagtggagcatccaagcatgatgagcc

SEQ ID NO: 74654 - DNA, 29 bp, Artificial Sequence
  Description of Artificial Sequence: Synthetic oligonucleotide
caagtggagcatccaagcatgatgagccc

SEQ ID NO: 74655 - DNA, 30 bp, Artificial Sequence
  Description of Artificial Sequence: Synthetic oligonucleotide
aagtggagcatccaagcatgatgagccctc

SEQ ID NO: 74656 - DNA, 29 bp, Artificial Sequence
  Description of Artificial Sequence: Synthetic oligonucleotide
agtggagcatccaagcatgatgagccctc

SEQ ID NO: 74657 - DNA, 28 bp, Artificial Sequence
  Description of Artificial Sequence: Synthetic oligonucleotide
gtggagcatccaagcatgatgagccctc

SEQ ID NO: 74658 - DNA, 29 bp, Artificial Sequence
  Description of Artificial Sequence: Synthetic oligonucleotide
tggagcatccaagcatgatgagccctctc

SEQ ID NO: 74659 - DNA, 28 bp, Artificial Sequence
  Description of Artificial Sequence: Synthetic oligonucleotide
ggagcatccaagcatgatgagccctctc

SEQ ID NO: 74660 - DNA, 29 bp, Artificial Sequence
  Description of Artificial Sequence: Synthetic oligonucleotide
gagcatccaagcatgatgagccctctcac

SEQ ID NO: 74661 - DNA, 29 bp, Artificial Sequence
  Description of Artificial Sequence: Synthetic oligonucleotide
agcatccaagcatgatgagccctctcacg

SEQ ID NO: 74662 - DNA, 28 bp, Artificial Sequence
  Description of Artificial Sequence: Synthetic oligonucleotide
gcatccaagcatgatgagccctctcacg

SEQ ID NO: 74663 - DNA, 28 bp, Artificial Sequence
  Description of Artificial Sequence: Synthetic oligonucleotide
catccaagcatgatgagccctctcacgg

SEQ ID NO: 74664 - DNA, 29 bp, Artificial Sequence
  Description of Artificial Sequence: Synthetic oligonucleotide
atccaagcatgatgagccctctcacggtg

SEQ ID NO: 74665 - DNA, 28 bp, Artificial Sequence
  Description of Artificial Sequence: Synthetic oligonucleotide
tccaagcatgatgagccctctcacggtg

SEQ ID NO: 74666 - DNA, 27 bp, Artificial Sequence
  Description of Artificial Sequence: Synthetic oligonucleotide
ccaagcatgatgagccctctcacggtg

SEQ ID NO: 74667 - DNA, 27 bp, Artificial Sequence
  Description of Artificial Sequence: Synthetic oligonucleotide
caagcatgatgagccctctcacggtgc

SEQ ID NO: 74668 - DNA, 30 bp, Artificial Sequence
  Description of Artificial Sequence: Synthetic oligonucleotide
aagcatgatgagccctctcacggtgcaatg

SEQ ID NO: 74669 - DNA, 29 bp, Artificial Sequence
  Description of Artificial Sequence: Synthetic oligonucleotide
agcatgatgagccctctcacggtgcaatg

SEQ ID NO: 74670 - DNA, 28 bp, Artificial Sequence
  Description of Artificial Sequence: Synthetic oligonucleotide
gcatgatgagccctctcacggtgcaatg

SEQ ID NO: 74671 - DNA, 28 bp, Artificial Sequence
  Description of Artificial Sequence: Synthetic oligonucleotide
catgatgagccctctcacggtgcaatgg

SEQ ID NO: 74672 - DNA, 29 bp, Artificial Sequence
  Description of Artificial Sequence: Synthetic oligonucleotide
atgatgagccctctcacggtgcaatggag

SEQ ID NO: 74673 - DNA, 28 bp, Artificial Sequence
  Description of Artificial Sequence: Synthetic oligonucleotide
tgatgagccctctcacggtgcaatggag

SEQ ID NO: 74674 - DNA, 27 bp, Artificial Sequence
  Description of Artificial Sequence: Synthetic oligonucleotide
gatgagccctctcacggtgcaatggag

SEQ ID NO: 74675 - DNA, 28 bp, Artificial Sequence
  Description of Artificial Sequence: Synthetic oligonucleotide
atgagccctctcacggtgcaatggagtg

SEQ ID NO: 74676 - DNA, 27 bp, Artificial Sequence
  Description of Artificial Sequence: Synthetic oligonucleotide
tgagccctctcacggtgcaatggagtg

SEQ ID NO: 74677 - DNA, 26 bp, Artificial Sequence
  Description of Artificial Sequence: Synthetic oligonucleotide
gagccctctcacggtgcaatggagtg

SEQ ID NO: 74678 - DNA, 27 bp, Artificial Sequence
  Description of Artificial Sequence: Synthetic oligonucleotide
agccctctcacggtgcaatggagtgca

SEQ ID NO: 74679 - DNA, 26 bp, Artificial Sequence
  Description of Artificial Sequence: Synthetic oligonucleotide
gccctctcacggtgcaatggagtgca

SEQ ID NO: 74680 - DNA, 26 bp, Artificial Sequence
  Description of Artificial Sequence: Synthetic oligonucleotide
ccctctcacggtgcaatggagtgcac

SEQ ID NO: 74681 - DNA, 26 bp, Artificial Sequence
  Description of Artificial Sequence: Synthetic oligonucleotide
cctctcacggtgcaatggagtgcacg

SEQ ID NO: 74682 - DNA, 27 bp, Artificial Sequence
  Description of Artificial Sequence: Synthetic oligonucleotide
ctctcacggtgcaatggagtgcacggt

SEQ ID NO: 74683 - DNA, 27 bp, Artificial Sequence
  Description of Artificial Sequence: Synthetic oligonucleotide
tctcacggtgcaatggagtgcacggtc

SEQ ID NO: 74684 - DNA, 27 bp, Artificial Sequence
  Description of Artificial Sequence: Synthetic oligonucleotide
ctcacggtgcaatggagtgcacggtct

SEQ ID NO: 74685 - DNA, 27 bp, Artificial Sequence
  Description of Artificial Sequence: Synthetic oligonucleotide
tcacggtgcaatggagtgcacggtctg

SEQ ID NO: 74686 - DNA, 27 bp, Artificial Sequence
  Description of Artificial Sequence: Synthetic oligonucleotide
cacggtgcaatggagtgcacggtctga

SEQ ID NO: 74687 - DNA, 29 bp, Artificial Sequence
  Description of Artificial Sequence: Synthetic oligonucleotide
acggtgcaatggagtgcacggtctgaatc

SEQ ID NO: 74688 - DNA, 28 bp, Artificial Sequence
  Description of Artificial Sequence: Synthetic oligonucleotide
cggtgcaatggagtgcacggtctgaatc

SEQ ID NO: 74689 - DNA, 29 bp, Artificial Sequence
  Description of Artificial Sequence: Synthetic oligonucleotide
ggtgcaatggagtgcacggtctgaatctg

SEQ ID NO: 74690 - DNA, 29 bp, Artificial Sequence
  Description of Artificial Sequence: Synthetic oligonucleotide
gtgcaatggagtgcacggtctgaatctgc

SEQ ID NO: 74691 - DNA, 30 bp, Artificial Sequence
  Description of Artificial Sequence: Synthetic oligonucleotide
tgcaatggagtgcacggtctgaatctgcac

SEQ ID NO: 74692 - DNA, 29 bp, Artificial Sequence
  Description of Artificial Sequence: Synthetic oligonucleotide
gcaatggagtgcacggtctgaatctgcac

SEQ ID NO: 74693 - DNA, 30 bp, Artificial Sequence
  Description of Artificial Sequence: Synthetic oligonucleotide
caatggagtgcacggtctgaatctgcacag

SEQ ID NO: 74694 - DNA, 27 bp, Artificial Sequence
  Description of Artificial Sequence: Synthetic oligonucleotide
ttgtgctgggcctgctcttccttggga

SEQ ID NO: 74695 - DNA, 26 bp, Artificial Sequence
  Description of Artificial Sequence: Synthetic oligonucleotide
tgtgctgggcctgctcttccttggga

SEQ ID NO: 74696 - DNA, 25 bp, Artificial Sequence
  Description of Artificial Sequence: Synthetic oligonucleotide
gtgctgggcctgctcttccttggga

SEQ ID NO: 74697 - DNA, 26 bp, Artificial Sequence
  Description of Artificial Sequence: Synthetic oligonucleotide
tgctgggcctgctcttccttgggaca

SEQ ID NO: 74698 - DNA, 25 bp, Artificial Sequence
  Description of Artificial Sequence: Synthetic oligonucleotide
gctgggcctgctcttccttgggaca

SEQ ID NO: 74699 - DNA, 25 bp, Artificial Sequence
  Description of Artificial Sequence: Synthetic oligonucleotide
ctgggcctgctcttccttgggacag

SEQ ID NO: 74700 - DNA, 25 bp, Artificial Sequence
  Description of Artificial Sequence: Synthetic oligonucleotide
tgggcctgctcttccttgggacagg

SEQ ID NO: 74701 - DNA, 24 bp, Artificial Sequence
  Description of Artificial Sequence: Synthetic oligonucleotide
gggcctgctcttccttgggacagg

SEQ ID NO: 74702 - DNA, 24 bp, Artificial Sequence
  Description of Artificial Sequence: Synthetic oligonucleotide
ggcctgctcttccttgggacaggg

SEQ ID NO: 74703 - DNA, 25 bp, Artificial Sequence
  Description of Artificial Sequence: Synthetic oligonucleotide
gcctgctcttccttgggacagggct

SEQ ID NO: 74704 - DNA, 27 bp, Artificial Sequence
  Description of Artificial Sequence: Synthetic oligonucleotide
cctgctcttccttgggacagggctgtt

SEQ ID NO: 74705 - DNA, 27 bp, Artificial Sequence
  Description of Artificial Sequence: Synthetic oligonucleotide
ctgctcttccttgggacagggctgttc

SEQ ID NO: 74706 - DNA, 29 bp, Artificial Sequence
  Description of Artificial Sequence: Synthetic oligonucleotide
tgctcttccttgggacagggctgttcatc

SEQ ID NO: 74707 - DNA, 28 bp, Artificial Sequence
  Description of Artificial Sequence: Synthetic oligonucleotide
gctcttccttgggacagggctgttcatc

SEQ ID NO: 74708 - DNA, 30 bp, Artificial Sequence
  Description of Artificial Sequence: Synthetic oligonucleotide
ctcttccttgggacagggctgttcatctac

SEQ ID NO: 74709 - DNA, 32 bp, Artificial Sequence
  Description of Artificial Sequence: Synthetic oligonucleotide
tcttccttgggacagggctgttcatctacttc

SEQ ID NO: 74710 - DNA, 31 bp, Artificial Sequence
  Description of Artificial Sequence: Synthetic oligonucleotide
cttccttgggacagggctgttcatctacttc

SEQ ID NO: 74711 - DNA, 32 bp, Artificial Sequence
  Description of Artificial Sequence: Synthetic oligonucleotide
ttccttgggacagggctgttcatctacttcag

SEQ ID NO: 74712 - DNA, 31 bp, Artificial Sequence
  Description of Artificial Sequence: Synthetic oligonucleotide
tccttgggacagggctgttcatctacttcag

SEQ ID NO: 74713 - DNA, 30 bp, Artificial Sequence
  Description of Artificial Sequence: Synthetic oligonucleotide
ccttgggacagggctgttcatctacttcag

SEQ ID NO: 74714 - DNA, 30 bp, Artificial Sequence
  Description of Artificial Sequence: Synthetic oligonucleotide
cttgggacagggctgttcatctacttcagg

SEQ ID NO: 74715 - DNA, 33 bp, Artificial Sequence
  Description of Artificial Sequence: Synthetic oligonucleotide
ttgggacagggctgttcatctacttcaggaatc

SEQ ID NO: 74716 - DNA, 32 bp, Artificial Sequence
  Description of Artificial Sequence: Synthetic oligonucleotide
tgggacagggctgttcatctacttcaggaatc

SEQ ID NO: 74717 - DNA, 31 bp, Artificial Sequence
  Description of Artificial Sequence: Synthetic oligonucleotide
gggacagggctgttcatctacttcaggaatc

SEQ ID NO: 74718 - DNA, 32 bp, Artificial Sequence
  Description of Artificial Sequence: Synthetic oligonucleotide
ggacagggctgttcatctacttcaggaatcag

SEQ ID NO: 74719 - DNA, 35 bp, Artificial Sequence
  Description of Artificial Sequence: Synthetic oligonucleotide
gacagggctgttcatctacttcaggaatcagaaag

SEQ ID NO: 74720 - DNA, 35 bp, Artificial Sequence
  Description of Artificial Sequence: Synthetic oligonucleotide
acagggctgttcatctacttcaggaatcagaaagg

SEQ ID NO: 74721 - DNA, 34 bp, Artificial Sequence
  Description of Artificial Sequence: Synthetic oligonucleotide
cagggctgttcatctacttcaggaatcagaaagg

SEQ ID NO: 74722 - DNA, 35 bp, Artificial Sequence
  Description of Artificial Sequence: Synthetic oligonucleotide
agggctgttcatctacttcaggaatcagaaaggac

SEQ ID NO: 74723 - DNA, 31 bp, Artificial Sequence
  Description of Artificial Sequence: Synthetic oligonucleotide
aaaggacactctggacttcagccaacaggac

SEQ ID NO: 74724 - DNA, 30 bp, Artificial Sequence
  Description of Artificial Sequence: Synthetic oligonucleotide
aaggacactctggacttcagccaacaggac

SEQ ID NO: 74725 - DNA, 29 bp, Artificial Sequence
  Description of Artificial Sequence: Synthetic oligonucleotide
aggacactctggacttcagccaacaggac

SEQ ID NO: 74726 - DNA, 28 bp, Artificial Sequence
  Description of Artificial Sequence: Synthetic oligonucleotide
ggacactctggacttcagccaacaggac

SEQ ID NO: 74727 - DNA, 29 bp, Artificial Sequence
  Description of Artificial Sequence: Synthetic oligonucleotide
gacactctggacttcagccaacaggactc

SEQ ID NO: 74728 - DNA, 31 bp, Artificial Sequence
  Description of Artificial Sequence: Synthetic oligonucleotide
acactctggacttcagccaacaggactcttg

SEQ ID NO: 74729 - DNA, 30 bp, Artificial Sequence
  Description of Artificial Sequence: Synthetic oligonucleotide
cactctggacttcagccaacaggactcttg

SEQ ID NO: 74730 - DNA, 31 bp, Artificial Sequence
  Description of Artificial Sequence: Synthetic oligonucleotide
actctggacttcagccaacaggactcttgag

SEQ ID NO: 74731 - DNA, 30 bp, Artificial Sequence
  Description of Artificial Sequence: Synthetic oligonucleotide
ctctggacttcagccaacaggactcttgag

SEQ ID NO: 74732 - DNA, 30 bp, Artificial Sequence
  Description of Artificial Sequence: Synthetic oligonucleotide
tctggacttcagccaacaggactcttgagc

SEQ ID NO: 74733 - DNA, 29 bp, Artificial Sequence
  Description of Artificial Sequence: Synthetic oligonucleotide
ctggacttcagccaacaggactcttgagc

SEQ ID NO: 74734 - DNA, 30 bp, Artificial Sequence
  Description of Artificial Sequence: Synthetic oligonucleotide
tggacttcagccaacaggactcttgagctg

SEQ ID NO: 74735 - DNA, 29 bp, Artificial Sequence
  Description of Artificial Sequence: Synthetic oligonucleotide
ggacttcagccaacaggactcttgagctg

SEQ ID NO: 74736 - DNA, 20 bp, Artificial Sequence
  Description of Artificial Sequence: Synthetic oligonucleotide
cggaggcgggccgaggtggt

SEQ ID NO: 74737 - DNA, 20 bp, Artificial Sequence
  Description of Artificial Sequence: Synthetic oligonucleotide
ggaggcgggccgaggtgggt

SEQ ID NO: 74738 - DNA, 20 bp, Artificial Sequence
  Description of Artificial Sequence: Synthetic oligonucleotide
gaggcgggccgaggtgggca

SEQ ID NO: 74739 - DNA, 20 bp, Artificial Sequence
  Description of Artificial Sequence: Synthetic oligonucleotide
aggcgggccgaggtgggcac

SEQ ID NO: 74740 - DNA, 20 bp, Artificial Sequence
  Description of Artificial Sequence: Synthetic oligonucleotide
ggcgggccgaggtgggcact

SEQ ID NO: 74741 - DNA, 21 bp, Artificial Sequence
  Description of Artificial Sequence: Synthetic oligonucleotide
gcgggccgaggtgggcaccta

SEQ ID NO: 74742 - DNA, 22 bp, Artificial Sequence
  Description of Artificial Sequence: Synthetic oligonucleotide
cgggccgaggtgggcacctact

SEQ ID NO: 74743 - DNA, 22 bp, Artificial Sequence
  Description of Artificial Sequence: Synthetic oligonucleotide
gggccgaggtgggcacctactg

SEQ ID NO: 74744 - DNA, 23 bp, Artificial Sequence
  Description of Artificial Sequence: Synthetic oligonucleotide
ggccgaggtgggcacctactgca

SEQ ID NO: 74745 - DNA, 26 bp, Artificial Sequence
  Description of Artificial Sequence: Synthetic oligonucleotide
gccgaggtgggcacctactgcagata

SEQ ID NO: 74746 - DNA, 27 bp, Artificial Sequence
  Description of Artificial Sequence: Synthetic oligonucleotide
ccgaggtgggcacctactgcagataca

SEQ ID NO: 74747 - DNA, 28 bp, Artificial Sequence
  Description of Artificial Sequence: Synthetic oligonucleotide
cgaggtgggcacctactgcagatacaac

SEQ ID NO: 74748 - DNA, 30 bp, Artificial Sequence
  Description of Artificial Sequence: Synthetic oligonucleotide
gaggtgggcacctactgcagatacaactac

SEQ ID NO: 74749 - DNA, 30 bp, Artificial Sequence
  Description of Artificial Sequence: Synthetic oligonucleotide
aggtgggcacctactgcagatacaactacg

SEQ ID NO: 74750 - DNA, 29 bp, Artificial Sequence
  Description of Artificial Sequence: Synthetic oligonucleotide
ggtgggcacctactgcagatacaactacg

SEQ ID NO: 74751 - DNA, 29 bp, Artificial Sequence
  Description of Artificial Sequence: Synthetic oligonucleotide
gtgggcacctactgcagatacaactacgg

SEQ ID NO: 74752 - DNA, 29 bp, Artificial Sequence
  Description of Artificial Sequence: Synthetic oligonucleotide
tgggcacctactgcagatacaactacggg

SEQ ID NO: 74753 - DNA, 28 bp, Artificial Sequence
  Description of Artificial Sequence: Synthetic oligonucleotide
gggcacctactgcagatacaactacggg

SEQ ID NO: 74754 - DNA, 28 bp, Artificial Sequence
  Description of Artificial Sequence: Synthetic oligonucleotide
ggcacctactgcagatacaactacgggg

SEQ ID NO: 74755 - DNA, 30 bp, Artificial Sequence
  Description of Artificial Sequence: Synthetic oligonucleotide
gcacctactgcagatacaactacggggttg

SEQ ID NO: 74756 - DNA, 27 bp, Artificial Sequence
  Description of Artificial Sequence: Synthetic oligonucleotide
gagagcttcacagtgcagcggcgagaa

SEQ ID NO: 74757 - DNA, 28 bp, Artificial Sequence
  Description of Artificial Sequence: Synthetic oligonucleotide
agagcttcacagtgcagcggcgagaaag

SEQ ID NO: 74758 - DNA, 27 bp, Artificial Sequence
  Description of Artificial Sequence: Synthetic oligonucleotide
gagcttcacagtgcagcggcgagaaag

SEQ ID NO: 74759 - DNA, 28 bp, Artificial Sequence
  Description of Artificial Sequence: Synthetic oligonucleotide
agcttcacagtgcagcggcgagaaagac

SEQ ID NO: 74760 - DNA, 27 bp, Artificial Sequence
  Description of Artificial Sequence: Synthetic oligonucleotide
gcttcacagtgcagcggcgagaaagac

SEQ ID NO: 74761 - DNA, 27 bp, Artificial Sequence
  Description of Artificial Sequence: Synthetic oligonucleotide
cttcacagtgcagcggcgagaaagacc

SEQ ID NO: 74762 - DNA, 27 bp, Artificial Sequence
  Description of Artificial Sequence: Synthetic oligonucleotide
ttcacagtgcagcggcgagaaagaccc

SEQ ID NO: 74763 - DNA, 27 bp, Artificial Sequence
  Description of Artificial Sequence: Synthetic oligonucleotide
tcacagtgcagcggcgagaaagaccca

SEQ ID NO: 74764 - DNA, 26 bp, Artificial Sequence
  Description of Artificial Sequence: Synthetic oligonucleotide
cacagtgcagcggcgagaaagaccca

SEQ ID NO: 74765 - DNA, 26 bp, Artificial Sequence
  Description of Artificial Sequence: Synthetic oligonucleotide
acagtgcagcggcgagaaagacccag

SEQ ID NO: 74766 - DNA, 25 bp, Artificial Sequence
  Description of Artificial Sequence: Synthetic oligonucleotide
cagtgcagcggcgagaaagacccag

SEQ ID NO: 74767 - DNA, 25 bp, Artificial Sequence
  Description of Artificial Sequence: Synthetic oligonucleotide
agtgcagcggcgagaaagacccagc

SEQ ID NO: 74768 - DNA, 24 bp, Artificial Sequence
  Description of Artificial Sequence: Synthetic oligonucleotide
gtgcagcggcgagaaagacccagc

SEQ ID NO: 74769 - DNA, 24 bp, Artificial Sequence
  Description of Artificial Sequence: Synthetic oligonucleotide
tgcagcggcgagaaagacccagcc

SEQ ID NO: 74770 - DNA, 23 bp, Artificial Sequence
  Description of Artificial Sequence: Synthetic oligonucleotide
gcagcggcgagaaagacccagcc

SEQ ID NO: 74771 - DNA, 23 bp, Artificial Sequence
  Description of Artificial Sequence: Synthetic oligonucleotide
cagcggcgagaaagacccagccc

SEQ ID NO: 74772 - DNA, 24 bp, Artificial Sequence
  Description of Artificial Sequence: Synthetic oligonucleotide
agcggcgagaaagacccagcccct

SEQ ID NO: 74773 - DNA, 23 bp, Artificial Sequence
  Description of Artificial Sequence: Synthetic oligonucleotide
gcggcgagaaagacccagcccct

SEQ ID NO: 74774 - DNA, 23 bp, Artificial Sequence
  Description of Artificial Sequence: Synthetic oligonucleotide
cggcgagaaagacccagcccctg

SEQ ID NO: 74775 - DNA, 24 bp, Artificial Sequence
  Description of Artificial Sequence: Synthetic oligonucleotide
ggcgagaaagacccagcccctgca

SEQ ID NO: 74776 - DNA, 24 bp, Artificial Sequence
  Description of Artificial Sequence: Synthetic oligonucleotide
gcgagaaagacccagcccctgcag

SEQ ID NO: 74777 - DNA, 25 bp, Artificial Sequence
  Description of Artificial Sequence: Synthetic oligonucleotide
cgagaaagacccagcccctgcagca

SEQ ID NO: 74778 - DNA, 25 bp, Artificial Sequence
  Description of Artificial Sequence: Synthetic oligonucleotide
gagaaagacccagcccctgcagcac

SEQ ID NO: 74779 - DNA, 26 bp, Artificial Sequence
  Description of Artificial Sequence: Synthetic oligonucleotide
agaaagacccagcccctgcagcacca

SEQ ID NO: 74780 - DNA, 25 bp, Artificial Sequence
  Description of Artificial Sequence: Synthetic oligonucleotide
gaaagacccagcccctgcagcacca

SEQ ID NO: 74781 - DNA, 30 bp, Artificial Sequence
  Description of Artificial Sequence: Synthetic oligonucleotide
agcatccaagcatgatgagccctctcacag

SEQ ID NO: 74782 - DNA, 29 bp, Artificial Sequence
  Description of Artificial Sequence: Synthetic oligonucleotide
gcatccaagcatgatgagccctctcacag

SEQ ID NO: 74783 - DNA, 30 bp, Artificial Sequence
  Description of Artificial Sequence: Synthetic oligonucleotide
catccaagcatgatgagccctctcacagtg

SEQ ID NO: 74784 - DNA, 30 bp, Artificial Sequence
  Description of Artificial Sequence: Synthetic oligonucleotide
atccaagcatgatgagccctctcacagtgc

SEQ ID NO: 74785 - DNA, 29 bp, Artificial Sequence
  Description of Artificial Sequence: Synthetic oligonucleotide
tccaagcatgatgagccctctcacagtgc

SEQ ID NO: 74786 - DNA, 28 bp, Artificial Sequence
  Description of Artificial Sequence: Synthetic oligonucleotide
ccaagcatgatgagccctctcacagtgc

SEQ ID NO: 74787 - DNA, 31 bp, Artificial Sequence
  Description of Artificial Sequence: Synthetic oligonucleotide
caagcatgatgagccctctcacagtgcaatg

SEQ ID NO: 74788 - DNA, 31 bp, Artificial Sequence
  Description of Artificial Sequence: Synthetic oligonucleotide
aagcatgatgagccctctcacagtgcaatgg

SEQ ID NO: 74789 - DNA, 30 bp, Artificial Sequence
  Description of Artificial Sequence: Synthetic oligonucleotide
agcatgatgagccctctcacagtgcaatgg

SEQ ID NO: 74790 - DNA, 29 bp, Artificial Sequence
  Description of Artificial Sequence: Synthetic oligonucleotide
gcatgatgagccctctcacagtgcaatgg

SEQ ID NO: 74791 - DNA, 30 bp, Artificial Sequence
  Description of Artificial Sequence: Synthetic oligonucleotide
catgatgagccctctcacagtgcaatggag

SEQ ID NO: 74792 - DNA, 31 bp, Artificial Sequence
  Description of Artificial Sequence: Synthetic oligonucleotide
atgatgagccctctcacagtgcaatggagtg

SEQ ID NO: 74793 - DNA, 30 bp, Artificial Sequence
  Description of Artificial Sequence: Synthetic oligonucleotide
tgatgagccctctcacagtgcaatggagtg

SEQ ID NO: 74794 - DNA, 29 bp, Artificial Sequence
  Description of Artificial Sequence: Synthetic oligonucleotide
gatgagccctctcacagtgcaatggagtg

SEQ ID NO: 74795 - DNA, 29 bp, Artificial Sequence
  Description of Artificial Sequence: Synthetic oligonucleotide
atgagccctctcacagtgcaatggagtgc

SEQ ID NO: 74796 - DNA, 28 bp, Artificial Sequence
  Description of Artificial Sequence: Synthetic oligonucleotide
tgagccctctcacagtgcaatggagtgc

SEQ ID NO: 74797 - DNA, 27 bp, Artificial Sequence
  Description of Artificial Sequence: Synthetic oligonucleotide
gagccctctcacagtgcaatggagtgc

SEQ ID NO: 74798 - DNA, 28 bp, Artificial Sequence
  Description of Artificial Sequence: Synthetic oligonucleotide
agccctctcacagtgcaatggagtgcac

SEQ ID NO: 74799 - DNA, 27 bp, Artificial Sequence
  Description of Artificial Sequence: Synthetic oligonucleotide
gccctctcacagtgcaatggagtgcac

SEQ ID NO: 74800 - DNA, 27 bp, Artificial Sequence
  Description of Artificial Sequence: Synthetic oligonucleotide
ccctctcacagtgcaatggagtgcacg

SEQ ID NO: 74801 - DNA, 27 bp, Artificial Sequence
  Description of Artificial Sequence: Synthetic oligonucleotide
cctctcacagtgcaatggagtgcacgg

SEQ ID NO: 74802 - DNA, 28 bp, Artificial Sequence
  Description of Artificial Sequence: Synthetic oligonucleotide
ctctcacagtgcaatggagtgcacggtc

SEQ ID NO: 74803 - DNA, 29 bp, Artificial Sequence
  Description of Artificial Sequence: Synthetic oligonucleotide
tctcacagtgcaatggagtgcacggtctg

SEQ ID NO: 74804 - DNA, 28 bp, Artificial Sequence
  Description of Artificial Sequence: Synthetic oligonucleotide
ctcacagtgcaatggagtgcacggtctg

SEQ ID NO: 74805 - DNA, 31 bp, Artificial Sequence
  Description of Artificial Sequence: Synthetic oligonucleotide
tcacagtgcaatggagtgcacggtctgaatc

SEQ ID NO: 74806 - DNA, 30 bp, Artificial Sequence
  Description of Artificial Sequence: Synthetic oligonucleotide
cacagtgcaatggagtgcacggtctgaatc

SEQ ID NO: 74807 - DNA, 31 bp, Artificial Sequence
  Description of Artificial Sequence: Synthetic oligonucleotide
acagtgcaatggagtgcacggtctgaatctg

SEQ ID NO: 74808 - DNA, 30 bp, Artificial Sequence
  Description of Artificial Sequence: Synthetic oligonucleotide
cagtgcaatggagtgcacggtctgaatctg

SEQ ID NO: 74809 - DNA, 30 bp, Artificial Sequence
  Description of Artificial Sequence: Synthetic oligonucleotide
agtgcaatggagtgcacggtctgaatctgc

SEQ ID NO: 74810 - DNA, 27 bp, Artificial Sequence
  Description of Artificial Sequence: Synthetic oligonucleotide
gggccgaggtggacacctattgcagat

SEQ ID NO: 74811 - DNA, 28 bp, Artificial Sequence
  Description of Artificial Sequence: Synthetic oligonucleotide
ggccgaggtggacacctattgcagatac

SEQ ID NO: 74812 - DNA, 30 bp, Artificial Sequence
  Description of Artificial Sequence: Synthetic oligonucleotide
gccgaggtggacacctattgcagatacaac

SEQ ID NO: 74813 - DNA, 32 bp, Artificial Sequence
  Description of Artificial Sequence: Synthetic oligonucleotide
ccgaggtggacacctattgcagatacaactac

SEQ ID NO: 74814 - DNA, 32 bp, Artificial Sequence
  Description of Artificial Sequence: Synthetic oligonucleotide
cgaggtggacacctattgcagatacaactacg

SEQ ID NO: 74815 - DNA, 32 bp, Artificial Sequence
  Description of Artificial Sequence: Synthetic oligonucleotide
gaggtggacacctattgcagatacaactacgg

SEQ ID NO: 74816 - DNA, 32 bp, Artificial Sequence
  Description of Artificial Sequence: Synthetic oligonucleotide
aggtggacacctattgcagatacaactacggg

SEQ ID NO: 74817 - DNA, 31 bp, Artificial Sequence
  Description of Artificial Sequence: Synthetic oligonucleotide
ggtggacacctattgcagatacaactacggg

SEQ ID NO: 74818 - DNA, 31 bp, Artificial Sequence
  Description of Artificial Sequence: Synthetic oligonucleotide
gtggacacctattgcagatacaactacgggg

SEQ ID NO: 74819 - DNA, 33 bp, Artificial Sequence
  Description of Artificial Sequence: Synthetic oligonucleotide
tggacacctattgcagatacaactacggggttg

SEQ ID NO: 74820 - DNA, 32 bp, Artificial Sequence
  Description of Artificial Sequence: Synthetic oligonucleotide
ggacacctattgcagatacaactacggggttg

SEQ ID NO: 74821 - DNA, 33 bp, Artificial Sequence
  Description of Artificial Sequence: Synthetic oligonucleotide
gacacctattgcagatacaactacggggttgtg

SEQ ID NO: 74822 - DNA, 33 bp, Artificial Sequence
  Description of Artificial Sequence: Synthetic oligonucleotide
acacctattgcagatacaactacggggttgtgg

SEQ ID NO: 74823 - DNA, 32 bp, Artificial Sequence
  Description of Artificial Sequence: Synthetic oligonucleotide
cacctattgcagatacaactacggggttgtgg

SEQ ID NO: 74824 - DNA, 33 bp, Artificial Sequence
  Description of Artificial Sequence: Synthetic oligonucleotide
acctattgcagatacaactacggggttgtggag

SEQ ID NO: 74825 - DNA, 32 bp, Artificial Sequence
  Description of Artificial Sequence: Synthetic oligonucleotide
cctattgcagatacaactacggggttgtggag

SEQ ID NO: 74826 - DNA, 33 bp, Artificial Sequence
  Description of Artificial Sequence: Synthetic oligonucleotide
ctattgcagatacaactacggggttgtggagag

SEQ ID NO: 74827 - DNA, 33 bp, Artificial Sequence
  Description of Artificial Sequence: Synthetic oligonucleotide
tattgcagatacaactacggggttgtggagagc

SEQ ID NO: 74828 - DNA, 32 bp, Artificial Sequence
  Description of Artificial Sequence: Synthetic oligonucleotide
attgcagatacaactacggggttgtggagagc

SEQ ID NO: 74829 - DNA, 31 bp, Artificial Sequence
  Description of Artificial Sequence: Synthetic oligonucleotide
ttgcagatacaactacggggttgtggagagc

SEQ ID NO: 74830 - DNA, 30 bp, Artificial Sequence
  Description of Artificial Sequence: Synthetic oligonucleotide
aagaggagtacgcgcgctacaacagtgatc

SEQ ID NO: 74831 - DNA, 29 bp, Artificial Sequence
  Description of Artificial Sequence: Synthetic oligonucleotide
agaggagtacgcgcgctacaacagtgatc

SEQ ID NO: 74832 - DNA, 28 bp, Artificial Sequence
  Description of Artificial Sequence: Synthetic oligonucleotide
gaggagtacgcgcgctacaacagtgatc

SEQ ID NO: 74833 - DNA, 29 bp, Artificial Sequence
  Description of Artificial Sequence: Synthetic oligonucleotide
aggagtacgcgcgctacaacagtgatctg

SEQ ID NO: 74834 - DNA, 28 bp, Artificial Sequence
  Description of Artificial Sequence: Synthetic oligonucleotide
ggagtacgcgcgctacaacagtgatctg

SEQ ID NO: 74835 - DNA, 28 bp, Artificial Sequence
  Description of Artificial Sequence: Synthetic oligonucleotide
gagtacgcgcgctacaacagtgatctgg

SEQ ID NO: 74836 - DNA, 28 bp, Artificial Sequence
  Description of Artificial Sequence: Synthetic oligonucleotide
agtacgcgcgctacaacagtgatctggg

SEQ ID NO: 74837 - DNA, 27 bp, Artificial Sequence
  Description of Artificial Sequence: Synthetic oligonucleotide
gtacgcgcgctacaacagtgatctggg

SEQ ID NO: 74838 - DNA, 27 bp, Artificial Sequence
  Description of Artificial Sequence: Synthetic oligonucleotide
tacgcgcgctacaacagtgatctgggg

SEQ ID NO: 74839 - DNA, 26 bp, Artificial Sequence
  Description of Artificial Sequence: Synthetic oligonucleotide
acgcgcgctacaacagtgatctgggg

SEQ ID NO: 74840 - DNA, 25 bp, Artificial Sequence
  Description of Artificial Sequence: Synthetic oligonucleotide
cgcgcgctacaacagtgatctgggg

SEQ ID NO: 74841 - DNA, 26 bp, Artificial Sequence
  Description of Artificial Sequence: Synthetic oligonucleotide
gcgcgctacaacagtgatctggggga

SEQ ID NO: 74842 - DNA, 27 bp, Artificial Sequence
  Description of Artificial Sequence: Synthetic oligonucleotide
cgcgctacaacagtgatctgggggagt

SEQ ID NO: 74843 - DNA, 28 bp, Artificial Sequence
  Description of Artificial Sequence: Synthetic oligonucleotide
gcgctacaacagtgatctgggggagtac

SEQ ID NO: 74844 - DNA, 28 bp, Artificial Sequence
  Description of Artificial Sequence: Synthetic oligonucleotide
cgctacaacagtgatctgggggagtacc

SEQ ID NO: 74845 - DNA, 29 bp, Artificial Sequence
  Description of Artificial Sequence: Synthetic oligonucleotide
gctacaacagtgatctgggggagtaccag

SEQ ID NO: 74846 - DNA, 29 bp, Artificial Sequence
  Description of Artificial Sequence: Synthetic oligonucleotide
ctacaacagtgatctgggggagtaccagg

SEQ ID NO: 74847 - DNA, 29 bp, Artificial Sequence
  Description of Artificial Sequence: Synthetic oligonucleotide
tacaacagtgatctgggggagtaccaggc

SEQ ID NO: 74848 - DNA, 28 bp, Artificial Sequence
  Description of Artificial Sequence: Synthetic oligonucleotide
acaacagtgatctgggggagtaccaggc

SEQ ID NO: 74849 - DNA, 27 bp, Artificial Sequence
  Description of Artificial Sequence: Synthetic oligonucleotide
caacagtgatctgggggagtaccaggc

SEQ ID NO: 74850 - DNA, 27 bp, Artificial Sequence
  Description of Artificial Sequence: Synthetic oligonucleotide
aacagtgatctgggggagtaccaggcg

SEQ ID NO: 74851 - DNA, 26 bp, Artificial Sequence
  Description of Artificial Sequence: Synthetic oligonucleotide
acagtgatctgggggagtaccaggcg

SEQ ID NO: 74852 - DNA, 25 bp, Artificial Sequence
  Description of Artificial Sequence: Synthetic oligonucleotide
cagtgatctgggggagtaccaggcg

SEQ ID NO: 74853 - DNA, 26 bp, Artificial Sequence
  Description of Artificial Sequence: Synthetic oligonucleotide
agtgatctgggggagtaccaggcggt

SEQ ID NO: 74854 - DNA, 25 bp, Artificial Sequence
  Description of Artificial Sequence: Synthetic oligonucleotide
gtgatctgggggagtaccaggcggt

SEQ ID NO: 74855 - DNA, 26 bp, Artificial Sequence
  Description of Artificial Sequence: Synthetic oligonucleotide
tgatctgggggagtaccaggcggtga

SEQ ID NO: 74856 - DNA, 25 bp, Artificial Sequence
  Description of Artificial Sequence: Synthetic oligonucleotide
gatctgggggagtaccaggcggtga

SEQ ID NO: 74857 - DNA, 25 bp, Artificial Sequence
  Description of Artificial Sequence: Synthetic oligonucleotide
atctgggggagtaccaggcggtgac

SEQ ID NO: 74858 - DNA, 24 bp, Artificial Sequence
  Description of Artificial Sequence: Synthetic oligonucleotide
tctgggggagtaccaggcggtgac

SEQ ID NO: 74859 - DNA, 27 bp, Artificial Sequence
  Description of Artificial Sequence: Synthetic oligonucleotide
gggccgaggtggacaactactgcagat

SEQ ID NO: 74860 - DNA, 28 bp, Artificial Sequence
  Description of Artificial Sequence: Synthetic oligonucleotide
ggccgaggtggacaactactgcagatac

SEQ ID NO: 74861 - DNA, 30 bp, Artificial Sequence
  Description of Artificial Sequence: Synthetic oligonucleotide
gccgaggtggacaactactgcagatacaac

SEQ ID NO: 74862 - DNA, 32 bp, Artificial Sequence
  Description of Artificial Sequence: Synthetic oligonucleotide
ccgaggtggacaactactgcagatacaactac

SEQ ID NO: 74863 - DNA, 32 bp, Artificial Sequence
  Description of Artificial Sequence: Synthetic oligonucleotide
cgaggtggacaactactgcagatacaactacg

SEQ ID NO: 74864 - DNA, 32 bp, Artificial Sequence
  Description of Artificial Sequence: Synthetic oligonucleotide
gaggtggacaactactgcagatacaactacgg

SEQ ID NO: 74865 - DNA, 32 bp, Artificial Sequence
  Description of Artificial Sequence: Synthetic oligonucleotide
aggtggacaactactgcagatacaactacggg

SEQ ID NO: 74866 - DNA, 31 bp, Artificial Sequence
  Description of Artificial Sequence: Synthetic oligonucleotide
ggtggacaactactgcagatacaactacggg

SEQ ID NO: 74867 - DNA, 31 bp, Artificial Sequence
  Description of Artificial Sequence: Synthetic oligonucleotide
gtggacaactactgcagatacaactacgggg

SEQ ID NO: 74868 - DNA, 33 bp, Artificial Sequence
  Description of Artificial Sequence: Synthetic oligonucleotide
tggacaactactgcagatacaactacggggttg

SEQ ID NO: 74869 - DNA, 32 bp, Artificial Sequence
  Description of Artificial Sequence: Synthetic oligonucleotide
ggacaactactgcagatacaactacggggttg

SEQ ID NO: 74870 - DNA, 33 bp, Artificial Sequence
  Description of Artificial Sequence: Synthetic oligonucleotide
gacaactactgcagatacaactacggggttgtg

SEQ ID NO: 74871 - DNA, 33 bp, Artificial Sequence
  Description of Artificial Sequence: Synthetic oligonucleotide
acaactactgcagatacaactacggggttgtgg

SEQ ID NO: 74872 - DNA, 32 bp, Artificial Sequence
  Description of Artificial Sequence: Synthetic oligonucleotide
caactactgcagatacaactacggggttgtgg

SEQ ID NO: 74873 - DNA, 33 bp, Artificial Sequence
  Description of Artificial Sequence: Synthetic oligonucleotide
aactactgcagatacaactacggggttgtggag

SEQ ID NO: 74874 - DNA, 32 bp, Artificial Sequence
  Description of Artificial Sequence: Synthetic oligonucleotide
actactgcagatacaactacggggttgtggag

SEQ ID NO: 74875 - DNA, 25 bp, Artificial Sequence
  Description of Artificial Sequence: Synthetic oligonucleotide
ccagcccctgcagcactacaacctc

SEQ ID NO: 74876 - DNA, 26 bp, Artificial Sequence
  Description of Artificial Sequence: Synthetic oligonucleotide
cagcccctgcagcactacaacctcct

SEQ ID NO: 74877 - DNA, 26 bp, Artificial Sequence
  Description of Artificial Sequence: Synthetic oligonucleotide
agcccctgcagcactacaacctcctg

SEQ ID NO: 74878 - DNA, 25 bp, Artificial Sequence
  Description of Artificial Sequence: Synthetic oligonucleotide
gcccctgcagcactacaacctcctg

SEQ ID NO: 74879 - DNA, 26 bp, Artificial Sequence
  Description of Artificial Sequence: Synthetic oligonucleotide
cccctgcagcactacaacctcctggt

SEQ ID NO: 74880 - DNA, 27 bp, Artificial Sequence
  Description of Artificial Sequence: Synthetic oligonucleotide
ccctgcagcactacaacctcctggtct

SEQ ID NO: 74881 - DNA, 27 bp, Artificial Sequence
  Description of Artificial Sequence: Synthetic oligonucleotide
cctgcagcactacaacctcctggtctg

SEQ ID NO: 74882 - DNA, 27 bp, Artificial Sequence
  Description of Artificial Sequence: Synthetic oligonucleotide
ctgcagcactacaacctcctggtctgc

SEQ ID NO: 74883 - DNA, 28 bp, Artificial Sequence
  Description of Artificial Sequence: Synthetic oligonucleotide
tgcagcactacaacctcctggtctgctc

SEQ ID NO: 74884 - DNA, 27 bp, Artificial Sequence
  Description of Artificial Sequence: Synthetic oligonucleotide
gcagcactacaacctcctggtctgctc

SEQ ID NO: 74885 - DNA, 28 bp, Artificial Sequence
  Description of Artificial Sequence: Synthetic oligonucleotide
cagcactacaacctcctggtctgctctg

SEQ ID NO: 74886 - DNA, 29 bp, Artificial Sequence
  Description of Artificial Sequence: Synthetic oligonucleotide
agcactacaacctcctggtctgctctgtg

SEQ ID NO: 74887 - DNA, 28 bp, Artificial Sequence
  Description of Artificial Sequence: Synthetic oligonucleotide
gcactacaacctcctggtctgctctgtg

SEQ ID NO: 74888 - DNA, 31 bp, Artificial Sequence
  Description of Artificial Sequence: Synthetic oligonucleotide
cactacaacctcctggtctgctctgtgaatg

SEQ ID NO: 74889 - DNA, 31 bp, Artificial Sequence
  Description of Artificial Sequence: Synthetic oligonucleotide
actacaacctcctggtctgctctgtgaatgg

SEQ ID NO: 74890 - DNA, 30 bp, Artificial Sequence
  Description of Artificial Sequence: Synthetic oligonucleotide
ctacaacctcctggtctgctctgtgaatgg

SEQ ID NO: 74891 - DNA, 33 bp, Artificial Sequence
  Description of Artificial Sequence: Synthetic oligonucleotide
tacaacctcctggtctgctctgtgaatggtttc

SEQ ID NO: 74892 - DNA, 31 bp, Artificial Sequence
  Description of Artificial Sequence: Synthetic oligonucleotide
gaggtggacacctactgcagatacaactacc

SEQ ID NO: 74893 - DNA, 31 bp, Artificial Sequence
  Description of Artificial Sequence: Synthetic oligonucleotide
aggtggacacctactgcagatacaactaccg

SEQ ID NO: 74894 - DNA, 30 bp, Artificial Sequence
  Description of Artificial Sequence: Synthetic oligonucleotide
ggtggacacctactgcagatacaactaccg

SEQ ID NO: 74895 - DNA, 30 bp, Artificial Sequence
  Description of Artificial Sequence: Synthetic oligonucleotide
gtggacacctactgcagatacaactaccgg

SEQ ID NO: 74896 - DNA, 30 bp, Artificial Sequence
  Description of Artificial Sequence: Synthetic oligonucleotide
tggacacctactgcagatacaactaccggg

SEQ ID NO: 74897 - DNA, 29 bp, Artificial Sequence
  Description of Artificial Sequence: Synthetic oligonucleotide
ggacacctactgcagatacaactaccggg

SEQ ID NO: 74898 - DNA, 31 bp, Artificial Sequence
  Description of Artificial Sequence: Synthetic oligonucleotide
gacacctactgcagatacaactaccgggttg

SEQ ID NO: 74899 - DNA, 32 bp, Artificial Sequence
  Description of Artificial Sequence: Synthetic oligonucleotide
acacctactgcagatacaactaccgggttgtg

SEQ ID NO: 74900 - DNA, 31 bp, Artificial Sequence
  Description of Artificial Sequence: Synthetic oligonucleotide
cacctactgcagatacaactaccgggttgtg

SEQ ID NO: 74901 - DNA, 31 bp, Artificial Sequence
  Description of Artificial Sequence: Synthetic oligonucleotide
acctactgcagatacaactaccgggttgtgg

SEQ ID NO: 74902 - DNA, 30 bp, Artificial Sequence
  Description of Artificial Sequence: Synthetic oligonucleotide
cctactgcagatacaactaccgggttgtgg

SEQ ID NO: 74903 - DNA, 31 bp, Artificial Sequence
  Description of Artificial Sequence: Synthetic oligonucleotide
ctactgcagatacaactaccgggttgtggag

SEQ ID NO: 74904 - DNA, 32 bp, Artificial Sequence
  Description of Artificial Sequence: Synthetic oligonucleotide
tactgcagatacaactaccgggttgtggagag

SEQ ID NO: 74905 - DNA, 31 bp, Artificial Sequence
  Description of Artificial Sequence: Synthetic oligonucleotide
actgcagatacaactaccgggttgtggagag

SEQ ID NO: 74906 - DNA, 30 bp, Artificial Sequence
  Description of Artificial Sequence: Synthetic oligonucleotide
ctgcagatacaactaccgggttgtggagag

SEQ ID NO: 74907 - DNA, 30 bp, Artificial Sequence
  Description of Artificial Sequence: Synthetic oligonucleotide
tgcagatacaactaccgggttgtggagagc

SEQ ID NO: 74908 - DNA, 29 bp, Artificial Sequence
  Description of Artificial Sequence: Synthetic oligonucleotide
gcagatacaactaccgggttgtggagagc

SEQ ID NO: 74909 - DNA, 31 bp, Artificial Sequence
  Description of Artificial Sequence: Synthetic oligonucleotide
cagatacaactaccgggttgtggagagcttc

SEQ ID NO: 74910 - DNA, 32 bp, Artificial Sequence
  Description of Artificial Sequence: Synthetic oligonucleotide
agatacaactaccgggttgtggagagcttcac

SEQ ID NO: 74911 - DNA, 31 bp, Artificial Sequence
  Description of Artificial Sequence: Synthetic oligonucleotide
gatacaactaccgggttgtggagagcttcac

SEQ ID NO: 74912 - DNA, 32 bp, Artificial Sequence
  Description of Artificial Sequence: Synthetic oligonucleotide
atacaactaccgggttgtggagagcttcacag

SEQ ID NO: 74913 - DNA, 31 bp, Artificial Sequence
  Description of Artificial Sequence: Synthetic oligonucleotide
tacaactaccgggttgtggagagcttcacag

SEQ ID NO: 74914 - DNA, 30 bp, Artificial Sequence
  Description of Artificial Sequence: Synthetic oligonucleotide
acaactaccgggttgtggagagcttcacag

SEQ ID NO: 74915 - DNA, 29 bp, Artificial Sequence
  Description of Artificial Sequence: Synthetic oligonucleotide
caactaccgggttgtggagagcttcacag

SEQ ID NO: 74916 - DNA, 30 bp, Artificial Sequence
  Description of Artificial Sequence: Synthetic oligonucleotide
aactaccgggttgtggagagcttcacagtg

SEQ ID NO: 74917 - DNA, 29 bp, Artificial Sequence
  Description of Artificial Sequence: Synthetic oligonucleotide
actaccgggttgtggagagcttcacagtg

SEQ ID NO: 74918 - DNA, 28 bp, Artificial Sequence
  Description of Artificial Sequence: Synthetic oligonucleotide
ctaccgggttgtggagagcttcacagtg

SEQ ID NO: 74919 - DNA, 28 bp, Artificial Sequence
  Description of Artificial Sequence: Synthetic oligonucleotide
taccgggttgtggagagcttcacagtgc

SEQ ID NO: 74920 - DNA, 27 bp, Artificial Sequence
  Description of Artificial Sequence: Synthetic oligonucleotide
accgggttgtggagagcttcacagtgc

SEQ ID NO: 74921 - DNA, 27 bp, Artificial Sequence
  Description of Artificial Sequence: Synthetic oligonucleotide
ccgggttgtggagagcttcacagtgca

SEQ ID NO: 74922 - DNA, 27 bp, Artificial Sequence
  Description of Artificial Sequence: Synthetic oligonucleotide
cgggttgtggagagcttcacagtgcag

SEQ ID NO: 74923 - DNA, 33 bp, Artificial Sequence
  Description of Artificial Sequence: Synthetic oligonucleotide
acctactgcagatacaactacggggttgtgaag

SEQ ID NO: 74924 - DNA, 32 bp, Artificial Sequence
  Description of Artificial Sequence: Synthetic oligonucleotide
cctactgcagatacaactacggggttgtgaag

SEQ ID NO: 74925 - DNA, 33 bp, Artificial Sequence
  Description of Artificial Sequence: Synthetic oligonucleotide
ctactgcagatacaactacggggttgtgaagag

SEQ ID NO: 74926 - DNA, 33 bp, Artificial Sequence
  Description of Artificial Sequence: Synthetic oligonucleotide
tactgcagatacaactacggggttgtgaagagc

SEQ ID NO: 74927 - DNA, 32 bp, Artificial Sequence
  Description of Artificial Sequence: Synthetic oligonucleotide
actgcagatacaactacggggttgtgaagagc

SEQ ID NO: 74928 - DNA, 31 bp, Artificial Sequence
  Description of Artificial Sequence: Synthetic oligonucleotide
ctgcagatacaactacggggttgtgaagagc

SEQ ID NO: 74929 - DNA, 33 bp, Artificial Sequence
  Description of Artificial Sequence: Synthetic oligonucleotide
tgcagatacaactacggggttgtgaagagcttc

SEQ ID NO: 74930 - DNA, 32 bp, Artificial Sequence
  Description of Artificial Sequence: Synthetic oligonucleotide
gcagatacaactacggggttgtgaagagcttc

SEQ ID NO: 74931 - DNA, 33 bp, Artificial Sequence
  Description of Artificial Sequence: Synthetic oligonucleotide
cagatacaactacggggttgtgaagagcttcac

SEQ ID NO: 74932 - DNA, 34 bp, Artificial Sequence
  Description of Artificial Sequence: Synthetic oligonucleotide
agatacaactacggggttgtgaagagcttcacag

SEQ ID NO: 74933 - DNA, 33 bp, Artificial Sequence
  Description of Artificial Sequence: Synthetic oligonucleotide
gatacaactacggggttgtgaagagcttcacag

SEQ ID NO: 74934 - DNA, 34 bp, Artificial Sequence
  Description of Artificial Sequence: Synthetic oligonucleotide
atacaactacggggttgtgaagagcttcacagtg

SEQ ID NO: 74935 - DNA, 33 bp, Artificial Sequence
  Description of Artificial Sequence: Synthetic oligonucleotide
tacaactacggggttgtgaagagcttcacagtg

SEQ ID NO: 74936 - DNA, 32 bp, Artificial Sequence
  Description of Artificial Sequence: Synthetic oligonucleotide
acaactacggggttgtgaagagcttcacagtg

SEQ ID NO: 74937 - DNA, 31 bp, Artificial Sequence
  Description of Artificial Sequence: Synthetic oligonucleotide
caactacggggttgtgaagagcttcacagtg

SEQ ID NO: 74938 - DNA, 31 bp, Artificial Sequence
  Description of Artificial Sequence: Synthetic oligonucleotide
aactacggggttgtgaagagcttcacagtgc

SEQ ID NO: 74939 - DNA, 30 bp, Artificial Sequence
  Description of Artificial Sequence: Synthetic oligonucleotide
actacggggttgtgaagagcttcacagtgc

SEQ ID NO: 74940 - DNA, 29 bp, Artificial Sequence
  Description of Artificial Sequence: Synthetic oligonucleotide
ctacggggttgtgaagagcttcacagtgc

SEQ ID NO: 74941 - DNA, 30 bp, Artificial Sequence
  Description of Artificial Sequence: Synthetic oligonucleotide
tacggggttgtgaagagcttcacagtgcag

SEQ ID NO: 74942 - DNA, 29 bp, Artificial Sequence
  Description of Artificial Sequence: Synthetic oligonucleotide
acggggttgtgaagagcttcacagtgcag

SEQ ID NO: 74943 - DNA, 28 bp, Artificial Sequence
  Description of Artificial Sequence: Synthetic oligonucleotide
cggggttgtgaagagcttcacagtgcag

SEQ ID NO: 74944 - DNA, 28 bp, Artificial Sequence
  Description of Artificial Sequence: Synthetic oligonucleotide
ggggttgtgaagagcttcacagtgcagc

SEQ ID NO: 74945 - DNA, 28 bp, Artificial Sequence
  Description of Artificial Sequence: Synthetic oligonucleotide
gggttgtgaagagcttcacagtgcagcg

SEQ ID NO: 74946 - DNA, 28 bp, Artificial Sequence
  Description of Artificial Sequence: Synthetic oligonucleotide
ggttgtgaagagcttcacagtgcagcgg

SEQ ID NO: 74947 - DNA, 28 bp, Artificial Sequence
  Description of Artificial Sequence: Synthetic oligonucleotide
gttgtgaagagcttcacagtgcagcggc

SEQ ID NO: 74948 - DNA, 28 bp, Artificial Sequence
  Description of Artificial Sequence: Synthetic oligonucleotide
ttgtgaagagcttcacagtgcagcggcg

SEQ ID NO: 74949 - DNA, 27 bp, Artificial Sequence
  Description of Artificial Sequence: Synthetic oligonucleotide
tgtgaagagcttcacagtgcagcggcg

SEQ ID NO: 74950 - DNA, 27 bp, Artificial Sequence
  Description of Artificial Sequence: Synthetic oligonucleotide
gtgaagagcttcacagtgcagcggcga

SEQ ID NO: 74951 - DNA, 27 bp, Artificial Sequence
  Description of Artificial Sequence: Synthetic oligonucleotide
tgaagagcttcacagtgcagcggcgag

SEQ ID NO: 74952 - DNA, 30 bp, Artificial Sequence
  Description of Artificial Sequence: Synthetic oligonucleotide
tgagtgtcatttcctcaatgggacggagcc

SEQ ID NO: 74953 - DNA, 29 bp, Artificial Sequence
  Description of Artificial Sequence: Synthetic oligonucleotide
gagtgtcatttcctcaatgggacggagcc

SEQ ID NO: 74954 - DNA, 30 bp, Artificial Sequence
  Description of Artificial Sequence: Synthetic oligonucleotide
agtgtcatttcctcaatgggacggagcctg

SEQ ID NO: 74955 - DNA, 29 bp, Artificial Sequence
  Description of Artificial Sequence: Synthetic oligonucleotide
gtgtcatttcctcaatgggacggagcctg

SEQ ID NO: 74956 - DNA, 31 bp, Artificial Sequence
  Description of Artificial Sequence: Synthetic oligonucleotide
tgtcatttcctcaatgggacggagcctgatc

SEQ ID NO: 74957 - DNA, 30 bp, Artificial Sequence
  Description of Artificial Sequence: Synthetic oligonucleotide
gtcatttcctcaatgggacggagcctgatc

SEQ ID NO: 74958 - DNA, 31 bp, Artificial Sequence
  Description of Artificial Sequence: Synthetic oligonucleotide
tcatttcctcaatgggacggagcctgatcag

SEQ ID NO: 74959 - DNA, 30 bp, Artificial Sequence
  Description of Artificial Sequence: Synthetic oligonucleotide
catttcctcaatgggacggagcctgatcag

SEQ ID NO: 74960 - DNA, 33 bp, Artificial Sequence
  Description of Artificial Sequence: Synthetic oligonucleotide
atttcctcaatgggacggagcctgatcagatac

SEQ ID NO: 74961 - DNA, 32 bp, Artificial Sequence
  Description of Artificial Sequence: Synthetic oligonucleotide
tttcctcaatgggacggagcctgatcagatac

SEQ ID NO: 74962 - DNA, 31 bp, Artificial Sequence
  Description of Artificial Sequence: Synthetic oligonucleotide
ttcctcaatgggacggagcctgatcagatac

SEQ ID NO: 74963 - DNA, 30 bp, Artificial Sequence
  Description of Artificial Sequence: Synthetic oligonucleotide
tcctcaatgggacggagcctgatcagatac

SEQ ID NO: 74964 - DNA, 29 bp, Artificial Sequence
  Description of Artificial Sequence: Synthetic oligonucleotide
cctcaatgggacggagcctgatcagatac

SEQ ID NO: 74965 - DNA, 31 bp, Artificial Sequence
  Description of Artificial Sequence: Synthetic oligonucleotide
ctcaatgggacggagcctgatcagatacatc

SEQ ID NO: 74966 - DNA, 36 bp, Artificial Sequence
  Description of Artificial Sequence: Synthetic oligonucleotide
tcaatgggacggagcctgatcagatacatctataac

SEQ ID NO: 74967 - DNA, 35 bp, Artificial Sequence
  Description of Artificial Sequence: Synthetic oligonucleotide
caatgggacggagcctgatcagatacatctataac

SEQ ID NO: 74968 - DNA, 35 bp, Artificial Sequence
  Description of Artificial Sequence: Synthetic oligonucleotide
aatgggacggagcctgatcagatacatctataacc

SEQ ID NO: 74969 - DNA, 34 bp, Artificial Sequence
  Description of Artificial Sequence: Synthetic oligonucleotide
atgggacggagcctgatcagatacatctataacc

SEQ ID NO: 74970 - DNA, 33 bp, Artificial Sequence
  Description of Artificial Sequence: Synthetic oligonucleotide
tgggacggagcctgatcagatacatctataacc

SEQ ID NO: 74971 - DNA, 32 bp, Artificial Sequence
  Description of Artificial Sequence: Synthetic oligonucleotide
gggacggagcctgatcagatacatctataacc

SEQ ID NO: 74972 - DNA, 34 bp, Artificial Sequence
  Description of Artificial Sequence: Synthetic oligonucleotide
ggacggagcctgatcagatacatctataaccaag

SEQ ID NO: 74973 - DNA, 35 bp, Artificial Sequence
  Description of Artificial Sequence: Synthetic oligonucleotide
gacggagcctgatcagatacatctataaccaagag

SEQ ID NO: 74974 - DNA, 35 bp, Artificial Sequence
  Description of Artificial Sequence: Synthetic oligonucleotide
acggagcctgatcagatacatctataaccaagagg

SEQ ID NO: 74975 - DNA, 34 bp, Artificial Sequence
  Description of Artificial Sequence: Synthetic oligonucleotide
cggagcctgatcagatacatctataaccaagagg

SEQ ID NO: 74976 - DNA, 35 bp, Artificial Sequence
  Description of Artificial Sequence: Synthetic oligonucleotide
ggagcctgatcagatacatctataaccaagaggag

SEQ ID NO: 74977 - DNA, 37 bp, Artificial Sequence
  Description of Artificial Sequence: Synthetic oligonucleotide
gagcctgatcagatacatctataaccaagaggagtac

SEQ ID NO: 74978 - DNA, 37 bp, Artificial Sequence
  Description of Artificial Sequence: Synthetic oligonucleotide
agcctgatcagatacatctataaccaagaggagtacg

SEQ ID NO: 74979 - DNA, 36 bp, Artificial Sequence
  Description of Artificial Sequence: Synthetic oligonucleotide
gcctgatcagatacatctataaccaagaggagtacg

SEQ ID NO: 74980 - DNA, 29 bp, Artificial Sequence
  Description of Artificial Sequence: Synthetic oligonucleotide
atggtgtgtctgaagctccctggaggttc

SEQ ID NO: 74981 - DNA, 28 bp, Artificial Sequence
  Description of Artificial Sequence: Synthetic oligonucleotide
tggtgtgtctgaagctccctggaggttc

SEQ ID NO: 74982 - DNA, 27 bp, Artificial Sequence
  Description of Artificial Sequence: Synthetic oligonucleotide
ggtgtgtctgaagctccctggaggttc

SEQ ID NO: 74983 - DNA, 27 bp, Artificial Sequence
  Description of Artificial Sequence: Synthetic oligonucleotide
gtgtgtctgaagctccctggaggttcc

SEQ ID NO: 74984 - DNA, 29 bp, Artificial Sequence
  Description of Artificial Sequence: Synthetic oligonucleotide
tgtgtctgaagctccctggaggttcctac

SEQ ID NO: 74985 - DNA, 28 bp, Artificial Sequence
  Description of Artificial Sequence: Synthetic oligonucleotide
gtgtctgaagctccctggaggttcctac

SEQ ID NO: 74986 - DNA, 30 bp, Artificial Sequence
  Description of Artificial Sequence: Synthetic oligonucleotide
tgtctgaagctccctggaggttcctacatg

SEQ ID NO: 74987 - DNA, 29 bp, Artificial Sequence
  Description of Artificial Sequence: Synthetic oligonucleotide
gtctgaagctccctggaggttcctacatg

SEQ ID NO: 74988 - DNA, 29 bp, Artificial Sequence
  Description of Artificial Sequence: Synthetic oligonucleotide
tctgaagctccctggaggttcctacatgg

SEQ ID NO: 74989 - DNA, 28 bp, Artificial Sequence
  Description of Artificial Sequence: Synthetic oligonucleotide
ctgaagctccctggaggttcctacatgg

SEQ ID NO: 74990 - DNA, 28 bp, Artificial Sequence
  Description of Artificial Sequence: Synthetic oligonucleotide
tgaagctccctggaggttcctacatggc

SEQ ID NO: 74991 - DNA, 27 bp, Artificial Sequence
  Description of Artificial Sequence: Synthetic oligonucleotide
gaagctccctggaggttcctacatggc

SEQ ID NO: 74992 - DNA, 30 bp, Artificial Sequence
  Description of Artificial Sequence: Synthetic oligonucleotide
aagctccctggaggttcctacatggcaaag

SEQ ID NO: 74993 - DNA, 29 bp, Artificial Sequence
  Description of Artificial Sequence: Synthetic oligonucleotide
agctccctggaggttcctacatggcaaag

SEQ ID NO: 74994 - DNA, 28 bp, Artificial Sequence
  Description of Artificial Sequence: Synthetic oligonucleotide
gctccctggaggttcctacatggcaaag

SEQ ID NO: 74995 - DNA, 28 bp, Artificial Sequence
  Description of Artificial Sequence: Synthetic oligonucleotide
ctccctggaggttcctacatggcaaagc

SEQ ID NO: 74996 - DNA, 29 bp, Artificial Sequence
  Description of Artificial Sequence: Synthetic oligonucleotide
tccctggaggttcctacatggcaaagctg

SEQ ID NO: 74997 - DNA, 28 bp, Artificial Sequence
  Description of Artificial Sequence: Synthetic oligonucleotide
ccctggaggttcctacatggcaaagctg

SEQ ID NO: 74998 - DNA, 29 bp, Artificial Sequence
  Description of Artificial Sequence: Synthetic oligonucleotide
cctggaggttcctacatggcaaagctgac

SEQ ID NO: 74999 - DNA, 30 bp, Artificial Sequence
  Description of Artificial Sequence: Synthetic oligonucleotide
ctggaggttcctacatggcaaagctgacag

SEQ ID NO: 75000 - DNA, 31 bp, Artificial Sequence
  Description of Artificial Sequence: Synthetic oligonucleotide
tggaggttcctacatggcaaagctgacagtg

SEQ ID NO: 75001 - DNA, 30 bp, Artificial Sequence
  Description of Artificial Sequence: Synthetic oligonucleotide
ggaggttcctacatggcaaagctgacagtg

SEQ ID NO: 75002 - DNA, 31 bp, Artificial Sequence
  Description of Artificial Sequence: Synthetic oligonucleotide
gaggttcctacatggcaaagctgacagtgac

SEQ ID NO: 75003 - DNA, 32 bp, Artificial Sequence
  Description of Artificial Sequence: Synthetic oligonucleotide
aggttcctacatggcaaagctgacagtgacac

SEQ ID NO: 75004 - DNA, 31 bp, Artificial Sequence
  Description of Artificial Sequence: Synthetic oligonucleotide
ggttcctacatggcaaagctgacagtgacac

SEQ ID NO: 75005 - DNA, 32 bp, Artificial Sequence
  Description of Artificial Sequence: Synthetic oligonucleotide
gttcctacatggcaaagctgacagtgacactg

SEQ ID NO: 75006 - DNA, 34 bp, Artificial Sequence
  Description of Artificial Sequence: Synthetic oligonucleotide
ttcctacatggcaaagctgacagtgacactgatg

SEQ ID NO: 75007 - DNA, 33 bp, Artificial Sequence
  Description of Artificial Sequence: Synthetic oligonucleotide
tcctacatggcaaagctgacagtgacactgatg

SEQ ID NO: 75008 - DNA, 32 bp, Artificial Sequence
  Description of Artificial Sequence: Synthetic oligonucleotide
cctacatggcaaagctgacagtgacactgatg

SEQ ID NO: 75009 - DNA, 32 bp, Artificial Sequence
  Description of Artificial Sequence: Synthetic oligonucleotide
ctacatggcaaagctgacagtgacactgatgg

SEQ ID NO: 75010 - DNA, 33 bp, Artificial Sequence
  Description of Artificial Sequence: Synthetic oligonucleotide
tacatggcaaagctgacagtgacactgatggtg

SEQ ID NO: 75011 - DNA, 32 bp, Artificial Sequence
  Description of Artificial Sequence: Synthetic oligonucleotide
acatggcaaagctgacagtgacactgatggtg

SEQ ID NO: 75012 - DNA, 31 bp, Artificial Sequence
  Description of Artificial Sequence: Synthetic oligonucleotide
catggcaaagctgacagtgacactgatggtg

SEQ ID NO: 75013 - DNA, 31 bp, Artificial Sequence
  Description of Artificial Sequence: Synthetic oligonucleotide
atggcaaagctgacagtgacactgatggtgc

SEQ ID NO: 75014 - DNA, 30 bp, Artificial Sequence
  Description of Artificial Sequence: Synthetic oligonucleotide
tggcaaagctgacagtgacactgatggtgc

SEQ ID NO: 75015 - DNA, 29 bp, Artificial Sequence
  Description of Artificial Sequence: Synthetic oligonucleotide
ggcaaagctgacagtgacactgatggtgc

SEQ ID NO: 75016 - DNA, 30 bp, Artificial Sequence
  Description of Artificial Sequence: Synthetic oligonucleotide
gcaaagctgacagtgacactgatggtgctg

SEQ ID NO: 75017 - DNA, 31 bp, Artificial Sequence
  Description of Artificial Sequence: Synthetic oligonucleotide
caaagctgacagtgacactgatggtgctgag

SEQ ID NO: 75018 - DNA, 31 bp, Artificial Sequence
  Description of Artificial Sequence: Synthetic oligonucleotide
aaagctgacagtgacactgatggtgctgagc

SEQ ID NO: 75019 - DNA, 30 bp, Artificial Sequence
  Description of Artificial Sequence: Synthetic oligonucleotide
aagctgacagtgacactgatggtgctgagc

SEQ ID NO: 75020 - DNA, 29 bp, Artificial Sequence
  Description of Artificial Sequence: Synthetic oligonucleotide
agctgacagtgacactgatggtgctgagc

SEQ ID NO: 75021 - DNA, 27 bp, Artificial Sequence
  Description of Artificial Sequence: Synthetic oligonucleotide
tggggacacccgaccacgtttcttgca

SEQ ID NO: 75022 - DNA, 26 bp, Artificial Sequence
  Description of Artificial Sequence: Synthetic oligonucleotide
ggggacacccgaccacgtttcttgca

SEQ ID NO: 75023 - DNA, 26 bp, Artificial Sequence
  Description of Artificial Sequence: Synthetic oligonucleotide
gggacacccgaccacgtttcttgcag

SEQ ID NO: 75024 - DNA, 27 bp, Artificial Sequence
  Description of Artificial Sequence: Synthetic oligonucleotide
ggacacccgaccacgtttcttgcagca

SEQ ID NO: 75025 - DNA, 27 bp, Artificial Sequence
  Description of Artificial Sequence: Synthetic oligonucleotide
gacacccgaccacgtttcttgcagcag

SEQ ID NO: 75026 - DNA, 27 bp, Artificial Sequence
  Description of Artificial Sequence: Synthetic oligonucleotide
acacccgaccacgtttcttgcagcagg

SEQ ID NO: 75027 - DNA, 27 bp, Artificial Sequence
  Description of Artificial Sequence: Synthetic oligonucleotide
cacccgaccacgtttcttgcagcagga

SEQ ID NO: 75028 - DNA, 30 bp, Artificial Sequence
  Description of Artificial Sequence: Synthetic oligonucleotide
acccgaccacgtttcttgcagcaggataag

SEQ ID NO: 75029 - DNA, 29 bp, Artificial Sequence
  Description of Artificial Sequence: Synthetic oligonucleotide
cccgaccacgtttcttgcagcaggataag

SEQ ID NO: 75030 - DNA, 32 bp, Artificial Sequence
  Description of Artificial Sequence: Synthetic oligonucleotide
ccgaccacgtttcttgcagcaggataagtatg

SEQ ID NO: 75031 - DNA, 33 bp, Artificial Sequence
  Description of Artificial Sequence: Synthetic oligonucleotide
cgaccacgtttcttgcagcaggataagtatgag

SEQ ID NO: 75032 - DNA, 34 bp, Artificial Sequence
  Description of Artificial Sequence: Synthetic oligonucleotide
gaccacgtttcttgcagcaggataagtatgagtg

SEQ ID NO: 75033 - DNA, 35 bp, Artificial Sequence
  Description of Artificial Sequence: Synthetic oligonucleotide
accacgtttcttgcagcaggataagtatgagtgtc

SEQ ID NO: 75034 - DNA, 34 bp, Artificial Sequence
  Description of Artificial Sequence: Synthetic oligonucleotide
ccacgtttcttgcagcaggataagtatgagtgtc

SEQ ID NO: 75035 - DNA, 23 bp, Artificial Sequence
  Description of Artificial Sequence: Synthetic oligonucleotide
acggagcgggtgcggttcctgca

SEQ ID NO: 75036 - DNA, 22 bp, Artificial Sequence
  Description of Artificial Sequence: Synthetic oligonucleotide
cggagcgggtgcggttcctgca

SEQ ID NO: 75037 - DNA, 23 bp, Artificial Sequence
  Description of Artificial Sequence: Synthetic oligonucleotide
ggagcgggtgcggttcctgcaca

SEQ ID NO: 75038 - DNA, 24 bp, Artificial Sequence
  Description of Artificial Sequence: Synthetic oligonucleotide
gagcgggtgcggttcctgcacaga

SEQ ID NO: 75039 - DNA, 25 bp, Artificial Sequence
  Description of Artificial Sequence: Synthetic oligonucleotide
agcgggtgcggttcctgcacagaga

SEQ ID NO: 75040 - DNA, 24 bp, Artificial Sequence
  Description of Artificial Sequence: Synthetic oligonucleotide
gcgggtgcggttcctgcacagaga

SEQ ID NO: 75041 - DNA, 26 bp, Artificial Sequence
  Description of Artificial Sequence: Synthetic oligonucleotide
cgggtgcggttcctgcacagagacat

SEQ ID NO: 75042 - DNA, 27 bp, Artificial Sequence
  Description of Artificial Sequence: Synthetic oligonucleotide
gggtgcggttcctgcacagagacatct

SEQ ID NO: 75043 - DNA, 31 bp, Artificial Sequence
  Description of Artificial Sequence: Synthetic oligonucleotide
ggtgcggttcctgcacagagacatctataac

SEQ ID NO: 75044 - DNA, 31 bp, Artificial Sequence
  Description of Artificial Sequence: Synthetic oligonucleotide
gtgcggttcctgcacagagacatctataacc

SEQ ID NO: 75045 - DNA, 33 bp, Artificial Sequence
  Description of Artificial Sequence: Synthetic oligonucleotide
tgcggttcctgcacagagacatctataaccaag

SEQ ID NO: 75046 - DNA, 32 bp, Artificial Sequence
  Description of Artificial Sequence: Synthetic oligonucleotide
gcggttcctgcacagagacatctataaccaag

SEQ ID NO: 75047 - DNA, 33 bp, Artificial Sequence
  Description of Artificial Sequence: Synthetic oligonucleotide
cggttcctgcacagagacatctataaccaagag

SEQ ID NO: 75048 - DNA, 33 bp, Artificial Sequence
  Description of Artificial Sequence: Synthetic oligonucleotide
ggttcctgcacagagacatctataaccaagagg

SEQ ID NO: 75049 - DNA, 34 bp, Artificial Sequence
  Description of Artificial Sequence: Synthetic oligonucleotide
gttcctgcacagagacatctataaccaagaggag

SEQ ID NO: 75050 - DNA, 34 bp, Artificial Sequence
  Description of Artificial Sequence: Synthetic oligonucleotide
ttcctgcacagagacatctataaccaagaggagg

SEQ ID NO: 75051 - DNA, 33 bp, Artificial Sequence
  Description of Artificial Sequence: Synthetic oligonucleotide
tcctgcacagagacatctataaccaagaggagg

SEQ ID NO: 75052 - DNA, 32 bp, Artificial Sequence
  Description of Artificial Sequence: Synthetic oligonucleotide
cctgcacagagacatctataaccaagaggagg

SEQ ID NO: 75053 - DNA, 33 bp, Artificial Sequence
  Description of Artificial Sequence: Synthetic oligonucleotide
ctgcacagagacatctataaccaagaggaggac

SEQ ID NO: 75054 - DNA, 35 bp, Artificial Sequence
  Description of Artificial Sequence: Synthetic oligonucleotide
tgcacagagacatctataaccaagaggaggacttg

SEQ ID NO: 75055 - DNA, 34 bp, Artificial Sequence
  Description of Artificial Sequence: Synthetic oligonucleotide
gcacagagacatctataaccaagaggaggacttg

SEQ ID NO: 75056 - DNA, 34 bp, Artificial Sequence
  Description of Artificial Sequence: Synthetic oligonucleotide
cacagagacatctataaccaagaggaggacttgc

SEQ ID NO: 75057 - DNA, 34 bp, Artificial Sequence
  Description of Artificial Sequence: Synthetic oligonucleotide
acagagacatctataaccaagaggaggacttgcg

SEQ ID NO: 75058 - DNA, 33 bp, Artificial Sequence
  Description of Artificial Sequence: Synthetic oligonucleotide
cagagacatctataaccaagaggaggacttgcg

SEQ ID NO: 75059 - DNA, 33 bp, Artificial Sequence
  Description of Artificial Sequence: Synthetic oligonucleotide
agagacatctataaccaagaggaggacttgcgc

SEQ ID NO: 75060 - DNA, 32 bp, Artificial Sequence
  Description of Artificial Sequence: Synthetic oligonucleotide
gagacatctataaccaagaggaggacttgcgc

SEQ ID NO: 75061 - DNA, 34 bp, Artificial Sequence
  Description of Artificial Sequence: Synthetic oligonucleotide
agacatctataaccaagaggaggacttgcgcttc

SEQ ID NO: 75062 - DNA, 33 bp, Artificial Sequence
  Description of Artificial Sequence: Synthetic oligonucleotide
gacatctataaccaagaggaggacttgcgcttc

SEQ ID NO: 75063 - DNA, 33 bp, Artificial Sequence
  Description of Artificial Sequence: Synthetic oligonucleotide
acatctataaccaagaggaggacttgcgcttcg

SEQ ID NO: 75064 - DNA, 32 bp, Artificial Sequence
  Description of Artificial Sequence: Synthetic oligonucleotide
catctataaccaagaggaggacttgcgcttcg

SEQ ID NO: 75065 - DNA, 33 bp, Artificial Sequence
  Description of Artificial Sequence: Synthetic oligonucleotide
atctataaccaagaggaggacttgcgcttcgac

SEQ ID NO: 75066 - DNA, 31 bp, Artificial Sequence
  Description of Artificial Sequence: Synthetic oligonucleotide
cgagttgagcctaaggtgactgtgtatcctg

SEQ ID NO: 75067 - DNA, 31 bp, Artificial Sequence
  Description of Artificial Sequence: Synthetic oligonucleotide
gagttgagcctaaggtgactgtgtatcctgc

SEQ ID NO: 75068 - DNA, 33 bp, Artificial Sequence
  Description of Artificial Sequence: Synthetic oligonucleotide
agttgagcctaaggtgactgtgtatcctgcaag

SEQ ID NO: 75069 - DNA, 32 bp, Artificial Sequence
  Description of Artificial Sequence: Synthetic oligonucleotide
gttgagcctaaggtgactgtgtatcctgcaag

SEQ ID NO: 75070 - DNA, 32 bp, Artificial Sequence
  Description of Artificial Sequence: Synthetic oligonucleotide
ttgagcctaaggtgactgtgtatcctgcaagg

SEQ ID NO: 75071 - DNA, 31 bp, Artificial Sequence
  Description of Artificial Sequence: Synthetic oligonucleotide
tgagcctaaggtgactgtgtatcctgcaagg

SEQ ID NO: 75072 - DNA, 30 bp, Artificial Sequence
  Description of Artificial Sequence: Synthetic oligonucleotide
gagcctaaggtgactgtgtatcctgcaagg

SEQ ID NO: 75073 - DNA, 31 bp, Artificial Sequence
  Description of Artificial Sequence: Synthetic oligonucleotide
agcctaaggtgactgtgtatcctgcaaggac

SEQ ID NO: 75074 - DNA, 30 bp, Artificial Sequence
  Description of Artificial Sequence: Synthetic oligonucleotide
gcctaaggtgactgtgtatcctgcaaggac

SEQ ID NO: 75075 - DNA, 30 bp, Artificial Sequence
  Description of Artificial Sequence: Synthetic oligonucleotide
cctaaggtgactgtgtatcctgcaaggacc

SEQ ID NO: 75076 - DNA, 30 bp, Artificial Sequence
  Description of Artificial Sequence: Synthetic oligonucleotide
ctaaggtgactgtgtatcctgcaaggaccc

SEQ ID NO: 75077 - DNA, 31 bp, Artificial Sequence
  Description of Artificial Sequence: Synthetic oligonucleotide
taaggtgactgtgtatcctgcaaggacccag

SEQ ID NO: 75078 - DNA, 30 bp, Artificial Sequence
  Description of Artificial Sequence: Synthetic oligonucleotide
aaggtgactgtgtatcctgcaaggacccag

SEQ ID NO: 75079 - DNA, 29 bp, Artificial Sequence
  Description of Artificial Sequence: Synthetic oligonucleotide
aggtgactgtgtatcctgcaaggacccag

SEQ ID NO: 75080 - DNA, 28 bp, Artificial Sequence
  Description of Artificial Sequence: Synthetic oligonucleotide
ggtgactgtgtatcctgcaaggacccag

SEQ ID NO: 75081 - DNA, 29 bp, Artificial Sequence
  Description of Artificial Sequence: Synthetic oligonucleotide
gtgactgtgtatcctgcaaggacccagac

SEQ ID NO: 75082 - DNA, 29 bp, Artificial Sequence
  Description of Artificial Sequence: Synthetic oligonucleotide
tgactgtgtatcctgcaaggacccagacc

SEQ ID NO: 75083 - DNA, 28 bp, Artificial Sequence
  Description of Artificial Sequence: Synthetic oligonucleotide
gactgtgtatcctgcaaggacccagacc

SEQ ID NO: 75084 - DNA, 28 bp, Artificial Sequence
  Description of Artificial Sequence: Synthetic oligonucleotide
actgtgtatcctgcaaggacccagaccc

SEQ ID NO: 75085 - DNA, 27 bp, Artificial Sequence
  Description of Artificial Sequence: Synthetic oligonucleotide
ctgtgtatcctgcaaggacccagaccc

SEQ ID NO: 75086 - DNA, 28 bp, Artificial Sequence
  Description of Artificial Sequence: Synthetic oligonucleotide
tgtgtatcctgcaaggacccagaccctg

SEQ ID NO: 75087 - DNA, 27 bp, Artificial Sequence
  Description of Artificial Sequence: Synthetic oligonucleotide
gtgtatcctgcaaggacccagaccctg

SEQ ID NO: 75088 - DNA, 27 bp, Artificial Sequence
  Description of Artificial Sequence: Synthetic oligonucleotide
tgtatcctgcaaggacccagaccctgc

SEQ ID NO: 75089 - DNA, 27 bp, Artificial Sequence
  Description of Artificial Sequence: Synthetic oligonucleotide
gtatcctgcaaggacccagaccctgca

SEQ ID NO: 75090 - DNA, 27 bp, Artificial Sequence
  Description of Artificial Sequence: Synthetic oligonucleotide
tatcctgcaaggacccagaccctgcag

SEQ ID NO: 75091 - DNA, 26 bp, Artificial Sequence
  Description of Artificial Sequence: Synthetic oligonucleotide
atcctgcaaggacccagaccctgcag

SEQ ID NO: 75092 - DNA, 25 bp, Artificial Sequence
  Description of Artificial Sequence: Synthetic oligonucleotide
tcctgcaaggacccagaccctgcag

SEQ ID NO: 75093 - DNA, 24 bp, Artificial Sequence
  Description of Artificial Sequence: Synthetic oligonucleotide
cctgcaaggacccagaccctgcag

SEQ ID NO: 75094 - DNA, 25 bp, Artificial Sequence
  Description of Artificial Sequence: Synthetic oligonucleotide
ctgcaaggacccagaccctgcagca

SEQ ID NO: 75095 - DNA, 25 bp, Artificial Sequence
  Description of Artificial Sequence: Synthetic oligonucleotide
tgcaaggacccagaccctgcagcac

SEQ ID NO: 75096 - DNA, 24 bp, Artificial Sequence
  Description of Artificial Sequence: Synthetic oligonucleotide
gcaaggacccagaccctgcagcac

SEQ ID NO: 75097 - DNA, 25 bp, Artificial Sequence
  Description of Artificial Sequence: Synthetic oligonucleotide
caaggacccagaccctgcagcacca

SEQ ID NO: 75098 - DNA, 27 bp, Artificial Sequence
  Description of Artificial Sequence: Synthetic oligonucleotide
aaggacccagaccctgcagcaccacaa

SEQ ID NO: 75099 - DNA, 26 bp, Artificial Sequence
  Description of Artificial Sequence: Synthetic oligonucleotide
aggacccagaccctgcagcaccacaa

SEQ ID NO: 75100 - DNA, 25 bp, Artificial Sequence
  Description of Artificial Sequence: Synthetic oligonucleotide
ggacccagaccctgcagcaccacaa

SEQ ID NO: 75101 - DNA, 25 bp, Artificial Sequence
  Description of Artificial Sequence: Synthetic oligonucleotide
gacccagaccctgcagcaccacaac

SEQ ID NO: 75102 - DNA, 26 bp, Artificial Sequence
  Description of Artificial Sequence: Synthetic oligonucleotide
acccagaccctgcagcaccacaacct

SEQ ID NO: 75103 - DNA, 25 bp, Artificial Sequence
  Description of Artificial Sequence: Synthetic oligonucleotide
cccagaccctgcagcaccacaacct

SEQ ID NO: 75104 - DNA, 25 bp, Artificial Sequence
  Description of Artificial Sequence: Synthetic oligonucleotide
ccagaccctgcagcaccacaacctc

SEQ ID NO: 75105 - DNA, 26 bp, Artificial Sequence
  Description of Artificial Sequence: Synthetic oligonucleotide
cagaccctgcagcaccacaacctcct

SEQ ID NO: 75106 - DNA, 26 bp, Artificial Sequence
  Description of Artificial Sequence: Synthetic oligonucleotide
agaccctgcagcaccacaacctcctg

SEQ ID NO: 75107 - DNA, 25 bp, Artificial Sequence
  Description of Artificial Sequence: Synthetic oligonucleotide
gaccctgcagcaccacaacctcctg

SEQ ID NO: 75108 - DNA, 26 bp, Artificial Sequence
  Description of Artificial Sequence: Synthetic oligonucleotide
accctgcagcaccacaacctcctggt

SEQ ID NO: 75109 - DNA, 26 bp, Artificial Sequence
  Description of Artificial Sequence: Synthetic oligonucleotide
ctggggtggtgtccacaggcctgatt

SEQ ID NO: 75110 - DNA, 27 bp, Artificial Sequence
  Description of Artificial Sequence: Synthetic oligonucleotide
tggggtggtgtccacaggcctgattca

SEQ ID NO: 75111 - DNA, 26 bp, Artificial Sequence
  Description of Artificial Sequence: Synthetic oligonucleotide
ggggtggtgtccacaggcctgattca

SEQ ID NO: 75112 - DNA, 27 bp, Artificial Sequence
  Description of Artificial Sequence: Synthetic oligonucleotide
gggtggtgtccacaggcctgattcaga

SEQ ID NO: 75113 - DNA, 29 bp, Artificial Sequence
  Description of Artificial Sequence: Synthetic oligonucleotide
ggtggtgtccacaggcctgattcagaatg

SEQ ID NO: 75114 - DNA, 29 bp, Artificial Sequence
  Description of Artificial Sequence: Synthetic oligonucleotide
gtggtgtccacaggcctgattcagaatgg

SEQ ID NO: 75115 - DNA, 30 bp, Artificial Sequence
  Description of Artificial Sequence: Synthetic oligonucleotide
tggtgtccacaggcctgattcagaatggag

SEQ ID NO: 75116 - DNA, 29 bp, Artificial Sequence
  Description of Artificial Sequence: Synthetic oligonucleotide
ggtgtccacaggcctgattcagaatggag

SEQ ID NO: 75117 - DNA, 30 bp, Artificial Sequence
  Description of Artificial Sequence: Synthetic oligonucleotide
gtgtccacaggcctgattcagaatggagac

SEQ ID NO: 75118 - DNA, 31 bp, Artificial Sequence
  Description of Artificial Sequence: Synthetic oligonucleotide
tgtccacaggcctgattcagaatggagactg

SEQ ID NO: 75119 - DNA, 30 bp, Artificial Sequence
  Description of Artificial Sequence: Synthetic oligonucleotide
gtccacaggcctgattcagaatggagactg

SEQ ID NO: 75120 - DNA, 30 bp, Artificial Sequence
  Description of Artificial Sequence: Synthetic oligonucleotide
tccacaggcctgattcagaatggagactgg

SEQ ID NO: 75121 - DNA, 29 bp, Artificial Sequence
  Description of Artificial Sequence: Synthetic oligonucleotide
ccacaggcctgattcagaatggagactgg

SEQ ID NO: 75122 - DNA, 30 bp, Artificial Sequence
  Description of Artificial Sequence: Synthetic oligonucleotide
cacaggcctgattcagaatggagactggac

SEQ ID NO: 75123 - DNA, 30 bp, Artificial Sequence
  Description of Artificial Sequence: Synthetic oligonucleotide
acaggcctgattcagaatggagactggacc

SEQ ID NO: 75124 - DNA, 29 bp, Artificial Sequence
  Description of Artificial Sequence: Synthetic oligonucleotide
caggcctgattcagaatggagactggacc

SEQ ID NO: 75125 - DNA, 31 bp, Artificial Sequence
  Description of Artificial Sequence: Synthetic oligonucleotide
aggcctgattcagaatggagactggaccttc

SEQ ID NO: 75126 - DNA, 30 bp, Artificial Sequence
  Description of Artificial Sequence: Synthetic oligonucleotide
ggcctgattcagaatggagactggaccttc

SEQ ID NO: 75127 - DNA, 30 bp, Artificial Sequence
  Description of Artificial Sequence: Synthetic oligonucleotide
gcctgattcagaatggagactggaccttcc

SEQ ID NO: 75128 - DNA, 31 bp, Artificial Sequence
  Description of Artificial Sequence: Synthetic oligonucleotide
cctgattcagaatggagactggaccttccag

SEQ ID NO: 75129 - DNA, 32 bp, Artificial Sequence
  Description of Artificial Sequence: Synthetic oligonucleotide
ctgattcagaatggagactggaccttccagac

SEQ ID NO: 75130 - DNA, 32 bp, Artificial Sequence
  Description of Artificial Sequence: Synthetic oligonucleotide
tgattcagaatggagactggaccttccagacc

SEQ ID NO: 75131 - DNA, 31 bp, Artificial Sequence
  Description of Artificial Sequence: Synthetic oligonucleotide
gattcagaatggagactggaccttccagacc

SEQ ID NO: 75132 - DNA, 31 bp, Artificial Sequence
  Description of Artificial Sequence: Synthetic oligonucleotide
attcagaatggagactggaccttccagaccc

SEQ ID NO: 75133 - DNA, 30 bp, Artificial Sequence
  Description of Artificial Sequence: Synthetic oligonucleotide
ttcagaatggagactggaccttccagaccc

SEQ ID NO: 75134 - DNA, 29 bp, Artificial Sequence
  Description of Artificial Sequence: Synthetic oligonucleotide
tcagaatggagactggaccttccagaccc

SEQ ID NO: 75135 - DNA, 26 bp, Artificial Sequence
  Description of Artificial Sequence: Synthetic oligonucleotide
tgccaagtggagcacccaagcgtgac

SEQ ID NO: 75136 - DNA, 25 bp, Artificial Sequence
  Description of Artificial Sequence: Synthetic oligonucleotide
gccaagtggagcacccaagcgtgac

SEQ ID NO: 75137 - DNA, 26 bp, Artificial Sequence
  Description of Artificial Sequence: Synthetic oligonucleotide
ccaagtggagcacccaagcgtgacga

SEQ ID NO: 75138 - DNA, 26 bp, Artificial Sequence
  Description of Artificial Sequence: Synthetic oligonucleotide
caagtggagcacccaagcgtgacgag

SEQ ID NO: 75139 - DNA, 26 bp, Artificial Sequence
  Description of Artificial Sequence: Synthetic oligonucleotide
aagtggagcacccaagcgtgacgagc

SEQ ID NO: 75140 - DNA, 25 bp, Artificial Sequence
  Description of Artificial Sequence: Synthetic oligonucleotide
agtggagcacccaagcgtgacgagc

SEQ ID NO: 75141 - DNA, 24 bp, Artificial Sequence
  Description of Artificial Sequence: Synthetic oligonucleotide
gtggagcacccaagcgtgacgagc

SEQ ID NO: 75142 - DNA, 24 bp, Artificial Sequence
  Description of Artificial Sequence: Synthetic oligonucleotide
tggagcacccaagcgtgacgagcc

SEQ ID NO: 75143 - DNA, 23 bp, Artificial Sequence
  Description of Artificial Sequence: Synthetic oligonucleotide
ggagcacccaagcgtgacgagcc

SEQ ID NO: 75144 - DNA, 24 bp, Artificial Sequence
  Description of Artificial Sequence: Synthetic oligonucleotide
gagcacccaagcgtgacgagccct

SEQ ID NO: 75145 - DNA, 25 bp, Artificial Sequence
  Description of Artificial Sequence: Synthetic oligonucleotide
agcacccaagcgtgacgagccctct

SEQ ID NO: 75146 - DNA, 24 bp, Artificial Sequence
  Description of Artificial Sequence: Synthetic oligonucleotide
gcacccaagcgtgacgagccctct

SEQ ID NO: 75147 - DNA, 25 bp, Artificial Sequence
  Description of Artificial Sequence: Synthetic oligonucleotide
cacccaagcgtgacgagccctctca

SEQ ID NO: 75148 - DNA, 26 bp, Artificial Sequence
  Description of Artificial Sequence: Synthetic oligonucleotide
acccaagcgtgacgagccctctcaca

SEQ ID NO: 75149 - DNA, 25 bp, Artificial Sequence
  Description of Artificial Sequence: Synthetic oligonucleotide
cccaagcgtgacgagccctctcaca

SEQ ID NO: 75150 - DNA, 26 bp, Artificial Sequence
  Description of Artificial Sequence: Synthetic oligonucleotide
ccaagcgtgacgagccctctcacagt

SEQ ID NO: 75151 - DNA, 26 bp, Artificial Sequence
  Description of Artificial Sequence: Synthetic oligonucleotide
caagcgtgacgagccctctcacagtg

SEQ ID NO: 75152 - DNA, 27 bp, Artificial Sequence
  Description of Artificial Sequence: Synthetic oligonucleotide
aagcgtgacgagccctctcacagtgga

SEQ ID NO: 75153 - DNA, 27 bp, Artificial Sequence
  Description of Artificial Sequence: Synthetic oligonucleotide
agcgtgacgagccctctcacagtggaa

SEQ ID NO: 75154 - DNA, 27 bp, Artificial Sequence
  Description of Artificial Sequence: Synthetic oligonucleotide
gcgtgacgagccctctcacagtggaat

SEQ ID NO: 75155 - DNA, 27 bp, Artificial Sequence
  Description of Artificial Sequence: Synthetic oligonucleotide
cgtgacgagccctctcacagtggaatg

SEQ ID NO: 75156 - DNA, 28 bp, Artificial Sequence
  Description of Artificial Sequence: Synthetic oligonucleotide
ccctctcacagtggaatggagagcacag

SEQ ID NO: 75157 - DNA, 29 bp, Artificial Sequence
  Description of Artificial Sequence: Synthetic oligonucleotide
cctctcacagtggaatggagagcacagtc

SEQ ID NO: 75158 - DNA, 30 bp, Artificial Sequence
  Description of Artificial Sequence: Synthetic oligonucleotide
ctctcacagtggaatggagagcacagtctg

SEQ ID NO: 75159 - DNA, 33 bp, Artificial Sequence
  Description of Artificial Sequence: Synthetic oligonucleotide
tctcacagtggaatggagagcacagtctgaatc

SEQ ID NO: 75160 - DNA, 32 bp, Artificial Sequence
  Description of Artificial Sequence: Synthetic oligonucleotide
ctcacagtggaatggagagcacagtctgaatc

SEQ ID NO: 75161 - DNA, 33 bp, Artificial Sequence
  Description of Artificial Sequence: Synthetic oligonucleotide
tcacagtggaatggagagcacagtctgaatctg

SEQ ID NO: 75162 - DNA, 32 bp, Artificial Sequence
  Description of Artificial Sequence: Synthetic oligonucleotide
cacagtggaatggagagcacagtctgaatctg

SEQ ID NO: 75163 - DNA, 32 bp, Artificial Sequence
  Description of Artificial Sequence: Synthetic oligonucleotide
acagtggaatggagagcacagtctgaatctgc

SEQ ID NO: 75164 - DNA, 31 bp, Artificial Sequence
  Description of Artificial Sequence: Synthetic oligonucleotide
cagtggaatggagagcacagtctgaatctgc

SEQ ID NO: 75165 - DNA, 32 bp, Artificial Sequence
  Description of Artificial Sequence: Synthetic oligonucleotide
agtggaatggagagcacagtctgaatctgcac

SEQ ID NO: 75166 - DNA, 31 bp, Artificial Sequence
  Description of Artificial Sequence: Synthetic oligonucleotide
gtggaatggagagcacagtctgaatctgcac

SEQ ID NO: 75167 - DNA, 32 bp, Artificial Sequence
  Description of Artificial Sequence: Synthetic oligonucleotide
tggaatggagagcacagtctgaatctgcacag

SEQ ID NO: 75168 - DNA, 31 bp, Artificial Sequence
  Description of Artificial Sequence: Synthetic oligonucleotide
ggaatggagagcacagtctgaatctgcacag

SEQ ID NO: 75169 - DNA, 32 bp, Artificial Sequence
  Description of Artificial Sequence: Synthetic oligonucleotide
gaatggagagcacagtctgaatctgcacagag

SEQ ID NO: 75170 - DNA, 32 bp, Artificial Sequence
  Description of Artificial Sequence: Synthetic oligonucleotide
aatggagagcacagtctgaatctgcacagagc

SEQ ID NO: 75171 - DNA, 31 bp, Artificial Sequence
  Description of Artificial Sequence: Synthetic oligonucleotide
atggagagcacagtctgaatctgcacagagc

SEQ ID NO: 75172 - DNA, 30 bp, Artificial Sequence
  Description of Artificial Sequence: Synthetic oligonucleotide
tggagagcacagtctgaatctgcacagagc

SEQ ID NO: 75173 - DNA, 29 bp, Artificial Sequence
  Description of Artificial Sequence: Synthetic oligonucleotide
ggagagcacagtctgaatctgcacagagc

SEQ ID NO: 75174 - DNA, 31 bp, Artificial Sequence
  Description of Artificial Sequence: Synthetic oligonucleotide
gagagcacagtctgaatctgcacagagcaag

SEQ ID NO: 75175 - DNA, 33 bp, Artificial Sequence
  Description of Artificial Sequence: Synthetic oligonucleotide
agagcacagtctgaatctgcacagagcaagatg

SEQ ID NO: 75176 - DNA, 32 bp, Artificial Sequence
  Description of Artificial Sequence: Synthetic oligonucleotide
gagcacagtctgaatctgcacagagcaagatg

SEQ ID NO: 75177 - DNA, 32 bp, Artificial Sequence
  Description of Artificial Sequence: Synthetic oligonucleotide
agcacagtctgaatctgcacagagcaagatgc

SEQ ID NO: 75178 - DNA, 31 bp, Artificial Sequence
  Description of Artificial Sequence: Synthetic oligonucleotide
gcacagtctgaatctgcacagagcaagatgc

SEQ ID NO: 75179 - DNA, 32 bp, Artificial Sequence
  Description of Artificial Sequence: Synthetic oligonucleotide
cacagtctgaatctgcacagagcaagatgctg

SEQ ID NO: 75180 - DNA, 33 bp, Artificial Sequence
  Description of Artificial Sequence: Synthetic oligonucleotide
acagtctgaatctgcacagagcaagatgctgag

SEQ ID NO: 75181 - DNA, 32 bp, Artificial Sequence
  Description of Artificial Sequence: Synthetic oligonucleotide
cagtctgaatctgcacagagcaagatgctgag

SEQ ID NO: 75182 - DNA, 33 bp, Artificial Sequence
  Description of Artificial Sequence: Synthetic oligonucleotide
agtctgaatctgcacagagcaagatgctgagtg

SEQ ID NO: 75183 - DNA, 26 bp, Artificial Sequence
  Description of Artificial Sequence: Synthetic oligonucleotide
ctgctcttccttggggccgggctatt

SEQ ID NO: 75184 - DNA, 27 bp, Artificial Sequence
  Description of Artificial Sequence: Synthetic oligonucleotide
tgctcttccttggggccgggctattca

SEQ ID NO: 75185 - DNA, 27 bp, Artificial Sequence
  Description of Artificial Sequence: Synthetic oligonucleotide
gctcttccttggggccgggctattcat

SEQ ID NO: 75186 - DNA, 27 bp, Artificial Sequence
  Description of Artificial Sequence: Synthetic oligonucleotide
ctcttccttggggccgggctattcatc

SEQ ID NO: 75187 - DNA, 29 bp, Artificial Sequence
  Description of Artificial Sequence: Synthetic oligonucleotide
tcttccttggggccgggctattcatctac

SEQ ID NO: 75188 - DNA, 28 bp, Artificial Sequence
  Description of Artificial Sequence: Synthetic oligonucleotide
cttccttggggccgggctattcatctac

SEQ ID NO: 75189 - DNA, 30 bp, Artificial Sequence
  Description of Artificial Sequence: Synthetic oligonucleotide
ttccttggggccgggctattcatctacttc

SEQ ID NO: 75190 - DNA, 29 bp, Artificial Sequence
  Description of Artificial Sequence: Synthetic oligonucleotide
tccttggggccgggctattcatctacttc

SEQ ID NO: 75191 - DNA, 28 bp, Artificial Sequence
  Description of Artificial Sequence: Synthetic oligonucleotide
ccttggggccgggctattcatctacttc

SEQ ID NO: 75192 - DNA, 30 bp, Artificial Sequence
  Description of Artificial Sequence: Synthetic oligonucleotide
cttggggccgggctattcatctacttcaag

SEQ ID NO: 75193 - DNA, 33 bp, Artificial Sequence
  Description of Artificial Sequence: Synthetic oligonucleotide
ttggggccgggctattcatctacttcaagaatc

SEQ ID NO: 75194 - DNA, 32 bp, Artificial Sequence
  Description of Artificial Sequence: Synthetic oligonucleotide
tggggccgggctattcatctacttcaagaatc

SEQ ID NO: 75195 - DNA, 31 bp, Artificial Sequence
  Description of Artificial Sequence: Synthetic oligonucleotide
ggggccgggctattcatctacttcaagaatc

SEQ ID NO: 75196 - DNA, 32 bp, Artificial Sequence
  Description of Artificial Sequence: Synthetic oligonucleotide
gggccgggctattcatctacttcaagaatcag

SEQ ID NO: 75197 - DNA, 35 bp, Artificial Sequence
  Description of Artificial Sequence: Synthetic oligonucleotide
ggccgggctattcatctacttcaagaatcagaaag

SEQ ID NO: 75198 - DNA, 35 bp, Artificial Sequence
  Description of Artificial Sequence: Synthetic oligonucleotide
gccgggctattcatctacttcaagaatcagaaagg

SEQ ID NO: 75199 - DNA, 35 bp, Artificial Sequence
  Description of Artificial Sequence: Synthetic oligonucleotide
ccgggctattcatctacttcaagaatcagaaaggg

SEQ ID NO: 75200 - DNA, 35 bp, Artificial Sequence
  Description of Artificial Sequence: Synthetic oligonucleotide
cgggctattcatctacttcaagaatcagaaagggc

SEQ ID NO: 75201 - DNA, 36 bp, Artificial Sequence
  Description of Artificial Sequence: Synthetic oligonucleotide
gggctattcatctacttcaagaatcagaaagggcac

SEQ ID NO: 75202 - DNA, 37 bp, Artificial Sequence
  Description of Artificial Sequence: Synthetic oligonucleotide
ggctattcatctacttcaagaatcagaaagggcactc

SEQ ID NO: 75203 - DNA, 38 bp, Artificial Sequence
  Description of Artificial Sequence: Synthetic oligonucleotide
gctattcatctacttcaagaatcagaaagggcactctg

SEQ ID NO: 75204 - DNA, 38 bp, Artificial Sequence
  Description of Artificial Sequence: Synthetic oligonucleotide
ctattcatctacttcaagaatcagaaagggcactctgg

SEQ ID NO: 75205 - DNA, 39 bp, Artificial Sequence
  Description of Artificial Sequence: Synthetic oligonucleotide
tattcatctacttcaagaatcagaaagggcactctggac

SEQ ID NO: 75206 - DNA, 38 bp, Artificial Sequence
  Description of Artificial Sequence: Synthetic oligonucleotide
attcatctacttcaagaatcagaaagggcactctggac

SEQ ID NO: 75207 - DNA, 37 bp, Artificial Sequence
  Description of Artificial Sequence: Synthetic oligonucleotide
ttcatctacttcaagaatcagaaagggcactctggac

SEQ ID NO: 75208 - DNA, 36 bp, Artificial Sequence
  Description of Artificial Sequence: Synthetic oligonucleotide
tcatctacttcaagaatcagaaagggcactctggac

SEQ ID NO: 75209 - DNA, 35 bp, Artificial Sequence
  Description of Artificial Sequence: Synthetic oligonucleotide
catctacttcaagaatcagaaagggcactctggac

SEQ ID NO: 75210 - DNA, 37 bp, Artificial Sequence
  Description of Artificial Sequence: Synthetic oligonucleotide
atctacttcaagaatcagaaagggcactctggacttc

SEQ ID NO: 75211 - DNA, 36 bp, Artificial Sequence
  Description of Artificial Sequence: Synthetic oligonucleotide
tctacttcaagaatcagaaagggcactctggacttc

SEQ ID NO: 75212 - DNA, 35 bp, Artificial Sequence
  Description of Artificial Sequence: Synthetic oligonucleotide
ctacttcaagaatcagaaagggcactctggacttc

SEQ ID NO: 75213 - DNA, 36 bp, Artificial Sequence
  Description of Artificial Sequence: Synthetic oligonucleotide
tacttcaagaatcagaaagggcactctggacttcac

SEQ ID NO: 75214 - DNA, 35 bp, Artificial Sequence
  Description of Artificial Sequence: Synthetic oligonucleotide
acttcaagaatcagaaagggcactctggacttcac

SEQ ID NO: 75215 - DNA, 34 bp, Artificial Sequence
  Description of Artificial Sequence: Synthetic oligonucleotide
cttcaagaatcagaaagggcactctggacttcac

SEQ ID NO: 75216 - DNA, 34 bp, Artificial Sequence
  Description of Artificial Sequence: Synthetic oligonucleotide
ttcaagaatcagaaagggcactctggacttcacc

SEQ ID NO: 75217 - DNA, 33 bp, Artificial Sequence
  Description of Artificial Sequence: Synthetic oligonucleotide
tcaagaatcagaaagggcactctggacttcacc

SEQ ID NO: 75218 - DNA, 32 bp, Artificial Sequence
  Description of Artificial Sequence: Synthetic oligonucleotide
caagaatcagaaagggcactctggacttcacc

SEQ ID NO: 75219 - DNA, 32 bp, Artificial Sequence
  Description of Artificial Sequence: Synthetic oligonucleotide
aagaatcagaaagggcactctggacttcaccc

SEQ ID NO: 75220 - DNA, 31 bp, Artificial Sequence
  Description of Artificial Sequence: Synthetic oligonucleotide
agaatcagaaagggcactctggacttcaccc

SEQ ID NO: 75221 - DNA, 30 bp, Artificial Sequence
  Description of Artificial Sequence: Synthetic oligonucleotide
gaatcagaaagggcactctggacttcaccc

SEQ ID NO: 75222 - DNA, 32 bp, Artificial Sequence
  Description of Artificial Sequence: Synthetic oligonucleotide
aatcagaaagggcactctggacttcacccaac

SEQ ID NO: 75223 - DNA, 31 bp, Artificial Sequence
  Description of Artificial Sequence: Synthetic oligonucleotide
atcagaaagggcactctggacttcacccaac

SEQ ID NO: 75224 - DNA, 30 bp, Artificial Sequence
  Description of Artificial Sequence: Synthetic oligonucleotide
tcagaaagggcactctggacttcacccaac

SEQ ID NO: 75225 - DNA, 29 bp, Artificial Sequence
  Description of Artificial Sequence: Synthetic oligonucleotide
cagaaagggcactctggacttcacccaac

SEQ ID NO: 75226 - DNA, 30 bp, Artificial Sequence
  Description of Artificial Sequence: Synthetic oligonucleotide
agaaagggcactctggacttcacccaacag

SEQ ID NO: 75227 - DNA, 29 bp, Artificial Sequence
  Description of Artificial Sequence: Synthetic oligonucleotide
gaaagggcactctggacttcacccaacag

SEQ ID NO: 75228 - DNA, 29 bp, Artificial Sequence
  Description of Artificial Sequence: Synthetic oligonucleotide
aaagggcactctggacttcacccaacagg

SEQ ID NO: 75229 - DNA, 28 bp, Artificial Sequence
  Description of Artificial Sequence: Synthetic oligonucleotide
aagggcactctggacttcacccaacagg

SEQ ID NO: 75230 - DNA, 27 bp, Artificial Sequence
  Description of Artificial Sequence: Synthetic oligonucleotide
agggcactctggacttcacccaacagg

SEQ ID NO: 75231 - DNA, 27 bp, Artificial Sequence
  Description of Artificial Sequence: Synthetic oligonucleotide
gggcactctggacttcacccaacagga

SEQ ID NO: 75232 - DNA, 27 bp, Artificial Sequence
  Description of Artificial Sequence: Synthetic oligonucleotide
ggcactctggacttcacccaacaggac

SEQ ID NO: 75233 - DNA, 28 bp, Artificial Sequence
  Description of Artificial Sequence: Synthetic oligonucleotide
gcactctggacttcacccaacaggactc

SEQ ID NO: 75234 - DNA, 28 bp, Artificial Sequence
  Description of Artificial Sequence: Synthetic oligonucleotide
cactctggacttcacccaacaggactcg

SEQ ID NO: 75235 - DNA, 29 bp, Artificial Sequence
  Description of Artificial Sequence: Synthetic oligonucleotide
actctggacttcacccaacaggactcgtg

SEQ ID NO: 75236 - DNA, 28 bp, Artificial Sequence
  Description of Artificial Sequence: Synthetic oligonucleotide
ctctggacttcacccaacaggactcgtg

SEQ ID NO: 75237 - DNA, 29 bp, Artificial Sequence
  Description of Artificial Sequence: Synthetic oligonucleotide
tctggacttcacccaacaggactcgtgag

SEQ ID NO: 75238 - DNA, 28 bp, Artificial Sequence
  Description of Artificial Sequence: Synthetic oligonucleotide
ctggacttcacccaacaggactcgtgag

SEQ ID NO: 75239 - DNA, 28 bp, Artificial Sequence
  Description of Artificial Sequence: Synthetic oligonucleotide
tggacttcacccaacaggactcgtgagc

SEQ ID NO: 75240 - DNA, 27 bp, Artificial Sequence
  Description of Artificial Sequence: Synthetic oligonucleotide
ggacttcacccaacaggactcgtgagc

SEQ ID NO: 75241 - DNA, 28 bp, Artificial Sequence
  Description of Artificial Sequence: Synthetic oligonucleotide
gacttcacccaacaggactcgtgagctg

SEQ ID NO: 75242 - DNA, 24 bp, Artificial Sequence
  Description of Artificial Sequence: Synthetic oligonucleotide
agcgggtgcggttcctgcacagag

SEQ ID NO: 75243 - DNA, 23 bp, Artificial Sequence
  Description of Artificial Sequence: Synthetic oligonucleotide
gcgggtgcggttcctgcacagag

SEQ ID NO: 75244 - DNA, 23 bp, Artificial Sequence
  Description of Artificial Sequence: Synthetic oligonucleotide
cgggtgcggttcctgcacagagg

SEQ ID NO: 75245 - DNA, 25 bp, Artificial Sequence
  Description of Artificial Sequence: Synthetic oligonucleotide
gggtgcggttcctgcacagaggcat

SEQ ID NO: 75246 - DNA, 27 bp, Artificial Sequence
  Description of Artificial Sequence: Synthetic oligonucleotide
ggtgcggttcctgcacagaggcatcta

SEQ ID NO: 75247 - DNA, 30 bp, Artificial Sequence
  Description of Artificial Sequence: Synthetic oligonucleotide
gtgcggttcctgcacagaggcatctataac

SEQ ID NO: 75248 - DNA, 30 bp, Artificial Sequence
  Description of Artificial Sequence: Synthetic oligonucleotide
tgcggttcctgcacagaggcatctataacc

SEQ ID NO: 75249 - DNA, 29 bp, Artificial Sequence
  Description of Artificial Sequence: Synthetic oligonucleotide
gcggttcctgcacagaggcatctataacc

SEQ ID NO: 75250 - DNA, 31 bp, Artificial Sequence
  Description of Artificial Sequence: Synthetic oligonucleotide
cggttcctgcacagaggcatctataaccaag

SEQ ID NO: 75251 - DNA, 32 bp, Artificial Sequence
  Description of Artificial Sequence: Synthetic oligonucleotide
ggttcctgcacagaggcatctataaccaagag

SEQ ID NO: 75252 - DNA, 32 bp, Artificial Sequence
  Description of Artificial Sequence: Synthetic oligonucleotide
gttcctgcacagaggcatctataaccaagagg

SEQ ID NO: 75253 - DNA, 33 bp, Artificial Sequence
  Description of Artificial Sequence: Synthetic oligonucleotide
ttcctgcacagaggcatctataaccaagaggag

SEQ ID NO: 75254 - DNA, 32 bp, Artificial Sequence
  Description of Artificial Sequence: Synthetic oligonucleotide
tcctgcacagaggcatctataaccaagaggag

SEQ ID NO: 75255 - DNA, 31 bp, Artificial Sequence
  Description of Artificial Sequence: Synthetic oligonucleotide
cctgcacagaggcatctataaccaagaggag

SEQ ID NO: 75256 - DNA, 30 bp, Artificial Sequence
  Description of Artificial Sequence: Synthetic oligonucleotide
gaacagccagaaggacttcctggaagacac

SEQ ID NO: 75257 - DNA, 30 bp, Artificial Sequence
  Description of Artificial Sequence: Synthetic oligonucleotide
aacagccagaaggacttcctggaagacacg

SEQ ID NO: 75258 - DNA, 29 bp, Artificial Sequence
  Description of Artificial Sequence: Synthetic oligonucleotide
acagccagaaggacttcctggaagacacg

SEQ ID NO: 75259 - DNA, 28 bp, Artificial Sequence
  Description of Artificial Sequence: Synthetic oligonucleotide
cagccagaaggacttcctggaagacacg

SEQ ID NO: 75260 - DNA, 28 bp, Artificial Sequence
  Description of Artificial Sequence: Synthetic oligonucleotide
agccagaaggacttcctggaagacacgc

SEQ ID NO: 75261 - DNA, 27 bp, Artificial Sequence
  Description of Artificial Sequence: Synthetic oligonucleotide
gccagaaggacttcctggaagacacgc

SEQ ID NO: 75262 - DNA, 27 bp, Artificial Sequence
  Description of Artificial Sequence: Synthetic oligonucleotide
ccagaaggacttcctggaagacacgcg

SEQ ID NO: 75263 - DNA, 27 bp, Artificial Sequence
  Description of Artificial Sequence: Synthetic oligonucleotide
cagaaggacttcctggaagacacgcgc

SEQ ID NO: 75264 - DNA, 27 bp, Artificial Sequence
  Description of Artificial Sequence: Synthetic oligonucleotide
agaaggacttcctggaagacacgcgcg

SEQ ID NO: 75265 - DNA, 26 bp, Artificial Sequence
  Description of Artificial Sequence: Synthetic oligonucleotide
gaaggacttcctggaagacacgcgcg

SEQ ID NO: 75266 - DNA, 26 bp, Artificial Sequence
  Description of Artificial Sequence: Synthetic oligonucleotide
aaggacttcctggaagacacgcgcgc

SEQ ID NO: 75267 - DNA, 25 bp, Artificial Sequence
  Description of Artificial Sequence: Synthetic oligonucleotide
aggacttcctggaagacacgcgcgc

SEQ ID NO: 75268 - DNA, 24 bp, Artificial Sequence
  Description of Artificial Sequence: Synthetic oligonucleotide
ggacttcctggaagacacgcgcgc

SEQ ID NO: 75269 - DNA, 24 bp, Artificial Sequence
  Description of Artificial Sequence: Synthetic oligonucleotide
gacttcctggaagacacgcgcgcc

SEQ ID NO: 75270 - DNA, 24 bp, Artificial Sequence
  Description of Artificial Sequence: Synthetic oligonucleotide
acttcctggaagacacgcgcgccg

SEQ ID NO: 75271 - DNA, 23 bp, Artificial Sequence
  Description of Artificial Sequence: Synthetic oligonucleotide
cttcctggaagacacgcgcgccg

SEQ ID NO: 75272 - DNA, 23 bp, Artificial Sequence
  Description of Artificial Sequence: Synthetic oligonucleotide
ttcctggaagacacgcgcgccgc

SEQ ID NO: 75273 - DNA, 22 bp, Artificial Sequence
  Description of Artificial Sequence: Synthetic oligonucleotide
tcctggaagacacgcgcgccgc

SEQ ID NO: 75274 - DNA, 21 bp, Artificial Sequence
  Description of Artificial Sequence: Synthetic oligonucleotide
cctggaagacacgcgcgccgc

SEQ ID NO: 75275 - DNA, 21 bp, Artificial Sequence
  Description of Artificial Sequence: Synthetic oligonucleotide
ctggaagacacgcgcgccgcg

SEQ ID NO: 75276 - DNA, 22 bp, Artificial Sequence
  Description of Artificial Sequence: Synthetic oligonucleotide
tggaagacacgcgcgccgcggt

SEQ ID NO: 75277 - DNA, 21 bp, Artificial Sequence
  Description of Artificial Sequence: Synthetic oligonucleotide
ggaagacacgcgcgccgcggt

SEQ ID NO: 75278 - DNA, 21 bp, Artificial Sequence
  Description of Artificial Sequence: Synthetic oligonucleotide
gaagacacgcgcgccgcggtg

SEQ ID NO: 75279 - DNA, 22 bp, Artificial Sequence
  Description of Artificial Sequence: Synthetic oligonucleotide
aagacacgcgcgccgcggtgga

SEQ ID NO: 75280 - DNA, 21 bp, Artificial Sequence
  Description of Artificial Sequence: Synthetic oligonucleotide
agacacgcgcgccgcggtgga

SEQ ID NO: 75281 - DNA, 20 bp, Artificial Sequence
  Description of Artificial Sequence: Synthetic oligonucleotide
gacacgcgcgccgcggtgga

SEQ ID NO: 75282 - DNA, 21 bp, Artificial Sequence
  Description of Artificial Sequence: Synthetic oligonucleotide
acacgcgcgccgcggtggaca

SEQ ID NO: 75283 - DNA, 20 bp, Artificial Sequence
  Description of Artificial Sequence: Synthetic oligonucleotide
cacgcgcgccgcggtggaca

SEQ ID NO: 75284 - DNA, 20 bp, Artificial Sequence
  Description of Artificial Sequence: Synthetic oligonucleotide
acgcgcgccgcggtggacac

SEQ ID NO: 75285 - DNA, 20 bp, Artificial Sequence
  Description of Artificial Sequence: Synthetic oligonucleotide
cgcgcgccgcggtggacact

SEQ ID NO: 75286 - DNA, 24 bp, Artificial Sequence
  Description of Artificial Sequence: Synthetic oligonucleotide
caaggacccagaccctgcagcacc

SEQ ID NO: 75287 - DNA, 33 bp, Artificial Sequence
  Description of Artificial Sequence: Synthetic oligonucleotide
tgcacagagacatctataaccaagaggaggacg

SEQ ID NO: 75288 - DNA, 32 bp, Artificial Sequence
  Description of Artificial Sequence: Synthetic oligonucleotide
gcacagagacatctataaccaagaggaggacg

SEQ ID NO: 75289 - DNA, 33 bp, Artificial Sequence
  Description of Artificial Sequence: Synthetic oligonucleotide
cacagagacatctataaccaagaggaggacgtg

SEQ ID NO: 75290 - DNA, 33 bp, Artificial Sequence
  Description of Artificial Sequence: Synthetic oligonucleotide
acagagacatctataaccaagaggaggacgtgc

SEQ ID NO: 75291 - DNA, 32 bp, Artificial Sequence
  Description of Artificial Sequence: Synthetic oligonucleotide
cagagacatctataaccaagaggaggacgtgc

SEQ ID NO: 75292 - DNA, 32 bp, Artificial Sequence
  Description of Artificial Sequence: Synthetic oligonucleotide
agagacatctataaccaagaggaggacgtgcg

SEQ ID NO: 75293 - DNA, 31 bp, Artificial Sequence
  Description of Artificial Sequence: Synthetic oligonucleotide
gagacatctataaccaagaggaggacgtgcg

SEQ ID NO: 75294 - DNA, 31 bp, Artificial Sequence
  Description of Artificial Sequence: Synthetic oligonucleotide
agacatctataaccaagaggaggacgtgcgc

SEQ ID NO: 75295 - DNA, 30 bp, Artificial Sequence
  Description of Artificial Sequence: Synthetic oligonucleotide
gacatctataaccaagaggaggacgtgcgc

SEQ ID NO: 75296 - DNA, 32 bp, Artificial Sequence
  Description of Artificial Sequence: Synthetic oligonucleotide
acatctataaccaagaggaggacgtgcgcttc

SEQ ID NO: 75297 - DNA, 31 bp, Artificial Sequence
  Description of Artificial Sequence: Synthetic oligonucleotide
catctataaccaagaggaggacgtgcgcttc

SEQ ID NO: 75298 - DNA, 31 bp, Artificial Sequence
  Description of Artificial Sequence: Synthetic oligonucleotide
atctataaccaagaggaggacgtgcgcttcg

SEQ ID NO: 75299 - DNA, 27 bp, Artificial Sequence
  Description of Artificial Sequence: Synthetic oligonucleotide
accttccagaccctggtgatgctggag

SEQ ID NO: 75300 - DNA, 27 bp, Artificial Sequence
  Description of Artificial Sequence: Synthetic oligonucleotide
ccttccagaccctggtgatgctggaga

SEQ ID NO: 75301 - DNA, 27 bp, Artificial Sequence
  Description of Artificial Sequence: Synthetic oligonucleotide
cttccagaccctggtgatgctggagag

SEQ ID NO: 75302 - DNA, 27 bp, Artificial Sequence
  Description of Artificial Sequence: Synthetic oligonucleotide
ttccagaccctggtgatgctggagagg

SEQ ID NO: 75303 - DNA, 27 bp, Artificial Sequence
  Description of Artificial Sequence: Synthetic oligonucleotide
tccagaccctggtgatgctggagaggt

SEQ ID NO: 75304 - DNA, 27 bp, Artificial Sequence
  Description of Artificial Sequence: Synthetic oligonucleotide
ccagaccctggtgatgctggagaggtt

SEQ ID NO: 75305 - DNA, 29 bp, Artificial Sequence
  Description of Artificial Sequence: Synthetic oligonucleotide
cagaccctggtgatgctggagaggtttac

SEQ ID NO: 75306 - DNA, 30 bp, Artificial Sequence
  Description of Artificial Sequence: Synthetic oligonucleotide
agaccctggtgatgctggagaggtttacac

SEQ ID NO: 75307 - DNA, 29 bp, Artificial Sequence
  Description of Artificial Sequence: Synthetic oligonucleotide
gaccctggtgatgctggagaggtttacac

SEQ ID NO: 75308 - DNA, 29 bp, Artificial Sequence
  Description of Artificial Sequence: Synthetic oligonucleotide
accctggtgatgctggagaggtttacacc

SEQ ID NO: 75309 - DNA, 28 bp, Artificial Sequence
  Description of Artificial Sequence: Synthetic oligonucleotide
ccctggtgatgctggagaggtttacacc

SEQ ID NO: 75310 - DNA, 29 bp, Artificial Sequence
  Description of Artificial Sequence: Synthetic oligonucleotide
cctggtgatgctggagaggtttacacctg

SEQ ID NO: 75311 - DNA, 29 bp, Artificial Sequence
  Description of Artificial Sequence: Synthetic oligonucleotide
ctggtgatgctggagaggtttacacctgc

SEQ ID NO: 75312 - DNA, 29 bp, Artificial Sequence
  Description of Artificial Sequence: Synthetic oligonucleotide
tggtgatgctggagaggtttacacctgcc

SEQ ID NO: 75313 - DNA, 28 bp, Artificial Sequence
  Description of Artificial Sequence: Synthetic oligonucleotide
ggtgatgctggagaggtttacacctgcc

SEQ ID NO: 75314 - DNA, 30 bp, Artificial Sequence
  Description of Artificial Sequence: Synthetic oligonucleotide
gtgatgctggagaggtttacacctgccaag

SEQ ID NO: 75315 - DNA, 31 bp, Artificial Sequence
  Description of Artificial Sequence: Synthetic oligonucleotide
tgatgctggagaggtttacacctgccaagtg

SEQ ID NO: 75316 - DNA, 30 bp, Artificial Sequence
  Description of Artificial Sequence: Synthetic oligonucleotide
gatgctggagaggtttacacctgccaagtg

SEQ ID NO: 75317 - DNA, 30 bp, Artificial Sequence
  Description of Artificial Sequence: Synthetic oligonucleotide
atgctggagaggtttacacctgccaagtgg

SEQ ID NO: 75318 - DNA, 29 bp, Artificial Sequence
  Description of Artificial Sequence: Synthetic oligonucleotide
tgctggagaggtttacacctgccaagtgg

SEQ ID NO: 75319 - DNA, 28 bp, Artificial Sequence
  Description of Artificial Sequence: Synthetic oligonucleotide
gctggagaggtttacacctgccaagtgg

SEQ ID NO: 75320 - DNA, 29 bp, Artificial Sequence
  Description of Artificial Sequence: Synthetic oligonucleotide
ctggagaggtttacacctgccaagtggag

SEQ ID NO: 75321 - DNA, 33 bp, Artificial Sequence
  Description of Artificial Sequence: Synthetic oligonucleotide
tactggaacagccagaaggacttcctggaaaac

SEQ ID NO: 75322 - DNA, 32 bp, Artificial Sequence
  Description of Artificial Sequence: Synthetic oligonucleotide
actggaacagccagaaggacttcctggaaaac

SEQ ID NO: 75323 - DNA, 31 bp, Artificial Sequence
  Description of Artificial Sequence: Synthetic oligonucleotide
ctggaacagccagaaggacttcctggaaaac

SEQ ID NO: 75324 - DNA, 32 bp, Artificial Sequence
  Description of Artificial Sequence: Synthetic oligonucleotide
tggaacagccagaaggacttcctggaaaacag

SEQ ID NO: 75325 - DNA, 31 bp, Artificial Sequence
  Description of Artificial Sequence: Synthetic oligonucleotide
ggaacagccagaaggacttcctggaaaacag

SEQ ID NO: 75326 - DNA, 31 bp, Artificial Sequence
  Description of Artificial Sequence: Synthetic oligonucleotide
gaacagccagaaggacttcctggaaaacagg

SEQ ID NO: 75327 - DNA, 31 bp, Artificial Sequence
  Description of Artificial Sequence: Synthetic oligonucleotide
aacagccagaaggacttcctggaaaacaggc

SEQ ID NO: 75328 - DNA, 30 bp, Artificial Sequence
  Description of Artificial Sequence: Synthetic oligonucleotide
acagccagaaggacttcctggaaaacaggc

SEQ ID NO: 75329 - DNA, 29 bp, Artificial Sequence
  Description of Artificial Sequence: Synthetic oligonucleotide
cagccagaaggacttcctggaaaacaggc

SEQ ID NO: 75330 - DNA, 29 bp, Artificial Sequence
  Description of Artificial Sequence: Synthetic oligonucleotide
agccagaaggacttcctggaaaacaggcg

SEQ ID NO: 75331 - DNA, 28 bp, Artificial Sequence
  Description of Artificial Sequence: Synthetic oligonucleotide
gccagaaggacttcctggaaaacaggcg

SEQ ID NO: 75332 - DNA, 28 bp, Artificial Sequence
  Description of Artificial Sequence: Synthetic oligonucleotide
ccagaaggacttcctggaaaacaggcgc

SEQ ID NO: 75333 - DNA, 28 bp, Artificial Sequence
  Description of Artificial Sequence: Synthetic oligonucleotide
cagaaggacttcctggaaaacaggcgcg

SEQ ID NO: 75334 - DNA, 28 bp, Artificial Sequence
  Description of Artificial Sequence: Synthetic oligonucleotide
agaaggacttcctggaaaacaggcgcgc

SEQ ID NO: 75335 - DNA, 27 bp, Artificial Sequence
  Description of Artificial Sequence: Synthetic oligonucleotide
gaaggacttcctggaaaacaggcgcgc

SEQ ID NO: 75336 - DNA, 27 bp, Artificial Sequence
  Description of Artificial Sequence: Synthetic oligonucleotide
aaggacttcctggaaaacaggcgcgcc

SEQ ID NO: 75337 - DNA, 26 bp, Artificial Sequence
  Description of Artificial Sequence: Synthetic oligonucleotide
aggacttcctggaaaacaggcgcgcc

SEQ ID NO: 75338 - DNA, 25 bp, Artificial Sequence
  Description of Artificial Sequence: Synthetic oligonucleotide
ggacttcctggaaaacaggcgcgcc

SEQ ID NO: 75339 - DNA, 25 bp, Artificial Sequence
  Description of Artificial Sequence: Synthetic oligonucleotide
gacttcctggaaaacaggcgcgccg

SEQ ID NO: 75340 - DNA, 25 bp, Artificial Sequence
  Description of Artificial Sequence: Synthetic oligonucleotide
acttcctggaaaacaggcgcgccgc

SEQ ID NO: 75341 - DNA, 24 bp, Artificial Sequence
  Description of Artificial Sequence: Synthetic oligonucleotide
cttcctggaaaacaggcgcgccgc

SEQ ID NO: 75342 - DNA, 24 bp, Artificial Sequence
  Description of Artificial Sequence: Synthetic oligonucleotide
ttcctggaaaacaggcgcgccgcg

SEQ ID NO: 75343 - DNA, 23 bp, Artificial Sequence
  Description of Artificial Sequence: Synthetic oligonucleotide
tcctggaaaacaggcgcgccgcg

SEQ ID NO: 75344 - DNA, 22 bp, Artificial Sequence
  Description of Artificial Sequence: Synthetic oligonucleotide
cctggaaaacaggcgcgccgcg

SEQ ID NO: 75345 - DNA, 23 bp, Artificial Sequence
  Description of Artificial Sequence: Synthetic oligonucleotide
ctggaaaacaggcgcgccgcggt

SEQ ID NO: 75346 - DNA, 23 bp, Artificial Sequence
  Description of Artificial Sequence: Synthetic oligonucleotide
tggaaaacaggcgcgccgcggtg

SEQ ID NO: 75347 - DNA, 22 bp, Artificial Sequence
  Description of Artificial Sequence: Synthetic oligonucleotide
ggaaaacaggcgcgccgcggtg

SEQ ID NO: 75348 - DNA, 23 bp, Artificial Sequence
  Description of Artificial Sequence: Synthetic oligonucleotide
gaaaacaggcgcgccgcggtgga

SEQ ID NO: 75349 - DNA, 24 bp, Artificial Sequence
  Description of Artificial Sequence: Synthetic oligonucleotide
aaaacaggcgcgccgcggtggaca

SEQ ID NO: 75350 - DNA, 23 bp, Artificial Sequence
  Description of Artificial Sequence: Synthetic oligonucleotide
aaacaggcgcgccgcggtggaca

SEQ ID NO: 75351 - DNA, 22 bp, Artificial Sequence
  Description of Artificial Sequence: Synthetic oligonucleotide
aacaggcgcgccgcggtggaca

SEQ ID NO: 75352 - DNA, 24 bp, Artificial Sequence
  Description of Artificial Sequence: Synthetic oligonucleotide
gccgcggtggacacctactgcaca

SEQ ID NO: 75353 - DNA, 26 bp, Artificial Sequence
  Description of Artificial Sequence: Synthetic oligonucleotide
ccgcggtggacacctactgcacacaa

SEQ ID NO: 75354 - DNA, 27 bp, Artificial Sequence
  Description of Artificial Sequence: Synthetic oligonucleotide
cgcggtggacacctactgcacacaact

SEQ ID NO: 75355 - DNA, 28 bp, Artificial Sequence
  Description of Artificial Sequence: Synthetic oligonucleotide
gcggtggacacctactgcacacaactac

SEQ ID NO: 75356 - DNA, 28 bp, Artificial Sequence
  Description of Artificial Sequence: Synthetic oligonucleotide
cggtggacacctactgcacacaactacg

SEQ ID NO: 75357 - DNA, 28 bp, Artificial Sequence
  Description of Artificial Sequence: Synthetic oligonucleotide
ggtggacacctactgcacacaactacgg

SEQ ID NO: 75358 - DNA, 28 bp, Artificial Sequence
  Description of Artificial Sequence: Synthetic oligonucleotide
gtggacacctactgcacacaactacggg

SEQ ID NO: 75359 - DNA, 28 bp, Artificial Sequence
  Description of Artificial Sequence: Synthetic oligonucleotide
tggacacctactgcacacaactacgggg

SEQ ID NO: 75360 - DNA, 27 bp, Artificial Sequence
  Description of Artificial Sequence: Synthetic oligonucleotide
ggacacctactgcacacaactacgggg

SEQ ID NO: 75361 - DNA, 29 bp, Artificial Sequence
  Description of Artificial Sequence: Synthetic oligonucleotide
gacacctactgcacacaactacggggttg

SEQ ID NO: 75362 - DNA, 29 bp, Artificial Sequence
  Description of Artificial Sequence: Synthetic oligonucleotide
acacctactgcacacaactacggggttgg

SEQ ID NO: 75363 - DNA, 28 bp, Artificial Sequence
  Description of Artificial Sequence: Synthetic oligonucleotide
cacctactgcacacaactacggggttgg

SEQ ID NO: 75364 - DNA, 29 bp, Artificial Sequence
  Description of Artificial Sequence: Synthetic oligonucleotide
acctactgcacacaactacggggttggtg

SEQ ID NO: 75365 - DNA, 28 bp, Artificial Sequence
  Description of Artificial Sequence: Synthetic oligonucleotide
cctactgcacacaactacggggttggtg

SEQ ID NO: 75366 - DNA, 29 bp, Artificial Sequence
  Description of Artificial Sequence: Synthetic oligonucleotide
ctactgcacacaactacggggttggtgag

SEQ ID NO: 75367 - DNA, 30 bp, Artificial Sequence
  Description of Artificial Sequence: Synthetic oligonucleotide
tactgcacacaactacggggttggtgagag

SEQ ID NO: 75368 - DNA, 29 bp, Artificial Sequence
  Description of Artificial Sequence: Synthetic oligonucleotide
actgcacacaactacggggttggtgagag

SEQ ID NO: 75369 - DNA, 28 bp, Artificial Sequence
  Description of Artificial Sequence: Synthetic oligonucleotide
ctgcacacaactacggggttggtgagag

SEQ ID NO: 75370 - DNA, 28 bp, Artificial Sequence
  Description of Artificial Sequence: Synthetic oligonucleotide
tgcacacaactacggggttggtgagagc

SEQ ID NO: 75371 - DNA, 27 bp, Artificial Sequence
  Description of Artificial Sequence: Synthetic oligonucleotide
gcacacaactacggggttggtgagagc

SEQ ID NO: 75372 - DNA, 29 bp, Artificial Sequence
  Description of Artificial Sequence: Synthetic oligonucleotide
cacacaactacggggttggtgagagcttc

SEQ ID NO: 75373 - DNA, 20 bp, Artificial Sequence
  Description of Artificial Sequence: Synthetic oligonucleotide
gagctggggcggcctgacgc

SEQ ID NO: 75374 - DNA, 20 bp, Artificial Sequence
  Description of Artificial Sequence: Synthetic oligonucleotide
agctggggcggcctgacgcc

SEQ ID NO: 75375 - DNA, 21 bp, Artificial Sequence
  Description of Artificial Sequence: Synthetic oligonucleotide
tggggcggcctgacgccgagt

SEQ ID NO: 75376 - DNA, 20 bp, Artificial Sequence
  Description of Artificial Sequence: Synthetic oligonucleotide
ggggcggcctgacgccgagt

SEQ ID NO: 75377 - DNA, 20 bp, Artificial Sequence
  Description of Artificial Sequence: Synthetic oligonucleotide
gggcggcctgacgccgagtc

SEQ ID NO: 75378 - DNA, 21 bp, Artificial Sequence
  Description of Artificial Sequence: Synthetic oligonucleotide
ggcggcctgacgccgagtcct

SEQ ID NO: 75379 - DNA, 21 bp, Artificial Sequence
  Description of Artificial Sequence: Synthetic oligonucleotide
gcggcctgacgccgagtcctg

SEQ ID NO: 75380 - DNA, 23 bp, Artificial Sequence
  Description of Artificial Sequence: Synthetic oligonucleotide
cggcctgacgccgagtcctggaa

SEQ ID NO: 75381 - DNA, 24 bp, Artificial Sequence
  Description of Artificial Sequence: Synthetic oligonucleotide
ggcctgacgccgagtcctggaaca

SEQ ID NO: 75382 - DNA, 24 bp, Artificial Sequence
  Description of Artificial Sequence: Synthetic oligonucleotide
gcctgacgccgagtcctggaacag

SEQ ID NO: 75383 - DNA, 24 bp, Artificial Sequence
  Description of Artificial Sequence: Synthetic oligonucleotide
cctgacgccgagtcctggaacagc

SEQ ID NO: 75384 - DNA, 25 bp, Artificial Sequence
  Description of Artificial Sequence: Synthetic oligonucleotide
ctgacgccgagtcctggaacagcca

SEQ ID NO: 75385 - DNA, 27 bp, Artificial Sequence
  Description of Artificial Sequence: Synthetic oligonucleotide
tgacgccgagtcctggaacagccagaa

SEQ ID NO: 75386 - DNA, 26 bp, Artificial Sequence
  Description of Artificial Sequence: Synthetic oligonucleotide
gacgccgagtcctggaacagccagaa

SEQ ID NO: 75387 - DNA, 26 bp, Artificial Sequence
  Description of Artificial Sequence: Synthetic oligonucleotide
acgccgagtcctggaacagccagaag

SEQ ID NO: 75388 - DNA, 36 bp, Artificial Sequence
  Description of Artificial Sequence: Synthetic oligonucleotide
ttcctgcacagagacatctataaccaagaggagtac

SEQ ID NO: 75389 - DNA, 35 bp, Artificial Sequence
  Description of Artificial Sequence: Synthetic oligonucleotide
tcctgcacagagacatctataaccaagaggagtac

SEQ ID NO: 75390 - DNA, 34 bp, Artificial Sequence
  Description of Artificial Sequence: Synthetic oligonucleotide
cctgcacagagacatctataaccaagaggagtac

SEQ ID NO: 75391 - DNA, 34 bp, Artificial Sequence
  Description of Artificial Sequence: Synthetic oligonucleotide
ctgcacagagacatctataaccaagaggagtacg

SEQ ID NO: 75392 - DNA, 35 bp, Artificial Sequence
  Description of Artificial Sequence: Synthetic oligonucleotide
tgcacagagacatctataaccaagaggagtacgtg

SEQ ID NO: 75393 - DNA, 34 bp, Artificial Sequence
  Description of Artificial Sequence: Synthetic oligonucleotide
gcacagagacatctataaccaagaggagtacgtg

SEQ ID NO: 75394 - DNA, 34 bp, Artificial Sequence
  Description of Artificial Sequence: Synthetic oligonucleotide
cacagagacatctataaccaagaggagtacgtgc

SEQ ID NO: 75395 - DNA, 34 bp, Artificial Sequence
  Description of Artificial Sequence: Synthetic oligonucleotide
acagagacatctataaccaagaggagtacgtgcg

SEQ ID NO: 75396 - DNA, 33 bp, Artificial Sequence
  Description of Artificial Sequence: Synthetic oligonucleotide
cagagacatctataaccaagaggagtacgtgcg

SEQ ID NO: 75397 - DNA, 33 bp, Artificial Sequence
  Description of Artificial Sequence: Synthetic oligonucleotide
agagacatctataaccaagaggagtacgtgcgc

SEQ ID NO: 75398 - DNA, 32 bp, Artificial Sequence
  Description of Artificial Sequence: Synthetic oligonucleotide
gagacatctataaccaagaggagtacgtgcgc

SEQ ID NO: 75399 - DNA, 34 bp, Artificial Sequence
  Description of Artificial Sequence: Synthetic oligonucleotide
agacatctataaccaagaggagtacgtgcgcttc

SEQ ID NO: 75400 - DNA, 33 bp, Artificial Sequence
  Description of Artificial Sequence: Synthetic oligonucleotide
gacatctataaccaagaggagtacgtgcgcttc

SEQ ID NO: 75401 - DNA, 33 bp, Artificial Sequence
  Description of Artificial Sequence: Synthetic oligonucleotide
acatctataaccaagaggagtacgtgcgcttcg

SEQ ID NO: 75402 - DNA, 28 bp, Artificial Sequence
  Description of Artificial Sequence: Synthetic oligonucleotide
aagctccctggaggttcctacatggcag

SEQ ID NO: 75403 - DNA, 27 bp, Artificial Sequence
  Description of Artificial Sequence: Synthetic oligonucleotide
agctccctggaggttcctacatggcag

SEQ ID NO: 75404 - DNA, 27 bp, Artificial Sequence
  Description of Artificial Sequence: Synthetic oligonucleotide
gctccctggaggttcctacatggcagt

SEQ ID NO: 75405 - DNA, 27 bp, Artificial Sequence
  Description of Artificial Sequence: Synthetic oligonucleotide
ctccctggaggttcctacatggcagtg

SEQ ID NO: 75406 - DNA, 27 bp, Artificial Sequence
  Description of Artificial Sequence: Synthetic oligonucleotide
tccctggaggttcctacatggcagtgc

SEQ ID NO: 75407 - DNA, 27 bp, Artificial Sequence
  Description of Artificial Sequence: Synthetic oligonucleotide
ccctggaggttcctacatggcagtgct

SEQ ID NO: 75408 - DNA, 27 bp, Artificial Sequence
  Description of Artificial Sequence: Synthetic oligonucleotide
cctggaggttcctacatggcagtgctg

SEQ ID NO: 75409 - DNA, 28 bp, Artificial Sequence
  Description of Artificial Sequence: Synthetic oligonucleotide
ctggaggttcctacatggcagtgctgac

SEQ ID NO: 75410 - DNA, 29 bp, Artificial Sequence
  Description of Artificial Sequence: Synthetic oligonucleotide
tggaggttcctacatggcagtgctgacag

SEQ ID NO: 75411 - DNA, 28 bp, Artificial Sequence
  Description of Artificial Sequence: Synthetic oligonucleotide
ggaggttcctacatggcagtgctgacag

SEQ ID NO: 75412 - DNA, 29 bp, Artificial Sequence
  Description of Artificial Sequence: Synthetic oligonucleotide
gaggttcctacatggcagtgctgacagtg

SEQ ID NO: 75413 - DNA, 30 bp, Artificial Sequence
  Description of Artificial Sequence: Synthetic oligonucleotide
aggttcctacatggcagtgctgacagtgac

SEQ ID NO: 75414 - DNA, 29 bp, Artificial Sequence
  Description of Artificial Sequence: Synthetic oligonucleotide
ggttcctacatggcagtgctgacagtgac

SEQ ID NO: 75415 - DNA, 30 bp, Artificial Sequence
  Description of Artificial Sequence: Synthetic oligonucleotide
gttcctacatggcagtgctgacagtgacac

SEQ ID NO: 75416 - DNA, 31 bp, Artificial Sequence
  Description of Artificial Sequence: Synthetic oligonucleotide
ttcctacatggcagtgctgacagtgacactg

SEQ ID NO: 75417 - DNA, 30 bp, Artificial Sequence
  Description of Artificial Sequence: Synthetic oligonucleotide
tcctacatggcagtgctgacagtgacactg

SEQ ID NO: 75418 - DNA, 29 bp, Artificial Sequence
  Description of Artificial Sequence: Synthetic oligonucleotide
cctacatggcagtgctgacagtgacactg

SEQ ID NO: 75419 - DNA, 31 bp, Artificial Sequence
  Description of Artificial Sequence: Synthetic oligonucleotide
ctacatggcagtgctgacagtgacactgatg

SEQ ID NO: 75420 - DNA, 31 bp, Artificial Sequence
  Description of Artificial Sequence: Synthetic oligonucleotide
tacatggcagtgctgacagtgacactgatgg

SEQ ID NO: 75421 - DNA, 30 bp, Artificial Sequence
  Description of Artificial Sequence: Synthetic oligonucleotide
acatggcagtgctgacagtgacactgatgg

SEQ ID NO: 75422 - DNA, 29 bp, Artificial Sequence
  Description of Artificial Sequence: Synthetic oligonucleotide
catggcagtgctgacagtgacactgatgg

SEQ ID NO: 75423 - DNA, 30 bp, Artificial Sequence
  Description of Artificial Sequence: Synthetic oligonucleotide
atggcagtgctgacagtgacactgatggtg

SEQ ID NO: 75424 - DNA, 29 bp, Artificial Sequence
  Description of Artificial Sequence: Synthetic oligonucleotide
tggcagtgctgacagtgacactgatggtg

SEQ ID NO: 75425 - DNA, 28 bp, Artificial Sequence
  Description of Artificial Sequence: Synthetic oligonucleotide
ggcagtgctgacagtgacactgatggtg

SEQ ID NO: 75426 - DNA, 28 bp, Artificial Sequence
  Description of Artificial Sequence: Synthetic oligonucleotide
gcagtgctgacagtgacactgatggtgc

SEQ ID NO: 75427 - DNA, 29 bp, Artificial Sequence
  Description of Artificial Sequence: Synthetic oligonucleotide
cagtgctgacagtgacactgatggtgctg

SEQ ID NO: 75428 - DNA, 30 bp, Artificial Sequence
  Description of Artificial Sequence: Synthetic oligonucleotide
agtgctgacagtgacactgatggtgctgag

SEQ ID NO: 75429 - DNA, 29 bp, Artificial Sequence
  Description of Artificial Sequence: Synthetic oligonucleotide
gtgctgacagtgacactgatggtgctgag

SEQ ID NO: 75430 - DNA, 29 bp, Artificial Sequence
  Description of Artificial Sequence: Synthetic oligonucleotide
tgctgacagtgacactgatggtgctgagc

SEQ ID NO: 75431 - DNA, 25 bp, Artificial Sequence
  Description of Artificial Sequence: Synthetic oligonucleotide
gctttggctggggacacccgaccat

SEQ ID NO: 75432 - DNA, 27 bp, Artificial Sequence
  Description of Artificial Sequence: Synthetic oligonucleotide
ctttggctggggacacccgaccatgtt

SEQ ID NO: 75433 - DNA, 28 bp, Artificial Sequence
  Description of Artificial Sequence: Synthetic oligonucleotide
tttggctggggacacccgaccatgtttc

SEQ ID NO: 75434 - DNA, 27 bp, Artificial Sequence
  Description of Artificial Sequence: Synthetic oligonucleotide
ttggctggggacacccgaccatgtttc

SEQ ID NO: 75435 - DNA, 27 bp, Artificial Sequence
  Description of Artificial Sequence: Synthetic oligonucleotide
tggctggggacacccgaccatgtttct

SEQ ID NO: 75436 - DNA, 27 bp, Artificial Sequence
  Description of Artificial Sequence: Synthetic oligonucleotide
ggctggggacacccgaccatgtttctt

SEQ ID NO: 75437 - DNA, 27 bp, Artificial Sequence
  Description of Artificial Sequence: Synthetic oligonucleotide
gctggggacacccgaccatgtttcttg

SEQ ID NO: 75438 - DNA, 27 bp, Artificial Sequence
  Description of Artificial Sequence: Synthetic oligonucleotide
ctggggacacccgaccatgtttcttgc

SEQ ID NO: 75439 - DNA, 28 bp, Artificial Sequence
  Description of Artificial Sequence: Synthetic oligonucleotide
tggggacacccgaccatgtttcttgcag

SEQ ID NO: 75440 - DNA, 27 bp, Artificial Sequence
  Description of Artificial Sequence: Synthetic oligonucleotide
ggggacacccgaccatgtttcttgcag

SEQ ID NO: 75441 - DNA, 27 bp, Artificial Sequence
  Description of Artificial Sequence: Synthetic oligonucleotide
gggacacccgaccatgtttcttgcagc

SEQ ID NO: 75442 - DNA, 28 bp, Artificial Sequence
  Description of Artificial Sequence: Synthetic oligonucleotide
ggacacccgaccatgtttcttgcagcag

SEQ ID NO: 75443 - DNA, 28 bp, Artificial Sequence
  Description of Artificial Sequence: Synthetic oligonucleotide
gacacccgaccatgtttcttgcagcagg

SEQ ID NO: 75444 - DNA, 32 bp, Artificial Sequence
  Description of Artificial Sequence: Synthetic oligonucleotide
acacccgaccatgtttcttgcagcaggataag

SEQ ID NO: 75445 - DNA, 31 bp, Artificial Sequence
  Description of Artificial Sequence: Synthetic oligonucleotide
cacccgaccatgtttcttgcagcaggataag

SEQ ID NO: 75446 - DNA, 34 bp, Artificial Sequence
  Description of Artificial Sequence: Synthetic oligonucleotide
acccgaccatgtttcttgcagcaggataagtatg

SEQ ID NO: 75447 - DNA, 33 bp, Artificial Sequence
  Description of Artificial Sequence: Synthetic oligonucleotide
cccgaccatgtttcttgcagcaggataagtatg

SEQ ID NO: 75448 - DNA, 34 bp, Artificial Sequence
  Description of Artificial Sequence: Synthetic oligonucleotide
ccgaccatgtttcttgcagcaggataagtatgag

SEQ ID NO: 75449 - DNA, 35 bp, Artificial Sequence
  Description of Artificial Sequence: Synthetic oligonucleotide
cgaccatgtttcttgcagcaggataagtatgagtg

SEQ ID NO: 75450 - DNA, 36 bp, Artificial Sequence
  Description of Artificial Sequence: Synthetic oligonucleotide
gaccatgtttcttgcagcaggataagtatgagtgtc

SEQ ID NO: 75451 - DNA, 40 bp, Artificial Sequence
  Description of Artificial Sequence: Synthetic oligonucleotide
accatgtttcttgcagcaggataagtatgagtgtcatttc

SEQ ID NO: 75452 - DNA, 39 bp, Artificial Sequence
  Description of Artificial Sequence: Synthetic oligonucleotide
ccatgtttcttgcagcaggataagtatgagtgtcatttc

SEQ ID NO: 75453 - DNA, 41 bp, Artificial Sequence
  Description of Artificial Sequence: Synthetic oligonucleotide
catgtttcttgcagcaggataagtatgagtgtcatttcttc

SEQ ID NO: 75454 - DNA, 43 bp, Artificial Sequence
  Description of Artificial Sequence: Synthetic oligonucleotide
atgtttcttgcagcaggataagtatgagtgtcatttcttcaac

SEQ ID NO: 75455 - DNA, 42 bp, Artificial Sequence
  Description of Artificial Sequence: Synthetic oligonucleotide
tgtttcttgcagcaggataagtatgagtgtcatttcttcaac

SEQ ID NO: 75456 - DNA, 34 bp, Artificial Sequence
  Description of Artificial Sequence: Synthetic oligonucleotide
ctgattcagaatggagactggaccttccagattc

SEQ ID NO: 75457 - DNA, 35 bp, Artificial Sequence
  Description of Artificial Sequence: Synthetic oligonucleotide
tgattcagaatggagactggaccttccagattctg

SEQ ID NO: 75458 - DNA, 34 bp, Artificial Sequence
  Description of Artificial Sequence: Synthetic oligonucleotide
gattcagaatggagactggaccttccagattctg

SEQ ID NO: 75459 - DNA, 34 bp, Artificial Sequence
  Description of Artificial Sequence: Synthetic oligonucleotide
attcagaatggagactggaccttccagattctgg

SEQ ID NO: 75460 - DNA, 33 bp, Artificial Sequence
  Description of Artificial Sequence: Synthetic oligonucleotide
ttcagaatggagactggaccttccagattctgg

SEQ ID NO: 75461 - DNA, 32 bp, Artificial Sequence
  Description of Artificial Sequence: Synthetic oligonucleotide
tcagaatggagactggaccttccagattctgg

SEQ ID NO: 75462 - DNA, 31 bp, Artificial Sequence
  Description of Artificial Sequence: Synthetic oligonucleotide
cagaatggagactggaccttccagattctgg

SEQ ID NO: 75463 - DNA, 32 bp, Artificial Sequence
  Description of Artificial Sequence: Synthetic oligonucleotide
agaatggagactggaccttccagattctggtg

SEQ ID NO: 75464 - DNA, 31 bp, Artificial Sequence
  Description of Artificial Sequence: Synthetic oligonucleotide
gaatggagactggaccttccagattctggtg

SEQ ID NO: 75465 - DNA, 33 bp, Artificial Sequence
  Description of Artificial Sequence: Synthetic oligonucleotide
aatggagactggaccttccagattctggtgatg

SEQ ID NO: 75466 - DNA, 32 bp, Artificial Sequence
  Description of Artificial Sequence: Synthetic oligonucleotide
atggagactggaccttccagattctggtgatg

SEQ ID NO: 75467 - DNA, 31 bp, Artificial Sequence
  Description of Artificial Sequence: Synthetic oligonucleotide
tggagactggaccttccagattctggtgatg

SEQ ID NO: 75468 - DNA, 30 bp, Artificial Sequence
  Description of Artificial Sequence: Synthetic oligonucleotide
ggagactggaccttccagattctggtgatg

SEQ ID NO: 75469 - DNA, 30 bp, Artificial Sequence
  Description of Artificial Sequence: Synthetic oligonucleotide
gagactggaccttccagattctggtgatgc

SEQ ID NO: 75470 - DNA, 31 bp, Artificial Sequence
  Description of Artificial Sequence: Synthetic oligonucleotide
agactggaccttccagattctggtgatgctg

SEQ ID NO: 75471 - DNA, 30 bp, Artificial Sequence
  Description of Artificial Sequence: Synthetic oligonucleotide
gactggaccttccagattctggtgatgctg

SEQ ID NO: 75472 - DNA, 30 bp, Artificial Sequence
  Description of Artificial Sequence: Synthetic oligonucleotide
actggaccttccagattctggtgatgctgg

SEQ ID NO: 75473 - DNA, 29 bp, Artificial Sequence
  Description of Artificial Sequence: Synthetic oligonucleotide
ctggaccttccagattctggtgatgctgg

SEQ ID NO: 75474 - DNA, 32 bp, Artificial Sequence
  Description of Artificial Sequence: Synthetic oligonucleotide
tggaccttccagattctggtgatgctggaaac

SEQ ID NO: 75475 - DNA, 31 bp, Artificial Sequence
  Description of Artificial Sequence: Synthetic oligonucleotide
ggaccttccagattctggtgatgctggaaac

SEQ ID NO: 75476 - DNA, 32 bp, Artificial Sequence
  Description of Artificial Sequence: Synthetic oligonucleotide
gaccttccagattctggtgatgctggaaacag

SEQ ID NO: 75477 - DNA, 34 bp, Artificial Sequence
  Description of Artificial Sequence: Synthetic oligonucleotide
accttccagattctggtgatgctggaaacagttc

SEQ ID NO: 75478 - DNA, 33 bp, Artificial Sequence
  Description of Artificial Sequence: Synthetic oligonucleotide
ccttccagattctggtgatgctggaaacagttc

SEQ ID NO: 75479 - DNA, 33 bp, Artificial Sequence
  Description of Artificial Sequence: Synthetic oligonucleotide
cttccagattctggtgatgctggaaacagttcc

SEQ ID NO: 75480 - DNA, 34 bp, Artificial Sequence
  Description of Artificial Sequence: Synthetic oligonucleotide
ttccagattctggtgatgctggaaacagttcctc

SEQ ID NO: 75481 - DNA, 33 bp, Artificial Sequence
  Description of Artificial Sequence: Synthetic oligonucleotide
tccagattctggtgatgctggaaacagttcctc

SEQ ID NO: 75482 - DNA, 32 bp, Artificial Sequence
  Description of Artificial Sequence: Synthetic oligonucleotide
ccagattctggtgatgctggaaacagttcctc

SEQ ID NO: 75483 - DNA, 32 bp, Artificial Sequence
  Description of Artificial Sequence: Synthetic oligonucleotide
cagattctggtgatgctggaaacagttcctcg

SEQ ID NO: 75484 - DNA, 32 bp, Artificial Sequence
  Description of Artificial Sequence: Synthetic oligonucleotide
agattctggtgatgctggaaacagttcctcgg

SEQ ID NO: 75485 - DNA, 31 bp, Artificial Sequence
  Description of Artificial Sequence: Synthetic oligonucleotide
gattctggtgatgctggaaacagttcctcgg

SEQ ID NO: 75486 - DNA, 32 bp, Artificial Sequence
  Description of Artificial Sequence: Synthetic oligonucleotide
attctggtgatgctggaaacagttcctcggag

SEQ ID NO: 75487 - DNA, 31 bp, Artificial Sequence
  Description of Artificial Sequence: Synthetic oligonucleotide
ttctggtgatgctggaaacagttcctcggag

SEQ ID NO: 75488 - DNA, 30 bp, Artificial Sequence
  Description of Artificial Sequence: Synthetic oligonucleotide
tctggtgatgctggaaacagttcctcggag

SEQ ID NO: 75489 - DNA, 34 bp, Artificial Sequence
  Description of Artificial Sequence: Synthetic oligonucleotide
tgaatctgcacagagcaagatgctgagtggaatc

SEQ ID NO: 75490 - DNA, 33 bp, Artificial Sequence
  Description of Artificial Sequence: Synthetic oligonucleotide
gaatctgcacagagcaagatgctgagtggaatc

SEQ ID NO: 75491 - DNA, 33 bp, Artificial Sequence
  Description of Artificial Sequence: Synthetic oligonucleotide
aatctgcacagagcaagatgctgagtggaatcg

SEQ ID NO: 75492 - DNA, 32 bp, Artificial Sequence
  Description of Artificial Sequence: Synthetic oligonucleotide
atctgcacagagcaagatgctgagtggaatcg

SEQ ID NO: 75493 - DNA, 31 bp, Artificial Sequence
  Description of Artificial Sequence: Synthetic oligonucleotide
tctgcacagagcaagatgctgagtggaatcg

SEQ ID NO: 75494 - DNA, 30 bp, Artificial Sequence
  Description of Artificial Sequence: Synthetic oligonucleotide
ctgcacagagcaagatgctgagtggaatcg

SEQ ID NO: 75495 - DNA, 30 bp, Artificial Sequence
  Description of Artificial Sequence: Synthetic oligonucleotide
tgcacagagcaagatgctgagtggaatcgg

SEQ ID NO: 75496 - DNA, 29 bp, Artificial Sequence
  Description of Artificial Sequence: Synthetic oligonucleotide
gcacagagcaagatgctgagtggaatcgg

SEQ ID NO: 75497 - DNA, 29 bp, Artificial Sequence
  Description of Artificial Sequence: Synthetic oligonucleotide
cacagagcaagatgctgagtggaatcggg

SEQ ID NO: 75498 - DNA, 29 bp, Artificial Sequence
  Description of Artificial Sequence: Synthetic oligonucleotide
acagagcaagatgctgagtggaatcgggg

SEQ ID NO: 75499 - DNA, 28 bp, Artificial Sequence
  Description of Artificial Sequence: Synthetic oligonucleotide
cagagcaagatgctgagtggaatcgggg

SEQ ID NO: 75500 - DNA, 28 bp, Artificial Sequence
  Description of Artificial Sequence: Synthetic oligonucleotide
agagcaagatgctgagtggaatcggggg

SEQ ID NO: 75501 - DNA, 27 bp, Artificial Sequence
  Description of Artificial Sequence: Synthetic oligonucleotide
gagcaagatgctgagtggaatcggggg

SEQ ID NO: 75502 - DNA, 27 bp, Artificial Sequence
  Description of Artificial Sequence: Synthetic oligonucleotide
agcaagatgctgagtggaatcgggggc

SEQ ID NO: 75503 - DNA, 27 bp, Artificial Sequence
  Description of Artificial Sequence: Synthetic oligonucleotide
gcaagatgctgagtggaatcgggggct

SEQ ID NO: 75504 - DNA, 29 bp, Artificial Sequence
  Description of Artificial Sequence: Synthetic oligonucleotide
caagatgctgagtggaatcgggggctttg

SEQ ID NO: 75505 - DNA, 30 bp, Artificial Sequence
  Description of Artificial Sequence: Synthetic oligonucleotide
aagatgctgagtggaatcgggggctttgtg

SEQ ID NO: 75506 - DNA, 29 bp, Artificial Sequence
  Description of Artificial Sequence: Synthetic oligonucleotide
agatgctgagtggaatcgggggctttgtg

SEQ ID NO: 75507 - DNA, 28 bp, Artificial Sequence
  Description of Artificial Sequence: Synthetic oligonucleotide
gatgctgagtggaatcgggggctttgtg

SEQ ID NO: 75508 - DNA, 28 bp, Artificial Sequence
  Description of Artificial Sequence: Synthetic oligonucleotide
atgctgagtggaatcgggggctttgtgc

SEQ ID NO: 75509 - DNA, 27 bp, Artificial Sequence
  Description of Artificial Sequence: Synthetic oligonucleotide
tgctgagtggaatcgggggctttgtgc

SEQ ID NO: 75510 - DNA, 27 bp, Artificial Sequence
  Description of Artificial Sequence: Synthetic oligonucleotide
gctgagtggaatcgggggctttgtgct

SEQ ID NO: 75511 - DNA, 27 bp, Artificial Sequence
  Description of Artificial Sequence: Synthetic oligonucleotide
ctgagtggaatcgggggctttgtgctg

SEQ ID NO: 75512 - DNA, 27 bp, Artificial Sequence
  Description of Artificial Sequence: Synthetic oligonucleotide
tgagtggaatcgggggctttgtgctgg

SEQ ID NO: 75513 - DNA, 26 bp, Artificial Sequence
  Description of Artificial Sequence: Synthetic oligonucleotide
gagtggaatcgggggctttgtgctgg

SEQ ID NO: 75514 - DNA, 26 bp, Artificial Sequence
  Description of Artificial Sequence: Synthetic oligonucleotide
agtggaatcgggggctttgtgctggg

SEQ ID NO: 75515 - DNA, 25 bp, Artificial Sequence
  Description of Artificial Sequence: Synthetic oligonucleotide
gtggaatcgggggctttgtgctggg

SEQ ID NO: 75516 - DNA, 25 bp, Artificial Sequence
  Description of Artificial Sequence: Synthetic oligonucleotide
tggaatcgggggctttgtgctgggc

SEQ ID NO: 75517 - DNA, 24 bp, Artificial Sequence
  Description of Artificial Sequence: Synthetic oligonucleotide
ggaatcgggggctttgtgctgggc

SEQ ID NO: 75518 - DNA, 25 bp, Artificial Sequence
  Description of Artificial Sequence: Synthetic oligonucleotide
gaatcgggggctttgtgctgggcct

SEQ ID NO: 75519 - DNA, 25 bp, Artificial Sequence
  Description of Artificial Sequence: Synthetic oligonucleotide
aatcgggggctttgtgctgggcctg

SEQ ID NO: 75520 - DNA, 24 bp, Artificial Sequence
  Description of Artificial Sequence: Synthetic oligonucleotide
atcgggggctttgtgctgggcctg

SEQ ID NO: 75521 - DNA, 33 bp, Artificial Sequence
  Description of Artificial Sequence: Synthetic oligonucleotide
atggtagatggaaccctccttttactcctctcg

SEQ ID NO: 75522 - DNA, 32 bp, Artificial Sequence
  Description of Artificial Sequence: Synthetic oligonucleotide
tggtagatggaaccctccttttactcctctcg

SEQ ID NO: 75523 - DNA, 31 bp, Artificial Sequence
  Description of Artificial Sequence: Synthetic oligonucleotide
ggtagatggaaccctccttttactcctctcg

SEQ ID NO: 75524 - DNA, 31 bp, Artificial Sequence
  Description of Artificial Sequence: Synthetic oligonucleotide
gtagatggaaccctccttttactcctctcgg

SEQ ID NO: 75525 - DNA, 32 bp, Artificial Sequence
  Description of Artificial Sequence: Synthetic oligonucleotide
tagatggaaccctccttttactcctctcggag

SEQ ID NO: 75526 - DNA, 31 bp, Artificial Sequence
  Description of Artificial Sequence: Synthetic oligonucleotide
agatggaaccctccttttactcctctcggag

SEQ ID NO: 75527 - DNA, 30 bp, Artificial Sequence
  Description of Artificial Sequence: Synthetic oligonucleotide
gatggaaccctccttttactcctctcggag

SEQ ID NO: 75528 - DNA, 30 bp, Artificial Sequence
  Description of Artificial Sequence: Synthetic oligonucleotide
atggaaccctccttttactcctctcggagg

SEQ ID NO: 75529 - DNA, 29 bp, Artificial Sequence
  Description of Artificial Sequence: Synthetic oligonucleotide
tggaaccctccttttactcctctcggagg

SEQ ID NO: 75530 - DNA, 28 bp, Artificial Sequence
  Description of Artificial Sequence: Synthetic oligonucleotide
ggaaccctccttttactcctctcggagg

SEQ ID NO: 75531 - DNA, 28 bp, Artificial Sequence
  Description of Artificial Sequence: Synthetic oligonucleotide
gaaccctccttttactcctctcggaggc

SEQ ID NO: 75532 - DNA, 28 bp, Artificial Sequence
  Description of Artificial Sequence: Synthetic oligonucleotide
aaccctccttttactcctctcggaggcc

SEQ ID NO: 75533 - DNA, 27 bp, Artificial Sequence
  Description of Artificial Sequence: Synthetic oligonucleotide
accctccttttactcctctcggaggcc

SEQ ID NO: 75534 - DNA, 26 bp, Artificial Sequence
  Description of Artificial Sequence: Synthetic oligonucleotide
ccctccttttactcctctcggaggcc

SEQ ID NO: 75535 - DNA, 27 bp, Artificial Sequence
  Description of Artificial Sequence: Synthetic oligonucleotide
cctccttttactcctctcggaggccct

SEQ ID NO: 75536 - DNA, 27 bp, Artificial Sequence
  Description of Artificial Sequence: Synthetic oligonucleotide
ctccttttactcctctcggaggccctg

SEQ ID NO: 75537 - DNA, 27 bp, Artificial Sequence
  Description of Artificial Sequence: Synthetic oligonucleotide
tccttttactcctctcggaggccctgg

SEQ ID NO: 75538 - DNA, 26 bp, Artificial Sequence
  Description of Artificial Sequence: Synthetic oligonucleotide
ccttttactcctctcggaggccctgg

SEQ ID NO: 75539 - DNA, 26 bp, Artificial Sequence
  Description of Artificial Sequence: Synthetic oligonucleotide
cttttactcctctcggaggccctggc

SEQ ID NO: 75540 - DNA, 26 bp, Artificial Sequence
  Description of Artificial Sequence: Synthetic oligonucleotide
ttttactcctctcggaggccctggcc

SEQ ID NO: 75541 - DNA, 25 bp, Artificial Sequence
  Description of Artificial Sequence: Synthetic oligonucleotide
tttactcctctcggaggccctggcc

SEQ ID NO: 75542 - DNA, 24 bp, Artificial Sequence
  Description of Artificial Sequence: Synthetic oligonucleotide
ttactcctctcggaggccctggcc

SEQ ID NO: 75543 - DNA, 23 bp, Artificial Sequence
  Description of Artificial Sequence: Synthetic oligonucleotide
tactcctctcggaggccctggcc

SEQ ID NO: 75544 - DNA, 22 bp, Artificial Sequence
  Description of Artificial Sequence: Synthetic oligonucleotide
actcctctcggaggccctggcc

SEQ ID NO: 75545 - DNA, 21 bp, Artificial Sequence
  Description of Artificial Sequence: Synthetic oligonucleotide
ctcctctcggaggccctggcc

SEQ ID NO: 75546 - DNA, 24 bp, Artificial Sequence
  Description of Artificial Sequence: Synthetic oligonucleotide
tcctctcggaggccctggccctta

SEQ ID NO: 75547 - DNA, 23 bp, Artificial Sequence
  Description of Artificial Sequence: Synthetic oligonucleotide
cctctcggaggccctggccctta

SEQ ID NO: 75548 - DNA, 23 bp, Artificial Sequence
  Description of Artificial Sequence: Synthetic oligonucleotide
ctctcggaggccctggcccttac

SEQ ID NO: 75549 - DNA, 23 bp, Artificial Sequence
  Description of Artificial Sequence: Synthetic oligonucleotide
tctcggaggccctggcccttacc

SEQ ID NO: 75550 - DNA, 22 bp, Artificial Sequence
  Description of Artificial Sequence: Synthetic oligonucleotide
ctcggaggccctggcccttacc

SEQ ID NO: 75551 - DNA, 23 bp, Artificial Sequence
  Description of Artificial Sequence: Synthetic oligonucleotide
tcggaggccctggcccttaccca

SEQ ID NO: 75552 - DNA, 22 bp, Artificial Sequence
  Description of Artificial Sequence: Synthetic oligonucleotide
cggaggccctggcccttaccca

SEQ ID NO: 75553 - DNA, 23 bp, Artificial Sequence
  Description of Artificial Sequence: Synthetic oligonucleotide
ggaggccctggcccttacccaga

SEQ ID NO: 75554 - DNA, 23 bp, Artificial Sequence
  Description of Artificial Sequence: Synthetic oligonucleotide
gaggccctggcccttacccagac

SEQ ID NO: 75555 - DNA, 24 bp, Artificial Sequence
  Description of Artificial Sequence: Synthetic oligonucleotide
aggccctggcccttacccagacct

SEQ ID NO: 75556 - DNA, 23 bp, Artificial Sequence
  Description of Artificial Sequence: Synthetic oligonucleotide
ggccctggcccttacccagacct

SEQ ID NO: 75557 - DNA, 23 bp, Artificial Sequence
  Description of Artificial Sequence: Synthetic oligonucleotide
gccctggcccttacccagacctg

SEQ ID NO: 75558 - DNA, 23 bp, Artificial Sequence
  Description of Artificial Sequence: Synthetic oligonucleotide
ccctggcccttacccagacctgg

SEQ ID NO: 75559 - DNA, 23 bp, Artificial Sequence
  Description of Artificial Sequence: Synthetic oligonucleotide
cctggcccttacccagacctggg

SEQ ID NO: 75560 - DNA, 23 bp, Artificial Sequence
  Description of Artificial Sequence: Synthetic oligonucleotide
ctggcccttacccagacctgggc

SEQ ID NO: 75561 - DNA, 23 bp, Artificial Sequence
  Description of Artificial Sequence: Synthetic oligonucleotide
tggcccttacccagacctgggcg

SEQ ID NO: 75562 - DNA, 22 bp, Artificial Sequence
  Description of Artificial Sequence: Synthetic oligonucleotide
ggcccttacccagacctgggcg

SEQ ID NO: 75563 - DNA, 22 bp, Artificial Sequence
  Description of Artificial Sequence: Synthetic oligonucleotide
gcccttacccagacctgggcgg

SEQ ID NO: 75564 - DNA, 22 bp, Artificial Sequence
  Description of Artificial Sequence: Synthetic oligonucleotide
cccttacccagacctgggcggg

SEQ ID NO: 75565 - DNA, 23 bp, Artificial Sequence
  Description of Artificial Sequence: Synthetic oligonucleotide
ccttacccagacctgggcgggct

SEQ ID NO: 75566 - DNA, 23 bp, Artificial Sequence
  Description of Artificial Sequence: Synthetic oligonucleotide
cttacccagacctgggcgggctc

SEQ ID NO: 75567 - DNA, 23 bp, Artificial Sequence
  Description of Artificial Sequence: Synthetic oligonucleotide
ttacccagacctgggcgggctcc

SEQ ID NO: 75568 - DNA, 22 bp, Artificial Sequence
  Description of Artificial Sequence: Synthetic oligonucleotide
tacccagacctgggcgggctcc

SEQ ID NO: 75569 - DNA, 23 bp, Artificial Sequence
  Description of Artificial Sequence: Synthetic oligonucleotide
acctgggcgggctcccactcctt

SEQ ID NO: 75570 - DNA, 22 bp, Artificial Sequence
  Description of Artificial Sequence: Synthetic oligonucleotide
cctgggcgggctcccactcctt

SEQ ID NO: 75571 - DNA, 24 bp, Artificial Sequence
  Description of Artificial Sequence: Synthetic oligonucleotide
ctgggcgggctcccactccttgaa

SEQ ID NO: 75572 - DNA, 27 bp, Artificial Sequence
  Description of Artificial Sequence: Synthetic oligonucleotide
tgggcgggctcccactccttgaagtat

SEQ ID NO: 75573 - DNA, 27 bp, Artificial Sequence
  Description of Artificial Sequence: Synthetic oligonucleotide
gggcgggctcccactccttgaagtatt

SEQ ID NO: 75574 - DNA, 28 bp, Artificial Sequence
  Description of Artificial Sequence: Synthetic oligonucleotide
ggcgggctcccactccttgaagtatttc

SEQ ID NO: 75575 - DNA, 28 bp, Artificial Sequence
  Description of Artificial Sequence: Synthetic oligonucleotide
gcgggctcccactccttgaagtatttcc

SEQ ID NO: 75576 - DNA, 29 bp, Artificial Sequence
  Description of Artificial Sequence: Synthetic oligonucleotide
cgggctcccactccttgaagtatttccac

SEQ ID NO: 75577 - DNA, 30 bp, Artificial Sequence
  Description of Artificial Sequence: Synthetic oligonucleotide
gggctcccactccttgaagtatttccacac

SEQ ID NO: 75578 - DNA, 32 bp, Artificial Sequence
  Description of Artificial Sequence: Synthetic oligonucleotide
ggctcccactccttgaagtatttccacacttc

SEQ ID NO: 75579 - DNA, 32 bp, Artificial Sequence
  Description of Artificial Sequence: Synthetic oligonucleotide
gctcccactccttgaagtatttccacacttcc

SEQ ID NO: 75580 - DNA, 32 bp, Artificial Sequence
  Description of Artificial Sequence: Synthetic oligonucleotide
ctcccactccttgaagtatttccacacttccg

SEQ ID NO: 75581 - DNA, 33 bp, Artificial Sequence
  Description of Artificial Sequence: Synthetic oligonucleotide
tcccactccttgaagtatttccacacttccgtg

SEQ ID NO: 75582 - DNA, 32 bp, Artificial Sequence
  Description of Artificial Sequence: Synthetic oligonucleotide
cccactccttgaagtatttccacacttccgtg

SEQ ID NO: 75583 - DNA, 33 bp, Artificial Sequence
  Description of Artificial Sequence: Synthetic oligonucleotide
ccactccttgaagtatttccacacttccgtgtc

SEQ ID NO: 75584 - DNA, 33 bp, Artificial Sequence
  Description of Artificial Sequence: Synthetic oligonucleotide
cactccttgaagtatttccacacttccgtgtcc

SEQ ID NO: 75585 - DNA, 33 bp, Artificial Sequence
  Description of Artificial Sequence: Synthetic oligonucleotide
actccttgaagtatttccacacttccgtgtccc

SEQ ID NO: 75586 - DNA, 32 bp, Artificial Sequence
  Description of Artificial Sequence: Synthetic oligonucleotide
ctccttgaagtatttccacacttccgtgtccc

SEQ ID NO: 75587 - DNA, 32 bp, Artificial Sequence
  Description of Artificial Sequence: Synthetic oligonucleotide
tccttgaagtatttccacacttccgtgtcccg

SEQ ID NO: 75588 - DNA, 31 bp, Artificial Sequence
  Description of Artificial Sequence: Synthetic oligonucleotide
ccttgaagtatttccacacttccgtgtcccg

SEQ ID NO: 75589 - DNA, 31 bp, Artificial Sequence
  Description of Artificial Sequence: Synthetic oligonucleotide
cttgaagtatttccacacttccgtgtcccgg

SEQ ID NO: 75590 - DNA, 31 bp, Artificial Sequence
  Description of Artificial Sequence: Synthetic oligonucleotide
ttgaagtatttccacacttccgtgtcccggc

SEQ ID NO: 75591 - DNA, 30 bp, Artificial Sequence
  Description of Artificial Sequence: Synthetic oligonucleotide
tgaagtatttccacacttccgtgtcccggc

SEQ ID NO: 75592 - DNA, 29 bp, Artificial Sequence
  Description of Artificial Sequence: Synthetic oligonucleotide
gaagtatttccacacttccgtgtcccggc

SEQ ID NO: 75593 - DNA, 29 bp, Artificial Sequence
  Description of Artificial Sequence: Synthetic oligonucleotide
aagtatttccacacttccgtgtcccggcc

SEQ ID NO: 75594 - DNA, 28 bp, Artificial Sequence
  Description of Artificial Sequence: Synthetic oligonucleotide
agtatttccacacttccgtgtcccggcc

SEQ ID NO: 75595 - DNA, 27 bp, Artificial Sequence
  Description of Artificial Sequence: Synthetic oligonucleotide
gtatttccacacttccgtgtcccggcc

SEQ ID NO: 75596 - DNA, 27 bp, Artificial Sequence
  Description of Artificial Sequence: Synthetic oligonucleotide
tatttccacacttccgtgtcccggccc

SEQ ID NO: 75597 - DNA, 26 bp, Artificial Sequence
  Description of Artificial Sequence: Synthetic oligonucleotide
atttccacacttccgtgtcccggccc

SEQ ID NO: 75598 - DNA, 25 bp, Artificial Sequence
  Description of Artificial Sequence: Synthetic oligonucleotide
tttccacacttccgtgtcccggccc

SEQ ID NO: 75599 - DNA, 24 bp, Artificial Sequence
  Description of Artificial Sequence: Synthetic oligonucleotide
ttccacacttccgtgtcccggccc

SEQ ID NO: 75600 - DNA, 23 bp, Artificial Sequence
  Description of Artificial Sequence: Synthetic oligonucleotide
tccacacttccgtgtcccggccc

SEQ ID NO: 75601 - DNA, 22 bp, Artificial Sequence
  Description of Artificial Sequence: Synthetic oligonucleotide
ccacacttccgtgtcccggccc

SEQ ID NO: 75602 - DNA, 22 bp, Artificial Sequence
  Description of Artificial Sequence: Synthetic oligonucleotide
cacacttccgtgtcccggcccg

SEQ ID NO: 75603 - DNA, 23 bp, Artificial Sequence
  Description of Artificial Sequence: Synthetic oligonucleotide
gcggggagccccgcttcatctct

SEQ ID NO: 75604 - DNA, 24 bp, Artificial Sequence
  Description of Artificial Sequence: Synthetic oligonucleotide
cggggagccccgcttcatctctgt

SEQ ID NO: 75605 - DNA, 24 bp, Artificial Sequence
  Description of Artificial Sequence: Synthetic oligonucleotide
ggggagccccgcttcatctctgtg

SEQ ID NO: 75606 - DNA, 24 bp, Artificial Sequence
  Description of Artificial Sequence: Synthetic oligonucleotide
gggagccccgcttcatctctgtgg

SEQ ID NO: 75607 - DNA, 24 bp, Artificial Sequence
  Description of Artificial Sequence: Synthetic oligonucleotide
ggagccccgcttcatctctgtggg

SEQ ID NO: 75608 - DNA, 26 bp, Artificial Sequence
  Description of Artificial Sequence: Synthetic oligonucleotide
gagccccgcttcatctctgtgggcta

SEQ ID NO: 75609 - DNA, 26 bp, Artificial Sequence
  Description of Artificial Sequence: Synthetic oligonucleotide
agccccgcttcatctctgtgggctac

SEQ ID NO: 75610 - DNA, 25 bp, Artificial Sequence
  Description of Artificial Sequence: Synthetic oligonucleotide
gccccgcttcatctctgtgggctac

SEQ ID NO: 75611 - DNA, 26 bp, Artificial Sequence
  Description of Artificial Sequence: Synthetic oligonucleotide
ccccgcttcatctctgtgggctacgt

SEQ ID NO: 75612 - DNA, 26 bp, Artificial Sequence
  Description of Artificial Sequence: Synthetic oligonucleotide
cccgcttcatctctgtgggctacgtg

SEQ ID NO: 75613 - DNA, 27 bp, Artificial Sequence
  Description of Artificial Sequence: Synthetic oligonucleotide
ccgcttcatctctgtgggctacgtgga

SEQ ID NO: 75614 - DNA, 27 bp, Artificial Sequence
  Description of Artificial Sequence: Synthetic oligonucleotide
cgcttcatctctgtgggctacgtggac

SEQ ID NO: 75615 - DNA, 27 bp, Artificial Sequence
  Description of Artificial Sequence: Synthetic oligonucleotide
gcttcatctctgtgggctacgtggacg

SEQ ID NO: 75616 - DNA, 28 bp, Artificial Sequence
  Description of Artificial Sequence: Synthetic oligonucleotide
cttcatctctgtgggctacgtggacgac

SEQ ID NO: 75617 - DNA, 29 bp, Artificial Sequence
  Description of Artificial Sequence: Synthetic oligonucleotide
ttcatctctgtgggctacgtggacgacac

SEQ ID NO: 75618 - DNA, 28 bp, Artificial Sequence
  Description of Artificial Sequence: Synthetic oligonucleotide
tcatctctgtgggctacgtggacgacac

SEQ ID NO: 75619 - DNA, 27 bp, Artificial Sequence
  Description of Artificial Sequence: Synthetic oligonucleotide
catctctgtgggctacgtggacgacac

SEQ ID NO: 75620 - DNA, 27 bp, Artificial Sequence
  Description of Artificial Sequence: Synthetic oligonucleotide
atctctgtgggctacgtggacgacacc

SEQ ID NO: 75621 - DNA, 26 bp, Artificial Sequence
  Description of Artificial Sequence: Synthetic oligonucleotide
tctctgtgggctacgtggacgacacc

SEQ ID NO: 75622 - DNA, 25 bp, Artificial Sequence
  Description of Artificial Sequence: Synthetic oligonucleotide
ctctgtgggctacgtggacgacacc

SEQ ID NO: 75623 - DNA, 26 bp, Artificial Sequence
  Description of Artificial Sequence: Synthetic oligonucleotide
tctgtgggctacgtggacgacaccca

SEQ ID NO: 75624 - DNA, 25 bp, Artificial Sequence
  Description of Artificial Sequence: Synthetic oligonucleotide
ctgtgggctacgtggacgacaccca

SEQ ID NO: 75625 - DNA, 27 bp, Artificial Sequence
  Description of Artificial Sequence: Synthetic oligonucleotide
tgtgggctacgtggacgacacccagtt

SEQ ID NO: 75626 - DNA, 26 bp, Artificial Sequence
  Description of Artificial Sequence: Synthetic oligonucleotide
gtggacgacacccagttcgtgcgctt

SEQ ID NO: 75627 - DNA, 26 bp, Artificial Sequence
  Description of Artificial Sequence: Synthetic oligonucleotide
tggacgacacccagttcgtgcgcttc

SEQ ID NO: 75628 - DNA, 25 bp, Artificial Sequence
  Description of Artificial Sequence: Synthetic oligonucleotide
ggacgacacccagttcgtgcgcttc

SEQ ID NO: 75629 - DNA, 26 bp, Artificial Sequence
  Description of Artificial Sequence: Synthetic oligonucleotide
gacgacacccagttcgtgcgcttcga

SEQ ID NO: 75630 - DNA, 27 bp, Artificial Sequence
  Description of Artificial Sequence: Synthetic oligonucleotide
acgacacccagttcgtgcgcttcgaca

SEQ ID NO: 75631 - DNA, 27 bp, Artificial Sequence
  Description of Artificial Sequence: Synthetic oligonucleotide
cgacacccagttcgtgcgcttcgacaa

SEQ ID NO: 75632 - DNA, 27 bp, Artificial Sequence
  Description of Artificial Sequence: Synthetic oligonucleotide
gacacccagttcgtgcgcttcgacaac

SEQ ID NO: 75633 - DNA, 27 bp, Artificial Sequence
  Description of Artificial Sequence: Synthetic oligonucleotide
acacccagttcgtgcgcttcgacaacg

SEQ ID NO: 75634 - DNA, 27 bp, Artificial Sequence
  Description of Artificial Sequence: Synthetic oligonucleotide
cacccagttcgtgcgcttcgacaacga

SEQ ID NO: 75635 - DNA, 27 bp, Artificial Sequence
  Description of Artificial Sequence: Synthetic oligonucleotide
acccagttcgtgcgcttcgacaacgac

SEQ ID NO: 75636 - DNA, 26 bp, Artificial Sequence
  Description of Artificial Sequence: Synthetic oligonucleotide
cccagttcgtgcgcttcgacaacgac

SEQ ID NO: 75637 - DNA, 26 bp, Artificial Sequence
  Description of Artificial Sequence: Synthetic oligonucleotide
ccagttcgtgcgcttcgacaacgacg

SEQ ID NO: 75638 - DNA, 26 bp, Artificial Sequence
  Description of Artificial Sequence: Synthetic oligonucleotide
cagttcgtgcgcttcgacaacgacgc

SEQ ID NO: 75639 - DNA, 26 bp, Artificial Sequence
  Description of Artificial Sequence: Synthetic oligonucleotide
agttcgtgcgcttcgacaacgacgcc

SEQ ID NO: 75640 - DNA, 25 bp, Artificial Sequence
  Description of Artificial Sequence: Synthetic oligonucleotide
gttcgtgcgcttcgacaacgacgcc

SEQ ID NO: 75641 - DNA, 25 bp, Artificial Sequence
  Description of Artificial Sequence: Synthetic oligonucleotide
ttcgtgcgcttcgacaacgacgccg

SEQ ID NO: 75642 - DNA, 24 bp, Artificial Sequence
  Description of Artificial Sequence: Synthetic oligonucleotide
tcgtgcgcttcgacaacgacgccg

SEQ ID NO: 75643 - DNA, 23 bp, Artificial Sequence
  Description of Artificial Sequence: Synthetic oligonucleotide
cgtgcgcttcgacaacgacgccg

SEQ ID NO: 75644 - DNA, 23 bp, Artificial Sequence
  Description of Artificial Sequence: Synthetic oligonucleotide
gtgcgcttcgacaacgacgccgc

SEQ ID NO: 75645 - DNA, 24 bp, Artificial Sequence
  Description of Artificial Sequence: Synthetic oligonucleotide
tgcgcttcgacaacgacgccgcga

SEQ ID NO: 75646 - DNA, 23 bp, Artificial Sequence
  Description of Artificial Sequence: Synthetic oligonucleotide
gcgcttcgacaacgacgccgcga

SEQ ID NO: 75647 - DNA, 24 bp, Artificial Sequence
  Description of Artificial Sequence: Synthetic oligonucleotide
cgcttcgacaacgacgccgcgagt

SEQ ID NO: 75648 - DNA, 24 bp, Artificial Sequence
  Description of Artificial Sequence: Synthetic oligonucleotide
gcttcgacaacgacgccgcgagtc

SEQ ID NO: 75649 - DNA, 24 bp, Artificial Sequence
  Description of Artificial Sequence: Synthetic oligonucleotide
cttcgacaacgacgccgcgagtcc

SEQ ID NO: 75650 - DNA, 25 bp, Artificial Sequence
  Description of Artificial Sequence: Synthetic oligonucleotide
ttcgacaacgacgccgcgagtccga

SEQ ID NO: 75651 - DNA, 24 bp, Artificial Sequence
  Description of Artificial Sequence: Synthetic oligonucleotide
tcgacaacgacgccgcgagtccga

SEQ ID NO: 75652 - DNA, 23 bp, Artificial Sequence
  Description of Artificial Sequence: Synthetic oligonucleotide
cgacaacgacgccgcgagtccga

SEQ ID NO: 75653 - DNA, 23 bp, Artificial Sequence
  Description of Artificial Sequence: Synthetic oligonucleotide
gacaacgacgccgcgagtccgag

SEQ ID NO: 75654 - DNA, 25 bp, Artificial Sequence
  Description of Artificial Sequence: Synthetic oligonucleotide
acaacgacgccgcgagtccgaggat

SEQ ID NO: 75655 - DNA, 24 bp, Artificial Sequence
  Description of Artificial Sequence: Synthetic oligonucleotide
caacgacgccgcgagtccgaggat

SEQ ID NO: 75656 - DNA, 24 bp, Artificial Sequence
  Description of Artificial Sequence: Synthetic oligonucleotide
aacgacgccgcgagtccgaggatg

SEQ ID NO: 75657 - DNA, 23 bp, Artificial Sequence
  Description of Artificial Sequence: Synthetic oligonucleotide
acgacgccgcgagtccgaggatg

SEQ ID NO: 75658 - DNA, 23 bp, Artificial Sequence
  Description of Artificial Sequence: Synthetic oligonucleotide
gacgccgcgagtccgaggatggt

SEQ ID NO: 75659 - DNA, 23 bp, Artificial Sequence
  Description of Artificial Sequence: Synthetic oligonucleotide
acgccgcgagtccgaggatggtg

SEQ ID NO: 75660 - DNA, 22 bp, Artificial Sequence
  Description of Artificial Sequence: Synthetic oligonucleotide
cgccgcgagtccgaggatggtg

SEQ ID NO: 75661 - DNA, 22 bp, Artificial Sequence
  Description of Artificial Sequence: Synthetic oligonucleotide
gccgcgagtccgaggatggtgc

SEQ ID NO: 75662 - DNA, 22 bp, Artificial Sequence
  Description of Artificial Sequence: Synthetic oligonucleotide
ccgcgagtccgaggatggtgcc

SEQ ID NO: 75663 - DNA, 22 bp, Artificial Sequence
  Description of Artificial Sequence: Synthetic oligonucleotide
cgcgagtccgaggatggtgccg

SEQ ID NO: 75664 - DNA, 22 bp, Artificial Sequence
  Description of Artificial Sequence: Synthetic oligonucleotide
gcgagtccgaggatggtgccgc

SEQ ID NO: 75665 - DNA, 22 bp, Artificial Sequence
  Description of Artificial Sequence: Synthetic oligonucleotide
cgagtccgaggatggtgccgcg

SEQ ID NO: 75666 - DNA, 22 bp, Artificial Sequence
  Description of Artificial Sequence: Synthetic oligonucleotide
gagtccgaggatggtgccgcgg

SEQ ID NO: 75667 - DNA, 22 bp, Artificial Sequence
  Description of Artificial Sequence: Synthetic oligonucleotide
agtccgaggatggtgccgcggg

SEQ ID NO: 75668 - DNA, 21 bp, Artificial Sequence
  Description of Artificial Sequence: Synthetic oligonucleotide
gtccgaggatggtgccgcggg

SEQ ID NO: 75669 - DNA, 21 bp, Artificial Sequence
  Description of Artificial Sequence: Synthetic oligonucleotide
tccgaggatggtgccgcgggc

SEQ ID NO: 75670 - DNA, 20 bp, Artificial Sequence
  Description of Artificial Sequence: Synthetic oligonucleotide
ccgaggatggtgccgcgggc

SEQ ID NO: 75671 - DNA, 20 bp, Artificial Sequence
  Description of Artificial Sequence: Synthetic oligonucleotide
cgaggatggtgccgcgggcg

SEQ ID NO: 75672 - DNA, 20 bp, Artificial Sequence
  Description of Artificial Sequence: Synthetic oligonucleotide
gaggatggtgccgcgggcgc

SEQ ID NO: 75673 - DNA, 20 bp, Artificial Sequence
  Description of Artificial Sequence: Synthetic oligonucleotide
aggatggtgccgcgggcgcc

SEQ ID NO: 75674 - DNA, 20 bp, Artificial Sequence
  Description of Artificial Sequence: Synthetic oligonucleotide
ggatggtgccgcgggcgcct

SEQ ID NO: 75675 - DNA, 20 bp, Artificial Sequence
  Description of Artificial Sequence: Synthetic oligonucleotide
gatggtgccgcgggcgccgt

SEQ ID NO: 75676 - DNA, 20 bp, Artificial Sequence
  Description of Artificial Sequence: Synthetic oligonucleotide
atggtgccgcgggcgccgtg

SEQ ID NO: 75677 - DNA, 20 bp, Artificial Sequence
  Description of Artificial Sequence: Synthetic oligonucleotide
tggtgccgcgggcgccgtgt

SEQ ID NO: 75678 - DNA, 20 bp, Artificial Sequence
  Description of Artificial Sequence: Synthetic oligonucleotide
ggtgccgcgggcgccgtgtt

SEQ ID NO: 75679 - DNA, 20 bp, Artificial Sequence
  Description of Artificial Sequence: Synthetic oligonucleotide
gtgccgcgggcgccgtggat

SEQ ID NO: 75680 - DNA, 20 bp, Artificial Sequence
  Description of Artificial Sequence: Synthetic oligonucleotide
tgccgcgggcgccgtggatg

SEQ ID NO: 75681 - DNA, 23 bp, Artificial Sequence
  Description of Artificial Sequence: Synthetic oligonucleotide
gccgtggatggagcaggaggggt

SEQ ID NO: 75682 - DNA, 24 bp, Artificial Sequence
  Description of Artificial Sequence: Synthetic oligonucleotide
ccgtggatggagcaggaggggtca

SEQ ID NO: 75683 - DNA, 25 bp, Artificial Sequence
  Description of Artificial Sequence: Synthetic oligonucleotide
cgtggatggagcaggaggggtcaga

SEQ ID NO: 75684 - DNA, 27 bp, Artificial Sequence
  Description of Artificial Sequence: Synthetic oligonucleotide
gtggatggagcaggaggggtcagagta

SEQ ID NO: 75685 - DNA, 29 bp, Artificial Sequence
  Description of Artificial Sequence: Synthetic oligonucleotide
tggatggagcaggaggggtcagagtattg

SEQ ID NO: 75686 - DNA, 28 bp, Artificial Sequence
  Description of Artificial Sequence: Synthetic oligonucleotide
ggatggagcaggaggggtcagagtattg

SEQ ID NO: 75687 - DNA, 28 bp, Artificial Sequence
  Description of Artificial Sequence: Synthetic oligonucleotide
gatggagcaggaggggtcagagtattgg

SEQ ID NO: 75688 - DNA, 28 bp, Artificial Sequence
  Description of Artificial Sequence: Synthetic oligonucleotide
atggagcaggaggggtcagagtattggg

SEQ ID NO: 75689 - DNA, 27 bp, Artificial Sequence
  Description of Artificial Sequence: Synthetic oligonucleotide
tggagcaggaggggtcagagtattggg

SEQ ID NO: 75690 - DNA, 27 bp, Artificial Sequence
  Description of Artificial Sequence: Synthetic oligonucleotide
ggagcaggaggggtcagagtattggga

SEQ ID NO: 75691 - DNA, 27 bp, Artificial Sequence
  Description of Artificial Sequence: Synthetic oligonucleotide
gagcaggaggggtcagagtattgggac

SEQ ID NO: 75692 - DNA, 27 bp, Artificial Sequence
  Description of Artificial Sequence: Synthetic oligonucleotide
agcaggaggggtcagagtattgggacc

SEQ ID NO: 75693 - DNA, 26 bp, Artificial Sequence
  Description of Artificial Sequence: Synthetic oligonucleotide
gcaggaggggtcagagtattgggacc

SEQ ID NO: 75694 - DNA, 26 bp, Artificial Sequence
  Description of Artificial Sequence: Synthetic oligonucleotide
caggaggggtcagagtattgggaccg

SEQ ID NO: 75695 - DNA, 26 bp, Artificial Sequence
  Description of Artificial Sequence: Synthetic oligonucleotide
aggaggggtcagagtattgggaccgg

SEQ ID NO: 75696 - DNA, 25 bp, Artificial Sequence
  Description of Artificial Sequence: Synthetic oligonucleotide
ggaggggtcagagtattgggaccgg

SEQ ID NO: 75697 - DNA, 26 bp, Artificial Sequence
  Description of Artificial Sequence: Synthetic oligonucleotide
gaggggtcagagtattgggaccggga

SEQ ID NO: 75698 - DNA, 27 bp, Artificial Sequence
  Description of Artificial Sequence: Synthetic oligonucleotide
aggggtcagagtattgggaccgggaga

SEQ ID NO: 75699 - DNA, 26 bp, Artificial Sequence
  Description of Artificial Sequence: Synthetic oligonucleotide
ggggtcagagtattgggaccgggaga

SEQ ID NO: 75700 - DNA, 27 bp, Artificial Sequence
  Description of Artificial Sequence: Synthetic oligonucleotide
gggtcagagtattgggaccgggagaca

SEQ ID NO: 75701 - DNA, 27 bp, Artificial Sequence
  Description of Artificial Sequence: Synthetic oligonucleotide
ggtcagagtattgggaccgggagacac

SEQ ID NO: 75702 - DNA, 27 bp, Artificial Sequence
  Description of Artificial Sequence: Synthetic oligonucleotide
gtcagagtattgggaccgggagacacg

SEQ ID NO: 75703 - DNA, 27 bp, Artificial Sequence
  Description of Artificial Sequence: Synthetic oligonucleotide
tcagagtattgggaccgggagacacgg

SEQ ID NO: 75704 - DNA, 27 bp, Artificial Sequence
  Description of Artificial Sequence: Synthetic oligonucleotide
cagagtattgggaccgggagacacgga

SEQ ID NO: 75705 - DNA, 27 bp, Artificial Sequence
  Description of Artificial Sequence: Synthetic oligonucleotide
agagtattgggaccgggagacacggag

SEQ ID NO: 75706 - DNA, 26 bp, Artificial Sequence
  Description of Artificial Sequence: Synthetic oligonucleotide
gagtattgggaccgggagacacggag

SEQ ID NO: 75707 - DNA, 26 bp, Artificial Sequence
  Description of Artificial Sequence: Synthetic oligonucleotide
agtattgggaccgggagacacggagc

SEQ ID NO: 75708 - DNA, 25 bp, Artificial Sequence
  Description of Artificial Sequence: Synthetic oligonucleotide
gtattgggaccgggagacacggagc

SEQ ID NO: 75709 - DNA, 25 bp, Artificial Sequence
  Description of Artificial Sequence: Synthetic oligonucleotide
tattgggaccgggagacacggagcg

SEQ ID NO: 75710 - DNA, 24 bp, Artificial Sequence
  Description of Artificial Sequence: Synthetic oligonucleotide
attgggaccgggagacacggagcg

SEQ ID NO: 75711 - DNA, 23 bp, Artificial Sequence
  Description of Artificial Sequence: Synthetic oligonucleotide
ttgggaccgggagacacggagcg

SEQ ID NO: 75712 - DNA, 22 bp, Artificial Sequence
  Description of Artificial Sequence: Synthetic oligonucleotide
tgggaccgggagacacggagcg

SEQ ID NO: 75713 - DNA, 21 bp, Artificial Sequence
  Description of Artificial Sequence: Synthetic oligonucleotide
gggaccgggagacacggagcg

SEQ ID NO: 75714 - DNA, 21 bp, Artificial Sequence
  Description of Artificial Sequence: Synthetic oligonucleotide
ggaccgggagacacggagcgc

SEQ ID NO: 75715 - DNA, 22 bp, Artificial Sequence
  Description of Artificial Sequence: Synthetic oligonucleotide
gaccgggagacacggagcgcca

SEQ ID NO: 75716 - DNA, 22 bp, Artificial Sequence
  Description of Artificial Sequence: Synthetic oligonucleotide
accgggagacacggagcgccag

SEQ ID NO: 75717 - DNA, 21 bp, Artificial Sequence
  Description of Artificial Sequence: Synthetic oligonucleotide
ccgggagacacggagcgccag

SEQ ID NO: 75718 - DNA, 21 bp, Artificial Sequence
  Description of Artificial Sequence: Synthetic oligonucleotide
cgggagacacggagcgccagg

SEQ ID NO: 75719 - DNA, 22 bp, Artificial Sequence
  Description of Artificial Sequence: Synthetic oligonucleotide
gggagacacggagcgccaggga

SEQ ID NO: 75720 - DNA, 23 bp, Artificial Sequence
  Description of Artificial Sequence: Synthetic oligonucleotide
ggagacacggagcgccagggaca

SEQ ID NO: 75721 - DNA, 23 bp, Artificial Sequence
  Description of Artificial Sequence: Synthetic oligonucleotide
gagacacggagcgccagggacac

SEQ ID NO: 75722 - DNA, 23 bp, Artificial Sequence
  Description of Artificial Sequence: Synthetic oligonucleotide
agacacggagcgccagggacacc

SEQ ID NO: 75723 - DNA, 22 bp, Artificial Sequence
  Description of Artificial Sequence: Synthetic oligonucleotide
gacacggagcgccagggacacc

SEQ ID NO: 75724 - DNA, 22 bp, Artificial Sequence
  Description of Artificial Sequence: Synthetic oligonucleotide
acacggagcgccagggacaccg

SEQ ID NO: 75725 - DNA, 21 bp, Artificial Sequence
  Description of Artificial Sequence: Synthetic oligonucleotide
cacggagcgccagggacaccg

SEQ ID NO: 75726 - DNA, 22 bp, Artificial Sequence
  Description of Artificial Sequence: Synthetic oligonucleotide
acggagcgccagggacaccgca

SEQ ID NO: 75727 - DNA, 21 bp, Artificial Sequence
  Description of Artificial Sequence: Synthetic oligonucleotide
cggagcgccagggacaccgca

SEQ ID NO: 75728 - DNA, 22 bp, Artificial Sequence
  Description of Artificial Sequence: Synthetic oligonucleotide
ggagcgccagggacaccgcaca

SEQ ID NO: 75729 - DNA, 27 bp, Artificial Sequence
  Description of Artificial Sequence: Synthetic oligonucleotide
gagcgccagggacaccgcacagatttt

SEQ ID NO: 75730 - DNA, 27 bp, Artificial Sequence
  Description of Artificial Sequence: Synthetic oligonucleotide
agcgccagggacaccgcacagattttc

SEQ ID NO: 75731 - DNA, 26 bp, Artificial Sequence
  Description of Artificial Sequence: Synthetic oligonucleotide
gcgccagggacaccgcacagattttc

SEQ ID NO: 75732 - DNA, 26 bp, Artificial Sequence
  Description of Artificial Sequence: Synthetic oligonucleotide
cgccagggacaccgcacagattttcc

SEQ ID NO: 75733 - DNA, 27 bp, Artificial Sequence
  Description of Artificial Sequence: Synthetic oligonucleotide
gccagggacaccgcacagattttccga

SEQ ID NO: 75734 - DNA, 27 bp, Artificial Sequence
  Description of Artificial Sequence: Synthetic oligonucleotide
ccagggacaccgcacagattttccgag

SEQ ID NO: 75735 - DNA, 28 bp, Artificial Sequence
  Description of Artificial Sequence: Synthetic oligonucleotide
cagggacaccgcacagattttccgagtg

SEQ ID NO: 75736 - DNA, 30 bp, Artificial Sequence
  Description of Artificial Sequence: Synthetic oligonucleotide
agggacaccgcacagattttccgagtgaac

SEQ ID NO: 75737 - DNA, 29 bp, Artificial Sequence
  Description of Artificial Sequence: Synthetic oligonucleotide
gggacaccgcacagattttccgagtgaac

SEQ ID NO: 75738 - DNA, 29 bp, Artificial Sequence
  Description of Artificial Sequence: Synthetic oligonucleotide
ggacaccgcacagattttccgagtgaacc

SEQ ID NO: 75739 - DNA, 30 bp, Artificial Sequence
  Description of Artificial Sequence: Synthetic oligonucleotide
gacaccgcacagattttccgagtgaacctg

SEQ ID NO: 75740 - DNA, 30 bp, Artificial Sequence
  Description of Artificial Sequence: Synthetic oligonucleotide
acaccgcacagattttccgagtgaacctgc

SEQ ID NO: 75741 - DNA, 29 bp, Artificial Sequence
  Description of Artificial Sequence: Synthetic oligonucleotide
caccgcacagattttccgagtgaacctgc

SEQ ID NO: 75742 - DNA, 29 bp, Artificial Sequence
  Description of Artificial Sequence: Synthetic oligonucleotide
accgcacagattttccgagtgaacctgcg

SEQ ID NO: 75743 - DNA, 28 bp, Artificial Sequence
  Description of Artificial Sequence: Synthetic oligonucleotide
ccgcacagattttccgagtgaacctgcg

SEQ ID NO: 75744 - DNA, 28 bp, Artificial Sequence
  Description of Artificial Sequence: Synthetic oligonucleotide
cgcacagattttccgagtgaacctgcgg

SEQ ID NO: 75745 - DNA, 29 bp, Artificial Sequence
  Description of Artificial Sequence: Synthetic oligonucleotide
gcacagattttccgagtgaacctgcggac

SEQ ID NO: 75746 - DNA, 29 bp, Artificial Sequence
  Description of Artificial Sequence: Synthetic oligonucleotide
cacagattttccgagtgaacctgcggacg

SEQ ID NO: 75747 - DNA, 29 bp, Artificial Sequence
  Description of Artificial Sequence: Synthetic oligonucleotide
acagattttccgagtgaacctgcggacgc

SEQ ID NO: 75748 - DNA, 28 bp, Artificial Sequence
  Description of Artificial Sequence: Synthetic oligonucleotide
cagattttccgagtgaacctgcggacgc

SEQ ID NO: 75749 - DNA, 29 bp, Artificial Sequence
  Description of Artificial Sequence: Synthetic oligonucleotide
agattttccgagtgaacctgcggacgctg

SEQ ID NO: 75750 - DNA, 28 bp, Artificial Sequence
  Description of Artificial Sequence: Synthetic oligonucleotide
gattttccgagtgaacctgcggacgctg

SEQ ID NO: 75751 - DNA, 28 bp, Artificial Sequence
  Description of Artificial Sequence: Synthetic oligonucleotide
attttccgagtgaacctgcggacgctgc

SEQ ID NO: 75752 - DNA, 27 bp, Artificial Sequence
  Description of Artificial Sequence: Synthetic oligonucleotide
ttttccgagtgaacctgcggacgctgc

SEQ ID NO: 75753 - DNA, 26 bp, Artificial Sequence
  Description of Artificial Sequence: Synthetic oligonucleotide
tttccgagtgaacctgcggacgctgc

SEQ ID NO: 75754 - DNA, 25 bp, Artificial Sequence
  Description of Artificial Sequence: Synthetic oligonucleotide
ttccgagtgaacctgcggacgctgc

SEQ ID NO: 75755 - DNA, 24 bp, Artificial Sequence
  Description of Artificial Sequence: Synthetic oligonucleotide
tccgagtgaacctgcggacgctgc

SEQ ID NO: 75756 - DNA, 23 bp, Artificial Sequence
  Description of Artificial Sequence: Synthetic oligonucleotide
ccgagtgaacctgcggacgctgc

SEQ ID NO: 75757 - DNA, 23 bp, Artificial Sequence
  Description of Artificial Sequence: Synthetic oligonucleotide
cgagtgaacctgcggacgctgcg

SEQ ID NO: 75758 - DNA, 23 bp, Artificial Sequence
  Description of Artificial Sequence: Synthetic oligonucleotide
gagtgaacctgcggacgctgcgc

SEQ ID NO: 75759 - DNA, 23 bp, Artificial Sequence
  Description of Artificial Sequence: Synthetic oligonucleotide
agtgaacctgcggacgctgcgcg

SEQ ID NO: 75760 - DNA, 22 bp, Artificial Sequence
  Description of Artificial Sequence: Synthetic oligonucleotide
gtgaacctgcggacgctgcgcg

SEQ ID NO: 75761 - DNA, 22 bp, Artificial Sequence
  Description of Artificial Sequence: Synthetic oligonucleotide
tgaacctgcggacgctgcgcgg

SEQ ID NO: 75762 - DNA, 21 bp, Artificial Sequence
  Description of Artificial Sequence: Synthetic oligonucleotide
gaacctgcggacgctgcgcgg

SEQ ID NO: 75763 - DNA, 23 bp, Artificial Sequence
  Description of Artificial Sequence: Synthetic oligonucleotide
aacctgcggacgctgcgcggcta

SEQ ID NO: 75764 - DNA, 22 bp, Artificial Sequence
  Description of Artificial Sequence: Synthetic oligonucleotide
acctgcggacgctgcgcggcta

SEQ ID NO: 75765 - DNA, 21 bp, Artificial Sequence
  Description of Artificial Sequence: Synthetic oligonucleotide
cctgcggacgctgcgcggcta

SEQ ID NO: 75766 - DNA, 23 bp, Artificial Sequence
  Description of Artificial Sequence: Synthetic oligonucleotide
ctgcggacgctgcgcggctacta

SEQ ID NO: 75767 - DNA, 26 bp, Artificial Sequence
  Description of Artificial Sequence: Synthetic oligonucleotide
tgcggacgctgcgcggctactacaat

SEQ ID NO: 75768 - DNA, 25 bp, Artificial Sequence
  Description of Artificial Sequence: Synthetic oligonucleotide
gcggacgctgcgcggctactacaat

SEQ ID NO: 75769 - DNA, 26 bp, Artificial Sequence
  Description of Artificial Sequence: Synthetic oligonucleotide
cggacgctgcgcggctactacaatca

SEQ ID NO: 75770 - DNA, 27 bp, Artificial Sequence
  Description of Artificial Sequence: Synthetic oligonucleotide
ggacgctgcgcggctactacaatcaga

SEQ ID NO: 75771 - DNA, 27 bp, Artificial Sequence
  Description of Artificial Sequence: Synthetic oligonucleotide
gacgctgcgcggctactacaatcagag

SEQ ID NO: 75772 - DNA, 27 bp, Artificial Sequence
  Description of Artificial Sequence: Synthetic oligonucleotide
acgctgcgcggctactacaatcagagc

SEQ ID NO: 75773 - DNA, 26 bp, Artificial Sequence
  Description of Artificial Sequence: Synthetic oligonucleotide
cgctgcgcggctactacaatcagagc

SEQ ID NO: 75774 - DNA, 27 bp, Artificial Sequence
  Description of Artificial Sequence: Synthetic oligonucleotide
gctgcgcggctactacaatcagagcga

SEQ ID NO: 75775 - DNA, 26 bp, Artificial Sequence
  Description of Artificial Sequence: Synthetic oligonucleotide
gcgcggctactacaatcagagcgagg

SEQ ID NO: 75776 - DNA, 26 bp, Artificial Sequence
  Description of Artificial Sequence: Synthetic oligonucleotide
cgcggctactacaatcagagcgaggc

SEQ ID NO: 75777 - DNA, 26 bp, Artificial Sequence
  Description of Artificial Sequence: Synthetic oligonucleotide
gcggctactacaatcagagcgaggcc

SEQ ID NO: 75778 - DNA, 26 bp, Artificial Sequence
  Description of Artificial Sequence: Synthetic oligonucleotide
cggctactacaatcagagcgaggccg

SEQ ID NO: 75779 - DNA, 26 bp, Artificial Sequence
  Description of Artificial Sequence: Synthetic oligonucleotide
ggctactacaatcagagcgaggccgg

SEQ ID NO: 75780 - DNA, 27 bp, Artificial Sequence
  Description of Artificial Sequence: Synthetic oligonucleotide
gctactacaatcagagcgaggccgggt

SEQ ID NO: 75781 - DNA, 27 bp, Artificial Sequence
  Description of Artificial Sequence: Synthetic oligonucleotide
ctactacaatcagagcgaggccgggtc

SEQ ID NO: 75782 - DNA, 28 bp, Artificial Sequence
  Description of Artificial Sequence: Synthetic oligonucleotide
tactacaatcagagcgaggccgggtctc

SEQ ID NO: 75783 - DNA, 27 bp, Artificial Sequence
  Description of Artificial Sequence: Synthetic oligonucleotide
actacaatcagagcgaggccgggtctc

SEQ ID NO: 75784 - DNA, 27 bp, Artificial Sequence
  Description of Artificial Sequence: Synthetic oligonucleotide
ctacaatcagagcgaggccgggtctca

SEQ ID NO: 75785 - DNA, 27 bp, Artificial Sequence
  Description of Artificial Sequence: Synthetic oligonucleotide
tacaatcagagcgaggccgggtctcac

SEQ ID NO: 75786 - DNA, 27 bp, Artificial Sequence
  Description of Artificial Sequence: Synthetic oligonucleotide
acaatcagagcgaggccgggtctcaca

SEQ ID NO: 75787 - DNA, 26 bp, Artificial Sequence
  Description of Artificial Sequence: Synthetic oligonucleotide
caatcagagcgaggccgggtctcaca

SEQ ID NO: 75788 - DNA, 26 bp, Artificial Sequence
  Description of Artificial Sequence: Synthetic oligonucleotide
aatcagagcgaggccgggtctcacac

SEQ ID NO: 75789 - DNA, 25 bp, Artificial Sequence
  Description of Artificial Sequence: Synthetic oligonucleotide
atcagagcgaggccgggtctcacac

SEQ ID NO: 75790 - DNA, 24 bp, Artificial Sequence
  Description of Artificial Sequence: Synthetic oligonucleotide
tcagagcgaggccgggtctcacac

SEQ ID NO: 75791 - DNA, 22 bp, Artificial Sequence
  Description of Artificial Sequence: Synthetic oligonucleotide
cgaggccgggtctcacaccctg

SEQ ID NO: 75792 - DNA, 23 bp, Artificial Sequence
  Description of Artificial Sequence: Synthetic oligonucleotide
gaggccgggtctcacaccctgca

SEQ ID NO: 75793 - DNA, 24 bp, Artificial Sequence
  Description of Artificial Sequence: Synthetic oligonucleotide
aggccgggtctcacaccctgcagt

SEQ ID NO: 75794 - DNA, 23 bp, Artificial Sequence
  Description of Artificial Sequence: Synthetic oligonucleotide
ggccgggtctcacaccctgcagt

SEQ ID NO: 75795 - DNA, 23 bp, Artificial Sequence
  Description of Artificial Sequence: Synthetic oligonucleotide
gccgggtctcacaccctgcagtg

SEQ ID NO: 75796 - DNA, 25 bp, Artificial Sequence
  Description of Artificial Sequence: Synthetic oligonucleotide
ccgggtctcacaccctgcagtggat

SEQ ID NO: 75797 - DNA, 25 bp, Artificial Sequence
  Description of Artificial Sequence: Synthetic oligonucleotide
cgggtctcacaccctgcagtggatg

SEQ ID NO: 75798 - DNA, 27 bp, Artificial Sequence
  Description of Artificial Sequence: Synthetic oligonucleotide
gggtctcacaccctgcagtggatgcat

SEQ ID NO: 75799 - DNA, 27 bp, Artificial Sequence
  Description of Artificial Sequence: Synthetic oligonucleotide
ggtctcacaccctgcagtggatgcatg

SEQ ID NO: 75800 - DNA, 27 bp, Artificial Sequence
  Description of Artificial Sequence: Synthetic oligonucleotide
gtctcacaccctgcagtggatgcatgg

SEQ ID NO: 75801 - DNA, 27 bp, Artificial Sequence
  Description of Artificial Sequence: Synthetic oligonucleotide
tctcacaccctgcagtggatgcatggc

SEQ ID NO: 75802 - DNA, 27 bp, Artificial Sequence
  Description of Artificial Sequence: Synthetic oligonucleotide
ctcacaccctgcagtggatgcatggct

SEQ ID NO: 75803 - DNA, 27 bp, Artificial Sequence
  Description of Artificial Sequence: Synthetic oligonucleotide
tcacaccctgcagtggatgcatggctg

SEQ ID NO: 75804 - DNA, 26 bp, Artificial Sequence
  Description of Artificial Sequence: Synthetic oligonucleotide
cacaccctgcagtggatgcatggctg

SEQ ID NO: 75805 - DNA, 26 bp, Artificial Sequence
  Description of Artificial Sequence: Synthetic oligonucleotide
acaccctgcagtggatgcatggctgc

SEQ ID NO: 75806 - DNA, 25 bp, Artificial Sequence
  Description of Artificial Sequence: Synthetic oligonucleotide
caccctgcagtggatgcatggctgc

SEQ ID NO: 75807 - DNA, 26 bp, Artificial Sequence
  Description of Artificial Sequence: Synthetic oligonucleotide
accctgcagtggatgcatggctgcga

SEQ ID NO: 75808 - DNA, 25 bp, Artificial Sequence
  Description of Artificial Sequence: Synthetic oligonucleotide
ccctgcagtggatgcatggctgcga

SEQ ID NO: 75809 - DNA, 25 bp, Artificial Sequence
  Description of Artificial Sequence: Synthetic oligonucleotide
cctgcagtggatgcatggctgcgag

SEQ ID NO: 75810 - DNA, 26 bp, Artificial Sequence
  Description of Artificial Sequence: Synthetic oligonucleotide
ctgcagtggatgcatggctgcgagct

SEQ ID NO: 75811 - DNA, 26 bp, Artificial Sequence
  Description of Artificial Sequence: Synthetic oligonucleotide
tgcagtggatgcatggctgcgagctg

SEQ ID NO: 75812 - DNA, 25 bp, Artificial Sequence
  Description of Artificial Sequence: Synthetic oligonucleotide
gcagtggatgcatggctgcgagctg

SEQ ID NO: 75813 - DNA, 25 bp, Artificial Sequence
  Description of Artificial Sequence: Synthetic oligonucleotide
cagtggatgcatggctgcgagctgg

SEQ ID NO: 75814 - DNA, 25 bp, Artificial Sequence
  Description of Artificial Sequence: Synthetic oligonucleotide
agtggatgcatggctgcgagctggg

SEQ ID NO: 75815 - DNA, 24 bp, Artificial Sequence
  Description of Artificial Sequence: Synthetic oligonucleotide
gtggatgcatggctgcgagctggg

SEQ ID NO: 75816 - DNA, 24 bp, Artificial Sequence
  Description of Artificial Sequence: Synthetic oligonucleotide
tggatgcatggctgcgagctgggg

SEQ ID NO: 75817 - DNA, 23 bp, Artificial Sequence
  Description of Artificial Sequence: Synthetic oligonucleotide
ggatgcatggctgcgagctgggg

SEQ ID NO: 75818 - DNA, 23 bp, Artificial Sequence
  Description of Artificial Sequence: Synthetic oligonucleotide
gatgcatggctgcgagctggggc

SEQ ID NO: 75819 - DNA, 23 bp, Artificial Sequence
  Description of Artificial Sequence: Synthetic oligonucleotide
atgcatggctgcgagctggggcc

SEQ ID NO: 75820 - DNA, 22 bp, Artificial Sequence
  Description of Artificial Sequence: Synthetic oligonucleotide
tgcatggctgcgagctggggcc

SEQ ID NO: 75821 - DNA, 21 bp, Artificial Sequence
  Description of Artificial Sequence: Synthetic oligonucleotide
gcatggctgcgagctggggcc

SEQ ID NO: 75822 - DNA, 21 bp, Artificial Sequence
  Description of Artificial Sequence: Synthetic oligonucleotide
catggctgcgagctggggccc

SEQ ID NO: 75823 - DNA, 22 bp, Artificial Sequence
  Description of Artificial Sequence: Synthetic oligonucleotide
atggctgcgagctggggcccga

SEQ ID NO: 75824 - DNA, 21 bp, Artificial Sequence
  Description of Artificial Sequence: Synthetic oligonucleotide
tggctgcgagctggggcccga

SEQ ID NO: 75825 - DNA, 20 bp, Artificial Sequence
  Description of Artificial Sequence: Synthetic oligonucleotide
ggctgcgagctggggcccga

SEQ ID NO: 75826 - DNA, 21 bp, Artificial Sequence
  Description of Artificial Sequence: Synthetic oligonucleotide
gctgcgagctggggcccgaca

SEQ ID NO: 75827 - DNA, 21 bp, Artificial Sequence
  Description of Artificial Sequence: Synthetic oligonucleotide
ctgcgagctggggcccgacag

SEQ ID NO: 75828 - DNA, 21 bp, Artificial Sequence
  Description of Artificial Sequence: Synthetic oligonucleotide
tgcgagctggggcccgacagg

SEQ ID NO: 75829 - DNA, 20 bp, Artificial Sequence
  Description of Artificial Sequence: Synthetic oligonucleotide
gcgagctggggcccgacagg

SEQ ID NO: 75830 - DNA, 20 bp, Artificial Sequence
  Description of Artificial Sequence: Synthetic oligonucleotide
cgagctggggcccgacaggc

SEQ ID NO: 75831 - DNA, 20 bp, Artificial Sequence
  Description of Artificial Sequence: Synthetic oligonucleotide
gagctggggcccgacaggcg

SEQ ID NO: 75832 - DNA, 22 bp, Artificial Sequence
  Description of Artificial Sequence: Synthetic oligonucleotide
agctggggcccgacaggcgctt

SEQ ID NO: 75833 - DNA, 21 bp, Artificial Sequence
  Description of Artificial Sequence: Synthetic oligonucleotide
gctggggcccgacaggcgctt

SEQ ID NO: 75834 - DNA, 21 bp, Artificial Sequence
  Description of Artificial Sequence: Synthetic oligonucleotide
ctggggcccgacaggcgcttc

SEQ ID NO: 75835 - DNA, 22 bp, Artificial Sequence
  Description of Artificial Sequence: Synthetic oligonucleotide
tggggcccgacaggcgcttcct

SEQ ID NO: 75836 - DNA, 21 bp, Artificial Sequence
  Description of Artificial Sequence: Synthetic oligonucleotide
ggggcccgacaggcgcttcct

SEQ ID NO: 75837 - DNA, 21 bp, Artificial Sequence
  Description of Artificial Sequence: Synthetic oligonucleotide
gggcccgacaggcgcttcctc

SEQ ID NO: 75838 - DNA, 21 bp, Artificial Sequence
  Description of Artificial Sequence: Synthetic oligonucleotide
ggcccgacaggcgcttcctcc

SEQ ID NO: 75839 - DNA, 21 bp, Artificial Sequence
  Description of Artificial Sequence: Synthetic oligonucleotide
gcccgacaggcgcttcctccg

SEQ ID NO: 75840 - DNA, 21 bp, Artificial Sequence
  Description of Artificial Sequence: Synthetic oligonucleotide
cccgacaggcgcttcctccgc

SEQ ID NO: 75841 - DNA, 21 bp, Artificial Sequence
  Description of Artificial Sequence: Synthetic oligonucleotide
ccgacaggcgcttcctccgcg

SEQ ID NO: 75842 - DNA, 21 bp, Artificial Sequence
  Description of Artificial Sequence: Synthetic oligonucleotide
cgacaggcgcttcctccgcgg

SEQ ID NO: 75843 - DNA, 24 bp, Artificial Sequence
  Description of Artificial Sequence: Synthetic oligonucleotide
gacaggcgcttcctccgcgggtat

SEQ ID NO: 75844 - DNA, 26 bp, Artificial Sequence
  Description of Artificial Sequence: Synthetic oligonucleotide
acaggcgcttcctccgcgggtatgaa

SEQ ID NO: 75845 - DNA, 25 bp, Artificial Sequence
  Description of Artificial Sequence: Synthetic oligonucleotide
caggcgcttcctccgcgggtatgaa

SEQ ID NO: 75846 - DNA, 26 bp, Artificial Sequence
  Description of Artificial Sequence: Synthetic oligonucleotide
aggcgcttcctccgcgggtatgaaca

SEQ ID NO: 75847 - DNA, 27 bp, Artificial Sequence
  Description of Artificial Sequence: Synthetic oligonucleotide
gcgcttcctccgcgggtatgaacagtt

SEQ ID NO: 75848 - DNA, 27 bp, Artificial Sequence
  Description of Artificial Sequence: Synthetic oligonucleotide
cgcttcctccgcgggtatgaacagttc

SEQ ID NO: 75849 - DNA, 27 bp, Artificial Sequence
  Description of Artificial Sequence: Synthetic oligonucleotide
gcttcctccgcgggtatgaacagttcg

SEQ ID NO: 75850 - DNA, 27 bp, Artificial Sequence
  Description of Artificial Sequence: Synthetic oligonucleotide
cttcctccgcgggtatgaacagttcgc

SEQ ID NO: 75851 - DNA, 27 bp, Artificial Sequence
  Description of Artificial Sequence: Synthetic oligonucleotide
ttcctccgcgggtatgaacagttcgcc

SEQ ID NO: 75852 - DNA, 27 bp, Artificial Sequence
  Description of Artificial Sequence: Synthetic oligonucleotide
tcctccgcgggtatgaacagttcgcct

SEQ ID NO: 75853 - DNA, 27 bp, Artificial Sequence
  Description of Artificial Sequence: Synthetic oligonucleotide
cctccgcgggtatgaacagttcgccta

SEQ ID NO: 75854 - DNA, 27 bp, Artificial Sequence
  Description of Artificial Sequence: Synthetic oligonucleotide
ctccgcgggtatgaacagttcgcctac

SEQ ID NO: 75855 - DNA, 27 bp, Artificial Sequence
  Description of Artificial Sequence: Synthetic oligonucleotide
tccgcgggtatgaacagttcgcctacg

SEQ ID NO: 75856 - DNA, 27 bp, Artificial Sequence
  Description of Artificial Sequence: Synthetic oligonucleotide
ccgcgggtatgaacagttcgcctacga

SEQ ID NO: 75857 - DNA, 27 bp, Artificial Sequence
  Description of Artificial Sequence: Synthetic oligonucleotide
cgcgggtatgaacagttcgcctacgac

SEQ ID NO: 75858 - DNA, 27 bp, Artificial Sequence
  Description of Artificial Sequence: Synthetic oligonucleotide
gcgggtatgaacagttcgcctacgacg

SEQ ID NO: 75859 - DNA, 27 bp, Artificial Sequence
  Description of Artificial Sequence: Synthetic oligonucleotide
cgggtatgaacagttcgcctacgacgg

SEQ ID NO: 75860 - DNA, 27 bp, Artificial Sequence
  Description of Artificial Sequence: Synthetic oligonucleotide
gggtatgaacagttcgcctacgacggc

SEQ ID NO: 75861 - DNA, 29 bp, Artificial Sequence
  Description of Artificial Sequence: Synthetic oligonucleotide
ggtatgaacagttcgcctacgacggcaag

SEQ ID NO: 75862 - DNA, 29 bp, Artificial Sequence
  Description of Artificial Sequence: Synthetic oligonucleotide
gtatgaacagttcgcctacgacggcaagg

SEQ ID NO: 75863 - DNA, 34 bp, Artificial Sequence
  Description of Artificial Sequence: Synthetic oligonucleotide
tatgaacagttcgcctacgacggcaaggattatc

SEQ ID NO: 75864 - DNA, 33 bp, Artificial Sequence
  Description of Artificial Sequence: Synthetic oligonucleotide
atgaacagttcgcctacgacggcaaggattatc

SEQ ID NO: 75865 - DNA, 32 bp, Artificial Sequence
  Description of Artificial Sequence: Synthetic oligonucleotide
tgaacagttcgcctacgacggcaaggattatc

SEQ ID NO: 75866 - DNA, 31 bp, Artificial Sequence
  Description of Artificial Sequence: Synthetic oligonucleotide
gaacagttcgcctacgacggcaaggattatc

SEQ ID NO: 75867 - DNA, 32 bp, Artificial Sequence
  Description of Artificial Sequence: Synthetic oligonucleotide
aacagttcgcctacgacggcaaggattatctc

SEQ ID NO: 75868 - DNA, 31 bp, Artificial Sequence
  Description of Artificial Sequence: Synthetic oligonucleotide
acagttcgcctacgacggcaaggattatctc

SEQ ID NO: 75869 - DNA, 30 bp, Artificial Sequence
  Description of Artificial Sequence: Synthetic oligonucleotide
cagttcgcctacgacggcaaggattatctc

SEQ ID NO: 75870 - DNA, 31 bp, Artificial Sequence
  Description of Artificial Sequence: Synthetic oligonucleotide
agttcgcctacgacggcaaggattatctcac

SEQ ID NO: 75871 - DNA, 30 bp, Artificial Sequence
  Description of Artificial Sequence: Synthetic oligonucleotide
gttcgcctacgacggcaaggattatctcac

SEQ ID NO: 75872 - DNA, 30 bp, Artificial Sequence
  Description of Artificial Sequence: Synthetic oligonucleotide
ttcgcctacgacggcaaggattatctcacc

SEQ ID NO: 75873 - DNA, 29 bp, Artificial Sequence
  Description of Artificial Sequence: Synthetic oligonucleotide
tcgcctacgacggcaaggattatctcacc

SEQ ID NO: 75874 - DNA, 28 bp, Artificial Sequence
  Description of Artificial Sequence: Synthetic oligonucleotide
cgcctacgacggcaaggattatctcacc

SEQ ID NO: 75875 - DNA, 28 bp, Artificial Sequence
  Description of Artificial Sequence: Synthetic oligonucleotide
gcctacgacggcaaggattatctcaccc

SEQ ID NO: 75876 - DNA, 29 bp, Artificial Sequence
  Description of Artificial Sequence: Synthetic oligonucleotide
cctacgacggcaaggattatctcaccctg

SEQ ID NO: 75877 - DNA, 32 bp, Artificial Sequence
  Description of Artificial Sequence: Synthetic oligonucleotide
ctacgacggcaaggattatctcaccctgaatg

SEQ ID NO: 75878 - DNA, 33 bp, Artificial Sequence
  Description of Artificial Sequence: Synthetic oligonucleotide
tacgacggcaaggattatctcaccctgaatgag

SEQ ID NO: 75879 - DNA, 32 bp, Artificial Sequence
  Description of Artificial Sequence: Synthetic oligonucleotide
acgacggcaaggattatctcaccctgaatgag

SEQ ID NO: 75880 - DNA, 31 bp, Artificial Sequence
  Description of Artificial Sequence: Synthetic oligonucleotide
cgacggcaaggattatctcaccctgaatgag

SEQ ID NO: 75881 - DNA, 31 bp, Artificial Sequence
  Description of Artificial Sequence: Synthetic oligonucleotide
gacggcaaggattatctcaccctgaatgagg

SEQ ID NO: 75882 - DNA, 32 bp, Artificial Sequence
  Description of Artificial Sequence: Synthetic oligonucleotide
acggcaaggattatctcaccctgaatgaggac

SEQ ID NO: 75883 - DNA, 31 bp, Artificial Sequence
  Description of Artificial Sequence: Synthetic oligonucleotide
cggcaaggattatctcaccctgaatgaggac

SEQ ID NO: 75884 - DNA, 31 bp, Artificial Sequence
  Description of Artificial Sequence: Synthetic oligonucleotide
ggcaaggattatctcaccctgaatgaggacc

SEQ ID NO: 75885 - DNA, 32 bp, Artificial Sequence
  Description of Artificial Sequence: Synthetic oligonucleotide
gcaaggattatctcaccctgaatgaggacctg

SEQ ID NO: 75886 - DNA, 32 bp, Artificial Sequence
  Description of Artificial Sequence: Synthetic oligonucleotide
caaggattatctcaccctgaatgaggacctgc

SEQ ID NO: 75887 - DNA, 32 bp, Artificial Sequence
  Description of Artificial Sequence: Synthetic oligonucleotide
aaggattatctcaccctgaatgaggacctgcg

SEQ ID NO: 75888 - DNA, 31 bp, Artificial Sequence
  Description of Artificial Sequence: Synthetic oligonucleotide
aggattatctcaccctgaatgaggacctgcg

SEQ ID NO: 75889 - DNA, 30 bp, Artificial Sequence
  Description of Artificial Sequence: Synthetic oligonucleotide
ggattatctcaccctgaatgaggacctgcg

SEQ ID NO: 75890 - DNA, 30 bp, Artificial Sequence
  Description of Artificial Sequence: Synthetic oligonucleotide
gattatctcaccctgaatgaggacctgcgc

SEQ ID NO: 75891 - DNA, 31 bp, Artificial Sequence
  Description of Artificial Sequence: Synthetic oligonucleotide
attatctcaccctgaatgaggacctgcgctc

SEQ ID NO: 75892 - DNA, 30 bp, Artificial Sequence
  Description of Artificial Sequence: Synthetic oligonucleotide
ttatctcaccctgaatgaggacctgcgctc

SEQ ID NO: 75893 - DNA, 29 bp, Artificial Sequence
  Description of Artificial Sequence: Synthetic oligonucleotide
tatctcaccctgaatgaggacctgcgctc

SEQ ID NO: 75894 - DNA, 28 bp, Artificial Sequence
  Description of Artificial Sequence: Synthetic oligonucleotide
atctcaccctgaatgaggacctgcgctc

SEQ ID NO: 75895 - DNA, 27 bp, Artificial Sequence
  Description of Artificial Sequence: Synthetic oligonucleotide
tctcaccctgaatgaggacctgcgctc

SEQ ID NO: 75896 - DNA, 26 bp, Artificial Sequence
  Description of Artificial Sequence: Synthetic oligonucleotide
ctcaccctgaatgaggacctgcgctc

SEQ ID NO: 75897 - DNA, 27 bp, Artificial Sequence
  Description of Artificial Sequence: Synthetic oligonucleotide
tcaccctgaatgaggacctgcgctcct

SEQ ID NO: 75898 - DNA, 26 bp, Artificial Sequence
  Description of Artificial Sequence: Synthetic oligonucleotide
caccctgaatgaggacctgcgctcct

SEQ ID NO: 75899 - DNA, 26 bp, Artificial Sequence
  Description of Artificial Sequence: Synthetic oligonucleotide
accctgaatgaggacctgcgctcctg

SEQ ID NO: 75900 - DNA, 22 bp, Artificial Sequence
  Description of Artificial Sequence: Synthetic oligonucleotide
acctgcgctcctggaccgcggt

SEQ ID NO: 75901 - DNA, 21 bp, Artificial Sequence
  Description of Artificial Sequence: Synthetic oligonucleotide
cctgcgctcctggaccgcggt

SEQ ID NO: 75902 - DNA, 21 bp, Artificial Sequence
  Description of Artificial Sequence: Synthetic oligonucleotide
ctgcgctcctggaccgcggtg

SEQ ID NO: 75903 - DNA, 22 bp, Artificial Sequence
  Description of Artificial Sequence: Synthetic oligonucleotide
tgcgctcctggaccgcggtgga

SEQ ID NO: 75904 - DNA, 21 bp, Artificial Sequence
  Description of Artificial Sequence: Synthetic oligonucleotide
gcgctcctggaccgcggtgga

SEQ ID NO: 75905 - DNA, 22 bp, Artificial Sequence
  Description of Artificial Sequence: Synthetic oligonucleotide
cgctcctggaccgcggtggaca

SEQ ID NO: 75906 - DNA, 22 bp, Artificial Sequence
  Description of Artificial Sequence: Synthetic oligonucleotide
ctcctggaccgcggtggacacg

SEQ ID NO: 75907 - DNA, 22 bp, Artificial Sequence
  Description of Artificial Sequence: Synthetic oligonucleotide
tcctggaccgcggtggacacgg

SEQ ID NO: 75908 - DNA, 21 bp, Artificial Sequence
  Description of Artificial Sequence: Synthetic oligonucleotide
cctggaccgcggtggacacgg

SEQ ID NO: 75909 - DNA, 21 bp, Artificial Sequence
  Description of Artificial Sequence: Synthetic oligonucleotide
ctggaccgcggtggacacggc

SEQ ID NO: 75910 - DNA, 21 bp, Artificial Sequence
  Description of Artificial Sequence: Synthetic oligonucleotide
tggaccgcggtggacacggcg

SEQ ID NO: 75911 - DNA, 20 bp, Artificial Sequence
  Description of Artificial Sequence: Synthetic oligonucleotide
ggaccgcggtggacacggcg

SEQ ID NO: 75912 - DNA, 20 bp, Artificial Sequence
  Description of Artificial Sequence: Synthetic oligonucleotide
gaccgcggtggacacggcgg

SEQ ID NO: 75913 - DNA, 21 bp, Artificial Sequence
  Description of Artificial Sequence: Synthetic oligonucleotide
accgcggtggacacggcggct

SEQ ID NO: 75914 - DNA, 20 bp, Artificial Sequence
  Description of Artificial Sequence: Synthetic oligonucleotide
ccgcggtggacacggcggct

SEQ ID NO: 75915 - DNA, 21 bp, Artificial Sequence
  Description of Artificial Sequence: Synthetic oligonucleotide
cgcggtggacacggcggctca

SEQ ID NO: 75916 - DNA, 23 bp, Artificial Sequence
  Description of Artificial Sequence: Synthetic oligonucleotide
gcggtggacacggcggctcagat

SEQ ID NO: 75917 - DNA, 24 bp, Artificial Sequence
  Description of Artificial Sequence: Synthetic oligonucleotide
cggtggacacggcggctcagatct

SEQ ID NO: 75918 - DNA, 24 bp, Artificial Sequence
  Description of Artificial Sequence: Synthetic oligonucleotide
ggtggacacggcggctcagatctc

SEQ ID NO: 75919 - DNA, 24 bp, Artificial Sequence
  Description of Artificial Sequence: Synthetic oligonucleotide
gtggacacggcggctcagatctcc

SEQ ID NO: 75920 - DNA, 25 bp, Artificial Sequence
  Description of Artificial Sequence: Synthetic oligonucleotide
tggacacggcggctcagatctccga

SEQ ID NO: 75921 - DNA, 24 bp, Artificial Sequence
  Description of Artificial Sequence: Synthetic oligonucleotide
ggacacggcggctcagatctccga

SEQ ID NO: 75922 - DNA, 24 bp, Artificial Sequence
  Description of Artificial Sequence: Synthetic oligonucleotide
gacacggcggctcagatctccgag

SEQ ID NO: 75923 - DNA, 27 bp, Artificial Sequence
  Description of Artificial Sequence: Synthetic oligonucleotide
acacggcggctcagatctccgagcaaa

SEQ ID NO: 75924 - DNA, 27 bp, Artificial Sequence
  Description of Artificial Sequence: Synthetic oligonucleotide
cacggcggctcagatctccgagcaaaa

SEQ ID NO: 75925 - DNA, 27 bp, Artificial Sequence
  Description of Artificial Sequence: Synthetic oligonucleotide
acggcggctcagatctccgagcaaaag

SEQ ID NO: 75926 - DNA, 27 bp, Artificial Sequence
  Description of Artificial Sequence: Synthetic oligonucleotide
cggcggctcagatctccgagcaaaagt

SEQ ID NO: 75927 - DNA, 27 bp, Artificial Sequence
  Description of Artificial Sequence: Synthetic oligonucleotide
ggcggctcagatctccgagcaaaagtc

SEQ ID NO: 75928 - DNA, 31 bp, Artificial Sequence
  Description of Artificial Sequence: Synthetic oligonucleotide
gcggctcagatctccgagcaaaagtcaaatg

SEQ ID NO: 75929 - DNA, 33 bp, Artificial Sequence
  Description of Artificial Sequence: Synthetic oligonucleotide
cggctcagatctccgagcaaaagtcaaatgatg

SEQ ID NO: 75930 - DNA, 33 bp, Artificial Sequence
  Description of Artificial Sequence: Synthetic oligonucleotide
ggctcagatctccgagcaaaagtcaaatgatgc

SEQ ID NO: 75931 - DNA, 33 bp, Artificial Sequence
  Description of Artificial Sequence: Synthetic oligonucleotide
gctcagatctccgagcaaaagtcaaatgatgcc

SEQ ID NO: 75932 - DNA, 34 bp, Artificial Sequence
  Description of Artificial Sequence: Synthetic oligonucleotide
ctcagatctccgagcaaaagtcaaatgatgcctc

SEQ ID NO: 75933 - DNA, 35 bp, Artificial Sequence
  Description of Artificial Sequence: Synthetic oligonucleotide
tcagatctccgagcaaaagtcaaatgatgcctctg

SEQ ID NO: 75934 - DNA, 34 bp, Artificial Sequence
  Description of Artificial Sequence: Synthetic oligonucleotide
cagatctccgagcaaaagtcaaatgatgcctctg

SEQ ID NO: 75935 - DNA, 35 bp, Artificial Sequence
  Description of Artificial Sequence: Synthetic oligonucleotide
agatctccgagcaaaagtcaaatgatgcctctgag

SEQ ID NO: 75936 - DNA, 34 bp, Artificial Sequence
  Description of Artificial Sequence: Synthetic oligonucleotide
gatctccgagcaaaagtcaaatgatgcctctgag

SEQ ID NO: 75937 - DNA, 34 bp, Artificial Sequence
  Description of Artificial Sequence: Synthetic oligonucleotide
atctccgagcaaaagtcaaatgatgcctctgagg

SEQ ID NO: 75938 - DNA, 33 bp, Artificial Sequence
  Description of Artificial Sequence: Synthetic oligonucleotide
tctccgagcaaaagtcaaatgatgcctctgagg

SEQ ID NO: 75939 - DNA, 32 bp, Artificial Sequence
  Description of Artificial Sequence: Synthetic oligonucleotide
ctccgagcaaaagtcaaatgatgcctctgagg

SEQ ID NO: 75940 - DNA, 32 bp, Artificial Sequence
  Description of Artificial Sequence: Synthetic oligonucleotide
tccgagcaaaagtcaaatgatgcctctgaggc

SEQ ID NO: 75941 - DNA, 31 bp, Artificial Sequence
  Description of Artificial Sequence: Synthetic oligonucleotide
ccgagcaaaagtcaaatgatgcctctgaggc

SEQ ID NO: 75942 - DNA, 31 bp, Artificial Sequence
  Description of Artificial Sequence: Synthetic oligonucleotide
cgagcaaaagtcaaatgatgcctctgaggcg

SEQ ID NO: 75943 - DNA, 31 bp, Artificial Sequence
  Description of Artificial Sequence: Synthetic oligonucleotide
gagcaaaagtcaaatgatgcctctgaggcgg

SEQ ID NO: 75944 - DNA, 32 bp, Artificial Sequence
  Description of Artificial Sequence: Synthetic oligonucleotide
agcaaaagtcaaatgatgcctctgaggcggag

SEQ ID NO: 75945 - DNA, 31 bp, Artificial Sequence
  Description of Artificial Sequence: Synthetic oligonucleotide
gcaaaagtcaaatgatgcctctgaggcggag

SEQ ID NO: 75946 - DNA, 31 bp, Artificial Sequence
  Description of Artificial Sequence: Synthetic oligonucleotide
caaaagtcaaatgatgcctctgaggcggagc

SEQ ID NO: 75947 - DNA, 32 bp, Artificial Sequence
  Description of Artificial Sequence: Synthetic oligonucleotide
aaaagtcaaatgatgcctctgaggcggagcac

SEQ ID NO: 75948 - DNA, 31 bp, Artificial Sequence
  Description of Artificial Sequence: Synthetic oligonucleotide
aaagtcaaatgatgcctctgaggcggagcac

SEQ ID NO: 75949 - DNA, 30 bp, Artificial Sequence
  Description of Artificial Sequence: Synthetic oligonucleotide
aagtcaaatgatgcctctgaggcggagcac

SEQ ID NO: 75950 - DNA, 29 bp, Artificial Sequence
  Description of Artificial Sequence: Synthetic oligonucleotide
agtcaaatgatgcctctgaggcggagcac

SEQ ID NO: 75951 - DNA, 28 bp, Artificial Sequence
  Description of Artificial Sequence: Synthetic oligonucleotide
gtcaaatgatgcctctgaggcggagcac

SEQ ID NO: 75952 - DNA, 28 bp, Artificial Sequence
  Description of Artificial Sequence: Synthetic oligonucleotide
tcaaatgatgcctctgaggcggagcacc

SEQ ID NO: 75953 - DNA, 27 bp, Artificial Sequence
  Description of Artificial Sequence: Synthetic oligonucleotide
caaatgatgcctctgaggcggagcacc

SEQ ID NO: 75954 - DNA, 28 bp, Artificial Sequence
  Description of Artificial Sequence: Synthetic oligonucleotide
aaatgatgcctctgaggcggagcaccag

SEQ ID NO: 75955 - DNA, 27 bp, Artificial Sequence
  Description of Artificial Sequence: Synthetic oligonucleotide
aatgatgcctctgaggcggagcaccag

SEQ ID NO: 75956 - DNA, 27 bp, Artificial Sequence
  Description of Artificial Sequence: Synthetic oligonucleotide
atgatgcctctgaggcggagcaccaga

SEQ ID NO: 75957 - DNA, 26 bp, Artificial Sequence
  Description of Artificial Sequence: Synthetic oligonucleotide
tgatgcctctgaggcggagcaccaga

SEQ ID NO: 75958 - DNA, 25 bp, Artificial Sequence
  Description of Artificial Sequence: Synthetic oligonucleotide
gatgcctctgaggcggagcaccaga

SEQ ID NO: 75959 - DNA, 26 bp, Artificial Sequence
  Description of Artificial Sequence: Synthetic oligonucleotide
atgcctctgaggcggagcaccagaga

SEQ ID NO: 75960 - DNA, 25 bp, Artificial Sequence
  Description of Artificial Sequence: Synthetic oligonucleotide
tgcctctgaggcggagcaccagaga

SEQ ID NO: 75961 - DNA, 24 bp, Artificial Sequence
  Description of Artificial Sequence: Synthetic oligonucleotide
gcctctgaggcggagcaccagaga

SEQ ID NO: 75962 - DNA, 24 bp, Artificial Sequence
  Description of Artificial Sequence: Synthetic oligonucleotide
cctctgaggcggagcaccagagag

SEQ ID NO: 75963 - DNA, 24 bp, Artificial Sequence
  Description of Artificial Sequence: Synthetic oligonucleotide
ctctgaggcggagcaccagagagc

SEQ ID NO: 75964 - DNA, 26 bp, Artificial Sequence
  Description of Artificial Sequence: Synthetic oligonucleotide
tctgaggcggagcaccagagagccta

SEQ ID NO: 75965 - DNA, 25 bp, Artificial Sequence
  Description of Artificial Sequence: Synthetic oligonucleotide
ctgaggcggagcaccagagagccta

SEQ ID NO: 75966 - DNA, 25 bp, Artificial Sequence
  Description of Artificial Sequence: Synthetic oligonucleotide
tgaggcggagcaccagagagcctac

SEQ ID NO: 75967 - DNA, 24 bp, Artificial Sequence
  Description of Artificial Sequence: Synthetic oligonucleotide
gaggcggagcaccagagagcctac

SEQ ID NO: 75968 - DNA, 25 bp, Artificial Sequence
  Description of Artificial Sequence: Synthetic oligonucleotide
aggcggagcaccagagagcctacct

SEQ ID NO: 75969 - DNA, 24 bp, Artificial Sequence
  Description of Artificial Sequence: Synthetic oligonucleotide
ggcggagcaccagagagcctacct

SEQ ID NO: 75970 - DNA, 24 bp, Artificial Sequence
  Description of Artificial Sequence: Synthetic oligonucleotide
gcggagcaccagagagcctacctg

SEQ ID NO: 75971 - DNA, 26 bp, Artificial Sequence
  Description of Artificial Sequence: Synthetic oligonucleotide
cggagcaccagagagcctacctggaa

SEQ ID NO: 75972 - DNA, 27 bp, Artificial Sequence
  Description of Artificial Sequence: Synthetic oligonucleotide
ggagcaccagagagcctacctggaaga

SEQ ID NO: 75973 - DNA, 27 bp, Artificial Sequence
  Description of Artificial Sequence: Synthetic oligonucleotide
gagcaccagagagcctacctggaagac

SEQ ID NO: 75974 - DNA, 28 bp, Artificial Sequence
  Description of Artificial Sequence: Synthetic oligonucleotide
agcaccagagagcctacctggaagacac

SEQ ID NO: 75975 - DNA, 27 bp, Artificial Sequence
  Description of Artificial Sequence: Synthetic oligonucleotide
gcaccagagagcctacctggaagacac

SEQ ID NO: 75976 - DNA, 29 bp, Artificial Sequence
  Description of Artificial Sequence: Synthetic oligonucleotide
caccagagagcctacctggaagacacatg

SEQ ID NO: 75977 - DNA, 29 bp, Artificial Sequence
  Description of Artificial Sequence: Synthetic oligonucleotide
accagagagcctacctggaagacacatgc

SEQ ID NO: 75978 - DNA, 28 bp, Artificial Sequence
  Description of Artificial Sequence: Synthetic oligonucleotide
ccagagagcctacctggaagacacatgc

SEQ ID NO: 75979 - DNA, 28 bp, Artificial Sequence
  Description of Artificial Sequence: Synthetic oligonucleotide
cagagagcctacctggaagacacatgcg

SEQ ID NO: 75980 - DNA, 29 bp, Artificial Sequence
  Description of Artificial Sequence: Synthetic oligonucleotide
agagagcctacctggaagacacatgcgtg

SEQ ID NO: 75981 - DNA, 28 bp, Artificial Sequence
  Description of Artificial Sequence: Synthetic oligonucleotide
gagagcctacctggaagacacatgcgtg

SEQ ID NO: 75982 - DNA, 28 bp, Artificial Sequence
  Description of Artificial Sequence: Synthetic oligonucleotide
agagcctacctggaagacacatgcgtgg

SEQ ID NO: 75983 - DNA, 27 bp, Artificial Sequence
  Description of Artificial Sequence: Synthetic oligonucleotide
gagcctacctggaagacacatgcgtgg

SEQ ID NO: 75984 - DNA, 28 bp, Artificial Sequence
  Description of Artificial Sequence: Synthetic oligonucleotide
agcctacctggaagacacatgcgtggag

SEQ ID NO: 75985 - DNA, 27 bp, Artificial Sequence
  Description of Artificial Sequence: Synthetic oligonucleotide
gcctacctggaagacacatgcgtggag

SEQ ID NO: 75986 - DNA, 28 bp, Artificial Sequence
  Description of Artificial Sequence: Synthetic oligonucleotide
cctacctggaagacacatgcgtggagtg

SEQ ID NO: 75987 - DNA, 28 bp, Artificial Sequence
  Description of Artificial Sequence: Synthetic oligonucleotide
ctacctggaagacacatgcgtggagtgg

SEQ ID NO: 75988 - DNA, 28 bp, Artificial Sequence
  Description of Artificial Sequence: Synthetic oligonucleotide
tacctggaagacacatgcgtggagtggc

SEQ ID NO: 75989 - DNA, 27 bp, Artificial Sequence
  Description of Artificial Sequence: Synthetic oligonucleotide
acctggaagacacatgcgtggagtggc

SEQ ID NO: 75990 - DNA, 27 bp, Artificial Sequence
  Description of Artificial Sequence: Synthetic oligonucleotide
cctggaagacacatgcgtggagtggct

SEQ ID NO: 75991 - DNA, 27 bp, Artificial Sequence
  Description of Artificial Sequence: Synthetic oligonucleotide
ctggaagacacatgcgtggagtggctc

SEQ ID NO: 75992 - DNA, 27 bp, Artificial Sequence
  Description of Artificial Sequence: Synthetic oligonucleotide
tggaagacacatgcgtggagtggctcc

SEQ ID NO: 75993 - DNA, 27 bp, Artificial Sequence
  Description of Artificial Sequence: Synthetic oligonucleotide
ggaagacacatgcgtggagtggctcca

SEQ ID NO: 75994 - DNA, 27 bp, Artificial Sequence
  Description of Artificial Sequence: Synthetic oligonucleotide
gaagacacatgcgtggagtggctccac

SEQ ID NO: 75995 - DNA, 32 bp, Artificial Sequence
  Description of Artificial Sequence: Synthetic oligonucleotide
aagacacatgcgtggagtggctccacaaatac

SEQ ID NO: 75996 - DNA, 31 bp, Artificial Sequence
  Description of Artificial Sequence: Synthetic oligonucleotide
agacacatgcgtggagtggctccacaaatac

SEQ ID NO: 75997 - DNA, 30 bp, Artificial Sequence
  Description of Artificial Sequence: Synthetic oligonucleotide
gacacatgcgtggagtggctccacaaatac

SEQ ID NO: 75998 - DNA, 30 bp, Artificial Sequence
  Description of Artificial Sequence: Synthetic oligonucleotide
acacatgcgtggagtggctccacaaatacc

SEQ ID NO: 75999 - DNA, 29 bp, Artificial Sequence
  Description of Artificial Sequence: Synthetic oligonucleotide
cacatgcgtggagtggctccacaaatacc

SEQ ID NO: 76000 - DNA, 30 bp, Artificial Sequence
  Description of Artificial Sequence: Synthetic oligonucleotide
acatgcgtggagtggctccacaaatacctg

SEQ ID NO: 76001 - DNA, 29 bp, Artificial Sequence
  Description of Artificial Sequence: Synthetic oligonucleotide
catgcgtggagtggctccacaaatacctg

SEQ ID NO: 76002 - DNA, 29 bp, Artificial Sequence
  Description of Artificial Sequence: Synthetic oligonucleotide
atgcgtggagtggctccacaaatacctgg

SEQ ID NO: 76003 - DNA, 28 bp, Artificial Sequence
  Description of Artificial Sequence: Synthetic oligonucleotide
tgcgtggagtggctccacaaatacctgg

SEQ ID NO: 76004 - DNA, 27 bp, Artificial Sequence
  Description of Artificial Sequence: Synthetic oligonucleotide
gcgtggagtggctccacaaatacctgg

SEQ ID NO: 76005 - DNA, 28 bp, Artificial Sequence
  Description of Artificial Sequence: Synthetic oligonucleotide
cgtggagtggctccacaaatacctggag

SEQ ID NO: 76006 - DNA, 30 bp, Artificial Sequence
  Description of Artificial Sequence: Synthetic oligonucleotide
gtggagtggctccacaaatacctggagaag

SEQ ID NO: 76007 - DNA, 30 bp, Artificial Sequence
  Description of Artificial Sequence: Synthetic oligonucleotide
tggagtggctccacaaatacctggagaagg

SEQ ID NO: 76008 - DNA, 29 bp, Artificial Sequence
  Description of Artificial Sequence: Synthetic oligonucleotide
ggagtggctccacaaatacctggagaagg

SEQ ID NO: 76009 - DNA, 29 bp, Artificial Sequence
  Description of Artificial Sequence: Synthetic oligonucleotide
gagtggctccacaaatacctggagaaggg

SEQ ID NO: 76010 - DNA, 29 bp, Artificial Sequence
  Description of Artificial Sequence: Synthetic oligonucleotide
agtggctccacaaatacctggagaagggg

SEQ ID NO: 76011 - DNA, 28 bp, Artificial Sequence
  Description of Artificial Sequence: Synthetic oligonucleotide
gtggctccacaaatacctggagaagggg

SEQ ID NO: 76012 - DNA, 30 bp, Artificial Sequence
  Description of Artificial Sequence: Synthetic oligonucleotide
tggctccacaaatacctggagaaggggaag

SEQ ID NO: 76013 - DNA, 29 bp, Artificial Sequence
  Description of Artificial Sequence: Synthetic oligonucleotide
ggctccacaaatacctggagaaggggaag

SEQ ID NO: 76014 - DNA, 29 bp, Artificial Sequence
  Description of Artificial Sequence: Synthetic oligonucleotide
gctccacaaatacctggagaaggggaagg

SEQ ID NO: 76015 - DNA, 30 bp, Artificial Sequence
  Description of Artificial Sequence: Synthetic oligonucleotide
ctccacaaatacctggagaaggggaaggag

SEQ ID NO: 76016 - DNA, 31 bp, Artificial Sequence
  Description of Artificial Sequence: Synthetic oligonucleotide
tccacaaatacctggagaaggggaaggagac

SEQ ID NO: 76017 - DNA, 30 bp, Artificial Sequence
  Description of Artificial Sequence: Synthetic oligonucleotide
ccacaaatacctggagaaggggaaggagac

SEQ ID NO: 76018 - DNA, 30 bp, Artificial Sequence
  Description of Artificial Sequence: Synthetic oligonucleotide
cacaaatacctggagaaggggaaggagacg

SEQ ID NO: 76019 - DNA, 30 bp, Artificial Sequence
  Description of Artificial Sequence: Synthetic oligonucleotide
acaaatacctggagaaggggaaggagacgc

SEQ ID NO: 76020 - DNA, 29 bp, Artificial Sequence
  Description of Artificial Sequence: Synthetic oligonucleotide
caaatacctggagaaggggaaggagacgc

SEQ ID NO: 76021 - DNA, 30 bp, Artificial Sequence
  Description of Artificial Sequence: Synthetic oligonucleotide
aaatacctggagaaggggaaggagacgctg

SEQ ID NO: 76022 - DNA, 29 bp, Artificial Sequence
  Description of Artificial Sequence: Synthetic oligonucleotide
aatacctggagaaggggaaggagacgctg

SEQ ID NO: 76023 - DNA, 28 bp, Artificial Sequence
  Description of Artificial Sequence: Synthetic oligonucleotide
atacctggagaaggggaaggagacgctg

SEQ ID NO: 76024 - DNA, 27 bp, Artificial Sequence
  Description of Artificial Sequence: Synthetic oligonucleotide
tacctggagaaggggaaggagacgctg

SEQ ID NO: 76025 - DNA, 26 bp, Artificial Sequence
  Description of Artificial Sequence: Synthetic oligonucleotide
acctggagaaggggaaggagacgctg

SEQ ID NO: 76026 - DNA, 25 bp, Artificial Sequence
  Description of Artificial Sequence: Synthetic oligonucleotide
cctggagaaggggaaggagacgctg

SEQ ID NO: 76027 - DNA, 27 bp, Artificial Sequence
  Description of Artificial Sequence: Synthetic oligonucleotide
ctggagaaggggaaggagacgctgctt

SEQ ID NO: 76028 - DNA, 27 bp, Artificial Sequence
  Description of Artificial Sequence: Synthetic oligonucleotide
tggagaaggggaaggagacgctgcttc

SEQ ID NO: 76029 - DNA, 27 bp, Artificial Sequence
  Description of Artificial Sequence: Synthetic oligonucleotide
ggagaaggggaaggagacgctgcttca

SEQ ID NO: 76030 - DNA, 27 bp, Artificial Sequence
  Description of Artificial Sequence: Synthetic oligonucleotide
gagaaggggaaggagacgctgcttcac

SEQ ID NO: 76031 - DNA, 27 bp, Artificial Sequence
  Description of Artificial Sequence: Synthetic oligonucleotide
agaaggggaaggagacgctgcttcacc

SEQ ID NO: 76032 - DNA, 27 bp, Artificial Sequence
  Description of Artificial Sequence: Synthetic oligonucleotide
gaaggggaaggagacgctgcttcacct

SEQ ID NO: 76033 - DNA, 27 bp, Artificial Sequence
  Description of Artificial Sequence: Synthetic oligonucleotide
aaggggaaggagacgctgcttcacctg

SEQ ID NO: 76034 - DNA, 26 bp, Artificial Sequence
  Description of Artificial Sequence: Synthetic oligonucleotide
aggggaaggagacgctgcttcacctg

SEQ ID NO: 76035 - DNA, 25 bp, Artificial Sequence
  Description of Artificial Sequence: Synthetic oligonucleotide
ggggaaggagacgctgcttcacctg

SEQ ID NO: 76036 - DNA, 26 bp, Artificial Sequence
  Description of Artificial Sequence: Synthetic oligonucleotide
gggaaggagacgctgcttcacctgga

SEQ ID NO: 76037 - DNA, 26 bp, Artificial Sequence
  Description of Artificial Sequence: Synthetic oligonucleotide
ggaaggagacgctgcttcacctggag

SEQ ID NO: 76038 - DNA, 26 bp, Artificial Sequence
  Description of Artificial Sequence: Synthetic oligonucleotide
gaaggagacgctgcttcacctggagc

SEQ ID NO: 76039 - DNA, 26 bp, Artificial Sequence
  Description of Artificial Sequence: Synthetic oligonucleotide
aaggagacgctgcttcacctggagcc

SEQ ID NO: 76040 - DNA, 25 bp, Artificial Sequence
  Description of Artificial Sequence: Synthetic oligonucleotide
aggagacgctgcttcacctggagcc

SEQ ID NO: 76041 - DNA, 24 bp, Artificial Sequence
  Description of Artificial Sequence: Synthetic oligonucleotide
ggagacgctgcttcacctggagcc

SEQ ID NO: 76042 - DNA, 24 bp, Artificial Sequence
  Description of Artificial Sequence: Synthetic oligonucleotide
gagacgctgcttcacctggagccc

SEQ ID NO: 76043 - DNA, 24 bp, Artificial Sequence
  Description of Artificial Sequence: Synthetic oligonucleotide
agacgctgcttcacctggagcccc

SEQ ID NO: 76044 - DNA, 23 bp, Artificial Sequence
  Description of Artificial Sequence: Synthetic oligonucleotide
gacgctgcttcacctggagcccc

SEQ ID NO: 76045 - DNA, 26 bp, Artificial Sequence
  Description of Artificial Sequence: Synthetic oligonucleotide
acgctgcttcacctggagcccccaaa

SEQ ID NO: 76046 - DNA, 25 bp, Artificial Sequence
  Description of Artificial Sequence: Synthetic oligonucleotide
cgctgcttcacctggagcccccaaa

SEQ ID NO: 76047 - DNA, 26 bp, Artificial Sequence
  Description of Artificial Sequence: Synthetic oligonucleotide
gctgcttcacctggagcccccaaaga

SEQ ID NO: 76048 - DNA, 27 bp, Artificial Sequence
  Description of Artificial Sequence: Synthetic oligonucleotide
ctgcttcacctggagcccccaaagaca

SEQ ID NO: 76049 - DNA, 27 bp, Artificial Sequence
  Description of Artificial Sequence: Synthetic oligonucleotide
tgcttcacctggagcccccaaagacac

SEQ ID NO: 76050 - DNA, 27 bp, Artificial Sequence
  Description of Artificial Sequence: Synthetic oligonucleotide
gcttcacctggagcccccaaagacaca

SEQ ID NO: 76051 - DNA, 27 bp, Artificial Sequence
  Description of Artificial Sequence: Synthetic oligonucleotide
cttcacctggagcccccaaagacacac

SEQ ID NO: 76052 - DNA, 27 bp, Artificial Sequence
  Description of Artificial Sequence: Synthetic oligonucleotide
ttcacctggagcccccaaagacacacg

SEQ ID NO: 76053 - DNA, 27 bp, Artificial Sequence
  Description of Artificial Sequence: Synthetic oligonucleotide
tcacctggagcccccaaagacacacgt

SEQ ID NO: 76054 - DNA, 26 bp, Artificial Sequence
  Description of Artificial Sequence: Synthetic oligonucleotide
cacctggagcccccaaagacacacgt

SEQ ID NO: 76055 - DNA, 27 bp, Artificial Sequence
  Description of Artificial Sequence: Synthetic oligonucleotide
acctggagcccccaaagacacacgtga

SEQ ID NO: 76056 - DNA, 26 bp, Artificial Sequence
  Description of Artificial Sequence: Synthetic oligonucleotide
cctggagcccccaaagacacacgtga

SEQ ID NO: 76057 - DNA, 27 bp, Artificial Sequence
  Description of Artificial Sequence: Synthetic oligonucleotide
ctggagcccccaaagacacacgtgact

SEQ ID NO: 76058 - DNA, 27 bp, Artificial Sequence
  Description of Artificial Sequence: Synthetic oligonucleotide
tggagcccccaaagacacacgtgactc

SEQ ID NO: 76059 - DNA, 27 bp, Artificial Sequence
  Description of Artificial Sequence: Synthetic oligonucleotide
ggagcccccaaagacacacgtgactca

SEQ ID NO: 76060 - DNA, 27 bp, Artificial Sequence
  Description of Artificial Sequence: Synthetic oligonucleotide
gagcccccaaagacacacgtgactcac

SEQ ID NO: 76061 - DNA, 27 bp, Artificial Sequence
  Description of Artificial Sequence: Synthetic oligonucleotide
agcccccaaagacacacgtgactcacc

SEQ ID NO: 76062 - DNA, 27 bp, Artificial Sequence
  Description of Artificial Sequence: Synthetic oligonucleotide
gcccccaaagacacacgtgactcacca

SEQ ID NO: 76063 - DNA, 27 bp, Artificial Sequence
  Description of Artificial Sequence: Synthetic oligonucleotide
cccccaaagacacacgtgactcaccac

SEQ ID NO: 76064 - DNA, 27 bp, Artificial Sequence
  Description of Artificial Sequence: Synthetic oligonucleotide
ccccaaagacacacgtgactcaccacc

SEQ ID NO: 76065 - DNA, 27 bp, Artificial Sequence
  Description of Artificial Sequence: Synthetic oligonucleotide
cccaaagacacacgtgactcaccaccc

SEQ ID NO: 76066 - DNA, 27 bp, Artificial Sequence
  Description of Artificial Sequence: Synthetic oligonucleotide
ccaaagacacacgtgactcaccacccc

SEQ ID NO: 76067 - DNA, 29 bp, Artificial Sequence
  Description of Artificial Sequence: Synthetic oligonucleotide
caaagacacacgtgactcaccaccccatc

SEQ ID NO: 76068 - DNA, 30 bp, Artificial Sequence
  Description of Artificial Sequence: Synthetic oligonucleotide
aaagacacacgtgactcaccaccccatctc

SEQ ID NO: 76069 - DNA, 29 bp, Artificial Sequence
  Description of Artificial Sequence: Synthetic oligonucleotide
aagacacacgtgactcaccaccccatctc

SEQ ID NO: 76070 - DNA, 28 bp, Artificial Sequence
  Description of Artificial Sequence: Synthetic oligonucleotide
agacacacgtgactcaccaccccatctc

SEQ ID NO: 76071 - DNA, 27 bp, Artificial Sequence
  Description of Artificial Sequence: Synthetic oligonucleotide
gacacacgtgactcaccaccccatctc

SEQ ID NO: 76072 - DNA, 28 bp, Artificial Sequence
  Description of Artificial Sequence: Synthetic oligonucleotide
acacacgtgactcaccaccccatctctg

SEQ ID NO: 76073 - DNA, 27 bp, Artificial Sequence
  Description of Artificial Sequence: Synthetic oligonucleotide
cacacgtgactcaccaccccatctctg

SEQ ID NO: 76074 - DNA, 28 bp, Artificial Sequence
  Description of Artificial Sequence: Synthetic oligonucleotide
acacgtgactcaccaccccatctctgac

SEQ ID NO: 76075 - DNA, 27 bp, Artificial Sequence
  Description of Artificial Sequence: Synthetic oligonucleotide
cacgtgactcaccaccccatctctgac

SEQ ID NO: 76076 - DNA, 27 bp, Artificial Sequence
  Description of Artificial Sequence: Synthetic oligonucleotide
acgtgactcaccaccccatctctgacc

SEQ ID NO: 76077 - DNA, 27 bp, Artificial Sequence
  Description of Artificial Sequence: Synthetic oligonucleotide
cgtgactcaccaccccatctctgacca

SEQ ID NO: 76078 - DNA, 28 bp, Artificial Sequence
  Description of Artificial Sequence: Synthetic oligonucleotide
gtgactcaccaccccatctctgaccatg

SEQ ID NO: 76079 - DNA, 29 bp, Artificial Sequence
  Description of Artificial Sequence: Synthetic oligonucleotide
tgactcaccaccccatctctgaccatgag

SEQ ID NO: 76080 - DNA, 28 bp, Artificial Sequence
  Description of Artificial Sequence: Synthetic oligonucleotide
gactcaccaccccatctctgaccatgag

SEQ ID NO: 76081 - DNA, 28 bp, Artificial Sequence
  Description of Artificial Sequence: Synthetic oligonucleotide
actcaccaccccatctctgaccatgagg

SEQ ID NO: 76082 - DNA, 27 bp, Artificial Sequence
  Description of Artificial Sequence: Synthetic oligonucleotide
ctcaccaccccatctctgaccatgagg

SEQ ID NO: 76083 - DNA, 27 bp, Artificial Sequence
  Description of Artificial Sequence: Synthetic oligonucleotide
tcaccaccccatctctgaccatgaggc

SEQ ID NO: 76084 - DNA, 24 bp, Artificial Sequence
  Description of Artificial Sequence: Synthetic oligonucleotide
tgacctggcagcaggatggggagg

SEQ ID NO: 76085 - DNA, 23 bp, Artificial Sequence
  Description of Artificial Sequence: Synthetic oligonucleotide
gacctggcagcaggatggggagg

SEQ ID NO: 76086 - DNA, 23 bp, Artificial Sequence
  Description of Artificial Sequence: Synthetic oligonucleotide
acctggcagcaggatggggaggg

SEQ ID NO: 76087 - DNA, 22 bp, Artificial Sequence
  Description of Artificial Sequence: Synthetic oligonucleotide
cctggcagcaggatggggaggg

SEQ ID NO: 76088 - DNA, 22 bp, Artificial Sequence
  Description of Artificial Sequence: Synthetic oligonucleotide
ctggcagcaggatggggagggc

SEQ ID NO: 76089 - DNA, 25 bp, Artificial Sequence
  Description of Artificial Sequence: Synthetic oligonucleotide
tggcagcaggatggggagggccata

SEQ ID NO: 76090 - DNA, 24 bp, Artificial Sequence
  Description of Artificial Sequence: Synthetic oligonucleotide
ggcagcaggatggggagggccata

SEQ ID NO: 76091 - DNA, 24 bp, Artificial Sequence
  Description of Artificial Sequence: Synthetic oligonucleotide
gcagcaggatggggagggccatac

SEQ ID NO: 76092 - DNA, 24 bp, Artificial Sequence
  Description of Artificial Sequence: Synthetic oligonucleotide
cagcaggatggggagggccatacc

SEQ ID NO: 76093 - DNA, 25 bp, Artificial Sequence
  Description of Artificial Sequence: Synthetic oligonucleotide
agcaggatggggagggccataccca

SEQ ID NO: 76094 - DNA, 24 bp, Artificial Sequence
  Description of Artificial Sequence: Synthetic oligonucleotide
gcaggatggggagggccataccca

SEQ ID NO: 76095 - DNA, 24 bp, Artificial Sequence
  Description of Artificial Sequence: Synthetic oligonucleotide
caggatggggagggccatacccag

SEQ ID NO: 76096 - DNA, 25 bp, Artificial Sequence
  Description of Artificial Sequence: Synthetic oligonucleotide
aggatggggagggccatacccagga

SEQ ID NO: 76097 - DNA, 24 bp, Artificial Sequence
  Description of Artificial Sequence: Synthetic oligonucleotide
ggatggggagggccatacccagga

SEQ ID NO: 76098 - DNA, 25 bp, Artificial Sequence
  Description of Artificial Sequence: Synthetic oligonucleotide
gatggggagggccatacccaggaca

SEQ ID NO: 76099 - DNA, 25 bp, Artificial Sequence
  Description of Artificial Sequence: Synthetic oligonucleotide
atggggagggccatacccaggacac

SEQ ID NO: 76100 - DNA, 24 bp, Artificial Sequence
  Description of Artificial Sequence: Synthetic oligonucleotide
tggggagggccatacccaggacac

SEQ ID NO: 76101 - DNA, 23 bp, Artificial Sequence
  Description of Artificial Sequence: Synthetic oligonucleotide
ggggagggccatacccaggacac

SEQ ID NO: 76102 - DNA, 23 bp, Artificial Sequence
  Description of Artificial Sequence: Synthetic oligonucleotide
gggagggccatacccaggacacg

SEQ ID NO: 76103 - DNA, 24 bp, Artificial Sequence
  Description of Artificial Sequence: Synthetic oligonucleotide
ggagggccatacccaggacacgga

SEQ ID NO: 76104 - DNA, 24 bp, Artificial Sequence
  Description of Artificial Sequence: Synthetic oligonucleotide
gagggccatacccaggacacggag

SEQ ID NO: 76105 - DNA, 25 bp, Artificial Sequence
  Description of Artificial Sequence: Synthetic oligonucleotide
agggccatacccaggacacggagct

SEQ ID NO: 76106 - DNA, 24 bp, Artificial Sequence
  Description of Artificial Sequence: Synthetic oligonucleotide
gggccatacccaggacacggagct

SEQ ID NO: 76107 - DNA, 24 bp, Artificial Sequence
  Description of Artificial Sequence: Synthetic oligonucleotide
ggccatacccaggacacggagctc

SEQ ID NO: 76108 - DNA, 25 bp, Artificial Sequence
  Description of Artificial Sequence: Synthetic oligonucleotide
gccatacccaggacacggagctcgt

SEQ ID NO: 76109 - DNA, 25 bp, Artificial Sequence
  Description of Artificial Sequence: Synthetic oligonucleotide
ccatacccaggacacggagctcgtg

SEQ ID NO: 76110 - DNA, 26 bp, Artificial Sequence
  Description of Artificial Sequence: Synthetic oligonucleotide
catacccaggacacggagctcgtgga

SEQ ID NO: 76111 - DNA, 27 bp, Artificial Sequence
  Description of Artificial Sequence: Synthetic oligonucleotide
atacccaggacacggagctcgtggaga

SEQ ID NO: 76112 - DNA, 26 bp, Artificial Sequence
  Description of Artificial Sequence: Synthetic oligonucleotide
tacccaggacacggagctcgtggaga

SEQ ID NO: 76113 - DNA, 29 bp, Artificial Sequence
  Description of Artificial Sequence: Synthetic oligonucleotide
tgccttctggagaggagcagagatacacg

SEQ ID NO: 76114 - DNA, 28 bp, Artificial Sequence
  Description of Artificial Sequence: Synthetic oligonucleotide
gccttctggagaggagcagagatacacg

SEQ ID NO: 76115 - DNA, 29 bp, Artificial Sequence
  Description of Artificial Sequence: Synthetic oligonucleotide
ccttctggagaggagcagagatacacgtg

SEQ ID NO: 76116 - DNA, 29 bp, Artificial Sequence
  Description of Artificial Sequence: Synthetic oligonucleotide
cttctggagaggagcagagatacacgtgc

SEQ ID NO: 76117 - DNA, 29 bp, Artificial Sequence
  Description of Artificial Sequence: Synthetic oligonucleotide
ttctggagaggagcagagatacacgtgcc

SEQ ID NO: 76118 - DNA, 28 bp, Artificial Sequence
  Description of Artificial Sequence: Synthetic oligonucleotide
tctggagaggagcagagatacacgtgcc

SEQ ID NO: 76119 - DNA, 27 bp, Artificial Sequence
  Description of Artificial Sequence: Synthetic oligonucleotide
ctggagaggagcagagatacacgtgcc

SEQ ID NO: 76120 - DNA, 29 bp, Artificial Sequence
  Description of Artificial Sequence: Synthetic oligonucleotide
tggagaggagcagagatacacgtgccatg

SEQ ID NO: 76121 - DNA, 28 bp, Artificial Sequence
  Description of Artificial Sequence: Synthetic oligonucleotide
ggagaggagcagagatacacgtgccatg

SEQ ID NO: 76122 - DNA, 29 bp, Artificial Sequence
  Description of Artificial Sequence: Synthetic oligonucleotide
gagaggagcagagatacacgtgccatgtg

SEQ ID NO: 76123 - DNA, 29 bp, Artificial Sequence
  Description of Artificial Sequence: Synthetic oligonucleotide
agaggagcagagatacacgtgccatgtgc

SEQ ID NO: 76124 - DNA, 28 bp, Artificial Sequence
  Description of Artificial Sequence: Synthetic oligonucleotide
gaggagcagagatacacgtgccatgtgc

SEQ ID NO: 76125 - DNA, 29 bp, Artificial Sequence
  Description of Artificial Sequence: Synthetic oligonucleotide
aggagcagagatacacgtgccatgtgcag

SEQ ID NO: 76126 - DNA, 28 bp, Artificial Sequence
  Description of Artificial Sequence: Synthetic oligonucleotide
ggagcagagatacacgtgccatgtgcag

SEQ ID NO: 76127 - DNA, 27 bp, Artificial Sequence
  Description of Artificial Sequence: Synthetic oligonucleotide
acgtgccatgtgcagcatgaggggcta

SEQ ID NO: 76128 - DNA, 26 bp, Artificial Sequence
  Description of Artificial Sequence: Synthetic oligonucleotide
cgtgccatgtgcagcatgaggggcta

SEQ ID NO: 76129 - DNA, 26 bp, Artificial Sequence
  Description of Artificial Sequence: Synthetic oligonucleotide
gtgccatgtgcagcatgaggggctac

SEQ ID NO: 76130 - DNA, 26 bp, Artificial Sequence
  Description of Artificial Sequence: Synthetic oligonucleotide
tgccatgtgcagcatgaggggctacc

SEQ ID NO: 76131 - DNA, 25 bp, Artificial Sequence
  Description of Artificial Sequence: Synthetic oligonucleotide
gccatgtgcagcatgaggggctacc

SEQ ID NO: 76132 - DNA, 25 bp, Artificial Sequence
  Description of Artificial Sequence: Synthetic oligonucleotide
ccatgtgcagcatgaggggctaccc

SEQ ID NO: 76133 - DNA, 26 bp, Artificial Sequence
  Description of Artificial Sequence: Synthetic oligonucleotide
catgtgcagcatgaggggctacccga

SEQ ID NO: 76134 - DNA, 26 bp, Artificial Sequence
  Description of Artificial Sequence: Synthetic oligonucleotide
atgtgcagcatgaggggctacccgag

SEQ ID NO: 76135 - DNA, 25 bp, Artificial Sequence
  Description of Artificial Sequence: Synthetic oligonucleotide
tgtgcagcatgaggggctacccgag

SEQ ID NO: 76136 - DNA, 24 bp, Artificial Sequence
  Description of Artificial Sequence: Synthetic oligonucleotide
gtgcagcatgaggggctacccgag

SEQ ID NO: 76137 - DNA, 24 bp, Artificial Sequence
  Description of Artificial Sequence: Synthetic oligonucleotide
tgcagcatgaggggctacccgagc

SEQ ID NO: 76138 - DNA, 23 bp, Artificial Sequence
  Description of Artificial Sequence: Synthetic oligonucleotide
gcagcatgaggggctacccgagc

SEQ ID NO: 76139 - DNA, 23 bp, Artificial Sequence
  Description of Artificial Sequence: Synthetic oligonucleotide
cagcatgaggggctacccgagcc

SEQ ID NO: 76140 - DNA, 23 bp, Artificial Sequence
  Description of Artificial Sequence: Synthetic oligonucleotide
agcatgaggggctacccgagccc

SEQ ID NO: 76141 - DNA, 22 bp, Artificial Sequence
  Description of Artificial Sequence: Synthetic oligonucleotide
gcatgaggggctacccgagccc

SEQ ID NO: 76142 - DNA, 23 bp, Artificial Sequence
  Description of Artificial Sequence: Synthetic oligonucleotide
catgaggggctacccgagcccgt

SEQ ID NO: 76143 - DNA, 24 bp, Artificial Sequence
  Description of Artificial Sequence: Synthetic oligonucleotide
atgaggggctacccgagcccgtca

SEQ ID NO: 76144 - DNA, 23 bp, Artificial Sequence
  Description of Artificial Sequence: Synthetic oligonucleotide
tgaggggctacccgagcccgtca

SEQ ID NO: 76145 - DNA, 22 bp, Artificial Sequence
  Description of Artificial Sequence: Synthetic oligonucleotide
gaggggctacccgagcccgtca

SEQ ID NO: 76146 - DNA, 22 bp, Artificial Sequence
  Description of Artificial Sequence: Synthetic oligonucleotide
aggggctacccgagcccgtcac

SEQ ID NO: 76147 - DNA, 21 bp, Artificial Sequence
  Description of Artificial Sequence: Synthetic oligonucleotide
ggggctacccgagcccgtcac

SEQ ID NO: 76148 - DNA, 21 bp, Artificial Sequence
  Description of Artificial Sequence: Synthetic oligonucleotide
gggctacccgagcccgtcacc

SEQ ID NO: 76149 - DNA, 22 bp, Artificial Sequence
  Description of Artificial Sequence: Synthetic oligonucleotide
ggctacccgagcccgtcaccct

SEQ ID NO: 76150 - DNA, 23 bp, Artificial Sequence
  Description of Artificial Sequence: Synthetic oligonucleotide
gctacccgagcccgtcaccctga

SEQ ID NO: 76151 - DNA, 25 bp, Artificial Sequence
  Description of Artificial Sequence: Synthetic oligonucleotide
ctacccgagcccgtcaccctgagat

SEQ ID NO: 76152 - DNA, 25 bp, Artificial Sequence
  Description of Artificial Sequence: Synthetic oligonucleotide
tacccgagcccgtcaccctgagatg

SEQ ID NO: 76153 - DNA, 24 bp, Artificial Sequence
  Description of Artificial Sequence: Synthetic oligonucleotide
acccgagcccgtcaccctgagatg

SEQ ID NO: 76154 - DNA, 23 bp, Artificial Sequence
  Description of Artificial Sequence: Synthetic oligonucleotide
cccgagcccgtcaccctgagatg

SEQ ID NO: 76155 - DNA, 25 bp, Artificial Sequence
  Description of Artificial Sequence: Synthetic oligonucleotide
ccgagcccgtcaccctgagatggaa

SEQ ID NO: 76156 - DNA, 25 bp, Artificial Sequence
  Description of Artificial Sequence: Synthetic oligonucleotide
cgagcccgtcaccctgagatggaag

SEQ ID NO: 76157 - DNA, 25 bp, Artificial Sequence
  Description of Artificial Sequence: Synthetic oligonucleotide
gagcccgtcaccctgagatggaagc

SEQ ID NO: 76158 - DNA, 25 bp, Artificial Sequence
  Description of Artificial Sequence: Synthetic oligonucleotide
agcccgtcaccctgagatggaagcc

SEQ ID NO: 76159 - DNA, 24 bp, Artificial Sequence
  Description of Artificial Sequence: Synthetic oligonucleotide
gcccgtcaccctgagatggaagcc

SEQ ID NO: 76160 - DNA, 24 bp, Artificial Sequence
  Description of Artificial Sequence: Synthetic oligonucleotide
cccgtcaccctgagatggaagccg

SEQ ID NO: 76161 - DNA, 24 bp, Artificial Sequence
  Description of Artificial Sequence: Synthetic oligonucleotide
ccgtcaccctgagatggaagccgg

SEQ ID NO: 76162 - DNA, 26 bp, Artificial Sequence
  Description of Artificial Sequence: Synthetic oligonucleotide
cgtcaccctgagatggaagccggctt

SEQ ID NO: 76163 - DNA, 26 bp, Artificial Sequence
  Description of Artificial Sequence: Synthetic oligonucleotide
gtcaccctgagatggaagccggcttc

SEQ ID NO: 76164 - DNA, 26 bp, Artificial Sequence
  Description of Artificial Sequence: Synthetic oligonucleotide
tcaccctgagatggaagccggcttcc

SEQ ID NO: 76165 - DNA, 25 bp, Artificial Sequence
  Description of Artificial Sequence: Synthetic oligonucleotide
caccctgagatggaagccggcttcc

SEQ ID NO: 76166 - DNA, 26 bp, Artificial Sequence
  Description of Artificial Sequence: Synthetic oligonucleotide
accctgagatggaagccggcttccca

SEQ ID NO: 76167 - DNA, 25 bp, Artificial Sequence
  Description of Artificial Sequence: Synthetic oligonucleotide
ccctgagatggaagccggcttccca

SEQ ID NO: 76168 - DNA, 25 bp, Artificial Sequence
  Description of Artificial Sequence: Synthetic oligonucleotide
cctgagatggaagccggcttcccag

SEQ ID NO: 76169 - DNA, 25 bp, Artificial Sequence
  Description of Artificial Sequence: Synthetic oligonucleotide
ctgagatggaagccggcttcccagc

SEQ ID NO: 76170 - DNA, 25 bp, Artificial Sequence
  Description of Artificial Sequence: Synthetic oligonucleotide
tgagatggaagccggcttcccagcc

SEQ ID NO: 76171 - DNA, 24 bp, Artificial Sequence
  Description of Artificial Sequence: Synthetic oligonucleotide
gagatggaagccggcttcccagcc

SEQ ID NO: 76172 - DNA, 25 bp, Artificial Sequence
  Description of Artificial Sequence: Synthetic oligonucleotide
agatggaagccggcttcccagccca

SEQ ID NO: 76173 - DNA, 24 bp, Artificial Sequence
  Description of Artificial Sequence: Synthetic oligonucleotide
gatggaagccggcttcccagccca

SEQ ID NO: 76174 - DNA, 24 bp, Artificial Sequence
  Description of Artificial Sequence: Synthetic oligonucleotide
atggaagccggcttcccagcccac

SEQ ID NO: 76175 - DNA, 23 bp, Artificial Sequence
  Description of Artificial Sequence: Synthetic oligonucleotide
tggaagccggcttcccagcccac

SEQ ID NO: 76176 - DNA, 22 bp, Artificial Sequence
  Description of Artificial Sequence: Synthetic oligonucleotide
ggaagccggcttcccagcccac

SEQ ID NO: 76177 - DNA, 24 bp, Artificial Sequence
  Description of Artificial Sequence: Synthetic oligonucleotide
gaagccggcttcccagcccaccat

SEQ ID NO: 76178 - DNA, 24 bp, Artificial Sequence
  Description of Artificial Sequence: Synthetic oligonucleotide
aagccggcttcccagcccaccatc

SEQ ID NO: 76179 - DNA, 23 bp, Artificial Sequence
  Description of Artificial Sequence: Synthetic oligonucleotide
agccggcttcccagcccaccatc

SEQ ID NO: 76180 - DNA, 22 bp, Artificial Sequence
  Description of Artificial Sequence: Synthetic oligonucleotide
gccggcttcccagcccaccatc

SEQ ID NO: 76181 - DNA, 22 bp, Artificial Sequence
  Description of Artificial Sequence: Synthetic oligonucleotide
ccggcttcccagcccaccatcc

SEQ ID NO: 76182 - DNA, 22 bp, Artificial Sequence
  Description of Artificial Sequence: Synthetic oligonucleotide
cggcttcccagcccaccatccc

SEQ ID NO: 76183 - DNA, 24 bp, Artificial Sequence
  Description of Artificial Sequence: Synthetic oligonucleotide
ggcttcccagcccaccatccccat

SEQ ID NO: 76184 - DNA, 24 bp, Artificial Sequence
  Description of Artificial Sequence: Synthetic oligonucleotide
gcttcccagcccaccatccccatc

SEQ ID NO: 76185 - DNA, 30 bp, Artificial Sequence
  Description of Artificial Sequence: Synthetic oligonucleotide
catcattgctggcctggttctccttggatc

SEQ ID NO: 76186 - DNA, 31 bp, Artificial Sequence
  Description of Artificial Sequence: Synthetic oligonucleotide
atcattgctggcctggttctccttggatctg

SEQ ID NO: 76187 - DNA, 30 bp, Artificial Sequence
  Description of Artificial Sequence: Synthetic oligonucleotide
tcattgctggcctggttctccttggatctg

SEQ ID NO: 76188 - DNA, 29 bp, Artificial Sequence
  Description of Artificial Sequence: Synthetic oligonucleotide
cattgctggcctggttctccttggatctg

SEQ ID NO: 76189 - DNA, 30 bp, Artificial Sequence
  Description of Artificial Sequence: Synthetic oligonucleotide
attgctggcctggttctccttggatctgtg

SEQ ID NO: 76190 - DNA, 29 bp, Artificial Sequence
  Description of Artificial Sequence: Synthetic oligonucleotide
ttgctggcctggttctccttggatctgtg

SEQ ID NO: 76191 - DNA, 28 bp, Artificial Sequence
  Description of Artificial Sequence: Synthetic oligonucleotide
tgctggcctggttctccttggatctgtg

SEQ ID NO: 76192 - DNA, 27 bp, Artificial Sequence
  Description of Artificial Sequence: Synthetic oligonucleotide
gctggcctggttctccttggatctgtg

SEQ ID NO: 76193 - DNA, 27 bp, Artificial Sequence
  Description of Artificial Sequence: Synthetic oligonucleotide
ctggcctggttctccttggatctgtgg

SEQ ID NO: 76194 - DNA, 28 bp, Artificial Sequence
  Description of Artificial Sequence: Synthetic oligonucleotide
tggcctggttctccttggatctgtggtc

SEQ ID NO: 76195 - DNA, 27 bp, Artificial Sequence
  Description of Artificial Sequence: Synthetic oligonucleotide
ggcctggttctccttggatctgtggtc

SEQ ID NO: 76196 - DNA, 28 bp, Artificial Sequence
  Description of Artificial Sequence: Synthetic oligonucleotide
gcctggttctccttggatctgtggtctc

SEQ ID NO: 76197 - DNA, 29 bp, Artificial Sequence
  Description of Artificial Sequence: Synthetic oligonucleotide
cctggttctccttggatctgtggtctctg

SEQ ID NO: 76198 - DNA, 29 bp, Artificial Sequence
  Description of Artificial Sequence: Synthetic oligonucleotide
ctggttctccttggatctgtggtctctgg

SEQ ID NO: 76199 - DNA, 30 bp, Artificial Sequence
  Description of Artificial Sequence: Synthetic oligonucleotide
tggttctccttggatctgtggtctctggag

SEQ ID NO: 76200 - DNA, 29 bp, Artificial Sequence
  Description of Artificial Sequence: Synthetic oligonucleotide
ggttctccttggatctgtggtctctggag

SEQ ID NO: 76201 - DNA, 29 bp, Artificial Sequence
  Description of Artificial Sequence: Synthetic oligonucleotide
gttctccttggatctgtggtctctggagc

SEQ ID NO: 76202 - DNA, 30 bp, Artificial Sequence
  Description of Artificial Sequence: Synthetic oligonucleotide
ttctccttggatctgtggtctctggagctg

SEQ ID NO: 76203 - DNA, 29 bp, Artificial Sequence
  Description of Artificial Sequence: Synthetic oligonucleotide
tctccttggatctgtggtctctggagctg

SEQ ID NO: 76204 - DNA, 28 bp, Artificial Sequence
  Description of Artificial Sequence: Synthetic oligonucleotide
ctccttggatctgtggtctctggagctg

SEQ ID NO: 76205 - DNA, 29 bp, Artificial Sequence
  Description of Artificial Sequence: Synthetic oligonucleotide
tccttggatctgtggtctctggagctgtg

SEQ ID NO: 76206 - DNA, 28 bp, Artificial Sequence
  Description of Artificial Sequence: Synthetic oligonucleotide
ccttggatctgtggtctctggagctgtg

SEQ ID NO: 76207 - DNA, 28 bp, Artificial Sequence
  Description of Artificial Sequence: Synthetic oligonucleotide
cttggatctgtggtctctggagctgtgg

SEQ ID NO: 76208 - DNA, 30 bp, Artificial Sequence
  Description of Artificial Sequence: Synthetic oligonucleotide
ttggatctgtggtctctggagctgtggttg

SEQ ID NO: 76209 - DNA, 29 bp, Artificial Sequence
  Description of Artificial Sequence: Synthetic oligonucleotide
tggatctgtggtctctggagctgtggttg

SEQ ID NO: 76210 - DNA, 28 bp, Artificial Sequence
  Description of Artificial Sequence: Synthetic oligonucleotide
ggatctgtggtctctggagctgtggttg

SEQ ID NO: 76211 - DNA, 28 bp, Artificial Sequence
  Description of Artificial Sequence: Synthetic oligonucleotide
gatctgtggtctctggagctgtggttgc

SEQ ID NO: 76212 - DNA, 29 bp, Artificial Sequence
  Description of Artificial Sequence: Synthetic oligonucleotide
atctgtggtctctggagctgtggttgctg

SEQ ID NO: 76213 - DNA, 28 bp, Artificial Sequence
  Description of Artificial Sequence: Synthetic oligonucleotide
tctgtggtctctggagctgtggttgctg

SEQ ID NO: 76214 - DNA, 27 bp, Artificial Sequence
  Description of Artificial Sequence: Synthetic oligonucleotide
ctgtggtctctggagctgtggttgctg

SEQ ID NO: 76215 - DNA, 27 bp, Artificial Sequence
  Description of Artificial Sequence: Synthetic oligonucleotide
tgtggtctctggagctgtggttgctgc

SEQ ID NO: 76216 - DNA, 27 bp, Artificial Sequence
  Description of Artificial Sequence: Synthetic oligonucleotide
gtggtctctggagctgtggttgctgct

SEQ ID NO: 76217 - DNA, 27 bp, Artificial Sequence
  Description of Artificial Sequence: Synthetic oligonucleotide
tggtctctggagctgtggttgctgctg

SEQ ID NO: 76218 - DNA, 27 bp, Artificial Sequence
  Description of Artificial Sequence: Synthetic oligonucleotide
ggtctctggagctgtggttgctgctgt

SEQ ID NO: 76219 - DNA, 27 bp, Artificial Sequence
  Description of Artificial Sequence: Synthetic oligonucleotide
gtctctggagctgtggttgctgctgtg

SEQ ID NO: 76220 - DNA, 31 bp, Artificial Sequence
  Description of Artificial Sequence: Synthetic oligonucleotide
tctctggagctgtggttgctgctgtgatatg

SEQ ID NO: 76221 - DNA, 30 bp, Artificial Sequence
  Description of Artificial Sequence: Synthetic oligonucleotide
ctctggagctgtggttgctgctgtgatatg

SEQ ID NO: 76222 - DNA, 30 bp, Artificial Sequence
  Description of Artificial Sequence: Synthetic oligonucleotide
tctggagctgtggttgctgctgtgatatgg

SEQ ID NO: 76223 - DNA, 29 bp, Artificial Sequence
  Description of Artificial Sequence: Synthetic oligonucleotide
ctggagctgtggttgctgctgtgatatgg

SEQ ID NO: 76224 - DNA, 30 bp, Artificial Sequence
  Description of Artificial Sequence: Synthetic oligonucleotide
tggagctgtggttgctgctgtgatatggag

SEQ ID NO: 76225 - DNA, 29 bp, Artificial Sequence
  Description of Artificial Sequence: Synthetic oligonucleotide
ggagctgtggttgctgctgtgatatggag

SEQ ID NO: 76226 - DNA, 29 bp, Artificial Sequence
  Description of Artificial Sequence: Synthetic oligonucleotide
gagctgtggttgctgctgtgatatggagg

SEQ ID NO: 76227 - DNA, 31 bp, Artificial Sequence
  Description of Artificial Sequence: Synthetic oligonucleotide
agctgtggttgctgctgtgatatggaggaag

SEQ ID NO: 76228 - DNA, 30 bp, Artificial Sequence
  Description of Artificial Sequence: Synthetic oligonucleotide
gctgtggttgctgctgtgatatggaggaag

SEQ ID NO: 76229 - DNA, 32 bp, Artificial Sequence
  Description of Artificial Sequence: Synthetic oligonucleotide
ctgtggttgctgctgtgatatggaggaagaag

SEQ ID NO: 76230 - DNA, 33 bp, Artificial Sequence
  Description of Artificial Sequence: Synthetic oligonucleotide
tgtggttgctgctgtgatatggaggaagaagag

SEQ ID NO: 76231 - DNA, 32 bp, Artificial Sequence
  Description of Artificial Sequence: Synthetic oligonucleotide
gtggttgctgctgtgatatggaggaagaagag

SEQ ID NO: 76232 - DNA, 32 bp, Artificial Sequence
  Description of Artificial Sequence: Synthetic oligonucleotide
tggttgctgctgtgatatggaggaagaagagc

SEQ ID NO: 76233 - DNA, 31 bp, Artificial Sequence
  Description of Artificial Sequence: Synthetic oligonucleotide
ggttgctgctgtgatatggaggaagaagagc

SEQ ID NO: 76234 - DNA, 32 bp, Artificial Sequence
  Description of Artificial Sequence: Synthetic oligonucleotide
gttgctgctgtgatatggaggaagaagagctc

SEQ ID NO: 76235 - DNA, 33 bp, Artificial Sequence
  Description of Artificial Sequence: Synthetic oligonucleotide
ttgctgctgtgatatggaggaagaagagctcag

SEQ ID NO: 76236 - DNA, 32 bp, Artificial Sequence
  Description of Artificial Sequence: Synthetic oligonucleotide
tgctgctgtgatatggaggaagaagagctcag

SEQ ID NO: 76237 - DNA, 31 bp, Artificial Sequence
  Description of Artificial Sequence: Synthetic oligonucleotide
gctgctgtgatatggaggaagaagagctcag

SEQ ID NO: 76238 - DNA, 31 bp, Artificial Sequence
  Description of Artificial Sequence: Synthetic oligonucleotide
ctgctgtgatatggaggaagaagagctcagg

SEQ ID NO: 76239 - DNA, 32 bp, Artificial Sequence
  Description of Artificial Sequence: Synthetic oligonucleotide
tgctgtgatatggaggaagaagagctcaggtg

SEQ ID NO: 76240 - DNA, 31 bp, Artificial Sequence
  Description of Artificial Sequence: Synthetic oligonucleotide
gctgtgatatggaggaagaagagctcaggtg

SEQ ID NO: 76241 - DNA, 31 bp, Artificial Sequence
  Description of Artificial Sequence: Synthetic oligonucleotide
ctgtgatatggaggaagaagagctcaggtgg

SEQ ID NO: 76242 - DNA, 35 bp, Artificial Sequence
  Description of Artificial Sequence: Synthetic oligonucleotide
tgtgatatggaggaagaagagctcaggtggaaaag

SEQ ID NO: 76243 - DNA, 34 bp, Artificial Sequence
  Description of Artificial Sequence: Synthetic oligonucleotide
gtgatatggaggaagaagagctcaggtggaaaag

SEQ ID NO: 76244 - DNA, 34 bp, Artificial Sequence
  Description of Artificial Sequence: Synthetic oligonucleotide
tgatatggaggaagaagagctcaggtggaaaagg

SEQ ID NO: 76245 - DNA, 33 bp, Artificial Sequence
  Description of Artificial Sequence: Synthetic oligonucleotide
gatatggaggaagaagagctcaggtggaaaagg

SEQ ID NO: 76246 - DNA, 34 bp, Artificial Sequence
  Description of Artificial Sequence: Synthetic oligonucleotide
atatggaggaagaagagctcaggtggaaaaggag

SEQ ID NO: 76247 - DNA, 33 bp, Artificial Sequence
  Description of Artificial Sequence: Synthetic oligonucleotide
tatggaggaagaagagctcaggtggaaaaggag

SEQ ID NO: 76248 - DNA, 32 bp, Artificial Sequence
  Description of Artificial Sequence: Synthetic oligonucleotide
atggaggaagaagagctcaggtggaaaaggag

SEQ ID NO: 76249 - DNA, 31 bp, Artificial Sequence
  Description of Artificial Sequence: Synthetic oligonucleotide
tggaggaagaagagctcaggtggaaaaggag

SEQ ID NO: 76250 - DNA, 30 bp, Artificial Sequence
  Description of Artificial Sequence: Synthetic oligonucleotide
ggaggaagaagagctcaggtggaaaaggag

SEQ ID NO: 76251 - DNA, 30 bp, Artificial Sequence
  Description of Artificial Sequence: Synthetic oligonucleotide
gaggaagaagagctcaggtggaaaaggagg

SEQ ID NO: 76252 - DNA, 30 bp, Artificial Sequence
  Description of Artificial Sequence: Synthetic oligonucleotide
aggaagaagagctcaggtggaaaaggaggg

SEQ ID NO: 76253 - DNA, 29 bp, Artificial Sequence
  Description of Artificial Sequence: Synthetic oligonucleotide
ggaagaagagctcaggtggaaaaggaggg

SEQ ID NO: 76254 - DNA, 30 bp, Artificial Sequence
  Description of Artificial Sequence: Synthetic oligonucleotide
gaagaagagctcaggtggaaaaggagggag

SEQ ID NO: 76255 - DNA, 30 bp, Artificial Sequence
  Description of Artificial Sequence: Synthetic oligonucleotide
aagaagagctcaggtggaaaaggagggagc

SEQ ID NO: 76256 - DNA, 29 bp, Artificial Sequence
  Description of Artificial Sequence: Synthetic oligonucleotide
agaagagctcaggtggaaaaggagggagc

SEQ ID NO: 76257 - DNA, 31 bp, Artificial Sequence
  Description of Artificial Sequence: Synthetic oligonucleotide
ctcaggtggaaaaggagggagctactctaag

SEQ ID NO: 76258 - DNA, 31 bp, Artificial Sequence
  Description of Artificial Sequence: Synthetic oligonucleotide
tcaggtggaaaaggagggagctactctaagg

SEQ ID NO: 76259 - DNA, 30 bp, Artificial Sequence
  Description of Artificial Sequence: Synthetic oligonucleotide
caggtggaaaaggagggagctactctaagg

SEQ ID NO: 76260 - DNA, 30 bp, Artificial Sequence
  Description of Artificial Sequence: Synthetic oligonucleotide
aggtggaaaaggagggagctactctaaggc

SEQ ID NO: 76261 - DNA, 29 bp, Artificial Sequence
  Description of Artificial Sequence: Synthetic oligonucleotide
ggtggaaaaggagggagctactctaaggc

SEQ ID NO: 76262 - DNA, 30 bp, Artificial Sequence
  Description of Artificial Sequence: Synthetic oligonucleotide
gtggaaaaggagggagctactctaaggctg

SEQ ID NO: 76263 - DNA, 31 bp, Artificial Sequence
  Description of Artificial Sequence: Synthetic oligonucleotide
tggaaaaggagggagctactctaaggctgag

SEQ ID NO: 76264 - DNA, 30 bp, Artificial Sequence
  Description of Artificial Sequence: Synthetic oligonucleotide
ggaaaaggagggagctactctaaggctgag

SEQ ID NO: 76265 - DNA, 31 bp, Artificial Sequence
  Description of Artificial Sequence: Synthetic oligonucleotide
gaaaaggagggagctactctaaggctgagtg

SEQ ID NO: 76266 - DNA, 31 bp, Artificial Sequence
  Description of Artificial Sequence: Synthetic oligonucleotide
aaaaggagggagctactctaaggctgagtgg

SEQ ID NO: 76267 - DNA, 30 bp, Artificial Sequence
  Description of Artificial Sequence: Synthetic oligonucleotide
aaaggagggagctactctaaggctgagtgg

SEQ ID NO: 76268 - DNA, 29 bp, Artificial Sequence
  Description of Artificial Sequence: Synthetic oligonucleotide
aaggagggagctactctaaggctgagtgg

SEQ ID NO: 76269 - DNA, 28 bp, Artificial Sequence
  Description of Artificial Sequence: Synthetic oligonucleotide
aggagggagctactctaaggctgagtgg

SEQ ID NO: 76270 - DNA, 27 bp, Artificial Sequence
  Description of Artificial Sequence: Synthetic oligonucleotide
ggagggagctactctaaggctgagtgg

SEQ ID NO: 76271 - DNA, 28 bp, Artificial Sequence
  Description of Artificial Sequence: Synthetic oligonucleotide
gagggagctactctaaggctgagtggag

SEQ ID NO: 76272 - DNA, 28 bp, Artificial Sequence
  Description of Artificial Sequence: Synthetic oligonucleotide
agggagctactctaaggctgagtggagc

SEQ ID NO: 76273 - DNA, 27 bp, Artificial Sequence
  Description of Artificial Sequence: Synthetic oligonucleotide
gggagctactctaaggctgagtggagc

SEQ ID NO: 76274 - DNA, 27 bp, Artificial Sequence
  Description of Artificial Sequence: Synthetic oligonucleotide
ggagctactctaaggctgagtggagcg

SEQ ID NO: 76275 - DNA, 28 bp, Artificial Sequence
  Description of Artificial Sequence: Synthetic oligonucleotide
gagctactctaaggctgagtggagcgac

SEQ ID NO: 76276 - DNA, 29 bp, Artificial Sequence
  Description of Artificial Sequence: Synthetic oligonucleotide
agctactctaaggctgagtggagcgacag

SEQ ID NO: 76277 - DNA, 28 bp, Artificial Sequence
  Description of Artificial Sequence: Synthetic oligonucleotide
gctactctaaggctgagtggagcgacag

SEQ ID NO: 76278 - DNA, 29 bp, Artificial Sequence
  Description of Artificial Sequence: Synthetic oligonucleotide
ctactctaaggctgagtggagcgacagtg

SEQ ID NO: 76279 - DNA, 29 bp, Artificial Sequence
  Description of Artificial Sequence: Synthetic oligonucleotide
tactctaaggctgagtggagcgacagtgc

SEQ ID NO: 76280 - DNA, 28 bp, Artificial Sequence
  Description of Artificial Sequence: Synthetic oligonucleotide
actctaaggctgagtggagcgacagtgc

SEQ ID NO: 76281 - DNA, 27 bp, Artificial Sequence
  Description of Artificial Sequence: Synthetic oligonucleotide
ctctaaggctgagtggagcgacagtgc

SEQ ID NO: 76282 - DNA, 27 bp, Artificial Sequence
  Description of Artificial Sequence: Synthetic oligonucleotide
tctaaggctgagtggagcgacagtgcc

SEQ ID NO: 76283 - DNA, 26 bp, Artificial Sequence
  Description of Artificial Sequence: Synthetic oligonucleotide
ctaaggctgagtggagcgacagtgcc

SEQ ID NO: 76284 - DNA, 27 bp, Artificial Sequence
  Description of Artificial Sequence: Synthetic oligonucleotide
taaggctgagtggagcgacagtgccca

SEQ ID NO: 76285 - DNA, 26 bp, Artificial Sequence
  Description of Artificial Sequence: Synthetic oligonucleotide
aaggctgagtggagcgacagtgccca

SEQ ID NO: 76286 - DNA, 25 bp, Artificial Sequence
  Description of Artificial Sequence: Synthetic oligonucleotide
aggctgagtggagcgacagtgccca

SEQ ID NO: 76287 - DNA, 24 bp, Artificial Sequence
  Description of Artificial Sequence: Synthetic oligonucleotide
ggctgagtggagcgacagtgccca

SEQ ID NO: 76288 - DNA, 24 bp, Artificial Sequence
  Description of Artificial Sequence: Synthetic oligonucleotide
gctgagtggagcgacagtgcccag

SEQ ID NO: 76289 - DNA, 24 bp, Artificial Sequence
  Description of Artificial Sequence: Synthetic oligonucleotide
ctgagtggagcgacagtgcccagg

SEQ ID NO: 76290 - DNA, 24 bp, Artificial Sequence
  Description of Artificial Sequence: Synthetic oligonucleotide
tgagtggagcgacagtgcccaggg

SEQ ID NO: 76291 - DNA, 23 bp, Artificial Sequence
  Description of Artificial Sequence: Synthetic oligonucleotide
gagtggagcgacagtgcccaggg

SEQ ID NO: 76292 - DNA, 24 bp, Artificial Sequence
  Description of Artificial Sequence: Synthetic oligonucleotide
agtggagcgacagtgcccaggggt

SEQ ID NO: 76293 - DNA, 23 bp, Artificial Sequence
  Description of Artificial Sequence: Synthetic oligonucleotide
gtggagcgacagtgcccaggggt

SEQ ID NO: 76294 - DNA, 24 bp, Artificial Sequence
  Description of Artificial Sequence: Synthetic oligonucleotide
tggagcgacagtgcccaggggtct

SEQ ID NO: 76295 - DNA, 23 bp, Artificial Sequence
  Description of Artificial Sequence: Synthetic oligonucleotide
ggagcgacagtgcccaggggtct

SEQ ID NO: 76296 - DNA, 24 bp, Artificial Sequence
  Description of Artificial Sequence: Synthetic oligonucleotide
gagcgacagtgcccaggggtctga

SEQ ID NO: 76297 - DNA, 25 bp, Artificial Sequence
  Description of Artificial Sequence: Synthetic oligonucleotide
agcgacagtgcccaggggtctgagt

SEQ ID NO: 76298 - DNA, 24 bp, Artificial Sequence
  Description of Artificial Sequence: Synthetic oligonucleotide
gcgacagtgcccaggggtctgagt

SEQ ID NO: 76299 - DNA, 25 bp, Artificial Sequence
  Description of Artificial Sequence: Synthetic oligonucleotide
cgacagtgcccaggggtctgagtct

SEQ ID NO: 76300 - DNA, 26 bp, Artificial Sequence
  Description of Artificial Sequence: Synthetic oligonucleotide
gacagtgcccaggggtctgagtctca

SEQ ID NO: 76301 - DNA, 27 bp, Artificial Sequence
  Description of Artificial Sequence: Synthetic oligonucleotide
acagtgcccaggggtctgagtctcaca

SEQ ID NO: 76302 - DNA, 26 bp, Artificial Sequence
  Description of Artificial Sequence: Synthetic oligonucleotide
cagtgcccaggggtctgagtctcaca

SEQ ID NO: 76303 - DNA, 26 bp, Artificial Sequence
  Description of Artificial Sequence: Synthetic oligonucleotide
agtgcccaggggtctgagtctcacag

SEQ ID NO: 76304 - DNA, 25 bp, Artificial Sequence
  Description of Artificial Sequence: Synthetic oligonucleotide
gtgcccaggggtctgagtctcacag

SEQ ID NO: 76305 - DNA, 27 bp, Artificial Sequence
  Description of Artificial Sequence: Synthetic oligonucleotide
tgcccaggggtctgagtctcacagctt

SEQ ID NO: 76306 - DNA, 26 bp, Artificial Sequence
  Description of Artificial Sequence: Synthetic oligonucleotide
gcccaggggtctgagtctcacagctt

SEQ ID NO: 76307 - DNA, 27 bp, Artificial Sequence
  Description of Artificial Sequence: Synthetic oligonucleotide
cccaggggtctgagtctcacagcttgt

SEQ ID NO: 76308 - DNA, 20 bp, Artificial Sequence
  Description of Artificial Sequence: Synthetic oligonucleotide
gctgcgagctggggcccgac

SEQ ID NO: 76309 - DNA, 20 bp, Artificial Sequence
  Description of Artificial Sequence: Synthetic oligonucleotide
ctgcgagctggggcccgacg

SEQ ID NO: 76310 - DNA, 20 bp, Artificial Sequence
  Description of Artificial Sequence: Synthetic oligonucleotide
tgcgagctggggcccgacgg

SEQ ID NO: 76311 - DNA, 20 bp, Artificial Sequence
  Description of Artificial Sequence: Synthetic oligonucleotide
gcgagctggggcccgacggt

SEQ ID NO: 76312 - DNA, 20 bp, Artificial Sequence
  Description of Artificial Sequence: Synthetic oligonucleotide
cgagctggggcccgacgggt

SEQ ID NO: 76313 - DNA, 20 bp, Artificial Sequence
  Description of Artificial Sequence: Synthetic oligonucleotide
gagctggggcccgacgggct

SEQ ID NO: 76314 - DNA, 20 bp, Artificial Sequence
  Description of Artificial Sequence: Synthetic oligonucleotide
agctggggcccgacgggcgt

SEQ ID NO: 76315 - DNA, 20 bp, Artificial Sequence
  Description of Artificial Sequence: Synthetic oligonucleotide
gctggggcccgacgggcgtt

SEQ ID NO: 76316 - DNA, 31 bp, Artificial Sequence
  Description of Artificial Sequence: Synthetic oligonucleotide
agggacaccgcacagattttccgagtgaatc

SEQ ID NO: 76317 - DNA, 30 bp, Artificial Sequence
  Description of Artificial Sequence: Synthetic oligonucleotide
gggacaccgcacagattttccgagtgaatc

SEQ ID NO: 76318 - DNA, 31 bp, Artificial Sequence
  Description of Artificial Sequence: Synthetic oligonucleotide
ggacaccgcacagattttccgagtgaatctg

SEQ ID NO: 76319 - DNA, 31 bp, Artificial Sequence
  Description of Artificial Sequence: Synthetic oligonucleotide
gacaccgcacagattttccgagtgaatctgc

SEQ ID NO: 76320 - DNA, 31 bp, Artificial Sequence
  Description of Artificial Sequence: Synthetic oligonucleotide
acaccgcacagattttccgagtgaatctgcg

SEQ ID NO: 76321 - DNA, 30 bp, Artificial Sequence
  Description of Artificial Sequence: Synthetic oligonucleotide
caccgcacagattttccgagtgaatctgcg

SEQ ID NO: 76322 - DNA, 30 bp, Artificial Sequence
  Description of Artificial Sequence: Synthetic oligonucleotide
accgcacagattttccgagtgaatctgcgg

SEQ ID NO: 76323 - DNA, 29 bp, Artificial Sequence
  Description of Artificial Sequence: Synthetic oligonucleotide
ccgcacagattttccgagtgaatctgcgg

SEQ ID NO: 76324 - DNA, 30 bp, Artificial Sequence
  Description of Artificial Sequence: Synthetic oligonucleotide
cgcacagattttccgagtgaatctgcggac

SEQ ID NO: 76325 - DNA, 30 bp, Artificial Sequence
  Description of Artificial Sequence: Synthetic oligonucleotide
gcacagattttccgagtgaatctgcggacg

SEQ ID NO: 76326 - DNA, 30 bp, Artificial Sequence
  Description of Artificial Sequence: Synthetic oligonucleotide
cacagattttccgagtgaatctgcggacgc

SEQ ID NO: 76327 - DNA, 31 bp, Artificial Sequence
  Description of Artificial Sequence: Synthetic oligonucleotide
acagattttccgagtgaatctgcggacgctg

SEQ ID NO: 76328 - DNA, 30 bp, Artificial Sequence
  Description of Artificial Sequence: Synthetic oligonucleotide
cagattttccgagtgaatctgcggacgctg

SEQ ID NO: 76329 - DNA, 30 bp, Artificial Sequence
  Description of Artificial Sequence: Synthetic oligonucleotide
agattttccgagtgaatctgcggacgctgc

SEQ ID NO: 76330 - DNA, 29 bp, Artificial Sequence
  Description of Artificial Sequence: Synthetic oligonucleotide
gattttccgagtgaatctgcggacgctgc

SEQ ID NO: 76331 - DNA, 29 bp, Artificial Sequence
  Description of Artificial Sequence: Synthetic oligonucleotide
attttccgagtgaatctgcggacgctgcg

SEQ ID NO: 76332 - DNA, 28 bp, Artificial Sequence
  Description of Artificial Sequence: Synthetic oligonucleotide
ttttccgagtgaatctgcggacgctgcg

SEQ ID NO: 76333 - DNA, 27 bp, Artificial Sequence
  Description of Artificial Sequence: Synthetic oligonucleotide
tttccgagtgaatctgcggacgctgcg

SEQ ID NO: 76334 - DNA, 26 bp, Artificial Sequence
  Description of Artificial Sequence: Synthetic oligonucleotide
ttccgagtgaatctgcggacgctgcg

SEQ ID NO: 76335 - DNA, 25 bp, Artificial Sequence
  Description of Artificial Sequence: Synthetic oligonucleotide
tccgagtgaatctgcggacgctgcg

SEQ ID NO: 76336 - DNA, 24 bp, Artificial Sequence
  Description of Artificial Sequence: Synthetic oligonucleotide
ccgagtgaatctgcggacgctgcg

SEQ ID NO: 76337 - DNA, 24 bp, Artificial Sequence
  Description of Artificial Sequence: Synthetic oligonucleotide
cgagtgaatctgcggacgctgcgc

SEQ ID NO: 76338 - DNA, 24 bp, Artificial Sequence
  Description of Artificial Sequence: Synthetic oligonucleotide
gagtgaatctgcggacgctgcgcg

SEQ ID NO: 76339 - DNA, 24 bp, Artificial Sequence
  Description of Artificial Sequence: Synthetic oligonucleotide
agtgaatctgcggacgctgcgcgg

SEQ ID NO: 76340 - DNA, 23 bp, Artificial Sequence
  Description of Artificial Sequence: Synthetic oligonucleotide
gtgaatctgcggacgctgcgcgg

SEQ ID NO: 76341 - DNA, 25 bp, Artificial Sequence
  Description of Artificial Sequence: Synthetic oligonucleotide
tgaatctgcggacgctgcgcggcta

SEQ ID NO: 76342 - DNA, 24 bp, Artificial Sequence
  Description of Artificial Sequence: Synthetic oligonucleotide
gaatctgcggacgctgcgcggcta

SEQ ID NO: 76343 - DNA, 26 bp, Artificial Sequence
  Description of Artificial Sequence: Synthetic oligonucleotide
aatctgcggacgctgcgcggctacta

SEQ ID NO: 76344 - DNA, 25 bp, Artificial Sequence
  Description of Artificial Sequence: Synthetic oligonucleotide
atctgcggacgctgcgcggctacta

SEQ ID NO: 76345 - DNA, 24 bp, Artificial Sequence
  Description of Artificial Sequence: Synthetic oligonucleotide
tctgcggacgctgcgcggctacta

SEQ ID NO: 76346 - DNA, 35 bp, Artificial Sequence
  Description of Artificial Sequence: Synthetic oligonucleotide
gctcagatctccgagcaaaagtcaaatgatgcttc

SEQ ID NO: 76347 - DNA, 36 bp, Artificial Sequence
  Description of Artificial Sequence: Synthetic oligonucleotide
ctcagatctccgagcaaaagtcaaatgatgcttctg

SEQ ID NO: 76348 - DNA, 37 bp, Artificial Sequence
  Description of Artificial Sequence: Synthetic oligonucleotide
tcagatctccgagcaaaagtcaaatgatgcttctgag

SEQ ID NO: 76349 - DNA, 36 bp, Artificial Sequence
  Description of Artificial Sequence: Synthetic oligonucleotide
cagatctccgagcaaaagtcaaatgatgcttctgag

SEQ ID NO: 76350 - DNA, 36 bp, Artificial Sequence
  Description of Artificial Sequence: Synthetic oligonucleotide
agatctccgagcaaaagtcaaatgatgcttctgagg

SEQ ID NO: 76351 - DNA, 35 bp, Artificial Sequence
  Description of Artificial Sequence: Synthetic oligonucleotide
gatctccgagcaaaagtcaaatgatgcttctgagg

SEQ ID NO: 76352 - DNA, 35 bp, Artificial Sequence
  Description of Artificial Sequence: Synthetic oligonucleotide
atctccgagcaaaagtcaaatgatgcttctgaggc

SEQ ID NO: 76353 - DNA, 34 bp, Artificial Sequence
  Description of Artificial Sequence: Synthetic oligonucleotide
tctccgagcaaaagtcaaatgatgcttctgaggc

SEQ ID NO: 76354 - DNA, 33 bp, Artificial Sequence
  Description of Artificial Sequence: Synthetic oligonucleotide
ctccgagcaaaagtcaaatgatgcttctgaggc

SEQ ID NO: 76355 - DNA, 33 bp, Artificial Sequence
  Description of Artificial Sequence: Synthetic oligonucleotide
tccgagcaaaagtcaaatgatgcttctgaggcg

SEQ ID NO: 76356 - DNA, 32 bp, Artificial Sequence
  Description of Artificial Sequence: Synthetic oligonucleotide
ccgagcaaaagtcaaatgatgcttctgaggcg

SEQ ID NO: 76357 - DNA, 32 bp, Artificial Sequence
  Description of Artificial Sequence: Synthetic oligonucleotide
cgagcaaaagtcaaatgatgcttctgaggcgg

SEQ ID NO: 76358 - DNA, 33 bp, Artificial Sequence
  Description of Artificial Sequence: Synthetic oligonucleotide
gagcaaaagtcaaatgatgcttctgaggcggag

SEQ ID NO: 76359 - DNA, 33 bp, Artificial Sequence
  Description of Artificial Sequence: Synthetic oligonucleotide
agcaaaagtcaaatgatgcttctgaggcggagc

SEQ ID NO: 76360 - DNA, 32 bp, Artificial Sequence
  Description of Artificial Sequence: Synthetic oligonucleotide
gcaaaagtcaaatgatgcttctgaggcggagc

SEQ ID NO: 76361 - DNA, 33 bp, Artificial Sequence
  Description of Artificial Sequence: Synthetic oligonucleotide
caaaagtcaaatgatgcttctgaggcggagcac

SEQ ID NO: 76362 - DNA, 33 bp, Artificial Sequence
  Description of Artificial Sequence: Synthetic oligonucleotide
aaaagtcaaatgatgcttctgaggcggagcacc

SEQ ID NO: 76363 - DNA, 32 bp, Artificial Sequence
  Description of Artificial Sequence: Synthetic oligonucleotide
aaagtcaaatgatgcttctgaggcggagcacc

SEQ ID NO: 76364 - DNA, 31 bp, Artificial Sequence
  Description of Artificial Sequence: Synthetic oligonucleotide
aagtcaaatgatgcttctgaggcggagcacc

SEQ ID NO: 76365 - DNA, 30 bp, Artificial Sequence
  Description of Artificial Sequence: Synthetic oligonucleotide
agtcaaatgatgcttctgaggcggagcacc

SEQ ID NO: 76366 - DNA, 29 bp, Artificial Sequence
  Description of Artificial Sequence: Synthetic oligonucleotide
gtcaaatgatgcttctgaggcggagcacc

SEQ ID NO: 76367 - DNA, 30 bp, Artificial Sequence
  Description of Artificial Sequence: Synthetic oligonucleotide
tcaaatgatgcttctgaggcggagcaccag

SEQ ID NO: 76368 - DNA, 29 bp, Artificial Sequence
  Description of Artificial Sequence: Synthetic oligonucleotide
caaatgatgcttctgaggcggagcaccag

SEQ ID NO: 76369 - DNA, 30 bp, Artificial Sequence
  Description of Artificial Sequence: Synthetic oligonucleotide
aaatgatgcttctgaggcggagcaccagag

SEQ ID NO: 76370 - DNA, 29 bp, Artificial Sequence
  Description of Artificial Sequence: Synthetic oligonucleotide
aatgatgcttctgaggcggagcaccagag

SEQ ID NO: 76371 - DNA, 28 bp, Artificial Sequence
  Description of Artificial Sequence: Synthetic oligonucleotide
atgatgcttctgaggcggagcaccagag

SEQ ID NO: 76372 - DNA, 27 bp, Artificial Sequence
  Description of Artificial Sequence: Synthetic oligonucleotide
tgatgcttctgaggcggagcaccagag

SEQ ID NO: 76373 - DNA, 27 bp, Artificial Sequence
  Description of Artificial Sequence: Synthetic oligonucleotide
gatgcttctgaggcggagcaccagaga

SEQ ID NO: 76374 - DNA, 27 bp, Artificial Sequence
  Description of Artificial Sequence: Synthetic oligonucleotide
atgcttctgaggcggagcaccagagag

SEQ ID NO: 76375 - DNA, 26 bp, Artificial Sequence
  Description of Artificial Sequence: Synthetic oligonucleotide
tgcttctgaggcggagcaccagagag

SEQ ID NO: 76376 - DNA, 25 bp, Artificial Sequence
  Description of Artificial Sequence: Synthetic oligonucleotide
gcttctgaggcggagcaccagagag

SEQ ID NO: 76377 - DNA, 25 bp, Artificial Sequence
  Description of Artificial Sequence: Synthetic oligonucleotide
cttctgaggcggagcaccagagagc

SEQ ID NO: 76378 - DNA, 27 bp, Artificial Sequence
  Description of Artificial Sequence: Synthetic oligonucleotide
ttctgaggcggagcaccagagagccta

SEQ ID NO: 76379 - DNA, 28 bp, Artificial Sequence
  Description of Artificial Sequence: Synthetic oligonucleotide
tgcagagatcacactgacctggcagcag

SEQ ID NO: 76380 - DNA, 27 bp, Artificial Sequence
  Description of Artificial Sequence: Synthetic oligonucleotide
gcagagatcacactgacctggcagcag

SEQ ID NO: 76381 - DNA, 27 bp, Artificial Sequence
  Description of Artificial Sequence: Synthetic oligonucleotide
cagagatcacactgacctggcagcagg

SEQ ID NO: 76382 - DNA, 29 bp, Artificial Sequence
  Description of Artificial Sequence: Synthetic oligonucleotide
agagatcacactgacctggcagcaggatg

SEQ ID NO: 76383 - DNA, 26 bp, Artificial Sequence
  Description of Artificial Sequence: Synthetic oligonucleotide
atgatgcctctgaggcggagcaccag

SEQ ID NO: 76384 - DNA, 25 bp, Artificial Sequence
  Description of Artificial Sequence: Synthetic oligonucleotide
tgatgcctctgaggcggagcaccag

SEQ ID NO: 76385 - DNA, 24 bp, Artificial Sequence
  Description of Artificial Sequence: Synthetic oligonucleotide
gatgcctctgaggcggagcaccag

SEQ ID NO: 76386 - DNA, 24 bp, Artificial Sequence
  Description of Artificial Sequence: Synthetic oligonucleotide
atgcctctgaggcggagcaccagg

SEQ ID NO: 76387 - DNA, 23 bp, Artificial Sequence
  Description of Artificial Sequence: Synthetic oligonucleotide
tgcctctgaggcggagcaccagg

SEQ ID NO: 76388 - DNA, 22 bp, Artificial Sequence
  Description of Artificial Sequence: Synthetic oligonucleotide
gcctctgaggcggagcaccagg

SEQ ID NO: 76389 - DNA, 23 bp, Artificial Sequence
  Description of Artificial Sequence: Synthetic oligonucleotide
cctctgaggcggagcaccaggga

SEQ ID NO: 76390 - DNA, 23 bp, Artificial Sequence
  Description of Artificial Sequence: Synthetic oligonucleotide
ctctgaggcggagcaccagggag

SEQ ID NO: 76391 - DNA, 23 bp, Artificial Sequence
  Description of Artificial Sequence: Synthetic oligonucleotide
tctgaggcggagcaccagggagc

SEQ ID NO: 76392 - DNA, 22 bp, Artificial Sequence
  Description of Artificial Sequence: Synthetic oligonucleotide
ctgaggcggagcaccagggagc

SEQ ID NO: 76393 - DNA, 24 bp, Artificial Sequence
  Description of Artificial Sequence: Synthetic oligonucleotide
tgaggcggagcaccagggagccta

SEQ ID NO: 76394 - DNA, 23 bp, Artificial Sequence
  Description of Artificial Sequence: Synthetic oligonucleotide
gaggcggagcaccagggagccta

SEQ ID NO: 76395 - DNA, 23 bp, Artificial Sequence
  Description of Artificial Sequence: Synthetic oligonucleotide
aggcggagcaccagggagcctac

SEQ ID NO: 76396 - DNA, 22 bp, Artificial Sequence
  Description of Artificial Sequence: Synthetic oligonucleotide
ggcggagcaccagggagcctac

SEQ ID NO: 76397 - DNA, 23 bp, Artificial Sequence
  Description of Artificial Sequence: Synthetic oligonucleotide
gcggagcaccagggagcctacct

SEQ ID NO: 76398 - DNA, 23 bp, Artificial Sequence
  Description of Artificial Sequence: Synthetic oligonucleotide
cggagcaccagggagcctacctg

SEQ ID NO: 76399 - DNA, 25 bp, Artificial Sequence
  Description of Artificial Sequence: Synthetic oligonucleotide
ggagcaccagggagcctacctggaa

SEQ ID NO: 76400 - DNA, 26 bp, Artificial Sequence
  Description of Artificial Sequence: Synthetic oligonucleotide
gagcaccagggagcctacctggaaga

SEQ ID NO: 76401 - DNA, 27 bp, Artificial Sequence
  Description of Artificial Sequence: Synthetic oligonucleotide
agcaccagggagcctacctggaagaca

SEQ ID NO: 76402 - DNA, 26 bp, Artificial Sequence
  Description of Artificial Sequence: Synthetic oligonucleotide
gcaccagggagcctacctggaagaca

SEQ ID NO: 76403 - DNA, 27 bp, Artificial Sequence
  Description of Artificial Sequence: Synthetic oligonucleotide
caccagggagcctacctggaagacaca

SEQ ID NO: 76404 - DNA, 28 bp, Artificial Sequence
  Description of Artificial Sequence: Synthetic oligonucleotide
accagggagcctacctggaagacacatg

SEQ ID NO: 76405 - DNA, 27 bp, Artificial Sequence
  Description of Artificial Sequence: Synthetic oligonucleotide
ccagggagcctacctggaagacacatg

SEQ ID NO: 76406 - DNA, 27 bp, Artificial Sequence
  Description of Artificial Sequence: Synthetic oligonucleotide
cagggagcctacctggaagacacatgc

SEQ ID NO: 76407 - DNA, 27 bp, Artificial Sequence
  Description of Artificial Sequence: Synthetic oligonucleotide
agggagcctacctggaagacacatgcg

SEQ ID NO: 76408 - DNA, 27 bp, Artificial Sequence
  Description of Artificial Sequence: Synthetic oligonucleotide
gggagcctacctggaagacacatgcgt

SEQ ID NO: 76409 - DNA, 27 bp, Artificial Sequence
  Description of Artificial Sequence: Synthetic oligonucleotide
ggagcctacctggaagacacatgcgtg

SEQ ID NO: 76410 - DNA, 23 bp, Artificial Sequence
  Description of Artificial Sequence: Synthetic oligonucleotide
atggcgccccgaagcctcctcct

SEQ ID NO: 76411 - DNA, 22 bp, Artificial Sequence
  Description of Artificial Sequence: Synthetic oligonucleotide
tggcgccccgaagcctcctcct

SEQ ID NO: 76412 - DNA, 21 bp, Artificial Sequence
  Description of Artificial Sequence: Synthetic oligonucleotide
ggcgccccgaagcctcctcct

SEQ ID NO: 76413 - DNA, 21 bp, Artificial Sequence
  Description of Artificial Sequence: Synthetic oligonucleotide
gcgccccgaagcctcctcctg

SEQ ID NO: 76414 - DNA, 22 bp, Artificial Sequence
  Description of Artificial Sequence: Synthetic oligonucleotide
cgccccgaagcctcctcctgct

SEQ ID NO: 76415 - DNA, 22 bp, Artificial Sequence
  Description of Artificial Sequence: Synthetic oligonucleotide
gccccgaagcctcctcctgctg

SEQ ID NO: 76416 - DNA, 23 bp, Artificial Sequence
  Description of Artificial Sequence: Synthetic oligonucleotide
ccccgaagcctcctcctgctgct

SEQ ID NO: 76417 - DNA, 24 bp, Artificial Sequence
  Description of Artificial Sequence: Synthetic oligonucleotide
cccgaagcctcctcctgctgctct

SEQ ID NO: 76418 - DNA, 25 bp, Artificial Sequence
  Description of Artificial Sequence: Synthetic oligonucleotide
ccgaagcctcctcctgctgctctca

SEQ ID NO: 76419 - DNA, 25 bp, Artificial Sequence
  Description of Artificial Sequence: Synthetic oligonucleotide
cgaagcctcctcctgctgctctcag

SEQ ID NO: 76420 - DNA, 25 bp, Artificial Sequence
  Description of Artificial Sequence: Synthetic oligonucleotide
gaagcctcctcctgctgctctcagg

SEQ ID NO: 76421 - DNA, 25 bp, Artificial Sequence
  Description of Artificial Sequence: Synthetic oligonucleotide
aagcctcctcctgctgctctcaggg

SEQ ID NO: 76422 - DNA, 24 bp, Artificial Sequence
  Description of Artificial Sequence: Synthetic oligonucleotide
agcctcctcctgctgctctcaggg

SEQ ID NO: 76423 - DNA, 23 bp, Artificial Sequence
  Description of Artificial Sequence: Synthetic oligonucleotide
gcctcctcctgctgctctcaggg

SEQ ID NO: 76424 - DNA, 23 bp, Artificial Sequence
  Description of Artificial Sequence: Synthetic oligonucleotide
cctcctcctgctgctctcagggg

SEQ ID NO: 76425 - DNA, 23 bp, Artificial Sequence
  Description of Artificial Sequence: Synthetic oligonucleotide
ctcctcctgctgctctcaggggc

SEQ ID NO: 76426 - DNA, 23 bp, Artificial Sequence
  Description of Artificial Sequence: Synthetic oligonucleotide
tcctcctgctgctctcaggggcc

SEQ ID NO: 76427 - DNA, 22 bp, Artificial Sequence
  Description of Artificial Sequence: Synthetic oligonucleotide
cctcctgctgctctcaggggcc

SEQ ID NO: 76428 - DNA, 23 bp, Artificial Sequence
  Description of Artificial Sequence: Synthetic oligonucleotide
ctcctgctgctctcaggggccct

SEQ ID NO: 76429 - DNA, 23 bp, Artificial Sequence
  Description of Artificial Sequence: Synthetic oligonucleotide
tcctgctgctctcaggggccctg

SEQ ID NO: 76430 - DNA, 22 bp, Artificial Sequence
  Description of Artificial Sequence: Synthetic oligonucleotide
cctgctgctctcaggggccctg

SEQ ID NO: 76431 - DNA, 22 bp, Artificial Sequence
  Description of Artificial Sequence: Synthetic oligonucleotide
ctgctgctctcaggggccctgg

SEQ ID NO: 76432 - DNA, 22 bp, Artificial Sequence
  Description of Artificial Sequence: Synthetic oligonucleotide
tgctgctctcaggggccctggc

SEQ ID NO: 76433 - DNA, 21 bp, Artificial Sequence
  Description of Artificial Sequence: Synthetic oligonucleotide
gctgctctcaggggccctggc

SEQ ID NO: 76434 - DNA, 21 bp, Artificial Sequence
  Description of Artificial Sequence: Synthetic oligonucleotide
ctgctctcaggggccctggcc

SEQ ID NO: 76435 - DNA, 22 bp, Artificial Sequence
  Description of Artificial Sequence: Synthetic oligonucleotide
tgctctcaggggccctggccct

SEQ ID NO: 76436 - DNA, 21 bp, Artificial Sequence
  Description of Artificial Sequence: Synthetic oligonucleotide
gctctcaggggccctggccct

SEQ ID NO: 76437 - DNA, 22 bp, Artificial Sequence
  Description of Artificial Sequence: Synthetic oligonucleotide
ctctcaggggccctggccctga

SEQ ID NO: 76438 - DNA, 22 bp, Artificial Sequence
  Description of Artificial Sequence: Synthetic oligonucleotide
tctcaggggccctggccctgac

SEQ ID NO: 76439 - DNA, 21 bp, Artificial Sequence
  Description of Artificial Sequence: Synthetic oligonucleotide
ctcaggggccctggccctgac

SEQ ID NO: 76440 - DNA, 21 bp, Artificial Sequence
  Description of Artificial Sequence: Synthetic oligonucleotide
tcaggggccctggccctgacc

SEQ ID NO: 76441 - DNA, 20 bp, Artificial Sequence
  Description of Artificial Sequence: Synthetic oligonucleotide
caggggccctggccctgacc

SEQ ID NO: 76442 - DNA, 23 bp, Artificial Sequence
  Description of Artificial Sequence: Synthetic oligonucleotide
aggggccctggccctgaccgata

SEQ ID NO: 76443 - DNA, 22 bp, Artificial Sequence
  Description of Artificial Sequence: Synthetic oligonucleotide
ggggccctggccctgaccgata

SEQ ID NO: 76444 - DNA, 24 bp, Artificial Sequence
  Description of Artificial Sequence: Synthetic oligonucleotide
gggccctggccctgaccgatactt

SEQ ID NO: 76445 - DNA, 24 bp, Artificial Sequence
  Description of Artificial Sequence: Synthetic oligonucleotide
ggccctggccctgaccgatacttg

SEQ ID NO: 76446 - DNA, 24 bp, Artificial Sequence
  Description of Artificial Sequence: Synthetic oligonucleotide
gccctggccctgaccgatacttgg

SEQ ID NO: 76447 - DNA, 24 bp, Artificial Sequence
  Description of Artificial Sequence: Synthetic oligonucleotide
ccctggccctgaccgatacttggg

SEQ ID NO: 76448 - DNA, 24 bp, Artificial Sequence
  Description of Artificial Sequence: Synthetic oligonucleotide
cctggccctgaccgatacttgggc

SEQ ID NO: 76449 - DNA, 24 bp, Artificial Sequence
  Description of Artificial Sequence: Synthetic oligonucleotide
ctggccctgaccgatacttgggcg

SEQ ID NO: 76450 - DNA, 24 bp, Artificial Sequence
  Description of Artificial Sequence: Synthetic oligonucleotide
tggccctgaccgatacttgggcgg

SEQ ID NO: 76451 - DNA, 23 bp, Artificial Sequence
  Description of Artificial Sequence: Synthetic oligonucleotide
ggccctgaccgatacttgggcgg

SEQ ID NO: 76452 - DNA, 23 bp, Artificial Sequence
  Description of Artificial Sequence: Synthetic oligonucleotide
gccctgaccgatacttgggcggg

SEQ ID NO: 76453 - DNA, 24 bp, Artificial Sequence
  Description of Artificial Sequence: Synthetic oligonucleotide
ccctgaccgatacttgggcgggct

SEQ ID NO: 76454 - DNA, 24 bp, Artificial Sequence
  Description of Artificial Sequence: Synthetic oligonucleotide
cctgaccgatacttgggcgggctc

SEQ ID NO: 76455 - DNA, 24 bp, Artificial Sequence
  Description of Artificial Sequence: Synthetic oligonucleotide
ctgaccgatacttgggcgggctcc

SEQ ID NO: 76456 - DNA, 25 bp, Artificial Sequence
  Description of Artificial Sequence: Synthetic oligonucleotide
tgaccgatacttgggcgggctccca

SEQ ID NO: 76457 - DNA, 24 bp, Artificial Sequence
  Description of Artificial Sequence: Synthetic oligonucleotide
gaccgatacttgggcgggctccca

SEQ ID NO: 76458 - DNA, 25 bp, Artificial Sequence
  Description of Artificial Sequence: Synthetic oligonucleotide
accgatacttgggcgggctcccact

SEQ ID NO: 76459 - DNA, 24 bp, Artificial Sequence
  Description of Artificial Sequence: Synthetic oligonucleotide
ccgatacttgggcgggctcccact

SEQ ID NO: 76460 - DNA, 24 bp, Artificial Sequence
  Description of Artificial Sequence: Synthetic oligonucleotide
cgatacttgggcgggctcccactc

SEQ ID NO: 76461 - DNA, 26 bp, Artificial Sequence
  Description of Artificial Sequence: Synthetic oligonucleotide
gatacttgggcgggctcccactcctt

SEQ ID NO: 76462 - DNA, 27 bp, Artificial Sequence
  Description of Artificial Sequence: Synthetic oligonucleotide
atacttgggcgggctcccactccttga

SEQ ID NO: 76463 - DNA, 26 bp, Artificial Sequence
  Description of Artificial Sequence: Synthetic oligonucleotide
tacttgggcgggctcccactccttga

SEQ ID NO: 76464 - DNA, 25 bp, Artificial Sequence
  Description of Artificial Sequence: Synthetic oligonucleotide
acttgggcgggctcccactccttga

SEQ ID NO: 76465 - DNA, 24 bp, Artificial Sequence
  Description of Artificial Sequence: Synthetic oligonucleotide
cttgggcgggctcccactccttga

SEQ ID NO: 76466 - DNA, 24 bp, Artificial Sequence
  Description of Artificial Sequence: Synthetic oligonucleotide
ttgggcgggctcccactccttgag

SEQ ID NO: 76467 - DNA, 23 bp, Artificial Sequence
  Description of Artificial Sequence: Synthetic oligonucleotide
tgggcgggctcccactccttgag

SEQ ID NO: 76468 - DNA, 22 bp, Artificial Sequence
  Description of Artificial Sequence: Synthetic oligonucleotide
gggcgggctcccactccttgag

SEQ ID NO: 76469 - DNA, 27 bp, Artificial Sequence
  Description of Artificial Sequence: Synthetic oligonucleotide
ggcgggctcccactccttgaggtattt

SEQ ID NO: 76470 - DNA, 27 bp, Artificial Sequence
  Description of Artificial Sequence: Synthetic oligonucleotide
gcgggctcccactccttgaggtatttc

SEQ ID NO: 76471 - DNA, 28 bp, Artificial Sequence
  Description of Artificial Sequence: Synthetic oligonucleotide
cgggctcccactccttgaggtatttcag

SEQ ID NO: 76472 - DNA, 28 bp, Artificial Sequence
  Description of Artificial Sequence: Synthetic oligonucleotide
gggctcccactccttgaggtatttcagc

SEQ ID NO: 76473 - DNA, 29 bp, Artificial Sequence
  Description of Artificial Sequence: Synthetic oligonucleotide
ggctcccactccttgaggtatttcagcac

SEQ ID NO: 76474 - DNA, 29 bp, Artificial Sequence
  Description of Artificial Sequence: Synthetic oligonucleotide
gctcccactccttgaggtatttcagcacc

SEQ ID NO: 76475 - DNA, 29 bp, Artificial Sequence
  Description of Artificial Sequence: Synthetic oligonucleotide
ctcccactccttgaggtatttcagcaccg

SEQ ID NO: 76476 - DNA, 29 bp, Artificial Sequence
  Description of Artificial Sequence: Synthetic oligonucleotide
tcccactccttgaggtatttcagcaccgc

SEQ ID NO: 76477 - DNA, 28 bp, Artificial Sequence
  Description of Artificial Sequence: Synthetic oligonucleotide
cccactccttgaggtatttcagcaccgc

SEQ ID NO: 76478 - DNA, 29 bp, Artificial Sequence
  Description of Artificial Sequence: Synthetic oligonucleotide
ccactccttgaggtatttcagcaccgctg

SEQ ID NO: 76479 - DNA, 30 bp, Artificial Sequence
  Description of Artificial Sequence: Synthetic oligonucleotide
cactccttgaggtatttcagcaccgctgtg

SEQ ID NO: 76480 - DNA, 31 bp, Artificial Sequence
  Description of Artificial Sequence: Synthetic oligonucleotide
actccttgaggtatttcagcaccgctgtgtc

SEQ ID NO: 76481 - DNA, 30 bp, Artificial Sequence
  Description of Artificial Sequence: Synthetic oligonucleotide
ctccttgaggtatttcagcaccgctgtgtc

SEQ ID NO: 76482 - DNA, 30 bp, Artificial Sequence
  Description of Artificial Sequence: Synthetic oligonucleotide
tccttgaggtatttcagcaccgctgtgtcg

SEQ ID NO: 76483 - DNA, 29 bp, Artificial Sequence
  Description of Artificial Sequence: Synthetic oligonucleotide
ccttgaggtatttcagcaccgctgtgtcg

SEQ ID NO: 76484 - DNA, 29 bp, Artificial Sequence
  Description of Artificial Sequence: Synthetic oligonucleotide
cttgaggtatttcagcaccgctgtgtcgc

SEQ ID NO: 76485 - DNA, 29 bp, Artificial Sequence
  Description of Artificial Sequence: Synthetic oligonucleotide
ttgaggtatttcagcaccgctgtgtcgcg

SEQ ID NO: 76486 - DNA, 28 bp, Artificial Sequence
  Description of Artificial Sequence: Synthetic oligonucleotide
tgaggtatttcagcaccgctgtgtcgcg

SEQ ID NO: 76487 - DNA, 27 bp, Artificial Sequence
  Description of Artificial Sequence: Synthetic oligonucleotide
gaggtatttcagcaccgctgtgtcgcg

SEQ ID NO: 76488 - DNA, 27 bp, Artificial Sequence
  Description of Artificial Sequence: Synthetic oligonucleotide
aggtatttcagcaccgctgtgtcgcgg

SEQ ID NO: 76489 - DNA, 26 bp, Artificial Sequence
  Description of Artificial Sequence: Synthetic oligonucleotide
ggtatttcagcaccgctgtgtcgcgg

SEQ ID NO: 76490 - DNA, 26 bp, Artificial Sequence
  Description of Artificial Sequence: Synthetic oligonucleotide
gtatttcagcaccgctgtgtcgcggc

SEQ ID NO: 76491 - DNA, 26 bp, Artificial Sequence
  Description of Artificial Sequence: Synthetic oligonucleotide
tatttcagcaccgctgtgtcgcggcc

SEQ ID NO: 76492 - DNA, 25 bp, Artificial Sequence
  Description of Artificial Sequence: Synthetic oligonucleotide
atttcagcaccgctgtgtcgcggcc

SEQ ID NO: 76493 - DNA, 24 bp, Artificial Sequence
  Description of Artificial Sequence: Synthetic oligonucleotide
tttcagcaccgctgtgtcgcggcc

SEQ ID NO: 76494 - DNA, 23 bp, Artificial Sequence
  Description of Artificial Sequence: Synthetic oligonucleotide
ttcagcaccgctgtgtcgcggcc

SEQ ID NO: 76495 - DNA, 22 bp, Artificial Sequence
  Description of Artificial Sequence: Synthetic oligonucleotide
tcagcaccgctgtgtcgcggcc

SEQ ID NO: 76496 - DNA, 21 bp, Artificial Sequence
  Description of Artificial Sequence: Synthetic oligonucleotide
cagcaccgctgtgtcgcggcc

SEQ ID NO: 76497 - DNA, 21 bp, Artificial Sequence
  Description of Artificial Sequence: Synthetic oligonucleotide
agcaccgctgtgtcgcggccc

SEQ ID NO: 76498 - DNA, 20 bp, Artificial Sequence
  Description of Artificial Sequence: Synthetic oligonucleotide
gcaccgctgtgtcgcggccc

SEQ ID NO: 76499 - DNA, 20 bp, Artificial Sequence
  Description of Artificial Sequence: Synthetic oligonucleotide
caccgctgtgtcgcggcccg

SEQ ID NO: 76500 - DNA, 20 bp, Artificial Sequence
  Description of Artificial Sequence: Synthetic oligonucleotide
accgctgtgtcgcggcccgg

SEQ ID NO: 76501 - DNA, 20 bp, Artificial Sequence
  Description of Artificial Sequence: Synthetic oligonucleotide
ccgctgtgtcgcggcccggt

SEQ ID NO: 76502 - DNA, 20 bp, Artificial Sequence
  Description of Artificial Sequence: Synthetic oligonucleotide
cgctgtgtcgcggcccggct

SEQ ID NO: 76503 - DNA, 20 bp, Artificial Sequence
  Description of Artificial Sequence: Synthetic oligonucleotide
gctgtgtcgcggcccggcct

SEQ ID NO: 76504 - DNA, 20 bp, Artificial Sequence
  Description of Artificial Sequence: Synthetic oligonucleotide
ctgtgtcgcggcccggccgt

SEQ ID NO: 76505 - DNA, 20 bp, Artificial Sequence
  Description of Artificial Sequence: Synthetic oligonucleotide
tgtgtcgcggcccggccgct

SEQ ID NO: 76506 - DNA, 20 bp, Artificial Sequence
  Description of Artificial Sequence: Synthetic oligonucleotide
gtgtcgcggcccggccgctt

SEQ ID NO: 76507 - DNA, 20 bp, Artificial Sequence
  Description of Artificial Sequence: Synthetic oligonucleotide
tgtcgcggcccggccgcgtt

SEQ ID NO: 76508 - DNA, 20 bp, Artificial Sequence
  Description of Artificial Sequence: Synthetic oligonucleotide
gtcgcggcccggccgcgttt

SEQ ID NO: 76509 - DNA, 20 bp, Artificial Sequence
  Description of Artificial Sequence: Synthetic oligonucleotide
tcgcggcccggccgcggttt

SEQ ID NO: 76510 - DNA, 20 bp, Artificial Sequence
  Description of Artificial Sequence: Synthetic oligonucleotide
cgcggcccggccgcggtttt

SEQ ID NO: 76511 - DNA, 20 bp, Artificial Sequence
  Description of Artificial Sequence: Synthetic oligonucleotide
gcggcccggccgcgggtttt

SEQ ID NO: 76512 - DNA, 20 bp, Artificial Sequence
  Description of Artificial Sequence: Synthetic oligonucleotide
gccgcggggagccccgctat

SEQ ID NO: 76513 - DNA, 21 bp, Artificial Sequence
  Description of Artificial Sequence: Synthetic oligonucleotide
ccgcggggagccccgctacat

SEQ ID NO: 76514 - DNA, 21 bp, Artificial Sequence
  Description of Artificial Sequence: Synthetic oligonucleotide
cgcggggagccccgctacatc

SEQ ID NO: 76515 - DNA, 21 bp, Artificial Sequence
  Description of Artificial Sequence: Synthetic oligonucleotide
gcggggagccccgctacatcg

SEQ ID NO: 76516 - DNA, 21 bp, Artificial Sequence
  Description of Artificial Sequence: Synthetic oligonucleotide
cggggagccccgctacatcgc

SEQ ID NO: 76517 - DNA, 21 bp, Artificial Sequence
  Description of Artificial Sequence: Synthetic oligonucleotide
ggggagccccgctacatcgcc

SEQ ID NO: 76518 - DNA, 22 bp, Artificial Sequence
  Description of Artificial Sequence: Synthetic oligonucleotide
gggagccccgctacatcgccgt

SEQ ID NO: 76519 - DNA, 22 bp, Artificial Sequence
  Description of Artificial Sequence: Synthetic oligonucleotide
ggagccccgctacatcgccgtg

SEQ ID NO: 76520 - DNA, 23 bp, Artificial Sequence
  Description of Artificial Sequence: Synthetic oligonucleotide
gagccccgctacatcgccgtgga

SEQ ID NO: 76521 - DNA, 25 bp, Artificial Sequence
  Description of Artificial Sequence: Synthetic oligonucleotide
agccccgctacatcgccgtggagta

SEQ ID NO: 76522 - DNA, 24 bp, Artificial Sequence
  Description of Artificial Sequence: Synthetic oligonucleotide
gccccgctacatcgccgtggagta

SEQ ID NO: 76523 - DNA, 24 bp, Artificial Sequence
  Description of Artificial Sequence: Synthetic oligonucleotide
ccccgctacatcgccgtggagtac

SEQ ID NO: 76524 - DNA, 26 bp, Artificial Sequence
  Description of Artificial Sequence: Synthetic oligonucleotide
cccgctacatcgccgtggagtacgta

SEQ ID NO: 76525 - DNA, 27 bp, Artificial Sequence
  Description of Artificial Sequence: Synthetic oligonucleotide
ccgctacatcgccgtggagtacgtaga

SEQ ID NO: 76526 - DNA, 27 bp, Artificial Sequence
  Description of Artificial Sequence: Synthetic oligonucleotide
cgctacatcgccgtggagtacgtagac

SEQ ID NO: 76527 - DNA, 27 bp, Artificial Sequence
  Description of Artificial Sequence: Synthetic oligonucleotide
gctacatcgccgtggagtacgtagacg

SEQ ID NO: 76528 - DNA, 28 bp, Artificial Sequence
  Description of Artificial Sequence: Synthetic oligonucleotide
ctacatcgccgtggagtacgtagacgac

SEQ ID NO: 76529 - DNA, 29 bp, Artificial Sequence
  Description of Artificial Sequence: Synthetic oligonucleotide
tacatcgccgtggagtacgtagacgacac

SEQ ID NO: 76530 - DNA, 28 bp, Artificial Sequence
  Description of Artificial Sequence: Synthetic oligonucleotide
acatcgccgtggagtacgtagacgacac

SEQ ID NO: 76531 - DNA, 27 bp, Artificial Sequence
  Description of Artificial Sequence: Synthetic oligonucleotide
catcgccgtggagtacgtagacgacac

SEQ ID NO: 76532 - DNA, 27 bp, Artificial Sequence
  Description of Artificial Sequence: Synthetic oligonucleotide
atcgccgtggagtacgtagacgacacg

SEQ ID NO: 76533 - DNA, 26 bp, Artificial Sequence
  Description of Artificial Sequence: Synthetic oligonucleotide
tcgccgtggagtacgtagacgacacg

SEQ ID NO: 76534 - DNA, 25 bp, Artificial Sequence
  Description of Artificial Sequence: Synthetic oligonucleotide
cgccgtggagtacgtagacgacacg

SEQ ID NO: 76535 - DNA, 27 bp, Artificial Sequence
  Description of Artificial Sequence: Synthetic oligonucleotide
gccgtggagtacgtagacgacacgcaa

SEQ ID NO: 76536 - DNA, 29 bp, Artificial Sequence
  Description of Artificial Sequence: Synthetic oligonucleotide
ccgtggagtacgtagacgacacgcaattc

SEQ ID NO: 76537 - DNA, 29 bp, Artificial Sequence
  Description of Artificial Sequence: Synthetic oligonucleotide
cgtggagtacgtagacgacacgcaattcc

SEQ ID NO: 76538 - DNA, 30 bp, Artificial Sequence
  Description of Artificial Sequence: Synthetic oligonucleotide
gtggagtacgtagacgacacgcaattcctg

SEQ ID NO: 76539 - DNA, 30 bp, Artificial Sequence
  Description of Artificial Sequence: Synthetic oligonucleotide
tggagtacgtagacgacacgcaattcctgc

SEQ ID NO: 76540 - DNA, 29 bp, Artificial Sequence
  Description of Artificial Sequence: Synthetic oligonucleotide
ggagtacgtagacgacacgcaattcctgc

SEQ ID NO: 76541 - DNA, 29 bp, Artificial Sequence
  Description of Artificial Sequence: Synthetic oligonucleotide
gagtacgtagacgacacgcaattcctgcg

SEQ ID NO: 76542 - DNA, 29 bp, Artificial Sequence
  Description of Artificial Sequence: Synthetic oligonucleotide
agtacgtagacgacacgcaattcctgcgg

SEQ ID NO: 76543 - DNA, 28 bp, Artificial Sequence
  Description of Artificial Sequence: Synthetic oligonucleotide
gtacgtagacgacacgcaattcctgcgg

SEQ ID NO: 76544 - DNA, 30 bp, Artificial Sequence
  Description of Artificial Sequence: Synthetic oligonucleotide
tacgtagacgacacgcaattcctgcggttc

SEQ ID NO: 76545 - DNA, 29 bp, Artificial Sequence
  Description of Artificial Sequence: Synthetic oligonucleotide
acgtagacgacacgcaattcctgcggttc

SEQ ID NO: 76546 - DNA, 28 bp, Artificial Sequence
  Description of Artificial Sequence: Synthetic oligonucleotide
cgtagacgacacgcaattcctgcggttc

SEQ ID NO: 76547 - DNA, 28 bp, Artificial Sequence
  Description of Artificial Sequence: Synthetic oligonucleotide
gtagacgacacgcaattcctgcggttcg

SEQ ID NO: 76548 - DNA, 29 bp, Artificial Sequence
  Description of Artificial Sequence: Synthetic oligonucleotide
tagacgacacgcaattcctgcggttcgac

SEQ ID NO: 76549 - DNA, 28 bp, Artificial Sequence
  Description of Artificial Sequence: Synthetic oligonucleotide
agacgacacgcaattcctgcggttcgac

SEQ ID NO: 76550 - DNA, 27 bp, Artificial Sequence
  Description of Artificial Sequence: Synthetic oligonucleotide
gacgacacgcaattcctgcggttcgac

SEQ ID NO: 76551 - DNA, 28 bp, Artificial Sequence
  Description of Artificial Sequence: Synthetic oligonucleotide
acgacacgcaattcctgcggttcgacag

SEQ ID NO: 76552 - DNA, 27 bp, Artificial Sequence
  Description of Artificial Sequence: Synthetic oligonucleotide
cgacacgcaattcctgcggttcgacag

SEQ ID NO: 76553 - DNA, 27 bp, Artificial Sequence
  Description of Artificial Sequence: Synthetic oligonucleotide
gacacgcaattcctgcggttcgacagc

SEQ ID NO: 76554 - DNA, 27 bp, Artificial Sequence
  Description of Artificial Sequence: Synthetic oligonucleotide
acacgcaattcctgcggttcgacagcg

SEQ ID NO: 76555 - DNA, 27 bp, Artificial Sequence
  Description of Artificial Sequence: Synthetic oligonucleotide
cacgcaattcctgcggttcgacagcga

SEQ ID NO: 76556 - DNA, 27 bp, Artificial Sequence
  Description of Artificial Sequence: Synthetic oligonucleotide
acgcaattcctgcggttcgacagcgac

SEQ ID NO: 76557 - DNA, 26 bp, Artificial Sequence
  Description of Artificial Sequence: Synthetic oligonucleotide
cgcaattcctgcggttcgacagcgac

SEQ ID NO: 76558 - DNA, 26 bp, Artificial Sequence
  Description of Artificial Sequence: Synthetic oligonucleotide
gcaattcctgcggttcgacagcgacg

SEQ ID NO: 76559 - DNA, 26 bp, Artificial Sequence
  Description of Artificial Sequence: Synthetic oligonucleotide
caattcctgcggttcgacagcgacgc

SEQ ID NO: 76560 - DNA, 26 bp, Artificial Sequence
  Description of Artificial Sequence: Synthetic oligonucleotide
aattcctgcggttcgacagcgacgcc

SEQ ID NO: 76561 - DNA, 25 bp, Artificial Sequence
  Description of Artificial Sequence: Synthetic oligonucleotide
attcctgcggttcgacagcgacgcc

SEQ ID NO: 76562 - DNA, 24 bp, Artificial Sequence
  Description of Artificial Sequence: Synthetic oligonucleotide
cggttcgacagcgacgccgcgatt

SEQ ID NO: 76563 - DNA, 25 bp, Artificial Sequence
  Description of Artificial Sequence: Synthetic oligonucleotide
acagcgacgccgcgattccgaggat

SEQ ID NO: 76564 - DNA, 24 bp, Artificial Sequence
  Description of Artificial Sequence: Synthetic oligonucleotide
cagcgacgccgcgattccgaggat

SEQ ID NO: 76565 - DNA, 24 bp, Artificial Sequence
  Description of Artificial Sequence: Synthetic oligonucleotide
agcgacgccgcgattccgaggatg

SEQ ID NO: 76566 - DNA, 23 bp, Artificial Sequence
  Description of Artificial Sequence: Synthetic oligonucleotide
gcgacgccgcgattccgaggatg

SEQ ID NO: 76567 - DNA, 24 bp, Artificial Sequence
  Description of Artificial Sequence: Synthetic oligonucleotide
cgacgccgcgattccgaggatgga

SEQ ID NO: 76568 - DNA, 24 bp, Artificial Sequence
  Description of Artificial Sequence: Synthetic oligonucleotide
gacgccgcgattccgaggatggag

SEQ ID NO: 76569 - DNA, 24 bp, Artificial Sequence
  Description of Artificial Sequence: Synthetic oligonucleotide
acgccgcgattccgaggatggagc

SEQ ID NO: 76570 - DNA, 23 bp, Artificial Sequence
  Description of Artificial Sequence: Synthetic oligonucleotide
cgccgcgattccgaggatggagc

SEQ ID NO: 76571 - DNA, 23 bp, Artificial Sequence
  Description of Artificial Sequence: Synthetic oligonucleotide
gccgcgattccgaggatggagcc

SEQ ID NO: 76572 - DNA, 23 bp, Artificial Sequence
  Description of Artificial Sequence: Synthetic oligonucleotide
ccgcgattccgaggatggagccg

SEQ ID NO: 76573 - DNA, 23 bp, Artificial Sequence
  Description of Artificial Sequence: Synthetic oligonucleotide
cgcgattccgaggatggagccgc

SEQ ID NO: 76574 - DNA, 23 bp, Artificial Sequence
  Description of Artificial Sequence: Synthetic oligonucleotide
gcgattccgaggatggagccgcg

SEQ ID NO: 76575 - DNA, 23 bp, Artificial Sequence
  Description of Artificial Sequence: Synthetic oligonucleotide
cgattccgaggatggagccgcgg

SEQ ID NO: 76576 - DNA, 24 bp, Artificial Sequence
  Description of Artificial Sequence: Synthetic oligonucleotide
gattccgaggatggagccgcggga

SEQ ID NO: 76577 - DNA, 24 bp, Artificial Sequence
  Description of Artificial Sequence: Synthetic oligonucleotide
attccgaggatggagccgcgggag

SEQ ID NO: 76578 - DNA, 23 bp, Artificial Sequence
  Description of Artificial Sequence: Synthetic oligonucleotide
ttccgaggatggagccgcgggag

SEQ ID NO: 76579 - DNA, 22 bp, Artificial Sequence
  Description of Artificial Sequence: Synthetic oligonucleotide
tccgaggatggagccgcgggag

SEQ ID NO: 76580 - DNA, 21 bp, Artificial Sequence
  Description of Artificial Sequence: Synthetic oligonucleotide
ccgaggatggagccgcgggag

SEQ ID NO: 76581 - DNA, 21 bp, Artificial Sequence
  Description of Artificial Sequence: Synthetic oligonucleotide
cgaggatggagccgcgggagc

SEQ ID NO: 76582 - DNA, 21 bp, Artificial Sequence
  Description of Artificial Sequence: Synthetic oligonucleotide
gaggatggagccgcgggagcc

SEQ ID NO: 76583 - DNA, 22 bp, Artificial Sequence
  Description of Artificial Sequence: Synthetic oligonucleotide
aggatggagccgcgggagccgt

SEQ ID NO: 76584 - DNA, 21 bp, Artificial Sequence
  Description of Artificial Sequence: Synthetic oligonucleotide
ggatggagccgcgggagccgt

SEQ ID NO: 76585 - DNA, 21 bp, Artificial Sequence
  Description of Artificial Sequence: Synthetic oligonucleotide
atggagccgcgggagccgtgg

SEQ ID NO: 76586 - DNA, 20 bp, Artificial Sequence
  Description of Artificial Sequence: Synthetic oligonucleotide
tggagccgcgggagccgtgg

SEQ ID NO: 76587 - DNA, 22 bp, Artificial Sequence
  Description of Artificial Sequence: Synthetic oligonucleotide
gcgggagccgtgggtggagcaa

SEQ ID NO: 76588 - DNA, 23 bp, Artificial Sequence
  Description of Artificial Sequence: Synthetic oligonucleotide
cgggagccgtgggtggagcaaga

SEQ ID NO: 76589 - DNA, 23 bp, Artificial Sequence
  Description of Artificial Sequence: Synthetic oligonucleotide
gggagccgtgggtggagcaagag

SEQ ID NO: 76590 - DNA, 23 bp, Artificial Sequence
  Description of Artificial Sequence: Synthetic oligonucleotide
ggagccgtgggtggagcaagagg

SEQ ID NO: 76591 - DNA, 23 bp, Artificial Sequence
  Description of Artificial Sequence: Synthetic oligonucleotide
gagccgtgggtggagcaagaggg

SEQ ID NO: 76592 - DNA, 23 bp, Artificial Sequence
  Description of Artificial Sequence: Synthetic oligonucleotide
agccgtgggtggagcaagagggg

SEQ ID NO: 76593 - DNA, 22 bp, Artificial Sequence
  Description of Artificial Sequence: Synthetic oligonucleotide
gccgtgggtggagcaagagggg

SEQ ID NO: 76594 - DNA, 22 bp, Artificial Sequence
  Description of Artificial Sequence: Synthetic oligonucleotide
ccgtgggtggagcaagaggggc

SEQ ID NO: 76595 - DNA, 22 bp, Artificial Sequence
  Description of Artificial Sequence: Synthetic oligonucleotide
cgtgggtggagcaagaggggcc

SEQ ID NO: 76596 - DNA, 22 bp, Artificial Sequence
  Description of Artificial Sequence: Synthetic oligonucleotide
gtgggtggagcaagaggggccg

SEQ ID NO: 76597 - DNA, 23 bp, Artificial Sequence
  Description of Artificial Sequence: Synthetic oligonucleotide
tgggtggagcaagaggggccgca

SEQ ID NO: 76598 - DNA, 22 bp, Artificial Sequence
  Description of Artificial Sequence: Synthetic oligonucleotide
gggtggagcaagaggggccgca

SEQ ID NO: 76599 - DNA, 26 bp, Artificial Sequence
  Description of Artificial Sequence: Synthetic oligonucleotide
ggtggagcaagaggggccgcagtatt

SEQ ID NO: 76600 - DNA, 26 bp, Artificial Sequence
  Description of Artificial Sequence: Synthetic oligonucleotide
gtggagcaagaggggccgcagtattg

SEQ ID NO: 76601 - DNA, 26 bp, Artificial Sequence
  Description of Artificial Sequence: Synthetic oligonucleotide
tggagcaagaggggccgcagtattgg

SEQ ID NO: 76602 - DNA, 25 bp, Artificial Sequence
  Description of Artificial Sequence: Synthetic oligonucleotide
ggagcaagaggggccgcagtattgg

SEQ ID NO: 76603 - DNA, 26 bp, Artificial Sequence
  Description of Artificial Sequence: Synthetic oligonucleotide
gagcaagaggggccgcagtattggga

SEQ ID NO: 76604 - DNA, 27 bp, Artificial Sequence
  Description of Artificial Sequence: Synthetic oligonucleotide
agcaagaggggccgcagtattgggagt

SEQ ID NO: 76605 - DNA, 26 bp, Artificial Sequence
  Description of Artificial Sequence: Synthetic oligonucleotide
gcaagaggggccgcagtattgggagt

SEQ ID NO: 76606 - DNA, 26 bp, Artificial Sequence
  Description of Artificial Sequence: Synthetic oligonucleotide
caagaggggccgcagtattgggagtg

SEQ ID NO: 76607 - DNA, 27 bp, Artificial Sequence
  Description of Artificial Sequence: Synthetic oligonucleotide
aagaggggccgcagtattgggagtgga

SEQ ID NO: 76608 - DNA, 26 bp, Artificial Sequence
  Description of Artificial Sequence: Synthetic oligonucleotide
agaggggccgcagtattgggagtgga

SEQ ID NO: 76609 - DNA, 25 bp, Artificial Sequence
  Description of Artificial Sequence: Synthetic oligonucleotide
gaggggccgcagtattgggagtgga

SEQ ID NO: 76610 - DNA, 25 bp, Artificial Sequence
  Description of Artificial Sequence: Synthetic oligonucleotide
aggggccgcagtattgggagtggac

SEQ ID NO: 76611 - DNA, 24 bp, Artificial Sequence
  Description of Artificial Sequence: Synthetic oligonucleotide
ggggccgcagtattgggagtggac

SEQ ID NO: 76612 - DNA, 25 bp, Artificial Sequence
  Description of Artificial Sequence: Synthetic oligonucleotide
gggccgcagtattgggagtggacca

SEQ ID NO: 76613 - DNA, 26 bp, Artificial Sequence
  Description of Artificial Sequence: Synthetic oligonucleotide
ggccgcagtattgggagtggaccaca

SEQ ID NO: 76614 - DNA, 26 bp, Artificial Sequence
  Description of Artificial Sequence: Synthetic oligonucleotide
gccgcagtattgggagtggaccacag

SEQ ID NO: 76615 - DNA, 26 bp, Artificial Sequence
  Description of Artificial Sequence: Synthetic oligonucleotide
ccgcagtattgggagtggaccacagg

SEQ ID NO: 76616 - DNA, 27 bp, Artificial Sequence
  Description of Artificial Sequence: Synthetic oligonucleotide
cgcagtattgggagtggaccacagggt

SEQ ID NO: 76617 - DNA, 28 bp, Artificial Sequence
  Description of Artificial Sequence: Synthetic oligonucleotide
gcagtattgggagtggaccacagggtac

SEQ ID NO: 76618 - DNA, 28 bp, Artificial Sequence
  Description of Artificial Sequence: Synthetic oligonucleotide
cagtattgggagtggaccacagggtacg

SEQ ID NO: 76619 - DNA, 28 bp, Artificial Sequence
  Description of Artificial Sequence: Synthetic oligonucleotide
agtattgggagtggaccacagggtacgc

SEQ ID NO: 76620 - DNA, 27 bp, Artificial Sequence
  Description of Artificial Sequence: Synthetic oligonucleotide
gtattgggagtggaccacagggtacgc

SEQ ID NO: 76621 - DNA, 27 bp, Artificial Sequence
  Description of Artificial Sequence: Synthetic oligonucleotide
tattgggagtggaccacagggtacgcc

SEQ ID NO: 76622 - DNA, 27 bp, Artificial Sequence
  Description of Artificial Sequence: Synthetic oligonucleotide
attgggagtggaccacagggtacgcca

SEQ ID NO: 76623 - DNA, 27 bp, Artificial Sequence
  Description of Artificial Sequence: Synthetic oligonucleotide
ttgggagtggaccacagggtacgccaa

SEQ ID NO: 76624 - DNA, 26 bp, Artificial Sequence
  Description of Artificial Sequence: Synthetic oligonucleotide
tgggagtggaccacagggtacgccaa

SEQ ID NO: 76625 - DNA, 25 bp, Artificial Sequence
  Description of Artificial Sequence: Synthetic oligonucleotide
gggagtggaccacagggtacgccaa

SEQ ID NO: 76626 - DNA, 25 bp, Artificial Sequence
  Description of Artificial Sequence: Synthetic oligonucleotide
ggagtggaccacagggtacgccaag

SEQ ID NO: 76627 - DNA, 25 bp, Artificial Sequence
  Description of Artificial Sequence: Synthetic oligonucleotide
gagtggaccacagggtacgccaagg

SEQ ID NO: 76628 - DNA, 25 bp, Artificial Sequence
  Description of Artificial Sequence: Synthetic oligonucleotide
agtggaccacagggtacgccaaggc

SEQ ID NO: 76629 - DNA, 24 bp, Artificial Sequence
  Description of Artificial Sequence: Synthetic oligonucleotide
gtggaccacagggtacgccaaggc

SEQ ID NO: 76630 - DNA, 26 bp, Artificial Sequence
  Description of Artificial Sequence: Synthetic oligonucleotide
tggaccacagggtacgccaaggccaa

SEQ ID NO: 76631 - DNA, 25 bp, Artificial Sequence
  Description of Artificial Sequence: Synthetic oligonucleotide
ggaccacagggtacgccaaggccaa

SEQ ID NO: 76632 - DNA, 25 bp, Artificial Sequence
  Description of Artificial Sequence: Synthetic oligonucleotide
gaccacagggtacgccaaggccaac

SEQ ID NO: 76633 - DNA, 25 bp, Artificial Sequence
  Description of Artificial Sequence: Synthetic oligonucleotide
accacagggtacgccaaggccaacg

SEQ ID NO: 76634 - DNA, 24 bp, Artificial Sequence
  Description of Artificial Sequence: Synthetic oligonucleotide
ccacagggtacgccaaggccaacg

SEQ ID NO: 76635 - DNA, 25 bp, Artificial Sequence
  Description of Artificial Sequence: Synthetic oligonucleotide
cacagggtacgccaaggccaacgca

SEQ ID NO: 76636 - DNA, 26 bp, Artificial Sequence
  Description of Artificial Sequence: Synthetic oligonucleotide
acagggtacgccaaggccaacgcaca

SEQ ID NO: 76637 - DNA, 25 bp, Artificial Sequence
  Description of Artificial Sequence: Synthetic oligonucleotide
cagggtacgccaaggccaacgcaca

SEQ ID NO: 76638 - DNA, 26 bp, Artificial Sequence
  Description of Artificial Sequence: Synthetic oligonucleotide
agggtacgccaaggccaacgcacaga

SEQ ID NO: 76639 - DNA, 25 bp, Artificial Sequence
  Description of Artificial Sequence: Synthetic oligonucleotide
gggtacgccaaggccaacgcacaga

SEQ ID NO: 76640 - DNA, 26 bp, Artificial Sequence
  Description of Artificial Sequence: Synthetic oligonucleotide
ggtacgccaaggccaacgcacagact

SEQ ID NO: 76641 - DNA, 27 bp, Artificial Sequence
  Description of Artificial Sequence: Synthetic oligonucleotide
gtacgccaaggccaacgcacagactga

SEQ ID NO: 76642 - DNA, 27 bp, Artificial Sequence
  Description of Artificial Sequence: Synthetic oligonucleotide
tacgccaaggccaacgcacagactgac

SEQ ID NO: 76643 - DNA, 26 bp, Artificial Sequence
  Description of Artificial Sequence: Synthetic oligonucleotide
acgccaaggccaacgcacagactgac

SEQ ID NO: 76644 - DNA, 25 bp, Artificial Sequence
  Description of Artificial Sequence: Synthetic oligonucleotide
cgccaaggccaacgcacagactgac

SEQ ID NO: 76645 - DNA, 25 bp, Artificial Sequence
  Description of Artificial Sequence: Synthetic oligonucleotide
gccaaggccaacgcacagactgacc

SEQ ID NO: 76646 - DNA, 26 bp, Artificial Sequence
  Description of Artificial Sequence: Synthetic oligonucleotide
ccaaggccaacgcacagactgaccga

SEQ ID NO: 76647 - DNA, 27 bp, Artificial Sequence
  Description of Artificial Sequence: Synthetic oligonucleotide
caaggccaacgcacagactgaccgagt

SEQ ID NO: 76648 - DNA, 27 bp, Artificial Sequence
  Description of Artificial Sequence: Synthetic oligonucleotide
aaggccaacgcacagactgaccgagtg

SEQ ID NO: 76649 - DNA, 26 bp, Artificial Sequence
  Description of Artificial Sequence: Synthetic oligonucleotide
aggccaacgcacagactgaccgagtg

SEQ ID NO: 76650 - DNA, 25 bp, Artificial Sequence
  Description of Artificial Sequence: Synthetic oligonucleotide
ggccaacgcacagactgaccgagtg

SEQ ID NO: 76651 - DNA, 25 bp, Artificial Sequence
  Description of Artificial Sequence: Synthetic oligonucleotide
gccaacgcacagactgaccgagtgg

SEQ ID NO: 76652 - DNA, 25 bp, Artificial Sequence
  Description of Artificial Sequence: Synthetic oligonucleotide
ccaacgcacagactgaccgagtggc

SEQ ID NO: 76653 - DNA, 25 bp, Artificial Sequence
  Description of Artificial Sequence: Synthetic oligonucleotide
caacgcacagactgaccgagtggcc

SEQ ID NO: 76654 - DNA, 26 bp, Artificial Sequence
  Description of Artificial Sequence: Synthetic oligonucleotide
aacgcacagactgaccgagtggccct

SEQ ID NO: 76655 - DNA, 25 bp, Artificial Sequence
  Description of Artificial Sequence: Synthetic oligonucleotide
acgcacagactgaccgagtggccct

SEQ ID NO: 76656 - DNA, 24 bp, Artificial Sequence
  Description of Artificial Sequence: Synthetic oligonucleotide
cgcacagactgaccgagtggccct

SEQ ID NO: 76657 - DNA, 25 bp, Artificial Sequence
  Description of Artificial Sequence: Synthetic oligonucleotide
gcacagactgaccgagtggccctga

SEQ ID NO: 76658 - DNA, 25 bp, Artificial Sequence
  Description of Artificial Sequence: Synthetic oligonucleotide
cacagactgaccgagtggccctgag

SEQ ID NO: 76659 - DNA, 27 bp, Artificial Sequence
  Description of Artificial Sequence: Synthetic oligonucleotide
acagactgaccgagtggccctgaggaa

SEQ ID NO: 76660 - DNA, 26 bp, Artificial Sequence
  Description of Artificial Sequence: Synthetic oligonucleotide
cagactgaccgagtggccctgaggaa

SEQ ID NO: 76661 - DNA, 26 bp, Artificial Sequence
  Description of Artificial Sequence: Synthetic oligonucleotide
agactgaccgagtggccctgaggaac

SEQ ID NO: 76662 - DNA, 25 bp, Artificial Sequence
  Description of Artificial Sequence: Synthetic oligonucleotide
gactgaccgagtggccctgaggaac

SEQ ID NO: 76663 - DNA, 26 bp, Artificial Sequence
  Description of Artificial Sequence: Synthetic oligonucleotide
actgaccgagtggccctgaggaacct

SEQ ID NO: 76664 - DNA, 25 bp, Artificial Sequence
  Description of Artificial Sequence: Synthetic oligonucleotide
ctgaccgagtggccctgaggaacct

SEQ ID NO: 76665 - DNA, 25 bp, Artificial Sequence
  Description of Artificial Sequence: Synthetic oligonucleotide
tgaccgagtggccctgaggaacctg

SEQ ID NO: 76666 - DNA, 24 bp, Artificial Sequence
  Description of Artificial Sequence: Synthetic oligonucleotide
gaccgagtggccctgaggaacctg

SEQ ID NO: 76667 - DNA, 25 bp, Artificial Sequence
  Description of Artificial Sequence: Synthetic oligonucleotide
accgagtggccctgaggaacctgct

SEQ ID NO: 76668 - DNA, 24 bp, Artificial Sequence
  Description of Artificial Sequence: Synthetic oligonucleotide
ccgagtggccctgaggaacctgct

SEQ ID NO: 76669 - DNA, 24 bp, Artificial Sequence
  Description of Artificial Sequence: Synthetic oligonucleotide
cgagtggccctgaggaacctgctc

SEQ ID NO: 76670 - DNA, 24 bp, Artificial Sequence
  Description of Artificial Sequence: Synthetic oligonucleotide
gagtggccctgaggaacctgctcc

SEQ ID NO: 76671 - DNA, 24 bp, Artificial Sequence
  Description of Artificial Sequence: Synthetic oligonucleotide
agtggccctgaggaacctgctccg

SEQ ID NO: 76672 - DNA, 23 bp, Artificial Sequence
  Description of Artificial Sequence: Synthetic oligonucleotide
gtggccctgaggaacctgctccg

SEQ ID NO: 76673 - DNA, 23 bp, Artificial Sequence
  Description of Artificial Sequence: Synthetic oligonucleotide
tggccctgaggaacctgctccgc

SEQ ID NO: 76674 - DNA, 22 bp, Artificial Sequence
  Description of Artificial Sequence: Synthetic oligonucleotide
ggccctgaggaacctgctccgc

SEQ ID NO: 76675 - DNA, 22 bp, Artificial Sequence
  Description of Artificial Sequence: Synthetic oligonucleotide
gccctgaggaacctgctccgcc

SEQ ID NO: 76676 - DNA, 22 bp, Artificial Sequence
  Description of Artificial Sequence: Synthetic oligonucleotide
ccctgaggaacctgctccgccg

SEQ ID NO: 76677 - DNA, 24 bp, Artificial Sequence
  Description of Artificial Sequence: Synthetic oligonucleotide
cctgaggaacctgctccgccgcta

SEQ ID NO: 76678 - DNA, 26 bp, Artificial Sequence
  Description of Artificial Sequence: Synthetic oligonucleotide
ctgaggaacctgctccgccgctacaa

SEQ ID NO: 76679 - DNA, 26 bp, Artificial Sequence
  Description of Artificial Sequence: Synthetic oligonucleotide
tgaggaacctgctccgccgctacaac

SEQ ID NO: 76680 - DNA, 25 bp, Artificial Sequence
  Description of Artificial Sequence: Synthetic oligonucleotide
gaggaacctgctccgccgctacaac

SEQ ID NO: 76681 - DNA, 26 bp, Artificial Sequence
  Description of Artificial Sequence: Synthetic oligonucleotide
aggaacctgctccgccgctacaacca

SEQ ID NO: 76682 - DNA, 25 bp, Artificial Sequence
  Description of Artificial Sequence: Synthetic oligonucleotide
ggaacctgctccgccgctacaacca

SEQ ID NO: 76683 - DNA, 26 bp, Artificial Sequence
  Description of Artificial Sequence: Synthetic oligonucleotide
gaacctgctccgccgctacaaccaga

SEQ ID NO: 76684 - DNA, 26 bp, Artificial Sequence
  Description of Artificial Sequence: Synthetic oligonucleotide
aacctgctccgccgctacaaccagag

SEQ ID NO: 76685 - DNA, 25 bp, Artificial Sequence
  Description of Artificial Sequence: Synthetic oligonucleotide
acctgctccgccgctacaaccagag

SEQ ID NO: 76686 - DNA, 24 bp, Artificial Sequence
  Description of Artificial Sequence: Synthetic oligonucleotide
cctgctccgccgctacaaccagag

SEQ ID NO: 76687 - DNA, 24 bp, Artificial Sequence
  Description of Artificial Sequence: Synthetic oligonucleotide
ctgctccgccgctacaaccagagc

SEQ ID NO: 76688 - DNA, 25 bp, Artificial Sequence
  Description of Artificial Sequence: Synthetic oligonucleotide
tgctccgccgctacaaccagagcga

SEQ ID NO: 76689 - DNA, 24 bp, Artificial Sequence
  Description of Artificial Sequence: Synthetic oligonucleotide
gctccgccgctacaaccagagcga

SEQ ID NO: 76690 - DNA, 24 bp, Artificial Sequence
  Description of Artificial Sequence: Synthetic oligonucleotide
ctccgccgctacaaccagagcgag

SEQ ID NO: 76691 - DNA, 24 bp, Artificial Sequence
  Description of Artificial Sequence: Synthetic oligonucleotide
tccgccgctacaaccagagcgagg

SEQ ID NO: 76692 - DNA, 23 bp, Artificial Sequence
  Description of Artificial Sequence: Synthetic oligonucleotide
ccgccgctacaaccagagcgagg

SEQ ID NO: 76693 - DNA, 24 bp, Artificial Sequence
  Description of Artificial Sequence: Synthetic oligonucleotide
cgccgctacaaccagagcgaggct

SEQ ID NO: 76694 - DNA, 24 bp, Artificial Sequence
  Description of Artificial Sequence: Synthetic oligonucleotide
gccgctacaaccagagcgaggctg

SEQ ID NO: 76695 - DNA, 24 bp, Artificial Sequence
  Description of Artificial Sequence: Synthetic oligonucleotide
ccgctacaaccagagcgaggctgg

SEQ ID NO: 76696 - DNA, 25 bp, Artificial Sequence
  Description of Artificial Sequence: Synthetic oligonucleotide
cgctacaaccagagcgaggctgggt

SEQ ID NO: 76697 - DNA, 26 bp, Artificial Sequence
  Description of Artificial Sequence: Synthetic oligonucleotide
gctacaaccagagcgaggctgggtct

SEQ ID NO: 76698 - DNA, 26 bp, Artificial Sequence
  Description of Artificial Sequence: Synthetic oligonucleotide
caaccagagcgaggctgggtctcaca

SEQ ID NO: 76699 - DNA, 26 bp, Artificial Sequence
  Description of Artificial Sequence: Synthetic oligonucleotide
aaccagagcgaggctgggtctcacac

SEQ ID NO: 76700 - DNA, 25 bp, Artificial Sequence
  Description of Artificial Sequence: Synthetic oligonucleotide
accagagcgaggctgggtctcacac

SEQ ID NO: 76701 - DNA, 24 bp, Artificial Sequence
  Description of Artificial Sequence: Synthetic oligonucleotide
ccagagcgaggctgggtctcacac

SEQ ID NO: 76702 - DNA, 24 bp, Artificial Sequence
  Description of Artificial Sequence: Synthetic oligonucleotide
cagagcgaggctgggtctcacacc

SEQ ID NO: 76703 - DNA, 25 bp, Artificial Sequence
  Description of Artificial Sequence: Synthetic oligonucleotide
agagcgaggctgggtctcacaccct

SEQ ID NO: 76704 - DNA, 24 bp, Artificial Sequence
  Description of Artificial Sequence: Synthetic oligonucleotide
gagcgaggctgggtctcacaccct

SEQ ID NO: 76705 - DNA, 24 bp, Artificial Sequence
  Description of Artificial Sequence: Synthetic oligonucleotide
agcgaggctgggtctcacaccctc

SEQ ID NO: 76706 - DNA, 23 bp, Artificial Sequence
  Description of Artificial Sequence: Synthetic oligonucleotide
gcgaggctgggtctcacaccctc

SEQ ID NO: 76707 - DNA, 24 bp, Artificial Sequence
  Description of Artificial Sequence: Synthetic oligonucleotide
cgaggctgggtctcacaccctcca

SEQ ID NO: 76708 - DNA, 24 bp, Artificial Sequence
  Description of Artificial Sequence: Synthetic oligonucleotide
gaggctgggtctcacaccctccag

SEQ ID NO: 76709 - DNA, 24 bp, Artificial Sequence
  Description of Artificial Sequence: Synthetic oligonucleotide
aggctgggtctcacaccctccagg

SEQ ID NO: 76710 - DNA, 23 bp, Artificial Sequence
  Description of Artificial Sequence: Synthetic oligonucleotide
ggctgggtctcacaccctccagg

SEQ ID NO: 76711 - DNA, 26 bp, Artificial Sequence
  Description of Artificial Sequence: Synthetic oligonucleotide
gctgggtctcacaccctccagggaat

SEQ ID NO: 76712 - DNA, 27 bp, Artificial Sequence
  Description of Artificial Sequence: Synthetic oligonucleotide
ctgggtctcacaccctccagggaatga

SEQ ID NO: 76713 - DNA, 29 bp, Artificial Sequence
  Description of Artificial Sequence: Synthetic oligonucleotide
tgggtctcacaccctccagggaatgaatg

SEQ ID NO: 76714 - DNA, 28 bp, Artificial Sequence
  Description of Artificial Sequence: Synthetic oligonucleotide
gggtctcacaccctccagggaatgaatg

SEQ ID NO: 76715 - DNA, 28 bp, Artificial Sequence
  Description of Artificial Sequence: Synthetic oligonucleotide
ggtctcacaccctccagggaatgaatgg

SEQ ID NO: 76716 - DNA, 28 bp, Artificial Sequence
  Description of Artificial Sequence: Synthetic oligonucleotide
gtctcacaccctccagggaatgaatggc

SEQ ID NO: 76717 - DNA, 29 bp, Artificial Sequence
  Description of Artificial Sequence: Synthetic oligonucleotide
tctcacaccctccagggaatgaatggctg

SEQ ID NO: 76718 - DNA, 28 bp, Artificial Sequence
  Description of Artificial Sequence: Synthetic oligonucleotide
ctcacaccctccagggaatgaatggctg

SEQ ID NO: 76719 - DNA, 28 bp, Artificial Sequence
  Description of Artificial Sequence: Synthetic oligonucleotide
tcacaccctccagggaatgaatggctgc

SEQ ID NO: 76720 - DNA, 27 bp, Artificial Sequence
  Description of Artificial Sequence: Synthetic oligonucleotide
cacaccctccagggaatgaatggctgc

SEQ ID NO: 76721 - DNA, 27 bp, Artificial Sequence
  Description of Artificial Sequence: Synthetic oligonucleotide
acaccctccagggaatgaatggctgcg

SEQ ID NO: 76722 - DNA, 27 bp, Artificial Sequence
  Description of Artificial Sequence: Synthetic oligonucleotide
caccctccagggaatgaatggctgcga

SEQ ID NO: 76723 - DNA, 27 bp, Artificial Sequence
  Description of Artificial Sequence: Synthetic oligonucleotide
accctccagggaatgaatggctgcgac

SEQ ID NO: 76724 - DNA, 27 bp, Artificial Sequence
  Description of Artificial Sequence: Synthetic oligonucleotide
ccctccagggaatgaatggctgcgaca

SEQ ID NO: 76725 - DNA, 28 bp, Artificial Sequence
  Description of Artificial Sequence: Synthetic oligonucleotide
cctccagggaatgaatggctgcgacatg

SEQ ID NO: 76726 - DNA, 28 bp, Artificial Sequence
  Description of Artificial Sequence: Synthetic oligonucleotide
ctccagggaatgaatggctgcgacatgg

SEQ ID NO: 76727 - DNA, 28 bp, Artificial Sequence
  Description of Artificial Sequence: Synthetic oligonucleotide
tccagggaatgaatggctgcgacatggg

SEQ ID NO: 76728 - DNA, 27 bp, Artificial Sequence
  Description of Artificial Sequence: Synthetic oligonucleotide
ccagggaatgaatggctgcgacatggg

SEQ ID NO: 76729 - DNA, 27 bp, Artificial Sequence
  Description of Artificial Sequence: Synthetic oligonucleotide
cagggaatgaatggctgcgacatgggg

SEQ ID NO: 76730 - DNA, 27 bp, Artificial Sequence
  Description of Artificial Sequence: Synthetic oligonucleotide
agggaatgaatggctgcgacatggggc

SEQ ID NO: 76731 - DNA, 26 bp, Artificial Sequence
  Description of Artificial Sequence: Synthetic oligonucleotide
gggaatgaatggctgcgacatggggc

SEQ ID NO: 76732 - DNA, 26 bp, Artificial Sequence
  Description of Artificial Sequence: Synthetic oligonucleotide
ggaatgaatggctgcgacatggggcc

SEQ ID NO: 76733 - DNA, 26 bp, Artificial Sequence
  Description of Artificial Sequence: Synthetic oligonucleotide
gaatgaatggctgcgacatggggccc

SEQ ID NO: 76734 - DNA, 27 bp, Artificial Sequence
  Description of Artificial Sequence: Synthetic oligonucleotide
aatgaatggctgcgacatggggcccga

SEQ ID NO: 76735 - DNA, 26 bp, Artificial Sequence
  Description of Artificial Sequence: Synthetic oligonucleotide
atgaatggctgcgacatggggcccga

SEQ ID NO: 76736 - DNA, 25 bp, Artificial Sequence
  Description of Artificial Sequence: Synthetic oligonucleotide
tgaatggctgcgacatggggcccga

SEQ ID NO: 76737 - DNA, 24 bp, Artificial Sequence
  Description of Artificial Sequence: Synthetic oligonucleotide
gaatggctgcgacatggggcccga

SEQ ID NO: 76738 - DNA, 24 bp, Artificial Sequence
  Description of Artificial Sequence: Synthetic oligonucleotide
aatggctgcgacatggggcccgac

SEQ ID NO: 76739 - DNA, 23 bp, Artificial Sequence
  Description of Artificial Sequence: Synthetic oligonucleotide
atggctgcgacatggggcccgac

SEQ ID NO: 76740 - DNA, 22 bp, Artificial Sequence
  Description of Artificial Sequence: Synthetic oligonucleotide
tggctgcgacatggggcccgac

SEQ ID NO: 76741 - DNA, 21 bp, Artificial Sequence
  Description of Artificial Sequence: Synthetic oligonucleotide
ggctgcgacatggggcccgac

SEQ ID NO: 76742 - DNA, 21 bp, Artificial Sequence
  Description of Artificial Sequence: Synthetic oligonucleotide
gctgcgacatggggcccgacg

SEQ ID NO: 76743 - DNA, 22 bp, Artificial Sequence
  Description of Artificial Sequence: Synthetic oligonucleotide
ctgcgacatggggcccgacgga

SEQ ID NO: 76744 - DNA, 22 bp, Artificial Sequence
  Description of Artificial Sequence: Synthetic oligonucleotide
tgcgacatggggcccgacggac

SEQ ID NO: 76745 - DNA, 21 bp, Artificial Sequence
  Description of Artificial Sequence: Synthetic oligonucleotide
gcgacatggggcccgacggac

SEQ ID NO: 76746 - DNA, 21 bp, Artificial Sequence
  Description of Artificial Sequence: Synthetic oligonucleotide
cgacatggggcccgacggacg

SEQ ID NO: 76747 - DNA, 21 bp, Artificial Sequence
  Description of Artificial Sequence: Synthetic oligonucleotide
gacatggggcccgacggacgc

SEQ ID NO: 76748 - DNA, 22 bp, Artificial Sequence
  Description of Artificial Sequence: Synthetic oligonucleotide
acatggggcccgacggacgcct

SEQ ID NO: 76749 - DNA, 21 bp, Artificial Sequence
  Description of Artificial Sequence: Synthetic oligonucleotide
catggggcccgacggacgcct

SEQ ID NO: 76750 - DNA, 21 bp, Artificial Sequence
  Description of Artificial Sequence: Synthetic oligonucleotide
atggggcccgacggacgcctc

SEQ ID NO: 76751 - DNA, 20 bp, Artificial Sequence
  Description of Artificial Sequence: Synthetic oligonucleotide
tggggcccgacggacgcctc

SEQ ID NO: 76752 - DNA, 20 bp, Artificial Sequence
  Description of Artificial Sequence: Synthetic oligonucleotide
ggggcccgacggacgcctct

SEQ ID NO: 76753 - DNA, 20 bp, Artificial Sequence
  Description of Artificial Sequence: Synthetic oligonucleotide
gggcccgacggacgcctcct

SEQ ID NO: 76754 - DNA, 20 bp, Artificial Sequence
  Description of Artificial Sequence: Synthetic oligonucleotide
ggcccgacggacgcctcctc

SEQ ID NO: 76755 - DNA, 20 bp, Artificial Sequence
  Description of Artificial Sequence: Synthetic oligonucleotide
gcccgacggacgcctcctcc

SEQ ID NO: 76756 - DNA, 20 bp, Artificial Sequence
  Description of Artificial Sequence: Synthetic oligonucleotide
cccgacggacgcctcctccg

SEQ ID NO: 76757 - DNA, 20 bp, Artificial Sequence
  Description of Artificial Sequence: Synthetic oligonucleotide
ccgacggacgcctcctccgc

SEQ ID NO: 76758 - DNA, 20 bp, Artificial Sequence
  Description of Artificial Sequence: Synthetic oligonucleotide
cgacggacgcctcctccgcg

SEQ ID NO: 76759 - DNA, 20 bp, Artificial Sequence
  Description of Artificial Sequence: Synthetic oligonucleotide
gacggacgcctcctccgcgg

SEQ ID NO: 76760 - DNA, 23 bp, Artificial Sequence
  Description of Artificial Sequence: Synthetic oligonucleotide
acggacgcctcctccgcgggtat

SEQ ID NO: 76761 - DNA, 22 bp, Artificial Sequence
  Description of Artificial Sequence: Synthetic oligonucleotide
cggacgcctcctccgcgggtat

SEQ ID NO: 76762 - DNA, 23 bp, Artificial Sequence
  Description of Artificial Sequence: Synthetic oligonucleotide
ggacgcctcctccgcgggtatca

SEQ ID NO: 76763 - DNA, 23 bp, Artificial Sequence
  Description of Artificial Sequence: Synthetic oligonucleotide
gacgcctcctccgcgggtatcac

SEQ ID NO: 76764 - DNA, 24 bp, Artificial Sequence
  Description of Artificial Sequence: Synthetic oligonucleotide
acgcctcctccgcgggtatcacca

SEQ ID NO: 76765 - DNA, 23 bp, Artificial Sequence
  Description of Artificial Sequence: Synthetic oligonucleotide
cgcctcctccgcgggtatcacca

SEQ ID NO: 76766 - DNA, 23 bp, Artificial Sequence
  Description of Artificial Sequence: Synthetic oligonucleotide
gcctcctccgcgggtatcaccag

SEQ ID NO: 76767 - DNA, 24 bp, Artificial Sequence
  Description of Artificial Sequence: Synthetic oligonucleotide
cctcctccgcgggtatcaccagca

SEQ ID NO: 76768 - DNA, 24 bp, Artificial Sequence
  Description of Artificial Sequence: Synthetic oligonucleotide
ctcctccgcgggtatcaccagcac

SEQ ID NO: 76769 - DNA, 24 bp, Artificial Sequence
  Description of Artificial Sequence: Synthetic oligonucleotide
tcctccgcgggtatcaccagcacg

SEQ ID NO: 76770 - DNA, 23 bp, Artificial Sequence
  Description of Artificial Sequence: Synthetic oligonucleotide
cctccgcgggtatcaccagcacg

SEQ ID NO: 76771 - DNA, 23 bp, Artificial Sequence
  Description of Artificial Sequence: Synthetic oligonucleotide
ctccgcgggtatcaccagcacgc

SEQ ID NO: 76772 - DNA, 25 bp, Artificial Sequence
  Description of Artificial Sequence: Synthetic oligonucleotide
tccgcgggtatcaccagcacgcgta

SEQ ID NO: 76773 - DNA, 24 bp, Artificial Sequence
  Description of Artificial Sequence: Synthetic oligonucleotide
ccgcgggtatcaccagcacgcgta

SEQ ID NO: 76774 - DNA, 24 bp, Artificial Sequence
  Description of Artificial Sequence: Synthetic oligonucleotide
cgcgggtatcaccagcacgcgtac

SEQ ID NO: 76775 - DNA, 25 bp, Artificial Sequence
  Description of Artificial Sequence: Synthetic oligonucleotide
gcgggtatcaccagcacgcgtacga

SEQ ID NO: 76776 - DNA, 25 bp, Artificial Sequence
  Description of Artificial Sequence: Synthetic oligonucleotide
cgggtatcaccagcacgcgtacgac

SEQ ID NO: 76777 - DNA, 25 bp, Artificial Sequence
  Description of Artificial Sequence: Synthetic oligonucleotide
gggtatcaccagcacgcgtacgacg

SEQ ID NO: 76778 - DNA, 25 bp, Artificial Sequence
  Description of Artificial Sequence: Synthetic oligonucleotide
ggtatcaccagcacgcgtacgacgg

SEQ ID NO: 76779 - DNA, 27 bp, Artificial Sequence
  Description of Artificial Sequence: Synthetic oligonucleotide
gtatcaccagcacgcgtacgacggcaa

SEQ ID NO: 76780 - DNA, 27 bp, Artificial Sequence
  Description of Artificial Sequence: Synthetic oligonucleotide
tatcaccagcacgcgtacgacggcaag

SEQ ID NO: 76781 - DNA, 26 bp, Artificial Sequence
  Description of Artificial Sequence: Synthetic oligonucleotide
atcaccagcacgcgtacgacggcaag

SEQ ID NO: 76782 - DNA, 25 bp, Artificial Sequence
  Description of Artificial Sequence: Synthetic oligonucleotide
tcaccagcacgcgtacgacggcaag

SEQ ID NO: 76783 - DNA, 24 bp, Artificial Sequence
  Description of Artificial Sequence: Synthetic oligonucleotide
caccagcacgcgtacgacggcaag

SEQ ID NO: 76784 - DNA, 27 bp, Artificial Sequence
  Description of Artificial Sequence: Synthetic oligonucleotide
accagcacgcgtacgacggcaaggatt

SEQ ID NO: 76785 - DNA, 27 bp, Artificial Sequence
  Description of Artificial Sequence: Synthetic oligonucleotide
ccagcacgcgtacgacggcaaggatta

SEQ ID NO: 76786 - DNA, 27 bp, Artificial Sequence
  Description of Artificial Sequence: Synthetic oligonucleotide
cagcacgcgtacgacggcaaggattac

SEQ ID NO: 76787 - DNA, 29 bp, Artificial Sequence
  Description of Artificial Sequence: Synthetic oligonucleotide
agcacgcgtacgacggcaaggattacatc

SEQ ID NO: 76788 - DNA, 28 bp, Artificial Sequence
  Description of Artificial Sequence: Synthetic oligonucleotide
gcacgcgtacgacggcaaggattacatc

SEQ ID NO: 76789 - DNA, 29 bp, Artificial Sequence
  Description of Artificial Sequence: Synthetic oligonucleotide
cacgcgtacgacggcaaggattacatctc

SEQ ID NO: 76790 - DNA, 29 bp, Artificial Sequence
  Description of Artificial Sequence: Synthetic oligonucleotide
acgcgtacgacggcaaggattacatctcc

SEQ ID NO: 76791 - DNA, 28 bp, Artificial Sequence
  Description of Artificial Sequence: Synthetic oligonucleotide
cgcgtacgacggcaaggattacatctcc

SEQ ID NO: 76792 - DNA, 28 bp, Artificial Sequence
  Description of Artificial Sequence: Synthetic oligonucleotide
gcgtacgacggcaaggattacatctccc

SEQ ID NO: 76793 - DNA, 29 bp, Artificial Sequence
  Description of Artificial Sequence: Synthetic oligonucleotide
cgtacgacggcaaggattacatctccctg

SEQ ID NO: 76794 - DNA, 31 bp, Artificial Sequence
  Description of Artificial Sequence: Synthetic oligonucleotide
gtacgacggcaaggattacatctccctgaac

SEQ ID NO: 76795 - DNA, 26 bp, Artificial Sequence
  Description of Artificial Sequence: Synthetic oligonucleotide
atctccctgaacgaggacctgcgctc

SEQ ID NO: 76796 - DNA, 25 bp, Artificial Sequence
  Description of Artificial Sequence: Synthetic oligonucleotide
tctccctgaacgaggacctgcgctc

SEQ ID NO: 76797 - DNA, 24 bp, Artificial Sequence
  Description of Artificial Sequence: Synthetic oligonucleotide
ctccctgaacgaggacctgcgctc

SEQ ID NO: 76798 - DNA, 25 bp, Artificial Sequence
  Description of Artificial Sequence: Synthetic oligonucleotide
tccctgaacgaggacctgcgctcct

SEQ ID NO: 76799 - DNA, 21 bp, Artificial Sequence
  Description of Artificial Sequence: Synthetic oligonucleotide
ctggaccgcggcggacaccgt

SEQ ID NO: 76800 - DNA, 21 bp, Artificial Sequence
  Description of Artificial Sequence: Synthetic oligonucleotide
tggaccgcggcggacaccgtg

SEQ ID NO: 76801 - DNA, 20 bp, Artificial Sequence
  Description of Artificial Sequence: Synthetic oligonucleotide
ggaccgcggcggacaccgtg

SEQ ID NO: 76802 - DNA, 20 bp, Artificial Sequence
  Description of Artificial Sequence: Synthetic oligonucleotide
gaccgcggcggacaccgtgg

SEQ ID NO: 76803 - DNA, 21 bp, Artificial Sequence
  Description of Artificial Sequence: Synthetic oligonucleotide
accgcggcggacaccgtggct

SEQ ID NO: 76804 - DNA, 20 bp, Artificial Sequence
  Description of Artificial Sequence: Synthetic oligonucleotide
ccgcggcggacaccgtggct

SEQ ID NO: 76805 - DNA, 21 bp, Artificial Sequence
  Description of Artificial Sequence: Synthetic oligonucleotide
cgcggcggacaccgtggctca

SEQ ID NO: 76806 - DNA, 23 bp, Artificial Sequence
  Description of Artificial Sequence: Synthetic oligonucleotide
gcggcggacaccgtggctcagat

SEQ ID NO: 76807 - DNA, 24 bp, Artificial Sequence
  Description of Artificial Sequence: Synthetic oligonucleotide
cggcggacaccgtggctcagatca

SEQ ID NO: 76808 - DNA, 24 bp, Artificial Sequence
  Description of Artificial Sequence: Synthetic oligonucleotide
ggcggacaccgtggctcagatcac

SEQ ID NO: 76809 - DNA, 26 bp, Artificial Sequence
  Description of Artificial Sequence: Synthetic oligonucleotide
accgtggctcagatcacccagcgctt

SEQ ID NO: 76810 - DNA, 25 bp, Artificial Sequence
  Description of Artificial Sequence: Synthetic oligonucleotide
ccgtggctcagatcacccagcgctt

SEQ ID NO: 76811 - DNA, 27 bp, Artificial Sequence
  Description of Artificial Sequence: Synthetic oligonucleotide
cgtggctcagatcacccagcgcttcta

SEQ ID NO: 76812 - DNA, 28 bp, Artificial Sequence
  Description of Artificial Sequence: Synthetic oligonucleotide
gtggctcagatcacccagcgcttctatg

SEQ ID NO: 76813 - DNA, 29 bp, Artificial Sequence
  Description of Artificial Sequence: Synthetic oligonucleotide
tggctcagatcacccagcgcttctatgag

SEQ ID NO: 76814 - DNA, 28 bp, Artificial Sequence
  Description of Artificial Sequence: Synthetic oligonucleotide
ggctcagatcacccagcgcttctatgag

SEQ ID NO: 76815 - DNA, 28 bp, Artificial Sequence
  Description of Artificial Sequence: Synthetic oligonucleotide
gctcagatcacccagcgcttctatgagg

SEQ ID NO: 76816 - DNA, 28 bp, Artificial Sequence
  Description of Artificial Sequence: Synthetic oligonucleotide
ctcagatcacccagcgcttctatgaggc

SEQ ID NO: 76817 - DNA, 29 bp, Artificial Sequence
  Description of Artificial Sequence: Synthetic oligonucleotide
tcagatcacccagcgcttctatgaggcag

SEQ ID NO: 76818 - DNA, 28 bp, Artificial Sequence
  Description of Artificial Sequence: Synthetic oligonucleotide
cagatcacccagcgcttctatgaggcag

SEQ ID NO: 76819 - DNA, 29 bp, Artificial Sequence
  Description of Artificial Sequence: Synthetic oligonucleotide
agatcacccagcgcttctatgaggcagag

SEQ ID NO: 76820 - DNA, 28 bp, Artificial Sequence
  Description of Artificial Sequence: Synthetic oligonucleotide
gatcacccagcgcttctatgaggcagag

SEQ ID NO: 76821 - DNA, 28 bp, Artificial Sequence
  Description of Artificial Sequence: Synthetic oligonucleotide
atcacccagcgcttctatgaggcagagg

SEQ ID NO: 76822 - DNA, 27 bp, Artificial Sequence
  Description of Artificial Sequence: Synthetic oligonucleotide
tcacccagcgcttctatgaggcagagg

SEQ ID NO: 76823 - DNA, 27 bp, Artificial Sequence
  Description of Artificial Sequence: Synthetic oligonucleotide
cacccagcgcttctatgaggcagagga

SEQ ID NO: 76824 - DNA, 31 bp, Artificial Sequence
  Description of Artificial Sequence: Synthetic oligonucleotide
acccagcgcttctatgaggcagaggaatatg

SEQ ID NO: 76825 - DNA, 30 bp, Artificial Sequence
  Description of Artificial Sequence: Synthetic oligonucleotide
cccagcgcttctatgaggcagaggaatatg

SEQ ID NO: 76826 - DNA, 30 bp, Artificial Sequence
  Description of Artificial Sequence: Synthetic oligonucleotide
ccagcgcttctatgaggcagaggaatatgc

SEQ ID NO: 76827 - DNA, 31 bp, Artificial Sequence
  Description of Artificial Sequence: Synthetic oligonucleotide
cagcgcttctatgaggcagaggaatatgcag

SEQ ID NO: 76828 - DNA, 32 bp, Artificial Sequence
  Description of Artificial Sequence: Synthetic oligonucleotide
agcgcttctatgaggcagaggaatatgcagag

SEQ ID NO: 76829 - DNA, 31 bp, Artificial Sequence
  Description of Artificial Sequence: Synthetic oligonucleotide
gcgcttctatgaggcagaggaatatgcagag

SEQ ID NO: 76830 - DNA, 31 bp, Artificial Sequence
  Description of Artificial Sequence: Synthetic oligonucleotide
cgcttctatgaggcagaggaatatgcagagg

SEQ ID NO: 76831 - DNA, 32 bp, Artificial Sequence
  Description of Artificial Sequence: Synthetic oligonucleotide
gcttctatgaggcagaggaatatgcagaggag

SEQ ID NO: 76832 - DNA, 34 bp, Artificial Sequence
  Description of Artificial Sequence: Synthetic oligonucleotide
cttctatgaggcagaggaatatgcagaggagttc

SEQ ID NO: 76833 - DNA, 35 bp, Artificial Sequence
  Description of Artificial Sequence: Synthetic oligonucleotide
ttctatgaggcagaggaatatgcagaggagttcag

SEQ ID NO: 76834 - DNA, 34 bp, Artificial Sequence
  Description of Artificial Sequence: Synthetic oligonucleotide
tctatgaggcagaggaatatgcagaggagttcag

SEQ ID NO: 76835 - DNA, 33 bp, Artificial Sequence
  Description of Artificial Sequence: Synthetic oligonucleotide
ctatgaggcagaggaatatgcagaggagttcag

SEQ ID NO: 76836 - DNA, 33 bp, Artificial Sequence
  Description of Artificial Sequence: Synthetic oligonucleotide
tatgaggcagaggaatatgcagaggagttcagg

SEQ ID NO: 76837 - DNA, 32 bp, Artificial Sequence
  Description of Artificial Sequence: Synthetic oligonucleotide
atgaggcagaggaatatgcagaggagttcagg

SEQ ID NO: 76838 - DNA, 31 bp, Artificial Sequence
  Description of Artificial Sequence: Synthetic oligonucleotide
tgaggcagaggaatatgcagaggagttcagg

SEQ ID NO: 76839 - DNA, 30 bp, Artificial Sequence
  Description of Artificial Sequence: Synthetic oligonucleotide
gaggcagaggaatatgcagaggagttcagg

SEQ ID NO: 76840 - DNA, 31 bp, Artificial Sequence
  Description of Artificial Sequence: Synthetic oligonucleotide
aggcagaggaatatgcagaggagttcaggac

SEQ ID NO: 76841 - DNA, 30 bp, Artificial Sequence
  Description of Artificial Sequence: Synthetic oligonucleotide
ggcagaggaatatgcagaggagttcaggac

SEQ ID NO: 76842 - DNA, 30 bp, Artificial Sequence
  Description of Artificial Sequence: Synthetic oligonucleotide
gcagaggaatatgcagaggagttcaggacc

SEQ ID NO: 76843 - DNA, 32 bp, Artificial Sequence
  Description of Artificial Sequence: Synthetic oligonucleotide
cagaggaatatgcagaggagttcaggacctac

SEQ ID NO: 76844 - DNA, 32 bp, Artificial Sequence
  Description of Artificial Sequence: Synthetic oligonucleotide
agaggaatatgcagaggagttcaggacctacc

SEQ ID NO: 76845 - DNA, 31 bp, Artificial Sequence
  Description of Artificial Sequence: Synthetic oligonucleotide
gaggaatatgcagaggagttcaggacctacc

SEQ ID NO: 76846 - DNA, 32 bp, Artificial Sequence
  Description of Artificial Sequence: Synthetic oligonucleotide
aggaatatgcagaggagttcaggacctacctg

SEQ ID NO: 76847 - DNA, 31 bp, Artificial Sequence
  Description of Artificial Sequence: Synthetic oligonucleotide
ggaatatgcagaggagttcaggacctacctg

SEQ ID NO: 76848 - DNA, 31 bp, Artificial Sequence
  Description of Artificial Sequence: Synthetic oligonucleotide
gaatatgcagaggagttcaggacctacctgg

SEQ ID NO: 76849 - DNA, 32 bp, Artificial Sequence
  Description of Artificial Sequence: Synthetic oligonucleotide
aatatgcagaggagttcaggacctacctggag

SEQ ID NO: 76850 - DNA, 31 bp, Artificial Sequence
  Description of Artificial Sequence: Synthetic oligonucleotide
atatgcagaggagttcaggacctacctggag

SEQ ID NO: 76851 - DNA, 30 bp, Artificial Sequence
  Description of Artificial Sequence: Synthetic oligonucleotide
tatgcagaggagttcaggacctacctggag

SEQ ID NO: 76852 - DNA, 29 bp, Artificial Sequence
  Description of Artificial Sequence: Synthetic oligonucleotide
atgcagaggagttcaggacctacctggag

SEQ ID NO: 76853 - DNA, 28 bp, Artificial Sequence
  Description of Artificial Sequence: Synthetic oligonucleotide
tgcagaggagttcaggacctacctggag

SEQ ID NO: 76854 - DNA, 27 bp, Artificial Sequence
  Description of Artificial Sequence: Synthetic oligonucleotide
gcagaggagttcaggacctacctggag

SEQ ID NO: 76855 - DNA, 27 bp, Artificial Sequence
  Description of Artificial Sequence: Synthetic oligonucleotide
cagaggagttcaggacctacctggagg

SEQ ID NO: 76856 - DNA, 27 bp, Artificial Sequence
  Description of Artificial Sequence: Synthetic oligonucleotide
agaggagttcaggacctacctggaggg

SEQ ID NO: 76857 - DNA, 26 bp, Artificial Sequence
  Description of Artificial Sequence: Synthetic oligonucleotide
gaggagttcaggacctacctggaggg

SEQ ID NO: 76858 - DNA, 26 bp, Artificial Sequence
  Description of Artificial Sequence: Synthetic oligonucleotide
aggagttcaggacctacctggagggc

SEQ ID NO: 76859 - DNA, 25 bp, Artificial Sequence
  Description of Artificial Sequence: Synthetic oligonucleotide
ggagttcaggacctacctggagggc

SEQ ID NO: 76860 - DNA, 26 bp, Artificial Sequence
  Description of Artificial Sequence: Synthetic oligonucleotide
gagttcaggacctacctggagggcga

SEQ ID NO: 76861 - DNA, 27 bp, Artificial Sequence
  Description of Artificial Sequence: Synthetic oligonucleotide
agttcaggacctacctggagggcgagt

SEQ ID NO: 76862 - DNA, 26 bp, Artificial Sequence
  Description of Artificial Sequence: Synthetic oligonucleotide
gttcaggacctacctggagggcgagt

SEQ ID NO: 76863 - DNA, 26 bp, Artificial Sequence
  Description of Artificial Sequence: Synthetic oligonucleotide
ttcaggacctacctggagggcgagtg

SEQ ID NO: 76864 - DNA, 25 bp, Artificial Sequence
  Description of Artificial Sequence: Synthetic oligonucleotide
tcaggacctacctggagggcgagtg

SEQ ID NO: 76865 - DNA, 24 bp, Artificial Sequence
  Description of Artificial Sequence: Synthetic oligonucleotide
caggacctacctggagggcgagtg

SEQ ID NO: 76866 - DNA, 24 bp, Artificial Sequence
  Description of Artificial Sequence: Synthetic oligonucleotide
aggacctacctggagggcgagtgc

SEQ ID NO: 76867 - DNA, 23 bp, Artificial Sequence
  Description of Artificial Sequence: Synthetic oligonucleotide
ggacctacctggagggcgagtgc

SEQ ID NO: 76868 - DNA, 24 bp, Artificial Sequence
  Description of Artificial Sequence: Synthetic oligonucleotide
gacctacctggagggcgagtgcct

SEQ ID NO: 76869 - DNA, 24 bp, Artificial Sequence
  Description of Artificial Sequence: Synthetic oligonucleotide
acctacctggagggcgagtgcctg

SEQ ID NO: 76870 - DNA, 23 bp, Artificial Sequence
  Description of Artificial Sequence: Synthetic oligonucleotide
cctacctggagggcgagtgcctg

SEQ ID NO: 76871 - DNA, 24 bp, Artificial Sequence
  Description of Artificial Sequence: Synthetic oligonucleotide
ctacctggagggcgagtgcctgga

SEQ ID NO: 76872 - DNA, 26 bp, Artificial Sequence
  Description of Artificial Sequence: Synthetic oligonucleotide
tacctggagggcgagtgcctggagtt

SEQ ID NO: 76873 - DNA, 25 bp, Artificial Sequence
  Description of Artificial Sequence: Synthetic oligonucleotide
acctggagggcgagtgcctggagtt

SEQ ID NO: 76874 - DNA, 24 bp, Artificial Sequence
  Description of Artificial Sequence: Synthetic oligonucleotide
cctggagggcgagtgcctggagtt

SEQ ID NO: 76875 - DNA, 24 bp, Artificial Sequence
  Description of Artificial Sequence: Synthetic oligonucleotide
ctggagggcgagtgcctggagttg

SEQ ID NO: 76876 - DNA, 25 bp, Artificial Sequence
  Description of Artificial Sequence: Synthetic oligonucleotide
tggagggcgagtgcctggagttgct

SEQ ID NO: 76877 - DNA, 24 bp, Artificial Sequence
  Description of Artificial Sequence: Synthetic oligonucleotide
ggagggcgagtgcctggagttgct

SEQ ID NO: 76878 - DNA, 24 bp, Artificial Sequence
  Description of Artificial Sequence: Synthetic oligonucleotide
gagggcgagtgcctggagttgctc

SEQ ID NO: 76879 - DNA, 24 bp, Artificial Sequence
  Description of Artificial Sequence: Synthetic oligonucleotide
agggcgagtgcctggagttgctcc

SEQ ID NO: 76880 - DNA, 23 bp, Artificial Sequence
  Description of Artificial Sequence: Synthetic oligonucleotide
gggcgagtgcctggagttgctcc

SEQ ID NO: 76881 - DNA, 23 bp, Artificial Sequence
  Description of Artificial Sequence: Synthetic oligonucleotide
ggcgagtgcctggagttgctccg

SEQ ID NO: 76882 - DNA, 24 bp, Artificial Sequence
  Description of Artificial Sequence: Synthetic oligonucleotide
gcgagtgcctggagttgctccgca

SEQ ID NO: 76883 - DNA, 27 bp, Artificial Sequence
  Description of Artificial Sequence: Synthetic oligonucleotide
cgagtgcctggagttgctccgcagata

SEQ ID NO: 76884 - DNA, 27 bp, Artificial Sequence
  Description of Artificial Sequence: Synthetic oligonucleotide
gagtgcctggagttgctccgcagatac

SEQ ID NO: 76885 - DNA, 29 bp, Artificial Sequence
  Description of Artificial Sequence: Synthetic oligonucleotide
agtgcctggagttgctccgcagatacttg

SEQ ID NO: 76886 - DNA, 28 bp, Artificial Sequence
  Description of Artificial Sequence: Synthetic oligonucleotide
gtgcctggagttgctccgcagatacttg

SEQ ID NO: 76887 - DNA, 28 bp, Artificial Sequence
  Description of Artificial Sequence: Synthetic oligonucleotide
tgcctggagttgctccgcagatacttgg

SEQ ID NO: 76888 - DNA, 27 bp, Artificial Sequence
  Description of Artificial Sequence: Synthetic oligonucleotide
gcctggagttgctccgcagatacttgg

SEQ ID NO: 76889 - DNA, 28 bp, Artificial Sequence
  Description of Artificial Sequence: Synthetic oligonucleotide
cctggagttgctccgcagatacttggag

SEQ ID NO: 76890 - DNA, 31 bp, Artificial Sequence
  Description of Artificial Sequence: Synthetic oligonucleotide
ctggagttgctccgcagatacttggagaatg

SEQ ID NO: 76891 - DNA, 31 bp, Artificial Sequence
  Description of Artificial Sequence: Synthetic oligonucleotide
tggagttgctccgcagatacttggagaatgg

SEQ ID NO: 76892 - DNA, 30 bp, Artificial Sequence
  Description of Artificial Sequence: Synthetic oligonucleotide
ggagttgctccgcagatacttggagaatgg

SEQ ID NO: 76893 - DNA, 30 bp, Artificial Sequence
  Description of Artificial Sequence: Synthetic oligonucleotide
gagttgctccgcagatacttggagaatggg

SEQ ID NO: 76894 - DNA, 32 bp, Artificial Sequence
  Description of Artificial Sequence: Synthetic oligonucleotide
agttgctccgcagatacttggagaatgggaag

SEQ ID NO: 76895 - DNA, 31 bp, Artificial Sequence
  Description of Artificial Sequence: Synthetic oligonucleotide
gttgctccgcagatacttggagaatgggaag

SEQ ID NO: 76896 - DNA, 31 bp, Artificial Sequence
  Description of Artificial Sequence: Synthetic oligonucleotide
ttgctccgcagatacttggagaatgggaagg

SEQ ID NO: 76897 - DNA, 30 bp, Artificial Sequence
  Description of Artificial Sequence: Synthetic oligonucleotide
tgctccgcagatacttggagaatgggaagg

SEQ ID NO: 76898 - DNA, 29 bp, Artificial Sequence
  Description of Artificial Sequence: Synthetic oligonucleotide
gctccgcagatacttggagaatgggaagg

SEQ ID NO: 76899 - DNA, 30 bp, Artificial Sequence
  Description of Artificial Sequence: Synthetic oligonucleotide
ctccgcagatacttggagaatgggaaggag

SEQ ID NO: 76900 - DNA, 31 bp, Artificial Sequence
  Description of Artificial Sequence: Synthetic oligonucleotide
tccgcagatacttggagaatgggaaggagac

SEQ ID NO: 76901 - DNA, 30 bp, Artificial Sequence
  Description of Artificial Sequence: Synthetic oligonucleotide
ccgcagatacttggagaatgggaaggagac

SEQ ID NO: 76902 - DNA, 30 bp, Artificial Sequence
  Description of Artificial Sequence: Synthetic oligonucleotide
cgcagatacttggagaatgggaaggagacg

SEQ ID NO: 76903 - DNA, 30 bp, Artificial Sequence
  Description of Artificial Sequence: Synthetic oligonucleotide
gcagatacttggagaatgggaaggagacgc

SEQ ID NO: 76904 - DNA, 32 bp, Artificial Sequence
  Description of Artificial Sequence: Synthetic oligonucleotide
cagatacttggagaatgggaaggagacgctac

SEQ ID NO: 76905 - DNA, 33 bp, Artificial Sequence
  Description of Artificial Sequence: Synthetic oligonucleotide
agatacttggagaatgggaaggagacgctacag

SEQ ID NO: 76906 - DNA, 32 bp, Artificial Sequence
  Description of Artificial Sequence: Synthetic oligonucleotide
gatacttggagaatgggaaggagacgctacag

SEQ ID NO: 76907 - DNA, 32 bp, Artificial Sequence
  Description of Artificial Sequence: Synthetic oligonucleotide
atacttggagaatgggaaggagacgctacagc

SEQ ID NO: 76908 - DNA, 31 bp, Artificial Sequence
  Description of Artificial Sequence: Synthetic oligonucleotide
tacttggagaatgggaaggagacgctacagc

SEQ ID NO: 76909 - DNA, 30 bp, Artificial Sequence
  Description of Artificial Sequence: Synthetic oligonucleotide
acttggagaatgggaaggagacgctacagc

SEQ ID NO: 76910 - DNA, 29 bp, Artificial Sequence
  Description of Artificial Sequence: Synthetic oligonucleotide
cttggagaatgggaaggagacgctacagc

SEQ ID NO: 76911 - DNA, 29 bp, Artificial Sequence
  Description of Artificial Sequence: Synthetic oligonucleotide
ttggagaatgggaaggagacgctacagcg

SEQ ID NO: 76912 - DNA, 28 bp, Artificial Sequence
  Description of Artificial Sequence: Synthetic oligonucleotide
tggagaatgggaaggagacgctacagcg

SEQ ID NO: 76913 - DNA, 27 bp, Artificial Sequence
  Description of Artificial Sequence: Synthetic oligonucleotide
ggagaatgggaaggagacgctacagcg

SEQ ID NO: 76914 - DNA, 27 bp, Artificial Sequence
  Description of Artificial Sequence: Synthetic oligonucleotide
gagaatgggaaggagacgctacagcgc

SEQ ID NO: 76915 - DNA, 27 bp, Artificial Sequence
  Description of Artificial Sequence: Synthetic oligonucleotide
agaatgggaaggagacgctacagcgcg

SEQ ID NO: 76916 - DNA, 26 bp, Artificial Sequence
  Description of Artificial Sequence: Synthetic oligonucleotide
gaatgggaaggagacgctacagcgcg

SEQ ID NO: 76917 - DNA, 27 bp, Artificial Sequence
  Description of Artificial Sequence: Synthetic oligonucleotide
aatgggaaggagacgctacagcgcgca

SEQ ID NO: 76918 - DNA, 26 bp, Artificial Sequence
  Description of Artificial Sequence: Synthetic oligonucleotide
atgggaaggagacgctacagcgcgca

SEQ ID NO: 76919 - DNA, 25 bp, Artificial Sequence
  Description of Artificial Sequence: Synthetic oligonucleotide
tgggaaggagacgctacagcgcgca

SEQ ID NO: 76920 - DNA, 24 bp, Artificial Sequence
  Description of Artificial Sequence: Synthetic oligonucleotide
gggaaggagacgctacagcgcgca

SEQ ID NO: 76921 - DNA, 26 bp, Artificial Sequence
  Description of Artificial Sequence: Synthetic oligonucleotide
ggaaggagacgctacagcgcgcagat

SEQ ID NO: 76922 - DNA, 26 bp, Artificial Sequence
  Description of Artificial Sequence: Synthetic oligonucleotide
gaaggagacgctacagcgcgcagatc

SEQ ID NO: 76923 - DNA, 27 bp, Artificial Sequence
  Description of Artificial Sequence: Synthetic oligonucleotide
aaggagacgctacagcgcgcagatcct

SEQ ID NO: 76924 - DNA, 26 bp, Artificial Sequence
  Description of Artificial Sequence: Synthetic oligonucleotide
aggagacgctacagcgcgcagatcct

SEQ ID NO: 76925 - DNA, 25 bp, Artificial Sequence
  Description of Artificial Sequence: Synthetic oligonucleotide
ggagacgctacagcgcgcagatcct

SEQ ID NO: 76926 - DNA, 25 bp, Artificial Sequence
  Description of Artificial Sequence: Synthetic oligonucleotide
gagacgctacagcgcgcagatcctc

SEQ ID NO: 76927 - DNA, 27 bp, Artificial Sequence
  Description of Artificial Sequence: Synthetic oligonucleotide
agacgctacagcgcgcagatcctccaa

SEQ ID NO: 76928 - DNA, 27 bp, Artificial Sequence
  Description of Artificial Sequence: Synthetic oligonucleotide
gacgctacagcgcgcagatcctccaaa

SEQ ID NO: 76929 - DNA, 27 bp, Artificial Sequence
  Description of Artificial Sequence: Synthetic oligonucleotide
acgctacagcgcgcagatcctccaaag

SEQ ID NO: 76930 - DNA, 26 bp, Artificial Sequence
  Description of Artificial Sequence: Synthetic oligonucleotide
cgctacagcgcgcagatcctccaaag

SEQ ID NO: 76931 - DNA, 26 bp, Artificial Sequence
  Description of Artificial Sequence: Synthetic oligonucleotide
gctacagcgcgcagatcctccaaagg

SEQ ID NO: 76932 - DNA, 27 bp, Artificial Sequence
  Description of Artificial Sequence: Synthetic oligonucleotide
ctacagcgcgcagatcctccaaaggca

SEQ ID NO: 76933 - DNA, 27 bp, Artificial Sequence
  Description of Artificial Sequence: Synthetic oligonucleotide
tacagcgcgcagatcctccaaaggcac

SEQ ID NO: 76934 - DNA, 27 bp, Artificial Sequence
  Description of Artificial Sequence: Synthetic oligonucleotide
acagcgcgcagatcctccaaaggcaca

SEQ ID NO: 76935 - DNA, 26 bp, Artificial Sequence
  Description of Artificial Sequence: Synthetic oligonucleotide
cagcgcgcagatcctccaaaggcaca

SEQ ID NO: 76936 - DNA, 26 bp, Artificial Sequence
  Description of Artificial Sequence: Synthetic oligonucleotide
agcgcgcagatcctccaaaggcacac

SEQ ID NO: 76937 - DNA, 25 bp, Artificial Sequence
  Description of Artificial Sequence: Synthetic oligonucleotide
gcgcgcagatcctccaaaggcacac

SEQ ID NO: 76938 - DNA, 27 bp, Artificial Sequence
  Description of Artificial Sequence: Synthetic oligonucleotide
cgcgcagatcctccaaaggcacacgtt

SEQ ID NO: 76939 - DNA, 27 bp, Artificial Sequence
  Description of Artificial Sequence: Synthetic oligonucleotide
gcgcagatcctccaaaggcacacgttg

SEQ ID NO: 76940 - DNA, 27 bp, Artificial Sequence
  Description of Artificial Sequence: Synthetic oligonucleotide
cgcagatcctccaaaggcacacgttgc

SEQ ID NO: 76941 - DNA, 27 bp, Artificial Sequence
  Description of Artificial Sequence: Synthetic oligonucleotide
gcagatcctccaaaggcacacgttgcc

SEQ ID NO: 76942 - DNA, 27 bp, Artificial Sequence
  Description of Artificial Sequence: Synthetic oligonucleotide
cagatcctccaaaggcacacgttgccc

SEQ ID NO: 76943 - DNA, 28 bp, Artificial Sequence
  Description of Artificial Sequence: Synthetic oligonucleotide
agatcctccaaaggcacacgttgcccac

SEQ ID NO: 76944 - DNA, 27 bp, Artificial Sequence
  Description of Artificial Sequence: Synthetic oligonucleotide
gatcctccaaaggcacacgttgcccac

SEQ ID NO: 76945 - DNA, 27 bp, Artificial Sequence
  Description of Artificial Sequence: Synthetic oligonucleotide
atcctccaaaggcacacgttgcccacc

SEQ ID NO: 76946 - DNA, 27 bp, Artificial Sequence
  Description of Artificial Sequence: Synthetic oligonucleotide
tcctccaaaggcacacgttgcccacca

SEQ ID NO: 76947 - DNA, 26 bp, Artificial Sequence
  Description of Artificial Sequence: Synthetic oligonucleotide
cctccaaaggcacacgttgcccacca

SEQ ID NO: 76948 - DNA, 26 bp, Artificial Sequence
  Description of Artificial Sequence: Synthetic oligonucleotide
ctccaaaggcacacgttgcccaccac

SEQ ID NO: 76949 - DNA, 26 bp, Artificial Sequence
  Description of Artificial Sequence: Synthetic oligonucleotide
tccaaaggcacacgttgcccaccacc

SEQ ID NO: 76950 - DNA, 25 bp, Artificial Sequence
  Description of Artificial Sequence: Synthetic oligonucleotide
ccaaaggcacacgttgcccaccacc

SEQ ID NO: 76951 - DNA, 25 bp, Artificial Sequence
  Description of Artificial Sequence: Synthetic oligonucleotide
caaaggcacacgttgcccaccaccc

SEQ ID NO: 76952 - DNA, 27 bp, Artificial Sequence
  Description of Artificial Sequence: Synthetic oligonucleotide
aaaggcacacgttgcccaccaccccat

SEQ ID NO: 76953 - DNA, 26 bp, Artificial Sequence
  Description of Artificial Sequence: Synthetic oligonucleotide
aaggcacacgttgcccaccaccccat

SEQ ID NO: 76954 - DNA, 25 bp, Artificial Sequence
  Description of Artificial Sequence: Synthetic oligonucleotide
aggcacacgttgcccaccaccccat

SEQ ID NO: 76955 - DNA, 24 bp, Artificial Sequence
  Description of Artificial Sequence: Synthetic oligonucleotide
ggcacacgttgcccaccaccccat

SEQ ID NO: 76956 - DNA, 25 bp, Artificial Sequence
  Description of Artificial Sequence: Synthetic oligonucleotide
gcacacgttgcccaccaccccatct

SEQ ID NO: 76957 - DNA, 26 bp, Artificial Sequence
  Description of Artificial Sequence: Synthetic oligonucleotide
cacacgttgcccaccaccccatctct

SEQ ID NO: 76958 - DNA, 27 bp, Artificial Sequence
  Description of Artificial Sequence: Synthetic oligonucleotide
acacgttgcccaccaccccatctctga

SEQ ID NO: 76959 - DNA, 26 bp, Artificial Sequence
  Description of Artificial Sequence: Synthetic oligonucleotide
cacgttgcccaccaccccatctctga

SEQ ID NO: 76960 - DNA, 26 bp, Artificial Sequence
  Description of Artificial Sequence: Synthetic oligonucleotide
acgttgcccaccaccccatctctgac

SEQ ID NO: 76961 - DNA, 25 bp, Artificial Sequence
  Description of Artificial Sequence: Synthetic oligonucleotide
cgttgcccaccaccccatctctgac

SEQ ID NO: 76962 - DNA, 27 bp, Artificial Sequence
  Description of Artificial Sequence: Synthetic oligonucleotide
gttgcccaccaccccatctctgaccat

SEQ ID NO: 76963 - DNA, 27 bp, Artificial Sequence
  Description of Artificial Sequence: Synthetic oligonucleotide
ttgcccaccaccccatctctgaccatg

SEQ ID NO: 76964 - DNA, 27 bp, Artificial Sequence
  Description of Artificial Sequence: Synthetic oligonucleotide
tgcccaccaccccatctctgaccatga

SEQ ID NO: 76965 - DNA, 26 bp, Artificial Sequence
  Description of Artificial Sequence: Synthetic oligonucleotide
gcccaccaccccatctctgaccatga

SEQ ID NO: 76966 - DNA, 26 bp, Artificial Sequence
  Description of Artificial Sequence: Synthetic oligonucleotide
ctgggcttctaccctgcggagatcac

SEQ ID NO: 76967 - DNA, 26 bp, Artificial Sequence
  Description of Artificial Sequence: Synthetic oligonucleotide
tgggcttctaccctgcggagatcacg

SEQ ID NO: 76968 - DNA, 25 bp, Artificial Sequence
  Description of Artificial Sequence: Synthetic oligonucleotide
gggcttctaccctgcggagatcacg

SEQ ID NO: 76969 - DNA, 26 bp, Artificial Sequence
  Description of Artificial Sequence: Synthetic oligonucleotide
ggcttctaccctgcggagatcacgct

SEQ ID NO: 76970 - DNA, 27 bp, Artificial Sequence
  Description of Artificial Sequence: Synthetic oligonucleotide
gcttctaccctgcggagatcacgctga

SEQ ID NO: 76971 - DNA, 27 bp, Artificial Sequence
  Description of Artificial Sequence: Synthetic oligonucleotide
cttctaccctgcggagatcacgctgac

SEQ ID NO: 76972 - DNA, 27 bp, Artificial Sequence
  Description of Artificial Sequence: Synthetic oligonucleotide
ttctaccctgcggagatcacgctgacc

SEQ ID NO: 76973 - DNA, 27 bp, Artificial Sequence
  Description of Artificial Sequence: Synthetic oligonucleotide
tctaccctgcggagatcacgctgacct

SEQ ID NO: 76974 - DNA, 26 bp, Artificial Sequence
  Description of Artificial Sequence: Synthetic oligonucleotide
ctaccctgcggagatcacgctgacct

SEQ ID NO: 76975 - DNA, 26 bp, Artificial Sequence
  Description of Artificial Sequence: Synthetic oligonucleotide
taccctgcggagatcacgctgacctg

SEQ ID NO: 76976 - DNA, 25 bp, Artificial Sequence
  Description of Artificial Sequence: Synthetic oligonucleotide
accctgcggagatcacgctgacctg

SEQ ID NO: 76977 - DNA, 24 bp, Artificial Sequence
  Description of Artificial Sequence: Synthetic oligonucleotide
ccctgcggagatcacgctgacctg

SEQ ID NO: 76978 - DNA, 24 bp, Artificial Sequence
  Description of Artificial Sequence: Synthetic oligonucleotide
cctgcggagatcacgctgacctgg

SEQ ID NO: 76979 - DNA, 25 bp, Artificial Sequence
  Description of Artificial Sequence: Synthetic oligonucleotide
ctgcggagatcacgctgacctggca

SEQ ID NO: 76980 - DNA, 25 bp, Artificial Sequence
  Description of Artificial Sequence: Synthetic oligonucleotide
tgcggagatcacgctgacctggcag

SEQ ID NO: 76981 - DNA, 24 bp, Artificial Sequence
  Description of Artificial Sequence: Synthetic oligonucleotide
gcggagatcacgctgacctggcag

SEQ ID NO: 76982 - DNA, 24 bp, Artificial Sequence
  Description of Artificial Sequence: Synthetic oligonucleotide
cggagatcacgctgacctggcagc

SEQ ID NO: 76983 - DNA, 24 bp, Artificial Sequence
  Description of Artificial Sequence: Synthetic oligonucleotide
ggagatcacgctgacctggcagcg

SEQ ID NO: 76984 - DNA, 24 bp, Artificial Sequence
  Description of Artificial Sequence: Synthetic oligonucleotide
gagatcacgctgacctggcagcgg

SEQ ID NO: 76985 - DNA, 26 bp, Artificial Sequence
  Description of Artificial Sequence: Synthetic oligonucleotide
agatcacgctgacctggcagcgggat

SEQ ID NO: 76986 - DNA, 25 bp, Artificial Sequence
  Description of Artificial Sequence: Synthetic oligonucleotide
gatcacgctgacctggcagcgggat

SEQ ID NO: 76987 - DNA, 25 bp, Artificial Sequence
  Description of Artificial Sequence: Synthetic oligonucleotide
atcacgctgacctggcagcgggatg

SEQ ID NO: 76988 - DNA, 24 bp, Artificial Sequence
  Description of Artificial Sequence: Synthetic oligonucleotide
tcacgctgacctggcagcgggatg

SEQ ID NO: 76989 - DNA, 23 bp, Artificial Sequence
  Description of Artificial Sequence: Synthetic oligonucleotide
cacgctgacctggcagcgggatg

SEQ ID NO: 76990 - DNA, 23 bp, Artificial Sequence
  Description of Artificial Sequence: Synthetic oligonucleotide
acgctgacctggcagcgggatgg

SEQ ID NO: 76991 - DNA, 22 bp, Artificial Sequence
  Description of Artificial Sequence: Synthetic oligonucleotide
cgctgacctggcagcgggatgg

SEQ ID NO: 76992 - DNA, 22 bp, Artificial Sequence
  Description of Artificial Sequence: Synthetic oligonucleotide
gctgacctggcagcgggatggg

SEQ ID NO: 76993 - DNA, 24 bp, Artificial Sequence
  Description of Artificial Sequence: Synthetic oligonucleotide
acctggcagcgggatggggaggaa

SEQ ID NO: 76994 - DNA, 23 bp, Artificial Sequence
  Description of Artificial Sequence: Synthetic oligonucleotide
cctggcagcgggatggggaggaa

SEQ ID NO: 76995 - DNA, 24 bp, Artificial Sequence
  Description of Artificial Sequence: Synthetic oligonucleotide
ctggcagcgggatggggaggaaca

SEQ ID NO: 76996 - DNA, 25 bp, Artificial Sequence
  Description of Artificial Sequence: Synthetic oligonucleotide
tggcagcgggatggggaggaacaga

SEQ ID NO: 76997 - DNA, 24 bp, Artificial Sequence
  Description of Artificial Sequence: Synthetic oligonucleotide
ggcagcgggatggggaggaacaga

SEQ ID NO: 76998 - DNA, 24 bp, Artificial Sequence
  Description of Artificial Sequence: Synthetic oligonucleotide
gcagcgggatggggaggaacagac

SEQ ID NO: 76999 - DNA, 24 bp, Artificial Sequence
  Description of Artificial Sequence: Synthetic oligonucleotide
cagcgggatggggaggaacagacc

SEQ ID NO: 77000 - DNA, 25 bp, Artificial Sequence
  Description of Artificial Sequence: Synthetic oligonucleotide
agcgggatggggaggaacagaccca

SEQ ID NO: 77001 - DNA, 24 bp, Artificial Sequence
  Description of Artificial Sequence: Synthetic oligonucleotide
gcgggatggggaggaacagaccca

SEQ ID NO: 77002 - DNA, 24 bp, Artificial Sequence
  Description of Artificial Sequence: Synthetic oligonucleotide
cgggatggggaggaacagacccag

SEQ ID NO: 77003 - DNA, 25 bp, Artificial Sequence
  Description of Artificial Sequence: Synthetic oligonucleotide
gggatggggaggaacagacccagga

SEQ ID NO: 77004 - DNA, 26 bp, Artificial Sequence
  Description of Artificial Sequence: Synthetic oligonucleotide
ggatggggaggaacagacccaggaca

SEQ ID NO: 77005 - DNA, 27 bp, Artificial Sequence
  Description of Artificial Sequence: Synthetic oligonucleotide
gatggggaggaacagacccaggacaca

SEQ ID NO: 77006 - DNA, 27 bp, Artificial Sequence
  Description of Artificial Sequence: Synthetic oligonucleotide
atggggaggaacagacccaggacacag

SEQ ID NO: 77007 - DNA, 27 bp, Artificial Sequence
  Description of Artificial Sequence: Synthetic oligonucleotide
tggggaggaacagacccaggacacaga

SEQ ID NO: 77008 - DNA, 26 bp, Artificial Sequence
  Description of Artificial Sequence: Synthetic oligonucleotide
ggggaggaacagacccaggacacaga

SEQ ID NO: 77009 - DNA, 26 bp, Artificial Sequence
  Description of Artificial Sequence: Synthetic oligonucleotide
gggaggaacagacccaggacacagag

SEQ ID NO: 77010 - DNA, 27 bp, Artificial Sequence
  Description of Artificial Sequence: Synthetic oligonucleotide
ggaggaacagacccaggacacagagct

SEQ ID NO: 77011 - DNA, 28 bp, Artificial Sequence
  Description of Artificial Sequence: Synthetic oligonucleotide
gaggaacagacccaggacacagagcttg

SEQ ID NO: 77012 - DNA, 29 bp, Artificial Sequence
  Description of Artificial Sequence: Synthetic oligonucleotide
aggaacagacccaggacacagagcttgtg

SEQ ID NO: 77013 - DNA, 28 bp, Artificial Sequence
  Description of Artificial Sequence: Synthetic oligonucleotide
ggaacagacccaggacacagagcttgtg

SEQ ID NO: 77014 - DNA, 28 bp, Artificial Sequence
  Description of Artificial Sequence: Synthetic oligonucleotide
gaacagacccaggacacagagcttgtgg

SEQ ID NO: 77015 - DNA, 29 bp, Artificial Sequence
  Description of Artificial Sequence: Synthetic oligonucleotide
aacagacccaggacacagagcttgtggag

SEQ ID NO: 77016 - DNA, 28 bp, Artificial Sequence
  Description of Artificial Sequence: Synthetic oligonucleotide
acagacccaggacacagagcttgtggag

SEQ ID NO: 77017 - DNA, 27 bp, Artificial Sequence
  Description of Artificial Sequence: Synthetic oligonucleotide
cagacccaggacacagagcttgtggag

SEQ ID NO: 77018 - DNA, 28 bp, Artificial Sequence
  Description of Artificial Sequence: Synthetic oligonucleotide
agacccaggacacagagcttgtggagac

SEQ ID NO: 77019 - DNA, 27 bp, Artificial Sequence
  Description of Artificial Sequence: Synthetic oligonucleotide
gacccaggacacagagcttgtggagac

SEQ ID NO: 77020 - DNA, 27 bp, Artificial Sequence
  Description of Artificial Sequence: Synthetic oligonucleotide
acccaggacacagagcttgtggagacc

SEQ ID NO: 77021 - DNA, 27 bp, Artificial Sequence
  Description of Artificial Sequence: Synthetic oligonucleotide
cccaggacacagagcttgtggagacca

SEQ ID NO: 77022 - DNA, 27 bp, Artificial Sequence
  Description of Artificial Sequence: Synthetic oligonucleotide
ccaggacacagagcttgtggagaccag

SEQ ID NO: 77023 - DNA, 27 bp, Artificial Sequence
  Description of Artificial Sequence: Synthetic oligonucleotide
caggacacagagcttgtggagaccagg

SEQ ID NO: 77024 - DNA, 27 bp, Artificial Sequence
  Description of Artificial Sequence: Synthetic oligonucleotide
aggacacagagcttgtggagaccaggc

SEQ ID NO: 77025 - DNA, 26 bp, Artificial Sequence
  Description of Artificial Sequence: Synthetic oligonucleotide
ggacacagagcttgtggagaccaggc

SEQ ID NO: 77026 - DNA, 27 bp, Artificial Sequence
  Description of Artificial Sequence: Synthetic oligonucleotide
gacacagagcttgtggagaccaggcct

SEQ ID NO: 77027 - DNA, 27 bp, Artificial Sequence
  Description of Artificial Sequence: Synthetic oligonucleotide
acacagagcttgtggagaccaggcctg

SEQ ID NO: 77028 - DNA, 26 bp, Artificial Sequence
  Description of Artificial Sequence: Synthetic oligonucleotide
cacagagcttgtggagaccaggcctg

SEQ ID NO: 77029 - DNA, 27 bp, Artificial Sequence
  Description of Artificial Sequence: Synthetic oligonucleotide
acagagcttgtggagaccaggcctgca

SEQ ID NO: 77030 - DNA, 26 bp, Artificial Sequence
  Description of Artificial Sequence: Synthetic oligonucleotide
cagagcttgtggagaccaggcctgca

SEQ ID NO: 77031 - DNA, 26 bp, Artificial Sequence
  Description of Artificial Sequence: Synthetic oligonucleotide
agagcttgtggagaccaggcctgcag

SEQ ID NO: 77032 - DNA, 25 bp, Artificial Sequence
  Description of Artificial Sequence: Synthetic oligonucleotide
ccgctgtggtggtgccttctggaga

SEQ ID NO: 77033 - DNA, 25 bp, Artificial Sequence
  Description of Artificial Sequence: Synthetic oligonucleotide
cgctgtggtggtgccttctggagag

SEQ ID NO: 77034 - DNA, 27 bp, Artificial Sequence
  Description of Artificial Sequence: Synthetic oligonucleotide
gctgtggtggtgccttctggagaggaa

SEQ ID NO: 77035 - DNA, 27 bp, Artificial Sequence
  Description of Artificial Sequence: Synthetic oligonucleotide
ctgtggtggtgccttctggagaggaac

SEQ ID NO: 77036 - DNA, 28 bp, Artificial Sequence
  Description of Artificial Sequence: Synthetic oligonucleotide
tgtggtggtgccttctggagaggaacag

SEQ ID NO: 77037 - DNA, 27 bp, Artificial Sequence
  Description of Artificial Sequence: Synthetic oligonucleotide
gtggtggtgccttctggagaggaacag

SEQ ID NO: 77038 - DNA, 28 bp, Artificial Sequence
  Description of Artificial Sequence: Synthetic oligonucleotide
tggtggtgccttctggagaggaacagag

SEQ ID NO: 77039 - DNA, 27 bp, Artificial Sequence
  Description of Artificial Sequence: Synthetic oligonucleotide
ggtggtgccttctggagaggaacagag

SEQ ID NO: 77040 - DNA, 30 bp, Artificial Sequence
  Description of Artificial Sequence: Synthetic oligonucleotide
gtggtgccttctggagaggaacagagatac

SEQ ID NO: 77041 - DNA, 31 bp, Artificial Sequence
  Description of Artificial Sequence: Synthetic oligonucleotide
tggtgccttctggagaggaacagagatacac

SEQ ID NO: 77042 - DNA, 30 bp, Artificial Sequence
  Description of Artificial Sequence: Synthetic oligonucleotide
ggtgccttctggagaggaacagagatacac

SEQ ID NO: 77043 - DNA, 32 bp, Artificial Sequence
  Description of Artificial Sequence: Synthetic oligonucleotide
gtgccttctggagaggaacagagatacacatg

SEQ ID NO: 77044 - DNA, 32 bp, Artificial Sequence
  Description of Artificial Sequence: Synthetic oligonucleotide
tgccttctggagaggaacagagatacacatgc

SEQ ID NO: 77045 - DNA, 31 bp, Artificial Sequence
  Description of Artificial Sequence: Synthetic oligonucleotide
gccttctggagaggaacagagatacacatgc

SEQ ID NO: 77046 - DNA, 31 bp, Artificial Sequence
  Description of Artificial Sequence: Synthetic oligonucleotide
ccttctggagaggaacagagatacacatgcc

SEQ ID NO: 77047 - DNA, 33 bp, Artificial Sequence
  Description of Artificial Sequence: Synthetic oligonucleotide
cttctggagaggaacagagatacacatgccatg

SEQ ID NO: 77048 - DNA, 34 bp, Artificial Sequence
  Description of Artificial Sequence: Synthetic oligonucleotide
ttctggagaggaacagagatacacatgccatgtg

SEQ ID NO: 77049 - DNA, 33 bp, Artificial Sequence
  Description of Artificial Sequence: Synthetic oligonucleotide
tctggagaggaacagagatacacatgccatgtg

SEQ ID NO: 77050 - DNA, 32 bp, Artificial Sequence
  Description of Artificial Sequence: Synthetic oligonucleotide
ctggagaggaacagagatacacatgccatgtg

SEQ ID NO: 77051 - DNA, 32 bp, Artificial Sequence
  Description of Artificial Sequence: Synthetic oligonucleotide
tggagaggaacagagatacacatgccatgtgc

SEQ ID NO: 77052 - DNA, 31 bp, Artificial Sequence
  Description of Artificial Sequence: Synthetic oligonucleotide
ggagaggaacagagatacacatgccatgtgc

SEQ ID NO: 77053 - DNA, 32 bp, Artificial Sequence
  Description of Artificial Sequence: Synthetic oligonucleotide
gagaggaacagagatacacatgccatgtgcag

SEQ ID NO: 77054 - DNA, 32 bp, Artificial Sequence
  Description of Artificial Sequence: Synthetic oligonucleotide
agaggaacagagatacacatgccatgtgcagc

SEQ ID NO: 77055 - DNA, 31 bp, Artificial Sequence
  Description of Artificial Sequence: Synthetic oligonucleotide
gaggaacagagatacacatgccatgtgcagc

SEQ ID NO: 77056 - DNA, 32 bp, Artificial Sequence
  Description of Artificial Sequence: Synthetic oligonucleotide
aggaacagagatacacatgccatgtgcagcac

SEQ ID NO: 77057 - DNA, 31 bp, Artificial Sequence
  Description of Artificial Sequence: Synthetic oligonucleotide
ggaacagagatacacatgccatgtgcagcac

SEQ ID NO: 77058 - DNA, 31 bp, Artificial Sequence
  Description of Artificial Sequence: Synthetic oligonucleotide
gaacagagatacacatgccatgtgcagcacg

SEQ ID NO: 77059 - DNA, 32 bp, Artificial Sequence
  Description of Artificial Sequence: Synthetic oligonucleotide
aacagagatacacatgccatgtgcagcacgag

SEQ ID NO: 77060 - DNA, 31 bp, Artificial Sequence
  Description of Artificial Sequence: Synthetic oligonucleotide
acagagatacacatgccatgtgcagcacgag

SEQ ID NO: 77061 - DNA, 23 bp, Artificial Sequence
  Description of Artificial Sequence: Synthetic oligonucleotide
atgtgcagcacgaggggctgccc

SEQ ID NO: 77062 - DNA, 22 bp, Artificial Sequence
  Description of Artificial Sequence: Synthetic oligonucleotide
tgtgcagcacgaggggctgccc

SEQ ID NO: 77063 - DNA, 21 bp, Artificial Sequence
  Description of Artificial Sequence: Synthetic oligonucleotide
gtgcagcacgaggggctgccc

SEQ ID NO: 77064 - DNA, 22 bp, Artificial Sequence
  Description of Artificial Sequence: Synthetic oligonucleotide
tgcagcacgaggggctgcccca

SEQ ID NO: 77065 - DNA, 21 bp, Artificial Sequence
  Description of Artificial Sequence: Synthetic oligonucleotide
gcagcacgaggggctgcccca

SEQ ID NO: 77066 - DNA, 21 bp, Artificial Sequence
  Description of Artificial Sequence: Synthetic oligonucleotide
cagcacgaggggctgccccag

SEQ ID NO: 77067 - DNA, 21 bp, Artificial Sequence
  Description of Artificial Sequence: Synthetic oligonucleotide
agcacgaggggctgccccagc

SEQ ID NO: 77068 - DNA, 20 bp, Artificial Sequence
  Description of Artificial Sequence: Synthetic oligonucleotide
gcacgaggggctgccccagc

SEQ ID NO: 77069 - DNA, 20 bp, Artificial Sequence
  Description of Artificial Sequence: Synthetic oligonucleotide
cacgaggggctgccccagcc

SEQ ID NO: 77070 - DNA, 20 bp, Artificial Sequence
  Description of Artificial Sequence: Synthetic oligonucleotide
acgaggggctgccccagccc

SEQ ID NO: 77071 - DNA, 20 bp, Artificial Sequence
  Description of Artificial Sequence: Synthetic oligonucleotide
cgaggggctgccccagccct

SEQ ID NO: 77072 - DNA, 20 bp, Artificial Sequence
  Description of Artificial Sequence: Synthetic oligonucleotide
gaggggctgccccagcccct

SEQ ID NO: 77073 - DNA, 22 bp, Artificial Sequence
  Description of Artificial Sequence: Synthetic oligonucleotide
aggggctgccccagcccctcat

SEQ ID NO: 77074 - DNA, 21 bp, Artificial Sequence
  Description of Artificial Sequence: Synthetic oligonucleotide
ggggctgccccagcccctcat

SEQ ID NO: 77075 - DNA, 21 bp, Artificial Sequence
  Description of Artificial Sequence: Synthetic oligonucleotide
gggctgccccagcccctcatc

SEQ ID NO: 77076 - DNA, 22 bp, Artificial Sequence
  Description of Artificial Sequence: Synthetic oligonucleotide
ggctgccccagcccctcatcct

SEQ ID NO: 77077 - DNA, 23 bp, Artificial Sequence
  Description of Artificial Sequence: Synthetic oligonucleotide
gctgccccagcccctcatcctga

SEQ ID NO: 77078 - DNA, 25 bp, Artificial Sequence
  Description of Artificial Sequence: Synthetic oligonucleotide
ctgccccagcccctcatcctgagat

SEQ ID NO: 77079 - DNA, 25 bp, Artificial Sequence
  Description of Artificial Sequence: Synthetic oligonucleotide
tgccccagcccctcatcctgagatg

SEQ ID NO: 77080 - DNA, 24 bp, Artificial Sequence
  Description of Artificial Sequence: Synthetic oligonucleotide
gccccagcccctcatcctgagatg

SEQ ID NO: 77081 - DNA, 24 bp, Artificial Sequence
  Description of Artificial Sequence: Synthetic oligonucleotide
ccccagcccctcatcctgagatgg

SEQ ID NO: 77082 - DNA, 25 bp, Artificial Sequence
  Description of Artificial Sequence: Synthetic oligonucleotide
cccagcccctcatcctgagatggga

SEQ ID NO: 77083 - DNA, 25 bp, Artificial Sequence
  Description of Artificial Sequence: Synthetic oligonucleotide
ccagcccctcatcctgagatgggag

SEQ ID NO: 77084 - DNA, 26 bp, Artificial Sequence
  Description of Artificial Sequence: Synthetic oligonucleotide
cagcccctcatcctgagatgggagca

SEQ ID NO: 77085 - DNA, 27 bp, Artificial Sequence
  Description of Artificial Sequence: Synthetic oligonucleotide
agcccctcatcctgagatgggagcagt

SEQ ID NO: 77086 - DNA, 26 bp, Artificial Sequence
  Description of Artificial Sequence: Synthetic oligonucleotide
gcccctcatcctgagatgggagcagt

SEQ ID NO: 77087 - DNA, 27 bp, Artificial Sequence
  Description of Artificial Sequence: Synthetic oligonucleotide
cccctcatcctgagatgggagcagtct

SEQ ID NO: 77088 - DNA, 27 bp, Artificial Sequence
  Description of Artificial Sequence: Synthetic oligonucleotide
ccctcatcctgagatgggagcagtctc

SEQ ID NO: 77089 - DNA, 27 bp, Artificial Sequence
  Description of Artificial Sequence: Synthetic oligonucleotide
cctcatcctgagatgggagcagtctcc

SEQ ID NO: 77090 - DNA, 27 bp, Artificial Sequence
  Description of Artificial Sequence: Synthetic oligonucleotide
ctcatcctgagatgggagcagtctccc

SEQ ID NO: 77091 - DNA, 27 bp, Artificial Sequence
  Description of Artificial Sequence: Synthetic oligonucleotide
tcatcctgagatgggagcagtctcccc

SEQ ID NO: 77092 - DNA, 27 bp, Artificial Sequence
  Description of Artificial Sequence: Synthetic oligonucleotide
catcctgagatgggagcagtctcccca

SEQ ID NO: 77093 - DNA, 27 bp, Artificial Sequence
  Description of Artificial Sequence: Synthetic oligonucleotide
atcctgagatgggagcagtctccccag

SEQ ID NO: 77094 - DNA, 26 bp, Artificial Sequence
  Description of Artificial Sequence: Synthetic oligonucleotide
tcctgagatgggagcagtctccccag

SEQ ID NO: 77095 - DNA, 25 bp, Artificial Sequence
  Description of Artificial Sequence: Synthetic oligonucleotide
cctgagatgggagcagtctccccag

SEQ ID NO: 77096 - DNA, 25 bp, Artificial Sequence
  Description of Artificial Sequence: Synthetic oligonucleotide
ctgagatgggagcagtctccccagc

SEQ ID NO: 77097 - DNA, 25 bp, Artificial Sequence
  Description of Artificial Sequence: Synthetic oligonucleotide
tgagatgggagcagtctccccagcc

SEQ ID NO: 77098 - DNA, 24 bp, Artificial Sequence
  Description of Artificial Sequence: Synthetic oligonucleotide
gagatgggagcagtctccccagcc

SEQ ID NO: 77099 - DNA, 25 bp, Artificial Sequence
  Description of Artificial Sequence: Synthetic oligonucleotide
agatgggagcagtctccccagccca

SEQ ID NO: 77100 - DNA, 24 bp, Artificial Sequence
  Description of Artificial Sequence: Synthetic oligonucleotide
gatgggagcagtctccccagccca

SEQ ID NO: 77101 - DNA, 24 bp, Artificial Sequence
  Description of Artificial Sequence: Synthetic oligonucleotide
atgggagcagtctccccagcccac

SEQ ID NO: 77102 - DNA, 23 bp, Artificial Sequence
  Description of Artificial Sequence: Synthetic oligonucleotide
tgggagcagtctccccagcccac

SEQ ID NO: 77103 - DNA, 22 bp, Artificial Sequence
  Description of Artificial Sequence: Synthetic oligonucleotide
gggagcagtctccccagcccac

SEQ ID NO: 77104 - DNA, 24 bp, Artificial Sequence
  Description of Artificial Sequence: Synthetic oligonucleotide
ggagcagtctccccagcccaccat

SEQ ID NO: 77105 - DNA, 24 bp, Artificial Sequence
  Description of Artificial Sequence: Synthetic oligonucleotide
gagcagtctccccagcccaccatc

SEQ ID NO: 77106 - DNA, 24 bp, Artificial Sequence
  Description of Artificial Sequence: Synthetic oligonucleotide
agcagtctccccagcccaccatcc

SEQ ID NO: 77107 - DNA, 23 bp, Artificial Sequence
  Description of Artificial Sequence: Synthetic oligonucleotide
gcagtctccccagcccaccatcc

SEQ ID NO: 77108 - DNA, 23 bp, Artificial Sequence
  Description of Artificial Sequence: Synthetic oligonucleotide
cagtctccccagcccaccatccc

SEQ ID NO: 77109 - DNA, 25 bp, Artificial Sequence
  Description of Artificial Sequence: Synthetic oligonucleotide
agtctccccagcccaccatccccat

SEQ ID NO: 77110 - DNA, 24 bp, Artificial Sequence
  Description of Artificial Sequence: Synthetic oligonucleotide
gtctccccagcccaccatccccat

SEQ ID NO: 77111 - DNA, 24 bp, Artificial Sequence
  Description of Artificial Sequence: Synthetic oligonucleotide
tctccccagcccaccatccccatc

SEQ ID NO: 77112 - DNA, 23 bp, Artificial Sequence
  Description of Artificial Sequence: Synthetic oligonucleotide
ctccccagcccaccatccccatc

SEQ ID NO: 77113 - DNA, 24 bp, Artificial Sequence
  Description of Artificial Sequence: Synthetic oligonucleotide
tccccagcccaccatccccatcgt

SEQ ID NO: 77114 - DNA, 23 bp, Artificial Sequence
  Description of Artificial Sequence: Synthetic oligonucleotide
ccccagcccaccatccccatcgt

SEQ ID NO: 77115 - DNA, 26 bp, Artificial Sequence
  Description of Artificial Sequence: Synthetic oligonucleotide
ccatcgtgggcatcgttgctggcctt

SEQ ID NO: 77116 - DNA, 27 bp, Artificial Sequence
  Description of Artificial Sequence: Synthetic oligonucleotide
catcgtgggcatcgttgctggccttgt

SEQ ID NO: 77117 - DNA, 28 bp, Artificial Sequence
  Description of Artificial Sequence: Synthetic oligonucleotide
atcgtgggcatcgttgctggccttgttg

SEQ ID NO: 77118 - DNA, 27 bp, Artificial Sequence
  Description of Artificial Sequence: Synthetic oligonucleotide
tcgtgggcatcgttgctggccttgttg

SEQ ID NO: 77119 - DNA, 27 bp, Artificial Sequence
  Description of Artificial Sequence: Synthetic oligonucleotide
cgtgggcatcgttgctggccttgttgt

SEQ ID NO: 77120 - DNA, 27 bp, Artificial Sequence
  Description of Artificial Sequence: Synthetic oligonucleotide
gtgggcatcgttgctggccttgttgtc

SEQ ID NO: 77121 - DNA, 27 bp, Artificial Sequence
  Description of Artificial Sequence: Synthetic oligonucleotide
tgggcatcgttgctggccttgttgtcc

SEQ ID NO: 77122 - DNA, 27 bp, Artificial Sequence
  Description of Artificial Sequence: Synthetic oligonucleotide
gggcatcgttgctggccttgttgtcct

SEQ ID NO: 77123 - DNA, 28 bp, Artificial Sequence
  Description of Artificial Sequence: Synthetic oligonucleotide
ggcatcgttgctggccttgttgtccttg

SEQ ID NO: 77124 - DNA, 28 bp, Artificial Sequence
  Description of Artificial Sequence: Synthetic oligonucleotide
gcatcgttgctggccttgttgtccttgg

SEQ ID NO: 77125 - DNA, 29 bp, Artificial Sequence
  Description of Artificial Sequence: Synthetic oligonucleotide
catcgttgctggccttgttgtccttggag

SEQ ID NO: 77126 - DNA, 29 bp, Artificial Sequence
  Description of Artificial Sequence: Synthetic oligonucleotide
atcgttgctggccttgttgtccttggagc

SEQ ID NO: 77127 - DNA, 28 bp, Artificial Sequence
  Description of Artificial Sequence: Synthetic oligonucleotide
tcgttgctggccttgttgtccttggagc

SEQ ID NO: 77128 - DNA, 27 bp, Artificial Sequence
  Description of Artificial Sequence: Synthetic oligonucleotide
cgttgctggccttgttgtccttggagc

SEQ ID NO: 77129 - DNA, 28 bp, Artificial Sequence
  Description of Artificial Sequence: Synthetic oligonucleotide
gttgctggccttgttgtccttggagctg

SEQ ID NO: 77130 - DNA, 29 bp, Artificial Sequence
  Description of Artificial Sequence: Synthetic oligonucleotide
ttgctggccttgttgtccttggagctgtg

SEQ ID NO: 77131 - DNA, 28 bp, Artificial Sequence
  Description of Artificial Sequence: Synthetic oligonucleotide
tgctggccttgttgtccttggagctgtg

SEQ ID NO: 77132 - DNA, 27 bp, Artificial Sequence
  Description of Artificial Sequence: Synthetic oligonucleotide
gctggccttgttgtccttggagctgtg

SEQ ID NO: 77133 - DNA, 27 bp, Artificial Sequence
  Description of Artificial Sequence: Synthetic oligonucleotide
ctggccttgttgtccttggagctgtgg

SEQ ID NO: 77134 - DNA, 28 bp, Artificial Sequence
  Description of Artificial Sequence: Synthetic oligonucleotide
tggccttgttgtccttggagctgtggtc

SEQ ID NO: 77135 - DNA, 27 bp, Artificial Sequence
  Description of Artificial Sequence: Synthetic oligonucleotide
ggccttgttgtccttggagctgtggtc

SEQ ID NO: 77136 - DNA, 28 bp, Artificial Sequence
  Description of Artificial Sequence: Synthetic oligonucleotide
gccttgttgtccttggagctgtggtcac

SEQ ID NO: 77137 - DNA, 29 bp, Artificial Sequence
  Description of Artificial Sequence: Synthetic oligonucleotide
ccttgttgtccttggagctgtggtcactg

SEQ ID NO: 77138 - DNA, 29 bp, Artificial Sequence
  Description of Artificial Sequence: Synthetic oligonucleotide
cttgttgtccttggagctgtggtcactgg

SEQ ID NO: 77139 - DNA, 30 bp, Artificial Sequence
  Description of Artificial Sequence: Synthetic oligonucleotide
ttgttgtccttggagctgtggtcactggag

SEQ ID NO: 77140 - DNA, 29 bp, Artificial Sequence
  Description of Artificial Sequence: Synthetic oligonucleotide
tgttgtccttggagctgtggtcactggag

SEQ ID NO: 77141 - DNA, 28 bp, Artificial Sequence
  Description of Artificial Sequence: Synthetic oligonucleotide
gttgtccttggagctgtggtcactggag

SEQ ID NO: 77142 - DNA, 28 bp, Artificial Sequence
  Description of Artificial Sequence: Synthetic oligonucleotide
ttgtccttggagctgtggtcactggagc

SEQ ID NO: 77143 - DNA, 27 bp, Artificial Sequence
  Description of Artificial Sequence: Synthetic oligonucleotide
tgtccttggagctgtggtcactggagc

SEQ ID NO: 77144 - DNA, 27 bp, Artificial Sequence
  Description of Artificial Sequence: Synthetic oligonucleotide
gtccttggagctgtggtcactggagct

SEQ ID NO: 77145 - DNA, 27 bp, Artificial Sequence
  Description of Artificial Sequence: Synthetic oligonucleotide
tccttggagctgtggtcactggagctg

SEQ ID NO: 77146 - DNA, 27 bp, Artificial Sequence
  Description of Artificial Sequence: Synthetic oligonucleotide
ccttggagctgtggtcactggagctgt

SEQ ID NO: 77147 - DNA, 27 bp, Artificial Sequence
  Description of Artificial Sequence: Synthetic oligonucleotide
cttggagctgtggtcactggagctgtg

SEQ ID NO: 77148 - DNA, 27 bp, Artificial Sequence
  Description of Artificial Sequence: Synthetic oligonucleotide
ttggagctgtggtcactggagctgtgg

SEQ ID NO: 77149 - DNA, 27 bp, Artificial Sequence
  Description of Artificial Sequence: Synthetic oligonucleotide
tggagctgtggtcactggagctgtggt

SEQ ID NO: 77150 - DNA, 26 bp, Artificial Sequence
  Description of Artificial Sequence: Synthetic oligonucleotide
ggagctgtggtcactggagctgtggt

SEQ ID NO: 77151 - DNA, 26 bp, Artificial Sequence
  Description of Artificial Sequence: Synthetic oligonucleotide
gagctgtggtcactggagctgtggtc

SEQ ID NO: 77152 - DNA, 26 bp, Artificial Sequence
  Description of Artificial Sequence: Synthetic oligonucleotide
agctgtggtcactggagctgtggtcg

SEQ ID NO: 77153 - DNA, 25 bp, Artificial Sequence
  Description of Artificial Sequence: Synthetic oligonucleotide
gctgtggtcactggagctgtggtcg

SEQ ID NO: 77154 - DNA, 26 bp, Artificial Sequence
  Description of Artificial Sequence: Synthetic oligonucleotide
ctgtggtcactggagctgtggtcgct

SEQ ID NO: 77155 - DNA, 26 bp, Artificial Sequence
  Description of Artificial Sequence: Synthetic oligonucleotide
tgtggtcactggagctgtggtcgctg

SEQ ID NO: 77156 - DNA, 25 bp, Artificial Sequence
  Description of Artificial Sequence: Synthetic oligonucleotide
gtggtcactggagctgtggtcgctg

SEQ ID NO: 77157 - DNA, 26 bp, Artificial Sequence
  Description of Artificial Sequence: Synthetic oligonucleotide
tggtcactggagctgtggtcgctgct

SEQ ID NO: 77158 - DNA, 25 bp, Artificial Sequence
  Description of Artificial Sequence: Synthetic oligonucleotide
ggtcactggagctgtggtcgctgct

SEQ ID NO: 77159 - DNA, 26 bp, Artificial Sequence
  Description of Artificial Sequence: Synthetic oligonucleotide
gtcactggagctgtggtcgctgctgt

SEQ ID NO: 77160 - DNA, 28 bp, Artificial Sequence
  Description of Artificial Sequence: Synthetic oligonucleotide
tgtggtcgctgctgtgatgtggaggaag

SEQ ID NO: 77161 - DNA, 27 bp, Artificial Sequence
  Description of Artificial Sequence: Synthetic oligonucleotide
gtggtcgctgctgtgatgtggaggaag

SEQ ID NO: 77162 - DNA, 29 bp, Artificial Sequence
  Description of Artificial Sequence: Synthetic oligonucleotide
tggtcgctgctgtgatgtggaggaagaag

SEQ ID NO: 77163 - DNA, 28 bp, Artificial Sequence
  Description of Artificial Sequence: Synthetic oligonucleotide
ggtcgctgctgtgatgtggaggaagaag

SEQ ID NO: 77164 - DNA, 29 bp, Artificial Sequence
  Description of Artificial Sequence: Synthetic oligonucleotide
gtcgctgctgtgatgtggaggaagaagag

SEQ ID NO: 77165 - DNA, 29 bp, Artificial Sequence
  Description of Artificial Sequence: Synthetic oligonucleotide
tcgctgctgtgatgtggaggaagaagagc

SEQ ID NO: 77166 - DNA, 28 bp, Artificial Sequence
  Description of Artificial Sequence: Synthetic oligonucleotide
cgctgctgtgatgtggaggaagaagagc

SEQ ID NO: 77167 - DNA, 29 bp, Artificial Sequence
  Description of Artificial Sequence: Synthetic oligonucleotide
gctgctgtgatgtggaggaagaagagctc

SEQ ID NO: 77168 - DNA, 30 bp, Artificial Sequence
  Description of Artificial Sequence: Synthetic oligonucleotide
ctgctgtgatgtggaggaagaagagctcag

SEQ ID NO: 77169 - DNA, 33 bp, Artificial Sequence
  Description of Artificial Sequence: Synthetic oligonucleotide
tgctgtgatgtggaggaagaagagctcagatag

SEQ ID NO: 77170 - DNA, 32 bp, Artificial Sequence
  Description of Artificial Sequence: Synthetic oligonucleotide
gctgtgatgtggaggaagaagagctcagatag

SEQ ID NO: 77171 - DNA, 35 bp, Artificial Sequence
  Description of Artificial Sequence: Synthetic oligonucleotide
ctgtgatgtggaggaagaagagctcagatagaaac

SEQ ID NO: 77172 - DNA, 36 bp, Artificial Sequence
  Description of Artificial Sequence: Synthetic oligonucleotide
tgtgatgtggaggaagaagagctcagatagaaacag

SEQ ID NO: 77173 - DNA, 35 bp, Artificial Sequence
  Description of Artificial Sequence: Synthetic oligonucleotide
gtgatgtggaggaagaagagctcagatagaaacag

SEQ ID NO: 77174 - DNA, 36 bp, Artificial Sequence
  Description of Artificial Sequence: Synthetic oligonucleotide
tgatgtggaggaagaagagctcagatagaaacagag

SEQ ID NO: 77175 - DNA, 35 bp, Artificial Sequence
  Description of Artificial Sequence: Synthetic oligonucleotide
gatgtggaggaagaagagctcagatagaaacagag

SEQ ID NO: 77176 - DNA, 35 bp, Artificial Sequence
  Description of Artificial Sequence: Synthetic oligonucleotide
atgtggaggaagaagagctcagatagaaacagagg

SEQ ID NO: 77177 - DNA, 34 bp, Artificial Sequence
  Description of Artificial Sequence: Synthetic oligonucleotide
tgtggaggaagaagagctcagatagaaacagagg

SEQ ID NO: 77178 - DNA, 33 bp, Artificial Sequence
  Description of Artificial Sequence: Synthetic oligonucleotide
gtggaggaagaagagctcagatagaaacagagg

SEQ ID NO: 77179 - DNA, 33 bp, Artificial Sequence
  Description of Artificial Sequence: Synthetic oligonucleotide
tggaggaagaagagctcagatagaaacagaggg

SEQ ID NO: 77180 - DNA, 32 bp, Artificial Sequence
  Description of Artificial Sequence: Synthetic oligonucleotide
ggaggaagaagagctcagatagaaacagaggg

SEQ ID NO: 77181 - DNA, 33 bp, Artificial Sequence
  Description of Artificial Sequence: Synthetic oligonucleotide
gaggaagaagagctcagatagaaacagagggag

SEQ ID NO: 77182 - DNA, 33 bp, Artificial Sequence
  Description of Artificial Sequence: Synthetic oligonucleotide
aggaagaagagctcagatagaaacagagggagc

SEQ ID NO: 77183 - DNA, 32 bp, Artificial Sequence
  Description of Artificial Sequence: Synthetic oligonucleotide
ggaagaagagctcagatagaaacagagggagc

SEQ ID NO: 77184 - DNA, 34 bp, Artificial Sequence
  Description of Artificial Sequence: Synthetic oligonucleotide
gaagaagagctcagatagaaacagagggagctac

SEQ ID NO: 77185 - DNA, 35 bp, Artificial Sequence
  Description of Artificial Sequence: Synthetic oligonucleotide
aagaagagctcagatagaaacagagggagctactc

SEQ ID NO: 77186 - DNA, 34 bp, Artificial Sequence
  Description of Artificial Sequence: Synthetic oligonucleotide
agaagagctcagatagaaacagagggagctactc

SEQ ID NO: 77187 - DNA, 33 bp, Artificial Sequence
  Description of Artificial Sequence: Synthetic oligonucleotide
gaagagctcagatagaaacagagggagctactc

SEQ ID NO: 77188 - DNA, 34 bp, Artificial Sequence
  Description of Artificial Sequence: Synthetic oligonucleotide
aagagctcagatagaaacagagggagctactctc

SEQ ID NO: 77189 - DNA, 33 bp, Artificial Sequence
  Description of Artificial Sequence: Synthetic oligonucleotide
agagctcagatagaaacagagggagctactctc

SEQ ID NO: 77190 - DNA, 32 bp, Artificial Sequence
  Description of Artificial Sequence: Synthetic oligonucleotide
gagctcagatagaaacagagggagctactctc

SEQ ID NO: 77191 - DNA, 33 bp, Artificial Sequence
  Description of Artificial Sequence: Synthetic oligonucleotide
agctcagatagaaacagagggagctactctcag

SEQ ID NO: 77192 - DNA, 32 bp, Artificial Sequence
  Description of Artificial Sequence: Synthetic oligonucleotide
gctcagatagaaacagagggagctactctcag

SEQ ID NO: 77193 - DNA, 32 bp, Artificial Sequence
  Description of Artificial Sequence: Synthetic oligonucleotide
ctcagatagaaacagagggagctactctcagg

SEQ ID NO: 77194 - DNA, 32 bp, Artificial Sequence
  Description of Artificial Sequence: Synthetic oligonucleotide
tcagatagaaacagagggagctactctcaggc

SEQ ID NO: 77195 - DNA, 31 bp, Artificial Sequence
  Description of Artificial Sequence: Synthetic oligonucleotide
cagatagaaacagagggagctactctcaggc

SEQ ID NO: 77196 - DNA, 32 bp, Artificial Sequence
  Description of Artificial Sequence: Synthetic oligonucleotide
agatagaaacagagggagctactctcaggctg

SEQ ID NO: 77197 - DNA, 31 bp, Artificial Sequence
  Description of Artificial Sequence: Synthetic oligonucleotide
gatagaaacagagggagctactctcaggctg

SEQ ID NO: 77198 - DNA, 31 bp, Artificial Sequence
  Description of Artificial Sequence: Synthetic oligonucleotide
atagaaacagagggagctactctcaggctgc

SEQ ID NO: 77199 - DNA, 30 bp, Artificial Sequence
  Description of Artificial Sequence: Synthetic oligonucleotide
tagaaacagagggagctactctcaggctgc

SEQ ID NO: 77200 - DNA, 29 bp, Artificial Sequence
  Description of Artificial Sequence: Synthetic oligonucleotide
agaaacagagggagctactctcaggctgc

SEQ ID NO: 77201 - DNA, 28 bp, Artificial Sequence
  Description of Artificial Sequence: Synthetic oligonucleotide
gaaacagagggagctactctcaggctgc

SEQ ID NO: 77202 - DNA, 29 bp, Artificial Sequence
  Description of Artificial Sequence: Synthetic oligonucleotide
aaacagagggagctactctcaggctgcag

SEQ ID NO: 77203 - DNA, 28 bp, Artificial Sequence
  Description of Artificial Sequence: Synthetic oligonucleotide
aacagagggagctactctcaggctgcag

SEQ ID NO: 77204 - DNA, 27 bp, Artificial Sequence
  Description of Artificial Sequence: Synthetic oligonucleotide
acagagggagctactctcaggctgcag

SEQ ID NO: 77205 - DNA, 27 bp, Artificial Sequence
  Description of Artificial Sequence: Synthetic oligonucleotide
cagagggagctactctcaggctgcagt

SEQ ID NO: 77206 - DNA, 27 bp, Artificial Sequence
  Description of Artificial Sequence: Synthetic oligonucleotide
agagggagctactctcaggctgcagtc

SEQ ID NO: 77207 - DNA, 27 bp, Artificial Sequence
  Description of Artificial Sequence: Synthetic oligonucleotide
gagggagctactctcaggctgcagtca

SEQ ID NO: 77208 - DNA, 27 bp, Artificial Sequence
  Description of Artificial Sequence: Synthetic oligonucleotide
agggagctactctcaggctgcagtcac

SEQ ID NO: 77209 - DNA, 27 bp, Artificial Sequence
  Description of Artificial Sequence: Synthetic oligonucleotide
gggagctactctcaggctgcagtcact

SEQ ID NO: 77210 - DNA, 27 bp, Artificial Sequence
  Description of Artificial Sequence: Synthetic oligonucleotide
ggagctactctcaggctgcagtcactg

SEQ ID NO: 77211 - DNA, 28 bp, Artificial Sequence
  Description of Artificial Sequence: Synthetic oligonucleotide
gagctactctcaggctgcagtcactgac

SEQ ID NO: 77212 - DNA, 29 bp, Artificial Sequence
  Description of Artificial Sequence: Synthetic oligonucleotide
agctactctcaggctgcagtcactgacag

SEQ ID NO: 77213 - DNA, 28 bp, Artificial Sequence
  Description of Artificial Sequence: Synthetic oligonucleotide
gctactctcaggctgcagtcactgacag

SEQ ID NO: 77214 - DNA, 29 bp, Artificial Sequence
  Description of Artificial Sequence: Synthetic oligonucleotide
ctactctcaggctgcagtcactgacagtg

SEQ ID NO: 77215 - DNA, 29 bp, Artificial Sequence
  Description of Artificial Sequence: Synthetic oligonucleotide
tactctcaggctgcagtcactgacagtgc

SEQ ID NO: 77216 - DNA, 28 bp, Artificial Sequence
  Description of Artificial Sequence: Synthetic oligonucleotide
actctcaggctgcagtcactgacagtgc

SEQ ID NO: 77217 - DNA, 27 bp, Artificial Sequence
  Description of Artificial Sequence: Synthetic oligonucleotide
ctctcaggctgcagtcactgacagtgc

SEQ ID NO: 77218 - DNA, 27 bp, Artificial Sequence
  Description of Artificial Sequence: Synthetic oligonucleotide
tctcaggctgcagtcactgacagtgcc

SEQ ID NO: 77219 - DNA, 26 bp, Artificial Sequence
  Description of Artificial Sequence: Synthetic oligonucleotide
ctcaggctgcagtcactgacagtgcc

SEQ ID NO: 77220 - DNA, 27 bp, Artificial Sequence
  Description of Artificial Sequence: Synthetic oligonucleotide
tcaggctgcagtcactgacagtgccca

SEQ ID NO: 77221 - DNA, 26 bp, Artificial Sequence
  Description of Artificial Sequence: Synthetic oligonucleotide
caggctgcagtcactgacagtgccca

SEQ ID NO: 77222 - DNA, 26 bp, Artificial Sequence
  Description of Artificial Sequence: Synthetic oligonucleotide
aggctgcagtcactgacagtgcccag

SEQ ID NO: 77223 - DNA, 25 bp, Artificial Sequence
  Description of Artificial Sequence: Synthetic oligonucleotide
ggctgcagtcactgacagtgcccag

SEQ ID NO: 77224 - DNA, 25 bp, Artificial Sequence
  Description of Artificial Sequence: Synthetic oligonucleotide
gctgcagtcactgacagtgcccagg

SEQ ID NO: 77225 - DNA, 25 bp, Artificial Sequence
  Description of Artificial Sequence: Synthetic oligonucleotide
ctgcagtcactgacagtgcccaggg

SEQ ID NO: 77226 - DNA, 26 bp, Artificial Sequence
  Description of Artificial Sequence: Synthetic oligonucleotide
tgcagtcactgacagtgcccagggct

SEQ ID NO: 77227 - DNA, 25 bp, Artificial Sequence
  Description of Artificial Sequence: Synthetic oligonucleotide
gcagtcactgacagtgcccagggct

SEQ ID NO: 77228 - DNA, 26 bp, Artificial Sequence
  Description of Artificial Sequence: Synthetic oligonucleotide
cagtcactgacagtgcccagggctct

SEQ ID NO: 77229 - DNA, 26 bp, Artificial Sequence
  Description of Artificial Sequence: Synthetic oligonucleotide
agtcactgacagtgcccagggctctg

SEQ ID NO: 77230 - DNA, 25 bp, Artificial Sequence
  Description of Artificial Sequence: Synthetic oligonucleotide
gtcactgacagtgcccagggctctg

SEQ ID NO: 77231 - DNA, 25 bp, Artificial Sequence
  Description of Artificial Sequence: Synthetic oligonucleotide
tcactgacagtgcccagggctctgg

SEQ ID NO: 77232 - DNA, 24 bp, Artificial Sequence
  Description of Artificial Sequence: Synthetic oligonucleotide
cactgacagtgcccagggctctgg

SEQ ID NO: 77233 - DNA, 24 bp, Artificial Sequence
  Description of Artificial Sequence: Synthetic oligonucleotide
actgacagtgcccagggctctggg

SEQ ID NO: 77234 - DNA, 23 bp, Artificial Sequence
  Description of Artificial Sequence: Synthetic oligonucleotide
ctgacagtgcccagggctctggg

SEQ ID NO: 77235 - DNA, 24 bp, Artificial Sequence
  Description of Artificial Sequence: Synthetic oligonucleotide
tgacagtgcccagggctctggggt

SEQ ID NO: 77236 - DNA, 23 bp, Artificial Sequence
  Description of Artificial Sequence: Synthetic oligonucleotide
gacagtgcccagggctctggggt

SEQ ID NO: 77237 - DNA, 24 bp, Artificial Sequence
  Description of Artificial Sequence: Synthetic oligonucleotide
acagtgcccagggctctggggtgt

SEQ ID NO: 77238 - DNA, 23 bp, Artificial Sequence
  Description of Artificial Sequence: Synthetic oligonucleotide
cagtgcccagggctctggggtgt

SEQ ID NO: 77239 - DNA, 24 bp, Artificial Sequence
  Description of Artificial Sequence: Synthetic oligonucleotide
agtgcccagggctctggggtgtct

SEQ ID NO: 77240 - DNA, 23 bp, Artificial Sequence
  Description of Artificial Sequence: Synthetic oligonucleotide
gtgcccagggctctggggtgtct

SEQ ID NO: 77241 - DNA, 24 bp, Artificial Sequence
  Description of Artificial Sequence: Synthetic oligonucleotide
tgcccagggctctggggtgtctct

SEQ ID NO: 77242 - DNA, 23 bp, Artificial Sequence
  Description of Artificial Sequence: Synthetic oligonucleotide
gcccagggctctggggtgtctct

SEQ ID NO: 77243 - DNA, 24 bp, Artificial Sequence
  Description of Artificial Sequence: Synthetic oligonucleotide
cccagggctctggggtgtctctca

SEQ ID NO: 77244 - DNA, 25 bp, Artificial Sequence
  Description of Artificial Sequence: Synthetic oligonucleotide
ccagggctctggggtgtctctcaca

SEQ ID NO: 77245 - DNA, 25 bp, Artificial Sequence
  Description of Artificial Sequence: Synthetic oligonucleotide
cagggctctggggtgtctctcacag

SEQ ID NO: 77246 - DNA, 27 bp, Artificial Sequence
  Description of Artificial Sequence: Synthetic oligonucleotide
agggctctggggtgtctctcacagcta

SEQ ID NO: 77247 - DNA, 27 bp, Artificial Sequence
  Description of Artificial Sequence: Synthetic oligonucleotide
gggctctggggtgtctctcacagctaa

SEQ ID NO: 77248 - DNA, 31 bp, Artificial Sequence
  Description of Artificial Sequence: Synthetic oligonucleotide
ggctctggggtgtctctcacagctaataaag

SEQ ID NO: 77249 - DNA, 32 bp, Artificial Sequence
  Description of Artificial Sequence: Synthetic oligonucleotide
gctctggggtgtctctcacagctaataaagtg

SEQ ID NO: 77250 - DNA, 33 bp, Artificial Sequence
  Description of Artificial Sequence: Synthetic oligonucleotide
ctctggggtgtctctcacagctaataaagtgtg

SEQ ID NO: 77251 - DNA, 25 bp, Artificial Sequence
  Description of Artificial Sequence: Synthetic oligonucleotide
cctggccctgaccgatacttgggca

SEQ ID NO: 77252 - DNA, 25 bp, Artificial Sequence
  Description of Artificial Sequence: Synthetic oligonucleotide
ctggccctgaccgatacttgggcag

SEQ ID NO: 77253 - DNA, 25 bp, Artificial Sequence
  Description of Artificial Sequence: Synthetic oligonucleotide
tggccctgaccgatacttgggcagg

SEQ ID NO: 77254 - DNA, 24 bp, Artificial Sequence
  Description of Artificial Sequence: Synthetic oligonucleotide
ggccctgaccgatacttgggcagg

SEQ ID NO: 77255 - DNA, 25 bp, Artificial Sequence
  Description of Artificial Sequence: Synthetic oligonucleotide
gccctgaccgatacttgggcaggct

SEQ ID NO: 77256 - DNA, 25 bp, Artificial Sequence
  Description of Artificial Sequence: Synthetic oligonucleotide
ccctgaccgatacttgggcaggctc

SEQ ID NO: 77257 - DNA, 25 bp, Artificial Sequence
  Description of Artificial Sequence: Synthetic oligonucleotide
cctgaccgatacttgggcaggctcc

SEQ ID NO: 77258 - DNA, 26 bp, Artificial Sequence
  Description of Artificial Sequence: Synthetic oligonucleotide
ctgaccgatacttgggcaggctccca

SEQ ID NO: 77259 - DNA, 27 bp, Artificial Sequence
  Description of Artificial Sequence: Synthetic oligonucleotide
tgaccgatacttgggcaggctcccact

SEQ ID NO: 77260 - DNA, 26 bp, Artificial Sequence
  Description of Artificial Sequence: Synthetic oligonucleotide
gaccgatacttgggcaggctcccact

SEQ ID NO: 77261 - DNA, 26 bp, Artificial Sequence
  Description of Artificial Sequence: Synthetic oligonucleotide
accgatacttgggcaggctcccactc

SEQ ID NO: 77262 - DNA, 25 bp, Artificial Sequence
  Description of Artificial Sequence: Synthetic oligonucleotide
ccgatacttgggcaggctcccactc

SEQ ID NO: 77263 - DNA, 27 bp, Artificial Sequence
  Description of Artificial Sequence: Synthetic oligonucleotide
cgatacttgggcaggctcccactcctt

SEQ ID NO: 77264 - DNA, 27 bp, Artificial Sequence
  Description of Artificial Sequence: Synthetic oligonucleotide
gatacttgggcaggctcccactccttg

SEQ ID NO: 77265 - DNA, 28 bp, Artificial Sequence
  Description of Artificial Sequence: Synthetic oligonucleotide
atacttgggcaggctcccactccttgag

SEQ ID NO: 77266 - DNA, 27 bp, Artificial Sequence
  Description of Artificial Sequence: Synthetic oligonucleotide
tacttgggcaggctcccactccttgag

SEQ ID NO: 77267 - DNA, 26 bp, Artificial Sequence
  Description of Artificial Sequence: Synthetic oligonucleotide
acttgggcaggctcccactccttgag

SEQ ID NO: 77268 - DNA, 25 bp, Artificial Sequence
  Description of Artificial Sequence: Synthetic oligonucleotide
cttgggcaggctcccactccttgag

SEQ ID NO: 77269 - DNA, 27 bp, Artificial Sequence
  Description of Artificial Sequence: Synthetic oligonucleotide
ttgggcaggctcccactccttgaggta

SEQ ID NO: 77270 - DNA, 27 bp, Artificial Sequence
  Description of Artificial Sequence: Synthetic oligonucleotide
tgggcaggctcccactccttgaggtat

SEQ ID NO: 77271 - DNA, 27 bp, Artificial Sequence
  Description of Artificial Sequence: Synthetic oligonucleotide
gggcaggctcccactccttgaggtatt

SEQ ID NO: 77272 - DNA, 28 bp, Artificial Sequence
  Description of Artificial Sequence: Synthetic oligonucleotide
ggcaggctcccactccttgaggtatttc

SEQ ID NO: 77273 - DNA, 29 bp, Artificial Sequence
  Description of Artificial Sequence: Synthetic oligonucleotide
gcaggctcccactccttgaggtatttcag

SEQ ID NO: 77274 - DNA, 29 bp, Artificial Sequence
  Description of Artificial Sequence: Synthetic oligonucleotide
caggctcccactccttgaggtatttcagc

SEQ ID NO: 77275 - DNA, 30 bp, Artificial Sequence
  Description of Artificial Sequence: Synthetic oligonucleotide
aggctcccactccttgaggtatttcagcac

SEQ ID NO: 77276 - DNA, 28 bp, Artificial Sequence
  Description of Artificial Sequence: Synthetic oligonucleotide
tctcaggctgcagtcactgacagtgctc

SEQ ID NO: 77277 - DNA, 27 bp, Artificial Sequence
  Description of Artificial Sequence: Synthetic oligonucleotide
ctcaggctgcagtcactgacagtgctc

SEQ ID NO: 77278 - DNA, 28 bp, Artificial Sequence
  Description of Artificial Sequence: Synthetic oligonucleotide
tcaggctgcagtcactgacagtgctcag

SEQ ID NO: 77279 - DNA, 27 bp, Artificial Sequence
  Description of Artificial Sequence: Synthetic oligonucleotide
caggctgcagtcactgacagtgctcag

SEQ ID NO: 77280 - DNA, 27 bp, Artificial Sequence
  Description of Artificial Sequence: Synthetic oligonucleotide
aggctgcagtcactgacagtgctcagg

SEQ ID NO: 77281 - DNA, 26 bp, Artificial Sequence
  Description of Artificial Sequence: Synthetic oligonucleotide
ggctgcagtcactgacagtgctcagg

SEQ ID NO: 77282 - DNA, 26 bp, Artificial Sequence
  Description of Artificial Sequence: Synthetic oligonucleotide
gctgcagtcactgacagtgctcaggg

SEQ ID NO: 77283 - DNA, 27 bp, Artificial Sequence
  Description of Artificial Sequence: Synthetic oligonucleotide
ctgcagtcactgacagtgctcagggct

SEQ ID NO: 77284 - DNA, 27 bp, Artificial Sequence
  Description of Artificial Sequence: Synthetic oligonucleotide
tgcagtcactgacagtgctcagggctc

SEQ ID NO: 77285 - DNA, 27 bp, Artificial Sequence
  Description of Artificial Sequence: Synthetic oligonucleotide
gcagtcactgacagtgctcagggctct

SEQ ID NO: 77286 - DNA, 27 bp, Artificial Sequence
  Description of Artificial Sequence: Synthetic oligonucleotide
cagtcactgacagtgctcagggctctg

SEQ ID NO: 77287 - DNA, 27 bp, Artificial Sequence
  Description of Artificial Sequence: Synthetic oligonucleotide
agtcactgacagtgctcagggctctgg

SEQ ID NO: 77288 - DNA, 26 bp, Artificial Sequence
  Description of Artificial Sequence: Synthetic oligonucleotide
gtcactgacagtgctcagggctctgg

SEQ ID NO: 77289 - DNA, 26 bp, Artificial Sequence
  Description of Artificial Sequence: Synthetic oligonucleotide
tcactgacagtgctcagggctctggg

SEQ ID NO: 77290 - DNA, 25 bp, Artificial Sequence
  Description of Artificial Sequence: Synthetic oligonucleotide
cactgacagtgctcagggctctggg

SEQ ID NO: 77291 - DNA, 26 bp, Artificial Sequence
  Description of Artificial Sequence: Synthetic oligonucleotide
actgacagtgctcagggctctggggt

SEQ ID NO: 77292 - DNA, 25 bp, Artificial Sequence
  Description of Artificial Sequence: Synthetic oligonucleotide
ctgacagtgctcagggctctggggt

SEQ ID NO: 77293 - DNA, 26 bp, Artificial Sequence
  Description of Artificial Sequence: Synthetic oligonucleotide
tgacagtgctcagggctctggggtgt

SEQ ID NO: 77294 - DNA, 25 bp, Artificial Sequence
  Description of Artificial Sequence: Synthetic oligonucleotide
gacagtgctcagggctctggggtgt

SEQ ID NO: 77295 - DNA, 26 bp, Artificial Sequence
  Description of Artificial Sequence: Synthetic oligonucleotide
acagtgctcagggctctggggtgtct

SEQ ID NO: 77296 - DNA, 25 bp, Artificial Sequence
  Description of Artificial Sequence: Synthetic oligonucleotide
cagtgctcagggctctggggtgtct

SEQ ID NO: 77297 - DNA, 26 bp, Artificial Sequence
  Description of Artificial Sequence: Synthetic oligonucleotide
agtgctcagggctctggggtgtctct

SEQ ID NO: 77298 - DNA, 25 bp, Artificial Sequence
  Description of Artificial Sequence: Synthetic oligonucleotide
gtgctcagggctctggggtgtctct

SEQ ID NO: 77299 - DNA, 26 bp, Artificial Sequence
  Description of Artificial Sequence: Synthetic oligonucleotide
tgctcagggctctggggtgtctctca

SEQ ID NO: 77300 - DNA, 25 bp, Artificial Sequence
  Description of Artificial Sequence: Synthetic oligonucleotide
gctcagggctctggggtgtctctca

SEQ ID NO: 77301 - DNA, 26 bp, Artificial Sequence
  Description of Artificial Sequence: Synthetic oligonucleotide
ctcagggctctggggtgtctctcaca

SEQ ID NO: 77302 - DNA, 26 bp, Artificial Sequence
  Description of Artificial Sequence: Synthetic oligonucleotide
tcagggctctggggtgtctctcacag

SEQ ID NO: 77303 - DNA, 24 bp, Artificial Sequence
  Description of Artificial Sequence: Synthetic oligonucleotide
cctcctcctgctgctctcaggggt

SEQ ID NO: 77304 - DNA, 24 bp, Artificial Sequence
  Description of Artificial Sequence: Synthetic oligonucleotide
ctcctcctgctgctctcaggggtc

SEQ ID NO: 77305 - DNA, 25 bp, Artificial Sequence
  Description of Artificial Sequence: Synthetic oligonucleotide
tcctcctgctgctctcaggggtcct

SEQ ID NO: 77306 - DNA, 24 bp, Artificial Sequence
  Description of Artificial Sequence: Synthetic oligonucleotide
cctcctgctgctctcaggggtcct

SEQ ID NO: 77307 - DNA, 24 bp, Artificial Sequence
  Description of Artificial Sequence: Synthetic oligonucleotide
ctcctgctgctctcaggggtcctg

SEQ ID NO: 77308 - DNA, 24 bp, Artificial Sequence
  Description of Artificial Sequence: Synthetic oligonucleotide
tcctgctgctctcaggggtcctgg

SEQ ID NO: 77309 - DNA, 23 bp, Artificial Sequence
  Description of Artificial Sequence: Synthetic oligonucleotide
cctgctgctctcaggggtcctgg

SEQ ID NO: 77310 - DNA, 23 bp, Artificial Sequence
  Description of Artificial Sequence: Synthetic oligonucleotide
ctgctgctctcaggggtcctggc

SEQ ID NO: 77311 - DNA, 23 bp, Artificial Sequence
  Description of Artificial Sequence: Synthetic oligonucleotide
tgctgctctcaggggtcctggcc

SEQ ID NO: 77312 - DNA, 22 bp, Artificial Sequence
  Description of Artificial Sequence: Synthetic oligonucleotide
gctgctctcaggggtcctggcc

SEQ ID NO: 77313 - DNA, 23 bp, Artificial Sequence
  Description of Artificial Sequence: Synthetic oligonucleotide
ctgctctcaggggtcctggccct

SEQ ID NO: 77314 - DNA, 24 bp, Artificial Sequence
  Description of Artificial Sequence: Synthetic oligonucleotide
tgctctcaggggtcctggccctga

SEQ ID NO: 77315 - DNA, 23 bp, Artificial Sequence
  Description of Artificial Sequence: Synthetic oligonucleotide
gctctcaggggtcctggccctga

SEQ ID NO: 77316 - DNA, 23 bp, Artificial Sequence
  Description of Artificial Sequence: Synthetic oligonucleotide
ctctcaggggtcctggccctgac

SEQ ID NO: 77317 - DNA, 23 bp, Artificial Sequence
  Description of Artificial Sequence: Synthetic oligonucleotide
tctcaggggtcctggccctgacc

SEQ ID NO: 77318 - DNA, 22 bp, Artificial Sequence
  Description of Artificial Sequence: Synthetic oligonucleotide
ctcaggggtcctggccctgacc

SEQ ID NO: 77319 - DNA, 25 bp, Artificial Sequence
  Description of Artificial Sequence: Synthetic oligonucleotide
tcaggggtcctggccctgaccgata

SEQ ID NO: 77320 - DNA, 24 bp, Artificial Sequence
  Description of Artificial Sequence: Synthetic oligonucleotide
caggggtcctggccctgaccgata

SEQ ID NO: 77321 - DNA, 26 bp, Artificial Sequence
  Description of Artificial Sequence: Synthetic oligonucleotide
aggggtcctggccctgaccgatactt

SEQ ID NO: 77322 - DNA, 25 bp, Artificial Sequence
  Description of Artificial Sequence: Synthetic oligonucleotide
ggggtcctggccctgaccgatactt

SEQ ID NO: 77323 - DNA, 25 bp, Artificial Sequence
  Description of Artificial Sequence: Synthetic oligonucleotide
gggtcctggccctgaccgatacttg

SEQ ID NO: 77324 - DNA, 25 bp, Artificial Sequence
  Description of Artificial Sequence: Synthetic oligonucleotide
ggtcctggccctgaccgatacttgg

SEQ ID NO: 77325 - DNA, 25 bp, Artificial Sequence
  Description of Artificial Sequence: Synthetic oligonucleotide
gtcctggccctgaccgatacttggg

SEQ ID NO: 77326 - DNA, 25 bp, Artificial Sequence
  Description of Artificial Sequence: Synthetic oligonucleotide
tcctggccctgaccgatacttgggc

SEQ ID NO: 77327 - DNA, 24 bp, Artificial Sequence
  Description of Artificial Sequence: Synthetic oligonucleotide
aagtgggccgctgtggtggtgcct

SEQ ID NO: 77328 - DNA, 23 bp, Artificial Sequence
  Description of Artificial Sequence: Synthetic oligonucleotide
agtgggccgctgtggtggtgcct

SEQ ID NO: 77329 - DNA, 22 bp, Artificial Sequence
  Description of Artificial Sequence: Synthetic oligonucleotide
gtgggccgctgtggtggtgcct

SEQ ID NO: 77330 - DNA, 22 bp, Artificial Sequence
  Description of Artificial Sequence: Synthetic oligonucleotide
tgggccgctgtggtggtgcctc

SEQ ID NO: 77331 - DNA, 21 bp, Artificial Sequence
  Description of Artificial Sequence: Synthetic oligonucleotide
gggccgctgtggtggtgcctc

SEQ ID NO: 77332 - DNA, 22 bp, Artificial Sequence
  Description of Artificial Sequence: Synthetic oligonucleotide
ggccgctgtggtggtgcctcct

SEQ ID NO: 77333 - DNA, 22 bp, Artificial Sequence
  Description of Artificial Sequence: Synthetic oligonucleotide
gccgctgtggtggtgcctcctg

SEQ ID NO: 77334 - DNA, 23 bp, Artificial Sequence
  Description of Artificial Sequence: Synthetic oligonucleotide
ccgctgtggtggtgcctcctgga

SEQ ID NO: 77335 - DNA, 24 bp, Artificial Sequence
  Description of Artificial Sequence: Synthetic oligonucleotide
cgctgtggtggtgcctcctggaga

SEQ ID NO: 77336 - DNA, 24 bp, Artificial Sequence
  Description of Artificial Sequence: Synthetic oligonucleotide
gctgtggtggtgcctcctggagag

SEQ ID NO: 77337 - DNA, 26 bp, Artificial Sequence
  Description of Artificial Sequence: Synthetic oligonucleotide
ctgtggtggtgcctcctggagaggaa

SEQ ID NO: 77338 - DNA, 27 bp, Artificial Sequence
  Description of Artificial Sequence: Synthetic oligonucleotide
tgtggtggtgcctcctggagaggaaca

SEQ ID NO: 77339 - DNA, 26 bp, Artificial Sequence
  Description of Artificial Sequence: Synthetic oligonucleotide
gtggtggtgcctcctggagaggaaca

SEQ ID NO: 77340 - DNA, 27 bp, Artificial Sequence
  Description of Artificial Sequence: Synthetic oligonucleotide
tggtggtgcctcctggagaggaacaga

SEQ ID NO: 77341 - DNA, 26 bp, Artificial Sequence
  Description of Artificial Sequence: Synthetic oligonucleotide
ggtggtgcctcctggagaggaacaga

SEQ ID NO: 77342 - DNA, 27 bp, Artificial Sequence
  Description of Artificial Sequence: Synthetic oligonucleotide
gtggtgcctcctggagaggaacagaga

SEQ ID NO: 77343 - DNA, 29 bp, Artificial Sequence
  Description of Artificial Sequence: Synthetic oligonucleotide
tggtgcctcctggagaggaacagagatac

SEQ ID NO: 77344 - DNA, 28 bp, Artificial Sequence
  Description of Artificial Sequence: Synthetic oligonucleotide
ggtgcctcctggagaggaacagagatac

SEQ ID NO: 77345 - DNA, 29 bp, Artificial Sequence
  Description of Artificial Sequence: Synthetic oligonucleotide
gtgcctcctggagaggaacagagatacac

SEQ ID NO: 77346 - DNA, 31 bp, Artificial Sequence
  Description of Artificial Sequence: Synthetic oligonucleotide
tgcctcctggagaggaacagagatacacatg

SEQ ID NO: 77347 - DNA, 30 bp, Artificial Sequence
  Description of Artificial Sequence: Synthetic oligonucleotide
gcctcctggagaggaacagagatacacatg

SEQ ID NO: 77348 - DNA, 30 bp, Artificial Sequence
  Description of Artificial Sequence: Synthetic oligonucleotide
cctcctggagaggaacagagatacacatgc

SEQ ID NO: 77349 - DNA, 30 bp, Artificial Sequence
  Description of Artificial Sequence: Synthetic oligonucleotide
ctcctggagaggaacagagatacacatgcc

SEQ ID NO: 77350 - DNA, 32 bp, Artificial Sequence
  Description of Artificial Sequence: Synthetic oligonucleotide
tcctggagaggaacagagatacacatgccatg

SEQ ID NO: 77351 - DNA, 31 bp, Artificial Sequence
  Description of Artificial Sequence: Synthetic oligonucleotide
cctggagaggaacagagatacacatgccatg

SEQ ID NO: 77352 - DNA, 22 bp, Artificial Sequence
  Description of Artificial Sequence: Synthetic oligonucleotide
cgaggatggagccgcgggagca

SEQ ID NO: 77353 - DNA, 23 bp, Artificial Sequence
  Description of Artificial Sequence: Synthetic oligonucleotide
gaggatggagccgcgggagcagt

SEQ ID NO: 77354 - DNA, 23 bp, Artificial Sequence
  Description of Artificial Sequence: Synthetic oligonucleotide
aggatggagccgcgggagcagtg

SEQ ID NO: 77355 - DNA, 22 bp, Artificial Sequence
  Description of Artificial Sequence: Synthetic oligonucleotide
ggatggagccgcgggagcagtg

SEQ ID NO: 77356 - DNA, 22 bp, Artificial Sequence
  Description of Artificial Sequence: Synthetic oligonucleotide
gatggagccgcgggagcagtgg

SEQ ID NO: 77357 - DNA, 23 bp, Artificial Sequence
  Description of Artificial Sequence: Synthetic oligonucleotide
atggagccgcgggagcagtgggt

SEQ ID NO: 77358 - DNA, 22 bp, Artificial Sequence
  Description of Artificial Sequence: Synthetic oligonucleotide
tggagccgcgggagcagtgggt

SEQ ID NO: 77359 - DNA, 21 bp, Artificial Sequence
  Description of Artificial Sequence: Synthetic oligonucleotide
ggagccgcgggagcagtgggt

SEQ ID NO: 77360 - DNA, 21 bp, Artificial Sequence
  Description of Artificial Sequence: Synthetic oligonucleotide
gagccgcgggagcagtgggtg

SEQ ID NO: 77361 - DNA, 22 bp, Artificial Sequence
  Description of Artificial Sequence: Synthetic oligonucleotide
agccgcgggagcagtgggtgga

SEQ ID NO: 77362 - DNA, 21 bp, Artificial Sequence
  Description of Artificial Sequence: Synthetic oligonucleotide
gccgcgggagcagtgggtgga

SEQ ID NO: 77363 - DNA, 21 bp, Artificial Sequence
  Description of Artificial Sequence: Synthetic oligonucleotide
ccgcgggagcagtgggtggag

SEQ ID NO: 77364 - DNA, 23 bp, Artificial Sequence
  Description of Artificial Sequence: Synthetic oligonucleotide
cgcgggagcagtgggtggagcaa

SEQ ID NO: 77365 - DNA, 24 bp, Artificial Sequence
  Description of Artificial Sequence: Synthetic oligonucleotide
gcgggagcagtgggtggagcaaga

SEQ ID NO: 77366 - DNA, 24 bp, Artificial Sequence
  Description of Artificial Sequence: Synthetic oligonucleotide
cgggagcagtgggtggagcaagag

SEQ ID NO: 77367 - DNA, 24 bp, Artificial Sequence
  Description of Artificial Sequence: Synthetic oligonucleotide
gggagcagtgggtggagcaagagg

SEQ ID NO: 77368 - DNA, 24 bp, Artificial Sequence
  Description of Artificial Sequence: Synthetic oligonucleotide
ggagcagtgggtggagcaagaggg

SEQ ID NO: 77369 - DNA, 24 bp, Artificial Sequence
  Description of Artificial Sequence: Synthetic oligonucleotide
gagcagtgggtggagcaagagggg

SEQ ID NO: 77370 - DNA, 24 bp, Artificial Sequence
  Description of Artificial Sequence: Synthetic oligonucleotide
agcagtgggtggagcaagaggggc

SEQ ID NO: 77371 - DNA, 23 bp, Artificial Sequence
  Description of Artificial Sequence: Synthetic oligonucleotide
gcagtgggtggagcaagaggggc

SEQ ID NO: 77372 - DNA, 23 bp, Artificial Sequence
  Description of Artificial Sequence: Synthetic oligonucleotide
cagtgggtggagcaagaggggcc

SEQ ID NO: 77373 - DNA, 23 bp, Artificial Sequence
  Description of Artificial Sequence: Synthetic oligonucleotide
agtgggtggagcaagaggggccg

SEQ ID NO: 77374 - DNA, 24 bp, Artificial Sequence
  Description of Artificial Sequence: Synthetic oligonucleotide
atggtggtcatggcgccccgaacc

SEQ ID NO: 77375 - DNA, 23 bp, Artificial Sequence
  Description of Artificial Sequence: Synthetic oligonucleotide
tggtggtcatggcgccccgaacc

SEQ ID NO: 77376 - DNA, 22 bp, Artificial Sequence
  Description of Artificial Sequence: Synthetic oligonucleotide
ggtggtcatggcgccccgaacc

SEQ ID NO: 77377 - DNA, 23 bp, Artificial Sequence
  Description of Artificial Sequence: Synthetic oligonucleotide
gtggtcatggcgccccgaaccct

SEQ ID NO: 77378 - DNA, 25 bp, Artificial Sequence
  Description of Artificial Sequence: Synthetic oligonucleotide
tggtcatggcgccccgaaccctctt

SEQ ID NO: 77379 - DNA, 24 bp, Artificial Sequence
  Description of Artificial Sequence: Synthetic oligonucleotide
ggtcatggcgccccgaaccctctt

SEQ ID NO: 77380 - DNA, 24 bp, Artificial Sequence
  Description of Artificial Sequence: Synthetic oligonucleotide
gtcatggcgccccgaaccctcttc

SEQ ID NO: 77381 - DNA, 25 bp, Artificial Sequence
  Description of Artificial Sequence: Synthetic oligonucleotide
tcatggcgccccgaaccctcttcct

SEQ ID NO: 77382 - DNA, 24 bp, Artificial Sequence
  Description of Artificial Sequence: Synthetic oligonucleotide
catggcgccccgaaccctcttcct

SEQ ID NO: 77383 - DNA, 24 bp, Artificial Sequence
  Description of Artificial Sequence: Synthetic oligonucleotide
atggcgccccgaaccctcttcctg

SEQ ID NO: 77384 - DNA, 23 bp, Artificial Sequence
  Description of Artificial Sequence: Synthetic oligonucleotide
tggcgccccgaaccctcttcctg

SEQ ID NO: 77385 - DNA, 22 bp, Artificial Sequence
  Description of Artificial Sequence: Synthetic oligonucleotide
ggcgccccgaaccctcttcctg

SEQ ID NO: 77386 - DNA, 23 bp, Artificial Sequence
  Description of Artificial Sequence: Synthetic oligonucleotide
gcgccccgaaccctcttcctgct

SEQ ID NO: 77387 - DNA, 23 bp, Artificial Sequence
  Description of Artificial Sequence: Synthetic oligonucleotide
cgccccgaaccctcttcctgctg

SEQ ID NO: 77388 - DNA, 24 bp, Artificial Sequence
  Description of Artificial Sequence: Synthetic oligonucleotide
gccccgaaccctcttcctgctgct

SEQ ID NO: 77389 - DNA, 25 bp, Artificial Sequence
  Description of Artificial Sequence: Synthetic oligonucleotide
ccccgaaccctcttcctgctgctct

SEQ ID NO: 77390 - DNA, 25 bp, Artificial Sequence
  Description of Artificial Sequence: Synthetic oligonucleotide
cccgaaccctcttcctgctgctctc

SEQ ID NO: 77391 - DNA, 25 bp, Artificial Sequence
  Description of Artificial Sequence: Synthetic oligonucleotide
ccgaaccctcttcctgctgctctcg

SEQ ID NO: 77392 - DNA, 25 bp, Artificial Sequence
  Description of Artificial Sequence: Synthetic oligonucleotide
cgaaccctcttcctgctgctctcgg

SEQ ID NO: 77393 - DNA, 25 bp, Artificial Sequence
  Description of Artificial Sequence: Synthetic oligonucleotide
gaaccctcttcctgctgctctcggg

SEQ ID NO: 77394 - DNA, 25 bp, Artificial Sequence
  Description of Artificial Sequence: Synthetic oligonucleotide
aaccctcttcctgctgctctcgggg

SEQ ID NO: 77395 - DNA, 24 bp, Artificial Sequence
  Description of Artificial Sequence: Synthetic oligonucleotide
accctcttcctgctgctctcgggg

SEQ ID NO: 77396 - DNA, 23 bp, Artificial Sequence
  Description of Artificial Sequence: Synthetic oligonucleotide
ccctcttcctgctgctctcgggg

SEQ ID NO: 77397 - DNA, 23 bp, Artificial Sequence
  Description of Artificial Sequence: Synthetic oligonucleotide
cctcttcctgctgctctcggggg

SEQ ID NO: 77398 - DNA, 23 bp, Artificial Sequence
  Description of Artificial Sequence: Synthetic oligonucleotide
ctcttcctgctgctctcgggggc

SEQ ID NO: 77399 - DNA, 23 bp, Artificial Sequence
  Description of Artificial Sequence: Synthetic oligonucleotide
tcttcctgctgctctcgggggcc

SEQ ID NO: 77400 - DNA, 22 bp, Artificial Sequence
  Description of Artificial Sequence: Synthetic oligonucleotide
cttcctgctgctctcgggggcc

SEQ ID NO: 77401 - DNA, 23 bp, Artificial Sequence
  Description of Artificial Sequence: Synthetic oligonucleotide
ttcctgctgctctcgggggccct

SEQ ID NO: 77402 - DNA, 22 bp, Artificial Sequence
  Description of Artificial Sequence: Synthetic oligonucleotide
tcctgctgctctcgggggccct

SEQ ID NO: 77403 - DNA, 21 bp, Artificial Sequence
  Description of Artificial Sequence: Synthetic oligonucleotide
cctgctgctctcgggggccct

SEQ ID NO: 77404 - DNA, 22 bp, Artificial Sequence
  Description of Artificial Sequence: Synthetic oligonucleotide
ctgctgctctcgggggccctga

SEQ ID NO: 77405 - DNA, 22 bp, Artificial Sequence
  Description of Artificial Sequence: Synthetic oligonucleotide
tgctgctctcgggggccctgac

SEQ ID NO: 77406 - DNA, 21 bp, Artificial Sequence
  Description of Artificial Sequence: Synthetic oligonucleotide
gctgctctcgggggccctgac

SEQ ID NO: 77407 - DNA, 21 bp, Artificial Sequence
  Description of Artificial Sequence: Synthetic oligonucleotide
ctgctctcgggggccctgacc

SEQ ID NO: 77408 - DNA, 22 bp, Artificial Sequence
  Description of Artificial Sequence: Synthetic oligonucleotide
tgctctcgggggccctgaccct

SEQ ID NO: 77409 - DNA, 21 bp, Artificial Sequence
  Description of Artificial Sequence: Synthetic oligonucleotide
gctctcgggggccctgaccct

SEQ ID NO: 77410 - DNA, 22 bp, Artificial Sequence
  Description of Artificial Sequence: Synthetic oligonucleotide
ctctcgggggccctgaccctga

SEQ ID NO: 77411 - DNA, 22 bp, Artificial Sequence
  Description of Artificial Sequence: Synthetic oligonucleotide
tctcgggggccctgaccctgac

SEQ ID NO: 77412 - DNA, 21 bp, Artificial Sequence
  Description of Artificial Sequence: Synthetic oligonucleotide
ctcgggggccctgaccctgac

SEQ ID NO: 77413 - DNA, 21 bp, Artificial Sequence
  Description of Artificial Sequence: Synthetic oligonucleotide
tcgggggccctgaccctgacc

SEQ ID NO: 77414 - DNA, 20 bp, Artificial Sequence
  Description of Artificial Sequence: Synthetic oligonucleotide
cgggggccctgaccctgacc

SEQ ID NO: 77415 - DNA, 21 bp, Artificial Sequence
  Description of Artificial Sequence: Synthetic oligonucleotide
gggggccctgaccctgaccga

SEQ ID NO: 77416 - DNA, 22 bp, Artificial Sequence
  Description of Artificial Sequence: Synthetic oligonucleotide
ggggccctgaccctgaccgaga

SEQ ID NO: 77417 - DNA, 22 bp, Artificial Sequence
  Description of Artificial Sequence: Synthetic oligonucleotide
gggccctgaccctgaccgagac

SEQ ID NO: 77418 - DNA, 23 bp, Artificial Sequence
  Description of Artificial Sequence: Synthetic oligonucleotide
ggccctgaccctgaccgagacct

SEQ ID NO: 77419 - DNA, 23 bp, Artificial Sequence
  Description of Artificial Sequence: Synthetic oligonucleotide
gccctgaccctgaccgagacctg

SEQ ID NO: 77420 - DNA, 23 bp, Artificial Sequence
  Description of Artificial Sequence: Synthetic oligonucleotide
ccctgaccctgaccgagacctgg

SEQ ID NO: 77421 - DNA, 23 bp, Artificial Sequence
  Description of Artificial Sequence: Synthetic oligonucleotide
cctgaccctgaccgagacctggg

SEQ ID NO: 77422 - DNA, 23 bp, Artificial Sequence
  Description of Artificial Sequence: Synthetic oligonucleotide
ctgaccctgaccgagacctgggc

SEQ ID NO: 77423 - DNA, 23 bp, Artificial Sequence
  Description of Artificial Sequence: Synthetic oligonucleotide
tgaccctgaccgagacctgggcg

SEQ ID NO: 77424 - DNA, 22 bp, Artificial Sequence
  Description of Artificial Sequence: Synthetic oligonucleotide
gaccctgaccgagacctgggcg

SEQ ID NO: 77425 - DNA, 22 bp, Artificial Sequence
  Description of Artificial Sequence: Synthetic oligonucleotide
accctgaccgagacctgggcgg

SEQ ID NO: 77426 - DNA, 28 bp, Artificial Sequence
  Description of Artificial Sequence: Synthetic oligonucleotide
cgggctcccactccatgaggtatttcag

SEQ ID NO: 77427 - DNA, 28 bp, Artificial Sequence
  Description of Artificial Sequence: Synthetic oligonucleotide
gggctcccactccatgaggtatttcagc

SEQ ID NO: 77428 - DNA, 28 bp, Artificial Sequence
  Description of Artificial Sequence: Synthetic oligonucleotide
ggctcccactccatgaggtatttcagcg

SEQ ID NO: 77429 - DNA, 28 bp, Artificial Sequence
  Description of Artificial Sequence: Synthetic oligonucleotide
gctcccactccatgaggtatttcagcgc

SEQ ID NO: 77430 - DNA, 28 bp, Artificial Sequence
  Description of Artificial Sequence: Synthetic oligonucleotide
ctcccactccatgaggtatttcagcgcc

SEQ ID NO: 77431 - DNA, 28 bp, Artificial Sequence
  Description of Artificial Sequence: Synthetic oligonucleotide
tcccactccatgaggtatttcagcgccg

SEQ ID NO: 77432 - DNA, 27 bp, Artificial Sequence
  Description of Artificial Sequence: Synthetic oligonucleotide
cccactccatgaggtatttcagcgccg

SEQ ID NO: 77433 - DNA, 27 bp, Artificial Sequence
  Description of Artificial Sequence: Synthetic oligonucleotide
ccactccatgaggtatttcagcgccgc

SEQ ID NO: 77434 - DNA, 27 bp, Artificial Sequence
  Description of Artificial Sequence: Synthetic oligonucleotide
cactccatgaggtatttcagcgccgcc

SEQ ID NO: 77435 - DNA, 27 bp, Artificial Sequence
  Description of Artificial Sequence: Synthetic oligonucleotide
actccatgaggtatttcagcgccgccg

SEQ ID NO: 77436 - DNA, 27 bp, Artificial Sequence
  Description of Artificial Sequence: Synthetic oligonucleotide
ctccatgaggtatttcagcgccgccgt

SEQ ID NO: 77437 - DNA, 27 bp, Artificial Sequence
  Description of Artificial Sequence: Synthetic oligonucleotide
tccatgaggtatttcagcgccgccgtg

SEQ ID NO: 77438 - DNA, 27 bp, Artificial Sequence
  Description of Artificial Sequence: Synthetic oligonucleotide
ccatgaggtatttcagcgccgccgtgt

SEQ ID NO: 77439 - DNA, 27 bp, Artificial Sequence
  Description of Artificial Sequence: Synthetic oligonucleotide
catgaggtatttcagcgccgccgtgtc

SEQ ID NO: 77440 - DNA, 27 bp, Artificial Sequence
  Description of Artificial Sequence: Synthetic oligonucleotide
atgaggtatttcagcgccgccgtgtcc

SEQ ID NO: 77441 - DNA, 26 bp, Artificial Sequence
  Description of Artificial Sequence: Synthetic oligonucleotide
tgaggtatttcagcgccgccgtgtcc

SEQ ID NO: 77442 - DNA, 25 bp, Artificial Sequence
  Description of Artificial Sequence: Synthetic oligonucleotide
gaggtatttcagcgccgccgtgtcc

SEQ ID NO: 77443 - DNA, 25 bp, Artificial Sequence
  Description of Artificial Sequence: Synthetic oligonucleotide
aggtatttcagcgccgccgtgtccc

SEQ ID NO: 77444 - DNA, 24 bp, Artificial Sequence
  Description of Artificial Sequence: Synthetic oligonucleotide
ggtatttcagcgccgccgtgtccc

SEQ ID NO: 77445 - DNA, 24 bp, Artificial Sequence
  Description of Artificial Sequence: Synthetic oligonucleotide
gtatttcagcgccgccgtgtcccg

SEQ ID NO: 77446 - DNA, 24 bp, Artificial Sequence
  Description of Artificial Sequence: Synthetic oligonucleotide
tatttcagcgccgccgtgtcccgg

SEQ ID NO: 77447 - DNA, 23 bp, Artificial Sequence
  Description of Artificial Sequence: Synthetic oligonucleotide
atttcagcgccgccgtgtcccgg

SEQ ID NO: 77448 - DNA, 22 bp, Artificial Sequence
  Description of Artificial Sequence: Synthetic oligonucleotide
tttcagcgccgccgtgtcccgg

SEQ ID NO: 77449 - DNA, 21 bp, Artificial Sequence
  Description of Artificial Sequence: Synthetic oligonucleotide
ttcagcgccgccgtgtcccgg

SEQ ID NO: 77450 - DNA, 20 bp, Artificial Sequence
  Description of Artificial Sequence: Synthetic oligonucleotide
tcagcgccgccgtgtcccgg

SEQ ID NO: 77451 - DNA, 20 bp, Artificial Sequence
  Description of Artificial Sequence: Synthetic oligonucleotide
cagcgccgccgtgtcccggt

SEQ ID NO: 77452 - DNA, 20 bp, Artificial Sequence
  Description of Artificial Sequence: Synthetic oligonucleotide
agcgccgccgtgtcccggct

SEQ ID NO: 77453 - DNA, 20 bp, Artificial Sequence
  Description of Artificial Sequence: Synthetic oligonucleotide
gcgccgccgtgtcccggctt

SEQ ID NO: 77454 - DNA, 20 bp, Artificial Sequence
  Description of Artificial Sequence: Synthetic oligonucleotide
cgccgccgtgtcccggcctt

SEQ ID NO: 77455 - DNA, 20 bp, Artificial Sequence
  Description of Artificial Sequence: Synthetic oligonucleotide
gccgccgtgtcccggccctt

SEQ ID NO: 77456 - DNA, 26 bp, Artificial Sequence
  Description of Artificial Sequence: Synthetic oligonucleotide
gcagttcgtgcggttcgacagcgact

SEQ ID NO: 77457 - DNA, 26 bp, Artificial Sequence
  Description of Artificial Sequence: Synthetic oligonucleotide
cagttcgtgcggttcgacagcgactc

SEQ ID NO: 77458 - DNA, 26 bp, Artificial Sequence
  Description of Artificial Sequence: Synthetic oligonucleotide
agttcgtgcggttcgacagcgactcg

SEQ ID NO: 77459 - DNA, 25 bp, Artificial Sequence
  Description of Artificial Sequence: Synthetic oligonucleotide
gttcgtgcggttcgacagcgactcg

SEQ ID NO: 77460 - DNA, 25 bp, Artificial Sequence
  Description of Artificial Sequence: Synthetic oligonucleotide
ttcgtgcggttcgacagcgactcgg

SEQ ID NO: 77461 - DNA, 24 bp, Artificial Sequence
  Description of Artificial Sequence: Synthetic oligonucleotide
tcgtgcggttcgacagcgactcgg

SEQ ID NO: 77462 - DNA, 23 bp, Artificial Sequence
  Description of Artificial Sequence: Synthetic oligonucleotide
cgtgcggttcgacagcgactcgg

SEQ ID NO: 77463 - DNA, 23 bp, Artificial Sequence
  Description of Artificial Sequence: Synthetic oligonucleotide
gtgcggttcgacagcgactcggc

SEQ ID NO: 77464 - DNA, 24 bp, Artificial Sequence
  Description of Artificial Sequence: Synthetic oligonucleotide
tgcggttcgacagcgactcggcgt

SEQ ID NO: 77465 - DNA, 23 bp, Artificial Sequence
  Description of Artificial Sequence: Synthetic oligonucleotide
gcggttcgacagcgactcggcgt

SEQ ID NO: 77466 - DNA, 24 bp, Artificial Sequence
  Description of Artificial Sequence: Synthetic oligonucleotide
cggttcgacagcgactcggcgtgt

SEQ ID NO: 77467 - DNA, 24 bp, Artificial Sequence
  Description of Artificial Sequence: Synthetic oligonucleotide
ggttcgacagcgactcggcgtgtc

SEQ ID NO: 77468 - DNA, 24 bp, Artificial Sequence
  Description of Artificial Sequence: Synthetic oligonucleotide
gttcgacagcgactcggcgtgtcc

SEQ ID NO: 77469 - DNA, 25 bp, Artificial Sequence
  Description of Artificial Sequence: Synthetic oligonucleotide
ttcgacagcgactcggcgtgtccga

SEQ ID NO: 77470 - DNA, 24 bp, Artificial Sequence
  Description of Artificial Sequence: Synthetic oligonucleotide
tcgacagcgactcggcgtgtccga

SEQ ID NO: 77471 - DNA, 23 bp, Artificial Sequence
  Description of Artificial Sequence: Synthetic oligonucleotide
cgacagcgactcggcgtgtccga

SEQ ID NO: 77472 - DNA, 23 bp, Artificial Sequence
  Description of Artificial Sequence: Synthetic oligonucleotide
gacagcgactcggcgtgtccgag

SEQ ID NO: 77473 - DNA, 25 bp, Artificial Sequence
  Description of Artificial Sequence: Synthetic oligonucleotide
acagcgactcggcgtgtccgaggat

SEQ ID NO: 77474 - DNA, 24 bp, Artificial Sequence
  Description of Artificial Sequence: Synthetic oligonucleotide
cagcgactcggcgtgtccgaggat

SEQ ID NO: 77475 - DNA, 24 bp, Artificial Sequence
  Description of Artificial Sequence: Synthetic oligonucleotide
agcgactcggcgtgtccgaggatg

SEQ ID NO: 77476 - DNA, 23 bp, Artificial Sequence
  Description of Artificial Sequence: Synthetic oligonucleotide
gcgactcggcgtgtccgaggatg

SEQ ID NO: 77477 - DNA, 24 bp, Artificial Sequence
  Description of Artificial Sequence: Synthetic oligonucleotide
cgactcggcgtgtccgaggatgga

SEQ ID NO: 77478 - DNA, 24 bp, Artificial Sequence
  Description of Artificial Sequence: Synthetic oligonucleotide
gactcggcgtgtccgaggatggag

SEQ ID NO: 77479 - DNA, 24 bp, Artificial Sequence
  Description of Artificial Sequence: Synthetic oligonucleotide
actcggcgtgtccgaggatggagc

SEQ ID NO: 77480 - DNA, 23 bp, Artificial Sequence
  Description of Artificial Sequence: Synthetic oligonucleotide
ctcggcgtgtccgaggatggagc

SEQ ID NO: 77481 - DNA, 23 bp, Artificial Sequence
  Description of Artificial Sequence: Synthetic oligonucleotide
tcggcgtgtccgaggatggagcc

SEQ ID NO: 77482 - DNA, 22 bp, Artificial Sequence
  Description of Artificial Sequence: Synthetic oligonucleotide
cggcgtgtccgaggatggagcc

SEQ ID NO: 77483 - DNA, 22 bp, Artificial Sequence
  Description of Artificial Sequence: Synthetic oligonucleotide
ggcgtgtccgaggatggagccg

SEQ ID NO: 77484 - DNA, 22 bp, Artificial Sequence
  Description of Artificial Sequence: Synthetic oligonucleotide
gcgtgtccgaggatggagccgc

SEQ ID NO: 77485 - DNA, 22 bp, Artificial Sequence
  Description of Artificial Sequence: Synthetic oligonucleotide
cgtgtccgaggatggagccgcg

SEQ ID NO: 77486 - DNA, 22 bp, Artificial Sequence
  Description of Artificial Sequence: Synthetic oligonucleotide
gtgtccgaggatggagccgcgg

SEQ ID NO: 77487 - DNA, 22 bp, Artificial Sequence
  Description of Artificial Sequence: Synthetic oligonucleotide
tgtccgaggatggagccgcggg

SEQ ID NO: 77488 - DNA, 21 bp, Artificial Sequence
  Description of Artificial Sequence: Synthetic oligonucleotide
gtccgaggatggagccgcggg

SEQ ID NO: 77489 - DNA, 21 bp, Artificial Sequence
  Description of Artificial Sequence: Synthetic oligonucleotide
tccgaggatggagccgcgggc

SEQ ID NO: 77490 - DNA, 20 bp, Artificial Sequence
  Description of Artificial Sequence: Synthetic oligonucleotide
ccgaggatggagccgcgggc

SEQ ID NO: 77491 - DNA, 20 bp, Artificial Sequence
  Description of Artificial Sequence: Synthetic oligonucleotide
cgaggatggagccgcgggcg

SEQ ID NO: 77492 - DNA, 26 bp, Artificial Sequence
  Description of Artificial Sequence: Synthetic oligonucleotide
agcaggaggggccggagtattgggaa

SEQ ID NO: 77493 - DNA, 25 bp, Artificial Sequence
  Description of Artificial Sequence: Synthetic oligonucleotide
gcaggaggggccggagtattgggaa

SEQ ID NO: 77494 - DNA, 26 bp, Artificial Sequence
  Description of Artificial Sequence: Synthetic oligonucleotide
caggaggggccggagtattgggaaga

SEQ ID NO: 77495 - DNA, 26 bp, Artificial Sequence
  Description of Artificial Sequence: Synthetic oligonucleotide
aggaggggccggagtattgggaagag

SEQ ID NO: 77496 - DNA, 25 bp, Artificial Sequence
  Description of Artificial Sequence: Synthetic oligonucleotide
ggaggggccggagtattgggaagag

SEQ ID NO: 77497 - DNA, 26 bp, Artificial Sequence
  Description of Artificial Sequence: Synthetic oligonucleotide
gaggggccggagtattgggaagagga

SEQ ID NO: 77498 - DNA, 27 bp, Artificial Sequence
  Description of Artificial Sequence: Synthetic oligonucleotide
aggggccggagtattgggaagaggaga

SEQ ID NO: 77499 - DNA, 26 bp, Artificial Sequence
  Description of Artificial Sequence: Synthetic oligonucleotide
ggggccggagtattgggaagaggaga

SEQ ID NO: 77500 - DNA, 27 bp, Artificial Sequence
  Description of Artificial Sequence: Synthetic oligonucleotide
gggccggagtattgggaagaggagaca

SEQ ID NO: 77501 - DNA, 27 bp, Artificial Sequence
  Description of Artificial Sequence: Synthetic oligonucleotide
ggccggagtattgggaagaggagacac

SEQ ID NO: 77502 - DNA, 27 bp, Artificial Sequence
  Description of Artificial Sequence: Synthetic oligonucleotide
gccggagtattgggaagaggagacacg

SEQ ID NO: 77503 - DNA, 27 bp, Artificial Sequence
  Description of Artificial Sequence: Synthetic oligonucleotide
ccggagtattgggaagaggagacacgg

SEQ ID NO: 77504 - DNA, 29 bp, Artificial Sequence
  Description of Artificial Sequence: Synthetic oligonucleotide
cggagtattgggaagaggagacacggaac

SEQ ID NO: 77505 - DNA, 30 bp, Artificial Sequence
  Description of Artificial Sequence: Synthetic oligonucleotide
ggagtattgggaagaggagacacggaacac

SEQ ID NO: 77506 - DNA, 30 bp, Artificial Sequence
  Description of Artificial Sequence: Synthetic oligonucleotide
gagtattgggaagaggagacacggaacacc

SEQ ID NO: 77507 - DNA, 32 bp, Artificial Sequence
  Description of Artificial Sequence: Synthetic oligonucleotide
agtattgggaagaggagacacggaacaccaag

SEQ ID NO: 77508 - DNA, 31 bp, Artificial Sequence
  Description of Artificial Sequence: Synthetic oligonucleotide
gtattgggaagaggagacacggaacaccaag

SEQ ID NO: 77509 - DNA, 31 bp, Artificial Sequence
  Description of Artificial Sequence: Synthetic oligonucleotide
tattgggaagaggagacacggaacaccaagg

SEQ ID NO: 77510 - DNA, 30 bp, Artificial Sequence
  Description of Artificial Sequence: Synthetic oligonucleotide
attgggaagaggagacacggaacaccaagg

SEQ ID NO: 77511 - DNA, 29 bp, Artificial Sequence
  Description of Artificial Sequence: Synthetic oligonucleotide
ttgggaagaggagacacggaacaccaagg

SEQ ID NO: 77512 - DNA, 28 bp, Artificial Sequence
  Description of Artificial Sequence: Synthetic oligonucleotide
tgggaagaggagacacggaacaccaagg

SEQ ID NO: 77513 - DNA, 27 bp, Artificial Sequence
  Description of Artificial Sequence: Synthetic oligonucleotide
gggaagaggagacacggaacaccaagg

SEQ ID NO: 77514 - DNA, 27 bp, Artificial Sequence
  Description of Artificial Sequence: Synthetic oligonucleotide
ggaagaggagacacggaacaccaaggc

SEQ ID NO: 77515 - DNA, 27 bp, Artificial Sequence
  Description of Artificial Sequence: Synthetic oligonucleotide
gaagaggagacacggaacaccaaggcc

SEQ ID NO: 77516 - DNA, 27 bp, Artificial Sequence
  Description of Artificial Sequence: Synthetic oligonucleotide
aagaggagacacggaacaccaaggccc

SEQ ID NO: 77517 - DNA, 27 bp, Artificial Sequence
  Description of Artificial Sequence: Synthetic oligonucleotide
agaggagacacggaacaccaaggccca

SEQ ID NO: 77518 - DNA, 26 bp, Artificial Sequence
  Description of Artificial Sequence: Synthetic oligonucleotide
gaggagacacggaacaccaaggccca

SEQ ID NO: 77519 - DNA, 26 bp, Artificial Sequence
  Description of Artificial Sequence: Synthetic oligonucleotide
aggagacacggaacaccaaggcccac

SEQ ID NO: 77520 - DNA, 25 bp, Artificial Sequence
  Description of Artificial Sequence: Synthetic oligonucleotide
ggagacacggaacaccaaggcccac

SEQ ID NO: 77521 - DNA, 25 bp, Artificial Sequence
  Description of Artificial Sequence: Synthetic oligonucleotide
gagacacggaacaccaaggcccacg

SEQ ID NO: 77522 - DNA, 26 bp, Artificial Sequence
  Description of Artificial Sequence: Synthetic oligonucleotide
agacacggaacaccaaggcccacgca

SEQ ID NO: 77523 - DNA, 25 bp, Artificial Sequence
  Description of Artificial Sequence: Synthetic oligonucleotide
gacacggaacaccaaggcccacgca

SEQ ID NO: 77524 - DNA, 26 bp, Artificial Sequence
  Description of Artificial Sequence: Synthetic oligonucleotide
acacggaacaccaaggcccacgcaca

SEQ ID NO: 77525 - DNA, 25 bp, Artificial Sequence
  Description of Artificial Sequence: Synthetic oligonucleotide
cacggaacaccaaggcccacgcaca

SEQ ID NO: 77526 - DNA, 26 bp, Artificial Sequence
  Description of Artificial Sequence: Synthetic oligonucleotide
acggaacaccaaggcccacgcacaga

SEQ ID NO: 77527 - DNA, 25 bp, Artificial Sequence
  Description of Artificial Sequence: Synthetic oligonucleotide
cggaacaccaaggcccacgcacaga

SEQ ID NO: 77528 - DNA, 26 bp, Artificial Sequence
  Description of Artificial Sequence: Synthetic oligonucleotide
ggaacaccaaggcccacgcacagact

SEQ ID NO: 77529 - DNA, 27 bp, Artificial Sequence
  Description of Artificial Sequence: Synthetic oligonucleotide
gaacaccaaggcccacgcacagactga

SEQ ID NO: 77530 - DNA, 27 bp, Artificial Sequence
  Description of Artificial Sequence: Synthetic oligonucleotide
aacaccaaggcccacgcacagactgac

SEQ ID NO: 77531 - DNA, 27 bp, Artificial Sequence
  Description of Artificial Sequence: Synthetic oligonucleotide
acaccaaggcccacgcacagactgaca

SEQ ID NO: 77532 - DNA, 26 bp, Artificial Sequence
  Description of Artificial Sequence: Synthetic oligonucleotide
caccaaggcccacgcacagactgaca

SEQ ID NO: 77533 - DNA, 27 bp, Artificial Sequence
  Description of Artificial Sequence: Synthetic oligonucleotide
accaaggcccacgcacagactgacaga

SEQ ID NO: 77534 - DNA, 27 bp, Artificial Sequence
  Description of Artificial Sequence: Synthetic oligonucleotide
ccaaggcccacgcacagactgacagaa

SEQ ID NO: 77535 - DNA, 28 bp, Artificial Sequence
  Description of Artificial Sequence: Synthetic oligonucleotide
caaggcccacgcacagactgacagaatg

SEQ ID NO: 77536 - DNA, 30 bp, Artificial Sequence
  Description of Artificial Sequence: Synthetic oligonucleotide
aaggcccacgcacagactgacagaatgaac

SEQ ID NO: 77537 - DNA, 29 bp, Artificial Sequence
  Description of Artificial Sequence: Synthetic oligonucleotide
aggcccacgcacagactgacagaatgaac

SEQ ID NO: 77538 - DNA, 28 bp, Artificial Sequence
  Description of Artificial Sequence: Synthetic oligonucleotide
ggcccacgcacagactgacagaatgaac

SEQ ID NO: 77539 - DNA, 28 bp, Artificial Sequence
  Description of Artificial Sequence: Synthetic oligonucleotide
gcccacgcacagactgacagaatgaacc

SEQ ID NO: 77540 - DNA, 29 bp, Artificial Sequence
  Description of Artificial Sequence: Synthetic oligonucleotide
cccacgcacagactgacagaatgaacctg

SEQ ID NO: 77541 - DNA, 29 bp, Artificial Sequence
  Description of Artificial Sequence: Synthetic oligonucleotide
ccacgcacagactgacagaatgaacctgc

SEQ ID NO: 77542 - DNA, 30 bp, Artificial Sequence
  Description of Artificial Sequence: Synthetic oligonucleotide
cacgcacagactgacagaatgaacctgcag

SEQ ID NO: 77543 - DNA, 31 bp, Artificial Sequence
  Description of Artificial Sequence: Synthetic oligonucleotide
acgcacagactgacagaatgaacctgcagac

SEQ ID NO: 77544 - DNA, 30 bp, Artificial Sequence
  Description of Artificial Sequence: Synthetic oligonucleotide
cgcacagactgacagaatgaacctgcagac

SEQ ID NO: 77545 - DNA, 30 bp, Artificial Sequence
  Description of Artificial Sequence: Synthetic oligonucleotide
gcacagactgacagaatgaacctgcagacc

SEQ ID NO: 77546 - DNA, 30 bp, Artificial Sequence
  Description of Artificial Sequence: Synthetic oligonucleotide
cacagactgacagaatgaacctgcagaccc

SEQ ID NO: 77547 - DNA, 31 bp, Artificial Sequence
  Description of Artificial Sequence: Synthetic oligonucleotide
acagactgacagaatgaacctgcagaccctg

SEQ ID NO: 77548 - DNA, 30 bp, Artificial Sequence
  Description of Artificial Sequence: Synthetic oligonucleotide
cagactgacagaatgaacctgcagaccctg

SEQ ID NO: 77549 - DNA, 30 bp, Artificial Sequence
  Description of Artificial Sequence: Synthetic oligonucleotide
agactgacagaatgaacctgcagaccctgc

SEQ ID NO: 77550 - DNA, 29 bp, Artificial Sequence
  Description of Artificial Sequence: Synthetic oligonucleotide
gactgacagaatgaacctgcagaccctgc

SEQ ID NO: 77551 - DNA, 29 bp, Artificial Sequence
  Description of Artificial Sequence: Synthetic oligonucleotide
actgacagaatgaacctgcagaccctgcg

SEQ ID NO: 77552 - DNA, 28 bp, Artificial Sequence
  Description of Artificial Sequence: Synthetic oligonucleotide
ctgacagaatgaacctgcagaccctgcg

SEQ ID NO: 77553 - DNA, 28 bp, Artificial Sequence
  Description of Artificial Sequence: Synthetic oligonucleotide
tgacagaatgaacctgcagaccctgcgc

SEQ ID NO: 77554 - DNA, 27 bp, Artificial Sequence
  Description of Artificial Sequence: Synthetic oligonucleotide
gacagaatgaacctgcagaccctgcgc

SEQ ID NO: 77555 - DNA, 27 bp, Artificial Sequence
  Description of Artificial Sequence: Synthetic oligonucleotide
acagaatgaacctgcagaccctgcgcg

SEQ ID NO: 77556 - DNA, 26 bp, Artificial Sequence
  Description of Artificial Sequence: Synthetic oligonucleotide
cagaatgaacctgcagaccctgcgcg

SEQ ID NO: 77557 - DNA, 26 bp, Artificial Sequence
  Description of Artificial Sequence: Synthetic oligonucleotide
agaatgaacctgcagaccctgcgcgg

SEQ ID NO: 77558 - DNA, 25 bp, Artificial Sequence
  Description of Artificial Sequence: Synthetic oligonucleotide
gaatgaacctgcagaccctgcgcgg

SEQ ID NO: 77559 - DNA, 27 bp, Artificial Sequence
  Description of Artificial Sequence: Synthetic oligonucleotide
aatgaacctgcagaccctgcgcggcta

SEQ ID NO: 77560 - DNA, 26 bp, Artificial Sequence
  Description of Artificial Sequence: Synthetic oligonucleotide
atgaacctgcagaccctgcgcggcta

SEQ ID NO: 77561 - DNA, 25 bp, Artificial Sequence
  Description of Artificial Sequence: Synthetic oligonucleotide
tgaacctgcagaccctgcgcggcta

SEQ ID NO: 77562 - DNA, 24 bp, Artificial Sequence
  Description of Artificial Sequence: Synthetic oligonucleotide
gaacctgcagaccctgcgcggcta

SEQ ID NO: 77563 - DNA, 26 bp, Artificial Sequence
  Description of Artificial Sequence: Synthetic oligonucleotide
aacctgcagaccctgcgcggctacta

SEQ ID NO: 77564 - DNA, 25 bp, Artificial Sequence
  Description of Artificial Sequence: Synthetic oligonucleotide
acctgcagaccctgcgcggctacta

SEQ ID NO: 77565 - DNA, 24 bp, Artificial Sequence
  Description of Artificial Sequence: Synthetic oligonucleotide
cctgcagaccctgcgcggctacta

SEQ ID NO: 77566 - DNA, 26 bp, Artificial Sequence
  Description of Artificial Sequence: Synthetic oligonucleotide
ctgcagaccctgcgcggctactacaa

SEQ ID NO: 77567 - DNA, 26 bp, Artificial Sequence
  Description of Artificial Sequence: Synthetic oligonucleotide
tgcagaccctgcgcggctactacaac

SEQ ID NO: 77568 - DNA, 25 bp, Artificial Sequence
  Description of Artificial Sequence: Synthetic oligonucleotide
gcagaccctgcgcggctactacaac

SEQ ID NO: 77569 - DNA, 26 bp, Artificial Sequence
  Description of Artificial Sequence: Synthetic oligonucleotide
cagaccctgcgcggctactacaacca

SEQ ID NO: 77570 - DNA, 26 bp, Artificial Sequence
  Description of Artificial Sequence: Synthetic oligonucleotide
accagagcgaggccagttctcacacc

SEQ ID NO: 77571 - DNA, 25 bp, Artificial Sequence
  Description of Artificial Sequence: Synthetic oligonucleotide
ccagagcgaggccagttctcacacc

SEQ ID NO: 77572 - DNA, 26 bp, Artificial Sequence
  Description of Artificial Sequence: Synthetic oligonucleotide
cagagcgaggccagttctcacaccct

SEQ ID NO: 77573 - DNA, 26 bp, Artificial Sequence
  Description of Artificial Sequence: Synthetic oligonucleotide
agagcgaggccagttctcacaccctc

SEQ ID NO: 77574 - DNA, 25 bp, Artificial Sequence
  Description of Artificial Sequence: Synthetic oligonucleotide
gagcgaggccagttctcacaccctc

SEQ ID NO: 77575 - DNA, 26 bp, Artificial Sequence
  Description of Artificial Sequence: Synthetic oligonucleotide
agcgaggccagttctcacaccctcca

SEQ ID NO: 77576 - DNA, 25 bp, Artificial Sequence
  Description of Artificial Sequence: Synthetic oligonucleotide
gcgaggccagttctcacaccctcca

SEQ ID NO: 77577 - DNA, 26 bp, Artificial Sequence
  Description of Artificial Sequence: Synthetic oligonucleotide
cgaggccagttctcacaccctccagt

SEQ ID NO: 77578 - DNA, 26 bp, Artificial Sequence
  Description of Artificial Sequence: Synthetic oligonucleotide
gaggccagttctcacaccctccagtg

SEQ ID NO: 77579 - DNA, 27 bp, Artificial Sequence
  Description of Artificial Sequence: Synthetic oligonucleotide
aggccagttctcacaccctccagtgga

SEQ ID NO: 77580 - DNA, 27 bp, Artificial Sequence
  Description of Artificial Sequence: Synthetic oligonucleotide
ggccagttctcacaccctccagtggat

SEQ ID NO: 77581 - DNA, 27 bp, Artificial Sequence
  Description of Artificial Sequence: Synthetic oligonucleotide
gccagttctcacaccctccagtggatg

SEQ ID NO: 77582 - DNA, 30 bp, Artificial Sequence
  Description of Artificial Sequence: Synthetic oligonucleotide
ccagttctcacaccctccagtggatgattg

SEQ ID NO: 77583 - DNA, 30 bp, Artificial Sequence
  Description of Artificial Sequence: Synthetic oligonucleotide
cagttctcacaccctccagtggatgattgg

SEQ ID NO: 77584 - DNA, 30 bp, Artificial Sequence
  Description of Artificial Sequence: Synthetic oligonucleotide
agttctcacaccctccagtggatgattggc

SEQ ID NO: 77585 - DNA, 27 bp, Artificial Sequence
  Description of Artificial Sequence: Synthetic oligonucleotide
cctccagtggatgattggctgcgacct

SEQ ID NO: 77586 - DNA, 27 bp, Artificial Sequence
  Description of Artificial Sequence: Synthetic oligonucleotide
ctccagtggatgattggctgcgacctg

SEQ ID NO: 77587 - DNA, 27 bp, Artificial Sequence
  Description of Artificial Sequence: Synthetic oligonucleotide
tccagtggatgattggctgcgacctgg

SEQ ID NO: 77588 - DNA, 26 bp, Artificial Sequence
  Description of Artificial Sequence: Synthetic oligonucleotide
ccagtggatgattggctgcgacctgg

SEQ ID NO: 77589 - DNA, 26 bp, Artificial Sequence
  Description of Artificial Sequence: Synthetic oligonucleotide
cagtggatgattggctgcgacctggg

SEQ ID NO: 77590 - DNA, 27 bp, Artificial Sequence
  Description of Artificial Sequence: Synthetic oligonucleotide
agtggatgattggctgcgacctggggt

SEQ ID NO: 77591 - DNA, 26 bp, Artificial Sequence
  Description of Artificial Sequence: Synthetic oligonucleotide
gtggatgattggctgcgacctggggt

SEQ ID NO: 77592 - DNA, 26 bp, Artificial Sequence
  Description of Artificial Sequence: Synthetic oligonucleotide
tggatgattggctgcgacctggggtc

SEQ ID NO: 77593 - DNA, 25 bp, Artificial Sequence
  Description of Artificial Sequence: Synthetic oligonucleotide
ggatgattggctgcgacctggggtc

SEQ ID NO: 77594 - DNA, 25 bp, Artificial Sequence
  Description of Artificial Sequence: Synthetic oligonucleotide
gatgattggctgcgacctggggtcc

SEQ ID NO: 77595 - DNA, 26 bp, Artificial Sequence
  Description of Artificial Sequence: Synthetic oligonucleotide
atgattggctgcgacctggggtccga

SEQ ID NO: 77596 - DNA, 25 bp, Artificial Sequence
  Description of Artificial Sequence: Synthetic oligonucleotide
tgattggctgcgacctggggtccga

SEQ ID NO: 77597 - DNA, 24 bp, Artificial Sequence
  Description of Artificial Sequence: Synthetic oligonucleotide
gattggctgcgacctggggtccga

SEQ ID NO: 77598 - DNA, 24 bp, Artificial Sequence
  Description of Artificial Sequence: Synthetic oligonucleotide
attggctgcgacctggggtccgac

SEQ ID NO: 77599 - DNA, 23 bp, Artificial Sequence
  Description of Artificial Sequence: Synthetic oligonucleotide
ttggctgcgacctggggtccgac

SEQ ID NO: 77600 - DNA, 22 bp, Artificial Sequence
  Description of Artificial Sequence: Synthetic oligonucleotide
ctgcgacctggggtccgacgga

SEQ ID NO: 77601 - DNA, 22 bp, Artificial Sequence
  Description of Artificial Sequence: Synthetic oligonucleotide
tgcgacctggggtccgacggac

SEQ ID NO: 77602 - DNA, 21 bp, Artificial Sequence
  Description of Artificial Sequence: Synthetic oligonucleotide
gcgacctggggtccgacggac

SEQ ID NO: 77603 - DNA, 21 bp, Artificial Sequence
  Description of Artificial Sequence: Synthetic oligonucleotide
cgacctggggtccgacggacg

SEQ ID NO: 77604 - DNA, 21 bp, Artificial Sequence
  Description of Artificial Sequence: Synthetic oligonucleotide
gacctggggtccgacggacgc

SEQ ID NO: 77605 - DNA, 22 bp, Artificial Sequence
  Description of Artificial Sequence: Synthetic oligonucleotide
acctggggtccgacggacgcct

SEQ ID NO: 77606 - DNA, 21 bp, Artificial Sequence
  Description of Artificial Sequence: Synthetic oligonucleotide
cctggggtccgacggacgcct

SEQ ID NO: 77607 - DNA, 21 bp, Artificial Sequence
  Description of Artificial Sequence: Synthetic oligonucleotide
ctggggtccgacggacgcctc

SEQ ID NO: 77608 - DNA, 22 bp, Artificial Sequence
  Description of Artificial Sequence: Synthetic oligonucleotide
tggggtccgacggacgcctcct

SEQ ID NO: 77609 - DNA, 21 bp, Artificial Sequence
  Description of Artificial Sequence: Synthetic oligonucleotide
ggggtccgacggacgcctcct

SEQ ID NO: 77610 - DNA, 21 bp, Artificial Sequence
  Description of Artificial Sequence: Synthetic oligonucleotide
gggtccgacggacgcctcctc

SEQ ID NO: 77611 - DNA, 21 bp, Artificial Sequence
  Description of Artificial Sequence: Synthetic oligonucleotide
ggtccgacggacgcctcctcc

SEQ ID NO: 77612 - DNA, 21 bp, Artificial Sequence
  Description of Artificial Sequence: Synthetic oligonucleotide
gtccgacggacgcctcctccg

SEQ ID NO: 77613 - DNA, 21 bp, Artificial Sequence
  Description of Artificial Sequence: Synthetic oligonucleotide
tccgacggacgcctcctccgc

SEQ ID NO: 77614 - DNA, 24 bp, Artificial Sequence
  Description of Artificial Sequence: Synthetic oligonucleotide
ggacgcctcctccgcgggtatgaa

SEQ ID NO: 77615 - DNA, 25 bp, Artificial Sequence
  Description of Artificial Sequence: Synthetic oligonucleotide
gacgcctcctccgcgggtatgaaca

SEQ ID NO: 77616 - DNA, 27 bp, Artificial Sequence
  Description of Artificial Sequence: Synthetic oligonucleotide
acgcctcctccgcgggtatgaacagta

SEQ ID NO: 77617 - DNA, 27 bp, Artificial Sequence
  Description of Artificial Sequence: Synthetic oligonucleotide
cgcctcctccgcgggtatgaacagtat

SEQ ID NO: 77618 - DNA, 27 bp, Artificial Sequence
  Description of Artificial Sequence: Synthetic oligonucleotide
gcctcctccgcgggtatgaacagtatg

SEQ ID NO: 77619 - DNA, 27 bp, Artificial Sequence
  Description of Artificial Sequence: Synthetic oligonucleotide
cctcctccgcgggtatgaacagtatgc

SEQ ID NO: 77620 - DNA, 27 bp, Artificial Sequence
  Description of Artificial Sequence: Synthetic oligonucleotide
ctcctccgcgggtatgaacagtatgcc

SEQ ID NO: 77621 - DNA, 29 bp, Artificial Sequence
  Description of Artificial Sequence: Synthetic oligonucleotide
tcctccgcgggtatgaacagtatgcctac

SEQ ID NO: 77622 - DNA, 28 bp, Artificial Sequence
  Description of Artificial Sequence: Synthetic oligonucleotide
cctccgcgggtatgaacagtatgcctac

SEQ ID NO: 77623 - DNA, 28 bp, Artificial Sequence
  Description of Artificial Sequence: Synthetic oligonucleotide
ctccgcgggtatgaacagtatgcctacg

SEQ ID NO: 77624 - DNA, 30 bp, Artificial Sequence
  Description of Artificial Sequence: Synthetic oligonucleotide
tccgcgggtatgaacagtatgcctacgatg

SEQ ID NO: 77625 - DNA, 29 bp, Artificial Sequence
  Description of Artificial Sequence: Synthetic oligonucleotide
ccgcgggtatgaacagtatgcctacgatg

SEQ ID NO: 77626 - DNA, 29 bp, Artificial Sequence
  Description of Artificial Sequence: Synthetic oligonucleotide
cgcgggtatgaacagtatgcctacgatgg

SEQ ID NO: 77627 - DNA, 29 bp, Artificial Sequence
  Description of Artificial Sequence: Synthetic oligonucleotide
gcgggtatgaacagtatgcctacgatggc

SEQ ID NO: 77628 - DNA, 31 bp, Artificial Sequence
  Description of Artificial Sequence: Synthetic oligonucleotide
cgggtatgaacagtatgcctacgatggcaag

SEQ ID NO: 77629 - DNA, 31 bp, Artificial Sequence
  Description of Artificial Sequence: Synthetic oligonucleotide
gggtatgaacagtatgcctacgatggcaagg

SEQ ID NO: 77630 - DNA, 35 bp, Artificial Sequence
  Description of Artificial Sequence: Synthetic oligonucleotide
ggtatgaacagtatgcctacgatggcaaggattac

SEQ ID NO: 77631 - DNA, 35 bp, Artificial Sequence
  Description of Artificial Sequence: Synthetic oligonucleotide
gtatgaacagtatgcctacgatggcaaggattacc

SEQ ID NO: 77632 - DNA, 36 bp, Artificial Sequence
  Description of Artificial Sequence: Synthetic oligonucleotide
tatgaacagtatgcctacgatggcaaggattacctc

SEQ ID NO: 77633 - DNA, 35 bp, Artificial Sequence
  Description of Artificial Sequence: Synthetic oligonucleotide
atgaacagtatgcctacgatggcaaggattacctc

SEQ ID NO: 77634 - DNA, 34 bp, Artificial Sequence
  Description of Artificial Sequence: Synthetic oligonucleotide
tgaacagtatgcctacgatggcaaggattacctc

SEQ ID NO: 77635 - DNA, 33 bp, Artificial Sequence
  Description of Artificial Sequence: Synthetic oligonucleotide
gaacagtatgcctacgatggcaaggattacctc

SEQ ID NO: 77636 - DNA, 33 bp, Artificial Sequence
  Description of Artificial Sequence: Synthetic oligonucleotide
aacagtatgcctacgatggcaaggattacctcg

SEQ ID NO: 77637 - DNA, 32 bp, Artificial Sequence
  Description of Artificial Sequence: Synthetic oligonucleotide
acagtatgcctacgatggcaaggattacctcg

SEQ ID NO: 77638 - DNA, 31 bp, Artificial Sequence
  Description of Artificial Sequence: Synthetic oligonucleotide
cagtatgcctacgatggcaaggattacctcg

SEQ ID NO: 77639 - DNA, 31 bp, Artificial Sequence
  Description of Artificial Sequence: Synthetic oligonucleotide
agtatgcctacgatggcaaggattacctcgc

SEQ ID NO: 77640 - DNA, 30 bp, Artificial Sequence
  Description of Artificial Sequence: Synthetic oligonucleotide
gtatgcctacgatggcaaggattacctcgc

SEQ ID NO: 77641 - DNA, 30 bp, Artificial Sequence
  Description of Artificial Sequence: Synthetic oligonucleotide
tatgcctacgatggcaaggattacctcgcc

SEQ ID NO: 77642 - DNA, 29 bp, Artificial Sequence
  Description of Artificial Sequence: Synthetic oligonucleotide
atgcctacgatggcaaggattacctcgcc

SEQ ID NO: 77643 - DNA, 28 bp, Artificial Sequence
  Description of Artificial Sequence: Synthetic oligonucleotide
tgcctacgatggcaaggattacctcgcc

SEQ ID NO: 77644 - DNA, 27 bp, Artificial Sequence
  Description of Artificial Sequence: Synthetic oligonucleotide
gcctacgatggcaaggattacctcgcc

SEQ ID NO: 77645 - DNA, 27 bp, Artificial Sequence
  Description of Artificial Sequence: Synthetic oligonucleotide
cctacgatggcaaggattacctcgccc

SEQ ID NO: 77646 - DNA, 28 bp, Artificial Sequence
  Description of Artificial Sequence: Synthetic oligonucleotide
ctacgatggcaaggattacctcgccctg

SEQ ID NO: 77647 - DNA, 30 bp, Artificial Sequence
  Description of Artificial Sequence: Synthetic oligonucleotide
tacgatggcaaggattacctcgccctgaac

SEQ ID NO: 77648 - DNA, 29 bp, Artificial Sequence
  Description of Artificial Sequence: Synthetic oligonucleotide
acgatggcaaggattacctcgccctgaac

SEQ ID NO: 77649 - DNA, 28 bp, Artificial Sequence
  Description of Artificial Sequence: Synthetic oligonucleotide
cgatggcaaggattacctcgccctgaac

SEQ ID NO: 77650 - DNA, 28 bp, Artificial Sequence
  Description of Artificial Sequence: Synthetic oligonucleotide
gatggcaaggattacctcgccctgaacg

SEQ ID NO: 77651 - DNA, 29 bp, Artificial Sequence
  Description of Artificial Sequence: Synthetic oligonucleotide
atggcaaggattacctcgccctgaacgag

SEQ ID NO: 77652 - DNA, 28 bp, Artificial Sequence
  Description of Artificial Sequence: Synthetic oligonucleotide
tggcaaggattacctcgccctgaacgag

SEQ ID NO: 77653 - DNA, 27 bp, Artificial Sequence
  Description of Artificial Sequence: Synthetic oligonucleotide
ggcaaggattacctcgccctgaacgag

SEQ ID NO: 77654 - DNA, 27 bp, Artificial Sequence
  Description of Artificial Sequence: Synthetic oligonucleotide
gcaaggattacctcgccctgaacgagg

SEQ ID NO: 77655 - DNA, 28 bp, Artificial Sequence
  Description of Artificial Sequence: Synthetic oligonucleotide
caaggattacctcgccctgaacgaggac

SEQ ID NO: 77656 - DNA, 28 bp, Artificial Sequence
  Description of Artificial Sequence: Synthetic oligonucleotide
aaggattacctcgccctgaacgaggacc

SEQ ID NO: 77657 - DNA, 27 bp, Artificial Sequence
  Description of Artificial Sequence: Synthetic oligonucleotide
aggattacctcgccctgaacgaggacc

SEQ ID NO: 77658 - DNA, 27 bp, Artificial Sequence
  Description of Artificial Sequence: Synthetic oligonucleotide
ggattacctcgccctgaacgaggacct

SEQ ID NO: 77659 - DNA, 27 bp, Artificial Sequence
  Description of Artificial Sequence: Synthetic oligonucleotide
gattacctcgccctgaacgaggacctg

SEQ ID NO: 77660 - DNA, 27 bp, Artificial Sequence
  Description of Artificial Sequence: Synthetic oligonucleotide
attacctcgccctgaacgaggacctgc

SEQ ID NO: 77661 - DNA, 26 bp, Artificial Sequence
  Description of Artificial Sequence: Synthetic oligonucleotide
ttacctcgccctgaacgaggacctgc

SEQ ID NO: 77662 - DNA, 25 bp, Artificial Sequence
  Description of Artificial Sequence: Synthetic oligonucleotide
tacctcgccctgaacgaggacctgc

SEQ ID NO: 77663 - DNA, 24 bp, Artificial Sequence
  Description of Artificial Sequence: Synthetic oligonucleotide
acctcgccctgaacgaggacctgc

SEQ ID NO: 77664 - DNA, 23 bp, Artificial Sequence
  Description of Artificial Sequence: Synthetic oligonucleotide
cctcgccctgaacgaggacctgc

SEQ ID NO: 77665 - DNA, 23 bp, Artificial Sequence
  Description of Artificial Sequence: Synthetic oligonucleotide
ctcgccctgaacgaggacctgcg

SEQ ID NO: 77666 - DNA, 23 bp, Artificial Sequence
  Description of Artificial Sequence: Synthetic oligonucleotide
aggacctgcgctcctggaccgca

SEQ ID NO: 77667 - DNA, 22 bp, Artificial Sequence
  Description of Artificial Sequence: Synthetic oligonucleotide
ggacctgcgctcctggaccgca

SEQ ID NO: 77668 - DNA, 22 bp, Artificial Sequence
  Description of Artificial Sequence: Synthetic oligonucleotide
gacctgcgctcctggaccgcag

SEQ ID NO: 77669 - DNA, 22 bp, Artificial Sequence
  Description of Artificial Sequence: Synthetic oligonucleotide
acctgcgctcctggaccgcagc

SEQ ID NO: 77670 - DNA, 21 bp, Artificial Sequence
  Description of Artificial Sequence: Synthetic oligonucleotide
cctgcgctcctggaccgcagc

SEQ ID NO: 77671 - DNA, 21 bp, Artificial Sequence
  Description of Artificial Sequence: Synthetic oligonucleotide
ctgcgctcctggaccgcagcg

SEQ ID NO: 77672 - DNA, 22 bp, Artificial Sequence
  Description of Artificial Sequence: Synthetic oligonucleotide
tgcgctcctggaccgcagcgga

SEQ ID NO: 77673 - DNA, 21 bp, Artificial Sequence
  Description of Artificial Sequence: Synthetic oligonucleotide
gcgctcctggaccgcagcgga

SEQ ID NO: 77674 - DNA, 22 bp, Artificial Sequence
  Description of Artificial Sequence: Synthetic oligonucleotide
cgctcctggaccgcagcggaca

SEQ ID NO: 77675 - DNA, 23 bp, Artificial Sequence
  Description of Artificial Sequence: Synthetic oligonucleotide
gctcctggaccgcagcggacact

SEQ ID NO: 77676 - DNA, 23 bp, Artificial Sequence
  Description of Artificial Sequence: Synthetic oligonucleotide
ctcctggaccgcagcggacactg

SEQ ID NO: 77677 - DNA, 23 bp, Artificial Sequence
  Description of Artificial Sequence: Synthetic oligonucleotide
tcctggaccgcagcggacactgc

SEQ ID NO: 77678 - DNA, 22 bp, Artificial Sequence
  Description of Artificial Sequence: Synthetic oligonucleotide
cctggaccgcagcggacactgc

SEQ ID NO: 77679 - DNA, 22 bp, Artificial Sequence
  Description of Artificial Sequence: Synthetic oligonucleotide
ctggaccgcagcggacactgcg

SEQ ID NO: 77680 - DNA, 22 bp, Artificial Sequence
  Description of Artificial Sequence: Synthetic oligonucleotide
tggaccgcagcggacactgcgg

SEQ ID NO: 77681 - DNA, 21 bp, Artificial Sequence
  Description of Artificial Sequence: Synthetic oligonucleotide
ggaccgcagcggacactgcgg

SEQ ID NO: 77682 - DNA, 22 bp, Artificial Sequence
  Description of Artificial Sequence: Synthetic oligonucleotide
gaccgcagcggacactgcggct

SEQ ID NO: 77683 - DNA, 23 bp, Artificial Sequence
  Description of Artificial Sequence: Synthetic oligonucleotide
accgcagcggacactgcggctca

SEQ ID NO: 77684 - DNA, 22 bp, Artificial Sequence
  Description of Artificial Sequence: Synthetic oligonucleotide
ccgcagcggacactgcggctca

SEQ ID NO: 77685 - DNA, 24 bp, Artificial Sequence
  Description of Artificial Sequence: Synthetic oligonucleotide
cgcagcggacactgcggctcagat

SEQ ID NO: 77686 - DNA, 25 bp, Artificial Sequence
  Description of Artificial Sequence: Synthetic oligonucleotide
gcagcggacactgcggctcagatct

SEQ ID NO: 77687 - DNA, 25 bp, Artificial Sequence
  Description of Artificial Sequence: Synthetic oligonucleotide
cagcggacactgcggctcagatctc

SEQ ID NO: 77688 - DNA, 27 bp, Artificial Sequence
  Description of Artificial Sequence: Synthetic oligonucleotide
agcggacactgcggctcagatctccaa

SEQ ID NO: 77689 - DNA, 26 bp, Artificial Sequence
  Description of Artificial Sequence: Synthetic oligonucleotide
gcggacactgcggctcagatctccaa

SEQ ID NO: 77690 - DNA, 26 bp, Artificial Sequence
  Description of Artificial Sequence: Synthetic oligonucleotide
cggacactgcggctcagatctccaag

SEQ ID NO: 77691 - DNA, 26 bp, Artificial Sequence
  Description of Artificial Sequence: Synthetic oligonucleotide
ggacactgcggctcagatctccaagc

SEQ ID NO: 77692 - DNA, 26 bp, Artificial Sequence
  Description of Artificial Sequence: Synthetic oligonucleotide
gacactgcggctcagatctccaagcg

SEQ ID NO: 77693 - DNA, 27 bp, Artificial Sequence
  Description of Artificial Sequence: Synthetic oligonucleotide
acactgcggctcagatctccaagcgca

SEQ ID NO: 77694 - DNA, 27 bp, Artificial Sequence
  Description of Artificial Sequence: Synthetic oligonucleotide
cactgcggctcagatctccaagcgcaa

SEQ ID NO: 77695 - DNA, 27 bp, Artificial Sequence
  Description of Artificial Sequence: Synthetic oligonucleotide
actgcggctcagatctccaagcgcaag

SEQ ID NO: 77696 - DNA, 27 bp, Artificial Sequence
  Description of Artificial Sequence: Synthetic oligonucleotide
ctgcggctcagatctccaagcgcaagt

SEQ ID NO: 77697 - DNA, 27 bp, Artificial Sequence
  Description of Artificial Sequence: Synthetic oligonucleotide
tgcggctcagatctccaagcgcaagtg

SEQ ID NO: 77698 - DNA, 27 bp, Artificial Sequence
  Description of Artificial Sequence: Synthetic oligonucleotide
gcggctcagatctccaagcgcaagtgt

SEQ ID NO: 77699 - DNA, 27 bp, Artificial Sequence
  Description of Artificial Sequence: Synthetic oligonucleotide
cggctcagatctccaagcgcaagtgtg

SEQ ID NO: 77700 - DNA, 28 bp, Artificial Sequence
  Description of Artificial Sequence: Synthetic oligonucleotide
ggctcagatctccaagcgcaagtgtgag

SEQ ID NO: 77701 - DNA, 28 bp, Artificial Sequence
  Description of Artificial Sequence: Synthetic oligonucleotide
gctcagatctccaagcgcaagtgtgagg

SEQ ID NO: 77702 - DNA, 28 bp, Artificial Sequence
  Description of Artificial Sequence: Synthetic oligonucleotide
ctcagatctccaagcgcaagtgtgaggc

SEQ ID NO: 77703 - DNA, 28 bp, Artificial Sequence
  Description of Artificial Sequence: Synthetic oligonucleotide
tcagatctccaagcgcaagtgtgaggcg

SEQ ID NO: 77704 - DNA, 27 bp, Artificial Sequence
  Description of Artificial Sequence: Synthetic oligonucleotide
cagatctccaagcgcaagtgtgaggcg

SEQ ID NO: 77705 - DNA, 27 bp, Artificial Sequence
  Description of Artificial Sequence: Synthetic oligonucleotide
agatctccaagcgcaagtgtgaggcgg

SEQ ID NO: 77706 - DNA, 26 bp, Artificial Sequence
  Description of Artificial Sequence: Synthetic oligonucleotide
gatctccaagcgcaagtgtgaggcgg

SEQ ID NO: 77707 - DNA, 26 bp, Artificial Sequence
  Description of Artificial Sequence: Synthetic oligonucleotide
atctccaagcgcaagtgtgaggcggc

SEQ ID NO: 77708 - DNA, 25 bp, Artificial Sequence
  Description of Artificial Sequence: Synthetic oligonucleotide
tctccaagcgcaagtgtgaggcggc

SEQ ID NO: 77709 - DNA, 24 bp, Artificial Sequence
  Description of Artificial Sequence: Synthetic oligonucleotide
ctccaagcgcaagtgtgaggcggc

SEQ ID NO: 77710 - DNA, 27 bp, Artificial Sequence
  Description of Artificial Sequence: Synthetic oligonucleotide
tccaagcgcaagtgtgaggcggccaat

SEQ ID NO: 77711 - DNA, 26 bp, Artificial Sequence
  Description of Artificial Sequence: Synthetic oligonucleotide
ccaagcgcaagtgtgaggcggccaat

SEQ ID NO: 77712 - DNA, 27 bp, Artificial Sequence
  Description of Artificial Sequence: Synthetic oligonucleotide
caagcgcaagtgtgaggcggccaatgt

SEQ ID NO: 77713 - DNA, 27 bp, Artificial Sequence
  Description of Artificial Sequence: Synthetic oligonucleotide
aagcgcaagtgtgaggcggccaatgtg

SEQ ID NO: 77714 - DNA, 26 bp, Artificial Sequence
  Description of Artificial Sequence: Synthetic oligonucleotide
agcgcaagtgtgaggcggccaatgtg

SEQ ID NO: 77715 - DNA, 25 bp, Artificial Sequence
  Description of Artificial Sequence: Synthetic oligonucleotide
gcgcaagtgtgaggcggccaatgtg

SEQ ID NO: 77716 - DNA, 25 bp, Artificial Sequence
  Description of Artificial Sequence: Synthetic oligonucleotide
cgcaagtgtgaggcggccaatgtgg

SEQ ID NO: 77717 - DNA, 26 bp, Artificial Sequence
  Description of Artificial Sequence: Synthetic oligonucleotide
gcaagtgtgaggcggccaatgtggct

SEQ ID NO: 77718 - DNA, 27 bp, Artificial Sequence
  Description of Artificial Sequence: Synthetic oligonucleotide
caagtgtgaggcggccaatgtggctga

SEQ ID NO: 77719 - DNA, 28 bp, Artificial Sequence
  Description of Artificial Sequence: Synthetic oligonucleotide
aagtgtgaggcggccaatgtggctgaac

SEQ ID NO: 77720 - DNA, 27 bp, Artificial Sequence
  Description of Artificial Sequence: Synthetic oligonucleotide
agtgtgaggcggccaatgtggctgaac

SEQ ID NO: 77721 - DNA, 27 bp, Artificial Sequence
  Description of Artificial Sequence: Synthetic oligonucleotide
gtgtgaggcggccaatgtggctgaaca

SEQ ID NO: 77722 - DNA, 29 bp, Artificial Sequence
  Description of Artificial Sequence: Synthetic oligonucleotide
tgtgaggcggccaatgtggctgaacaaag

SEQ ID NO: 77723 - DNA, 28 bp, Artificial Sequence
  Description of Artificial Sequence: Synthetic oligonucleotide
gtgaggcggccaatgtggctgaacaaag

SEQ ID NO: 77724 - DNA, 28 bp, Artificial Sequence
  Description of Artificial Sequence: Synthetic oligonucleotide
tgaggcggccaatgtggctgaacaaagg

SEQ ID NO: 77725 - DNA, 27 bp, Artificial Sequence
  Description of Artificial Sequence: Synthetic oligonucleotide
gaggcggccaatgtggctgaacaaagg

SEQ ID NO: 77726 - DNA, 28 bp, Artificial Sequence
  Description of Artificial Sequence: Synthetic oligonucleotide
aggcggccaatgtggctgaacaaaggag

SEQ ID NO: 77727 - DNA, 27 bp, Artificial Sequence
  Description of Artificial Sequence: Synthetic oligonucleotide
ggcggccaatgtggctgaacaaaggag

SEQ ID NO: 77728 - DNA, 28 bp, Artificial Sequence
  Description of Artificial Sequence: Synthetic oligonucleotide
gcggccaatgtggctgaacaaaggagag

SEQ ID NO: 77729 - DNA, 28 bp, Artificial Sequence
  Description of Artificial Sequence: Synthetic oligonucleotide
cggccaatgtggctgaacaaaggagagc

SEQ ID NO: 77730 - DNA, 28 bp, Artificial Sequence
  Description of Artificial Sequence: Synthetic oligonucleotide
ggccaatgtggctgaacaaaggagagcc

SEQ ID NO: 77731 - DNA, 30 bp, Artificial Sequence
  Description of Artificial Sequence: Synthetic oligonucleotide
gccaatgtggctgaacaaaggagagcctac

SEQ ID NO: 77732 - DNA, 30 bp, Artificial Sequence
  Description of Artificial Sequence: Synthetic oligonucleotide
ccaatgtggctgaacaaaggagagcctacc

SEQ ID NO: 77733 - DNA, 31 bp, Artificial Sequence
  Description of Artificial Sequence: Synthetic oligonucleotide
caatgtggctgaacaaaggagagcctacctg

SEQ ID NO: 77734 - DNA, 31 bp, Artificial Sequence
  Description of Artificial Sequence: Synthetic oligonucleotide
aatgtggctgaacaaaggagagcctacctgg

SEQ ID NO: 77735 - DNA, 30 bp, Artificial Sequence
  Description of Artificial Sequence: Synthetic oligonucleotide
atgtggctgaacaaaggagagcctacctgg

SEQ ID NO: 77736 - DNA, 29 bp, Artificial Sequence
  Description of Artificial Sequence: Synthetic oligonucleotide
tgtggctgaacaaaggagagcctacctgg

SEQ ID NO: 77737 - DNA, 28 bp, Artificial Sequence
  Description of Artificial Sequence: Synthetic oligonucleotide
gtggctgaacaaaggagagcctacctgg

SEQ ID NO: 77738 - DNA, 29 bp, Artificial Sequence
  Description of Artificial Sequence: Synthetic oligonucleotide
tggctgaacaaaggagagcctacctggag

SEQ ID NO: 77739 - DNA, 28 bp, Artificial Sequence
  Description of Artificial Sequence: Synthetic oligonucleotide
ggctgaacaaaggagagcctacctggag

SEQ ID NO: 77740 - DNA, 28 bp, Artificial Sequence
  Description of Artificial Sequence: Synthetic oligonucleotide
gctgaacaaaggagagcctacctggagg

SEQ ID NO: 77741 - DNA, 28 bp, Artificial Sequence
  Description of Artificial Sequence: Synthetic oligonucleotide
ctgaacaaaggagagcctacctggaggg

SEQ ID NO: 77742 - DNA, 28 bp, Artificial Sequence
  Description of Artificial Sequence: Synthetic oligonucleotide
tgaacaaaggagagcctacctggagggc

SEQ ID NO: 77743 - DNA, 27 bp, Artificial Sequence
  Description of Artificial Sequence: Synthetic oligonucleotide
gaacaaaggagagcctacctggagggc

SEQ ID NO: 77744 - DNA, 28 bp, Artificial Sequence
  Description of Artificial Sequence: Synthetic oligonucleotide
aacaaaggagagcctacctggagggcac

SEQ ID NO: 77745 - DNA, 27 bp, Artificial Sequence
  Description of Artificial Sequence: Synthetic oligonucleotide
acaaaggagagcctacctggagggcac

SEQ ID NO: 77746 - DNA, 26 bp, Artificial Sequence
  Description of Artificial Sequence: Synthetic oligonucleotide
caaaggagagcctacctggagggcac

SEQ ID NO: 77747 - DNA, 27 bp, Artificial Sequence
  Description of Artificial Sequence: Synthetic oligonucleotide
aaaggagagcctacctggagggcacgt

SEQ ID NO: 77748 - DNA, 26 bp, Artificial Sequence
  Description of Artificial Sequence: Synthetic oligonucleotide
aaggagagcctacctggagggcacgt

SEQ ID NO: 77749 - DNA, 25 bp, Artificial Sequence
  Description of Artificial Sequence: Synthetic oligonucleotide
aggagagcctacctggagggcacgt

SEQ ID NO: 77750 - DNA, 30 bp, Artificial Sequence
  Description of Artificial Sequence: Synthetic oligonucleotide
cacagatacctggagaacgggaaggagatg

SEQ ID NO: 77751 - DNA, 30 bp, Artificial Sequence
  Description of Artificial Sequence: Synthetic oligonucleotide
acagatacctggagaacgggaaggagatgc

SEQ ID NO: 77752 - DNA, 24 bp, Artificial Sequence
  Description of Artificial Sequence: Synthetic oligonucleotide
gaaggagatgctgcagcgcgcgga

SEQ ID NO: 77753 - DNA, 24 bp, Artificial Sequence
  Description of Artificial Sequence: Synthetic oligonucleotide
aaggagatgctgcagcgcgcggac

SEQ ID NO: 77754 - DNA, 23 bp, Artificial Sequence
  Description of Artificial Sequence: Synthetic oligonucleotide
aggagatgctgcagcgcgcggac

SEQ ID NO: 77755 - DNA, 22 bp, Artificial Sequence
  Description of Artificial Sequence: Synthetic oligonucleotide
ggagatgctgcagcgcgcggac

SEQ ID NO: 77756 - DNA, 22 bp, Artificial Sequence
  Description of Artificial Sequence: Synthetic oligonucleotide
gagatgctgcagcgcgcggacc

SEQ ID NO: 77757 - DNA, 22 bp, Artificial Sequence
  Description of Artificial Sequence: Synthetic oligonucleotide
agatgctgcagcgcgcggaccc

SEQ ID NO: 77758 - DNA, 21 bp, Artificial Sequence
  Description of Artificial Sequence: Synthetic oligonucleotide
gatgctgcagcgcgcggaccc

SEQ ID NO: 77759 - DNA, 21 bp, Artificial Sequence
  Description of Artificial Sequence: Synthetic oligonucleotide
atgctgcagcgcgcggacccc

SEQ ID NO: 77760 - DNA, 20 bp, Artificial Sequence
  Description of Artificial Sequence: Synthetic oligonucleotide
tgctgcagcgcgcggacccc

SEQ ID NO: 77761 - DNA, 22 bp, Artificial Sequence
  Description of Artificial Sequence: Synthetic oligonucleotide
gcgcggacccccccaagacaca

SEQ ID NO: 77762 - DNA, 22 bp, Artificial Sequence
  Description of Artificial Sequence: Synthetic oligonucleotide
cgcggacccccccaagacacac

SEQ ID NO: 77763 - DNA, 23 bp, Artificial Sequence
  Description of Artificial Sequence: Synthetic oligonucleotide
gcggacccccccaagacacacgt

SEQ ID NO: 77764 - DNA, 24 bp, Artificial Sequence
  Description of Artificial Sequence: Synthetic oligonucleotide
cggacccccccaagacacacgtga

SEQ ID NO: 77765 - DNA, 24 bp, Artificial Sequence
  Description of Artificial Sequence: Synthetic oligonucleotide
ggacccccccaagacacacgtgac

SEQ ID NO: 77766 - DNA, 24 bp, Artificial Sequence
  Description of Artificial Sequence: Synthetic oligonucleotide
gacccccccaagacacacgtgacc

SEQ ID NO: 77767 - DNA, 25 bp, Artificial Sequence
  Description of Artificial Sequence: Synthetic oligonucleotide
acccccccaagacacacgtgaccca

SEQ ID NO: 77768 - DNA, 24 bp, Artificial Sequence
  Description of Artificial Sequence: Synthetic oligonucleotide
cccccccaagacacacgtgaccca

SEQ ID NO: 77769 - DNA, 24 bp, Artificial Sequence
  Description of Artificial Sequence: Synthetic oligonucleotide
ccccccaagacacacgtgacccac

SEQ ID NO: 77770 - DNA, 25 bp, Artificial Sequence
  Description of Artificial Sequence: Synthetic oligonucleotide
cccccaagacacacgtgacccacca

SEQ ID NO: 77771 - DNA, 25 bp, Artificial Sequence
  Description of Artificial Sequence: Synthetic oligonucleotide
ccccaagacacacgtgacccaccac

SEQ ID NO: 77772 - DNA, 25 bp, Artificial Sequence
  Description of Artificial Sequence: Synthetic oligonucleotide
cccaagacacacgtgacccaccacc

SEQ ID NO: 77773 - DNA, 26 bp, Artificial Sequence
  Description of Artificial Sequence: Synthetic oligonucleotide
ccaagacacacgtgacccaccaccct

SEQ ID NO: 77774 - DNA, 27 bp, Artificial Sequence
  Description of Artificial Sequence: Synthetic oligonucleotide
caagacacacgtgacccaccaccctgt

SEQ ID NO: 77775 - DNA, 27 bp, Artificial Sequence
  Description of Artificial Sequence: Synthetic oligonucleotide
aagacacacgtgacccaccaccctgtc

SEQ ID NO: 77776 - DNA, 27 bp, Artificial Sequence
  Description of Artificial Sequence: Synthetic oligonucleotide
agacacacgtgacccaccaccctgtct

SEQ ID NO: 77777 - DNA, 27 bp, Artificial Sequence
  Description of Artificial Sequence: Synthetic oligonucleotide
gacacacgtgacccaccaccctgtctt

SEQ ID NO: 77778 - DNA, 28 bp, Artificial Sequence
  Description of Artificial Sequence: Synthetic oligonucleotide
acacacgtgacccaccaccctgtctttg

SEQ ID NO: 77779 - DNA, 27 bp, Artificial Sequence
  Description of Artificial Sequence: Synthetic oligonucleotide
cacacgtgacccaccaccctgtctttg

SEQ ID NO: 77780 - DNA, 28 bp, Artificial Sequence
  Description of Artificial Sequence: Synthetic oligonucleotide
acacgtgacccaccaccctgtctttgac

SEQ ID NO: 77781 - DNA, 27 bp, Artificial Sequence
  Description of Artificial Sequence: Synthetic oligonucleotide
cacgtgacccaccaccctgtctttgac

SEQ ID NO: 77782 - DNA, 30 bp, Artificial Sequence
  Description of Artificial Sequence: Synthetic oligonucleotide
acgtgacccaccaccctgtctttgactatg

SEQ ID NO: 77783 - DNA, 29 bp, Artificial Sequence
  Description of Artificial Sequence: Synthetic oligonucleotide
cgtgacccaccaccctgtctttgactatg

SEQ ID NO: 77784 - DNA, 30 bp, Artificial Sequence
  Description of Artificial Sequence: Synthetic oligonucleotide
gtgacccaccaccctgtctttgactatgag

SEQ ID NO: 77785 - DNA, 30 bp, Artificial Sequence
  Description of Artificial Sequence: Synthetic oligonucleotide
tgacccaccaccctgtctttgactatgagg

SEQ ID NO: 77786 - DNA, 29 bp, Artificial Sequence
  Description of Artificial Sequence: Synthetic oligonucleotide
gacccaccaccctgtctttgactatgagg

SEQ ID NO: 77787 - DNA, 29 bp, Artificial Sequence
  Description of Artificial Sequence: Synthetic oligonucleotide
acccaccaccctgtctttgactatgaggc

SEQ ID NO: 77788 - DNA, 28 bp, Artificial Sequence
  Description of Artificial Sequence: Synthetic oligonucleotide
cccaccaccctgtctttgactatgaggc

SEQ ID NO: 77789 - DNA, 28 bp, Artificial Sequence
  Description of Artificial Sequence: Synthetic oligonucleotide
ccaccaccctgtctttgactatgaggcc

SEQ ID NO: 77790 - DNA, 29 bp, Artificial Sequence
  Description of Artificial Sequence: Synthetic oligonucleotide
caccaccctgtctttgactatgaggccac

SEQ ID NO: 77791 - DNA, 29 bp, Artificial Sequence
  Description of Artificial Sequence: Synthetic oligonucleotide
accaccctgtctttgactatgaggccacc

SEQ ID NO: 77792 - DNA, 28 bp, Artificial Sequence
  Description of Artificial Sequence: Synthetic oligonucleotide
ccaccctgtctttgactatgaggccacc

SEQ ID NO: 77793 - DNA, 28 bp, Artificial Sequence
  Description of Artificial Sequence: Synthetic oligonucleotide
caccctgtctttgactatgaggccaccc

SEQ ID NO: 77794 - DNA, 29 bp, Artificial Sequence
  Description of Artificial Sequence: Synthetic oligonucleotide
accctgtctttgactatgaggccaccctg

SEQ ID NO: 77795 - DNA, 28 bp, Artificial Sequence
  Description of Artificial Sequence: Synthetic oligonucleotide
ccctgtctttgactatgaggccaccctg

SEQ ID NO: 77796 - DNA, 29 bp, Artificial Sequence
  Description of Artificial Sequence: Synthetic oligonucleotide
cctgtctttgactatgaggccaccctgag

SEQ ID NO: 77797 - DNA, 29 bp, Artificial Sequence
  Description of Artificial Sequence: Synthetic oligonucleotide
ctgtctttgactatgaggccaccctgagg

SEQ ID NO: 77798 - DNA, 30 bp, Artificial Sequence
  Description of Artificial Sequence: Synthetic oligonucleotide
tgtctttgactatgaggccaccctgaggtg

SEQ ID NO: 77799 - DNA, 29 bp, Artificial Sequence
  Description of Artificial Sequence: Synthetic oligonucleotide
gtctttgactatgaggccaccctgaggtg

SEQ ID NO: 77800 - DNA, 29 bp, Artificial Sequence
  Description of Artificial Sequence: Synthetic oligonucleotide
tctttgactatgaggccaccctgaggtgc

SEQ ID NO: 77801 - DNA, 28 bp, Artificial Sequence
  Description of Artificial Sequence: Synthetic oligonucleotide
ctttgactatgaggccaccctgaggtgc

SEQ ID NO: 77802 - DNA, 29 bp, Artificial Sequence
  Description of Artificial Sequence: Synthetic oligonucleotide
tttgactatgaggccaccctgaggtgctg

SEQ ID NO: 77803 - DNA, 28 bp, Artificial Sequence
  Description of Artificial Sequence: Synthetic oligonucleotide
ttgactatgaggccaccctgaggtgctg

SEQ ID NO: 77804 - DNA, 27 bp, Artificial Sequence
  Description of Artificial Sequence: Synthetic oligonucleotide
tgactatgaggccaccctgaggtgctg

SEQ ID NO: 77805 - DNA, 26 bp, Artificial Sequence
  Description of Artificial Sequence: Synthetic oligonucleotide
gactatgaggccaccctgaggtgctg

SEQ ID NO: 77806 - DNA, 26 bp, Artificial Sequence
  Description of Artificial Sequence: Synthetic oligonucleotide
actatgaggccaccctgaggtgctgg

SEQ ID NO: 77807 - DNA, 25 bp, Artificial Sequence
  Description of Artificial Sequence: Synthetic oligonucleotide
ctatgaggccaccctgaggtgctgg

SEQ ID NO: 77808 - DNA, 25 bp, Artificial Sequence
  Description of Artificial Sequence: Synthetic oligonucleotide
tatgaggccaccctgaggtgctggg

SEQ ID NO: 77809 - DNA, 27 bp, Artificial Sequence
  Description of Artificial Sequence: Synthetic oligonucleotide
cctgggcttctaccctgcggagatcat

SEQ ID NO: 77810 - DNA, 28 bp, Artificial Sequence
  Description of Artificial Sequence: Synthetic oligonucleotide
ctgggcttctaccctgcggagatcatac

SEQ ID NO: 77811 - DNA, 29 bp, Artificial Sequence
  Description of Artificial Sequence: Synthetic oligonucleotide
tgggcttctaccctgcggagatcatactg

SEQ ID NO: 77812 - DNA, 28 bp, Artificial Sequence
  Description of Artificial Sequence: Synthetic oligonucleotide
gggcttctaccctgcggagatcatactg

SEQ ID NO: 77813 - DNA, 29 bp, Artificial Sequence
  Description of Artificial Sequence: Synthetic oligonucleotide
ggcttctaccctgcggagatcatactgac

SEQ ID NO: 77814 - DNA, 29 bp, Artificial Sequence
  Description of Artificial Sequence: Synthetic oligonucleotide
gcttctaccctgcggagatcatactgacc

SEQ ID NO: 77815 - DNA, 30 bp, Artificial Sequence
  Description of Artificial Sequence: Synthetic oligonucleotide
cttctaccctgcggagatcatactgacctg

SEQ ID NO: 77816 - DNA, 30 bp, Artificial Sequence
  Description of Artificial Sequence: Synthetic oligonucleotide
ttctaccctgcggagatcatactgacctgg

SEQ ID NO: 77817 - DNA, 29 bp, Artificial Sequence
  Description of Artificial Sequence: Synthetic oligonucleotide
tctaccctgcggagatcatactgacctgg

SEQ ID NO: 77818 - DNA, 28 bp, Artificial Sequence
  Description of Artificial Sequence: Synthetic oligonucleotide
ctaccctgcggagatcatactgacctgg

SEQ ID NO: 77819 - DNA, 28 bp, Artificial Sequence
  Description of Artificial Sequence: Synthetic oligonucleotide
taccctgcggagatcatactgacctggc

SEQ ID NO: 77820 - DNA, 27 bp, Artificial Sequence
  Description of Artificial Sequence: Synthetic oligonucleotide
accctgcggagatcatactgacctggc

SEQ ID NO: 77821 - DNA, 27 bp, Artificial Sequence
  Description of Artificial Sequence: Synthetic oligonucleotide
ccctgcggagatcatactgacctggca

SEQ ID NO: 77822 - DNA, 27 bp, Artificial Sequence
  Description of Artificial Sequence: Synthetic oligonucleotide
cctgcggagatcatactgacctggcag

SEQ ID NO: 77823 - DNA, 27 bp, Artificial Sequence
  Description of Artificial Sequence: Synthetic oligonucleotide
ctgcggagatcatactgacctggcagc

SEQ ID NO: 77824 - DNA, 27 bp, Artificial Sequence
  Description of Artificial Sequence: Synthetic oligonucleotide
tgcggagatcatactgacctggcagcg

SEQ ID NO: 77825 - DNA, 26 bp, Artificial Sequence
  Description of Artificial Sequence: Synthetic oligonucleotide
gcggagatcatactgacctggcagcg

SEQ ID NO: 77826 - DNA, 26 bp, Artificial Sequence
  Description of Artificial Sequence: Synthetic oligonucleotide
cggagatcatactgacctggcagcgg

SEQ ID NO: 77827 - DNA, 27 bp, Artificial Sequence
  Description of Artificial Sequence: Synthetic oligonucleotide
ggagatcatactgacctggcagcggga

SEQ ID NO: 77828 - DNA, 28 bp, Artificial Sequence
  Description of Artificial Sequence: Synthetic oligonucleotide
gagatcatactgacctggcagcgggatg

SEQ ID NO: 77829 - DNA, 28 bp, Artificial Sequence
  Description of Artificial Sequence: Synthetic oligonucleotide
agatcatactgacctggcagcgggatgg

SEQ ID NO: 77830 - DNA, 27 bp, Artificial Sequence
  Description of Artificial Sequence: Synthetic oligonucleotide
gatcatactgacctggcagcgggatgg

SEQ ID NO: 77831 - DNA, 27 bp, Artificial Sequence
  Description of Artificial Sequence: Synthetic oligonucleotide
atcatactgacctggcagcgggatggg

SEQ ID NO: 77832 - DNA, 26 bp, Artificial Sequence
  Description of Artificial Sequence: Synthetic oligonucleotide
tcatactgacctggcagcgggatggg

SEQ ID NO: 77833 - DNA, 25 bp, Artificial Sequence
  Description of Artificial Sequence: Synthetic oligonucleotide
catactgacctggcagcgggatggg

SEQ ID NO: 77834 - DNA, 26 bp, Artificial Sequence
  Description of Artificial Sequence: Synthetic oligonucleotide
atactgacctggcagcgggatgggga

SEQ ID NO: 77835 - DNA, 25 bp, Artificial Sequence
  Description of Artificial Sequence: Synthetic oligonucleotide
tactgacctggcagcgggatgggga

SEQ ID NO: 77836 - DNA, 24 bp, Artificial Sequence
  Description of Artificial Sequence: Synthetic oligonucleotide
gatggggaggaccagacccaggac

SEQ ID NO: 77837 - DNA, 25 bp, Artificial Sequence
  Description of Artificial Sequence: Synthetic oligonucleotide
atggggaggaccagacccaggacgt

SEQ ID NO: 77838 - DNA, 24 bp, Artificial Sequence
  Description of Artificial Sequence: Synthetic oligonucleotide
tggggaggaccagacccaggacgt

SEQ ID NO: 77839 - DNA, 23 bp, Artificial Sequence
  Description of Artificial Sequence: Synthetic oligonucleotide
ggggaggaccagacccaggacgt

SEQ ID NO: 77840 - DNA, 23 bp, Artificial Sequence
  Description of Artificial Sequence: Synthetic oligonucleotide
gggaggaccagacccaggacgtg

SEQ ID NO: 77841 - DNA, 24 bp, Artificial Sequence
  Description of Artificial Sequence: Synthetic oligonucleotide
ggaggaccagacccaggacgtgga

SEQ ID NO: 77842 - DNA, 24 bp, Artificial Sequence
  Description of Artificial Sequence: Synthetic oligonucleotide
gaggaccagacccaggacgtggag

SEQ ID NO: 77843 - DNA, 25 bp, Artificial Sequence
  Description of Artificial Sequence: Synthetic oligonucleotide
aggaccagacccaggacgtggagct

SEQ ID NO: 77844 - DNA, 24 bp, Artificial Sequence
  Description of Artificial Sequence: Synthetic oligonucleotide
ggaccagacccaggacgtggagct

SEQ ID NO: 77845 - DNA, 24 bp, Artificial Sequence
  Description of Artificial Sequence: Synthetic oligonucleotide
gaccagacccaggacgtggagctc

SEQ ID NO: 77846 - DNA, 25 bp, Artificial Sequence
  Description of Artificial Sequence: Synthetic oligonucleotide
accagacccaggacgtggagctcgt

SEQ ID NO: 77847 - DNA, 24 bp, Artificial Sequence
  Description of Artificial Sequence: Synthetic oligonucleotide
ccagacccaggacgtggagctcgt

SEQ ID NO: 77848 - DNA, 24 bp, Artificial Sequence
  Description of Artificial Sequence: Synthetic oligonucleotide
cagacccaggacgtggagctcgtg

SEQ ID NO: 77849 - DNA, 25 bp, Artificial Sequence
  Description of Artificial Sequence: Synthetic oligonucleotide
agacccaggacgtggagctcgtgga

SEQ ID NO: 77850 - DNA, 24 bp, Artificial Sequence
  Description of Artificial Sequence: Synthetic oligonucleotide
gacccaggacgtggagctcgtgga

SEQ ID NO: 77851 - DNA, 25 bp, Artificial Sequence
  Description of Artificial Sequence: Synthetic oligonucleotide
acccaggacgtggagctcgtggaga

SEQ ID NO: 77852 - DNA, 24 bp, Artificial Sequence
  Description of Artificial Sequence: Synthetic oligonucleotide
cccaggacgtggagctcgtggaga

SEQ ID NO: 77853 - DNA, 24 bp, Artificial Sequence
  Description of Artificial Sequence: Synthetic oligonucleotide
ccaggacgtggagctcgtggagac

SEQ ID NO: 77854 - DNA, 25 bp, Artificial Sequence
  Description of Artificial Sequence: Synthetic oligonucleotide
caggacgtggagctcgtggagacca

SEQ ID NO: 77855 - DNA, 25 bp, Artificial Sequence
  Description of Artificial Sequence: Synthetic oligonucleotide
aggacgtggagctcgtggagaccag

SEQ ID NO: 77856 - DNA, 24 bp, Artificial Sequence
  Description of Artificial Sequence: Synthetic oligonucleotide
ggacgtggagctcgtggagaccag

SEQ ID NO: 77857 - DNA, 24 bp, Artificial Sequence
  Description of Artificial Sequence: Synthetic oligonucleotide
gacgtggagctcgtggagaccagg

SEQ ID NO: 77858 - DNA, 24 bp, Artificial Sequence
  Description of Artificial Sequence: Synthetic oligonucleotide
acgtggagctcgtggagaccaggc

SEQ ID NO: 77859 - DNA, 23 bp, Artificial Sequence
  Description of Artificial Sequence: Synthetic oligonucleotide
cgtggagctcgtggagaccaggc

SEQ ID NO: 77860 - DNA, 24 bp, Artificial Sequence
  Description of Artificial Sequence: Synthetic oligonucleotide
gtggagctcgtggagaccaggcct

SEQ ID NO: 77861 - DNA, 24 bp, Artificial Sequence
  Description of Artificial Sequence: Synthetic oligonucleotide
ccatgtgcagcatgaggggctgcc

SEQ ID NO: 77862 - DNA, 24 bp, Artificial Sequence
  Description of Artificial Sequence: Synthetic oligonucleotide
catgtgcagcatgaggggctgccg

SEQ ID NO: 77863 - DNA, 25 bp, Artificial Sequence
  Description of Artificial Sequence: Synthetic oligonucleotide
atgtgcagcatgaggggctgccgga

SEQ ID NO: 77864 - DNA, 24 bp, Artificial Sequence
  Description of Artificial Sequence: Synthetic oligonucleotide
tgtgcagcatgaggggctgccgga

SEQ ID NO: 77865 - DNA, 23 bp, Artificial Sequence
  Description of Artificial Sequence: Synthetic oligonucleotide
gtgcagcatgaggggctgccgga

SEQ ID NO: 77866 - DNA, 23 bp, Artificial Sequence
  Description of Artificial Sequence: Synthetic oligonucleotide
tgcagcatgaggggctgccggag

SEQ ID NO: 77867 - DNA, 22 bp, Artificial Sequence
  Description of Artificial Sequence: Synthetic oligonucleotide
gcagcatgaggggctgccggag

SEQ ID NO: 77868 - DNA, 22 bp, Artificial Sequence
  Description of Artificial Sequence: Synthetic oligonucleotide
aggggctgccggagcccctcat

SEQ ID NO: 77869 - DNA, 21 bp, Artificial Sequence
  Description of Artificial Sequence: Synthetic oligonucleotide
ggggctgccggagcccctcat

SEQ ID NO: 77870 - DNA, 21 bp, Artificial Sequence
  Description of Artificial Sequence: Synthetic oligonucleotide
gggctgccggagcccctcatg

SEQ ID NO: 77871 - DNA, 22 bp, Artificial Sequence
  Description of Artificial Sequence: Synthetic oligonucleotide
ggctgccggagcccctcatgct

SEQ ID NO: 77872 - DNA, 23 bp, Artificial Sequence
  Description of Artificial Sequence: Synthetic oligonucleotide
gctgccggagcccctcatgctga

SEQ ID NO: 77873 - DNA, 25 bp, Artificial Sequence
  Description of Artificial Sequence: Synthetic oligonucleotide
ctgccggagcccctcatgctgagat

SEQ ID NO: 77874 - DNA, 25 bp, Artificial Sequence
  Description of Artificial Sequence: Synthetic oligonucleotide
tgccggagcccctcatgctgagatg

SEQ ID NO: 77875 - DNA, 24 bp, Artificial Sequence
  Description of Artificial Sequence: Synthetic oligonucleotide
gccggagcccctcatgctgagatg

SEQ ID NO: 77876 - DNA, 26 bp, Artificial Sequence
  Description of Artificial Sequence: Synthetic oligonucleotide
ccggagcccctcatgctgagatggaa

SEQ ID NO: 77877 - DNA, 26 bp, Artificial Sequence
  Description of Artificial Sequence: Synthetic oligonucleotide
cggagcccctcatgctgagatggaag

SEQ ID NO: 77878 - DNA, 27 bp, Artificial Sequence
  Description of Artificial Sequence: Synthetic oligonucleotide
ggagcccctcatgctgagatggaagca

SEQ ID NO: 77879 - DNA, 27 bp, Artificial Sequence
  Description of Artificial Sequence: Synthetic oligonucleotide
gagcccctcatgctgagatggaagcag

SEQ ID NO: 77880 - DNA, 28 bp, Artificial Sequence
  Description of Artificial Sequence: Synthetic oligonucleotide
agcccctcatgctgagatggaagcagtc

SEQ ID NO: 77881 - DNA, 27 bp, Artificial Sequence
  Description of Artificial Sequence: Synthetic oligonucleotide
gcccctcatgctgagatggaagcagtc

SEQ ID NO: 77882 - DNA, 29 bp, Artificial Sequence
  Description of Artificial Sequence: Synthetic oligonucleotide
cccctcatgctgagatggaagcagtcttc

SEQ ID NO: 77883 - DNA, 29 bp, Artificial Sequence
  Description of Artificial Sequence: Synthetic oligonucleotide
ccctcatgctgagatggaagcagtcttcc

SEQ ID NO: 77884 - DNA, 29 bp, Artificial Sequence
  Description of Artificial Sequence: Synthetic oligonucleotide
cctcatgctgagatggaagcagtcttccc

SEQ ID NO: 77885 - DNA, 30 bp, Artificial Sequence
  Description of Artificial Sequence: Synthetic oligonucleotide
ctcatgctgagatggaagcagtcttccctg

SEQ ID NO: 77886 - DNA, 30 bp, Artificial Sequence
  Description of Artificial Sequence: Synthetic oligonucleotide
tcatgctgagatggaagcagtcttccctgc

SEQ ID NO: 77887 - DNA, 29 bp, Artificial Sequence
  Description of Artificial Sequence: Synthetic oligonucleotide
catgctgagatggaagcagtcttccctgc

SEQ ID NO: 77888 - DNA, 29 bp, Artificial Sequence
  Description of Artificial Sequence: Synthetic oligonucleotide
atgctgagatggaagcagtcttccctgcc

SEQ ID NO: 77889 - DNA, 28 bp, Artificial Sequence
  Description of Artificial Sequence: Synthetic oligonucleotide
tgctgagatggaagcagtcttccctgcc

SEQ ID NO: 77890 - DNA, 27 bp, Artificial Sequence
  Description of Artificial Sequence: Synthetic oligonucleotide
gctgagatggaagcagtcttccctgcc

SEQ ID NO: 77891 - DNA, 27 bp, Artificial Sequence
  Description of Artificial Sequence: Synthetic oligonucleotide
ctgagatggaagcagtcttccctgccc

SEQ ID NO: 77892 - DNA, 28 bp, Artificial Sequence
  Description of Artificial Sequence: Synthetic oligonucleotide
tgagatggaagcagtcttccctgcccac

SEQ ID NO: 77893 - DNA, 27 bp, Artificial Sequence
  Description of Artificial Sequence: Synthetic oligonucleotide
gagatggaagcagtcttccctgcccac

SEQ ID NO: 77894 - DNA, 27 bp, Artificial Sequence
  Description of Artificial Sequence: Synthetic oligonucleotide
agatggaagcagtcttccctgcccacc

SEQ ID NO: 77895 - DNA, 27 bp, Artificial Sequence
  Description of Artificial Sequence: Synthetic oligonucleotide
gatggaagcagtcttccctgcccacca

SEQ ID NO: 77896 - DNA, 28 bp, Artificial Sequence
  Description of Artificial Sequence: Synthetic oligonucleotide
atggaagcagtcttccctgcccaccatc

SEQ ID NO: 77897 - DNA, 27 bp, Artificial Sequence
  Description of Artificial Sequence: Synthetic oligonucleotide
tggaagcagtcttccctgcccaccatc

SEQ ID NO: 77898 - DNA, 26 bp, Artificial Sequence
  Description of Artificial Sequence: Synthetic oligonucleotide
ggaagcagtcttccctgcccaccatc

SEQ ID NO: 77899 - DNA, 26 bp, Artificial Sequence
  Description of Artificial Sequence: Synthetic oligonucleotide
gaagcagtcttccctgcccaccatcc

SEQ ID NO: 77900 - DNA, 26 bp, Artificial Sequence
  Description of Artificial Sequence: Synthetic oligonucleotide
aagcagtcttccctgcccaccatccc

SEQ ID NO: 77901 - DNA, 25 bp, Artificial Sequence
  Description of Artificial Sequence: Synthetic oligonucleotide
agcagtcttccctgcccaccatccc

SEQ ID NO: 77902 - DNA, 24 bp, Artificial Sequence
  Description of Artificial Sequence: Synthetic oligonucleotide
gcagtcttccctgcccaccatccc

SEQ ID NO: 77903 - DNA, 26 bp, Artificial Sequence
  Description of Artificial Sequence: Synthetic oligonucleotide
cagtcttccctgcccaccatccccat

SEQ ID NO: 77904 - DNA, 27 bp, Artificial Sequence
  Description of Artificial Sequence: Synthetic oligonucleotide
agtcttccctgcccaccatccccatca

SEQ ID NO: 77905 - DNA, 27 bp, Artificial Sequence
  Description of Artificial Sequence: Synthetic oligonucleotide
gtcttccctgcccaccatccccatcat

SEQ ID NO: 77906 - DNA, 27 bp, Artificial Sequence
  Description of Artificial Sequence: Synthetic oligonucleotide
tcttccctgcccaccatccccatcatg

SEQ ID NO: 77907 - DNA, 26 bp, Artificial Sequence
  Description of Artificial Sequence: Synthetic oligonucleotide
cttccctgcccaccatccccatcatg

SEQ ID NO: 77908 - DNA, 26 bp, Artificial Sequence
  Description of Artificial Sequence: Synthetic oligonucleotide
ttccctgcccaccatccccatcatgg

SEQ ID NO: 77909 - DNA, 25 bp, Artificial Sequence
  Description of Artificial Sequence: Synthetic oligonucleotide
tccctgcccaccatccccatcatgg

SEQ ID NO: 77910 - DNA, 24 bp, Artificial Sequence
  Description of Artificial Sequence: Synthetic oligonucleotide
ccctgcccaccatccccatcatgg

SEQ ID NO: 77911 - DNA, 27 bp, Artificial Sequence
  Description of Artificial Sequence: Synthetic oligonucleotide
cctgcccaccatccccatcatgggtat

SEQ ID NO: 77912 - DNA, 27 bp, Artificial Sequence
  Description of Artificial Sequence: Synthetic oligonucleotide
ctgcccaccatccccatcatgggtatc

SEQ ID NO: 77913 - DNA, 27 bp, Artificial Sequence
  Description of Artificial Sequence: Synthetic oligonucleotide
tgcccaccatccccatcatgggtatcg

SEQ ID NO: 77914 - DNA, 27 bp, Artificial Sequence
  Description of Artificial Sequence: Synthetic oligonucleotide
gcccaccatccccatcatgggtatcgt

SEQ ID NO: 77915 - DNA, 28 bp, Artificial Sequence
  Description of Artificial Sequence: Synthetic oligonucleotide
cccaccatccccatcatgggtatcgttg

SEQ ID NO: 77916 - DNA, 28 bp, Artificial Sequence
  Description of Artificial Sequence: Synthetic oligonucleotide
ccaccatccccatcatgggtatcgttgc

SEQ ID NO: 77917 - DNA, 29 bp, Artificial Sequence
  Description of Artificial Sequence: Synthetic oligonucleotide
caccatccccatcatgggtatcgttgctg

SEQ ID NO: 77918 - DNA, 29 bp, Artificial Sequence
  Description of Artificial Sequence: Synthetic oligonucleotide
accatccccatcatgggtatcgttgctgg

SEQ ID NO: 77919 - DNA, 28 bp, Artificial Sequence
  Description of Artificial Sequence: Synthetic oligonucleotide
ccatccccatcatgggtatcgttgctgg

SEQ ID NO: 77920 - DNA, 28 bp, Artificial Sequence
  Description of Artificial Sequence: Synthetic oligonucleotide
catccccatcatgggtatcgttgctggc

SEQ ID NO: 77921 - DNA, 28 bp, Artificial Sequence
  Description of Artificial Sequence: Synthetic oligonucleotide
atccccatcatgggtatcgttgctggcc

SEQ ID NO: 77922 - DNA, 27 bp, Artificial Sequence
  Description of Artificial Sequence: Synthetic oligonucleotide
tccccatcatgggtatcgttgctggcc

SEQ ID NO: 77923 - DNA, 27 bp, Artificial Sequence
  Description of Artificial Sequence: Synthetic oligonucleotide
ccccatcatgggtatcgttgctggcct

SEQ ID NO: 77924 - DNA, 27 bp, Artificial Sequence
  Description of Artificial Sequence: Synthetic oligonucleotide
cccatcatgggtatcgttgctggcctg

SEQ ID NO: 77925 - DNA, 27 bp, Artificial Sequence
  Description of Artificial Sequence: Synthetic oligonucleotide
ccatcatgggtatcgttgctggcctgg

SEQ ID NO: 77926 - DNA, 29 bp, Artificial Sequence
  Description of Artificial Sequence: Synthetic oligonucleotide
catcatgggtatcgttgctggcctggttg

SEQ ID NO: 77927 - DNA, 30 bp, Artificial Sequence
  Description of Artificial Sequence: Synthetic oligonucleotide
atcatgggtatcgttgctggcctggttgtc

SEQ ID NO: 77928 - DNA, 29 bp, Artificial Sequence
  Description of Artificial Sequence: Synthetic oligonucleotide
tcatgggtatcgttgctggcctggttgtc

SEQ ID NO: 77929 - DNA, 28 bp, Artificial Sequence
  Description of Artificial Sequence: Synthetic oligonucleotide
catgggtatcgttgctggcctggttgtc

SEQ ID NO: 77930 - DNA, 28 bp, Artificial Sequence
  Description of Artificial Sequence: Synthetic oligonucleotide
atgggtatcgttgctggcctggttgtcc

SEQ ID NO: 77931 - DNA, 27 bp, Artificial Sequence
  Description of Artificial Sequence: Synthetic oligonucleotide
tgggtatcgttgctggcctggttgtcc

SEQ ID NO: 77932 - DNA, 27 bp, Artificial Sequence
  Description of Artificial Sequence: Synthetic oligonucleotide
gggtatcgttgctggcctggttgtcct

SEQ ID NO: 77933 - DNA, 28 bp, Artificial Sequence
  Description of Artificial Sequence: Synthetic oligonucleotide
ggtatcgttgctggcctggttgtccttg

SEQ ID NO: 77934 - DNA, 28 bp, Artificial Sequence
  Description of Artificial Sequence: Synthetic oligonucleotide
gtatcgttgctggcctggttgtccttgc

SEQ ID NO: 77935 - DNA, 29 bp, Artificial Sequence
  Description of Artificial Sequence: Synthetic oligonucleotide
tatcgttgctggcctggttgtccttgcag

SEQ ID NO: 77936 - DNA, 28 bp, Artificial Sequence
  Description of Artificial Sequence: Synthetic oligonucleotide
atcgttgctggcctggttgtccttgcag

SEQ ID NO: 77937 - DNA, 27 bp, Artificial Sequence
  Description of Artificial Sequence: Synthetic oligonucleotide
tcgttgctggcctggttgtccttgcag

SEQ ID NO: 77938 - DNA, 26 bp, Artificial Sequence
  Description of Artificial Sequence: Synthetic oligonucleotide
cgttgctggcctggttgtccttgcag

SEQ ID NO: 77939 - DNA, 27 bp, Artificial Sequence
  Description of Artificial Sequence: Synthetic oligonucleotide
gttgctggcctggttgtccttgcagct

SEQ ID NO: 77940 - DNA, 27 bp, Artificial Sequence
  Description of Artificial Sequence: Synthetic oligonucleotide
ttgctggcctggttgtccttgcagctg

SEQ ID NO: 77941 - DNA, 27 bp, Artificial Sequence
  Description of Artificial Sequence: Synthetic oligonucleotide
tgctggcctggttgtccttgcagctgt

SEQ ID NO: 77942 - DNA, 27 bp, Artificial Sequence
  Description of Artificial Sequence: Synthetic oligonucleotide
gctggcctggttgtccttgcagctgta

SEQ ID NO: 77943 - DNA, 27 bp, Artificial Sequence
  Description of Artificial Sequence: Synthetic oligonucleotide
ctggcctggttgtccttgcagctgtag

SEQ ID NO: 77944 - DNA, 28 bp, Artificial Sequence
  Description of Artificial Sequence: Synthetic oligonucleotide
tggcctggttgtccttgcagctgtagtc

SEQ ID NO: 77945 - DNA, 27 bp, Artificial Sequence
  Description of Artificial Sequence: Synthetic oligonucleotide
ggcctggttgtccttgcagctgtagtc

SEQ ID NO: 77946 - DNA, 28 bp, Artificial Sequence
  Description of Artificial Sequence: Synthetic oligonucleotide
gcctggttgtccttgcagctgtagtcac

SEQ ID NO: 77947 - DNA, 29 bp, Artificial Sequence
  Description of Artificial Sequence: Synthetic oligonucleotide
cctggttgtccttgcagctgtagtcactg

SEQ ID NO: 77948 - DNA, 29 bp, Artificial Sequence
  Description of Artificial Sequence: Synthetic oligonucleotide
ctggttgtccttgcagctgtagtcactgg

SEQ ID NO: 77949 - DNA, 30 bp, Artificial Sequence
  Description of Artificial Sequence: Synthetic oligonucleotide
tggttgtccttgcagctgtagtcactggag

SEQ ID NO: 77950 - DNA, 29 bp, Artificial Sequence
  Description of Artificial Sequence: Synthetic oligonucleotide
ggttgtccttgcagctgtagtcactggag

SEQ ID NO: 77951 - DNA, 29 bp, Artificial Sequence
  Description of Artificial Sequence: Synthetic oligonucleotide
gttgtccttgcagctgtagtcactggagc

SEQ ID NO: 77952 - DNA, 30 bp, Artificial Sequence
  Description of Artificial Sequence: Synthetic oligonucleotide
ttgtccttgcagctgtagtcactggagctg

SEQ ID NO: 77953 - DNA, 29 bp, Artificial Sequence
  Description of Artificial Sequence: Synthetic oligonucleotide
tgtccttgcagctgtagtcactggagctg

SEQ ID NO: 77954 - DNA, 28 bp, Artificial Sequence
  Description of Artificial Sequence: Synthetic oligonucleotide
gtccttgcagctgtagtcactggagctg

SEQ ID NO: 77955 - DNA, 28 bp, Artificial Sequence
  Description of Artificial Sequence: Synthetic oligonucleotide
tccttgcagctgtagtcactggagctgc

SEQ ID NO: 77956 - DNA, 27 bp, Artificial Sequence
  Description of Artificial Sequence: Synthetic oligonucleotide
ccttgcagctgtagtcactggagctgc

SEQ ID NO: 77957 - DNA, 27 bp, Artificial Sequence
  Description of Artificial Sequence: Synthetic oligonucleotide
cttgcagctgtagtcactggagctgcg

SEQ ID NO: 77958 - DNA, 27 bp, Artificial Sequence
  Description of Artificial Sequence: Synthetic oligonucleotide
ttgcagctgtagtcactggagctgcgg

SEQ ID NO: 77959 - DNA, 27 bp, Artificial Sequence
  Description of Artificial Sequence: Synthetic oligonucleotide
tgcagctgtagtcactggagctgcggt

SEQ ID NO: 77960 - DNA, 26 bp, Artificial Sequence
  Description of Artificial Sequence: Synthetic oligonucleotide
gcagctgtagtcactggagctgcggt

SEQ ID NO: 77961 - DNA, 26 bp, Artificial Sequence
  Description of Artificial Sequence: Synthetic oligonucleotide
cagctgtagtcactggagctgcggtc

SEQ ID NO: 77962 - DNA, 26 bp, Artificial Sequence
  Description of Artificial Sequence: Synthetic oligonucleotide
agctgtagtcactggagctgcggtcg

SEQ ID NO: 77963 - DNA, 25 bp, Artificial Sequence
  Description of Artificial Sequence: Synthetic oligonucleotide
gctgtagtcactggagctgcggtcg

SEQ ID NO: 77964 - DNA, 26 bp, Artificial Sequence
  Description of Artificial Sequence: Synthetic oligonucleotide
ctgtagtcactggagctgcggtcgct

SEQ ID NO: 77965 - DNA, 26 bp, Artificial Sequence
  Description of Artificial Sequence: Synthetic oligonucleotide
tgtagtcactggagctgcggtcgctg

SEQ ID NO: 77966 - DNA, 25 bp, Artificial Sequence
  Description of Artificial Sequence: Synthetic oligonucleotide
gtagtcactggagctgcggtcgctg

SEQ ID NO: 77967 - DNA, 26 bp, Artificial Sequence
  Description of Artificial Sequence: Synthetic oligonucleotide
tagtcactggagctgcggtcgctgct

SEQ ID NO: 77968 - DNA, 25 bp, Artificial Sequence
  Description of Artificial Sequence: Synthetic oligonucleotide
agtcactggagctgcggtcgctgct

SEQ ID NO: 77969 - DNA, 24 bp, Artificial Sequence
  Description of Artificial Sequence: Synthetic oligonucleotide
gtcactggagctgcggtcgctgct

SEQ ID NO: 77970 - DNA, 25 bp, Artificial Sequence
  Description of Artificial Sequence: Synthetic oligonucleotide
tcactggagctgcggtcgctgctgt

SEQ ID NO: 77971 - DNA, 24 bp, Artificial Sequence
  Description of Artificial Sequence: Synthetic oligonucleotide
cactggagctgcggtcgctgctgt

SEQ ID NO: 77972 - DNA, 24 bp, Artificial Sequence
  Description of Artificial Sequence: Synthetic oligonucleotide
actggagctgcggtcgctgctgtg

SEQ ID NO: 77973 - DNA, 23 bp, Artificial Sequence
  Description of Artificial Sequence: Synthetic oligonucleotide
ctggagctgcggtcgctgctgtg

SEQ ID NO: 77974 - DNA, 24 bp, Artificial Sequence
  Description of Artificial Sequence: Synthetic oligonucleotide
tggagctgcggtcgctgctgtgct

SEQ ID NO: 77975 - DNA, 23 bp, Artificial Sequence
  Description of Artificial Sequence: Synthetic oligonucleotide
ggagctgcggtcgctgctgtgct

SEQ ID NO: 77976 - DNA, 24 bp, Artificial Sequence
  Description of Artificial Sequence: Synthetic oligonucleotide
gagctgcggtcgctgctgtgctgt

SEQ ID NO: 77977 - DNA, 24 bp, Artificial Sequence
  Description of Artificial Sequence: Synthetic oligonucleotide
agctgcggtcgctgctgtgctgtg

SEQ ID NO: 77978 - DNA, 23 bp, Artificial Sequence
  Description of Artificial Sequence: Synthetic oligonucleotide
gctgcggtcgctgctgtgctgtg

SEQ ID NO: 77979 - DNA, 24 bp, Artificial Sequence
  Description of Artificial Sequence: Synthetic oligonucleotide
ctgcggtcgctgctgtgctgtgga

SEQ ID NO: 77980 - DNA, 27 bp, Artificial Sequence
  Description of Artificial Sequence: Synthetic oligonucleotide
tgcggtcgctgctgtgctgtggagaaa

SEQ ID NO: 77981 - DNA, 26 bp, Artificial Sequence
  Description of Artificial Sequence: Synthetic oligonucleotide
gcggtcgctgctgtgctgtggagaaa

SEQ ID NO: 77982 - DNA, 27 bp, Artificial Sequence
  Description of Artificial Sequence: Synthetic oligonucleotide
cggtcgctgctgtgctgtggagaaaga

SEQ ID NO: 77983 - DNA, 28 bp, Artificial Sequence
  Description of Artificial Sequence: Synthetic oligonucleotide
ggtcgctgctgtgctgtggagaaagaag

SEQ ID NO: 77984 - DNA, 29 bp, Artificial Sequence
  Description of Artificial Sequence: Synthetic oligonucleotide
gtcgctgctgtgctgtggagaaagaagag

SEQ ID NO: 77985 - DNA, 29 bp, Artificial Sequence
  Description of Artificial Sequence: Synthetic oligonucleotide
tcgctgctgtgctgtggagaaagaagagc

SEQ ID NO: 77986 - DNA, 28 bp, Artificial Sequence
  Description of Artificial Sequence: Synthetic oligonucleotide
cgctgctgtgctgtggagaaagaagagc

SEQ ID NO: 77987 - DNA, 29 bp, Artificial Sequence
  Description of Artificial Sequence: Synthetic oligonucleotide
gctgctgtgctgtggagaaagaagagctc

SEQ ID NO: 77988 - DNA, 30 bp, Artificial Sequence
  Description of Artificial Sequence: Synthetic oligonucleotide
ctgctgtgctgtggagaaagaagagctcag

SEQ ID NO: 77989 - DNA, 33 bp, Artificial Sequence
  Description of Artificial Sequence: Synthetic oligonucleotide
tgctgtgctgtggagaaagaagagctcagattg

SEQ ID NO: 77990 - DNA, 32 bp, Artificial Sequence
  Description of Artificial Sequence: Synthetic oligonucleotide
gctgtgctgtggagaaagaagagctcagattg

SEQ ID NO: 77991 - DNA, 26 bp, Artificial Sequence
  Description of Artificial Sequence: Synthetic oligonucleotide
atggtggtcatggcaccccgaaccct

SEQ ID NO: 77992 - DNA, 25 bp, Artificial Sequence
  Description of Artificial Sequence: Synthetic oligonucleotide
tggtggtcatggcaccccgaaccct

SEQ ID NO: 77993 - DNA, 24 bp, Artificial Sequence
  Description of Artificial Sequence: Synthetic oligonucleotide
ggtggtcatggcaccccgaaccct

SEQ ID NO: 77994 - DNA, 26 bp, Artificial Sequence
  Description of Artificial Sequence: Synthetic oligonucleotide
gtggtcatggcaccccgaaccctctt

SEQ ID NO: 77995 - DNA, 26 bp, Artificial Sequence
  Description of Artificial Sequence: Synthetic oligonucleotide
tggtcatggcaccccgaaccctcttc

SEQ ID NO: 77996 - DNA, 25 bp, Artificial Sequence
  Description of Artificial Sequence: Synthetic oligonucleotide
ggtcatggcaccccgaaccctcttc

SEQ ID NO: 77997 - DNA, 26 bp, Artificial Sequence
  Description of Artificial Sequence: Synthetic oligonucleotide
gtcatggcaccccgaaccctcttcct

SEQ ID NO: 77998 - DNA, 26 bp, Artificial Sequence
  Description of Artificial Sequence: Synthetic oligonucleotide
tcatggcaccccgaaccctcttcctg

SEQ ID NO: 77999 - DNA, 25 bp, Artificial Sequence
  Description of Artificial Sequence: Synthetic oligonucleotide
catggcaccccgaaccctcttcctg

SEQ ID NO: 78000 - DNA, 27 bp, Artificial Sequence
  Description of Artificial Sequence: Synthetic oligonucleotide
atggcaccccgaaccctcttcctgcta

SEQ ID NO: 78001 - DNA, 26 bp, Artificial Sequence
  Description of Artificial Sequence: Synthetic oligonucleotide
tggcaccccgaaccctcttcctgcta

SEQ ID NO: 78002 - DNA, 25 bp, Artificial Sequence
  Description of Artificial Sequence: Synthetic oligonucleotide
ggcaccccgaaccctcttcctgcta

SEQ ID NO: 78003 - DNA, 26 bp, Artificial Sequence
  Description of Artificial Sequence: Synthetic oligonucleotide
gcaccccgaaccctcttcctgctact

SEQ ID NO: 78004 - DNA, 27 bp, Artificial Sequence
  Description of Artificial Sequence: Synthetic oligonucleotide
caccccgaaccctcttcctgctactct

SEQ ID NO: 78005 - DNA, 27 bp, Artificial Sequence
  Description of Artificial Sequence: Synthetic oligonucleotide
accccgaaccctcttcctgctactctc

SEQ ID NO: 78006 - DNA, 26 bp, Artificial Sequence
  Description of Artificial Sequence: Synthetic oligonucleotide
ccccgaaccctcttcctgctactctc

SEQ ID NO: 78007 - DNA, 26 bp, Artificial Sequence
  Description of Artificial Sequence: Synthetic oligonucleotide
cccgaaccctcttcctgctactctcg

SEQ ID NO: 78008 - DNA, 26 bp, Artificial Sequence
  Description of Artificial Sequence: Synthetic oligonucleotide
ccgaaccctcttcctgctactctcgg

SEQ ID NO: 78009 - DNA, 26 bp, Artificial Sequence
  Description of Artificial Sequence: Synthetic oligonucleotide
cgaaccctcttcctgctactctcggg

SEQ ID NO: 78010 - DNA, 26 bp, Artificial Sequence
  Description of Artificial Sequence: Synthetic oligonucleotide
gaaccctcttcctgctactctcgggg

SEQ ID NO: 78011 - DNA, 26 bp, Artificial Sequence
  Description of Artificial Sequence: Synthetic oligonucleotide
aaccctcttcctgctactctcggggg

SEQ ID NO: 78012 - DNA, 25 bp, Artificial Sequence
  Description of Artificial Sequence: Synthetic oligonucleotide
accctcttcctgctactctcggggg

SEQ ID NO: 78013 - DNA, 24 bp, Artificial Sequence
  Description of Artificial Sequence: Synthetic oligonucleotide
ccctcttcctgctactctcggggg

SEQ ID NO: 78014 - DNA, 24 bp, Artificial Sequence
  Description of Artificial Sequence: Synthetic oligonucleotide
cctcttcctgctactctcgggggc

SEQ ID NO: 78015 - DNA, 24 bp, Artificial Sequence
  Description of Artificial Sequence: Synthetic oligonucleotide
ctcttcctgctactctcgggggcc

SEQ ID NO: 78016 - DNA, 25 bp, Artificial Sequence
  Description of Artificial Sequence: Synthetic oligonucleotide
tcttcctgctactctcgggggccct

SEQ ID NO: 78017 - DNA, 24 bp, Artificial Sequence
  Description of Artificial Sequence: Synthetic oligonucleotide
cttcctgctactctcgggggccct

SEQ ID NO: 78018 - DNA, 25 bp, Artificial Sequence
  Description of Artificial Sequence: Synthetic oligonucleotide
ttcctgctactctcgggggccctga

SEQ ID NO: 78019 - DNA, 24 bp, Artificial Sequence
  Description of Artificial Sequence: Synthetic oligonucleotide
tcctgctactctcgggggccctga

SEQ ID NO: 78020 - DNA, 23 bp, Artificial Sequence
  Description of Artificial Sequence: Synthetic oligonucleotide
cctgctactctcgggggccctga

SEQ ID NO: 78021 - DNA, 23 bp, Artificial Sequence
  Description of Artificial Sequence: Synthetic oligonucleotide
ctgctactctcgggggccctgac

SEQ ID NO: 78022 - DNA, 23 bp, Artificial Sequence
  Description of Artificial Sequence: Synthetic oligonucleotide
tgctactctcgggggccctgacc

SEQ ID NO: 78023 - DNA, 22 bp, Artificial Sequence
  Description of Artificial Sequence: Synthetic oligonucleotide
gctactctcgggggccctgacc

SEQ ID NO: 78024 - DNA, 23 bp, Artificial Sequence
  Description of Artificial Sequence: Synthetic oligonucleotide
ctactctcgggggccctgaccct

SEQ ID NO: 78025 - DNA, 24 bp, Artificial Sequence
  Description of Artificial Sequence: Synthetic oligonucleotide
tactctcgggggccctgaccctga

SEQ ID NO: 78026 - DNA, 23 bp, Artificial Sequence
  Description of Artificial Sequence: Synthetic oligonucleotide
actctcgggggccctgaccctga

SEQ ID NO: 78027 - DNA, 27 bp, Artificial Sequence
  Description of Artificial Sequence: Synthetic oligonucleotide
gagcaggaggggccagagtattgggaa

SEQ ID NO: 78028 - DNA, 27 bp, Artificial Sequence
  Description of Artificial Sequence: Synthetic oligonucleotide
agcaggaggggccagagtattgggaag

SEQ ID NO: 78029 - DNA, 27 bp, Artificial Sequence
  Description of Artificial Sequence: Synthetic oligonucleotide
gcaggaggggccagagtattgggaaga

SEQ ID NO: 78030 - DNA, 27 bp, Artificial Sequence
  Description of Artificial Sequence: Synthetic oligonucleotide
caggaggggccagagtattgggaagag

SEQ ID NO: 78031 - DNA, 27 bp, Artificial Sequence
  Description of Artificial Sequence: Synthetic oligonucleotide
aggaggggccagagtattgggaagagg

SEQ ID NO: 78032 - DNA, 27 bp, Artificial Sequence
  Description of Artificial Sequence: Synthetic oligonucleotide
ggaggggccagagtattgggaagagga

SEQ ID NO: 78033 - DNA, 27 bp, Artificial Sequence
  Description of Artificial Sequence: Synthetic oligonucleotide
gaggggccagagtattgggaagaggag

SEQ ID NO: 78034 - DNA, 28 bp, Artificial Sequence
  Description of Artificial Sequence: Synthetic oligonucleotide
aggggccagagtattgggaagaggagac

SEQ ID NO: 78035 - DNA, 27 bp, Artificial Sequence
  Description of Artificial Sequence: Synthetic oligonucleotide
ggggccagagtattgggaagaggagac

SEQ ID NO: 78036 - DNA, 28 bp, Artificial Sequence
  Description of Artificial Sequence: Synthetic oligonucleotide
gggccagagtattgggaagaggagacac

SEQ ID NO: 78037 - DNA, 28 bp, Artificial Sequence
  Description of Artificial Sequence: Synthetic oligonucleotide
ggccagagtattgggaagaggagacacg

SEQ ID NO: 78038 - DNA, 28 bp, Artificial Sequence
  Description of Artificial Sequence: Synthetic oligonucleotide
gccagagtattgggaagaggagacacgg

SEQ ID NO: 78039 - DNA, 30 bp, Artificial Sequence
  Description of Artificial Sequence: Synthetic oligonucleotide
ccagagtattgggaagaggagacacggaac

SEQ ID NO: 78040 - DNA, 31 bp, Artificial Sequence
  Description of Artificial Sequence: Synthetic oligonucleotide
cagagtattgggaagaggagacacggaacac

SEQ ID NO: 78041 - DNA, 31 bp, Artificial Sequence
  Description of Artificial Sequence: Synthetic oligonucleotide
agagtattgggaagaggagacacggaacacc

SEQ ID NO: 78042 - DNA, 32 bp, Artificial Sequence
  Description of Artificial Sequence: Synthetic oligonucleotide
tactacaaccagagcgaggccagttctcatac

SEQ ID NO: 78043 - DNA, 31 bp, Artificial Sequence
  Description of Artificial Sequence: Synthetic oligonucleotide
actacaaccagagcgaggccagttctcatac

SEQ ID NO: 78044 - DNA, 30 bp, Artificial Sequence
  Description of Artificial Sequence: Synthetic oligonucleotide
ctacaaccagagcgaggccagttctcatac

SEQ ID NO: 78045 - DNA, 30 bp, Artificial Sequence
  Description of Artificial Sequence: Synthetic oligonucleotide
tacaaccagagcgaggccagttctcatacc

SEQ ID NO: 78046 - DNA, 29 bp, Artificial Sequence
  Description of Artificial Sequence: Synthetic oligonucleotide
acaaccagagcgaggccagttctcatacc

SEQ ID NO: 78047 - DNA, 28 bp, Artificial Sequence
  Description of Artificial Sequence: Synthetic oligonucleotide
caaccagagcgaggccagttctcatacc

SEQ ID NO: 78048 - DNA, 28 bp, Artificial Sequence
  Description of Artificial Sequence: Synthetic oligonucleotide
aaccagagcgaggccagttctcataccc

SEQ ID NO: 78049 - DNA, 27 bp, Artificial Sequence
  Description of Artificial Sequence: Synthetic oligonucleotide
accagagcgaggccagttctcataccc

SEQ ID NO: 78050 - DNA, 27 bp, Artificial Sequence
  Description of Artificial Sequence: Synthetic oligonucleotide
ccagagcgaggccagttctcataccct

SEQ ID NO: 78051 - DNA, 27 bp, Artificial Sequence
  Description of Artificial Sequence: Synthetic oligonucleotide
cagagcgaggccagttctcataccctc

SEQ ID NO: 78052 - DNA, 27 bp, Artificial Sequence
  Description of Artificial Sequence: Synthetic oligonucleotide
agagcgaggccagttctcataccctcc

SEQ ID NO: 78053 - DNA, 27 bp, Artificial Sequence
  Description of Artificial Sequence: Synthetic oligonucleotide
gagcgaggccagttctcataccctcca

SEQ ID NO: 78054 - DNA, 27 bp, Artificial Sequence
  Description of Artificial Sequence: Synthetic oligonucleotide
agcgaggccagttctcataccctccag

SEQ ID NO: 78055 - DNA, 27 bp, Artificial Sequence
  Description of Artificial Sequence: Synthetic oligonucleotide
gcgaggccagttctcataccctccagt

SEQ ID NO: 78056 - DNA, 27 bp, Artificial Sequence
  Description of Artificial Sequence: Synthetic oligonucleotide
cgaggccagttctcataccctccagtg

SEQ ID NO: 78057 - DNA, 27 bp, Artificial Sequence
  Description of Artificial Sequence: Synthetic oligonucleotide
gaggccagttctcataccctccagtgg

SEQ ID NO: 78058 - DNA, 29 bp, Artificial Sequence
  Description of Artificial Sequence: Synthetic oligonucleotide
aggccagttctcataccctccagtggatg

SEQ ID NO: 78059 - DNA, 28 bp, Artificial Sequence
  Description of Artificial Sequence: Synthetic oligonucleotide
ggccagttctcataccctccagtggatg

SEQ ID NO: 78060 - DNA, 31 bp, Artificial Sequence
  Description of Artificial Sequence: Synthetic oligonucleotide
gccagttctcataccctccagtggatgattg

SEQ ID NO: 78061 - DNA, 31 bp, Artificial Sequence
  Description of Artificial Sequence: Synthetic oligonucleotide
ccagttctcataccctccagtggatgattgg

SEQ ID NO: 78062 - DNA, 31 bp, Artificial Sequence
  Description of Artificial Sequence: Synthetic oligonucleotide
cagttctcataccctccagtggatgattggc

SEQ ID NO: 78063 - DNA, 32 bp, Artificial Sequence
  Description of Artificial Sequence: Synthetic oligonucleotide
agttctcataccctccagtggatgattggctg

SEQ ID NO: 78064 - DNA, 31 bp, Artificial Sequence
  Description of Artificial Sequence: Synthetic oligonucleotide
gttctcataccctccagtggatgattggctg

SEQ ID NO: 78065 - DNA, 31 bp, Artificial Sequence
  Description of Artificial Sequence: Synthetic oligonucleotide
ttctcataccctccagtggatgattggctgc

SEQ ID NO: 78066 - DNA, 30 bp, Artificial Sequence
  Description of Artificial Sequence: Synthetic oligonucleotide
tctcataccctccagtggatgattggctgc

SEQ ID NO: 78067 - DNA, 29 bp, Artificial Sequence
  Description of Artificial Sequence: Synthetic oligonucleotide
ctcataccctccagtggatgattggctgc

SEQ ID NO: 78068 - DNA, 29 bp, Artificial Sequence
  Description of Artificial Sequence: Synthetic oligonucleotide
tcataccctccagtggatgattggctgcg

SEQ ID NO: 78069 - DNA, 28 bp, Artificial Sequence
  Description of Artificial Sequence: Synthetic oligonucleotide
cataccctccagtggatgattggctgcg

SEQ ID NO: 78070 - DNA, 29 bp, Artificial Sequence
  Description of Artificial Sequence: Synthetic oligonucleotide
ataccctccagtggatgattggctgcgac

SEQ ID NO: 78071 - DNA, 28 bp, Artificial Sequence
  Description of Artificial Sequence: Synthetic oligonucleotide
taccctccagtggatgattggctgcgac

SEQ ID NO: 78072 - DNA, 29 bp, Artificial Sequence
  Description of Artificial Sequence: Synthetic oligonucleotide
catccccatcatgggtatcgttgctggtc

SEQ ID NO: 78073 - DNA, 30 bp, Artificial Sequence
  Description of Artificial Sequence: Synthetic oligonucleotide
atccccatcatgggtatcgttgctggtctg

SEQ ID NO: 78074 - DNA, 29 bp, Artificial Sequence
  Description of Artificial Sequence: Synthetic oligonucleotide
tccccatcatgggtatcgttgctggtctg

SEQ ID NO: 78075 - DNA, 28 bp, Artificial Sequence
  Description of Artificial Sequence: Synthetic oligonucleotide
ccccatcatgggtatcgttgctggtctg

SEQ ID NO: 78076 - DNA, 28 bp, Artificial Sequence
  Description of Artificial Sequence: Synthetic oligonucleotide
cccatcatgggtatcgttgctggtctgg

SEQ ID NO: 78077 - DNA, 30 bp, Artificial Sequence
  Description of Artificial Sequence: Synthetic oligonucleotide
ccatcatgggtatcgttgctggtctggttg

SEQ ID NO: 78078 - DNA, 31 bp, Artificial Sequence
  Description of Artificial Sequence: Synthetic oligonucleotide
catcatgggtatcgttgctggtctggttgtc

SEQ ID NO: 78079 - DNA, 31 bp, Artificial Sequence
  Description of Artificial Sequence: Synthetic oligonucleotide
atcatgggtatcgttgctggtctggttgtcc

SEQ ID NO: 78080 - DNA, 30 bp, Artificial Sequence
  Description of Artificial Sequence: Synthetic oligonucleotide
tcatgggtatcgttgctggtctggttgtcc

SEQ ID NO: 78081 - DNA, 29 bp, Artificial Sequence
  Description of Artificial Sequence: Synthetic oligonucleotide
catgggtatcgttgctggtctggttgtcc

SEQ ID NO: 78082 - DNA, 31 bp, Artificial Sequence
  Description of Artificial Sequence: Synthetic oligonucleotide
atgggtatcgttgctggtctggttgtccttg

SEQ ID NO: 78083 - DNA, 30 bp, Artificial Sequence
  Description of Artificial Sequence: Synthetic oligonucleotide
tgggtatcgttgctggtctggttgtccttg

SEQ ID NO: 78084 - DNA, 29 bp, Artificial Sequence
  Description of Artificial Sequence: Synthetic oligonucleotide
gggtatcgttgctggtctggttgtccttg

SEQ ID NO: 78085 - DNA, 29 bp, Artificial Sequence
  Description of Artificial Sequence: Synthetic oligonucleotide
ggtatcgttgctggtctggttgtccttgc

SEQ ID NO: 78086 - DNA, 30 bp, Artificial Sequence
  Description of Artificial Sequence: Synthetic oligonucleotide
gtatcgttgctggtctggttgtccttgcag

SEQ ID NO: 78087 - DNA, 30 bp, Artificial Sequence
  Description of Artificial Sequence: Synthetic oligonucleotide
tatcgttgctggtctggttgtccttgcagc

SEQ ID NO: 78088 - DNA, 29 bp, Artificial Sequence
  Description of Artificial Sequence: Synthetic oligonucleotide
atcgttgctggtctggttgtccttgcagc

SEQ ID NO: 78089 - DNA, 28 bp, Artificial Sequence
  Description of Artificial Sequence: Synthetic oligonucleotide
tcgttgctggtctggttgtccttgcagc

SEQ ID NO: 78090 - DNA, 27 bp, Artificial Sequence
  Description of Artificial Sequence: Synthetic oligonucleotide
cgttgctggtctggttgtccttgcagc

SEQ ID NO: 78091 - DNA, 28 bp, Artificial Sequence
  Description of Artificial Sequence: Synthetic oligonucleotide
gttgctggtctggttgtccttgcagctg

SEQ ID NO: 78092 - DNA, 30 bp, Artificial Sequence
  Description of Artificial Sequence: Synthetic oligonucleotide
ttgctggtctggttgtccttgcagctgtag

SEQ ID NO: 78093 - DNA, 29 bp, Artificial Sequence
  Description of Artificial Sequence: Synthetic oligonucleotide
tgctggtctggttgtccttgcagctgtag

SEQ ID NO: 78094 - DNA, 28 bp, Artificial Sequence
  Description of Artificial Sequence: Synthetic oligonucleotide
gctggtctggttgtccttgcagctgtag

SEQ ID NO: 78095 - DNA, 29 bp, Artificial Sequence
  Description of Artificial Sequence: Synthetic oligonucleotide
ctggtctggttgtccttgcagctgtagtc

SEQ ID NO: 78096 - DNA, 30 bp, Artificial Sequence
  Description of Artificial Sequence: Synthetic oligonucleotide
tggtctggttgtccttgcagctgtagtcac

SEQ ID NO: 78097 - DNA, 29 bp, Artificial Sequence
  Description of Artificial Sequence: Synthetic oligonucleotide
ggtctggttgtccttgcagctgtagtcac

SEQ ID NO: 78098 - DNA, 30 bp, Artificial Sequence
  Description of Artificial Sequence: Synthetic oligonucleotide
gtctggttgtccttgcagctgtagtcactg

SEQ ID NO: 78099 - DNA, 30 bp, Artificial Sequence
  Description of Artificial Sequence: Synthetic oligonucleotide
tctggttgtccttgcagctgtagtcactgg

SEQ ID NO: 78100 - DNA, 24 bp, Artificial Sequence
  Description of Artificial Sequence: Synthetic oligonucleotide
tgcggtcgctgctgtgctgtggag

SEQ ID NO: 78101 - DNA, 23 bp, Artificial Sequence
  Description of Artificial Sequence: Synthetic oligonucleotide
gcggtcgctgctgtgctgtggag

SEQ ID NO: 78102 - DNA, 25 bp, Artificial Sequence
  Description of Artificial Sequence: Synthetic oligonucleotide
cggtcgctgctgtgctgtggaggaa

SEQ ID NO: 78103 - DNA, 27 bp, Artificial Sequence
  Description of Artificial Sequence: Synthetic oligonucleotide
ggtcgctgctgtgctgtggaggaagaa

SEQ ID NO: 78104 - DNA, 27 bp, Artificial Sequence
  Description of Artificial Sequence: Synthetic oligonucleotide
gtcgctgctgtgctgtggaggaagaag

SEQ ID NO: 78105 - DNA, 28 bp, Artificial Sequence
  Description of Artificial Sequence: Synthetic oligonucleotide
tcgctgctgtgctgtggaggaagaagag

SEQ ID NO: 78106 - DNA, 27 bp, Artificial Sequence
  Description of Artificial Sequence: Synthetic oligonucleotide
cgctgctgtgctgtggaggaagaagag

SEQ ID NO: 78107 - DNA, 27 bp, Artificial Sequence
  Description of Artificial Sequence: Synthetic oligonucleotide
gctgctgtgctgtggaggaagaagagc

SEQ ID NO: 78108 - DNA, 28 bp, Artificial Sequence
  Description of Artificial Sequence: Synthetic oligonucleotide
ctgctgtgctgtggaggaagaagagctc

SEQ ID NO: 78109 - DNA, 29 bp, Artificial Sequence
  Description of Artificial Sequence: Synthetic oligonucleotide
tgctgtgctgtggaggaagaagagctcag

SEQ ID NO: 78110 - DNA, 28 bp, Artificial Sequence
  Description of Artificial Sequence: Synthetic oligonucleotide
gctgtgctgtggaggaagaagagctcag

SEQ ID NO: 78111 - DNA, 31 bp, Artificial Sequence
  Description of Artificial Sequence: Synthetic oligonucleotide
ctgtgctgtggaggaagaagagctcagattg

SEQ ID NO: 78112 - DNA, 22 bp, Artificial Sequence
  Description of Artificial Sequence: Synthetic oligonucleotide
ctgcgacctggggtccgacggt

SEQ ID NO: 78113 - DNA, 22 bp, Artificial Sequence
  Description of Artificial Sequence: Synthetic oligonucleotide
tgcgacctggggtccgacggtc

SEQ ID NO: 78114 - DNA, 21 bp, Artificial Sequence
  Description of Artificial Sequence: Synthetic oligonucleotide
gcgacctggggtccgacggtc

SEQ ID NO: 78115 - DNA, 21 bp, Artificial Sequence
  Description of Artificial Sequence: Synthetic oligonucleotide
cgacctggggtccgacggtcg

SEQ ID NO: 78116 - DNA, 21 bp, Artificial Sequence
  Description of Artificial Sequence: Synthetic oligonucleotide
gacctggggtccgacggtcgc

SEQ ID NO: 78117 - DNA, 22 bp, Artificial Sequence
  Description of Artificial Sequence: Synthetic oligonucleotide
acctggggtccgacggtcgcct

SEQ ID NO: 78118 - DNA, 21 bp, Artificial Sequence
  Description of Artificial Sequence: Synthetic oligonucleotide
cctggggtccgacggtcgcct

SEQ ID NO: 78119 - DNA, 21 bp, Artificial Sequence
  Description of Artificial Sequence: Synthetic oligonucleotide
ctggggtccgacggtcgcctc

SEQ ID NO: 78120 - DNA, 22 bp, Artificial Sequence
  Description of Artificial Sequence: Synthetic oligonucleotide
tggggtccgacggtcgcctcct

SEQ ID NO: 78121 - DNA, 21 bp, Artificial Sequence
  Description of Artificial Sequence: Synthetic oligonucleotide
ggggtccgacggtcgcctcct

SEQ ID NO: 78122 - DNA, 21 bp, Artificial Sequence
  Description of Artificial Sequence: Synthetic oligonucleotide
gggtccgacggtcgcctcctc

SEQ ID NO: 78123 - DNA, 21 bp, Artificial Sequence
  Description of Artificial Sequence: Synthetic oligonucleotide
ggtccgacggtcgcctcctcc

SEQ ID NO: 78124 - DNA, 21 bp, Artificial Sequence
  Description of Artificial Sequence: Synthetic oligonucleotide
gtccgacggtcgcctcctccg

SEQ ID NO: 78125 - DNA, 21 bp, Artificial Sequence
  Description of Artificial Sequence: Synthetic oligonucleotide
tccgacggtcgcctcctccgc

SEQ ID NO: 78126 - DNA, 20 bp, Artificial Sequence
  Description of Artificial Sequence: Synthetic oligonucleotide
ccgacggtcgcctcctccgc

SEQ ID NO: 78127 - DNA, 20 bp, Artificial Sequence
  Description of Artificial Sequence: Synthetic oligonucleotide
cgacggtcgcctcctccgcg

SEQ ID NO: 78128 - DNA, 20 bp, Artificial Sequence
  Description of Artificial Sequence: Synthetic oligonucleotide
gacggtcgcctcctccgcgg

SEQ ID NO: 78129 - DNA, 23 bp, Artificial Sequence
  Description of Artificial Sequence: Synthetic oligonucleotide
acggtcgcctcctccgcgggtat

SEQ ID NO: 78130 - DNA, 22 bp, Artificial Sequence
  Description of Artificial Sequence: Synthetic oligonucleotide
cggtcgcctcctccgcgggtat

SEQ ID NO: 78131 - DNA, 24 bp, Artificial Sequence
  Description of Artificial Sequence: Synthetic oligonucleotide
ggtcgcctcctccgcgggtatgaa

SEQ ID NO: 78132 - DNA, 25 bp, Artificial Sequence
  Description of Artificial Sequence: Synthetic oligonucleotide
gtcgcctcctccgcgggtatgaaca

SEQ ID NO: 78133 - DNA, 27 bp, Artificial Sequence
  Description of Artificial Sequence: Synthetic oligonucleotide
tcgcctcctccgcgggtatgaacagta

SEQ ID NO: 78134 - DNA, 28 bp, Artificial Sequence
  Description of Artificial Sequence: Synthetic oligonucleotide
gaagaggagacacggaacaccaaggctc

SEQ ID NO: 78135 - DNA, 29 bp, Artificial Sequence
  Description of Artificial Sequence: Synthetic oligonucleotide
aagaggagacacggaacaccaaggctcac

SEQ ID NO: 78136 - DNA, 28 bp, Artificial Sequence
  Description of Artificial Sequence: Synthetic oligonucleotide
agaggagacacggaacaccaaggctcac

SEQ ID NO: 78137 - DNA, 27 bp, Artificial Sequence
  Description of Artificial Sequence: Synthetic oligonucleotide
gaggagacacggaacaccaaggctcac

SEQ ID NO: 78138 - DNA, 27 bp, Artificial Sequence
  Description of Artificial Sequence: Synthetic oligonucleotide
aggagacacggaacaccaaggctcacg

SEQ ID NO: 78139 - DNA, 26 bp, Artificial Sequence
  Description of Artificial Sequence: Synthetic oligonucleotide
ggagacacggaacaccaaggctcacg

SEQ ID NO: 78140 - DNA, 27 bp, Artificial Sequence
  Description of Artificial Sequence: Synthetic oligonucleotide
gagacacggaacaccaaggctcacgca

SEQ ID NO: 78141 - DNA, 27 bp, Artificial Sequence
  Description of Artificial Sequence: Synthetic oligonucleotide
agacacggaacaccaaggctcacgcac

SEQ ID NO: 78142 - DNA, 27 bp, Artificial Sequence
  Description of Artificial Sequence: Synthetic oligonucleotide
gacacggaacaccaaggctcacgcaca

SEQ ID NO: 78143 - DNA, 27 bp, Artificial Sequence
  Description of Artificial Sequence: Synthetic oligonucleotide
acacggaacaccaaggctcacgcacag

SEQ ID NO: 78144 - DNA, 27 bp, Artificial Sequence
  Description of Artificial Sequence: Synthetic oligonucleotide
cacggaacaccaaggctcacgcacaga

SEQ ID NO: 78145 - DNA, 27 bp, Artificial Sequence
  Description of Artificial Sequence: Synthetic oligonucleotide
acggaacaccaaggctcacgcacagac

SEQ ID NO: 78146 - DNA, 27 bp, Artificial Sequence
  Description of Artificial Sequence: Synthetic oligonucleotide
cggaacaccaaggctcacgcacagact

SEQ ID NO: 78147 - DNA, 27 bp, Artificial Sequence
  Description of Artificial Sequence: Synthetic oligonucleotide
ggaacaccaaggctcacgcacagactg

SEQ ID NO: 78148 - DNA, 28 bp, Artificial Sequence
  Description of Artificial Sequence: Synthetic oligonucleotide
gaacaccaaggctcacgcacagactgac

SEQ ID NO: 78149 - DNA, 29 bp, Artificial Sequence
  Description of Artificial Sequence: Synthetic oligonucleotide
aacaccaaggctcacgcacagactgacag

SEQ ID NO: 78150 - DNA, 28 bp, Artificial Sequence
  Description of Artificial Sequence: Synthetic oligonucleotide
acaccaaggctcacgcacagactgacag

SEQ ID NO: 78151 - DNA, 27 bp, Artificial Sequence
  Description of Artificial Sequence: Synthetic oligonucleotide
caccaaggctcacgcacagactgacag

SEQ ID NO: 78152 - DNA, 30 bp, Artificial Sequence
  Description of Artificial Sequence: Synthetic oligonucleotide
accaaggctcacgcacagactgacagaatg

SEQ ID NO: 78153 - DNA, 29 bp, Artificial Sequence
  Description of Artificial Sequence: Synthetic oligonucleotide
ccaaggctcacgcacagactgacagaatg

SEQ ID NO: 78154 - DNA, 31 bp, Artificial Sequence
  Description of Artificial Sequence: Synthetic oligonucleotide
caaggctcacgcacagactgacagaatgaac

SEQ ID NO: 78155 - DNA, 31 bp, Artificial Sequence
  Description of Artificial Sequence: Synthetic oligonucleotide
aaggctcacgcacagactgacagaatgaacc

SEQ ID NO: 78156 - DNA, 30 bp, Artificial Sequence
  Description of Artificial Sequence: Synthetic oligonucleotide
aggctcacgcacagactgacagaatgaacc

SEQ ID NO: 78157 - DNA, 29 bp, Artificial Sequence
  Description of Artificial Sequence: Synthetic oligonucleotide
ggctcacgcacagactgacagaatgaacc

SEQ ID NO: 78158 - DNA, 30 bp, Artificial Sequence
  Description of Artificial Sequence: Synthetic oligonucleotide
gctcacgcacagactgacagaatgaacctg

SEQ ID NO: 78159 - DNA, 30 bp, Artificial Sequence
  Description of Artificial Sequence: Synthetic oligonucleotide
ctcacgcacagactgacagaatgaacctgc

SEQ ID NO: 78160 - DNA, 31 bp, Artificial Sequence
  Description of Artificial Sequence: Synthetic oligonucleotide
tcacgcacagactgacagaatgaacctgcag

SEQ ID NO: 78161 - DNA, 23 bp, Artificial Sequence
  Description of Artificial Sequence: Synthetic oligonucleotide
gcgcggacccccccaagacacat

SEQ ID NO: 78162 - DNA, 24 bp, Artificial Sequence
  Description of Artificial Sequence: Synthetic oligonucleotide
cgcggacccccccaagacacatgt

SEQ ID NO: 78163 - DNA, 25 bp, Artificial Sequence
  Description of Artificial Sequence: Synthetic oligonucleotide
gcggacccccccaagacacatgtga

SEQ ID NO: 78164 - DNA, 25 bp, Artificial Sequence
  Description of Artificial Sequence: Synthetic oligonucleotide
cggacccccccaagacacatgtgac

SEQ ID NO: 78165 - DNA, 25 bp, Artificial Sequence
  Description of Artificial Sequence: Synthetic oligonucleotide
ggacccccccaagacacatgtgacc

SEQ ID NO: 78166 - DNA, 26 bp, Artificial Sequence
  Description of Artificial Sequence: Synthetic oligonucleotide
gacccccccaagacacatgtgaccca

SEQ ID NO: 78167 - DNA, 26 bp, Artificial Sequence
  Description of Artificial Sequence: Synthetic oligonucleotide
acccccccaagacacatgtgacccac

SEQ ID NO: 78168 - DNA, 25 bp, Artificial Sequence
  Description of Artificial Sequence: Synthetic oligonucleotide
cccccccaagacacatgtgacccac

SEQ ID NO: 78169 - DNA, 26 bp, Artificial Sequence
  Description of Artificial Sequence: Synthetic oligonucleotide
ccccccaagacacatgtgacccacca

SEQ ID NO: 78170 - DNA, 26 bp, Artificial Sequence
  Description of Artificial Sequence: Synthetic oligonucleotide
cccccaagacacatgtgacccaccac

SEQ ID NO: 78171 - DNA, 26 bp, Artificial Sequence
  Description of Artificial Sequence: Synthetic oligonucleotide
ccccaagacacatgtgacccaccacc

SEQ ID NO: 78172 - DNA, 27 bp, Artificial Sequence
  Description of Artificial Sequence: Synthetic oligonucleotide
cccaagacacatgtgacccaccaccct

SEQ ID NO: 78173 - DNA, 27 bp, Artificial Sequence
  Description of Artificial Sequence: Synthetic oligonucleotide
ccaagacacatgtgacccaccaccctg

SEQ ID NO: 78174 - DNA, 28 bp, Artificial Sequence
  Description of Artificial Sequence: Synthetic oligonucleotide
caagacacatgtgacccaccaccctgtc

SEQ ID NO: 78175 - DNA, 31 bp, Artificial Sequence
  Description of Artificial Sequence: Synthetic oligonucleotide
aagacacatgtgacccaccaccctgtctttg

SEQ ID NO: 78176 - DNA, 30 bp, Artificial Sequence
  Description of Artificial Sequence: Synthetic oligonucleotide
agacacatgtgacccaccaccctgtctttg

SEQ ID NO: 78177 - DNA, 29 bp, Artificial Sequence
  Description of Artificial Sequence: Synthetic oligonucleotide
gacacatgtgacccaccaccctgtctttg

SEQ ID NO: 78178 - DNA, 30 bp, Artificial Sequence
  Description of Artificial Sequence: Synthetic oligonucleotide
acacatgtgacccaccaccctgtctttgac

SEQ ID NO: 78179 - DNA, 29 bp, Artificial Sequence
  Description of Artificial Sequence: Synthetic oligonucleotide
cacatgtgacccaccaccctgtctttgac

SEQ ID NO: 78180 - DNA, 32 bp, Artificial Sequence
  Description of Artificial Sequence: Synthetic oligonucleotide
acatgtgacccaccaccctgtctttgactatg

SEQ ID NO: 78181 - DNA, 31 bp, Artificial Sequence
  Description of Artificial Sequence: Synthetic oligonucleotide
catgtgacccaccaccctgtctttgactatg

SEQ ID NO: 78182 - DNA, 32 bp, Artificial Sequence
  Description of Artificial Sequence: Synthetic oligonucleotide
atgtgacccaccaccctgtctttgactatgag

SEQ ID NO: 78183 - DNA, 31 bp, Artificial Sequence
  Description of Artificial Sequence: Synthetic oligonucleotide
tgtgacccaccaccctgtctttgactatgag

SEQ ID NO: 78184 - DNA, 24 bp, Artificial Sequence
  Description of Artificial Sequence: Synthetic oligonucleotide
ccggagcccctcatgctgagatgg

SEQ ID NO: 78185 - DNA, 29 bp, Artificial Sequence
  Description of Artificial Sequence: Synthetic oligonucleotide
ggctcagatctccaagcgcaagtgtgaag

SEQ ID NO: 78186 - DNA, 29 bp, Artificial Sequence
  Description of Artificial Sequence: Synthetic oligonucleotide
gctcagatctccaagcgcaagtgtgaagc

SEQ ID NO: 78187 - DNA, 29 bp, Artificial Sequence
  Description of Artificial Sequence: Synthetic oligonucleotide
ctcagatctccaagcgcaagtgtgaagcg

SEQ ID NO: 78188 - DNA, 29 bp, Artificial Sequence
  Description of Artificial Sequence: Synthetic oligonucleotide
tcagatctccaagcgcaagtgtgaagcgg

SEQ ID NO: 78189 - DNA, 28 bp, Artificial Sequence
  Description of Artificial Sequence: Synthetic oligonucleotide
cagatctccaagcgcaagtgtgaagcgg

SEQ ID NO: 78190 - DNA, 28 bp, Artificial Sequence
  Description of Artificial Sequence: Synthetic oligonucleotide
agatctccaagcgcaagtgtgaagcggc

SEQ ID NO: 78191 - DNA, 27 bp, Artificial Sequence
  Description of Artificial Sequence: Synthetic oligonucleotide
gatctccaagcgcaagtgtgaagcggc

SEQ ID NO: 78192 - DNA, 27 bp, Artificial Sequence
  Description of Artificial Sequence: Synthetic oligonucleotide
atctccaagcgcaagtgtgaagcggcc

SEQ ID NO: 78193 - DNA, 27 bp, Artificial Sequence
  Description of Artificial Sequence: Synthetic oligonucleotide
tctccaagcgcaagtgtgaagcggcca

SEQ ID NO: 78194 - DNA, 27 bp, Artificial Sequence
  Description of Artificial Sequence: Synthetic oligonucleotide
ctccaagcgcaagtgtgaagcggccaa

SEQ ID NO: 78195 - DNA, 28 bp, Artificial Sequence
  Description of Artificial Sequence: Synthetic oligonucleotide
tccaagcgcaagtgtgaagcggccaatg

SEQ ID NO: 78196 - DNA, 27 bp, Artificial Sequence
  Description of Artificial Sequence: Synthetic oligonucleotide
ccaagcgcaagtgtgaagcggccaatg

SEQ ID NO: 78197 - DNA, 28 bp, Artificial Sequence
  Description of Artificial Sequence: Synthetic oligonucleotide
caagcgcaagtgtgaagcggccaatgtg

SEQ ID NO: 78198 - DNA, 28 bp, Artificial Sequence
  Description of Artificial Sequence: Synthetic oligonucleotide
aagcgcaagtgtgaagcggccaatgtgg

SEQ ID NO: 78199 - DNA, 27 bp, Artificial Sequence
  Description of Artificial Sequence: Synthetic oligonucleotide
agcgcaagtgtgaagcggccaatgtgg

SEQ ID NO: 78200 - DNA, 26 bp, Artificial Sequence
  Description of Artificial Sequence: Synthetic oligonucleotide
gcgcaagtgtgaagcggccaatgtgg

SEQ ID NO: 78201 - DNA, 27 bp, Artificial Sequence
  Description of Artificial Sequence: Synthetic oligonucleotide
cgcaagtgtgaagcggccaatgtggct

SEQ ID NO: 78202 - DNA, 27 bp, Artificial Sequence
  Description of Artificial Sequence: Synthetic oligonucleotide
gcaagtgtgaagcggccaatgtggctg

SEQ ID NO: 78203 - DNA, 29 bp, Artificial Sequence
  Description of Artificial Sequence: Synthetic oligonucleotide
caagtgtgaagcggccaatgtggctgaac

SEQ ID NO: 78204 - DNA, 32 bp, Artificial Sequence
  Description of Artificial Sequence: Synthetic oligonucleotide
aagtgtgaagcggccaatgtggctgaacaaag

SEQ ID NO: 78205 - DNA, 31 bp, Artificial Sequence
  Description of Artificial Sequence: Synthetic oligonucleotide
agtgtgaagcggccaatgtggctgaacaaag

SEQ ID NO: 78206 - DNA, 30 bp, Artificial Sequence
  Description of Artificial Sequence: Synthetic oligonucleotide
gtgtgaagcggccaatgtggctgaacaaag

SEQ ID NO: 78207 - DNA, 30 bp, Artificial Sequence
  Description of Artificial Sequence: Synthetic oligonucleotide
tgtgaagcggccaatgtggctgaacaaagg

SEQ ID NO: 78208 - DNA, 29 bp, Artificial Sequence
  Description of Artificial Sequence: Synthetic oligonucleotide
gtgaagcggccaatgtggctgaacaaagg

SEQ ID NO: 78209 - DNA, 30 bp, Artificial Sequence
  Description of Artificial Sequence: Synthetic oligonucleotide
tgaagcggccaatgtggctgaacaaaggag

SEQ ID NO: 78210 - DNA, 29 bp, Artificial Sequence
  Description of Artificial Sequence: Synthetic oligonucleotide
gaagcggccaatgtggctgaacaaaggag

SEQ ID NO: 78211 - DNA, 30 bp, Artificial Sequence
  Description of Artificial Sequence: Synthetic oligonucleotide
aagcggccaatgtggctgaacaaaggagag

SEQ ID NO: 78212 - DNA, 29 bp, Artificial Sequence
  Description of Artificial Sequence: Synthetic oligonucleotide
agcggccaatgtggctgaacaaaggagag

SEQ ID NO: 78213 - DNA, 27 bp, Artificial Sequence
  Description of Artificial Sequence: Synthetic oligonucleotide
ctcctccgcgggtatgaacagtatgcg

SEQ ID NO: 78214 - DNA, 29 bp, Artificial Sequence
  Description of Artificial Sequence: Synthetic oligonucleotide
tcctccgcgggtatgaacagtatgcgtac

SEQ ID NO: 78215 - DNA, 28 bp, Artificial Sequence
  Description of Artificial Sequence: Synthetic oligonucleotide
cctccgcgggtatgaacagtatgcgtac

SEQ ID NO: 78216 - DNA, 28 bp, Artificial Sequence
  Description of Artificial Sequence: Synthetic oligonucleotide
ctccgcgggtatgaacagtatgcgtacg

SEQ ID NO: 78217 - DNA, 30 bp, Artificial Sequence
  Description of Artificial Sequence: Synthetic oligonucleotide
tccgcgggtatgaacagtatgcgtacgatg

SEQ ID NO: 78218 - DNA, 29 bp, Artificial Sequence
  Description of Artificial Sequence: Synthetic oligonucleotide
ccgcgggtatgaacagtatgcgtacgatg

SEQ ID NO: 78219 - DNA, 29 bp, Artificial Sequence
  Description of Artificial Sequence: Synthetic oligonucleotide
cgcgggtatgaacagtatgcgtacgatgg

SEQ ID NO: 78220 - DNA, 29 bp, Artificial Sequence
  Description of Artificial Sequence: Synthetic oligonucleotide
gcgggtatgaacagtatgcgtacgatggc

SEQ ID NO: 78221 - DNA, 31 bp, Artificial Sequence
  Description of Artificial Sequence: Synthetic oligonucleotide
cgggtatgaacagtatgcgtacgatggcaag

SEQ ID NO: 78222 - DNA, 31 bp, Artificial Sequence
  Description of Artificial Sequence: Synthetic oligonucleotide
gggtatgaacagtatgcgtacgatggcaagg

SEQ ID NO: 78223 - DNA, 35 bp, Artificial Sequence
  Description of Artificial Sequence: Synthetic oligonucleotide
ggtatgaacagtatgcgtacgatggcaaggattac

SEQ ID NO: 78224 - DNA, 35 bp, Artificial Sequence
  Description of Artificial Sequence: Synthetic oligonucleotide
gtatgaacagtatgcgtacgatggcaaggattacc

SEQ ID NO: 78225 - DNA, 36 bp, Artificial Sequence
  Description of Artificial Sequence: Synthetic oligonucleotide
tatgaacagtatgcgtacgatggcaaggattacctc

SEQ ID NO: 78226 - DNA, 35 bp, Artificial Sequence
  Description of Artificial Sequence: Synthetic oligonucleotide
atgaacagtatgcgtacgatggcaaggattacctc

SEQ ID NO: 78227 - DNA, 34 bp, Artificial Sequence
  Description of Artificial Sequence: Synthetic oligonucleotide
tgaacagtatgcgtacgatggcaaggattacctc

SEQ ID NO: 78228 - DNA, 33 bp, Artificial Sequence
  Description of Artificial Sequence: Synthetic oligonucleotide
gaacagtatgcgtacgatggcaaggattacctc

SEQ ID NO: 78229 - DNA, 33 bp, Artificial Sequence
  Description of Artificial Sequence: Synthetic oligonucleotide
aacagtatgcgtacgatggcaaggattacctcg

SEQ ID NO: 78230 - DNA, 32 bp, Artificial Sequence
  Description of Artificial Sequence: Synthetic oligonucleotide
acagtatgcgtacgatggcaaggattacctcg

SEQ ID NO: 78231 - DNA, 31 bp, Artificial Sequence
  Description of Artificial Sequence: Synthetic oligonucleotide
cagtatgcgtacgatggcaaggattacctcg

SEQ ID NO: 78232 - DNA, 31 bp, Artificial Sequence
  Description of Artificial Sequence: Synthetic oligonucleotide
agtatgcgtacgatggcaaggattacctcgc

SEQ ID NO: 78233 - DNA, 30 bp, Artificial Sequence
  Description of Artificial Sequence: Synthetic oligonucleotide
gtatgcgtacgatggcaaggattacctcgc

SEQ ID NO: 78234 - DNA, 30 bp, Artificial Sequence
  Description of Artificial Sequence: Synthetic oligonucleotide
tatgcgtacgatggcaaggattacctcgcc

SEQ ID NO: 78235 - DNA, 29 bp, Artificial Sequence
  Description of Artificial Sequence: Synthetic oligonucleotide
atgcgtacgatggcaaggattacctcgcc

SEQ ID NO: 78236 - DNA, 28 bp, Artificial Sequence
  Description of Artificial Sequence: Synthetic oligonucleotide
tgcgtacgatggcaaggattacctcgcc

SEQ ID NO: 78237 - DNA, 27 bp, Artificial Sequence
  Description of Artificial Sequence: Synthetic oligonucleotide
gcgtacgatggcaaggattacctcgcc

SEQ ID NO: 78238 - DNA, 27 bp, Artificial Sequence
  Description of Artificial Sequence: Synthetic oligonucleotide
cgtacgatggcaaggattacctcgccc

SEQ ID NO: 78239 - DNA, 28 bp, Artificial Sequence
  Description of Artificial Sequence: Synthetic oligonucleotide
gtacgatggcaaggattacctcgccctg

SEQ ID NO: 78240 - DNA, 25 bp, Artificial Sequence
  Description of Artificial Sequence: Synthetic oligonucleotide
ccggagcccctcatgctgagatgga

SEQ ID NO: 78241 - DNA, 25 bp, Artificial Sequence
  Description of Artificial Sequence: Synthetic oligonucleotide
gtgcggttcgacagcgactcggctt

SEQ ID NO: 78242 - DNA, 26 bp, Artificial Sequence
  Description of Artificial Sequence: Synthetic oligonucleotide
tgcggttcgacagcgactcggcttgt

SEQ ID NO: 78243 - DNA, 25 bp, Artificial Sequence
  Description of Artificial Sequence: Synthetic oligonucleotide
gcggttcgacagcgactcggcttgt

SEQ ID NO: 78244 - DNA, 25 bp, Artificial Sequence
  Description of Artificial Sequence: Synthetic oligonucleotide
cggttcgacagcgactcggcttgtc

SEQ ID NO: 78245 - DNA, 25 bp, Artificial Sequence
  Description of Artificial Sequence: Synthetic oligonucleotide
ggttcgacagcgactcggcttgtcc

SEQ ID NO: 78246 - DNA, 26 bp, Artificial Sequence
  Description of Artificial Sequence: Synthetic oligonucleotide
gttcgacagcgactcggcttgtccga

SEQ ID NO: 78247 - DNA, 26 bp, Artificial Sequence
  Description of Artificial Sequence: Synthetic oligonucleotide
ttcgacagcgactcggcttgtccgag

SEQ ID NO: 78248 - DNA, 25 bp, Artificial Sequence
  Description of Artificial Sequence: Synthetic oligonucleotide
tcgacagcgactcggcttgtccgag

SEQ ID NO: 78249 - DNA, 24 bp, Artificial Sequence
  Description of Artificial Sequence: Synthetic oligonucleotide
cgacagcgactcggcttgtccgag

SEQ ID NO: 78250 - DNA, 26 bp, Artificial Sequence
  Description of Artificial Sequence: Synthetic oligonucleotide
gacagcgactcggcttgtccgaggat

SEQ ID NO: 78251 - DNA, 26 bp, Artificial Sequence
  Description of Artificial Sequence: Synthetic oligonucleotide
acagcgactcggcttgtccgaggatg

SEQ ID NO: 78252 - DNA, 25 bp, Artificial Sequence
  Description of Artificial Sequence: Synthetic oligonucleotide
cagcgactcggcttgtccgaggatg

SEQ ID NO: 78253 - DNA, 26 bp, Artificial Sequence
  Description of Artificial Sequence: Synthetic oligonucleotide
agcgactcggcttgtccgaggatgga

SEQ ID NO: 78254 - DNA, 25 bp, Artificial Sequence
  Description of Artificial Sequence: Synthetic oligonucleotide
gcgactcggcttgtccgaggatgga

SEQ ID NO: 78255 - DNA, 25 bp, Artificial Sequence
  Description of Artificial Sequence: Synthetic oligonucleotide
cgactcggcttgtccgaggatggag

SEQ ID NO: 78256 - DNA, 25 bp, Artificial Sequence
  Description of Artificial Sequence: Synthetic oligonucleotide
gactcggcttgtccgaggatggagc

SEQ ID NO: 78257 - DNA, 25 bp, Artificial Sequence
  Description of Artificial Sequence: Synthetic oligonucleotide
actcggcttgtccgaggatggagcc

SEQ ID NO: 78258 - DNA, 24 bp, Artificial Sequence
  Description of Artificial Sequence: Synthetic oligonucleotide
ctcggcttgtccgaggatggagcc

SEQ ID NO: 78259 - DNA, 24 bp, Artificial Sequence
  Description of Artificial Sequence: Synthetic oligonucleotide
tcggcttgtccgaggatggagccg

SEQ ID NO: 78260 - DNA, 23 bp, Artificial Sequence
  Description of Artificial Sequence: Synthetic oligonucleotide
cggcttgtccgaggatggagccg

SEQ ID NO: 78261 - DNA, 23 bp, Artificial Sequence
  Description of Artificial Sequence: Synthetic oligonucleotide
ggcttgtccgaggatggagccgc

SEQ ID NO: 78262 - DNA, 23 bp, Artificial Sequence
  Description of Artificial Sequence: Synthetic oligonucleotide
gcttgtccgaggatggagccgcg

SEQ ID NO: 78263 - DNA, 23 bp, Artificial Sequence
  Description of Artificial Sequence: Synthetic oligonucleotide
cttgtccgaggatggagccgcgg

SEQ ID NO: 78264 - DNA, 23 bp, Artificial Sequence
  Description of Artificial Sequence: Synthetic oligonucleotide
ttgtccgaggatggagccgcggg

SEQ ID NO: 78265 - DNA, 25 bp, Artificial Sequence
  Description of Artificial Sequence: Synthetic oligonucleotide
ggcacgtgcgtggagtggctccata

SEQ ID NO: 78266 - DNA, 27 bp, Artificial Sequence
  Description of Artificial Sequence: Synthetic oligonucleotide
gcacgtgcgtggagtggctccatagat

SEQ ID NO: 78267 - DNA, 28 bp, Artificial Sequence
  Description of Artificial Sequence: Synthetic oligonucleotide
cacgtgcgtggagtggctccatagatac

SEQ ID NO: 78268 - DNA, 28 bp, Artificial Sequence
  Description of Artificial Sequence: Synthetic oligonucleotide
acgtgcgtggagtggctccatagatacc

SEQ ID NO: 78269 - DNA, 27 bp, Artificial Sequence
  Description of Artificial Sequence: Synthetic oligonucleotide
cgtgcgtggagtggctccatagatacc

SEQ ID NO: 78270 - DNA, 28 bp, Artificial Sequence
  Description of Artificial Sequence: Synthetic oligonucleotide
gtgcgtggagtggctccatagatacctg

SEQ ID NO: 78271 - DNA, 28 bp, Artificial Sequence
  Description of Artificial Sequence: Synthetic oligonucleotide
tgcgtggagtggctccatagatacctgg

SEQ ID NO: 78272 - DNA, 27 bp, Artificial Sequence
  Description of Artificial Sequence: Synthetic oligonucleotide
gcgtggagtggctccatagatacctgg

SEQ ID NO: 78273 - DNA, 28 bp, Artificial Sequence
  Description of Artificial Sequence: Synthetic oligonucleotide
cgtggagtggctccatagatacctggag

SEQ ID NO: 78274 - DNA, 30 bp, Artificial Sequence
  Description of Artificial Sequence: Synthetic oligonucleotide
gtggagtggctccatagatacctggagaac

SEQ ID NO: 78275 - DNA, 30 bp, Artificial Sequence
  Description of Artificial Sequence: Synthetic oligonucleotide
tggagtggctccatagatacctggagaacg

SEQ ID NO: 78276 - DNA, 29 bp, Artificial Sequence
  Description of Artificial Sequence: Synthetic oligonucleotide
ggagtggctccatagatacctggagaacg

SEQ ID NO: 78277 - DNA, 29 bp, Artificial Sequence
  Description of Artificial Sequence: Synthetic oligonucleotide
gagtggctccatagatacctggagaacgg

SEQ ID NO: 78278 - DNA, 29 bp, Artificial Sequence
  Description of Artificial Sequence: Synthetic oligonucleotide
agtggctccatagatacctggagaacggg

SEQ ID NO: 78279 - DNA, 28 bp, Artificial Sequence
  Description of Artificial Sequence: Synthetic oligonucleotide
gtggctccatagatacctggagaacggg

SEQ ID NO: 78280 - DNA, 30 bp, Artificial Sequence
  Description of Artificial Sequence: Synthetic oligonucleotide
tggctccatagatacctggagaacgggaag

SEQ ID NO: 78281 - DNA, 29 bp, Artificial Sequence
  Description of Artificial Sequence: Synthetic oligonucleotide
ggctccatagatacctggagaacgggaag

SEQ ID NO: 78282 - DNA, 29 bp, Artificial Sequence
  Description of Artificial Sequence: Synthetic oligonucleotide
gctccatagatacctggagaacgggaagg

SEQ ID NO: 78283 - DNA, 30 bp, Artificial Sequence
  Description of Artificial Sequence: Synthetic oligonucleotide
ctccatagatacctggagaacgggaaggag

SEQ ID NO: 78284 - DNA, 32 bp, Artificial Sequence
  Description of Artificial Sequence: Synthetic oligonucleotide
tccatagatacctggagaacgggaaggagatg

SEQ ID NO: 78285 - DNA, 31 bp, Artificial Sequence
  Description of Artificial Sequence: Synthetic oligonucleotide
ccatagatacctggagaacgggaaggagatg

SEQ ID NO: 78286 - DNA, 31 bp, Artificial Sequence
  Description of Artificial Sequence: Synthetic oligonucleotide
catagatacctggagaacgggaaggagatgc

SEQ ID NO: 78287 - DNA, 32 bp, Artificial Sequence
  Description of Artificial Sequence: Synthetic oligonucleotide
atagatacctggagaacgggaaggagatgctg

SEQ ID NO: 78288 - DNA, 31 bp, Artificial Sequence
  Description of Artificial Sequence: Synthetic oligonucleotide
tagatacctggagaacgggaaggagatgctg

SEQ ID NO: 78289 - DNA, 27 bp, Artificial Sequence
  Description of Artificial Sequence: Synthetic oligonucleotide
cgcagttcgtgcgattcgacagcgact

SEQ ID NO: 78290 - DNA, 27 bp, Artificial Sequence
  Description of Artificial Sequence: Synthetic oligonucleotide
gcagttcgtgcgattcgacagcgactc

SEQ ID NO: 78291 - DNA, 27 bp, Artificial Sequence
  Description of Artificial Sequence: Synthetic oligonucleotide
cagttcgtgcgattcgacagcgactcg

SEQ ID NO: 78292 - DNA, 27 bp, Artificial Sequence
  Description of Artificial Sequence: Synthetic oligonucleotide
agttcgtgcgattcgacagcgactcgg

SEQ ID NO: 78293 - DNA, 26 bp, Artificial Sequence
  Description of Artificial Sequence: Synthetic oligonucleotide
gttcgtgcgattcgacagcgactcgg

SEQ ID NO: 78294 - DNA, 26 bp, Artificial Sequence
  Description of Artificial Sequence: Synthetic oligonucleotide
ttcgtgcgattcgacagcgactcggc

SEQ ID NO: 78295 - DNA, 25 bp, Artificial Sequence
  Description of Artificial Sequence: Synthetic oligonucleotide
tcgtgcgattcgacagcgactcggc

SEQ ID NO: 78296 - DNA, 24 bp, Artificial Sequence
  Description of Artificial Sequence: Synthetic oligonucleotide
cgtgcgattcgacagcgactcggc

SEQ ID NO: 78297 - DNA, 25 bp, Artificial Sequence
  Description of Artificial Sequence: Synthetic oligonucleotide
gtgcgattcgacagcgactcggcgt

SEQ ID NO: 78298 - DNA, 26 bp, Artificial Sequence
  Description of Artificial Sequence: Synthetic oligonucleotide
tgcgattcgacagcgactcggcgtgt

SEQ ID NO: 78299 - DNA, 25 bp, Artificial Sequence
  Description of Artificial Sequence: Synthetic oligonucleotide
gcgattcgacagcgactcggcgtgt

SEQ ID NO: 78300 - DNA, 25 bp, Artificial Sequence
  Description of Artificial Sequence: Synthetic oligonucleotide
cgattcgacagcgactcggcgtgtc

SEQ ID NO: 78301 - DNA, 25 bp, Artificial Sequence
  Description of Artificial Sequence: Synthetic oligonucleotide
gattcgacagcgactcggcgtgtcc

SEQ ID NO: 78302 - DNA, 26 bp, Artificial Sequence
  Description of Artificial Sequence: Synthetic oligonucleotide
attcgacagcgactcggcgtgtccga

SEQ ID NO: 78303 - DNA, 22 bp, Artificial Sequence
  Description of Artificial Sequence: Synthetic oligonucleotide
ggcgccgtgggtggagcaggaa

SEQ ID NO: 78304 - DNA, 22 bp, Artificial Sequence
  Description of Artificial Sequence: Synthetic oligonucleotide
gcgccgtgggtggagcaggaag

SEQ ID NO: 78305 - DNA, 22 bp, Artificial Sequence
  Description of Artificial Sequence: Synthetic oligonucleotide
cgccgtgggtggagcaggaagg

SEQ ID NO: 78306 - DNA, 27 bp, Artificial Sequence
  Description of Artificial Sequence: Synthetic oligonucleotide
gagcaggaagggccggagtattgggaa

SEQ ID NO: 78307 - DNA, 27 bp, Artificial Sequence
  Description of Artificial Sequence: Synthetic oligonucleotide
agcaggaagggccggagtattgggaag

SEQ ID NO: 78308 - DNA, 27 bp, Artificial Sequence
  Description of Artificial Sequence: Synthetic oligonucleotide
gcaggaagggccggagtattgggaaga

SEQ ID NO: 78309 - DNA, 27 bp, Artificial Sequence
  Description of Artificial Sequence: Synthetic oligonucleotide
caggaagggccggagtattgggaagag

SEQ ID NO: 78310 - DNA, 27 bp, Artificial Sequence
  Description of Artificial Sequence: Synthetic oligonucleotide
aggaagggccggagtattgggaagagg

SEQ ID NO: 78311 - DNA, 27 bp, Artificial Sequence
  Description of Artificial Sequence: Synthetic oligonucleotide
ggaagggccggagtattgggaagagga

SEQ ID NO: 78312 - DNA, 27 bp, Artificial Sequence
  Description of Artificial Sequence: Synthetic oligonucleotide
gaagggccggagtattgggaagaggag

SEQ ID NO: 78313 - DNA, 28 bp, Artificial Sequence
  Description of Artificial Sequence: Synthetic oligonucleotide
aagggccggagtattgggaagaggagac

SEQ ID NO: 78314 - DNA, 27 bp, Artificial Sequence
  Description of Artificial Sequence: Synthetic oligonucleotide
agggccggagtattgggaagaggagac

SEQ ID NO: 78315 - DNA, 27 bp, Artificial Sequence
  Description of Artificial Sequence: Synthetic oligonucleotide
cactccatgaggtatttcagcgccgcg

SEQ ID NO: 78316 - DNA, 27 bp, Artificial Sequence
  Description of Artificial Sequence: Synthetic oligonucleotide
actccatgaggtatttcagcgccgcgg

SEQ ID NO: 78317 - DNA, 27 bp, Artificial Sequence
  Description of Artificial Sequence: Synthetic oligonucleotide
ctccatgaggtatttcagcgccgcggt

SEQ ID NO: 78318 - DNA, 27 bp, Artificial Sequence
  Description of Artificial Sequence: Synthetic oligonucleotide
tccatgaggtatttcagcgccgcggtg

SEQ ID NO: 78319 - DNA, 27 bp, Artificial Sequence
  Description of Artificial Sequence: Synthetic oligonucleotide
ccatgaggtatttcagcgccgcggtgt

SEQ ID NO: 78320 - DNA, 27 bp, Artificial Sequence
  Description of Artificial Sequence: Synthetic oligonucleotide
catgaggtatttcagcgccgcggtgtc

SEQ ID NO: 78321 - DNA, 27 bp, Artificial Sequence
  Description of Artificial Sequence: Synthetic oligonucleotide
atgaggtatttcagcgccgcggtgtcc

SEQ ID NO: 78322 - DNA, 26 bp, Artificial Sequence
  Description of Artificial Sequence: Synthetic oligonucleotide
tgaggtatttcagcgccgcggtgtcc

SEQ ID NO: 78323 - DNA, 25 bp, Artificial Sequence
  Description of Artificial Sequence: Synthetic oligonucleotide
gaggtatttcagcgccgcggtgtcc

SEQ ID NO: 78324 - DNA, 25 bp, Artificial Sequence
  Description of Artificial Sequence: Synthetic oligonucleotide
aggtatttcagcgccgcggtgtccc

SEQ ID NO: 78325 - DNA, 24 bp, Artificial Sequence
  Description of Artificial Sequence: Synthetic oligonucleotide
ggtatttcagcgccgcggtgtccc

SEQ ID NO: 78326 - DNA, 24 bp, Artificial Sequence
  Description of Artificial Sequence: Synthetic oligonucleotide
gtatttcagcgccgcggtgtcccg

SEQ ID NO: 78327 - DNA, 24 bp, Artificial Sequence
  Description of Artificial Sequence: Synthetic oligonucleotide
tatttcagcgccgcggtgtcccgg

SEQ ID NO: 78328 - DNA, 23 bp, Artificial Sequence
  Description of Artificial Sequence: Synthetic oligonucleotide
atttcagcgccgcggtgtcccgg

SEQ ID NO: 78329 - DNA, 22 bp, Artificial Sequence
  Description of Artificial Sequence: Synthetic oligonucleotide
tttcagcgccgcggtgtcccgg

SEQ ID NO: 78330 - DNA, 21 bp, Artificial Sequence
  Description of Artificial Sequence: Synthetic oligonucleotide
ttcagcgccgcggtgtcccgg

SEQ ID NO: 78331 - DNA, 20 bp, Artificial Sequence
  Description of Artificial Sequence: Synthetic oligonucleotide
tcagcgccgcggtgtcccgg

SEQ ID NO: 78332 - DNA, 20 bp, Artificial Sequence
  Description of Artificial Sequence: Synthetic oligonucleotide
cagcgccgcggtgtcccggt

SEQ ID NO: 78333 - DNA, 20 bp, Artificial Sequence
  Description of Artificial Sequence: Synthetic oligonucleotide
agcgccgcggtgtcccggct

SEQ ID NO: 78334 - DNA, 20 bp, Artificial Sequence
  Description of Artificial Sequence: Synthetic oligonucleotide
gcgccgcggtgtcccggctt

SEQ ID NO: 78335 - DNA, 20 bp, Artificial Sequence
  Description of Artificial Sequence: Synthetic oligonucleotide
cgccgcggtgtcccggcctt

SEQ ID NO: 78336 - DNA, 20 bp, Artificial Sequence
  Description of Artificial Sequence: Synthetic oligonucleotide
gccgcggtgtcccggccctt

SEQ ID NO: 78337 - DNA, 20 bp, Artificial Sequence
  Description of Artificial Sequence: Synthetic oligonucleotide
ccgcggtgtcccggcccgtt

SEQ ID NO: 78338 - DNA, 20 bp, Artificial Sequence
  Description of Artificial Sequence: Synthetic oligonucleotide
cgcggtgtcccggcccggtt

SEQ ID NO: 78339 - DNA, 20 bp, Artificial Sequence
  Description of Artificial Sequence: Synthetic oligonucleotide
gcggtgtcccggcccggctt

SEQ ID NO: 78340 - DNA, 20 bp, Artificial Sequence
  Description of Artificial Sequence: Synthetic oligonucleotide
cggtgtcccggcccggcctt

SEQ ID NO: 78341 - DNA, 33 bp, Artificial Sequence
  Description of Artificial Sequence: Synthetic oligonucleotide
cagttctcataccctccagtggatgattggttg

SEQ ID NO: 78342 - DNA, 33 bp, Artificial Sequence
  Description of Artificial Sequence: Synthetic oligonucleotide
agttctcataccctccagtggatgattggttgc

SEQ ID NO: 78343 - DNA, 32 bp, Artificial Sequence
  Description of Artificial Sequence: Synthetic oligonucleotide
gttctcataccctccagtggatgattggttgc

SEQ ID NO: 78344 - DNA, 32 bp, Artificial Sequence
  Description of Artificial Sequence: Synthetic oligonucleotide
ttctcataccctccagtggatgattggttgcg

SEQ ID NO: 78345 - DNA, 31 bp, Artificial Sequence
  Description of Artificial Sequence: Synthetic oligonucleotide
tctcataccctccagtggatgattggttgcg

SEQ ID NO: 78346 - DNA, 30 bp, Artificial Sequence
  Description of Artificial Sequence: Synthetic oligonucleotide
ctcataccctccagtggatgattggttgcg

SEQ ID NO: 78347 - DNA, 31 bp, Artificial Sequence
  Description of Artificial Sequence: Synthetic oligonucleotide
tcataccctccagtggatgattggttgcgac

SEQ ID NO: 78348 - DNA, 30 bp, Artificial Sequence
  Description of Artificial Sequence: Synthetic oligonucleotide
cataccctccagtggatgattggttgcgac

SEQ ID NO: 78349 - DNA, 30 bp, Artificial Sequence
  Description of Artificial Sequence: Synthetic oligonucleotide
ataccctccagtggatgattggttgcgacc

SEQ ID NO: 78350 - DNA, 29 bp, Artificial Sequence
  Description of Artificial Sequence: Synthetic oligonucleotide
taccctccagtggatgattggttgcgacc

SEQ ID NO: 78351 - DNA, 28 bp, Artificial Sequence
  Description of Artificial Sequence: Synthetic oligonucleotide
accctccagtggatgattggttgcgacc

SEQ ID NO: 78352 - DNA, 27 bp, Artificial Sequence
  Description of Artificial Sequence: Synthetic oligonucleotide
ccctccagtggatgattggttgcgacc

SEQ ID NO: 78353 - DNA, 28 bp, Artificial Sequence
  Description of Artificial Sequence: Synthetic oligonucleotide
cctccagtggatgattggttgcgacctg

SEQ ID NO: 78354 - DNA, 28 bp, Artificial Sequence
  Description of Artificial Sequence: Synthetic oligonucleotide
ctccagtggatgattggttgcgacctgg

SEQ ID NO: 78355 - DNA, 28 bp, Artificial Sequence
  Description of Artificial Sequence: Synthetic oligonucleotide
tccagtggatgattggttgcgacctggg

SEQ ID NO: 78356 - DNA, 27 bp, Artificial Sequence
  Description of Artificial Sequence: Synthetic oligonucleotide
ccagtggatgattggttgcgacctggg

SEQ ID NO: 78357 - DNA, 27 bp, Artificial Sequence
  Description of Artificial Sequence: Synthetic oligonucleotide
cagtggatgattggttgcgacctgggg

SEQ ID NO: 78358 - DNA, 28 bp, Artificial Sequence
  Description of Artificial Sequence: Synthetic oligonucleotide
agtggatgattggttgcgacctggggtc

SEQ ID NO: 78359 - DNA, 27 bp, Artificial Sequence
  Description of Artificial Sequence: Synthetic oligonucleotide
gtggatgattggttgcgacctggggtc

SEQ ID NO: 78360 - DNA, 27 bp, Artificial Sequence
  Description of Artificial Sequence: Synthetic oligonucleotide
tggatgattggttgcgacctggggtcc

SEQ ID NO: 78361 - DNA, 26 bp, Artificial Sequence
  Description of Artificial Sequence: Synthetic oligonucleotide
ggatgattggttgcgacctggggtcc

SEQ ID NO: 78362 - DNA, 27 bp, Artificial Sequence
  Description of Artificial Sequence: Synthetic oligonucleotide
gatgattggttgcgacctggggtccga

SEQ ID NO: 78363 - DNA, 27 bp, Artificial Sequence
  Description of Artificial Sequence: Synthetic oligonucleotide
atgattggttgcgacctggggtccgac

SEQ ID NO: 78364 - DNA, 26 bp, Artificial Sequence
  Description of Artificial Sequence: Synthetic oligonucleotide
tgattggttgcgacctggggtccgac

SEQ ID NO: 78365 - DNA, 25 bp, Artificial Sequence
  Description of Artificial Sequence: Synthetic oligonucleotide
gattggttgcgacctggggtccgac

SEQ ID NO: 78366 - DNA, 25 bp, Artificial Sequence
  Description of Artificial Sequence: Synthetic oligonucleotide
attggttgcgacctggggtccgacg

SEQ ID NO: 78367 - DNA, 24 bp, Artificial Sequence
  Description of Artificial Sequence: Synthetic oligonucleotide
ttggttgcgacctggggtccgacg

SEQ ID NO: 78368 - DNA, 23 bp, Artificial Sequence
  Description of Artificial Sequence: Synthetic oligonucleotide
tggttgcgacctggggtccgacg

SEQ ID NO: 78369 - DNA, 22 bp, Artificial Sequence
  Description of Artificial Sequence: Synthetic oligonucleotide
ggttgcgacctggggtccgacg

SEQ ID NO: 78370 - DNA, 23 bp, Artificial Sequence
  Description of Artificial Sequence: Synthetic oligonucleotide
gttgcgacctggggtccgacgga

SEQ ID NO: 78371 - DNA, 23 bp, Artificial Sequence
  Description of Artificial Sequence: Synthetic oligonucleotide
ttgcgacctggggtccgacggac

SEQ ID NO: 78372 - DNA, 29 bp, Artificial Sequence
  Description of Artificial Sequence: Synthetic oligonucleotide
cctgggcttctaccctgcagagatcatac

SEQ ID NO: 78373 - DNA, 30 bp, Artificial Sequence
  Description of Artificial Sequence: Synthetic oligonucleotide
ctgggcttctaccctgcagagatcatactg

SEQ ID NO: 78374 - DNA, 31 bp, Artificial Sequence
  Description of Artificial Sequence: Synthetic oligonucleotide
tgggcttctaccctgcagagatcatactgac

SEQ ID NO: 78375 - DNA, 30 bp, Artificial Sequence
  Description of Artificial Sequence: Synthetic oligonucleotide
gggcttctaccctgcagagatcatactgac

SEQ ID NO: 78376 - DNA, 30 bp, Artificial Sequence
  Description of Artificial Sequence: Synthetic oligonucleotide
ggcttctaccctgcagagatcatactgacc

SEQ ID NO: 78377 - DNA, 31 bp, Artificial Sequence
  Description of Artificial Sequence: Synthetic oligonucleotide
gcttctaccctgcagagatcatactgacctg

SEQ ID NO: 78378 - DNA, 31 bp, Artificial Sequence
  Description of Artificial Sequence: Synthetic oligonucleotide
cttctaccctgcagagatcatactgacctgg

SEQ ID NO: 78379 - DNA, 31 bp, Artificial Sequence
  Description of Artificial Sequence: Synthetic oligonucleotide
ttctaccctgcagagatcatactgacctggc

SEQ ID NO: 78380 - DNA, 30 bp, Artificial Sequence
  Description of Artificial Sequence: Synthetic oligonucleotide
tctaccctgcagagatcatactgacctggc

SEQ ID NO: 78381 - DNA, 29 bp, Artificial Sequence
  Description of Artificial Sequence: Synthetic oligonucleotide
ctaccctgcagagatcatactgacctggc

SEQ ID NO: 78382 - DNA, 30 bp, Artificial Sequence
  Description of Artificial Sequence: Synthetic oligonucleotide
taccctgcagagatcatactgacctggcag

SEQ ID NO: 78383 - DNA, 29 bp, Artificial Sequence
  Description of Artificial Sequence: Synthetic oligonucleotide
accctgcagagatcatactgacctggcag

SEQ ID NO: 78384 - DNA, 28 bp, Artificial Sequence
  Description of Artificial Sequence: Synthetic oligonucleotide
ccctgcagagatcatactgacctggcag

SEQ ID NO: 78385 - DNA, 28 bp, Artificial Sequence
  Description of Artificial Sequence: Synthetic oligonucleotide
cctgcagagatcatactgacctggcagc

SEQ ID NO: 78386 - DNA, 28 bp, Artificial Sequence
  Description of Artificial Sequence: Synthetic oligonucleotide
ctgcagagatcatactgacctggcagcg

SEQ ID NO: 78387 - DNA, 28 bp, Artificial Sequence
  Description of Artificial Sequence: Synthetic oligonucleotide
tgcagagatcatactgacctggcagcgg

SEQ ID NO: 78388 - DNA, 27 bp, Artificial Sequence
  Description of Artificial Sequence: Synthetic oligonucleotide
gcagagatcatactgacctggcagcgg

SEQ ID NO: 78389 - DNA, 27 bp, Artificial Sequence
  Description of Artificial Sequence: Synthetic oligonucleotide
cagagatcatactgacctggcagcggg

SEQ ID NO: 78390 - DNA, 29 bp, Artificial Sequence
  Description of Artificial Sequence: Synthetic oligonucleotide
agagatcatactgacctggcagcgggatg

SEQ ID NO: 78391 - DNA, 31 bp, Artificial Sequence
  Description of Artificial Sequence: Synthetic oligonucleotide
tggagaggagcagagatacacatgccatgtg

SEQ ID NO: 78392 - DNA, 30 bp, Artificial Sequence
  Description of Artificial Sequence: Synthetic oligonucleotide
ggagaggagcagagatacacatgccatgtg

SEQ ID NO: 78393 - DNA, 30 bp, Artificial Sequence
  Description of Artificial Sequence: Synthetic oligonucleotide
gagaggagcagagatacacatgccatgtgc

SEQ ID NO: 78394 - DNA, 31 bp, Artificial Sequence
  Description of Artificial Sequence: Synthetic oligonucleotide
agaggagcagagatacacatgccatgtgcag

SEQ ID NO: 78395 - DNA, 30 bp, Artificial Sequence
  Description of Artificial Sequence: Synthetic oligonucleotide
gaggagcagagatacacatgccatgtgcag

SEQ ID NO: 78396 - DNA, 30 bp, Artificial Sequence
  Description of Artificial Sequence: Synthetic oligonucleotide
aggagcagagatacacatgccatgtgcagc

SEQ ID NO: 78397 - DNA, 29 bp, Artificial Sequence
  Description of Artificial Sequence: Synthetic oligonucleotide
ggagcagagatacacatgccatgtgcagc

SEQ ID NO: 78398 - DNA, 24 bp, Artificial Sequence
  Description of Artificial Sequence: Synthetic oligonucleotide
cgggaggggccggagtattgggaa

SEQ ID NO: 78399 - DNA, 25 bp, Artificial Sequence
  Description of Artificial Sequence: Synthetic oligonucleotide
gggaggggccggagtattgggaaga

SEQ ID NO: 78400 - DNA, 23 bp, Artificial Sequence
  Description of Artificial Sequence: Synthetic oligonucleotide
agctcgtggagaccaggcctgcc

SEQ ID NO: 78401 - DNA, 22 bp, Artificial Sequence
  Description of Artificial Sequence: Synthetic oligonucleotide
gctcgtggagaccaggcctgcc

SEQ ID NO: 78402 - DNA, 22 bp, Artificial Sequence
  Description of Artificial Sequence: Synthetic oligonucleotide
ctcgtggagaccaggcctgccg

SEQ ID NO: 78403 - DNA, 22 bp, Artificial Sequence
  Description of Artificial Sequence: Synthetic oligonucleotide
tcgtggagaccaggcctgccgg

SEQ ID NO: 78404 - DNA, 21 bp, Artificial Sequence
  Description of Artificial Sequence: Synthetic oligonucleotide
cgtggagaccaggcctgccgg

SEQ ID NO: 78405 - DNA, 21 bp, Artificial Sequence
  Description of Artificial Sequence: Synthetic oligonucleotide
gtggagaccaggcctgccggg

SEQ ID NO: 78406 - DNA, 23 bp, Artificial Sequence
  Description of Artificial Sequence: Synthetic oligonucleotide
tggagaccaggcctgccggggat

SEQ ID NO: 78407 - DNA, 22 bp, Artificial Sequence
  Description of Artificial Sequence: Synthetic oligonucleotide
ggagaccaggcctgccggggat

SEQ ID NO: 78408 - DNA, 22 bp, Artificial Sequence
  Description of Artificial Sequence: Synthetic oligonucleotide
gagaccaggcctgccggggatg

SEQ ID NO: 78409 - DNA, 24 bp, Artificial Sequence
  Description of Artificial Sequence: Synthetic oligonucleotide
agaccaggcctgccggggatggaa

SEQ ID NO: 78410 - DNA, 23 bp, Artificial Sequence
  Description of Artificial Sequence: Synthetic oligonucleotide
gaccaggcctgccggggatggaa

SEQ ID NO: 78411 - DNA, 23 bp, Artificial Sequence
  Description of Artificial Sequence: Synthetic oligonucleotide
accaggcctgccggggatggaac

SEQ ID NO: 78412 - DNA, 22 bp, Artificial Sequence
  Description of Artificial Sequence: Synthetic oligonucleotide
ccaggcctgccggggatggaac

SEQ ID NO: 78413 - DNA, 24 bp, Artificial Sequence
  Description of Artificial Sequence: Synthetic oligonucleotide
caggcctgccggggatggaacctt

SEQ ID NO: 78414 - DNA, 24 bp, Artificial Sequence
  Description of Artificial Sequence: Synthetic oligonucleotide
aggcctgccggggatggaaccttc

SEQ ID NO: 78415 - DNA, 23 bp, Artificial Sequence
  Description of Artificial Sequence: Synthetic oligonucleotide
ggcctgccggggatggaaccttc

SEQ ID NO: 78416 - DNA, 24 bp, Artificial Sequence
  Description of Artificial Sequence: Synthetic oligonucleotide
gcctgccggggatggaaccttcca

SEQ ID NO: 78417 - DNA, 26 bp, Artificial Sequence
  Description of Artificial Sequence: Synthetic oligonucleotide
cctgccggggatggaaccttccagaa

SEQ ID NO: 78418 - DNA, 27 bp, Artificial Sequence
  Description of Artificial Sequence: Synthetic oligonucleotide
ctgccggggatggaaccttccagaagt

SEQ ID NO: 78419 - DNA, 27 bp, Artificial Sequence
  Description of Artificial Sequence: Synthetic oligonucleotide
tgccggggatggaaccttccagaagtg

SEQ ID NO: 78420 - DNA, 26 bp, Artificial Sequence
  Description of Artificial Sequence: Synthetic oligonucleotide
gccggggatggaaccttccagaagtg

SEQ ID NO: 78421 - DNA, 26 bp, Artificial Sequence
  Description of Artificial Sequence: Synthetic oligonucleotide
ccggggatggaaccttccagaagtgg

SEQ ID NO: 78422 - DNA, 26 bp, Artificial Sequence
  Description of Artificial Sequence: Synthetic oligonucleotide
cggggatggaaccttccagaagtggg

SEQ ID NO: 78423 - DNA, 27 bp, Artificial Sequence
  Description of Artificial Sequence: Synthetic oligonucleotide
tcatcgccatgggctacgtggacgact

SEQ ID NO: 78424 - DNA, 26 bp, Artificial Sequence
  Description of Artificial Sequence: Synthetic oligonucleotide
catcgccatgggctacgtggacgact

SEQ ID NO: 78425 - DNA, 26 bp, Artificial Sequence
  Description of Artificial Sequence: Synthetic oligonucleotide
atcgccatgggctacgtggacgactc

SEQ ID NO: 78426 - DNA, 25 bp, Artificial Sequence
  Description of Artificial Sequence: Synthetic oligonucleotide
tcgccatgggctacgtggacgactc

SEQ ID NO: 78427 - DNA, 24 bp, Artificial Sequence
  Description of Artificial Sequence: Synthetic oligonucleotide
cgccatgggctacgtggacgactc

SEQ ID NO: 78428 - DNA, 24 bp, Artificial Sequence
  Description of Artificial Sequence: Synthetic oligonucleotide
gccatgggctacgtggacgactcg

SEQ ID NO: 78429 - DNA, 25 bp, Artificial Sequence
  Description of Artificial Sequence: Synthetic oligonucleotide
ccatgggctacgtggacgactcgca

SEQ ID NO: 78430 - DNA, 27 bp, Artificial Sequence
  Description of Artificial Sequence: Synthetic oligonucleotide
catgggctacgtggacgactcgcagtt

SEQ ID NO: 78431 - DNA, 27 bp, Artificial Sequence
  Description of Artificial Sequence: Synthetic oligonucleotide
atgggctacgtggacgactcgcagttc

SEQ ID NO: 78432 - DNA, 26 bp, Artificial Sequence
  Description of Artificial Sequence: Synthetic oligonucleotide
ctacgtggacgactcgcagttcgtgc

SEQ ID NO: 78433 - DNA, 26 bp, Artificial Sequence
  Description of Artificial Sequence: Synthetic oligonucleotide
tacgtggacgactcgcagttcgtgcg

SEQ ID NO: 78434 - DNA, 25 bp, Artificial Sequence
  Description of Artificial Sequence: Synthetic oligonucleotide
acgtggacgactcgcagttcgtgcg

SEQ ID NO: 78435 - DNA, 24 bp, Artificial Sequence
  Description of Artificial Sequence: Synthetic oligonucleotide
cgtggacgactcgcagttcgtgcg

SEQ ID NO: 78436 - DNA, 26 bp, Artificial Sequence
  Description of Artificial Sequence: Synthetic oligonucleotide
gtggacgactcgcagttcgtgcggtt

SEQ ID NO: 78437 - DNA, 26 bp, Artificial Sequence
  Description of Artificial Sequence: Synthetic oligonucleotide
tggacgactcgcagttcgtgcggttc

SEQ ID NO: 78438 - DNA, 25 bp, Artificial Sequence
  Description of Artificial Sequence: Synthetic oligonucleotide
ggacgactcgcagttcgtgcggttc

SEQ ID NO: 78439 - DNA, 26 bp, Artificial Sequence
  Description of Artificial Sequence: Synthetic oligonucleotide
gacgactcgcagttcgtgcggttcga

SEQ ID NO: 78440 - DNA, 27 bp, Artificial Sequence
  Description of Artificial Sequence: Synthetic oligonucleotide
acgactcgcagttcgtgcggttcgaca

SEQ ID NO: 78441 - DNA, 26 bp, Artificial Sequence
  Description of Artificial Sequence: Synthetic oligonucleotide
cgactcgcagttcgtgcggttcgaca

SEQ ID NO: 78442 - DNA, 26 bp, Artificial Sequence
  Description of Artificial Sequence: Synthetic oligonucleotide
gactcgcagttcgtgcggttcgacag

SEQ ID NO: 78443 - DNA, 26 bp, Artificial Sequence
  Description of Artificial Sequence: Synthetic oligonucleotide
actcgcagttcgtgcggttcgacagc

SEQ ID NO: 78444 - DNA, 25 bp, Artificial Sequence
  Description of Artificial Sequence: Synthetic oligonucleotide
ctcgcagttcgtgcggttcgacagc

SEQ ID NO: 78445 - DNA, 26 bp, Artificial Sequence
  Description of Artificial Sequence: Synthetic oligonucleotide
tcgcagttcgtgcggttcgacagcga

SEQ ID NO: 78446 - DNA, 23 bp, Artificial Sequence
  Description of Artificial Sequence: Synthetic oligonucleotide
ctggggtccgacggacgcctcat

SEQ ID NO: 78447 - DNA, 23 bp, Artificial Sequence
  Description of Artificial Sequence: Synthetic oligonucleotide
tggggtccgacggacgcctcatc

SEQ ID NO: 78448 - DNA, 22 bp, Artificial Sequence
  Description of Artificial Sequence: Synthetic oligonucleotide
ggggtccgacggacgcctcatc

SEQ ID NO: 78449 - DNA, 22 bp, Artificial Sequence
  Description of Artificial Sequence: Synthetic oligonucleotide
gggtccgacggacgcctcatcc

SEQ ID NO: 78450 - DNA, 22 bp, Artificial Sequence
  Description of Artificial Sequence: Synthetic oligonucleotide
ggtccgacggacgcctcatccg

SEQ ID NO: 78451 - DNA, 22 bp, Artificial Sequence
  Description of Artificial Sequence: Synthetic oligonucleotide
gtccgacggacgcctcatccgc

SEQ ID NO: 78452 - DNA, 22 bp, Artificial Sequence
  Description of Artificial Sequence: Synthetic oligonucleotide
tccgacggacgcctcatccgcg

SEQ ID NO: 78453 - DNA, 21 bp, Artificial Sequence
  Description of Artificial Sequence: Synthetic oligonucleotide
ccgacggacgcctcatccgcg

SEQ ID NO: 78454 - DNA, 21 bp, Artificial Sequence
  Description of Artificial Sequence: Synthetic oligonucleotide
cgacggacgcctcatccgcgg

SEQ ID NO: 78455 - DNA, 24 bp, Artificial Sequence
  Description of Artificial Sequence: Synthetic oligonucleotide
gacggacgcctcatccgcgggtat

SEQ ID NO: 78456 - DNA, 26 bp, Artificial Sequence
  Description of Artificial Sequence: Synthetic oligonucleotide
acggacgcctcatccgcgggtatgaa

SEQ ID NO: 78457 - DNA, 25 bp, Artificial Sequence
  Description of Artificial Sequence: Synthetic oligonucleotide
cggacgcctcatccgcgggtatgaa

SEQ ID NO: 78458 - DNA, 26 bp, Artificial Sequence
  Description of Artificial Sequence: Synthetic oligonucleotide
ggacgcctcatccgcgggtatgaaca

SEQ ID NO: 78459 - DNA, 27 bp, Artificial Sequence
  Description of Artificial Sequence: Synthetic oligonucleotide
gacgcctcatccgcgggtatgaacagt

SEQ ID NO: 78460 - DNA, 29 bp, Artificial Sequence
  Description of Artificial Sequence: Synthetic oligonucleotide
acgcctcatccgcgggtatgaacagtatg

SEQ ID NO: 78461 - DNA, 28 bp, Artificial Sequence
  Description of Artificial Sequence: Synthetic oligonucleotide
cgcctcatccgcgggtatgaacagtatg

SEQ ID NO: 78462 - DNA, 28 bp, Artificial Sequence
  Description of Artificial Sequence: Synthetic oligonucleotide
gcctcatccgcgggtatgaacagtatgc

SEQ ID NO: 78463 - DNA, 28 bp, Artificial Sequence
  Description of Artificial Sequence: Synthetic oligonucleotide
cctcatccgcgggtatgaacagtatgcc

SEQ ID NO: 78464 - DNA, 30 bp, Artificial Sequence
  Description of Artificial Sequence: Synthetic oligonucleotide
ctcatccgcgggtatgaacagtatgcctac

SEQ ID NO: 78465 - DNA, 30 bp, Artificial Sequence
  Description of Artificial Sequence: Synthetic oligonucleotide
tcatccgcgggtatgaacagtatgcctacg

SEQ ID NO: 78466 - DNA, 29 bp, Artificial Sequence
  Description of Artificial Sequence: Synthetic oligonucleotide
catccgcgggtatgaacagtatgcctacg

SEQ ID NO: 78467 - DNA, 31 bp, Artificial Sequence
  Description of Artificial Sequence: Synthetic oligonucleotide
atccgcgggtatgaacagtatgcctacgatg

SEQ ID NO: 78468 - DNA, 26 bp, Artificial Sequence
  Description of Artificial Sequence: Synthetic oligonucleotide
agcaggaggggcccgagtattgggaa

SEQ ID NO: 78469 - DNA, 25 bp, Artificial Sequence
  Description of Artificial Sequence: Synthetic oligonucleotide
gcaggaggggcccgagtattgggaa

SEQ ID NO: 78470 - DNA, 26 bp, Artificial Sequence
  Description of Artificial Sequence: Synthetic oligonucleotide
caggaggggcccgagtattgggaaga

SEQ ID NO: 78471 - DNA, 26 bp, Artificial Sequence
  Description of Artificial Sequence: Synthetic oligonucleotide
aggaggggcccgagtattgggaagag

SEQ ID NO: 78472 - DNA, 25 bp, Artificial Sequence
  Description of Artificial Sequence: Synthetic oligonucleotide
ggaggggcccgagtattgggaagag

SEQ ID NO: 78473 - DNA, 26 bp, Artificial Sequence
  Description of Artificial Sequence: Synthetic oligonucleotide
gaggggcccgagtattgggaagagga

SEQ ID NO: 78474 - DNA, 27 bp, Artificial Sequence
  Description of Artificial Sequence: Synthetic oligonucleotide
aggggcccgagtattgggaagaggaga

SEQ ID NO: 78475 - DNA, 26 bp, Artificial Sequence
  Description of Artificial Sequence: Synthetic oligonucleotide
ggggcccgagtattgggaagaggaga

SEQ ID NO: 78476 - DNA, 27 bp, Artificial Sequence
  Description of Artificial Sequence: Synthetic oligonucleotide
gggcccgagtattgggaagaggagaca

SEQ ID NO: 78477 - DNA, 27 bp, Artificial Sequence
  Description of Artificial Sequence: Synthetic oligonucleotide
ggcccgagtattgggaagaggagacac

SEQ ID NO: 78478 - DNA, 27 bp, Artificial Sequence
  Description of Artificial Sequence: Synthetic oligonucleotide
gcccgagtattgggaagaggagacacg

SEQ ID NO: 78479 - DNA, 27 bp, Artificial Sequence
  Description of Artificial Sequence: Synthetic oligonucleotide
cccgagtattgggaagaggagacacgg

SEQ ID NO: 78480 - DNA, 29 bp, Artificial Sequence
  Description of Artificial Sequence: Synthetic oligonucleotide
ccgagtattgggaagaggagacacggaac

SEQ ID NO: 78481 - DNA, 30 bp, Artificial Sequence
  Description of Artificial Sequence: Synthetic oligonucleotide
cgagtattgggaagaggagacacggaacac

SEQ ID NO: 78482 - DNA, 25 bp, Artificial Sequence
  Description of Artificial Sequence: Synthetic oligonucleotide
atgaggggctgccagagcccctcat

SEQ ID NO: 78483 - DNA, 24 bp, Artificial Sequence
  Description of Artificial Sequence: Synthetic oligonucleotide
tgaggggctgccagagcccctcat

SEQ ID NO: 78484 - DNA, 23 bp, Artificial Sequence
  Description of Artificial Sequence: Synthetic oligonucleotide
gaggggctgccagagcccctcat

SEQ ID NO: 78485 - DNA, 23 bp, Artificial Sequence
  Description of Artificial Sequence: Synthetic oligonucleotide
aggggctgccagagcccctcatg

SEQ ID NO: 78486 - DNA, 22 bp, Artificial Sequence
  Description of Artificial Sequence: Synthetic oligonucleotide
ggggctgccagagcccctcatg

SEQ ID NO: 78487 - DNA, 23 bp, Artificial Sequence
  Description of Artificial Sequence: Synthetic oligonucleotide
gggctgccagagcccctcatgct

SEQ ID NO: 78488 - DNA, 24 bp, Artificial Sequence
  Description of Artificial Sequence: Synthetic oligonucleotide
ggctgccagagcccctcatgctga

SEQ ID NO: 78489 - DNA, 26 bp, Artificial Sequence
  Description of Artificial Sequence: Synthetic oligonucleotide
gctgccagagcccctcatgctgagat

SEQ ID NO: 78490 - DNA, 26 bp, Artificial Sequence
  Description of Artificial Sequence: Synthetic oligonucleotide
ctgccagagcccctcatgctgagatg

SEQ ID NO: 78491 - DNA, 27 bp, Artificial Sequence
  Description of Artificial Sequence: Synthetic oligonucleotide
tgccagagcccctcatgctgagatgga

SEQ ID NO: 78492 - DNA, 27 bp, Artificial Sequence
  Description of Artificial Sequence: Synthetic oligonucleotide
gccagagcccctcatgctgagatggaa

SEQ ID NO: 78493 - DNA, 27 bp, Artificial Sequence
  Description of Artificial Sequence: Synthetic oligonucleotide
ccagagcccctcatgctgagatggaag

SEQ ID NO: 78494 - DNA, 27 bp, Artificial Sequence
  Description of Artificial Sequence: Synthetic oligonucleotide
cagagcccctcatgctgagatggaagc

SEQ ID NO: 78495 - DNA, 28 bp, Artificial Sequence
  Description of Artificial Sequence: Synthetic oligonucleotide
agagcccctcatgctgagatggaagcag

SEQ ID NO: 78496 - DNA, 27 bp, Artificial Sequence
  Description of Artificial Sequence: Synthetic oligonucleotide
ccatgggctacgtggacgacacgcaat

SEQ ID NO: 78497 - DNA, 28 bp, Artificial Sequence
  Description of Artificial Sequence: Synthetic oligonucleotide
catgggctacgtggacgacacgcaattc

SEQ ID NO: 78498 - DNA, 28 bp, Artificial Sequence
  Description of Artificial Sequence: Synthetic oligonucleotide
atgggctacgtggacgacacgcaattcg

SEQ ID NO: 78499 - DNA, 27 bp, Artificial Sequence
  Description of Artificial Sequence: Synthetic oligonucleotide
cgcaattcgtgcggttcgacagcgact

SEQ ID NO: 78500 - DNA, 27 bp, Artificial Sequence
  Description of Artificial Sequence: Synthetic oligonucleotide
gcaattcgtgcggttcgacagcgactc

SEQ ID NO: 78501 - DNA, 27 bp, Artificial Sequence
  Description of Artificial Sequence: Synthetic oligonucleotide
caattcgtgcggttcgacagcgactcg

SEQ ID NO: 78502 - DNA, 27 bp, Artificial Sequence
  Description of Artificial Sequence: Synthetic oligonucleotide
aattcgtgcggttcgacagcgactcgg

SEQ ID NO: 78503 - DNA, 26 bp, Artificial Sequence
  Description of Artificial Sequence: Synthetic oligonucleotide
attcgtgcggttcgacagcgactcgg

SEQ ID NO: 78504 - DNA, 29 bp, Artificial Sequence
  Description of Artificial Sequence: Synthetic oligonucleotide
aaggattacctcgccctgaacgaggactg

SEQ ID NO: 78505 - DNA, 28 bp, Artificial Sequence
  Description of Artificial Sequence: Synthetic oligonucleotide
aggattacctcgccctgaacgaggactg

SEQ ID NO: 78506 - DNA, 27 bp, Artificial Sequence
  Description of Artificial Sequence: Synthetic oligonucleotide
ggattacctcgccctgaacgaggactg

SEQ ID NO: 78507 - DNA, 27 bp, Artificial Sequence
  Description of Artificial Sequence: Synthetic oligonucleotide
gattacctcgccctgaacgaggactgc

SEQ ID NO: 78508 - DNA, 27 bp, Artificial Sequence
  Description of Artificial Sequence: Synthetic oligonucleotide
attacctcgccctgaacgaggactgcg

SEQ ID NO: 78509 - DNA, 26 bp, Artificial Sequence
  Description of Artificial Sequence: Synthetic oligonucleotide
ttacctcgccctgaacgaggactgcg

SEQ ID NO: 78510 - DNA, 25 bp, Artificial Sequence
  Description of Artificial Sequence: Synthetic oligonucleotide
tacctcgccctgaacgaggactgcg

SEQ ID NO: 78511 - DNA, 24 bp, Artificial Sequence
  Description of Artificial Sequence: Synthetic oligonucleotide
acctcgccctgaacgaggactgcg

SEQ ID NO: 78512 - DNA, 23 bp, Artificial Sequence
  Description of Artificial Sequence: Synthetic oligonucleotide
cctcgccctgaacgaggactgcg

SEQ ID NO: 78513 - DNA, 24 bp, Artificial Sequence
  Description of Artificial Sequence: Synthetic oligonucleotide
ctcgccctgaacgaggactgcgct

SEQ ID NO: 78514 - DNA, 24 bp, Artificial Sequence
  Description of Artificial Sequence: Synthetic oligonucleotide
tcgccctgaacgaggactgcgctc

SEQ ID NO: 78515 - DNA, 23 bp, Artificial Sequence
  Description of Artificial Sequence: Synthetic oligonucleotide
cgccctgaacgaggactgcgctc

SEQ ID NO: 78516 - DNA, 24 bp, Artificial Sequence
  Description of Artificial Sequence: Synthetic oligonucleotide
gccctgaacgaggactgcgctcct

SEQ ID NO: 78517 - DNA, 24 bp, Artificial Sequence
  Description of Artificial Sequence: Synthetic oligonucleotide
ccctgaacgaggactgcgctcctg

SEQ ID NO: 78518 - DNA, 25 bp, Artificial Sequence
  Description of Artificial Sequence: Synthetic oligonucleotide
cctgaacgaggactgcgctcctgga

SEQ ID NO: 78519 - DNA, 25 bp, Artificial Sequence
  Description of Artificial Sequence: Synthetic oligonucleotide
ctgaacgaggactgcgctcctggac

SEQ ID NO: 78520 - DNA, 25 bp, Artificial Sequence
  Description of Artificial Sequence: Synthetic oligonucleotide
tgaacgaggactgcgctcctggacc

SEQ ID NO: 78521 - DNA, 24 bp, Artificial Sequence
  Description of Artificial Sequence: Synthetic oligonucleotide
gaacgaggactgcgctcctggacc

SEQ ID NO: 78522 - DNA, 24 bp, Artificial Sequence
  Description of Artificial Sequence: Synthetic oligonucleotide
aacgaggactgcgctcctggaccg

SEQ ID NO: 78523 - DNA, 23 bp, Artificial Sequence
  Description of Artificial Sequence: Synthetic oligonucleotide
acgaggactgcgctcctggaccg

SEQ ID NO: 78524 - DNA, 22 bp, Artificial Sequence
  Description of Artificial Sequence: Synthetic oligonucleotide
cgaggactgcgctcctggaccg

SEQ ID NO: 78525 - DNA, 23 bp, Artificial Sequence
  Description of Artificial Sequence: Synthetic oligonucleotide
gaggactgcgctcctggaccgca

SEQ ID NO: 78526 - DNA, 23 bp, Artificial Sequence
  Description of Artificial Sequence: Synthetic oligonucleotide
aggactgcgctcctggaccgcag

SEQ ID NO: 78527 - DNA, 22 bp, Artificial Sequence
  Description of Artificial Sequence: Synthetic oligonucleotide
ggactgcgctcctggaccgcag

SEQ ID NO: 78528 - DNA, 22 bp, Artificial Sequence
  Description of Artificial Sequence: Synthetic oligonucleotide
gactgcgctcctggaccgcagc

SEQ ID NO: 78529 - DNA, 22 bp, Artificial Sequence
  Description of Artificial Sequence: Synthetic oligonucleotide
actgcgctcctggaccgcagcg

SEQ ID NO: 78530 - DNA, 30 bp, Artificial Sequence
  Description of Artificial Sequence: Synthetic oligonucleotide
gtgccttctggagaggagcagagatacatg

SEQ ID NO: 78531 - DNA, 31 bp, Artificial Sequence
  Description of Artificial Sequence: Synthetic oligonucleotide
tgccttctggagaggagcagagatacatgtg

SEQ ID NO: 78532 - DNA, 30 bp, Artificial Sequence
  Description of Artificial Sequence: Synthetic oligonucleotide
gccttctggagaggagcagagatacatgtg

SEQ ID NO: 78533 - DNA, 30 bp, Artificial Sequence
  Description of Artificial Sequence: Synthetic oligonucleotide
ccttctggagaggagcagagatacatgtgc

SEQ ID NO: 78534 - DNA, 30 bp, Artificial Sequence
  Description of Artificial Sequence: Synthetic oligonucleotide
cttctggagaggagcagagatacatgtgcc

SEQ ID NO: 78535 - DNA, 32 bp, Artificial Sequence
  Description of Artificial Sequence: Synthetic oligonucleotide
ttctggagaggagcagagatacatgtgccatg

SEQ ID NO: 78536 - DNA, 31 bp, Artificial Sequence
  Description of Artificial Sequence: Synthetic oligonucleotide
tctggagaggagcagagatacatgtgccatg

SEQ ID NO: 78537 - DNA, 30 bp, Artificial Sequence
  Description of Artificial Sequence: Synthetic oligonucleotide
ctggagaggagcagagatacatgtgccatg

SEQ ID NO: 78538 - DNA, 31 bp, Artificial Sequence
  Description of Artificial Sequence: Synthetic oligonucleotide
tggagaggagcagagatacatgtgccatgtg

SEQ ID NO: 78539 - DNA, 30 bp, Artificial Sequence
  Description of Artificial Sequence: Synthetic oligonucleotide
ggagaggagcagagatacatgtgccatgtg

SEQ ID NO: 78540 - DNA, 30 bp, Artificial Sequence
  Description of Artificial Sequence: Synthetic oligonucleotide
gagaggagcagagatacatgtgccatgtgc

SEQ ID NO: 78541 - DNA, 31 bp, Artificial Sequence
  Description of Artificial Sequence: Synthetic oligonucleotide
agaggagcagagatacatgtgccatgtgcag

SEQ ID NO: 78542 - DNA, 30 bp, Artificial Sequence
  Description of Artificial Sequence: Synthetic oligonucleotide
gaggagcagagatacatgtgccatgtgcag

SEQ ID NO: 78543 - DNA, 30 bp, Artificial Sequence
  Description of Artificial Sequence: Synthetic oligonucleotide
aggagcagagatacatgtgccatgtgcagc

SEQ ID NO: 78544 - DNA, 29 bp, Artificial Sequence
  Description of Artificial Sequence: Synthetic oligonucleotide
ggagcagagatacatgtgccatgtgcagc

SEQ ID NO: 78545 - DNA, 31 bp, Artificial Sequence
  Description of Artificial Sequence: Synthetic oligonucleotide
gagcagagatacatgtgccatgtgcagcatg

SEQ ID NO: 78546 - DNA, 32 bp, Artificial Sequence
  Description of Artificial Sequence: Synthetic oligonucleotide
agcagagatacatgtgccatgtgcagcatgag

SEQ ID NO: 78547 - DNA, 31 bp, Artificial Sequence
  Description of Artificial Sequence: Synthetic oligonucleotide
gcagagatacatgtgccatgtgcagcatgag

SEQ ID NO: 78548 - DNA, 31 bp, Artificial Sequence
  Description of Artificial Sequence: Synthetic oligonucleotide
cagagatacatgtgccatgtgcagcatgagg

SEQ ID NO: 78549 - DNA, 31 bp, Artificial Sequence
  Description of Artificial Sequence: Synthetic oligonucleotide
agagatacatgtgccatgtgcagcatgaggg

SEQ ID NO: 78550 - DNA, 30 bp, Artificial Sequence
  Description of Artificial Sequence: Synthetic oligonucleotide
gagatacatgtgccatgtgcagcatgaggg

SEQ ID NO: 78551 - DNA, 30 bp, Artificial Sequence
  Description of Artificial Sequence: Synthetic oligonucleotide
agatacatgtgccatgtgcagcatgagggg

SEQ ID NO: 78552 - DNA, 29 bp, Artificial Sequence
  Description of Artificial Sequence: Synthetic oligonucleotide
gatacatgtgccatgtgcagcatgagggg

SEQ ID NO: 78553 - DNA, 29 bp, Artificial Sequence
  Description of Artificial Sequence: Synthetic oligonucleotide
atacatgtgccatgtgcagcatgaggggc

SEQ ID NO: 78554 - DNA, 28 bp, Artificial Sequence
  Description of Artificial Sequence: Synthetic oligonucleotide
tacatgtgccatgtgcagcatgaggggc

SEQ ID NO: 78555 - DNA, 27 bp, Artificial Sequence
  Description of Artificial Sequence: Synthetic oligonucleotide
acatgtgccatgtgcagcatgaggggc

SEQ ID NO: 78556 - DNA, 27 bp, Artificial Sequence
  Description of Artificial Sequence: Synthetic oligonucleotide
catgtgccatgtgcagcatgaggggct

SEQ ID NO: 78557 - DNA, 27 bp, Artificial Sequence
  Description of Artificial Sequence: Synthetic oligonucleotide
atgtgccatgtgcagcatgaggggctg

SEQ ID NO: 78558 - DNA, 26 bp, Artificial Sequence
  Description of Artificial Sequence: Synthetic oligonucleotide
tgtgccatgtgcagcatgaggggctg

SEQ ID NO: 78559 - DNA, 28 bp, Artificial Sequence
  Description of Artificial Sequence: Synthetic oligonucleotide
catgaggtatttcagcgccgccgtgttc

SEQ ID NO: 78560 - DNA, 28 bp, Artificial Sequence
  Description of Artificial Sequence: Synthetic oligonucleotide
atgaggtatttcagcgccgccgtgttcc

SEQ ID NO: 78561 - DNA, 27 bp, Artificial Sequence
  Description of Artificial Sequence: Synthetic oligonucleotide
tgaggtatttcagcgccgccgtgttcc

SEQ ID NO: 78562 - DNA, 26 bp, Artificial Sequence
  Description of Artificial Sequence: Synthetic oligonucleotide
gaggtatttcagcgccgccgtgttcc

SEQ ID NO: 78563 - DNA, 26 bp, Artificial Sequence
  Description of Artificial Sequence: Synthetic oligonucleotide
aggtatttcagcgccgccgtgttccg

SEQ ID NO: 78564 - DNA, 25 bp, Artificial Sequence
  Description of Artificial Sequence: Synthetic oligonucleotide
ggtatttcagcgccgccgtgttccg

SEQ ID NO: 78565 - DNA, 25 bp, Artificial Sequence
  Description of Artificial Sequence: Synthetic oligonucleotide
gtatttcagcgccgccgtgttccgg

SEQ ID NO: 78566 - DNA, 25 bp, Artificial Sequence
  Description of Artificial Sequence: Synthetic oligonucleotide
tatttcagcgccgccgtgttccggc

SEQ ID NO: 78567 - DNA, 24 bp, Artificial Sequence
  Description of Artificial Sequence: Synthetic oligonucleotide
atttcagcgccgccgtgttccggc

SEQ ID NO: 78568 - DNA, 23 bp, Artificial Sequence
  Description of Artificial Sequence: Synthetic oligonucleotide
tttcagcgccgccgtgttccggc

SEQ ID NO: 78569 - DNA, 22 bp, Artificial Sequence
  Description of Artificial Sequence: Synthetic oligonucleotide
ttcagcgccgccgtgttccggc

SEQ ID NO: 78570 - DNA, 21 bp, Artificial Sequence
  Description of Artificial Sequence: Synthetic oligonucleotide
tcagcgccgccgtgttccggc

SEQ ID NO: 78571 - DNA, 20 bp, Artificial Sequence
  Description of Artificial Sequence: Synthetic oligonucleotide
cagcgccgccgtgttccggc

SEQ ID NO: 78572 - DNA, 20 bp, Artificial Sequence
  Description of Artificial Sequence: Synthetic oligonucleotide
agcgccgccgtgttccggcc

SEQ ID NO: 78573 - DNA, 20 bp, Artificial Sequence
  Description of Artificial Sequence: Synthetic oligonucleotide
gcgccgccgtgttccggcct

SEQ ID NO: 78574 - DNA, 20 bp, Artificial Sequence
  Description of Artificial Sequence: Synthetic oligonucleotide
cgccgccgtgttccggccct

SEQ ID NO: 78575 - DNA, 20 bp, Artificial Sequence
  Description of Artificial Sequence: Synthetic oligonucleotide
gccgccgtgttccggcccgt

SEQ ID NO: 78576 - DNA, 20 bp, Artificial Sequence
  Description of Artificial Sequence: Synthetic oligonucleotide
ccgccgtgttccggcccggt

SEQ ID NO: 78577 - DNA, 20 bp, Artificial Sequence
  Description of Artificial Sequence: Synthetic oligonucleotide
cgccgtgttccggcccggct

SEQ ID NO: 78578 - DNA, 20 bp, Artificial Sequence
  Description of Artificial Sequence: Synthetic oligonucleotide
gccgtgttccggcccggcct

SEQ ID NO: 78579 - DNA, 20 bp, Artificial Sequence
  Description of Artificial Sequence: Synthetic oligonucleotide
ccgtgttccggcccggccgt

SEQ ID NO: 78580 - DNA, 20 bp, Artificial Sequence
  Description of Artificial Sequence: Synthetic oligonucleotide
cgtgttccggcccggccgct

SEQ ID NO: 78581 - DNA, 20 bp, Artificial Sequence
  Description of Artificial Sequence: Synthetic oligonucleotide
gtgttccggcccggccgcgt

SEQ ID NO: 78582 - DNA, 28 bp, Artificial Sequence
  Description of Artificial Sequence: Synthetic oligonucleotide
ctgcggagatcatactgacctggcagtg

SEQ ID NO: 78583 - DNA, 28 bp, Artificial Sequence
  Description of Artificial Sequence: Synthetic oligonucleotide
tgcggagatcatactgacctggcagtgg

SEQ ID NO: 78584 - DNA, 27 bp, Artificial Sequence
  Description of Artificial Sequence: Synthetic oligonucleotide
gcggagatcatactgacctggcagtgg

SEQ ID NO: 78585 - DNA, 27 bp, Artificial Sequence
  Description of Artificial Sequence: Synthetic oligonucleotide
cggagatcatactgacctggcagtggg

SEQ ID NO: 78586 - DNA, 29 bp, Artificial Sequence
  Description of Artificial Sequence: Synthetic oligonucleotide
ggagatcatactgacctggcagtgggatg

SEQ ID NO: 78587 - DNA, 29 bp, Artificial Sequence
  Description of Artificial Sequence: Synthetic oligonucleotide
gagatcatactgacctggcagtgggatgg

SEQ ID NO: 78588 - DNA, 29 bp, Artificial Sequence
  Description of Artificial Sequence: Synthetic oligonucleotide
agatcatactgacctggcagtgggatggg

SEQ ID NO: 78589 - DNA, 28 bp, Artificial Sequence
  Description of Artificial Sequence: Synthetic oligonucleotide
gatcatactgacctggcagtgggatggg

SEQ ID NO: 78590 - DNA, 28 bp, Artificial Sequence
  Description of Artificial Sequence: Synthetic oligonucleotide
atcatactgacctggcagtgggatgggg

SEQ ID NO: 78591 - DNA, 27 bp, Artificial Sequence
  Description of Artificial Sequence: Synthetic oligonucleotide
tcatactgacctggcagtgggatgggg

SEQ ID NO: 78592 - DNA, 27 bp, Artificial Sequence
  Description of Artificial Sequence: Synthetic oligonucleotide
catactgacctggcagtgggatgggga

SEQ ID NO: 78593 - DNA, 27 bp, Artificial Sequence
  Description of Artificial Sequence: Synthetic oligonucleotide
atactgacctggcagtgggatggggag

SEQ ID NO: 78594 - DNA, 26 bp, Artificial Sequence
  Description of Artificial Sequence: Synthetic oligonucleotide
tactgacctggcagtgggatggggag

SEQ ID NO: 78595 - DNA, 35 bp, Artificial Sequence
  Description of Artificial Sequence: Synthetic oligonucleotide
tgtgctgtggaggaagaagagctcagattgaaaag

SEQ ID NO: 78596 - DNA, 34 bp, Artificial Sequence
  Description of Artificial Sequence: Synthetic oligonucleotide
gtgctgtggaggaagaagagctcagattgaaaag

SEQ ID NO: 78597 - DNA, 34 bp, Artificial Sequence
  Description of Artificial Sequence: Synthetic oligonucleotide
tgctgtggaggaagaagagctcagattgaaaagg

SEQ ID NO: 78598 - DNA, 33 bp, Artificial Sequence
  Description of Artificial Sequence: Synthetic oligonucleotide
gctgtggaggaagaagagctcagattgaaaagg

SEQ ID NO: 78599 - DNA, 34 bp, Artificial Sequence
  Description of Artificial Sequence: Synthetic oligonucleotide
ctgtggaggaagaagagctcagattgaaaaggag

SEQ ID NO: 78600 - DNA, 34 bp, Artificial Sequence
  Description of Artificial Sequence: Synthetic oligonucleotide
tgtggaggaagaagagctcagattgaaaaggagg

SEQ ID NO: 78601 - DNA, 33 bp, Artificial Sequence
  Description of Artificial Sequence: Synthetic oligonucleotide
gtggaggaagaagagctcagattgaaaaggagg

SEQ ID NO: 78602 - DNA, 33 bp, Artificial Sequence
  Description of Artificial Sequence: Synthetic oligonucleotide
tggaggaagaagagctcagattgaaaaggaggg

SEQ ID NO: 78603 - DNA, 32 bp, Artificial Sequence
  Description of Artificial Sequence: Synthetic oligonucleotide
ggaggaagaagagctcagattgaaaaggaggg

SEQ ID NO: 78604 - DNA, 33 bp, Artificial Sequence
  Description of Artificial Sequence: Synthetic oligonucleotide
gaggaagaagagctcagattgaaaaggagggag

SEQ ID NO: 78605 - DNA, 33 bp, Artificial Sequence
  Description of Artificial Sequence: Synthetic oligonucleotide
aggaagaagagctcagattgaaaaggagggagc

SEQ ID NO: 78606 - DNA, 32 bp, Artificial Sequence
  Description of Artificial Sequence: Synthetic oligonucleotide
ggaagaagagctcagattgaaaaggagggagc

SEQ ID NO: 78607 - DNA, 34 bp, Artificial Sequence
  Description of Artificial Sequence: Synthetic oligonucleotide
gaagaagagctcagattgaaaaggagggagctac

SEQ ID NO: 78608 - DNA, 35 bp, Artificial Sequence
  Description of Artificial Sequence: Synthetic oligonucleotide
aagaagagctcagattgaaaaggagggagctactc

SEQ ID NO: 78609 - DNA, 34 bp, Artificial Sequence
  Description of Artificial Sequence: Synthetic oligonucleotide
agaagagctcagattgaaaaggagggagctactc

SEQ ID NO: 78610 - DNA, 33 bp, Artificial Sequence
  Description of Artificial Sequence: Synthetic oligonucleotide
gaagagctcagattgaaaaggagggagctactc

SEQ ID NO: 78611 - DNA, 34 bp, Artificial Sequence
  Description of Artificial Sequence: Synthetic oligonucleotide
aagagctcagattgaaaaggagggagctactctc

SEQ ID NO: 78612 - DNA, 33 bp, Artificial Sequence
  Description of Artificial Sequence: Synthetic oligonucleotide
agagctcagattgaaaaggagggagctactctc

SEQ ID NO: 78613 - DNA, 32 bp, Artificial Sequence
  Description of Artificial Sequence: Synthetic oligonucleotide
gagctcagattgaaaaggagggagctactctc

SEQ ID NO: 78614 - DNA, 33 bp, Artificial Sequence
  Description of Artificial Sequence: Synthetic oligonucleotide
agctcagattgaaaaggagggagctactctcag

SEQ ID NO: 78615 - DNA, 32 bp, Artificial Sequence
  Description of Artificial Sequence: Synthetic oligonucleotide
gctcagattgaaaaggagggagctactctcag

SEQ ID NO: 78616 - DNA, 32 bp, Artificial Sequence
  Description of Artificial Sequence: Synthetic oligonucleotide
ctcagattgaaaaggagggagctactctcagg

SEQ ID NO: 78617 - DNA, 32 bp, Artificial Sequence
  Description of Artificial Sequence: Synthetic oligonucleotide
tcagattgaaaaggagggagctactctcaggc

SEQ ID NO: 78618 - DNA, 31 bp, Artificial Sequence
  Description of Artificial Sequence: Synthetic oligonucleotide
cagattgaaaaggagggagctactctcaggc

SEQ ID NO: 78619 - DNA, 32 bp, Artificial Sequence
  Description of Artificial Sequence: Synthetic oligonucleotide
agattgaaaaggagggagctactctcaggctg

SEQ ID NO: 78620 - DNA, 31 bp, Artificial Sequence
  Description of Artificial Sequence: Synthetic oligonucleotide
gattgaaaaggagggagctactctcaggctg

SEQ ID NO: 78621 - DNA, 31 bp, Artificial Sequence
  Description of Artificial Sequence: Synthetic oligonucleotide
attgaaaaggagggagctactctcaggctgc

SEQ ID NO: 78622 - DNA, 30 bp, Artificial Sequence
  Description of Artificial Sequence: Synthetic oligonucleotide
ttgaaaaggagggagctactctcaggctgc

SEQ ID NO: 78623 - DNA, 29 bp, Artificial Sequence
  Description of Artificial Sequence: Synthetic oligonucleotide
tgaaaaggagggagctactctcaggctgc

SEQ ID NO: 78624 - DNA, 27 bp, Artificial Sequence
  Description of Artificial Sequence: Synthetic oligonucleotide
caagcagtgacagtgcccagggctcta

SEQ ID NO: 78625 - DNA, 29 bp, Artificial Sequence
  Description of Artificial Sequence: Synthetic oligonucleotide
aagcagtgacagtgcccagggctctaatg

SEQ ID NO: 78626 - DNA, 28 bp, Artificial Sequence
  Description of Artificial Sequence: Synthetic oligonucleotide
agcagtgacagtgcccagggctctaatg

SEQ ID NO: 78627 - DNA, 27 bp, Artificial Sequence
  Description of Artificial Sequence: Synthetic oligonucleotide
gcagtgacagtgcccagggctctaatg

SEQ ID NO: 78628 - DNA, 28 bp, Artificial Sequence
  Description of Artificial Sequence: Synthetic oligonucleotide
cagtgacagtgcccagggctctaatgtg

SEQ ID NO: 78629 - DNA, 29 bp, Artificial Sequence
  Description of Artificial Sequence: Synthetic oligonucleotide
agtgacagtgcccagggctctaatgtgtc

SEQ ID NO: 78630 - DNA, 28 bp, Artificial Sequence
  Description of Artificial Sequence: Synthetic oligonucleotide
gtgacagtgcccagggctctaatgtgtc

SEQ ID NO: 78631 - DNA, 29 bp, Artificial Sequence
  Description of Artificial Sequence: Synthetic oligonucleotide
tgacagtgcccagggctctaatgtgtctc

SEQ ID NO: 78632 - DNA, 28 bp, Artificial Sequence
  Description of Artificial Sequence: Synthetic oligonucleotide
gacagtgcccagggctctaatgtgtctc

SEQ ID NO: 78633 - DNA, 29 bp, Artificial Sequence
  Description of Artificial Sequence: Synthetic oligonucleotide
acagtgcccagggctctaatgtgtctctc

SEQ ID NO: 78634 - DNA, 28 bp, Artificial Sequence
  Description of Artificial Sequence: Synthetic oligonucleotide
cagtgcccagggctctaatgtgtctctc

SEQ ID NO: 78635 - DNA, 29 bp, Artificial Sequence
  Description of Artificial Sequence: Synthetic oligonucleotide
agtgcccagggctctaatgtgtctctcac

SEQ ID NO: 78636 - DNA, 28 bp, Artificial Sequence
  Description of Artificial Sequence: Synthetic oligonucleotide
gtgcccagggctctaatgtgtctctcac

SEQ ID NO: 78637 - DNA, 28 bp, Artificial Sequence
  Description of Artificial Sequence: Synthetic oligonucleotide
tgcccagggctctaatgtgtctctcacg

SEQ ID NO: 78638 - DNA, 27 bp, Artificial Sequence
  Description of Artificial Sequence: Synthetic oligonucleotide
gcccagggctctaatgtgtctctcacg

SEQ ID NO: 78639 - DNA, 27 bp, Artificial Sequence
  Description of Artificial Sequence: Synthetic oligonucleotide
cccagggctctaatgtgtctctcacgg

SEQ ID NO: 78640 - DNA, 27 bp, Artificial Sequence
  Description of Artificial Sequence: Synthetic oligonucleotide
ccagggctctaatgtgtctctcacggc

SEQ ID NO: 78641 - DNA, 29 bp, Artificial Sequence
  Description of Artificial Sequence: Synthetic oligonucleotide
cagggctctaatgtgtctctcacggcttg

SEQ ID NO: 78642 - DNA, 28 bp, Artificial Sequence
  Description of Artificial Sequence: Synthetic oligonucleotide
gccaatgtggctgaacaaaggagagccc

SEQ ID NO: 78643 - DNA, 29 bp, Artificial Sequence
  Description of Artificial Sequence: Synthetic oligonucleotide
ccaatgtggctgaacaaaggagagcccac

SEQ ID NO: 78644 - DNA, 29 bp, Artificial Sequence
  Description of Artificial Sequence: Synthetic oligonucleotide
caatgtggctgaacaaaggagagcccacc

SEQ ID NO: 78645 - DNA, 30 bp, Artificial Sequence
  Description of Artificial Sequence: Synthetic oligonucleotide
aatgtggctgaacaaaggagagcccacctg

SEQ ID NO: 78646 - DNA, 29 bp, Artificial Sequence
  Description of Artificial Sequence: Synthetic oligonucleotide
atgtggctgaacaaaggagagcccacctg

SEQ ID NO: 78647 - DNA, 28 bp, Artificial Sequence
  Description of Artificial Sequence: Synthetic oligonucleotide
tgtggctgaacaaaggagagcccacctg

SEQ ID NO: 78648 - DNA, 27 bp, Artificial Sequence
  Description of Artificial Sequence: Synthetic oligonucleotide
gtggctgaacaaaggagagcccacctg

SEQ ID NO: 78649 - DNA, 27 bp, Artificial Sequence
  Description of Artificial Sequence: Synthetic oligonucleotide
tggctgaacaaaggagagcccacctgg

SEQ ID NO: 78650 - DNA, 27 bp, Artificial Sequence
  Description of Artificial Sequence: Synthetic oligonucleotide
ggctgaacaaaggagagcccacctgga

SEQ ID NO: 78651 - DNA, 27 bp, Artificial Sequence
  Description of Artificial Sequence: Synthetic oligonucleotide
gctgaacaaaggagagcccacctggag

SEQ ID NO: 78652 - DNA, 27 bp, Artificial Sequence
  Description of Artificial Sequence: Synthetic oligonucleotide
ctgaacaaaggagagcccacctggagg

SEQ ID NO: 78653 - DNA, 27 bp, Artificial Sequence
  Description of Artificial Sequence: Synthetic oligonucleotide
tgaacaaaggagagcccacctggaggg

SEQ ID NO: 78654 - DNA, 26 bp, Artificial Sequence
  Description of Artificial Sequence: Synthetic oligonucleotide
gaacaaaggagagcccacctggaggg

SEQ ID NO: 78655 - DNA, 27 bp, Artificial Sequence
  Description of Artificial Sequence: Synthetic oligonucleotide
aacaaaggagagcccacctggagggca

SEQ ID NO: 78656 - DNA, 26 bp, Artificial Sequence
  Description of Artificial Sequence: Synthetic oligonucleotide
acaaaggagagcccacctggagggca

SEQ ID NO: 78657 - DNA, 25 bp, Artificial Sequence
  Description of Artificial Sequence: Synthetic oligonucleotide
caaaggagagcccacctggagggca

SEQ ID NO: 78658 - DNA, 25 bp, Artificial Sequence
  Description of Artificial Sequence: Synthetic oligonucleotide
aaaggagagcccacctggagggcac

SEQ ID NO: 78659 - DNA, 24 bp, Artificial Sequence
  Description of Artificial Sequence: Synthetic oligonucleotide
aaggagagcccacctggagggcac

SEQ ID NO: 78660 - DNA, 23 bp, Artificial Sequence
  Description of Artificial Sequence: Synthetic oligonucleotide
aggagagcccacctggagggcac

SEQ ID NO: 78661 - DNA, 27 bp, Artificial Sequence
  Description of Artificial Sequence: Synthetic oligonucleotide
catcgccatgggctacgtggacgacat

SEQ ID NO: 78662 - DNA, 27 bp, Artificial Sequence
  Description of Artificial Sequence: Synthetic oligonucleotide
atcgccatgggctacgtggacgacatg

SEQ ID NO: 78663 - DNA, 26 bp, Artificial Sequence
  Description of Artificial Sequence: Synthetic oligonucleotide
tcgccatgggctacgtggacgacatg

SEQ ID NO: 78664 - DNA, 25 bp, Artificial Sequence
  Description of Artificial Sequence: Synthetic oligonucleotide
cgccatgggctacgtggacgacatg

SEQ ID NO: 78665 - DNA, 26 bp, Artificial Sequence
  Description of Artificial Sequence: Synthetic oligonucleotide
gccatgggctacgtggacgacatgca

SEQ ID NO: 78666 - DNA, 27 bp, Artificial Sequence
  Description of Artificial Sequence: Synthetic oligonucleotide
ccatgggctacgtggacgacatgcagt

SEQ ID NO: 78667 - DNA, 28 bp, Artificial Sequence
  Description of Artificial Sequence: Synthetic oligonucleotide
catgggctacgtggacgacatgcagttc

SEQ ID NO: 78668 - DNA, 28 bp, Artificial Sequence
  Description of Artificial Sequence: Synthetic oligonucleotide
atgggctacgtggacgacatgcagttcg

SEQ ID NO: 78669 - DNA, 27 bp, Artificial Sequence
  Description of Artificial Sequence: Synthetic oligonucleotide
tgcagttcgtgcggttcgacagcgact

SEQ ID NO: 78670 - DNA, 23 bp, Artificial Sequence
  Description of Artificial Sequence: Synthetic oligonucleotide
agccccgcttcatcgccatgggc

SEQ ID NO: 78671 - DNA, 22 bp, Artificial Sequence
  Description of Artificial Sequence: Synthetic oligonucleotide
gccccgcttcatcgccatgggc

SEQ ID NO: 78672 - DNA, 23 bp, Artificial Sequence
  Description of Artificial Sequence: Synthetic oligonucleotide
ccccgcttcatcgccatgggcca

SEQ ID NO: 78673 - DNA, 23 bp, Artificial Sequence
  Description of Artificial Sequence: Synthetic oligonucleotide
cccgcttcatcgccatgggccac

SEQ ID NO: 78674 - DNA, 24 bp, Artificial Sequence
  Description of Artificial Sequence: Synthetic oligonucleotide
ccgcttcatcgccatgggccacgt

SEQ ID NO: 78675 - DNA, 24 bp, Artificial Sequence
  Description of Artificial Sequence: Synthetic oligonucleotide
cgcttcatcgccatgggccacgtg

SEQ ID NO: 78676 - DNA, 25 bp, Artificial Sequence
  Description of Artificial Sequence: Synthetic oligonucleotide
gcttcatcgccatgggccacgtgga

SEQ ID NO: 78677 - DNA, 25 bp, Artificial Sequence
  Description of Artificial Sequence: Synthetic oligonucleotide
cttcatcgccatgggccacgtggac

SEQ ID NO: 78678 - DNA, 26 bp, Artificial Sequence
  Description of Artificial Sequence: Synthetic oligonucleotide
ttcatcgccatgggccacgtggacga

SEQ ID NO: 78679 - DNA, 25 bp, Artificial Sequence
  Description of Artificial Sequence: Synthetic oligonucleotide
tcatcgccatgggccacgtggacga

SEQ ID NO: 78680 - DNA, 24 bp, Artificial Sequence
  Description of Artificial Sequence: Synthetic oligonucleotide
catcgccatgggccacgtggacga

SEQ ID NO: 78681 - DNA, 25 bp, Artificial Sequence
  Description of Artificial Sequence: Synthetic oligonucleotide
atcgccatgggccacgtggacgaca

SEQ ID NO: 78682 - DNA, 24 bp, Artificial Sequence
  Description of Artificial Sequence: Synthetic oligonucleotide
tcgccatgggccacgtggacgaca

SEQ ID NO: 78683 - DNA, 23 bp, Artificial Sequence
  Description of Artificial Sequence: Synthetic oligonucleotide
cgccatgggccacgtggacgaca

SEQ ID NO: 78684 - DNA, 23 bp, Artificial Sequence
  Description of Artificial Sequence: Synthetic oligonucleotide
gccatgggccacgtggacgacac

SEQ ID NO: 78685 - DNA, 23 bp, Artificial Sequence
  Description of Artificial Sequence: Synthetic oligonucleotide
ccatgggccacgtggacgacacg

SEQ ID NO: 78686 - DNA, 24 bp, Artificial Sequence
  Description of Artificial Sequence: Synthetic oligonucleotide
catgggccacgtggacgacacgca

SEQ ID NO: 78687 - DNA, 26 bp, Artificial Sequence
  Description of Artificial Sequence: Synthetic oligonucleotide
atgggccacgtggacgacacgcagtt

SEQ ID NO: 78688 - DNA, 21 bp, Artificial Sequence
  Description of Artificial Sequence: Synthetic oligonucleotide
gcgggcgccgtgggtggagta

SEQ ID NO: 78689 - DNA, 21 bp, Artificial Sequence
  Description of Artificial Sequence: Synthetic oligonucleotide
cgggcgccgtgggtggagtag

SEQ ID NO: 78690 - DNA, 22 bp, Artificial Sequence
  Description of Artificial Sequence: Synthetic oligonucleotide
gggcgccgtgggtggagtagga

SEQ ID NO: 78691 - DNA, 22 bp, Artificial Sequence
  Description of Artificial Sequence: Synthetic oligonucleotide
ggcgccgtgggtggagtaggag

SEQ ID NO: 78692 - DNA, 22 bp, Artificial Sequence
  Description of Artificial Sequence: Synthetic oligonucleotide
gcgccgtgggtggagtaggagg

SEQ ID NO: 78693 - DNA, 22 bp, Artificial Sequence
  Description of Artificial Sequence: Synthetic oligonucleotide
cgccgtgggtggagtaggaggg

SEQ ID NO: 78694 - DNA, 22 bp, Artificial Sequence
  Description of Artificial Sequence: Synthetic oligonucleotide
gccgtgggtggagtaggagggg

SEQ ID NO: 78695 - DNA, 22 bp, Artificial Sequence
  Description of Artificial Sequence: Synthetic oligonucleotide
ccgtgggtggagtaggaggggc

SEQ ID NO: 78696 - DNA, 23 bp, Artificial Sequence
  Description of Artificial Sequence: Synthetic oligonucleotide
cgtgggtggagtaggaggggcca

SEQ ID NO: 78697 - DNA, 24 bp, Artificial Sequence
  Description of Artificial Sequence: Synthetic oligonucleotide
gtgggtggagtaggaggggccaga

SEQ ID NO: 78698 - DNA, 27 bp, Artificial Sequence
  Description of Artificial Sequence: Synthetic oligonucleotide
tgggtggagtaggaggggccagagtat

SEQ ID NO: 78699 - DNA, 27 bp, Artificial Sequence
  Description of Artificial Sequence: Synthetic oligonucleotide
gggtggagtaggaggggccagagtatt

SEQ ID NO: 78700 - DNA, 27 bp, Artificial Sequence
  Description of Artificial Sequence: Synthetic oligonucleotide
ggtggagtaggaggggccagagtattg

SEQ ID NO: 78701 - DNA, 27 bp, Artificial Sequence
  Description of Artificial Sequence: Synthetic oligonucleotide
gtggagtaggaggggccagagtattgg

SEQ ID NO: 78702 - DNA, 27 bp, Artificial Sequence
  Description of Artificial Sequence: Synthetic oligonucleotide
tggagtaggaggggccagagtattggg

SEQ ID NO: 78703 - DNA, 27 bp, Artificial Sequence
  Description of Artificial Sequence: Synthetic oligonucleotide
ggagtaggaggggccagagtattggga

SEQ ID NO: 78704 - DNA, 28 bp, Artificial Sequence
  Description of Artificial Sequence: Synthetic oligonucleotide
gagtaggaggggccagagtattgggaag

SEQ ID NO: 78705 - DNA, 29 bp, Artificial Sequence
  Description of Artificial Sequence: Synthetic oligonucleotide
agtaggaggggccagagtattgggaagag

SEQ ID NO: 78706 - DNA, 28 bp, Artificial Sequence
  Description of Artificial Sequence: Synthetic oligonucleotide
gtaggaggggccagagtattgggaagag

SEQ ID NO: 78707 - DNA, 28 bp, Artificial Sequence
  Description of Artificial Sequence: Synthetic oligonucleotide
taggaggggccagagtattgggaagagg

SEQ ID NO: 78708 - DNA, 31 bp, Artificial Sequence
  Description of Artificial Sequence: Synthetic oligonucleotide
cagttctcacaccctccagtggatgattgac

SEQ ID NO: 78709 - DNA, 32 bp, Artificial Sequence
  Description of Artificial Sequence: Synthetic oligonucleotide
agttctcacaccctccagtggatgattgactg

SEQ ID NO: 78710 - DNA, 31 bp, Artificial Sequence
  Description of Artificial Sequence: Synthetic oligonucleotide
gttctcacaccctccagtggatgattgactg

SEQ ID NO: 78711 - DNA, 31 bp, Artificial Sequence
  Description of Artificial Sequence: Synthetic oligonucleotide
ttctcacaccctccagtggatgattgactgc

SEQ ID NO: 78712 - DNA, 30 bp, Artificial Sequence
  Description of Artificial Sequence: Synthetic oligonucleotide
tctcacaccctccagtggatgattgactgc

SEQ ID NO: 78713 - DNA, 29 bp, Artificial Sequence
  Description of Artificial Sequence: Synthetic oligonucleotide
ctcacaccctccagtggatgattgactgc

SEQ ID NO: 78714 - DNA, 29 bp, Artificial Sequence
  Description of Artificial Sequence: Synthetic oligonucleotide
tcacaccctccagtggatgattgactgcg

SEQ ID NO: 78715 - DNA, 28 bp, Artificial Sequence
  Description of Artificial Sequence: Synthetic oligonucleotide
cacaccctccagtggatgattgactgcg

SEQ ID NO: 78716 - DNA, 29 bp, Artificial Sequence
  Description of Artificial Sequence: Synthetic oligonucleotide
acaccctccagtggatgattgactgcgac

SEQ ID NO: 78717 - DNA, 28 bp, Artificial Sequence
  Description of Artificial Sequence: Synthetic oligonucleotide
caccctccagtggatgattgactgcgac

SEQ ID NO: 78718 - DNA, 28 bp, Artificial Sequence
  Description of Artificial Sequence: Synthetic oligonucleotide
accctccagtggatgattgactgcgacc

SEQ ID NO: 78719 - DNA, 27 bp, Artificial Sequence
  Description of Artificial Sequence: Synthetic oligonucleotide
ccctccagtggatgattgactgcgacc

SEQ ID NO: 78720 - DNA, 28 bp, Artificial Sequence
  Description of Artificial Sequence: Synthetic oligonucleotide
cctccagtggatgattgactgcgacctg

SEQ ID NO: 78721 - DNA, 28 bp, Artificial Sequence
  Description of Artificial Sequence: Synthetic oligonucleotide
ctccagtggatgattgactgcgacctgg

SEQ ID NO: 78722 - DNA, 28 bp, Artificial Sequence
  Description of Artificial Sequence: Synthetic oligonucleotide
tccagtggatgattgactgcgacctggg

SEQ ID NO: 78723 - DNA, 27 bp, Artificial Sequence
  Description of Artificial Sequence: Synthetic oligonucleotide
ccagtggatgattgactgcgacctggg

SEQ ID NO: 78724 - DNA, 27 bp, Artificial Sequence
  Description of Artificial Sequence: Synthetic oligonucleotide
cagtggatgattgactgcgacctgggg

SEQ ID NO: 78725 - DNA, 28 bp, Artificial Sequence
  Description of Artificial Sequence: Synthetic oligonucleotide
agtggatgattgactgcgacctggggtc

SEQ ID NO: 78726 - DNA, 27 bp, Artificial Sequence
  Description of Artificial Sequence: Synthetic oligonucleotide
gtggatgattgactgcgacctggggtc

SEQ ID NO: 78727 - DNA, 27 bp, Artificial Sequence
  Description of Artificial Sequence: Synthetic oligonucleotide
tggatgattgactgcgacctggggtcc

SEQ ID NO: 78728 - DNA, 26 bp, Artificial Sequence
  Description of Artificial Sequence: Synthetic oligonucleotide
ggatgattgactgcgacctggggtcc

SEQ ID NO: 78729 - DNA, 27 bp, Artificial Sequence
  Description of Artificial Sequence: Synthetic oligonucleotide
gatgattgactgcgacctggggtccga

SEQ ID NO: 78730 - DNA, 27 bp, Artificial Sequence
  Description of Artificial Sequence: Synthetic oligonucleotide
atgattgactgcgacctggggtccgac

SEQ ID NO: 78731 - DNA, 26 bp, Artificial Sequence
  Description of Artificial Sequence: Synthetic oligonucleotide
tgattgactgcgacctggggtccgac

SEQ ID NO: 78732 - DNA, 25 bp, Artificial Sequence
  Description of Artificial Sequence: Synthetic oligonucleotide
gattgactgcgacctggggtccgac

SEQ ID NO: 78733 - DNA, 25 bp, Artificial Sequence
  Description of Artificial Sequence: Synthetic oligonucleotide
attgactgcgacctggggtccgacg

SEQ ID NO: 78734 - DNA, 24 bp, Artificial Sequence
  Description of Artificial Sequence: Synthetic oligonucleotide
ttgactgcgacctggggtccgacg

SEQ ID NO: 78735 - DNA, 23 bp, Artificial Sequence
  Description of Artificial Sequence: Synthetic oligonucleotide
tgactgcgacctggggtccgacg

SEQ ID NO: 78736 - DNA, 22 bp, Artificial Sequence
  Description of Artificial Sequence: Synthetic oligonucleotide
gactgcgacctggggtccgacg

SEQ ID NO: 78737 - DNA, 23 bp, Artificial Sequence
  Description of Artificial Sequence: Synthetic oligonucleotide
actgcgacctggggtccgacgga

SEQ ID NO: 78738 - DNA, 28 bp, Artificial Sequence
  Description of Artificial Sequence: Synthetic oligonucleotide
tgcggagatcatactgacctggcagcag

SEQ ID NO: 78739 - DNA, 27 bp, Artificial Sequence
  Description of Artificial Sequence: Synthetic oligonucleotide
gcggagatcatactgacctggcagcag

SEQ ID NO: 78740 - DNA, 27 bp, Artificial Sequence
  Description of Artificial Sequence: Synthetic oligonucleotide
cggagatcatactgacctggcagcagg

SEQ ID NO: 78741 - DNA, 29 bp, Artificial Sequence
  Description of Artificial Sequence: Synthetic oligonucleotide
ggagatcatactgacctggcagcaggatg

SEQ ID NO: 78742 - DNA, 29 bp, Artificial Sequence
  Description of Artificial Sequence: Synthetic oligonucleotide
gagatcatactgacctggcagcaggatgg

SEQ ID NO: 78743 - DNA, 29 bp, Artificial Sequence
  Description of Artificial Sequence: Synthetic oligonucleotide
agatcatactgacctggcagcaggatggg

SEQ ID NO: 78744 - DNA, 28 bp, Artificial Sequence
  Description of Artificial Sequence: Synthetic oligonucleotide
gatcatactgacctggcagcaggatggg

SEQ ID NO: 78745 - DNA, 28 bp, Artificial Sequence
  Description of Artificial Sequence: Synthetic oligonucleotide
atcatactgacctggcagcaggatgggg

SEQ ID NO: 78746 - DNA, 27 bp, Artificial Sequence
  Description of Artificial Sequence: Synthetic oligonucleotide
tcatactgacctggcagcaggatgggg

SEQ ID NO: 78747 - DNA, 27 bp, Artificial Sequence
  Description of Artificial Sequence: Synthetic oligonucleotide
catactgacctggcagcaggatgggga

SEQ ID NO: 78748 - DNA, 27 bp, Artificial Sequence
  Description of Artificial Sequence: Synthetic oligonucleotide
atactgacctggcagcaggatggggag

SEQ ID NO: 78749 - DNA, 26 bp, Artificial Sequence
  Description of Artificial Sequence: Synthetic oligonucleotide
tactgacctggcagcaggatggggag

SEQ ID NO: 78750 - DNA, 27 bp, Artificial Sequence
  Description of Artificial Sequence: Synthetic oligonucleotide
ccagtggatgattggctgcgacctggt

SEQ ID NO: 78751 - DNA, 27 bp, Artificial Sequence
  Description of Artificial Sequence: Synthetic oligonucleotide
cagtggatgattggctgcgacctggtg

SEQ ID NO: 78752 - DNA, 28 bp, Artificial Sequence
  Description of Artificial Sequence: Synthetic oligonucleotide
agtggatgattggctgcgacctggtgtc

SEQ ID NO: 78753 - DNA, 27 bp, Artificial Sequence
  Description of Artificial Sequence: Synthetic oligonucleotide
gtggatgattggctgcgacctggtgtc

SEQ ID NO: 78754 - DNA, 27 bp, Artificial Sequence
  Description of Artificial Sequence: Synthetic oligonucleotide
tggatgattggctgcgacctggtgtcc

SEQ ID NO: 78755 - DNA, 26 bp, Artificial Sequence
  Description of Artificial Sequence: Synthetic oligonucleotide
ggatgattggctgcgacctggtgtcc

SEQ ID NO: 78756 - DNA, 27 bp, Artificial Sequence
  Description of Artificial Sequence: Synthetic oligonucleotide
gatgattggctgcgacctggtgtccga

SEQ ID NO: 78757 - DNA, 27 bp, Artificial Sequence
  Description of Artificial Sequence: Synthetic oligonucleotide
atgattggctgcgacctggtgtccgac

SEQ ID NO: 78758 - DNA, 26 bp, Artificial Sequence
  Description of Artificial Sequence: Synthetic oligonucleotide
tgattggctgcgacctggtgtccgac

SEQ ID NO: 78759 - DNA, 25 bp, Artificial Sequence
  Description of Artificial Sequence: Synthetic oligonucleotide
gattggctgcgacctggtgtccgac

SEQ ID NO: 78760 - DNA, 25 bp, Artificial Sequence
  Description of Artificial Sequence: Synthetic oligonucleotide
attggctgcgacctggtgtccgacg

SEQ ID NO: 78761 - DNA, 24 bp, Artificial Sequence
  Description of Artificial Sequence: Synthetic oligonucleotide
ttggctgcgacctggtgtccgacg

SEQ ID NO: 78762 - DNA, 23 bp, Artificial Sequence
  Description of Artificial Sequence: Synthetic oligonucleotide
tggctgcgacctggtgtccgacg

SEQ ID NO: 78763 - DNA, 22 bp, Artificial Sequence
  Description of Artificial Sequence: Synthetic oligonucleotide
ggctgcgacctggtgtccgacg

SEQ ID NO: 78764 - DNA, 23 bp, Artificial Sequence
  Description of Artificial Sequence: Synthetic oligonucleotide
gctgcgacctggtgtccgacgga

SEQ ID NO: 78765 - DNA, 23 bp, Artificial Sequence
  Description of Artificial Sequence: Synthetic oligonucleotide
ctgcgacctggtgtccgacggac

SEQ ID NO: 78766 - DNA, 23 bp, Artificial Sequence
  Description of Artificial Sequence: Synthetic oligonucleotide
tgcgacctggtgtccgacggacg

SEQ ID NO: 78767 - DNA, 22 bp, Artificial Sequence
  Description of Artificial Sequence: Synthetic oligonucleotide
gcgacctggtgtccgacggacg

SEQ ID NO: 78768 - DNA, 22 bp, Artificial Sequence
  Description of Artificial Sequence: Synthetic oligonucleotide
cgacctggtgtccgacggacgc

SEQ ID NO: 78769 - DNA, 23 bp, Artificial Sequence
  Description of Artificial Sequence: Synthetic oligonucleotide
gacctggtgtccgacggacgcct

SEQ ID NO: 78770 - DNA, 25 bp, Artificial Sequence
  Description of Artificial Sequence: Synthetic oligonucleotide
acctggtgtccgacggacgcctcat

SEQ ID NO: 78771 - DNA, 24 bp, Artificial Sequence
  Description of Artificial Sequence: Synthetic oligonucleotide
cctggtgtccgacggacgcctcat

SEQ ID NO: 78772 - DNA, 24 bp, Artificial Sequence
  Description of Artificial Sequence: Synthetic oligonucleotide
ctggtgtccgacggacgcctcatc

SEQ ID NO: 78773 - DNA, 24 bp, Artificial Sequence
  Description of Artificial Sequence: Synthetic oligonucleotide
tggtgtccgacggacgcctcatcc

SEQ ID NO: 78774 - DNA, 23 bp, Artificial Sequence
  Description of Artificial Sequence: Synthetic oligonucleotide
ggtgtccgacggacgcctcatcc

SEQ ID NO: 78775 - DNA, 23 bp, Artificial Sequence
  Description of Artificial Sequence: Synthetic oligonucleotide
gtgtccgacggacgcctcatccg

SEQ ID NO: 78776 - DNA, 23 bp, Artificial Sequence
  Description of Artificial Sequence: Synthetic oligonucleotide
tgtccgacggacgcctcatccgc

SEQ ID NO: 78777 - DNA, 26 bp, Artificial Sequence
  Description of Artificial Sequence: Synthetic oligonucleotide
tggatgattggctgcgacctggggtg

SEQ ID NO: 78778 - DNA, 25 bp, Artificial Sequence
  Description of Artificial Sequence: Synthetic oligonucleotide
ggatgattggctgcgacctggggtg

SEQ ID NO: 78779 - DNA, 25 bp, Artificial Sequence
  Description of Artificial Sequence: Synthetic oligonucleotide
gatgattggctgcgacctggggtgc

SEQ ID NO: 78780 - DNA, 26 bp, Artificial Sequence
  Description of Artificial Sequence: Synthetic oligonucleotide
atgattggctgcgacctggggtgcga

SEQ ID NO: 78781 - DNA, 25 bp, Artificial Sequence
  Description of Artificial Sequence: Synthetic oligonucleotide
tgattggctgcgacctggggtgcga

SEQ ID NO: 78782 - DNA, 24 bp, Artificial Sequence
  Description of Artificial Sequence: Synthetic oligonucleotide
gattggctgcgacctggggtgcga

SEQ ID NO: 78783 - DNA, 24 bp, Artificial Sequence
  Description of Artificial Sequence: Synthetic oligonucleotide
attggctgcgacctggggtgcgac

SEQ ID NO: 78784 - DNA, 23 bp, Artificial Sequence
  Description of Artificial Sequence: Synthetic oligonucleotide
ttggctgcgacctggggtgcgac

SEQ ID NO: 78785 - DNA, 22 bp, Artificial Sequence
  Description of Artificial Sequence: Synthetic oligonucleotide
tggctgcgacctggggtgcgac

SEQ ID NO: 78786 - DNA, 21 bp, Artificial Sequence
  Description of Artificial Sequence: Synthetic oligonucleotide
ggctgcgacctggggtgcgac

SEQ ID NO: 78787 - DNA, 21 bp, Artificial Sequence
  Description of Artificial Sequence: Synthetic oligonucleotide
gctgcgacctggggtgcgacg

SEQ ID NO: 78788 - DNA, 22 bp, Artificial Sequence
  Description of Artificial Sequence: Synthetic oligonucleotide
ctgcgacctggggtgcgacgga

SEQ ID NO: 78789 - DNA, 22 bp, Artificial Sequence
  Description of Artificial Sequence: Synthetic oligonucleotide
tgcgacctggggtgcgacggac

SEQ ID NO: 78790 - DNA, 21 bp, Artificial Sequence
  Description of Artificial Sequence: Synthetic oligonucleotide
gcgacctggggtgcgacggac

SEQ ID NO: 78791 - DNA, 21 bp, Artificial Sequence
  Description of Artificial Sequence: Synthetic oligonucleotide
cgacctggggtgcgacggacg

SEQ ID NO: 78792 - DNA, 21 bp, Artificial Sequence
  Description of Artificial Sequence: Synthetic oligonucleotide
gacctggggtgcgacggacgc

SEQ ID NO: 78793 - DNA, 22 bp, Artificial Sequence
  Description of Artificial Sequence: Synthetic oligonucleotide
acctggggtgcgacggacgcct

SEQ ID NO: 78794 - DNA, 21 bp, Artificial Sequence
  Description of Artificial Sequence: Synthetic oligonucleotide
cctggggtgcgacggacgcct

SEQ ID NO: 78795 - DNA, 21 bp, Artificial Sequence
  Description of Artificial Sequence: Synthetic oligonucleotide
ctggggtgcgacggacgcctc

SEQ ID NO: 78796 - DNA, 22 bp, Artificial Sequence
  Description of Artificial Sequence: Synthetic oligonucleotide
tggggtgcgacggacgcctcct

SEQ ID NO: 78797 - DNA, 21 bp, Artificial Sequence
  Description of Artificial Sequence: Synthetic oligonucleotide
ggggtgcgacggacgcctcct

SEQ ID NO: 78798 - DNA, 21 bp, Artificial Sequence
  Description of Artificial Sequence: Synthetic oligonucleotide
gggtgcgacggacgcctcctc

SEQ ID NO: 78799 - DNA, 21 bp, Artificial Sequence
  Description of Artificial Sequence: Synthetic oligonucleotide
ggtgcgacggacgcctcctcc

SEQ ID NO: 78800 - DNA, 21 bp, Artificial Sequence
  Description of Artificial Sequence: Synthetic oligonucleotide
gtgcgacggacgcctcctccg

SEQ ID NO: 78801 - DNA, 21 bp, Artificial Sequence
  Description of Artificial Sequence: Synthetic oligonucleotide
tgcgacggacgcctcctccgc

SEQ ID NO: 78802 - DNA, 20 bp, Artificial Sequence
  Description of Artificial Sequence: Synthetic oligonucleotide
gcgacggacgcctcctccgc

SEQ ID NO: 78803 - DNA, 28 bp, Artificial Sequence
  Description of Artificial Sequence: Synthetic oligonucleotide
cagacacctggagaacgggaaggagatg

SEQ ID NO: 78804 - DNA, 28 bp, Artificial Sequence
  Description of Artificial Sequence: Synthetic oligonucleotide
agacacctggagaacgggaaggagatgc

SEQ ID NO: 78805 - DNA, 27 bp, Artificial Sequence
  Description of Artificial Sequence: Synthetic oligonucleotide
gacacctggagaacgggaaggagatgc

SEQ ID NO: 78806 - DNA, 28 bp, Artificial Sequence
  Description of Artificial Sequence: Synthetic oligonucleotide
acacctggagaacgggaaggagatgctg

SEQ ID NO: 78807 - DNA, 27 bp, Artificial Sequence
  Description of Artificial Sequence: Synthetic oligonucleotide
cacctggagaacgggaaggagatgctg

SEQ ID NO: 78808 - DNA, 30 bp, Artificial Sequence
  Description of Artificial Sequence: Synthetic oligonucleotide
atgggtcatgaacagaaccaaggagctgcg

SEQ ID NO: 78809 - DNA, 29 bp, Artificial Sequence
  Description of Artificial Sequence: Synthetic oligonucleotide
tgggtcatgaacagaaccaaggagctgcg

SEQ ID NO: 78810 - DNA, 28 bp, Artificial Sequence
  Description of Artificial Sequence: Synthetic oligonucleotide
gggtcatgaacagaaccaaggagctgcg

SEQ ID NO: 78811 - DNA, 28 bp, Artificial Sequence
  Description of Artificial Sequence: Synthetic oligonucleotide
ggtcatgaacagaaccaaggagctgcgc

SEQ ID NO: 78812 - DNA, 29 bp, Artificial Sequence
  Description of Artificial Sequence: Synthetic oligonucleotide
gtcatgaacagaaccaaggagctgcgctg

SEQ ID NO: 78813 - DNA, 29 bp, Artificial Sequence
  Description of Artificial Sequence: Synthetic oligonucleotide
tcatgaacagaaccaaggagctgcgctgc

SEQ ID NO: 78814 - DNA, 28 bp, Artificial Sequence
  Description of Artificial Sequence: Synthetic oligonucleotide
catgaacagaaccaaggagctgcgctgc

SEQ ID NO: 78815 - DNA, 30 bp, Artificial Sequence
  Description of Artificial Sequence: Synthetic oligonucleotide
atgaacagaaccaaggagctgcgctgctac

SEQ ID NO: 78816 - DNA, 29 bp, Artificial Sequence
  Description of Artificial Sequence: Synthetic oligonucleotide
tgaacagaaccaaggagctgcgctgctac

SEQ ID NO: 78817 - DNA, 28 bp, Artificial Sequence
  Description of Artificial Sequence: Synthetic oligonucleotide
gaacagaaccaaggagctgcgctgctac

SEQ ID NO: 78818 - DNA, 29 bp, Artificial Sequence
  Description of Artificial Sequence: Synthetic oligonucleotide
aacagaaccaaggagctgcgctgctacag

SEQ ID NO: 78819 - DNA, 28 bp, Artificial Sequence
  Description of Artificial Sequence: Synthetic oligonucleotide
acagaaccaaggagctgcgctgctacag

SEQ ID NO: 78820 - DNA, 27 bp, Artificial Sequence
  Description of Artificial Sequence: Synthetic oligonucleotide
cagaaccaaggagctgcgctgctacag

SEQ ID NO: 78821 - DNA, 29 bp, Artificial Sequence
  Description of Artificial Sequence: Synthetic oligonucleotide
agaaccaaggagctgcgctgctacagatg

SEQ ID NO: 78822 - DNA, 28 bp, Artificial Sequence
  Description of Artificial Sequence: Synthetic oligonucleotide
gaaccaaggagctgcgctgctacagatg

SEQ ID NO: 78823 - DNA, 31 bp, Artificial Sequence
  Description of Artificial Sequence: Synthetic oligonucleotide
aaccaaggagctgcgctgctacagatgttac

SEQ ID NO: 78824 - DNA, 30 bp, Artificial Sequence
  Description of Artificial Sequence: Synthetic oligonucleotide
accaaggagctgcgctgctacagatgttac

SEQ ID NO: 78825 - DNA, 29 bp, Artificial Sequence
  Description of Artificial Sequence: Synthetic oligonucleotide
ccaaggagctgcgctgctacagatgttac

SEQ ID NO: 78826 - DNA, 29 bp, Artificial Sequence
  Description of Artificial Sequence: Synthetic oligonucleotide
caaggagctgcgctgctacagatgttacc

SEQ ID NO: 78827 - DNA, 30 bp, Artificial Sequence
  Description of Artificial Sequence: Synthetic oligonucleotide
aaggagctgcgctgctacagatgttaccac

SEQ ID NO: 78828 - DNA, 29 bp, Artificial Sequence
  Description of Artificial Sequence: Synthetic oligonucleotide
aggagctgcgctgctacagatgttaccac

SEQ ID NO: 78829 - DNA, 28 bp, Artificial Sequence
  Description of Artificial Sequence: Synthetic oligonucleotide
ggagctgcgctgctacagatgttaccac

SEQ ID NO: 78830 - DNA, 30 bp, Artificial Sequence
  Description of Artificial Sequence: Synthetic oligonucleotide
gagctgcgctgctacagatgttaccacttc

SEQ ID NO: 78831 - DNA, 31 bp, Artificial Sequence
  Description of Artificial Sequence: Synthetic oligonucleotide
agctgcgctgctacagatgttaccacttctg

SEQ ID NO: 78832 - DNA, 30 bp, Artificial Sequence
  Description of Artificial Sequence: Synthetic oligonucleotide
gctgcgctgctacagatgttaccacttctg

SEQ ID NO: 78833 - DNA, 31 bp, Artificial Sequence
  Description of Artificial Sequence: Synthetic oligonucleotide
ctgcgctgctacagatgttaccacttctgtg

SEQ ID NO: 78834 - DNA, 31 bp, Artificial Sequence
  Description of Artificial Sequence: Synthetic oligonucleotide
tgcgctgctacagatgttaccacttctgtgg

SEQ ID NO: 78835 - DNA, 30 bp, Artificial Sequence
  Description of Artificial Sequence: Synthetic oligonucleotide
gcgctgctacagatgttaccacttctgtgg

SEQ ID NO: 78836 - DNA, 30 bp, Artificial Sequence
  Description of Artificial Sequence: Synthetic oligonucleotide
cgctgctacagatgttaccacttctgtggc

SEQ ID NO: 78837 - DNA, 31 bp, Artificial Sequence
  Description of Artificial Sequence: Synthetic oligonucleotide
gctgctacagatgttaccacttctgtggctg

SEQ ID NO: 78838 - DNA, 31 bp, Artificial Sequence
  Description of Artificial Sequence: Synthetic oligonucleotide
ctgctacagatgttaccacttctgtggctgc

SEQ ID NO: 78839 - DNA, 33 bp, Artificial Sequence
  Description of Artificial Sequence: Synthetic oligonucleotide
tgctacagatgttaccacttctgtggctgctac

SEQ ID NO: 78840 - DNA, 32 bp, Artificial Sequence
  Description of Artificial Sequence: Synthetic oligonucleotide
gctacagatgttaccacttctgtggctgctac

SEQ ID NO: 78841 - DNA, 32 bp, Artificial Sequence
  Description of Artificial Sequence: Synthetic oligonucleotide
ctacagatgttaccacttctgtggctgctacc

SEQ ID NO: 78842 - DNA, 32 bp, Artificial Sequence
  Description of Artificial Sequence: Synthetic oligonucleotide
tacagatgttaccacttctgtggctgctaccc

SEQ ID NO: 78843 - DNA, 31 bp, Artificial Sequence
  Description of Artificial Sequence: Synthetic oligonucleotide
acagatgttaccacttctgtggctgctaccc

SEQ ID NO: 78844 - DNA, 30 bp, Artificial Sequence
  Description of Artificial Sequence: Synthetic oligonucleotide
cagatgttaccacttctgtggctgctaccc

SEQ ID NO: 78845 - DNA, 30 bp, Artificial Sequence
  Description of Artificial Sequence: Synthetic oligonucleotide
agatgttaccacttctgtggctgctacccc

SEQ ID NO: 78846 - DNA, 29 bp, Artificial Sequence
  Description of Artificial Sequence: Synthetic oligonucleotide
gatgttaccacttctgtggctgctacccc

SEQ ID NO: 78847 - DNA, 30 bp, Artificial Sequence
  Description of Artificial Sequence: Synthetic oligonucleotide
atgttaccacttctgtggctgctaccccac

SEQ ID NO: 78848 - DNA, 29 bp, Artificial Sequence
  Description of Artificial Sequence: Synthetic oligonucleotide
tgttaccacttctgtggctgctaccccac

SEQ ID NO: 78849 - DNA, 28 bp, Artificial Sequence
  Description of Artificial Sequence: Synthetic oligonucleotide
gttaccacttctgtggctgctaccccac

SEQ ID NO: 78850 - DNA, 29 bp, Artificial Sequence
  Description of Artificial Sequence: Synthetic oligonucleotide
ttaccacttctgtggctgctaccccactc

SEQ ID NO: 78851 - DNA, 28 bp, Artificial Sequence
  Description of Artificial Sequence: Synthetic oligonucleotide
taccacttctgtggctgctaccccactc

SEQ ID NO: 78852 - DNA, 27 bp, Artificial Sequence
  Description of Artificial Sequence: Synthetic oligonucleotide
accacttctgtggctgctaccccactc

SEQ ID NO: 78853 - DNA, 26 bp, Artificial Sequence
  Description of Artificial Sequence: Synthetic oligonucleotide
ccacttctgtggctgctaccccactc

SEQ ID NO: 78854 - DNA, 27 bp, Artificial Sequence
  Description of Artificial Sequence: Synthetic oligonucleotide
cacttctgtggctgctaccccactcct

SEQ ID NO: 78855 - DNA, 27 bp, Artificial Sequence
  Description of Artificial Sequence: Synthetic oligonucleotide
acttctgtggctgctaccccactcctg

SEQ ID NO: 78856 - DNA, 26 bp, Artificial Sequence
  Description of Artificial Sequence: Synthetic oligonucleotide
cttctgtggctgctaccccactcctg

SEQ ID NO: 78857 - DNA, 26 bp, Artificial Sequence
  Description of Artificial Sequence: Synthetic oligonucleotide
ttctgtggctgctaccccactcctgg

SEQ ID NO: 78858 - DNA, 25 bp, Artificial Sequence
  Description of Artificial Sequence: Synthetic oligonucleotide
tctgtggctgctaccccactcctgg

SEQ ID NO: 78859 - DNA, 24 bp, Artificial Sequence
  Description of Artificial Sequence: Synthetic oligonucleotide
ctgtggctgctaccccactcctgg

SEQ ID NO: 78860 - DNA, 24 bp, Artificial Sequence
  Description of Artificial Sequence: Synthetic oligonucleotide
tgtggctgctaccccactcctggg

SEQ ID NO: 78861 - DNA, 23 bp, Artificial Sequence
  Description of Artificial Sequence: Synthetic oligonucleotide
gtggctgctaccccactcctggg

SEQ ID NO: 78862 - DNA, 23 bp, Artificial Sequence
  Description of Artificial Sequence: Synthetic oligonucleotide
tggctgctaccccactcctgggc

SEQ ID NO: 78863 - DNA, 22 bp, Artificial Sequence
  Description of Artificial Sequence: Synthetic oligonucleotide
ggctgctaccccactcctgggc

SEQ ID NO: 78864 - DNA, 22 bp, Artificial Sequence
  Description of Artificial Sequence: Synthetic oligonucleotide
gctgctaccccactcctgggcc

SEQ ID NO: 78865 - DNA, 23 bp, Artificial Sequence
  Description of Artificial Sequence: Synthetic oligonucleotide
ctgctaccccactcctgggccgt

SEQ ID NO: 78866 - DNA, 23 bp, Artificial Sequence
  Description of Artificial Sequence: Synthetic oligonucleotide
tgctaccccactcctgggccgtc

SEQ ID NO: 78867 - DNA, 22 bp, Artificial Sequence
  Description of Artificial Sequence: Synthetic oligonucleotide
gctaccccactcctgggccgtc

SEQ ID NO: 78868 - DNA, 22 bp, Artificial Sequence
  Description of Artificial Sequence: Synthetic oligonucleotide
ctaccccactcctgggccgtcc

SEQ ID NO: 78869 - DNA, 23 bp, Artificial Sequence
  Description of Artificial Sequence: Synthetic oligonucleotide
taccccactcctgggccgtccct

SEQ ID NO: 78870 - DNA, 22 bp, Artificial Sequence
  Description of Artificial Sequence: Synthetic oligonucleotide
accccactcctgggccgtccct

SEQ ID NO: 78871 - DNA, 21 bp, Artificial Sequence
  Description of Artificial Sequence: Synthetic oligonucleotide
ccccactcctgggccgtccct

SEQ ID NO: 78872 - DNA, 23 bp, Artificial Sequence
  Description of Artificial Sequence: Synthetic oligonucleotide
cccactcctgggccgtccctgaa

SEQ ID NO: 78873 - DNA, 23 bp, Artificial Sequence
  Description of Artificial Sequence: Synthetic oligonucleotide
ccactcctgggccgtccctgaag

SEQ ID NO: 78874 - DNA, 24 bp, Artificial Sequence
  Description of Artificial Sequence: Synthetic oligonucleotide
cactcctgggccgtccctgaagct

SEQ ID NO: 78875 - DNA, 24 bp, Artificial Sequence
  Description of Artificial Sequence: Synthetic oligonucleotide
actcctgggccgtccctgaagctc

SEQ ID NO: 78876 - DNA, 23 bp, Artificial Sequence
  Description of Artificial Sequence: Synthetic oligonucleotide
ctcctgggccgtccctgaagctc

SEQ ID NO: 78877 - DNA, 25 bp, Artificial Sequence
  Description of Artificial Sequence: Synthetic oligonucleotide
tcctgggccgtccctgaagctccta

SEQ ID NO: 78878 - DNA, 24 bp, Artificial Sequence
  Description of Artificial Sequence: Synthetic oligonucleotide
cctgggccgtccctgaagctccta

SEQ ID NO: 78879 - DNA, 25 bp, Artificial Sequence
  Description of Artificial Sequence: Synthetic oligonucleotide
ctgggccgtccctgaagctcctact

SEQ ID NO: 78880 - DNA, 25 bp, Artificial Sequence
  Description of Artificial Sequence: Synthetic oligonucleotide
tgggccgtccctgaagctcctactc

SEQ ID NO: 78881 - DNA, 24 bp, Artificial Sequence
  Description of Artificial Sequence: Synthetic oligonucleotide
gggccgtccctgaagctcctactc

SEQ ID NO: 78882 - DNA, 27 bp, Artificial Sequence
  Description of Artificial Sequence: Synthetic oligonucleotide
ggccgtccctgaagctcctactccaat

SEQ ID NO: 78883 - DNA, 27 bp, Artificial Sequence
  Description of Artificial Sequence: Synthetic oligonucleotide
gccgtccctgaagctcctactccaatg

SEQ ID NO: 78884 - DNA, 28 bp, Artificial Sequence
  Description of Artificial Sequence: Synthetic oligonucleotide
ccgtccctgaagctcctactccaatgtg

SEQ ID NO: 78885 - DNA, 28 bp, Artificial Sequence
  Description of Artificial Sequence: Synthetic oligonucleotide
cgtccctgaagctcctactccaatgtgg

SEQ ID NO: 78886 - DNA, 28 bp, Artificial Sequence
  Description of Artificial Sequence: Synthetic oligonucleotide
gtccctgaagctcctactccaatgtggc

SEQ ID NO: 78887 - DNA, 28 bp, Artificial Sequence
  Description of Artificial Sequence: Synthetic oligonucleotide
tccctgaagctcctactccaatgtggcc

SEQ ID NO: 78888 - DNA, 27 bp, Artificial Sequence
  Description of Artificial Sequence: Synthetic oligonucleotide
ccctgaagctcctactccaatgtggcc

SEQ ID NO: 78889 - DNA, 28 bp, Artificial Sequence
  Description of Artificial Sequence: Synthetic oligonucleotide
cctgaagctcctactccaatgtggccag

SEQ ID NO: 78890 - DNA, 30 bp, Artificial Sequence
  Description of Artificial Sequence: Synthetic oligonucleotide
ctgaagctcctactccaatgtggccagatg

SEQ ID NO: 78891 - DNA, 31 bp, Artificial Sequence
  Description of Artificial Sequence: Synthetic oligonucleotide
tgaagctcctactccaatgtggccagatgac

SEQ ID NO: 78892 - DNA, 30 bp, Artificial Sequence
  Description of Artificial Sequence: Synthetic oligonucleotide
gaagctcctactccaatgtggccagatgac

SEQ ID NO: 78893 - DNA, 30 bp, Artificial Sequence
  Description of Artificial Sequence: Synthetic oligonucleotide
aagctcctactccaatgtggccagatgacc

SEQ ID NO: 78894 - DNA, 29 bp, Artificial Sequence
  Description of Artificial Sequence: Synthetic oligonucleotide
agctcctactccaatgtggccagatgacc

SEQ ID NO: 78895 - DNA, 28 bp, Artificial Sequence
  Description of Artificial Sequence: Synthetic oligonucleotide
gctcctactccaatgtggccagatgacc

SEQ ID NO: 78896 - DNA, 29 bp, Artificial Sequence
  Description of Artificial Sequence: Synthetic oligonucleotide
ctcctactccaatgtggccagatgacctg

SEQ ID NO: 78897 - DNA, 29 bp, Artificial Sequence
  Description of Artificial Sequence: Synthetic oligonucleotide
tcctactccaatgtggccagatgacctgc

SEQ ID NO: 78898 - DNA, 28 bp, Artificial Sequence
  Description of Artificial Sequence: Synthetic oligonucleotide
cctactccaatgtggccagatgacctgc

SEQ ID NO: 78899 - DNA, 32 bp, Artificial Sequence
  Description of Artificial Sequence: Synthetic oligonucleotide
ctactccaatgtggccagatgacctgcaaaac

SEQ ID NO: 78900 - DNA, 32 bp, Artificial Sequence
  Description of Artificial Sequence: Synthetic oligonucleotide
tactccaatgtggccagatgacctgcaaaacc

SEQ ID NO: 78901 - DNA, 31 bp, Artificial Sequence
  Description of Artificial Sequence: Synthetic oligonucleotide
actccaatgtggccagatgacctgcaaaacc

SEQ ID NO: 78902 - DNA, 30 bp, Artificial Sequence
  Description of Artificial Sequence: Synthetic oligonucleotide
ctccaatgtggccagatgacctgcaaaacc

SEQ ID NO: 78903 - DNA, 31 bp, Artificial Sequence
  Description of Artificial Sequence: Synthetic oligonucleotide
tccaatgtggccagatgacctgcaaaaccac

SEQ ID NO: 78904 - DNA, 30 bp, Artificial Sequence
  Description of Artificial Sequence: Synthetic oligonucleotide
ccaatgtggccagatgacctgcaaaaccac

SEQ ID NO: 78905 - DNA, 31 bp, Artificial Sequence
  Description of Artificial Sequence: Synthetic oligonucleotide
caatgtggccagatgacctgcaaaaccacac

SEQ ID NO: 78906 - DNA, 34 bp, Artificial Sequence
  Description of Artificial Sequence: Synthetic oligonucleotide
aatgtggccagatgacctgcaaaaccacacattc

SEQ ID NO: 78907 - DNA, 33 bp, Artificial Sequence
  Description of Artificial Sequence: Synthetic oligonucleotide
atgtggccagatgacctgcaaaaccacacattc

SEQ ID NO: 78908 - DNA, 32 bp, Artificial Sequence
  Description of Artificial Sequence: Synthetic oligonucleotide
tgtggccagatgacctgcaaaaccacacattc

SEQ ID NO: 78909 - DNA, 31 bp, Artificial Sequence
  Description of Artificial Sequence: Synthetic oligonucleotide
gtggccagatgacctgcaaaaccacacattc

SEQ ID NO: 78910 - DNA, 31 bp, Artificial Sequence
  Description of Artificial Sequence: Synthetic oligonucleotide
tggccagatgacctgcaaaaccacacattcc

SEQ ID NO: 78911 - DNA, 30 bp, Artificial Sequence
  Description of Artificial Sequence: Synthetic oligonucleotide
ggccagatgacctgcaaaaccacacattcc

SEQ ID NO: 78912 - DNA, 31 bp, Artificial Sequence
  Description of Artificial Sequence: Synthetic oligonucleotide
gccagatgacctgcaaaaccacacattcctg

SEQ ID NO: 78913 - DNA, 31 bp, Artificial Sequence
  Description of Artificial Sequence: Synthetic oligonucleotide
ccagatgacctgcaaaaccacacattcctgc

SEQ ID NO: 78914 - DNA, 32 bp, Artificial Sequence
  Description of Artificial Sequence: Synthetic oligonucleotide
cagatgacctgcaaaaccacacattcctgcac

SEQ ID NO: 78915 - DNA, 33 bp, Artificial Sequence
  Description of Artificial Sequence: Synthetic oligonucleotide
agatgacctgcaaaaccacacattcctgcacac

SEQ ID NO: 78916 - DNA, 32 bp, Artificial Sequence
  Description of Artificial Sequence: Synthetic oligonucleotide
gatgacctgcaaaaccacacattcctgcacac

SEQ ID NO: 78917 - DNA, 33 bp, Artificial Sequence
  Description of Artificial Sequence: Synthetic oligonucleotide
atgacctgcaaaaccacacattcctgcacacag

SEQ ID NO: 78918 - DNA, 32 bp, Artificial Sequence
  Description of Artificial Sequence: Synthetic oligonucleotide
tgacctgcaaaaccacacattcctgcacacag

SEQ ID NO: 78919 - DNA, 31 bp, Artificial Sequence
  Description of Artificial Sequence: Synthetic oligonucleotide
gacctgcaaaaccacacattcctgcacacag

SEQ ID NO: 78920 - DNA, 32 bp, Artificial Sequence
  Description of Artificial Sequence: Synthetic oligonucleotide
acctgcaaaaccacacattcctgcacacagtg

SEQ ID NO: 78921 - DNA, 31 bp, Artificial Sequence
  Description of Artificial Sequence: Synthetic oligonucleotide
cctgcaaaaccacacattcctgcacacagtg

SEQ ID NO: 78922 - DNA, 33 bp, Artificial Sequence
  Description of Artificial Sequence: Synthetic oligonucleotide
ctgcaaaaccacacattcctgcacacagtgtac

SEQ ID NO: 78923 - DNA, 34 bp, Artificial Sequence
  Description of Artificial Sequence: Synthetic oligonucleotide
tgcaaaaccacacattcctgcacacagtgtactg

SEQ ID NO: 78924 - DNA, 33 bp, Artificial Sequence
  Description of Artificial Sequence: Synthetic oligonucleotide
gcaaaaccacacattcctgcacacagtgtactg

SEQ ID NO: 78925 - DNA, 33 bp, Artificial Sequence
  Description of Artificial Sequence: Synthetic oligonucleotide
caaaaccacacattcctgcacacagtgtactgc

SEQ ID NO: 78926 - DNA, 33 bp, Artificial Sequence
  Description of Artificial Sequence: Synthetic oligonucleotide
aaaaccacacattcctgcacacagtgtactgcc

SEQ ID NO: 78927 - DNA, 32 bp, Artificial Sequence
  Description of Artificial Sequence: Synthetic oligonucleotide
aaaccacacattcctgcacacagtgtactgcc

SEQ ID NO: 78928 - DNA, 31 bp, Artificial Sequence
  Description of Artificial Sequence: Synthetic oligonucleotide
aaccacacattcctgcacacagtgtactgcc

SEQ ID NO: 78929 - DNA, 30 bp, Artificial Sequence
  Description of Artificial Sequence: Synthetic oligonucleotide
accacacattcctgcacacagtgtactgcc

SEQ ID NO: 78930 - DNA, 29 bp, Artificial Sequence
  Description of Artificial Sequence: Synthetic oligonucleotide
ccacacattcctgcacacagtgtactgcc

SEQ ID NO: 78931 - DNA, 30 bp, Artificial Sequence
  Description of Artificial Sequence: Synthetic oligonucleotide
cacacattcctgcacacagtgtactgccag

SEQ ID NO: 78932 - DNA, 30 bp, Artificial Sequence
  Description of Artificial Sequence: Synthetic oligonucleotide
acacattcctgcacacagtgtactgccagg

SEQ ID NO: 78933 - DNA, 29 bp, Artificial Sequence
  Description of Artificial Sequence: Synthetic oligonucleotide
cacattcctgcacacagtgtactgccagg

SEQ ID NO: 78934 - DNA, 31 bp, Artificial Sequence
  Description of Artificial Sequence: Synthetic oligonucleotide
acattcctgcacacagtgtactgccaggatg

SEQ ID NO: 78935 - DNA, 30 bp, Artificial Sequence
  Description of Artificial Sequence: Synthetic oligonucleotide
cattcctgcacacagtgtactgccaggatg

SEQ ID NO: 78936 - DNA, 30 bp, Artificial Sequence
  Description of Artificial Sequence: Synthetic oligonucleotide
attcctgcacacagtgtactgccaggatgg

SEQ ID NO: 78937 - DNA, 29 bp, Artificial Sequence
  Description of Artificial Sequence: Synthetic oligonucleotide
ttcctgcacacagtgtactgccaggatgg

SEQ ID NO: 78938 - DNA, 28 bp, Artificial Sequence
  Description of Artificial Sequence: Synthetic oligonucleotide
tcctgcacacagtgtactgccaggatgg

SEQ ID NO: 78939 - DNA, 27 bp, Artificial Sequence
  Description of Artificial Sequence: Synthetic oligonucleotide
cctgcacacagtgtactgccaggatgg

SEQ ID NO: 78940 - DNA, 27 bp, Artificial Sequence
  Description of Artificial Sequence: Synthetic oligonucleotide
ctgcacacagtgtactgccaggatggg

SEQ ID NO: 78941 - DNA, 28 bp, Artificial Sequence
  Description of Artificial Sequence: Synthetic oligonucleotide
tgcacacagtgtactgccaggatgggag

SEQ ID NO: 78942 - DNA, 27 bp, Artificial Sequence
  Description of Artificial Sequence: Synthetic oligonucleotide
gcacacagtgtactgccaggatgggag

SEQ ID NO: 78943 - DNA, 28 bp, Artificial Sequence
  Description of Artificial Sequence: Synthetic oligonucleotide
cacacagtgtactgccaggatgggagtc

SEQ ID NO: 78944 - DNA, 28 bp, Artificial Sequence
  Description of Artificial Sequence: Synthetic oligonucleotide
acacagtgtactgccaggatgggagtcc

SEQ ID NO: 78945 - DNA, 27 bp, Artificial Sequence
  Description of Artificial Sequence: Synthetic oligonucleotide
cacagtgtactgccaggatgggagtcc

SEQ ID NO: 78946 - DNA, 27 bp, Artificial Sequence
  Description of Artificial Sequence: Synthetic oligonucleotide
acagtgtactgccaggatgggagtccc

SEQ ID NO: 78947 - DNA, 27 bp, Artificial Sequence
  Description of Artificial Sequence: Synthetic oligonucleotide
cagtgtactgccaggatgggagtccca

SEQ ID NO: 78948 - DNA, 27 bp, Artificial Sequence
  Description of Artificial Sequence: Synthetic oligonucleotide
agtgtactgccaggatgggagtcccag

SEQ ID NO: 78949 - DNA, 27 bp, Artificial Sequence
  Description of Artificial Sequence: Synthetic oligonucleotide
gtgtactgccaggatgggagtcccagt

SEQ ID NO: 78950 - DNA, 27 bp, Artificial Sequence
  Description of Artificial Sequence: Synthetic oligonucleotide
tgtactgccaggatgggagtcccagtg

SEQ ID NO: 78951 - DNA, 27 bp, Artificial Sequence
  Description of Artificial Sequence: Synthetic oligonucleotide
gtactgccaggatgggagtcccagtgt

SEQ ID NO: 78952 - DNA, 27 bp, Artificial Sequence
  Description of Artificial Sequence: Synthetic oligonucleotide
tactgccaggatgggagtcccagtgtg

SEQ ID NO: 78953 - DNA, 26 bp, Artificial Sequence
  Description of Artificial Sequence: Synthetic oligonucleotide
actgccaggatgggagtcccagtgtg

SEQ ID NO: 78954 - DNA, 25 bp, Artificial Sequence
  Description of Artificial Sequence: Synthetic oligonucleotide
ctgccaggatgggagtcccagtgtg

SEQ ID NO: 78955 - DNA, 25 bp, Artificial Sequence
  Description of Artificial Sequence: Synthetic oligonucleotide
tgccaggatgggagtcccagtgtgg

SEQ ID NO: 78956 - DNA, 24 bp, Artificial Sequence
  Description of Artificial Sequence: Synthetic oligonucleotide
gccaggatgggagtcccagtgtgg

SEQ ID NO: 78957 - DNA, 25 bp, Artificial Sequence
  Description of Artificial Sequence: Synthetic oligonucleotide
ccaggatgggagtcccagtgtggga

SEQ ID NO: 78958 - DNA, 26 bp, Artificial Sequence
  Description of Artificial Sequence: Synthetic oligonucleotide
caggatgggagtcccagtgtgggact

SEQ ID NO: 78959 - DNA, 27 bp, Artificial Sequence
  Description of Artificial Sequence: Synthetic oligonucleotide
aggatgggagtcccagtgtgggactct

SEQ ID NO: 78960 - DNA, 26 bp, Artificial Sequence
  Description of Artificial Sequence: Synthetic oligonucleotide
ggatgggagtcccagtgtgggactct

SEQ ID NO: 78961 - DNA, 27 bp, Artificial Sequence
  Description of Artificial Sequence: Synthetic oligonucleotide
gatgggagtcccagtgtgggactctct

SEQ ID NO: 78962 - DNA, 27 bp, Artificial Sequence
  Description of Artificial Sequence: Synthetic oligonucleotide
atgggagtcccagtgtgggactctctg

SEQ ID NO: 78963 - DNA, 27 bp, Artificial Sequence
  Description of Artificial Sequence: Synthetic oligonucleotide
tgggagtcccagtgtgggactctctga

SEQ ID NO: 78964 - DNA, 26 bp, Artificial Sequence
  Description of Artificial Sequence: Synthetic oligonucleotide
gggagtcccagtgtgggactctctga

SEQ ID NO: 78965 - DNA, 26 bp, Artificial Sequence
  Description of Artificial Sequence: Synthetic oligonucleotide
ggagtcccagtgtgggactctctgag

SEQ ID NO: 78966 - DNA, 26 bp, Artificial Sequence
  Description of Artificial Sequence: Synthetic oligonucleotide
gagtcccagtgtgggactctctgagg

SEQ ID NO: 78967 - DNA, 26 bp, Artificial Sequence
  Description of Artificial Sequence: Synthetic oligonucleotide
agtcccagtgtgggactctctgaggc

SEQ ID NO: 78968 - DNA, 25 bp, Artificial Sequence
  Description of Artificial Sequence: Synthetic oligonucleotide
gtcccagtgtgggactctctgaggc

SEQ ID NO: 78969 - DNA, 27 bp, Artificial Sequence
  Description of Artificial Sequence: Synthetic oligonucleotide
tcccagtgtgggactctctgaggccta

SEQ ID NO: 78970 - DNA, 26 bp, Artificial Sequence
  Description of Artificial Sequence: Synthetic oligonucleotide
cccagtgtgggactctctgaggccta

SEQ ID NO: 78971 - DNA, 26 bp, Artificial Sequence
  Description of Artificial Sequence: Synthetic oligonucleotide
ccagtgtgggactctctgaggcctac

SEQ ID NO: 78972 - DNA, 27 bp, Artificial Sequence
  Description of Artificial Sequence: Synthetic oligonucleotide
cagtgtgggactctctgaggcctacga

SEQ ID NO: 78973 - DNA, 27 bp, Artificial Sequence
  Description of Artificial Sequence: Synthetic oligonucleotide
agtgtgggactctctgaggcctacgac

SEQ ID NO: 78974 - DNA, 26 bp, Artificial Sequence
  Description of Artificial Sequence: Synthetic oligonucleotide
gtgtgggactctctgaggcctacgac

SEQ ID NO: 78975 - DNA, 27 bp, Artificial Sequence
  Description of Artificial Sequence: Synthetic oligonucleotide
tgtgggactctctgaggcctacgacga

SEQ ID NO: 78976 - DNA, 26 bp, Artificial Sequence
  Description of Artificial Sequence: Synthetic oligonucleotide
gtgggactctctgaggcctacgacga

SEQ ID NO: 78977 - DNA, 26 bp, Artificial Sequence
  Description of Artificial Sequence: Synthetic oligonucleotide
tgggactctctgaggcctacgacgag

SEQ ID NO: 78978 - DNA, 25 bp, Artificial Sequence
  Description of Artificial Sequence: Synthetic oligonucleotide
gggactctctgaggcctacgacgag

SEQ ID NO: 78979 - DNA, 26 bp, Artificial Sequence
  Description of Artificial Sequence: Synthetic oligonucleotide
ggactctctgaggcctacgacgagga

SEQ ID NO: 78980 - DNA, 26 bp, Artificial Sequence
  Description of Artificial Sequence: Synthetic oligonucleotide
gactctctgaggcctacgacgaggac

SEQ ID NO: 78981 - DNA, 27 bp, Artificial Sequence
  Description of Artificial Sequence: Synthetic oligonucleotide
actctctgaggcctacgacgaggacca

SEQ ID NO: 78982 - DNA, 26 bp, Artificial Sequence
  Description of Artificial Sequence: Synthetic oligonucleotide
ctctctgaggcctacgacgaggacca

SEQ ID NO: 78983 - DNA, 26 bp, Artificial Sequence
  Description of Artificial Sequence: Synthetic oligonucleotide
tctctgaggcctacgacgaggaccag

SEQ ID NO: 78984 - DNA, 25 bp, Artificial Sequence
  Description of Artificial Sequence: Synthetic oligonucleotide
ctctgaggcctacgacgaggaccag

SEQ ID NO: 78985 - DNA, 27 bp, Artificial Sequence
  Description of Artificial Sequence: Synthetic oligonucleotide
tctgaggcctacgacgaggaccagctt

SEQ ID NO: 78986 - DNA, 27 bp, Artificial Sequence
  Description of Artificial Sequence: Synthetic oligonucleotide
ctgaggcctacgacgaggaccagcttt

SEQ ID NO: 78987 - DNA, 28 bp, Artificial Sequence
  Description of Artificial Sequence: Synthetic oligonucleotide
tgaggcctacgacgaggaccagcttttc

SEQ ID NO: 78988 - DNA, 27 bp, Artificial Sequence
  Description of Artificial Sequence: Synthetic oligonucleotide
gaggcctacgacgaggaccagcttttc

SEQ ID NO: 78989 - DNA, 29 bp, Artificial Sequence
  Description of Artificial Sequence: Synthetic oligonucleotide
aggcctacgacgaggaccagcttttcttc

SEQ ID NO: 78990 - DNA, 28 bp, Artificial Sequence
  Description of Artificial Sequence: Synthetic oligonucleotide
ggcctacgacgaggaccagcttttcttc

SEQ ID NO: 78991 - DNA, 30 bp, Artificial Sequence
  Description of Artificial Sequence: Synthetic oligonucleotide
gcctacgacgaggaccagcttttcttcttc

SEQ ID NO: 78992 - DNA, 30 bp, Artificial Sequence
  Description of Artificial Sequence: Synthetic oligonucleotide
cctacgacgaggaccagcttttcttcttcg

SEQ ID NO: 78993 - DNA, 31 bp, Artificial Sequence
  Description of Artificial Sequence: Synthetic oligonucleotide
ctacgacgaggaccagcttttcttcttcgac

SEQ ID NO: 78994 - DNA, 35 bp, Artificial Sequence
  Description of Artificial Sequence: Synthetic oligonucleotide
tacgacgaggaccagcttttcttcttcgacttttc

SEQ ID NO: 78995 - DNA, 34 bp, Artificial Sequence
  Description of Artificial Sequence: Synthetic oligonucleotide
acgacgaggaccagcttttcttcttcgacttttc

SEQ ID NO: 78996 - DNA, 33 bp, Artificial Sequence
  Description of Artificial Sequence: Synthetic oligonucleotide
cgacgaggaccagcttttcttcttcgacttttc

SEQ ID NO: 78997 - DNA, 33 bp, Artificial Sequence
  Description of Artificial Sequence: Synthetic oligonucleotide
gacgaggaccagcttttcttcttcgacttttcc

SEQ ID NO: 78998 - DNA, 33 bp, Artificial Sequence
  Description of Artificial Sequence: Synthetic oligonucleotide
acgaggaccagcttttcttcttcgacttttccc

SEQ ID NO: 78999 - DNA, 32 bp, Artificial Sequence
  Description of Artificial Sequence: Synthetic oligonucleotide
cgaggaccagcttttcttcttcgacttttccc

SEQ ID NO: 79000 - DNA, 33 bp, Artificial Sequence
  Description of Artificial Sequence: Synthetic oligonucleotide
gaggaccagcttttcttcttcgacttttcccag

SEQ ID NO: 79001 - DNA, 35 bp, Artificial Sequence
  Description of Artificial Sequence: Synthetic oligonucleotide
aggaccagcttttcttcttcgacttttcccagaac

SEQ ID NO: 79002 - DNA, 34 bp, Artificial Sequence
  Description of Artificial Sequence: Synthetic oligonucleotide
ggaccagcttttcttcttcgacttttcccagaac

SEQ ID NO: 79003 - DNA, 35 bp, Artificial Sequence
  Description of Artificial Sequence: Synthetic oligonucleotide
gaccagcttttcttcttcgacttttcccagaacac

SEQ ID NO: 79004 - DNA, 36 bp, Artificial Sequence
  Description of Artificial Sequence: Synthetic oligonucleotide
accagcttttcttcttcgacttttcccagaacactc

SEQ ID NO: 79005 - DNA, 35 bp, Artificial Sequence
  Description of Artificial Sequence: Synthetic oligonucleotide
ccagcttttcttcttcgacttttcccagaacactc

SEQ ID NO: 79006 - DNA, 35 bp, Artificial Sequence
  Description of Artificial Sequence: Synthetic oligonucleotide
cagcttttcttcttcgacttttcccagaacactcg

SEQ ID NO: 79007 - DNA, 35 bp, Artificial Sequence
  Description of Artificial Sequence: Synthetic oligonucleotide
agcttttcttcttcgacttttcccagaacactcgg

SEQ ID NO: 79008 - DNA, 34 bp, Artificial Sequence
  Description of Artificial Sequence: Synthetic oligonucleotide
gcttttcttcttcgacttttcccagaacactcgg

SEQ ID NO: 79009 - DNA, 34 bp, Artificial Sequence
  Description of Artificial Sequence: Synthetic oligonucleotide
cttttcttcttcgacttttcccagaacactcggg

SEQ ID NO: 79010 - DNA, 35 bp, Artificial Sequence
  Description of Artificial Sequence: Synthetic oligonucleotide
ttttcttcttcgacttttcccagaacactcgggtg

SEQ ID NO: 79011 - DNA, 34 bp, Artificial Sequence
  Description of Artificial Sequence: Synthetic oligonucleotide
tttcttcttcgacttttcccagaacactcgggtg

SEQ ID NO: 79012 - DNA, 33 bp, Artificial Sequence
  Description of Artificial Sequence: Synthetic oligonucleotide
ttcttcttcgacttttcccagaacactcgggtg

SEQ ID NO: 79013 - DNA, 32 bp, Artificial Sequence
  Description of Artificial Sequence: Synthetic oligonucleotide
tcttcttcgacttttcccagaacactcgggtg

SEQ ID NO: 79014 - DNA, 31 bp, Artificial Sequence
  Description of Artificial Sequence: Synthetic oligonucleotide
cttcttcgacttttcccagaacactcgggtg

SEQ ID NO: 79015 - DNA, 31 bp, Artificial Sequence
  Description of Artificial Sequence: Synthetic oligonucleotide
ttcttcgacttttcccagaacactcgggtgc

SEQ ID NO: 79016 - DNA, 30 bp, Artificial Sequence
  Description of Artificial Sequence: Synthetic oligonucleotide
tcttcgacttttcccagaacactcgggtgc

SEQ ID NO: 79017 - DNA, 29 bp, Artificial Sequence
  Description of Artificial Sequence: Synthetic oligonucleotide
cttcgacttttcccagaacactcgggtgc

SEQ ID NO: 79018 - DNA, 29 bp, Artificial Sequence
  Description of Artificial Sequence: Synthetic oligonucleotide
ttcgacttttcccagaacactcgggtgcc

SEQ ID NO: 79019 - DNA, 28 bp, Artificial Sequence
  Description of Artificial Sequence: Synthetic oligonucleotide
tcgacttttcccagaacactcgggtgcc

SEQ ID NO: 79020 - DNA, 27 bp, Artificial Sequence
  Description of Artificial Sequence: Synthetic oligonucleotide
cgacttttcccagaacactcgggtgcc

SEQ ID NO: 79021 - DNA, 28 bp, Artificial Sequence
  Description of Artificial Sequence: Synthetic oligonucleotide
gacttttcccagaacactcgggtgcctc

SEQ ID NO: 79022 - DNA, 28 bp, Artificial Sequence
  Description of Artificial Sequence: Synthetic oligonucleotide
acttttcccagaacactcgggtgcctcg

SEQ ID NO: 79023 - DNA, 27 bp, Artificial Sequence
  Description of Artificial Sequence: Synthetic oligonucleotide
cttttcccagaacactcgggtgcctcg

SEQ ID NO: 79024 - DNA, 27 bp, Artificial Sequence
  Description of Artificial Sequence: Synthetic oligonucleotide
ttttcccagaacactcgggtgcctcgc

SEQ ID NO: 79025 - DNA, 26 bp, Artificial Sequence
  Description of Artificial Sequence: Synthetic oligonucleotide
tttcccagaacactcgggtgcctcgc

SEQ ID NO: 79026 - DNA, 25 bp, Artificial Sequence
  Description of Artificial Sequence: Synthetic oligonucleotide
ttcccagaacactcgggtgcctcgc

SEQ ID NO: 79027 - DNA, 24 bp, Artificial Sequence
  Description of Artificial Sequence: Synthetic oligonucleotide
tcccagaacactcgggtgcctcgc

SEQ ID NO: 79028 - DNA, 23 bp, Artificial Sequence
  Description of Artificial Sequence: Synthetic oligonucleotide
cccagaacactcgggtgcctcgc

SEQ ID NO: 79029 - DNA, 24 bp, Artificial Sequence
  Description of Artificial Sequence: Synthetic oligonucleotide
ccagaacactcgggtgcctcgcct

SEQ ID NO: 79030 - DNA, 24 bp, Artificial Sequence
  Description of Artificial Sequence: Synthetic oligonucleotide
cagaacactcgggtgcctcgcctg

SEQ ID NO: 79031 - DNA, 24 bp, Artificial Sequence
  Description of Artificial Sequence: Synthetic oligonucleotide
agaacactcgggtgcctcgcctgc

SEQ ID NO: 79032 - DNA, 23 bp, Artificial Sequence
  Description of Artificial Sequence: Synthetic oligonucleotide
gaacactcgggtgcctcgcctgc

SEQ ID NO: 79033 - DNA, 23 bp, Artificial Sequence
  Description of Artificial Sequence: Synthetic oligonucleotide
aacactcgggtgcctcgcctgcc

SEQ ID NO: 79034 - DNA, 22 bp, Artificial Sequence
  Description of Artificial Sequence: Synthetic oligonucleotide
acactcgggtgcctcgcctgcc

SEQ ID NO: 79035 - DNA, 21 bp, Artificial Sequence
  Description of Artificial Sequence: Synthetic oligonucleotide
cactcgggtgcctcgcctgcc

SEQ ID NO: 79036 - DNA, 21 bp, Artificial Sequence
  Description of Artificial Sequence: Synthetic oligonucleotide
actcgggtgcctcgcctgccc

SEQ ID NO: 79037 - DNA, 20 bp, Artificial Sequence
  Description of Artificial Sequence: Synthetic oligonucleotide
ctcgggtgcctcgcctgccc

SEQ ID NO: 79038 - DNA, 25 bp, Artificial Sequence
  Description of Artificial Sequence: Synthetic oligonucleotide
tcgggtgcctcgcctgcccgaattt

SEQ ID NO: 79039 - DNA, 24 bp, Artificial Sequence
  Description of Artificial Sequence: Synthetic oligonucleotide
cgggtgcctcgcctgcccgaattt

SEQ ID NO: 79040 - DNA, 24 bp, Artificial Sequence
  Description of Artificial Sequence: Synthetic oligonucleotide
gggtgcctcgcctgcccgaatttg

SEQ ID NO: 79041 - DNA, 25 bp, Artificial Sequence
  Description of Artificial Sequence: Synthetic oligonucleotide
ggtgcctcgcctgcccgaatttgct

SEQ ID NO: 79042 - DNA, 26 bp, Artificial Sequence
  Description of Artificial Sequence: Synthetic oligonucleotide
gtgcctcgcctgcccgaatttgctga

SEQ ID NO: 79043 - DNA, 27 bp, Artificial Sequence
  Description of Artificial Sequence: Synthetic oligonucleotide
tgcctcgcctgcccgaatttgctgact

SEQ ID NO: 79044 - DNA, 26 bp, Artificial Sequence
  Description of Artificial Sequence: Synthetic oligonucleotide
gcctcgcctgcccgaatttgctgact

SEQ ID NO: 79045 - DNA, 26 bp, Artificial Sequence
  Description of Artificial Sequence: Synthetic oligonucleotide
cctcgcctgcccgaatttgctgactg

SEQ ID NO: 79046 - DNA, 26 bp, Artificial Sequence
  Description of Artificial Sequence: Synthetic oligonucleotide
ctcgcctgcccgaatttgctgactgg

SEQ ID NO: 79047 - DNA, 26 bp, Artificial Sequence
  Description of Artificial Sequence: Synthetic oligonucleotide
tcgcctgcccgaatttgctgactggg

SEQ ID NO: 79048 - DNA, 25 bp, Artificial Sequence
  Description of Artificial Sequence: Synthetic oligonucleotide
cgcctgcccgaatttgctgactggg

SEQ ID NO: 79049 - DNA, 26 bp, Artificial Sequence
  Description of Artificial Sequence: Synthetic oligonucleotide
gcctgcccgaatttgctgactgggct

SEQ ID NO: 79050 - DNA, 27 bp, Artificial Sequence
  Description of Artificial Sequence: Synthetic oligonucleotide
cctgcccgaatttgctgactgggctca

SEQ ID NO: 79051 - DNA, 27 bp, Artificial Sequence
  Description of Artificial Sequence: Synthetic oligonucleotide
ctgcccgaatttgctgactgggctcag

SEQ ID NO: 79052 - DNA, 27 bp, Artificial Sequence
  Description of Artificial Sequence: Synthetic oligonucleotide
tgcccgaatttgctgactgggctcagg

SEQ ID NO: 79053 - DNA, 27 bp, Artificial Sequence
  Description of Artificial Sequence: Synthetic oligonucleotide
gcccgaatttgctgactgggctcagga

SEQ ID NO: 79054 - DNA, 28 bp, Artificial Sequence
  Description of Artificial Sequence: Synthetic oligonucleotide
cccgaatttgctgactgggctcaggaac

SEQ ID NO: 79055 - DNA, 29 bp, Artificial Sequence
  Description of Artificial Sequence: Synthetic oligonucleotide
ccgaatttgctgactgggctcaggaacag

SEQ ID NO: 79056 - DNA, 29 bp, Artificial Sequence
  Description of Artificial Sequence: Synthetic oligonucleotide
cgaatttgctgactgggctcaggaacagg

SEQ ID NO: 79057 - DNA, 29 bp, Artificial Sequence
  Description of Artificial Sequence: Synthetic oligonucleotide
gaatttgctgactgggctcaggaacaggg

SEQ ID NO: 79058 - DNA, 30 bp, Artificial Sequence
  Description of Artificial Sequence: Synthetic oligonucleotide
aatttgctgactgggctcaggaacagggag

SEQ ID NO: 79059 - DNA, 29 bp, Artificial Sequence
  Description of Artificial Sequence: Synthetic oligonucleotide
atttgctgactgggctcaggaacagggag

SEQ ID NO: 79060 - DNA, 28 bp, Artificial Sequence
  Description of Artificial Sequence: Synthetic oligonucleotide
tttgctgactgggctcaggaacagggag

SEQ ID NO: 79061 - DNA, 27 bp, Artificial Sequence
  Description of Artificial Sequence: Synthetic oligonucleotide
ttgctgactgggctcaggaacagggag

SEQ ID NO: 79062 - DNA, 27 bp, Artificial Sequence
  Description of Artificial Sequence: Synthetic oligonucleotide
tgctgactgggctcaggaacagggaga

SEQ ID NO: 79063 - DNA, 27 bp, Artificial Sequence
  Description of Artificial Sequence: Synthetic oligonucleotide
gctgactgggctcaggaacagggagat

SEQ ID NO: 79064 - DNA, 27 bp, Artificial Sequence
  Description of Artificial Sequence: Synthetic oligonucleotide
ctgactgggctcaggaacagggagatg

SEQ ID NO: 79065 - DNA, 27 bp, Artificial Sequence
  Description of Artificial Sequence: Synthetic oligonucleotide
tgactgggctcaggaacagggagatgc

SEQ ID NO: 79066 - DNA, 27 bp, Artificial Sequence
  Description of Artificial Sequence: Synthetic oligonucleotide
gactgggctcaggaacagggagatgct

SEQ ID NO: 79067 - DNA, 27 bp, Artificial Sequence
  Description of Artificial Sequence: Synthetic oligonucleotide
actgggctcaggaacagggagatgctc

SEQ ID NO: 79068 - DNA, 26 bp, Artificial Sequence
  Description of Artificial Sequence: Synthetic oligonucleotide
ctgggctcaggaacagggagatgctc

SEQ ID NO: 79069 - DNA, 27 bp, Artificial Sequence
  Description of Artificial Sequence: Synthetic oligonucleotide
tgggctcaggaacagggagatgctcct

SEQ ID NO: 79070 - DNA, 26 bp, Artificial Sequence
  Description of Artificial Sequence: Synthetic oligonucleotide
gggctcaggaacagggagatgctcct

SEQ ID NO: 79071 - DNA, 26 bp, Artificial Sequence
  Description of Artificial Sequence: Synthetic oligonucleotide
ggctcaggaacagggagatgctcctg

SEQ ID NO: 79072 - DNA, 26 bp, Artificial Sequence
  Description of Artificial Sequence: Synthetic oligonucleotide
gctcaggaacagggagatgctcctgc

SEQ ID NO: 79073 - DNA, 27 bp, Artificial Sequence
  Description of Artificial Sequence: Synthetic oligonucleotide
ctcaggaacagggagatgctcctgcca

SEQ ID NO: 79074 - DNA, 35 bp, Artificial Sequence
  Description of Artificial Sequence: Synthetic oligonucleotide
tcaggaacagggagatgctcctgccattttatttg

SEQ ID NO: 79075 - DNA, 34 bp, Artificial Sequence
  Description of Artificial Sequence: Synthetic oligonucleotide
caggaacagggagatgctcctgccattttatttg

SEQ ID NO: 79076 - DNA, 35 bp, Artificial Sequence
  Description of Artificial Sequence: Synthetic oligonucleotide
aggaacagggagatgctcctgccattttatttgac

SEQ ID NO: 79077 - DNA, 34 bp, Artificial Sequence
  Description of Artificial Sequence: Synthetic oligonucleotide
ggaacagggagatgctcctgccattttatttgac

SEQ ID NO: 79078 - DNA, 37 bp, Artificial Sequence
  Description of Artificial Sequence: Synthetic oligonucleotide
gaacagggagatgctcctgccattttatttgacaaag

SEQ ID NO: 79079 - DNA, 38 bp, Artificial Sequence
  Description of Artificial Sequence: Synthetic oligonucleotide
aacagggagatgctcctgccattttatttgacaaagag

SEQ ID NO: 79080 - DNA, 37 bp, Artificial Sequence
  Description of Artificial Sequence: Synthetic oligonucleotide
acagggagatgctcctgccattttatttgacaaagag

SEQ ID NO: 79081 - DNA, 36 bp, Artificial Sequence
  Description of Artificial Sequence: Synthetic oligonucleotide
cagggagatgctcctgccattttatttgacaaagag

SEQ ID NO: 79082 - DNA, 38 bp, Artificial Sequence
  Description of Artificial Sequence: Synthetic oligonucleotide
agggagatgctcctgccattttatttgacaaagagttc

SEQ ID NO: 79083 - DNA, 37 bp, Artificial Sequence
  Description of Artificial Sequence: Synthetic oligonucleotide
gggagatgctcctgccattttatttgacaaagagttc

SEQ ID NO: 79084 - DNA, 38 bp, Artificial Sequence
  Description of Artificial Sequence: Synthetic oligonucleotide
ggagatgctcctgccattttatttgacaaagagttctg

SEQ ID NO: 79085 - DNA, 38 bp, Artificial Sequence
  Description of Artificial Sequence: Synthetic oligonucleotide
gagatgctcctgccattttatttgacaaagagttctgc

SEQ ID NO: 79086 - DNA, 38 bp, Artificial Sequence
  Description of Artificial Sequence: Synthetic oligonucleotide
agatgctcctgccattttatttgacaaagagttctgcg

SEQ ID NO: 79087 - DNA, 37 bp, Artificial Sequence
  Description of Artificial Sequence: Synthetic oligonucleotide
gatgctcctgccattttatttgacaaagagttctgcg

SEQ ID NO: 79088 - DNA, 38 bp, Artificial Sequence
  Description of Artificial Sequence: Synthetic oligonucleotide
atgctcctgccattttatttgacaaagagttctgcgag

SEQ ID NO: 79089 - DNA, 37 bp, Artificial Sequence
  Description of Artificial Sequence: Synthetic oligonucleotide
tgctcctgccattttatttgacaaagagttctgcgag

SEQ ID NO: 79090 - DNA, 36 bp, Artificial Sequence
  Description of Artificial Sequence: Synthetic oligonucleotide
gctcctgccattttatttgacaaagagttctgcgag

SEQ ID NO: 79091 - DNA, 37 bp, Artificial Sequence
  Description of Artificial Sequence: Synthetic oligonucleotide
ctcctgccattttatttgacaaagagttctgcgagtg

SEQ ID NO: 79092 - DNA, 37 bp, Artificial Sequence
  Description of Artificial Sequence: Synthetic oligonucleotide
tcctgccattttatttgacaaagagttctgcgagtgg

SEQ ID NO: 79093 - DNA, 36 bp, Artificial Sequence
  Description of Artificial Sequence: Synthetic oligonucleotide
cctgccattttatttgacaaagagttctgcgagtgg

SEQ ID NO: 79094 - DNA, 38 bp, Artificial Sequence
  Description of Artificial Sequence: Synthetic oligonucleotide
ctgccattttatttgacaaagagttctgcgagtggatg

SEQ ID NO: 79095 - DNA, 40 bp, Artificial Sequence
  Description of Artificial Sequence: Synthetic oligonucleotide
tgccattttatttgacaaagagttctgcgagtggatgatc

SEQ ID NO: 79096 - DNA, 39 bp, Artificial Sequence
  Description of Artificial Sequence: Synthetic oligonucleotide
gccattttatttgacaaagagttctgcgagtggatgatc

SEQ ID NO: 79097 - DNA, 39 bp, Artificial Sequence
  Description of Artificial Sequence: Synthetic oligonucleotide
ccattttatttgacaaagagttctgcgagtggatgatcc

SEQ ID NO: 79098 - DNA, 40 bp, Artificial Sequence
  Description of Artificial Sequence: Synthetic oligonucleotide
cattttatttgacaaagagttctgcgagtggatgatccag

SEQ ID NO: 79099 - DNA, 40 bp, Artificial Sequence
  Description of Artificial Sequence: Synthetic oligonucleotide
attttatttgacaaagagttctgcgagtggatgatccagc

SEQ ID NO: 79100 - DNA, 39 bp, Artificial Sequence
  Description of Artificial Sequence: Synthetic oligonucleotide
ttttatttgacaaagagttctgcgagtggatgatccagc

SEQ ID NO: 79101 - DNA, 38 bp, Artificial Sequence
  Description of Artificial Sequence: Synthetic oligonucleotide
tttatttgacaaagagttctgcgagtggatgatccagc

SEQ ID NO: 79102 - DNA, 37 bp, Artificial Sequence
  Description of Artificial Sequence: Synthetic oligonucleotide
ttatttgacaaagagttctgcgagtggatgatccagc

SEQ ID NO: 79103 - DNA, 36 bp, Artificial Sequence
  Description of Artificial Sequence: Synthetic oligonucleotide
tatttgacaaagagttctgcgagtggatgatccagc

SEQ ID NO: 79104 - DNA, 35 bp, Artificial Sequence
  Description of Artificial Sequence: Synthetic oligonucleotide
atttgacaaagagttctgcgagtggatgatccagc

SEQ ID NO: 79105 - DNA, 34 bp, Artificial Sequence
  Description of Artificial Sequence: Synthetic oligonucleotide
tttgacaaagagttctgcgagtggatgatccagc

SEQ ID NO: 79106 - DNA, 33 bp, Artificial Sequence
  Description of Artificial Sequence: Synthetic oligonucleotide
ttgacaaagagttctgcgagtggatgatccagc

SEQ ID NO: 79107 - DNA, 32 bp, Artificial Sequence
  Description of Artificial Sequence: Synthetic oligonucleotide
tgacaaagagttctgcgagtggatgatccagc

SEQ ID NO: 79108 - DNA, 31 bp, Artificial Sequence
  Description of Artificial Sequence: Synthetic oligonucleotide
gacaaagagttctgcgagtggatgatccagc

SEQ ID NO: 79109 - DNA, 36 bp, Artificial Sequence
  Description of Artificial Sequence: Synthetic oligonucleotide
acaaagagttctgcgagtggatgatccagcaaatag

SEQ ID NO: 79110 - DNA, 35 bp, Artificial Sequence
  Description of Artificial Sequence: Synthetic oligonucleotide
caaagagttctgcgagtggatgatccagcaaatag

SEQ ID NO: 79111 - DNA, 35 bp, Artificial Sequence
  Description of Artificial Sequence: Synthetic oligonucleotide
aaagagttctgcgagtggatgatccagcaaatagg

SEQ ID NO: 79112 - DNA, 34 bp, Artificial Sequence
  Description of Artificial Sequence: Synthetic oligonucleotide
aagagttctgcgagtggatgatccagcaaatagg

SEQ ID NO: 79113 - DNA, 33 bp, Artificial Sequence
  Description of Artificial Sequence: Synthetic oligonucleotide
agagttctgcgagtggatgatccagcaaatagg

SEQ ID NO: 79114 - DNA, 32 bp, Artificial Sequence
  Description of Artificial Sequence: Synthetic oligonucleotide
gagttctgcgagtggatgatccagcaaatagg

SEQ ID NO: 79115 - DNA, 32 bp, Artificial Sequence
  Description of Artificial Sequence: Synthetic oligonucleotide
agttctgcgagtggatgatccagcaaataggg

SEQ ID NO: 79116 - DNA, 31 bp, Artificial Sequence
  Description of Artificial Sequence: Synthetic oligonucleotide
gttctgcgagtggatgatccagcaaataggg

SEQ ID NO: 79117 - DNA, 31 bp, Artificial Sequence
  Description of Artificial Sequence: Synthetic oligonucleotide
ttctgcgagtggatgatccagcaaatagggc

SEQ ID NO: 79118 - DNA, 30 bp, Artificial Sequence
  Description of Artificial Sequence: Synthetic oligonucleotide
tctgcgagtggatgatccagcaaatagggc

SEQ ID NO: 79119 - DNA, 29 bp, Artificial Sequence
  Description of Artificial Sequence: Synthetic oligonucleotide
ctgcgagtggatgatccagcaaatagggc

SEQ ID NO: 79120 - DNA, 29 bp, Artificial Sequence
  Description of Artificial Sequence: Synthetic oligonucleotide
tgcgagtggatgatccagcaaatagggcc

SEQ ID NO: 79121 - DNA, 28 bp, Artificial Sequence
  Description of Artificial Sequence: Synthetic oligonucleotide
gcgagtggatgatccagcaaatagggcc

SEQ ID NO: 79122 - DNA, 32 bp, Artificial Sequence
  Description of Artificial Sequence: Synthetic oligonucleotide
cgagtggatgatccagcaaatagggccaaaac

SEQ ID NO: 79123 - DNA, 34 bp, Artificial Sequence
  Description of Artificial Sequence: Synthetic oligonucleotide
gagtggatgatccagcaaatagggccaaaacttg

SEQ ID NO: 79124 - DNA, 36 bp, Artificial Sequence
  Description of Artificial Sequence: Synthetic oligonucleotide
agtggatgatccagcaaatagggccaaaacttgatg

SEQ ID NO: 79125 - DNA, 35 bp, Artificial Sequence
  Description of Artificial Sequence: Synthetic oligonucleotide
gtggatgatccagcaaatagggccaaaacttgatg

SEQ ID NO: 79126 - DNA, 35 bp, Artificial Sequence
  Description of Artificial Sequence: Synthetic oligonucleotide
tggatgatccagcaaatagggccaaaacttgatgg

SEQ ID NO: 79127 - DNA, 34 bp, Artificial Sequence
  Description of Artificial Sequence: Synthetic oligonucleotide
ggatgatccagcaaatagggccaaaacttgatgg

SEQ ID NO: 79128 - DNA, 34 bp, Artificial Sequence
  Description of Artificial Sequence: Synthetic oligonucleotide
gatgatccagcaaatagggccaaaacttgatggg

SEQ ID NO: 79129 - DNA, 39 bp, Artificial Sequence
  Description of Artificial Sequence: Synthetic oligonucleotide
atgatccagcaaatagggccaaaacttgatgggaaaatc

SEQ ID NO: 79130 - DNA, 38 bp, Artificial Sequence
  Description of Artificial Sequence: Synthetic oligonucleotide
tgatccagcaaatagggccaaaacttgatgggaaaatc

SEQ ID NO: 79131 - DNA, 37 bp, Artificial Sequence
  Description of Artificial Sequence: Synthetic oligonucleotide
gatccagcaaatagggccaaaacttgatgggaaaatc

SEQ ID NO: 79132 - DNA, 37 bp, Artificial Sequence
  Description of Artificial Sequence: Synthetic oligonucleotide
atccagcaaatagggccaaaacttgatgggaaaatcc

SEQ ID NO: 79133 - DNA, 36 bp, Artificial Sequence
  Description of Artificial Sequence: Synthetic oligonucleotide
tccagcaaatagggccaaaacttgatgggaaaatcc

SEQ ID NO: 79134 - DNA, 35 bp, Artificial Sequence
  Description of Artificial Sequence: Synthetic oligonucleotide
ccagcaaatagggccaaaacttgatgggaaaatcc

SEQ ID NO: 79135 - DNA, 35 bp, Artificial Sequence
  Description of Artificial Sequence: Synthetic oligonucleotide
cagcaaatagggccaaaacttgatgggaaaatccc

SEQ ID NO: 79136 - DNA, 35 bp, Artificial Sequence
  Description of Artificial Sequence: Synthetic oligonucleotide
agcaaatagggccaaaacttgatgggaaaatcccg

SEQ ID NO: 79137 - DNA, 34 bp, Artificial Sequence
  Description of Artificial Sequence: Synthetic oligonucleotide
gcaaatagggccaaaacttgatgggaaaatcccg

SEQ ID NO: 79138 - DNA, 34 bp, Artificial Sequence
  Description of Artificial Sequence: Synthetic oligonucleotide
caaatagggccaaaacttgatgggaaaatcccgg

SEQ ID NO: 79139 - DNA, 35 bp, Artificial Sequence
  Description of Artificial Sequence: Synthetic oligonucleotide
aaatagggccaaaacttgatgggaaaatcccggtg

SEQ ID NO: 79140 - DNA, 34 bp, Artificial Sequence
  Description of Artificial Sequence: Synthetic oligonucleotide
aatagggccaaaacttgatgggaaaatcccggtg

SEQ ID NO: 79141 - DNA, 33 bp, Artificial Sequence
  Description of Artificial Sequence: Synthetic oligonucleotide
atagggccaaaacttgatgggaaaatcccggtg

SEQ ID NO: 79142 - DNA, 32 bp, Artificial Sequence
  Description of Artificial Sequence: Synthetic oligonucleotide
tagggccaaaacttgatgggaaaatcccggtg

SEQ ID NO: 79143 - DNA, 31 bp, Artificial Sequence
  Description of Artificial Sequence: Synthetic oligonucleotide
agggccaaaacttgatgggaaaatcccggtg

SEQ ID NO: 79144 - DNA, 30 bp, Artificial Sequence
  Description of Artificial Sequence: Synthetic oligonucleotide
gggccaaaacttgatgggaaaatcccggtg

SEQ ID NO: 79145 - DNA, 31 bp, Artificial Sequence
  Description of Artificial Sequence: Synthetic oligonucleotide
ggccaaaacttgatgggaaaatcccggtgtc

SEQ ID NO: 79146 - DNA, 31 bp, Artificial Sequence
  Description of Artificial Sequence: Synthetic oligonucleotide
gccaaaacttgatgggaaaatcccggtgtcc

SEQ ID NO: 79147 - DNA, 32 bp, Artificial Sequence
  Description of Artificial Sequence: Synthetic oligonucleotide
ccaaaacttgatgggaaaatcccggtgtccag

SEQ ID NO: 79148 - DNA, 33 bp, Artificial Sequence
  Description of Artificial Sequence: Synthetic oligonucleotide
caaaacttgatgggaaaatcccggtgtccagag

SEQ ID NO: 79149 - DNA, 33 bp, Artificial Sequence
  Description of Artificial Sequence: Synthetic oligonucleotide
aaaacttgatgggaaaatcccggtgtccagagg

SEQ ID NO: 79150 - DNA, 32 bp, Artificial Sequence
  Description of Artificial Sequence: Synthetic oligonucleotide
aaacttgatgggaaaatcccggtgtccagagg

SEQ ID NO: 79151 - DNA, 31 bp, Artificial Sequence
  Description of Artificial Sequence: Synthetic oligonucleotide
aacttgatgggaaaatcccggtgtccagagg

SEQ ID NO: 79152 - DNA, 30 bp, Artificial Sequence
  Description of Artificial Sequence: Synthetic oligonucleotide
acttgatgggaaaatcccggtgtccagagg

SEQ ID NO: 79153 - DNA, 29 bp, Artificial Sequence
  Description of Artificial Sequence: Synthetic oligonucleotide
cttgatgggaaaatcccggtgtccagagg

SEQ ID NO: 79154 - DNA, 29 bp, Artificial Sequence
  Description of Artificial Sequence: Synthetic oligonucleotide
ttgatgggaaaatcccggtgtccagaggg

SEQ ID NO: 79155 - DNA, 28 bp, Artificial Sequence
  Description of Artificial Sequence: Synthetic oligonucleotide
tgatgggaaaatcccggtgtccagaggg

SEQ ID NO: 79156 - DNA, 27 bp, Artificial Sequence
  Description of Artificial Sequence: Synthetic oligonucleotide
gatgggaaaatcccggtgtccagaggg

SEQ ID NO: 79157 - DNA, 30 bp, Artificial Sequence
  Description of Artificial Sequence: Synthetic oligonucleotide
atgggaaaatcccggtgtccagagggtttc

SEQ ID NO: 79158 - DNA, 29 bp, Artificial Sequence
  Description of Artificial Sequence: Synthetic oligonucleotide
tgggaaaatcccggtgtccagagggtttc

SEQ ID NO: 79159 - DNA, 28 bp, Artificial Sequence
  Description of Artificial Sequence: Synthetic oligonucleotide
gggaaaatcccggtgtccagagggtttc

SEQ ID NO: 79160 - DNA, 28 bp, Artificial Sequence
  Description of Artificial Sequence: Synthetic oligonucleotide
ggaaaatcccggtgtccagagggtttcc

SEQ ID NO: 79161 - DNA, 31 bp, Artificial Sequence
  Description of Artificial Sequence: Synthetic oligonucleotide
gaaaatcccggtgtccagagggtttcctatc

SEQ ID NO: 79162 - DNA, 31 bp, Artificial Sequence
  Description of Artificial Sequence: Synthetic oligonucleotide
aaaatcccggtgtccagagggtttcctatcg

SEQ ID NO: 79163 - DNA, 30 bp, Artificial Sequence
  Description of Artificial Sequence: Synthetic oligonucleotide
aaatcccggtgtccagagggtttcctatcg

SEQ ID NO: 79164 - DNA, 29 bp, Artificial Sequence
  Description of Artificial Sequence: Synthetic oligonucleotide
aatcccggtgtccagagggtttcctatcg

SEQ ID NO: 79165 - DNA, 28 bp, Artificial Sequence
  Description of Artificial Sequence: Synthetic oligonucleotide
atcccggtgtccagagggtttcctatcg

SEQ ID NO: 79166 - DNA, 27 bp, Artificial Sequence
  Description of Artificial Sequence: Synthetic oligonucleotide
tcccggtgtccagagggtttcctatcg

SEQ ID NO: 79167 - DNA, 26 bp, Artificial Sequence
  Description of Artificial Sequence: Synthetic oligonucleotide
cccggtgtccagagggtttcctatcg

SEQ ID NO: 79168 - DNA, 27 bp, Artificial Sequence
  Description of Artificial Sequence: Synthetic oligonucleotide
ccggtgtccagagggtttcctatcgct

SEQ ID NO: 79169 - DNA, 27 bp, Artificial Sequence
  Description of Artificial Sequence: Synthetic oligonucleotide
cggtgtccagagggtttcctatcgctg

SEQ ID NO: 79170 - DNA, 29 bp, Artificial Sequence
  Description of Artificial Sequence: Synthetic oligonucleotide
ggtgtccagagggtttcctatcgctgaag

SEQ ID NO: 79171 - DNA, 30 bp, Artificial Sequence
  Description of Artificial Sequence: Synthetic oligonucleotide
gtgtccagagggtttcctatcgctgaagtg

SEQ ID NO: 79172 - DNA, 32 bp, Artificial Sequence
  Description of Artificial Sequence: Synthetic oligonucleotide
tgtccagagggtttcctatcgctgaagtgttc

SEQ ID NO: 79173 - DNA, 31 bp, Artificial Sequence
  Description of Artificial Sequence: Synthetic oligonucleotide
gtccagagggtttcctatcgctgaagtgttc

SEQ ID NO: 79174 - DNA, 32 bp, Artificial Sequence
  Description of Artificial Sequence: Synthetic oligonucleotide
tccagagggtttcctatcgctgaagtgttcac

SEQ ID NO: 79175 - DNA, 31 bp, Artificial Sequence
  Description of Artificial Sequence: Synthetic oligonucleotide
ccagagggtttcctatcgctgaagtgttcac

SEQ ID NO: 79176 - DNA, 31 bp, Artificial Sequence
  Description of Artificial Sequence: Synthetic oligonucleotide
cagagggtttcctatcgctgaagtgttcacg

SEQ ID NO: 79177 - DNA, 31 bp, Artificial Sequence
  Description of Artificial Sequence: Synthetic oligonucleotide
agagggtttcctatcgctgaagtgttcacgc

SEQ ID NO: 79178 - DNA, 30 bp, Artificial Sequence
  Description of Artificial Sequence: Synthetic oligonucleotide
gagggtttcctatcgctgaagtgttcacgc

SEQ ID NO: 79179 - DNA, 31 bp, Artificial Sequence
  Description of Artificial Sequence: Synthetic oligonucleotide
agggtttcctatcgctgaagtgttcacgctg

SEQ ID NO: 79180 - DNA, 30 bp, Artificial Sequence
  Description of Artificial Sequence: Synthetic oligonucleotide
gggtttcctatcgctgaagtgttcacgctg

SEQ ID NO: 79181 - DNA, 32 bp, Artificial Sequence
  Description of Artificial Sequence: Synthetic oligonucleotide
ggtttcctatcgctgaagtgttcacgctgaag

SEQ ID NO: 79182 - DNA, 32 bp, Artificial Sequence
  Description of Artificial Sequence: Synthetic oligonucleotide
gtttcctatcgctgaagtgttcacgctgaagc

SEQ ID NO: 79183 - DNA, 32 bp, Artificial Sequence
  Description of Artificial Sequence: Synthetic oligonucleotide
tttcctatcgctgaagtgttcacgctgaagcc

SEQ ID NO: 79184 - DNA, 31 bp, Artificial Sequence
  Description of Artificial Sequence: Synthetic oligonucleotide
ttcctatcgctgaagtgttcacgctgaagcc

SEQ ID NO: 79185 - DNA, 30 bp, Artificial Sequence
  Description of Artificial Sequence: Synthetic oligonucleotide
tcctatcgctgaagtgttcacgctgaagcc

SEQ ID NO: 79186 - DNA, 29 bp, Artificial Sequence
  Description of Artificial Sequence: Synthetic oligonucleotide
cctatcgctgaagtgttcacgctgaagcc

SEQ ID NO: 79187 - DNA, 29 bp, Artificial Sequence
  Description of Artificial Sequence: Synthetic oligonucleotide
ctatcgctgaagtgttcacgctgaagccc

SEQ ID NO: 79188 - DNA, 29 bp, Artificial Sequence
  Description of Artificial Sequence: Synthetic oligonucleotide
tatcgctgaagtgttcacgctgaagcccc

SEQ ID NO: 79189 - DNA, 28 bp, Artificial Sequence
  Description of Artificial Sequence: Synthetic oligonucleotide
atcgctgaagtgttcacgctgaagcccc

SEQ ID NO: 79190 - DNA, 27 bp, Artificial Sequence
  Description of Artificial Sequence: Synthetic oligonucleotide
tcgctgaagtgttcacgctgaagcccc

SEQ ID NO: 79191 - DNA, 27 bp, Artificial Sequence
  Description of Artificial Sequence: Synthetic oligonucleotide
cgctgaagtgttcacgctgaagcccct

SEQ ID NO: 79192 - DNA, 27 bp, Artificial Sequence
  Description of Artificial Sequence: Synthetic oligonucleotide
gctgaagtgttcacgctgaagcccctg

SEQ ID NO: 79193 - DNA, 27 bp, Artificial Sequence
  Description of Artificial Sequence: Synthetic oligonucleotide
ctgaagtgttcacgctgaagcccctgg

SEQ ID NO: 79194 - DNA, 28 bp, Artificial Sequence
  Description of Artificial Sequence: Synthetic oligonucleotide
tgaagtgttcacgctgaagcccctggag

SEQ ID NO: 79195 - DNA, 27 bp, Artificial Sequence
  Description of Artificial Sequence: Synthetic oligonucleotide
gaagtgttcacgctgaagcccctggag

SEQ ID NO: 79196 - DNA, 30 bp, Artificial Sequence
  Description of Artificial Sequence: Synthetic oligonucleotide
aagtgttcacgctgaagcccctggagtttg

SEQ ID NO: 79197 - DNA, 29 bp, Artificial Sequence
  Description of Artificial Sequence: Synthetic oligonucleotide
agtgttcacgctgaagcccctggagtttg

SEQ ID NO: 79198 - DNA, 28 bp, Artificial Sequence
  Description of Artificial Sequence: Synthetic oligonucleotide
gtgttcacgctgaagcccctggagtttg

SEQ ID NO: 79199 - DNA, 28 bp, Artificial Sequence
  Description of Artificial Sequence: Synthetic oligonucleotide
tgttcacgctgaagcccctggagtttgg

SEQ ID NO: 79200 - DNA, 27 bp, Artificial Sequence
  Description of Artificial Sequence: Synthetic oligonucleotide
gttcacgctgaagcccctggagtttgg

SEQ ID NO: 79201 - DNA, 27 bp, Artificial Sequence
  Description of Artificial Sequence: Synthetic oligonucleotide
ttcacgctgaagcccctggagtttggc

SEQ ID NO: 79202 - DNA, 27 bp, Artificial Sequence
  Description of Artificial Sequence: Synthetic oligonucleotide
tcacgctgaagcccctggagtttggca

SEQ ID NO: 79203 - DNA, 27 bp, Artificial Sequence
  Description of Artificial Sequence: Synthetic oligonucleotide
cacgctgaagcccctggagtttggcaa

SEQ ID NO: 79204 - DNA, 27 bp, Artificial Sequence
  Description of Artificial Sequence: Synthetic oligonucleotide
acgctgaagcccctggagtttggcaag

SEQ ID NO: 79205 - DNA, 26 bp, Artificial Sequence
  Description of Artificial Sequence: Synthetic oligonucleotide
cgctgaagcccctggagtttggcaag

SEQ ID NO: 79206 - DNA, 26 bp, Artificial Sequence
  Description of Artificial Sequence: Synthetic oligonucleotide
gctgaagcccctggagtttggcaagc

SEQ ID NO: 79207 - DNA, 26 bp, Artificial Sequence
  Description of Artificial Sequence: Synthetic oligonucleotide
ctgaagcccctggagtttggcaagcc

SEQ ID NO: 79208 - DNA, 27 bp, Artificial Sequence
  Description of Artificial Sequence: Synthetic oligonucleotide
tgaagcccctggagtttggcaagccca

SEQ ID NO: 79209 - DNA, 27 bp, Artificial Sequence
  Description of Artificial Sequence: Synthetic oligonucleotide
gaagcccctggagtttggcaagcccaa

SEQ ID NO: 79210 - DNA, 27 bp, Artificial Sequence
  Description of Artificial Sequence: Synthetic oligonucleotide
aagcccctggagtttggcaagcccaac

SEQ ID NO: 79211 - DNA, 27 bp, Artificial Sequence
  Description of Artificial Sequence: Synthetic oligonucleotide
agcccctggagtttggcaagcccaaca

SEQ ID NO: 79212 - DNA, 26 bp, Artificial Sequence
  Description of Artificial Sequence: Synthetic oligonucleotide
gcccctggagtttggcaagcccaaca

SEQ ID NO: 79213 - DNA, 27 bp, Artificial Sequence
  Description of Artificial Sequence: Synthetic oligonucleotide
cccctggagtttggcaagcccaacact

SEQ ID NO: 79214 - DNA, 29 bp, Artificial Sequence
  Description of Artificial Sequence: Synthetic oligonucleotide
ccctggagtttggcaagcccaacactttg

SEQ ID NO: 79215 - DNA, 29 bp, Artificial Sequence
  Description of Artificial Sequence: Synthetic oligonucleotide
cctggagtttggcaagcccaacactttgg

SEQ ID NO: 79216 - DNA, 30 bp, Artificial Sequence
  Description of Artificial Sequence: Synthetic oligonucleotide
ctggagtttggcaagcccaacactttggtc

SEQ ID NO: 79217 - DNA, 31 bp, Artificial Sequence
  Description of Artificial Sequence: Synthetic oligonucleotide
tggagtttggcaagcccaacactttggtctg

SEQ ID NO: 79218 - DNA, 30 bp, Artificial Sequence
  Description of Artificial Sequence: Synthetic oligonucleotide
ggagtttggcaagcccaacactttggtctg

SEQ ID NO: 79219 - DNA, 34 bp, Artificial Sequence
  Description of Artificial Sequence: Synthetic oligonucleotide
gagtttggcaagcccaacactttggtctgttttg

SEQ ID NO: 79220 - DNA, 35 bp, Artificial Sequence
  Description of Artificial Sequence: Synthetic oligonucleotide
agtttggcaagcccaacactttggtctgttttgtc

SEQ ID NO: 79221 - DNA, 34 bp, Artificial Sequence
  Description of Artificial Sequence: Synthetic oligonucleotide
gtttggcaagcccaacactttggtctgttttgtc

SEQ ID NO: 79222 - DNA, 35 bp, Artificial Sequence
  Description of Artificial Sequence: Synthetic oligonucleotide
tttggcaagcccaacactttggtctgttttgtcag

SEQ ID NO: 79223 - DNA, 34 bp, Artificial Sequence
  Description of Artificial Sequence: Synthetic oligonucleotide
ttggcaagcccaacactttggtctgttttgtcag

SEQ ID NO: 79224 - DNA, 33 bp, Artificial Sequence
  Description of Artificial Sequence: Synthetic oligonucleotide
tggcaagcccaacactttggtctgttttgtcag

SEQ ID NO: 79225 - DNA, 32 bp, Artificial Sequence
  Description of Artificial Sequence: Synthetic oligonucleotide
ggcaagcccaacactttggtctgttttgtcag

SEQ ID NO: 79226 - DNA, 36 bp, Artificial Sequence
  Description of Artificial Sequence: Synthetic oligonucleotide
gcaagcccaacactttggtctgttttgtcagtaatc

SEQ ID NO: 79227 - DNA, 37 bp, Artificial Sequence
  Description of Artificial Sequence: Synthetic oligonucleotide
caagcccaacactttggtctgttttgtcagtaatctc

SEQ ID NO: 79228 - DNA, 39 bp, Artificial Sequence
  Description of Artificial Sequence: Synthetic oligonucleotide
aagcccaacactttggtctgttttgtcagtaatctcttc

SEQ ID NO: 79229 - DNA, 38 bp, Artificial Sequence
  Description of Artificial Sequence: Synthetic oligonucleotide
agcccaacactttggtctgttttgtcagtaatctcttc

SEQ ID NO: 79230 - DNA, 37 bp, Artificial Sequence
  Description of Artificial Sequence: Synthetic oligonucleotide
gcccaacactttggtctgttttgtcagtaatctcttc

SEQ ID NO: 79231 - DNA, 37 bp, Artificial Sequence
  Description of Artificial Sequence: Synthetic oligonucleotide
cccaacactttggtctgttttgtcagtaatctcttcc

SEQ ID NO: 79232 - DNA, 37 bp, Artificial Sequence
  Description of Artificial Sequence: Synthetic oligonucleotide
ccaacactttggtctgttttgtcagtaatctcttccc

SEQ ID NO: 79233 - DNA, 38 bp, Artificial Sequence
  Description of Artificial Sequence: Synthetic oligonucleotide
caacactttggtctgttttgtcagtaatctcttcccac

SEQ ID NO: 79234 - DNA, 38 bp, Artificial Sequence
  Description of Artificial Sequence: Synthetic oligonucleotide
aacactttggtctgttttgtcagtaatctcttcccacc

SEQ ID NO: 79235 - DNA, 37 bp, Artificial Sequence
  Description of Artificial Sequence: Synthetic oligonucleotide
acactttggtctgttttgtcagtaatctcttcccacc

SEQ ID NO: 79236 - DNA, 36 bp, Artificial Sequence
  Description of Artificial Sequence: Synthetic oligonucleotide
cactttggtctgttttgtcagtaatctcttcccacc

SEQ ID NO: 79237 - DNA, 36 bp, Artificial Sequence
  Description of Artificial Sequence: Synthetic oligonucleotide
actttggtctgttttgtcagtaatctcttcccaccc

SEQ ID NO: 79238 - DNA, 35 bp, Artificial Sequence
  Description of Artificial Sequence: Synthetic oligonucleotide
ctttggtctgttttgtcagtaatctcttcccaccc

SEQ ID NO: 79239 - DNA, 37 bp, Artificial Sequence
  Description of Artificial Sequence: Synthetic oligonucleotide
tttggtctgttttgtcagtaatctcttcccacccatg

SEQ ID NO: 79240 - DNA, 36 bp, Artificial Sequence
  Description of Artificial Sequence: Synthetic oligonucleotide
ttggtctgttttgtcagtaatctcttcccacccatg

SEQ ID NO: 79241 - DNA, 35 bp, Artificial Sequence
  Description of Artificial Sequence: Synthetic oligonucleotide
tggtctgttttgtcagtaatctcttcccacccatg

SEQ ID NO: 79242 - DNA, 34 bp, Artificial Sequence
  Description of Artificial Sequence: Synthetic oligonucleotide
ggtctgttttgtcagtaatctcttcccacccatg

SEQ ID NO: 79243 - DNA, 34 bp, Artificial Sequence
  Description of Artificial Sequence: Synthetic oligonucleotide
gtctgttttgtcagtaatctcttcccacccatgc

SEQ ID NO: 79244 - DNA, 35 bp, Artificial Sequence
  Description of Artificial Sequence: Synthetic oligonucleotide
tctgttttgtcagtaatctcttcccacccatgctg

SEQ ID NO: 79245 - DNA, 34 bp, Artificial Sequence
  Description of Artificial Sequence: Synthetic oligonucleotide
ctgttttgtcagtaatctcttcccacccatgctg

SEQ ID NO: 79246 - DNA, 35 bp, Artificial Sequence
  Description of Artificial Sequence: Synthetic oligonucleotide
tgttttgtcagtaatctcttcccacccatgctgac

SEQ ID NO: 79247 - DNA, 34 bp, Artificial Sequence
  Description of Artificial Sequence: Synthetic oligonucleotide
gttttgtcagtaatctcttcccacccatgctgac

SEQ ID NO: 79248 - DNA, 35 bp, Artificial Sequence
  Description of Artificial Sequence: Synthetic oligonucleotide
ttttgtcagtaatctcttcccacccatgctgacag

SEQ ID NO: 79249 - DNA, 34 bp, Artificial Sequence
  Description of Artificial Sequence: Synthetic oligonucleotide
tttgtcagtaatctcttcccacccatgctgacag

SEQ ID NO: 79250 - DNA, 33 bp, Artificial Sequence
  Description of Artificial Sequence: Synthetic oligonucleotide
ttgtcagtaatctcttcccacccatgctgacag

SEQ ID NO: 79251 - DNA, 32 bp, Artificial Sequence
  Description of Artificial Sequence: Synthetic oligonucleotide
tgtcagtaatctcttcccacccatgctgacag

SEQ ID NO: 79252 - DNA, 31 bp, Artificial Sequence
  Description of Artificial Sequence: Synthetic oligonucleotide
gtcagtaatctcttcccacccatgctgacag

SEQ ID NO: 79253 - DNA, 32 bp, Artificial Sequence
  Description of Artificial Sequence: Synthetic oligonucleotide
tcagtaatctcttcccacccatgctgacagtg

SEQ ID NO: 79254 - DNA, 31 bp, Artificial Sequence
  Description of Artificial Sequence: Synthetic oligonucleotide
cagtaatctcttcccacccatgctgacagtg

SEQ ID NO: 79255 - DNA, 33 bp, Artificial Sequence
  Description of Artificial Sequence: Synthetic oligonucleotide
agtaatctcttcccacccatgctgacagtgaac

SEQ ID NO: 79256 - DNA, 32 bp, Artificial Sequence
  Description of Artificial Sequence: Synthetic oligonucleotide
gtaatctcttcccacccatgctgacagtgaac

SEQ ID NO: 79257 - DNA, 33 bp, Artificial Sequence
  Description of Artificial Sequence: Synthetic oligonucleotide
taatctcttcccacccatgctgacagtgaactg

SEQ ID NO: 79258 - DNA, 32 bp, Artificial Sequence
  Description of Artificial Sequence: Synthetic oligonucleotide
aatctcttcccacccatgctgacagtgaactg

SEQ ID NO: 79259 - DNA, 31 bp, Artificial Sequence
  Description of Artificial Sequence: Synthetic oligonucleotide
atctcttcccacccatgctgacagtgaactg

SEQ ID NO: 79260 - DNA, 30 bp, Artificial Sequence
  Description of Artificial Sequence: Synthetic oligonucleotide
tctcttcccacccatgctgacagtgaactg

SEQ ID NO: 79261 - DNA, 29 bp, Artificial Sequence
  Description of Artificial Sequence: Synthetic oligonucleotide
ctcttcccacccatgctgacagtgaactg

SEQ ID NO: 79262 - DNA, 29 bp, Artificial Sequence
  Description of Artificial Sequence: Synthetic oligonucleotide
tcttcccacccatgctgacagtgaactgg

SEQ ID NO: 79263 - DNA, 28 bp, Artificial Sequence
  Description of Artificial Sequence: Synthetic oligonucleotide
cttcccacccatgctgacagtgaactgg

SEQ ID NO: 79264 - DNA, 28 bp, Artificial Sequence
  Description of Artificial Sequence: Synthetic oligonucleotide
ttcccacccatgctgacagtgaactggc

SEQ ID NO: 79265 - DNA, 27 bp, Artificial Sequence
  Description of Artificial Sequence: Synthetic oligonucleotide
tcccacccatgctgacagtgaactggc

SEQ ID NO: 79266 - DNA, 27 bp, Artificial Sequence
  Description of Artificial Sequence: Synthetic oligonucleotide
cccacccatgctgacagtgaactggca

SEQ ID NO: 79267 - DNA, 27 bp, Artificial Sequence
  Description of Artificial Sequence: Synthetic oligonucleotide
ccacccatgctgacagtgaactggcag

SEQ ID NO: 79268 - DNA, 27 bp, Artificial Sequence
  Description of Artificial Sequence: Synthetic oligonucleotide
cacccatgctgacagtgaactggcagc

SEQ ID NO: 79269 - DNA, 29 bp, Artificial Sequence
  Description of Artificial Sequence: Synthetic oligonucleotide
acccatgctgacagtgaactggcagcatc

SEQ ID NO: 79270 - DNA, 28 bp, Artificial Sequence
  Description of Artificial Sequence: Synthetic oligonucleotide
cccatgctgacagtgaactggcagcatc

SEQ ID NO: 79271 - DNA, 31 bp, Artificial Sequence
  Description of Artificial Sequence: Synthetic oligonucleotide
ccatgctgacagtgaactggcagcatcattc

SEQ ID NO: 79272 - DNA, 31 bp, Artificial Sequence
  Description of Artificial Sequence: Synthetic oligonucleotide
catgctgacagtgaactggcagcatcattcc

SEQ ID NO: 79273 - DNA, 31 bp, Artificial Sequence
  Description of Artificial Sequence: Synthetic oligonucleotide
atgctgacagtgaactggcagcatcattccg

SEQ ID NO: 79274 - DNA, 30 bp, Artificial Sequence
  Description of Artificial Sequence: Synthetic oligonucleotide
tgctgacagtgaactggcagcatcattccg

SEQ ID NO: 79275 - DNA, 29 bp, Artificial Sequence
  Description of Artificial Sequence: Synthetic oligonucleotide
gctgacagtgaactggcagcatcattccg

SEQ ID NO: 79276 - DNA, 30 bp, Artificial Sequence
  Description of Artificial Sequence: Synthetic oligonucleotide
ctgacagtgaactggcagcatcattccgtc

SEQ ID NO: 79277 - DNA, 30 bp, Artificial Sequence
  Description of Artificial Sequence: Synthetic oligonucleotide
tgacagtgaactggcagcatcattccgtcc

SEQ ID NO: 79278 - DNA, 29 bp, Artificial Sequence
  Description of Artificial Sequence: Synthetic oligonucleotide
gacagtgaactggcagcatcattccgtcc

SEQ ID NO: 79279 - DNA, 29 bp, Artificial Sequence
  Description of Artificial Sequence: Synthetic oligonucleotide
acagtgaactggcagcatcattccgtccc

SEQ ID NO: 79280 - DNA, 28 bp, Artificial Sequence
  Description of Artificial Sequence: Synthetic oligonucleotide
cagtgaactggcagcatcattccgtccc

SEQ ID NO: 79281 - DNA, 29 bp, Artificial Sequence
  Description of Artificial Sequence: Synthetic oligonucleotide
agtgaactggcagcatcattccgtccctg

SEQ ID NO: 79282 - DNA, 28 bp, Artificial Sequence
  Description of Artificial Sequence: Synthetic oligonucleotide
gtgaactggcagcatcattccgtccctg

SEQ ID NO: 79283 - DNA, 29 bp, Artificial Sequence
  Description of Artificial Sequence: Synthetic oligonucleotide
tgaactggcagcatcattccgtccctgtg

SEQ ID NO: 79284 - DNA, 28 bp, Artificial Sequence
  Description of Artificial Sequence: Synthetic oligonucleotide
gaactggcagcatcattccgtccctgtg

SEQ ID NO: 79285 - DNA, 28 bp, Artificial Sequence
  Description of Artificial Sequence: Synthetic oligonucleotide
aactggcagcatcattccgtccctgtgg

SEQ ID NO: 79286 - DNA, 27 bp, Artificial Sequence
  Description of Artificial Sequence: Synthetic oligonucleotide
actggcagcatcattccgtccctgtgg

SEQ ID NO: 79287 - DNA, 27 bp, Artificial Sequence
  Description of Artificial Sequence: Synthetic oligonucleotide
ctggcagcatcattccgtccctgtgga

SEQ ID NO: 79288 - DNA, 28 bp, Artificial Sequence
  Description of Artificial Sequence: Synthetic oligonucleotide
tggcagcatcattccgtccctgtggaag

SEQ ID NO: 79289 - DNA, 27 bp, Artificial Sequence
  Description of Artificial Sequence: Synthetic oligonucleotide
ggcagcatcattccgtccctgtggaag

SEQ ID NO: 79290 - DNA, 27 bp, Artificial Sequence
  Description of Artificial Sequence: Synthetic oligonucleotide
gcagcatcattccgtccctgtggaagg

SEQ ID NO: 79291 - DNA, 31 bp, Artificial Sequence
  Description of Artificial Sequence: Synthetic oligonucleotide
cagcatcattccgtccctgtggaaggatttg

SEQ ID NO: 79292 - DNA, 31 bp, Artificial Sequence
  Description of Artificial Sequence: Synthetic oligonucleotide
agcatcattccgtccctgtggaaggatttgg

SEQ ID NO: 79293 - DNA, 30 bp, Artificial Sequence
  Description of Artificial Sequence: Synthetic oligonucleotide
gcatcattccgtccctgtggaaggatttgg

SEQ ID NO: 79294 - DNA, 30 bp, Artificial Sequence
  Description of Artificial Sequence: Synthetic oligonucleotide
catcattccgtccctgtggaaggatttggg

SEQ ID NO: 79295 - DNA, 30 bp, Artificial Sequence
  Description of Artificial Sequence: Synthetic oligonucleotide
atcattccgtccctgtggaaggatttgggc

SEQ ID NO: 79296 - DNA, 29 bp, Artificial Sequence
  Description of Artificial Sequence: Synthetic oligonucleotide
tcattccgtccctgtggaaggatttgggc

SEQ ID NO: 79297 - DNA, 28 bp, Artificial Sequence
  Description of Artificial Sequence: Synthetic oligonucleotide
cattccgtccctgtggaaggatttgggc

SEQ ID NO: 79298 - DNA, 28 bp, Artificial Sequence
  Description of Artificial Sequence: Synthetic oligonucleotide
attccgtccctgtggaaggatttgggcc

SEQ ID NO: 79299 - DNA, 27 bp, Artificial Sequence
  Description of Artificial Sequence: Synthetic oligonucleotide
ttccgtccctgtggaaggatttgggcc

SEQ ID NO: 79300 - DNA, 27 bp, Artificial Sequence
  Description of Artificial Sequence: Synthetic oligonucleotide
tccgtccctgtggaaggatttgggcct

SEQ ID NO: 79301 - DNA, 27 bp, Artificial Sequence
  Description of Artificial Sequence: Synthetic oligonucleotide
ccgtccctgtggaaggatttgggccta

SEQ ID NO: 79302 - DNA, 27 bp, Artificial Sequence
  Description of Artificial Sequence: Synthetic oligonucleotide
cgtccctgtggaaggatttgggcctac

SEQ ID NO: 79303 - DNA, 31 bp, Artificial Sequence
  Description of Artificial Sequence: Synthetic oligonucleotide
gtccctgtggaaggatttgggcctacttttg

SEQ ID NO: 79304 - DNA, 32 bp, Artificial Sequence
  Description of Artificial Sequence: Synthetic oligonucleotide
tccctgtggaaggatttgggcctacttttgtc

SEQ ID NO: 79305 - DNA, 31 bp, Artificial Sequence
  Description of Artificial Sequence: Synthetic oligonucleotide
ccctgtggaaggatttgggcctacttttgtc

SEQ ID NO: 79306 - DNA, 32 bp, Artificial Sequence
  Description of Artificial Sequence: Synthetic oligonucleotide
cctgtggaaggatttgggcctacttttgtctc

SEQ ID NO: 79307 - DNA, 33 bp, Artificial Sequence
  Description of Artificial Sequence: Synthetic oligonucleotide
ctgtggaaggatttgggcctacttttgtctcag

SEQ ID NO: 79308 - DNA, 33 bp, Artificial Sequence
  Description of Artificial Sequence: Synthetic oligonucleotide
tgtggaaggatttgggcctacttttgtctcagc

SEQ ID NO: 79309 - DNA, 32 bp, Artificial Sequence
  Description of Artificial Sequence: Synthetic oligonucleotide
gtggaaggatttgggcctacttttgtctcagc

SEQ ID NO: 79310 - DNA, 33 bp, Artificial Sequence
  Description of Artificial Sequence: Synthetic oligonucleotide
tggaaggatttgggcctacttttgtctcagctg

SEQ ID NO: 79311 - DNA, 32 bp, Artificial Sequence
  Description of Artificial Sequence: Synthetic oligonucleotide
ggaaggatttgggcctacttttgtctcagctg

SEQ ID NO: 79312 - DNA, 33 bp, Artificial Sequence
  Description of Artificial Sequence: Synthetic oligonucleotide
gaaggatttgggcctacttttgtctcagctgtc

SEQ ID NO: 79313 - DNA, 33 bp, Artificial Sequence
  Description of Artificial Sequence: Synthetic oligonucleotide
aaggatttgggcctacttttgtctcagctgtcg

SEQ ID NO: 79314 - DNA, 32 bp, Artificial Sequence
  Description of Artificial Sequence: Synthetic oligonucleotide
aggatttgggcctacttttgtctcagctgtcg

SEQ ID NO: 79315 - DNA, 31 bp, Artificial Sequence
  Description of Artificial Sequence: Synthetic oligonucleotide
ggatttgggcctacttttgtctcagctgtcg

SEQ ID NO: 79316 - DNA, 33 bp, Artificial Sequence
  Description of Artificial Sequence: Synthetic oligonucleotide
gatttgggcctacttttgtctcagctgtcgatg

SEQ ID NO: 79317 - DNA, 33 bp, Artificial Sequence
  Description of Artificial Sequence: Synthetic oligonucleotide
atttgggcctacttttgtctcagctgtcgatgg

SEQ ID NO: 79318 - DNA, 32 bp, Artificial Sequence
  Description of Artificial Sequence: Synthetic oligonucleotide
tttgggcctacttttgtctcagctgtcgatgg

SEQ ID NO: 79319 - DNA, 31 bp, Artificial Sequence
  Description of Artificial Sequence: Synthetic oligonucleotide
ttgggcctacttttgtctcagctgtcgatgg

SEQ ID NO: 79320 - DNA, 30 bp, Artificial Sequence
  Description of Artificial Sequence: Synthetic oligonucleotide
tgggcctacttttgtctcagctgtcgatgg

SEQ ID NO: 79321 - DNA, 29 bp, Artificial Sequence
  Description of Artificial Sequence: Synthetic oligonucleotide
gggcctacttttgtctcagctgtcgatgg

SEQ ID NO: 79322 - DNA, 30 bp, Artificial Sequence
  Description of Artificial Sequence: Synthetic oligonucleotide
ggcctacttttgtctcagctgtcgatggac

SEQ ID NO: 79323 - DNA, 31 bp, Artificial Sequence
  Description of Artificial Sequence: Synthetic oligonucleotide
gcctacttttgtctcagctgtcgatggactc

SEQ ID NO: 79324 - DNA, 32 bp, Artificial Sequence
  Description of Artificial Sequence: Synthetic oligonucleotide
cctacttttgtctcagctgtcgatggactcag

SEQ ID NO: 79325 - DNA, 32 bp, Artificial Sequence
  Description of Artificial Sequence: Synthetic oligonucleotide
ctacttttgtctcagctgtcgatggactcagc

SEQ ID NO: 79326 - DNA, 34 bp, Artificial Sequence
  Description of Artificial Sequence: Synthetic oligonucleotide
tacttttgtctcagctgtcgatggactcagcttc

SEQ ID NO: 79327 - DNA, 33 bp, Artificial Sequence
  Description of Artificial Sequence: Synthetic oligonucleotide
acttttgtctcagctgtcgatggactcagcttc

SEQ ID NO: 79328 - DNA, 32 bp, Artificial Sequence
  Description of Artificial Sequence: Synthetic oligonucleotide
cttttgtctcagctgtcgatggactcagcttc

SEQ ID NO: 79329 - DNA, 32 bp, Artificial Sequence
  Description of Artificial Sequence: Synthetic oligonucleotide
ttttgtctcagctgtcgatggactcagcttcc

SEQ ID NO: 79330 - DNA, 31 bp, Artificial Sequence
  Description of Artificial Sequence: Synthetic oligonucleotide
tttgtctcagctgtcgatggactcagcttcc

SEQ ID NO: 79331 - DNA, 30 bp, Artificial Sequence
  Description of Artificial Sequence: Synthetic oligonucleotide
ttgtctcagctgtcgatggactcagcttcc

SEQ ID NO: 79332 - DNA, 29 bp, Artificial Sequence
  Description of Artificial Sequence: Synthetic oligonucleotide
tgtctcagctgtcgatggactcagcttcc

SEQ ID NO: 79333 - DNA, 28 bp, Artificial Sequence
  Description of Artificial Sequence: Synthetic oligonucleotide
gtctcagctgtcgatggactcagcttcc

SEQ ID NO: 79334 - DNA, 29 bp, Artificial Sequence
  Description of Artificial Sequence: Synthetic oligonucleotide
tctcagctgtcgatggactcagcttccag

SEQ ID NO: 79335 - DNA, 28 bp, Artificial Sequence
  Description of Artificial Sequence: Synthetic oligonucleotide
ctcagctgtcgatggactcagcttccag

SEQ ID NO: 79336 - DNA, 28 bp, Artificial Sequence
  Description of Artificial Sequence: Synthetic oligonucleotide
tcagctgtcgatggactcagcttccagg

SEQ ID NO: 79337 - DNA, 27 bp, Artificial Sequence
  Description of Artificial Sequence: Synthetic oligonucleotide
cagctgtcgatggactcagcttccagg

SEQ ID NO: 79338 - DNA, 27 bp, Artificial Sequence
  Description of Artificial Sequence: Synthetic oligonucleotide
agctgtcgatggactcagcttccaggc

SEQ ID NO: 79339 - DNA, 26 bp, Artificial Sequence
  Description of Artificial Sequence: Synthetic oligonucleotide
gctgtcgatggactcagcttccaggc

SEQ ID NO: 79340 - DNA, 27 bp, Artificial Sequence
  Description of Artificial Sequence: Synthetic oligonucleotide
ctgtcgatggactcagcttccaggcct

SEQ ID NO: 79341 - DNA, 30 bp, Artificial Sequence
  Description of Artificial Sequence: Synthetic oligonucleotide
tgtcgatggactcagcttccaggccttttc

SEQ ID NO: 79342 - DNA, 29 bp, Artificial Sequence
  Description of Artificial Sequence: Synthetic oligonucleotide
gtcgatggactcagcttccaggccttttc

SEQ ID NO: 79343 - DNA, 32 bp, Artificial Sequence
  Description of Artificial Sequence: Synthetic oligonucleotide
tcgatggactcagcttccaggccttttcttac

SEQ ID NO: 79344 - DNA, 31 bp, Artificial Sequence
  Description of Artificial Sequence: Synthetic oligonucleotide
cgatggactcagcttccaggccttttcttac

SEQ ID NO: 79345 - DNA, 36 bp, Artificial Sequence
  Description of Artificial Sequence: Synthetic oligonucleotide
gatggactcagcttccaggccttttcttacttaaac

SEQ ID NO: 79346 - DNA, 38 bp, Artificial Sequence
  Description of Artificial Sequence: Synthetic oligonucleotide
atggactcagcttccaggccttttcttacttaaacttc

SEQ ID NO: 79347 - DNA, 37 bp, Artificial Sequence
  Description of Artificial Sequence: Synthetic oligonucleotide
tggactcagcttccaggccttttcttacttaaacttc

SEQ ID NO: 79348 - DNA, 36 bp, Artificial Sequence
  Description of Artificial Sequence: Synthetic oligonucleotide
ggactcagcttccaggccttttcttacttaaacttc

SEQ ID NO: 79349 - DNA, 37 bp, Artificial Sequence
  Description of Artificial Sequence: Synthetic oligonucleotide
gactcagcttccaggccttttcttacttaaacttcac

SEQ ID NO: 79350 - DNA, 38 bp, Artificial Sequence
  Description of Artificial Sequence: Synthetic oligonucleotide
actcagcttccaggccttttcttacttaaacttcacac

SEQ ID NO: 79351 - DNA, 37 bp, Artificial Sequence
  Description of Artificial Sequence: Synthetic oligonucleotide
ctcagcttccaggccttttcttacttaaacttcacac

SEQ ID NO: 79352 - DNA, 37 bp, Artificial Sequence
  Description of Artificial Sequence: Synthetic oligonucleotide
tcagcttccaggccttttcttacttaaacttcacacc

SEQ ID NO: 79353 - DNA, 36 bp, Artificial Sequence
  Description of Artificial Sequence: Synthetic oligonucleotide
cagcttccaggccttttcttacttaaacttcacacc

SEQ ID NO: 79354 - DNA, 37 bp, Artificial Sequence
  Description of Artificial Sequence: Synthetic oligonucleotide
agcttccaggccttttcttacttaaacttcacaccag

SEQ ID NO: 79355 - DNA, 36 bp, Artificial Sequence
  Description of Artificial Sequence: Synthetic oligonucleotide
gcttccaggccttttcttacttaaacttcacaccag

SEQ ID NO: 79356 - DNA, 38 bp, Artificial Sequence
  Description of Artificial Sequence: Synthetic oligonucleotide
cttccaggccttttcttacttaaacttcacaccagaac

SEQ ID NO: 79357 - DNA, 38 bp, Artificial Sequence
  Description of Artificial Sequence: Synthetic oligonucleotide
ttccaggccttttcttacttaaacttcacaccagaacc

SEQ ID NO: 79358 - DNA, 37 bp, Artificial Sequence
  Description of Artificial Sequence: Synthetic oligonucleotide
tccaggccttttcttacttaaacttcacaccagaacc

SEQ ID NO: 79359 - DNA, 36 bp, Artificial Sequence
  Description of Artificial Sequence: Synthetic oligonucleotide
ccaggccttttcttacttaaacttcacaccagaacc

SEQ ID NO: 79360 - DNA, 38 bp, Artificial Sequence
  Description of Artificial Sequence: Synthetic oligonucleotide
caggccttttcttacttaaacttcacaccagaaccttc

SEQ ID NO: 79361 - DNA, 39 bp, Artificial Sequence
  Description of Artificial Sequence: Synthetic oligonucleotide
aggccttttcttacttaaacttcacaccagaaccttctg

SEQ ID NO: 79362 - DNA, 38 bp, Artificial Sequence
  Description of Artificial Sequence: Synthetic oligonucleotide
ggccttttcttacttaaacttcacaccagaaccttctg

SEQ ID NO: 79363 - DNA, 39 bp, Artificial Sequence
  Description of Artificial Sequence: Synthetic oligonucleotide
gccttttcttacttaaacttcacaccagaaccttctgac

SEQ ID NO: 79364 - DNA, 44 bp, Artificial Sequence
  Description of Artificial Sequence: Synthetic oligonucleotide
ccttttcttacttaaacttcacaccagaaccttctgacattttc

SEQ ID NO: 79365 - DNA, 45 bp, Artificial Sequence
  Description of Artificial Sequence: Synthetic oligonucleotide
cttttcttacttaaacttcacaccagaaccttctgacattttctc

SEQ ID NO: 79366 - DNA, 45 bp, Artificial Sequence
  Description of Artificial Sequence: Synthetic oligonucleotide
ttttcttacttaaacttcacaccagaaccttctgacattttctcc

SEQ ID NO: 79367 - DNA, 44 bp, Artificial Sequence
  Description of Artificial Sequence: Synthetic oligonucleotide
tttcttacttaaacttcacaccagaaccttctgacattttctcc

SEQ ID NO: 79368 - DNA, 43 bp, Artificial Sequence
  Description of Artificial Sequence: Synthetic oligonucleotide
ttcttacttaaacttcacaccagaaccttctgacattttctcc

SEQ ID NO: 79369 - DNA, 42 bp, Artificial Sequence
  Description of Artificial Sequence: Synthetic oligonucleotide
tcttacttaaacttcacaccagaaccttctgacattttctcc

SEQ ID NO: 79370 - DNA, 41 bp, Artificial Sequence
  Description of Artificial Sequence: Synthetic oligonucleotide
cttacttaaacttcacaccagaaccttctgacattttctcc

SEQ ID NO: 79371 - DNA, 42 bp, Artificial Sequence
  Description of Artificial Sequence: Synthetic oligonucleotide
ttacttaaacttcacaccagaaccttctgacattttctcctg

SEQ ID NO: 79372 - DNA, 41 bp, Artificial Sequence
  Description of Artificial Sequence: Synthetic oligonucleotide
tacttaaacttcacaccagaaccttctgacattttctcctg

SEQ ID NO: 79373 - DNA, 40 bp, Artificial Sequence
  Description of Artificial Sequence: Synthetic oligonucleotide
acttaaacttcacaccagaaccttctgacattttctcctg

SEQ ID NO: 79374 - DNA, 39 bp, Artificial Sequence
  Description of Artificial Sequence: Synthetic oligonucleotide
cttaaacttcacaccagaaccttctgacattttctcctg

SEQ ID NO: 79375 - DNA, 39 bp, Artificial Sequence
  Description of Artificial Sequence: Synthetic oligonucleotide
ttaaacttcacaccagaaccttctgacattttctcctgc

SEQ ID NO: 79376 - DNA, 38 bp, Artificial Sequence
  Description of Artificial Sequence: Synthetic oligonucleotide
taaacttcacaccagaaccttctgacattttctcctgc

SEQ ID NO: 79377 - DNA, 37 bp, Artificial Sequence
  Description of Artificial Sequence: Synthetic oligonucleotide
aaacttcacaccagaaccttctgacattttctcctgc

SEQ ID NO: 79378 - DNA, 36 bp, Artificial Sequence
  Description of Artificial Sequence: Synthetic oligonucleotide
aacttcacaccagaaccttctgacattttctcctgc

SEQ ID NO: 79379 - DNA, 35 bp, Artificial Sequence
  Description of Artificial Sequence: Synthetic oligonucleotide
acttcacaccagaaccttctgacattttctcctgc

SEQ ID NO: 79380 - DNA, 34 bp, Artificial Sequence
  Description of Artificial Sequence: Synthetic oligonucleotide
cttcacaccagaaccttctgacattttctcctgc

SEQ ID NO: 79381 - DNA, 37 bp, Artificial Sequence
  Description of Artificial Sequence: Synthetic oligonucleotide
ttcacaccagaaccttctgacattttctcctgcattg

SEQ ID NO: 79382 - DNA, 36 bp, Artificial Sequence
  Description of Artificial Sequence: Synthetic oligonucleotide
tcacaccagaaccttctgacattttctcctgcattg

SEQ ID NO: 79383 - DNA, 35 bp, Artificial Sequence
  Description of Artificial Sequence: Synthetic oligonucleotide
cacaccagaaccttctgacattttctcctgcattg

SEQ ID NO: 79384 - DNA, 36 bp, Artificial Sequence
  Description of Artificial Sequence: Synthetic oligonucleotide
acaccagaaccttctgacattttctcctgcattgtg

SEQ ID NO: 79385 - DNA, 35 bp, Artificial Sequence
  Description of Artificial Sequence: Synthetic oligonucleotide
caccagaaccttctgacattttctcctgcattgtg

SEQ ID NO: 79386 - DNA, 36 bp, Artificial Sequence
  Description of Artificial Sequence: Synthetic oligonucleotide
accagaaccttctgacattttctcctgcattgtgac

SEQ ID NO: 79387 - DNA, 35 bp, Artificial Sequence
  Description of Artificial Sequence: Synthetic oligonucleotide
ccagaaccttctgacattttctcctgcattgtgac

SEQ ID NO: 79388 - DNA, 36 bp, Artificial Sequence
  Description of Artificial Sequence: Synthetic oligonucleotide
cagaaccttctgacattttctcctgcattgtgactc

SEQ ID NO: 79389 - DNA, 37 bp, Artificial Sequence
  Description of Artificial Sequence: Synthetic oligonucleotide
agaaccttctgacattttctcctgcattgtgactcac

SEQ ID NO: 79390 - DNA, 36 bp, Artificial Sequence
  Description of Artificial Sequence: Synthetic oligonucleotide
gaaccttctgacattttctcctgcattgtgactcac

SEQ ID NO: 79391 - DNA, 36 bp, Artificial Sequence
  Description of Artificial Sequence: Synthetic oligonucleotide
aaccttctgacattttctcctgcattgtgactcacg

SEQ ID NO: 79392 - DNA, 35 bp, Artificial Sequence
  Description of Artificial Sequence: Synthetic oligonucleotide
accttctgacattttctcctgcattgtgactcacg

SEQ ID NO: 79393 - DNA, 34 bp, Artificial Sequence
  Description of Artificial Sequence: Synthetic oligonucleotide
ccttctgacattttctcctgcattgtgactcacg

SEQ ID NO: 79394 - DNA, 39 bp, Artificial Sequence
  Description of Artificial Sequence: Synthetic oligonucleotide
cttctgacattttctcctgcattgtgactcacgaaattg

SEQ ID NO: 79395 - DNA, 40 bp, Artificial Sequence
  Description of Artificial Sequence: Synthetic oligonucleotide
ttctgacattttctcctgcattgtgactcacgaaattgac

SEQ ID NO: 79396 - DNA, 39 bp, Artificial Sequence
  Description of Artificial Sequence: Synthetic oligonucleotide
tctgacattttctcctgcattgtgactcacgaaattgac

SEQ ID NO: 79397 - DNA, 38 bp, Artificial Sequence
  Description of Artificial Sequence: Synthetic oligonucleotide
ctgacattttctcctgcattgtgactcacgaaattgac

SEQ ID NO: 79398 - DNA, 38 bp, Artificial Sequence
  Description of Artificial Sequence: Synthetic oligonucleotide
tgacattttctcctgcattgtgactcacgaaattgacc

SEQ ID NO: 79399 - DNA, 37 bp, Artificial Sequence
  Description of Artificial Sequence: Synthetic oligonucleotide
gacattttctcctgcattgtgactcacgaaattgacc

SEQ ID NO: 79400 - DNA, 37 bp, Artificial Sequence
  Description of Artificial Sequence: Synthetic oligonucleotide
acattttctcctgcattgtgactcacgaaattgaccg

SEQ ID NO: 79401 - DNA, 36 bp, Artificial Sequence
  Description of Artificial Sequence: Synthetic oligonucleotide
cattttctcctgcattgtgactcacgaaattgaccg

SEQ ID NO: 79402 - DNA, 36 bp, Artificial Sequence
  Description of Artificial Sequence: Synthetic oligonucleotide
attttctcctgcattgtgactcacgaaattgaccgc

SEQ ID NO: 79403 - DNA, 35 bp, Artificial Sequence
  Description of Artificial Sequence: Synthetic oligonucleotide
ttttctcctgcattgtgactcacgaaattgaccgc

SEQ ID NO: 79404 - DNA, 34 bp, Artificial Sequence
  Description of Artificial Sequence: Synthetic oligonucleotide
tttctcctgcattgtgactcacgaaattgaccgc

SEQ ID NO: 79405 - DNA, 33 bp, Artificial Sequence
  Description of Artificial Sequence: Synthetic oligonucleotide
ttctcctgcattgtgactcacgaaattgaccgc

SEQ ID NO: 79406 - DNA, 32 bp, Artificial Sequence
  Description of Artificial Sequence: Synthetic oligonucleotide
tctcctgcattgtgactcacgaaattgaccgc

SEQ ID NO: 79407 - DNA, 31 bp, Artificial Sequence
  Description of Artificial Sequence: Synthetic oligonucleotide
ctcctgcattgtgactcacgaaattgaccgc

SEQ ID NO: 79408 - DNA, 33 bp, Artificial Sequence
  Description of Artificial Sequence: Synthetic oligonucleotide
tcctgcattgtgactcacgaaattgaccgctac

SEQ ID NO: 79409 - DNA, 32 bp, Artificial Sequence
  Description of Artificial Sequence: Synthetic oligonucleotide
cctgcattgtgactcacgaaattgaccgctac

SEQ ID NO: 79410 - DNA, 33 bp, Artificial Sequence
  Description of Artificial Sequence: Synthetic oligonucleotide
ctgcattgtgactcacgaaattgaccgctacac

SEQ ID NO: 79411 - DNA, 34 bp, Artificial Sequence
  Description of Artificial Sequence: Synthetic oligonucleotide
tgcattgtgactcacgaaattgaccgctacacag

SEQ ID NO: 79412 - DNA, 33 bp, Artificial Sequence
  Description of Artificial Sequence: Synthetic oligonucleotide
gcattgtgactcacgaaattgaccgctacacag

SEQ ID NO: 79413 - DNA, 33 bp, Artificial Sequence
  Description of Artificial Sequence: Synthetic oligonucleotide
cattgtgactcacgaaattgaccgctacacagc

SEQ ID NO: 79414 - DNA, 37 bp, Artificial Sequence
  Description of Artificial Sequence: Synthetic oligonucleotide
attgtgactcacgaaattgaccgctacacagcaattg

SEQ ID NO: 79415 - DNA, 36 bp, Artificial Sequence
  Description of Artificial Sequence: Synthetic oligonucleotide
ttgtgactcacgaaattgaccgctacacagcaattg

SEQ ID NO: 79416 - DNA, 35 bp, Artificial Sequence
  Description of Artificial Sequence: Synthetic oligonucleotide
tgtgactcacgaaattgaccgctacacagcaattg

SEQ ID NO: 79417 - DNA, 34 bp, Artificial Sequence
  Description of Artificial Sequence: Synthetic oligonucleotide
gtgactcacgaaattgaccgctacacagcaattg

SEQ ID NO: 79418 - DNA, 34 bp, Artificial Sequence
  Description of Artificial Sequence: Synthetic oligonucleotide
tgactcacgaaattgaccgctacacagcaattgc

SEQ ID NO: 79419 - DNA, 33 bp, Artificial Sequence
  Description of Artificial Sequence: Synthetic oligonucleotide
gactcacgaaattgaccgctacacagcaattgc

SEQ ID NO: 79420 - DNA, 33 bp, Artificial Sequence
  Description of Artificial Sequence: Synthetic oligonucleotide
actcacgaaattgaccgctacacagcaattgcc

SEQ ID NO: 79421 - DNA, 32 bp, Artificial Sequence
  Description of Artificial Sequence: Synthetic oligonucleotide
ctcacgaaattgaccgctacacagcaattgcc

SEQ ID NO: 79422 - DNA, 36 bp, Artificial Sequence
  Description of Artificial Sequence: Synthetic oligonucleotide
tcacgaaattgaccgctacacagcaattgcctattg

SEQ ID NO: 79423 - DNA, 35 bp, Artificial Sequence
  Description of Artificial Sequence: Synthetic oligonucleotide
cacgaaattgaccgctacacagcaattgcctattg

SEQ ID NO: 79424 - DNA, 35 bp, Artificial Sequence
  Description of Artificial Sequence: Synthetic oligonucleotide
acgaaattgaccgctacacagcaattgcctattgg

SEQ ID NO: 79425 - DNA, 34 bp, Artificial Sequence
  Description of Artificial Sequence: Synthetic oligonucleotide
cgaaattgaccgctacacagcaattgcctattgg

SEQ ID NO: 79426 - DNA, 34 bp, Artificial Sequence
  Description of Artificial Sequence: Synthetic oligonucleotide
gaaattgaccgctacacagcaattgcctattggg

SEQ ID NO: 79427 - DNA, 36 bp, Artificial Sequence
  Description of Artificial Sequence: Synthetic oligonucleotide
aaattgaccgctacacagcaattgcctattgggtac

SEQ ID NO: 79428 - DNA, 35 bp, Artificial Sequence
  Description of Artificial Sequence: Synthetic oligonucleotide
aattgaccgctacacagcaattgcctattgggtac

SEQ ID NO: 79429 - DNA, 34 bp, Artificial Sequence
  Description of Artificial Sequence: Synthetic oligonucleotide
attgaccgctacacagcaattgcctattgggtac

SEQ ID NO: 79430 - DNA, 33 bp, Artificial Sequence
  Description of Artificial Sequence: Synthetic oligonucleotide
ttgaccgctacacagcaattgcctattgggtac

SEQ ID NO: 79431 - DNA, 32 bp, Artificial Sequence
  Description of Artificial Sequence: Synthetic oligonucleotide
tgaccgctacacagcaattgcctattgggtac

SEQ ID NO: 79432 - DNA, 31 bp, Artificial Sequence
  Description of Artificial Sequence: Synthetic oligonucleotide
gaccgctacacagcaattgcctattgggtac

SEQ ID NO: 79433 - DNA, 31 bp, Artificial Sequence
  Description of Artificial Sequence: Synthetic oligonucleotide
accgctacacagcaattgcctattgggtacc

SEQ ID NO: 79434 - DNA, 30 bp, Artificial Sequence
  Description of Artificial Sequence: Synthetic oligonucleotide
ccgctacacagcaattgcctattgggtacc

SEQ ID NO: 79435 - DNA, 30 bp, Artificial Sequence
  Description of Artificial Sequence: Synthetic oligonucleotide
cgctacacagcaattgcctattgggtaccc

SEQ ID NO: 79436 - DNA, 30 bp, Artificial Sequence
  Description of Artificial Sequence: Synthetic oligonucleotide
gctacacagcaattgcctattgggtacccc

SEQ ID NO: 79437 - DNA, 30 bp, Artificial Sequence
  Description of Artificial Sequence: Synthetic oligonucleotide
ctacacagcaattgcctattgggtaccccg

SEQ ID NO: 79438 - DNA, 30 bp, Artificial Sequence
  Description of Artificial Sequence: Synthetic oligonucleotide
tacacagcaattgcctattgggtaccccgg

SEQ ID NO: 79439 - DNA, 29 bp, Artificial Sequence
  Description of Artificial Sequence: Synthetic oligonucleotide
acacagcaattgcctattgggtaccccgg

SEQ ID NO: 79440 - DNA, 28 bp, Artificial Sequence
  Description of Artificial Sequence: Synthetic oligonucleotide
cacagcaattgcctattgggtaccccgg

SEQ ID NO: 79441 - DNA, 30 bp, Artificial Sequence
  Description of Artificial Sequence: Synthetic oligonucleotide
acagcaattgcctattgggtaccccggaac

SEQ ID NO: 79442 - DNA, 29 bp, Artificial Sequence
  Description of Artificial Sequence: Synthetic oligonucleotide
cagcaattgcctattgggtaccccggaac

SEQ ID NO: 79443 - DNA, 29 bp, Artificial Sequence
  Description of Artificial Sequence: Synthetic oligonucleotide
agcaattgcctattgggtaccccggaacg

SEQ ID NO: 79444 - DNA, 28 bp, Artificial Sequence
  Description of Artificial Sequence: Synthetic oligonucleotide
gcaattgcctattgggtaccccggaacg

SEQ ID NO: 79445 - DNA, 28 bp, Artificial Sequence
  Description of Artificial Sequence: Synthetic oligonucleotide
caattgcctattgggtaccccggaacgc

SEQ ID NO: 79446 - DNA, 29 bp, Artificial Sequence
  Description of Artificial Sequence: Synthetic oligonucleotide
aattgcctattgggtaccccggaacgcac

SEQ ID NO: 79447 - DNA, 28 bp, Artificial Sequence
  Description of Artificial Sequence: Synthetic oligonucleotide
attgcctattgggtaccccggaacgcac

SEQ ID NO: 79448 - DNA, 27 bp, Artificial Sequence
  Description of Artificial Sequence: Synthetic oligonucleotide
ttgcctattgggtaccccggaacgcac

SEQ ID NO: 79449 - DNA, 27 bp, Artificial Sequence
  Description of Artificial Sequence: Synthetic oligonucleotide
tgcctattgggtaccccggaacgcact

SEQ ID NO: 79450 - DNA, 26 bp, Artificial Sequence
  Description of Artificial Sequence: Synthetic oligonucleotide
gcctattgggtaccccggaacgcact

SEQ ID NO: 79451 - DNA, 26 bp, Artificial Sequence
  Description of Artificial Sequence: Synthetic oligonucleotide
cctattgggtaccccggaacgcactg

SEQ ID NO: 79452 - DNA, 26 bp, Artificial Sequence
  Description of Artificial Sequence: Synthetic oligonucleotide
ctattgggtaccccggaacgcactgc

SEQ ID NO: 79453 - DNA, 26 bp, Artificial Sequence
  Description of Artificial Sequence: Synthetic oligonucleotide
tattgggtaccccggaacgcactgcc

SEQ ID NO: 79454 - DNA, 25 bp, Artificial Sequence
  Description of Artificial Sequence: Synthetic oligonucleotide
attgggtaccccggaacgcactgcc

SEQ ID NO: 79455 - DNA, 24 bp, Artificial Sequence
  Description of Artificial Sequence: Synthetic oligonucleotide
ttgggtaccccggaacgcactgcc

SEQ ID NO: 79456 - DNA, 23 bp, Artificial Sequence
  Description of Artificial Sequence: Synthetic oligonucleotide
tgggtaccccggaacgcactgcc

SEQ ID NO: 79457 - DNA, 22 bp, Artificial Sequence
  Description of Artificial Sequence: Synthetic oligonucleotide
gggtaccccggaacgcactgcc

SEQ ID NO: 79458 - DNA, 23 bp, Artificial Sequence
  Description of Artificial Sequence: Synthetic oligonucleotide
ggtaccccggaacgcactgccct

SEQ ID NO: 79459 - DNA, 24 bp, Artificial Sequence
  Description of Artificial Sequence: Synthetic oligonucleotide
gtaccccggaacgcactgccctca

SEQ ID NO: 79460 - DNA, 26 bp, Artificial Sequence
  Description of Artificial Sequence: Synthetic oligonucleotide
taccccggaacgcactgccctcagat

SEQ ID NO: 79461 - DNA, 25 bp, Artificial Sequence
  Description of Artificial Sequence: Synthetic oligonucleotide
accccggaacgcactgccctcagat

SEQ ID NO: 79462 - DNA, 24 bp, Artificial Sequence
  Description of Artificial Sequence: Synthetic oligonucleotide
ccccggaacgcactgccctcagat

SEQ ID NO: 79463 - DNA, 25 bp, Artificial Sequence
  Description of Artificial Sequence: Synthetic oligonucleotide
cccggaacgcactgccctcagatct

SEQ ID NO: 79464 - DNA, 25 bp, Artificial Sequence
  Description of Artificial Sequence: Synthetic oligonucleotide
ccggaacgcactgccctcagatctg

SEQ ID NO: 79465 - DNA, 26 bp, Artificial Sequence
  Description of Artificial Sequence: Synthetic oligonucleotide
cggaacgcactgccctcagatctgct

SEQ ID NO: 79466 - DNA, 26 bp, Artificial Sequence
  Description of Artificial Sequence: Synthetic oligonucleotide
ggaacgcactgccctcagatctgctg

SEQ ID NO: 79467 - DNA, 27 bp, Artificial Sequence
  Description of Artificial Sequence: Synthetic oligonucleotide
gaacgcactgccctcagatctgctgga

SEQ ID NO: 79468 - DNA, 27 bp, Artificial Sequence
  Description of Artificial Sequence: Synthetic oligonucleotide
aacgcactgccctcagatctgctggag

SEQ ID NO: 79469 - DNA, 27 bp, Artificial Sequence
  Description of Artificial Sequence: Synthetic oligonucleotide
acgcactgccctcagatctgctggaga

SEQ ID NO: 79470 - DNA, 27 bp, Artificial Sequence
  Description of Artificial Sequence: Synthetic oligonucleotide
cgcactgccctcagatctgctggagaa

SEQ ID NO: 79471 - DNA, 28 bp, Artificial Sequence
  Description of Artificial Sequence: Synthetic oligonucleotide
gcactgccctcagatctgctggagaatg

SEQ ID NO: 79472 - DNA, 29 bp, Artificial Sequence
  Description of Artificial Sequence: Synthetic oligonucleotide
cactgccctcagatctgctggagaatgtg

SEQ ID NO: 79473 - DNA, 29 bp, Artificial Sequence
  Description of Artificial Sequence: Synthetic oligonucleotide
actgccctcagatctgctggagaatgtgc

SEQ ID NO: 79474 - DNA, 28 bp, Artificial Sequence
  Description of Artificial Sequence: Synthetic oligonucleotide
ctgccctcagatctgctggagaatgtgc

SEQ ID NO: 79475 - DNA, 29 bp, Artificial Sequence
  Description of Artificial Sequence: Synthetic oligonucleotide
tgccctcagatctgctggagaatgtgctg

SEQ ID NO: 79476 - DNA, 28 bp, Artificial Sequence
  Description of Artificial Sequence: Synthetic oligonucleotide
gccctcagatctgctggagaatgtgctg

SEQ ID NO: 79477 - DNA, 29 bp, Artificial Sequence
  Description of Artificial Sequence: Synthetic oligonucleotide
ccctcagatctgctggagaatgtgctgtg

SEQ ID NO: 79478 - DNA, 30 bp, Artificial Sequence
  Description of Artificial Sequence: Synthetic oligonucleotide
cctcagatctgctggagaatgtgctgtgtg

SEQ ID NO: 79479 - DNA, 30 bp, Artificial Sequence
  Description of Artificial Sequence: Synthetic oligonucleotide
ctcagatctgctggagaatgtgctgtgtgg

SEQ ID NO: 79480 - DNA, 30 bp, Artificial Sequence
  Description of Artificial Sequence: Synthetic oligonucleotide
tcagatctgctggagaatgtgctgtgtggc

SEQ ID NO: 79481 - DNA, 29 bp, Artificial Sequence
  Description of Artificial Sequence: Synthetic oligonucleotide
cagatctgctggagaatgtgctgtgtggc

SEQ ID NO: 79482 - DNA, 29 bp, Artificial Sequence
  Description of Artificial Sequence: Synthetic oligonucleotide
agatctgctggagaatgtgctgtgtggcg

SEQ ID NO: 79483 - DNA, 28 bp, Artificial Sequence
  Description of Artificial Sequence: Synthetic oligonucleotide
gatctgctggagaatgtgctgtgtggcg

SEQ ID NO: 79484 - DNA, 29 bp, Artificial Sequence
  Description of Artificial Sequence: Synthetic oligonucleotide
atctgctggagaatgtgctgtgtggcgtg

SEQ ID NO: 79485 - DNA, 28 bp, Artificial Sequence
  Description of Artificial Sequence: Synthetic oligonucleotide
tctgctggagaatgtgctgtgtggcgtg

SEQ ID NO: 79486 - DNA, 27 bp, Artificial Sequence
  Description of Artificial Sequence: Synthetic oligonucleotide
ctgctggagaatgtgctgtgtggcgtg

SEQ ID NO: 79487 - DNA, 27 bp, Artificial Sequence
  Description of Artificial Sequence: Synthetic oligonucleotide
tgctggagaatgtgctgtgtggcgtgg

SEQ ID NO: 79488 - DNA, 26 bp, Artificial Sequence
  Description of Artificial Sequence: Synthetic oligonucleotide
gctggagaatgtgctgtgtggcgtgg

SEQ ID NO: 79489 - DNA, 26 bp, Artificial Sequence
  Description of Artificial Sequence: Synthetic oligonucleotide
ctggagaatgtgctgtgtggcgtggc

SEQ ID NO: 79490 - DNA, 27 bp, Artificial Sequence
  Description of Artificial Sequence: Synthetic oligonucleotide
tggagaatgtgctgtgtggcgtggcct

SEQ ID NO: 79491 - DNA, 27 bp, Artificial Sequence
  Description of Artificial Sequence: Synthetic oligonucleotide
ggagaatgtgctgtgtggcgtggcctt

SEQ ID NO: 79492 - DNA, 28 bp, Artificial Sequence
  Description of Artificial Sequence: Synthetic oligonucleotide
gagaatgtgctgtgtggcgtggcctttg

SEQ ID NO: 79493 - DNA, 28 bp, Artificial Sequence
  Description of Artificial Sequence: Synthetic oligonucleotide
agaatgtgctgtgtggcgtggcctttgg

SEQ ID NO: 79494 - DNA, 27 bp, Artificial Sequence
  Description of Artificial Sequence: Synthetic oligonucleotide
gaatgtgctgtgtggcgtggcctttgg

SEQ ID NO: 79495 - DNA, 27 bp, Artificial Sequence
  Description of Artificial Sequence: Synthetic oligonucleotide
aatgtgctgtgtggcgtggcctttggc

SEQ ID NO: 79496 - DNA, 26 bp, Artificial Sequence
  Description of Artificial Sequence: Synthetic oligonucleotide
atgtgctgtgtggcgtggcctttggc

SEQ ID NO: 79497 - DNA, 25 bp, Artificial Sequence
  Description of Artificial Sequence: Synthetic oligonucleotide
tgtgctgtgtggcgtggcctttggc

SEQ ID NO: 79498 - DNA, 24 bp, Artificial Sequence
  Description of Artificial Sequence: Synthetic oligonucleotide
gtgctgtgtggcgtggcctttggc

SEQ ID NO: 79499 - DNA, 25 bp, Artificial Sequence
  Description of Artificial Sequence: Synthetic oligonucleotide
tgctgtgtggcgtggcctttggcct

SEQ ID NO: 79500 - DNA, 24 bp, Artificial Sequence
  Description of Artificial Sequence: Synthetic oligonucleotide
gctgtgtggcgtggcctttggcct

SEQ ID NO: 79501 - DNA, 24 bp, Artificial Sequence
  Description of Artificial Sequence: Synthetic oligonucleotide
ctgtgtggcgtggcctttggcctg

SEQ ID NO: 79502 - DNA, 24 bp, Artificial Sequence
  Description of Artificial Sequence: Synthetic oligonucleotide
tgtgtggcgtggcctttggcctgg

SEQ ID NO: 79503 - DNA, 23 bp, Artificial Sequence
  Description of Artificial Sequence: Synthetic oligonucleotide
gtgtggcgtggcctttggcctgg

SEQ ID NO: 79504 - DNA, 24 bp, Artificial Sequence
  Description of Artificial Sequence: Synthetic oligonucleotide
tgtggcgtggcctttggcctgggt

SEQ ID NO: 79505 - DNA, 23 bp, Artificial Sequence
  Description of Artificial Sequence: Synthetic oligonucleotide
gtggcgtggcctttggcctgggt

SEQ ID NO: 79506 - DNA, 24 bp, Artificial Sequence
  Description of Artificial Sequence: Synthetic oligonucleotide
tggcgtggcctttggcctgggtgt

SEQ ID NO: 79507 - DNA, 23 bp, Artificial Sequence
  Description of Artificial Sequence: Synthetic oligonucleotide
ggcgtggcctttggcctgggtgt

SEQ ID NO: 79508 - DNA, 23 bp, Artificial Sequence
  Description of Artificial Sequence: Synthetic oligonucleotide
gcgtggcctttggcctgggtgtg

SEQ ID NO: 79509 - DNA, 24 bp, Artificial Sequence
  Description of Artificial Sequence: Synthetic oligonucleotide
cgtggcctttggcctgggtgtgct

SEQ ID NO: 79510 - DNA, 24 bp, Artificial Sequence
  Description of Artificial Sequence: Synthetic oligonucleotide
gtggcctttggcctgggtgtgctg

SEQ ID NO: 79511 - DNA, 24 bp, Artificial Sequence
  Description of Artificial Sequence: Synthetic oligonucleotide
tggcctttggcctgggtgtgctgg

SEQ ID NO: 79512 - DNA, 23 bp, Artificial Sequence
  Description of Artificial Sequence: Synthetic oligonucleotide
ggcctttggcctgggtgtgctgg

SEQ ID NO: 79513 - DNA, 23 bp, Artificial Sequence
  Description of Artificial Sequence: Synthetic oligonucleotide
gcctttggcctgggtgtgctggg

SEQ ID NO: 79514 - DNA, 25 bp, Artificial Sequence
  Description of Artificial Sequence: Synthetic oligonucleotide
cctttggcctgggtgtgctgggcat

SEQ ID NO: 79515 - DNA, 27 bp, Artificial Sequence
  Description of Artificial Sequence: Synthetic oligonucleotide
ctttggcctgggtgtgctgggcatcat

SEQ ID NO: 79516 - DNA, 27 bp, Artificial Sequence
  Description of Artificial Sequence: Synthetic oligonucleotide
tttggcctgggtgtgctgggcatcatc

SEQ ID NO: 79517 - DNA, 26 bp, Artificial Sequence
  Description of Artificial Sequence: Synthetic oligonucleotide
ttggcctgggtgtgctgggcatcatc

SEQ ID NO: 79518 - DNA, 25 bp, Artificial Sequence
  Description of Artificial Sequence: Synthetic oligonucleotide
tggcctgggtgtgctgggcatcatc

SEQ ID NO: 79519 - DNA, 24 bp, Artificial Sequence
  Description of Artificial Sequence: Synthetic oligonucleotide
ggcctgggtgtgctgggcatcatc

SEQ ID NO: 79520 - DNA, 25 bp, Artificial Sequence
  Description of Artificial Sequence: Synthetic oligonucleotide
gcctgggtgtgctgggcatcatcgt

SEQ ID NO: 79521 - DNA, 25 bp, Artificial Sequence
  Description of Artificial Sequence: Synthetic oligonucleotide
cctgggtgtgctgggcatcatcgtg

SEQ ID NO: 79522 - DNA, 25 bp, Artificial Sequence
  Description of Artificial Sequence: Synthetic oligonucleotide
ctgggtgtgctgggcatcatcgtgg

SEQ ID NO: 79523 - DNA, 25 bp, Artificial Sequence
  Description of Artificial Sequence: Synthetic oligonucleotide
tgggtgtgctgggcatcatcgtggg

SEQ ID NO: 79524 - DNA, 24 bp, Artificial Sequence
  Description of Artificial Sequence: Synthetic oligonucleotide
gggtgtgctgggcatcatcgtggg

SEQ ID NO: 79525 - DNA, 27 bp, Artificial Sequence
  Description of Artificial Sequence: Synthetic oligonucleotide
ggtgtgctgggcatcatcgtgggcatt

SEQ ID NO: 79526 - DNA, 27 bp, Artificial Sequence
  Description of Artificial Sequence: Synthetic oligonucleotide
gtgtgctgggcatcatcgtgggcattg

SEQ ID NO: 79527 - DNA, 29 bp, Artificial Sequence
  Description of Artificial Sequence: Synthetic oligonucleotide
tgtgctgggcatcatcgtgggcattgttc

SEQ ID NO: 79528 - DNA, 28 bp, Artificial Sequence
  Description of Artificial Sequence: Synthetic oligonucleotide
gtgctgggcatcatcgtgggcattgttc

SEQ ID NO: 79529 - DNA, 29 bp, Artificial Sequence
  Description of Artificial Sequence: Synthetic oligonucleotide
tgctgggcatcatcgtgggcattgttctc

SEQ ID NO: 79530 - DNA, 28 bp, Artificial Sequence
  Description of Artificial Sequence: Synthetic oligonucleotide
gctgggcatcatcgtgggcattgttctc

SEQ ID NO: 79531 - DNA, 30 bp, Artificial Sequence
  Description of Artificial Sequence: Synthetic oligonucleotide
ctgggcatcatcgtgggcattgttctcatc

SEQ ID NO: 79532 - DNA, 32 bp, Artificial Sequence
  Description of Artificial Sequence: Synthetic oligonucleotide
tgggcatcatcgtgggcattgttctcatcatc

SEQ ID NO: 79533 - DNA, 31 bp, Artificial Sequence
  Description of Artificial Sequence: Synthetic oligonucleotide
gggcatcatcgtgggcattgttctcatcatc

SEQ ID NO: 79534 - DNA, 33 bp, Artificial Sequence
  Description of Artificial Sequence: Synthetic oligonucleotide
ggcatcatcgtgggcattgttctcatcatctac

SEQ ID NO: 79535 - DNA, 35 bp, Artificial Sequence
  Description of Artificial Sequence: Synthetic oligonucleotide
gcatcatcgtgggcattgttctcatcatctacttc

SEQ ID NO: 79536 - DNA, 35 bp, Artificial Sequence
  Description of Artificial Sequence: Synthetic oligonucleotide
catcatcgtgggcattgttctcatcatctacttcc

SEQ ID NO: 79537 - DNA, 35 bp, Artificial Sequence
  Description of Artificial Sequence: Synthetic oligonucleotide
atcatcgtgggcattgttctcatcatctacttccg

SEQ ID NO: 79538 - DNA, 34 bp, Artificial Sequence
  Description of Artificial Sequence: Synthetic oligonucleotide
tcatcgtgggcattgttctcatcatctacttccg

SEQ ID NO: 79539 - DNA, 33 bp, Artificial Sequence
  Description of Artificial Sequence: Synthetic oligonucleotide
catcgtgggcattgttctcatcatctacttccg

SEQ ID NO: 79540 - DNA, 33 bp, Artificial Sequence
  Description of Artificial Sequence: Synthetic oligonucleotide
atcgtgggcattgttctcatcatctacttccgg

SEQ ID NO: 79541 - DNA, 32 bp, Artificial Sequence
  Description of Artificial Sequence: Synthetic oligonucleotide
tcgtgggcattgttctcatcatctacttccgg

SEQ ID NO: 79542 - DNA, 31 bp, Artificial Sequence
  Description of Artificial Sequence: Synthetic oligonucleotide
cgtgggcattgttctcatcatctacttccgg

SEQ ID NO: 79543 - DNA, 33 bp, Artificial Sequence
  Description of Artificial Sequence: Synthetic oligonucleotide
gtgggcattgttctcatcatctacttccggaag

SEQ ID NO: 79544 - DNA, 33 bp, Artificial Sequence
  Description of Artificial Sequence: Synthetic oligonucleotide
tgggcattgttctcatcatctacttccggaagc

SEQ ID NO: 79545 - DNA, 32 bp, Artificial Sequence
  Description of Artificial Sequence: Synthetic oligonucleotide
gggcattgttctcatcatctacttccggaagc

SEQ ID NO: 79546 - DNA, 32 bp, Artificial Sequence
  Description of Artificial Sequence: Synthetic oligonucleotide
ggcattgttctcatcatctacttccggaagcc

SEQ ID NO: 79547 - DNA, 34 bp, Artificial Sequence
  Description of Artificial Sequence: Synthetic oligonucleotide
gcattgttctcatcatctacttccggaagccttg

SEQ ID NO: 79548 - DNA, 34 bp, Artificial Sequence
  Description of Artificial Sequence: Synthetic oligonucleotide
cattgttctcatcatctacttccggaagccttgc

SEQ ID NO: 79549 - DNA, 35 bp, Artificial Sequence
  Description of Artificial Sequence: Synthetic oligonucleotide
attgttctcatcatctacttccggaagccttgctc

SEQ ID NO: 79550 - DNA, 34 bp, Artificial Sequence
  Description of Artificial Sequence: Synthetic oligonucleotide
ttgttctcatcatctacttccggaagccttgctc

SEQ ID NO: 79551 - DNA, 33 bp, Artificial Sequence
  Description of Artificial Sequence: Synthetic oligonucleotide
tgttctcatcatctacttccggaagccttgctc

SEQ ID NO: 79552 - DNA, 32 bp, Artificial Sequence
  Description of Artificial Sequence: Synthetic oligonucleotide
gttctcatcatctacttccggaagccttgctc

SEQ ID NO: 79553 - DNA, 33 bp, Artificial Sequence
  Description of Artificial Sequence: Synthetic oligonucleotide
ttctcatcatctacttccggaagccttgctcag

SEQ ID NO: 79554 - DNA, 32 bp, Artificial Sequence
  Description of Artificial Sequence: Synthetic oligonucleotide
tctcatcatctacttccggaagccttgctcag

SEQ ID NO: 79555 - DNA, 31 bp, Artificial Sequence
  Description of Artificial Sequence: Synthetic oligonucleotide
ctcatcatctacttccggaagccttgctcag

SEQ ID NO: 79556 - DNA, 31 bp, Artificial Sequence
  Description of Artificial Sequence: Synthetic oligonucleotide
tcatcatctacttccggaagccttgctcagg

SEQ ID NO: 79557 - DNA, 30 bp, Artificial Sequence
  Description of Artificial Sequence: Synthetic oligonucleotide
catcatctacttccggaagccttgctcagg

SEQ ID NO: 79558 - DNA, 31 bp, Artificial Sequence
  Description of Artificial Sequence: Synthetic oligonucleotide
atcatctacttccggaagccttgctcaggtg

SEQ ID NO: 79559 - DNA, 30 bp, Artificial Sequence
  Description of Artificial Sequence: Synthetic oligonucleotide
tcatctacttccggaagccttgctcaggtg

SEQ ID NO: 79560 - DNA, 29 bp, Artificial Sequence
  Description of Artificial Sequence: Synthetic oligonucleotide
catctacttccggaagccttgctcaggtg

SEQ ID NO: 79561 - DNA, 30 bp, Artificial Sequence
  Description of Artificial Sequence: Synthetic oligonucleotide
atctacttccggaagccttgctcaggtgac

SEQ ID NO: 79562 - DNA, 29 bp, Artificial Sequence
  Description of Artificial Sequence: Synthetic oligonucleotide
tctacttccggaagccttgctcaggtgac

SEQ ID NO: 79563 - DNA, 28 bp, Artificial Sequence
  Description of Artificial Sequence: Synthetic oligonucleotide
ctacttccggaagccttgctcaggtgac

SEQ ID NO: 79564 - DNA, 29 bp, Artificial Sequence
  Description of Artificial Sequence: Synthetic oligonucleotide
tacttccggaagccttgctcaggtgactg

SEQ ID NO: 79565 - DNA, 28 bp, Artificial Sequence
  Description of Artificial Sequence: Synthetic oligonucleotide
acttccggaagccttgctcaggtgactg

SEQ ID NO: 79566 - DNA, 27 bp, Artificial Sequence
  Description of Artificial Sequence: Synthetic oligonucleotide
cttccggaagccttgctcaggtgactg

SEQ ID NO: 79567 - DNA, 33 bp, Artificial Sequence
  Description of Artificial Sequence: Synthetic oligonucleotide
atgctgacagtgaactggcagcatcattccatc

SEQ ID NO: 79568 - DNA, 32 bp, Artificial Sequence
  Description of Artificial Sequence: Synthetic oligonucleotide
tgctgacagtgaactggcagcatcattccatc

SEQ ID NO: 79569 - DNA, 31 bp, Artificial Sequence
  Description of Artificial Sequence: Synthetic oligonucleotide
gctgacagtgaactggcagcatcattccatc

SEQ ID NO: 79570 - DNA, 31 bp, Artificial Sequence
  Description of Artificial Sequence: Synthetic oligonucleotide
ctgacagtgaactggcagcatcattccatcc

SEQ ID NO: 79571 - DNA, 31 bp, Artificial Sequence
  Description of Artificial Sequence: Synthetic oligonucleotide
tgacagtgaactggcagcatcattccatccc

SEQ ID NO: 79572 - DNA, 30 bp, Artificial Sequence
  Description of Artificial Sequence: Synthetic oligonucleotide
gacagtgaactggcagcatcattccatccc

SEQ ID NO: 79573 - DNA, 31 bp, Artificial Sequence
  Description of Artificial Sequence: Synthetic oligonucleotide
acagtgaactggcagcatcattccatccctg

SEQ ID NO: 79574 - DNA, 30 bp, Artificial Sequence
  Description of Artificial Sequence: Synthetic oligonucleotide
cagtgaactggcagcatcattccatccctg

SEQ ID NO: 79575 - DNA, 31 bp, Artificial Sequence
  Description of Artificial Sequence: Synthetic oligonucleotide
agtgaactggcagcatcattccatccctgtg

SEQ ID NO: 79576 - DNA, 30 bp, Artificial Sequence
  Description of Artificial Sequence: Synthetic oligonucleotide
gtgaactggcagcatcattccatccctgtg

SEQ ID NO: 79577 - DNA, 30 bp, Artificial Sequence
  Description of Artificial Sequence: Synthetic oligonucleotide
tgaactggcagcatcattccatccctgtgg

SEQ ID NO: 79578 - DNA, 29 bp, Artificial Sequence
  Description of Artificial Sequence: Synthetic oligonucleotide
gaactggcagcatcattccatccctgtgg

SEQ ID NO: 79579 - DNA, 31 bp, Artificial Sequence
  Description of Artificial Sequence: Synthetic oligonucleotide
aactggcagcatcattccatccctgtggaag

SEQ ID NO: 79580 - DNA, 30 bp, Artificial Sequence
  Description of Artificial Sequence: Synthetic oligonucleotide
actggcagcatcattccatccctgtggaag

SEQ ID NO: 79581 - DNA, 29 bp, Artificial Sequence
  Description of Artificial Sequence: Synthetic oligonucleotide
ctggcagcatcattccatccctgtggaag

SEQ ID NO: 79582 - DNA, 29 bp, Artificial Sequence
  Description of Artificial Sequence: Synthetic oligonucleotide
tggcagcatcattccatccctgtggaagg

SEQ ID NO: 79583 - DNA, 28 bp, Artificial Sequence
  Description of Artificial Sequence: Synthetic oligonucleotide
ggcagcatcattccatccctgtggaagg

SEQ ID NO: 79584 - DNA, 32 bp, Artificial Sequence
  Description of Artificial Sequence: Synthetic oligonucleotide
gcagcatcattccatccctgtggaaggatttg

SEQ ID NO: 79585 - DNA, 32 bp, Artificial Sequence
  Description of Artificial Sequence: Synthetic oligonucleotide
cagcatcattccatccctgtggaaggatttgg

SEQ ID NO: 79586 - DNA, 32 bp, Artificial Sequence
  Description of Artificial Sequence: Synthetic oligonucleotide
agcatcattccatccctgtggaaggatttggg

SEQ ID NO: 79587 - DNA, 31 bp, Artificial Sequence
  Description of Artificial Sequence: Synthetic oligonucleotide
gcatcattccatccctgtggaaggatttggg

SEQ ID NO: 79588 - DNA, 31 bp, Artificial Sequence
  Description of Artificial Sequence: Synthetic oligonucleotide
catcattccatccctgtggaaggatttgggc

SEQ ID NO: 79589 - DNA, 31 bp, Artificial Sequence
  Description of Artificial Sequence: Synthetic oligonucleotide
atcattccatccctgtggaaggatttgggcc

SEQ ID NO: 79590 - DNA, 30 bp, Artificial Sequence
  Description of Artificial Sequence: Synthetic oligonucleotide
tcattccatccctgtggaaggatttgggcc

SEQ ID NO: 79591 - DNA, 29 bp, Artificial Sequence
  Description of Artificial Sequence: Synthetic oligonucleotide
cattccatccctgtggaaggatttgggcc

SEQ ID NO: 79592 - DNA, 31 bp, Artificial Sequence
  Description of Artificial Sequence: Synthetic oligonucleotide
attccatccctgtggaaggatttgggcctac

SEQ ID NO: 79593 - DNA, 30 bp, Artificial Sequence
  Description of Artificial Sequence: Synthetic oligonucleotide
ttccatccctgtggaaggatttgggcctac

SEQ ID NO: 79594 - DNA, 29 bp, Artificial Sequence
  Description of Artificial Sequence: Synthetic oligonucleotide
tccatccctgtggaaggatttgggcctac

SEQ ID NO: 79595 - DNA, 28 bp, Artificial Sequence
  Description of Artificial Sequence: Synthetic oligonucleotide
ccatccctgtggaaggatttgggcctac

SEQ ID NO: 79596 - DNA, 32 bp, Artificial Sequence
  Description of Artificial Sequence: Synthetic oligonucleotide
catccctgtggaaggatttgggcctacttttg

SEQ ID NO: 79597 - DNA, 33 bp, Artificial Sequence
  Description of Artificial Sequence: Synthetic oligonucleotide
atccctgtggaaggatttgggcctacttttgtc

SEQ ID NO: 79598 - DNA, 33 bp, Artificial Sequence
  Description of Artificial Sequence: Synthetic oligonucleotide
atttgggcctacttttgtctcagctgtcgatgc

SEQ ID NO: 79599 - DNA, 32 bp, Artificial Sequence
  Description of Artificial Sequence: Synthetic oligonucleotide
tttgggcctacttttgtctcagctgtcgatgc

SEQ ID NO: 79600 - DNA, 31 bp, Artificial Sequence
  Description of Artificial Sequence: Synthetic oligonucleotide
ttgggcctacttttgtctcagctgtcgatgc

SEQ ID NO: 79601 - DNA, 30 bp, Artificial Sequence
  Description of Artificial Sequence: Synthetic oligonucleotide
tgggcctacttttgtctcagctgtcgatgc

SEQ ID NO: 79602 - DNA, 29 bp, Artificial Sequence
  Description of Artificial Sequence: Synthetic oligonucleotide
gggcctacttttgtctcagctgtcgatgc

SEQ ID NO: 79603 - DNA, 30 bp, Artificial Sequence
  Description of Artificial Sequence: Synthetic oligonucleotide
ggcctacttttgtctcagctgtcgatgcac

SEQ ID NO: 79604 - DNA, 31 bp, Artificial Sequence
  Description of Artificial Sequence: Synthetic oligonucleotide
gcctacttttgtctcagctgtcgatgcactc

SEQ ID NO: 79605 - DNA, 32 bp, Artificial Sequence
  Description of Artificial Sequence: Synthetic oligonucleotide
cctacttttgtctcagctgtcgatgcactcag

SEQ ID NO: 79606 - DNA, 32 bp, Artificial Sequence
  Description of Artificial Sequence: Synthetic oligonucleotide
ctacttttgtctcagctgtcgatgcactcagc

SEQ ID NO: 79607 - DNA, 34 bp, Artificial Sequence
  Description of Artificial Sequence: Synthetic oligonucleotide
tacttttgtctcagctgtcgatgcactcagcttc

SEQ ID NO: 79608 - DNA, 33 bp, Artificial Sequence
  Description of Artificial Sequence: Synthetic oligonucleotide
acttttgtctcagctgtcgatgcactcagcttc

SEQ ID NO: 79609 - DNA, 32 bp, Artificial Sequence
  Description of Artificial Sequence: Synthetic oligonucleotide
cttttgtctcagctgtcgatgcactcagcttc

SEQ ID NO: 79610 - DNA, 32 bp, Artificial Sequence
  Description of Artificial Sequence: Synthetic oligonucleotide
ttttgtctcagctgtcgatgcactcagcttcc

SEQ ID NO: 79611 - DNA, 31 bp, Artificial Sequence
  Description of Artificial Sequence: Synthetic oligonucleotide
tttgtctcagctgtcgatgcactcagcttcc

SEQ ID NO: 79612 - DNA, 30 bp, Artificial Sequence
  Description of Artificial Sequence: Synthetic oligonucleotide
ttgtctcagctgtcgatgcactcagcttcc

SEQ ID NO: 79613 - DNA, 29 bp, Artificial Sequence
  Description of Artificial Sequence: Synthetic oligonucleotide
tgtctcagctgtcgatgcactcagcttcc

SEQ ID NO: 79614 - DNA, 28 bp, Artificial Sequence
  Description of Artificial Sequence: Synthetic oligonucleotide
gtctcagctgtcgatgcactcagcttcc

SEQ ID NO: 79615 - DNA, 29 bp, Artificial Sequence
  Description of Artificial Sequence: Synthetic oligonucleotide
tctcagctgtcgatgcactcagcttccag

SEQ ID NO: 79616 - DNA, 28 bp, Artificial Sequence
  Description of Artificial Sequence: Synthetic oligonucleotide
ctcagctgtcgatgcactcagcttccag

SEQ ID NO: 79617 - DNA, 28 bp, Artificial Sequence
  Description of Artificial Sequence: Synthetic oligonucleotide
tcagctgtcgatgcactcagcttccagg

SEQ ID NO: 79618 - DNA, 27 bp, Artificial Sequence
  Description of Artificial Sequence: Synthetic oligonucleotide
cagctgtcgatgcactcagcttccagg

SEQ ID NO: 79619 - DNA, 27 bp, Artificial Sequence
  Description of Artificial Sequence: Synthetic oligonucleotide
agctgtcgatgcactcagcttccaggc

SEQ ID NO: 79620 - DNA, 26 bp, Artificial Sequence
  Description of Artificial Sequence: Synthetic oligonucleotide
gctgtcgatgcactcagcttccaggc

SEQ ID NO: 79621 - DNA, 27 bp, Artificial Sequence
  Description of Artificial Sequence: Synthetic oligonucleotide
ctgtcgatgcactcagcttccaggcct

SEQ ID NO: 79622 - DNA, 30 bp, Artificial Sequence
  Description of Artificial Sequence: Synthetic oligonucleotide
tgtcgatgcactcagcttccaggccttttc

SEQ ID NO: 79623 - DNA, 29 bp, Artificial Sequence
  Description of Artificial Sequence: Synthetic oligonucleotide
gtcgatgcactcagcttccaggccttttc

SEQ ID NO: 79624 - DNA, 32 bp, Artificial Sequence
  Description of Artificial Sequence: Synthetic oligonucleotide
tcgatgcactcagcttccaggccttttcttac

SEQ ID NO: 79625 - DNA, 31 bp, Artificial Sequence
  Description of Artificial Sequence: Synthetic oligonucleotide
cgatgcactcagcttccaggccttttcttac

SEQ ID NO: 79626 - DNA, 36 bp, Artificial Sequence
  Description of Artificial Sequence: Synthetic oligonucleotide
gatgcactcagcttccaggccttttcttacttaaac

SEQ ID NO: 79627 - DNA, 38 bp, Artificial Sequence
  Description of Artificial Sequence: Synthetic oligonucleotide
atgcactcagcttccaggccttttcttacttaaacttc

SEQ ID NO: 79628 - DNA, 37 bp, Artificial Sequence
  Description of Artificial Sequence: Synthetic oligonucleotide
tgcactcagcttccaggccttttcttacttaaacttc

SEQ ID NO: 79629 - DNA, 36 bp, Artificial Sequence
  Description of Artificial Sequence: Synthetic oligonucleotide
gcactcagcttccaggccttttcttacttaaacttc

SEQ ID NO: 79630 - DNA, 37 bp, Artificial Sequence
  Description of Artificial Sequence: Synthetic oligonucleotide
cactcagcttccaggccttttcttacttaaacttcac

SEQ ID NO: 79631 - DNA, 38 bp, Artificial Sequence
  Description of Artificial Sequence: Synthetic oligonucleotide
acattttctcctgcattgtgactcacgaaattgaccac

SEQ ID NO: 79632 - DNA, 37 bp, Artificial Sequence
  Description of Artificial Sequence: Synthetic oligonucleotide
cattttctcctgcattgtgactcacgaaattgaccac

SEQ ID NO: 79633 - DNA, 39 bp, Artificial Sequence
  Description of Artificial Sequence: Synthetic oligonucleotide
attttctcctgcattgtgactcacgaaattgaccactac

SEQ ID NO: 79634 - DNA, 38 bp, Artificial Sequence
  Description of Artificial Sequence: Synthetic oligonucleotide
ttttctcctgcattgtgactcacgaaattgaccactac

SEQ ID NO: 79635 - DNA, 37 bp, Artificial Sequence
  Description of Artificial Sequence: Synthetic oligonucleotide
tttctcctgcattgtgactcacgaaattgaccactac

SEQ ID NO: 79636 - DNA, 36 bp, Artificial Sequence
  Description of Artificial Sequence: Synthetic oligonucleotide
ttctcctgcattgtgactcacgaaattgaccactac

SEQ ID NO: 79637 - DNA, 35 bp, Artificial Sequence
  Description of Artificial Sequence: Synthetic oligonucleotide
tctcctgcattgtgactcacgaaattgaccactac

SEQ ID NO: 79638 - DNA, 34 bp, Artificial Sequence
  Description of Artificial Sequence: Synthetic oligonucleotide
ctcctgcattgtgactcacgaaattgaccactac

SEQ ID NO: 79639 - DNA, 35 bp, Artificial Sequence
  Description of Artificial Sequence: Synthetic oligonucleotide
tcctgcattgtgactcacgaaattgaccactacac

SEQ ID NO: 79640 - DNA, 34 bp, Artificial Sequence
  Description of Artificial Sequence: Synthetic oligonucleotide
cctgcattgtgactcacgaaattgaccactacac

SEQ ID NO: 79641 - DNA, 35 bp, Artificial Sequence
  Description of Artificial Sequence: Synthetic oligonucleotide
ctgcattgtgactcacgaaattgaccactacacag

SEQ ID NO: 79642 - DNA, 35 bp, Artificial Sequence
  Description of Artificial Sequence: Synthetic oligonucleotide
tgcattgtgactcacgaaattgaccactacacagc

SEQ ID NO: 79643 - DNA, 34 bp, Artificial Sequence
  Description of Artificial Sequence: Synthetic oligonucleotide
gcattgtgactcacgaaattgaccactacacagc

SEQ ID NO: 79644 - DNA, 38 bp, Artificial Sequence
  Description of Artificial Sequence: Synthetic oligonucleotide
cattgtgactcacgaaattgaccactacacagcaattg

SEQ ID NO: 79645 - DNA, 38 bp, Artificial Sequence
  Description of Artificial Sequence: Synthetic oligonucleotide
attgtgactcacgaaattgaccactacacagcaattgc

SEQ ID NO: 79646 - DNA, 37 bp, Artificial Sequence
  Description of Artificial Sequence: Synthetic oligonucleotide
ttgtgactcacgaaattgaccactacacagcaattgc

SEQ ID NO: 79647 - DNA, 36 bp, Artificial Sequence
  Description of Artificial Sequence: Synthetic oligonucleotide
tgtgactcacgaaattgaccactacacagcaattgc

SEQ ID NO: 79648 - DNA, 35 bp, Artificial Sequence
  Description of Artificial Sequence: Synthetic oligonucleotide
gtgactcacgaaattgaccactacacagcaattgc

SEQ ID NO: 79649 - DNA, 35 bp, Artificial Sequence
  Description of Artificial Sequence: Synthetic oligonucleotide
tgactcacgaaattgaccactacacagcaattgcc

SEQ ID NO: 79650 - DNA, 34 bp, Artificial Sequence
  Description of Artificial Sequence: Synthetic oligonucleotide
gactcacgaaattgaccactacacagcaattgcc

SEQ ID NO: 79651 - DNA, 38 bp, Artificial Sequence
  Description of Artificial Sequence: Synthetic oligonucleotide
actcacgaaattgaccactacacagcaattgcctattg

SEQ ID NO: 79652 - DNA, 37 bp, Artificial Sequence
  Description of Artificial Sequence: Synthetic oligonucleotide
ctcacgaaattgaccactacacagcaattgcctattg

SEQ ID NO: 79653 - DNA, 37 bp, Artificial Sequence
  Description of Artificial Sequence: Synthetic oligonucleotide
tcacgaaattgaccactacacagcaattgcctattgg

SEQ ID NO: 79654 - DNA, 39 bp, Artificial Sequence
  Description of Artificial Sequence: Synthetic oligonucleotide
tgacattttctcctgcattgtgactcacgaaattgactg

SEQ ID NO: 79655 - DNA, 38 bp, Artificial Sequence
  Description of Artificial Sequence: Synthetic oligonucleotide
gacattttctcctgcattgtgactcacgaaattgactg

SEQ ID NO: 79656 - DNA, 38 bp, Artificial Sequence
  Description of Artificial Sequence: Synthetic oligonucleotide
acattttctcctgcattgtgactcacgaaattgactgc

SEQ ID NO: 79657 - DNA, 37 bp, Artificial Sequence
  Description of Artificial Sequence: Synthetic oligonucleotide
cattttctcctgcattgtgactcacgaaattgactgc

SEQ ID NO: 79658 - DNA, 39 bp, Artificial Sequence
  Description of Artificial Sequence: Synthetic oligonucleotide
attttctcctgcattgtgactcacgaaattgactgctac

SEQ ID NO: 79659 - DNA, 38 bp, Artificial Sequence
  Description of Artificial Sequence: Synthetic oligonucleotide
ttttctcctgcattgtgactcacgaaattgactgctac

SEQ ID NO: 79660 - DNA, 37 bp, Artificial Sequence
  Description of Artificial Sequence: Synthetic oligonucleotide
tttctcctgcattgtgactcacgaaattgactgctac

SEQ ID NO: 79661 - DNA, 36 bp, Artificial Sequence
  Description of Artificial Sequence: Synthetic oligonucleotide
ttctcctgcattgtgactcacgaaattgactgctac

SEQ ID NO: 79662 - DNA, 35 bp, Artificial Sequence
  Description of Artificial Sequence: Synthetic oligonucleotide
tctcctgcattgtgactcacgaaattgactgctac

SEQ ID NO: 79663 - DNA, 34 bp, Artificial Sequence
  Description of Artificial Sequence: Synthetic oligonucleotide
ctcctgcattgtgactcacgaaattgactgctac

SEQ ID NO: 79664 - DNA, 35 bp, Artificial Sequence
  Description of Artificial Sequence: Synthetic oligonucleotide
tcctgcattgtgactcacgaaattgactgctacac

SEQ ID NO: 79665 - DNA, 34 bp, Artificial Sequence
  Description of Artificial Sequence: Synthetic oligonucleotide
cctgcattgtgactcacgaaattgactgctacac

SEQ ID NO: 79666 - DNA, 35 bp, Artificial Sequence
  Description of Artificial Sequence: Synthetic oligonucleotide
ctgcattgtgactcacgaaattgactgctacacag

SEQ ID NO: 79667 - DNA, 35 bp, Artificial Sequence
  Description of Artificial Sequence: Synthetic oligonucleotide
tgcattgtgactcacgaaattgactgctacacagc

SEQ ID NO: 79668 - DNA, 34 bp, Artificial Sequence
  Description of Artificial Sequence: Synthetic oligonucleotide
gcattgtgactcacgaaattgactgctacacagc

SEQ ID NO: 79669 - DNA, 38 bp, Artificial Sequence
  Description of Artificial Sequence: Synthetic oligonucleotide
cattgtgactcacgaaattgactgctacacagcaattg

SEQ ID NO: 79670 - DNA, 38 bp, Artificial Sequence
  Description of Artificial Sequence: Synthetic oligonucleotide
attgtgactcacgaaattgactgctacacagcaattgc

SEQ ID NO: 79671 - DNA, 37 bp, Artificial Sequence
  Description of Artificial Sequence: Synthetic oligonucleotide
ttgtgactcacgaaattgactgctacacagcaattgc

SEQ ID NO: 79672 - DNA, 36 bp, Artificial Sequence
  Description of Artificial Sequence: Synthetic oligonucleotide
tgtgactcacgaaattgactgctacacagcaattgc

SEQ ID NO: 79673 - DNA, 35 bp, Artificial Sequence
  Description of Artificial Sequence: Synthetic oligonucleotide
gtgactcacgaaattgactgctacacagcaattgc

SEQ ID NO: 79674 - DNA, 35 bp, Artificial Sequence
  Description of Artificial Sequence: Synthetic oligonucleotide
tgactcacgaaattgactgctacacagcaattgcc

SEQ ID NO: 79675 - DNA, 34 bp, Artificial Sequence
  Description of Artificial Sequence: Synthetic oligonucleotide
gactcacgaaattgactgctacacagcaattgcc

SEQ ID NO: 79676 - DNA, 38 bp, Artificial Sequence
  Description of Artificial Sequence: Synthetic oligonucleotide
actcacgaaattgactgctacacagcaattgcctattg

SEQ ID NO: 79677 - DNA, 37 bp, Artificial Sequence
  Description of Artificial Sequence: Synthetic oligonucleotide
ctcacgaaattgactgctacacagcaattgcctattg

SEQ ID NO: 79678 - DNA, 37 bp, Artificial Sequence
  Description of Artificial Sequence: Synthetic oligonucleotide
tcacgaaattgactgctacacagcaattgcctattgg

SEQ ID NO: 79679 - DNA, 28 bp, Artificial Sequence
  Description of Artificial Sequence: Synthetic oligonucleotide
atgatcacattcctgccgctgctgctgg

SEQ ID NO: 79680 - DNA, 27 bp, Artificial Sequence
  Description of Artificial Sequence: Synthetic oligonucleotide
tgatcacattcctgccgctgctgctgg

SEQ ID NO: 79681 - DNA, 26 bp, Artificial Sequence
  Description of Artificial Sequence: Synthetic oligonucleotide
gatcacattcctgccgctgctgctgg

SEQ ID NO: 79682 - DNA, 26 bp, Artificial Sequence
  Description of Artificial Sequence: Synthetic oligonucleotide
atcacattcctgccgctgctgctggg

SEQ ID NO: 79683 - DNA, 25 bp, Artificial Sequence
  Description of Artificial Sequence: Synthetic oligonucleotide
tcacattcctgccgctgctgctggg

SEQ ID NO: 79684 - DNA, 24 bp, Artificial Sequence
  Description of Artificial Sequence: Synthetic oligonucleotide
cacattcctgccgctgctgctggg

SEQ ID NO: 79685 - DNA, 24 bp, Artificial Sequence
  Description of Artificial Sequence: Synthetic oligonucleotide
acattcctgccgctgctgctgggg

SEQ ID NO: 79686 - DNA, 23 bp, Artificial Sequence
  Description of Artificial Sequence: Synthetic oligonucleotide
cattcctgccgctgctgctgggg

SEQ ID NO: 79687 - DNA, 24 bp, Artificial Sequence
  Description of Artificial Sequence: Synthetic oligonucleotide
attcctgccgctgctgctggggct

SEQ ID NO: 79688 - DNA, 23 bp, Artificial Sequence
  Description of Artificial Sequence: Synthetic oligonucleotide
ttcctgccgctgctgctggggct

SEQ ID NO: 79689 - DNA, 22 bp, Artificial Sequence
  Description of Artificial Sequence: Synthetic oligonucleotide
tcctgccgctgctgctggggct

SEQ ID NO: 79690 - DNA, 21 bp, Artificial Sequence
  Description of Artificial Sequence: Synthetic oligonucleotide
cctgccgctgctgctggggct

SEQ ID NO: 79691 - DNA, 22 bp, Artificial Sequence
  Description of Artificial Sequence: Synthetic oligonucleotide
ctgccgctgctgctggggctca

SEQ ID NO: 79692 - DNA, 22 bp, Artificial Sequence
  Description of Artificial Sequence: Synthetic oligonucleotide
tgccgctgctgctggggctcag

SEQ ID NO: 79693 - DNA, 21 bp, Artificial Sequence
  Description of Artificial Sequence: Synthetic oligonucleotide
gccgctgctgctggggctcag

SEQ ID NO: 79694 - DNA, 21 bp, Artificial Sequence
  Description of Artificial Sequence: Synthetic oligonucleotide
ccgctgctgctggggctcagc

SEQ ID NO: 79695 - DNA, 22 bp, Artificial Sequence
  Description of Artificial Sequence: Synthetic oligonucleotide
cgctgctgctggggctcagcct

SEQ ID NO: 79696 - DNA, 22 bp, Artificial Sequence
  Description of Artificial Sequence: Synthetic oligonucleotide
gctgctgctggggctcagcctg

SEQ ID NO: 79697 - DNA, 22 bp, Artificial Sequence
  Description of Artificial Sequence: Synthetic oligonucleotide
ctgctgctggggctcagcctgg

SEQ ID NO: 79698 - DNA, 22 bp, Artificial Sequence
  Description of Artificial Sequence: Synthetic oligonucleotide
tgctgctggggctcagcctggg

SEQ ID NO: 79699 - DNA, 21 bp, Artificial Sequence
  Description of Artificial Sequence: Synthetic oligonucleotide
gctgctggggctcagcctggg

SEQ ID NO: 79700 - DNA, 22 bp, Artificial Sequence
  Description of Artificial Sequence: Synthetic oligonucleotide
ctgctggggctcagcctgggct

SEQ ID NO: 79701 - DNA, 22 bp, Artificial Sequence
  Description of Artificial Sequence: Synthetic oligonucleotide
tgctggggctcagcctgggctg

SEQ ID NO: 79702 - DNA, 21 bp, Artificial Sequence
  Description of Artificial Sequence: Synthetic oligonucleotide
gctggggctcagcctgggctg

SEQ ID NO: 79703 - DNA, 22 bp, Artificial Sequence
  Description of Artificial Sequence: Synthetic oligonucleotide
ctggggctcagcctgggctgca

SEQ ID NO: 79704 - DNA, 23 bp, Artificial Sequence
  Description of Artificial Sequence: Synthetic oligonucleotide
tggggctcagcctgggctgcaca

SEQ ID NO: 79705 - DNA, 22 bp, Artificial Sequence
  Description of Artificial Sequence: Synthetic oligonucleotide
ggggctcagcctgggctgcaca

SEQ ID NO: 79706 - DNA, 22 bp, Artificial Sequence
  Description of Artificial Sequence: Synthetic oligonucleotide
gggctcagcctgggctgcacag

SEQ ID NO: 79707 - DNA, 23 bp, Artificial Sequence
  Description of Artificial Sequence: Synthetic oligonucleotide
ggctcagcctgggctgcacagga

SEQ ID NO: 79708 - DNA, 23 bp, Artificial Sequence
  Description of Artificial Sequence: Synthetic oligonucleotide
gctcagcctgggctgcacaggag

SEQ ID NO: 79709 - DNA, 24 bp, Artificial Sequence
  Description of Artificial Sequence: Synthetic oligonucleotide
ctcagcctgggctgcacaggagca

SEQ ID NO: 79710 - DNA, 24 bp, Artificial Sequence
  Description of Artificial Sequence: Synthetic oligonucleotide
tcagcctgggctgcacaggagcag

SEQ ID NO: 79711 - DNA, 23 bp, Artificial Sequence
  Description of Artificial Sequence: Synthetic oligonucleotide
cagcctgggctgcacaggagcag

SEQ ID NO: 79712 - DNA, 24 bp, Artificial Sequence
  Description of Artificial Sequence: Synthetic oligonucleotide
agcctgggctgcacaggagcaggt

SEQ ID NO: 79713 - DNA, 23 bp, Artificial Sequence
  Description of Artificial Sequence: Synthetic oligonucleotide
gcctgggctgcacaggagcaggt

SEQ ID NO: 79714 - DNA, 23 bp, Artificial Sequence
  Description of Artificial Sequence: Synthetic oligonucleotide
cctgggctgcacaggagcaggtg

SEQ ID NO: 79715 - DNA, 23 bp, Artificial Sequence
  Description of Artificial Sequence: Synthetic oligonucleotide
ctgggctgcacaggagcaggtgg

SEQ ID NO: 79716 - DNA, 25 bp, Artificial Sequence
  Description of Artificial Sequence: Synthetic oligonucleotide
tgggctgcacaggagcaggtggctt

SEQ ID NO: 79717 - DNA, 24 bp, Artificial Sequence
  Description of Artificial Sequence: Synthetic oligonucleotide
gggctgcacaggagcaggtggctt

SEQ ID NO: 79718 - DNA, 24 bp, Artificial Sequence
  Description of Artificial Sequence: Synthetic oligonucleotide
ggctgcacaggagcaggtggcttc

SEQ ID NO: 79719 - DNA, 25 bp, Artificial Sequence
  Description of Artificial Sequence: Synthetic oligonucleotide
gctgcacaggagcaggtggcttcgt

SEQ ID NO: 79720 - DNA, 25 bp, Artificial Sequence
  Description of Artificial Sequence: Synthetic oligonucleotide
ctgcacaggagcaggtggcttcgtg

SEQ ID NO: 79721 - DNA, 25 bp, Artificial Sequence
  Description of Artificial Sequence: Synthetic oligonucleotide
tgcacaggagcaggtggcttcgtgg

SEQ ID NO: 79722 - DNA, 24 bp, Artificial Sequence
  Description of Artificial Sequence: Synthetic oligonucleotide
gcacaggagcaggtggcttcgtgg

SEQ ID NO: 79723 - DNA, 24 bp, Artificial Sequence
  Description of Artificial Sequence: Synthetic oligonucleotide
cacaggagcaggtggcttcgtggc

SEQ ID NO: 79724 - DNA, 24 bp, Artificial Sequence
  Description of Artificial Sequence: Synthetic oligonucleotide
acaggagcaggtggcttcgtggcc

SEQ ID NO: 79725 - DNA, 23 bp, Artificial Sequence
  Description of Artificial Sequence: Synthetic oligonucleotide
caggagcaggtggcttcgtggcc

SEQ ID NO: 79726 - DNA, 25 bp, Artificial Sequence
  Description of Artificial Sequence: Synthetic oligonucleotide
aggagcaggtggcttcgtggcccat

SEQ ID NO: 79727 - DNA, 24 bp, Artificial Sequence
  Description of Artificial Sequence: Synthetic oligonucleotide
ggagcaggtggcttcgtggcccat

SEQ ID NO: 79728 - DNA, 25 bp, Artificial Sequence
  Description of Artificial Sequence: Synthetic oligonucleotide
gagcaggtggcttcgtggcccatgt

SEQ ID NO: 79729 - DNA, 25 bp, Artificial Sequence
  Description of Artificial Sequence: Synthetic oligonucleotide
agcaggtggcttcgtggcccatgtg

SEQ ID NO: 79730 - DNA, 24 bp, Artificial Sequence
  Description of Artificial Sequence: Synthetic oligonucleotide
gcaggtggcttcgtggcccatgtg

SEQ ID NO: 79731 - DNA, 27 bp, Artificial Sequence
  Description of Artificial Sequence: Synthetic oligonucleotide
caggtggcttcgtggcccatgtggaaa

SEQ ID NO: 79732 - DNA, 27 bp, Artificial Sequence
  Description of Artificial Sequence: Synthetic oligonucleotide
aggtggcttcgtggcccatgtggaaag

SEQ ID NO: 79733 - DNA, 26 bp, Artificial Sequence
  Description of Artificial Sequence: Synthetic oligonucleotide
ggtggcttcgtggcccatgtggaaag

SEQ ID NO: 79734 - DNA, 27 bp, Artificial Sequence
  Description of Artificial Sequence: Synthetic oligonucleotide
gtggcttcgtggcccatgtggaaagca

SEQ ID NO: 79735 - DNA, 27 bp, Artificial Sequence
  Description of Artificial Sequence: Synthetic oligonucleotide
tggcttcgtggcccatgtggaaagcac

SEQ ID NO: 79736 - DNA, 26 bp, Artificial Sequence
  Description of Artificial Sequence: Synthetic oligonucleotide
ggcttcgtggcccatgtggaaagcac

SEQ ID NO: 79737 - DNA, 27 bp, Artificial Sequence
  Description of Artificial Sequence: Synthetic oligonucleotide
gcttcgtggcccatgtggaaagcacct

SEQ ID NO: 79738 - DNA, 27 bp, Artificial Sequence
  Description of Artificial Sequence: Synthetic oligonucleotide
cttcgtggcccatgtggaaagcacctg

SEQ ID NO: 79739 - DNA, 28 bp, Artificial Sequence
  Description of Artificial Sequence: Synthetic oligonucleotide
ttcgtggcccatgtggaaagcacctgtc

SEQ ID NO: 79740 - DNA, 27 bp, Artificial Sequence
  Description of Artificial Sequence: Synthetic oligonucleotide
tcgtggcccatgtggaaagcacctgtc

SEQ ID NO: 79741 - DNA, 27 bp, Artificial Sequence
  Description of Artificial Sequence: Synthetic oligonucleotide
cgtggcccatgtggaaagcacctgtct

SEQ ID NO: 79742 - DNA, 27 bp, Artificial Sequence
  Description of Artificial Sequence: Synthetic oligonucleotide
gtggcccatgtggaaagcacctgtctg

SEQ ID NO: 79743 - DNA, 29 bp, Artificial Sequence
  Description of Artificial Sequence: Synthetic oligonucleotide
tggcccatgtggaaagcacctgtctgttg

SEQ ID NO: 79744 - DNA, 28 bp, Artificial Sequence
  Description of Artificial Sequence: Synthetic oligonucleotide
ggcccatgtggaaagcacctgtctgttg

SEQ ID NO: 79745 - DNA, 28 bp, Artificial Sequence
  Description of Artificial Sequence: Synthetic oligonucleotide
gcccatgtggaaagcacctgtctgttgg

SEQ ID NO: 79746 - DNA, 30 bp, Artificial Sequence
  Description of Artificial Sequence: Synthetic oligonucleotide
cccatgtggaaagcacctgtctgttggatg

SEQ ID NO: 79747 - DNA, 32 bp, Artificial Sequence
  Description of Artificial Sequence: Synthetic oligonucleotide
ccatgtggaaagcacctgtctgttggatgatg

SEQ ID NO: 79748 - DNA, 32 bp, Artificial Sequence
  Description of Artificial Sequence: Synthetic oligonucleotide
catgtggaaagcacctgtctgttggatgatgc

SEQ ID NO: 79749 - DNA, 33 bp, Artificial Sequence
  Description of Artificial Sequence: Synthetic oligonucleotide
atgtggaaagcacctgtctgttggatgatgctg

SEQ ID NO: 79750 - DNA, 32 bp, Artificial Sequence
  Description of Artificial Sequence: Synthetic oligonucleotide
tgtggaaagcacctgtctgttggatgatgctg

SEQ ID NO: 79751 - DNA, 31 bp, Artificial Sequence
  Description of Artificial Sequence: Synthetic oligonucleotide
gtggaaagcacctgtctgttggatgatgctg

SEQ ID NO: 79752 - DNA, 31 bp, Artificial Sequence
  Description of Artificial Sequence: Synthetic oligonucleotide
tggaaagcacctgtctgttggatgatgctgg

SEQ ID NO: 79753 - DNA, 30 bp, Artificial Sequence
  Description of Artificial Sequence: Synthetic oligonucleotide
ggaaagcacctgtctgttggatgatgctgg

SEQ ID NO: 79754 - DNA, 30 bp, Artificial Sequence
  Description of Artificial Sequence: Synthetic oligonucleotide
gaaagcacctgtctgttggatgatgctggg

SEQ ID NO: 79755 - DNA, 31 bp, Artificial Sequence
  Description of Artificial Sequence: Synthetic oligonucleotide
aaagcacctgtctgttggatgatgctgggac

SEQ ID NO: 79756 - DNA, 30 bp, Artificial Sequence
  Description of Artificial Sequence: Synthetic oligonucleotide
aagcacctgtctgttggatgatgctgggac

SEQ ID NO: 79757 - DNA, 29 bp, Artificial Sequence
  Description of Artificial Sequence: Synthetic oligonucleotide
agcacctgtctgttggatgatgctgggac

SEQ ID NO: 79758 - DNA, 28 bp, Artificial Sequence
  Description of Artificial Sequence: Synthetic oligonucleotide
gcacctgtctgttggatgatgctgggac

SEQ ID NO: 79759 - DNA, 29 bp, Artificial Sequence
  Description of Artificial Sequence: Synthetic oligonucleotide
cacctgtctgttggatgatgctgggactc

SEQ ID NO: 79760 - DNA, 29 bp, Artificial Sequence
  Description of Artificial Sequence: Synthetic oligonucleotide
acctgtctgttggatgatgctgggactcc

SEQ ID NO: 79761 - DNA, 28 bp, Artificial Sequence
  Description of Artificial Sequence: Synthetic oligonucleotide
cctgtctgttggatgatgctgggactcc

SEQ ID NO: 79762 - DNA, 31 bp, Artificial Sequence
  Description of Artificial Sequence: Synthetic oligonucleotide
ctgtctgttggatgatgctgggactccaaag

SEQ ID NO: 79763 - DNA, 31 bp, Artificial Sequence
  Description of Artificial Sequence: Synthetic oligonucleotide
tgtctgttggatgatgctgggactccaaagg

SEQ ID NO: 79764 - DNA, 30 bp, Artificial Sequence
  Description of Artificial Sequence: Synthetic oligonucleotide
gtctgttggatgatgctgggactccaaagg

SEQ ID NO: 79765 - DNA, 34 bp, Artificial Sequence
  Description of Artificial Sequence: Synthetic oligonucleotide
tctgttggatgatgctgggactccaaaggatttc

SEQ ID NO: 79766 - DNA, 33 bp, Artificial Sequence
  Description of Artificial Sequence: Synthetic oligonucleotide
ctgttggatgatgctgggactccaaaggatttc

SEQ ID NO: 79767 - DNA, 34 bp, Artificial Sequence
  Description of Artificial Sequence: Synthetic oligonucleotide
tgttggatgatgctgggactccaaaggatttcac

SEQ ID NO: 79768 - DNA, 33 bp, Artificial Sequence
  Description of Artificial Sequence: Synthetic oligonucleotide
gttggatgatgctgggactccaaaggatttcac

SEQ ID NO: 79769 - DNA, 36 bp, Artificial Sequence
  Description of Artificial Sequence: Synthetic oligonucleotide
ttggatgatgctgggactccaaaggatttcacatac

SEQ ID NO: 79770 - DNA, 35 bp, Artificial Sequence
  Description of Artificial Sequence: Synthetic oligonucleotide
tggatgatgctgggactccaaaggatttcacatac

SEQ ID NO: 79771 - DNA, 34 bp, Artificial Sequence
  Description of Artificial Sequence: Synthetic oligonucleotide
ggatgatgctgggactccaaaggatttcacatac

SEQ ID NO: 79772 - DNA, 35 bp, Artificial Sequence
  Description of Artificial Sequence: Synthetic oligonucleotide
gatgatgctgggactccaaaggatttcacatactg

SEQ ID NO: 79773 - DNA, 35 bp, Artificial Sequence
  Description of Artificial Sequence: Synthetic oligonucleotide
atgatgctgggactccaaaggatttcacatactgc

SEQ ID NO: 79774 - DNA, 34 bp, Artificial Sequence
  Description of Artificial Sequence: Synthetic oligonucleotide
tgatgctgggactccaaaggatttcacatactgc

SEQ ID NO: 79775 - DNA, 33 bp, Artificial Sequence
  Description of Artificial Sequence: Synthetic oligonucleotide
gatgctgggactccaaaggatttcacatactgc

SEQ ID NO: 79776 - DNA, 35 bp, Artificial Sequence
  Description of Artificial Sequence: Synthetic oligonucleotide
atgctgggactccaaaggatttcacatactgcatc

SEQ ID NO: 79777 - DNA, 34 bp, Artificial Sequence
  Description of Artificial Sequence: Synthetic oligonucleotide
tgctgggactccaaaggatttcacatactgcatc

SEQ ID NO: 79778 - DNA, 33 bp, Artificial Sequence
  Description of Artificial Sequence: Synthetic oligonucleotide
gctgggactccaaaggatttcacatactgcatc

SEQ ID NO: 79779 - DNA, 34 bp, Artificial Sequence
  Description of Artificial Sequence: Synthetic oligonucleotide
ctgggactccaaaggatttcacatactgcatctc

SEQ ID NO: 79780 - DNA, 34 bp, Artificial Sequence
  Description of Artificial Sequence: Synthetic oligonucleotide
tgggactccaaaggatttcacatactgcatctcc

SEQ ID NO: 79781 - DNA, 33 bp, Artificial Sequence
  Description of Artificial Sequence: Synthetic oligonucleotide
gggactccaaaggatttcacatactgcatctcc

SEQ ID NO: 79782 - DNA, 35 bp, Artificial Sequence
  Description of Artificial Sequence: Synthetic oligonucleotide
ggactccaaaggatttcacatactgcatctccttc

SEQ ID NO: 79783 - DNA, 37 bp, Artificial Sequence
  Description of Artificial Sequence: Synthetic oligonucleotide
gactccaaaggatttcacatactgcatctccttcaac

SEQ ID NO: 79784 - DNA, 39 bp, Artificial Sequence
  Description of Artificial Sequence: Synthetic oligonucleotide
actccaaaggatttcacatactgcatctccttcaacaag

SEQ ID NO: 79785 - DNA, 38 bp, Artificial Sequence
  Description of Artificial Sequence: Synthetic oligonucleotide
ctccaaaggatttcacatactgcatctccttcaacaag

SEQ ID NO: 79786 - DNA, 38 bp, Artificial Sequence
  Description of Artificial Sequence: Synthetic oligonucleotide
tccaaaggatttcacatactgcatctccttcaacaagg

SEQ ID NO: 79787 - DNA, 37 bp, Artificial Sequence
  Description of Artificial Sequence: Synthetic oligonucleotide
ccaaaggatttcacatactgcatctccttcaacaagg

SEQ ID NO: 79788 - DNA, 39 bp, Artificial Sequence
  Description of Artificial Sequence: Synthetic oligonucleotide
caaaggatttcacatactgcatctccttcaacaaggatc

SEQ ID NO: 79789 - DNA, 40 bp, Artificial Sequence
  Description of Artificial Sequence: Synthetic oligonucleotide
aaaggatttcacatactgcatctccttcaacaaggatctg

SEQ ID NO: 79790 - DNA, 39 bp, Artificial Sequence
  Description of Artificial Sequence: Synthetic oligonucleotide
aaggatttcacatactgcatctccttcaacaaggatctg

SEQ ID NO: 79791 - DNA, 38 bp, Artificial Sequence
  Description of Artificial Sequence: Synthetic oligonucleotide
aggatttcacatactgcatctccttcaacaaggatctg

SEQ ID NO: 79792 - DNA, 37 bp, Artificial Sequence
  Description of Artificial Sequence: Synthetic oligonucleotide
ggatttcacatactgcatctccttcaacaaggatctg

SEQ ID NO: 79793 - DNA, 37 bp, Artificial Sequence
  Description of Artificial Sequence: Synthetic oligonucleotide
gatttcacatactgcatctccttcaacaaggatctgc

SEQ ID NO: 79794 - DNA, 38 bp, Artificial Sequence
  Description of Artificial Sequence: Synthetic oligonucleotide
atttcacatactgcatctccttcaacaaggatctgctg

SEQ ID NO: 79795 - DNA, 37 bp, Artificial Sequence
  Description of Artificial Sequence: Synthetic oligonucleotide
tttcacatactgcatctccttcaacaaggatctgctg

SEQ ID NO: 79796 - DNA, 36 bp, Artificial Sequence
  Description of Artificial Sequence: Synthetic oligonucleotide
ttcacatactgcatctccttcaacaaggatctgctg

SEQ ID NO: 79797 - DNA, 35 bp, Artificial Sequence
  Description of Artificial Sequence: Synthetic oligonucleotide
tcacatactgcatctccttcaacaaggatctgctg

SEQ ID NO: 79798 - DNA, 34 bp, Artificial Sequence
  Description of Artificial Sequence: Synthetic oligonucleotide
cacatactgcatctccttcaacaaggatctgctg

SEQ ID NO: 79799 - DNA, 35 bp, Artificial Sequence
  Description of Artificial Sequence: Synthetic oligonucleotide
acatactgcatctccttcaacaaggatctgctgac

SEQ ID NO: 79800 - DNA, 34 bp, Artificial Sequence
  Description of Artificial Sequence: Synthetic oligonucleotide
catactgcatctccttcaacaaggatctgctgac

SEQ ID NO: 79801 - DNA, 34 bp, Artificial Sequence
  Description of Artificial Sequence: Synthetic oligonucleotide
atactgcatctccttcaacaaggatctgctgacc

SEQ ID NO: 79802 - DNA, 33 bp, Artificial Sequence
  Description of Artificial Sequence: Synthetic oligonucleotide
tactgcatctccttcaacaaggatctgctgacc

SEQ ID NO: 79803 - DNA, 32 bp, Artificial Sequence
  Description of Artificial Sequence: Synthetic oligonucleotide
actgcatctccttcaacaaggatctgctgacc

SEQ ID NO: 79804 - DNA, 31 bp, Artificial Sequence
  Description of Artificial Sequence: Synthetic oligonucleotide
ctgcatctccttcaacaaggatctgctgacc

SEQ ID NO: 79805 - DNA, 32 bp, Artificial Sequence
  Description of Artificial Sequence: Synthetic oligonucleotide
tgcatctccttcaacaaggatctgctgacctg

SEQ ID NO: 79806 - DNA, 31 bp, Artificial Sequence
  Description of Artificial Sequence: Synthetic oligonucleotide
gcatctccttcaacaaggatctgctgacctg

SEQ ID NO: 79807 - DNA, 31 bp, Artificial Sequence
  Description of Artificial Sequence: Synthetic oligonucleotide
catctccttcaacaaggatctgctgacctgc

SEQ ID NO: 79808 - DNA, 32 bp, Artificial Sequence
  Description of Artificial Sequence: Synthetic oligonucleotide
atctccttcaacaaggatctgctgacctgctg

SEQ ID NO: 79809 - DNA, 31 bp, Artificial Sequence
  Description of Artificial Sequence: Synthetic oligonucleotide
tctccttcaacaaggatctgctgacctgctg

SEQ ID NO: 79810 - DNA, 30 bp, Artificial Sequence
  Description of Artificial Sequence: Synthetic oligonucleotide
ctccttcaacaaggatctgctgacctgctg

SEQ ID NO: 79811 - DNA, 30 bp, Artificial Sequence
  Description of Artificial Sequence: Synthetic oligonucleotide
tccttcaacaaggatctgctgacctgctgg

SEQ ID NO: 79812 - DNA, 29 bp, Artificial Sequence
  Description of Artificial Sequence: Synthetic oligonucleotide
ccttcaacaaggatctgctgacctgctgg

SEQ ID NO: 79813 - DNA, 29 bp, Artificial Sequence
  Description of Artificial Sequence: Synthetic oligonucleotide
cttcaacaaggatctgctgacctgctggg

SEQ ID NO: 79814 - DNA, 31 bp, Artificial Sequence
  Description of Artificial Sequence: Synthetic oligonucleotide
ttcaacaaggatctgctgacctgctgggatc

SEQ ID NO: 79815 - DNA, 30 bp, Artificial Sequence
  Description of Artificial Sequence: Synthetic oligonucleotide
tcaacaaggatctgctgacctgctgggatc

SEQ ID NO: 79816 - DNA, 29 bp, Artificial Sequence
  Description of Artificial Sequence: Synthetic oligonucleotide
caacaaggatctgctgacctgctgggatc

SEQ ID NO: 79817 - DNA, 29 bp, Artificial Sequence
  Description of Artificial Sequence: Synthetic oligonucleotide
aacaaggatctgctgacctgctgggatcc

SEQ ID NO: 79818 - DNA, 28 bp, Artificial Sequence
  Description of Artificial Sequence: Synthetic oligonucleotide
acaaggatctgctgacctgctgggatcc

SEQ ID NO: 79819 - DNA, 27 bp, Artificial Sequence
  Description of Artificial Sequence: Synthetic oligonucleotide
caaggatctgctgacctgctgggatcc

SEQ ID NO: 79820 - DNA, 28 bp, Artificial Sequence
  Description of Artificial Sequence: Synthetic oligonucleotide
aaggatctgctgacctgctgggatccag

SEQ ID NO: 79821 - DNA, 27 bp, Artificial Sequence
  Description of Artificial Sequence: Synthetic oligonucleotide
aggatctgctgacctgctgggatccag

SEQ ID NO: 79822 - DNA, 27 bp, Artificial Sequence
  Description of Artificial Sequence: Synthetic oligonucleotide
ggatctgctgacctgctgggatccaga

SEQ ID NO: 79823 - DNA, 27 bp, Artificial Sequence
  Description of Artificial Sequence: Synthetic oligonucleotide
gatctgctgacctgctgggatccagag

SEQ ID NO: 79824 - DNA, 27 bp, Artificial Sequence
  Description of Artificial Sequence: Synthetic oligonucleotide
atctgctgacctgctgggatccagagg

SEQ ID NO: 79825 - DNA, 27 bp, Artificial Sequence
  Description of Artificial Sequence: Synthetic oligonucleotide
tctgctgacctgctgggatccagagga

SEQ ID NO: 79826 - DNA, 26 bp, Artificial Sequence
  Description of Artificial Sequence: Synthetic oligonucleotide
ctgctgacctgctgggatccagagga

SEQ ID NO: 79827 - DNA, 27 bp, Artificial Sequence
  Description of Artificial Sequence: Synthetic oligonucleotide
tgctgacctgctgggatccagaggaga

SEQ ID NO: 79828 - DNA, 27 bp, Artificial Sequence
  Description of Artificial Sequence: Synthetic oligonucleotide
gctgacctgctgggatccagaggagaa

SEQ ID NO: 79829 - DNA, 30 bp, Artificial Sequence
  Description of Artificial Sequence: Synthetic oligonucleotide
ctgacctgctgggatccagaggagaataag

SEQ ID NO: 79830 - DNA, 32 bp, Artificial Sequence
  Description of Artificial Sequence: Synthetic oligonucleotide
tgacctgctgggatccagaggagaataagatg

SEQ ID NO: 79831 - DNA, 31 bp, Artificial Sequence
  Description of Artificial Sequence: Synthetic oligonucleotide
gacctgctgggatccagaggagaataagatg

SEQ ID NO: 79832 - DNA, 31 bp, Artificial Sequence
  Description of Artificial Sequence: Synthetic oligonucleotide
acctgctgggatccagaggagaataagatgg

SEQ ID NO: 79833 - DNA, 30 bp, Artificial Sequence
  Description of Artificial Sequence: Synthetic oligonucleotide
cctgctgggatccagaggagaataagatgg

SEQ ID NO: 79834 - DNA, 30 bp, Artificial Sequence
  Description of Artificial Sequence: Synthetic oligonucleotide
ctgctgggatccagaggagaataagatggc

SEQ ID NO: 79835 - DNA, 30 bp, Artificial Sequence
  Description of Artificial Sequence: Synthetic oligonucleotide
tgctgggatccagaggagaataagatggcc

SEQ ID NO: 79836 - DNA, 29 bp, Artificial Sequence
  Description of Artificial Sequence: Synthetic oligonucleotide
gctgggatccagaggagaataagatggcc

SEQ ID NO: 79837 - DNA, 29 bp, Artificial Sequence
  Description of Artificial Sequence: Synthetic oligonucleotide
ctgggatccagaggagaataagatggccc

SEQ ID NO: 79838 - DNA, 29 bp, Artificial Sequence
  Description of Artificial Sequence: Synthetic oligonucleotide
tgggatccagaggagaataagatggcccc

SEQ ID NO: 79839 - DNA, 28 bp, Artificial Sequence
  Description of Artificial Sequence: Synthetic oligonucleotide
gggatccagaggagaataagatggcccc

SEQ ID NO: 79840 - DNA, 30 bp, Artificial Sequence
  Description of Artificial Sequence: Synthetic oligonucleotide
ggatccagaggagaataagatggccccttg

SEQ ID NO: 79841 - DNA, 30 bp, Artificial Sequence
  Description of Artificial Sequence: Synthetic oligonucleotide
gatccagaggagaataagatggccccttgc

SEQ ID NO: 79842 - DNA, 30 bp, Artificial Sequence
  Description of Artificial Sequence: Synthetic oligonucleotide
atccagaggagaataagatggccccttgcg

SEQ ID NO: 79843 - DNA, 29 bp, Artificial Sequence
  Description of Artificial Sequence: Synthetic oligonucleotide
tccagaggagaataagatggccccttgcg

SEQ ID NO: 79844 - DNA, 28 bp, Artificial Sequence
  Description of Artificial Sequence: Synthetic oligonucleotide
ccagaggagaataagatggccccttgcg

SEQ ID NO: 79845 - DNA, 33 bp, Artificial Sequence
  Description of Artificial Sequence: Synthetic oligonucleotide
cagaggagaataagatggccccttgcgaatttg

SEQ ID NO: 79846 - DNA, 33 bp, Artificial Sequence
  Description of Artificial Sequence: Synthetic oligonucleotide
agaggagaataagatggccccttgcgaatttgg

SEQ ID NO: 79847 - DNA, 32 bp, Artificial Sequence
  Description of Artificial Sequence: Synthetic oligonucleotide
gaggagaataagatggccccttgcgaatttgg

SEQ ID NO: 79848 - DNA, 32 bp, Artificial Sequence
  Description of Artificial Sequence: Synthetic oligonucleotide
aggagaataagatggccccttgcgaatttggg

SEQ ID NO: 79849 - DNA, 31 bp, Artificial Sequence
  Description of Artificial Sequence: Synthetic oligonucleotide
ggagaataagatggccccttgcgaatttggg

SEQ ID NO: 79850 - DNA, 31 bp, Artificial Sequence
  Description of Artificial Sequence: Synthetic oligonucleotide
gagaataagatggccccttgcgaatttgggg

SEQ ID NO: 79851 - DNA, 32 bp, Artificial Sequence
  Description of Artificial Sequence: Synthetic oligonucleotide
agaataagatggccccttgcgaatttggggtg

SEQ ID NO: 79852 - DNA, 31 bp, Artificial Sequence
  Description of Artificial Sequence: Synthetic oligonucleotide
gaataagatggccccttgcgaatttggggtg

SEQ ID NO: 79853 - DNA, 31 bp, Artificial Sequence
  Description of Artificial Sequence: Synthetic oligonucleotide
aataagatggccccttgcgaatttggggtgc

SEQ ID NO: 79854 - DNA, 30 bp, Artificial Sequence
  Description of Artificial Sequence: Synthetic oligonucleotide
ataagatggccccttgcgaatttggggtgc

SEQ ID NO: 79855 - DNA, 29 bp, Artificial Sequence
  Description of Artificial Sequence: Synthetic oligonucleotide
taagatggccccttgcgaatttggggtgc

SEQ ID NO: 79856 - DNA, 28 bp, Artificial Sequence
  Description of Artificial Sequence: Synthetic oligonucleotide
aagatggccccttgcgaatttggggtgc

SEQ ID NO: 79857 - DNA, 27 bp, Artificial Sequence
  Description of Artificial Sequence: Synthetic oligonucleotide
agatggccccttgcgaatttggggtgc

SEQ ID NO: 79858 - DNA, 27 bp, Artificial Sequence
  Description of Artificial Sequence: Synthetic oligonucleotide
gatggccccttgcgaatttggggtgct

SEQ ID NO: 79859 - DNA, 27 bp, Artificial Sequence
  Description of Artificial Sequence: Synthetic oligonucleotide
atggccccttgcgaatttggggtgctg

SEQ ID NO: 79860 - DNA, 27 bp, Artificial Sequence
  Description of Artificial Sequence: Synthetic oligonucleotide
tggccccttgcgaatttggggtgctga

SEQ ID NO: 79861 - DNA, 27 bp, Artificial Sequence
  Description of Artificial Sequence: Synthetic oligonucleotide
ggccccttgcgaatttggggtgctgaa

SEQ ID NO: 79862 - DNA, 29 bp, Artificial Sequence
  Description of Artificial Sequence: Synthetic oligonucleotide
gccccttgcgaatttggggtgctgaatag

SEQ ID NO: 79863 - DNA, 29 bp, Artificial Sequence
  Description of Artificial Sequence: Synthetic oligonucleotide
ccccttgcgaatttggggtgctgaatagc

SEQ ID NO: 79864 - DNA, 31 bp, Artificial Sequence
  Description of Artificial Sequence: Synthetic oligonucleotide
cccttgcgaatttggggtgctgaatagcttg

SEQ ID NO: 79865 - DNA, 31 bp, Artificial Sequence
  Description of Artificial Sequence: Synthetic oligonucleotide
ccttgcgaatttggggtgctgaatagcttgg

SEQ ID NO: 79866 - DNA, 31 bp, Artificial Sequence
  Description of Artificial Sequence: Synthetic oligonucleotide
cttgcgaatttggggtgctgaatagcttggc

SEQ ID NO: 79867 - DNA, 31 bp, Artificial Sequence
  Description of Artificial Sequence: Synthetic oligonucleotide
ttgcgaatttggggtgctgaatagcttggcg

SEQ ID NO: 79868 - DNA, 30 bp, Artificial Sequence
  Description of Artificial Sequence: Synthetic oligonucleotide
tgcgaatttggggtgctgaatagcttggcg

SEQ ID NO: 79869 - DNA, 29 bp, Artificial Sequence
  Description of Artificial Sequence: Synthetic oligonucleotide
gcgaatttggggtgctgaatagcttggcg

SEQ ID NO: 79870 - DNA, 32 bp, Artificial Sequence
  Description of Artificial Sequence: Synthetic oligonucleotide
cgaatttggggtgctgaatagcttggcgaatg

SEQ ID NO: 79871 - DNA, 33 bp, Artificial Sequence
  Description of Artificial Sequence: Synthetic oligonucleotide
gaatttggggtgctgaatagcttggcgaatgtc

SEQ ID NO: 79872 - DNA, 33 bp, Artificial Sequence
  Description of Artificial Sequence: Synthetic oligonucleotide
aatttggggtgctgaatagcttggcgaatgtcc

SEQ ID NO: 79873 - DNA, 32 bp, Artificial Sequence
  Description of Artificial Sequence: Synthetic oligonucleotide
atttggggtgctgaatagcttggcgaatgtcc

SEQ ID NO: 79874 - DNA, 31 bp, Artificial Sequence
  Description of Artificial Sequence: Synthetic oligonucleotide
tttggggtgctgaatagcttggcgaatgtcc

SEQ ID NO: 79875 - DNA, 30 bp, Artificial Sequence
  Description of Artificial Sequence: Synthetic oligonucleotide
ttggggtgctgaatagcttggcgaatgtcc

SEQ ID NO: 79876 - DNA, 29 bp, Artificial Sequence
  Description of Artificial Sequence: Synthetic oligonucleotide
tggggtgctgaatagcttggcgaatgtcc

SEQ ID NO: 79877 - DNA, 28 bp, Artificial Sequence
  Description of Artificial Sequence: Synthetic oligonucleotide
ggggtgctgaatagcttggcgaatgtcc

SEQ ID NO: 79878 - DNA, 29 bp, Artificial Sequence
  Description of Artificial Sequence: Synthetic oligonucleotide
gggtgctgaatagcttggcgaatgtcctc

SEQ ID NO: 79879 - DNA, 30 bp, Artificial Sequence
  Description of Artificial Sequence: Synthetic oligonucleotide
ggtgctgaatagcttggcgaatgtcctctc

SEQ ID NO: 79880 - DNA, 31 bp, Artificial Sequence
  Description of Artificial Sequence: Synthetic oligonucleotide
gtgctgaatagcttggcgaatgtcctctcac

SEQ ID NO: 79881 - DNA, 32 bp, Artificial Sequence
  Description of Artificial Sequence: Synthetic oligonucleotide
tgctgaatagcttggcgaatgtcctctcacag

SEQ ID NO: 79882 - DNA, 31 bp, Artificial Sequence
  Description of Artificial Sequence: Synthetic oligonucleotide
gctgaatagcttggcgaatgtcctctcacag

SEQ ID NO: 79883 - DNA, 31 bp, Artificial Sequence
  Description of Artificial Sequence: Synthetic oligonucleotide
ctgaatagcttggcgaatgtcctctcacagc

SEQ ID NO: 79884 - DNA, 32 bp, Artificial Sequence
  Description of Artificial Sequence: Synthetic oligonucleotide
tgaatagcttggcgaatgtcctctcacagcac

SEQ ID NO: 79885 - DNA, 31 bp, Artificial Sequence
  Description of Artificial Sequence: Synthetic oligonucleotide
gaatagcttggcgaatgtcctctcacagcac

SEQ ID NO: 79886 - DNA, 31 bp, Artificial Sequence
  Description of Artificial Sequence: Synthetic oligonucleotide
aatagcttggcgaatgtcctctcacagcacc

SEQ ID NO: 79887 - DNA, 30 bp, Artificial Sequence
  Description of Artificial Sequence: Synthetic oligonucleotide
atagcttggcgaatgtcctctcacagcacc

SEQ ID NO: 79888 - DNA, 29 bp, Artificial Sequence
  Description of Artificial Sequence: Synthetic oligonucleotide
tagcttggcgaatgtcctctcacagcacc

SEQ ID NO: 79889 - DNA, 28 bp, Artificial Sequence
  Description of Artificial Sequence: Synthetic oligonucleotide
agcttggcgaatgtcctctcacagcacc

SEQ ID NO: 79890 - DNA, 27 bp, Artificial Sequence
  Description of Artificial Sequence: Synthetic oligonucleotide
gcttggcgaatgtcctctcacagcacc

SEQ ID NO: 79891 - DNA, 28 bp, Artificial Sequence
  Description of Artificial Sequence: Synthetic oligonucleotide
cttggcgaatgtcctctcacagcacctc

SEQ ID NO: 79892 - DNA, 30 bp, Artificial Sequence
  Description of Artificial Sequence: Synthetic oligonucleotide
ttggcgaatgtcctctcacagcacctcaac

SEQ ID NO: 79893 - DNA, 29 bp, Artificial Sequence
  Description of Artificial Sequence: Synthetic oligonucleotide
tggcgaatgtcctctcacagcacctcaac

SEQ ID NO: 79894 - DNA, 28 bp, Artificial Sequence
  Description of Artificial Sequence: Synthetic oligonucleotide
ggcgaatgtcctctcacagcacctcaac

SEQ ID NO: 79895 - DNA, 28 bp, Artificial Sequence
  Description of Artificial Sequence: Synthetic oligonucleotide
gcgaatgtcctctcacagcacctcaacc

SEQ ID NO: 79896 - DNA, 33 bp, Artificial Sequence
  Description of Artificial Sequence: Synthetic oligonucleotide
cgaatgtcctctcacagcacctcaaccaaaaag

SEQ ID NO: 79897 - DNA, 34 bp, Artificial Sequence
  Description of Artificial Sequence: Synthetic oligonucleotide
gaatgtcctctcacagcacctcaaccaaaaagac

SEQ ID NO: 79898 - DNA, 35 bp, Artificial Sequence
  Description of Artificial Sequence: Synthetic oligonucleotide
aatgtcctctcacagcacctcaaccaaaaagacac

SEQ ID NO: 79899 - DNA, 34 bp, Artificial Sequence
  Description of Artificial Sequence: Synthetic oligonucleotide
atgtcctctcacagcacctcaaccaaaaagacac

SEQ ID NO: 79900 - DNA, 33 bp, Artificial Sequence
  Description of Artificial Sequence: Synthetic oligonucleotide
tgtcctctcacagcacctcaaccaaaaagacac

SEQ ID NO: 79901 - DNA, 32 bp, Artificial Sequence
  Description of Artificial Sequence: Synthetic oligonucleotide
gtcctctcacagcacctcaaccaaaaagacac

SEQ ID NO: 79902 - DNA, 32 bp, Artificial Sequence
  Description of Artificial Sequence: Synthetic oligonucleotide
tcctctcacagcacctcaaccaaaaagacacc

SEQ ID NO: 79903 - DNA, 31 bp, Artificial Sequence
  Description of Artificial Sequence: Synthetic oligonucleotide
cctctcacagcacctcaaccaaaaagacacc

SEQ ID NO: 79904 - DNA, 31 bp, Artificial Sequence
  Description of Artificial Sequence: Synthetic oligonucleotide
ctctcacagcacctcaaccaaaaagacaccc

SEQ ID NO: 79905 - DNA, 32 bp, Artificial Sequence
  Description of Artificial Sequence: Synthetic oligonucleotide
tctcacagcacctcaaccaaaaagacaccctg

SEQ ID NO: 79906 - DNA, 31 bp, Artificial Sequence
  Description of Artificial Sequence: Synthetic oligonucleotide
ctcacagcacctcaaccaaaaagacaccctg

SEQ ID NO: 79907 - DNA, 33 bp, Artificial Sequence
  Description of Artificial Sequence: Synthetic oligonucleotide
tcacagcacctcaaccaaaaagacaccctgatg

SEQ ID NO: 79908 - DNA, 32 bp, Artificial Sequence
  Description of Artificial Sequence: Synthetic oligonucleotide
cacagcacctcaaccaaaaagacaccctgatg

SEQ ID NO: 79909 - DNA, 32 bp, Artificial Sequence
  Description of Artificial Sequence: Synthetic oligonucleotide
acagcacctcaaccaaaaagacaccctgatgc

SEQ ID NO: 79910 - DNA, 31 bp, Artificial Sequence
  Description of Artificial Sequence: Synthetic oligonucleotide
cagcacctcaaccaaaaagacaccctgatgc

SEQ ID NO: 79911 - DNA, 32 bp, Artificial Sequence
  Description of Artificial Sequence: Synthetic oligonucleotide
agcacctcaaccaaaaagacaccctgatgcag

SEQ ID NO: 79912 - DNA, 31 bp, Artificial Sequence
  Description of Artificial Sequence: Synthetic oligonucleotide
gcacctcaaccaaaaagacaccctgatgcag

SEQ ID NO: 79913 - DNA, 31 bp, Artificial Sequence
  Description of Artificial Sequence: Synthetic oligonucleotide
cacctcaaccaaaaagacaccctgatgcagc

SEQ ID NO: 79914 - DNA, 31 bp, Artificial Sequence
  Description of Artificial Sequence: Synthetic oligonucleotide
acctcaaccaaaaagacaccctgatgcagcg

SEQ ID NO: 79915 - DNA, 30 bp, Artificial Sequence
  Description of Artificial Sequence: Synthetic oligonucleotide
cctcaaccaaaaagacaccctgatgcagcg

SEQ ID NO: 79916 - DNA, 30 bp, Artificial Sequence
  Description of Artificial Sequence: Synthetic oligonucleotide
ctcaaccaaaaagacaccctgatgcagcgc

SEQ ID NO: 79917 - DNA, 32 bp, Artificial Sequence
  Description of Artificial Sequence: Synthetic oligonucleotide
tcaaccaaaaagacaccctgatgcagcgcttg

SEQ ID NO: 79918 - DNA, 31 bp, Artificial Sequence
  Description of Artificial Sequence: Synthetic oligonucleotide
caaccaaaaagacaccctgatgcagcgcttg

SEQ ID NO: 79919 - DNA, 31 bp, Artificial Sequence
  Description of Artificial Sequence: Synthetic oligonucleotide
aaccaaaaagacaccctgatgcagcgcttgc

SEQ ID NO: 79920 - DNA, 30 bp, Artificial Sequence
  Description of Artificial Sequence: Synthetic oligonucleotide
accaaaaagacaccctgatgcagcgcttgc

SEQ ID NO: 79921 - DNA, 29 bp, Artificial Sequence
  Description of Artificial Sequence: Synthetic oligonucleotide
ccaaaaagacaccctgatgcagcgcttgc

SEQ ID NO: 79922 - DNA, 29 bp, Artificial Sequence
  Description of Artificial Sequence: Synthetic oligonucleotide
caaaaagacaccctgatgcagcgcttgcg

SEQ ID NO: 79923 - DNA, 29 bp, Artificial Sequence
  Description of Artificial Sequence: Synthetic oligonucleotide
aaaaagacaccctgatgcagcgcttgcgc

SEQ ID NO: 79924 - DNA, 28 bp, Artificial Sequence
  Description of Artificial Sequence: Synthetic oligonucleotide
aaaagacaccctgatgcagcgcttgcgc

SEQ ID NO: 79925 - DNA, 27 bp, Artificial Sequence
  Description of Artificial Sequence: Synthetic oligonucleotide
aaagacaccctgatgcagcgcttgcgc

SEQ ID NO: 79926 - DNA, 27 bp, Artificial Sequence
  Description of Artificial Sequence: Synthetic oligonucleotide
aagacaccctgatgcagcgcttgcgca

SEQ ID NO: 79927 - DNA, 27 bp, Artificial Sequence
  Description of Artificial Sequence: Synthetic oligonucleotide
agacaccctgatgcagcgcttgcgcaa

SEQ ID NO: 79928 - DNA, 27 bp, Artificial Sequence
  Description of Artificial Sequence: Synthetic oligonucleotide
gacaccctgatgcagcgcttgcgcaat

SEQ ID NO: 79929 - DNA, 27 bp, Artificial Sequence
  Description of Artificial Sequence: Synthetic oligonucleotide
acaccctgatgcagcgcttgcgcaatg

SEQ ID NO: 79930 - DNA, 26 bp, Artificial Sequence
  Description of Artificial Sequence: Synthetic oligonucleotide
caccctgatgcagcgcttgcgcaatg

SEQ ID NO: 79931 - DNA, 26 bp, Artificial Sequence
  Description of Artificial Sequence: Synthetic oligonucleotide
accctgatgcagcgcttgcgcaatgg

SEQ ID NO: 79932 - DNA, 25 bp, Artificial Sequence
  Description of Artificial Sequence: Synthetic oligonucleotide
ccctgatgcagcgcttgcgcaatgg

SEQ ID NO: 79933 - DNA, 25 bp, Artificial Sequence
  Description of Artificial Sequence: Synthetic oligonucleotide
cctgatgcagcgcttgcgcaatggg

SEQ ID NO: 79934 - DNA, 27 bp, Artificial Sequence
  Description of Artificial Sequence: Synthetic oligonucleotide
ctgatgcagcgcttgcgcaatgggctt

SEQ ID NO: 79935 - DNA, 27 bp, Artificial Sequence
  Description of Artificial Sequence: Synthetic oligonucleotide
tgatgcagcgcttgcgcaatgggcttc

SEQ ID NO: 79936 - DNA, 27 bp, Artificial Sequence
  Description of Artificial Sequence: Synthetic oligonucleotide
gatgcagcgcttgcgcaatgggcttca

SEQ ID NO: 79937 - DNA, 27 bp, Artificial Sequence
  Description of Artificial Sequence: Synthetic oligonucleotide
atgcagcgcttgcgcaatgggcttcag

SEQ ID NO: 79938 - DNA, 27 bp, Artificial Sequence
  Description of Artificial Sequence: Synthetic oligonucleotide
tgcagcgcttgcgcaatgggcttcaga

SEQ ID NO: 79939 - DNA, 27 bp, Artificial Sequence
  Description of Artificial Sequence: Synthetic oligonucleotide
gcagcgcttgcgcaatgggcttcagaa

SEQ ID NO: 79940 - DNA, 29 bp, Artificial Sequence
  Description of Artificial Sequence: Synthetic oligonucleotide
cagcgcttgcgcaatgggcttcagaattg

SEQ ID NO: 79941 - DNA, 30 bp, Artificial Sequence
  Description of Artificial Sequence: Synthetic oligonucleotide
agcgcttgcgcaatgggcttcagaattgtg

SEQ ID NO: 79942 - DNA, 29 bp, Artificial Sequence
  Description of Artificial Sequence: Synthetic oligonucleotide
gcgcttgcgcaatgggcttcagaattgtg

SEQ ID NO: 79943 - DNA, 29 bp, Artificial Sequence
  Description of Artificial Sequence: Synthetic oligonucleotide
cgcttgcgcaatgggcttcagaattgtgc

SEQ ID NO: 79944 - DNA, 29 bp, Artificial Sequence
  Description of Artificial Sequence: Synthetic oligonucleotide
gcttgcgcaatgggcttcagaattgtgcc

SEQ ID NO: 79945 - DNA, 30 bp, Artificial Sequence
  Description of Artificial Sequence: Synthetic oligonucleotide
cttgcgcaatgggcttcagaattgtgccac

SEQ ID NO: 79946 - DNA, 31 bp, Artificial Sequence
  Description of Artificial Sequence: Synthetic oligonucleotide
ttgcgcaatgggcttcagaattgtgccacac

SEQ ID NO: 79947 - DNA, 30 bp, Artificial Sequence
  Description of Artificial Sequence: Synthetic oligonucleotide
tgcgcaatgggcttcagaattgtgccacac

SEQ ID NO: 79948 - DNA, 29 bp, Artificial Sequence
  Description of Artificial Sequence: Synthetic oligonucleotide
gcgcaatgggcttcagaattgtgccacac

SEQ ID NO: 79949 - DNA, 30 bp, Artificial Sequence
  Description of Artificial Sequence: Synthetic oligonucleotide
cgcaatgggcttcagaattgtgccacacac

SEQ ID NO: 79950 - DNA, 31 bp, Artificial Sequence
  Description of Artificial Sequence: Synthetic oligonucleotide
gcaatgggcttcagaattgtgccacacacac

SEQ ID NO: 79951 - DNA, 31 bp, Artificial Sequence
  Description of Artificial Sequence: Synthetic oligonucleotide
caatgggcttcagaattgtgccacacacacc

SEQ ID NO: 79952 - DNA, 31 bp, Artificial Sequence
  Description of Artificial Sequence: Synthetic oligonucleotide
aatgggcttcagaattgtgccacacacaccc

SEQ ID NO: 79953 - DNA, 30 bp, Artificial Sequence
  Description of Artificial Sequence: Synthetic oligonucleotide
atgggcttcagaattgtgccacacacaccc

SEQ ID NO: 79954 - DNA, 29 bp, Artificial Sequence
  Description of Artificial Sequence: Synthetic oligonucleotide
tgggcttcagaattgtgccacacacaccc

SEQ ID NO: 79955 - DNA, 28 bp, Artificial Sequence
  Description of Artificial Sequence: Synthetic oligonucleotide
gggcttcagaattgtgccacacacaccc

SEQ ID NO: 79956 - DNA, 29 bp, Artificial Sequence
  Description of Artificial Sequence: Synthetic oligonucleotide
ggcttcagaattgtgccacacacacccag

SEQ ID NO: 79957 - DNA, 29 bp, Artificial Sequence
  Description of Artificial Sequence: Synthetic oligonucleotide
gcttcagaattgtgccacacacacccagc

SEQ ID NO: 79958 - DNA, 29 bp, Artificial Sequence
  Description of Artificial Sequence: Synthetic oligonucleotide
cttcagaattgtgccacacacacccagcc

SEQ ID NO: 79959 - DNA, 29 bp, Artificial Sequence
  Description of Artificial Sequence: Synthetic oligonucleotide
ttcagaattgtgccacacacacccagccc

SEQ ID NO: 79960 - DNA, 28 bp, Artificial Sequence
  Description of Artificial Sequence: Synthetic oligonucleotide
tcagaattgtgccacacacacccagccc

SEQ ID NO: 79961 - DNA, 27 bp, Artificial Sequence
  Description of Artificial Sequence: Synthetic oligonucleotide
cagaattgtgccacacacacccagccc

SEQ ID NO: 79962 - DNA, 29 bp, Artificial Sequence
  Description of Artificial Sequence: Synthetic oligonucleotide
agaattgtgccacacacacccagcccttc

SEQ ID NO: 79963 - DNA, 28 bp, Artificial Sequence
  Description of Artificial Sequence: Synthetic oligonucleotide
gaattgtgccacacacacccagcccttc

SEQ ID NO: 79964 - DNA, 29 bp, Artificial Sequence
  Description of Artificial Sequence: Synthetic oligonucleotide
aattgtgccacacacacccagcccttctg

SEQ ID NO: 79965 - DNA, 28 bp, Artificial Sequence
  Description of Artificial Sequence: Synthetic oligonucleotide
attgtgccacacacacccagcccttctg

SEQ ID NO: 79966 - DNA, 27 bp, Artificial Sequence
  Description of Artificial Sequence: Synthetic oligonucleotide
ttgtgccacacacacccagcccttctg

SEQ ID NO: 79967 - DNA, 26 bp, Artificial Sequence
  Description of Artificial Sequence: Synthetic oligonucleotide
tgtgccacacacacccagcccttctg

SEQ ID NO: 79968 - DNA, 25 bp, Artificial Sequence
  Description of Artificial Sequence: Synthetic oligonucleotide
gtgccacacacacccagcccttctg

SEQ ID NO: 79969 - DNA, 25 bp, Artificial Sequence
  Description of Artificial Sequence: Synthetic oligonucleotide
tgccacacacacccagcccttctgg

SEQ ID NO: 79970 - DNA, 24 bp, Artificial Sequence
  Description of Artificial Sequence: Synthetic oligonucleotide
gccacacacacccagcccttctgg

SEQ ID NO: 79971 - DNA, 24 bp, Artificial Sequence
  Description of Artificial Sequence: Synthetic oligonucleotide
ccacacacacccagcccttctggg

SEQ ID NO: 79972 - DNA, 26 bp, Artificial Sequence
  Description of Artificial Sequence: Synthetic oligonucleotide
cacacacacccagcccttctggggat

SEQ ID NO: 79973 - DNA, 27 bp, Artificial Sequence
  Description of Artificial Sequence: Synthetic oligonucleotide
acacacacccagcccttctggggatca

SEQ ID NO: 79974 - DNA, 26 bp, Artificial Sequence
  Description of Artificial Sequence: Synthetic oligonucleotide
cacacacccagcccttctggggatca

SEQ ID NO: 79975 - DNA, 27 bp, Artificial Sequence
  Description of Artificial Sequence: Synthetic oligonucleotide
acacacccagcccttctggggatcact

SEQ ID NO: 79976 - DNA, 26 bp, Artificial Sequence
  Description of Artificial Sequence: Synthetic oligonucleotide
cacacccagcccttctggggatcact

SEQ ID NO: 79977 - DNA, 27 bp, Artificial Sequence
  Description of Artificial Sequence: Synthetic oligonucleotide
acacccagcccttctggggatcactga

SEQ ID NO: 79978 - DNA, 26 bp, Artificial Sequence
  Description of Artificial Sequence: Synthetic oligonucleotide
cacccagcccttctggggatcactga

SEQ ID NO: 79979 - DNA, 26 bp, Artificial Sequence
  Description of Artificial Sequence: Synthetic oligonucleotide
acccagcccttctggggatcactgac

SEQ ID NO: 79980 - DNA, 25 bp, Artificial Sequence
  Description of Artificial Sequence: Synthetic oligonucleotide
cccagcccttctggggatcactgac

SEQ ID NO: 79981 - DNA, 27 bp, Artificial Sequence
  Description of Artificial Sequence: Synthetic oligonucleotide
ccagcccttctggggatcactgaccaa

SEQ ID NO: 79982 - DNA, 27 bp, Artificial Sequence
  Description of Artificial Sequence: Synthetic oligonucleotide
cagcccttctggggatcactgaccaac

SEQ ID NO: 79983 - DNA, 28 bp, Artificial Sequence
  Description of Artificial Sequence: Synthetic oligonucleotide
agcccttctggggatcactgaccaacag

SEQ ID NO: 79984 - DNA, 27 bp, Artificial Sequence
  Description of Artificial Sequence: Synthetic oligonucleotide
gcccttctggggatcactgaccaacag

SEQ ID NO: 79985 - DNA, 27 bp, Artificial Sequence
  Description of Artificial Sequence: Synthetic oligonucleotide
cccttctggggatcactgaccaacagg

SEQ ID NO: 79986 - DNA, 28 bp, Artificial Sequence
  Description of Artificial Sequence: Synthetic oligonucleotide
ccttctggggatcactgaccaacaggac

SEQ ID NO: 79987 - DNA, 29 bp, Artificial Sequence
  Description of Artificial Sequence: Synthetic oligonucleotide
cttctggggatcactgaccaacaggacac

SEQ ID NO: 79988 - DNA, 29 bp, Artificial Sequence
  Description of Artificial Sequence: Synthetic oligonucleotide
ttctggggatcactgaccaacaggacacg

SEQ ID NO: 79989 - DNA, 28 bp, Artificial Sequence
  Description of Artificial Sequence: Synthetic oligonucleotide
tctggggatcactgaccaacaggacacg

SEQ ID NO: 79990 - DNA, 27 bp, Artificial Sequence
  Description of Artificial Sequence: Synthetic oligonucleotide
ctggggatcactgaccaacaggacacg

SEQ ID NO: 79991 - DNA, 27 bp, Artificial Sequence
  Description of Artificial Sequence: Synthetic oligonucleotide
tggggatcactgaccaacaggacacgg

SEQ ID NO: 79992 - DNA, 26 bp, Artificial Sequence
  Description of Artificial Sequence: Synthetic oligonucleotide
ggggatcactgaccaacaggacacgg

SEQ ID NO: 79993 - DNA, 26 bp, Artificial Sequence
  Description of Artificial Sequence: Synthetic oligonucleotide
gggatcactgaccaacaggacacggc

SEQ ID NO: 79994 - DNA, 27 bp, Artificial Sequence
  Description of Artificial Sequence: Synthetic oligonucleotide
ggatcactgaccaacaggacacggcca

SEQ ID NO: 79995 - DNA, 27 bp, Artificial Sequence
  Description of Artificial Sequence: Synthetic oligonucleotide
gatcactgaccaacaggacacggccac

SEQ ID NO: 79996 - DNA, 27 bp, Artificial Sequence
  Description of Artificial Sequence: Synthetic oligonucleotide
atcactgaccaacaggacacggccacc

SEQ ID NO: 79997 - DNA, 27 bp, Artificial Sequence
  Description of Artificial Sequence: Synthetic oligonucleotide
tcactgaccaacaggacacggccacca

SEQ ID NO: 79998 - DNA, 27 bp, Artificial Sequence
  Description of Artificial Sequence: Synthetic oligonucleotide
cactgaccaacaggacacggccaccat

SEQ ID NO: 79999 - DNA, 27 bp, Artificial Sequence
  Description of Artificial Sequence: Synthetic oligonucleotide
actgaccaacaggacacggccaccatc

SEQ ID NO: 80000 - DNA, 27 bp, Artificial Sequence
  Description of Artificial Sequence: Synthetic oligonucleotide
ctgaccaacaggacacggccaccatct

SEQ ID NO: 80001 - DNA, 27 bp, Artificial Sequence
  Description of Artificial Sequence: Synthetic oligonucleotide
tgaccaacaggacacggccaccatctg

SEQ ID NO: 80002 - DNA, 27 bp, Artificial Sequence
  Description of Artificial Sequence: Synthetic oligonucleotide
gaccaacaggacacggccaccatctgt

SEQ ID NO: 80003 - DNA, 27 bp, Artificial Sequence
  Description of Artificial Sequence: Synthetic oligonucleotide
accaacaggacacggccaccatctgtg

SEQ ID NO: 80004 - DNA, 26 bp, Artificial Sequence
  Description of Artificial Sequence: Synthetic oligonucleotide
ccaacaggacacggccaccatctgtg

SEQ ID NO: 80005 - DNA, 27 bp, Artificial Sequence
  Description of Artificial Sequence: Synthetic oligonucleotide
caacaggacacggccaccatctgtgca

SEQ ID NO: 80006 - DNA, 28 bp, Artificial Sequence
  Description of Artificial Sequence: Synthetic oligonucleotide
aacaggacacggccaccatctgtgcaag

SEQ ID NO: 80007 - DNA, 27 bp, Artificial Sequence
  Description of Artificial Sequence: Synthetic oligonucleotide
acaggacacggccaccatctgtgcaag

SEQ ID NO: 80008 - DNA, 27 bp, Artificial Sequence
  Description of Artificial Sequence: Synthetic oligonucleotide
caggacacggccaccatctgtgcaagt

SEQ ID NO: 80009 - DNA, 28 bp, Artificial Sequence
  Description of Artificial Sequence: Synthetic oligonucleotide
aggacacggccaccatctgtgcaagtag

SEQ ID NO: 80010 - DNA, 27 bp, Artificial Sequence
  Description of Artificial Sequence: Synthetic oligonucleotide
ggacacggccaccatctgtgcaagtag

SEQ ID NO: 80011 - DNA, 27 bp, Artificial Sequence
  Description of Artificial Sequence: Synthetic oligonucleotide
gacacggccaccatctgtgcaagtagc

SEQ ID NO: 80012 - DNA, 27 bp, Artificial Sequence
  Description of Artificial Sequence: Synthetic oligonucleotide
acacggccaccatctgtgcaagtagcc

SEQ ID NO: 80013 - DNA, 27 bp, Artificial Sequence
  Description of Artificial Sequence: Synthetic oligonucleotide
cacggccaccatctgtgcaagtagcca

SEQ ID NO: 80014 - DNA, 30 bp, Artificial Sequence
  Description of Artificial Sequence: Synthetic oligonucleotide
acggccaccatctgtgcaagtagccaaaac

SEQ ID NO: 80015 - DNA, 29 bp, Artificial Sequence
  Description of Artificial Sequence: Synthetic oligonucleotide
cggccaccatctgtgcaagtagccaaaac

SEQ ID NO: 80016 - DNA, 29 bp, Artificial Sequence
  Description of Artificial Sequence: Synthetic oligonucleotide
ggccaccatctgtgcaagtagccaaaacc

SEQ ID NO: 80017 - DNA, 30 bp, Artificial Sequence
  Description of Artificial Sequence: Synthetic oligonucleotide
gccaccatctgtgcaagtagccaaaaccac

SEQ ID NO: 80018 - DNA, 31 bp, Artificial Sequence
  Description of Artificial Sequence: Synthetic oligonucleotide
ccaccatctgtgcaagtagccaaaaccactc

SEQ ID NO: 80019 - DNA, 31 bp, Artificial Sequence
  Description of Artificial Sequence: Synthetic oligonucleotide
caccatctgtgcaagtagccaaaaccactcc

SEQ ID NO: 80020 - DNA, 37 bp, Artificial Sequence
  Description of Artificial Sequence: Synthetic oligonucleotide
accatctgtgcaagtagccaaaaccactccttttaac

SEQ ID NO: 80021 - DNA, 36 bp, Artificial Sequence
  Description of Artificial Sequence: Synthetic oligonucleotide
ccatctgtgcaagtagccaaaaccactccttttaac

SEQ ID NO: 80022 - DNA, 37 bp, Artificial Sequence
  Description of Artificial Sequence: Synthetic oligonucleotide
catctgtgcaagtagccaaaaccactccttttaacac

SEQ ID NO: 80023 - DNA, 37 bp, Artificial Sequence
  Description of Artificial Sequence: Synthetic oligonucleotide
atctgtgcaagtagccaaaaccactccttttaacacg

SEQ ID NO: 80024 - DNA, 36 bp, Artificial Sequence
  Description of Artificial Sequence: Synthetic oligonucleotide
tctgtgcaagtagccaaaaccactccttttaacacg

SEQ ID NO: 80025 - DNA, 35 bp, Artificial Sequence
  Description of Artificial Sequence: Synthetic oligonucleotide
ctgtgcaagtagccaaaaccactccttttaacacg

SEQ ID NO: 80026 - DNA, 36 bp, Artificial Sequence
  Description of Artificial Sequence: Synthetic oligonucleotide
tgtgcaagtagccaaaaccactccttttaacacgag

SEQ ID NO: 80027 - DNA, 35 bp, Artificial Sequence
  Description of Artificial Sequence: Synthetic oligonucleotide
gtgcaagtagccaaaaccactccttttaacacgag

SEQ ID NO: 80028 - DNA, 35 bp, Artificial Sequence
  Description of Artificial Sequence: Synthetic oligonucleotide
tgcaagtagccaaaaccactccttttaacacgagg

SEQ ID NO: 80029 - DNA, 34 bp, Artificial Sequence
  Description of Artificial Sequence: Synthetic oligonucleotide
gcaagtagccaaaaccactccttttaacacgagg

SEQ ID NO: 80030 - DNA, 34 bp, Artificial Sequence
  Description of Artificial Sequence: Synthetic oligonucleotide
caagtagccaaaaccactccttttaacacgaggg

SEQ ID NO: 80031 - DNA, 35 bp, Artificial Sequence
  Description of Artificial Sequence: Synthetic oligonucleotide
aagtagccaaaaccactccttttaacacgagggag

SEQ ID NO: 80032 - DNA, 34 bp, Artificial Sequence
  Description of Artificial Sequence: Synthetic oligonucleotide
agtagccaaaaccactccttttaacacgagggag

SEQ ID NO: 80033 - DNA, 33 bp, Artificial Sequence
  Description of Artificial Sequence: Synthetic oligonucleotide
gtagccaaaaccactccttttaacacgagggag

SEQ ID NO: 80034 - DNA, 33 bp, Artificial Sequence
  Description of Artificial Sequence: Synthetic oligonucleotide
tagccaaaaccactccttttaacacgagggagc

SEQ ID NO: 80035 - DNA, 32 bp, Artificial Sequence
  Description of Artificial Sequence: Synthetic oligonucleotide
agccaaaaccactccttttaacacgagggagc

SEQ ID NO: 80036 - DNA, 31 bp, Artificial Sequence
  Description of Artificial Sequence: Synthetic oligonucleotide
gccaaaaccactccttttaacacgagggagc

SEQ ID NO: 80037 - DNA, 31 bp, Artificial Sequence
  Description of Artificial Sequence: Synthetic oligonucleotide
ccaaaaccactccttttaacacgagggagcc

SEQ ID NO: 80038 - DNA, 32 bp, Artificial Sequence
  Description of Artificial Sequence: Synthetic oligonucleotide
caaaaccactccttttaacacgagggagcctg

SEQ ID NO: 80039 - DNA, 33 bp, Artificial Sequence
  Description of Artificial Sequence: Synthetic oligonucleotide
aaaaccactccttttaacacgagggagcctgtg

SEQ ID NO: 80040 - DNA, 32 bp, Artificial Sequence
  Description of Artificial Sequence: Synthetic oligonucleotide
aaaccactccttttaacacgagggagcctgtg

SEQ ID NO: 80041 - DNA, 31 bp, Artificial Sequence
  Description of Artificial Sequence: Synthetic oligonucleotide
aaccactccttttaacacgagggagcctgtg

SEQ ID NO: 80042 - DNA, 30 bp, Artificial Sequence
  Description of Artificial Sequence: Synthetic oligonucleotide
accactccttttaacacgagggagcctgtg

SEQ ID NO: 80043 - DNA, 29 bp, Artificial Sequence
  Description of Artificial Sequence: Synthetic oligonucleotide
ccactccttttaacacgagggagcctgtg

SEQ ID NO: 80044 - DNA, 31 bp, Artificial Sequence
  Description of Artificial Sequence: Synthetic oligonucleotide
cactccttttaacacgagggagcctgtgatg

SEQ ID NO: 80045 - DNA, 31 bp, Artificial Sequence
  Description of Artificial Sequence: Synthetic oligonucleotide
actccttttaacacgagggagcctgtgatgc

SEQ ID NO: 80046 - DNA, 30 bp, Artificial Sequence
  Description of Artificial Sequence: Synthetic oligonucleotide
ctccttttaacacgagggagcctgtgatgc

SEQ ID NO: 80047 - DNA, 31 bp, Artificial Sequence
  Description of Artificial Sequence: Synthetic oligonucleotide
tccttttaacacgagggagcctgtgatgctg

SEQ ID NO: 80048 - DNA, 30 bp, Artificial Sequence
  Description of Artificial Sequence: Synthetic oligonucleotide
ccttttaacacgagggagcctgtgatgctg

SEQ ID NO: 80049 - DNA, 30 bp, Artificial Sequence
  Description of Artificial Sequence: Synthetic oligonucleotide
cttttaacacgagggagcctgtgatgctgg

SEQ ID NO: 80050 - DNA, 30 bp, Artificial Sequence
  Description of Artificial Sequence: Synthetic oligonucleotide
ttttaacacgagggagcctgtgatgctggc

SEQ ID NO: 80051 - DNA, 29 bp, Artificial Sequence
  Description of Artificial Sequence: Synthetic oligonucleotide
tttaacacgagggagcctgtgatgctggc

SEQ ID NO: 80052 - DNA, 28 bp, Artificial Sequence
  Description of Artificial Sequence: Synthetic oligonucleotide
ttaacacgagggagcctgtgatgctggc

SEQ ID NO: 80053 - DNA, 27 bp, Artificial Sequence
  Description of Artificial Sequence: Synthetic oligonucleotide
taacacgagggagcctgtgatgctggc

SEQ ID NO: 80054 - DNA, 26 bp, Artificial Sequence
  Description of Artificial Sequence: Synthetic oligonucleotide
aacacgagggagcctgtgatgctggc

SEQ ID NO: 80055 - DNA, 25 bp, Artificial Sequence
  Description of Artificial Sequence: Synthetic oligonucleotide
acacgagggagcctgtgatgctggc

SEQ ID NO: 80056 - DNA, 24 bp, Artificial Sequence
  Description of Artificial Sequence: Synthetic oligonucleotide
cacgagggagcctgtgatgctggc

SEQ ID NO: 80057 - DNA, 25 bp, Artificial Sequence
  Description of Artificial Sequence: Synthetic oligonucleotide
acgagggagcctgtgatgctggcct

SEQ ID NO: 80058 - DNA, 24 bp, Artificial Sequence
  Description of Artificial Sequence: Synthetic oligonucleotide
cgagggagcctgtgatgctggcct

SEQ ID NO: 80059 - DNA, 24 bp, Artificial Sequence
  Description of Artificial Sequence: Synthetic oligonucleotide
gagggagcctgtgatgctggcctg

SEQ ID NO: 80060 - DNA, 27 bp, Artificial Sequence
  Description of Artificial Sequence: Synthetic oligonucleotide
agggagcctgtgatgctggcctgctat

SEQ ID NO: 80061 - DNA, 26 bp, Artificial Sequence
  Description of Artificial Sequence: Synthetic oligonucleotide
gggagcctgtgatgctggcctgctat

SEQ ID NO: 80062 - DNA, 27 bp, Artificial Sequence
  Description of Artificial Sequence: Synthetic oligonucleotide
ggagcctgtgatgctggcctgctatgt

SEQ ID NO: 80063 - DNA, 27 bp, Artificial Sequence
  Description of Artificial Sequence: Synthetic oligonucleotide
gagcctgtgatgctggcctgctatgtg

SEQ ID NO: 80064 - DNA, 28 bp, Artificial Sequence
  Description of Artificial Sequence: Synthetic oligonucleotide
agcctgtgatgctggcctgctatgtgtg

SEQ ID NO: 80065 - DNA, 27 bp, Artificial Sequence
  Description of Artificial Sequence: Synthetic oligonucleotide
gcctgtgatgctggcctgctatgtgtg

SEQ ID NO: 80066 - DNA, 27 bp, Artificial Sequence
  Description of Artificial Sequence: Synthetic oligonucleotide
cctgtgatgctggcctgctatgtgtgg

SEQ ID NO: 80067 - DNA, 27 bp, Artificial Sequence
  Description of Artificial Sequence: Synthetic oligonucleotide
ctgtgatgctggcctgctatgtgtggg

SEQ ID NO: 80068 - DNA, 27 bp, Artificial Sequence
  Description of Artificial Sequence: Synthetic oligonucleotide
tgtgatgctggcctgctatgtgtgggg

SEQ ID NO: 80069 - DNA, 26 bp, Artificial Sequence
  Description of Artificial Sequence: Synthetic oligonucleotide
gtgatgctggcctgctatgtgtgggg

SEQ ID NO: 80070 - DNA, 27 bp, Artificial Sequence
  Description of Artificial Sequence: Synthetic oligonucleotide
tgatgctggcctgctatgtgtggggct

SEQ ID NO: 80071 - DNA, 27 bp, Artificial Sequence
  Description of Artificial Sequence: Synthetic oligonucleotide
gatgctggcctgctatgtgtggggctt

SEQ ID NO: 80072 - DNA, 27 bp, Artificial Sequence
  Description of Artificial Sequence: Synthetic oligonucleotide
atgctggcctgctatgtgtggggcttc

SEQ ID NO: 80073 - DNA, 27 bp, Artificial Sequence
  Description of Artificial Sequence: Synthetic oligonucleotide
tgctggcctgctatgtgtggggcttct

SEQ ID NO: 80074 - DNA, 27 bp, Artificial Sequence
  Description of Artificial Sequence: Synthetic oligonucleotide
gctggcctgctatgtgtggggcttcta

SEQ ID NO: 80075 - DNA, 28 bp, Artificial Sequence
  Description of Artificial Sequence: Synthetic oligonucleotide
ctggcctgctatgtgtggggcttctatc

SEQ ID NO: 80076 - DNA, 28 bp, Artificial Sequence
  Description of Artificial Sequence: Synthetic oligonucleotide
tggcctgctatgtgtggggcttctatcc

SEQ ID NO: 80077 - DNA, 27 bp, Artificial Sequence
  Description of Artificial Sequence: Synthetic oligonucleotide
ggcctgctatgtgtggggcttctatcc

SEQ ID NO: 80078 - DNA, 28 bp, Artificial Sequence
  Description of Artificial Sequence: Synthetic oligonucleotide
gcctgctatgtgtggggcttctatccag

SEQ ID NO: 80079 - DNA, 28 bp, Artificial Sequence
  Description of Artificial Sequence: Synthetic oligonucleotide
cctgctatgtgtggggcttctatccagc

SEQ ID NO: 80080 - DNA, 29 bp, Artificial Sequence
  Description of Artificial Sequence: Synthetic oligonucleotide
ctgctatgtgtggggcttctatccagcag

SEQ ID NO: 80081 - DNA, 31 bp, Artificial Sequence
  Description of Artificial Sequence: Synthetic oligonucleotide
tgctatgtgtggggcttctatccagcagaag

SEQ ID NO: 80082 - DNA, 30 bp, Artificial Sequence
  Description of Artificial Sequence: Synthetic oligonucleotide
gctatgtgtggggcttctatccagcagaag

SEQ ID NO: 80083 - DNA, 31 bp, Artificial Sequence
  Description of Artificial Sequence: Synthetic oligonucleotide
ctatgtgtggggcttctatccagcagaagtg

SEQ ID NO: 80084 - DNA, 32 bp, Artificial Sequence
  Description of Artificial Sequence: Synthetic oligonucleotide
tatgtgtggggcttctatccagcagaagtgac

SEQ ID NO: 80085 - DNA, 31 bp, Artificial Sequence
  Description of Artificial Sequence: Synthetic oligonucleotide
atgtgtggggcttctatccagcagaagtgac

SEQ ID NO: 80086 - DNA, 30 bp, Artificial Sequence
  Description of Artificial Sequence: Synthetic oligonucleotide
tgtgtggggcttctatccagcagaagtgac

SEQ ID NO: 80087 - DNA, 29 bp, Artificial Sequence
  Description of Artificial Sequence: Synthetic oligonucleotide
gtgtggggcttctatccagcagaagtgac

SEQ ID NO: 80088 - DNA, 32 bp, Artificial Sequence
  Description of Artificial Sequence: Synthetic oligonucleotide
tgtggggcttctatccagcagaagtgactatc

SEQ ID NO: 80089 - DNA, 31 bp, Artificial Sequence
  Description of Artificial Sequence: Synthetic oligonucleotide
gtggggcttctatccagcagaagtgactatc

SEQ ID NO: 80090 - DNA, 32 bp, Artificial Sequence
  Description of Artificial Sequence: Synthetic oligonucleotide
tggggcttctatccagcagaagtgactatcac

SEQ ID NO: 80091 - DNA, 31 bp, Artificial Sequence
  Description of Artificial Sequence: Synthetic oligonucleotide
ggggcttctatccagcagaagtgactatcac

SEQ ID NO: 80092 - DNA, 31 bp, Artificial Sequence
  Description of Artificial Sequence: Synthetic oligonucleotide
gggcttctatccagcagaagtgactatcacg

SEQ ID NO: 80093 - DNA, 32 bp, Artificial Sequence
  Description of Artificial Sequence: Synthetic oligonucleotide
ggcttctatccagcagaagtgactatcacgtg

SEQ ID NO: 80094 - DNA, 32 bp, Artificial Sequence
  Description of Artificial Sequence: Synthetic oligonucleotide
gcttctatccagcagaagtgactatcacgtgg

SEQ ID NO: 80095 - DNA, 33 bp, Artificial Sequence
  Description of Artificial Sequence: Synthetic oligonucleotide
cttctatccagcagaagtgactatcacgtggag

SEQ ID NO: 80096 - DNA, 33 bp, Artificial Sequence
  Description of Artificial Sequence: Synthetic oligonucleotide
ttctatccagcagaagtgactatcacgtggagg

SEQ ID NO: 80097 - DNA, 32 bp, Artificial Sequence
  Description of Artificial Sequence: Synthetic oligonucleotide
tctatccagcagaagtgactatcacgtggagg

SEQ ID NO: 80098 - DNA, 31 bp, Artificial Sequence
  Description of Artificial Sequence: Synthetic oligonucleotide
ctatccagcagaagtgactatcacgtggagg

SEQ ID NO: 80099 - DNA, 33 bp, Artificial Sequence
  Description of Artificial Sequence: Synthetic oligonucleotide
tatccagcagaagtgactatcacgtggaggaag

SEQ ID NO: 80100 - DNA, 32 bp, Artificial Sequence
  Description of Artificial Sequence: Synthetic oligonucleotide
atccagcagaagtgactatcacgtggaggaag

SEQ ID NO: 80101 - DNA, 31 bp, Artificial Sequence
  Description of Artificial Sequence: Synthetic oligonucleotide
tccagcagaagtgactatcacgtggaggaag

SEQ ID NO: 80102 - DNA, 30 bp, Artificial Sequence
  Description of Artificial Sequence: Synthetic oligonucleotide
ccagcagaagtgactatcacgtggaggaag

SEQ ID NO: 80103 - DNA, 32 bp, Artificial Sequence
  Description of Artificial Sequence: Synthetic oligonucleotide
cagcagaagtgactatcacgtggaggaagaac

SEQ ID NO: 80104 - DNA, 32 bp, Artificial Sequence
  Description of Artificial Sequence: Synthetic oligonucleotide
agcagaagtgactatcacgtggaggaagaacg

SEQ ID NO: 80105 - DNA, 31 bp, Artificial Sequence
  Description of Artificial Sequence: Synthetic oligonucleotide
gcagaagtgactatcacgtggaggaagaacg

SEQ ID NO: 80106 - DNA, 31 bp, Artificial Sequence
  Description of Artificial Sequence: Synthetic oligonucleotide
cagaagtgactatcacgtggaggaagaacgg

SEQ ID NO: 80107 - DNA, 31 bp, Artificial Sequence
  Description of Artificial Sequence: Synthetic oligonucleotide
agaagtgactatcacgtggaggaagaacggg

SEQ ID NO: 80108 - DNA, 30 bp, Artificial Sequence
  Description of Artificial Sequence: Synthetic oligonucleotide
gaagtgactatcacgtggaggaagaacggg

SEQ ID NO: 80109 - DNA, 32 bp, Artificial Sequence
  Description of Artificial Sequence: Synthetic oligonucleotide
aagtgactatcacgtggaggaagaacgggaag

SEQ ID NO: 80110 - DNA, 31 bp, Artificial Sequence
  Description of Artificial Sequence: Synthetic oligonucleotide
agtgactatcacgtggaggaagaacgggaag

SEQ ID NO: 80111 - DNA, 30 bp, Artificial Sequence
  Description of Artificial Sequence: Synthetic oligonucleotide
gtgactatcacgtggaggaagaacgggaag

SEQ ID NO: 80112 - DNA, 30 bp, Artificial Sequence
  Description of Artificial Sequence: Synthetic oligonucleotide
tgactatcacgtggaggaagaacgggaagc

SEQ ID NO: 80113 - DNA, 29 bp, Artificial Sequence
  Description of Artificial Sequence: Synthetic oligonucleotide
gactatcacgtggaggaagaacgggaagc

SEQ ID NO: 80114 - DNA, 31 bp, Artificial Sequence
  Description of Artificial Sequence: Synthetic oligonucleotide
actatcacgtggaggaagaacgggaagcttg

SEQ ID NO: 80115 - DNA, 30 bp, Artificial Sequence
  Description of Artificial Sequence: Synthetic oligonucleotide
ctatcacgtggaggaagaacgggaagcttg

SEQ ID NO: 80116 - DNA, 31 bp, Artificial Sequence
  Description of Artificial Sequence: Synthetic oligonucleotide
tatcacgtggaggaagaacgggaagcttgtc

SEQ ID NO: 80117 - DNA, 30 bp, Artificial Sequence
  Description of Artificial Sequence: Synthetic oligonucleotide
atcacgtggaggaagaacgggaagcttgtc

SEQ ID NO: 80118 - DNA, 29 bp, Artificial Sequence
  Description of Artificial Sequence: Synthetic oligonucleotide
tcacgtggaggaagaacgggaagcttgtc

SEQ ID NO: 80119 - DNA, 28 bp, Artificial Sequence
  Description of Artificial Sequence: Synthetic oligonucleotide
cacgtggaggaagaacgggaagcttgtc

SEQ ID NO: 80120 - DNA, 30 bp, Artificial Sequence
  Description of Artificial Sequence: Synthetic oligonucleotide
acgtggaggaagaacgggaagcttgtcatg

SEQ ID NO: 80121 - DNA, 29 bp, Artificial Sequence
  Description of Artificial Sequence: Synthetic oligonucleotide
cgtggaggaagaacgggaagcttgtcatg

SEQ ID NO: 80122 - DNA, 29 bp, Artificial Sequence
  Description of Artificial Sequence: Synthetic oligonucleotide
gtggaggaagaacgggaagcttgtcatgc

SEQ ID NO: 80123 - DNA, 29 bp, Artificial Sequence
  Description of Artificial Sequence: Synthetic oligonucleotide
tggaggaagaacgggaagcttgtcatgcc

SEQ ID NO: 80124 - DNA, 28 bp, Artificial Sequence
  Description of Artificial Sequence: Synthetic oligonucleotide
ggaggaagaacgggaagcttgtcatgcc

SEQ ID NO: 80125 - DNA, 29 bp, Artificial Sequence
  Description of Artificial Sequence: Synthetic oligonucleotide
gaggaagaacgggaagcttgtcatgcctc

SEQ ID NO: 80126 - DNA, 30 bp, Artificial Sequence
  Description of Artificial Sequence: Synthetic oligonucleotide
aggaagaacgggaagcttgtcatgcctcac

SEQ ID NO: 80127 - DNA, 29 bp, Artificial Sequence
  Description of Artificial Sequence: Synthetic oligonucleotide
ggaagaacgggaagcttgtcatgcctcac

SEQ ID NO: 80128 - DNA, 30 bp, Artificial Sequence
  Description of Artificial Sequence: Synthetic oligonucleotide
gaagaacgggaagcttgtcatgcctcacag

SEQ ID NO: 80129 - DNA, 30 bp, Artificial Sequence
  Description of Artificial Sequence: Synthetic oligonucleotide
aagaacgggaagcttgtcatgcctcacagc

SEQ ID NO: 80130 - DNA, 29 bp, Artificial Sequence
  Description of Artificial Sequence: Synthetic oligonucleotide
agaacgggaagcttgtcatgcctcacagc

SEQ ID NO: 80131 - DNA, 28 bp, Artificial Sequence
  Description of Artificial Sequence: Synthetic oligonucleotide
gaacgggaagcttgtcatgcctcacagc

SEQ ID NO: 80132 - DNA, 29 bp, Artificial Sequence
  Description of Artificial Sequence: Synthetic oligonucleotide
aacgggaagcttgtcatgcctcacagcag

SEQ ID NO: 80133 - DNA, 28 bp, Artificial Sequence
  Description of Artificial Sequence: Synthetic oligonucleotide
acgggaagcttgtcatgcctcacagcag

SEQ ID NO: 80134 - DNA, 27 bp, Artificial Sequence
  Description of Artificial Sequence: Synthetic oligonucleotide
cgggaagcttgtcatgcctcacagcag

SEQ ID NO: 80135 - DNA, 28 bp, Artificial Sequence
  Description of Artificial Sequence: Synthetic oligonucleotide
gggaagcttgtcatgcctcacagcagtg

SEQ ID NO: 80136 - DNA, 28 bp, Artificial Sequence
  Description of Artificial Sequence: Synthetic oligonucleotide
ggaagcttgtcatgcctcacagcagtgc

SEQ ID NO: 80137 - DNA, 28 bp, Artificial Sequence
  Description of Artificial Sequence: Synthetic oligonucleotide
gaagcttgtcatgcctcacagcagtgcg

SEQ ID NO: 80138 - DNA, 28 bp, Artificial Sequence
  Description of Artificial Sequence: Synthetic oligonucleotide
aagcttgtcatgcctcacagcagtgcgc

SEQ ID NO: 80139 - DNA, 27 bp, Artificial Sequence
  Description of Artificial Sequence: Synthetic oligonucleotide
agcttgtcatgcctcacagcagtgcgc

SEQ ID NO: 80140 - DNA, 27 bp, Artificial Sequence
  Description of Artificial Sequence: Synthetic oligonucleotide
gcttgtcatgcctcacagcagtgcgca

SEQ ID NO: 80141 - DNA, 27 bp, Artificial Sequence
  Description of Artificial Sequence: Synthetic oligonucleotide
cttgtcatgcctcacagcagtgcgcac

SEQ ID NO: 80142 - DNA, 29 bp, Artificial Sequence
  Description of Artificial Sequence: Synthetic oligonucleotide
ttgtcatgcctcacagcagtgcgcacaag

SEQ ID NO: 80143 - DNA, 28 bp, Artificial Sequence
  Description of Artificial Sequence: Synthetic oligonucleotide
tgtcatgcctcacagcagtgcgcacaag

SEQ ID NO: 80144 - DNA, 27 bp, Artificial Sequence
  Description of Artificial Sequence: Synthetic oligonucleotide
gtcatgcctcacagcagtgcgcacaag

SEQ ID NO: 80145 - DNA, 28 bp, Artificial Sequence
  Description of Artificial Sequence: Synthetic oligonucleotide
tcatgcctcacagcagtgcgcacaagac

SEQ ID NO: 80146 - DNA, 27 bp, Artificial Sequence
  Description of Artificial Sequence: Synthetic oligonucleotide
catgcctcacagcagtgcgcacaagac

SEQ ID NO: 80147 - DNA, 28 bp, Artificial Sequence
  Description of Artificial Sequence: Synthetic oligonucleotide
atgcctcacagcagtgcgcacaagactg

SEQ ID NO: 80148 - DNA, 27 bp, Artificial Sequence
  Description of Artificial Sequence: Synthetic oligonucleotide
tgcctcacagcagtgcgcacaagactg

SEQ ID NO: 80149 - DNA, 26 bp, Artificial Sequence
  Description of Artificial Sequence: Synthetic oligonucleotide
gcctcacagcagtgcgcacaagactg

SEQ ID NO: 80150 - DNA, 26 bp, Artificial Sequence
  Description of Artificial Sequence: Synthetic oligonucleotide
cctcacagcagtgcgcacaagactgc

SEQ ID NO: 80151 - DNA, 26 bp, Artificial Sequence
  Description of Artificial Sequence: Synthetic oligonucleotide
ctcacagcagtgcgcacaagactgcc

SEQ ID NO: 80152 - DNA, 27 bp, Artificial Sequence
  Description of Artificial Sequence: Synthetic oligonucleotide
tcacagcagtgcgcacaagactgccca

SEQ ID NO: 80153 - DNA, 26 bp, Artificial Sequence
  Description of Artificial Sequence: Synthetic oligonucleotide
cacagcagtgcgcacaagactgccca

SEQ ID NO: 80154 - DNA, 26 bp, Artificial Sequence
  Description of Artificial Sequence: Synthetic oligonucleotide
acagcagtgcgcacaagactgcccag

SEQ ID NO: 80155 - DNA, 25 bp, Artificial Sequence
  Description of Artificial Sequence: Synthetic oligonucleotide
cagcagtgcgcacaagactgcccag

SEQ ID NO: 80156 - DNA, 25 bp, Artificial Sequence
  Description of Artificial Sequence: Synthetic oligonucleotide
agcagtgcgcacaagactgcccagc

SEQ ID NO: 80157 - DNA, 24 bp, Artificial Sequence
  Description of Artificial Sequence: Synthetic oligonucleotide
gcagtgcgcacaagactgcccagc

SEQ ID NO: 80158 - DNA, 24 bp, Artificial Sequence
  Description of Artificial Sequence: Synthetic oligonucleotide
cagtgcgcacaagactgcccagcc

SEQ ID NO: 80159 - DNA, 27 bp, Artificial Sequence
  Description of Artificial Sequence: Synthetic oligonucleotide
agtgcgcacaagactgcccagcccaat

SEQ ID NO: 80160 - DNA, 26 bp, Artificial Sequence
  Description of Artificial Sequence: Synthetic oligonucleotide
gtgcgcacaagactgcccagcccaat

SEQ ID NO: 80161 - DNA, 26 bp, Artificial Sequence
  Description of Artificial Sequence: Synthetic oligonucleotide
tgcgcacaagactgcccagcccaatg

SEQ ID NO: 80162 - DNA, 25 bp, Artificial Sequence
  Description of Artificial Sequence: Synthetic oligonucleotide
gcgcacaagactgcccagcccaatg

SEQ ID NO: 80163 - DNA, 26 bp, Artificial Sequence
  Description of Artificial Sequence: Synthetic oligonucleotide
cgcacaagactgcccagcccaatgga

SEQ ID NO: 80164 - DNA, 27 bp, Artificial Sequence
  Description of Artificial Sequence: Synthetic oligonucleotide
gcacaagactgcccagcccaatggaga

SEQ ID NO: 80165 - DNA, 27 bp, Artificial Sequence
  Description of Artificial Sequence: Synthetic oligonucleotide
cacaagactgcccagcccaatggagac

SEQ ID NO: 80166 - DNA, 28 bp, Artificial Sequence
  Description of Artificial Sequence: Synthetic oligonucleotide
acaagactgcccagcccaatggagactg

SEQ ID NO: 80167 - DNA, 27 bp, Artificial Sequence
  Description of Artificial Sequence: Synthetic oligonucleotide
caagactgcccagcccaatggagactg

SEQ ID NO: 80168 - DNA, 27 bp, Artificial Sequence
  Description of Artificial Sequence: Synthetic oligonucleotide
aagactgcccagcccaatggagactgg

SEQ ID NO: 80169 - DNA, 27 bp, Artificial Sequence
  Description of Artificial Sequence: Synthetic oligonucleotide
agactgcccagcccaatggagactgga

SEQ ID NO: 80170 - DNA, 26 bp, Artificial Sequence
  Description of Artificial Sequence: Synthetic oligonucleotide
gactgcccagcccaatggagactgga

SEQ ID NO: 80171 - DNA, 27 bp, Artificial Sequence
  Description of Artificial Sequence: Synthetic oligonucleotide
actgcccagcccaatggagactggaca

SEQ ID NO: 80172 - DNA, 27 bp, Artificial Sequence
  Description of Artificial Sequence: Synthetic oligonucleotide
ctgcccagcccaatggagactggacat

SEQ ID NO: 80173 - DNA, 28 bp, Artificial Sequence
  Description of Artificial Sequence: Synthetic oligonucleotide
tgcccagcccaatggagactggacatac

SEQ ID NO: 80174 - DNA, 27 bp, Artificial Sequence
  Description of Artificial Sequence: Synthetic oligonucleotide
gcccagcccaatggagactggacatac

SEQ ID NO: 80175 - DNA, 27 bp, Artificial Sequence
  Description of Artificial Sequence: Synthetic oligonucleotide
cccagcccaatggagactggacatacc

SEQ ID NO: 80176 - DNA, 28 bp, Artificial Sequence
  Description of Artificial Sequence: Synthetic oligonucleotide
ccagcccaatggagactggacataccag

SEQ ID NO: 80177 - DNA, 29 bp, Artificial Sequence
  Description of Artificial Sequence: Synthetic oligonucleotide
cagcccaatggagactggacataccagac

SEQ ID NO: 80178 - DNA, 29 bp, Artificial Sequence
  Description of Artificial Sequence: Synthetic oligonucleotide
agcccaatggagactggacataccagacc

SEQ ID NO: 80179 - DNA, 28 bp, Artificial Sequence
  Description of Artificial Sequence: Synthetic oligonucleotide
gcccaatggagactggacataccagacc

SEQ ID NO: 80180 - DNA, 28 bp, Artificial Sequence
  Description of Artificial Sequence: Synthetic oligonucleotide
cccaatggagactggacataccagaccc

SEQ ID NO: 80181 - DNA, 29 bp, Artificial Sequence
  Description of Artificial Sequence: Synthetic oligonucleotide
ccaatggagactggacataccagaccctc

SEQ ID NO: 80182 - DNA, 30 bp, Artificial Sequence
  Description of Artificial Sequence: Synthetic oligonucleotide
caatggagactggacataccagaccctctc

SEQ ID NO: 80183 - DNA, 30 bp, Artificial Sequence
  Description of Artificial Sequence: Synthetic oligonucleotide
aatggagactggacataccagaccctctcc

SEQ ID NO: 80184 - DNA, 29 bp, Artificial Sequence
  Description of Artificial Sequence: Synthetic oligonucleotide
atggagactggacataccagaccctctcc

SEQ ID NO: 80185 - DNA, 28 bp, Artificial Sequence
  Description of Artificial Sequence: Synthetic oligonucleotide
tggagactggacataccagaccctctcc

SEQ ID NO: 80186 - DNA, 27 bp, Artificial Sequence
  Description of Artificial Sequence: Synthetic oligonucleotide
ggagactggacataccagaccctctcc

SEQ ID NO: 80187 - DNA, 27 bp, Artificial Sequence
  Description of Artificial Sequence: Synthetic oligonucleotide
gagactggacataccagaccctctccc

SEQ ID NO: 80188 - DNA, 32 bp, Artificial Sequence
  Description of Artificial Sequence: Synthetic oligonucleotide
agactggacataccagaccctctcccatttag

SEQ ID NO: 80189 - DNA, 31 bp, Artificial Sequence
  Description of Artificial Sequence: Synthetic oligonucleotide
gactggacataccagaccctctcccatttag

SEQ ID NO: 80190 - DNA, 31 bp, Artificial Sequence
  Description of Artificial Sequence: Synthetic oligonucleotide
actggacataccagaccctctcccatttagc

SEQ ID NO: 80191 - DNA, 30 bp, Artificial Sequence
  Description of Artificial Sequence: Synthetic oligonucleotide
ctggacataccagaccctctcccatttagc

SEQ ID NO: 80192 - DNA, 30 bp, Artificial Sequence
  Description of Artificial Sequence: Synthetic oligonucleotide
tggacataccagaccctctcccatttagcc

SEQ ID NO: 80193 - DNA, 29 bp, Artificial Sequence
  Description of Artificial Sequence: Synthetic oligonucleotide
ggacataccagaccctctcccatttagcc

SEQ ID NO: 80194 - DNA, 33 bp, Artificial Sequence
  Description of Artificial Sequence: Synthetic oligonucleotide
gacataccagaccctctcccatttagccttaac

SEQ ID NO: 80195 - DNA, 33 bp, Artificial Sequence
  Description of Artificial Sequence: Synthetic oligonucleotide
acataccagaccctctcccatttagccttaacc

SEQ ID NO: 80196 - DNA, 32 bp, Artificial Sequence
  Description of Artificial Sequence: Synthetic oligonucleotide
cataccagaccctctcccatttagccttaacc

SEQ ID NO: 80197 - DNA, 32 bp, Artificial Sequence
  Description of Artificial Sequence: Synthetic oligonucleotide
ataccagaccctctcccatttagccttaaccc

SEQ ID NO: 80198 - DNA, 31 bp, Artificial Sequence
  Description of Artificial Sequence: Synthetic oligonucleotide
taccagaccctctcccatttagccttaaccc

SEQ ID NO: 80199 - DNA, 30 bp, Artificial Sequence
  Description of Artificial Sequence: Synthetic oligonucleotide
accagaccctctcccatttagccttaaccc

SEQ ID NO: 80200 - DNA, 29 bp, Artificial Sequence
  Description of Artificial Sequence: Synthetic oligonucleotide
ccagaccctctcccatttagccttaaccc

SEQ ID NO: 80201 - DNA, 29 bp, Artificial Sequence
  Description of Artificial Sequence: Synthetic oligonucleotide
cagaccctctcccatttagccttaacccc

SEQ ID NO: 80202 - DNA, 29 bp, Artificial Sequence
  Description of Artificial Sequence: Synthetic oligonucleotide
agaccctctcccatttagccttaaccccc

SEQ ID NO: 80203 - DNA, 28 bp, Artificial Sequence
  Description of Artificial Sequence: Synthetic oligonucleotide
gaccctctcccatttagccttaaccccc

SEQ ID NO: 80204 - DNA, 29 bp, Artificial Sequence
  Description of Artificial Sequence: Synthetic oligonucleotide
accctctcccatttagccttaaccccctc

SEQ ID NO: 80205 - DNA, 28 bp, Artificial Sequence
  Description of Artificial Sequence: Synthetic oligonucleotide
ccctctcccatttagccttaaccccctc

SEQ ID NO: 80206 - DNA, 31 bp, Artificial Sequence
  Description of Artificial Sequence: Synthetic oligonucleotide
cctctcccatttagccttaaccccctcttac

SEQ ID NO: 80207 - DNA, 31 bp, Artificial Sequence
  Description of Artificial Sequence: Synthetic oligonucleotide
ctctcccatttagccttaaccccctcttacg

SEQ ID NO: 80208 - DNA, 31 bp, Artificial Sequence
  Description of Artificial Sequence: Synthetic oligonucleotide
tctcccatttagccttaaccccctcttacgg

SEQ ID NO: 80209 - DNA, 30 bp, Artificial Sequence
  Description of Artificial Sequence: Synthetic oligonucleotide
ctcccatttagccttaaccccctcttacgg

SEQ ID NO: 80210 - DNA, 30 bp, Artificial Sequence
  Description of Artificial Sequence: Synthetic oligonucleotide
tcccatttagccttaaccccctcttacggg

SEQ ID NO: 80211 - DNA, 29 bp, Artificial Sequence
  Description of Artificial Sequence: Synthetic oligonucleotide
cccatttagccttaaccccctcttacggg

SEQ ID NO: 80212 - DNA, 29 bp, Artificial Sequence
  Description of Artificial Sequence: Synthetic oligonucleotide
ccatttagccttaaccccctcttacgggg

SEQ ID NO: 80213 - DNA, 30 bp, Artificial Sequence
  Description of Artificial Sequence: Synthetic oligonucleotide
catttagccttaaccccctcttacggggac

SEQ ID NO: 80214 - DNA, 31 bp, Artificial Sequence
  Description of Artificial Sequence: Synthetic oligonucleotide
atttagccttaaccccctcttacggggacac

SEQ ID NO: 80215 - DNA, 30 bp, Artificial Sequence
  Description of Artificial Sequence: Synthetic oligonucleotide
tttagccttaaccccctcttacggggacac

SEQ ID NO: 80216 - DNA, 29 bp, Artificial Sequence
  Description of Artificial Sequence: Synthetic oligonucleotide
ttagccttaaccccctcttacggggacac

SEQ ID NO: 80217 - DNA, 28 bp, Artificial Sequence
  Description of Artificial Sequence: Synthetic oligonucleotide
tagccttaaccccctcttacggggacac

SEQ ID NO: 80218 - DNA, 27 bp, Artificial Sequence
  Description of Artificial Sequence: Synthetic oligonucleotide
agccttaaccccctcttacggggacac

SEQ ID NO: 80219 - DNA, 27 bp, Artificial Sequence
  Description of Artificial Sequence: Synthetic oligonucleotide
gccttaaccccctcttacggggacact

SEQ ID NO: 80220 - DNA, 29 bp, Artificial Sequence
  Description of Artificial Sequence: Synthetic oligonucleotide
ccttaaccccctcttacggggacacttac

SEQ ID NO: 80221 - DNA, 30 bp, Artificial Sequence
  Description of Artificial Sequence: Synthetic oligonucleotide
cttaaccccctcttacggggacacttacac

SEQ ID NO: 80222 - DNA, 30 bp, Artificial Sequence
  Description of Artificial Sequence: Synthetic oligonucleotide
ttaaccccctcttacggggacacttacacc

SEQ ID NO: 80223 - DNA, 29 bp, Artificial Sequence
  Description of Artificial Sequence: Synthetic oligonucleotide
taaccccctcttacggggacacttacacc

SEQ ID NO: 80224 - DNA, 28 bp, Artificial Sequence
  Description of Artificial Sequence: Synthetic oligonucleotide
aaccccctcttacggggacacttacacc

SEQ ID NO: 80225 - DNA, 27 bp, Artificial Sequence
  Description of Artificial Sequence: Synthetic oligonucleotide
accccctcttacggggacacttacacc

SEQ ID NO: 80226 - DNA, 27 bp, Artificial Sequence
  Description of Artificial Sequence: Synthetic oligonucleotide
ccccctcttacggggacacttacacct

SEQ ID NO: 80227 - DNA, 27 bp, Artificial Sequence
  Description of Artificial Sequence: Synthetic oligonucleotide
cccctcttacggggacacttacacctg

SEQ ID NO: 80228 - DNA, 28 bp, Artificial Sequence
  Description of Artificial Sequence: Synthetic oligonucleotide
ccctcttacggggacacttacacctgtg

SEQ ID NO: 80229 - DNA, 29 bp, Artificial Sequence
  Description of Artificial Sequence: Synthetic oligonucleotide
cctcttacggggacacttacacctgtgtg

SEQ ID NO: 80230 - DNA, 29 bp, Artificial Sequence
  Description of Artificial Sequence: Synthetic oligonucleotide
ctcttacggggacacttacacctgtgtgg

SEQ ID NO: 80231 - DNA, 31 bp, Artificial Sequence
  Description of Artificial Sequence: Synthetic oligonucleotide
tcttacggggacacttacacctgtgtggtag

SEQ ID NO: 80232 - DNA, 30 bp, Artificial Sequence
  Description of Artificial Sequence: Synthetic oligonucleotide
cttacggggacacttacacctgtgtggtag

SEQ ID NO: 80233 - DNA, 31 bp, Artificial Sequence
  Description of Artificial Sequence: Synthetic oligonucleotide
ttacggggacacttacacctgtgtggtagag

SEQ ID NO: 80234 - DNA, 30 bp, Artificial Sequence
  Description of Artificial Sequence: Synthetic oligonucleotide
tacggggacacttacacctgtgtggtagag

SEQ ID NO: 80235 - DNA, 29 bp, Artificial Sequence
  Description of Artificial Sequence: Synthetic oligonucleotide
acggggacacttacacctgtgtggtagag

SEQ ID NO: 80236 - DNA, 28 bp, Artificial Sequence
  Description of Artificial Sequence: Synthetic oligonucleotide
cggggacacttacacctgtgtggtagag

SEQ ID NO: 80237 - DNA, 28 bp, Artificial Sequence
  Description of Artificial Sequence: Synthetic oligonucleotide
ggggacacttacacctgtgtggtagagc

SEQ ID NO: 80238 - DNA, 29 bp, Artificial Sequence
  Description of Artificial Sequence: Synthetic oligonucleotide
gggacacttacacctgtgtggtagagcac

SEQ ID NO: 80239 - DNA, 32 bp, Artificial Sequence
  Description of Artificial Sequence: Synthetic oligonucleotide
ggacacttacacctgtgtggtagagcacattg

SEQ ID NO: 80240 - DNA, 32 bp, Artificial Sequence
  Description of Artificial Sequence: Synthetic oligonucleotide
gacacttacacctgtgtggtagagcacattgg

SEQ ID NO: 80241 - DNA, 32 bp, Artificial Sequence
  Description of Artificial Sequence: Synthetic oligonucleotide
acacttacacctgtgtggtagagcacattggg

SEQ ID NO: 80242 - DNA, 31 bp, Artificial Sequence
  Description of Artificial Sequence: Synthetic oligonucleotide
cacttacacctgtgtggtagagcacattggg

SEQ ID NO: 80243 - DNA, 31 bp, Artificial Sequence
  Description of Artificial Sequence: Synthetic oligonucleotide
acttacacctgtgtggtagagcacattgggg

SEQ ID NO: 80244 - DNA, 30 bp, Artificial Sequence
  Description of Artificial Sequence: Synthetic oligonucleotide
cttacacctgtgtggtagagcacattgggg

SEQ ID NO: 80245 - DNA, 30 bp, Artificial Sequence
  Description of Artificial Sequence: Synthetic oligonucleotide
ttacacctgtgtggtagagcacattggggc

SEQ ID NO: 80246 - DNA, 29 bp, Artificial Sequence
  Description of Artificial Sequence: Synthetic oligonucleotide
tacacctgtgtggtagagcacattggggc

SEQ ID NO: 80247 - DNA, 28 bp, Artificial Sequence
  Description of Artificial Sequence: Synthetic oligonucleotide
acacctgtgtggtagagcacattggggc

SEQ ID NO: 80248 - DNA, 27 bp, Artificial Sequence
  Description of Artificial Sequence: Synthetic oligonucleotide
cacctgtgtggtagagcacattggggc

SEQ ID NO: 80249 - DNA, 28 bp, Artificial Sequence
  Description of Artificial Sequence: Synthetic oligonucleotide
acctgtgtggtagagcacattggggctc

SEQ ID NO: 80250 - DNA, 27 bp, Artificial Sequence
  Description of Artificial Sequence: Synthetic oligonucleotide
cctgtgtggtagagcacattggggctc

SEQ ID NO: 80251 - DNA, 27 bp, Artificial Sequence
  Description of Artificial Sequence: Synthetic oligonucleotide
ctgtgtggtagagcacattggggctcc

SEQ ID NO: 80252 - DNA, 28 bp, Artificial Sequence
  Description of Artificial Sequence: Synthetic oligonucleotide
tgtgtggtagagcacattggggctcctg

SEQ ID NO: 80253 - DNA, 27 bp, Artificial Sequence
  Description of Artificial Sequence: Synthetic oligonucleotide
gtgtggtagagcacattggggctcctg

SEQ ID NO: 80254 - DNA, 28 bp, Artificial Sequence
  Description of Artificial Sequence: Synthetic oligonucleotide
tgtggtagagcacattggggctcctgag

SEQ ID NO: 80255 - DNA, 27 bp, Artificial Sequence
  Description of Artificial Sequence: Synthetic oligonucleotide
gtggtagagcacattggggctcctgag

SEQ ID NO: 80256 - DNA, 27 bp, Artificial Sequence
  Description of Artificial Sequence: Synthetic oligonucleotide
tggtagagcacattggggctcctgagc

SEQ ID NO: 80257 - DNA, 26 bp, Artificial Sequence
  Description of Artificial Sequence: Synthetic oligonucleotide
ggtagagcacattggggctcctgagc

SEQ ID NO: 80258 - DNA, 26 bp, Artificial Sequence
  Description of Artificial Sequence: Synthetic oligonucleotide
gtagagcacattggggctcctgagcc

SEQ ID NO: 80259 - DNA, 27 bp, Artificial Sequence
  Description of Artificial Sequence: Synthetic oligonucleotide
tagagcacattggggctcctgagccca

SEQ ID NO: 80260 - DNA, 27 bp, Artificial Sequence
  Description of Artificial Sequence: Synthetic oligonucleotide
agagcacattggggctcctgagcccat

SEQ ID NO: 80261 - DNA, 26 bp, Artificial Sequence
  Description of Artificial Sequence: Synthetic oligonucleotide
gagcacattggggctcctgagcccat

SEQ ID NO: 80262 - DNA, 26 bp, Artificial Sequence
  Description of Artificial Sequence: Synthetic oligonucleotide
agcacattggggctcctgagcccatc

SEQ ID NO: 80263 - DNA, 25 bp, Artificial Sequence
  Description of Artificial Sequence: Synthetic oligonucleotide
gcacattggggctcctgagcccatc

SEQ ID NO: 80264 - DNA, 27 bp, Artificial Sequence
  Description of Artificial Sequence: Synthetic oligonucleotide
cacattggggctcctgagcccatcctt

SEQ ID NO: 80265 - DNA, 27 bp, Artificial Sequence
  Description of Artificial Sequence: Synthetic oligonucleotide
acattggggctcctgagcccatccttc

SEQ ID NO: 80266 - DNA, 26 bp, Artificial Sequence
  Description of Artificial Sequence: Synthetic oligonucleotide
cattggggctcctgagcccatccttc

SEQ ID NO: 80267 - DNA, 26 bp, Artificial Sequence
  Description of Artificial Sequence: Synthetic oligonucleotide
attggggctcctgagcccatccttcg

SEQ ID NO: 80268 - DNA, 25 bp, Artificial Sequence
  Description of Artificial Sequence: Synthetic oligonucleotide
ttggggctcctgagcccatccttcg

SEQ ID NO: 80269 - DNA, 24 bp, Artificial Sequence
  Description of Artificial Sequence: Synthetic oligonucleotide
tggggctcctgagcccatccttcg

SEQ ID NO: 80270 - DNA, 23 bp, Artificial Sequence
  Description of Artificial Sequence: Synthetic oligonucleotide
ggggctcctgagcccatccttcg

SEQ ID NO: 80271 - DNA, 23 bp, Artificial Sequence
  Description of Artificial Sequence: Synthetic oligonucleotide
gggctcctgagcccatccttcgg

SEQ ID NO: 80272 - DNA, 24 bp, Artificial Sequence
  Description of Artificial Sequence: Synthetic oligonucleotide
ggctcctgagcccatccttcggga

SEQ ID NO: 80273 - DNA, 25 bp, Artificial Sequence
  Description of Artificial Sequence: Synthetic oligonucleotide
gctcctgagcccatccttcgggact

SEQ ID NO: 80274 - DNA, 25 bp, Artificial Sequence
  Description of Artificial Sequence: Synthetic oligonucleotide
ctcctgagcccatccttcgggactg

SEQ ID NO: 80275 - DNA, 26 bp, Artificial Sequence
  Description of Artificial Sequence: Synthetic oligonucleotide
tcctgagcccatccttcgggactgga

SEQ ID NO: 80276 - DNA, 25 bp, Artificial Sequence
  Description of Artificial Sequence: Synthetic oligonucleotide
cctgagcccatccttcgggactgga

SEQ ID NO: 80277 - DNA, 26 bp, Artificial Sequence
  Description of Artificial Sequence: Synthetic oligonucleotide
ctgagcccatccttcgggactggaca

SEQ ID NO: 80278 - DNA, 26 bp, Artificial Sequence
  Description of Artificial Sequence: Synthetic oligonucleotide
tgagcccatccttcgggactggacac

SEQ ID NO: 80279 - DNA, 25 bp, Artificial Sequence
  Description of Artificial Sequence: Synthetic oligonucleotide
gagcccatccttcgggactggacac

SEQ ID NO: 80280 - DNA, 26 bp, Artificial Sequence
  Description of Artificial Sequence: Synthetic oligonucleotide
agcccatccttcgggactggacacct

SEQ ID NO: 80281 - DNA, 25 bp, Artificial Sequence
  Description of Artificial Sequence: Synthetic oligonucleotide
gcccatccttcgggactggacacct

SEQ ID NO: 80282 - DNA, 25 bp, Artificial Sequence
  Description of Artificial Sequence: Synthetic oligonucleotide
cccatccttcgggactggacacctg

SEQ ID NO: 80283 - DNA, 25 bp, Artificial Sequence
  Description of Artificial Sequence: Synthetic oligonucleotide
ccatccttcgggactggacacctgg

SEQ ID NO: 80284 - DNA, 25 bp, Artificial Sequence
  Description of Artificial Sequence: Synthetic oligonucleotide
catccttcgggactggacacctggg

SEQ ID NO: 80285 - DNA, 26 bp, Artificial Sequence
  Description of Artificial Sequence: Synthetic oligonucleotide
atccttcgggactggacacctgggct

SEQ ID NO: 80286 - DNA, 25 bp, Artificial Sequence
  Description of Artificial Sequence: Synthetic oligonucleotide
tccttcgggactggacacctgggct

SEQ ID NO: 80287 - DNA, 24 bp, Artificial Sequence
  Description of Artificial Sequence: Synthetic oligonucleotide
ccttcgggactggacacctgggct

SEQ ID NO: 80288 - DNA, 25 bp, Artificial Sequence
  Description of Artificial Sequence: Synthetic oligonucleotide
cttcgggactggacacctgggctgt

SEQ ID NO: 80289 - DNA, 25 bp, Artificial Sequence
  Description of Artificial Sequence: Synthetic oligonucleotide
ttcgggactggacacctgggctgtc

SEQ ID NO: 80290 - DNA, 24 bp, Artificial Sequence
  Description of Artificial Sequence: Synthetic oligonucleotide
tcgggactggacacctgggctgtc

SEQ ID NO: 80291 - DNA, 23 bp, Artificial Sequence
  Description of Artificial Sequence: Synthetic oligonucleotide
cgggactggacacctgggctgtc

SEQ ID NO: 80292 - DNA, 23 bp, Artificial Sequence
  Description of Artificial Sequence: Synthetic oligonucleotide
gggactggacacctgggctgtcc

SEQ ID NO: 80293 - DNA, 23 bp, Artificial Sequence
  Description of Artificial Sequence: Synthetic oligonucleotide
ggactggacacctgggctgtccc

SEQ ID NO: 80294 - DNA, 23 bp, Artificial Sequence
  Description of Artificial Sequence: Synthetic oligonucleotide
gactggacacctgggctgtcccc

SEQ ID NO: 80295 - DNA, 25 bp, Artificial Sequence
  Description of Artificial Sequence: Synthetic oligonucleotide
actggacacctgggctgtcccccat

SEQ ID NO: 80296 - DNA, 24 bp, Artificial Sequence
  Description of Artificial Sequence: Synthetic oligonucleotide
ctggacacctgggctgtcccccat

SEQ ID NO: 80297 - DNA, 24 bp, Artificial Sequence
  Description of Artificial Sequence: Synthetic oligonucleotide
tggacacctgggctgtcccccatg

SEQ ID NO: 80298 - DNA, 23 bp, Artificial Sequence
  Description of Artificial Sequence: Synthetic oligonucleotide
ggacacctgggctgtcccccatg

SEQ ID NO: 80299 - DNA, 24 bp, Artificial Sequence
  Description of Artificial Sequence: Synthetic oligonucleotide
gacacctgggctgtcccccatgca

SEQ ID NO: 80300 - DNA, 25 bp, Artificial Sequence
  Description of Artificial Sequence: Synthetic oligonucleotide
acacctgggctgtcccccatgcaga

SEQ ID NO: 80301 - DNA, 24 bp, Artificial Sequence
  Description of Artificial Sequence: Synthetic oligonucleotide
cacctgggctgtcccccatgcaga

SEQ ID NO: 80302 - DNA, 24 bp, Artificial Sequence
  Description of Artificial Sequence: Synthetic oligonucleotide
acctgggctgtcccccatgcagac

SEQ ID NO: 80303 - DNA, 23 bp, Artificial Sequence
  Description of Artificial Sequence: Synthetic oligonucleotide
cctgggctgtcccccatgcagac

SEQ ID NO: 80304 - DNA, 23 bp, Artificial Sequence
  Description of Artificial Sequence: Synthetic oligonucleotide
ctgggctgtcccccatgcagacc

SEQ ID NO: 80305 - DNA, 24 bp, Artificial Sequence
  Description of Artificial Sequence: Synthetic oligonucleotide
tgggctgtcccccatgcagaccct

SEQ ID NO: 80306 - DNA, 23 bp, Artificial Sequence
  Description of Artificial Sequence: Synthetic oligonucleotide
gggctgtcccccatgcagaccct

SEQ ID NO: 80307 - DNA, 25 bp, Artificial Sequence
  Description of Artificial Sequence: Synthetic oligonucleotide
ggctgtcccccatgcagaccctgaa

SEQ ID NO: 80308 - DNA, 25 bp, Artificial Sequence
  Description of Artificial Sequence: Synthetic oligonucleotide
gctgtcccccatgcagaccctgaag

SEQ ID NO: 80309 - DNA, 27 bp, Artificial Sequence
  Description of Artificial Sequence: Synthetic oligonucleotide
ctgtcccccatgcagaccctgaaggtt

SEQ ID NO: 80310 - DNA, 28 bp, Artificial Sequence
  Description of Artificial Sequence: Synthetic oligonucleotide
tgtcccccatgcagaccctgaaggtttc

SEQ ID NO: 80311 - DNA, 27 bp, Artificial Sequence
  Description of Artificial Sequence: Synthetic oligonucleotide
gtcccccatgcagaccctgaaggtttc

SEQ ID NO: 80312 - DNA, 28 bp, Artificial Sequence
  Description of Artificial Sequence: Synthetic oligonucleotide
tcccccatgcagaccctgaaggtttctg

SEQ ID NO: 80313 - DNA, 27 bp, Artificial Sequence
  Description of Artificial Sequence: Synthetic oligonucleotide
cccccatgcagaccctgaaggtttctg

SEQ ID NO: 80314 - DNA, 28 bp, Artificial Sequence
  Description of Artificial Sequence: Synthetic oligonucleotide
ccccatgcagaccctgaaggtttctgtg

SEQ ID NO: 80315 - DNA, 29 bp, Artificial Sequence
  Description of Artificial Sequence: Synthetic oligonucleotide
cccatgcagaccctgaaggtttctgtgtc

SEQ ID NO: 80316 - DNA, 30 bp, Artificial Sequence
  Description of Artificial Sequence: Synthetic oligonucleotide
ccatgcagaccctgaaggtttctgtgtctg

SEQ ID NO: 80317 - DNA, 30 bp, Artificial Sequence
  Description of Artificial Sequence: Synthetic oligonucleotide
catgcagaccctgaaggtttctgtgtctgc

SEQ ID NO: 80318 - DNA, 31 bp, Artificial Sequence
  Description of Artificial Sequence: Synthetic oligonucleotide
atgcagaccctgaaggtttctgtgtctgcag

SEQ ID NO: 80319 - DNA, 30 bp, Artificial Sequence
  Description of Artificial Sequence: Synthetic oligonucleotide
tgcagaccctgaaggtttctgtgtctgcag

SEQ ID NO: 80320 - DNA, 29 bp, Artificial Sequence
  Description of Artificial Sequence: Synthetic oligonucleotide
gcagaccctgaaggtttctgtgtctgcag

SEQ ID NO: 80321 - DNA, 30 bp, Artificial Sequence
  Description of Artificial Sequence: Synthetic oligonucleotide
cagaccctgaaggtttctgtgtctgcagtg

SEQ ID NO: 80322 - DNA, 31 bp, Artificial Sequence
  Description of Artificial Sequence: Synthetic oligonucleotide
agaccctgaaggtttctgtgtctgcagtgac

SEQ ID NO: 80323 - DNA, 30 bp, Artificial Sequence
  Description of Artificial Sequence: Synthetic oligonucleotide
gaccctgaaggtttctgtgtctgcagtgac

SEQ ID NO: 80324 - DNA, 31 bp, Artificial Sequence
  Description of Artificial Sequence: Synthetic oligonucleotide
accctgaaggtttctgtgtctgcagtgactc

SEQ ID NO: 80325 - DNA, 30 bp, Artificial Sequence
  Description of Artificial Sequence: Synthetic oligonucleotide
ccctgaaggtttctgtgtctgcagtgactc

SEQ ID NO: 80326 - DNA, 31 bp, Artificial Sequence
  Description of Artificial Sequence: Synthetic oligonucleotide
cctgaaggtttctgtgtctgcagtgactctg

SEQ ID NO: 80327 - DNA, 31 bp, Artificial Sequence
  Description of Artificial Sequence: Synthetic oligonucleotide
ctgaaggtttctgtgtctgcagtgactctgg

SEQ ID NO: 80328 - DNA, 31 bp, Artificial Sequence
  Description of Artificial Sequence: Synthetic oligonucleotide
tgaaggtttctgtgtctgcagtgactctggg

SEQ ID NO: 80329 - DNA, 30 bp, Artificial Sequence
  Description of Artificial Sequence: Synthetic oligonucleotide
gaaggtttctgtgtctgcagtgactctggg

SEQ ID NO: 80330 - DNA, 30 bp, Artificial Sequence
  Description of Artificial Sequence: Synthetic oligonucleotide
aaggtttctgtgtctgcagtgactctgggc

SEQ ID NO: 80331 - DNA, 29 bp, Artificial Sequence
  Description of Artificial Sequence: Synthetic oligonucleotide
aggtttctgtgtctgcagtgactctgggc

SEQ ID NO: 80332 - DNA, 28 bp, Artificial Sequence
  Description of Artificial Sequence: Synthetic oligonucleotide
ggtttctgtgtctgcagtgactctgggc

SEQ ID NO: 80333 - DNA, 28 bp, Artificial Sequence
  Description of Artificial Sequence: Synthetic oligonucleotide
gtttctgtgtctgcagtgactctgggcc

SEQ ID NO: 80334 - DNA, 29 bp, Artificial Sequence
  Description of Artificial Sequence: Synthetic oligonucleotide
tttctgtgtctgcagtgactctgggcctg

SEQ ID NO: 80335 - DNA, 28 bp, Artificial Sequence
  Description of Artificial Sequence: Synthetic oligonucleotide
ttctgtgtctgcagtgactctgggcctg

SEQ ID NO: 80336 - DNA, 27 bp, Artificial Sequence
  Description of Artificial Sequence: Synthetic oligonucleotide
tctgtgtctgcagtgactctgggcctg

SEQ ID NO: 80337 - DNA, 26 bp, Artificial Sequence
  Description of Artificial Sequence: Synthetic oligonucleotide
ctgtgtctgcagtgactctgggcctg

SEQ ID NO: 80338 - DNA, 26 bp, Artificial Sequence
  Description of Artificial Sequence: Synthetic oligonucleotide
tgtgtctgcagtgactctgggcctgg

SEQ ID NO: 80339 - DNA, 25 bp, Artificial Sequence
  Description of Artificial Sequence: Synthetic oligonucleotide
gtgtctgcagtgactctgggcctgg

SEQ ID NO: 80340 - DNA, 25 bp, Artificial Sequence
  Description of Artificial Sequence: Synthetic oligonucleotide
tgtctgcagtgactctgggcctggg

SEQ ID NO: 80341 - DNA, 24 bp, Artificial Sequence
  Description of Artificial Sequence: Synthetic oligonucleotide
gtctgcagtgactctgggcctggg

SEQ ID NO: 80342 - DNA, 24 bp, Artificial Sequence
  Description of Artificial Sequence: Synthetic oligonucleotide
tctgcagtgactctgggcctgggc

SEQ ID NO: 80343 - DNA, 23 bp, Artificial Sequence
  Description of Artificial Sequence: Synthetic oligonucleotide
ctgcagtgactctgggcctgggc

SEQ ID NO: 80344 - DNA, 24 bp, Artificial Sequence
  Description of Artificial Sequence: Synthetic oligonucleotide
tgcagtgactctgggcctgggcct

SEQ ID NO: 80345 - DNA, 23 bp, Artificial Sequence
  Description of Artificial Sequence: Synthetic oligonucleotide
gcagtgactctgggcctgggcct

SEQ ID NO: 80346 - DNA, 25 bp, Artificial Sequence
  Description of Artificial Sequence: Synthetic oligonucleotide
cagtgactctgggcctgggcctcat

SEQ ID NO: 80347 - DNA, 27 bp, Artificial Sequence
  Description of Artificial Sequence: Synthetic oligonucleotide
agtgactctgggcctgggcctcatcat

SEQ ID NO: 80348 - DNA, 26 bp, Artificial Sequence
  Description of Artificial Sequence: Synthetic oligonucleotide
gtgactctgggcctgggcctcatcat

SEQ ID NO: 80349 - DNA, 27 bp, Artificial Sequence
  Description of Artificial Sequence: Synthetic oligonucleotide
tgactctgggcctgggcctcatcatct

SEQ ID NO: 80350 - DNA, 27 bp, Artificial Sequence
  Description of Artificial Sequence: Synthetic oligonucleotide
gactctgggcctgggcctcatcatctt

SEQ ID NO: 80351 - DNA, 27 bp, Artificial Sequence
  Description of Artificial Sequence: Synthetic oligonucleotide
actctgggcctgggcctcatcatcttc

SEQ ID NO: 80352 - DNA, 27 bp, Artificial Sequence
  Description of Artificial Sequence: Synthetic oligonucleotide
ctctgggcctgggcctcatcatcttct

SEQ ID NO: 80353 - DNA, 27 bp, Artificial Sequence
  Description of Artificial Sequence: Synthetic oligonucleotide
tctgggcctgggcctcatcatcttctc

SEQ ID NO: 80354 - DNA, 27 bp, Artificial Sequence
  Description of Artificial Sequence: Synthetic oligonucleotide
ctgggcctgggcctcatcatcttctct

SEQ ID NO: 80355 - DNA, 27 bp, Artificial Sequence
  Description of Artificial Sequence: Synthetic oligonucleotide
tgggcctgggcctcatcatcttctctc

SEQ ID NO: 80356 - DNA, 27 bp, Artificial Sequence
  Description of Artificial Sequence: Synthetic oligonucleotide
gggcctgggcctcatcatcttctctct

SEQ ID NO: 80357 - DNA, 28 bp, Artificial Sequence
  Description of Artificial Sequence: Synthetic oligonucleotide
ggcctgggcctcatcatcttctctcttg

SEQ ID NO: 80358 - DNA, 28 bp, Artificial Sequence
  Description of Artificial Sequence: Synthetic oligonucleotide
gcctgggcctcatcatcttctctcttgg

SEQ ID NO: 80359 - DNA, 29 bp, Artificial Sequence
  Description of Artificial Sequence: Synthetic oligonucleotide
cctgggcctcatcatcttctctcttggtg

SEQ ID NO: 80360 - DNA, 30 bp, Artificial Sequence
  Description of Artificial Sequence: Synthetic oligonucleotide
ctgggcctcatcatcttctctcttggtgtg

SEQ ID NO: 80361 - DNA, 32 bp, Artificial Sequence
  Description of Artificial Sequence: Synthetic oligonucleotide
tgggcctcatcatcttctctcttggtgtgatc

SEQ ID NO: 80362 - DNA, 31 bp, Artificial Sequence
  Description of Artificial Sequence: Synthetic oligonucleotide
gggcctcatcatcttctctcttggtgtgatc

SEQ ID NO: 80363 - DNA, 32 bp, Artificial Sequence
  Description of Artificial Sequence: Synthetic oligonucleotide
ggcctcatcatcttctctcttggtgtgatcag

SEQ ID NO: 80364 - DNA, 32 bp, Artificial Sequence
  Description of Artificial Sequence: Synthetic oligonucleotide
gcctcatcatcttctctcttggtgtgatcagc

SEQ ID NO: 80365 - DNA, 33 bp, Artificial Sequence
  Description of Artificial Sequence: Synthetic oligonucleotide
cctcatcatcttctctcttggtgtgatcagctg

SEQ ID NO: 80366 - DNA, 33 bp, Artificial Sequence
  Description of Artificial Sequence: Synthetic oligonucleotide
ctcatcatcttctctcttggtgtgatcagctgg

SEQ ID NO: 80367 - DNA, 33 bp, Artificial Sequence
  Description of Artificial Sequence: Synthetic oligonucleotide
tcatcatcttctctcttggtgtgatcagctggc

SEQ ID NO: 80368 - DNA, 32 bp, Artificial Sequence
  Description of Artificial Sequence: Synthetic oligonucleotide
catcatcttctctcttggtgtgatcagctggc

SEQ ID NO: 80369 - DNA, 32 bp, Artificial Sequence
  Description of Artificial Sequence: Synthetic oligonucleotide
atcatcttctctcttggtgtgatcagctggcg

SEQ ID NO: 80370 - DNA, 31 bp, Artificial Sequence
  Description of Artificial Sequence: Synthetic oligonucleotide
tcatcttctctcttggtgtgatcagctggcg

SEQ ID NO: 80371 - DNA, 30 bp, Artificial Sequence
  Description of Artificial Sequence: Synthetic oligonucleotide
catcttctctcttggtgtgatcagctggcg

SEQ ID NO: 80372 - DNA, 30 bp, Artificial Sequence
  Description of Artificial Sequence: Synthetic oligonucleotide
atcttctctcttggtgtgatcagctggcgg

SEQ ID NO: 80373 - DNA, 29 bp, Artificial Sequence
  Description of Artificial Sequence: Synthetic oligonucleotide
tcttctctcttggtgtgatcagctggcgg

SEQ ID NO: 80374 - DNA, 28 bp, Artificial Sequence
  Description of Artificial Sequence: Synthetic oligonucleotide
cttctctcttggtgtgatcagctggcgg

SEQ ID NO: 80375 - DNA, 29 bp, Artificial Sequence
  Description of Artificial Sequence: Synthetic oligonucleotide
ttctctcttggtgtgatcagctggcggag

SEQ ID NO: 80376 - DNA, 28 bp, Artificial Sequence
  Description of Artificial Sequence: Synthetic oligonucleotide
tctctcttggtgtgatcagctggcggag

SEQ ID NO: 80377 - DNA, 27 bp, Artificial Sequence
  Description of Artificial Sequence: Synthetic oligonucleotide
ctctcttggtgtgatcagctggcggag

SEQ ID NO: 80378 - DNA, 28 bp, Artificial Sequence
  Description of Artificial Sequence: Synthetic oligonucleotide
tctcttggtgtgatcagctggcggagag

SEQ ID NO: 80379 - DNA, 27 bp, Artificial Sequence
  Description of Artificial Sequence: Synthetic oligonucleotide
ctcttggtgtgatcagctggcggagag

SEQ ID NO: 80380 - DNA, 27 bp, Artificial Sequence
  Description of Artificial Sequence: Synthetic oligonucleotide
tcttggtgtgatcagctggcggagagc

SEQ ID NO: 80381 - DNA, 27 bp, Artificial Sequence
  Description of Artificial Sequence: Synthetic oligonucleotide
cttggtgtgatcagctggcggagagct

SEQ ID NO: 80382 - DNA, 27 bp, Artificial Sequence
  Description of Artificial Sequence: Synthetic oligonucleotide
ttggtgtgatcagctggcggagagctg

SEQ ID NO: 80383 - DNA, 26 bp, Artificial Sequence
  Description of Artificial Sequence: Synthetic oligonucleotide
tggtgtgatcagctggcggagagctg

SEQ ID NO: 80384 - DNA, 25 bp, Artificial Sequence
  Description of Artificial Sequence: Synthetic oligonucleotide
ggtgtgatcagctggcggagagctg

SEQ ID NO: 80385 - DNA, 25 bp, Artificial Sequence
  Description of Artificial Sequence: Synthetic oligonucleotide
gtgtgatcagctggcggagagctgg

SEQ ID NO: 80386 - DNA, 25 bp, Artificial Sequence
  Description of Artificial Sequence: Synthetic oligonucleotide
tgtgatcagctggcggagagctggc

SEQ ID NO: 80387 - DNA, 24 bp, Artificial Sequence
  Description of Artificial Sequence: Synthetic oligonucleotide
gtgatcagctggcggagagctggc

SEQ ID NO: 80388 - DNA, 25 bp, Artificial Sequence
  Description of Artificial Sequence: Synthetic oligonucleotide
tgatcagctggcggagagctggcca

SEQ ID NO: 80389 - DNA, 24 bp, Artificial Sequence
  Description of Artificial Sequence: Synthetic oligonucleotide
gatcagctggcggagagctggcca

SEQ ID NO: 80390 - DNA, 25 bp, Artificial Sequence
  Description of Artificial Sequence: Synthetic oligonucleotide
atcagctggcggagagctggccact

SEQ ID NO: 80391 - DNA, 24 bp, Artificial Sequence
  Description of Artificial Sequence: Synthetic oligonucleotide
tcagctggcggagagctggccact

SEQ ID NO: 80392 - DNA, 23 bp, Artificial Sequence
  Description of Artificial Sequence: Synthetic oligonucleotide
cagctggcggagagctggccact

SEQ ID NO: 80393 - DNA, 25 bp, Artificial Sequence
  Description of Artificial Sequence: Synthetic oligonucleotide
agctggcggagagctggccactcta

SEQ ID NO: 80394 - DNA, 24 bp, Artificial Sequence
  Description of Artificial Sequence: Synthetic oligonucleotide
gctggcggagagctggccactcta

SEQ ID NO: 80395 - DNA, 27 bp, Artificial Sequence
  Description of Artificial Sequence: Synthetic oligonucleotide
ctggcggagagctggccactctagtta

SEQ ID NO: 80396 - DNA, 27 bp, Artificial Sequence
  Description of Artificial Sequence: Synthetic oligonucleotide
tggcggagagctggccactctagttac

SEQ ID NO: 80397 - DNA, 27 bp, Artificial Sequence
  Description of Artificial Sequence: Synthetic oligonucleotide
ggcggagagctggccactctagttaca

SEQ ID NO: 80398 - DNA, 27 bp, Artificial Sequence
  Description of Artificial Sequence: Synthetic oligonucleotide
gcggagagctggccactctagttacac

SEQ ID NO: 80399 - DNA, 28 bp, Artificial Sequence
  Description of Artificial Sequence: Synthetic oligonucleotide
cggagagctggccactctagttacactc

SEQ ID NO: 80400 - DNA, 28 bp, Artificial Sequence
  Description of Artificial Sequence: Synthetic oligonucleotide
ggagagctggccactctagttacactcc

SEQ ID NO: 80401 - DNA, 29 bp, Artificial Sequence
  Description of Artificial Sequence: Synthetic oligonucleotide
gagagctggccactctagttacactcctc

SEQ ID NO: 80402 - DNA, 31 bp, Artificial Sequence
  Description of Artificial Sequence: Synthetic oligonucleotide
agagctggccactctagttacactcctcttc

SEQ ID NO: 80403 - DNA, 30 bp, Artificial Sequence
  Description of Artificial Sequence: Synthetic oligonucleotide
gagctggccactctagttacactcctcttc

SEQ ID NO: 80404 - DNA, 30 bp, Artificial Sequence
  Description of Artificial Sequence: Synthetic oligonucleotide
agctggccactctagttacactcctcttcc

SEQ ID NO: 80405 - DNA, 29 bp, Artificial Sequence
  Description of Artificial Sequence: Synthetic oligonucleotide
gctggccactctagttacactcctcttcc

SEQ ID NO: 80406 - DNA, 30 bp, Artificial Sequence
  Description of Artificial Sequence: Synthetic oligonucleotide
ctggccactctagttacactcctcttcctg

SEQ ID NO: 80407 - DNA, 30 bp, Artificial Sequence
  Description of Artificial Sequence: Synthetic oligonucleotide
tggccactctagttacactcctcttcctgg

SEQ ID NO: 80408 - DNA, 29 bp, Artificial Sequence
  Description of Artificial Sequence: Synthetic oligonucleotide
ggccactctagttacactcctcttcctgg

SEQ ID NO: 80409 - DNA, 29 bp, Artificial Sequence
  Description of Artificial Sequence: Synthetic oligonucleotide
gccactctagttacactcctcttcctggg

SEQ ID NO: 80410 - DNA, 30 bp, Artificial Sequence
  Description of Artificial Sequence: Synthetic oligonucleotide
ccactctagttacactcctcttcctgggtc

SEQ ID NO: 80411 - DNA, 30 bp, Artificial Sequence
  Description of Artificial Sequence: Synthetic oligonucleotide
cactctagttacactcctcttcctgggtcc

SEQ ID NO: 80412 - DNA, 37 bp, Artificial Sequence
  Description of Artificial Sequence: Synthetic oligonucleotide
actctagttacactcctcttcctgggtccaattattc

SEQ ID NO: 80413 - DNA, 36 bp, Artificial Sequence
  Description of Artificial Sequence: Synthetic oligonucleotide
ctctagttacactcctcttcctgggtccaattattc

SEQ ID NO: 80414 - DNA, 37 bp, Artificial Sequence
  Description of Artificial Sequence: Synthetic oligonucleotide
tctagttacactcctcttcctgggtccaattattcag

SEQ ID NO: 80415 - DNA, 36 bp, Artificial Sequence
  Description of Artificial Sequence: Synthetic oligonucleotide
ctagttacactcctcttcctgggtccaattattcag

SEQ ID NO: 80416 - DNA, 38 bp, Artificial Sequence
  Description of Artificial Sequence: Synthetic oligonucleotide
tagttacactcctcttcctgggtccaattattcagaag

SEQ ID NO: 80417 - DNA, 37 bp, Artificial Sequence
  Description of Artificial Sequence: Synthetic oligonucleotide
agttacactcctcttcctgggtccaattattcagaag

SEQ ID NO: 80418 - DNA, 36 bp, Artificial Sequence
  Description of Artificial Sequence: Synthetic oligonucleotide
gttacactcctcttcctgggtccaattattcagaag

SEQ ID NO: 80419 - DNA, 36 bp, Artificial Sequence
  Description of Artificial Sequence: Synthetic oligonucleotide
ttacactcctcttcctgggtccaattattcagaagg

SEQ ID NO: 80420 - DNA, 35 bp, Artificial Sequence
  Description of Artificial Sequence: Synthetic oligonucleotide
tacactcctcttcctgggtccaattattcagaagg

SEQ ID NO: 80421 - DNA, 34 bp, Artificial Sequence
  Description of Artificial Sequence: Synthetic oligonucleotide
acactcctcttcctgggtccaattattcagaagg

SEQ ID NO: 80422 - DNA, 33 bp, Artificial Sequence
  Description of Artificial Sequence: Synthetic oligonucleotide
cactcctcttcctgggtccaattattcagaagg

SEQ ID NO: 80423 - DNA, 35 bp, Artificial Sequence
  Description of Artificial Sequence: Synthetic oligonucleotide
actcctcttcctgggtccaattattcagaaggatg

SEQ ID NO: 80424 - DNA, 34 bp, Artificial Sequence
  Description of Artificial Sequence: Synthetic oligonucleotide
ctcctcttcctgggtccaattattcagaaggatg

SEQ ID NO: 80425 - DNA, 34 bp, Artificial Sequence
  Description of Artificial Sequence: Synthetic oligonucleotide
tcctcttcctgggtccaattattcagaaggatgg

SEQ ID NO: 80426 - DNA, 33 bp, Artificial Sequence
  Description of Artificial Sequence: Synthetic oligonucleotide
cctcttcctgggtccaattattcagaaggatgg

SEQ ID NO: 80427 - DNA, 33 bp, Artificial Sequence
  Description of Artificial Sequence: Synthetic oligonucleotide
ctcttcctgggtccaattattcagaaggatggc

SEQ ID NO: 80428 - DNA, 34 bp, Artificial Sequence
  Description of Artificial Sequence: Synthetic oligonucleotide
tcttcctgggtccaattattcagaaggatggcac

SEQ ID NO: 80429 - DNA, 33 bp, Artificial Sequence
  Description of Artificial Sequence: Synthetic oligonucleotide
cttcctgggtccaattattcagaaggatggcac

SEQ ID NO: 80430 - DNA, 37 bp, Artificial Sequence
  Description of Artificial Sequence: Synthetic oligonucleotide
ttcctgggtccaattattcagaaggatggcacatttc

SEQ ID NO: 80431 - DNA, 36 bp, Artificial Sequence
  Description of Artificial Sequence: Synthetic oligonucleotide
tcctgggtccaattattcagaaggatggcacatttc

SEQ ID NO: 80432 - DNA, 35 bp, Artificial Sequence
  Description of Artificial Sequence: Synthetic oligonucleotide
cctgggtccaattattcagaaggatggcacatttc

SEQ ID NO: 80433 - DNA, 35 bp, Artificial Sequence
  Description of Artificial Sequence: Synthetic oligonucleotide
ctgggtccaattattcagaaggatggcacatttcc

SEQ ID NO: 80434 - DNA, 37 bp, Artificial Sequence
  Description of Artificial Sequence: Synthetic oligonucleotide
tgggtccaattattcagaaggatggcacatttcctag

SEQ ID NO: 80435 - DNA, 29 bp, Artificial Sequence
  Description of Artificial Sequence: Synthetic oligonucleotide
ggaagcttgtcatgcctcacagcagtgag

SEQ ID NO: 80436 - DNA, 29 bp, Artificial Sequence
  Description of Artificial Sequence: Synthetic oligonucleotide
gaagcttgtcatgcctcacagcagtgagc

SEQ ID NO: 80437 - DNA, 30 bp, Artificial Sequence
  Description of Artificial Sequence: Synthetic oligonucleotide
aagcttgtcatgcctcacagcagtgagcac

SEQ ID NO: 80438 - DNA, 29 bp, Artificial Sequence
  Description of Artificial Sequence: Synthetic oligonucleotide
agcttgtcatgcctcacagcagtgagcac

SEQ ID NO: 80439 - DNA, 28 bp, Artificial Sequence
  Description of Artificial Sequence: Synthetic oligonucleotide
gcttgtcatgcctcacagcagtgagcac

SEQ ID NO: 80440 - DNA, 30 bp, Artificial Sequence
  Description of Artificial Sequence: Synthetic oligonucleotide
cttgtcatgcctcacagcagtgagcacaag

SEQ ID NO: 80441 - DNA, 31 bp, Artificial Sequence
  Description of Artificial Sequence: Synthetic oligonucleotide
ttgtcatgcctcacagcagtgagcacaagac

SEQ ID NO: 80442 - DNA, 30 bp, Artificial Sequence
  Description of Artificial Sequence: Synthetic oligonucleotide
tgtcatgcctcacagcagtgagcacaagac

SEQ ID NO: 80443 - DNA, 29 bp, Artificial Sequence
  Description of Artificial Sequence: Synthetic oligonucleotide
gtcatgcctcacagcagtgagcacaagac

SEQ ID NO: 80444 - DNA, 30 bp, Artificial Sequence
  Description of Artificial Sequence: Synthetic oligonucleotide
tcatgcctcacagcagtgagcacaagactg

SEQ ID NO: 80445 - DNA, 29 bp, Artificial Sequence
  Description of Artificial Sequence: Synthetic oligonucleotide
catgcctcacagcagtgagcacaagactg

SEQ ID NO: 80446 - DNA, 29 bp, Artificial Sequence
  Description of Artificial Sequence: Synthetic oligonucleotide
atgcctcacagcagtgagcacaagactgc

SEQ ID NO: 80447 - DNA, 28 bp, Artificial Sequence
  Description of Artificial Sequence: Synthetic oligonucleotide
tgcctcacagcagtgagcacaagactgc

SEQ ID NO: 80448 - DNA, 27 bp, Artificial Sequence
  Description of Artificial Sequence: Synthetic oligonucleotide
gcctcacagcagtgagcacaagactgc

SEQ ID NO: 80449 - DNA, 27 bp, Artificial Sequence
  Description of Artificial Sequence: Synthetic oligonucleotide
cctcacagcagtgagcacaagactgcc

SEQ ID NO: 80450 - DNA, 27 bp, Artificial Sequence
  Description of Artificial Sequence: Synthetic oligonucleotide
ctcacagcagtgagcacaagactgccc

SEQ ID NO: 80451 - DNA, 28 bp, Artificial Sequence
  Description of Artificial Sequence: Synthetic oligonucleotide
tcacagcagtgagcacaagactgcccag

SEQ ID NO: 80452 - DNA, 27 bp, Artificial Sequence
  Description of Artificial Sequence: Synthetic oligonucleotide
cacagcagtgagcacaagactgcccag

SEQ ID NO: 80453 - DNA, 27 bp, Artificial Sequence
  Description of Artificial Sequence: Synthetic oligonucleotide
acagcagtgagcacaagactgcccagc

SEQ ID NO: 80454 - DNA, 26 bp, Artificial Sequence
  Description of Artificial Sequence: Synthetic oligonucleotide
cagcagtgagcacaagactgcccagc

SEQ ID NO: 80455 - DNA, 26 bp, Artificial Sequence
  Description of Artificial Sequence: Synthetic oligonucleotide
agcagtgagcacaagactgcccagcc

SEQ ID NO: 80456 - DNA, 25 bp, Artificial Sequence
  Description of Artificial Sequence: Synthetic oligonucleotide
gcagtgagcacaagactgcccagcc

SEQ ID NO: 80457 - DNA, 27 bp, Artificial Sequence
  Description of Artificial Sequence: Synthetic oligonucleotide
cagtgagcacaagactgcccagcccaa

SEQ ID NO: 80458 - DNA, 28 bp, Artificial Sequence
  Description of Artificial Sequence: Synthetic oligonucleotide
agtgagcacaagactgcccagcccaatg

SEQ ID NO: 80459 - DNA, 27 bp, Artificial Sequence
  Description of Artificial Sequence: Synthetic oligonucleotide
gtgagcacaagactgcccagcccaatg

SEQ ID NO: 80460 - DNA, 27 bp, Artificial Sequence
  Description of Artificial Sequence: Synthetic oligonucleotide
tgagcacaagactgcccagcccaatgg

SEQ ID NO: 80461 - DNA, 27 bp, Artificial Sequence
  Description of Artificial Sequence: Synthetic oligonucleotide
gagcacaagactgcccagcccaatgga

SEQ ID NO: 80462 - DNA, 27 bp, Artificial Sequence
  Description of Artificial Sequence: Synthetic oligonucleotide
agcacaagactgcccagcccaatggag

SEQ ID NO: 80463 - DNA, 25 bp, Artificial Sequence
  Description of Artificial Sequence: Synthetic oligonucleotide
tcctgagcccatccttcgggactgg

SEQ ID NO: 80464 - DNA, 30 bp, Artificial Sequence
  Description of Artificial Sequence: Synthetic oligonucleotide
ggacacttacacctgtgtggtagagcacac

SEQ ID NO: 80465 - DNA, 31 bp, Artificial Sequence
  Description of Artificial Sequence: Synthetic oligonucleotide
gacacttacacctgtgtggtagagcacactg

SEQ ID NO: 80466 - DNA, 31 bp, Artificial Sequence
  Description of Artificial Sequence: Synthetic oligonucleotide
acacttacacctgtgtggtagagcacactgg

SEQ ID NO: 80467 - DNA, 30 bp, Artificial Sequence
  Description of Artificial Sequence: Synthetic oligonucleotide
cacttacacctgtgtggtagagcacactgg

SEQ ID NO: 80468 - DNA, 30 bp, Artificial Sequence
  Description of Artificial Sequence: Synthetic oligonucleotide
acttacacctgtgtggtagagcacactggg

SEQ ID NO: 80469 - DNA, 29 bp, Artificial Sequence
  Description of Artificial Sequence: Synthetic oligonucleotide
cttacacctgtgtggtagagcacactggg

SEQ ID NO: 80470 - DNA, 29 bp, Artificial Sequence
  Description of Artificial Sequence: Synthetic oligonucleotide
ttacacctgtgtggtagagcacactgggg

SEQ ID NO: 80471 - DNA, 28 bp, Artificial Sequence
  Description of Artificial Sequence: Synthetic oligonucleotide
tacacctgtgtggtagagcacactgggg

SEQ ID NO: 80472 - DNA, 27 bp, Artificial Sequence
  Description of Artificial Sequence: Synthetic oligonucleotide
acacctgtgtggtagagcacactgggg

SEQ ID NO: 80473 - DNA, 26 bp, Artificial Sequence
  Description of Artificial Sequence: Synthetic oligonucleotide
cacctgtgtggtagagcacactgggg

SEQ ID NO: 80474 - DNA, 27 bp, Artificial Sequence
  Description of Artificial Sequence: Synthetic oligonucleotide
acctgtgtggtagagcacactggggct

SEQ ID NO: 80475 - DNA, 26 bp, Artificial Sequence
  Description of Artificial Sequence: Synthetic oligonucleotide
cctgtgtggtagagcacactggggct

SEQ ID NO: 80476 - DNA, 26 bp, Artificial Sequence
  Description of Artificial Sequence: Synthetic oligonucleotide
ctgtgtggtagagcacactggggctc

SEQ ID NO: 80477 - DNA, 27 bp, Artificial Sequence
  Description of Artificial Sequence: Synthetic oligonucleotide
tgtgtggtagagcacactggggctcct

SEQ ID NO: 80478 - DNA, 26 bp, Artificial Sequence
  Description of Artificial Sequence: Synthetic oligonucleotide
gtgtggtagagcacactggggctcct

SEQ ID NO: 80479 - DNA, 27 bp, Artificial Sequence
  Description of Artificial Sequence: Synthetic oligonucleotide
tgtggtagagcacactggggctcctga

SEQ ID NO: 80480 - DNA, 26 bp, Artificial Sequence
  Description of Artificial Sequence: Synthetic oligonucleotide
gtggtagagcacactggggctcctga

SEQ ID NO: 80481 - DNA, 26 bp, Artificial Sequence
  Description of Artificial Sequence: Synthetic oligonucleotide
tggtagagcacactggggctcctgag

SEQ ID NO: 80482 - DNA, 25 bp, Artificial Sequence
  Description of Artificial Sequence: Synthetic oligonucleotide
ggtagagcacactggggctcctgag

SEQ ID NO: 80483 - DNA, 25 bp, Artificial Sequence
  Description of Artificial Sequence: Synthetic oligonucleotide
gtagagcacactggggctcctgagc

SEQ ID NO: 80484 - DNA, 25 bp, Artificial Sequence
  Description of Artificial Sequence: Synthetic oligonucleotide
tagagcacactggggctcctgagcc

SEQ ID NO: 80485 - DNA, 24 bp, Artificial Sequence
  Description of Artificial Sequence: Synthetic oligonucleotide
agagcacactggggctcctgagcc

SEQ ID NO: 80486 - DNA, 23 bp, Artificial Sequence
  Description of Artificial Sequence: Synthetic oligonucleotide
gagcacactggggctcctgagcc

SEQ ID NO: 80487 - DNA, 25 bp, Artificial Sequence
  Description of Artificial Sequence: Synthetic oligonucleotide
agcacactggggctcctgagcccat

SEQ ID NO: 80488 - DNA, 24 bp, Artificial Sequence
  Description of Artificial Sequence: Synthetic oligonucleotide
gcacactggggctcctgagcccat

SEQ ID NO: 80489 - DNA, 24 bp, Artificial Sequence
  Description of Artificial Sequence: Synthetic oligonucleotide
cacactggggctcctgagcccatc

SEQ ID NO: 80490 - DNA, 26 bp, Artificial Sequence
  Description of Artificial Sequence: Synthetic oligonucleotide
acactggggctcctgagcccatcctt

SEQ ID NO: 80491 - DNA, 25 bp, Artificial Sequence
  Description of Artificial Sequence: Synthetic oligonucleotide
cactggggctcctgagcccatcctt

SEQ ID NO: 80492 - DNA, 25 bp, Artificial Sequence
  Description of Artificial Sequence: Synthetic oligonucleotide
actggggctcctgagcccatccttc

SEQ ID NO: 80493 - DNA, 24 bp, Artificial Sequence
  Description of Artificial Sequence: Synthetic oligonucleotide
ctggggctcctgagcccatccttc

SEQ ID NO: 80494 - DNA, 29 bp, Artificial Sequence
  Description of Artificial Sequence: Synthetic oligonucleotide
ggaagcttgtcatgcctcacagcagtgtg

SEQ ID NO: 80495 - DNA, 29 bp, Artificial Sequence
  Description of Artificial Sequence: Synthetic oligonucleotide
gaagcttgtcatgcctcacagcagtgtgc

SEQ ID NO: 80496 - DNA, 30 bp, Artificial Sequence
  Description of Artificial Sequence: Synthetic oligonucleotide
aagcttgtcatgcctcacagcagtgtgcac

SEQ ID NO: 80497 - DNA, 29 bp, Artificial Sequence
  Description of Artificial Sequence: Synthetic oligonucleotide
agcttgtcatgcctcacagcagtgtgcac

SEQ ID NO: 80498 - DNA, 28 bp, Artificial Sequence
  Description of Artificial Sequence: Synthetic oligonucleotide
gcttgtcatgcctcacagcagtgtgcac

SEQ ID NO: 80499 - DNA, 30 bp, Artificial Sequence
  Description of Artificial Sequence: Synthetic oligonucleotide
cttgtcatgcctcacagcagtgtgcacaag

SEQ ID NO: 80500 - DNA, 31 bp, Artificial Sequence
  Description of Artificial Sequence: Synthetic oligonucleotide
ttgtcatgcctcacagcagtgtgcacaagac

SEQ ID NO: 80501 - DNA, 30 bp, Artificial Sequence
  Description of Artificial Sequence: Synthetic oligonucleotide
tgtcatgcctcacagcagtgtgcacaagac

SEQ ID NO: 80502 - DNA, 29 bp, Artificial Sequence
  Description of Artificial Sequence: Synthetic oligonucleotide
gtcatgcctcacagcagtgtgcacaagac

SEQ ID NO: 80503 - DNA, 30 bp, Artificial Sequence
  Description of Artificial Sequence: Synthetic oligonucleotide
tcatgcctcacagcagtgtgcacaagactg

SEQ ID NO: 80504 - DNA, 29 bp, Artificial Sequence
  Description of Artificial Sequence: Synthetic oligonucleotide
catgcctcacagcagtgtgcacaagactg

SEQ ID NO: 80505 - DNA, 29 bp, Artificial Sequence
  Description of Artificial Sequence: Synthetic oligonucleotide
atgcctcacagcagtgtgcacaagactgc

SEQ ID NO: 80506 - DNA, 28 bp, Artificial Sequence
  Description of Artificial Sequence: Synthetic oligonucleotide
tgcctcacagcagtgtgcacaagactgc

SEQ ID NO: 80507 - DNA, 27 bp, Artificial Sequence
  Description of Artificial Sequence: Synthetic oligonucleotide
gcctcacagcagtgtgcacaagactgc

SEQ ID NO: 80508 - DNA, 27 bp, Artificial Sequence
  Description of Artificial Sequence: Synthetic oligonucleotide
cctcacagcagtgtgcacaagactgcc

SEQ ID NO: 80509 - DNA, 27 bp, Artificial Sequence
  Description of Artificial Sequence: Synthetic oligonucleotide
ctcacagcagtgtgcacaagactgccc

SEQ ID NO: 80510 - DNA, 28 bp, Artificial Sequence
  Description of Artificial Sequence: Synthetic oligonucleotide
tcacagcagtgtgcacaagactgcccag

SEQ ID NO: 80511 - DNA, 27 bp, Artificial Sequence
  Description of Artificial Sequence: Synthetic oligonucleotide
cacagcagtgtgcacaagactgcccag

SEQ ID NO: 80512 - DNA, 27 bp, Artificial Sequence
  Description of Artificial Sequence: Synthetic oligonucleotide
acagcagtgtgcacaagactgcccagc

SEQ ID NO: 80513 - DNA, 26 bp, Artificial Sequence
  Description of Artificial Sequence: Synthetic oligonucleotide
cagcagtgtgcacaagactgcccagc

SEQ ID NO: 80514 - DNA, 26 bp, Artificial Sequence
  Description of Artificial Sequence: Synthetic oligonucleotide
agcagtgtgcacaagactgcccagcc

SEQ ID NO: 80515 - DNA, 25 bp, Artificial Sequence
  Description of Artificial Sequence: Synthetic oligonucleotide
gcagtgtgcacaagactgcccagcc

SEQ ID NO: 80516 - DNA, 27 bp, Artificial Sequence
  Description of Artificial Sequence: Synthetic oligonucleotide
cagtgtgcacaagactgcccagcccaa

SEQ ID NO: 80517 - DNA, 28 bp, Artificial Sequence
  Description of Artificial Sequence: Synthetic oligonucleotide
agtgtgcacaagactgcccagcccaatg

SEQ ID NO: 80518 - DNA, 27 bp, Artificial Sequence
  Description of Artificial Sequence: Synthetic oligonucleotide
gtgtgcacaagactgcccagcccaatg

SEQ ID NO: 80519 - DNA, 27 bp, Artificial Sequence
  Description of Artificial Sequence: Synthetic oligonucleotide
tgtgcacaagactgcccagcccaatgg

SEQ ID NO: 80520 - DNA, 27 bp, Artificial Sequence
  Description of Artificial Sequence: Synthetic oligonucleotide
gtgcacaagactgcccagcccaatgga

SEQ ID NO: 80521 - DNA, 27 bp, Artificial Sequence
  Description of Artificial Sequence: Synthetic oligonucleotide
tgcacaagactgcccagcccaatggag

SEQ ID NO: 80522 - DNA, 26 bp, Artificial Sequence
  Description of Artificial Sequence: Synthetic oligonucleotide
tgtggtagagcacactggggctcctg

SEQ ID NO: 80523 - DNA, 35 bp, Artificial Sequence
  Description of Artificial Sequence: Synthetic oligonucleotide
ctgggactccaaaggatttcacatactgcatcttc

SEQ ID NO: 80524 - DNA, 37 bp, Artificial Sequence
  Description of Artificial Sequence: Synthetic oligonucleotide
tgggactccaaaggatttcacatactgcatcttcttc

SEQ ID NO: 80525 - DNA, 36 bp, Artificial Sequence
  Description of Artificial Sequence: Synthetic oligonucleotide
gggactccaaaggatttcacatactgcatcttcttc

SEQ ID NO: 80526 - DNA, 38 bp, Artificial Sequence
  Description of Artificial Sequence: Synthetic oligonucleotide
ggactccaaaggatttcacatactgcatcttcttcaac

SEQ ID NO: 80527 - DNA, 40 bp, Artificial Sequence
  Description of Artificial Sequence: Synthetic oligonucleotide
gactccaaaggatttcacatactgcatcttcttcaacaag

SEQ ID NO: 80528 - DNA, 40 bp, Artificial Sequence
  Description of Artificial Sequence: Synthetic oligonucleotide
actccaaaggatttcacatactgcatcttcttcaacaagg

SEQ ID NO: 80529 - DNA, 39 bp, Artificial Sequence
  Description of Artificial Sequence: Synthetic oligonucleotide
ctccaaaggatttcacatactgcatcttcttcaacaagg

SEQ ID NO: 80530 - DNA, 41 bp, Artificial Sequence
  Description of Artificial Sequence: Synthetic oligonucleotide
tccaaaggatttcacatactgcatcttcttcaacaaggatc

SEQ ID NO: 80531 - DNA, 40 bp, Artificial Sequence
  Description of Artificial Sequence: Synthetic oligonucleotide
ccaaaggatttcacatactgcatcttcttcaacaaggatc

SEQ ID NO: 80532 - DNA, 41 bp, Artificial Sequence
  Description of Artificial Sequence: Synthetic oligonucleotide
caaaggatttcacatactgcatcttcttcaacaaggatctg

SEQ ID NO: 80533 - DNA, 41 bp, Artificial Sequence
  Description of Artificial Sequence: Synthetic oligonucleotide
aaaggatttcacatactgcatcttcttcaacaaggatctgc

SEQ ID NO: 80534 - DNA, 40 bp, Artificial Sequence
  Description of Artificial Sequence: Synthetic oligonucleotide
aaggatttcacatactgcatcttcttcaacaaggatctgc

SEQ ID NO: 80535 - DNA, 39 bp, Artificial Sequence
  Description of Artificial Sequence: Synthetic oligonucleotide
aggatttcacatactgcatcttcttcaacaaggatctgc

SEQ ID NO: 80536 - DNA, 38 bp, Artificial Sequence
  Description of Artificial Sequence: Synthetic oligonucleotide
ggatttcacatactgcatcttcttcaacaaggatctgc

SEQ ID NO: 80537 - DNA, 39 bp, Artificial Sequence
  Description of Artificial Sequence: Synthetic oligonucleotide
gatttcacatactgcatcttcttcaacaaggatctgctg

SEQ ID NO: 80538 - DNA, 40 bp, Artificial Sequence
  Description of Artificial Sequence: Synthetic oligonucleotide
atttcacatactgcatcttcttcaacaaggatctgctgac

SEQ ID NO: 80539 - DNA, 39 bp, Artificial Sequence
  Description of Artificial Sequence: Synthetic oligonucleotide
tttcacatactgcatcttcttcaacaaggatctgctgac

SEQ ID NO: 80540 - DNA, 38 bp, Artificial Sequence
  Description of Artificial Sequence: Synthetic oligonucleotide
ttcacatactgcatcttcttcaacaaggatctgctgac

SEQ ID NO: 80541 - DNA, 37 bp, Artificial Sequence
  Description of Artificial Sequence: Synthetic oligonucleotide
tcacatactgcatcttcttcaacaaggatctgctgac

SEQ ID NO: 80542 - DNA, 36 bp, Artificial Sequence
  Description of Artificial Sequence: Synthetic oligonucleotide
cacatactgcatcttcttcaacaaggatctgctgac

SEQ ID NO: 80543 - DNA, 36 bp, Artificial Sequence
  Description of Artificial Sequence: Synthetic oligonucleotide
acatactgcatcttcttcaacaaggatctgctgacc

SEQ ID NO: 80544 - DNA, 35 bp, Artificial Sequence
  Description of Artificial Sequence: Synthetic oligonucleotide
catactgcatcttcttcaacaaggatctgctgacc

SEQ ID NO: 80545 - DNA, 36 bp, Artificial Sequence
  Description of Artificial Sequence: Synthetic oligonucleotide
atactgcatcttcttcaacaaggatctgctgacctg

SEQ ID NO: 80546 - DNA, 35 bp, Artificial Sequence
  Description of Artificial Sequence: Synthetic oligonucleotide
tactgcatcttcttcaacaaggatctgctgacctg

SEQ ID NO: 80547 - DNA, 34 bp, Artificial Sequence
  Description of Artificial Sequence: Synthetic oligonucleotide
actgcatcttcttcaacaaggatctgctgacctg

SEQ ID NO: 80548 - DNA, 33 bp, Artificial Sequence
  Description of Artificial Sequence: Synthetic oligonucleotide
ctgcatcttcttcaacaaggatctgctgacctg

SEQ ID NO: 80549 - DNA, 33 bp, Artificial Sequence
  Description of Artificial Sequence: Synthetic oligonucleotide
tgcatcttcttcaacaaggatctgctgacctgc

SEQ ID NO: 80550 - DNA, 32 bp, Artificial Sequence
  Description of Artificial Sequence: Synthetic oligonucleotide
gcatcttcttcaacaaggatctgctgacctgc

SEQ ID NO: 80551 - DNA, 33 bp, Artificial Sequence
  Description of Artificial Sequence: Synthetic oligonucleotide
catcttcttcaacaaggatctgctgacctgctg

SEQ ID NO: 80552 - DNA, 33 bp, Artificial Sequence
  Description of Artificial Sequence: Synthetic oligonucleotide
atcttcttcaacaaggatctgctgacctgctgg

SEQ ID NO: 80553 - DNA, 32 bp, Artificial Sequence
  Description of Artificial Sequence: Synthetic oligonucleotide
tcttcttcaacaaggatctgctgacctgctgg

SEQ ID NO: 80554 - DNA, 31 bp, Artificial Sequence
  Description of Artificial Sequence: Synthetic oligonucleotide
cttcttcaacaaggatctgctgacctgctgg

SEQ ID NO: 80555 - DNA, 31 bp, Artificial Sequence
  Description of Artificial Sequence: Synthetic oligonucleotide
ttcttcaacaaggatctgctgacctgctggg

SEQ ID NO: 80556 - DNA, 30 bp, Artificial Sequence
  Description of Artificial Sequence: Synthetic oligonucleotide
tcttcaacaaggatctgctgacctgctggg

SEQ ID NO: 80557 - DNA, 26 bp, Artificial Sequence
  Description of Artificial Sequence: Synthetic oligonucleotide
gtggcttcgtggcccatgtggaaagc

SEQ ID NO: 80558 - DNA, 26 bp, Artificial Sequence
  Description of Artificial Sequence: Synthetic oligonucleotide
tggcttcgtggcccatgtggaaagcg

SEQ ID NO: 80559 - DNA, 25 bp, Artificial Sequence
  Description of Artificial Sequence: Synthetic oligonucleotide
ggcttcgtggcccatgtggaaagcg

SEQ ID NO: 80560 - DNA, 25 bp, Artificial Sequence
  Description of Artificial Sequence: Synthetic oligonucleotide
gcttcgtggcccatgtggaaagcgc

SEQ ID NO: 80561 - DNA, 26 bp, Artificial Sequence
  Description of Artificial Sequence: Synthetic oligonucleotide
cttcgtggcccatgtggaaagcgcct

SEQ ID NO: 80562 - DNA, 27 bp, Artificial Sequence
  Description of Artificial Sequence: Synthetic oligonucleotide
ttcgtggcccatgtggaaagcgcctgt

SEQ ID NO: 80563 - DNA, 26 bp, Artificial Sequence
  Description of Artificial Sequence: Synthetic oligonucleotide
tcgtggcccatgtggaaagcgcctgt

SEQ ID NO: 80564 - DNA, 25 bp, Artificial Sequence
  Description of Artificial Sequence: Synthetic oligonucleotide
cgtggcccatgtggaaagcgcctgt

SEQ ID NO: 80565 - DNA, 26 bp, Artificial Sequence
  Description of Artificial Sequence: Synthetic oligonucleotide
gtggcccatgtggaaagcgcctgtct

SEQ ID NO: 80566 - DNA, 27 bp, Artificial Sequence
  Description of Artificial Sequence: Synthetic oligonucleotide
tggcccatgtggaaagcgcctgtctgt

SEQ ID NO: 80567 - DNA, 27 bp, Artificial Sequence
  Description of Artificial Sequence: Synthetic oligonucleotide
ggcccatgtggaaagcgcctgtctgtt

SEQ ID NO: 80568 - DNA, 27 bp, Artificial Sequence
  Description of Artificial Sequence: Synthetic oligonucleotide
gcccatgtggaaagcgcctgtctgttg

SEQ ID NO: 80569 - DNA, 27 bp, Artificial Sequence
  Description of Artificial Sequence: Synthetic oligonucleotide
cccatgtggaaagcgcctgtctgttgg

SEQ ID NO: 80570 - DNA, 29 bp, Artificial Sequence
  Description of Artificial Sequence: Synthetic oligonucleotide
ccatgtggaaagcgcctgtctgttggatg

SEQ ID NO: 80571 - DNA, 31 bp, Artificial Sequence
  Description of Artificial Sequence: Synthetic oligonucleotide
catgtggaaagcgcctgtctgttggatgatg

SEQ ID NO: 80572 - DNA, 31 bp, Artificial Sequence
  Description of Artificial Sequence: Synthetic oligonucleotide
atgtggaaagcgcctgtctgttggatgatgc

SEQ ID NO: 80573 - DNA, 30 bp, Artificial Sequence
  Description of Artificial Sequence: Synthetic oligonucleotide
tgtggaaagcgcctgtctgttggatgatgc

SEQ ID NO: 80574 - DNA, 29 bp, Artificial Sequence
  Description of Artificial Sequence: Synthetic oligonucleotide
gtggaaagcgcctgtctgttggatgatgc

SEQ ID NO: 80575 - DNA, 30 bp, Artificial Sequence
  Description of Artificial Sequence: Synthetic oligonucleotide
tggaaagcgcctgtctgttggatgatgctg

SEQ ID NO: 80576 - DNA, 29 bp, Artificial Sequence
  Description of Artificial Sequence: Synthetic oligonucleotide
ggaaagcgcctgtctgttggatgatgctg

SEQ ID NO: 80577 - DNA, 29 bp, Artificial Sequence
  Description of Artificial Sequence: Synthetic oligonucleotide
gaaagcgcctgtctgttggatgatgctgg

SEQ ID NO: 80578 - DNA, 29 bp, Artificial Sequence
  Description of Artificial Sequence: Synthetic oligonucleotide
aaagcgcctgtctgttggatgatgctggg

SEQ ID NO: 80579 - DNA, 28 bp, Artificial Sequence
  Description of Artificial Sequence: Synthetic oligonucleotide
aagcgcctgtctgttggatgatgctggg

SEQ ID NO: 80580 - DNA, 27 bp, Artificial Sequence
  Description of Artificial Sequence: Synthetic oligonucleotide
agcgcctgtctgttggatgatgctggg

SEQ ID NO: 80581 - DNA, 27 bp, Artificial Sequence
  Description of Artificial Sequence: Synthetic oligonucleotide
gcgcctgtctgttggatgatgctggga

SEQ ID NO: 80582 - DNA, 27 bp, Artificial Sequence
  Description of Artificial Sequence: Synthetic oligonucleotide
cgcctgtctgttggatgatgctgggac

SEQ ID NO: 80583 - DNA, 28 bp, Artificial Sequence
  Description of Artificial Sequence: Synthetic oligonucleotide
gcctgtctgttggatgatgctgggactc

SEQ ID NO: 80584 - DNA, 39 bp, Artificial Sequence
  Description of Artificial Sequence: Synthetic oligonucleotide
caaaggatttcacatactgcatctccttcaacaaggttc

SEQ ID NO: 80585 - DNA, 40 bp, Artificial Sequence
  Description of Artificial Sequence: Synthetic oligonucleotide
aaaggatttcacatactgcatctccttcaacaaggttctg

SEQ ID NO: 80586 - DNA, 39 bp, Artificial Sequence
  Description of Artificial Sequence: Synthetic oligonucleotide
aaggatttcacatactgcatctccttcaacaaggttctg

SEQ ID NO: 80587 - DNA, 38 bp, Artificial Sequence
  Description of Artificial Sequence: Synthetic oligonucleotide
aggatttcacatactgcatctccttcaacaaggttctg

SEQ ID NO: 80588 - DNA, 37 bp, Artificial Sequence
  Description of Artificial Sequence: Synthetic oligonucleotide
ggatttcacatactgcatctccttcaacaaggttctg

SEQ ID NO: 80589 - DNA, 37 bp, Artificial Sequence
  Description of Artificial Sequence: Synthetic oligonucleotide
gatttcacatactgcatctccttcaacaaggttctgc

SEQ ID NO: 80590 - DNA, 38 bp, Artificial Sequence
  Description of Artificial Sequence: Synthetic oligonucleotide
atttcacatactgcatctccttcaacaaggttctgctg

SEQ ID NO: 80591 - DNA, 37 bp, Artificial Sequence
  Description of Artificial Sequence: Synthetic oligonucleotide
tttcacatactgcatctccttcaacaaggttctgctg

SEQ ID NO: 80592 - DNA, 36 bp, Artificial Sequence
  Description of Artificial Sequence: Synthetic oligonucleotide
ttcacatactgcatctccttcaacaaggttctgctg

SEQ ID NO: 80593 - DNA, 35 bp, Artificial Sequence
  Description of Artificial Sequence: Synthetic oligonucleotide
tcacatactgcatctccttcaacaaggttctgctg

SEQ ID NO: 80594 - DNA, 34 bp, Artificial Sequence
  Description of Artificial Sequence: Synthetic oligonucleotide
cacatactgcatctccttcaacaaggttctgctg

SEQ ID NO: 80595 - DNA, 35 bp, Artificial Sequence
  Description of Artificial Sequence: Synthetic oligonucleotide
acatactgcatctccttcaacaaggttctgctgac

SEQ ID NO: 80596 - DNA, 34 bp, Artificial Sequence
  Description of Artificial Sequence: Synthetic oligonucleotide
catactgcatctccttcaacaaggttctgctgac

SEQ ID NO: 80597 - DNA, 34 bp, Artificial Sequence
  Description of Artificial Sequence: Synthetic oligonucleotide
atactgcatctccttcaacaaggttctgctgacc

SEQ ID NO: 80598 - DNA, 33 bp, Artificial Sequence
  Description of Artificial Sequence: Synthetic oligonucleotide
tactgcatctccttcaacaaggttctgctgacc

SEQ ID NO: 80599 - DNA, 32 bp, Artificial Sequence
  Description of Artificial Sequence: Synthetic oligonucleotide
actgcatctccttcaacaaggttctgctgacc

SEQ ID NO: 80600 - DNA, 31 bp, Artificial Sequence
  Description of Artificial Sequence: Synthetic oligonucleotide
ctgcatctccttcaacaaggttctgctgacc

SEQ ID NO: 80601 - DNA, 32 bp, Artificial Sequence
  Description of Artificial Sequence: Synthetic oligonucleotide
tgcatctccttcaacaaggttctgctgacctg

SEQ ID NO: 80602 - DNA, 31 bp, Artificial Sequence
  Description of Artificial Sequence: Synthetic oligonucleotide
gcatctccttcaacaaggttctgctgacctg

SEQ ID NO: 80603 - DNA, 31 bp, Artificial Sequence
  Description of Artificial Sequence: Synthetic oligonucleotide
catctccttcaacaaggttctgctgacctgc

SEQ ID NO: 80604 - DNA, 32 bp, Artificial Sequence
  Description of Artificial Sequence: Synthetic oligonucleotide
atctccttcaacaaggttctgctgacctgctg

SEQ ID NO: 80605 - DNA, 31 bp, Artificial Sequence
  Description of Artificial Sequence: Synthetic oligonucleotide
tctccttcaacaaggttctgctgacctgctg

SEQ ID NO: 80606 - DNA, 30 bp, Artificial Sequence
  Description of Artificial Sequence: Synthetic oligonucleotide
ctccttcaacaaggttctgctgacctgctg

SEQ ID NO: 80607 - DNA, 30 bp, Artificial Sequence
  Description of Artificial Sequence: Synthetic oligonucleotide
tccttcaacaaggttctgctgacctgctgg

SEQ ID NO: 80608 - DNA, 29 bp, Artificial Sequence
  Description of Artificial Sequence: Synthetic oligonucleotide
ccttcaacaaggttctgctgacctgctgg

SEQ ID NO: 80609 - DNA, 29 bp, Artificial Sequence
  Description of Artificial Sequence: Synthetic oligonucleotide
cttcaacaaggttctgctgacctgctggg

SEQ ID NO: 80610 - DNA, 31 bp, Artificial Sequence
  Description of Artificial Sequence: Synthetic oligonucleotide
ttcaacaaggttctgctgacctgctgggatc

SEQ ID NO: 80611 - DNA, 30 bp, Artificial Sequence
  Description of Artificial Sequence: Synthetic oligonucleotide
tcaacaaggttctgctgacctgctgggatc

SEQ ID NO: 80612 - DNA, 29 bp, Artificial Sequence
  Description of Artificial Sequence: Synthetic oligonucleotide
caacaaggttctgctgacctgctgggatc

SEQ ID NO: 80613 - DNA, 29 bp, Artificial Sequence
  Description of Artificial Sequence: Synthetic oligonucleotide
aacaaggttctgctgacctgctgggatcc

SEQ ID NO: 80614 - DNA, 28 bp, Artificial Sequence
  Description of Artificial Sequence: Synthetic oligonucleotide
acaaggttctgctgacctgctgggatcc

SEQ ID NO: 80615 - DNA, 27 bp, Artificial Sequence
  Description of Artificial Sequence: Synthetic oligonucleotide
caaggttctgctgacctgctgggatcc

SEQ ID NO: 80616 - DNA, 28 bp, Artificial Sequence
  Description of Artificial Sequence: Synthetic oligonucleotide
aaggttctgctgacctgctgggatccag

SEQ ID NO: 80617 - DNA, 27 bp, Artificial Sequence
  Description of Artificial Sequence: Synthetic oligonucleotide
aggttctgctgacctgctgggatccag

SEQ ID NO: 80618 - DNA, 27 bp, Artificial Sequence
  Description of Artificial Sequence: Synthetic oligonucleotide
ggttctgctgacctgctgggatccaga

SEQ ID NO: 80619 - DNA, 27 bp, Artificial Sequence
  Description of Artificial Sequence: Synthetic oligonucleotide
gttctgctgacctgctgggatccagag

SEQ ID NO: 80620 - DNA, 27 bp, Artificial Sequence
  Description of Artificial Sequence: Synthetic oligonucleotide
ttctgctgacctgctgggatccagagg

SEQ ID NO: 80621 - DNA, 30 bp, Artificial Sequence
  Description of Artificial Sequence: Synthetic oligonucleotide
gccccttgcgaatttggggtgctgaataac

SEQ ID NO: 80622 - DNA, 32 bp, Artificial Sequence
  Description of Artificial Sequence: Synthetic oligonucleotide
ccccttgcgaatttggggtgctgaataacttg

SEQ ID NO: 80623 - DNA, 32 bp, Artificial Sequence
  Description of Artificial Sequence: Synthetic oligonucleotide
cccttgcgaatttggggtgctgaataacttgg

SEQ ID NO: 80624 - DNA, 32 bp, Artificial Sequence
  Description of Artificial Sequence: Synthetic oligonucleotide
ccttgcgaatttggggtgctgaataacttggc

SEQ ID NO: 80625 - DNA, 32 bp, Artificial Sequence
  Description of Artificial Sequence: Synthetic oligonucleotide
cttgcgaatttggggtgctgaataacttggcg

SEQ ID NO: 80626 - DNA, 35 bp, Artificial Sequence
  Description of Artificial Sequence: Synthetic oligonucleotide
ttgcgaatttggggtgctgaataacttggcgaatg

SEQ ID NO: 80627 - DNA, 34 bp, Artificial Sequence
  Description of Artificial Sequence: Synthetic oligonucleotide
tgcgaatttggggtgctgaataacttggcgaatg

SEQ ID NO: 80628 - DNA, 33 bp, Artificial Sequence
  Description of Artificial Sequence: Synthetic oligonucleotide
gcgaatttggggtgctgaataacttggcgaatg

SEQ ID NO: 80629 - DNA, 34 bp, Artificial Sequence
  Description of Artificial Sequence: Synthetic oligonucleotide
cgaatttggggtgctgaataacttggcgaatgtc

SEQ ID NO: 80630 - DNA, 34 bp, Artificial Sequence
  Description of Artificial Sequence: Synthetic oligonucleotide
gaatttggggtgctgaataacttggcgaatgtcc

SEQ ID NO: 80631 - DNA, 35 bp, Artificial Sequence
  Description of Artificial Sequence: Synthetic oligonucleotide
aatttggggtgctgaataacttggcgaatgtcctc

SEQ ID NO: 80632 - DNA, 34 bp, Artificial Sequence
  Description of Artificial Sequence: Synthetic oligonucleotide
atttggggtgctgaataacttggcgaatgtcctc

SEQ ID NO: 80633 - DNA, 33 bp, Artificial Sequence
  Description of Artificial Sequence: Synthetic oligonucleotide
tttggggtgctgaataacttggcgaatgtcctc

SEQ ID NO: 80634 - DNA, 32 bp, Artificial Sequence
  Description of Artificial Sequence: Synthetic oligonucleotide
ttggggtgctgaataacttggcgaatgtcctc

SEQ ID NO: 80635 - DNA, 31 bp, Artificial Sequence
  Description of Artificial Sequence: Synthetic oligonucleotide
tggggtgctgaataacttggcgaatgtcctc

SEQ ID NO: 80636 - DNA, 30 bp, Artificial Sequence
  Description of Artificial Sequence: Synthetic oligonucleotide
ggggtgctgaataacttggcgaatgtcctc

SEQ ID NO: 80637 - DNA, 31 bp, Artificial Sequence
  Description of Artificial Sequence: Synthetic oligonucleotide
gggtgctgaataacttggcgaatgtcctctc

SEQ ID NO: 80638 - DNA, 32 bp, Artificial Sequence
  Description of Artificial Sequence: Synthetic oligonucleotide
ggtgctgaataacttggcgaatgtcctctcac

SEQ ID NO: 80639 - DNA, 33 bp, Artificial Sequence
  Description of Artificial Sequence: Synthetic oligonucleotide
gtgctgaataacttggcgaatgtcctctcacag

SEQ ID NO: 80640 - DNA, 33 bp, Artificial Sequence
  Description of Artificial Sequence: Synthetic oligonucleotide
tgctgaataacttggcgaatgtcctctcacagc

SEQ ID NO: 80641 - DNA, 32 bp, Artificial Sequence
  Description of Artificial Sequence: Synthetic oligonucleotide
gctgaataacttggcgaatgtcctctcacagc

SEQ ID NO: 80642 - DNA, 33 bp, Artificial Sequence
  Description of Artificial Sequence: Synthetic oligonucleotide
ctgaataacttggcgaatgtcctctcacagcac

SEQ ID NO: 80643 - DNA, 33 bp, Artificial Sequence
  Description of Artificial Sequence: Synthetic oligonucleotide
tgaataacttggcgaatgtcctctcacagcacc

SEQ ID NO: 80644 - DNA, 32 bp, Artificial Sequence
  Description of Artificial Sequence: Synthetic oligonucleotide
gaataacttggcgaatgtcctctcacagcacc

SEQ ID NO: 80645 - DNA, 33 bp, Artificial Sequence
  Description of Artificial Sequence: Synthetic oligonucleotide
aataacttggcgaatgtcctctcacagcacctc

SEQ ID NO: 80646 - DNA, 32 bp, Artificial Sequence
  Description of Artificial Sequence: Synthetic oligonucleotide
ataacttggcgaatgtcctctcacagcacctc

SEQ ID NO: 80647 - DNA, 31 bp, Artificial Sequence
  Description of Artificial Sequence: Synthetic oligonucleotide
taacttggcgaatgtcctctcacagcacctc

SEQ ID NO: 80648 - DNA, 30 bp, Artificial Sequence
  Description of Artificial Sequence: Synthetic oligonucleotide
aacttggcgaatgtcctctcacagcacctc

SEQ ID NO: 80649 - DNA, 29 bp, Artificial Sequence
  Description of Artificial Sequence: Synthetic oligonucleotide
acttggcgaatgtcctctcacagcacctc

SEQ ID NO: 80650 - DNA, 24 bp, Artificial Sequence
  Description of Artificial Sequence: Synthetic oligonucleotide
atggccctcagagcagggctggtc

SEQ ID NO: 80651 - DNA, 23 bp, Artificial Sequence
  Description of Artificial Sequence: Synthetic oligonucleotide
tggccctcagagcagggctggtc

SEQ ID NO: 80652 - DNA, 22 bp, Artificial Sequence
  Description of Artificial Sequence: Synthetic oligonucleotide
ggccctcagagcagggctggtc

SEQ ID NO: 80653 - DNA, 23 bp, Artificial Sequence
  Description of Artificial Sequence: Synthetic oligonucleotide
gccctcagagcagggctggtcct

SEQ ID NO: 80654 - DNA, 23 bp, Artificial Sequence
  Description of Artificial Sequence: Synthetic oligonucleotide
ccctcagagcagggctggtcctg

SEQ ID NO: 80655 - DNA, 23 bp, Artificial Sequence
  Description of Artificial Sequence: Synthetic oligonucleotide
cctcagagcagggctggtcctgg

SEQ ID NO: 80656 - DNA, 23 bp, Artificial Sequence
  Description of Artificial Sequence: Synthetic oligonucleotide
ctcagagcagggctggtcctggg

SEQ ID NO: 80657 - DNA, 25 bp, Artificial Sequence
  Description of Artificial Sequence: Synthetic oligonucleotide
tcagagcagggctggtcctggggtt

SEQ ID NO: 80658 - DNA, 24 bp, Artificial Sequence
  Description of Artificial Sequence: Synthetic oligonucleotide
cagagcagggctggtcctggggtt

SEQ ID NO: 80659 - DNA, 24 bp, Artificial Sequence
  Description of Artificial Sequence: Synthetic oligonucleotide
agagcagggctggtcctggggttc

SEQ ID NO: 80660 - DNA, 23 bp, Artificial Sequence
  Description of Artificial Sequence: Synthetic oligonucleotide
gagcagggctggtcctggggttc

SEQ ID NO: 80661 - DNA, 24 bp, Artificial Sequence
  Description of Artificial Sequence: Synthetic oligonucleotide
agcagggctggtcctggggttcca

SEQ ID NO: 80662 - DNA, 23 bp, Artificial Sequence
  Description of Artificial Sequence: Synthetic oligonucleotide
gcagggctggtcctggggttcca

SEQ ID NO: 80663 - DNA, 24 bp, Artificial Sequence
  Description of Artificial Sequence: Synthetic oligonucleotide
cagggctggtcctggggttccaca

SEQ ID NO: 80664 - DNA, 24 bp, Artificial Sequence
  Description of Artificial Sequence: Synthetic oligonucleotide
agggctggtcctggggttccacac

SEQ ID NO: 80665 - DNA, 23 bp, Artificial Sequence
  Description of Artificial Sequence: Synthetic oligonucleotide
gggctggtcctggggttccacac

SEQ ID NO: 80666 - DNA, 23 bp, Artificial Sequence
  Description of Artificial Sequence: Synthetic oligonucleotide
ggctggtcctggggttccacacc

SEQ ID NO: 80667 - DNA, 24 bp, Artificial Sequence
  Description of Artificial Sequence: Synthetic oligonucleotide
gctggtcctggggttccacaccct

SEQ ID NO: 80668 - DNA, 26 bp, Artificial Sequence
  Description of Artificial Sequence: Synthetic oligonucleotide
ctggtcctggggttccacaccctgat

SEQ ID NO: 80669 - DNA, 27 bp, Artificial Sequence
  Description of Artificial Sequence: Synthetic oligonucleotide
tggtcctggggttccacaccctgatga

SEQ ID NO: 80670 - DNA, 26 bp, Artificial Sequence
  Description of Artificial Sequence: Synthetic oligonucleotide
ggtcctggggttccacaccctgatga

SEQ ID NO: 80671 - DNA, 26 bp, Artificial Sequence
  Description of Artificial Sequence: Synthetic oligonucleotide
gtcctggggttccacaccctgatgac

SEQ ID NO: 80672 - DNA, 26 bp, Artificial Sequence
  Description of Artificial Sequence: Synthetic oligonucleotide
tcctggggttccacaccctgatgacc

SEQ ID NO: 80673 - DNA, 25 bp, Artificial Sequence
  Description of Artificial Sequence: Synthetic oligonucleotide
cctggggttccacaccctgatgacc

SEQ ID NO: 80674 - DNA, 26 bp, Artificial Sequence
  Description of Artificial Sequence: Synthetic oligonucleotide
ctggggttccacaccctgatgaccct

SEQ ID NO: 80675 - DNA, 26 bp, Artificial Sequence
  Description of Artificial Sequence: Synthetic oligonucleotide
tggggttccacaccctgatgaccctc

SEQ ID NO: 80676 - DNA, 25 bp, Artificial Sequence
  Description of Artificial Sequence: Synthetic oligonucleotide
ggggttccacaccctgatgaccctc

SEQ ID NO: 80677 - DNA, 26 bp, Artificial Sequence
  Description of Artificial Sequence: Synthetic oligonucleotide
gggttccacaccctgatgaccctcct

SEQ ID NO: 80678 - DNA, 27 bp, Artificial Sequence
  Description of Artificial Sequence: Synthetic oligonucleotide
ggttccacaccctgatgaccctcctga

SEQ ID NO: 80679 - DNA, 27 bp, Artificial Sequence
  Description of Artificial Sequence: Synthetic oligonucleotide
gttccacaccctgatgaccctcctgag

SEQ ID NO: 80680 - DNA, 27 bp, Artificial Sequence
  Description of Artificial Sequence: Synthetic oligonucleotide
ttccacaccctgatgaccctcctgagc

SEQ ID NO: 80681 - DNA, 26 bp, Artificial Sequence
  Description of Artificial Sequence: Synthetic oligonucleotide
tccacaccctgatgaccctcctgagc

SEQ ID NO: 80682 - DNA, 25 bp, Artificial Sequence
  Description of Artificial Sequence: Synthetic oligonucleotide
ccacaccctgatgaccctcctgagc

SEQ ID NO: 80683 - DNA, 25 bp, Artificial Sequence
  Description of Artificial Sequence: Synthetic oligonucleotide
cacaccctgatgaccctcctgagcc

SEQ ID NO: 80684 - DNA, 25 bp, Artificial Sequence
  Description of Artificial Sequence: Synthetic oligonucleotide
acaccctgatgaccctcctgagccc

SEQ ID NO: 80685 - DNA, 24 bp, Artificial Sequence
  Description of Artificial Sequence: Synthetic oligonucleotide
caccctgatgaccctcctgagccc

SEQ ID NO: 80686 - DNA, 24 bp, Artificial Sequence
  Description of Artificial Sequence: Synthetic oligonucleotide
accctgatgaccctcctgagcccg

SEQ ID NO: 80687 - DNA, 23 bp, Artificial Sequence
  Description of Artificial Sequence: Synthetic oligonucleotide
ccctgatgaccctcctgagcccg

SEQ ID NO: 80688 - DNA, 24 bp, Artificial Sequence
  Description of Artificial Sequence: Synthetic oligonucleotide
cctgatgaccctcctgagcccgca

SEQ ID NO: 80689 - DNA, 24 bp, Artificial Sequence
  Description of Artificial Sequence: Synthetic oligonucleotide
ctgatgaccctcctgagcccgcag

SEQ ID NO: 80690 - DNA, 25 bp, Artificial Sequence
  Description of Artificial Sequence: Synthetic oligonucleotide
tgatgaccctcctgagcccgcagga

SEQ ID NO: 80691 - DNA, 24 bp, Artificial Sequence
  Description of Artificial Sequence: Synthetic oligonucleotide
gatgaccctcctgagcccgcagga

SEQ ID NO: 80692 - DNA, 24 bp, Artificial Sequence
  Description of Artificial Sequence: Synthetic oligonucleotide
atgaccctcctgagcccgcaggag

SEQ ID NO: 80693 - DNA, 23 bp, Artificial Sequence
  Description of Artificial Sequence: Synthetic oligonucleotide
tgaccctcctgagcccgcaggag

SEQ ID NO: 80694 - DNA, 22 bp, Artificial Sequence
  Description of Artificial Sequence: Synthetic oligonucleotide
gaccctcctgagcccgcaggag

SEQ ID NO: 80695 - DNA, 22 bp, Artificial Sequence
  Description of Artificial Sequence: Synthetic oligonucleotide
accctcctgagcccgcaggagg

SEQ ID NO: 80696 - DNA, 21 bp, Artificial Sequence
  Description of Artificial Sequence: Synthetic oligonucleotide
ccctcctgagcccgcaggagg

SEQ ID NO: 80697 - DNA, 22 bp, Artificial Sequence
  Description of Artificial Sequence: Synthetic oligonucleotide
cctcctgagcccgcaggaggca

SEQ ID NO: 80698 - DNA, 22 bp, Artificial Sequence
  Description of Artificial Sequence: Synthetic oligonucleotide
ctcctgagcccgcaggaggcag

SEQ ID NO: 80699 - DNA, 22 bp, Artificial Sequence
  Description of Artificial Sequence: Synthetic oligonucleotide
tcctgagcccgcaggaggcagg

SEQ ID NO: 80700 - DNA, 21 bp, Artificial Sequence
  Description of Artificial Sequence: Synthetic oligonucleotide
cctgagcccgcaggaggcagg

SEQ ID NO: 80701 - DNA, 21 bp, Artificial Sequence
  Description of Artificial Sequence: Synthetic oligonucleotide
ctgagcccgcaggaggcaggg

SEQ ID NO: 80702 - DNA, 21 bp, Artificial Sequence
  Description of Artificial Sequence: Synthetic oligonucleotide
tgagcccgcaggaggcagggg

SEQ ID NO: 80703 - DNA, 20 bp, Artificial Sequence
  Description of Artificial Sequence: Synthetic oligonucleotide
gagcccgcaggaggcagggg

SEQ ID NO: 80704 - DNA, 20 bp, Artificial Sequence
  Description of Artificial Sequence: Synthetic oligonucleotide
agcccgcaggaggcaggggc

SEQ ID NO: 80705 - DNA, 20 bp, Artificial Sequence
  Description of Artificial Sequence: Synthetic oligonucleotide
gcccgcaggaggcaggggct

SEQ ID NO: 80706 - DNA, 20 bp, Artificial Sequence
  Description of Artificial Sequence: Synthetic oligonucleotide
cccgcaggaggcaggggcca

SEQ ID NO: 80707 - DNA, 20 bp, Artificial Sequence
  Description of Artificial Sequence: Synthetic oligonucleotide
ccgcaggaggcaggggccac

SEQ ID NO: 80708 - DNA, 22 bp, Artificial Sequence
  Description of Artificial Sequence: Synthetic oligonucleotide
cgcaggaggcaggggccaccaa

SEQ ID NO: 80709 - DNA, 22 bp, Artificial Sequence
  Description of Artificial Sequence: Synthetic oligonucleotide
gcaggaggcaggggccaccaag

SEQ ID NO: 80710 - DNA, 22 bp, Artificial Sequence
  Description of Artificial Sequence: Synthetic oligonucleotide
caggaggcaggggccaccaagg

SEQ ID NO: 80711 - DNA, 23 bp, Artificial Sequence
  Description of Artificial Sequence: Synthetic oligonucleotide
aggaggcaggggccaccaaggct

SEQ ID NO: 80712 - DNA, 22 bp, Artificial Sequence
  Description of Artificial Sequence: Synthetic oligonucleotide
ggaggcaggggccaccaaggct

SEQ ID NO: 80713 - DNA, 23 bp, Artificial Sequence
  Description of Artificial Sequence: Synthetic oligonucleotide
gaggcaggggccaccaaggctga

SEQ ID NO: 80714 - DNA, 23 bp, Artificial Sequence
  Description of Artificial Sequence: Synthetic oligonucleotide
aggcaggggccaccaaggctgac

SEQ ID NO: 80715 - DNA, 22 bp, Artificial Sequence
  Description of Artificial Sequence: Synthetic oligonucleotide
ggcaggggccaccaaggctgac

SEQ ID NO: 80716 - DNA, 23 bp, Artificial Sequence
  Description of Artificial Sequence: Synthetic oligonucleotide
gcaggggccaccaaggctgacca

SEQ ID NO: 80717 - DNA, 25 bp, Artificial Sequence
  Description of Artificial Sequence: Synthetic oligonucleotide
caggggccaccaaggctgaccacat

SEQ ID NO: 80718 - DNA, 25 bp, Artificial Sequence
  Description of Artificial Sequence: Synthetic oligonucleotide
aggggccaccaaggctgaccacatg

SEQ ID NO: 80719 - DNA, 24 bp, Artificial Sequence
  Description of Artificial Sequence: Synthetic oligonucleotide
ggggccaccaaggctgaccacatg

SEQ ID NO: 80720 - DNA, 24 bp, Artificial Sequence
  Description of Artificial Sequence: Synthetic oligonucleotide
gggccaccaaggctgaccacatgg

SEQ ID NO: 80721 - DNA, 24 bp, Artificial Sequence
  Description of Artificial Sequence: Synthetic oligonucleotide
ggccaccaaggctgaccacatggg

SEQ ID NO: 80722 - DNA, 25 bp, Artificial Sequence
  Description of Artificial Sequence: Synthetic oligonucleotide
gccaccaaggctgaccacatgggct

SEQ ID NO: 80723 - DNA, 25 bp, Artificial Sequence
  Description of Artificial Sequence: Synthetic oligonucleotide
ccaccaaggctgaccacatgggctc

SEQ ID NO: 80724 - DNA, 27 bp, Artificial Sequence
  Description of Artificial Sequence: Synthetic oligonucleotide
caccaaggctgaccacatgggctccta

SEQ ID NO: 80725 - DNA, 27 bp, Artificial Sequence
  Description of Artificial Sequence: Synthetic oligonucleotide
accaaggctgaccacatgggctcctac

SEQ ID NO: 80726 - DNA, 26 bp, Artificial Sequence
  Description of Artificial Sequence: Synthetic oligonucleotide
ccaaggctgaccacatgggctcctac

SEQ ID NO: 80727 - DNA, 26 bp, Artificial Sequence
  Description of Artificial Sequence: Synthetic oligonucleotide
caaggctgaccacatgggctcctacg

SEQ ID NO: 80728 - DNA, 27 bp, Artificial Sequence
  Description of Artificial Sequence: Synthetic oligonucleotide
aaggctgaccacatgggctcctacgga

SEQ ID NO: 80729 - DNA, 26 bp, Artificial Sequence
  Description of Artificial Sequence: Synthetic oligonucleotide
aggctgaccacatgggctcctacgga

SEQ ID NO: 80730 - DNA, 25 bp, Artificial Sequence
  Description of Artificial Sequence: Synthetic oligonucleotide
ggctgaccacatgggctcctacgga

SEQ ID NO: 80731 - DNA, 25 bp, Artificial Sequence
  Description of Artificial Sequence: Synthetic oligonucleotide
gctgaccacatgggctcctacggac

SEQ ID NO: 80732 - DNA, 25 bp, Artificial Sequence
  Description of Artificial Sequence: Synthetic oligonucleotide
ctgaccacatgggctcctacggacc

SEQ ID NO: 80733 - DNA, 25 bp, Artificial Sequence
  Description of Artificial Sequence: Synthetic oligonucleotide
tgaccacatgggctcctacggaccc

SEQ ID NO: 80734 - DNA, 24 bp, Artificial Sequence
  Description of Artificial Sequence: Synthetic oligonucleotide
gaccacatgggctcctacggaccc

SEQ ID NO: 80735 - DNA, 24 bp, Artificial Sequence
  Description of Artificial Sequence: Synthetic oligonucleotide
accacatgggctcctacggacccg

SEQ ID NO: 80736 - DNA, 23 bp, Artificial Sequence
  Description of Artificial Sequence: Synthetic oligonucleotide
ccacatgggctcctacggacccg

SEQ ID NO: 80737 - DNA, 23 bp, Artificial Sequence
  Description of Artificial Sequence: Synthetic oligonucleotide
cacatgggctcctacggacccgc

SEQ ID NO: 80738 - DNA, 25 bp, Artificial Sequence
  Description of Artificial Sequence: Synthetic oligonucleotide
acatgggctcctacggacccgcctt

SEQ ID NO: 80739 - DNA, 24 bp, Artificial Sequence
  Description of Artificial Sequence: Synthetic oligonucleotide
catgggctcctacggacccgcctt

SEQ ID NO: 80740 - DNA, 26 bp, Artificial Sequence
  Description of Artificial Sequence: Synthetic oligonucleotide
atgggctcctacggacccgccttcta

SEQ ID NO: 80741 - DNA, 25 bp, Artificial Sequence
  Description of Artificial Sequence: Synthetic oligonucleotide
tgggctcctacggacccgccttcta

SEQ ID NO: 80742 - DNA, 24 bp, Artificial Sequence
  Description of Artificial Sequence: Synthetic oligonucleotide
gggctcctacggacccgccttcta

SEQ ID NO: 80743 - DNA, 24 bp, Artificial Sequence
  Description of Artificial Sequence: Synthetic oligonucleotide
ggctcctacggacccgccttctac

SEQ ID NO: 80744 - DNA, 25 bp, Artificial Sequence
  Description of Artificial Sequence: Synthetic oligonucleotide
gctcctacggacccgccttctacca

SEQ ID NO: 80745 - DNA, 26 bp, Artificial Sequence
  Description of Artificial Sequence: Synthetic oligonucleotide
ctcctacggacccgccttctaccagt

SEQ ID NO: 80746 - DNA, 27 bp, Artificial Sequence
  Description of Artificial Sequence: Synthetic oligonucleotide
tcctacggacccgccttctaccagtct

SEQ ID NO: 80747 - DNA, 27 bp, Artificial Sequence
  Description of Artificial Sequence: Synthetic oligonucleotide
cctacggacccgccttctaccagtctt

SEQ ID NO: 80748 - DNA, 28 bp, Artificial Sequence
  Description of Artificial Sequence: Synthetic oligonucleotide
ctacggacccgccttctaccagtcttac

SEQ ID NO: 80749 - DNA, 28 bp, Artificial Sequence
  Description of Artificial Sequence: Synthetic oligonucleotide
tacggacccgccttctaccagtcttacg

SEQ ID NO: 80750 - DNA, 27 bp, Artificial Sequence
  Description of Artificial Sequence: Synthetic oligonucleotide
acggacccgccttctaccagtcttacg

SEQ ID NO: 80751 - DNA, 26 bp, Artificial Sequence
  Description of Artificial Sequence: Synthetic oligonucleotide
cggacccgccttctaccagtcttacg

SEQ ID NO: 80752 - DNA, 26 bp, Artificial Sequence
  Description of Artificial Sequence: Synthetic oligonucleotide
ggacccgccttctaccagtcttacgg

SEQ ID NO: 80753 - DNA, 26 bp, Artificial Sequence
  Description of Artificial Sequence: Synthetic oligonucleotide
gacccgccttctaccagtcttacggc

SEQ ID NO: 80754 - DNA, 26 bp, Artificial Sequence
  Description of Artificial Sequence: Synthetic oligonucleotide
acccgccttctaccagtcttacggcg

SEQ ID NO: 80755 - DNA, 25 bp, Artificial Sequence
  Description of Artificial Sequence: Synthetic oligonucleotide
cccgccttctaccagtcttacggcg

SEQ ID NO: 80756 - DNA, 25 bp, Artificial Sequence
  Description of Artificial Sequence: Synthetic oligonucleotide
ccgccttctaccagtcttacggcgc

SEQ ID NO: 80757 - DNA, 26 bp, Artificial Sequence
  Description of Artificial Sequence: Synthetic oligonucleotide
cgccttctaccagtcttacggcgcct

SEQ ID NO: 80758 - DNA, 26 bp, Artificial Sequence
  Description of Artificial Sequence: Synthetic oligonucleotide
gccttctaccagtcttacggcgcctc

SEQ ID NO: 80759 - DNA, 26 bp, Artificial Sequence
  Description of Artificial Sequence: Synthetic oligonucleotide
ccttctaccagtcttacggcgcctcg

SEQ ID NO: 80760 - DNA, 26 bp, Artificial Sequence
  Description of Artificial Sequence: Synthetic oligonucleotide
cttctaccagtcttacggcgcctcgg

SEQ ID NO: 80761 - DNA, 26 bp, Artificial Sequence
  Description of Artificial Sequence: Synthetic oligonucleotide
ttctaccagtcttacggcgcctcggg

SEQ ID NO: 80762 - DNA, 25 bp, Artificial Sequence
  Description of Artificial Sequence: Synthetic oligonucleotide
tctaccagtcttacggcgcctcggg

SEQ ID NO: 80763 - DNA, 24 bp, Artificial Sequence
  Description of Artificial Sequence: Synthetic oligonucleotide
ctaccagtcttacggcgcctcggg

SEQ ID NO: 80764 - DNA, 24 bp, Artificial Sequence
  Description of Artificial Sequence: Synthetic oligonucleotide
taccagtcttacggcgcctcgggc

SEQ ID NO: 80765 - DNA, 23 bp, Artificial Sequence
  Description of Artificial Sequence: Synthetic oligonucleotide
accagtcttacggcgcctcgggc

SEQ ID NO: 80766 - DNA, 22 bp, Artificial Sequence
  Description of Artificial Sequence: Synthetic oligonucleotide
ccagtcttacggcgcctcgggc

SEQ ID NO: 80767 - DNA, 23 bp, Artificial Sequence
  Description of Artificial Sequence: Synthetic oligonucleotide
cagtcttacggcgcctcgggcca

SEQ ID NO: 80768 - DNA, 25 bp, Artificial Sequence
  Description of Artificial Sequence: Synthetic oligonucleotide
agtcttacggcgcctcgggccagtt

SEQ ID NO: 80769 - DNA, 24 bp, Artificial Sequence
  Description of Artificial Sequence: Synthetic oligonucleotide
gtcttacggcgcctcgggccagtt

SEQ ID NO: 80770 - DNA, 25 bp, Artificial Sequence
  Description of Artificial Sequence: Synthetic oligonucleotide
tcttacggcgcctcgggccagttca

SEQ ID NO: 80771 - DNA, 24 bp, Artificial Sequence
  Description of Artificial Sequence: Synthetic oligonucleotide
cttacggcgcctcgggccagttca

SEQ ID NO: 80772 - DNA, 24 bp, Artificial Sequence
  Description of Artificial Sequence: Synthetic oligonucleotide
ttacggcgcctcgggccagttcac

SEQ ID NO: 80773 - DNA, 23 bp, Artificial Sequence
  Description of Artificial Sequence: Synthetic oligonucleotide
tacggcgcctcgggccagttcac

SEQ ID NO: 80774 - DNA, 22 bp, Artificial Sequence
  Description of Artificial Sequence: Synthetic oligonucleotide
acggcgcctcgggccagttcac

SEQ ID NO: 80775 - DNA, 21 bp, Artificial Sequence
  Description of Artificial Sequence: Synthetic oligonucleotide
cggcgcctcgggccagttcac

SEQ ID NO: 80776 - DNA, 21 bp, Artificial Sequence
  Description of Artificial Sequence: Synthetic oligonucleotide
ggcgcctcgggccagttcacc

SEQ ID NO: 80777 - DNA, 23 bp, Artificial Sequence
  Description of Artificial Sequence: Synthetic oligonucleotide
gcgcctcgggccagttcacccat

SEQ ID NO: 80778 - DNA, 27 bp, Artificial Sequence
  Description of Artificial Sequence: Synthetic oligonucleotide
cgcctcgggccagttcacccatgaatt

SEQ ID NO: 80779 - DNA, 28 bp, Artificial Sequence
  Description of Artificial Sequence: Synthetic oligonucleotide
gcctcgggccagttcacccatgaatttg

SEQ ID NO: 80780 - DNA, 30 bp, Artificial Sequence
  Description of Artificial Sequence: Synthetic oligonucleotide
cctcgggccagttcacccatgaatttgatg

SEQ ID NO: 80781 - DNA, 31 bp, Artificial Sequence
  Description of Artificial Sequence: Synthetic oligonucleotide
ctcgggccagttcacccatgaatttgatgag

SEQ ID NO: 80782 - DNA, 31 bp, Artificial Sequence
  Description of Artificial Sequence: Synthetic oligonucleotide
tcgggccagttcacccatgaatttgatgagg

SEQ ID NO: 80783 - DNA, 30 bp, Artificial Sequence
  Description of Artificial Sequence: Synthetic oligonucleotide
cgggccagttcacccatgaatttgatgagg

SEQ ID NO: 80784 - DNA, 32 bp, Artificial Sequence
  Description of Artificial Sequence: Synthetic oligonucleotide
gggccagttcacccatgaatttgatgaggaac

SEQ ID NO: 80785 - DNA, 33 bp, Artificial Sequence
  Description of Artificial Sequence: Synthetic oligonucleotide
ggccagttcacccatgaatttgatgaggaacag

SEQ ID NO: 80786 - DNA, 33 bp, Artificial Sequence
  Description of Artificial Sequence: Synthetic oligonucleotide
gccagttcacccatgaatttgatgaggaacagc

SEQ ID NO: 80787 - DNA, 34 bp, Artificial Sequence
  Description of Artificial Sequence: Synthetic oligonucleotide
ccagttcacccatgaatttgatgaggaacagctg

SEQ ID NO: 80788 - DNA, 36 bp, Artificial Sequence
  Description of Artificial Sequence: Synthetic oligonucleotide
cagttcacccatgaatttgatgaggaacagctgttc

SEQ ID NO: 80789 - DNA, 37 bp, Artificial Sequence
  Description of Artificial Sequence: Synthetic oligonucleotide
agttcacccatgaatttgatgaggaacagctgttctc

SEQ ID NO: 80790 - DNA, 36 bp, Artificial Sequence
  Description of Artificial Sequence: Synthetic oligonucleotide
gttcacccatgaatttgatgaggaacagctgttctc

SEQ ID NO: 80791 - DNA, 37 bp, Artificial Sequence
  Description of Artificial Sequence: Synthetic oligonucleotide
ttcacccatgaatttgatgaggaacagctgttctctg

SEQ ID NO: 80792 - DNA, 36 bp, Artificial Sequence
  Description of Artificial Sequence: Synthetic oligonucleotide
tcacccatgaatttgatgaggaacagctgttctctg

SEQ ID NO: 80793 - DNA, 35 bp, Artificial Sequence
  Description of Artificial Sequence: Synthetic oligonucleotide
cacccatgaatttgatgaggaacagctgttctctg

SEQ ID NO: 80794 - DNA, 36 bp, Artificial Sequence
  Description of Artificial Sequence: Synthetic oligonucleotide
acccatgaatttgatgaggaacagctgttctctgtg

SEQ ID NO: 80795 - DNA, 35 bp, Artificial Sequence
  Description of Artificial Sequence: Synthetic oligonucleotide
cccatgaatttgatgaggaacagctgttctctgtg

SEQ ID NO: 80796 - DNA, 35 bp, Artificial Sequence
  Description of Artificial Sequence: Synthetic oligonucleotide
ccatgaatttgatgaggaacagctgttctctgtgg

SEQ ID NO: 80797 - DNA, 36 bp, Artificial Sequence
  Description of Artificial Sequence: Synthetic oligonucleotide
catgaatttgatgaggaacagctgttctctgtggac

SEQ ID NO: 80798 - DNA, 36 bp, Artificial Sequence
  Description of Artificial Sequence: Synthetic oligonucleotide
atgaatttgatgaggaacagctgttctctgtggacc

SEQ ID NO: 80799 - DNA, 35 bp, Artificial Sequence
  Description of Artificial Sequence: Synthetic oligonucleotide
tgaatttgatgaggaacagctgttctctgtggacc

SEQ ID NO: 80800 - DNA, 34 bp, Artificial Sequence
  Description of Artificial Sequence: Synthetic oligonucleotide
gaatttgatgaggaacagctgttctctgtggacc

SEQ ID NO: 80801 - DNA, 35 bp, Artificial Sequence
  Description of Artificial Sequence: Synthetic oligonucleotide
aatttgatgaggaacagctgttctctgtggacctg

SEQ ID NO: 80802 - DNA, 34 bp, Artificial Sequence
  Description of Artificial Sequence: Synthetic oligonucleotide
atttgatgaggaacagctgttctctgtggacctg

SEQ ID NO: 80803 - DNA, 33 bp, Artificial Sequence
  Description of Artificial Sequence: Synthetic oligonucleotide
tttgatgaggaacagctgttctctgtggacctg

SEQ ID NO: 80804 - DNA, 32 bp, Artificial Sequence
  Description of Artificial Sequence: Synthetic oligonucleotide
ttgatgaggaacagctgttctctgtggacctg

SEQ ID NO: 80805 - DNA, 31 bp, Artificial Sequence
  Description of Artificial Sequence: Synthetic oligonucleotide
tgatgaggaacagctgttctctgtggacctg

SEQ ID NO: 80806 - DNA, 30 bp, Artificial Sequence
  Description of Artificial Sequence: Synthetic oligonucleotide
gatgaggaacagctgttctctgtggacctg

SEQ ID NO: 80807 - DNA, 32 bp, Artificial Sequence
  Description of Artificial Sequence: Synthetic oligonucleotide
atgaggaacagctgttctctgtggacctgaag

SEQ ID NO: 80808 - DNA, 31 bp, Artificial Sequence
  Description of Artificial Sequence: Synthetic oligonucleotide
tgaggaacagctgttctctgtggacctgaag

SEQ ID NO: 80809 - DNA, 30 bp, Artificial Sequence
  Description of Artificial Sequence: Synthetic oligonucleotide
gaggaacagctgttctctgtggacctgaag

SEQ ID NO: 80810 - DNA, 34 bp, Artificial Sequence
  Description of Artificial Sequence: Synthetic oligonucleotide
aggaacagctgttctctgtggacctgaagaaaag

SEQ ID NO: 80811 - DNA, 33 bp, Artificial Sequence
  Description of Artificial Sequence: Synthetic oligonucleotide
ggaacagctgttctctgtggacctgaagaaaag

SEQ ID NO: 80812 - DNA, 33 bp, Artificial Sequence
  Description of Artificial Sequence: Synthetic oligonucleotide
gaacagctgttctctgtggacctgaagaaaagc

SEQ ID NO: 80813 - DNA, 33 bp, Artificial Sequence
  Description of Artificial Sequence: Synthetic oligonucleotide
aacagctgttctctgtggacctgaagaaaagcg

SEQ ID NO: 80814 - DNA, 32 bp, Artificial Sequence
  Description of Artificial Sequence: Synthetic oligonucleotide
acagctgttctctgtggacctgaagaaaagcg

SEQ ID NO: 80815 - DNA, 31 bp, Artificial Sequence
  Description of Artificial Sequence: Synthetic oligonucleotide
cagctgttctctgtggacctgaagaaaagcg

SEQ ID NO: 80816 - DNA, 32 bp, Artificial Sequence
  Description of Artificial Sequence: Synthetic oligonucleotide
agctgttctctgtggacctgaagaaaagcgag

SEQ ID NO: 80817 - DNA, 31 bp, Artificial Sequence
  Description of Artificial Sequence: Synthetic oligonucleotide
gctgttctctgtggacctgaagaaaagcgag

SEQ ID NO: 80818 - DNA, 31 bp, Artificial Sequence
  Description of Artificial Sequence: Synthetic oligonucleotide
ctgttctctgtggacctgaagaaaagcgagg

SEQ ID NO: 80819 - DNA, 31 bp, Artificial Sequence
  Description of Artificial Sequence: Synthetic oligonucleotide
tgttctctgtggacctgaagaaaagcgaggc

SEQ ID NO: 80820 - DNA, 30 bp, Artificial Sequence
  Description of Artificial Sequence: Synthetic oligonucleotide
gttctctgtggacctgaagaaaagcgaggc

SEQ ID NO: 80821 - DNA, 30 bp, Artificial Sequence
  Description of Artificial Sequence: Synthetic oligonucleotide
ttctctgtggacctgaagaaaagcgaggcc

SEQ ID NO: 80822 - DNA, 29 bp, Artificial Sequence
  Description of Artificial Sequence: Synthetic oligonucleotide
tctctgtggacctgaagaaaagcgaggcc

SEQ ID NO: 80823 - DNA, 28 bp, Artificial Sequence
  Description of Artificial Sequence: Synthetic oligonucleotide
ctctgtggacctgaagaaaagcgaggcc

SEQ ID NO: 80824 - DNA, 28 bp, Artificial Sequence
  Description of Artificial Sequence: Synthetic oligonucleotide
tctgtggacctgaagaaaagcgaggccg

SEQ ID NO: 80825 - DNA, 27 bp, Artificial Sequence
  Description of Artificial Sequence: Synthetic oligonucleotide
ctgtggacctgaagaaaagcgaggccg

SEQ ID NO: 80826 - DNA, 28 bp, Artificial Sequence
  Description of Artificial Sequence: Synthetic oligonucleotide
tgtggacctgaagaaaagcgaggccgtg

SEQ ID NO: 80827 - DNA, 27 bp, Artificial Sequence
  Description of Artificial Sequence: Synthetic oligonucleotide
gtggacctgaagaaaagcgaggccgtg

SEQ ID NO: 80828 - DNA, 28 bp, Artificial Sequence
  Description of Artificial Sequence: Synthetic oligonucleotide
tggacctgaagaaaagcgaggccgtgtg

SEQ ID NO: 80829 - DNA, 27 bp, Artificial Sequence
  Description of Artificial Sequence: Synthetic oligonucleotide
ggacctgaagaaaagcgaggccgtgtg

SEQ ID NO: 80830 - DNA, 27 bp, Artificial Sequence
  Description of Artificial Sequence: Synthetic oligonucleotide
gacctgaagaaaagcgaggccgtgtgg

SEQ ID NO: 80831 - DNA, 27 bp, Artificial Sequence
  Description of Artificial Sequence: Synthetic oligonucleotide
acctgaagaaaagcgaggccgtgtggc

SEQ ID NO: 80832 - DNA, 26 bp, Artificial Sequence
  Description of Artificial Sequence: Synthetic oligonucleotide
cctgaagaaaagcgaggccgtgtggc

SEQ ID NO: 80833 - DNA, 27 bp, Artificial Sequence
  Description of Artificial Sequence: Synthetic oligonucleotide
ctgaagaaaagcgaggccgtgtggcgt

SEQ ID NO: 80834 - DNA, 27 bp, Artificial Sequence
  Description of Artificial Sequence: Synthetic oligonucleotide
tgaagaaaagcgaggccgtgtggcgtc

SEQ ID NO: 80835 - DNA, 27 bp, Artificial Sequence
  Description of Artificial Sequence: Synthetic oligonucleotide
gaagaaaagcgaggccgtgtggcgtct

SEQ ID NO: 80836 - DNA, 27 bp, Artificial Sequence
  Description of Artificial Sequence: Synthetic oligonucleotide
aagaaaagcgaggccgtgtggcgtctg

SEQ ID NO: 80837 - DNA, 26 bp, Artificial Sequence
  Description of Artificial Sequence: Synthetic oligonucleotide
agaaaagcgaggccgtgtggcgtctg

SEQ ID NO: 80838 - DNA, 25 bp, Artificial Sequence
  Description of Artificial Sequence: Synthetic oligonucleotide
gaaaagcgaggccgtgtggcgtctg

SEQ ID NO: 80839 - DNA, 25 bp, Artificial Sequence
  Description of Artificial Sequence: Synthetic oligonucleotide
aaaagcgaggccgtgtggcgtctgc

SEQ ID NO: 80840 - DNA, 24 bp, Artificial Sequence
  Description of Artificial Sequence: Synthetic oligonucleotide
aaagcgaggccgtgtggcgtctgc

SEQ ID NO: 80841 - DNA, 23 bp, Artificial Sequence
  Description of Artificial Sequence: Synthetic oligonucleotide
aagcgaggccgtgtggcgtctgc

SEQ ID NO: 80842 - DNA, 22 bp, Artificial Sequence
  Description of Artificial Sequence: Synthetic oligonucleotide
agcgaggccgtgtggcgtctgc

SEQ ID NO: 80843 - DNA, 21 bp, Artificial Sequence
  Description of Artificial Sequence: Synthetic oligonucleotide
gcgaggccgtgtggcgtctgc

SEQ ID NO: 80844 - DNA, 22 bp, Artificial Sequence
  Description of Artificial Sequence: Synthetic oligonucleotide
cgaggccgtgtggcgtctgcct

SEQ ID NO: 80845 - DNA, 23 bp, Artificial Sequence
  Description of Artificial Sequence: Synthetic oligonucleotide
gaggccgtgtggcgtctgcctga

SEQ ID NO: 80846 - DNA, 26 bp, Artificial Sequence
  Description of Artificial Sequence: Synthetic oligonucleotide
aggccgtgtggcgtctgcctgagttt

SEQ ID NO: 80847 - DNA, 25 bp, Artificial Sequence
  Description of Artificial Sequence: Synthetic oligonucleotide
ggccgtgtggcgtctgcctgagttt

SEQ ID NO: 80848 - DNA, 25 bp, Artificial Sequence
  Description of Artificial Sequence: Synthetic oligonucleotide
gccgtgtggcgtctgcctgagtttg

SEQ ID NO: 80849 - DNA, 26 bp, Artificial Sequence
  Description of Artificial Sequence: Synthetic oligonucleotide
ccgtgtggcgtctgcctgagtttggt

SEQ ID NO: 80850 - DNA, 27 bp, Artificial Sequence
  Description of Artificial Sequence: Synthetic oligonucleotide
cgtgtggcgtctgcctgagtttggtga

SEQ ID NO: 80851 - DNA, 27 bp, Artificial Sequence
  Description of Artificial Sequence: Synthetic oligonucleotide
gtgtggcgtctgcctgagtttggtgac

SEQ ID NO: 80852 - DNA, 30 bp, Artificial Sequence
  Description of Artificial Sequence: Synthetic oligonucleotide
tgtggcgtctgcctgagtttggtgactttg

SEQ ID NO: 80853 - DNA, 29 bp, Artificial Sequence
  Description of Artificial Sequence: Synthetic oligonucleotide
gtggcgtctgcctgagtttggtgactttg

SEQ ID NO: 80854 - DNA, 29 bp, Artificial Sequence
  Description of Artificial Sequence: Synthetic oligonucleotide
tggcgtctgcctgagtttggtgactttgc

SEQ ID NO: 80855 - DNA, 28 bp, Artificial Sequence
  Description of Artificial Sequence: Synthetic oligonucleotide
ggcgtctgcctgagtttggtgactttgc

SEQ ID NO: 80856 - DNA, 28 bp, Artificial Sequence
  Description of Artificial Sequence: Synthetic oligonucleotide
gcgtctgcctgagtttggtgactttgcc

SEQ ID NO: 80857 - DNA, 28 bp, Artificial Sequence
  Description of Artificial Sequence: Synthetic oligonucleotide
cgtctgcctgagtttggtgactttgccc

SEQ ID NO: 80858 - DNA, 28 bp, Artificial Sequence
  Description of Artificial Sequence: Synthetic oligonucleotide
gtctgcctgagtttggtgactttgcccg

SEQ ID NO: 80859 - DNA, 28 bp, Artificial Sequence
  Description of Artificial Sequence: Synthetic oligonucleotide
tctgcctgagtttggtgactttgcccgc

SEQ ID NO: 80860 - DNA, 27 bp, Artificial Sequence
  Description of Artificial Sequence: Synthetic oligonucleotide
ctgcctgagtttggtgactttgcccgc

SEQ ID NO: 80861 - DNA, 30 bp, Artificial Sequence
  Description of Artificial Sequence: Synthetic oligonucleotide
tgcctgagtttggtgactttgcccgctttg

SEQ ID NO: 80862 - DNA, 29 bp, Artificial Sequence
  Description of Artificial Sequence: Synthetic oligonucleotide
gcctgagtttggtgactttgcccgctttg

SEQ ID NO: 80863 - DNA, 30 bp, Artificial Sequence
  Description of Artificial Sequence: Synthetic oligonucleotide
cctgagtttggtgactttgcccgctttgac

SEQ ID NO: 80864 - DNA, 30 bp, Artificial Sequence
  Description of Artificial Sequence: Synthetic oligonucleotide
ctgagtttggtgactttgcccgctttgacc

SEQ ID NO: 80865 - DNA, 30 bp, Artificial Sequence
  Description of Artificial Sequence: Synthetic oligonucleotide
tgagtttggtgactttgcccgctttgaccc

SEQ ID NO: 80866 - DNA, 29 bp, Artificial Sequence
  Description of Artificial Sequence: Synthetic oligonucleotide
gagtttggtgactttgcccgctttgaccc

SEQ ID NO: 80867 - DNA, 29 bp, Artificial Sequence
  Description of Artificial Sequence: Synthetic oligonucleotide
agtttggtgactttgcccgctttgacccg

SEQ ID NO: 80868 - DNA, 28 bp, Artificial Sequence
  Description of Artificial Sequence: Synthetic oligonucleotide
gtttggtgactttgcccgctttgacccg

SEQ ID NO: 80869 - DNA, 28 bp, Artificial Sequence
  Description of Artificial Sequence: Synthetic oligonucleotide
tttggtgactttgcccgctttgacccgc

SEQ ID NO: 80870 - DNA, 27 bp, Artificial Sequence
  Description of Artificial Sequence: Synthetic oligonucleotide
ttggtgactttgcccgctttgacccgc

SEQ ID NO: 80871 - DNA, 27 bp, Artificial Sequence
  Description of Artificial Sequence: Synthetic oligonucleotide
tggtgactttgcccgctttgacccgca

SEQ ID NO: 80872 - DNA, 26 bp, Artificial Sequence
  Description of Artificial Sequence: Synthetic oligonucleotide
ggtgactttgcccgctttgacccgca

SEQ ID NO: 80873 - DNA, 26 bp, Artificial Sequence
  Description of Artificial Sequence: Synthetic oligonucleotide
gtgactttgcccgctttgacccgcag

SEQ ID NO: 80874 - DNA, 26 bp, Artificial Sequence
  Description of Artificial Sequence: Synthetic oligonucleotide
tgactttgcccgctttgacccgcagg

SEQ ID NO: 80875 - DNA, 25 bp, Artificial Sequence
  Description of Artificial Sequence: Synthetic oligonucleotide
gactttgcccgctttgacccgcagg

SEQ ID NO: 80876 - DNA, 26 bp, Artificial Sequence
  Description of Artificial Sequence: Synthetic oligonucleotide
actttgcccgctttgacccgcagggt

SEQ ID NO: 80877 - DNA, 25 bp, Artificial Sequence
  Description of Artificial Sequence: Synthetic oligonucleotide
ctttgcccgctttgacccgcagggt

SEQ ID NO: 80878 - DNA, 25 bp, Artificial Sequence
  Description of Artificial Sequence: Synthetic oligonucleotide
tttgcccgctttgacccgcagggtg

SEQ ID NO: 80879 - DNA, 24 bp, Artificial Sequence
  Description of Artificial Sequence: Synthetic oligonucleotide
ttgcccgctttgacccgcagggtg

SEQ ID NO: 80880 - DNA, 23 bp, Artificial Sequence
  Description of Artificial Sequence: Synthetic oligonucleotide
tgcccgctttgacccgcagggtg

SEQ ID NO: 80881 - DNA, 22 bp, Artificial Sequence
  Description of Artificial Sequence: Synthetic oligonucleotide
gcccgctttgacccgcagggtg

SEQ ID NO: 80882 - DNA, 22 bp, Artificial Sequence
  Description of Artificial Sequence: Synthetic oligonucleotide
cccgctttgacccgcagggtgg

SEQ ID NO: 80883 - DNA, 22 bp, Artificial Sequence
  Description of Artificial Sequence: Synthetic oligonucleotide
ccgctttgacccgcagggtggg

SEQ ID NO: 80884 - DNA, 23 bp, Artificial Sequence
  Description of Artificial Sequence: Synthetic oligonucleotide
cgctttgacccgcagggtgggct

SEQ ID NO: 80885 - DNA, 23 bp, Artificial Sequence
  Description of Artificial Sequence: Synthetic oligonucleotide
gctttgacccgcagggtgggctg

SEQ ID NO: 80886 - DNA, 23 bp, Artificial Sequence
  Description of Artificial Sequence: Synthetic oligonucleotide
ctttgacccgcagggtgggctgg

SEQ ID NO: 80887 - DNA, 23 bp, Artificial Sequence
  Description of Artificial Sequence: Synthetic oligonucleotide
tttgacccgcagggtgggctggc

SEQ ID NO: 80888 - DNA, 22 bp, Artificial Sequence
  Description of Artificial Sequence: Synthetic oligonucleotide
ttgacccgcagggtgggctggc

SEQ ID NO: 80889 - DNA, 21 bp, Artificial Sequence
  Description of Artificial Sequence: Synthetic oligonucleotide
tgacccgcagggtgggctggc

SEQ ID NO: 80890 - DNA, 20 bp, Artificial Sequence
  Description of Artificial Sequence: Synthetic oligonucleotide
gacccgcagggtgggctggc

SEQ ID NO: 80891 - DNA, 20 bp, Artificial Sequence
  Description of Artificial Sequence: Synthetic oligonucleotide
acccgcagggtgggctggcc

SEQ ID NO: 80892 - DNA, 20 bp, Artificial Sequence
  Description of Artificial Sequence: Synthetic oligonucleotide
cccgcagggtgggctggcct

SEQ ID NO: 80893 - DNA, 20 bp, Artificial Sequence
  Description of Artificial Sequence: Synthetic oligonucleotide
ccgcagggtgggctggccgt

SEQ ID NO: 80894 - DNA, 20 bp, Artificial Sequence
  Description of Artificial Sequence: Synthetic oligonucleotide
cgcagggtgggctggccggt

SEQ ID NO: 80895 - DNA, 21 bp, Artificial Sequence
  Description of Artificial Sequence: Synthetic oligonucleotide
gcagggtgggctggccggcat

SEQ ID NO: 80896 - DNA, 21 bp, Artificial Sequence
  Description of Artificial Sequence: Synthetic oligonucleotide
cagggtgggctggccggcatc

SEQ ID NO: 80897 - DNA, 21 bp, Artificial Sequence
  Description of Artificial Sequence: Synthetic oligonucleotide
agggtgggctggccggcatcg

SEQ ID NO: 80898 - DNA, 20 bp, Artificial Sequence
  Description of Artificial Sequence: Synthetic oligonucleotide
gggtgggctggccggcatcg

SEQ ID NO: 80899 - DNA, 20 bp, Artificial Sequence
  Description of Artificial Sequence: Synthetic oligonucleotide
ggtgggctggccggcatcgc

SEQ ID NO: 80900 - DNA, 20 bp, Artificial Sequence
  Description of Artificial Sequence: Synthetic oligonucleotide
gtgggctggccggcatcgcc

SEQ ID NO: 80901 - DNA, 20 bp, Artificial Sequence
  Description of Artificial Sequence: Synthetic oligonucleotide
tgggctggccggcatcgccg

SEQ ID NO: 80902 - DNA, 20 bp, Artificial Sequence
  Description of Artificial Sequence: Synthetic oligonucleotide
gggctggccggcatcgccgt

SEQ ID NO: 80903 - DNA, 22 bp, Artificial Sequence
  Description of Artificial Sequence: Synthetic oligonucleotide
ggctggccggcatcgccgcaat

SEQ ID NO: 80904 - DNA, 25 bp, Artificial Sequence
  Description of Artificial Sequence: Synthetic oligonucleotide
gctggccggcatcgccgcaatcaaa

SEQ ID NO: 80905 - DNA, 25 bp, Artificial Sequence
  Description of Artificial Sequence: Synthetic oligonucleotide
ctggccggcatcgccgcaatcaaag

SEQ ID NO: 80906 - DNA, 25 bp, Artificial Sequence
  Description of Artificial Sequence: Synthetic oligonucleotide
tggccggcatcgccgcaatcaaagc

SEQ ID NO: 80907 - DNA, 24 bp, Artificial Sequence
  Description of Artificial Sequence: Synthetic oligonucleotide
ggccggcatcgccgcaatcaaagc

SEQ ID NO: 80908 - DNA, 24 bp, Artificial Sequence
  Description of Artificial Sequence: Synthetic oligonucleotide
gccggcatcgccgcaatcaaagcc

SEQ ID NO: 80909 - DNA, 26 bp, Artificial Sequence
  Description of Artificial Sequence: Synthetic oligonucleotide
ccggcatcgccgcaatcaaagcccat

SEQ ID NO: 80910 - DNA, 27 bp, Artificial Sequence
  Description of Artificial Sequence: Synthetic oligonucleotide
cggcatcgccgcaatcaaagcccatct

SEQ ID NO: 80911 - DNA, 27 bp, Artificial Sequence
  Description of Artificial Sequence: Synthetic oligonucleotide
ggcatcgccgcaatcaaagcccatctg

SEQ ID NO: 80912 - DNA, 27 bp, Artificial Sequence
  Description of Artificial Sequence: Synthetic oligonucleotide
gcatcgccgcaatcaaagcccatctgg

SEQ ID NO: 80913 - DNA, 28 bp, Artificial Sequence
  Description of Artificial Sequence: Synthetic oligonucleotide
catcgccgcaatcaaagcccatctggac

SEQ ID NO: 80914 - DNA, 30 bp, Artificial Sequence
  Description of Artificial Sequence: Synthetic oligonucleotide
atcgccgcaatcaaagcccatctggacatc

SEQ ID NO: 80915 - DNA, 29 bp, Artificial Sequence
  Description of Artificial Sequence: Synthetic oligonucleotide
tcgccgcaatcaaagcccatctggacatc

SEQ ID NO: 80916 - DNA, 28 bp, Artificial Sequence
  Description of Artificial Sequence: Synthetic oligonucleotide
cgccgcaatcaaagcccatctggacatc

SEQ ID NO: 80917 - DNA, 28 bp, Artificial Sequence
  Description of Artificial Sequence: Synthetic oligonucleotide
gccgcaatcaaagcccatctggacatcc

SEQ ID NO: 80918 - DNA, 29 bp, Artificial Sequence
  Description of Artificial Sequence: Synthetic oligonucleotide
ccgcaatcaaagcccatctggacatcctg

SEQ ID NO: 80919 - DNA, 29 bp, Artificial Sequence
  Description of Artificial Sequence: Synthetic oligonucleotide
cgcaatcaaagcccatctggacatcctgg

SEQ ID NO: 80920 - DNA, 30 bp, Artificial Sequence
  Description of Artificial Sequence: Synthetic oligonucleotide
gcaatcaaagcccatctggacatcctggtg

SEQ ID NO: 80921 - DNA, 30 bp, Artificial Sequence
  Description of Artificial Sequence: Synthetic oligonucleotide
caatcaaagcccatctggacatcctggtgg

SEQ ID NO: 80922 - DNA, 31 bp, Artificial Sequence
  Description of Artificial Sequence: Synthetic oligonucleotide
aatcaaagcccatctggacatcctggtggag

SEQ ID NO: 80923 - DNA, 30 bp, Artificial Sequence
  Description of Artificial Sequence: Synthetic oligonucleotide
atcaaagcccatctggacatcctggtggag

SEQ ID NO: 80924 - DNA, 29 bp, Artificial Sequence
  Description of Artificial Sequence: Synthetic oligonucleotide
tcaaagcccatctggacatcctggtggag

SEQ ID NO: 80925 - DNA, 28 bp, Artificial Sequence
  Description of Artificial Sequence: Synthetic oligonucleotide
caaagcccatctggacatcctggtggag

SEQ ID NO: 80926 - DNA, 28 bp, Artificial Sequence
  Description of Artificial Sequence: Synthetic oligonucleotide
aaagcccatctggacatcctggtggagc

SEQ ID NO: 80927 - DNA, 27 bp, Artificial Sequence
  Description of Artificial Sequence: Synthetic oligonucleotide
aagcccatctggacatcctggtggagc

SEQ ID NO: 80928 - DNA, 26 bp, Artificial Sequence
  Description of Artificial Sequence: Synthetic oligonucleotide
agcccatctggacatcctggtggagc

SEQ ID NO: 80929 - DNA, 25 bp, Artificial Sequence
  Description of Artificial Sequence: Synthetic oligonucleotide
gcccatctggacatcctggtggagc

SEQ ID NO: 80930 - DNA, 25 bp, Artificial Sequence
  Description of Artificial Sequence: Synthetic oligonucleotide
cccatctggacatcctggtggagcg

SEQ ID NO: 80931 - DNA, 26 bp, Artificial Sequence
  Description of Artificial Sequence: Synthetic oligonucleotide
ccatctggacatcctggtggagcgct

SEQ ID NO: 80932 - DNA, 26 bp, Artificial Sequence
  Description of Artificial Sequence: Synthetic oligonucleotide
catctggacatcctggtggagcgctc

SEQ ID NO: 80933 - DNA, 27 bp, Artificial Sequence
  Description of Artificial Sequence: Synthetic oligonucleotide
atctggacatcctggtggagcgctcca

SEQ ID NO: 80934 - DNA, 27 bp, Artificial Sequence
  Description of Artificial Sequence: Synthetic oligonucleotide
tctggacatcctggtggagcgctccaa

SEQ ID NO: 80935 - DNA, 26 bp, Artificial Sequence
  Description of Artificial Sequence: Synthetic oligonucleotide
ctggacatcctggtggagcgctccaa

SEQ ID NO: 80936 - DNA, 26 bp, Artificial Sequence
  Description of Artificial Sequence: Synthetic oligonucleotide
tggacatcctggtggagcgctccaac

SEQ ID NO: 80937 - DNA, 25 bp, Artificial Sequence
  Description of Artificial Sequence: Synthetic oligonucleotide
ggacatcctggtggagcgctccaac

SEQ ID NO: 80938 - DNA, 25 bp, Artificial Sequence
  Description of Artificial Sequence: Synthetic oligonucleotide
gacatcctggtggagcgctccaacc

SEQ ID NO: 80939 - DNA, 25 bp, Artificial Sequence
  Description of Artificial Sequence: Synthetic oligonucleotide
acatcctggtggagcgctccaaccg

SEQ ID NO: 80940 - DNA, 24 bp, Artificial Sequence
  Description of Artificial Sequence: Synthetic oligonucleotide
catcctggtggagcgctccaaccg

SEQ ID NO: 80941 - DNA, 25 bp, Artificial Sequence
  Description of Artificial Sequence: Synthetic oligonucleotide
atcctggtggagcgctccaaccgca

SEQ ID NO: 80942 - DNA, 24 bp, Artificial Sequence
  Description of Artificial Sequence: Synthetic oligonucleotide
tcctggtggagcgctccaaccgca

SEQ ID NO: 80943 - DNA, 23 bp, Artificial Sequence
  Description of Artificial Sequence: Synthetic oligonucleotide
cctggtggagcgctccaaccgca

SEQ ID NO: 80944 - DNA, 23 bp, Artificial Sequence
  Description of Artificial Sequence: Synthetic oligonucleotide
ctggtggagcgctccaaccgcag

SEQ ID NO: 80945 - DNA, 24 bp, Artificial Sequence
  Description of Artificial Sequence: Synthetic oligonucleotide
tggtggagcgctccaaccgcagca

SEQ ID NO: 80946 - DNA, 23 bp, Artificial Sequence
  Description of Artificial Sequence: Synthetic oligonucleotide
ggtggagcgctccaaccgcagca

SEQ ID NO: 80947 - DNA, 24 bp, Artificial Sequence
  Description of Artificial Sequence: Synthetic oligonucleotide
gtggagcgctccaaccgcagcaga

SEQ ID NO: 80948 - DNA, 24 bp, Artificial Sequence
  Description of Artificial Sequence: Synthetic oligonucleotide
tggagcgctccaaccgcagcagag

SEQ ID NO: 80949 - DNA, 23 bp, Artificial Sequence
  Description of Artificial Sequence: Synthetic oligonucleotide
ggagcgctccaaccgcagcagag

SEQ ID NO: 80950 - DNA, 23 bp, Artificial Sequence
  Description of Artificial Sequence: Synthetic oligonucleotide
gagcgctccaaccgcagcagagc

SEQ ID NO: 80951 - DNA, 25 bp, Artificial Sequence
  Description of Artificial Sequence: Synthetic oligonucleotide
agcgctccaaccgcagcagagccat

SEQ ID NO: 80952 - DNA, 24 bp, Artificial Sequence
  Description of Artificial Sequence: Synthetic oligonucleotide
gcgctccaaccgcagcagagccat

SEQ ID NO: 80953 - DNA, 26 bp, Artificial Sequence
  Description of Artificial Sequence: Synthetic oligonucleotide
cgctccaaccgcagcagagccatcaa

SEQ ID NO: 80954 - DNA, 26 bp, Artificial Sequence
  Description of Artificial Sequence: Synthetic oligonucleotide
gctccaaccgcagcagagccatcaac

SEQ ID NO: 80955 - DNA, 27 bp, Artificial Sequence
  Description of Artificial Sequence: Synthetic oligonucleotide
ctccaaccgcagcagagccatcaacgt

SEQ ID NO: 80956 - DNA, 27 bp, Artificial Sequence
  Description of Artificial Sequence: Synthetic oligonucleotide
tccaaccgcagcagagccatcaacgtg

SEQ ID NO: 80957 - DNA, 26 bp, Artificial Sequence
  Description of Artificial Sequence: Synthetic oligonucleotide
ccaaccgcagcagagccatcaacgtg

SEQ ID NO: 80958 - DNA, 26 bp, Artificial Sequence
  Description of Artificial Sequence: Synthetic oligonucleotide
caaccgcagcagagccatcaacgtgc

SEQ ID NO: 80959 - DNA, 27 bp, Artificial Sequence
  Description of Artificial Sequence: Synthetic oligonucleotide
aaccgcagcagagccatcaacgtgcct

SEQ ID NO: 80960 - DNA, 26 bp, Artificial Sequence
  Description of Artificial Sequence: Synthetic oligonucleotide
accgcagcagagccatcaacgtgcct

SEQ ID NO: 80961 - DNA, 25 bp, Artificial Sequence
  Description of Artificial Sequence: Synthetic oligonucleotide
ccgcagcagagccatcaacgtgcct

SEQ ID NO: 80962 - DNA, 25 bp, Artificial Sequence
  Description of Artificial Sequence: Synthetic oligonucleotide
cgcagcagagccatcaacgtgcctc

SEQ ID NO: 80963 - DNA, 26 bp, Artificial Sequence
  Description of Artificial Sequence: Synthetic oligonucleotide
gcagcagagccatcaacgtgcctcca

SEQ ID NO: 80964 - DNA, 26 bp, Artificial Sequence
  Description of Artificial Sequence: Synthetic oligonucleotide
cagcagagccatcaacgtgcctccac

SEQ ID NO: 80965 - DNA, 26 bp, Artificial Sequence
  Description of Artificial Sequence: Synthetic oligonucleotide
agcagagccatcaacgtgcctccacg

SEQ ID NO: 80966 - DNA, 25 bp, Artificial Sequence
  Description of Artificial Sequence: Synthetic oligonucleotide
gcagagccatcaacgtgcctccacg

SEQ ID NO: 80967 - DNA, 25 bp, Artificial Sequence
  Description of Artificial Sequence: Synthetic oligonucleotide
cagagccatcaacgtgcctccacgg

SEQ ID NO: 80968 - DNA, 26 bp, Artificial Sequence
  Description of Artificial Sequence: Synthetic oligonucleotide
agagccatcaacgtgcctccacgggt

SEQ ID NO: 80969 - DNA, 25 bp, Artificial Sequence
  Description of Artificial Sequence: Synthetic oligonucleotide
gagccatcaacgtgcctccacgggt

SEQ ID NO: 80970 - DNA, 26 bp, Artificial Sequence
  Description of Artificial Sequence: Synthetic oligonucleotide
agccatcaacgtgcctccacgggtga

SEQ ID NO: 80971 - DNA, 25 bp, Artificial Sequence
  Description of Artificial Sequence: Synthetic oligonucleotide
gccatcaacgtgcctccacgggtga

SEQ ID NO: 80972 - DNA, 25 bp, Artificial Sequence
  Description of Artificial Sequence: Synthetic oligonucleotide
ccatcaacgtgcctccacgggtgac

SEQ ID NO: 80973 - DNA, 25 bp, Artificial Sequence
  Description of Artificial Sequence: Synthetic oligonucleotide
catcaacgtgcctccacgggtgacc

SEQ ID NO: 80974 - DNA, 26 bp, Artificial Sequence
  Description of Artificial Sequence: Synthetic oligonucleotide
atcaacgtgcctccacgggtgaccgt

SEQ ID NO: 80975 - DNA, 25 bp, Artificial Sequence
  Description of Artificial Sequence: Synthetic oligonucleotide
tcaacgtgcctccacgggtgaccgt

SEQ ID NO: 80976 - DNA, 24 bp, Artificial Sequence
  Description of Artificial Sequence: Synthetic oligonucleotide
caacgtgcctccacgggtgaccgt

SEQ ID NO: 80977 - DNA, 24 bp, Artificial Sequence
  Description of Artificial Sequence: Synthetic oligonucleotide
aacgtgcctccacgggtgaccgtg

SEQ ID NO: 80978 - DNA, 23 bp, Artificial Sequence
  Description of Artificial Sequence: Synthetic oligonucleotide
acgtgcctccacgggtgaccgtg

SEQ ID NO: 80979 - DNA, 22 bp, Artificial Sequence
  Description of Artificial Sequence: Synthetic oligonucleotide
cgtgcctccacgggtgaccgtg

SEQ ID NO: 80980 - DNA, 23 bp, Artificial Sequence
  Description of Artificial Sequence: Synthetic oligonucleotide
gtgcctccacgggtgaccgtgct

SEQ ID NO: 80981 - DNA, 23 bp, Artificial Sequence
  Description of Artificial Sequence: Synthetic oligonucleotide
tgcctccacgggtgaccgtgctc

SEQ ID NO: 80982 - DNA, 22 bp, Artificial Sequence
  Description of Artificial Sequence: Synthetic oligonucleotide
gcctccacgggtgaccgtgctc

SEQ ID NO: 80983 - DNA, 22 bp, Artificial Sequence
  Description of Artificial Sequence: Synthetic oligonucleotide
cctccacgggtgaccgtgctcc

SEQ ID NO: 80984 - DNA, 22 bp, Artificial Sequence
  Description of Artificial Sequence: Synthetic oligonucleotide
ctccacgggtgaccgtgctccc

SEQ ID NO: 80985 - DNA, 24 bp, Artificial Sequence
  Description of Artificial Sequence: Synthetic oligonucleotide
tccacgggtgaccgtgctccccaa

SEQ ID NO: 80986 - DNA, 23 bp, Artificial Sequence
  Description of Artificial Sequence: Synthetic oligonucleotide
ccacgggtgaccgtgctccccaa

SEQ ID NO: 80987 - DNA, 24 bp, Artificial Sequence
  Description of Artificial Sequence: Synthetic oligonucleotide
cacgggtgaccgtgctccccaagt

SEQ ID NO: 80988 - DNA, 25 bp, Artificial Sequence
  Description of Artificial Sequence: Synthetic oligonucleotide
acgggtgaccgtgctccccaagtct

SEQ ID NO: 80989 - DNA, 24 bp, Artificial Sequence
  Description of Artificial Sequence: Synthetic oligonucleotide
cgggtgaccgtgctccccaagtct

SEQ ID NO: 80990 - DNA, 24 bp, Artificial Sequence
  Description of Artificial Sequence: Synthetic oligonucleotide
gggtgaccgtgctccccaagtctc

SEQ ID NO: 80991 - DNA, 24 bp, Artificial Sequence
  Description of Artificial Sequence: Synthetic oligonucleotide
ggtgaccgtgctccccaagtctcg

SEQ ID NO: 80992 - DNA, 24 bp, Artificial Sequence
  Description of Artificial Sequence: Synthetic oligonucleotide
gtgaccgtgctccccaagtctcgg

SEQ ID NO: 80993 - DNA, 25 bp, Artificial Sequence
  Description of Artificial Sequence: Synthetic oligonucleotide
tgaccgtgctccccaagtctcgggt

SEQ ID NO: 80994 - DNA, 24 bp, Artificial Sequence
  Description of Artificial Sequence: Synthetic oligonucleotide
gaccgtgctccccaagtctcgggt

SEQ ID NO: 80995 - DNA, 24 bp, Artificial Sequence
  Description of Artificial Sequence: Synthetic oligonucleotide
accgtgctccccaagtctcgggtg

SEQ ID NO: 80996 - DNA, 23 bp, Artificial Sequence
  Description of Artificial Sequence: Synthetic oligonucleotide
ccgtgctccccaagtctcgggtg

SEQ ID NO: 80997 - DNA, 24 bp, Artificial Sequence
  Description of Artificial Sequence: Synthetic oligonucleotide
cgtgctccccaagtctcgggtgga

SEQ ID NO: 80998 - DNA, 24 bp, Artificial Sequence
  Description of Artificial Sequence: Synthetic oligonucleotide
gtgctccccaagtctcgggtggag

SEQ ID NO: 80999 - DNA, 25 bp, Artificial Sequence
  Description of Artificial Sequence: Synthetic oligonucleotide
tgctccccaagtctcgggtggagct

SEQ ID NO: 81000 - DNA, 24 bp, Artificial Sequence
  Description of Artificial Sequence: Synthetic oligonucleotide
gctccccaagtctcgggtggagct

SEQ ID NO: 81001 - DNA, 24 bp, Artificial Sequence
  Description of Artificial Sequence: Synthetic oligonucleotide
ctccccaagtctcgggtggagctg

SEQ ID NO: 81002 - DNA, 24 bp, Artificial Sequence
  Description of Artificial Sequence: Synthetic oligonucleotide
tccccaagtctcgggtggagctgg

SEQ ID NO: 81003 - DNA, 23 bp, Artificial Sequence
  Description of Artificial Sequence: Synthetic oligonucleotide
ccccaagtctcgggtggagctgg

SEQ ID NO: 81004 - DNA, 23 bp, Artificial Sequence
  Description of Artificial Sequence: Synthetic oligonucleotide
cccaagtctcgggtggagctggg

SEQ ID NO: 81005 - DNA, 23 bp, Artificial Sequence
  Description of Artificial Sequence: Synthetic oligonucleotide
ccaagtctcgggtggagctgggc

SEQ ID NO: 81006 - DNA, 24 bp, Artificial Sequence
  Description of Artificial Sequence: Synthetic oligonucleotide
caagtctcgggtggagctgggcca

SEQ ID NO: 81007 - DNA, 24 bp, Artificial Sequence
  Description of Artificial Sequence: Synthetic oligonucleotide
aagtctcgggtggagctgggccag

SEQ ID NO: 81008 - DNA, 23 bp, Artificial Sequence
  Description of Artificial Sequence: Synthetic oligonucleotide
agtctcgggtggagctgggccag

SEQ ID NO: 81009 - DNA, 22 bp, Artificial Sequence
  Description of Artificial Sequence: Synthetic oligonucleotide
gtctcgggtggagctgggccag

SEQ ID NO: 81010 - DNA, 22 bp, Artificial Sequence
  Description of Artificial Sequence: Synthetic oligonucleotide
tctcgggtggagctgggccagc

SEQ ID NO: 81011 - DNA, 21 bp, Artificial Sequence
  Description of Artificial Sequence: Synthetic oligonucleotide
ctcgggtggagctgggccagc

SEQ ID NO: 81012 - DNA, 21 bp, Artificial Sequence
  Description of Artificial Sequence: Synthetic oligonucleotide
tcgggtggagctgggccagcc

SEQ ID NO: 81013 - DNA, 20 bp, Artificial Sequence
  Description of Artificial Sequence: Synthetic oligonucleotide
cgggtggagctgggccagcc

SEQ ID NO: 81014 - DNA, 22 bp, Artificial Sequence
  Description of Artificial Sequence: Synthetic oligonucleotide
gggtggagctgggccagcccaa

SEQ ID NO: 81015 - DNA, 24 bp, Artificial Sequence
  Description of Artificial Sequence: Synthetic oligonucleotide
ggtggagctgggccagcccaacat

SEQ ID NO: 81016 - DNA, 24 bp, Artificial Sequence
  Description of Artificial Sequence: Synthetic oligonucleotide
gtggagctgggccagcccaacatc

SEQ ID NO: 81017 - DNA, 25 bp, Artificial Sequence
  Description of Artificial Sequence: Synthetic oligonucleotide
tggagctgggccagcccaacatcct

SEQ ID NO: 81018 - DNA, 24 bp, Artificial Sequence
  Description of Artificial Sequence: Synthetic oligonucleotide
ggagctgggccagcccaacatcct

SEQ ID NO: 81019 - DNA, 26 bp, Artificial Sequence
  Description of Artificial Sequence: Synthetic oligonucleotide
gagctgggccagcccaacatcctcat

SEQ ID NO: 81020 - DNA, 27 bp, Artificial Sequence
  Description of Artificial Sequence: Synthetic oligonucleotide
agctgggccagcccaacatcctcatct

SEQ ID NO: 81021 - DNA, 26 bp, Artificial Sequence
  Description of Artificial Sequence: Synthetic oligonucleotide
gctgggccagcccaacatcctcatct

SEQ ID NO: 81022 - DNA, 26 bp, Artificial Sequence
  Description of Artificial Sequence: Synthetic oligonucleotide
ctgggccagcccaacatcctcatctg

SEQ ID NO: 81023 - DNA, 27 bp, Artificial Sequence
  Description of Artificial Sequence: Synthetic oligonucleotide
tgggccagcccaacatcctcatctgca

SEQ ID NO: 81024 - DNA, 27 bp, Artificial Sequence
  Description of Artificial Sequence: Synthetic oligonucleotide
gggccagcccaacatcctcatctgcat

SEQ ID NO: 81025 - DNA, 27 bp, Artificial Sequence
  Description of Artificial Sequence: Synthetic oligonucleotide
ggccagcccaacatcctcatctgcatc

SEQ ID NO: 81026 - DNA, 27 bp, Artificial Sequence
  Description of Artificial Sequence: Synthetic oligonucleotide
gccagcccaacatcctcatctgcatcg

SEQ ID NO: 81027 - DNA, 28 bp, Artificial Sequence
  Description of Artificial Sequence: Synthetic oligonucleotide
ccagcccaacatcctcatctgcatcgtg

SEQ ID NO: 81028 - DNA, 28 bp, Artificial Sequence
  Description of Artificial Sequence: Synthetic oligonucleotide
cagcccaacatcctcatctgcatcgtgg

SEQ ID NO: 81029 - DNA, 29 bp, Artificial Sequence
  Description of Artificial Sequence: Synthetic oligonucleotide
agcccaacatcctcatctgcatcgtggac

SEQ ID NO: 81030 - DNA, 28 bp, Artificial Sequence
  Description of Artificial Sequence: Synthetic oligonucleotide
gcccaacatcctcatctgcatcgtggac

SEQ ID NO: 81031 - DNA, 30 bp, Artificial Sequence
  Description of Artificial Sequence: Synthetic oligonucleotide
cccaacatcctcatctgcatcgtggacaac

SEQ ID NO: 81032 - DNA, 32 bp, Artificial Sequence
  Description of Artificial Sequence: Synthetic oligonucleotide
ccaacatcctcatctgcatcgtggacaacatc

SEQ ID NO: 81033 - DNA, 34 bp, Artificial Sequence
  Description of Artificial Sequence: Synthetic oligonucleotide
caacatcctcatctgcatcgtggacaacatcttc

SEQ ID NO: 81034 - DNA, 34 bp, Artificial Sequence
  Description of Artificial Sequence: Synthetic oligonucleotide
aacatcctcatctgcatcgtggacaacatcttcc

SEQ ID NO: 81035 - DNA, 33 bp, Artificial Sequence
  Description of Artificial Sequence: Synthetic oligonucleotide
acatcctcatctgcatcgtggacaacatcttcc

SEQ ID NO: 81036 - DNA, 32 bp, Artificial Sequence
  Description of Artificial Sequence: Synthetic oligonucleotide
catcctcatctgcatcgtggacaacatcttcc

SEQ ID NO: 81037 - DNA, 32 bp, Artificial Sequence
  Description of Artificial Sequence: Synthetic oligonucleotide
atcctcatctgcatcgtggacaacatcttccc

SEQ ID NO: 81038 - DNA, 31 bp, Artificial Sequence
  Description of Artificial Sequence: Synthetic oligonucleotide
tcctcatctgcatcgtggacaacatcttccc

SEQ ID NO: 81039 - DNA, 30 bp, Artificial Sequence
  Description of Artificial Sequence: Synthetic oligonucleotide
cctcatctgcatcgtggacaacatcttccc

SEQ ID NO: 81040 - DNA, 30 bp, Artificial Sequence
  Description of Artificial Sequence: Synthetic oligonucleotide
ctcatctgcatcgtggacaacatcttcccc

SEQ ID NO: 81041 - DNA, 30 bp, Artificial Sequence
  Description of Artificial Sequence: Synthetic oligonucleotide
tcatctgcatcgtggacaacatcttccccc

SEQ ID NO: 81042 - DNA, 29 bp, Artificial Sequence
  Description of Artificial Sequence: Synthetic oligonucleotide
catctgcatcgtggacaacatcttccccc

SEQ ID NO: 81043 - DNA, 29 bp, Artificial Sequence
  Description of Artificial Sequence: Synthetic oligonucleotide
atctgcatcgtggacaacatcttcccccc

SEQ ID NO: 81044 - DNA, 28 bp, Artificial Sequence
  Description of Artificial Sequence: Synthetic oligonucleotide
tctgcatcgtggacaacatcttcccccc

SEQ ID NO: 81045 - DNA, 27 bp, Artificial Sequence
  Description of Artificial Sequence: Synthetic oligonucleotide
ctgcatcgtggacaacatcttcccccc

SEQ ID NO: 81046 - DNA, 28 bp, Artificial Sequence
  Description of Artificial Sequence: Synthetic oligonucleotide
tgcatcgtggacaacatcttcccccctg

SEQ ID NO: 81047 - DNA, 27 bp, Artificial Sequence
  Description of Artificial Sequence: Synthetic oligonucleotide
gcatcgtggacaacatcttcccccctg

SEQ ID NO: 81048 - DNA, 28 bp, Artificial Sequence
  Description of Artificial Sequence: Synthetic oligonucleotide
catcgtggacaacatcttcccccctgtg

SEQ ID NO: 81049 - DNA, 30 bp, Artificial Sequence
  Description of Artificial Sequence: Synthetic oligonucleotide
atcgtggacaacatcttcccccctgtgatc

SEQ ID NO: 81050 - DNA, 29 bp, Artificial Sequence
  Description of Artificial Sequence: Synthetic oligonucleotide
tcgtggacaacatcttcccccctgtgatc

SEQ ID NO: 81051 - DNA, 28 bp, Artificial Sequence
  Description of Artificial Sequence: Synthetic oligonucleotide
cgtggacaacatcttcccccctgtgatc

SEQ ID NO: 81052 - DNA, 33 bp, Artificial Sequence
  Description of Artificial Sequence: Synthetic oligonucleotide
gtggacaacatcttcccccctgtgatcaatatc

SEQ ID NO: 81053 - DNA, 34 bp, Artificial Sequence
  Description of Artificial Sequence: Synthetic oligonucleotide
tggacaacatcttcccccctgtgatcaatatcac

SEQ ID NO: 81054 - DNA, 33 bp, Artificial Sequence
  Description of Artificial Sequence: Synthetic oligonucleotide
ggacaacatcttcccccctgtgatcaatatcac

SEQ ID NO: 81055 - DNA, 33 bp, Artificial Sequence
  Description of Artificial Sequence: Synthetic oligonucleotide
gacaacatcttcccccctgtgatcaatatcacc

SEQ ID NO: 81056 - DNA, 34 bp, Artificial Sequence
  Description of Artificial Sequence: Synthetic oligonucleotide
acaacatcttcccccctgtgatcaatatcacctg

SEQ ID NO: 81057 - DNA, 33 bp, Artificial Sequence
  Description of Artificial Sequence: Synthetic oligonucleotide
caacatcttcccccctgtgatcaatatcacctg

SEQ ID NO: 81058 - DNA, 33 bp, Artificial Sequence
  Description of Artificial Sequence: Synthetic oligonucleotide
aacatcttcccccctgtgatcaatatcacctgg

SEQ ID NO: 81059 - DNA, 32 bp, Artificial Sequence
  Description of Artificial Sequence: Synthetic oligonucleotide
acatcttcccccctgtgatcaatatcacctgg

SEQ ID NO: 81060 - DNA, 31 bp, Artificial Sequence
  Description of Artificial Sequence: Synthetic oligonucleotide
catcttcccccctgtgatcaatatcacctgg

SEQ ID NO: 81061 - DNA, 31 bp, Artificial Sequence
  Description of Artificial Sequence: Synthetic oligonucleotide
atcttcccccctgtgatcaatatcacctggc

SEQ ID NO: 81062 - DNA, 30 bp, Artificial Sequence
  Description of Artificial Sequence: Synthetic oligonucleotide
tcttcccccctgtgatcaatatcacctggc

SEQ ID NO: 81063 - DNA, 29 bp, Artificial Sequence
  Description of Artificial Sequence: Synthetic oligonucleotide
cttcccccctgtgatcaatatcacctggc

SEQ ID NO: 81064 - DNA, 31 bp, Artificial Sequence
  Description of Artificial Sequence: Synthetic oligonucleotide
ttcccccctgtgatcaatatcacctggctac

SEQ ID NO: 81065 - DNA, 30 bp, Artificial Sequence
  Description of Artificial Sequence: Synthetic oligonucleotide
tcccccctgtgatcaatatcacctggctac

SEQ ID NO: 81066 - DNA, 29 bp, Artificial Sequence
  Description of Artificial Sequence: Synthetic oligonucleotide
cccccctgtgatcaatatcacctggctac

SEQ ID NO: 81067 - DNA, 29 bp, Artificial Sequence
  Description of Artificial Sequence: Synthetic oligonucleotide
ccccctgtgatcaatatcacctggctacg

SEQ ID NO: 81068 - DNA, 29 bp, Artificial Sequence
  Description of Artificial Sequence: Synthetic oligonucleotide
cccctgtgatcaatatcacctggctacgc

SEQ ID NO: 81069 - DNA, 31 bp, Artificial Sequence
  Description of Artificial Sequence: Synthetic oligonucleotide
ccctgtgatcaatatcacctggctacgcaac

SEQ ID NO: 81070 - DNA, 31 bp, Artificial Sequence
  Description of Artificial Sequence: Synthetic oligonucleotide
cctgtgatcaatatcacctggctacgcaacg

SEQ ID NO: 81071 - DNA, 31 bp, Artificial Sequence
  Description of Artificial Sequence: Synthetic oligonucleotide
ctgtgatcaatatcacctggctacgcaacgg

SEQ ID NO: 81072 - DNA, 31 bp, Artificial Sequence
  Description of Artificial Sequence: Synthetic oligonucleotide
tgtgatcaatatcacctggctacgcaacggc

SEQ ID NO: 81073 - DNA, 30 bp, Artificial Sequence
  Description of Artificial Sequence: Synthetic oligonucleotide
gtgatcaatatcacctggctacgcaacggc

SEQ ID NO: 81074 - DNA, 30 bp, Artificial Sequence
  Description of Artificial Sequence: Synthetic oligonucleotide
tgatcaatatcacctggctacgcaacggcc

SEQ ID NO: 81075 - DNA, 29 bp, Artificial Sequence
  Description of Artificial Sequence: Synthetic oligonucleotide
gatcaatatcacctggctacgcaacggcc

SEQ ID NO: 81076 - DNA, 32 bp, Artificial Sequence
  Description of Artificial Sequence: Synthetic oligonucleotide
atcaatatcacctggctacgcaacggccaaac

SEQ ID NO: 81077 - DNA, 31 bp, Artificial Sequence
  Description of Artificial Sequence: Synthetic oligonucleotide
tcaatatcacctggctacgcaacggccaaac

SEQ ID NO: 81078 - DNA, 30 bp, Artificial Sequence
  Description of Artificial Sequence: Synthetic oligonucleotide
caatatcacctggctacgcaacggccaaac

SEQ ID NO: 81079 - DNA, 31 bp, Artificial Sequence
  Description of Artificial Sequence: Synthetic oligonucleotide
aatatcacctggctacgcaacggccaaactg

SEQ ID NO: 81080 - DNA, 30 bp, Artificial Sequence
  Description of Artificial Sequence: Synthetic oligonucleotide
atatcacctggctacgcaacggccaaactg

SEQ ID NO: 81081 - DNA, 29 bp, Artificial Sequence
  Description of Artificial Sequence: Synthetic oligonucleotide
tatcacctggctacgcaacggccaaactg

SEQ ID NO: 81082 - DNA, 28 bp, Artificial Sequence
  Description of Artificial Sequence: Synthetic oligonucleotide
atcacctggctacgcaacggccaaactg

SEQ ID NO: 81083 - DNA, 27 bp, Artificial Sequence
  Description of Artificial Sequence: Synthetic oligonucleotide
tcacctggctacgcaacggccaaactg

SEQ ID NO: 81084 - DNA, 27 bp, Artificial Sequence
  Description of Artificial Sequence: Synthetic oligonucleotide
cacctggctacgcaacggccaaactgt

SEQ ID NO: 81085 - DNA, 27 bp, Artificial Sequence
  Description of Artificial Sequence: Synthetic oligonucleotide
acctggctacgcaacggccaaactgtc

SEQ ID NO: 81086 - DNA, 27 bp, Artificial Sequence
  Description of Artificial Sequence: Synthetic oligonucleotide
cctggctacgcaacggccaaactgtca

SEQ ID NO: 81087 - DNA, 27 bp, Artificial Sequence
  Description of Artificial Sequence: Synthetic oligonucleotide
ctggctacgcaacggccaaactgtcac

SEQ ID NO: 81088 - DNA, 28 bp, Artificial Sequence
  Description of Artificial Sequence: Synthetic oligonucleotide
tggctacgcaacggccaaactgtcactg

SEQ ID NO: 81089 - DNA, 27 bp, Artificial Sequence
  Description of Artificial Sequence: Synthetic oligonucleotide
ggctacgcaacggccaaactgtcactg

SEQ ID NO: 81090 - DNA, 28 bp, Artificial Sequence
  Description of Artificial Sequence: Synthetic oligonucleotide
gctacgcaacggccaaactgtcactgag

SEQ ID NO: 81091 - DNA, 28 bp, Artificial Sequence
  Description of Artificial Sequence: Synthetic oligonucleotide
ctacgcaacggccaaactgtcactgagg

SEQ ID NO: 81092 - DNA, 28 bp, Artificial Sequence
  Description of Artificial Sequence: Synthetic oligonucleotide
tacgcaacggccaaactgtcactgaggg

SEQ ID NO: 81093 - DNA, 27 bp, Artificial Sequence
  Description of Artificial Sequence: Synthetic oligonucleotide
acgcaacggccaaactgtcactgaggg

SEQ ID NO: 81094 - DNA, 27 bp, Artificial Sequence
  Description of Artificial Sequence: Synthetic oligonucleotide
cgcaacggccaaactgtcactgaggga

SEQ ID NO: 81095 - DNA, 27 bp, Artificial Sequence
  Description of Artificial Sequence: Synthetic oligonucleotide
gcaacggccaaactgtcactgagggag

SEQ ID NO: 81096 - DNA, 28 bp, Artificial Sequence
  Description of Artificial Sequence: Synthetic oligonucleotide
caacggccaaactgtcactgagggagtg

SEQ ID NO: 81097 - DNA, 28 bp, Artificial Sequence
  Description of Artificial Sequence: Synthetic oligonucleotide
aacggccaaactgtcactgagggagtgg

SEQ ID NO: 81098 - DNA, 27 bp, Artificial Sequence
  Description of Artificial Sequence: Synthetic oligonucleotide
acggccaaactgtcactgagggagtgg

SEQ ID NO: 81099 - DNA, 26 bp, Artificial Sequence
  Description of Artificial Sequence: Synthetic oligonucleotide
cggccaaactgtcactgagggagtgg

SEQ ID NO: 81100 - DNA, 26 bp, Artificial Sequence
  Description of Artificial Sequence: Synthetic oligonucleotide
ggccaaactgtcactgagggagtggc

SEQ ID NO: 81101 - DNA, 26 bp, Artificial Sequence
  Description of Artificial Sequence: Synthetic oligonucleotide
gccaaactgtcactgagggagtggcc

SEQ ID NO: 81102 - DNA, 27 bp, Artificial Sequence
  Description of Artificial Sequence: Synthetic oligonucleotide
ccaaactgtcactgagggagtggccca

SEQ ID NO: 81103 - DNA, 27 bp, Artificial Sequence
  Description of Artificial Sequence: Synthetic oligonucleotide
caaactgtcactgagggagtggcccag

SEQ ID NO: 81104 - DNA, 28 bp, Artificial Sequence
  Description of Artificial Sequence: Synthetic oligonucleotide
aaactgtcactgagggagtggcccagac

SEQ ID NO: 81105 - DNA, 27 bp, Artificial Sequence
  Description of Artificial Sequence: Synthetic oligonucleotide
aactgtcactgagggagtggcccagac

SEQ ID NO: 81106 - DNA, 26 bp, Artificial Sequence
  Description of Artificial Sequence: Synthetic oligonucleotide
actgtcactgagggagtggcccagac

SEQ ID NO: 81107 - DNA, 25 bp, Artificial Sequence
  Description of Artificial Sequence: Synthetic oligonucleotide
ctgtcactgagggagtggcccagac

SEQ ID NO: 81108 - DNA, 26 bp, Artificial Sequence
  Description of Artificial Sequence: Synthetic oligonucleotide
tgtcactgagggagtggcccagacca

SEQ ID NO: 81109 - DNA, 25 bp, Artificial Sequence
  Description of Artificial Sequence: Synthetic oligonucleotide
gtcactgagggagtggcccagacca

SEQ ID NO: 81110 - DNA, 25 bp, Artificial Sequence
  Description of Artificial Sequence: Synthetic oligonucleotide
tcactgagggagtggcccagaccag

SEQ ID NO: 81111 - DNA, 24 bp, Artificial Sequence
  Description of Artificial Sequence: Synthetic oligonucleotide
cactgagggagtggcccagaccag

SEQ ID NO: 81112 - DNA, 26 bp, Artificial Sequence
  Description of Artificial Sequence: Synthetic oligonucleotide
actgagggagtggcccagaccagctt

SEQ ID NO: 81113 - DNA, 25 bp, Artificial Sequence
  Description of Artificial Sequence: Synthetic oligonucleotide
ctgagggagtggcccagaccagctt

SEQ ID NO: 81114 - DNA, 27 bp, Artificial Sequence
  Description of Artificial Sequence: Synthetic oligonucleotide
tgagggagtggcccagaccagcttcta

SEQ ID NO: 81115 - DNA, 27 bp, Artificial Sequence
  Description of Artificial Sequence: Synthetic oligonucleotide
gagggagtggcccagaccagcttctat

SEQ ID NO: 81116 - DNA, 28 bp, Artificial Sequence
  Description of Artificial Sequence: Synthetic oligonucleotide
agggagtggcccagaccagcttctattc

SEQ ID NO: 81117 - DNA, 27 bp, Artificial Sequence
  Description of Artificial Sequence: Synthetic oligonucleotide
gggagtggcccagaccagcttctattc

SEQ ID NO: 81118 - DNA, 27 bp, Artificial Sequence
  Description of Artificial Sequence: Synthetic oligonucleotide
ggagtggcccagaccagcttctattcc

SEQ ID NO: 81119 - DNA, 27 bp, Artificial Sequence
  Description of Artificial Sequence: Synthetic oligonucleotide
gagtggcccagaccagcttctattccc

SEQ ID NO: 81120 - DNA, 28 bp, Artificial Sequence
  Description of Artificial Sequence: Synthetic oligonucleotide
agtggcccagaccagcttctattcccag

SEQ ID NO: 81121 - DNA, 27 bp, Artificial Sequence
  Description of Artificial Sequence: Synthetic oligonucleotide
gtggcccagaccagcttctattcccag

SEQ ID NO: 81122 - DNA, 27 bp, Artificial Sequence
  Description of Artificial Sequence: Synthetic oligonucleotide
tggcccagaccagcttctattcccagc

SEQ ID NO: 81123 - DNA, 26 bp, Artificial Sequence
  Description of Artificial Sequence: Synthetic oligonucleotide
ggcccagaccagcttctattcccagc

SEQ ID NO: 81124 - DNA, 27 bp, Artificial Sequence
  Description of Artificial Sequence: Synthetic oligonucleotide
gcccagaccagcttctattcccagcct

SEQ ID NO: 81125 - DNA, 27 bp, Artificial Sequence
  Description of Artificial Sequence: Synthetic oligonucleotide
cccagaccagcttctattcccagcctg

SEQ ID NO: 81126 - DNA, 28 bp, Artificial Sequence
  Description of Artificial Sequence: Synthetic oligonucleotide
ccagaccagcttctattcccagcctgac

SEQ ID NO: 81127 - DNA, 28 bp, Artificial Sequence
  Description of Artificial Sequence: Synthetic oligonucleotide
cagaccagcttctattcccagcctgacc

SEQ ID NO: 81128 - DNA, 32 bp, Artificial Sequence
  Description of Artificial Sequence: Synthetic oligonucleotide
agaccagcttctattcccagcctgaccatttg

SEQ ID NO: 81129 - DNA, 31 bp, Artificial Sequence
  Description of Artificial Sequence: Synthetic oligonucleotide
gaccagcttctattcccagcctgaccatttg

SEQ ID NO: 81130 - DNA, 33 bp, Artificial Sequence
  Description of Artificial Sequence: Synthetic oligonucleotide
accagcttctattcccagcctgaccatttgttc

SEQ ID NO: 81131 - DNA, 32 bp, Artificial Sequence
  Description of Artificial Sequence: Synthetic oligonucleotide
ccagcttctattcccagcctgaccatttgttc

SEQ ID NO: 81132 - DNA, 32 bp, Artificial Sequence
  Description of Artificial Sequence: Synthetic oligonucleotide
cagcttctattcccagcctgaccatttgttcc

SEQ ID NO: 81133 - DNA, 32 bp, Artificial Sequence
  Description of Artificial Sequence: Synthetic oligonucleotide
agcttctattcccagcctgaccatttgttccg

SEQ ID NO: 81134 - DNA, 31 bp, Artificial Sequence
  Description of Artificial Sequence: Synthetic oligonucleotide
gcttctattcccagcctgaccatttgttccg

SEQ ID NO: 81135 - DNA, 31 bp, Artificial Sequence
  Description of Artificial Sequence: Synthetic oligonucleotide
cttctattcccagcctgaccatttgttccgc

SEQ ID NO: 81136 - DNA, 33 bp, Artificial Sequence
  Description of Artificial Sequence: Synthetic oligonucleotide
ttctattcccagcctgaccatttgttccgcaag

SEQ ID NO: 81137 - DNA, 32 bp, Artificial Sequence
  Description of Artificial Sequence: Synthetic oligonucleotide
tctattcccagcctgaccatttgttccgcaag

SEQ ID NO: 81138 - DNA, 31 bp, Artificial Sequence
  Description of Artificial Sequence: Synthetic oligonucleotide
ctattcccagcctgaccatttgttccgcaag

SEQ ID NO: 81139 - DNA, 33 bp, Artificial Sequence
  Description of Artificial Sequence: Synthetic oligonucleotide
tattcccagcctgaccatttgttccgcaagttc

SEQ ID NO: 81140 - DNA, 32 bp, Artificial Sequence
  Description of Artificial Sequence: Synthetic oligonucleotide
attcccagcctgaccatttgttccgcaagttc

SEQ ID NO: 81141 - DNA, 31 bp, Artificial Sequence
  Description of Artificial Sequence: Synthetic oligonucleotide
ttcccagcctgaccatttgttccgcaagttc

SEQ ID NO: 81142 - DNA, 30 bp, Artificial Sequence
  Description of Artificial Sequence: Synthetic oligonucleotide
tcccagcctgaccatttgttccgcaagttc

SEQ ID NO: 81143 - DNA, 29 bp, Artificial Sequence
  Description of Artificial Sequence: Synthetic oligonucleotide
cccagcctgaccatttgttccgcaagttc

SEQ ID NO: 81144 - DNA, 29 bp, Artificial Sequence
  Description of Artificial Sequence: Synthetic oligonucleotide
ccagcctgaccatttgttccgcaagttcc

SEQ ID NO: 81145 - DNA, 30 bp, Artificial Sequence
  Description of Artificial Sequence: Synthetic oligonucleotide
cagcctgaccatttgttccgcaagttccac

SEQ ID NO: 81146 - DNA, 32 bp, Artificial Sequence
  Description of Artificial Sequence: Synthetic oligonucleotide
agcctgaccatttgttccgcaagttccactac

SEQ ID NO: 81147 - DNA, 31 bp, Artificial Sequence
  Description of Artificial Sequence: Synthetic oligonucleotide
gcctgaccatttgttccgcaagttccactac

SEQ ID NO: 81148 - DNA, 31 bp, Artificial Sequence
  Description of Artificial Sequence: Synthetic oligonucleotide
cctgaccatttgttccgcaagttccactacc

SEQ ID NO: 81149 - DNA, 32 bp, Artificial Sequence
  Description of Artificial Sequence: Synthetic oligonucleotide
ctgaccatttgttccgcaagttccactacctg

SEQ ID NO: 81150 - DNA, 32 bp, Artificial Sequence
  Description of Artificial Sequence: Synthetic oligonucleotide
tgaccatttgttccgcaagttccactacctgc

SEQ ID NO: 81151 - DNA, 31 bp, Artificial Sequence
  Description of Artificial Sequence: Synthetic oligonucleotide
gaccatttgttccgcaagttccactacctgc

SEQ ID NO: 81152 - DNA, 31 bp, Artificial Sequence
  Description of Artificial Sequence: Synthetic oligonucleotide
accatttgttccgcaagttccactacctgcc

SEQ ID NO: 81153 - DNA, 30 bp, Artificial Sequence
  Description of Artificial Sequence: Synthetic oligonucleotide
ccatttgttccgcaagttccactacctgcc

SEQ ID NO: 81154 - DNA, 30 bp, Artificial Sequence
  Description of Artificial Sequence: Synthetic oligonucleotide
catttgttccgcaagttccactacctgccc

SEQ ID NO: 81155 - DNA, 32 bp, Artificial Sequence
  Description of Artificial Sequence: Synthetic oligonucleotide
atttgttccgcaagttccactacctgcccttc

SEQ ID NO: 81156 - DNA, 31 bp, Artificial Sequence
  Description of Artificial Sequence: Synthetic oligonucleotide
tttgttccgcaagttccactacctgcccttc

SEQ ID NO: 81157 - DNA, 30 bp, Artificial Sequence
  Description of Artificial Sequence: Synthetic oligonucleotide
ttgttccgcaagttccactacctgcccttc

SEQ ID NO: 81158 - DNA, 29 bp, Artificial Sequence
  Description of Artificial Sequence: Synthetic oligonucleotide
tgttccgcaagttccactacctgcccttc

SEQ ID NO: 81159 - DNA, 28 bp, Artificial Sequence
  Description of Artificial Sequence: Synthetic oligonucleotide
gttccgcaagttccactacctgcccttc

SEQ ID NO: 81160 - DNA, 28 bp, Artificial Sequence
  Description of Artificial Sequence: Synthetic oligonucleotide
ttccgcaagttccactacctgcccttcg

SEQ ID NO: 81161 - DNA, 27 bp, Artificial Sequence
  Description of Artificial Sequence: Synthetic oligonucleotide
tccgcaagttccactacctgcccttcg

SEQ ID NO: 81162 - DNA, 27 bp, Artificial Sequence
  Description of Artificial Sequence: Synthetic oligonucleotide
ccgcaagttccactacctgcccttcgt

SEQ ID NO: 81163 - DNA, 27 bp, Artificial Sequence
  Description of Artificial Sequence: Synthetic oligonucleotide
cgcaagttccactacctgcccttcgtg

SEQ ID NO: 81164 - DNA, 27 bp, Artificial Sequence
  Description of Artificial Sequence: Synthetic oligonucleotide
gcaagttccactacctgcccttcgtgc

SEQ ID NO: 81165 - DNA, 27 bp, Artificial Sequence
  Description of Artificial Sequence: Synthetic oligonucleotide
caagttccactacctgcccttcgtgcc

SEQ ID NO: 81166 - DNA, 27 bp, Artificial Sequence
  Description of Artificial Sequence: Synthetic oligonucleotide
aagttccactacctgcccttcgtgccc

SEQ ID NO: 81167 - DNA, 27 bp, Artificial Sequence
  Description of Artificial Sequence: Synthetic oligonucleotide
agttccactacctgcccttcgtgccct

SEQ ID NO: 81168 - DNA, 26 bp, Artificial Sequence
  Description of Artificial Sequence: Synthetic oligonucleotide
gttccactacctgcccttcgtgccct

SEQ ID NO: 81169 - DNA, 27 bp, Artificial Sequence
  Description of Artificial Sequence: Synthetic oligonucleotide
ttccactacctgcccttcgtgccctca

SEQ ID NO: 81170 - DNA, 26 bp, Artificial Sequence
  Description of Artificial Sequence: Synthetic oligonucleotide
tccactacctgcccttcgtgccctca

SEQ ID NO: 81171 - DNA, 25 bp, Artificial Sequence
  Description of Artificial Sequence: Synthetic oligonucleotide
ccactacctgcccttcgtgccctca

SEQ ID NO: 81172 - DNA, 25 bp, Artificial Sequence
  Description of Artificial Sequence: Synthetic oligonucleotide
cactacctgcccttcgtgccctcag

SEQ ID NO: 81173 - DNA, 25 bp, Artificial Sequence
  Description of Artificial Sequence: Synthetic oligonucleotide
actacctgcccttcgtgccctcagc

SEQ ID NO: 81174 - DNA, 24 bp, Artificial Sequence
  Description of Artificial Sequence: Synthetic oligonucleotide
ctacctgcccttcgtgccctcagc

SEQ ID NO: 81175 - DNA, 24 bp, Artificial Sequence
  Description of Artificial Sequence: Synthetic oligonucleotide
tacctgcccttcgtgccctcagcc

SEQ ID NO: 81176 - DNA, 23 bp, Artificial Sequence
  Description of Artificial Sequence: Synthetic oligonucleotide
acctgcccttcgtgccctcagcc

SEQ ID NO: 81177 - DNA, 22 bp, Artificial Sequence
  Description of Artificial Sequence: Synthetic oligonucleotide
cctgcccttcgtgccctcagcc

SEQ ID NO: 81178 - DNA, 23 bp, Artificial Sequence
  Description of Artificial Sequence: Synthetic oligonucleotide
ctgcccttcgtgccctcagccga

SEQ ID NO: 81179 - DNA, 23 bp, Artificial Sequence
  Description of Artificial Sequence: Synthetic oligonucleotide
tgcccttcgtgccctcagccgag

SEQ ID NO: 81180 - DNA, 22 bp, Artificial Sequence
  Description of Artificial Sequence: Synthetic oligonucleotide
gcccttcgtgccctcagccgag

SEQ ID NO: 81181 - DNA, 23 bp, Artificial Sequence
  Description of Artificial Sequence: Synthetic oligonucleotide
cccttcgtgccctcagccgagga

SEQ ID NO: 81182 - DNA, 23 bp, Artificial Sequence
  Description of Artificial Sequence: Synthetic oligonucleotide
ccttcgtgccctcagccgaggac

SEQ ID NO: 81183 - DNA, 24 bp, Artificial Sequence
  Description of Artificial Sequence: Synthetic oligonucleotide
cttcgtgccctcagccgaggacgt

SEQ ID NO: 81184 - DNA, 27 bp, Artificial Sequence
  Description of Artificial Sequence: Synthetic oligonucleotide
ttcgtgccctcagccgaggacgtctat

SEQ ID NO: 81185 - DNA, 26 bp, Artificial Sequence
  Description of Artificial Sequence: Synthetic oligonucleotide
tcgtgccctcagccgaggacgtctat

SEQ ID NO: 81186 - DNA, 25 bp, Artificial Sequence
  Description of Artificial Sequence: Synthetic oligonucleotide
cgtgccctcagccgaggacgtctat

SEQ ID NO: 81187 - DNA, 26 bp, Artificial Sequence
  Description of Artificial Sequence: Synthetic oligonucleotide
gtgccctcagccgaggacgtctatga

SEQ ID NO: 81188 - DNA, 27 bp, Artificial Sequence
  Description of Artificial Sequence: Synthetic oligonucleotide
tgccctcagccgaggacgtctatgact

SEQ ID NO: 81189 - DNA, 26 bp, Artificial Sequence
  Description of Artificial Sequence: Synthetic oligonucleotide
gccctcagccgaggacgtctatgact

SEQ ID NO: 81190 - DNA, 26 bp, Artificial Sequence
  Description of Artificial Sequence: Synthetic oligonucleotide
ccctcagccgaggacgtctatgactg

SEQ ID NO: 81191 - DNA, 26 bp, Artificial Sequence
  Description of Artificial Sequence: Synthetic oligonucleotide
cctcagccgaggacgtctatgactgc

SEQ ID NO: 81192 - DNA, 27 bp, Artificial Sequence
  Description of Artificial Sequence: Synthetic oligonucleotide
ctcagccgaggacgtctatgactgcca

SEQ ID NO: 81193 - DNA, 27 bp, Artificial Sequence
  Description of Artificial Sequence: Synthetic oligonucleotide
tcagccgaggacgtctatgactgccag

SEQ ID NO: 81194 - DNA, 26 bp, Artificial Sequence
  Description of Artificial Sequence: Synthetic oligonucleotide
cagccgaggacgtctatgactgccag

SEQ ID NO: 81195 - DNA, 27 bp, Artificial Sequence
  Description of Artificial Sequence: Synthetic oligonucleotide
agccgaggacgtctatgactgccaggt

SEQ ID NO: 81196 - DNA, 26 bp, Artificial Sequence
  Description of Artificial Sequence: Synthetic oligonucleotide
gccgaggacgtctatgactgccaggt

SEQ ID NO: 81197 - DNA, 26 bp, Artificial Sequence
  Description of Artificial Sequence: Synthetic oligonucleotide
ccgaggacgtctatgactgccaggtg

SEQ ID NO: 81198 - DNA, 27 bp, Artificial Sequence
  Description of Artificial Sequence: Synthetic oligonucleotide
cgaggacgtctatgactgccaggtgga

SEQ ID NO: 81199 - DNA, 27 bp, Artificial Sequence
  Description of Artificial Sequence: Synthetic oligonucleotide
gaggacgtctatgactgccaggtggag

SEQ ID NO: 81200 - DNA, 27 bp, Artificial Sequence
  Description of Artificial Sequence: Synthetic oligonucleotide
aggacgtctatgactgccaggtggagc

SEQ ID NO: 81201 - DNA, 27 bp, Artificial Sequence
  Description of Artificial Sequence: Synthetic oligonucleotide
ggacgtctatgactgccaggtggagca

SEQ ID NO: 81202 - DNA, 27 bp, Artificial Sequence
  Description of Artificial Sequence: Synthetic oligonucleotide
gacgtctatgactgccaggtggagcac

SEQ ID NO: 81203 - DNA, 28 bp, Artificial Sequence
  Description of Artificial Sequence: Synthetic oligonucleotide
acgtctatgactgccaggtggagcactg

SEQ ID NO: 81204 - DNA, 27 bp, Artificial Sequence
  Description of Artificial Sequence: Synthetic oligonucleotide
cgtctatgactgccaggtggagcactg

SEQ ID NO: 81205 - DNA, 27 bp, Artificial Sequence
  Description of Artificial Sequence: Synthetic oligonucleotide
gtctatgactgccaggtggagcactgg

SEQ ID NO: 81206 - DNA, 27 bp, Artificial Sequence
  Description of Artificial Sequence: Synthetic oligonucleotide
tctatgactgccaggtggagcactggg

SEQ ID NO: 81207 - DNA, 26 bp, Artificial Sequence
  Description of Artificial Sequence: Synthetic oligonucleotide
ctatgactgccaggtggagcactggg

SEQ ID NO: 81208 - DNA, 26 bp, Artificial Sequence
  Description of Artificial Sequence: Synthetic oligonucleotide
tatgactgccaggtggagcactgggg

SEQ ID NO: 81209 - DNA, 25 bp, Artificial Sequence
  Description of Artificial Sequence: Synthetic oligonucleotide
atgactgccaggtggagcactgggg

SEQ ID NO: 81210 - DNA, 24 bp, Artificial Sequence
  Description of Artificial Sequence: Synthetic oligonucleotide
tgactgccaggtggagcactgggg

SEQ ID NO: 81211 - DNA, 23 bp, Artificial Sequence
  Description of Artificial Sequence: Synthetic oligonucleotide
gactgccaggtggagcactgggg

SEQ ID NO: 81212 - DNA, 23 bp, Artificial Sequence
  Description of Artificial Sequence: Synthetic oligonucleotide
actgccaggtggagcactggggc

SEQ ID NO: 81213 - DNA, 22 bp, Artificial Sequence
  Description of Artificial Sequence: Synthetic oligonucleotide
ctgccaggtggagcactggggc

SEQ ID NO: 81214 - DNA, 23 bp, Artificial Sequence
  Description of Artificial Sequence: Synthetic oligonucleotide
tgccaggtggagcactggggcct

SEQ ID NO: 81215 - DNA, 22 bp, Artificial Sequence
  Description of Artificial Sequence: Synthetic oligonucleotide
gccaggtggagcactggggcct

SEQ ID NO: 81216 - DNA, 22 bp, Artificial Sequence
  Description of Artificial Sequence: Synthetic oligonucleotide
ccaggtggagcactggggcctg

SEQ ID NO: 81217 - DNA, 24 bp, Artificial Sequence
  Description of Artificial Sequence: Synthetic oligonucleotide
caggtggagcactggggcctggat

SEQ ID NO: 81218 - DNA, 24 bp, Artificial Sequence
  Description of Artificial Sequence: Synthetic oligonucleotide
aggtggagcactggggcctggatg

SEQ ID NO: 81219 - DNA, 23 bp, Artificial Sequence
  Description of Artificial Sequence: Synthetic oligonucleotide
ggtggagcactggggcctggatg

SEQ ID NO: 81220 - DNA, 23 bp, Artificial Sequence
  Description of Artificial Sequence: Synthetic oligonucleotide
gtggagcactggggcctggatgc

SEQ ID NO: 81221 - DNA, 23 bp, Artificial Sequence
  Description of Artificial Sequence: Synthetic oligonucleotide
tggagcactggggcctggatgcg

SEQ ID NO: 81222 - DNA, 22 bp, Artificial Sequence
  Description of Artificial Sequence: Synthetic oligonucleotide
ggagcactggggcctggatgcg

SEQ ID NO: 81223 - DNA, 22 bp, Artificial Sequence
  Description of Artificial Sequence: Synthetic oligonucleotide
gagcactggggcctggatgcgc

SEQ ID NO: 81224 - DNA, 23 bp, Artificial Sequence
  Description of Artificial Sequence: Synthetic oligonucleotide
agcactggggcctggatgcgcca

SEQ ID NO: 81225 - DNA, 22 bp, Artificial Sequence
  Description of Artificial Sequence: Synthetic oligonucleotide
gcactggggcctggatgcgcca

SEQ ID NO: 81226 - DNA, 23 bp, Artificial Sequence
  Description of Artificial Sequence: Synthetic oligonucleotide
cactggggcctggatgcgccact

SEQ ID NO: 81227 - DNA, 23 bp, Artificial Sequence
  Description of Artificial Sequence: Synthetic oligonucleotide
actggggcctggatgcgccactc

SEQ ID NO: 81228 - DNA, 22 bp, Artificial Sequence
  Description of Artificial Sequence: Synthetic oligonucleotide
ctggggcctggatgcgccactc

SEQ ID NO: 81229 - DNA, 23 bp, Artificial Sequence
  Description of Artificial Sequence: Synthetic oligonucleotide
tggggcctggatgcgccactcct

SEQ ID NO: 81230 - DNA, 22 bp, Artificial Sequence
  Description of Artificial Sequence: Synthetic oligonucleotide
ggggcctggatgcgccactcct

SEQ ID NO: 81231 - DNA, 23 bp, Artificial Sequence
  Description of Artificial Sequence: Synthetic oligonucleotide
gggcctggatgcgccactcctca

SEQ ID NO: 81232 - DNA, 23 bp, Artificial Sequence
  Description of Artificial Sequence: Synthetic oligonucleotide
ggcctggatgcgccactcctcag

SEQ ID NO: 81233 - DNA, 23 bp, Artificial Sequence
  Description of Artificial Sequence: Synthetic oligonucleotide
gcctggatgcgccactcctcagg

SEQ ID NO: 81234 - DNA, 26 bp, Artificial Sequence
  Description of Artificial Sequence: Synthetic oligonucleotide
cctggatgcgccactcctcaggcatt

SEQ ID NO: 81235 - DNA, 26 bp, Artificial Sequence
  Description of Artificial Sequence: Synthetic oligonucleotide
ctggatgcgccactcctcaggcattg

SEQ ID NO: 81236 - DNA, 26 bp, Artificial Sequence
  Description of Artificial Sequence: Synthetic oligonucleotide
tggatgcgccactcctcaggcattgg

SEQ ID NO: 81237 - DNA, 25 bp, Artificial Sequence
  Description of Artificial Sequence: Synthetic oligonucleotide
ggatgcgccactcctcaggcattgg

SEQ ID NO: 81238 - DNA, 26 bp, Artificial Sequence
  Description of Artificial Sequence: Synthetic oligonucleotide
gatgcgccactcctcaggcattggga

SEQ ID NO: 81239 - DNA, 26 bp, Artificial Sequence
  Description of Artificial Sequence: Synthetic oligonucleotide
atgcgccactcctcaggcattgggag

SEQ ID NO: 81240 - DNA, 25 bp, Artificial Sequence
  Description of Artificial Sequence: Synthetic oligonucleotide
tgcgccactcctcaggcattgggag

SEQ ID NO: 81241 - DNA, 24 bp, Artificial Sequence
  Description of Artificial Sequence: Synthetic oligonucleotide
gcgccactcctcaggcattgggag

SEQ ID NO: 81242 - DNA, 25 bp, Artificial Sequence
  Description of Artificial Sequence: Synthetic oligonucleotide
cgccactcctcaggcattgggagct

SEQ ID NO: 81243 - DNA, 25 bp, Artificial Sequence
  Description of Artificial Sequence: Synthetic oligonucleotide
gccactcctcaggcattgggagctc

SEQ ID NO: 81244 - DNA, 26 bp, Artificial Sequence
  Description of Artificial Sequence: Synthetic oligonucleotide
ccactcctcaggcattgggagctcca

SEQ ID NO: 81245 - DNA, 26 bp, Artificial Sequence
  Description of Artificial Sequence: Synthetic oligonucleotide
cactcctcaggcattgggagctccag

SEQ ID NO: 81246 - DNA, 27 bp, Artificial Sequence
  Description of Artificial Sequence: Synthetic oligonucleotide
actcctcaggcattgggagctccaggt

SEQ ID NO: 81247 - DNA, 26 bp, Artificial Sequence
  Description of Artificial Sequence: Synthetic oligonucleotide
ctcctcaggcattgggagctccaggt

SEQ ID NO: 81248 - DNA, 26 bp, Artificial Sequence
  Description of Artificial Sequence: Synthetic oligonucleotide
tcctcaggcattgggagctccaggtg

SEQ ID NO: 81249 - DNA, 25 bp, Artificial Sequence
  Description of Artificial Sequence: Synthetic oligonucleotide
cctcaggcattgggagctccaggtg

SEQ ID NO: 81250 - DNA, 25 bp, Artificial Sequence
  Description of Artificial Sequence: Synthetic oligonucleotide
ctcaggcattgggagctccaggtgc

SEQ ID NO: 81251 - DNA, 27 bp, Artificial Sequence
  Description of Artificial Sequence: Synthetic oligonucleotide
tcaggcattgggagctccaggtgccta

SEQ ID NO: 81252 - DNA, 27 bp, Artificial Sequence
  Description of Artificial Sequence: Synthetic oligonucleotide
caggcattgggagctccaggtgcctat

SEQ ID NO: 81253 - DNA, 28 bp, Artificial Sequence
  Description of Artificial Sequence: Synthetic oligonucleotide
aggcattgggagctccaggtgcctattc

SEQ ID NO: 81254 - DNA, 27 bp, Artificial Sequence
  Description of Artificial Sequence: Synthetic oligonucleotide
ggcattgggagctccaggtgcctattc

SEQ ID NO: 81255 - DNA, 27 bp, Artificial Sequence
  Description of Artificial Sequence: Synthetic oligonucleotide
gcattgggagctccaggtgcctattcc

SEQ ID NO: 81256 - DNA, 28 bp, Artificial Sequence
  Description of Artificial Sequence: Synthetic oligonucleotide
cattgggagctccaggtgcctattccac

SEQ ID NO: 81257 - DNA, 28 bp, Artificial Sequence
  Description of Artificial Sequence: Synthetic oligonucleotide
attgggagctccaggtgcctattccacc

SEQ ID NO: 81258 - DNA, 27 bp, Artificial Sequence
  Description of Artificial Sequence: Synthetic oligonucleotide
ttgggagctccaggtgcctattccacc

SEQ ID NO: 81259 - DNA, 27 bp, Artificial Sequence
  Description of Artificial Sequence: Synthetic oligonucleotide
tgggagctccaggtgcctattccacca

SEQ ID NO: 81260 - DNA, 26 bp, Artificial Sequence
  Description of Artificial Sequence: Synthetic oligonucleotide
gggagctccaggtgcctattccacca

SEQ ID NO: 81261 - DNA, 26 bp, Artificial Sequence
  Description of Artificial Sequence: Synthetic oligonucleotide
ggagctccaggtgcctattccaccac

SEQ ID NO: 81262 - DNA, 27 bp, Artificial Sequence
  Description of Artificial Sequence: Synthetic oligonucleotide
gagctccaggtgcctattccaccacca

SEQ ID NO: 81263 - DNA, 27 bp, Artificial Sequence
  Description of Artificial Sequence: Synthetic oligonucleotide
agctccaggtgcctattccaccaccag

SEQ ID NO: 81264 - DNA, 27 bp, Artificial Sequence
  Description of Artificial Sequence: Synthetic oligonucleotide
gctccaggtgcctattccaccaccaga

SEQ ID NO: 81265 - DNA, 28 bp, Artificial Sequence
  Description of Artificial Sequence: Synthetic oligonucleotide
ctccaggtgcctattccaccaccagatg

SEQ ID NO: 81266 - DNA, 28 bp, Artificial Sequence
  Description of Artificial Sequence: Synthetic oligonucleotide
tccaggtgcctattccaccaccagatgc

SEQ ID NO: 81267 - DNA, 27 bp, Artificial Sequence
  Description of Artificial Sequence: Synthetic oligonucleotide
ccaggtgcctattccaccaccagatgc

SEQ ID NO: 81268 - DNA, 27 bp, Artificial Sequence
  Description of Artificial Sequence: Synthetic oligonucleotide
caggtgcctattccaccaccagatgcc

SEQ ID NO: 81269 - DNA, 29 bp, Artificial Sequence
  Description of Artificial Sequence: Synthetic oligonucleotide
aggtgcctattccaccaccagatgccatg

SEQ ID NO: 81270 - DNA, 28 bp, Artificial Sequence
  Description of Artificial Sequence: Synthetic oligonucleotide
ggtgcctattccaccaccagatgccatg

SEQ ID NO: 81271 - DNA, 28 bp, Artificial Sequence
  Description of Artificial Sequence: Synthetic oligonucleotide
gtgcctattccaccaccagatgccatgg

SEQ ID NO: 81272 - DNA, 29 bp, Artificial Sequence
  Description of Artificial Sequence: Synthetic oligonucleotide
tgcctattccaccaccagatgccatggag

SEQ ID NO: 81273 - DNA, 28 bp, Artificial Sequence
  Description of Artificial Sequence: Synthetic oligonucleotide
gcctattccaccaccagatgccatggag

SEQ ID NO: 81274 - DNA, 29 bp, Artificial Sequence
  Description of Artificial Sequence: Synthetic oligonucleotide
cctattccaccaccagatgccatggagac

SEQ ID NO: 81275 - DNA, 29 bp, Artificial Sequence
  Description of Artificial Sequence: Synthetic oligonucleotide
ctattccaccaccagatgccatggagacc

SEQ ID NO: 81276 - DNA, 29 bp, Artificial Sequence
  Description of Artificial Sequence: Synthetic oligonucleotide
tattccaccaccagatgccatggagaccc

SEQ ID NO: 81277 - DNA, 28 bp, Artificial Sequence
  Description of Artificial Sequence: Synthetic oligonucleotide
attccaccaccagatgccatggagaccc

SEQ ID NO: 81278 - DNA, 27 bp, Artificial Sequence
  Description of Artificial Sequence: Synthetic oligonucleotide
ttccaccaccagatgccatggagaccc

SEQ ID NO: 81279 - DNA, 27 bp, Artificial Sequence
  Description of Artificial Sequence: Synthetic oligonucleotide
tccaccaccagatgccatggagaccct

SEQ ID NO: 81280 - DNA, 26 bp, Artificial Sequence
  Description of Artificial Sequence: Synthetic oligonucleotide
ccaccaccagatgccatggagaccct

SEQ ID NO: 81281 - DNA, 26 bp, Artificial Sequence
  Description of Artificial Sequence: Synthetic oligonucleotide
caccaccagatgccatggagaccctg

SEQ ID NO: 81282 - DNA, 27 bp, Artificial Sequence
  Description of Artificial Sequence: Synthetic oligonucleotide
accaccagatgccatggagaccctggt

SEQ ID NO: 81283 - DNA, 26 bp, Artificial Sequence
  Description of Artificial Sequence: Synthetic oligonucleotide
ccaccagatgccatggagaccctggt

SEQ ID NO: 81284 - DNA, 27 bp, Artificial Sequence
  Description of Artificial Sequence: Synthetic oligonucleotide
caccagatgccatggagaccctggtct

SEQ ID NO: 81285 - DNA, 27 bp, Artificial Sequence
  Description of Artificial Sequence: Synthetic oligonucleotide
accagatgccatggagaccctggtctg

SEQ ID NO: 81286 - DNA, 27 bp, Artificial Sequence
  Description of Artificial Sequence: Synthetic oligonucleotide
ccagatgccatggagaccctggtctgt

SEQ ID NO: 81287 - DNA, 27 bp, Artificial Sequence
  Description of Artificial Sequence: Synthetic oligonucleotide
cagatgccatggagaccctggtctgtg

SEQ ID NO: 81288 - DNA, 27 bp, Artificial Sequence
  Description of Artificial Sequence: Synthetic oligonucleotide
agatgccatggagaccctggtctgtgc

SEQ ID NO: 81289 - DNA, 26 bp, Artificial Sequence
  Description of Artificial Sequence: Synthetic oligonucleotide
gatgccatggagaccctggtctgtgc

SEQ ID NO: 81290 - DNA, 26 bp, Artificial Sequence
  Description of Artificial Sequence: Synthetic oligonucleotide
atgccatggagaccctggtctgtgcc

SEQ ID NO: 81291 - DNA, 25 bp, Artificial Sequence
  Description of Artificial Sequence: Synthetic oligonucleotide
tgccatggagaccctggtctgtgcc

SEQ ID NO: 81292 - DNA, 24 bp, Artificial Sequence
  Description of Artificial Sequence: Synthetic oligonucleotide
gccatggagaccctggtctgtgcc

SEQ ID NO: 81293 - DNA, 25 bp, Artificial Sequence
  Description of Artificial Sequence: Synthetic oligonucleotide
ccatggagaccctggtctgtgccct

SEQ ID NO: 81294 - DNA, 25 bp, Artificial Sequence
  Description of Artificial Sequence: Synthetic oligonucleotide
catggagaccctggtctgtgccctg

SEQ ID NO: 81295 - DNA, 25 bp, Artificial Sequence
  Description of Artificial Sequence: Synthetic oligonucleotide
atggagaccctggtctgtgccctgg

SEQ ID NO: 81296 - DNA, 24 bp, Artificial Sequence
  Description of Artificial Sequence: Synthetic oligonucleotide
tggagaccctggtctgtgccctgg

SEQ ID NO: 81297 - DNA, 23 bp, Artificial Sequence
  Description of Artificial Sequence: Synthetic oligonucleotide
ggagaccctggtctgtgccctgg

SEQ ID NO: 81298 - DNA, 24 bp, Artificial Sequence
  Description of Artificial Sequence: Synthetic oligonucleotide
gagaccctggtctgtgccctgggt

SEQ ID NO: 81299 - DNA, 25 bp, Artificial Sequence
  Description of Artificial Sequence: Synthetic oligonucleotide
agaccctggtctgtgccctgggtct

SEQ ID NO: 81300 - DNA, 24 bp, Artificial Sequence
  Description of Artificial Sequence: Synthetic oligonucleotide
gaccctggtctgtgccctgggtct

SEQ ID NO: 81301 - DNA, 24 bp, Artificial Sequence
  Description of Artificial Sequence: Synthetic oligonucleotide
accctggtctgtgccctgggtctg

SEQ ID NO: 81302 - DNA, 23 bp, Artificial Sequence
  Description of Artificial Sequence: Synthetic oligonucleotide
ccctggtctgtgccctgggtctg

SEQ ID NO: 81303 - DNA, 23 bp, Artificial Sequence
  Description of Artificial Sequence: Synthetic oligonucleotide
cctggtctgtgccctgggtctgg

SEQ ID NO: 81304 - DNA, 23 bp, Artificial Sequence
  Description of Artificial Sequence: Synthetic oligonucleotide
ctggtctgtgccctgggtctggc

SEQ ID NO: 81305 - DNA, 25 bp, Artificial Sequence
  Description of Artificial Sequence: Synthetic oligonucleotide
tggtctgtgccctgggtctggccat

SEQ ID NO: 81306 - DNA, 24 bp, Artificial Sequence
  Description of Artificial Sequence: Synthetic oligonucleotide
ggtctgtgccctgggtctggccat

SEQ ID NO: 81307 - DNA, 24 bp, Artificial Sequence
  Description of Artificial Sequence: Synthetic oligonucleotide
gtctgtgccctgggtctggccatc

SEQ ID NO: 81308 - DNA, 24 bp, Artificial Sequence
  Description of Artificial Sequence: Synthetic oligonucleotide
tctgtgccctgggtctggccatcg

SEQ ID NO: 81309 - DNA, 23 bp, Artificial Sequence
  Description of Artificial Sequence: Synthetic oligonucleotide
ctgtgccctgggtctggccatcg

SEQ ID NO: 81310 - DNA, 23 bp, Artificial Sequence
  Description of Artificial Sequence: Synthetic oligonucleotide
tgtgccctgggtctggccatcgg

SEQ ID NO: 81311 - DNA, 22 bp, Artificial Sequence
  Description of Artificial Sequence: Synthetic oligonucleotide
gtgccctgggtctggccatcgg

SEQ ID NO: 81312 - DNA, 22 bp, Artificial Sequence
  Description of Artificial Sequence: Synthetic oligonucleotide
tgccctgggtctggccatcggc

SEQ ID NO: 81313 - DNA, 21 bp, Artificial Sequence
  Description of Artificial Sequence: Synthetic oligonucleotide
gccctgggtctggccatcggc

SEQ ID NO: 81314 - DNA, 22 bp, Artificial Sequence
  Description of Artificial Sequence: Synthetic oligonucleotide
ccctgggtctggccatcggcct

SEQ ID NO: 81315 - DNA, 22 bp, Artificial Sequence
  Description of Artificial Sequence: Synthetic oligonucleotide
cctgggtctggccatcggcctg

SEQ ID NO: 81316 - DNA, 23 bp, Artificial Sequence
  Description of Artificial Sequence: Synthetic oligonucleotide
ctgggtctggccatcggcctggt

SEQ ID NO: 81317 - DNA, 23 bp, Artificial Sequence
  Description of Artificial Sequence: Synthetic oligonucleotide
tgggtctggccatcggcctggtg

SEQ ID NO: 81318 - DNA, 22 bp, Artificial Sequence
  Description of Artificial Sequence: Synthetic oligonucleotide
gggtctggccatcggcctggtg

SEQ ID NO: 81319 - DNA, 22 bp, Artificial Sequence
  Description of Artificial Sequence: Synthetic oligonucleotide
ggtctggccatcggcctggtgg

SEQ ID NO: 81320 - DNA, 22 bp, Artificial Sequence
  Description of Artificial Sequence: Synthetic oligonucleotide
gtctggccatcggcctggtggg

SEQ ID NO: 81321 - DNA, 24 bp, Artificial Sequence
  Description of Artificial Sequence: Synthetic oligonucleotide
tctggccatcggcctggtgggctt

SEQ ID NO: 81322 - DNA, 23 bp, Artificial Sequence
  Description of Artificial Sequence: Synthetic oligonucleotide
ctggccatcggcctggtgggctt

SEQ ID NO: 81323 - DNA, 23 bp, Artificial Sequence
  Description of Artificial Sequence: Synthetic oligonucleotide
tggccatcggcctggtgggcttc

SEQ ID NO: 81324 - DNA, 22 bp, Artificial Sequence
  Description of Artificial Sequence: Synthetic oligonucleotide
ggccatcggcctggtgggcttc

SEQ ID NO: 81325 - DNA, 23 bp, Artificial Sequence
  Description of Artificial Sequence: Synthetic oligonucleotide
gccatcggcctggtgggcttcct

SEQ ID NO: 81326 - DNA, 23 bp, Artificial Sequence
  Description of Artificial Sequence: Synthetic oligonucleotide
ccatcggcctggtgggcttcctc

SEQ ID NO: 81327 - DNA, 24 bp, Artificial Sequence
  Description of Artificial Sequence: Synthetic oligonucleotide
catcggcctggtgggcttcctcgt

SEQ ID NO: 81328 - DNA, 24 bp, Artificial Sequence
  Description of Artificial Sequence: Synthetic oligonucleotide
atcggcctggtgggcttcctcgtg

SEQ ID NO: 81329 - DNA, 23 bp, Artificial Sequence
  Description of Artificial Sequence: Synthetic oligonucleotide
tcggcctggtgggcttcctcgtg

SEQ ID NO: 81330 - DNA, 22 bp, Artificial Sequence
  Description of Artificial Sequence: Synthetic oligonucleotide
cggcctggtgggcttcctcgtg

SEQ ID NO: 81331 - DNA, 22 bp, Artificial Sequence
  Description of Artificial Sequence: Synthetic oligonucleotide
ggcctggtgggcttcctcgtgg

SEQ ID NO: 81332 - DNA, 22 bp, Artificial Sequence
  Description of Artificial Sequence: Synthetic oligonucleotide
gcctggtgggcttcctcgtggg

SEQ ID NO: 81333 - DNA, 23 bp, Artificial Sequence
  Description of Artificial Sequence: Synthetic oligonucleotide
cctggtgggcttcctcgtgggca

SEQ ID NO: 81334 - DNA, 23 bp, Artificial Sequence
  Description of Artificial Sequence: Synthetic oligonucleotide
ctggtgggcttcctcgtgggcac

SEQ ID NO: 81335 - DNA, 23 bp, Artificial Sequence
  Description of Artificial Sequence: Synthetic oligonucleotide
tggtgggcttcctcgtgggcacc

SEQ ID NO: 81336 - DNA, 22 bp, Artificial Sequence
  Description of Artificial Sequence: Synthetic oligonucleotide
ggtgggcttcctcgtgggcacc

SEQ ID NO: 81337 - DNA, 23 bp, Artificial Sequence
  Description of Artificial Sequence: Synthetic oligonucleotide
gtgggcttcctcgtgggcaccgt

SEQ ID NO: 81338 - DNA, 23 bp, Artificial Sequence
  Description of Artificial Sequence: Synthetic oligonucleotide
tgggcttcctcgtgggcaccgtc

SEQ ID NO: 81339 - DNA, 22 bp, Artificial Sequence
  Description of Artificial Sequence: Synthetic oligonucleotide
gggcttcctcgtgggcaccgtc

SEQ ID NO: 81340 - DNA, 23 bp, Artificial Sequence
  Description of Artificial Sequence: Synthetic oligonucleotide
ggcttcctcgtgggcaccgtcct

SEQ ID NO: 81341 - DNA, 25 bp, Artificial Sequence
  Description of Artificial Sequence: Synthetic oligonucleotide
gcttcctcgtgggcaccgtcctcat

SEQ ID NO: 81342 - DNA, 27 bp, Artificial Sequence
  Description of Artificial Sequence: Synthetic oligonucleotide
cttcctcgtgggcaccgtcctcatcat

SEQ ID NO: 81343 - DNA, 27 bp, Artificial Sequence
  Description of Artificial Sequence: Synthetic oligonucleotide
ttcctcgtgggcaccgtcctcatcatc

SEQ ID NO: 81344 - DNA, 27 bp, Artificial Sequence
  Description of Artificial Sequence: Synthetic oligonucleotide
tcctcgtgggcaccgtcctcatcatca

SEQ ID NO: 81345 - DNA, 27 bp, Artificial Sequence
  Description of Artificial Sequence: Synthetic oligonucleotide
cctcgtgggcaccgtcctcatcatcat

SEQ ID NO: 81346 - DNA, 27 bp, Artificial Sequence
  Description of Artificial Sequence: Synthetic oligonucleotide
ctcgtgggcaccgtcctcatcatcatg

SEQ ID NO: 81347 - DNA, 27 bp, Artificial Sequence
  Description of Artificial Sequence: Synthetic oligonucleotide
tcgtgggcaccgtcctcatcatcatgg

SEQ ID NO: 81348 - DNA, 26 bp, Artificial Sequence
  Description of Artificial Sequence: Synthetic oligonucleotide
cgtgggcaccgtcctcatcatcatgg

SEQ ID NO: 81349 - DNA, 26 bp, Artificial Sequence
  Description of Artificial Sequence: Synthetic oligonucleotide
gtgggcaccgtcctcatcatcatggg

SEQ ID NO: 81350 - DNA, 27 bp, Artificial Sequence
  Description of Artificial Sequence: Synthetic oligonucleotide
tgggcaccgtcctcatcatcatgggca

SEQ ID NO: 81351 - DNA, 26 bp, Artificial Sequence
  Description of Artificial Sequence: Synthetic oligonucleotide
gggcaccgtcctcatcatcatgggca

SEQ ID NO: 81352 - DNA, 27 bp, Artificial Sequence
  Description of Artificial Sequence: Synthetic oligonucleotide
ggcaccgtcctcatcatcatgggcaca

SEQ ID NO: 81353 - DNA, 30 bp, Artificial Sequence
  Description of Artificial Sequence: Synthetic oligonucleotide
gcaccgtcctcatcatcatgggcacatatg

SEQ ID NO: 81354 - DNA, 31 bp, Artificial Sequence
  Description of Artificial Sequence: Synthetic oligonucleotide
caccgtcctcatcatcatgggcacatatgtg

SEQ ID NO: 81355 - DNA, 32 bp, Artificial Sequence
  Description of Artificial Sequence: Synthetic oligonucleotide
accgtcctcatcatcatgggcacatatgtgtc

SEQ ID NO: 81356 - DNA, 31 bp, Artificial Sequence
  Description of Artificial Sequence: Synthetic oligonucleotide
ccgtcctcatcatcatgggcacatatgtgtc

SEQ ID NO: 81357 - DNA, 31 bp, Artificial Sequence
  Description of Artificial Sequence: Synthetic oligonucleotide
cgtcctcatcatcatgggcacatatgtgtcc

SEQ ID NO: 81358 - DNA, 32 bp, Artificial Sequence
  Description of Artificial Sequence: Synthetic oligonucleotide
gtcctcatcatcatgggcacatatgtgtccag

SEQ ID NO: 81359 - DNA, 33 bp, Artificial Sequence
  Description of Artificial Sequence: Synthetic oligonucleotide
tcctcatcatcatgggcacatatgtgtccagtg

SEQ ID NO: 81360 - DNA, 32 bp, Artificial Sequence
  Description of Artificial Sequence: Synthetic oligonucleotide
cctcatcatcatgggcacatatgtgtccagtg

SEQ ID NO: 81361 - DNA, 33 bp, Artificial Sequence
  Description of Artificial Sequence: Synthetic oligonucleotide
ctcatcatcatgggcacatatgtgtccagtgtc

SEQ ID NO: 81362 - DNA, 33 bp, Artificial Sequence
  Description of Artificial Sequence: Synthetic oligonucleotide
tcatcatcatgggcacatatgtgtccagtgtcc

SEQ ID NO: 81363 - DNA, 32 bp, Artificial Sequence
  Description of Artificial Sequence: Synthetic oligonucleotide
catcatcatgggcacatatgtgtccagtgtcc

SEQ ID NO: 81364 - DNA, 32 bp, Artificial Sequence
  Description of Artificial Sequence: Synthetic oligonucleotide
atcatcatgggcacatatgtgtccagtgtccc

SEQ ID NO: 81365 - DNA, 31 bp, Artificial Sequence
  Description of Artificial Sequence: Synthetic oligonucleotide
tcatcatgggcacatatgtgtccagtgtccc

SEQ ID NO: 81366 - DNA, 30 bp, Artificial Sequence
  Description of Artificial Sequence: Synthetic oligonucleotide
catcatgggcacatatgtgtccagtgtccc

SEQ ID NO: 81367 - DNA, 30 bp, Artificial Sequence
  Description of Artificial Sequence: Synthetic oligonucleotide
atcatgggcacatatgtgtccagtgtcccc

SEQ ID NO: 81368 - DNA, 29 bp, Artificial Sequence
  Description of Artificial Sequence: Synthetic oligonucleotide
tcatgggcacatatgtgtccagtgtcccc

SEQ ID NO: 81369 - DNA, 28 bp, Artificial Sequence
  Description of Artificial Sequence: Synthetic oligonucleotide
catgggcacatatgtgtccagtgtcccc

SEQ ID NO: 81370 - DNA, 29 bp, Artificial Sequence
  Description of Artificial Sequence: Synthetic oligonucleotide
atgggcacatatgtgtccagtgtccccag

SEQ ID NO: 81371 - DNA, 28 bp, Artificial Sequence
  Description of Artificial Sequence: Synthetic oligonucleotide
tgggcacatatgtgtccagtgtccccag

SEQ ID NO: 81372 - DNA, 27 bp, Artificial Sequence
  Description of Artificial Sequence: Synthetic oligonucleotide
gggcacatatgtgtccagtgtccccag

SEQ ID NO: 81373 - DNA, 27 bp, Artificial Sequence
  Description of Artificial Sequence: Synthetic oligonucleotide
ggcacatatgtgtccagtgtccccagg

SEQ ID NO: 81374 - DNA, 31 bp, Artificial Sequence
  Description of Artificial Sequence: Synthetic oligonucleotide
gcacatatgtgtccagtgtccccaggtaatg

SEQ ID NO: 81375 - DNA, 33 bp, Artificial Sequence
  Description of Artificial Sequence: Synthetic oligonucleotide
cacatatgtgtccagtgtccccaggtaatgatc

SEQ ID NO: 81376 - DNA, 33 bp, Artificial Sequence
  Description of Artificial Sequence: Synthetic oligonucleotide
acatatgtgtccagtgtccccaggtaatgatcc

SEQ ID NO: 81377 - DNA, 32 bp, Artificial Sequence
  Description of Artificial Sequence: Synthetic oligonucleotide
catatgtgtccagtgtccccaggtaatgatcc

SEQ ID NO: 81378 - DNA, 34 bp, Artificial Sequence
  Description of Artificial Sequence: Synthetic oligonucleotide
atatgtgtccagtgtccccaggtaatgatccttc

SEQ ID NO: 81379 - DNA, 33 bp, Artificial Sequence
  Description of Artificial Sequence: Synthetic oligonucleotide
tatgtgtccagtgtccccaggtaatgatccttc

SEQ ID NO: 81380 - DNA, 32 bp, Artificial Sequence
  Description of Artificial Sequence: Synthetic oligonucleotide
atgtgtccagtgtccccaggtaatgatccttc

SEQ ID NO: 81381 - DNA, 31 bp, Artificial Sequence
  Description of Artificial Sequence: Synthetic oligonucleotide
tgtgtccagtgtccccaggtaatgatccttc

SEQ ID NO: 81382 - DNA, 30 bp, Artificial Sequence
  Description of Artificial Sequence: Synthetic oligonucleotide
gtgtccagtgtccccaggtaatgatccttc

SEQ ID NO: 81383 - DNA, 31 bp, Artificial Sequence
  Description of Artificial Sequence: Synthetic oligonucleotide
tgtccagtgtccccaggtaatgatccttctg

SEQ ID NO: 81384 - DNA, 30 bp, Artificial Sequence
  Description of Artificial Sequence: Synthetic oligonucleotide
gtccagtgtccccaggtaatgatccttctg

SEQ ID NO: 81385 - DNA, 31 bp, Artificial Sequence
  Description of Artificial Sequence: Synthetic oligonucleotide
tccagtgtccccaggtaatgatccttctgag

SEQ ID NO: 81386 - DNA, 30 bp, Artificial Sequence
  Description of Artificial Sequence: Synthetic oligonucleotide
ccagtgtccccaggtaatgatccttctgag

SEQ ID NO: 81387 - DNA, 31 bp, Artificial Sequence
  Description of Artificial Sequence: Synthetic oligonucleotide
cagtgtccccaggtaatgatccttctgagag

SEQ ID NO: 81388 - DNA, 35 bp, Artificial Sequence
  Description of Artificial Sequence: Synthetic oligonucleotide
agtgtccccaggtaatgatccttctgagagaaatg

SEQ ID NO: 81389 - DNA, 34 bp, Artificial Sequence
  Description of Artificial Sequence: Synthetic oligonucleotide
gtgtccccaggtaatgatccttctgagagaaatg

SEQ ID NO: 81390 - DNA, 35 bp, Artificial Sequence
  Description of Artificial Sequence: Synthetic oligonucleotide
tgtccccaggtaatgatccttctgagagaaatgac

SEQ ID NO: 81391 - DNA, 34 bp, Artificial Sequence
  Description of Artificial Sequence: Synthetic oligonucleotide
gtccccaggtaatgatccttctgagagaaatgac

SEQ ID NO: 81392 - DNA, 36 bp, Artificial Sequence
  Description of Artificial Sequence: Synthetic oligonucleotide
tccccaggtaatgatccttctgagagaaatgacttg

SEQ ID NO: 81393 - DNA, 35 bp, Artificial Sequence
  Description of Artificial Sequence: Synthetic oligonucleotide
ccccaggtaatgatccttctgagagaaatgacttg

SEQ ID NO: 81394 - DNA, 36 bp, Artificial Sequence
  Description of Artificial Sequence: Synthetic oligonucleotide
cccaggtaatgatccttctgagagaaatgacttgtg

SEQ ID NO: 81395 - DNA, 36 bp, Artificial Sequence
  Description of Artificial Sequence: Synthetic oligonucleotide
ccaggtaatgatccttctgagagaaatgacttgtgg

SEQ ID NO: 81396 - DNA, 36 bp, Artificial Sequence
  Description of Artificial Sequence: Synthetic oligonucleotide
caggtaatgatccttctgagagaaatgacttgtggg

SEQ ID NO: 81397 - DNA, 37 bp, Artificial Sequence
  Description of Artificial Sequence: Synthetic oligonucleotide
aggtaatgatccttctgagagaaatgacttgtgggag

SEQ ID NO: 81398 - DNA, 36 bp, Artificial Sequence
  Description of Artificial Sequence: Synthetic oligonucleotide
ggtaatgatccttctgagagaaatgacttgtgggag

SEQ ID NO: 81399 - DNA, 37 bp, Artificial Sequence
  Description of Artificial Sequence: Synthetic oligonucleotide
gtaatgatccttctgagagaaatgacttgtgggagac

SEQ ID NO: 81400 - DNA, 38 bp, Artificial Sequence
  Description of Artificial Sequence: Synthetic oligonucleotide
taatgatccttctgagagaaatgacttgtgggagacac

SEQ ID NO: 81401 - DNA, 37 bp, Artificial Sequence
  Description of Artificial Sequence: Synthetic oligonucleotide
aatgatccttctgagagaaatgacttgtgggagacac

SEQ ID NO: 81402 - DNA, 36 bp, Artificial Sequence
  Description of Artificial Sequence: Synthetic oligonucleotide
atgatccttctgagagaaatgacttgtgggagacac

SEQ ID NO: 81403 - DNA, 35 bp, Artificial Sequence
  Description of Artificial Sequence: Synthetic oligonucleotide
tgatccttctgagagaaatgacttgtgggagacac

SEQ ID NO: 81404 - DNA, 34 bp, Artificial Sequence
  Description of Artificial Sequence: Synthetic oligonucleotide
gatccttctgagagaaatgacttgtgggagacac

SEQ ID NO: 81405 - DNA, 34 bp, Artificial Sequence
  Description of Artificial Sequence: Synthetic oligonucleotide
atccttctgagagaaatgacttgtgggagacacc

SEQ ID NO: 81406 - DNA, 33 bp, Artificial Sequence
  Description of Artificial Sequence: Synthetic oligonucleotide
tccttctgagagaaatgacttgtgggagacacc

SEQ ID NO: 81407 - DNA, 32 bp, Artificial Sequence
  Description of Artificial Sequence: Synthetic oligonucleotide
ccttctgagagaaatgacttgtgggagacacc

SEQ ID NO: 81408 - DNA, 32 bp, Artificial Sequence
  Description of Artificial Sequence: Synthetic oligonucleotide
cttctgagagaaatgacttgtgggagacaccc

SEQ ID NO: 81409 - DNA, 33 bp, Artificial Sequence
  Description of Artificial Sequence: Synthetic oligonucleotide
ttctgagagaaatgacttgtgggagacaccctg

SEQ ID NO: 81410 - DNA, 32 bp, Artificial Sequence
  Description of Artificial Sequence: Synthetic oligonucleotide
tctgagagaaatgacttgtgggagacaccctg

SEQ ID NO: 81411 - DNA, 31 bp, Artificial Sequence
  Description of Artificial Sequence: Synthetic oligonucleotide
ctgagagaaatgacttgtgggagacaccctg

SEQ ID NO: 81412 - DNA, 31 bp, Artificial Sequence
  Description of Artificial Sequence: Synthetic oligonucleotide
tgagagaaatgacttgtgggagacaccctgc

SEQ ID NO: 81413 - DNA, 30 bp, Artificial Sequence
  Description of Artificial Sequence: Synthetic oligonucleotide
gagagaaatgacttgtgggagacaccctgc

SEQ ID NO: 81414 - DNA, 31 bp, Artificial Sequence
  Description of Artificial Sequence: Synthetic oligonucleotide
agagaaatgacttgtgggagacaccctgcag

SEQ ID NO: 81415 - DNA, 30 bp, Artificial Sequence
  Description of Artificial Sequence: Synthetic oligonucleotide
gagaaatgacttgtgggagacaccctgcag

SEQ ID NO: 81416 - DNA, 32 bp, Artificial Sequence
  Description of Artificial Sequence: Synthetic oligonucleotide
agaaatgacttgtgggagacaccctgcagatc

SEQ ID NO: 81417 - DNA, 31 bp, Artificial Sequence
  Description of Artificial Sequence: Synthetic oligonucleotide
gaaatgacttgtgggagacaccctgcagatc

SEQ ID NO: 81418 - DNA, 31 bp, Artificial Sequence
  Description of Artificial Sequence: Synthetic oligonucleotide
aaatgacttgtgggagacaccctgcagatcc

SEQ ID NO: 81419 - DNA, 30 bp, Artificial Sequence
  Description of Artificial Sequence: Synthetic oligonucleotide
aatgacttgtgggagacaccctgcagatcc

SEQ ID NO: 81420 - DNA, 29 bp, Artificial Sequence
  Description of Artificial Sequence: Synthetic oligonucleotide
atgacttgtgggagacaccctgcagatcc

SEQ ID NO: 81421 - DNA, 28 bp, Artificial Sequence
  Description of Artificial Sequence: Synthetic oligonucleotide
tgacttgtgggagacaccctgcagatcc

SEQ ID NO: 81422 - DNA, 27 bp, Artificial Sequence
  Description of Artificial Sequence: Synthetic oligonucleotide
gacttgtgggagacaccctgcagatcc

SEQ ID NO: 81423 - DNA, 28 bp, Artificial Sequence
  Description of Artificial Sequence: Synthetic oligonucleotide
acttgtgggagacaccctgcagatcctc

SEQ ID NO: 81424 - DNA, 27 bp, Artificial Sequence
  Description of Artificial Sequence: Synthetic oligonucleotide
cttgtgggagacaccctgcagatcctc

SEQ ID NO: 81425 - DNA, 29 bp, Artificial Sequence
  Description of Artificial Sequence: Synthetic oligonucleotide
ttgtgggagacaccctgcagatcctcatg

SEQ ID NO: 81426 - DNA, 28 bp, Artificial Sequence
  Description of Artificial Sequence: Synthetic oligonucleotide
tgtgggagacaccctgcagatcctcatg

SEQ ID NO: 81427 - DNA, 27 bp, Artificial Sequence
  Description of Artificial Sequence: Synthetic oligonucleotide
gtgggagacaccctgcagatcctcatg

SEQ ID NO: 81428 - DNA, 27 bp, Artificial Sequence
  Description of Artificial Sequence: Synthetic oligonucleotide
tgggagacaccctgcagatcctcatgg

SEQ ID NO: 81429 - DNA, 26 bp, Artificial Sequence
  Description of Artificial Sequence: Synthetic oligonucleotide
gggagacaccctgcagatcctcatgg

SEQ ID NO: 81430 - DNA, 27 bp, Artificial Sequence
  Description of Artificial Sequence: Synthetic oligonucleotide
ggagacaccctgcagatcctcatgggt

SEQ ID NO: 81431 - DNA, 29 bp, Artificial Sequence
  Description of Artificial Sequence: Synthetic oligonucleotide
gagacaccctgcagatcctcatgggtttg

SEQ ID NO: 81432 - DNA, 30 bp, Artificial Sequence
  Description of Artificial Sequence: Synthetic oligonucleotide
agacaccctgcagatcctcatgggtttgtg

SEQ ID NO: 81433 - DNA, 29 bp, Artificial Sequence
  Description of Artificial Sequence: Synthetic oligonucleotide
gacaccctgcagatcctcatgggtttgtg

SEQ ID NO: 81434 - DNA, 30 bp, Artificial Sequence
  Description of Artificial Sequence: Synthetic oligonucleotide
acaccctgcagatcctcatgggtttgtgac

SEQ ID NO: 81435 - DNA, 29 bp, Artificial Sequence
  Description of Artificial Sequence: Synthetic oligonucleotide
caccctgcagatcctcatgggtttgtgac

SEQ ID NO: 81436 - DNA, 30 bp, Artificial Sequence
  Description of Artificial Sequence: Synthetic oligonucleotide
accctgcagatcctcatgggtttgtgacag

SEQ ID NO: 81437 - DNA, 29 bp, Artificial Sequence
  Description of Artificial Sequence: Synthetic oligonucleotide
ccctgcagatcctcatgggtttgtgacag

SEQ ID NO: 81438 - DNA, 29 bp, Artificial Sequence
  Description of Artificial Sequence: Synthetic oligonucleotide
cctgcagatcctcatgggtttgtgacagc

SEQ ID NO: 81439 - DNA, 29 bp, Artificial Sequence
  Description of Artificial Sequence: Synthetic oligonucleotide
ctgcagatcctcatgggtttgtgacagcc

SEQ ID NO: 81440 - DNA, 29 bp, Artificial Sequence
  Description of Artificial Sequence: Synthetic oligonucleotide
tgcagatcctcatgggtttgtgacagccc

SEQ ID NO: 81441 - DNA, 28 bp, Artificial Sequence
  Description of Artificial Sequence: Synthetic oligonucleotide
gcagatcctcatgggtttgtgacagccc

SEQ ID NO: 81442 - DNA, 28 bp, Artificial Sequence
  Description of Artificial Sequence: Synthetic oligonucleotide
cagatcctcatgggtttgtgacagcccc

SEQ ID NO: 81443 - DNA, 29 bp, Artificial Sequence
  Description of Artificial Sequence: Synthetic oligonucleotide
agatcctcatgggtttgtgacagcccctg

SEQ ID NO: 81444 - DNA, 28 bp, Artificial Sequence
  Description of Artificial Sequence: Synthetic oligonucleotide
gatcctcatgggtttgtgacagcccctg

SEQ ID NO: 81445 - DNA, 28 bp, Artificial Sequence
  Description of Artificial Sequence: Synthetic oligonucleotide
atcctcatgggtttgtgacagcccctgc

SEQ ID NO: 81446 - DNA, 27 bp, Artificial Sequence
  Description of Artificial Sequence: Synthetic oligonucleotide
tcctcatgggtttgtgacagcccctgc

SEQ ID NO: 81447 - DNA, 26 bp, Artificial Sequence
  Description of Artificial Sequence: Synthetic oligonucleotide
cctcatgggtttgtgacagcccctgc

SEQ ID NO: 81448 - DNA, 27 bp, Artificial Sequence
  Description of Artificial Sequence: Synthetic oligonucleotide
ctcatgggtttgtgacagcccctgcgt

SEQ ID NO: 81449 - DNA, 27 bp, Artificial Sequence
  Description of Artificial Sequence: Synthetic oligonucleotide
tcatgggtttgtgacagcccctgcgtg

SEQ ID NO: 81450 - DNA, 26 bp, Artificial Sequence
  Description of Artificial Sequence: Synthetic oligonucleotide
catgggtttgtgacagcccctgcgtg

SEQ ID NO: 81451 - DNA, 27 bp, Artificial Sequence
  Description of Artificial Sequence: Synthetic oligonucleotide
atgggtttgtgacagcccctgcgtgct

SEQ ID NO: 81452 - DNA, 26 bp, Artificial Sequence
  Description of Artificial Sequence: Synthetic oligonucleotide
tgggtttgtgacagcccctgcgtgct

SEQ ID NO: 81453 - DNA, 25 bp, Artificial Sequence
  Description of Artificial Sequence: Synthetic oligonucleotide
gggtttgtgacagcccctgcgtgct

SEQ ID NO: 81454 - DNA, 26 bp, Artificial Sequence
  Description of Artificial Sequence: Synthetic oligonucleotide
ggtttgtgacagcccctgcgtgctca

SEQ ID NO: 81455 - DNA, 27 bp, Artificial Sequence
  Description of Artificial Sequence: Synthetic oligonucleotide
gtttgtgacagcccctgcgtgctcagt

SEQ ID NO: 81456 - DNA, 27 bp, Artificial Sequence
  Description of Artificial Sequence: Synthetic oligonucleotide
tttgtgacagcccctgcgtgctcagtg

SEQ ID NO: 81457 - DNA, 26 bp, Artificial Sequence
  Description of Artificial Sequence: Synthetic oligonucleotide
ttgtgacagcccctgcgtgctcagtg

SEQ ID NO: 81458 - DNA, 25 bp, Artificial Sequence
  Description of Artificial Sequence: Synthetic oligonucleotide
tgtgacagcccctgcgtgctcagtg

SEQ ID NO: 81459 - DNA, 24 bp, Artificial Sequence
  Description of Artificial Sequence: Synthetic oligonucleotide
gtgacagcccctgcgtgctcagtg

SEQ ID NO: 81460 - DNA, 24 bp, Artificial Sequence
  Description of Artificial Sequence: Synthetic oligonucleotide
tgacagcccctgcgtgctcagtgc

SEQ ID NO: 81461 - DNA, 23 bp, Artificial Sequence
  Description of Artificial Sequence: Synthetic oligonucleotide
gacagcccctgcgtgctcagtgc

SEQ ID NO: 81462 - DNA, 23 bp, Artificial Sequence
  Description of Artificial Sequence: Synthetic oligonucleotide
acagcccctgcgtgctcagtgcc

SEQ ID NO: 81463 - DNA, 22 bp, Artificial Sequence
  Description of Artificial Sequence: Synthetic oligonucleotide
cagcccctgcgtgctcagtgcc

SEQ ID NO: 81464 - DNA, 27 bp, Artificial Sequence
  Description of Artificial Sequence: Synthetic oligonucleotide
agcccctgcgtgctcagtgccctttaa

SEQ ID NO: 81465 - DNA, 26 bp, Artificial Sequence
  Description of Artificial Sequence: Synthetic oligonucleotide
gcccctgcgtgctcagtgccctttaa

SEQ ID NO: 81466 - DNA, 27 bp, Artificial Sequence
  Description of Artificial Sequence: Synthetic oligonucleotide
cccctgcgtgctcagtgccctttaagt

SEQ ID NO: 81467 - DNA, 27 bp, Artificial Sequence
  Description of Artificial Sequence: Synthetic oligonucleotide
ccctgcgtgctcagtgccctttaagtg

SEQ ID NO: 81468 - DNA, 27 bp, Artificial Sequence
  Description of Artificial Sequence: Synthetic oligonucleotide
cctgcgtgctcagtgccctttaagtgc

SEQ ID NO: 81469 - DNA, 29 bp, Artificial Sequence
  Description of Artificial Sequence: Synthetic oligonucleotide
ctgcgtgctcagtgccctttaagtgcatc

SEQ ID NO: 81470 - DNA, 29 bp, Artificial Sequence
  Description of Artificial Sequence: Synthetic oligonucleotide
tgcgtgctcagtgccctttaagtgcatcc

SEQ ID NO: 81471 - DNA, 28 bp, Artificial Sequence
  Description of Artificial Sequence: Synthetic oligonucleotide
gcgtgctcagtgccctttaagtgcatcc

SEQ ID NO: 81472 - DNA, 28 bp, Artificial Sequence
  Description of Artificial Sequence: Synthetic oligonucleotide
cgtgctcagtgccctttaagtgcatccc

SEQ ID NO: 81473 - DNA, 28 bp, Artificial Sequence
  Description of Artificial Sequence: Synthetic oligonucleotide
gtgctcagtgccctttaagtgcatcccg

SEQ ID NO: 81474 - DNA, 28 bp, Artificial Sequence
  Description of Artificial Sequence: Synthetic oligonucleotide
tgctcagtgccctttaagtgcatcccgc

SEQ ID NO: 81475 - DNA, 27 bp, Artificial Sequence
  Description of Artificial Sequence: Synthetic oligonucleotide
gctcagtgccctttaagtgcatcccgc

SEQ ID NO: 81476 - DNA, 28 bp, Artificial Sequence
  Description of Artificial Sequence: Synthetic oligonucleotide
ctcagtgccctttaagtgcatcccgctg

SEQ ID NO: 81477 - DNA, 29 bp, Artificial Sequence
  Description of Artificial Sequence: Synthetic oligonucleotide
tcagtgccctttaagtgcatcccgctgtg

SEQ ID NO: 81478 - DNA, 28 bp, Artificial Sequence
  Description of Artificial Sequence: Synthetic oligonucleotide
cagtgccctttaagtgcatcccgctgtg

SEQ ID NO: 81479 - DNA, 28 bp, Artificial Sequence
  Description of Artificial Sequence: Synthetic oligonucleotide
agtgccctttaagtgcatcccgctgtgc

SEQ ID NO: 81480 - DNA, 27 bp, Artificial Sequence
  Description of Artificial Sequence: Synthetic oligonucleotide
gtgccctttaagtgcatcccgctgtgc

SEQ ID NO: 81481 - DNA, 28 bp, Artificial Sequence
  Description of Artificial Sequence: Synthetic oligonucleotide
tgccctttaagtgcatcccgctgtgctg

SEQ ID NO: 81482 - DNA, 27 bp, Artificial Sequence
  Description of Artificial Sequence: Synthetic oligonucleotide
gccctttaagtgcatcccgctgtgctg

SEQ ID NO: 81483 - DNA, 28 bp, Artificial Sequence
  Description of Artificial Sequence: Synthetic oligonucleotide
ccctttaagtgcatcccgctgtgctgac

SEQ ID NO: 81484 - DNA, 31 bp, Artificial Sequence
  Description of Artificial Sequence: Synthetic oligonucleotide
cctttaagtgcatcccgctgtgctgactttg

SEQ ID NO: 81485 - DNA, 32 bp, Artificial Sequence
  Description of Artificial Sequence: Synthetic oligonucleotide
ctttaagtgcatcccgctgtgctgactttgag

SEQ ID NO: 81486 - DNA, 33 bp, Artificial Sequence
  Description of Artificial Sequence: Synthetic oligonucleotide
tttaagtgcatcccgctgtgctgactttgagtg

SEQ ID NO: 81487 - DNA, 32 bp, Artificial Sequence
  Description of Artificial Sequence: Synthetic oligonucleotide
ttaagtgcatcccgctgtgctgactttgagtg

SEQ ID NO: 81488 - DNA, 31 bp, Artificial Sequence
  Description of Artificial Sequence: Synthetic oligonucleotide
taagtgcatcccgctgtgctgactttgagtg

SEQ ID NO: 81489 - DNA, 30 bp, Artificial Sequence
  Description of Artificial Sequence: Synthetic oligonucleotide
aagtgcatcccgctgtgctgactttgagtg

SEQ ID NO: 81490 - DNA, 29 bp, Artificial Sequence
  Description of Artificial Sequence: Synthetic oligonucleotide
agtgcatcccgctgtgctgactttgagtg

SEQ ID NO: 81491 - DNA, 28 bp, Artificial Sequence
  Description of Artificial Sequence: Synthetic oligonucleotide
gtgcatcccgctgtgctgactttgagtg

SEQ ID NO: 81492 - DNA, 28 bp, Artificial Sequence
  Description of Artificial Sequence: Synthetic oligonucleotide
tgcatcccgctgtgctgactttgagtgg

SEQ ID NO: 81493 - DNA, 27 bp, Artificial Sequence
  Description of Artificial Sequence: Synthetic oligonucleotide
gcatcccgctgtgctgactttgagtgg

SEQ ID NO: 81494 - DNA, 27 bp, Artificial Sequence
  Description of Artificial Sequence: Synthetic oligonucleotide
catcccgctgtgctgactttgagtggg

SEQ ID NO: 81495 - DNA, 29 bp, Artificial Sequence
  Description of Artificial Sequence: Synthetic oligonucleotide
atcccgctgtgctgactttgagtgggatc

SEQ ID NO: 81496 - DNA, 28 bp, Artificial Sequence
  Description of Artificial Sequence: Synthetic oligonucleotide
tcccgctgtgctgactttgagtgggatc

SEQ ID NO: 81497 - DNA, 27 bp, Artificial Sequence
  Description of Artificial Sequence: Synthetic oligonucleotide
cccgctgtgctgactttgagtgggatc

SEQ ID NO: 81498 - DNA, 29 bp, Artificial Sequence
  Description of Artificial Sequence: Synthetic oligonucleotide
ccgctgtgctgactttgagtgggatcaac

SEQ ID NO: 81499 - DNA, 31 bp, Artificial Sequence
  Description of Artificial Sequence: Synthetic oligonucleotide
cgctgtgctgactttgagtgggatcaacatc

SEQ ID NO: 81500 - DNA, 32 bp, Artificial Sequence
  Description of Artificial Sequence: Synthetic oligonucleotide
gctgtgctgactttgagtgggatcaacatctg

SEQ ID NO: 81501 - DNA, 33 bp, Artificial Sequence
  Description of Artificial Sequence: Synthetic oligonucleotide
ctgtgctgactttgagtgggatcaacatctgtc

SEQ ID NO: 81502 - DNA, 33 bp, Artificial Sequence
  Description of Artificial Sequence: Synthetic oligonucleotide
tgtgctgactttgagtgggatcaacatctgtcc

SEQ ID NO: 81503 - DNA, 32 bp, Artificial Sequence
  Description of Artificial Sequence: Synthetic oligonucleotide
gtgctgactttgagtgggatcaacatctgtcc

SEQ ID NO: 81504 - DNA, 34 bp, Artificial Sequence
  Description of Artificial Sequence: Synthetic oligonucleotide
tgctgactttgagtgggatcaacatctgtcctac

SEQ ID NO: 81505 - DNA, 33 bp, Artificial Sequence
  Description of Artificial Sequence: Synthetic oligonucleotide
gctgactttgagtgggatcaacatctgtcctac

SEQ ID NO: 81506 - DNA, 33 bp, Artificial Sequence
  Description of Artificial Sequence: Synthetic oligonucleotide
ctgactttgagtgggatcaacatctgtcctacg

SEQ ID NO: 81507 - DNA, 33 bp, Artificial Sequence
  Description of Artificial Sequence: Synthetic oligonucleotide
tgactttgagtgggatcaacatctgtcctacgg

SEQ ID NO: 81508 - DNA, 32 bp, Artificial Sequence
  Description of Artificial Sequence: Synthetic oligonucleotide
gactttgagtgggatcaacatctgtcctacgg

SEQ ID NO: 81509 - DNA, 32 bp, Artificial Sequence
  Description of Artificial Sequence: Synthetic oligonucleotide
actttgagtgggatcaacatctgtcctacggg

SEQ ID NO: 81510 - DNA, 31 bp, Artificial Sequence
  Description of Artificial Sequence: Synthetic oligonucleotide
ctttgagtgggatcaacatctgtcctacggg

SEQ ID NO: 81511 - DNA, 32 bp, Artificial Sequence
  Description of Artificial Sequence: Synthetic oligonucleotide
tttgagtgggatcaacatctgtcctacgggtc

SEQ ID NO: 81512 - DNA, 31 bp, Artificial Sequence
  Description of Artificial Sequence: Synthetic oligonucleotide
ttgagtgggatcaacatctgtcctacgggtc

SEQ ID NO: 81513 - DNA, 30 bp, Artificial Sequence
  Description of Artificial Sequence: Synthetic oligonucleotide
tgagtgggatcaacatctgtcctacgggtc

SEQ ID NO: 81514 - DNA, 29 bp, Artificial Sequence
  Description of Artificial Sequence: Synthetic oligonucleotide
gagtgggatcaacatctgtcctacgggtc

SEQ ID NO: 81515 - DNA, 29 bp, Artificial Sequence
  Description of Artificial Sequence: Synthetic oligonucleotide
agtgggatcaacatctgtcctacgggtcc

SEQ ID NO: 81516 - DNA, 28 bp, Artificial Sequence
  Description of Artificial Sequence: Synthetic oligonucleotide
gtgggatcaacatctgtcctacgggtcc

SEQ ID NO: 81517 - DNA, 28 bp, Artificial Sequence
  Description of Artificial Sequence: Synthetic oligonucleotide
tgggatcaacatctgtcctacgggtccc

SEQ ID NO: 81518 - DNA, 27 bp, Artificial Sequence
  Description of Artificial Sequence: Synthetic oligonucleotide
gggatcaacatctgtcctacgggtccc

SEQ ID NO: 81519 - DNA, 27 bp, Artificial Sequence
  Description of Artificial Sequence: Synthetic oligonucleotide
ggatcaacatctgtcctacgggtcccc

SEQ ID NO: 81520 - DNA, 28 bp, Artificial Sequence
  Description of Artificial Sequence: Synthetic oligonucleotide
gatcaacatctgtcctacgggtcccctc

SEQ ID NO: 81521 - DNA, 34 bp, Artificial Sequence
  Description of Artificial Sequence: Synthetic oligonucleotide
atcaacatctgtcctacgggtcccctcttttttg

SEQ ID NO: 81522 - DNA, 33 bp, Artificial Sequence
  Description of Artificial Sequence: Synthetic oligonucleotide
tcaacatctgtcctacgggtcccctcttttttg

SEQ ID NO: 81523 - DNA, 32 bp, Artificial Sequence
  Description of Artificial Sequence: Synthetic oligonucleotide
caacatctgtcctacgggtcccctcttttttg

SEQ ID NO: 81524 - DNA, 32 bp, Artificial Sequence
  Description of Artificial Sequence: Synthetic oligonucleotide
aacatctgtcctacgggtcccctcttttttgg

SEQ ID NO: 81525 - DNA, 31 bp, Artificial Sequence
  Description of Artificial Sequence: Synthetic oligonucleotide
acatctgtcctacgggtcccctcttttttgg

SEQ ID NO: 81526 - DNA, 30 bp, Artificial Sequence
  Description of Artificial Sequence: Synthetic oligonucleotide
catctgtcctacgggtcccctcttttttgg

SEQ ID NO: 81527 - DNA, 30 bp, Artificial Sequence
  Description of Artificial Sequence: Synthetic oligonucleotide
atctgtcctacgggtcccctcttttttggc

SEQ ID NO: 81528 - DNA, 29 bp, Artificial Sequence
  Description of Artificial Sequence: Synthetic oligonucleotide
tctgtcctacgggtcccctcttttttggc

SEQ ID NO: 81529 - DNA, 28 bp, Artificial Sequence
  Description of Artificial Sequence: Synthetic oligonucleotide
ctgtcctacgggtcccctcttttttggc

SEQ ID NO: 81530 - DNA, 28 bp, Artificial Sequence
  Description of Artificial Sequence: Synthetic oligonucleotide
tgtcctacgggtcccctcttttttggcc

SEQ ID NO: 81531 - DNA, 27 bp, Artificial Sequence
  Description of Artificial Sequence: Synthetic oligonucleotide
gtcctacgggtcccctcttttttggcc

SEQ ID NO: 81532 - DNA, 27 bp, Artificial Sequence
  Description of Artificial Sequence: Synthetic oligonucleotide
tcctacgggtcccctcttttttggccc

SEQ ID NO: 81533 - DNA, 26 bp, Artificial Sequence
  Description of Artificial Sequence: Synthetic oligonucleotide
cctacgggtcccctcttttttggccc

SEQ ID NO: 81534 - DNA, 27 bp, Artificial Sequence
  Description of Artificial Sequence: Synthetic oligonucleotide
ctacgggtcccctcttttttggcccca

SEQ ID NO: 81535 - DNA, 27 bp, Artificial Sequence
  Description of Artificial Sequence: Synthetic oligonucleotide
tacgggtcccctcttttttggccccag

SEQ ID NO: 81536 - DNA, 27 bp, Artificial Sequence
  Description of Artificial Sequence: Synthetic oligonucleotide
acgggtcccctcttttttggccccagt

SEQ ID NO: 81537 - DNA, 27 bp, Artificial Sequence
  Description of Artificial Sequence: Synthetic oligonucleotide
cgggtcccctcttttttggccccagta

SEQ ID NO: 81538 - DNA, 29 bp, Artificial Sequence
  Description of Artificial Sequence: Synthetic oligonucleotide
gggtcccctcttttttggccccagtattc

SEQ ID NO: 81539 - DNA, 31 bp, Artificial Sequence
  Description of Artificial Sequence: Synthetic oligonucleotide
ggtcccctcttttttggccccagtattcatg

SEQ ID NO: 81540 - DNA, 31 bp, Artificial Sequence
  Description of Artificial Sequence: Synthetic oligonucleotide
gtcccctcttttttggccccagtattcatgg

SEQ ID NO: 81541 - DNA, 31 bp, Artificial Sequence
  Description of Artificial Sequence: Synthetic oligonucleotide
tcccctcttttttggccccagtattcatggc

SEQ ID NO: 81542 - DNA, 30 bp, Artificial Sequence
  Description of Artificial Sequence: Synthetic oligonucleotide
cccctcttttttggccccagtattcatggc

SEQ ID NO: 81543 - DNA, 31 bp, Artificial Sequence
  Description of Artificial Sequence: Synthetic oligonucleotide
ccctcttttttggccccagtattcatggcag

SEQ ID NO: 81544 - DNA, 31 bp, Artificial Sequence
  Description of Artificial Sequence: Synthetic oligonucleotide
cctcttttttggccccagtattcatggcagg

SEQ ID NO: 81545 - DNA, 31 bp, Artificial Sequence
  Description of Artificial Sequence: Synthetic oligonucleotide
ctcttttttggccccagtattcatggcaggg

SEQ ID NO: 81546 - DNA, 34 bp, Artificial Sequence
  Description of Artificial Sequence: Synthetic oligonucleotide
tcttttttggccccagtattcatggcagggtttg

SEQ ID NO: 81547 - DNA, 33 bp, Artificial Sequence
  Description of Artificial Sequence: Synthetic oligonucleotide
cttttttggccccagtattcatggcagggtttg

SEQ ID NO: 81548 - DNA, 35 bp, Artificial Sequence
  Description of Artificial Sequence: Synthetic oligonucleotide
ttttttggccccagtattcatggcagggtttgttg

SEQ ID NO: 81549 - DNA, 34 bp, Artificial Sequence
  Description of Artificial Sequence: Synthetic oligonucleotide
tttttggccccagtattcatggcagggtttgttg

SEQ ID NO: 81550 - DNA, 33 bp, Artificial Sequence
  Description of Artificial Sequence: Synthetic oligonucleotide
ttttggccccagtattcatggcagggtttgttg

SEQ ID NO: 81551 - DNA, 32 bp, Artificial Sequence
  Description of Artificial Sequence: Synthetic oligonucleotide
tttggccccagtattcatggcagggtttgttg

SEQ ID NO: 81552 - DNA, 31 bp, Artificial Sequence
  Description of Artificial Sequence: Synthetic oligonucleotide
ttggccccagtattcatggcagggtttgttg

SEQ ID NO: 81553 - DNA, 30 bp, Artificial Sequence
  Description of Artificial Sequence: Synthetic oligonucleotide
tggccccagtattcatggcagggtttgttg

SEQ ID NO: 81554 - DNA, 29 bp, Artificial Sequence
  Description of Artificial Sequence: Synthetic oligonucleotide
ggccccagtattcatggcagggtttgttg

SEQ ID NO: 81555 - DNA, 29 bp, Artificial Sequence
  Description of Artificial Sequence: Synthetic oligonucleotide
gccccagtattcatggcagggtttgttgg

SEQ ID NO: 81556 - DNA, 30 bp, Artificial Sequence
  Description of Artificial Sequence: Synthetic oligonucleotide
ccccagtattcatggcagggtttgttggac

SEQ ID NO: 81557 - DNA, 31 bp, Artificial Sequence
  Description of Artificial Sequence: Synthetic oligonucleotide
cccagtattcatggcagggtttgttggacac

SEQ ID NO: 81558 - DNA, 31 bp, Artificial Sequence
  Description of Artificial Sequence: Synthetic oligonucleotide
ccagtattcatggcagggtttgttggacacc

SEQ ID NO: 81559 - DNA, 33 bp, Artificial Sequence
  Description of Artificial Sequence: Synthetic oligonucleotide
cagtattcatggcagggtttgttggacacctac

SEQ ID NO: 81560 - DNA, 35 bp, Artificial Sequence
  Description of Artificial Sequence: Synthetic oligonucleotide
agtattcatggcagggtttgttggacacctactag

SEQ ID NO: 81561 - DNA, 34 bp, Artificial Sequence
  Description of Artificial Sequence: Synthetic oligonucleotide
gtattcatggcagggtttgttggacacctactag

SEQ ID NO: 81562 - DNA, 34 bp, Artificial Sequence
  Description of Artificial Sequence: Synthetic oligonucleotide
tattcatggcagggtttgttggacacctactagc

SEQ ID NO: 81563 - DNA, 33 bp, Artificial Sequence
  Description of Artificial Sequence: Synthetic oligonucleotide
attcatggcagggtttgttggacacctactagc

SEQ ID NO: 81564 - DNA, 32 bp, Artificial Sequence
  Description of Artificial Sequence: Synthetic oligonucleotide
ttcatggcagggtttgttggacacctactagc

SEQ ID NO: 81565 - DNA, 31 bp, Artificial Sequence
  Description of Artificial Sequence: Synthetic oligonucleotide
tcatggcagggtttgttggacacctactagc

SEQ ID NO: 81566 - DNA, 30 bp, Artificial Sequence
  Description of Artificial Sequence: Synthetic oligonucleotide
catggcagggtttgttggacacctactagc

SEQ ID NO: 81567 - DNA, 32 bp, Artificial Sequence
  Description of Artificial Sequence: Synthetic oligonucleotide
atggcagggtttgttggacacctactagcttc

SEQ ID NO: 81568 - DNA, 31 bp, Artificial Sequence
  Description of Artificial Sequence: Synthetic oligonucleotide
tggcagggtttgttggacacctactagcttc

SEQ ID NO: 81569 - DNA, 30 bp, Artificial Sequence
  Description of Artificial Sequence: Synthetic oligonucleotide
ggcagggtttgttggacacctactagcttc

SEQ ID NO: 81570 - DNA, 30 bp, Artificial Sequence
  Description of Artificial Sequence: Synthetic oligonucleotide
gcagggtttgttggacacctactagcttcc

SEQ ID NO: 81571 - DNA, 30 bp, Artificial Sequence
  Description of Artificial Sequence: Synthetic oligonucleotide
cagggtttgttggacacctactagcttccc

SEQ ID NO: 81572 - DNA, 32 bp, Artificial Sequence
  Description of Artificial Sequence: Synthetic oligonucleotide
agggtttgttggacacctactagcttcccttc

SEQ ID NO: 81573 - DNA, 31 bp, Artificial Sequence
  Description of Artificial Sequence: Synthetic oligonucleotide
gggtttgttggacacctactagcttcccttc

SEQ ID NO: 81574 - DNA, 31 bp, Artificial Sequence
  Description of Artificial Sequence: Synthetic oligonucleotide
ggtttgttggacacctactagcttcccttcc

SEQ ID NO: 81575 - DNA, 31 bp, Artificial Sequence
  Description of Artificial Sequence: Synthetic oligonucleotide
gtttgttggacacctactagcttcccttccc

SEQ ID NO: 81576 - DNA, 34 bp, Artificial Sequence
  Description of Artificial Sequence: Synthetic oligonucleotide
tttgttggacacctactagcttcccttcccattc

SEQ ID NO: 81577 - DNA, 33 bp, Artificial Sequence
  Description of Artificial Sequence: Synthetic oligonucleotide
ttgttggacacctactagcttcccttcccattc

SEQ ID NO: 81578 - DNA, 32 bp, Artificial Sequence
  Description of Artificial Sequence: Synthetic oligonucleotide
tgttggacacctactagcttcccttcccattc

SEQ ID NO: 81579 - DNA, 31 bp, Artificial Sequence
  Description of Artificial Sequence: Synthetic oligonucleotide
gttggacacctactagcttcccttcccattc

SEQ ID NO: 81580 - DNA, 33 bp, Artificial Sequence
  Description of Artificial Sequence: Synthetic oligonucleotide
ttggacacctactagcttcccttcccattcaac

SEQ ID NO: 81581 - DNA, 32 bp, Artificial Sequence
  Description of Artificial Sequence: Synthetic oligonucleotide
tggacacctactagcttcccttcccattcaac

SEQ ID NO: 81582 - DNA, 31 bp, Artificial Sequence
  Description of Artificial Sequence: Synthetic oligonucleotide
ggacacctactagcttcccttcccattcaac

SEQ ID NO: 81583 - DNA, 32 bp, Artificial Sequence
  Description of Artificial Sequence: Synthetic oligonucleotide
gacacctactagcttcccttcccattcaacac

SEQ ID NO: 81584 - DNA, 35 bp, Artificial Sequence
  Description of Artificial Sequence: Synthetic oligonucleotide
acacctactagcttcccttcccattcaacacaaac

SEQ ID NO: 81585 - DNA, 34 bp, Artificial Sequence
  Description of Artificial Sequence: Synthetic oligonucleotide
cacctactagcttcccttcccattcaacacaaac

SEQ ID NO: 81586 - DNA, 35 bp, Artificial Sequence
  Description of Artificial Sequence: Synthetic oligonucleotide
acctactagcttcccttcccattcaacacaaacac

SEQ ID NO: 81587 - DNA, 34 bp, Artificial Sequence
  Description of Artificial Sequence: Synthetic oligonucleotide
cctactagcttcccttcccattcaacacaaacac

SEQ ID NO: 81588 - DNA, 35 bp, Artificial Sequence
  Description of Artificial Sequence: Synthetic oligonucleotide
ctactagcttcccttcccattcaacacaaacacac

SEQ ID NO: 81589 - DNA, 38 bp, Artificial Sequence
  Description of Artificial Sequence: Synthetic oligonucleotide
tactagcttcccttcccattcaacacaaacacacattc

SEQ ID NO: 81590 - DNA, 37 bp, Artificial Sequence
  Description of Artificial Sequence: Synthetic oligonucleotide
actagcttcccttcccattcaacacaaacacacattc

SEQ ID NO: 81591 - DNA, 36 bp, Artificial Sequence
  Description of Artificial Sequence: Synthetic oligonucleotide
ctagcttcccttcccattcaacacaaacacacattc

SEQ ID NO: 81592 - DNA, 38 bp, Artificial Sequence
  Description of Artificial Sequence: Synthetic oligonucleotide
tagcttcccttcccattcaacacaaacacacattcttg

SEQ ID NO: 81593 - DNA, 37 bp, Artificial Sequence
  Description of Artificial Sequence: Synthetic oligonucleotide
agcttcccttcccattcaacacaaacacacattcttg

SEQ ID NO: 81594 - DNA, 36 bp, Artificial Sequence
  Description of Artificial Sequence: Synthetic oligonucleotide
gcttcccttcccattcaacacaaacacacattcttg

SEQ ID NO: 81595 - DNA, 36 bp, Artificial Sequence
  Description of Artificial Sequence: Synthetic oligonucleotide
cttcccttcccattcaacacaaacacacattcttgc

SEQ ID NO: 81596 - DNA, 37 bp, Artificial Sequence
  Description of Artificial Sequence: Synthetic oligonucleotide
ttcccttcccattcaacacaaacacacattcttgctc

SEQ ID NO: 81597 - DNA, 36 bp, Artificial Sequence
  Description of Artificial Sequence: Synthetic oligonucleotide
tcccttcccattcaacacaaacacacattcttgctc

SEQ ID NO: 81598 - DNA, 35 bp, Artificial Sequence
  Description of Artificial Sequence: Synthetic oligonucleotide
cccttcccattcaacacaaacacacattcttgctc

SEQ ID NO: 81599 - DNA, 37 bp, Artificial Sequence
  Description of Artificial Sequence: Synthetic oligonucleotide
ccttcccattcaacacaaacacacattcttgctctac

SEQ ID NO: 81600 - DNA, 37 bp, Artificial Sequence
  Description of Artificial Sequence: Synthetic oligonucleotide
cttcccattcaacacaaacacacattcttgctctacc

SEQ ID NO: 81601 - DNA, 37 bp, Artificial Sequence
  Description of Artificial Sequence: Synthetic oligonucleotide
ttcccattcaacacaaacacacattcttgctctaccc

SEQ ID NO: 81602 - DNA, 36 bp, Artificial Sequence
  Description of Artificial Sequence: Synthetic oligonucleotide
tcccattcaacacaaacacacattcttgctctaccc

SEQ ID NO: 81603 - DNA, 35 bp, Artificial Sequence
  Description of Artificial Sequence: Synthetic oligonucleotide
cccattcaacacaaacacacattcttgctctaccc

SEQ ID NO: 81604 - DNA, 38 bp, Artificial Sequence
  Description of Artificial Sequence: Synthetic oligonucleotide
ccattcaacacaaacacacattcttgctctacccaaag

SEQ ID NO: 81605 - DNA, 38 bp, Artificial Sequence
  Description of Artificial Sequence: Synthetic oligonucleotide
cattcaacacaaacacacattcttgctctacccaaagc

SEQ ID NO: 81606 - DNA, 39 bp, Artificial Sequence
  Description of Artificial Sequence: Synthetic oligonucleotide
attcaacacaaacacacattcttgctctacccaaagctc

SEQ ID NO: 81607 - DNA, 38 bp, Artificial Sequence
  Description of Artificial Sequence: Synthetic oligonucleotide
ttcaacacaaacacacattcttgctctacccaaagctc

SEQ ID NO: 81608 - DNA, 37 bp, Artificial Sequence
  Description of Artificial Sequence: Synthetic oligonucleotide
tcaacacaaacacacattcttgctctacccaaagctc

SEQ ID NO: 81609 - DNA, 36 bp, Artificial Sequence
  Description of Artificial Sequence: Synthetic oligonucleotide
caacacaaacacacattcttgctctacccaaagctc

SEQ ID NO: 81610 - DNA, 37 bp, Artificial Sequence
  Description of Artificial Sequence: Synthetic oligonucleotide
aacacaaacacacattcttgctctacccaaagctctg

SEQ ID NO: 81611 - DNA, 36 bp, Artificial Sequence
  Description of Artificial Sequence: Synthetic oligonucleotide
acacaaacacacattcttgctctacccaaagctctg

SEQ ID NO: 81612 - DNA, 35 bp, Artificial Sequence
  Description of Artificial Sequence: Synthetic oligonucleotide
cacaaacacacattcttgctctacccaaagctctg

SEQ ID NO: 81613 - DNA, 35 bp, Artificial Sequence
  Description of Artificial Sequence: Synthetic oligonucleotide
acaaacacacattcttgctctacccaaagctctgg

SEQ ID NO: 81614 - DNA, 34 bp, Artificial Sequence
  Description of Artificial Sequence: Synthetic oligonucleotide
caaacacacattcttgctctacccaaagctctgg

SEQ ID NO: 81615 - DNA, 34 bp, Artificial Sequence
  Description of Artificial Sequence: Synthetic oligonucleotide
aaacacacattcttgctctacccaaagctctggc

SEQ ID NO: 81616 - DNA, 33 bp, Artificial Sequence
  Description of Artificial Sequence: Synthetic oligonucleotide
aacacacattcttgctctacccaaagctctggc

SEQ ID NO: 81617 - DNA, 32 bp, Artificial Sequence
  Description of Artificial Sequence: Synthetic oligonucleotide
acacacattcttgctctacccaaagctctggc

SEQ ID NO: 81618 - DNA, 31 bp, Artificial Sequence
  Description of Artificial Sequence: Synthetic oligonucleotide
cacacattcttgctctacccaaagctctggc

SEQ ID NO: 81619 - DNA, 32 bp, Artificial Sequence
  Description of Artificial Sequence: Synthetic oligonucleotide
acacattcttgctctacccaaagctctggctg

SEQ ID NO: 81620 - DNA, 31 bp, Artificial Sequence
  Description of Artificial Sequence: Synthetic oligonucleotide
cacattcttgctctacccaaagctctggctg

SEQ ID NO: 81621 - DNA, 31 bp, Artificial Sequence
  Description of Artificial Sequence: Synthetic oligonucleotide
acattcttgctctacccaaagctctggctgg

SEQ ID NO: 81622 - DNA, 30 bp, Artificial Sequence
  Description of Artificial Sequence: Synthetic oligonucleotide
cattcttgctctacccaaagctctggctgg

SEQ ID NO: 81623 - DNA, 30 bp, Artificial Sequence
  Description of Artificial Sequence: Synthetic oligonucleotide
attcttgctctacccaaagctctggctggc

SEQ ID NO: 81624 - DNA, 29 bp, Artificial Sequence
  Description of Artificial Sequence: Synthetic oligonucleotide
ttcttgctctacccaaagctctggctggc

SEQ ID NO: 81625 - DNA, 28 bp, Artificial Sequence
  Description of Artificial Sequence: Synthetic oligonucleotide
tcttgctctacccaaagctctggctggc

SEQ ID NO: 81626 - DNA, 27 bp, Artificial Sequence
  Description of Artificial Sequence: Synthetic oligonucleotide
cttgctctacccaaagctctggctggc

SEQ ID NO: 81627 - DNA, 28 bp, Artificial Sequence
  Description of Artificial Sequence: Synthetic oligonucleotide
ttgctctacccaaagctctggctggcag

SEQ ID NO: 81628 - DNA, 27 bp, Artificial Sequence
  Description of Artificial Sequence: Synthetic oligonucleotide
tgctctacccaaagctctggctggcag

SEQ ID NO: 81629 - DNA, 26 bp, Artificial Sequence
  Description of Artificial Sequence: Synthetic oligonucleotide
gctctacccaaagctctggctggcag

SEQ ID NO: 81630 - DNA, 27 bp, Artificial Sequence
  Description of Artificial Sequence: Synthetic oligonucleotide
ctctacccaaagctctggctggcagca

SEQ ID NO: 81631 - DNA, 27 bp, Artificial Sequence
  Description of Artificial Sequence: Synthetic oligonucleotide
tctacccaaagctctggctggcagcac

SEQ ID NO: 81632 - DNA, 27 bp, Artificial Sequence
  Description of Artificial Sequence: Synthetic oligonucleotide
ctacccaaagctctggctggcagcact

SEQ ID NO: 81633 - DNA, 31 bp, Artificial Sequence
  Description of Artificial Sequence: Synthetic oligonucleotide
tacccaaagctctggctggcagcactaaatg

SEQ ID NO: 81634 - DNA, 30 bp, Artificial Sequence
  Description of Artificial Sequence: Synthetic oligonucleotide
acccaaagctctggctggcagcactaaatg

SEQ ID NO: 81635 - DNA, 29 bp, Artificial Sequence
  Description of Artificial Sequence: Synthetic oligonucleotide
cccaaagctctggctggcagcactaaatg

SEQ ID NO: 81636 - DNA, 29 bp, Artificial Sequence
  Description of Artificial Sequence: Synthetic oligonucleotide
ccaaagctctggctggcagcactaaatgc

SEQ ID NO: 81637 - DNA, 32 bp, Artificial Sequence
  Description of Artificial Sequence: Synthetic oligonucleotide
caaagctctggctggcagcactaaatgctttg

SEQ ID NO: 81638 - DNA, 32 bp, Artificial Sequence
  Description of Artificial Sequence: Synthetic oligonucleotide
aaagctctggctggcagcactaaatgctttgg

SEQ ID NO: 81639 - DNA, 31 bp, Artificial Sequence
  Description of Artificial Sequence: Synthetic oligonucleotide
aagctctggctggcagcactaaatgctttgg

SEQ ID NO: 81640 - DNA, 30 bp, Artificial Sequence
  Description of Artificial Sequence: Synthetic oligonucleotide
agctctggctggcagcactaaatgctttgg

SEQ ID NO: 81641 - DNA, 29 bp, Artificial Sequence
  Description of Artificial Sequence: Synthetic oligonucleotide
gctctggctggcagcactaaatgctttgg

SEQ ID NO: 81642 - DNA, 30 bp, Artificial Sequence
  Description of Artificial Sequence: Synthetic oligonucleotide
ctctggctggcagcactaaatgctttggtg

SEQ ID NO: 81643 - DNA, 30 bp, Artificial Sequence
  Description of Artificial Sequence: Synthetic oligonucleotide
tctggctggcagcactaaatgctttggtgg

SEQ ID NO: 81644 - DNA, 29 bp, Artificial Sequence
  Description of Artificial Sequence: Synthetic oligonucleotide
ctggctggcagcactaaatgctttggtgg

SEQ ID NO: 81645 - DNA, 30 bp, Artificial Sequence
  Description of Artificial Sequence: Synthetic oligonucleotide
tggctggcagcactaaatgctttggtggtg

SEQ ID NO: 81646 - DNA, 29 bp, Artificial Sequence
  Description of Artificial Sequence: Synthetic oligonucleotide
ggctggcagcactaaatgctttggtggtg

SEQ ID NO: 81647 - DNA, 32 bp, Artificial Sequence
  Description of Artificial Sequence: Synthetic oligonucleotide
gctggcagcactaaatgctttggtggtgtttg

SEQ ID NO: 81648 - DNA, 32 bp, Artificial Sequence
  Description of Artificial Sequence: Synthetic oligonucleotide
ctggcagcactaaatgctttggtggtgtttgc

SEQ ID NO: 81649 - DNA, 25 bp, Artificial Sequence
  Description of Artificial Sequence: Synthetic oligonucleotide
actttgcccgctttgacccgcaggg

SEQ ID NO: 81650 - DNA, 24 bp, Artificial Sequence
  Description of Artificial Sequence: Synthetic oligonucleotide
ctttgcccgctttgacccgcaggg

SEQ ID NO: 81651 - DNA, 24 bp, Artificial Sequence
  Description of Artificial Sequence: Synthetic oligonucleotide
tttgcccgctttgacccgcagggc

SEQ ID NO: 81652 - DNA, 23 bp, Artificial Sequence
  Description of Artificial Sequence: Synthetic oligonucleotide
ttgcccgctttgacccgcagggc

SEQ ID NO: 81653 - DNA, 22 bp, Artificial Sequence
  Description of Artificial Sequence: Synthetic oligonucleotide
tgcccgctttgacccgcagggc

SEQ ID NO: 81654 - DNA, 21 bp, Artificial Sequence
  Description of Artificial Sequence: Synthetic oligonucleotide
gcccgctttgacccgcagggc

SEQ ID NO: 81655 - DNA, 21 bp, Artificial Sequence
  Description of Artificial Sequence: Synthetic oligonucleotide
cccgctttgacccgcagggcg

SEQ ID NO: 81656 - DNA, 21 bp, Artificial Sequence
  Description of Artificial Sequence: Synthetic oligonucleotide
ccgctttgacccgcagggcgg

SEQ ID NO: 81657 - DNA, 21 bp, Artificial Sequence
  Description of Artificial Sequence: Synthetic oligonucleotide
cgctttgacccgcagggcggg

SEQ ID NO: 81658 - DNA, 22 bp, Artificial Sequence
  Description of Artificial Sequence: Synthetic oligonucleotide
gctttgacccgcagggcgggct

SEQ ID NO: 81659 - DNA, 22 bp, Artificial Sequence
  Description of Artificial Sequence: Synthetic oligonucleotide
ctttgacccgcagggcgggctg

SEQ ID NO: 81660 - DNA, 22 bp, Artificial Sequence
  Description of Artificial Sequence: Synthetic oligonucleotide
tttgacccgcagggcgggctgg

SEQ ID NO: 81661 - DNA, 21 bp, Artificial Sequence
  Description of Artificial Sequence: Synthetic oligonucleotide
ttgacccgcagggcgggctgg

SEQ ID NO: 81662 - DNA, 20 bp, Artificial Sequence
  Description of Artificial Sequence: Synthetic oligonucleotide
tgacccgcagggcgggctgg

SEQ ID NO: 81663 - DNA, 20 bp, Artificial Sequence
  Description of Artificial Sequence: Synthetic oligonucleotide
gacccgcagggcgggctggt

SEQ ID NO: 81664 - DNA, 20 bp, Artificial Sequence
  Description of Artificial Sequence: Synthetic oligonucleotide
acccgcagggcgggctggct

SEQ ID NO: 81665 - DNA, 20 bp, Artificial Sequence
  Description of Artificial Sequence: Synthetic oligonucleotide
cccgcagggcgggctggctt

SEQ ID NO: 81666 - DNA, 20 bp, Artificial Sequence
  Description of Artificial Sequence: Synthetic oligonucleotide
ccgcagggcgggctggcctt

SEQ ID NO: 81667 - DNA, 20 bp, Artificial Sequence
  Description of Artificial Sequence: Synthetic oligonucleotide
cgcagggcgggctggccgtt

SEQ ID NO: 81668 - DNA, 20 bp, Artificial Sequence
  Description of Artificial Sequence: Synthetic oligonucleotide
gcagggcgggctggccggtt

SEQ ID NO: 81669 - DNA, 20 bp, Artificial Sequence
  Description of Artificial Sequence: Synthetic oligonucleotide
cagggcgggctggccggcat

SEQ ID NO: 81670 - DNA, 20 bp, Artificial Sequence
  Description of Artificial Sequence: Synthetic oligonucleotide
agggcgggctggccggcatc

SEQ ID NO: 81671 - DNA, 20 bp, Artificial Sequence
  Description of Artificial Sequence: Synthetic oligonucleotide
gggcgggctggccggcatct

SEQ ID NO: 81672 - DNA, 20 bp, Artificial Sequence
  Description of Artificial Sequence: Synthetic oligonucleotide
ggcgggctggccggcatcgt

SEQ ID NO: 81673 - DNA, 20 bp, Artificial Sequence
  Description of Artificial Sequence: Synthetic oligonucleotide
gcgggctggccggcatcgct

SEQ ID NO: 81674 - DNA, 20 bp, Artificial Sequence
  Description of Artificial Sequence: Synthetic oligonucleotide
cgggctggccggcatcgcct

SEQ ID NO: 81675 - DNA, 30 bp, Artificial Sequence
  Description of Artificial Sequence: Synthetic oligonucleotide
ttcccccctgtgatcaatatcacctggctg

SEQ ID NO: 81676 - DNA, 29 bp, Artificial Sequence
  Description of Artificial Sequence: Synthetic oligonucleotide
tcccccctgtgatcaatatcacctggctg

SEQ ID NO: 81677 - DNA, 28 bp, Artificial Sequence
  Description of Artificial Sequence: Synthetic oligonucleotide
cccccctgtgatcaatatcacctggctg

SEQ ID NO: 81678 - DNA, 28 bp, Artificial Sequence
  Description of Artificial Sequence: Synthetic oligonucleotide
ccccctgtgatcaatatcacctggctgc

SEQ ID NO: 81679 - DNA, 28 bp, Artificial Sequence
  Description of Artificial Sequence: Synthetic oligonucleotide
cccctgtgatcaatatcacctggctgcg

SEQ ID NO: 81680 - DNA, 28 bp, Artificial Sequence
  Description of Artificial Sequence: Synthetic oligonucleotide
ccctgtgatcaatatcacctggctgcgc

SEQ ID NO: 81681 - DNA, 30 bp, Artificial Sequence
  Description of Artificial Sequence: Synthetic oligonucleotide
cctgtgatcaatatcacctggctgcgcaac

SEQ ID NO: 81682 - DNA, 30 bp, Artificial Sequence
  Description of Artificial Sequence: Synthetic oligonucleotide
ctgtgatcaatatcacctggctgcgcaacg

SEQ ID NO: 81683 - DNA, 30 bp, Artificial Sequence
  Description of Artificial Sequence: Synthetic oligonucleotide
tgtgatcaatatcacctggctgcgcaacgg

SEQ ID NO: 81684 - DNA, 29 bp, Artificial Sequence
  Description of Artificial Sequence: Synthetic oligonucleotide
gtgatcaatatcacctggctgcgcaacgg

SEQ ID NO: 81685 - DNA, 29 bp, Artificial Sequence
  Description of Artificial Sequence: Synthetic oligonucleotide
tgatcaatatcacctggctgcgcaacggc

SEQ ID NO: 81686 - DNA, 28 bp, Artificial Sequence
  Description of Artificial Sequence: Synthetic oligonucleotide
gatcaatatcacctggctgcgcaacggc

SEQ ID NO: 81687 - DNA, 28 bp, Artificial Sequence
  Description of Artificial Sequence: Synthetic oligonucleotide
atcaatatcacctggctgcgcaacggcc

SEQ ID NO: 81688 - DNA, 27 bp, Artificial Sequence
  Description of Artificial Sequence: Synthetic oligonucleotide
tcaatatcacctggctgcgcaacggcc

SEQ ID NO: 81689 - DNA, 27 bp, Artificial Sequence
  Description of Artificial Sequence: Synthetic oligonucleotide
caatatcacctggctgcgcaacggcca

SEQ ID NO: 81690 - DNA, 29 bp, Artificial Sequence
  Description of Artificial Sequence: Synthetic oligonucleotide
aatatcacctggctgcgcaacggccaaac

SEQ ID NO: 81691 - DNA, 28 bp, Artificial Sequence
  Description of Artificial Sequence: Synthetic oligonucleotide
atatcacctggctgcgcaacggccaaac

SEQ ID NO: 81692 - DNA, 27 bp, Artificial Sequence
  Description of Artificial Sequence: Synthetic oligonucleotide
tatcacctggctgcgcaacggccaaac

SEQ ID NO: 81693 - DNA, 27 bp, Artificial Sequence
  Description of Artificial Sequence: Synthetic oligonucleotide
atcacctggctgcgcaacggccaaact

SEQ ID NO: 81694 - DNA, 26 bp, Artificial Sequence
  Description of Artificial Sequence: Synthetic oligonucleotide
tcacctggctgcgcaacggccaaact

SEQ ID NO: 81695 - DNA, 25 bp, Artificial Sequence
  Description of Artificial Sequence: Synthetic oligonucleotide
cacctggctgcgcaacggccaaact

SEQ ID NO: 81696 - DNA, 26 bp, Artificial Sequence
  Description of Artificial Sequence: Synthetic oligonucleotide
acctggctgcgcaacggccaaactgt

SEQ ID NO: 81697 - DNA, 25 bp, Artificial Sequence
  Description of Artificial Sequence: Synthetic oligonucleotide
cctggctgcgcaacggccaaactgt

SEQ ID NO: 81698 - DNA, 26 bp, Artificial Sequence
  Description of Artificial Sequence: Synthetic oligonucleotide
ctggctgcgcaacggccaaactgtca

SEQ ID NO: 81699 - DNA, 27 bp, Artificial Sequence
  Description of Artificial Sequence: Synthetic oligonucleotide
tggctgcgcaacggccaaactgtcact

SEQ ID NO: 81700 - DNA, 26 bp, Artificial Sequence
  Description of Artificial Sequence: Synthetic oligonucleotide
ggctgcgcaacggccaaactgtcact

SEQ ID NO: 81701 - DNA, 27 bp, Artificial Sequence
  Description of Artificial Sequence: Synthetic oligonucleotide
gctgcgcaacggccaaactgtcactga

SEQ ID NO: 81702 - DNA, 27 bp, Artificial Sequence
  Description of Artificial Sequence: Synthetic oligonucleotide
ctgcgcaacggccaaactgtcactgag

SEQ ID NO: 81703 - DNA, 27 bp, Artificial Sequence
  Description of Artificial Sequence: Synthetic oligonucleotide
tgcgcaacggccaaactgtcactgagg

SEQ ID NO: 81704 - DNA, 26 bp, Artificial Sequence
  Description of Artificial Sequence: Synthetic oligonucleotide
gcgcaacggccaaactgtcactgagg

SEQ ID NO: 81705 - DNA, 23 bp, Artificial Sequence
  Description of Artificial Sequence: Synthetic oligonucleotide
gagaccctggtctgtgccctggg

SEQ ID NO: 81706 - DNA, 23 bp, Artificial Sequence
  Description of Artificial Sequence: Synthetic oligonucleotide
agaccctggtctgtgccctgggc

SEQ ID NO: 81707 - DNA, 22 bp, Artificial Sequence
  Description of Artificial Sequence: Synthetic oligonucleotide
gaccctggtctgtgccctgggc

SEQ ID NO: 81708 - DNA, 23 bp, Artificial Sequence
  Description of Artificial Sequence: Synthetic oligonucleotide
accctggtctgtgccctgggcct

SEQ ID NO: 81709 - DNA, 22 bp, Artificial Sequence
  Description of Artificial Sequence: Synthetic oligonucleotide
ccctggtctgtgccctgggcct

SEQ ID NO: 81710 - DNA, 22 bp, Artificial Sequence
  Description of Artificial Sequence: Synthetic oligonucleotide
cctggtctgtgccctgggcctg

SEQ ID NO: 81711 - DNA, 22 bp, Artificial Sequence
  Description of Artificial Sequence: Synthetic oligonucleotide
ctggtctgtgccctgggcctgg

SEQ ID NO: 81712 - DNA, 22 bp, Artificial Sequence
  Description of Artificial Sequence: Synthetic oligonucleotide
tggtctgtgccctgggcctggc

SEQ ID NO: 81713 - DNA, 21 bp, Artificial Sequence
  Description of Artificial Sequence: Synthetic oligonucleotide
ggtctgtgccctgggcctggc

SEQ ID NO: 81714 - DNA, 23 bp, Artificial Sequence
  Description of Artificial Sequence: Synthetic oligonucleotide
gtctgtgccctgggcctggccat

SEQ ID NO: 81715 - DNA, 23 bp, Artificial Sequence
  Description of Artificial Sequence: Synthetic oligonucleotide
tctgtgccctgggcctggccatc

SEQ ID NO: 81716 - DNA, 22 bp, Artificial Sequence
  Description of Artificial Sequence: Synthetic oligonucleotide
ctgtgccctgggcctggccatc

SEQ ID NO: 81717 - DNA, 22 bp, Artificial Sequence
  Description of Artificial Sequence: Synthetic oligonucleotide
tgtgccctgggcctggccatcg

SEQ ID NO: 81718 - DNA, 21 bp, Artificial Sequence
  Description of Artificial Sequence: Synthetic oligonucleotide
gtgccctgggcctggccatcg

SEQ ID NO: 81719 - DNA, 21 bp, Artificial Sequence
  Description of Artificial Sequence: Synthetic oligonucleotide
tgccctgggcctggccatcgg

SEQ ID NO: 81720 - DNA, 20 bp, Artificial Sequence
  Description of Artificial Sequence: Synthetic oligonucleotide
gccctgggcctggccatcgg

SEQ ID NO: 81721 - DNA, 20 bp, Artificial Sequence
  Description of Artificial Sequence: Synthetic oligonucleotide
ccctgggcctggccatcggc

SEQ ID NO: 81722 - DNA, 21 bp, Artificial Sequence
  Description of Artificial Sequence: Synthetic oligonucleotide
cctgggcctggccatcggcct

SEQ ID NO: 81723 - DNA, 21 bp, Artificial Sequence
  Description of Artificial Sequence: Synthetic oligonucleotide
ctgggcctggccatcggcctg

SEQ ID NO: 81724 - DNA, 22 bp, Artificial Sequence
  Description of Artificial Sequence: Synthetic oligonucleotide
tgggcctggccatcggcctggt

SEQ ID NO: 81725 - DNA, 21 bp, Artificial Sequence
  Description of Artificial Sequence: Synthetic oligonucleotide
gggcctggccatcggcctggt

SEQ ID NO: 81726 - DNA, 21 bp, Artificial Sequence
  Description of Artificial Sequence: Synthetic oligonucleotide
ggcctggccatcggcctggtg

SEQ ID NO: 81727 - DNA, 21 bp, Artificial Sequence
  Description of Artificial Sequence: Synthetic oligonucleotide
gcctggccatcggcctggtgg

SEQ ID NO: 81728 - DNA, 21 bp, Artificial Sequence
  Description of Artificial Sequence: Synthetic oligonucleotide
cctggccatcggcctggtggg

SEQ ID NO: 81729 - DNA, 30 bp, Artificial Sequence
  Description of Artificial Sequence: Synthetic oligonucleotide
cctgcagatcctcatgggtttgtgacagac

SEQ ID NO: 81730 - DNA, 30 bp, Artificial Sequence
  Description of Artificial Sequence: Synthetic oligonucleotide
ctgcagatcctcatgggtttgtgacagacc

SEQ ID NO: 81731 - DNA, 30 bp, Artificial Sequence
  Description of Artificial Sequence: Synthetic oligonucleotide
tgcagatcctcatgggtttgtgacagaccc

SEQ ID NO: 81732 - DNA, 29 bp, Artificial Sequence
  Description of Artificial Sequence: Synthetic oligonucleotide
gcagatcctcatgggtttgtgacagaccc

SEQ ID NO: 81733 - DNA, 30 bp, Artificial Sequence
  Description of Artificial Sequence: Synthetic oligonucleotide
cagatcctcatgggtttgtgacagaccctg

SEQ ID NO: 81734 - DNA, 30 bp, Artificial Sequence
  Description of Artificial Sequence: Synthetic oligonucleotide
agatcctcatgggtttgtgacagaccctgc

SEQ ID NO: 81735 - DNA, 29 bp, Artificial Sequence
  Description of Artificial Sequence: Synthetic oligonucleotide
gatcctcatgggtttgtgacagaccctgc

SEQ ID NO: 81736 - DNA, 29 bp, Artificial Sequence
  Description of Artificial Sequence: Synthetic oligonucleotide
atcctcatgggtttgtgacagaccctgcg

SEQ ID NO: 81737 - DNA, 28 bp, Artificial Sequence
  Description of Artificial Sequence: Synthetic oligonucleotide
tcctcatgggtttgtgacagaccctgcg

SEQ ID NO: 81738 - DNA, 27 bp, Artificial Sequence
  Description of Artificial Sequence: Synthetic oligonucleotide
cctcatgggtttgtgacagaccctgcg

SEQ ID NO: 81739 - DNA, 28 bp, Artificial Sequence
  Description of Artificial Sequence: Synthetic oligonucleotide
ctcatgggtttgtgacagaccctgcgtg

SEQ ID NO: 81740 - DNA, 28 bp, Artificial Sequence
  Description of Artificial Sequence: Synthetic oligonucleotide
tcatgggtttgtgacagaccctgcgtgc

SEQ ID NO: 81741 - DNA, 27 bp, Artificial Sequence
  Description of Artificial Sequence: Synthetic oligonucleotide
catgggtttgtgacagaccctgcgtgc

SEQ ID NO: 81742 - DNA, 28 bp, Artificial Sequence
  Description of Artificial Sequence: Synthetic oligonucleotide
atgggtttgtgacagaccctgcgtgctc

SEQ ID NO: 81743 - DNA, 27 bp, Artificial Sequence
  Description of Artificial Sequence: Synthetic oligonucleotide
tgggtttgtgacagaccctgcgtgctc

SEQ ID NO: 81744 - DNA, 27 bp, Artificial Sequence
  Description of Artificial Sequence: Synthetic oligonucleotide
gggtttgtgacagaccctgcgtgctca

SEQ ID NO: 81745 - DNA, 27 bp, Artificial Sequence
  Description of Artificial Sequence: Synthetic oligonucleotide
ggtttgtgacagaccctgcgtgctcag

SEQ ID NO: 81746 - DNA, 28 bp, Artificial Sequence
  Description of Artificial Sequence: Synthetic oligonucleotide
gtttgtgacagaccctgcgtgctcagtg

SEQ ID NO: 81747 - DNA, 28 bp, Artificial Sequence
  Description of Artificial Sequence: Synthetic oligonucleotide
tttgtgacagaccctgcgtgctcagtgc

SEQ ID NO: 81748 - DNA, 27 bp, Artificial Sequence
  Description of Artificial Sequence: Synthetic oligonucleotide
ttgtgacagaccctgcgtgctcagtgc

SEQ ID NO: 81749 - DNA, 26 bp, Artificial Sequence
  Description of Artificial Sequence: Synthetic oligonucleotide
tgtgacagaccctgcgtgctcagtgc

SEQ ID NO: 81750 - DNA, 25 bp, Artificial Sequence
  Description of Artificial Sequence: Synthetic oligonucleotide
gtgacagaccctgcgtgctcagtgc

SEQ ID NO: 81751 - DNA, 25 bp, Artificial Sequence
  Description of Artificial Sequence: Synthetic oligonucleotide
tgacagaccctgcgtgctcagtgcc

SEQ ID NO: 81752 - DNA, 24 bp, Artificial Sequence
  Description of Artificial Sequence: Synthetic oligonucleotide
gacagaccctgcgtgctcagtgcc

SEQ ID NO: 81753 - DNA, 27 bp, Artificial Sequence
  Description of Artificial Sequence: Synthetic oligonucleotide
acagaccctgcgtgctcagtgcccttt

SEQ ID NO: 81754 - DNA, 27 bp, Artificial Sequence
  Description of Artificial Sequence: Synthetic oligonucleotide
cagaccctgcgtgctcagtgcccttta

SEQ ID NO: 81755 - DNA, 28 bp, Artificial Sequence
  Description of Artificial Sequence: Synthetic oligonucleotide
agaccctgcgtgctcagtgccctttaag

SEQ ID NO: 81756 - DNA, 27 bp, Artificial Sequence
  Description of Artificial Sequence: Synthetic oligonucleotide
gaccctgcgtgctcagtgccctttaag

SEQ ID NO: 81757 - DNA, 28 bp, Artificial Sequence
  Description of Artificial Sequence: Synthetic oligonucleotide
accctgcgtgctcagtgccctttaagtg

SEQ ID NO: 81758 - DNA, 33 bp, Artificial Sequence
  Description of Artificial Sequence: Synthetic oligonucleotide
acacctactagcttcccttcccattcaacacac

SEQ ID NO: 81759 - DNA, 32 bp, Artificial Sequence
  Description of Artificial Sequence: Synthetic oligonucleotide
cacctactagcttcccttcccattcaacacac

SEQ ID NO: 81760 - DNA, 33 bp, Artificial Sequence
  Description of Artificial Sequence: Synthetic oligonucleotide
acctactagcttcccttcccattcaacacacac

SEQ ID NO: 81761 - DNA, 32 bp, Artificial Sequence
  Description of Artificial Sequence: Synthetic oligonucleotide
cctactagcttcccttcccattcaacacacac

SEQ ID NO: 81762 - DNA, 33 bp, Artificial Sequence
  Description of Artificial Sequence: Synthetic oligonucleotide
ctactagcttcccttcccattcaacacacacac

SEQ ID NO: 81763 - DNA, 34 bp, Artificial Sequence
  Description of Artificial Sequence: Synthetic oligonucleotide
tactagcttcccttcccattcaacacacacacac

SEQ ID NO: 81764 - DNA, 33 bp, Artificial Sequence
  Description of Artificial Sequence: Synthetic oligonucleotide
actagcttcccttcccattcaacacacacacac

SEQ ID NO: 81765 - DNA, 32 bp, Artificial Sequence
  Description of Artificial Sequence: Synthetic oligonucleotide
ctagcttcccttcccattcaacacacacacac

SEQ ID NO: 81766 - DNA, 35 bp, Artificial Sequence
  Description of Artificial Sequence: Synthetic oligonucleotide
tagcttcccttcccattcaacacacacacacattc

SEQ ID NO: 81767 - DNA, 34 bp, Artificial Sequence
  Description of Artificial Sequence: Synthetic oligonucleotide
agcttcccttcccattcaacacacacacacattc

SEQ ID NO: 81768 - DNA, 33 bp, Artificial Sequence
  Description of Artificial Sequence: Synthetic oligonucleotide
gcttcccttcccattcaacacacacacacattc

SEQ ID NO: 81769 - DNA, 35 bp, Artificial Sequence
  Description of Artificial Sequence: Synthetic oligonucleotide
cttcccttcccattcaacacacacacacattcttg

SEQ ID NO: 81770 - DNA, 35 bp, Artificial Sequence
  Description of Artificial Sequence: Synthetic oligonucleotide
ttcccttcccattcaacacacacacacattcttgc

SEQ ID NO: 81771 - DNA, 34 bp, Artificial Sequence
  Description of Artificial Sequence: Synthetic oligonucleotide
tcccttcccattcaacacacacacacattcttgc

SEQ ID NO: 81772 - DNA, 33 bp, Artificial Sequence
  Description of Artificial Sequence: Synthetic oligonucleotide
cccttcccattcaacacacacacacattcttgc

SEQ ID NO: 81773 - DNA, 34 bp, Artificial Sequence
  Description of Artificial Sequence: Synthetic oligonucleotide
ccttcccattcaacacacacacacattcttgctc

SEQ ID NO: 81774 - DNA, 36 bp, Artificial Sequence
  Description of Artificial Sequence: Synthetic oligonucleotide
cttcccattcaacacacacacacattcttgctctac

SEQ ID NO: 81775 - DNA, 36 bp, Artificial Sequence
  Description of Artificial Sequence: Synthetic oligonucleotide
ttcccattcaacacacacacacattcttgctctacc

SEQ ID NO: 81776 - DNA, 35 bp, Artificial Sequence
  Description of Artificial Sequence: Synthetic oligonucleotide
tcccattcaacacacacacacattcttgctctacc

SEQ ID NO: 81777 - DNA, 34 bp, Artificial Sequence
  Description of Artificial Sequence: Synthetic oligonucleotide
cccattcaacacacacacacattcttgctctacc

SEQ ID NO: 81778 - DNA, 34 bp, Artificial Sequence
  Description of Artificial Sequence: Synthetic oligonucleotide
ccattcaacacacacacacattcttgctctaccc

SEQ ID NO: 81779 - DNA, 37 bp, Artificial Sequence
  Description of Artificial Sequence: Synthetic oligonucleotide
cattcaacacacacacacattcttgctctacccaaag

SEQ ID NO: 81780 - DNA, 37 bp, Artificial Sequence
  Description of Artificial Sequence: Synthetic oligonucleotide
attcaacacacacacacattcttgctctacccaaagc

SEQ ID NO: 81781 - DNA, 36 bp, Artificial Sequence
  Description of Artificial Sequence: Synthetic oligonucleotide
ttcaacacacacacacattcttgctctacccaaagc

SEQ ID NO: 81782 - DNA, 35 bp, Artificial Sequence
  Description of Artificial Sequence: Synthetic oligonucleotide
tcaacacacacacacattcttgctctacccaaagc

SEQ ID NO: 81783 - DNA, 34 bp, Artificial Sequence
  Description of Artificial Sequence: Synthetic oligonucleotide
caacacacacacacattcttgctctacccaaagc

SEQ ID NO: 81784 - DNA, 35 bp, Artificial Sequence
  Description of Artificial Sequence: Synthetic oligonucleotide
aacacacacacacattcttgctctacccaaagctc

SEQ ID NO: 81785 - DNA, 34 bp, Artificial Sequence
  Description of Artificial Sequence: Synthetic oligonucleotide
acacacacacacattcttgctctacccaaagctc

SEQ ID NO: 81786 - DNA, 33 bp, Artificial Sequence
  Description of Artificial Sequence: Synthetic oligonucleotide
cacacacacacattcttgctctacccaaagctc

SEQ ID NO: 81787 - DNA, 34 bp, Artificial Sequence
  Description of Artificial Sequence: Synthetic oligonucleotide
acacacacacattcttgctctacccaaagctctg

SEQ ID NO: 81788 - DNA, 33 bp, Artificial Sequence
  Description of Artificial Sequence: Synthetic oligonucleotide
cacacacacattcttgctctacccaaagctctg

SEQ ID NO: 81789 - DNA, 33 bp, Artificial Sequence
  Description of Artificial Sequence: Synthetic oligonucleotide
acacacacattcttgctctacccaaagctctgg

SEQ ID NO: 81790 - DNA, 32 bp, Artificial Sequence
  Description of Artificial Sequence: Synthetic oligonucleotide
cacacacattcttgctctacccaaagctctgg

SEQ ID NO: 81791 - DNA, 25 bp, Artificial Sequence
  Description of Artificial Sequence: Synthetic oligonucleotide
ccgtgtggcgtctgcctgagtttgg

SEQ ID NO: 81792 - DNA, 25 bp, Artificial Sequence
  Description of Artificial Sequence: Synthetic oligonucleotide
cgtgtggcgtctgcctgagtttggc

SEQ ID NO: 81793 - DNA, 26 bp, Artificial Sequence
  Description of Artificial Sequence: Synthetic oligonucleotide
gtgtggcgtctgcctgagtttggcga

SEQ ID NO: 81794 - DNA, 27 bp, Artificial Sequence
  Description of Artificial Sequence: Synthetic oligonucleotide
tgtggcgtctgcctgagtttggcgact

SEQ ID NO: 81795 - DNA, 27 bp, Artificial Sequence
  Description of Artificial Sequence: Synthetic oligonucleotide
gtggcgtctgcctgagtttggcgactt

SEQ ID NO: 81796 - DNA, 28 bp, Artificial Sequence
  Description of Artificial Sequence: Synthetic oligonucleotide
tggcgtctgcctgagtttggcgactttg

SEQ ID NO: 81797 - DNA, 27 bp, Artificial Sequence
  Description of Artificial Sequence: Synthetic oligonucleotide
ggcgtctgcctgagtttggcgactttg

SEQ ID NO: 81798 - DNA, 27 bp, Artificial Sequence
  Description of Artificial Sequence: Synthetic oligonucleotide
gcgtctgcctgagtttggcgactttgc

SEQ ID NO: 81799 - DNA, 27 bp, Artificial Sequence
  Description of Artificial Sequence: Synthetic oligonucleotide
cgtctgcctgagtttggcgactttgcc

SEQ ID NO: 81800 - DNA, 27 bp, Artificial Sequence
  Description of Artificial Sequence: Synthetic oligonucleotide
gtctgcctgagtttggcgactttgccc

SEQ ID NO: 81801 - DNA, 27 bp, Artificial Sequence
  Description of Artificial Sequence: Synthetic oligonucleotide
tctgcctgagtttggcgactttgcccg

SEQ ID NO: 81802 - DNA, 26 bp, Artificial Sequence
  Description of Artificial Sequence: Synthetic oligonucleotide
ctgcctgagtttggcgactttgcccg

SEQ ID NO: 81803 - DNA, 27 bp, Artificial Sequence
  Description of Artificial Sequence: Synthetic oligonucleotide
tgcctgagtttggcgactttgcccgct

SEQ ID NO: 81804 - DNA, 27 bp, Artificial Sequence
  Description of Artificial Sequence: Synthetic oligonucleotide
gcctgagtttggcgactttgcccgctt

SEQ ID NO: 81805 - DNA, 28 bp, Artificial Sequence
  Description of Artificial Sequence: Synthetic oligonucleotide
cctgagtttggcgactttgcccgctttg

SEQ ID NO: 81806 - DNA, 29 bp, Artificial Sequence
  Description of Artificial Sequence: Synthetic oligonucleotide
ctgagtttggcgactttgcccgctttgac

SEQ ID NO: 81807 - DNA, 29 bp, Artificial Sequence
  Description of Artificial Sequence: Synthetic oligonucleotide
tgagtttggcgactttgcccgctttgacc

SEQ ID NO: 81808 - DNA, 28 bp, Artificial Sequence
  Description of Artificial Sequence: Synthetic oligonucleotide
gagtttggcgactttgcccgctttgacc

SEQ ID NO: 81809 - DNA, 28 bp, Artificial Sequence
  Description of Artificial Sequence: Synthetic oligonucleotide
agtttggcgactttgcccgctttgaccc

SEQ ID NO: 81810 - DNA, 27 bp, Artificial Sequence
  Description of Artificial Sequence: Synthetic oligonucleotide
gtttggcgactttgcccgctttgaccc

SEQ ID NO: 81811 - DNA, 27 bp, Artificial Sequence
  Description of Artificial Sequence: Synthetic oligonucleotide
tttggcgactttgcccgctttgacccg

SEQ ID NO: 81812 - DNA, 26 bp, Artificial Sequence
  Description of Artificial Sequence: Synthetic oligonucleotide
ttggcgactttgcccgctttgacccg

SEQ ID NO: 81813 - DNA, 25 bp, Artificial Sequence
  Description of Artificial Sequence: Synthetic oligonucleotide
tggcgactttgcccgctttgacccg

SEQ ID NO: 81814 - DNA, 24 bp, Artificial Sequence
  Description of Artificial Sequence: Synthetic oligonucleotide
ggcgactttgcccgctttgacccg

SEQ ID NO: 81815 - DNA, 25 bp, Artificial Sequence
  Description of Artificial Sequence: Synthetic oligonucleotide
gcgactttgcccgctttgacccgca

SEQ ID NO: 81816 - DNA, 25 bp, Artificial Sequence
  Description of Artificial Sequence: Synthetic oligonucleotide
cgactttgcccgctttgacccgcag

SEQ ID NO: 81817 - DNA, 34 bp, Artificial Sequence
  Description of Artificial Sequence: Synthetic oligonucleotide
tggctggcagcactaaatgctttggtggtatttg

SEQ ID NO: 81818 - DNA, 33 bp, Artificial Sequence
  Description of Artificial Sequence: Synthetic oligonucleotide
ggctggcagcactaaatgctttggtggtatttg

SEQ ID NO: 81819 - DNA, 33 bp, Artificial Sequence
  Description of Artificial Sequence: Synthetic oligonucleotide
gctggcagcactaaatgctttggtggtatttgc

SEQ ID NO: 81820 - DNA, 27 bp, Artificial Sequence
  Description of Artificial Sequence: Synthetic oligonucleotide
gccttctaccagtcttacggcgcctca

SEQ ID NO: 81821 - DNA, 27 bp, Artificial Sequence
  Description of Artificial Sequence: Synthetic oligonucleotide
ccttctaccagtcttacggcgcctcag

SEQ ID NO: 81822 - DNA, 27 bp, Artificial Sequence
  Description of Artificial Sequence: Synthetic oligonucleotide
cttctaccagtcttacggcgcctcagg

SEQ ID NO: 81823 - DNA, 27 bp, Artificial Sequence
  Description of Artificial Sequence: Synthetic oligonucleotide
ttctaccagtcttacggcgcctcaggc

SEQ ID NO: 81824 - DNA, 26 bp, Artificial Sequence
  Description of Artificial Sequence: Synthetic oligonucleotide
tctaccagtcttacggcgcctcaggc

SEQ ID NO: 81825 - DNA, 25 bp, Artificial Sequence
  Description of Artificial Sequence: Synthetic oligonucleotide
ctaccagtcttacggcgcctcaggc

SEQ ID NO: 81826 - DNA, 26 bp, Artificial Sequence
  Description of Artificial Sequence: Synthetic oligonucleotide
taccagtcttacggcgcctcaggcca

SEQ ID NO: 81827 - DNA, 25 bp, Artificial Sequence
  Description of Artificial Sequence: Synthetic oligonucleotide
accagtcttacggcgcctcaggcca

SEQ ID NO: 81828 - DNA, 24 bp, Artificial Sequence
  Description of Artificial Sequence: Synthetic oligonucleotide
ccagtcttacggcgcctcaggcca

SEQ ID NO: 81829 - DNA, 26 bp, Artificial Sequence
  Description of Artificial Sequence: Synthetic oligonucleotide
cagtcttacggcgcctcaggccagtt

SEQ ID NO: 81830 - DNA, 27 bp, Artificial Sequence
  Description of Artificial Sequence: Synthetic oligonucleotide
agtcttacggcgcctcaggccagttca

SEQ ID NO: 81831 - DNA, 26 bp, Artificial Sequence
  Description of Artificial Sequence: Synthetic oligonucleotide
gtcttacggcgcctcaggccagttca

SEQ ID NO: 81832 - DNA, 26 bp, Artificial Sequence
  Description of Artificial Sequence: Synthetic oligonucleotide
tcttacggcgcctcaggccagttcac

SEQ ID NO: 81833 - DNA, 25 bp, Artificial Sequence
  Description of Artificial Sequence: Synthetic oligonucleotide
cttacggcgcctcaggccagttcac

SEQ ID NO: 81834 - DNA, 25 bp, Artificial Sequence
  Description of Artificial Sequence: Synthetic oligonucleotide
ttacggcgcctcaggccagttcacc

SEQ ID NO: 81835 - DNA, 24 bp, Artificial Sequence
  Description of Artificial Sequence: Synthetic oligonucleotide
tacggcgcctcaggccagttcacc

SEQ ID NO: 81836 - DNA, 23 bp, Artificial Sequence
  Description of Artificial Sequence: Synthetic oligonucleotide
acggcgcctcaggccagttcacc

SEQ ID NO: 81837 - DNA, 22 bp, Artificial Sequence
  Description of Artificial Sequence: Synthetic oligonucleotide
cggcgcctcaggccagttcacc

SEQ ID NO: 81838 - DNA, 24 bp, Artificial Sequence
  Description of Artificial Sequence: Synthetic oligonucleotide
ggcgcctcaggccagttcacccat

SEQ ID NO: 81839 - DNA, 27 bp, Artificial Sequence
  Description of Artificial Sequence: Synthetic oligonucleotide
gcgcctcaggccagttcacccatgaat

SEQ ID NO: 81840 - DNA, 29 bp, Artificial Sequence
  Description of Artificial Sequence: Synthetic oligonucleotide
cgcctcaggccagttcacccatgaatttg

SEQ ID NO: 81841 - DNA, 31 bp, Artificial Sequence
  Description of Artificial Sequence: Synthetic oligonucleotide
gcctcaggccagttcacccatgaatttgatg

SEQ ID NO: 81842 - DNA, 32 bp, Artificial Sequence
  Description of Artificial Sequence: Synthetic oligonucleotide
cctcaggccagttcacccatgaatttgatgag

SEQ ID NO: 81843 - DNA, 32 bp, Artificial Sequence
  Description of Artificial Sequence: Synthetic oligonucleotide
ctcaggccagttcacccatgaatttgatgagg

SEQ ID NO: 81844 - DNA, 34 bp, Artificial Sequence
  Description of Artificial Sequence: Synthetic oligonucleotide
tcaggccagttcacccatgaatttgatgaggaac

SEQ ID NO: 81845 - DNA, 33 bp, Artificial Sequence
  Description of Artificial Sequence: Synthetic oligonucleotide
caggccagttcacccatgaatttgatgaggaac

SEQ ID NO: 81846 - DNA, 34 bp, Artificial Sequence
  Description of Artificial Sequence: Synthetic oligonucleotide
aggccagttcacccatgaatttgatgaggaacag

SEQ ID NO: 81847 - DNA, 27 bp, Artificial Sequence
  Description of Artificial Sequence: Synthetic oligonucleotide
tggacatcctggtggagcgctccaact

SEQ ID NO: 81848 - DNA, 26 bp, Artificial Sequence
  Description of Artificial Sequence: Synthetic oligonucleotide
ggacatcctggtggagcgctccaact

SEQ ID NO: 81849 - DNA, 26 bp, Artificial Sequence
  Description of Artificial Sequence: Synthetic oligonucleotide
gacatcctggtggagcgctccaactg

SEQ ID NO: 81850 - DNA, 27 bp, Artificial Sequence
  Description of Artificial Sequence: Synthetic oligonucleotide
acatcctggtggagcgctccaactgca

SEQ ID NO: 81851 - DNA, 26 bp, Artificial Sequence
  Description of Artificial Sequence: Synthetic oligonucleotide
catcctggtggagcgctccaactgca

SEQ ID NO: 81852 - DNA, 26 bp, Artificial Sequence
  Description of Artificial Sequence: Synthetic oligonucleotide
atcctggtggagcgctccaactgcag

SEQ ID NO: 81853 - DNA, 25 bp, Artificial Sequence
  Description of Artificial Sequence: Synthetic oligonucleotide
tcctggtggagcgctccaactgcag

SEQ ID NO: 81854 - DNA, 24 bp, Artificial Sequence
  Description of Artificial Sequence: Synthetic oligonucleotide
cctggtggagcgctccaactgcag

SEQ ID NO: 81855 - DNA, 25 bp, Artificial Sequence
  Description of Artificial Sequence: Synthetic oligonucleotide
ctggtggagcgctccaactgcagca

SEQ ID NO: 81856 - DNA, 26 bp, Artificial Sequence
  Description of Artificial Sequence: Synthetic oligonucleotide
tggtggagcgctccaactgcagcaga

SEQ ID NO: 81857 - DNA, 25 bp, Artificial Sequence
  Description of Artificial Sequence: Synthetic oligonucleotide
ggtggagcgctccaactgcagcaga

SEQ ID NO: 81858 - DNA, 25 bp, Artificial Sequence
  Description of Artificial Sequence: Synthetic oligonucleotide
gtggagcgctccaactgcagcagag

SEQ ID NO: 81859 - DNA, 25 bp, Artificial Sequence
  Description of Artificial Sequence: Synthetic oligonucleotide
tggagcgctccaactgcagcagagc

SEQ ID NO: 81860 - DNA, 24 bp, Artificial Sequence
  Description of Artificial Sequence: Synthetic oligonucleotide
ggagcgctccaactgcagcagagc

SEQ ID NO: 81861 - DNA, 26 bp, Artificial Sequence
  Description of Artificial Sequence: Synthetic oligonucleotide
gagcgctccaactgcagcagagccat

SEQ ID NO: 81862 - DNA, 27 bp, Artificial Sequence
  Description of Artificial Sequence: Synthetic oligonucleotide
agcgctccaactgcagcagagccatca

SEQ ID NO: 81863 - DNA, 27 bp, Artificial Sequence
  Description of Artificial Sequence: Synthetic oligonucleotide
gcgctccaactgcagcagagccatcaa

SEQ ID NO: 81864 - DNA, 27 bp, Artificial Sequence
  Description of Artificial Sequence: Synthetic oligonucleotide
cgctccaactgcagcagagccatcaac

SEQ ID NO: 81865 - DNA, 27 bp, Artificial Sequence
  Description of Artificial Sequence: Synthetic oligonucleotide
gctccaactgcagcagagccatcaacg

SEQ ID NO: 81866 - DNA, 28 bp, Artificial Sequence
  Description of Artificial Sequence: Synthetic oligonucleotide
ctccaactgcagcagagccatcaacgtg

SEQ ID NO: 81867 - DNA, 28 bp, Artificial Sequence
  Description of Artificial Sequence: Synthetic oligonucleotide
tccaactgcagcagagccatcaacgtgc

SEQ ID NO: 81868 - DNA, 27 bp, Artificial Sequence
  Description of Artificial Sequence: Synthetic oligonucleotide
ccaactgcagcagagccatcaacgtgc

SEQ ID NO: 81869 - DNA, 27 bp, Artificial Sequence
  Description of Artificial Sequence: Synthetic oligonucleotide
caactgcagcagagccatcaacgtgcc

SEQ ID NO: 81870 - DNA, 28 bp, Artificial Sequence
  Description of Artificial Sequence: Synthetic oligonucleotide
aactgcagcagagccatcaacgtgcctc

SEQ ID NO: 81871 - DNA, 27 bp, Artificial Sequence
  Description of Artificial Sequence: Synthetic oligonucleotide
actgcagcagagccatcaacgtgcctc

SEQ ID NO: 81872 - DNA, 26 bp, Artificial Sequence
  Description of Artificial Sequence: Synthetic oligonucleotide
ctgcagcagagccatcaacgtgcctc

SEQ ID NO: 81873 - DNA, 27 bp, Artificial Sequence
  Description of Artificial Sequence: Synthetic oligonucleotide
tgcagcagagccatcaacgtgcctcca

SEQ ID NO: 81874 - DNA, 28 bp, Artificial Sequence
  Description of Artificial Sequence: Synthetic oligonucleotide
gccgcaatcaaagcccatctggacatcg

SEQ ID NO: 81875 - DNA, 29 bp, Artificial Sequence
  Description of Artificial Sequence: Synthetic oligonucleotide
ccgcaatcaaagcccatctggacatcgtg

SEQ ID NO: 81876 - DNA, 29 bp, Artificial Sequence
  Description of Artificial Sequence: Synthetic oligonucleotide
cgcaatcaaagcccatctggacatcgtgg

SEQ ID NO: 81877 - DNA, 30 bp, Artificial Sequence
  Description of Artificial Sequence: Synthetic oligonucleotide
gcaatcaaagcccatctggacatcgtggtg

SEQ ID NO: 81878 - DNA, 30 bp, Artificial Sequence
  Description of Artificial Sequence: Synthetic oligonucleotide
caatcaaagcccatctggacatcgtggtgg

SEQ ID NO: 81879 - DNA, 31 bp, Artificial Sequence
  Description of Artificial Sequence: Synthetic oligonucleotide
aatcaaagcccatctggacatcgtggtggag

SEQ ID NO: 81880 - DNA, 30 bp, Artificial Sequence
  Description of Artificial Sequence: Synthetic oligonucleotide
atcaaagcccatctggacatcgtggtggag

SEQ ID NO: 81881 - DNA, 29 bp, Artificial Sequence
  Description of Artificial Sequence: Synthetic oligonucleotide
tcaaagcccatctggacatcgtggtggag

SEQ ID NO: 81882 - DNA, 28 bp, Artificial Sequence
  Description of Artificial Sequence: Synthetic oligonucleotide
caaagcccatctggacatcgtggtggag

SEQ ID NO: 81883 - DNA, 28 bp, Artificial Sequence
  Description of Artificial Sequence: Synthetic oligonucleotide
aaagcccatctggacatcgtggtggagc

SEQ ID NO: 81884 - DNA, 27 bp, Artificial Sequence
  Description of Artificial Sequence: Synthetic oligonucleotide
aagcccatctggacatcgtggtggagc

SEQ ID NO: 81885 - DNA, 26 bp, Artificial Sequence
  Description of Artificial Sequence: Synthetic oligonucleotide
agcccatctggacatcgtggtggagc

SEQ ID NO: 81886 - DNA, 25 bp, Artificial Sequence
  Description of Artificial Sequence: Synthetic oligonucleotide
gcccatctggacatcgtggtggagc

SEQ ID NO: 81887 - DNA, 25 bp, Artificial Sequence
  Description of Artificial Sequence: Synthetic oligonucleotide
cccatctggacatcgtggtggagcg

SEQ ID NO: 81888 - DNA, 26 bp, Artificial Sequence
  Description of Artificial Sequence: Synthetic oligonucleotide
ccatctggacatcgtggtggagcgct

SEQ ID NO: 81889 - DNA, 26 bp, Artificial Sequence
  Description of Artificial Sequence: Synthetic oligonucleotide
catctggacatcgtggtggagcgctc

SEQ ID NO: 81890 - DNA, 27 bp, Artificial Sequence
  Description of Artificial Sequence: Synthetic oligonucleotide
atctggacatcgtggtggagcgctcca

SEQ ID NO: 81891 - DNA, 27 bp, Artificial Sequence
  Description of Artificial Sequence: Synthetic oligonucleotide
tctggacatcgtggtggagcgctccaa

SEQ ID NO: 81892 - DNA, 26 bp, Artificial Sequence
  Description of Artificial Sequence: Synthetic oligonucleotide
ctggacatcgtggtggagcgctccaa

SEQ ID NO: 81893 - DNA, 26 bp, Artificial Sequence
  Description of Artificial Sequence: Synthetic oligonucleotide
tggacatcgtggtggagcgctccaac

SEQ ID NO: 81894 - DNA, 25 bp, Artificial Sequence
  Description of Artificial Sequence: Synthetic oligonucleotide
ggacatcgtggtggagcgctccaac

SEQ ID NO: 81895 - DNA, 25 bp, Artificial Sequence
  Description of Artificial Sequence: Synthetic oligonucleotide
gacatcgtggtggagcgctccaacc

SEQ ID NO: 81896 - DNA, 25 bp, Artificial Sequence
  Description of Artificial Sequence: Synthetic oligonucleotide
acatcgtggtggagcgctccaaccg

SEQ ID NO: 81897 - DNA, 24 bp, Artificial Sequence
  Description of Artificial Sequence: Synthetic oligonucleotide
catcgtggtggagcgctccaaccg

SEQ ID NO: 81898 - DNA, 25 bp, Artificial Sequence
  Description of Artificial Sequence: Synthetic oligonucleotide
atcgtggtggagcgctccaaccgca

SEQ ID NO: 81899 - DNA, 24 bp, Artificial Sequence
  Description of Artificial Sequence: Synthetic oligonucleotide
tcgtggtggagcgctccaaccgca

SEQ ID NO: 81900 - DNA, 23 bp, Artificial Sequence
  Description of Artificial Sequence: Synthetic oligonucleotide
cgtggtggagcgctccaaccgca

SEQ ID NO: 81901 - DNA, 23 bp, Artificial Sequence
  Description of Artificial Sequence: Synthetic oligonucleotide
gtggtggagcgctccaaccgcag

SEQ ID NO: 81902 - DNA, 25 bp, Artificial Sequence
  Description of Artificial Sequence: Synthetic oligonucleotide
tgaccacatgggctcctacggaccg

SEQ ID NO: 81903 - DNA, 24 bp, Artificial Sequence
  Description of Artificial Sequence: Synthetic oligonucleotide
gaccacatgggctcctacggaccg

SEQ ID NO: 81904 - DNA, 24 bp, Artificial Sequence
  Description of Artificial Sequence: Synthetic oligonucleotide
accacatgggctcctacggaccgc

SEQ ID NO: 81905 - DNA, 23 bp, Artificial Sequence
  Description of Artificial Sequence: Synthetic oligonucleotide
ccacatgggctcctacggaccgc

SEQ ID NO: 81906 - DNA, 25 bp, Artificial Sequence
  Description of Artificial Sequence: Synthetic oligonucleotide
cacatgggctcctacggaccgcctt

SEQ ID NO: 81907 - DNA, 27 bp, Artificial Sequence
  Description of Artificial Sequence: Synthetic oligonucleotide
acatgggctcctacggaccgccttcta

SEQ ID NO: 81908 - DNA, 26 bp, Artificial Sequence
  Description of Artificial Sequence: Synthetic oligonucleotide
catgggctcctacggaccgccttcta

SEQ ID NO: 81909 - DNA, 26 bp, Artificial Sequence
  Description of Artificial Sequence: Synthetic oligonucleotide
atgggctcctacggaccgccttctac

SEQ ID NO: 81910 - DNA, 25 bp, Artificial Sequence
  Description of Artificial Sequence: Synthetic oligonucleotide
tgggctcctacggaccgccttctac

SEQ ID NO: 81911 - DNA, 24 bp, Artificial Sequence
  Description of Artificial Sequence: Synthetic oligonucleotide
gggctcctacggaccgccttctac

SEQ ID NO: 81912 - DNA, 25 bp, Artificial Sequence
  Description of Artificial Sequence: Synthetic oligonucleotide
ggctcctacggaccgccttctacca

SEQ ID NO: 81913 - DNA, 26 bp, Artificial Sequence
  Description of Artificial Sequence: Synthetic oligonucleotide
gctcctacggaccgccttctaccagt

SEQ ID NO: 81914 - DNA, 27 bp, Artificial Sequence
  Description of Artificial Sequence: Synthetic oligonucleotide
ctcctacggaccgccttctaccagtct

SEQ ID NO: 81915 - DNA, 29 bp, Artificial Sequence
  Description of Artificial Sequence: Synthetic oligonucleotide
tcctacggaccgccttctaccagtcttac

SEQ ID NO: 81916 - DNA, 28 bp, Artificial Sequence
  Description of Artificial Sequence: Synthetic oligonucleotide
cctacggaccgccttctaccagtcttac

SEQ ID NO: 81917 - DNA, 28 bp, Artificial Sequence
  Description of Artificial Sequence: Synthetic oligonucleotide
ctacggaccgccttctaccagtcttacg

SEQ ID NO: 81918 - DNA, 28 bp, Artificial Sequence
  Description of Artificial Sequence: Synthetic oligonucleotide
tacggaccgccttctaccagtcttacgg

SEQ ID NO: 81919 - DNA, 27 bp, Artificial Sequence
  Description of Artificial Sequence: Synthetic oligonucleotide
acggaccgccttctaccagtcttacgg

SEQ ID NO: 81920 - DNA, 26 bp, Artificial Sequence
  Description of Artificial Sequence: Synthetic oligonucleotide
cggaccgccttctaccagtcttacgg

SEQ ID NO: 81921 - DNA, 26 bp, Artificial Sequence
  Description of Artificial Sequence: Synthetic oligonucleotide
ggaccgccttctaccagtcttacggc

SEQ ID NO: 81922 - DNA, 26 bp, Artificial Sequence
  Description of Artificial Sequence: Synthetic oligonucleotide
gaccgccttctaccagtcttacggcg

SEQ ID NO: 81923 - DNA, 26 bp, Artificial Sequence
  Description of Artificial Sequence: Synthetic oligonucleotide
accgccttctaccagtcttacggcgc

SEQ ID NO: 81924 - DNA, 24 bp, Artificial Sequence
  Description of Artificial Sequence: Synthetic oligonucleotide
atgggttctgggtgggtcccctgg

SEQ ID NO: 81925 - DNA, 23 bp, Artificial Sequence
  Description of Artificial Sequence: Synthetic oligonucleotide
tgggttctgggtgggtcccctgg

SEQ ID NO: 81926 - DNA, 22 bp, Artificial Sequence
  Description of Artificial Sequence: Synthetic oligonucleotide
gggttctgggtgggtcccctgg

SEQ ID NO: 81927 - DNA, 23 bp, Artificial Sequence
  Description of Artificial Sequence: Synthetic oligonucleotide
ggttctgggtgggtcccctgggt

SEQ ID NO: 81928 - DNA, 23 bp, Artificial Sequence
  Description of Artificial Sequence: Synthetic oligonucleotide
gttctgggtgggtcccctgggtg

SEQ ID NO: 81929 - DNA, 24 bp, Artificial Sequence
  Description of Artificial Sequence: Synthetic oligonucleotide
ttctgggtgggtcccctgggtggt

SEQ ID NO: 81930 - DNA, 23 bp, Artificial Sequence
  Description of Artificial Sequence: Synthetic oligonucleotide
tctgggtgggtcccctgggtggt

SEQ ID NO: 81931 - DNA, 22 bp, Artificial Sequence
  Description of Artificial Sequence: Synthetic oligonucleotide
ctgggtgggtcccctgggtggt

SEQ ID NO: 81932 - DNA, 22 bp, Artificial Sequence
  Description of Artificial Sequence: Synthetic oligonucleotide
tgggtgggtcccctgggtggtg

SEQ ID NO: 81933 - DNA, 21 bp, Artificial Sequence
  Description of Artificial Sequence: Synthetic oligonucleotide
gggtgggtcccctgggtggtg

SEQ ID NO: 81934 - DNA, 21 bp, Artificial Sequence
  Description of Artificial Sequence: Synthetic oligonucleotide
ggtgggtcccctgggtggtgg

SEQ ID NO: 81935 - DNA, 22 bp, Artificial Sequence
  Description of Artificial Sequence: Synthetic oligonucleotide
gtgggtcccctgggtggtggct

SEQ ID NO: 81936 - DNA, 23 bp, Artificial Sequence
  Description of Artificial Sequence: Synthetic oligonucleotide
tgggtcccctgggtggtggctct

SEQ ID NO: 81937 - DNA, 22 bp, Artificial Sequence
  Description of Artificial Sequence: Synthetic oligonucleotide
gggtcccctgggtggtggctct

SEQ ID NO: 81938 - DNA, 22 bp, Artificial Sequence
  Description of Artificial Sequence: Synthetic oligonucleotide
ggtcccctgggtggtggctctg

SEQ ID NO: 81939 - DNA, 24 bp, Artificial Sequence
  Description of Artificial Sequence: Synthetic oligonucleotide
gtcccctgggtggtggctctgcta

SEQ ID NO: 81940 - DNA, 25 bp, Artificial Sequence
  Description of Artificial Sequence: Synthetic oligonucleotide
tcccctgggtggtggctctgctagt

SEQ ID NO: 81941 - DNA, 24 bp, Artificial Sequence
  Description of Artificial Sequence: Synthetic oligonucleotide
cccctgggtggtggctctgctagt

SEQ ID NO: 81942 - DNA, 27 bp, Artificial Sequence
  Description of Artificial Sequence: Synthetic oligonucleotide
ccctgggtggtggctctgctagtgaat

SEQ ID NO: 81943 - DNA, 27 bp, Artificial Sequence
  Description of Artificial Sequence: Synthetic oligonucleotide
cctgggtggtggctctgctagtgaatc

SEQ ID NO: 81944 - DNA, 28 bp, Artificial Sequence
  Description of Artificial Sequence: Synthetic oligonucleotide
ctgggtggtggctctgctagtgaatctg

SEQ ID NO: 81945 - DNA, 29 bp, Artificial Sequence
  Description of Artificial Sequence: Synthetic oligonucleotide
tgggtggtggctctgctagtgaatctgac

SEQ ID NO: 81946 - DNA, 28 bp, Artificial Sequence
  Description of Artificial Sequence: Synthetic oligonucleotide
gggtggtggctctgctagtgaatctgac

SEQ ID NO: 81947 - DNA, 28 bp, Artificial Sequence
  Description of Artificial Sequence: Synthetic oligonucleotide
ggtggtggctctgctagtgaatctgacc

SEQ ID NO: 81948 - DNA, 28 bp, Artificial Sequence
  Description of Artificial Sequence: Synthetic oligonucleotide
gtggtggctctgctagtgaatctgaccc

SEQ ID NO: 81949 - DNA, 28 bp, Artificial Sequence
  Description of Artificial Sequence: Synthetic oligonucleotide
tggtggctctgctagtgaatctgacccg

SEQ ID NO: 81950 - DNA, 27 bp, Artificial Sequence
  Description of Artificial Sequence: Synthetic oligonucleotide
ggtggctctgctagtgaatctgacccg

SEQ ID NO: 81951 - DNA, 28 bp, Artificial Sequence
  Description of Artificial Sequence: Synthetic oligonucleotide
gtggctctgctagtgaatctgacccgac

SEQ ID NO: 81952 - DNA, 29 bp, Artificial Sequence
  Description of Artificial Sequence: Synthetic oligonucleotide
tggctctgctagtgaatctgacccgactg

SEQ ID NO: 81953 - DNA, 28 bp, Artificial Sequence
  Description of Artificial Sequence: Synthetic oligonucleotide
ggctctgctagtgaatctgacccgactg

SEQ ID NO: 81954 - DNA, 28 bp, Artificial Sequence
  Description of Artificial Sequence: Synthetic oligonucleotide
gctctgctagtgaatctgacccgactgg

SEQ ID NO: 81955 - DNA, 31 bp, Artificial Sequence
  Description of Artificial Sequence: Synthetic oligonucleotide
ctctgctagtgaatctgacccgactggattc

SEQ ID NO: 81956 - DNA, 31 bp, Artificial Sequence
  Description of Artificial Sequence: Synthetic oligonucleotide
tctgctagtgaatctgacccgactggattcc

SEQ ID NO: 81957 - DNA, 30 bp, Artificial Sequence
  Description of Artificial Sequence: Synthetic oligonucleotide
ctgctagtgaatctgacccgactggattcc

SEQ ID NO: 81958 - DNA, 31 bp, Artificial Sequence
  Description of Artificial Sequence: Synthetic oligonucleotide
tgctagtgaatctgacccgactggattcctc

SEQ ID NO: 81959 - DNA, 30 bp, Artificial Sequence
  Description of Artificial Sequence: Synthetic oligonucleotide
gctagtgaatctgacccgactggattcctc

SEQ ID NO: 81960 - DNA, 30 bp, Artificial Sequence
  Description of Artificial Sequence: Synthetic oligonucleotide
ctagtgaatctgacccgactggattcctcc

SEQ ID NO: 81961 - DNA, 32 bp, Artificial Sequence
  Description of Artificial Sequence: Synthetic oligonucleotide
tagtgaatctgacccgactggattcctccatg

SEQ ID NO: 81962 - DNA, 31 bp, Artificial Sequence
  Description of Artificial Sequence: Synthetic oligonucleotide
agtgaatctgacccgactggattcctccatg

SEQ ID NO: 81963 - DNA, 30 bp, Artificial Sequence
  Description of Artificial Sequence: Synthetic oligonucleotide
gtgaatctgacccgactggattcctccatg

SEQ ID NO: 81964 - DNA, 31 bp, Artificial Sequence
  Description of Artificial Sequence: Synthetic oligonucleotide
tgaatctgacccgactggattcctccatgac

SEQ ID NO: 81965 - DNA, 30 bp, Artificial Sequence
  Description of Artificial Sequence: Synthetic oligonucleotide
gaatctgacccgactggattcctccatgac

SEQ ID NO: 81966 - DNA, 31 bp, Artificial Sequence
  Description of Artificial Sequence: Synthetic oligonucleotide
aatctgacccgactggattcctccatgactc

SEQ ID NO: 81967 - DNA, 30 bp, Artificial Sequence
  Description of Artificial Sequence: Synthetic oligonucleotide
atctgacccgactggattcctccatgactc

SEQ ID NO: 81968 - DNA, 29 bp, Artificial Sequence
  Description of Artificial Sequence: Synthetic oligonucleotide
tctgacccgactggattcctccatgactc

SEQ ID NO: 81969 - DNA, 28 bp, Artificial Sequence
  Description of Artificial Sequence: Synthetic oligonucleotide
ctgacccgactggattcctccatgactc

SEQ ID NO: 81970 - DNA, 30 bp, Artificial Sequence
  Description of Artificial Sequence: Synthetic oligonucleotide
tgacccgactggattcctccatgactcaag

SEQ ID NO: 81971 - DNA, 29 bp, Artificial Sequence
  Description of Artificial Sequence: Synthetic oligonucleotide
gacccgactggattcctccatgactcaag

SEQ ID NO: 81972 - DNA, 29 bp, Artificial Sequence
  Description of Artificial Sequence: Synthetic oligonucleotide
acccgactggattcctccatgactcaagg

SEQ ID NO: 81973 - DNA, 28 bp, Artificial Sequence
  Description of Artificial Sequence: Synthetic oligonucleotide
cccgactggattcctccatgactcaagg

SEQ ID NO: 81974 - DNA, 28 bp, Artificial Sequence
  Description of Artificial Sequence: Synthetic oligonucleotide
ccgactggattcctccatgactcaaggc

SEQ ID NO: 81975 - DNA, 29 bp, Artificial Sequence
  Description of Artificial Sequence: Synthetic oligonucleotide
cgactggattcctccatgactcaaggcac

SEQ ID NO: 81976 - DNA, 30 bp, Artificial Sequence
  Description of Artificial Sequence: Synthetic oligonucleotide
gactggattcctccatgactcaaggcacag

SEQ ID NO: 81977 - DNA, 31 bp, Artificial Sequence
  Description of Artificial Sequence: Synthetic oligonucleotide
actggattcctccatgactcaaggcacagac

SEQ ID NO: 81978 - DNA, 30 bp, Artificial Sequence
  Description of Artificial Sequence: Synthetic oligonucleotide
ctggattcctccatgactcaaggcacagac

SEQ ID NO: 81979 - DNA, 31 bp, Artificial Sequence
  Description of Artificial Sequence: Synthetic oligonucleotide
tggattcctccatgactcaaggcacagactc

SEQ ID NO: 81980 - DNA, 30 bp, Artificial Sequence
  Description of Artificial Sequence: Synthetic oligonucleotide
ggattcctccatgactcaaggcacagactc

SEQ ID NO: 81981 - DNA, 31 bp, Artificial Sequence
  Description of Artificial Sequence: Synthetic oligonucleotide
gattcctccatgactcaaggcacagactctc

SEQ ID NO: 81982 - DNA, 31 bp, Artificial Sequence
  Description of Artificial Sequence: Synthetic oligonucleotide
attcctccatgactcaaggcacagactctcc

SEQ ID NO: 81983 - DNA, 30 bp, Artificial Sequence
  Description of Artificial Sequence: Synthetic oligonucleotide
ttcctccatgactcaaggcacagactctcc

SEQ ID NO: 81984 - DNA, 29 bp, Artificial Sequence
  Description of Artificial Sequence: Synthetic oligonucleotide
tcctccatgactcaaggcacagactctcc

SEQ ID NO: 81985 - DNA, 28 bp, Artificial Sequence
  Description of Artificial Sequence: Synthetic oligonucleotide
cctccatgactcaaggcacagactctcc

SEQ ID NO: 81986 - DNA, 29 bp, Artificial Sequence
  Description of Artificial Sequence: Synthetic oligonucleotide
ctccatgactcaaggcacagactctccag

SEQ ID NO: 81987 - DNA, 31 bp, Artificial Sequence
  Description of Artificial Sequence: Synthetic oligonucleotide
tccatgactcaaggcacagactctccagaag

SEQ ID NO: 81988 - DNA, 30 bp, Artificial Sequence
  Description of Artificial Sequence: Synthetic oligonucleotide
ccatgactcaaggcacagactctccagaag

SEQ ID NO: 81989 - DNA, 35 bp, Artificial Sequence
  Description of Artificial Sequence: Synthetic oligonucleotide
catgactcaaggcacagactctccagaagattttg

SEQ ID NO: 81990 - DNA, 36 bp, Artificial Sequence
  Description of Artificial Sequence: Synthetic oligonucleotide
atgactcaaggcacagactctccagaagattttgtg

SEQ ID NO: 81991 - DNA, 35 bp, Artificial Sequence
  Description of Artificial Sequence: Synthetic oligonucleotide
tgactcaaggcacagactctccagaagattttgtg

SEQ ID NO: 81992 - DNA, 34 bp, Artificial Sequence
  Description of Artificial Sequence: Synthetic oligonucleotide
gactcaaggcacagactctccagaagattttgtg

SEQ ID NO: 81993 - DNA, 37 bp, Artificial Sequence
  Description of Artificial Sequence: Synthetic oligonucleotide
actcaaggcacagactctccagaagattttgtgattc

SEQ ID NO: 81994 - DNA, 36 bp, Artificial Sequence
  Description of Artificial Sequence: Synthetic oligonucleotide
ctcaaggcacagactctccagaagattttgtgattc

SEQ ID NO: 81995 - DNA, 37 bp, Artificial Sequence
  Description of Artificial Sequence: Synthetic oligonucleotide
tcaaggcacagactctccagaagattttgtgattcag

SEQ ID NO: 81996 - DNA, 36 bp, Artificial Sequence
  Description of Artificial Sequence: Synthetic oligonucleotide
caaggcacagactctccagaagattttgtgattcag

SEQ ID NO: 81997 - DNA, 36 bp, Artificial Sequence
  Description of Artificial Sequence: Synthetic oligonucleotide
aaggcacagactctccagaagattttgtgattcagg

SEQ ID NO: 81998 - DNA, 35 bp, Artificial Sequence
  Description of Artificial Sequence: Synthetic oligonucleotide
aggcacagactctccagaagattttgtgattcagg

SEQ ID NO: 81999 - DNA, 34 bp, Artificial Sequence
  Description of Artificial Sequence: Synthetic oligonucleotide
ggcacagactctccagaagattttgtgattcagg

SEQ ID NO: 82000 - DNA, 34 bp, Artificial Sequence
  Description of Artificial Sequence: Synthetic oligonucleotide
gcacagactctccagaagattttgtgattcaggc

SEQ ID NO: 82001 - DNA, 37 bp, Artificial Sequence
  Description of Artificial Sequence: Synthetic oligonucleotide
cacagactctccagaagattttgtgattcaggcaaag

SEQ ID NO: 82002 - DNA, 37 bp, Artificial Sequence
  Description of Artificial Sequence: Synthetic oligonucleotide
acagactctccagaagattttgtgattcaggcaaagg

SEQ ID NO: 82003 - DNA, 36 bp, Artificial Sequence
  Description of Artificial Sequence: Synthetic oligonucleotide
cagactctccagaagattttgtgattcaggcaaagg

SEQ ID NO: 82004 - DNA, 36 bp, Artificial Sequence
  Description of Artificial Sequence: Synthetic oligonucleotide
agactctccagaagattttgtgattcaggcaaaggc

SEQ ID NO: 82005 - DNA, 35 bp, Artificial Sequence
  Description of Artificial Sequence: Synthetic oligonucleotide
gactctccagaagattttgtgattcaggcaaaggc

SEQ ID NO: 82006 - DNA, 36 bp, Artificial Sequence
  Description of Artificial Sequence: Synthetic oligonucleotide
actctccagaagattttgtgattcaggcaaaggctg

SEQ ID NO: 82007 - DNA, 35 bp, Artificial Sequence
  Description of Artificial Sequence: Synthetic oligonucleotide
ctctccagaagattttgtgattcaggcaaaggctg

SEQ ID NO: 82008 - DNA, 36 bp, Artificial Sequence
  Description of Artificial Sequence: Synthetic oligonucleotide
tctccagaagattttgtgattcaggcaaaggctgac

SEQ ID NO: 82009 - DNA, 35 bp, Artificial Sequence
  Description of Artificial Sequence: Synthetic oligonucleotide
ctccagaagattttgtgattcaggcaaaggctgac

SEQ ID NO: 82010 - DNA, 36 bp, Artificial Sequence
  Description of Artificial Sequence: Synthetic oligonucleotide
tccagaagattttgtgattcaggcaaaggctgactg

SEQ ID NO: 82011 - DNA, 35 bp, Artificial Sequence
  Description of Artificial Sequence: Synthetic oligonucleotide
ccagaagattttgtgattcaggcaaaggctgactg

SEQ ID NO: 82012 - DNA, 38 bp, Artificial Sequence
  Description of Artificial Sequence: Synthetic oligonucleotide
cagaagattttgtgattcaggcaaaggctgactgttac

SEQ ID NO: 82013 - DNA, 40 bp, Artificial Sequence
  Description of Artificial Sequence: Synthetic oligonucleotide
agaagattttgtgattcaggcaaaggctgactgttacttc

SEQ ID NO: 82014 - DNA, 39 bp, Artificial Sequence
  Description of Artificial Sequence: Synthetic oligonucleotide
gaagattttgtgattcaggcaaaggctgactgttacttc

SEQ ID NO: 82015 - DNA, 40 bp, Artificial Sequence
  Description of Artificial Sequence: Synthetic oligonucleotide
aagattttgtgattcaggcaaaggctgactgttacttcac

SEQ ID NO: 82016 - DNA, 39 bp, Artificial Sequence
  Description of Artificial Sequence: Synthetic oligonucleotide
agattttgtgattcaggcaaaggctgactgttacttcac

SEQ ID NO: 82017 - DNA, 38 bp, Artificial Sequence
  Description of Artificial Sequence: Synthetic oligonucleotide
gattttgtgattcaggcaaaggctgactgttacttcac

SEQ ID NO: 82018 - DNA, 38 bp, Artificial Sequence
  Description of Artificial Sequence: Synthetic oligonucleotide
attttgtgattcaggcaaaggctgactgttacttcacc

SEQ ID NO: 82019 - DNA, 37 bp, Artificial Sequence
  Description of Artificial Sequence: Synthetic oligonucleotide
ttttgtgattcaggcaaaggctgactgttacttcacc

SEQ ID NO: 82020 - DNA, 36 bp, Artificial Sequence
  Description of Artificial Sequence: Synthetic oligonucleotide
tttgtgattcaggcaaaggctgactgttacttcacc

SEQ ID NO: 82021 - DNA, 35 bp, Artificial Sequence
  Description of Artificial Sequence: Synthetic oligonucleotide
ttgtgattcaggcaaaggctgactgttacttcacc

SEQ ID NO: 82022 - DNA, 34 bp, Artificial Sequence
  Description of Artificial Sequence: Synthetic oligonucleotide
tgtgattcaggcaaaggctgactgttacttcacc

SEQ ID NO: 82023 - DNA, 33 bp, Artificial Sequence
  Description of Artificial Sequence: Synthetic oligonucleotide
gtgattcaggcaaaggctgactgttacttcacc

SEQ ID NO: 82024 - DNA, 35 bp, Artificial Sequence
  Description of Artificial Sequence: Synthetic oligonucleotide
tgattcaggcaaaggctgactgttacttcaccaac

SEQ ID NO: 82025 - DNA, 34 bp, Artificial Sequence
  Description of Artificial Sequence: Synthetic oligonucleotide
gattcaggcaaaggctgactgttacttcaccaac

SEQ ID NO: 82026 - DNA, 34 bp, Artificial Sequence
  Description of Artificial Sequence: Synthetic oligonucleotide
attcaggcaaaggctgactgttacttcaccaacg

SEQ ID NO: 82027 - DNA, 33 bp, Artificial Sequence
  Description of Artificial Sequence: Synthetic oligonucleotide
ttcaggcaaaggctgactgttacttcaccaacg

SEQ ID NO: 82028 - DNA, 32 bp, Artificial Sequence
  Description of Artificial Sequence: Synthetic oligonucleotide
tcaggcaaaggctgactgttacttcaccaacg

SEQ ID NO: 82029 - DNA, 31 bp, Artificial Sequence
  Description of Artificial Sequence: Synthetic oligonucleotide
caggcaaaggctgactgttacttcaccaacg

SEQ ID NO: 82030 - DNA, 31 bp, Artificial Sequence
  Description of Artificial Sequence: Synthetic oligonucleotide
aggcaaaggctgactgttacttcaccaacgg

SEQ ID NO: 82031 - DNA, 30 bp, Artificial Sequence
  Description of Artificial Sequence: Synthetic oligonucleotide
ggcaaaggctgactgttacttcaccaacgg

SEQ ID NO: 82032 - DNA, 30 bp, Artificial Sequence
  Description of Artificial Sequence: Synthetic oligonucleotide
gcaaaggctgactgttacttcaccaacggg

SEQ ID NO: 82033 - DNA, 31 bp, Artificial Sequence
  Description of Artificial Sequence: Synthetic oligonucleotide
caaaggctgactgttacttcaccaacgggac

SEQ ID NO: 82034 - DNA, 32 bp, Artificial Sequence
  Description of Artificial Sequence: Synthetic oligonucleotide
aaaggctgactgttacttcaccaacgggacag

SEQ ID NO: 82035 - DNA, 31 bp, Artificial Sequence
  Description of Artificial Sequence: Synthetic oligonucleotide
aaggctgactgttacttcaccaacgggacag

SEQ ID NO: 82036 - DNA, 30 bp, Artificial Sequence
  Description of Artificial Sequence: Synthetic oligonucleotide
aggctgactgttacttcaccaacgggacag

SEQ ID NO: 82037 - DNA, 29 bp, Artificial Sequence
  Description of Artificial Sequence: Synthetic oligonucleotide
ggctgactgttacttcaccaacgggacag

SEQ ID NO: 82038 - DNA, 33 bp, Artificial Sequence
  Description of Artificial Sequence: Synthetic oligonucleotide
gctgactgttacttcaccaacgggacagaaaag

SEQ ID NO: 82039 - DNA, 33 bp, Artificial Sequence
  Description of Artificial Sequence: Synthetic oligonucleotide
ctgactgttacttcaccaacgggacagaaaagg

SEQ ID NO: 82040 - DNA, 34 bp, Artificial Sequence
  Description of Artificial Sequence: Synthetic oligonucleotide
tgactgttacttcaccaacgggacagaaaaggtg

SEQ ID NO: 82041 - DNA, 33 bp, Artificial Sequence
  Description of Artificial Sequence: Synthetic oligonucleotide
gactgttacttcaccaacgggacagaaaaggtg

SEQ ID NO: 82042 - DNA, 33 bp, Artificial Sequence
  Description of Artificial Sequence: Synthetic oligonucleotide
actgttacttcaccaacgggacagaaaaggtgc

SEQ ID NO: 82043 - DNA, 32 bp, Artificial Sequence
  Description of Artificial Sequence: Synthetic oligonucleotide
ctgttacttcaccaacgggacagaaaaggtgc

SEQ ID NO: 82044 - DNA, 33 bp, Artificial Sequence
  Description of Artificial Sequence: Synthetic oligonucleotide
tgttacttcaccaacgggacagaaaaggtgcag

SEQ ID NO: 82045 - DNA, 32 bp, Artificial Sequence
  Description of Artificial Sequence: Synthetic oligonucleotide
gttacttcaccaacgggacagaaaaggtgcag

SEQ ID NO: 82046 - DNA, 35 bp, Artificial Sequence
  Description of Artificial Sequence: Synthetic oligonucleotide
ttacttcaccaacgggacagaaaaggtgcagtttg

SEQ ID NO: 82047 - DNA, 34 bp, Artificial Sequence
  Description of Artificial Sequence: Synthetic oligonucleotide
tacttcaccaacgggacagaaaaggtgcagtttg

SEQ ID NO: 82048 - DNA, 33 bp, Artificial Sequence
  Description of Artificial Sequence: Synthetic oligonucleotide
acttcaccaacgggacagaaaaggtgcagtttg

SEQ ID NO: 82049 - DNA, 32 bp, Artificial Sequence
  Description of Artificial Sequence: Synthetic oligonucleotide
cttcaccaacgggacagaaaaggtgcagtttg

SEQ ID NO: 82050 - DNA, 33 bp, Artificial Sequence
  Description of Artificial Sequence: Synthetic oligonucleotide
ttcaccaacgggacagaaaaggtgcagtttgtg

SEQ ID NO: 82051 - DNA, 32 bp, Artificial Sequence
  Description of Artificial Sequence: Synthetic oligonucleotide
tcaccaacgggacagaaaaggtgcagtttgtg

SEQ ID NO: 82052 - DNA, 31 bp, Artificial Sequence
  Description of Artificial Sequence: Synthetic oligonucleotide
caccaacgggacagaaaaggtgcagtttgtg

SEQ ID NO: 82053 - DNA, 31 bp, Artificial Sequence
  Description of Artificial Sequence: Synthetic oligonucleotide
accaacgggacagaaaaggtgcagtttgtgg

SEQ ID NO: 82054 - DNA, 30 bp, Artificial Sequence
  Description of Artificial Sequence: Synthetic oligonucleotide
ccaacgggacagaaaaggtgcagtttgtgg

SEQ ID NO: 82055 - DNA, 31 bp, Artificial Sequence
  Description of Artificial Sequence: Synthetic oligonucleotide
caacgggacagaaaaggtgcagtttgtggtc

SEQ ID NO: 82056 - DNA, 32 bp, Artificial Sequence
  Description of Artificial Sequence: Synthetic oligonucleotide
aacgggacagaaaaggtgcagtttgtggtcag

SEQ ID NO: 82057 - DNA, 31 bp, Artificial Sequence
  Description of Artificial Sequence: Synthetic oligonucleotide
acgggacagaaaaggtgcagtttgtggtcag

SEQ ID NO: 82058 - DNA, 30 bp, Artificial Sequence
  Description of Artificial Sequence: Synthetic oligonucleotide
cgggacagaaaaggtgcagtttgtggtcag

SEQ ID NO: 82059 - DNA, 33 bp, Artificial Sequence
  Description of Artificial Sequence: Synthetic oligonucleotide
gggacagaaaaggtgcagtttgtggtcagattc

SEQ ID NO: 82060 - DNA, 35 bp, Artificial Sequence
  Description of Artificial Sequence: Synthetic oligonucleotide
ggacagaaaaggtgcagtttgtggtcagattcatc

SEQ ID NO: 82061 - DNA, 40 bp, Artificial Sequence
  Description of Artificial Sequence: Synthetic oligonucleotide
gacagaaaaggtgcagtttgtggtcagattcatctttaac

SEQ ID NO: 82062 - DNA, 42 bp, Artificial Sequence
  Description of Artificial Sequence: Synthetic oligonucleotide
acagaaaaggtgcagtttgtggtcagattcatctttaacttg

SEQ ID NO: 82063 - DNA, 41 bp, Artificial Sequence
  Description of Artificial Sequence: Synthetic oligonucleotide
cagaaaaggtgcagtttgtggtcagattcatctttaacttg

SEQ ID NO: 82064 - DNA, 41 bp, Artificial Sequence
  Description of Artificial Sequence: Synthetic oligonucleotide
agaaaaggtgcagtttgtggtcagattcatctttaacttgg

SEQ ID NO: 82065 - DNA, 40 bp, Artificial Sequence
  Description of Artificial Sequence: Synthetic oligonucleotide
gaaaaggtgcagtttgtggtcagattcatctttaacttgg

SEQ ID NO: 82066 - DNA, 41 bp, Artificial Sequence
  Description of Artificial Sequence: Synthetic oligonucleotide
aaaaggtgcagtttgtggtcagattcatctttaacttggag

SEQ ID NO: 82067 - DNA, 40 bp, Artificial Sequence
  Description of Artificial Sequence: Synthetic oligonucleotide
aaaggtgcagtttgtggtcagattcatctttaacttggag

SEQ ID NO: 82068 - DNA, 39 bp, Artificial Sequence
  Description of Artificial Sequence: Synthetic oligonucleotide
aaggtgcagtttgtggtcagattcatctttaacttggag

SEQ ID NO: 82069 - DNA, 38 bp, Artificial Sequence
  Description of Artificial Sequence: Synthetic oligonucleotide
aggtgcagtttgtggtcagattcatctttaacttggag

SEQ ID NO: 82070 - DNA, 37 bp, Artificial Sequence
  Description of Artificial Sequence: Synthetic oligonucleotide
ggtgcagtttgtggtcagattcatctttaacttggag

SEQ ID NO: 82071 - DNA, 37 bp, Artificial Sequence
  Description of Artificial Sequence: Synthetic oligonucleotide
gtgcagtttgtggtcagattcatctttaacttggagg

SEQ ID NO: 82072 - DNA, 38 bp, Artificial Sequence
  Description of Artificial Sequence: Synthetic oligonucleotide
tgcagtttgtggtcagattcatctttaacttggaggag

SEQ ID NO: 82073 - DNA, 37 bp, Artificial Sequence
  Description of Artificial Sequence: Synthetic oligonucleotide
gcagtttgtggtcagattcatctttaacttggaggag

SEQ ID NO: 82074 - DNA, 40 bp, Artificial Sequence
  Description of Artificial Sequence: Synthetic oligonucleotide
cagtttgtggtcagattcatctttaacttggaggagtatg

SEQ ID NO: 82075 - DNA, 42 bp, Artificial Sequence
  Description of Artificial Sequence: Synthetic oligonucleotide
agtttgtggtcagattcatctttaacttggaggagtatgtac

SEQ ID NO: 82076 - DNA, 41 bp, Artificial Sequence
  Description of Artificial Sequence: Synthetic oligonucleotide
gtttgtggtcagattcatctttaacttggaggagtatgtac

SEQ ID NO: 82077 - DNA, 41 bp, Artificial Sequence
  Description of Artificial Sequence: Synthetic oligonucleotide
tttgtggtcagattcatctttaacttggaggagtatgtacg

SEQ ID NO: 82078 - DNA, 40 bp, Artificial Sequence
  Description of Artificial Sequence: Synthetic oligonucleotide
ttgtggtcagattcatctttaacttggaggagtatgtacg

SEQ ID NO: 82079 - DNA, 39 bp, Artificial Sequence
  Description of Artificial Sequence: Synthetic oligonucleotide
tgtggtcagattcatctttaacttggaggagtatgtacg

SEQ ID NO: 82080 - DNA, 38 bp, Artificial Sequence
  Description of Artificial Sequence: Synthetic oligonucleotide
gtggtcagattcatctttaacttggaggagtatgtacg

SEQ ID NO: 82081 - DNA, 41 bp, Artificial Sequence
  Description of Artificial Sequence: Synthetic oligonucleotide
tggtcagattcatctttaacttggaggagtatgtacgtttc

SEQ ID NO: 82082 - DNA, 40 bp, Artificial Sequence
  Description of Artificial Sequence: Synthetic oligonucleotide
ggtcagattcatctttaacttggaggagtatgtacgtttc

SEQ ID NO: 82083 - DNA, 40 bp, Artificial Sequence
  Description of Artificial Sequence: Synthetic oligonucleotide
gtcagattcatctttaacttggaggagtatgtacgtttcg

SEQ ID NO: 82084 - DNA, 41 bp, Artificial Sequence
  Description of Artificial Sequence: Synthetic oligonucleotide
tcagattcatctttaacttggaggagtatgtacgtttcgac

SEQ ID NO: 82085 - DNA, 40 bp, Artificial Sequence
  Description of Artificial Sequence: Synthetic oligonucleotide
cagattcatctttaacttggaggagtatgtacgtttcgac

SEQ ID NO: 82086 - DNA, 41 bp, Artificial Sequence
  Description of Artificial Sequence: Synthetic oligonucleotide
agattcatctttaacttggaggagtatgtacgtttcgacag

SEQ ID NO: 82087 - DNA, 40 bp, Artificial Sequence
  Description of Artificial Sequence: Synthetic oligonucleotide
gattcatctttaacttggaggagtatgtacgtttcgacag

SEQ ID NO: 82088 - DNA, 41 bp, Artificial Sequence
  Description of Artificial Sequence: Synthetic oligonucleotide
attcatctttaacttggaggagtatgtacgtttcgacagtg

SEQ ID NO: 82089 - DNA, 40 bp, Artificial Sequence
  Description of Artificial Sequence: Synthetic oligonucleotide
ttcatctttaacttggaggagtatgtacgtttcgacagtg

SEQ ID NO: 82090 - DNA, 39 bp, Artificial Sequence
  Description of Artificial Sequence: Synthetic oligonucleotide
tcatctttaacttggaggagtatgtacgtttcgacagtg

SEQ ID NO: 82091 - DNA, 38 bp, Artificial Sequence
  Description of Artificial Sequence: Synthetic oligonucleotide
catctttaacttggaggagtatgtacgtttcgacagtg

SEQ ID NO: 82092 - DNA, 40 bp, Artificial Sequence
  Description of Artificial Sequence: Synthetic oligonucleotide
atctttaacttggaggagtatgtacgtttcgacagtgatg

SEQ ID NO: 82093 - DNA, 39 bp, Artificial Sequence
  Description of Artificial Sequence: Synthetic oligonucleotide
tctttaacttggaggagtatgtacgtttcgacagtgatg

SEQ ID NO: 82094 - DNA, 38 bp, Artificial Sequence
  Description of Artificial Sequence: Synthetic oligonucleotide
ctttaacttggaggagtatgtacgtttcgacagtgatg

SEQ ID NO: 82095 - DNA, 39 bp, Artificial Sequence
  Description of Artificial Sequence: Synthetic oligonucleotide
tttaacttggaggagtatgtacgtttcgacagtgatgtg

SEQ ID NO: 82096 - DNA, 38 bp, Artificial Sequence
  Description of Artificial Sequence: Synthetic oligonucleotide
ttaacttggaggagtatgtacgtttcgacagtgatgtg

SEQ ID NO: 82097 - DNA, 37 bp, Artificial Sequence
  Description of Artificial Sequence: Synthetic oligonucleotide
taacttggaggagtatgtacgtttcgacagtgatgtg

SEQ ID NO: 82098 - DNA, 36 bp, Artificial Sequence
  Description of Artificial Sequence: Synthetic oligonucleotide
aacttggaggagtatgtacgtttcgacagtgatgtg

SEQ ID NO: 82099 - DNA, 35 bp, Artificial Sequence
  Description of Artificial Sequence: Synthetic oligonucleotide
acttggaggagtatgtacgtttcgacagtgatgtg

SEQ ID NO: 82100 - DNA, 34 bp, Artificial Sequence
  Description of Artificial Sequence: Synthetic oligonucleotide
cttggaggagtatgtacgtttcgacagtgatgtg

SEQ ID NO: 82101 - DNA, 34 bp, Artificial Sequence
  Description of Artificial Sequence: Synthetic oligonucleotide
ttggaggagtatgtacgtttcgacagtgatgtgg

SEQ ID NO: 82102 - DNA, 33 bp, Artificial Sequence
  Description of Artificial Sequence: Synthetic oligonucleotide
tggaggagtatgtacgtttcgacagtgatgtgg

SEQ ID NO: 82103 - DNA, 32 bp, Artificial Sequence
  Description of Artificial Sequence: Synthetic oligonucleotide
ggaggagtatgtacgtttcgacagtgatgtgg

SEQ ID NO: 82104 - DNA, 32 bp, Artificial Sequence
  Description of Artificial Sequence: Synthetic oligonucleotide
gaggagtatgtacgtttcgacagtgatgtggg

SEQ ID NO: 82105 - DNA, 32 bp, Artificial Sequence
  Description of Artificial Sequence: Synthetic oligonucleotide
aggagtatgtacgtttcgacagtgatgtgggg

SEQ ID NO: 82106 - DNA, 31 bp, Artificial Sequence
  Description of Artificial Sequence: Synthetic oligonucleotide
ggagtatgtacgtttcgacagtgatgtgggg

SEQ ID NO: 82107 - DNA, 33 bp, Artificial Sequence
  Description of Artificial Sequence: Synthetic oligonucleotide
gagtatgtacgtttcgacagtgatgtggggatg

SEQ ID NO: 82108 - DNA, 36 bp, Artificial Sequence
  Description of Artificial Sequence: Synthetic oligonucleotide
agtatgtacgtttcgacagtgatgtggggatgtttg

SEQ ID NO: 82109 - DNA, 35 bp, Artificial Sequence
  Description of Artificial Sequence: Synthetic oligonucleotide
gtatgtacgtttcgacagtgatgtggggatgtttg

SEQ ID NO: 82110 - DNA, 36 bp, Artificial Sequence
  Description of Artificial Sequence: Synthetic oligonucleotide
tatgtacgtttcgacagtgatgtggggatgtttgtg

SEQ ID NO: 82111 - DNA, 35 bp, Artificial Sequence
  Description of Artificial Sequence: Synthetic oligonucleotide
atgtacgtttcgacagtgatgtggggatgtttgtg

SEQ ID NO: 82112 - DNA, 34 bp, Artificial Sequence
  Description of Artificial Sequence: Synthetic oligonucleotide
tgtacgtttcgacagtgatgtggggatgtttgtg

SEQ ID NO: 82113 - DNA, 33 bp, Artificial Sequence
  Description of Artificial Sequence: Synthetic oligonucleotide
gtacgtttcgacagtgatgtggggatgtttgtg

SEQ ID NO: 82114 - DNA, 33 bp, Artificial Sequence
  Description of Artificial Sequence: Synthetic oligonucleotide
tacgtttcgacagtgatgtggggatgtttgtgg

SEQ ID NO: 82115 - DNA, 32 bp, Artificial Sequence
  Description of Artificial Sequence: Synthetic oligonucleotide
acgtttcgacagtgatgtggggatgtttgtgg

SEQ ID NO: 82116 - DNA, 31 bp, Artificial Sequence
  Description of Artificial Sequence: Synthetic oligonucleotide
cgtttcgacagtgatgtggggatgtttgtgg

SEQ ID NO: 82117 - DNA, 31 bp, Artificial Sequence
  Description of Artificial Sequence: Synthetic oligonucleotide
gtttcgacagtgatgtggggatgtttgtggc

SEQ ID NO: 82118 - DNA, 34 bp, Artificial Sequence
  Description of Artificial Sequence: Synthetic oligonucleotide
tttcgacagtgatgtggggatgtttgtggcattg

SEQ ID NO: 82119 - DNA, 33 bp, Artificial Sequence
  Description of Artificial Sequence: Synthetic oligonucleotide
ttcgacagtgatgtggggatgtttgtggcattg

SEQ ID NO: 82120 - DNA, 32 bp, Artificial Sequence
  Description of Artificial Sequence: Synthetic oligonucleotide
tcgacagtgatgtggggatgtttgtggcattg

SEQ ID NO: 82121 - DNA, 31 bp, Artificial Sequence
  Description of Artificial Sequence: Synthetic oligonucleotide
cgacagtgatgtggggatgtttgtggcattg

SEQ ID NO: 82122 - DNA, 32 bp, Artificial Sequence
  Description of Artificial Sequence: Synthetic oligonucleotide
gacagtgatgtggggatgtttgtggcattgac

SEQ ID NO: 82123 - DNA, 32 bp, Artificial Sequence
  Description of Artificial Sequence: Synthetic oligonucleotide
acagtgatgtggggatgtttgtggcattgacc

SEQ ID NO: 82124 - DNA, 31 bp, Artificial Sequence
  Description of Artificial Sequence: Synthetic oligonucleotide
cagtgatgtggggatgtttgtggcattgacc

SEQ ID NO: 82125 - DNA, 33 bp, Artificial Sequence
  Description of Artificial Sequence: Synthetic oligonucleotide
agtgatgtggggatgtttgtggcattgaccaag

SEQ ID NO: 82126 - DNA, 32 bp, Artificial Sequence
  Description of Artificial Sequence: Synthetic oligonucleotide
gtgatgtggggatgtttgtggcattgaccaag

SEQ ID NO: 82127 - DNA, 32 bp, Artificial Sequence
  Description of Artificial Sequence: Synthetic oligonucleotide
tgatgtggggatgtttgtggcattgaccaagc

SEQ ID NO: 82128 - DNA, 31 bp, Artificial Sequence
  Description of Artificial Sequence: Synthetic oligonucleotide
gatgtggggatgtttgtggcattgaccaagc

SEQ ID NO: 82129 - DNA, 32 bp, Artificial Sequence
  Description of Artificial Sequence: Synthetic oligonucleotide
atgtggggatgtttgtggcattgaccaagctg

SEQ ID NO: 82130 - DNA, 31 bp, Artificial Sequence
  Description of Artificial Sequence: Synthetic oligonucleotide
tgtggggatgtttgtggcattgaccaagctg

SEQ ID NO: 82131 - DNA, 30 bp, Artificial Sequence
  Description of Artificial Sequence: Synthetic oligonucleotide
gtggggatgtttgtggcattgaccaagctg

SEQ ID NO: 82132 - DNA, 30 bp, Artificial Sequence
  Description of Artificial Sequence: Synthetic oligonucleotide
tggggatgtttgtggcattgaccaagctgg

SEQ ID NO: 82133 - DNA, 29 bp, Artificial Sequence
  Description of Artificial Sequence: Synthetic oligonucleotide
ggggatgtttgtggcattgaccaagctgg

SEQ ID NO: 82134 - DNA, 29 bp, Artificial Sequence
  Description of Artificial Sequence: Synthetic oligonucleotide
gggatgtttgtggcattgaccaagctggg

SEQ ID NO: 82135 - DNA, 29 bp, Artificial Sequence
  Description of Artificial Sequence: Synthetic oligonucleotide
ggatgtttgtggcattgaccaagctgggg

SEQ ID NO: 82136 - DNA, 29 bp, Artificial Sequence
  Description of Artificial Sequence: Synthetic oligonucleotide
gatgtttgtggcattgaccaagctggggc

SEQ ID NO: 82137 - DNA, 30 bp, Artificial Sequence
  Description of Artificial Sequence: Synthetic oligonucleotide
atgtttgtggcattgaccaagctggggcag

SEQ ID NO: 82138 - DNA, 29 bp, Artificial Sequence
  Description of Artificial Sequence: Synthetic oligonucleotide
tgtttgtggcattgaccaagctggggcag

SEQ ID NO: 82139 - DNA, 28 bp, Artificial Sequence
  Description of Artificial Sequence: Synthetic oligonucleotide
gtttgtggcattgaccaagctggggcag

SEQ ID NO: 82140 - DNA, 28 bp, Artificial Sequence
  Description of Artificial Sequence: Synthetic oligonucleotide
tttgtggcattgaccaagctggggcagc

SEQ ID NO: 82141 - DNA, 27 bp, Artificial Sequence
  Description of Artificial Sequence: Synthetic oligonucleotide
ttgtggcattgaccaagctggggcagc

SEQ ID NO: 82142 - DNA, 26 bp, Artificial Sequence
  Description of Artificial Sequence: Synthetic oligonucleotide
tgtggcattgaccaagctggggcagc

SEQ ID NO: 82143 - DNA, 25 bp, Artificial Sequence
  Description of Artificial Sequence: Synthetic oligonucleotide
gtggcattgaccaagctggggcagc

SEQ ID NO: 82144 - DNA, 26 bp, Artificial Sequence
  Description of Artificial Sequence: Synthetic oligonucleotide
tggcattgaccaagctggggcagcca

SEQ ID NO: 82145 - DNA, 25 bp, Artificial Sequence
  Description of Artificial Sequence: Synthetic oligonucleotide
ggcattgaccaagctggggcagcca

SEQ ID NO: 82146 - DNA, 27 bp, Artificial Sequence
  Description of Artificial Sequence: Synthetic oligonucleotide
gcattgaccaagctggggcagccagat

SEQ ID NO: 82147 - DNA, 27 bp, Artificial Sequence
  Description of Artificial Sequence: Synthetic oligonucleotide
cattgaccaagctggggcagccagatg

SEQ ID NO: 82148 - DNA, 27 bp, Artificial Sequence
  Description of Artificial Sequence: Synthetic oligonucleotide
attgaccaagctggggcagccagatgc

SEQ ID NO: 82149 - DNA, 27 bp, Artificial Sequence
  Description of Artificial Sequence: Synthetic oligonucleotide
ttgaccaagctggggcagccagatgct

SEQ ID NO: 82150 - DNA, 26 bp, Artificial Sequence
  Description of Artificial Sequence: Synthetic oligonucleotide
tgaccaagctggggcagccagatgct

SEQ ID NO: 82151 - DNA, 25 bp, Artificial Sequence
  Description of Artificial Sequence: Synthetic oligonucleotide
gaccaagctggggcagccagatgct

SEQ ID NO: 82152 - DNA, 26 bp, Artificial Sequence
  Description of Artificial Sequence: Synthetic oligonucleotide
accaagctggggcagccagatgctga

SEQ ID NO: 82153 - DNA, 25 bp, Artificial Sequence
  Description of Artificial Sequence: Synthetic oligonucleotide
ccaagctggggcagccagatgctga

SEQ ID NO: 82154 - DNA, 25 bp, Artificial Sequence
  Description of Artificial Sequence: Synthetic oligonucleotide
caagctggggcagccagatgctgag

SEQ ID NO: 82155 - DNA, 26 bp, Artificial Sequence
  Description of Artificial Sequence: Synthetic oligonucleotide
aagctggggcagccagatgctgagca

SEQ ID NO: 82156 - DNA, 25 bp, Artificial Sequence
  Description of Artificial Sequence: Synthetic oligonucleotide
agctggggcagccagatgctgagca

SEQ ID NO: 82157 - DNA, 24 bp, Artificial Sequence
  Description of Artificial Sequence: Synthetic oligonucleotide
gctggggcagccagatgctgagca

SEQ ID NO: 82158 - DNA, 25 bp, Artificial Sequence
  Description of Artificial Sequence: Synthetic oligonucleotide
ctggggcagccagatgctgagcagt

SEQ ID NO: 82159 - DNA, 25 bp, Artificial Sequence
  Description of Artificial Sequence: Synthetic oligonucleotide
tggggcagccagatgctgagcagtg

SEQ ID NO: 82160 - DNA, 24 bp, Artificial Sequence
  Description of Artificial Sequence: Synthetic oligonucleotide
ggggcagccagatgctgagcagtg

SEQ ID NO: 82161 - DNA, 26 bp, Artificial Sequence
  Description of Artificial Sequence: Synthetic oligonucleotide
gggcagccagatgctgagcagtggaa

SEQ ID NO: 82162 - DNA, 27 bp, Artificial Sequence
  Description of Artificial Sequence: Synthetic oligonucleotide
ggcagccagatgctgagcagtggaaca

SEQ ID NO: 82163 - DNA, 27 bp, Artificial Sequence
  Description of Artificial Sequence: Synthetic oligonucleotide
gcagccagatgctgagcagtggaacag

SEQ ID NO: 82164 - DNA, 27 bp, Artificial Sequence
  Description of Artificial Sequence: Synthetic oligonucleotide
cagccagatgctgagcagtggaacagc

SEQ ID NO: 82165 - DNA, 27 bp, Artificial Sequence
  Description of Artificial Sequence: Synthetic oligonucleotide
agccagatgctgagcagtggaacagcc

SEQ ID NO: 82166 - DNA, 26 bp, Artificial Sequence
  Description of Artificial Sequence: Synthetic oligonucleotide
gccagatgctgagcagtggaacagcc

SEQ ID NO: 82167 - DNA, 26 bp, Artificial Sequence
  Description of Artificial Sequence: Synthetic oligonucleotide
ccagatgctgagcagtggaacagccg

SEQ ID NO: 82168 - DNA, 26 bp, Artificial Sequence
  Description of Artificial Sequence: Synthetic oligonucleotide
cagatgctgagcagtggaacagccgg

SEQ ID NO: 82169 - DNA, 27 bp, Artificial Sequence
  Description of Artificial Sequence: Synthetic oligonucleotide
agatgctgagcagtggaacagccggct

SEQ ID NO: 82170 - DNA, 26 bp, Artificial Sequence
  Description of Artificial Sequence: Synthetic oligonucleotide
gatgctgagcagtggaacagccggct

SEQ ID NO: 82171 - DNA, 26 bp, Artificial Sequence
  Description of Artificial Sequence: Synthetic oligonucleotide
atgctgagcagtggaacagccggctg

SEQ ID NO: 82172 - DNA, 25 bp, Artificial Sequence
  Description of Artificial Sequence: Synthetic oligonucleotide
tgctgagcagtggaacagccggctg

SEQ ID NO: 82173 - DNA, 24 bp, Artificial Sequence
  Description of Artificial Sequence: Synthetic oligonucleotide
gctgagcagtggaacagccggctg

SEQ ID NO: 82174 - DNA, 26 bp, Artificial Sequence
  Description of Artificial Sequence: Synthetic oligonucleotide
ctgagcagtggaacagccggctggat

SEQ ID NO: 82175 - DNA, 27 bp, Artificial Sequence
  Description of Artificial Sequence: Synthetic oligonucleotide
tgagcagtggaacagccggctggatct

SEQ ID NO: 82176 - DNA, 26 bp, Artificial Sequence
  Description of Artificial Sequence: Synthetic oligonucleotide
gagcagtggaacagccggctggatct

SEQ ID NO: 82177 - DNA, 27 bp, Artificial Sequence
  Description of Artificial Sequence: Synthetic oligonucleotide
agcagtggaacagccggctggatctct

SEQ ID NO: 82178 - DNA, 27 bp, Artificial Sequence
  Description of Artificial Sequence: Synthetic oligonucleotide
gcagtggaacagccggctggatctctt

SEQ ID NO: 82179 - DNA, 27 bp, Artificial Sequence
  Description of Artificial Sequence: Synthetic oligonucleotide
cagtggaacagccggctggatctcttg

SEQ ID NO: 82180 - DNA, 27 bp, Artificial Sequence
  Description of Artificial Sequence: Synthetic oligonucleotide
agtggaacagccggctggatctcttgg

SEQ ID NO: 82181 - DNA, 27 bp, Artificial Sequence
  Description of Artificial Sequence: Synthetic oligonucleotide
gtggaacagccggctggatctcttgga

SEQ ID NO: 82182 - DNA, 27 bp, Artificial Sequence
  Description of Artificial Sequence: Synthetic oligonucleotide
tggaacagccggctggatctcttggag

SEQ ID NO: 82183 - DNA, 27 bp, Artificial Sequence
  Description of Artificial Sequence: Synthetic oligonucleotide
ggaacagccggctggatctcttggaga

SEQ ID NO: 82184 - DNA, 27 bp, Artificial Sequence
  Description of Artificial Sequence: Synthetic oligonucleotide
gaacagccggctggatctcttggagag

SEQ ID NO: 82185 - DNA, 27 bp, Artificial Sequence
  Description of Artificial Sequence: Synthetic oligonucleotide
aacagccggctggatctcttggagagg

SEQ ID NO: 82186 - DNA, 27 bp, Artificial Sequence
  Description of Artificial Sequence: Synthetic oligonucleotide
acagccggctggatctcttggagagga

SEQ ID NO: 82187 - DNA, 26 bp, Artificial Sequence
  Description of Artificial Sequence: Synthetic oligonucleotide
cagccggctggatctcttggagagga

SEQ ID NO: 82188 - DNA, 26 bp, Artificial Sequence
  Description of Artificial Sequence: Synthetic oligonucleotide
agccggctggatctcttggagaggag

SEQ ID NO: 82189 - DNA, 25 bp, Artificial Sequence
  Description of Artificial Sequence: Synthetic oligonucleotide
gccggctggatctcttggagaggag

SEQ ID NO: 82190 - DNA, 26 bp, Artificial Sequence
  Description of Artificial Sequence: Synthetic oligonucleotide
ccggctggatctcttggagaggagca

SEQ ID NO: 82191 - DNA, 27 bp, Artificial Sequence
  Description of Artificial Sequence: Synthetic oligonucleotide
cggctggatctcttggagaggagcaga

SEQ ID NO: 82192 - DNA, 27 bp, Artificial Sequence
  Description of Artificial Sequence: Synthetic oligonucleotide
ggctggatctcttggagaggagcagac

SEQ ID NO: 82193 - DNA, 28 bp, Artificial Sequence
  Description of Artificial Sequence: Synthetic oligonucleotide
gctggatctcttggagaggagcagacag

SEQ ID NO: 82194 - DNA, 28 bp, Artificial Sequence
  Description of Artificial Sequence: Synthetic oligonucleotide
ctggatctcttggagaggagcagacagg

SEQ ID NO: 82195 - DNA, 28 bp, Artificial Sequence
  Description of Artificial Sequence: Synthetic oligonucleotide
tggatctcttggagaggagcagacaggc

SEQ ID NO: 82196 - DNA, 27 bp, Artificial Sequence
  Description of Artificial Sequence: Synthetic oligonucleotide
ggatctcttggagaggagcagacaggc

SEQ ID NO: 82197 - DNA, 27 bp, Artificial Sequence
  Description of Artificial Sequence: Synthetic oligonucleotide
gatctcttggagaggagcagacaggcc

SEQ ID NO: 82198 - DNA, 27 bp, Artificial Sequence
  Description of Artificial Sequence: Synthetic oligonucleotide
atctcttggagaggagcagacaggccg

SEQ ID NO: 82199 - DNA, 27 bp, Artificial Sequence
  Description of Artificial Sequence: Synthetic oligonucleotide
tctcttggagaggagcagacaggccgt

SEQ ID NO: 82200 - DNA, 26 bp, Artificial Sequence
  Description of Artificial Sequence: Synthetic oligonucleotide
ctcttggagaggagcagacaggccgt

SEQ ID NO: 82201 - DNA, 26 bp, Artificial Sequence
  Description of Artificial Sequence: Synthetic oligonucleotide
tcttggagaggagcagacaggccgtg

SEQ ID NO: 82202 - DNA, 25 bp, Artificial Sequence
  Description of Artificial Sequence: Synthetic oligonucleotide
cttggagaggagcagacaggccgtg

SEQ ID NO: 82203 - DNA, 27 bp, Artificial Sequence
  Description of Artificial Sequence: Synthetic oligonucleotide
ttggagaggagcagacaggccgtggat

SEQ ID NO: 82204 - DNA, 26 bp, Artificial Sequence
  Description of Artificial Sequence: Synthetic oligonucleotide
tggagaggagcagacaggccgtggat

SEQ ID NO: 82205 - DNA, 25 bp, Artificial Sequence
  Description of Artificial Sequence: Synthetic oligonucleotide
ggagaggagcagacaggccgtggat

SEQ ID NO: 82206 - DNA, 25 bp, Artificial Sequence
  Description of Artificial Sequence: Synthetic oligonucleotide
gagaggagcagacaggccgtggatg

SEQ ID NO: 82207 - DNA, 25 bp, Artificial Sequence
  Description of Artificial Sequence: Synthetic oligonucleotide
agaggagcagacaggccgtggatgg

SEQ ID NO: 82208 - DNA, 24 bp, Artificial Sequence
  Description of Artificial Sequence: Synthetic oligonucleotide
gaggagcagacaggccgtggatgg

SEQ ID NO: 82209 - DNA, 24 bp, Artificial Sequence
  Description of Artificial Sequence: Synthetic oligonucleotide
aggagcagacaggccgtggatggg

SEQ ID NO: 82210 - DNA, 23 bp, Artificial Sequence
  Description of Artificial Sequence: Synthetic oligonucleotide
ggagcagacaggccgtggatggg

SEQ ID NO: 82211 - DNA, 24 bp, Artificial Sequence
  Description of Artificial Sequence: Synthetic oligonucleotide
gagcagacaggccgtggatggggt

SEQ ID NO: 82212 - DNA, 25 bp, Artificial Sequence
  Description of Artificial Sequence: Synthetic oligonucleotide
agcagacaggccgtggatggggtct

SEQ ID NO: 82213 - DNA, 24 bp, Artificial Sequence
  Description of Artificial Sequence: Synthetic oligonucleotide
gcagacaggccgtggatggggtct

SEQ ID NO: 82214 - DNA, 26 bp, Artificial Sequence
  Description of Artificial Sequence: Synthetic oligonucleotide
cagacaggccgtggatggggtctgta

SEQ ID NO: 82215 - DNA, 27 bp, Artificial Sequence
  Description of Artificial Sequence: Synthetic oligonucleotide
agacaggccgtggatggggtctgtaga

SEQ ID NO: 82216 - DNA, 26 bp, Artificial Sequence
  Description of Artificial Sequence: Synthetic oligonucleotide
gacaggccgtggatggggtctgtaga

SEQ ID NO: 82217 - DNA, 27 bp, Artificial Sequence
  Description of Artificial Sequence: Synthetic oligonucleotide
acaggccgtggatggggtctgtagaca

SEQ ID NO: 82218 - DNA, 26 bp, Artificial Sequence
  Description of Artificial Sequence: Synthetic oligonucleotide
caggccgtggatggggtctgtagaca

SEQ ID NO: 82219 - DNA, 27 bp, Artificial Sequence
  Description of Artificial Sequence: Synthetic oligonucleotide
aggccgtggatggggtctgtagacaca

SEQ ID NO: 82220 - DNA, 27 bp, Artificial Sequence
  Description of Artificial Sequence: Synthetic oligonucleotide
ggccgtggatggggtctgtagacacaa

SEQ ID NO: 82221 - DNA, 27 bp, Artificial Sequence
  Description of Artificial Sequence: Synthetic oligonucleotide
gccgtggatggggtctgtagacacaac

SEQ ID NO: 82222 - DNA, 29 bp, Artificial Sequence
  Description of Artificial Sequence: Synthetic oligonucleotide
ccgtggatggggtctgtagacacaactac

SEQ ID NO: 82223 - DNA, 30 bp, Artificial Sequence
  Description of Artificial Sequence: Synthetic oligonucleotide
cgtggatggggtctgtagacacaactacag

SEQ ID NO: 82224 - DNA, 30 bp, Artificial Sequence
  Description of Artificial Sequence: Synthetic oligonucleotide
gtggatggggtctgtagacacaactacagg

SEQ ID NO: 82225 - DNA, 30 bp, Artificial Sequence
  Description of Artificial Sequence: Synthetic oligonucleotide
tggatggggtctgtagacacaactacaggc

SEQ ID NO: 82226 - DNA, 29 bp, Artificial Sequence
  Description of Artificial Sequence: Synthetic oligonucleotide
ggatggggtctgtagacacaactacaggc

SEQ ID NO: 82227 - DNA, 30 bp, Artificial Sequence
  Description of Artificial Sequence: Synthetic oligonucleotide
gatggggtctgtagacacaactacaggctg

SEQ ID NO: 82228 - DNA, 30 bp, Artificial Sequence
  Description of Artificial Sequence: Synthetic oligonucleotide
atggggtctgtagacacaactacaggctgg

SEQ ID NO: 82229 - DNA, 29 bp, Artificial Sequence
  Description of Artificial Sequence: Synthetic oligonucleotide
tggggtctgtagacacaactacaggctgg

SEQ ID NO: 82230 - DNA, 28 bp, Artificial Sequence
  Description of Artificial Sequence: Synthetic oligonucleotide
ggggtctgtagacacaactacaggctgg

SEQ ID NO: 82231 - DNA, 28 bp, Artificial Sequence
  Description of Artificial Sequence: Synthetic oligonucleotide
gggtctgtagacacaactacaggctggg

SEQ ID NO: 82232 - DNA, 28 bp, Artificial Sequence
  Description of Artificial Sequence: Synthetic oligonucleotide
ggtctgtagacacaactacaggctgggc

SEQ ID NO: 82233 - DNA, 28 bp, Artificial Sequence
  Description of Artificial Sequence: Synthetic oligonucleotide
gtctgtagacacaactacaggctgggcg

SEQ ID NO: 82234 - DNA, 28 bp, Artificial Sequence
  Description of Artificial Sequence: Synthetic oligonucleotide
tctgtagacacaactacaggctgggcgc

SEQ ID NO: 82235 - DNA, 27 bp, Artificial Sequence
  Description of Artificial Sequence: Synthetic oligonucleotide
ctgtagacacaactacaggctgggcgc

SEQ ID NO: 82236 - DNA, 28 bp, Artificial Sequence
  Description of Artificial Sequence: Synthetic oligonucleotide
tgtagacacaactacaggctgggcgcac

SEQ ID NO: 82237 - DNA, 27 bp, Artificial Sequence
  Description of Artificial Sequence: Synthetic oligonucleotide
gtagacacaactacaggctgggcgcac

SEQ ID NO: 82238 - DNA, 27 bp, Artificial Sequence
  Description of Artificial Sequence: Synthetic oligonucleotide
tagacacaactacaggctgggcgcacc

SEQ ID NO: 82239 - DNA, 26 bp, Artificial Sequence
  Description of Artificial Sequence: Synthetic oligonucleotide
agacacaactacaggctgggcgcacc

SEQ ID NO: 82240 - DNA, 25 bp, Artificial Sequence
  Description of Artificial Sequence: Synthetic oligonucleotide
gacacaactacaggctgggcgcacc

SEQ ID NO: 82241 - DNA, 27 bp, Artificial Sequence
  Description of Artificial Sequence: Synthetic oligonucleotide
acacaactacaggctgggcgcaccctt

SEQ ID NO: 82242 - DNA, 26 bp, Artificial Sequence
  Description of Artificial Sequence: Synthetic oligonucleotide
cacaactacaggctgggcgcaccctt

SEQ ID NO: 82243 - DNA, 27 bp, Artificial Sequence
  Description of Artificial Sequence: Synthetic oligonucleotide
acaactacaggctgggcgcacccttca

SEQ ID NO: 82244 - DNA, 26 bp, Artificial Sequence
  Description of Artificial Sequence: Synthetic oligonucleotide
caactacaggctgggcgcacccttca

SEQ ID NO: 82245 - DNA, 27 bp, Artificial Sequence
  Description of Artificial Sequence: Synthetic oligonucleotide
aactacaggctgggcgcacccttcact

SEQ ID NO: 82246 - DNA, 26 bp, Artificial Sequence
  Description of Artificial Sequence: Synthetic oligonucleotide
actacaggctgggcgcacccttcact

SEQ ID NO: 82247 - DNA, 25 bp, Artificial Sequence
  Description of Artificial Sequence: Synthetic oligonucleotide
ctacaggctgggcgcacccttcact

SEQ ID NO: 82248 - DNA, 26 bp, Artificial Sequence
  Description of Artificial Sequence: Synthetic oligonucleotide
tacaggctgggcgcacccttcactgt

SEQ ID NO: 82249 - DNA, 25 bp, Artificial Sequence
  Description of Artificial Sequence: Synthetic oligonucleotide
acaggctgggcgcacccttcactgt

SEQ ID NO: 82250 - DNA, 24 bp, Artificial Sequence
  Description of Artificial Sequence: Synthetic oligonucleotide
caggctgggcgcacccttcactgt

SEQ ID NO: 82251 - DNA, 24 bp, Artificial Sequence
  Description of Artificial Sequence: Synthetic oligonucleotide
aggctgggcgcacccttcactgtg

SEQ ID NO: 82252 - DNA, 23 bp, Artificial Sequence
  Description of Artificial Sequence: Synthetic oligonucleotide
ggctgggcgcacccttcactgtg

SEQ ID NO: 82253 - DNA, 23 bp, Artificial Sequence
  Description of Artificial Sequence: Synthetic oligonucleotide
gctgggcgcacccttcactgtgg

SEQ ID NO: 82254 - DNA, 23 bp, Artificial Sequence
  Description of Artificial Sequence: Synthetic oligonucleotide
ctgggcgcacccttcactgtggg

SEQ ID NO: 82255 - DNA, 24 bp, Artificial Sequence
  Description of Artificial Sequence: Synthetic oligonucleotide
tgggcgcacccttcactgtgggga

SEQ ID NO: 82256 - DNA, 23 bp, Artificial Sequence
  Description of Artificial Sequence: Synthetic oligonucleotide
gggcgcacccttcactgtgggga

SEQ ID NO: 82257 - DNA, 27 bp, Artificial Sequence
  Description of Artificial Sequence: Synthetic oligonucleotide
ggcgcacccttcactgtggggagaaaa

SEQ ID NO: 82258 - DNA, 27 bp, Artificial Sequence
  Description of Artificial Sequence: Synthetic oligonucleotide
gcgcacccttcactgtggggagaaaag

SEQ ID NO: 82259 - DNA, 28 bp, Artificial Sequence
  Description of Artificial Sequence: Synthetic oligonucleotide
cgcacccttcactgtggggagaaaagtg

SEQ ID NO: 82260 - DNA, 28 bp, Artificial Sequence
  Description of Artificial Sequence: Synthetic oligonucleotide
gcacccttcactgtggggagaaaagtgc

SEQ ID NO: 82261 - DNA, 30 bp, Artificial Sequence
  Description of Artificial Sequence: Synthetic oligonucleotide
cacccttcactgtggggagaaaagtgcaac

SEQ ID NO: 82262 - DNA, 30 bp, Artificial Sequence
  Description of Artificial Sequence: Synthetic oligonucleotide
acccttcactgtggggagaaaagtgcaacc

SEQ ID NO: 82263 - DNA, 29 bp, Artificial Sequence
  Description of Artificial Sequence: Synthetic oligonucleotide
cccttcactgtggggagaaaagtgcaacc

SEQ ID NO: 82264 - DNA, 30 bp, Artificial Sequence
  Description of Artificial Sequence: Synthetic oligonucleotide
ccttcactgtggggagaaaagtgcaaccag

SEQ ID NO: 82265 - DNA, 31 bp, Artificial Sequence
  Description of Artificial Sequence: Synthetic oligonucleotide
cttcactgtggggagaaaagtgcaaccagag

SEQ ID NO: 82266 - DNA, 31 bp, Artificial Sequence
  Description of Artificial Sequence: Synthetic oligonucleotide
ttcactgtggggagaaaagtgcaaccagagg

SEQ ID NO: 82267 - DNA, 30 bp, Artificial Sequence
  Description of Artificial Sequence: Synthetic oligonucleotide
tcactgtggggagaaaagtgcaaccagagg

SEQ ID NO: 82268 - DNA, 29 bp, Artificial Sequence
  Description of Artificial Sequence: Synthetic oligonucleotide
cactgtggggagaaaagtgcaaccagagg

SEQ ID NO: 82269 - DNA, 30 bp, Artificial Sequence
  Description of Artificial Sequence: Synthetic oligonucleotide
actgtggggagaaaagtgcaaccagaggtg

SEQ ID NO: 82270 - DNA, 29 bp, Artificial Sequence
  Description of Artificial Sequence: Synthetic oligonucleotide
ctgtggggagaaaagtgcaaccagaggtg

SEQ ID NO: 82271 - DNA, 30 bp, Artificial Sequence
  Description of Artificial Sequence: Synthetic oligonucleotide
tgtggggagaaaagtgcaaccagaggtgac

SEQ ID NO: 82272 - DNA, 29 bp, Artificial Sequence
  Description of Artificial Sequence: Synthetic oligonucleotide
gtggggagaaaagtgcaaccagaggtgac

SEQ ID NO: 82273 - DNA, 30 bp, Artificial Sequence
  Description of Artificial Sequence: Synthetic oligonucleotide
tggggagaaaagtgcaaccagaggtgacag

SEQ ID NO: 82274 - DNA, 29 bp, Artificial Sequence
  Description of Artificial Sequence: Synthetic oligonucleotide
ggggagaaaagtgcaaccagaggtgacag

SEQ ID NO: 82275 - DNA, 30 bp, Artificial Sequence
  Description of Artificial Sequence: Synthetic oligonucleotide
gggagaaaagtgcaaccagaggtgacagtg

SEQ ID NO: 82276 - DNA, 32 bp, Artificial Sequence
  Description of Artificial Sequence: Synthetic oligonucleotide
ggagaaaagtgcaaccagaggtgacagtgtac

SEQ ID NO: 82277 - DNA, 32 bp, Artificial Sequence
  Description of Artificial Sequence: Synthetic oligonucleotide
gagaaaagtgcaaccagaggtgacagtgtacc

SEQ ID NO: 82278 - DNA, 32 bp, Artificial Sequence
  Description of Artificial Sequence: Synthetic oligonucleotide
agaaaagtgcaaccagaggtgacagtgtaccc

SEQ ID NO: 82279 - DNA, 31 bp, Artificial Sequence
  Description of Artificial Sequence: Synthetic oligonucleotide
gaaaagtgcaaccagaggtgacagtgtaccc

SEQ ID NO: 82280 - DNA, 32 bp, Artificial Sequence
  Description of Artificial Sequence: Synthetic oligonucleotide
aaaagtgcaaccagaggtgacagtgtacccag

SEQ ID NO: 82281 - DNA, 31 bp, Artificial Sequence
  Description of Artificial Sequence: Synthetic oligonucleotide
aaagtgcaaccagaggtgacagtgtacccag

SEQ ID NO: 82282 - DNA, 30 bp, Artificial Sequence
  Description of Artificial Sequence: Synthetic oligonucleotide
aagtgcaaccagaggtgacagtgtacccag

SEQ ID NO: 82283 - DNA, 29 bp, Artificial Sequence
  Description of Artificial Sequence: Synthetic oligonucleotide
agtgcaaccagaggtgacagtgtacccag

SEQ ID NO: 82284 - DNA, 28 bp, Artificial Sequence
  Description of Artificial Sequence: Synthetic oligonucleotide
gtgcaaccagaggtgacagtgtacccag

SEQ ID NO: 82285 - DNA, 29 bp, Artificial Sequence
  Description of Artificial Sequence: Synthetic oligonucleotide
tgcaaccagaggtgacagtgtacccagag

SEQ ID NO: 82286 - DNA, 28 bp, Artificial Sequence
  Description of Artificial Sequence: Synthetic oligonucleotide
gcaaccagaggtgacagtgtacccagag

SEQ ID NO: 82287 - DNA, 29 bp, Artificial Sequence
  Description of Artificial Sequence: Synthetic oligonucleotide
caaccagaggtgacagtgtacccagagag

SEQ ID NO: 82288 - DNA, 29 bp, Artificial Sequence
  Description of Artificial Sequence: Synthetic oligonucleotide
aaccagaggtgacagtgtacccagagagg

SEQ ID NO: 82289 - DNA, 28 bp, Artificial Sequence
  Description of Artificial Sequence: Synthetic oligonucleotide
accagaggtgacagtgtacccagagagg

SEQ ID NO: 82290 - DNA, 27 bp, Artificial Sequence
  Description of Artificial Sequence: Synthetic oligonucleotide
ccagaggtgacagtgtacccagagagg

SEQ ID NO: 82291 - DNA, 28 bp, Artificial Sequence
  Description of Artificial Sequence: Synthetic oligonucleotide
cagaggtgacagtgtacccagagaggac

SEQ ID NO: 82292 - DNA, 28 bp, Artificial Sequence
  Description of Artificial Sequence: Synthetic oligonucleotide
agaggtgacagtgtacccagagaggacc

SEQ ID NO: 82293 - DNA, 27 bp, Artificial Sequence
  Description of Artificial Sequence: Synthetic oligonucleotide
gaggtgacagtgtacccagagaggacc

SEQ ID NO: 82294 - DNA, 27 bp, Artificial Sequence
  Description of Artificial Sequence: Synthetic oligonucleotide
aggtgacagtgtacccagagaggaccc

SEQ ID NO: 82295 - DNA, 26 bp, Artificial Sequence
  Description of Artificial Sequence: Synthetic oligonucleotide
ggtgacagtgtacccagagaggaccc

SEQ ID NO: 82296 - DNA, 27 bp, Artificial Sequence
  Description of Artificial Sequence: Synthetic oligonucleotide
gtgacagtgtacccagagaggacccca

SEQ ID NO: 82297 - DNA, 27 bp, Artificial Sequence
  Description of Artificial Sequence: Synthetic oligonucleotide
tgacagtgtacccagagaggaccccac

SEQ ID NO: 82298 - DNA, 27 bp, Artificial Sequence
  Description of Artificial Sequence: Synthetic oligonucleotide
gacagtgtacccagagaggaccccact

SEQ ID NO: 82299 - DNA, 27 bp, Artificial Sequence
  Description of Artificial Sequence: Synthetic oligonucleotide
acagtgtacccagagaggaccccactc

SEQ ID NO: 82300 - DNA, 26 bp, Artificial Sequence
  Description of Artificial Sequence: Synthetic oligonucleotide
cagtgtacccagagaggaccccactc

SEQ ID NO: 82301 - DNA, 27 bp, Artificial Sequence
  Description of Artificial Sequence: Synthetic oligonucleotide
agtgtacccagagaggaccccactcct

SEQ ID NO: 82302 - DNA, 26 bp, Artificial Sequence
  Description of Artificial Sequence: Synthetic oligonucleotide
gtgtacccagagaggaccccactcct

SEQ ID NO: 82303 - DNA, 26 bp, Artificial Sequence
  Description of Artificial Sequence: Synthetic oligonucleotide
tgtacccagagaggaccccactcctg

SEQ ID NO: 82304 - DNA, 25 bp, Artificial Sequence
  Description of Artificial Sequence: Synthetic oligonucleotide
gtacccagagaggaccccactcctg

SEQ ID NO: 82305 - DNA, 26 bp, Artificial Sequence
  Description of Artificial Sequence: Synthetic oligonucleotide
tacccagagaggaccccactcctgca

SEQ ID NO: 82306 - DNA, 25 bp, Artificial Sequence
  Description of Artificial Sequence: Synthetic oligonucleotide
acccagagaggaccccactcctgca

SEQ ID NO: 82307 - DNA, 24 bp, Artificial Sequence
  Description of Artificial Sequence: Synthetic oligonucleotide
cccagagaggaccccactcctgca

SEQ ID NO: 82308 - DNA, 24 bp, Artificial Sequence
  Description of Artificial Sequence: Synthetic oligonucleotide
ccagagaggaccccactcctgcac

SEQ ID NO: 82309 - DNA, 25 bp, Artificial Sequence
  Description of Artificial Sequence: Synthetic oligonucleotide
cagagaggaccccactcctgcacca

SEQ ID NO: 82310 - DNA, 25 bp, Artificial Sequence
  Description of Artificial Sequence: Synthetic oligonucleotide
agagaggaccccactcctgcaccag

SEQ ID NO: 82311 - DNA, 24 bp, Artificial Sequence
  Description of Artificial Sequence: Synthetic oligonucleotide
gagaggaccccactcctgcaccag

SEQ ID NO: 82312 - DNA, 27 bp, Artificial Sequence
  Description of Artificial Sequence: Synthetic oligonucleotide
agaggaccccactcctgcaccagcata

SEQ ID NO: 82313 - DNA, 27 bp, Artificial Sequence
  Description of Artificial Sequence: Synthetic oligonucleotide
gaggaccccactcctgcaccagcataa

SEQ ID NO: 82314 - DNA, 28 bp, Artificial Sequence
  Description of Artificial Sequence: Synthetic oligonucleotide
aggaccccactcctgcaccagcataatc

SEQ ID NO: 82315 - DNA, 27 bp, Artificial Sequence
  Description of Artificial Sequence: Synthetic oligonucleotide
ggaccccactcctgcaccagcataatc

SEQ ID NO: 82316 - DNA, 28 bp, Artificial Sequence
  Description of Artificial Sequence: Synthetic oligonucleotide
gaccccactcctgcaccagcataatctg

SEQ ID NO: 82317 - DNA, 28 bp, Artificial Sequence
  Description of Artificial Sequence: Synthetic oligonucleotide
accccactcctgcaccagcataatctgc

SEQ ID NO: 82318 - DNA, 27 bp, Artificial Sequence
  Description of Artificial Sequence: Synthetic oligonucleotide
ccccactcctgcaccagcataatctgc

SEQ ID NO: 82319 - DNA, 28 bp, Artificial Sequence
  Description of Artificial Sequence: Synthetic oligonucleotide
cccactcctgcaccagcataatctgctg

SEQ ID NO: 82320 - DNA, 28 bp, Artificial Sequence
  Description of Artificial Sequence: Synthetic oligonucleotide
ccactcctgcaccagcataatctgctgc

SEQ ID NO: 82321 - DNA, 29 bp, Artificial Sequence
  Description of Artificial Sequence: Synthetic oligonucleotide
cactcctgcaccagcataatctgctgcac

SEQ ID NO: 82322 - DNA, 30 bp, Artificial Sequence
  Description of Artificial Sequence: Synthetic oligonucleotide
actcctgcaccagcataatctgctgcactg

SEQ ID NO: 82323 - DNA, 29 bp, Artificial Sequence
  Description of Artificial Sequence: Synthetic oligonucleotide
ctcctgcaccagcataatctgctgcactg

SEQ ID NO: 82324 - DNA, 29 bp, Artificial Sequence
  Description of Artificial Sequence: Synthetic oligonucleotide
tcctgcaccagcataatctgctgcactgc

SEQ ID NO: 82325 - DNA, 28 bp, Artificial Sequence
  Description of Artificial Sequence: Synthetic oligonucleotide
cctgcaccagcataatctgctgcactgc

SEQ ID NO: 82326 - DNA, 29 bp, Artificial Sequence
  Description of Artificial Sequence: Synthetic oligonucleotide
ctgcaccagcataatctgctgcactgctc

SEQ ID NO: 82327 - DNA, 30 bp, Artificial Sequence
  Description of Artificial Sequence: Synthetic oligonucleotide
tgcaccagcataatctgctgcactgctctg

SEQ ID NO: 82328 - DNA, 29 bp, Artificial Sequence
  Description of Artificial Sequence: Synthetic oligonucleotide
gcaccagcataatctgctgcactgctctg

SEQ ID NO: 82329 - DNA, 30 bp, Artificial Sequence
  Description of Artificial Sequence: Synthetic oligonucleotide
caccagcataatctgctgcactgctctgtg

SEQ ID NO: 82330 - DNA, 31 bp, Artificial Sequence
  Description of Artificial Sequence: Synthetic oligonucleotide
accagcataatctgctgcactgctctgtgac

SEQ ID NO: 82331 - DNA, 30 bp, Artificial Sequence
  Description of Artificial Sequence: Synthetic oligonucleotide
ccagcataatctgctgcactgctctgtgac

SEQ ID NO: 82332 - DNA, 31 bp, Artificial Sequence
  Description of Artificial Sequence: Synthetic oligonucleotide
cagcataatctgctgcactgctctgtgacag

SEQ ID NO: 82333 - DNA, 31 bp, Artificial Sequence
  Description of Artificial Sequence: Synthetic oligonucleotide
agcataatctgctgcactgctctgtgacagg

SEQ ID NO: 82334 - DNA, 30 bp, Artificial Sequence
  Description of Artificial Sequence: Synthetic oligonucleotide
gcataatctgctgcactgctctgtgacagg

SEQ ID NO: 82335 - DNA, 30 bp, Artificial Sequence
  Description of Artificial Sequence: Synthetic oligonucleotide
cataatctgctgcactgctctgtgacaggc

SEQ ID NO: 82336 - DNA, 32 bp, Artificial Sequence
  Description of Artificial Sequence: Synthetic oligonucleotide
ataatctgctgcactgctctgtgacaggcttc

SEQ ID NO: 82337 - DNA, 31 bp, Artificial Sequence
  Description of Artificial Sequence: Synthetic oligonucleotide
taatctgctgcactgctctgtgacaggcttc

SEQ ID NO: 82338 - DNA, 30 bp, Artificial Sequence
  Description of Artificial Sequence: Synthetic oligonucleotide
aatctgctgcactgctctgtgacaggcttc

SEQ ID NO: 82339 - DNA, 29 bp, Artificial Sequence
  Description of Artificial Sequence: Synthetic oligonucleotide
atctgctgcactgctctgtgacaggcttc

SEQ ID NO: 82340 - DNA, 28 bp, Artificial Sequence
  Description of Artificial Sequence: Synthetic oligonucleotide
tctgctgcactgctctgtgacaggcttc

SEQ ID NO: 82341 - DNA, 27 bp, Artificial Sequence
  Description of Artificial Sequence: Synthetic oligonucleotide
ctgctgcactgctctgtgacaggcttc

SEQ ID NO: 82342 - DNA, 30 bp, Artificial Sequence
  Description of Artificial Sequence: Synthetic oligonucleotide
tgctgcactgctctgtgacaggcttctatc

SEQ ID NO: 82343 - DNA, 29 bp, Artificial Sequence
  Description of Artificial Sequence: Synthetic oligonucleotide
gctgcactgctctgtgacaggcttctatc

SEQ ID NO: 82344 - DNA, 29 bp, Artificial Sequence
  Description of Artificial Sequence: Synthetic oligonucleotide
ctgcactgctctgtgacaggcttctatcc

SEQ ID NO: 82345 - DNA, 30 bp, Artificial Sequence
  Description of Artificial Sequence: Synthetic oligonucleotide
tgcactgctctgtgacaggcttctatccag

SEQ ID NO: 82346 - DNA, 29 bp, Artificial Sequence
  Description of Artificial Sequence: Synthetic oligonucleotide
gcactgctctgtgacaggcttctatccag

SEQ ID NO: 82347 - DNA, 29 bp, Artificial Sequence
  Description of Artificial Sequence: Synthetic oligonucleotide
cactgctctgtgacaggcttctatccagg

SEQ ID NO: 82348 - DNA, 29 bp, Artificial Sequence
  Description of Artificial Sequence: Synthetic oligonucleotide
actgctctgtgacaggcttctatccaggg

SEQ ID NO: 82349 - DNA, 28 bp, Artificial Sequence
  Description of Artificial Sequence: Synthetic oligonucleotide
ctgctctgtgacaggcttctatccaggg

SEQ ID NO: 82350 - DNA, 28 bp, Artificial Sequence
  Description of Artificial Sequence: Synthetic oligonucleotide
tgctctgtgacaggcttctatccagggg

SEQ ID NO: 82351 - DNA, 27 bp, Artificial Sequence
  Description of Artificial Sequence: Synthetic oligonucleotide
gctctgtgacaggcttctatccagggg

SEQ ID NO: 82352 - DNA, 31 bp, Artificial Sequence
  Description of Artificial Sequence: Synthetic oligonucleotide
ctctgtgacaggcttctatccaggggatatc

SEQ ID NO: 82353 - DNA, 33 bp, Artificial Sequence
  Description of Artificial Sequence: Synthetic oligonucleotide
tctgtgacaggcttctatccaggggatatcaag

SEQ ID NO: 82354 - DNA, 32 bp, Artificial Sequence
  Description of Artificial Sequence: Synthetic oligonucleotide
ctgtgacaggcttctatccaggggatatcaag

SEQ ID NO: 82355 - DNA, 34 bp, Artificial Sequence
  Description of Artificial Sequence: Synthetic oligonucleotide
tgtgacaggcttctatccaggggatatcaagatc

SEQ ID NO: 82356 - DNA, 33 bp, Artificial Sequence
  Description of Artificial Sequence: Synthetic oligonucleotide
gtgacaggcttctatccaggggatatcaagatc

SEQ ID NO: 82357 - DNA, 35 bp, Artificial Sequence
  Description of Artificial Sequence: Synthetic oligonucleotide
tgacaggcttctatccaggggatatcaagatcaag

SEQ ID NO: 82358 - DNA, 34 bp, Artificial Sequence
  Description of Artificial Sequence: Synthetic oligonucleotide
gacaggcttctatccaggggatatcaagatcaag

SEQ ID NO: 82359 - DNA, 35 bp, Artificial Sequence
  Description of Artificial Sequence: Synthetic oligonucleotide
acaggcttctatccaggggatatcaagatcaagtg

SEQ ID NO: 82360 - DNA, 34 bp, Artificial Sequence
  Description of Artificial Sequence: Synthetic oligonucleotide
caggcttctatccaggggatatcaagatcaagtg

SEQ ID NO: 82361 - DNA, 34 bp, Artificial Sequence
  Description of Artificial Sequence: Synthetic oligonucleotide
aggcttctatccaggggatatcaagatcaagtgg

SEQ ID NO: 82362 - DNA, 33 bp, Artificial Sequence
  Description of Artificial Sequence: Synthetic oligonucleotide
ggcttctatccaggggatatcaagatcaagtgg

SEQ ID NO: 82363 - DNA, 35 bp, Artificial Sequence
  Description of Artificial Sequence: Synthetic oligonucleotide
gcttctatccaggggatatcaagatcaagtggttc

SEQ ID NO: 82364 - DNA, 35 bp, Artificial Sequence
  Description of Artificial Sequence: Synthetic oligonucleotide
cttctatccaggggatatcaagatcaagtggttcc

SEQ ID NO: 82365 - DNA, 36 bp, Artificial Sequence
  Description of Artificial Sequence: Synthetic oligonucleotide
ttctatccaggggatatcaagatcaagtggttcctg

SEQ ID NO: 82366 - DNA, 35 bp, Artificial Sequence
  Description of Artificial Sequence: Synthetic oligonucleotide
tctatccaggggatatcaagatcaagtggttcctg

SEQ ID NO: 82367 - DNA, 34 bp, Artificial Sequence
  Description of Artificial Sequence: Synthetic oligonucleotide
ctatccaggggatatcaagatcaagtggttcctg

SEQ ID NO: 82368 - DNA, 37 bp, Artificial Sequence
  Description of Artificial Sequence: Synthetic oligonucleotide
tatccaggggatatcaagatcaagtggttcctgaatg

SEQ ID NO: 82369 - DNA, 36 bp, Artificial Sequence
  Description of Artificial Sequence: Synthetic oligonucleotide
atccaggggatatcaagatcaagtggttcctgaatg

SEQ ID NO: 82370 - DNA, 35 bp, Artificial Sequence
  Description of Artificial Sequence: Synthetic oligonucleotide
tccaggggatatcaagatcaagtggttcctgaatg

SEQ ID NO: 82371 - DNA, 34 bp, Artificial Sequence
  Description of Artificial Sequence: Synthetic oligonucleotide
ccaggggatatcaagatcaagtggttcctgaatg

SEQ ID NO: 82372 - DNA, 34 bp, Artificial Sequence
  Description of Artificial Sequence: Synthetic oligonucleotide
caggggatatcaagatcaagtggttcctgaatgg

SEQ ID NO: 82373 - DNA, 34 bp, Artificial Sequence
  Description of Artificial Sequence: Synthetic oligonucleotide
aggggatatcaagatcaagtggttcctgaatggg

SEQ ID NO: 82374 - DNA, 33 bp, Artificial Sequence
  Description of Artificial Sequence: Synthetic oligonucleotide
ggggatatcaagatcaagtggttcctgaatggg

SEQ ID NO: 82375 - DNA, 33 bp, Artificial Sequence
  Description of Artificial Sequence: Synthetic oligonucleotide
gggatatcaagatcaagtggttcctgaatgggc

SEQ ID NO: 82376 - DNA, 34 bp, Artificial Sequence
  Description of Artificial Sequence: Synthetic oligonucleotide
ggatatcaagatcaagtggttcctgaatgggcag

SEQ ID NO: 82377 - DNA, 34 bp, Artificial Sequence
  Description of Artificial Sequence: Synthetic oligonucleotide
gatatcaagatcaagtggttcctgaatgggcagg

SEQ ID NO: 82378 - DNA, 35 bp, Artificial Sequence
  Description of Artificial Sequence: Synthetic oligonucleotide
atatcaagatcaagtggttcctgaatgggcaggag

SEQ ID NO: 82379 - DNA, 34 bp, Artificial Sequence
  Description of Artificial Sequence: Synthetic oligonucleotide
tatcaagatcaagtggttcctgaatgggcaggag

SEQ ID NO: 82380 - DNA, 33 bp, Artificial Sequence
  Description of Artificial Sequence: Synthetic oligonucleotide
atcaagatcaagtggttcctgaatgggcaggag

SEQ ID NO: 82381 - DNA, 32 bp, Artificial Sequence
  Description of Artificial Sequence: Synthetic oligonucleotide
tcaagatcaagtggttcctgaatgggcaggag

SEQ ID NO: 82382 - DNA, 31 bp, Artificial Sequence
  Description of Artificial Sequence: Synthetic oligonucleotide
caagatcaagtggttcctgaatgggcaggag

SEQ ID NO: 82383 - DNA, 31 bp, Artificial Sequence
  Description of Artificial Sequence: Synthetic oligonucleotide
aagatcaagtggttcctgaatgggcaggagg

SEQ ID NO: 82384 - DNA, 30 bp, Artificial Sequence
  Description of Artificial Sequence: Synthetic oligonucleotide
agatcaagtggttcctgaatgggcaggagg

SEQ ID NO: 82385 - DNA, 29 bp, Artificial Sequence
  Description of Artificial Sequence: Synthetic oligonucleotide
gatcaagtggttcctgaatgggcaggagg

SEQ ID NO: 82386 - DNA, 30 bp, Artificial Sequence
  Description of Artificial Sequence: Synthetic oligonucleotide
atcaagtggttcctgaatgggcaggaggag

SEQ ID NO: 82387 - DNA, 29 bp, Artificial Sequence
  Description of Artificial Sequence: Synthetic oligonucleotide
tcaagtggttcctgaatgggcaggaggag

SEQ ID NO: 82388 - DNA, 28 bp, Artificial Sequence
  Description of Artificial Sequence: Synthetic oligonucleotide
caagtggttcctgaatgggcaggaggag

SEQ ID NO: 82389 - DNA, 29 bp, Artificial Sequence
  Description of Artificial Sequence: Synthetic oligonucleotide
aagtggttcctgaatgggcaggaggagag

SEQ ID NO: 82390 - DNA, 28 bp, Artificial Sequence
  Description of Artificial Sequence: Synthetic oligonucleotide
agtggttcctgaatgggcaggaggagag

SEQ ID NO: 82391 - DNA, 27 bp, Artificial Sequence
  Description of Artificial Sequence: Synthetic oligonucleotide
gtggttcctgaatgggcaggaggagag

SEQ ID NO: 82392 - DNA, 28 bp, Artificial Sequence
  Description of Artificial Sequence: Synthetic oligonucleotide
tggttcctgaatgggcaggaggagagag

SEQ ID NO: 82393 - DNA, 27 bp, Artificial Sequence
  Description of Artificial Sequence: Synthetic oligonucleotide
ggttcctgaatgggcaggaggagagag

SEQ ID NO: 82394 - DNA, 27 bp, Artificial Sequence
  Description of Artificial Sequence: Synthetic oligonucleotide
gttcctgaatgggcaggaggagagagc

SEQ ID NO: 82395 - DNA, 28 bp, Artificial Sequence
  Description of Artificial Sequence: Synthetic oligonucleotide
ttcctgaatgggcaggaggagagagctg

SEQ ID NO: 82396 - DNA, 27 bp, Artificial Sequence
  Description of Artificial Sequence: Synthetic oligonucleotide
tcctgaatgggcaggaggagagagctg

SEQ ID NO: 82397 - DNA, 26 bp, Artificial Sequence
  Description of Artificial Sequence: Synthetic oligonucleotide
cctgaatgggcaggaggagagagctg

SEQ ID NO: 82398 - DNA, 26 bp, Artificial Sequence
  Description of Artificial Sequence: Synthetic oligonucleotide
ctgaatgggcaggaggagagagctgg

SEQ ID NO: 82399 - DNA, 26 bp, Artificial Sequence
  Description of Artificial Sequence: Synthetic oligonucleotide
tgaatgggcaggaggagagagctggg

SEQ ID NO: 82400 - DNA, 25 bp, Artificial Sequence
  Description of Artificial Sequence: Synthetic oligonucleotide
gaatgggcaggaggagagagctggg

SEQ ID NO: 82401 - DNA, 26 bp, Artificial Sequence
  Description of Artificial Sequence: Synthetic oligonucleotide
aatgggcaggaggagagagctggggt

SEQ ID NO: 82402 - DNA, 25 bp, Artificial Sequence
  Description of Artificial Sequence: Synthetic oligonucleotide
atgggcaggaggagagagctggggt

SEQ ID NO: 82403 - DNA, 24 bp, Artificial Sequence
  Description of Artificial Sequence: Synthetic oligonucleotide
tgggcaggaggagagagctggggt

SEQ ID NO: 82404 - DNA, 23 bp, Artificial Sequence
  Description of Artificial Sequence: Synthetic oligonucleotide
gggcaggaggagagagctggggt

SEQ ID NO: 82405 - DNA, 25 bp, Artificial Sequence
  Description of Artificial Sequence: Synthetic oligonucleotide
ggcaggaggagagagctggggtcat

SEQ ID NO: 82406 - DNA, 26 bp, Artificial Sequence
  Description of Artificial Sequence: Synthetic oligonucleotide
gcaggaggagagagctggggtcatgt

SEQ ID NO: 82407 - DNA, 26 bp, Artificial Sequence
  Description of Artificial Sequence: Synthetic oligonucleotide
caggaggagagagctggggtcatgtc

SEQ ID NO: 82408 - DNA, 27 bp, Artificial Sequence
  Description of Artificial Sequence: Synthetic oligonucleotide
aggaggagagagctggggtcatgtcca

SEQ ID NO: 82409 - DNA, 26 bp, Artificial Sequence
  Description of Artificial Sequence: Synthetic oligonucleotide
ggaggagagagctggggtcatgtcca

SEQ ID NO: 82410 - DNA, 27 bp, Artificial Sequence
  Description of Artificial Sequence: Synthetic oligonucleotide
gaggagagagctggggtcatgtccact

SEQ ID NO: 82411 - DNA, 27 bp, Artificial Sequence
  Description of Artificial Sequence: Synthetic oligonucleotide
aggagagagctggggtcatgtccactg

SEQ ID NO: 82412 - DNA, 26 bp, Artificial Sequence
  Description of Artificial Sequence: Synthetic oligonucleotide
ggagagagctggggtcatgtccactg

SEQ ID NO: 82413 - DNA, 26 bp, Artificial Sequence
  Description of Artificial Sequence: Synthetic oligonucleotide
gagagagctggggtcatgtccactgg

SEQ ID NO: 82414 - DNA, 26 bp, Artificial Sequence
  Description of Artificial Sequence: Synthetic oligonucleotide
agagagctggggtcatgtccactggc

SEQ ID NO: 82415 - DNA, 25 bp, Artificial Sequence
  Description of Artificial Sequence: Synthetic oligonucleotide
gagagctggggtcatgtccactggc

SEQ ID NO: 82416 - DNA, 25 bp, Artificial Sequence
  Description of Artificial Sequence: Synthetic oligonucleotide
agagctggggtcatgtccactggcc

SEQ ID NO: 82417 - DNA, 24 bp, Artificial Sequence
  Description of Artificial Sequence: Synthetic oligonucleotide
gagctggggtcatgtccactggcc

SEQ ID NO: 82418 - DNA, 27 bp, Artificial Sequence
  Description of Artificial Sequence: Synthetic oligonucleotide
agctggggtcatgtccactggccctat

SEQ ID NO: 82419 - DNA, 26 bp, Artificial Sequence
  Description of Artificial Sequence: Synthetic oligonucleotide
gctggggtcatgtccactggccctat

SEQ ID NO: 82420 - DNA, 27 bp, Artificial Sequence
  Description of Artificial Sequence: Synthetic oligonucleotide
ctggggtcatgtccactggccctatca

SEQ ID NO: 82421 - DNA, 27 bp, Artificial Sequence
  Description of Artificial Sequence: Synthetic oligonucleotide
tggggtcatgtccactggccctatcag

SEQ ID NO: 82422 - DNA, 26 bp, Artificial Sequence
  Description of Artificial Sequence: Synthetic oligonucleotide
ggggtcatgtccactggccctatcag

SEQ ID NO: 82423 - DNA, 27 bp, Artificial Sequence
  Description of Artificial Sequence: Synthetic oligonucleotide
gggtcatgtccactggccctatcagga

SEQ ID NO: 82424 - DNA, 29 bp, Artificial Sequence
  Description of Artificial Sequence: Synthetic oligonucleotide
ggtcatgtccactggccctatcaggaatg

SEQ ID NO: 82425 - DNA, 29 bp, Artificial Sequence
  Description of Artificial Sequence: Synthetic oligonucleotide
gtcatgtccactggccctatcaggaatgg

SEQ ID NO: 82426 - DNA, 30 bp, Artificial Sequence
  Description of Artificial Sequence: Synthetic oligonucleotide
tcatgtccactggccctatcaggaatggag

SEQ ID NO: 82427 - DNA, 29 bp, Artificial Sequence
  Description of Artificial Sequence: Synthetic oligonucleotide
catgtccactggccctatcaggaatggag

SEQ ID NO: 82428 - DNA, 30 bp, Artificial Sequence
  Description of Artificial Sequence: Synthetic oligonucleotide
atgtccactggccctatcaggaatggagac

SEQ ID NO: 82429 - DNA, 29 bp, Artificial Sequence
  Description of Artificial Sequence: Synthetic oligonucleotide
tgtccactggccctatcaggaatggagac

SEQ ID NO: 82430 - DNA, 28 bp, Artificial Sequence
  Description of Artificial Sequence: Synthetic oligonucleotide
gtccactggccctatcaggaatggagac

SEQ ID NO: 82431 - DNA, 29 bp, Artificial Sequence
  Description of Artificial Sequence: Synthetic oligonucleotide
tccactggccctatcaggaatggagactg

SEQ ID NO: 82432 - DNA, 28 bp, Artificial Sequence
  Description of Artificial Sequence: Synthetic oligonucleotide
ccactggccctatcaggaatggagactg

SEQ ID NO: 82433 - DNA, 28 bp, Artificial Sequence
  Description of Artificial Sequence: Synthetic oligonucleotide
cactggccctatcaggaatggagactgg

SEQ ID NO: 82434 - DNA, 29 bp, Artificial Sequence
  Description of Artificial Sequence: Synthetic oligonucleotide
actggccctatcaggaatggagactggac

SEQ ID NO: 82435 - DNA, 28 bp, Artificial Sequence
  Description of Artificial Sequence: Synthetic oligonucleotide
ctggccctatcaggaatggagactggac

SEQ ID NO: 82436 - DNA, 28 bp, Artificial Sequence
  Description of Artificial Sequence: Synthetic oligonucleotide
tggccctatcaggaatggagactggacc

SEQ ID NO: 82437 - DNA, 27 bp, Artificial Sequence
  Description of Artificial Sequence: Synthetic oligonucleotide
ggccctatcaggaatggagactggacc

SEQ ID NO: 82438 - DNA, 30 bp, Artificial Sequence
  Description of Artificial Sequence: Synthetic oligonucleotide
gccctatcaggaatggagactggacctttc

SEQ ID NO: 82439 - DNA, 31 bp, Artificial Sequence
  Description of Artificial Sequence: Synthetic oligonucleotide
ccctatcaggaatggagactggacctttcag

SEQ ID NO: 82440 - DNA, 32 bp, Artificial Sequence
  Description of Artificial Sequence: Synthetic oligonucleotide
cctatcaggaatggagactggacctttcagac

SEQ ID NO: 82441 - DNA, 33 bp, Artificial Sequence
  Description of Artificial Sequence: Synthetic oligonucleotide
ctatcaggaatggagactggacctttcagactg

SEQ ID NO: 82442 - DNA, 34 bp, Artificial Sequence
  Description of Artificial Sequence: Synthetic oligonucleotide
tatcaggaatggagactggacctttcagactgtg

SEQ ID NO: 82443 - DNA, 33 bp, Artificial Sequence
  Description of Artificial Sequence: Synthetic oligonucleotide
atcaggaatggagactggacctttcagactgtg

SEQ ID NO: 82444 - DNA, 32 bp, Artificial Sequence
  Description of Artificial Sequence: Synthetic oligonucleotide
tcaggaatggagactggacctttcagactgtg

SEQ ID NO: 82445 - DNA, 31 bp, Artificial Sequence
  Description of Artificial Sequence: Synthetic oligonucleotide
caggaatggagactggacctttcagactgtg

SEQ ID NO: 82446 - DNA, 31 bp, Artificial Sequence
  Description of Artificial Sequence: Synthetic oligonucleotide
aggaatggagactggacctttcagactgtgg

SEQ ID NO: 82447 - DNA, 30 bp, Artificial Sequence
  Description of Artificial Sequence: Synthetic oligonucleotide
ggaatggagactggacctttcagactgtgg

SEQ ID NO: 82448 - DNA, 31 bp, Artificial Sequence
  Description of Artificial Sequence: Synthetic oligonucleotide
gaatggagactggacctttcagactgtggtg

SEQ ID NO: 82449 - DNA, 33 bp, Artificial Sequence
  Description of Artificial Sequence: Synthetic oligonucleotide
aatggagactggacctttcagactgtggtgatg

SEQ ID NO: 82450 - DNA, 32 bp, Artificial Sequence
  Description of Artificial Sequence: Synthetic oligonucleotide
atggagactggacctttcagactgtggtgatg

SEQ ID NO: 82451 - DNA, 31 bp, Artificial Sequence
  Description of Artificial Sequence: Synthetic oligonucleotide
tggagactggacctttcagactgtggtgatg

SEQ ID NO: 82452 - DNA, 30 bp, Artificial Sequence
  Description of Artificial Sequence: Synthetic oligonucleotide
ggagactggacctttcagactgtggtgatg

SEQ ID NO: 82453 - DNA, 30 bp, Artificial Sequence
  Description of Artificial Sequence: Synthetic oligonucleotide
gagactggacctttcagactgtggtgatgc

SEQ ID NO: 82454 - DNA, 32 bp, Artificial Sequence
  Description of Artificial Sequence: Synthetic oligonucleotide
agactggacctttcagactgtggtgatgctag

SEQ ID NO: 82455 - DNA, 31 bp, Artificial Sequence
  Description of Artificial Sequence: Synthetic oligonucleotide
gactggacctttcagactgtggtgatgctag

SEQ ID NO: 82456 - DNA, 35 bp, Artificial Sequence
  Description of Artificial Sequence: Synthetic oligonucleotide
actggacctttcagactgtggtgatgctagaaatg

SEQ ID NO: 82457 - DNA, 34 bp, Artificial Sequence
  Description of Artificial Sequence: Synthetic oligonucleotide
ctggacctttcagactgtggtgatgctagaaatg

SEQ ID NO: 82458 - DNA, 35 bp, Artificial Sequence
  Description of Artificial Sequence: Synthetic oligonucleotide
tggacctttcagactgtggtgatgctagaaatgac

SEQ ID NO: 82459 - DNA, 34 bp, Artificial Sequence
  Description of Artificial Sequence: Synthetic oligonucleotide
ggacctttcagactgtggtgatgctagaaatgac

SEQ ID NO: 82460 - DNA, 35 bp, Artificial Sequence
  Description of Artificial Sequence: Synthetic oligonucleotide
gacctttcagactgtggtgatgctagaaatgactc

SEQ ID NO: 82461 - DNA, 35 bp, Artificial Sequence
  Description of Artificial Sequence: Synthetic oligonucleotide
acctttcagactgtggtgatgctagaaatgactcc

SEQ ID NO: 82462 - DNA, 34 bp, Artificial Sequence
  Description of Artificial Sequence: Synthetic oligonucleotide
cctttcagactgtggtgatgctagaaatgactcc

SEQ ID NO: 82463 - DNA, 35 bp, Artificial Sequence
  Description of Artificial Sequence: Synthetic oligonucleotide
ctttcagactgtggtgatgctagaaatgactcctg

SEQ ID NO: 82464 - DNA, 37 bp, Artificial Sequence
  Description of Artificial Sequence: Synthetic oligonucleotide
tttcagactgtggtgatgctagaaatgactcctgaac

SEQ ID NO: 82465 - DNA, 36 bp, Artificial Sequence
  Description of Artificial Sequence: Synthetic oligonucleotide
ttcagactgtggtgatgctagaaatgactcctgaac

SEQ ID NO: 82466 - DNA, 35 bp, Artificial Sequence
  Description of Artificial Sequence: Synthetic oligonucleotide
tcagactgtggtgatgctagaaatgactcctgaac

SEQ ID NO: 82467 - DNA, 34 bp, Artificial Sequence
  Description of Artificial Sequence: Synthetic oligonucleotide
cagactgtggtgatgctagaaatgactcctgaac

SEQ ID NO: 82468 - DNA, 36 bp, Artificial Sequence
  Description of Artificial Sequence: Synthetic oligonucleotide
agactgtggtgatgctagaaatgactcctgaacttg

SEQ ID NO: 82469 - DNA, 35 bp, Artificial Sequence
  Description of Artificial Sequence: Synthetic oligonucleotide
gactgtggtgatgctagaaatgactcctgaacttg

SEQ ID NO: 82470 - DNA, 35 bp, Artificial Sequence
  Description of Artificial Sequence: Synthetic oligonucleotide
actgtggtgatgctagaaatgactcctgaacttgg

SEQ ID NO: 82471 - DNA, 34 bp, Artificial Sequence
  Description of Artificial Sequence: Synthetic oligonucleotide
ctgtggtgatgctagaaatgactcctgaacttgg

SEQ ID NO: 82472 - DNA, 35 bp, Artificial Sequence
  Description of Artificial Sequence: Synthetic oligonucleotide
tgtggtgatgctagaaatgactcctgaacttggac

SEQ ID NO: 82473 - DNA, 34 bp, Artificial Sequence
  Description of Artificial Sequence: Synthetic oligonucleotide
gtggtgatgctagaaatgactcctgaacttggac

SEQ ID NO: 82474 - DNA, 36 bp, Artificial Sequence
  Description of Artificial Sequence: Synthetic oligonucleotide
tggtgatgctagaaatgactcctgaacttggacatg

SEQ ID NO: 82475 - DNA, 35 bp, Artificial Sequence
  Description of Artificial Sequence: Synthetic oligonucleotide
ggtgatgctagaaatgactcctgaacttggacatg

SEQ ID NO: 82476 - DNA, 36 bp, Artificial Sequence
  Description of Artificial Sequence: Synthetic oligonucleotide
gtgatgctagaaatgactcctgaacttggacatgtc

SEQ ID NO: 82477 - DNA, 38 bp, Artificial Sequence
  Description of Artificial Sequence: Synthetic oligonucleotide
tgatgctagaaatgactcctgaacttggacatgtctac

SEQ ID NO: 82478 - DNA, 37 bp, Artificial Sequence
  Description of Artificial Sequence: Synthetic oligonucleotide
gatgctagaaatgactcctgaacttggacatgtctac

SEQ ID NO: 82479 - DNA, 38 bp, Artificial Sequence
  Description of Artificial Sequence: Synthetic oligonucleotide
atgctagaaatgactcctgaacttggacatgtctacac

SEQ ID NO: 82480 - DNA, 37 bp, Artificial Sequence
  Description of Artificial Sequence: Synthetic oligonucleotide
tgctagaaatgactcctgaacttggacatgtctacac

SEQ ID NO: 82481 - DNA, 36 bp, Artificial Sequence
  Description of Artificial Sequence: Synthetic oligonucleotide
gctagaaatgactcctgaacttggacatgtctacac

SEQ ID NO: 82482 - DNA, 36 bp, Artificial Sequence
  Description of Artificial Sequence: Synthetic oligonucleotide
ctagaaatgactcctgaacttggacatgtctacacc

SEQ ID NO: 82483 - DNA, 37 bp, Artificial Sequence
  Description of Artificial Sequence: Synthetic oligonucleotide
tagaaatgactcctgaacttggacatgtctacacctg

SEQ ID NO: 82484 - DNA, 36 bp, Artificial Sequence
  Description of Artificial Sequence: Synthetic oligonucleotide
agaaatgactcctgaacttggacatgtctacacctg

SEQ ID NO: 82485 - DNA, 35 bp, Artificial Sequence
  Description of Artificial Sequence: Synthetic oligonucleotide
gaaatgactcctgaacttggacatgtctacacctg

SEQ ID NO: 82486 - DNA, 35 bp, Artificial Sequence
  Description of Artificial Sequence: Synthetic oligonucleotide
aaatgactcctgaacttggacatgtctacacctgc

SEQ ID NO: 82487 - DNA, 34 bp, Artificial Sequence
  Description of Artificial Sequence: Synthetic oligonucleotide
aatgactcctgaacttggacatgtctacacctgc

SEQ ID NO: 82488 - DNA, 33 bp, Artificial Sequence
  Description of Artificial Sequence: Synthetic oligonucleotide
atgactcctgaacttggacatgtctacacctgc

SEQ ID NO: 82489 - DNA, 32 bp, Artificial Sequence
  Description of Artificial Sequence: Synthetic oligonucleotide
tgactcctgaacttggacatgtctacacctgc

SEQ ID NO: 82490 - DNA, 31 bp, Artificial Sequence
  Description of Artificial Sequence: Synthetic oligonucleotide
gactcctgaacttggacatgtctacacctgc

SEQ ID NO: 82491 - DNA, 31 bp, Artificial Sequence
  Description of Artificial Sequence: Synthetic oligonucleotide
actcctgaacttggacatgtctacacctgcc

SEQ ID NO: 82492 - DNA, 30 bp, Artificial Sequence
  Description of Artificial Sequence: Synthetic oligonucleotide
ctcctgaacttggacatgtctacacctgcc

SEQ ID NO: 82493 - DNA, 32 bp, Artificial Sequence
  Description of Artificial Sequence: Synthetic oligonucleotide
tcctgaacttggacatgtctacacctgccttg

SEQ ID NO: 82494 - DNA, 31 bp, Artificial Sequence
  Description of Artificial Sequence: Synthetic oligonucleotide
cctgaacttggacatgtctacacctgccttg

SEQ ID NO: 82495 - DNA, 32 bp, Artificial Sequence
  Description of Artificial Sequence: Synthetic oligonucleotide
ctgaacttggacatgtctacacctgccttgtc

SEQ ID NO: 82496 - DNA, 32 bp, Artificial Sequence
  Description of Artificial Sequence: Synthetic oligonucleotide
tgaacttggacatgtctacacctgccttgtcg

SEQ ID NO: 82497 - DNA, 31 bp, Artificial Sequence
  Description of Artificial Sequence: Synthetic oligonucleotide
gaacttggacatgtctacacctgccttgtcg

SEQ ID NO: 82498 - DNA, 33 bp, Artificial Sequence
  Description of Artificial Sequence: Synthetic oligonucleotide
aacttggacatgtctacacctgccttgtcgatc

SEQ ID NO: 82499 - DNA, 32 bp, Artificial Sequence
  Description of Artificial Sequence: Synthetic oligonucleotide
acttggacatgtctacacctgccttgtcgatc

SEQ ID NO: 82500 - DNA, 31 bp, Artificial Sequence
  Description of Artificial Sequence: Synthetic oligonucleotide
cttggacatgtctacacctgccttgtcgatc

SEQ ID NO: 82501 - DNA, 32 bp, Artificial Sequence
  Description of Artificial Sequence: Synthetic oligonucleotide
ttggacatgtctacacctgccttgtcgatcac

SEQ ID NO: 82502 - DNA, 31 bp, Artificial Sequence
  Description of Artificial Sequence: Synthetic oligonucleotide
tggacatgtctacacctgccttgtcgatcac

SEQ ID NO: 82503 - DNA, 30 bp, Artificial Sequence
  Description of Artificial Sequence: Synthetic oligonucleotide
ggacatgtctacacctgccttgtcgatcac

SEQ ID NO: 82504 - DNA, 31 bp, Artificial Sequence
  Description of Artificial Sequence: Synthetic oligonucleotide
gacatgtctacacctgccttgtcgatcactc

SEQ ID NO: 82505 - DNA, 31 bp, Artificial Sequence
  Description of Artificial Sequence: Synthetic oligonucleotide
acatgtctacacctgccttgtcgatcactcc

SEQ ID NO: 82506 - DNA, 30 bp, Artificial Sequence
  Description of Artificial Sequence: Synthetic oligonucleotide
catgtctacacctgccttgtcgatcactcc

SEQ ID NO: 82507 - DNA, 31 bp, Artificial Sequence
  Description of Artificial Sequence: Synthetic oligonucleotide
atgtctacacctgccttgtcgatcactccag

SEQ ID NO: 82508 - DNA, 30 bp, Artificial Sequence
  Description of Artificial Sequence: Synthetic oligonucleotide
tgtctacacctgccttgtcgatcactccag

SEQ ID NO: 82509 - DNA, 29 bp, Artificial Sequence
  Description of Artificial Sequence: Synthetic oligonucleotide
gtctacacctgccttgtcgatcactccag

SEQ ID NO: 82510 - DNA, 29 bp, Artificial Sequence
  Description of Artificial Sequence: Synthetic oligonucleotide
tctacacctgccttgtcgatcactccagc

SEQ ID NO: 82511 - DNA, 28 bp, Artificial Sequence
  Description of Artificial Sequence: Synthetic oligonucleotide
ctacacctgccttgtcgatcactccagc

SEQ ID NO: 82512 - DNA, 28 bp, Artificial Sequence
  Description of Artificial Sequence: Synthetic oligonucleotide
tacacctgccttgtcgatcactccagcc

SEQ ID NO: 82513 - DNA, 27 bp, Artificial Sequence
  Description of Artificial Sequence: Synthetic oligonucleotide
acacctgccttgtcgatcactccagcc

SEQ ID NO: 82514 - DNA, 27 bp, Artificial Sequence
  Description of Artificial Sequence: Synthetic oligonucleotide
cacctgccttgtcgatcactccagcct

SEQ ID NO: 82515 - DNA, 27 bp, Artificial Sequence
  Description of Artificial Sequence: Synthetic oligonucleotide
acctgccttgtcgatcactccagcctg

SEQ ID NO: 82516 - DNA, 26 bp, Artificial Sequence
  Description of Artificial Sequence: Synthetic oligonucleotide
cctgccttgtcgatcactccagcctg

SEQ ID NO: 82517 - DNA, 27 bp, Artificial Sequence
  Description of Artificial Sequence: Synthetic oligonucleotide
ctgccttgtcgatcactccagcctgct

SEQ ID NO: 82518 - DNA, 27 bp, Artificial Sequence
  Description of Artificial Sequence: Synthetic oligonucleotide
tgccttgtcgatcactccagcctgctg

SEQ ID NO: 82519 - DNA, 27 bp, Artificial Sequence
  Description of Artificial Sequence: Synthetic oligonucleotide
gccttgtcgatcactccagcctgctga

SEQ ID NO: 82520 - DNA, 27 bp, Artificial Sequence
  Description of Artificial Sequence: Synthetic oligonucleotide
ccttgtcgatcactccagcctgctgag

SEQ ID NO: 82521 - DNA, 27 bp, Artificial Sequence
  Description of Artificial Sequence: Synthetic oligonucleotide
cttgtcgatcactccagcctgctgagc

SEQ ID NO: 82522 - DNA, 27 bp, Artificial Sequence
  Description of Artificial Sequence: Synthetic oligonucleotide
ttgtcgatcactccagcctgctgagcc

SEQ ID NO: 82523 - DNA, 26 bp, Artificial Sequence
  Description of Artificial Sequence: Synthetic oligonucleotide
tgtcgatcactccagcctgctgagcc

SEQ ID NO: 82524 - DNA, 25 bp, Artificial Sequence
  Description of Artificial Sequence: Synthetic oligonucleotide
gtcgatcactccagcctgctgagcc

SEQ ID NO: 82525 - DNA, 26 bp, Artificial Sequence
  Description of Artificial Sequence: Synthetic oligonucleotide
tcgatcactccagcctgctgagccct

SEQ ID NO: 82526 - DNA, 25 bp, Artificial Sequence
  Description of Artificial Sequence: Synthetic oligonucleotide
cgatcactccagcctgctgagccct

SEQ ID NO: 82527 - DNA, 27 bp, Artificial Sequence
  Description of Artificial Sequence: Synthetic oligonucleotide
gatcactccagcctgctgagccctgtt

SEQ ID NO: 82528 - DNA, 28 bp, Artificial Sequence
  Description of Artificial Sequence: Synthetic oligonucleotide
atcactccagcctgctgagccctgtttc

SEQ ID NO: 82529 - DNA, 27 bp, Artificial Sequence
  Description of Artificial Sequence: Synthetic oligonucleotide
tcactccagcctgctgagccctgtttc

SEQ ID NO: 82530 - DNA, 27 bp, Artificial Sequence
  Description of Artificial Sequence: Synthetic oligonucleotide
cactccagcctgctgagccctgtttct

SEQ ID NO: 82531 - DNA, 27 bp, Artificial Sequence
  Description of Artificial Sequence: Synthetic oligonucleotide
actccagcctgctgagccctgtttctg

SEQ ID NO: 82532 - DNA, 27 bp, Artificial Sequence
  Description of Artificial Sequence: Synthetic oligonucleotide
ctccagcctgctgagccctgtttctgt

SEQ ID NO: 82533 - DNA, 27 bp, Artificial Sequence
  Description of Artificial Sequence: Synthetic oligonucleotide
tccagcctgctgagccctgtttctgtg

SEQ ID NO: 82534 - DNA, 26 bp, Artificial Sequence
  Description of Artificial Sequence: Synthetic oligonucleotide
ccagcctgctgagccctgtttctgtg

SEQ ID NO: 82535 - DNA, 27 bp, Artificial Sequence
  Description of Artificial Sequence: Synthetic oligonucleotide
cagcctgctgagccctgtttctgtgga

SEQ ID NO: 82536 - DNA, 27 bp, Artificial Sequence
  Description of Artificial Sequence: Synthetic oligonucleotide
agcctgctgagccctgtttctgtggag

SEQ ID NO: 82537 - DNA, 27 bp, Artificial Sequence
  Description of Artificial Sequence: Synthetic oligonucleotide
gcctgctgagccctgtttctgtggagt

SEQ ID NO: 82538 - DNA, 27 bp, Artificial Sequence
  Description of Artificial Sequence: Synthetic oligonucleotide
cctgctgagccctgtttctgtggagtg

SEQ ID NO: 82539 - DNA, 27 bp, Artificial Sequence
  Description of Artificial Sequence: Synthetic oligonucleotide
ctgctgagccctgtttctgtggagtgg

SEQ ID NO: 82540 - DNA, 28 bp, Artificial Sequence
  Description of Artificial Sequence: Synthetic oligonucleotide
tgctgagccctgtttctgtggagtggag

SEQ ID NO: 82541 - DNA, 27 bp, Artificial Sequence
  Description of Artificial Sequence: Synthetic oligonucleotide
gctgagccctgtttctgtggagtggag

SEQ ID NO: 82542 - DNA, 28 bp, Artificial Sequence
  Description of Artificial Sequence: Synthetic oligonucleotide
ctgagccctgtttctgtggagtggagag

SEQ ID NO: 82543 - DNA, 28 bp, Artificial Sequence
  Description of Artificial Sequence: Synthetic oligonucleotide
tgagccctgtttctgtggagtggagagc

SEQ ID NO: 82544 - DNA, 27 bp, Artificial Sequence
  Description of Artificial Sequence: Synthetic oligonucleotide
gagccctgtttctgtggagtggagagc

SEQ ID NO: 82545 - DNA, 28 bp, Artificial Sequence
  Description of Artificial Sequence: Synthetic oligonucleotide
agccctgtttctgtggagtggagagctc

SEQ ID NO: 82546 - DNA, 27 bp, Artificial Sequence
  Description of Artificial Sequence: Synthetic oligonucleotide
gccctgtttctgtggagtggagagctc

SEQ ID NO: 82547 - DNA, 28 bp, Artificial Sequence
  Description of Artificial Sequence: Synthetic oligonucleotide
ccctgtttctgtggagtggagagctcag

SEQ ID NO: 82548 - DNA, 29 bp, Artificial Sequence
  Description of Artificial Sequence: Synthetic oligonucleotide
cctgtttctgtggagtggagagctcagtc

SEQ ID NO: 82549 - DNA, 30 bp, Artificial Sequence
  Description of Artificial Sequence: Synthetic oligonucleotide
ctgtttctgtggagtggagagctcagtctg

SEQ ID NO: 82550 - DNA, 36 bp, Artificial Sequence
  Description of Artificial Sequence: Synthetic oligonucleotide
tgtttctgtggagtggagagctcagtctgaatattc

SEQ ID NO: 82551 - DNA, 35 bp, Artificial Sequence
  Description of Artificial Sequence: Synthetic oligonucleotide
gtttctgtggagtggagagctcagtctgaatattc

SEQ ID NO: 82552 - DNA, 37 bp, Artificial Sequence
  Description of Artificial Sequence: Synthetic oligonucleotide
tttctgtggagtggagagctcagtctgaatattcttg

SEQ ID NO: 82553 - DNA, 36 bp, Artificial Sequence
  Description of Artificial Sequence: Synthetic oligonucleotide
ttctgtggagtggagagctcagtctgaatattcttg

SEQ ID NO: 82554 - DNA, 35 bp, Artificial Sequence
  Description of Artificial Sequence: Synthetic oligonucleotide
tctgtggagtggagagctcagtctgaatattcttg

SEQ ID NO: 82555 - DNA, 34 bp, Artificial Sequence
  Description of Artificial Sequence: Synthetic oligonucleotide
ctgtggagtggagagctcagtctgaatattcttg

SEQ ID NO: 82556 - DNA, 34 bp, Artificial Sequence
  Description of Artificial Sequence: Synthetic oligonucleotide
tgtggagtggagagctcagtctgaatattcttgg

SEQ ID NO: 82557 - DNA, 33 bp, Artificial Sequence
  Description of Artificial Sequence: Synthetic oligonucleotide
gtggagtggagagctcagtctgaatattcttgg

SEQ ID NO: 82558 - DNA, 34 bp, Artificial Sequence
  Description of Artificial Sequence: Synthetic oligonucleotide
tggagtggagagctcagtctgaatattcttggag

SEQ ID NO: 82559 - DNA, 33 bp, Artificial Sequence
  Description of Artificial Sequence: Synthetic oligonucleotide
ggagtggagagctcagtctgaatattcttggag

SEQ ID NO: 82560 - DNA, 36 bp, Artificial Sequence
  Description of Artificial Sequence: Synthetic oligonucleotide
gagtggagagctcagtctgaatattcttggagaaag

SEQ ID NO: 82561 - DNA, 38 bp, Artificial Sequence
  Description of Artificial Sequence: Synthetic oligonucleotide
agtggagagctcagtctgaatattcttggagaaagatg

SEQ ID NO: 82562 - DNA, 37 bp, Artificial Sequence
  Description of Artificial Sequence: Synthetic oligonucleotide
gtggagagctcagtctgaatattcttggagaaagatg

SEQ ID NO: 82563 - DNA, 37 bp, Artificial Sequence
  Description of Artificial Sequence: Synthetic oligonucleotide
tggagagctcagtctgaatattcttggagaaagatgc

SEQ ID NO: 82564 - DNA, 36 bp, Artificial Sequence
  Description of Artificial Sequence: Synthetic oligonucleotide
ggagagctcagtctgaatattcttggagaaagatgc

SEQ ID NO: 82565 - DNA, 37 bp, Artificial Sequence
  Description of Artificial Sequence: Synthetic oligonucleotide
gagagctcagtctgaatattcttggagaaagatgctg

SEQ ID NO: 82566 - DNA, 38 bp, Artificial Sequence
  Description of Artificial Sequence: Synthetic oligonucleotide
agagctcagtctgaatattcttggagaaagatgctgag

SEQ ID NO: 82567 - DNA, 37 bp, Artificial Sequence
  Description of Artificial Sequence: Synthetic oligonucleotide
gagctcagtctgaatattcttggagaaagatgctgag

SEQ ID NO: 82568 - DNA, 38 bp, Artificial Sequence
  Description of Artificial Sequence: Synthetic oligonucleotide
agctcagtctgaatattcttggagaaagatgctgagtg

SEQ ID NO: 82569 - DNA, 37 bp, Artificial Sequence
  Description of Artificial Sequence: Synthetic oligonucleotide
gctcagtctgaatattcttggagaaagatgctgagtg

SEQ ID NO: 82570 - DNA, 37 bp, Artificial Sequence
  Description of Artificial Sequence: Synthetic oligonucleotide
ctcagtctgaatattcttggagaaagatgctgagtgg

SEQ ID NO: 82571 - DNA, 37 bp, Artificial Sequence
  Description of Artificial Sequence: Synthetic oligonucleotide
tcagtctgaatattcttggagaaagatgctgagtggc

SEQ ID NO: 82572 - DNA, 36 bp, Artificial Sequence
  Description of Artificial Sequence: Synthetic oligonucleotide
cagtctgaatattcttggagaaagatgctgagtggc

SEQ ID NO: 82573 - DNA, 39 bp, Artificial Sequence
  Description of Artificial Sequence: Synthetic oligonucleotide
agtctgaatattcttggagaaagatgctgagtggcattg

SEQ ID NO: 82574 - DNA, 38 bp, Artificial Sequence
  Description of Artificial Sequence: Synthetic oligonucleotide
gtctgaatattcttggagaaagatgctgagtggcattg

SEQ ID NO: 82575 - DNA, 38 bp, Artificial Sequence
  Description of Artificial Sequence: Synthetic oligonucleotide
tctgaatattcttggagaaagatgctgagtggcattgc

SEQ ID NO: 82576 - DNA, 37 bp, Artificial Sequence
  Description of Artificial Sequence: Synthetic oligonucleotide
ctgaatattcttggagaaagatgctgagtggcattgc

SEQ ID NO: 82577 - DNA, 38 bp, Artificial Sequence
  Description of Artificial Sequence: Synthetic oligonucleotide
tgaatattcttggagaaagatgctgagtggcattgcag

SEQ ID NO: 82578 - DNA, 37 bp, Artificial Sequence
  Description of Artificial Sequence: Synthetic oligonucleotide
gaatattcttggagaaagatgctgagtggcattgcag

SEQ ID NO: 82579 - DNA, 37 bp, Artificial Sequence
  Description of Artificial Sequence: Synthetic oligonucleotide
aatattcttggagaaagatgctgagtggcattgcagc

SEQ ID NO: 82580 - DNA, 36 bp, Artificial Sequence
  Description of Artificial Sequence: Synthetic oligonucleotide
atattcttggagaaagatgctgagtggcattgcagc

SEQ ID NO: 82581 - DNA, 35 bp, Artificial Sequence
  Description of Artificial Sequence: Synthetic oligonucleotide
tattcttggagaaagatgctgagtggcattgcagc

SEQ ID NO: 82582 - DNA, 34 bp, Artificial Sequence
  Description of Artificial Sequence: Synthetic oligonucleotide
attcttggagaaagatgctgagtggcattgcagc

SEQ ID NO: 82583 - DNA, 33 bp, Artificial Sequence
  Description of Artificial Sequence: Synthetic oligonucleotide
ttcttggagaaagatgctgagtggcattgcagc

SEQ ID NO: 82584 - DNA, 32 bp, Artificial Sequence
  Description of Artificial Sequence: Synthetic oligonucleotide
tcttggagaaagatgctgagtggcattgcagc

SEQ ID NO: 82585 - DNA, 31 bp, Artificial Sequence
  Description of Artificial Sequence: Synthetic oligonucleotide
cttggagaaagatgctgagtggcattgcagc

SEQ ID NO: 82586 - DNA, 31 bp, Artificial Sequence
  Description of Artificial Sequence: Synthetic oligonucleotide
ttggagaaagatgctgagtggcattgcagcc

SEQ ID NO: 82587 - DNA, 30 bp, Artificial Sequence
  Description of Artificial Sequence: Synthetic oligonucleotide
tggagaaagatgctgagtggcattgcagcc

SEQ ID NO: 82588 - DNA, 29 bp, Artificial Sequence
  Description of Artificial Sequence: Synthetic oligonucleotide
ggagaaagatgctgagtggcattgcagcc

SEQ ID NO: 82589 - DNA, 31 bp, Artificial Sequence
  Description of Artificial Sequence: Synthetic oligonucleotide
gagaaagatgctgagtggcattgcagccttc

SEQ ID NO: 82590 - DNA, 31 bp, Artificial Sequence
  Description of Artificial Sequence: Synthetic oligonucleotide
agaaagatgctgagtggcattgcagccttcc

SEQ ID NO: 82591 - DNA, 30 bp, Artificial Sequence
  Description of Artificial Sequence: Synthetic oligonucleotide
gaaagatgctgagtggcattgcagccttcc

SEQ ID NO: 82592 - DNA, 32 bp, Artificial Sequence
  Description of Artificial Sequence: Synthetic oligonucleotide
aaagatgctgagtggcattgcagccttcctac

SEQ ID NO: 82593 - DNA, 31 bp, Artificial Sequence
  Description of Artificial Sequence: Synthetic oligonucleotide
aagatgctgagtggcattgcagccttcctac

SEQ ID NO: 82594 - DNA, 30 bp, Artificial Sequence
  Description of Artificial Sequence: Synthetic oligonucleotide
agatgctgagtggcattgcagccttcctac

SEQ ID NO: 82595 - DNA, 29 bp, Artificial Sequence
  Description of Artificial Sequence: Synthetic oligonucleotide
gatgctgagtggcattgcagccttcctac

SEQ ID NO: 82596 - DNA, 31 bp, Artificial Sequence
  Description of Artificial Sequence: Synthetic oligonucleotide
atgctgagtggcattgcagccttcctacttg

SEQ ID NO: 82597 - DNA, 30 bp, Artificial Sequence
  Description of Artificial Sequence: Synthetic oligonucleotide
tgctgagtggcattgcagccttcctacttg

SEQ ID NO: 82598 - DNA, 29 bp, Artificial Sequence
  Description of Artificial Sequence: Synthetic oligonucleotide
gctgagtggcattgcagccttcctacttg

SEQ ID NO: 82599 - DNA, 29 bp, Artificial Sequence
  Description of Artificial Sequence: Synthetic oligonucleotide
ctgagtggcattgcagccttcctacttgg

SEQ ID NO: 82600 - DNA, 29 bp, Artificial Sequence
  Description of Artificial Sequence: Synthetic oligonucleotide
tgagtggcattgcagccttcctacttggg

SEQ ID NO: 82601 - DNA, 28 bp, Artificial Sequence
  Description of Artificial Sequence: Synthetic oligonucleotide
gagtggcattgcagccttcctacttggg

SEQ ID NO: 82602 - DNA, 28 bp, Artificial Sequence
  Description of Artificial Sequence: Synthetic oligonucleotide
agtggcattgcagccttcctacttgggc

SEQ ID NO: 82603 - DNA, 27 bp, Artificial Sequence
  Description of Artificial Sequence: Synthetic oligonucleotide
gtggcattgcagccttcctacttgggc

SEQ ID NO: 82604 - DNA, 31 bp, Artificial Sequence
  Description of Artificial Sequence: Synthetic oligonucleotide
tggcattgcagccttcctacttgggctaatc

SEQ ID NO: 82605 - DNA, 30 bp, Artificial Sequence
  Description of Artificial Sequence: Synthetic oligonucleotide
ggcattgcagccttcctacttgggctaatc

SEQ ID NO: 82606 - DNA, 32 bp, Artificial Sequence
  Description of Artificial Sequence: Synthetic oligonucleotide
gcattgcagccttcctacttgggctaatcttc

SEQ ID NO: 82607 - DNA, 32 bp, Artificial Sequence
  Description of Artificial Sequence: Synthetic oligonucleotide
cattgcagccttcctacttgggctaatcttcc

SEQ ID NO: 82608 - DNA, 34 bp, Artificial Sequence
  Description of Artificial Sequence: Synthetic oligonucleotide
attgcagccttcctacttgggctaatcttccttc

SEQ ID NO: 82609 - DNA, 33 bp, Artificial Sequence
  Description of Artificial Sequence: Synthetic oligonucleotide
ttgcagccttcctacttgggctaatcttccttc

SEQ ID NO: 82610 - DNA, 32 bp, Artificial Sequence
  Description of Artificial Sequence: Synthetic oligonucleotide
tgcagccttcctacttgggctaatcttccttc

SEQ ID NO: 82611 - DNA, 31 bp, Artificial Sequence
  Description of Artificial Sequence: Synthetic oligonucleotide
gcagccttcctacttgggctaatcttccttc

SEQ ID NO: 82612 - DNA, 32 bp, Artificial Sequence
  Description of Artificial Sequence: Synthetic oligonucleotide
cagccttcctacttgggctaatcttccttctg

SEQ ID NO: 82613 - DNA, 32 bp, Artificial Sequence
  Description of Artificial Sequence: Synthetic oligonucleotide
agccttcctacttgggctaatcttccttctgg

SEQ ID NO: 82614 - DNA, 31 bp, Artificial Sequence
  Description of Artificial Sequence: Synthetic oligonucleotide
gccttcctacttgggctaatcttccttctgg

SEQ ID NO: 82615 - DNA, 32 bp, Artificial Sequence
  Description of Artificial Sequence: Synthetic oligonucleotide
ccttcctacttgggctaatcttccttctggtg

SEQ ID NO: 82616 - DNA, 32 bp, Artificial Sequence
  Description of Artificial Sequence: Synthetic oligonucleotide
cttcctacttgggctaatcttccttctggtgg

SEQ ID NO: 82617 - DNA, 32 bp, Artificial Sequence
  Description of Artificial Sequence: Synthetic oligonucleotide
ttcctacttgggctaatcttccttctggtggg

SEQ ID NO: 82618 - DNA, 31 bp, Artificial Sequence
  Description of Artificial Sequence: Synthetic oligonucleotide
tcctacttgggctaatcttccttctggtggg

SEQ ID NO: 82619 - DNA, 30 bp, Artificial Sequence
  Description of Artificial Sequence: Synthetic oligonucleotide
cctacttgggctaatcttccttctggtggg

SEQ ID NO: 82620 - DNA, 33 bp, Artificial Sequence
  Description of Artificial Sequence: Synthetic oligonucleotide
ctacttgggctaatcttccttctggtgggaatc

SEQ ID NO: 82621 - DNA, 33 bp, Artificial Sequence
  Description of Artificial Sequence: Synthetic oligonucleotide
tacttgggctaatcttccttctggtgggaatcg

SEQ ID NO: 82622 - DNA, 32 bp, Artificial Sequence
  Description of Artificial Sequence: Synthetic oligonucleotide
acttgggctaatcttccttctggtgggaatcg

SEQ ID NO: 82623 - DNA, 31 bp, Artificial Sequence
  Description of Artificial Sequence: Synthetic oligonucleotide
cttgggctaatcttccttctggtgggaatcg

SEQ ID NO: 82624 - DNA, 32 bp, Artificial Sequence
  Description of Artificial Sequence: Synthetic oligonucleotide
ttgggctaatcttccttctggtgggaatcgtc

SEQ ID NO: 82625 - DNA, 31 bp, Artificial Sequence
  Description of Artificial Sequence: Synthetic oligonucleotide
tgggctaatcttccttctggtgggaatcgtc

SEQ ID NO: 82626 - DNA, 30 bp, Artificial Sequence
  Description of Artificial Sequence: Synthetic oligonucleotide
gggctaatcttccttctggtgggaatcgtc

SEQ ID NO: 82627 - DNA, 32 bp, Artificial Sequence
  Description of Artificial Sequence: Synthetic oligonucleotide
ggctaatcttccttctggtgggaatcgtcatc

SEQ ID NO: 82628 - DNA, 32 bp, Artificial Sequence
  Description of Artificial Sequence: Synthetic oligonucleotide
gctaatcttccttctggtgggaatcgtcatcc

SEQ ID NO: 82629 - DNA, 33 bp, Artificial Sequence
  Description of Artificial Sequence: Synthetic oligonucleotide
ctaatcttccttctggtgggaatcgtcatccag

SEQ ID NO: 82630 - DNA, 33 bp, Artificial Sequence
  Description of Artificial Sequence: Synthetic oligonucleotide
taatcttccttctggtgggaatcgtcatccagc

SEQ ID NO: 82631 - DNA, 32 bp, Artificial Sequence
  Description of Artificial Sequence: Synthetic oligonucleotide
aatcttccttctggtgggaatcgtcatccagc

SEQ ID NO: 82632 - DNA, 31 bp, Artificial Sequence
  Description of Artificial Sequence: Synthetic oligonucleotide
atcttccttctggtgggaatcgtcatccagc

SEQ ID NO: 82633 - DNA, 30 bp, Artificial Sequence
  Description of Artificial Sequence: Synthetic oligonucleotide
tcttccttctggtgggaatcgtcatccagc

SEQ ID NO: 82634 - DNA, 29 bp, Artificial Sequence
  Description of Artificial Sequence: Synthetic oligonucleotide
cttccttctggtgggaatcgtcatccagc

SEQ ID NO: 82635 - DNA, 32 bp, Artificial Sequence
  Description of Artificial Sequence: Synthetic oligonucleotide
ttccttctggtgggaatcgtcatccagctaag

SEQ ID NO: 82636 - DNA, 31 bp, Artificial Sequence
  Description of Artificial Sequence: Synthetic oligonucleotide
tccttctggtgggaatcgtcatccagctaag

SEQ ID NO: 82637 - DNA, 30 bp, Artificial Sequence
  Description of Artificial Sequence: Synthetic oligonucleotide
ccttctggtgggaatcgtcatccagctaag

SEQ ID NO: 82638 - DNA, 30 bp, Artificial Sequence
  Description of Artificial Sequence: Synthetic oligonucleotide
cttctggtgggaatcgtcatccagctaagg

SEQ ID NO: 82639 - DNA, 30 bp, Artificial Sequence
  Description of Artificial Sequence: Synthetic oligonucleotide
ttctggtgggaatcgtcatccagctaaggg

SEQ ID NO: 82640 - DNA, 29 bp, Artificial Sequence
  Description of Artificial Sequence: Synthetic oligonucleotide
tctggtgggaatcgtcatccagctaaggg

SEQ ID NO: 82641 - DNA, 28 bp, Artificial Sequence
  Description of Artificial Sequence: Synthetic oligonucleotide
ctggtgggaatcgtcatccagctaaggg

SEQ ID NO: 82642 - DNA, 28 bp, Artificial Sequence
  Description of Artificial Sequence: Synthetic oligonucleotide
tggtgggaatcgtcatccagctaagggc

SEQ ID NO: 82643 - DNA, 27 bp, Artificial Sequence
  Description of Artificial Sequence: Synthetic oligonucleotide
ggtgggaatcgtcatccagctaagggc

SEQ ID NO: 82644 - DNA, 28 bp, Artificial Sequence
  Description of Artificial Sequence: Synthetic oligonucleotide
gtgggaatcgtcatccagctaagggctc

SEQ ID NO: 82645 - DNA, 29 bp, Artificial Sequence
  Description of Artificial Sequence: Synthetic oligonucleotide
tgggaatcgtcatccagctaagggctcag

SEQ ID NO: 82646 - DNA, 28 bp, Artificial Sequence
  Description of Artificial Sequence: Synthetic oligonucleotide
gggaatcgtcatccagctaagggctcag

SEQ ID NO: 82647 - DNA, 31 bp, Artificial Sequence
  Description of Artificial Sequence: Synthetic oligonucleotide
ggaatcgtcatccagctaagggctcagaaag

SEQ ID NO: 82648 - DNA, 31 bp, Artificial Sequence
  Description of Artificial Sequence: Synthetic oligonucleotide
gaatcgtcatccagctaagggctcagaaagg

SEQ ID NO: 82649 - DNA, 35 bp, Artificial Sequence
  Description of Artificial Sequence: Synthetic oligonucleotide
aatcgtcatccagctaagggctcagaaaggatatg

SEQ ID NO: 82650 - DNA, 34 bp, Artificial Sequence
  Description of Artificial Sequence: Synthetic oligonucleotide
atcgtcatccagctaagggctcagaaaggatatg

SEQ ID NO: 82651 - DNA, 33 bp, Artificial Sequence
  Description of Artificial Sequence: Synthetic oligonucleotide
tcgtcatccagctaagggctcagaaaggatatg

SEQ ID NO: 82652 - DNA, 32 bp, Artificial Sequence
  Description of Artificial Sequence: Synthetic oligonucleotide
cgtcatccagctaagggctcagaaaggatatg

SEQ ID NO: 82653 - DNA, 33 bp, Artificial Sequence
  Description of Artificial Sequence: Synthetic oligonucleotide
gtcatccagctaagggctcagaaaggatatgtg

SEQ ID NO: 82654 - DNA, 34 bp, Artificial Sequence
  Description of Artificial Sequence: Synthetic oligonucleotide
tcatccagctaagggctcagaaaggatatgtgag

SEQ ID NO: 82655 - DNA, 33 bp, Artificial Sequence
  Description of Artificial Sequence: Synthetic oligonucleotide
catccagctaagggctcagaaaggatatgtgag

SEQ ID NO: 82656 - DNA, 33 bp, Artificial Sequence
  Description of Artificial Sequence: Synthetic oligonucleotide
atccagctaagggctcagaaaggatatgtgagg

SEQ ID NO: 82657 - DNA, 32 bp, Artificial Sequence
  Description of Artificial Sequence: Synthetic oligonucleotide
tccagctaagggctcagaaaggatatgtgagg

SEQ ID NO: 82658 - DNA, 31 bp, Artificial Sequence
  Description of Artificial Sequence: Synthetic oligonucleotide
ccagctaagggctcagaaaggatatgtgagg

SEQ ID NO: 82659 - DNA, 32 bp, Artificial Sequence
  Description of Artificial Sequence: Synthetic oligonucleotide
cagctaagggctcagaaaggatatgtgaggac

SEQ ID NO: 82660 - DNA, 32 bp, Artificial Sequence
  Description of Artificial Sequence: Synthetic oligonucleotide
agctaagggctcagaaaggatatgtgaggacg

SEQ ID NO: 82661 - DNA, 31 bp, Artificial Sequence
  Description of Artificial Sequence: Synthetic oligonucleotide
gctaagggctcagaaaggatatgtgaggacg

SEQ ID NO: 82662 - DNA, 31 bp, Artificial Sequence
  Description of Artificial Sequence: Synthetic oligonucleotide
ctaagggctcagaaaggatatgtgaggacgc

SEQ ID NO: 82663 - DNA, 32 bp, Artificial Sequence
  Description of Artificial Sequence: Synthetic oligonucleotide
taagggctcagaaaggatatgtgaggacgcag

SEQ ID NO: 82664 - DNA, 31 bp, Artificial Sequence
  Description of Artificial Sequence: Synthetic oligonucleotide
aagggctcagaaaggatatgtgaggacgcag

SEQ ID NO: 82665 - DNA, 30 bp, Artificial Sequence
  Description of Artificial Sequence: Synthetic oligonucleotide
agggctcagaaaggatatgtgaggacgcag

SEQ ID NO: 82666 - DNA, 29 bp, Artificial Sequence
  Description of Artificial Sequence: Synthetic oligonucleotide
gggctcagaaaggatatgtgaggacgcag

SEQ ID NO: 82667 - DNA, 31 bp, Artificial Sequence
  Description of Artificial Sequence: Synthetic oligonucleotide
ggctcagaaaggatatgtgaggacgcagatg

SEQ ID NO: 82668 - DNA, 32 bp, Artificial Sequence
  Description of Artificial Sequence: Synthetic oligonucleotide
gctcagaaaggatatgtgaggacgcagatgtc

SEQ ID NO: 82669 - DNA, 33 bp, Artificial Sequence
  Description of Artificial Sequence: Synthetic oligonucleotide
ctcagaaaggatatgtgaggacgcagatgtctg

SEQ ID NO: 82670 - DNA, 33 bp, Artificial Sequence
  Description of Artificial Sequence: Synthetic oligonucleotide
tcagaaaggatatgtgaggacgcagatgtctgg

SEQ ID NO: 82671 - DNA, 32 bp, Artificial Sequence
  Description of Artificial Sequence: Synthetic oligonucleotide
cagaaaggatatgtgaggacgcagatgtctgg

SEQ ID NO: 82672 - DNA, 36 bp, Artificial Sequence
  Description of Artificial Sequence: Synthetic oligonucleotide
agaaaggatatgtgaggacgcagatgtctggtaatg

SEQ ID NO: 82673 - DNA, 35 bp, Artificial Sequence
  Description of Artificial Sequence: Synthetic oligonucleotide
gaaaggatatgtgaggacgcagatgtctggtaatg

SEQ ID NO: 82674 - DNA, 36 bp, Artificial Sequence
  Description of Artificial Sequence: Synthetic oligonucleotide
aaaggatatgtgaggacgcagatgtctggtaatgag

SEQ ID NO: 82675 - DNA, 35 bp, Artificial Sequence
  Description of Artificial Sequence: Synthetic oligonucleotide
aaggatatgtgaggacgcagatgtctggtaatgag

SEQ ID NO: 82676 - DNA, 34 bp, Artificial Sequence
  Description of Artificial Sequence: Synthetic oligonucleotide
aggatatgtgaggacgcagatgtctggtaatgag

SEQ ID NO: 82677 - DNA, 33 bp, Artificial Sequence
  Description of Artificial Sequence: Synthetic oligonucleotide
ggatatgtgaggacgcagatgtctggtaatgag

SEQ ID NO: 82678 - DNA, 33 bp, Artificial Sequence
  Description of Artificial Sequence: Synthetic oligonucleotide
gatatgtgaggacgcagatgtctggtaatgagg

SEQ ID NO: 82679 - DNA, 34 bp, Artificial Sequence
  Description of Artificial Sequence: Synthetic oligonucleotide
atatgtgaggacgcagatgtctggtaatgaggtc

SEQ ID NO: 82680 - DNA, 33 bp, Artificial Sequence
  Description of Artificial Sequence: Synthetic oligonucleotide
tatgtgaggacgcagatgtctggtaatgaggtc

SEQ ID NO: 82681 - DNA, 32 bp, Artificial Sequence
  Description of Artificial Sequence: Synthetic oligonucleotide
atgtgaggacgcagatgtctggtaatgaggtc

SEQ ID NO: 82682 - DNA, 31 bp, Artificial Sequence
  Description of Artificial Sequence: Synthetic oligonucleotide
tgtgaggacgcagatgtctggtaatgaggtc

SEQ ID NO: 82683 - DNA, 30 bp, Artificial Sequence
  Description of Artificial Sequence: Synthetic oligonucleotide
gtgaggacgcagatgtctggtaatgaggtc

SEQ ID NO: 82684 - DNA, 31 bp, Artificial Sequence
  Description of Artificial Sequence: Synthetic oligonucleotide
tgaggacgcagatgtctggtaatgaggtctc

SEQ ID NO: 82685 - DNA, 30 bp, Artificial Sequence
  Description of Artificial Sequence: Synthetic oligonucleotide
gaggacgcagatgtctggtaatgaggtctc

SEQ ID NO: 82686 - DNA, 32 bp, Artificial Sequence
  Description of Artificial Sequence: Synthetic oligonucleotide
aggacgcagatgtctggtaatgaggtctcaag

SEQ ID NO: 82687 - DNA, 31 bp, Artificial Sequence
  Description of Artificial Sequence: Synthetic oligonucleotide
ggacgcagatgtctggtaatgaggtctcaag

SEQ ID NO: 82688 - DNA, 32 bp, Artificial Sequence
  Description of Artificial Sequence: Synthetic oligonucleotide
gacgcagatgtctggtaatgaggtctcaagag

SEQ ID NO: 82689 - DNA, 32 bp, Artificial Sequence
  Description of Artificial Sequence: Synthetic oligonucleotide
acgcagatgtctggtaatgaggtctcaagagc

SEQ ID NO: 82690 - DNA, 31 bp, Artificial Sequence
  Description of Artificial Sequence: Synthetic oligonucleotide
cgcagatgtctggtaatgaggtctcaagagc

SEQ ID NO: 82691 - DNA, 32 bp, Artificial Sequence
  Description of Artificial Sequence: Synthetic oligonucleotide
gcagatgtctggtaatgaggtctcaagagctg

SEQ ID NO: 82692 - DNA, 34 bp, Artificial Sequence
  Description of Artificial Sequence: Synthetic oligonucleotide
cagatgtctggtaatgaggtctcaagagctgttc

SEQ ID NO: 82693 - DNA, 35 bp, Artificial Sequence
  Description of Artificial Sequence: Synthetic oligonucleotide
agatgtctggtaatgaggtctcaagagctgttctg

SEQ ID NO: 82694 - DNA, 34 bp, Artificial Sequence
  Description of Artificial Sequence: Synthetic oligonucleotide
gatgtctggtaatgaggtctcaagagctgttctg

SEQ ID NO: 82695 - DNA, 34 bp, Artificial Sequence
  Description of Artificial Sequence: Synthetic oligonucleotide
atgtctggtaatgaggtctcaagagctgttctgc

SEQ ID NO: 82696 - DNA, 33 bp, Artificial Sequence
  Description of Artificial Sequence: Synthetic oligonucleotide
tgtctggtaatgaggtctcaagagctgttctgc

SEQ ID NO: 82697 - DNA, 32 bp, Artificial Sequence
  Description of Artificial Sequence: Synthetic oligonucleotide
gtctggtaatgaggtctcaagagctgttctgc

SEQ ID NO: 82698 - DNA, 33 bp, Artificial Sequence
  Description of Artificial Sequence: Synthetic oligonucleotide
tctggtaatgaggtctcaagagctgttctgctc

SEQ ID NO: 82699 - DNA, 32 bp, Artificial Sequence
  Description of Artificial Sequence: Synthetic oligonucleotide
ctggtaatgaggtctcaagagctgttctgctc

SEQ ID NO: 82700 - DNA, 32 bp, Artificial Sequence
  Description of Artificial Sequence: Synthetic oligonucleotide
tggtaatgaggtctcaagagctgttctgctcc

SEQ ID NO: 82701 - DNA, 31 bp, Artificial Sequence
  Description of Artificial Sequence: Synthetic oligonucleotide
ggtaatgaggtctcaagagctgttctgctcc

SEQ ID NO: 82702 - DNA, 31 bp, Artificial Sequence
  Description of Artificial Sequence: Synthetic oligonucleotide
gtaatgaggtctcaagagctgttctgctccc

SEQ ID NO: 82703 - DNA, 32 bp, Artificial Sequence
  Description of Artificial Sequence: Synthetic oligonucleotide
taatgaggtctcaagagctgttctgctccctc

SEQ ID NO: 82704 - DNA, 31 bp, Artificial Sequence
  Description of Artificial Sequence: Synthetic oligonucleotide
aatgaggtctcaagagctgttctgctccctc

SEQ ID NO: 82705 - DNA, 30 bp, Artificial Sequence
  Description of Artificial Sequence: Synthetic oligonucleotide
atgaggtctcaagagctgttctgctccctc

SEQ ID NO: 82706 - DNA, 29 bp, Artificial Sequence
  Description of Artificial Sequence: Synthetic oligonucleotide
tgaggtctcaagagctgttctgctccctc

SEQ ID NO: 82707 - DNA, 28 bp, Artificial Sequence
  Description of Artificial Sequence: Synthetic oligonucleotide
gaggtctcaagagctgttctgctccctc

SEQ ID NO: 82708 - DNA, 29 bp, Artificial Sequence
  Description of Artificial Sequence: Synthetic oligonucleotide
aggtctcaagagctgttctgctccctcag

SEQ ID NO: 82709 - DNA, 28 bp, Artificial Sequence
  Description of Artificial Sequence: Synthetic oligonucleotide
ggtctcaagagctgttctgctccctcag

SEQ ID NO: 82710 - DNA, 29 bp, Artificial Sequence
  Description of Artificial Sequence: Synthetic oligonucleotide
gtctcaagagctgttctgctccctcagtc

SEQ ID NO: 82711 - DNA, 31 bp, Artificial Sequence
  Description of Artificial Sequence: Synthetic oligonucleotide
tctcaagagctgttctgctccctcagtcatg

SEQ ID NO: 82712 - DNA, 30 bp, Artificial Sequence
  Description of Artificial Sequence: Synthetic oligonucleotide
ctcaagagctgttctgctccctcagtcatg

SEQ ID NO: 82713 - DNA, 30 bp, Artificial Sequence
  Description of Artificial Sequence: Synthetic oligonucleotide
tcaagagctgttctgctccctcagtcatgc

SEQ ID NO: 82714 - DNA, 29 bp, Artificial Sequence
  Description of Artificial Sequence: Synthetic oligonucleotide
caagagctgttctgctccctcagtcatgc

SEQ ID NO: 82715 - DNA, 32 bp, Artificial Sequence
  Description of Artificial Sequence: Synthetic oligonucleotide
aagagctgttctgctccctcagtcatgctaag

SEQ ID NO: 82716 - DNA, 31 bp, Artificial Sequence
  Description of Artificial Sequence: Synthetic oligonucleotide
agagctgttctgctccctcagtcatgctaag

SEQ ID NO: 82717 - DNA, 30 bp, Artificial Sequence
  Description of Artificial Sequence: Synthetic oligonucleotide
gagctgttctgctccctcagtcatgctaag

SEQ ID NO: 82718 - DNA, 30 bp, Artificial Sequence
  Description of Artificial Sequence: Synthetic oligonucleotide
agctgttctgctccctcagtcatgctaagg

SEQ ID NO: 82719 - DNA, 29 bp, Artificial Sequence
  Description of Artificial Sequence: Synthetic oligonucleotide
gctgttctgctccctcagtcatgctaagg

SEQ ID NO: 82720 - DNA, 30 bp, Artificial Sequence
  Description of Artificial Sequence: Synthetic oligonucleotide
ctgttctgctccctcagtcatgctaaggtc

SEQ ID NO: 82721 - DNA, 30 bp, Artificial Sequence
  Description of Artificial Sequence: Synthetic oligonucleotide
tgttctgctccctcagtcatgctaaggtcc

SEQ ID NO: 82722 - DNA, 29 bp, Artificial Sequence
  Description of Artificial Sequence: Synthetic oligonucleotide
gttctgctccctcagtcatgctaaggtcc

SEQ ID NO: 82723 - DNA, 30 bp, Artificial Sequence
  Description of Artificial Sequence: Synthetic oligonucleotide
ttctgctccctcagtcatgctaaggtcctc

SEQ ID NO: 82724 - DNA, 29 bp, Artificial Sequence
  Description of Artificial Sequence: Synthetic oligonucleotide
tctgctccctcagtcatgctaaggtcctc

SEQ ID NO: 82725 - DNA, 28 bp, Artificial Sequence
  Description of Artificial Sequence: Synthetic oligonucleotide
ctgctccctcagtcatgctaaggtcctc

SEQ ID NO: 82726 - DNA, 29 bp, Artificial Sequence
  Description of Artificial Sequence: Synthetic oligonucleotide
tgctccctcagtcatgctaaggtcctcac

SEQ ID NO: 82727 - DNA, 28 bp, Artificial Sequence
  Description of Artificial Sequence: Synthetic oligonucleotide
gctccctcagtcatgctaaggtcctcac

SEQ ID NO: 82728 - DNA, 29 bp, Artificial Sequence
  Description of Artificial Sequence: Synthetic oligonucleotide
ctccctcagtcatgctaaggtcctcactg

SEQ ID NO: 82729 - DNA, 31 bp, Artificial Sequence
  Description of Artificial Sequence: Synthetic oligonucleotide
tccctcagtcatgctaaggtcctcactgaag

SEQ ID NO: 82730 - DNA, 30 bp, Artificial Sequence
  Description of Artificial Sequence: Synthetic oligonucleotide
ccctcagtcatgctaaggtcctcactgaag

SEQ ID NO: 82731 - DNA, 30 bp, Artificial Sequence
  Description of Artificial Sequence: Synthetic oligonucleotide
cctcagtcatgctaaggtcctcactgaagc

SEQ ID NO: 82732 - DNA, 32 bp, Artificial Sequence
  Description of Artificial Sequence: Synthetic oligonucleotide
ctcagtcatgctaaggtcctcactgaagcttc

SEQ ID NO: 82733 - DNA, 33 bp, Artificial Sequence
  Description of Artificial Sequence: Synthetic oligonucleotide
tcagtcatgctaaggtcctcactgaagcttctc

SEQ ID NO: 82734 - DNA, 32 bp, Artificial Sequence
  Description of Artificial Sequence: Synthetic oligonucleotide
cagtcatgctaaggtcctcactgaagcttctc

SEQ ID NO: 82735 - DNA, 33 bp, Artificial Sequence
  Description of Artificial Sequence: Synthetic oligonucleotide
agtcatgctaaggtcctcactgaagcttctctc

SEQ ID NO: 82736 - DNA, 32 bp, Artificial Sequence
  Description of Artificial Sequence: Synthetic oligonucleotide
gtcatgctaaggtcctcactgaagcttctctc

SEQ ID NO: 82737 - DNA, 33 bp, Artificial Sequence
  Description of Artificial Sequence: Synthetic oligonucleotide
tcatgctaaggtcctcactgaagcttctctctc

SEQ ID NO: 82738 - DNA, 32 bp, Artificial Sequence
  Description of Artificial Sequence: Synthetic oligonucleotide
catgctaaggtcctcactgaagcttctctctc

SEQ ID NO: 82739 - DNA, 33 bp, Artificial Sequence
  Description of Artificial Sequence: Synthetic oligonucleotide
atgctaaggtcctcactgaagcttctctctctg

SEQ ID NO: 82740 - DNA, 32 bp, Artificial Sequence
  Description of Artificial Sequence: Synthetic oligonucleotide
tgctaaggtcctcactgaagcttctctctctg

SEQ ID NO: 82741 - DNA, 31 bp, Artificial Sequence
  Description of Artificial Sequence: Synthetic oligonucleotide
gctaaggtcctcactgaagcttctctctctg

SEQ ID NO: 82742 - DNA, 31 bp, Artificial Sequence
  Description of Artificial Sequence: Synthetic oligonucleotide
ctaaggtcctcactgaagcttctctctctgg

SEQ ID NO: 82743 - DNA, 32 bp, Artificial Sequence
  Description of Artificial Sequence: Synthetic oligonucleotide
taaggtcctcactgaagcttctctctctggag

SEQ ID NO: 82744 - DNA, 31 bp, Artificial Sequence
  Description of Artificial Sequence: Synthetic oligonucleotide
aaggtcctcactgaagcttctctctctggag

SEQ ID NO: 82745 - DNA, 30 bp, Artificial Sequence
  Description of Artificial Sequence: Synthetic oligonucleotide
aggtcctcactgaagcttctctctctggag

SEQ ID NO: 82746 - DNA, 29 bp, Artificial Sequence
  Description of Artificial Sequence: Synthetic oligonucleotide
ggtcctcactgaagcttctctctctggag

SEQ ID NO: 82747 - DNA, 29 bp, Artificial Sequence
  Description of Artificial Sequence: Synthetic oligonucleotide
gtcctcactgaagcttctctctctggagc

SEQ ID NO: 82748 - DNA, 29 bp, Artificial Sequence
  Description of Artificial Sequence: Synthetic oligonucleotide
tcctcactgaagcttctctctctggagcc

SEQ ID NO: 82749 - DNA, 28 bp, Artificial Sequence
  Description of Artificial Sequence: Synthetic oligonucleotide
cctcactgaagcttctctctctggagcc

SEQ ID NO: 82750 - DNA, 29 bp, Artificial Sequence
  Description of Artificial Sequence: Synthetic oligonucleotide
ctcactgaagcttctctctctggagcctg

SEQ ID NO: 82751 - DNA, 31 bp, Artificial Sequence
  Description of Artificial Sequence: Synthetic oligonucleotide
tcactgaagcttctctctctggagcctgaag

SEQ ID NO: 82752 - DNA, 30 bp, Artificial Sequence
  Description of Artificial Sequence: Synthetic oligonucleotide
cactgaagcttctctctctggagcctgaag

SEQ ID NO: 82753 - DNA, 32 bp, Artificial Sequence
  Description of Artificial Sequence: Synthetic oligonucleotide
actgaagcttctctctctggagcctgaagtag

SEQ ID NO: 82754 - DNA, 31 bp, Artificial Sequence
  Description of Artificial Sequence: Synthetic oligonucleotide
ctgaagcttctctctctggagcctgaagtag

SEQ ID NO: 82755 - DNA, 32 bp, Artificial Sequence
  Description of Artificial Sequence: Synthetic oligonucleotide
tgaagcttctctctctggagcctgaagtagtg

SEQ ID NO: 82756 - DNA, 31 bp, Artificial Sequence
  Description of Artificial Sequence: Synthetic oligonucleotide
gaagcttctctctctggagcctgaagtagtg

SEQ ID NO: 82757 - DNA, 33 bp, Artificial Sequence
  Description of Artificial Sequence: Synthetic oligonucleotide
aagcttctctctctggagcctgaagtagtgatg

SEQ ID NO: 82758 - DNA, 32 bp, Artificial Sequence
  Description of Artificial Sequence: Synthetic oligonucleotide
agcttctctctctggagcctgaagtagtgatg

SEQ ID NO: 82759 - DNA, 31 bp, Artificial Sequence
  Description of Artificial Sequence: Synthetic oligonucleotide
gcttctctctctggagcctgaagtagtgatg

SEQ ID NO: 82760 - DNA, 32 bp, Artificial Sequence
  Description of Artificial Sequence: Synthetic oligonucleotide
cttctctctctggagcctgaagtagtgatgag

SEQ ID NO: 82761 - DNA, 34 bp, Artificial Sequence
  Description of Artificial Sequence: Synthetic oligonucleotide
ttctctctctggagcctgaagtagtgatgagtag

SEQ ID NO: 82762 - DNA, 33 bp, Artificial Sequence
  Description of Artificial Sequence: Synthetic oligonucleotide
tctctctctggagcctgaagtagtgatgagtag

SEQ ID NO: 82763 - DNA, 32 bp, Artificial Sequence
  Description of Artificial Sequence: Synthetic oligonucleotide
ctctctctggagcctgaagtagtgatgagtag

SEQ ID NO: 82764 - DNA, 33 bp, Artificial Sequence
  Description of Artificial Sequence: Synthetic oligonucleotide
tctctctggagcctgaagtagtgatgagtagtc

SEQ ID NO: 82765 - DNA, 32 bp, Artificial Sequence
  Description of Artificial Sequence: Synthetic oligonucleotide
ctctctggagcctgaagtagtgatgagtagtc

SEQ ID NO: 82766 - DNA, 33 bp, Artificial Sequence
  Description of Artificial Sequence: Synthetic oligonucleotide
tctctggagcctgaagtagtgatgagtagtctg

SEQ ID NO: 82767 - DNA, 32 bp, Artificial Sequence
  Description of Artificial Sequence: Synthetic oligonucleotide
ctctggagcctgaagtagtgatgagtagtctg

SEQ ID NO: 82768 - DNA, 32 bp, Artificial Sequence
  Description of Artificial Sequence: Synthetic oligonucleotide
tctggagcctgaagtagtgatgagtagtctgg

SEQ ID NO: 82769 - DNA, 31 bp, Artificial Sequence
  Description of Artificial Sequence: Synthetic oligonucleotide
ctggagcctgaagtagtgatgagtagtctgg

SEQ ID NO: 82770 - DNA, 31 bp, Artificial Sequence
  Description of Artificial Sequence: Synthetic oligonucleotide
tggagcctgaagtagtgatgagtagtctggg

SEQ ID NO: 82771 - DNA, 30 bp, Artificial Sequence
  Description of Artificial Sequence: Synthetic oligonucleotide
ggagcctgaagtagtgatgagtagtctggg

SEQ ID NO: 82772 - DNA, 30 bp, Artificial Sequence
  Description of Artificial Sequence: Synthetic oligonucleotide
gagcctgaagtagtgatgagtagtctgggc

SEQ ID NO: 82773 - DNA, 30 bp, Artificial Sequence
  Description of Artificial Sequence: Synthetic oligonucleotide
agcctgaagtagtgatgagtagtctgggcc

SEQ ID NO: 82774 - DNA, 29 bp, Artificial Sequence
  Description of Artificial Sequence: Synthetic oligonucleotide
gcctgaagtagtgatgagtagtctgggcc

SEQ ID NO: 82775 - DNA, 29 bp, Artificial Sequence
  Description of Artificial Sequence: Synthetic oligonucleotide
cctgaagtagtgatgagtagtctgggccc

SEQ ID NO: 82776 - DNA, 30 bp, Artificial Sequence
  Description of Artificial Sequence: Synthetic oligonucleotide
ctgaagtagtgatgagtagtctgggccctg

SEQ ID NO: 82777 - DNA, 30 bp, Artificial Sequence
  Description of Artificial Sequence: Synthetic oligonucleotide
tgaagtagtgatgagtagtctgggccctgg

SEQ ID NO: 82778 - DNA, 29 bp, Artificial Sequence
  Description of Artificial Sequence: Synthetic oligonucleotide
gaagtagtgatgagtagtctgggccctgg

SEQ ID NO: 82779 - DNA, 29 bp, Artificial Sequence
  Description of Artificial Sequence: Synthetic oligonucleotide
aagtagtgatgagtagtctgggccctggg

SEQ ID NO: 82780 - DNA, 28 bp, Artificial Sequence
  Description of Artificial Sequence: Synthetic oligonucleotide
agtagtgatgagtagtctgggccctggg

SEQ ID NO: 82781 - DNA, 27 bp, Artificial Sequence
  Description of Artificial Sequence: Synthetic oligonucleotide
gtagtgatgagtagtctgggccctggg

SEQ ID NO: 82782 - DNA, 28 bp, Artificial Sequence
  Description of Artificial Sequence: Synthetic oligonucleotide
tagtgatgagtagtctgggccctgggtg

SEQ ID NO: 82783 - DNA, 27 bp, Artificial Sequence
  Description of Artificial Sequence: Synthetic oligonucleotide
agtgatgagtagtctgggccctgggtg

SEQ ID NO: 82784 - DNA, 27 bp, Artificial Sequence
  Description of Artificial Sequence: Synthetic oligonucleotide
gtgatgagtagtctgggccctgggtga

SEQ ID NO: 82785 - DNA, 27 bp, Artificial Sequence
  Description of Artificial Sequence: Synthetic oligonucleotide
tgatgagtagtctgggccctgggtgag

SEQ ID NO: 82786 - DNA, 26 bp, Artificial Sequence
  Description of Artificial Sequence: Synthetic oligonucleotide
gatgagtagtctgggccctgggtgag

SEQ ID NO: 82787 - DNA, 27 bp, Artificial Sequence
  Description of Artificial Sequence: Synthetic oligonucleotide
atgagtagtctgggccctgggtgaggt

SEQ ID NO: 82788 - DNA, 27 bp, Artificial Sequence
  Description of Artificial Sequence: Synthetic oligonucleotide
tgagtagtctgggccctgggtgaggta

SEQ ID NO: 82789 - DNA, 27 bp, Artificial Sequence
  Description of Artificial Sequence: Synthetic oligonucleotide
gagtagtctgggccctgggtgaggtaa

SEQ ID NO: 82790 - DNA, 28 bp, Artificial Sequence
  Description of Artificial Sequence: Synthetic oligonucleotide
agtagtctgggccctgggtgaggtaaag

SEQ ID NO: 82791 - DNA, 27 bp, Artificial Sequence
  Description of Artificial Sequence: Synthetic oligonucleotide
gtagtctgggccctgggtgaggtaaag

SEQ ID NO: 82792 - DNA, 27 bp, Artificial Sequence
  Description of Artificial Sequence: Synthetic oligonucleotide
tagtctgggccctgggtgaggtaaagg

SEQ ID NO: 82793 - DNA, 27 bp, Artificial Sequence
  Description of Artificial Sequence: Synthetic oligonucleotide
agtctgggccctgggtgaggtaaagga

SEQ ID NO: 82794 - DNA, 26 bp, Artificial Sequence
  Description of Artificial Sequence: Synthetic oligonucleotide
gtctgggccctgggtgaggtaaagga

SEQ ID NO: 82795 - DNA, 27 bp, Artificial Sequence
  Description of Artificial Sequence: Synthetic oligonucleotide
tctgggccctgggtgaggtaaaggaca

SEQ ID NO: 82796 - DNA, 27 bp, Artificial Sequence
  Description of Artificial Sequence: Synthetic oligonucleotide
ctgggccctgggtgaggtaaaggacat

SEQ ID NO: 82797 - DNA, 28 bp, Artificial Sequence
  Description of Artificial Sequence: Synthetic oligonucleotide
tgggccctgggtgaggtaaaggacattc

SEQ ID NO: 82798 - DNA, 27 bp, Artificial Sequence
  Description of Artificial Sequence: Synthetic oligonucleotide
gggccctgggtgaggtaaaggacattc

SEQ ID NO: 82799 - DNA, 29 bp, Artificial Sequence
  Description of Artificial Sequence: Synthetic oligonucleotide
ggccctgggtgaggtaaaggacattcatg

SEQ ID NO: 82800 - DNA, 30 bp, Artificial Sequence
  Description of Artificial Sequence: Synthetic oligonucleotide
gccctgggtgaggtaaaggacattcatgag

SEQ ID NO: 82801 - DNA, 30 bp, Artificial Sequence
  Description of Artificial Sequence: Synthetic oligonucleotide
ccctgggtgaggtaaaggacattcatgagg

SEQ ID NO: 82802 - DNA, 31 bp, Artificial Sequence
  Description of Artificial Sequence: Synthetic oligonucleotide
cctgggtgaggtaaaggacattcatgaggtc

SEQ ID NO: 82803 - DNA, 34 bp, Artificial Sequence
  Description of Artificial Sequence: Synthetic oligonucleotide
ctgggtgaggtaaaggacattcatgaggtcaatg

SEQ ID NO: 82804 - DNA, 36 bp, Artificial Sequence
  Description of Artificial Sequence: Synthetic oligonucleotide
tgggtgaggtaaaggacattcatgaggtcaatgttc

SEQ ID NO: 82805 - DNA, 35 bp, Artificial Sequence
  Description of Artificial Sequence: Synthetic oligonucleotide
gggtgaggtaaaggacattcatgaggtcaatgttc

SEQ ID NO: 82806 - DNA, 36 bp, Artificial Sequence
  Description of Artificial Sequence: Synthetic oligonucleotide
ggtgaggtaaaggacattcatgaggtcaatgttctg

SEQ ID NO: 82807 - DNA, 36 bp, Artificial Sequence
  Description of Artificial Sequence: Synthetic oligonucleotide
gtgaggtaaaggacattcatgaggtcaatgttctgg

SEQ ID NO: 82808 - DNA, 36 bp, Artificial Sequence
  Description of Artificial Sequence: Synthetic oligonucleotide
tgaggtaaaggacattcatgaggtcaatgttctggg

SEQ ID NO: 82809 - DNA, 35 bp, Artificial Sequence
  Description of Artificial Sequence: Synthetic oligonucleotide
gaggtaaaggacattcatgaggtcaatgttctggg

SEQ ID NO: 82810 - DNA, 40 bp, Artificial Sequence
  Description of Artificial Sequence: Synthetic oligonucleotide
aggtaaaggacattcatgaggtcaatgttctgggaataac

SEQ ID NO: 82811 - DNA, 39 bp, Artificial Sequence
  Description of Artificial Sequence: Synthetic oligonucleotide
ggtaaaggacattcatgaggtcaatgttctgggaataac

SEQ ID NO: 82812 - DNA, 40 bp, Artificial Sequence
  Description of Artificial Sequence: Synthetic oligonucleotide
gtaaaggacattcatgaggtcaatgttctgggaataactc

SEQ ID NO: 82813 - DNA, 41 bp, Artificial Sequence
  Description of Artificial Sequence: Synthetic oligonucleotide
taaaggacattcatgaggtcaatgttctgggaataactctc

SEQ ID NO: 82814 - DNA, 40 bp, Artificial Sequence
  Description of Artificial Sequence: Synthetic oligonucleotide
aaaggacattcatgaggtcaatgttctgggaataactctc

SEQ ID NO: 82815 - DNA, 39 bp, Artificial Sequence
  Description of Artificial Sequence: Synthetic oligonucleotide
aaggacattcatgaggtcaatgttctgggaataactctc

SEQ ID NO: 82816 - DNA, 38 bp, Artificial Sequence
  Description of Artificial Sequence: Synthetic oligonucleotide
aggacattcatgaggtcaatgttctgggaataactctc

SEQ ID NO: 82817 - DNA, 37 bp, Artificial Sequence
  Description of Artificial Sequence: Synthetic oligonucleotide
ggacattcatgaggtcaatgttctgggaataactctc

SEQ ID NO: 82818 - DNA, 39 bp, Artificial Sequence
  Description of Artificial Sequence: Synthetic oligonucleotide
gacattcatgaggtcaatgttctgggaataactctcttc

SEQ ID NO: 82819 - DNA, 39 bp, Artificial Sequence
  Description of Artificial Sequence: Synthetic oligonucleotide
acattcatgaggtcaatgttctgggaataactctcttcc

SEQ ID NO: 82820 - DNA, 38 bp, Artificial Sequence
  Description of Artificial Sequence: Synthetic oligonucleotide
cattcatgaggtcaatgttctgggaataactctcttcc

SEQ ID NO: 82821 - DNA, 38 bp, Artificial Sequence
  Description of Artificial Sequence: Synthetic oligonucleotide
attcatgaggtcaatgttctgggaataactctcttccc

SEQ ID NO: 82822 - DNA, 37 bp, Artificial Sequence
  Description of Artificial Sequence: Synthetic oligonucleotide
ttcatgaggtcaatgttctgggaataactctcttccc

SEQ ID NO: 82823 - DNA, 36 bp, Artificial Sequence
  Description of Artificial Sequence: Synthetic oligonucleotide
tcatgaggtcaatgttctgggaataactctcttccc

SEQ ID NO: 82824 - DNA, 35 bp, Artificial Sequence
  Description of Artificial Sequence: Synthetic oligonucleotide
catgaggtcaatgttctgggaataactctcttccc

SEQ ID NO: 82825 - DNA, 36 bp, Artificial Sequence
  Description of Artificial Sequence: Synthetic oligonucleotide
atgaggtcaatgttctgggaataactctcttccctg

SEQ ID NO: 82826 - DNA, 35 bp, Artificial Sequence
  Description of Artificial Sequence: Synthetic oligonucleotide
tgaggtcaatgttctgggaataactctcttccctg

SEQ ID NO: 82827 - DNA, 34 bp, Artificial Sequence
  Description of Artificial Sequence: Synthetic oligonucleotide
gaggtcaatgttctgggaataactctcttccctg

SEQ ID NO: 82828 - DNA, 36 bp, Artificial Sequence
  Description of Artificial Sequence: Synthetic oligonucleotide
aggtcaatgttctgggaataactctcttccctgatc

SEQ ID NO: 82829 - DNA, 35 bp, Artificial Sequence
  Description of Artificial Sequence: Synthetic oligonucleotide
ggtcaatgttctgggaataactctcttccctgatc

SEQ ID NO: 82830 - DNA, 35 bp, Artificial Sequence
  Description of Artificial Sequence: Synthetic oligonucleotide
gtcaatgttctgggaataactctcttccctgatcc

SEQ ID NO: 82831 - DNA, 37 bp, Artificial Sequence
  Description of Artificial Sequence: Synthetic oligonucleotide
tcaatgttctgggaataactctcttccctgatccttg

SEQ ID NO: 82832 - DNA, 36 bp, Artificial Sequence
  Description of Artificial Sequence: Synthetic oligonucleotide
caatgttctgggaataactctcttccctgatccttg

SEQ ID NO: 82833 - DNA, 36 bp, Artificial Sequence
  Description of Artificial Sequence: Synthetic oligonucleotide
aatgttctgggaataactctcttccctgatccttgg

SEQ ID NO: 82834 - DNA, 35 bp, Artificial Sequence
  Description of Artificial Sequence: Synthetic oligonucleotide
atgttctgggaataactctcttccctgatccttgg

SEQ ID NO: 82835 - DNA, 34 bp, Artificial Sequence
  Description of Artificial Sequence: Synthetic oligonucleotide
tgttctgggaataactctcttccctgatccttgg

SEQ ID NO: 82836 - DNA, 33 bp, Artificial Sequence
  Description of Artificial Sequence: Synthetic oligonucleotide
gttctgggaataactctcttccctgatccttgg

SEQ ID NO: 82837 - DNA, 34 bp, Artificial Sequence
  Description of Artificial Sequence: Synthetic oligonucleotide
ttctgggaataactctcttccctgatccttggag

SEQ ID NO: 82838 - DNA, 33 bp, Artificial Sequence
  Description of Artificial Sequence: Synthetic oligonucleotide
tctgggaataactctcttccctgatccttggag

SEQ ID NO: 82839 - DNA, 32 bp, Artificial Sequence
  Description of Artificial Sequence: Synthetic oligonucleotide
ctgggaataactctcttccctgatccttggag

SEQ ID NO: 82840 - DNA, 32 bp, Artificial Sequence
  Description of Artificial Sequence: Synthetic oligonucleotide
tgggaataactctcttccctgatccttggagg

SEQ ID NO: 82841 - DNA, 31 bp, Artificial Sequence
  Description of Artificial Sequence: Synthetic oligonucleotide
gggaataactctcttccctgatccttggagg

SEQ ID NO: 82842 - DNA, 32 bp, Artificial Sequence
  Description of Artificial Sequence: Synthetic oligonucleotide
ggaataactctcttccctgatccttggaggag

SEQ ID NO: 82843 - DNA, 32 bp, Artificial Sequence
  Description of Artificial Sequence: Synthetic oligonucleotide
gaataactctcttccctgatccttggaggagc

SEQ ID NO: 82844 - DNA, 32 bp, Artificial Sequence
  Description of Artificial Sequence: Synthetic oligonucleotide
aataactctcttccctgatccttggaggagcc

SEQ ID NO: 82845 - DNA, 31 bp, Artificial Sequence
  Description of Artificial Sequence: Synthetic oligonucleotide
ataactctcttccctgatccttggaggagcc

SEQ ID NO: 82846 - DNA, 30 bp, Artificial Sequence
  Description of Artificial Sequence: Synthetic oligonucleotide
taactctcttccctgatccttggaggagcc

SEQ ID NO: 82847 - DNA, 29 bp, Artificial Sequence
  Description of Artificial Sequence: Synthetic oligonucleotide
aactctcttccctgatccttggaggagcc

SEQ ID NO: 82848 - DNA, 28 bp, Artificial Sequence
  Description of Artificial Sequence: Synthetic oligonucleotide
actctcttccctgatccttggaggagcc

SEQ ID NO: 82849 - DNA, 27 bp, Artificial Sequence
  Description of Artificial Sequence: Synthetic oligonucleotide
ctctcttccctgatccttggaggagcc

SEQ ID NO: 82850 - DNA, 27 bp, Artificial Sequence
  Description of Artificial Sequence: Synthetic oligonucleotide
tctcttccctgatccttggaggagccc

SEQ ID NO: 82851 - DNA, 26 bp, Artificial Sequence
  Description of Artificial Sequence: Synthetic oligonucleotide
ctcttccctgatccttggaggagccc

SEQ ID NO: 82852 - DNA, 27 bp, Artificial Sequence
  Description of Artificial Sequence: Synthetic oligonucleotide
tcttccctgatccttggaggagcccga

SEQ ID NO: 82853 - DNA, 27 bp, Artificial Sequence
  Description of Artificial Sequence: Synthetic oligonucleotide
cttccctgatccttggaggagcccgaa

SEQ ID NO: 82854 - DNA, 27 bp, Artificial Sequence
  Description of Artificial Sequence: Synthetic oligonucleotide
ttccctgatccttggaggagcccgaac

SEQ ID NO: 82855 - DNA, 27 bp, Artificial Sequence
  Description of Artificial Sequence: Synthetic oligonucleotide
tccctgatccttggaggagcccgaact

SEQ ID NO: 82856 - DNA, 26 bp, Artificial Sequence
  Description of Artificial Sequence: Synthetic oligonucleotide
ccctgatccttggaggagcccgaact

SEQ ID NO: 82857 - DNA, 27 bp, Artificial Sequence
  Description of Artificial Sequence: Synthetic oligonucleotide
cctgatccttggaggagcccgaactga

SEQ ID NO: 82858 - DNA, 29 bp, Artificial Sequence
  Description of Artificial Sequence: Synthetic oligonucleotide
ctgatccttggaggagcccgaactgattc

SEQ ID NO: 82859 - DNA, 30 bp, Artificial Sequence
  Description of Artificial Sequence: Synthetic oligonucleotide
tgatccttggaggagcccgaactgattctg

SEQ ID NO: 82860 - DNA, 29 bp, Artificial Sequence
  Description of Artificial Sequence: Synthetic oligonucleotide
gatccttggaggagcccgaactgattctg

SEQ ID NO: 82861 - DNA, 29 bp, Artificial Sequence
  Description of Artificial Sequence: Synthetic oligonucleotide
atccttggaggagcccgaactgattctgg

SEQ ID NO: 82862 - DNA, 28 bp, Artificial Sequence
  Description of Artificial Sequence: Synthetic oligonucleotide
tccttggaggagcccgaactgattctgg

SEQ ID NO: 82863 - DNA, 27 bp, Artificial Sequence
  Description of Artificial Sequence: Synthetic oligonucleotide
ccttggaggagcccgaactgattctgg

SEQ ID NO: 82864 - DNA, 28 bp, Artificial Sequence
  Description of Artificial Sequence: Synthetic oligonucleotide
cttggaggagcccgaactgattctggag

SEQ ID NO: 82865 - DNA, 28 bp, Artificial Sequence
  Description of Artificial Sequence: Synthetic oligonucleotide
ttggaggagcccgaactgattctggagc

SEQ ID NO: 82866 - DNA, 27 bp, Artificial Sequence
  Description of Artificial Sequence: Synthetic oligonucleotide
tggaggagcccgaactgattctggagc

SEQ ID NO: 82867 - DNA, 27 bp, Artificial Sequence
  Description of Artificial Sequence: Synthetic oligonucleotide
ggaggagcccgaactgattctggagct

SEQ ID NO: 82868 - DNA, 27 bp, Artificial Sequence
  Description of Artificial Sequence: Synthetic oligonucleotide
gaggagcccgaactgattctggagctc

SEQ ID NO: 82869 - DNA, 28 bp, Artificial Sequence
  Description of Artificial Sequence: Synthetic oligonucleotide
aggagcccgaactgattctggagctctg

SEQ ID NO: 82870 - DNA, 27 bp, Artificial Sequence
  Description of Artificial Sequence: Synthetic oligonucleotide
ggagcccgaactgattctggagctctg

SEQ ID NO: 82871 - DNA, 28 bp, Artificial Sequence
  Description of Artificial Sequence: Synthetic oligonucleotide
gagcccgaactgattctggagctctgtg

SEQ ID NO: 82872 - DNA, 30 bp, Artificial Sequence
  Description of Artificial Sequence: Synthetic oligonucleotide
agcccgaactgattctggagctctgtgttc

SEQ ID NO: 82873 - DNA, 29 bp, Artificial Sequence
  Description of Artificial Sequence: Synthetic oligonucleotide
gcccgaactgattctggagctctgtgttc

SEQ ID NO: 82874 - DNA, 30 bp, Artificial Sequence
  Description of Artificial Sequence: Synthetic oligonucleotide
cccgaactgattctggagctctgtgttctg

SEQ ID NO: 82875 - DNA, 31 bp, Artificial Sequence
  Description of Artificial Sequence: Synthetic oligonucleotide
ccgaactgattctggagctctgtgttctgag

SEQ ID NO: 82876 - DNA, 33 bp, Artificial Sequence
  Description of Artificial Sequence: Synthetic oligonucleotide
cgaactgattctggagctctgtgttctgagatc

SEQ ID NO: 82877 - DNA, 35 bp, Artificial Sequence
  Description of Artificial Sequence: Synthetic oligonucleotide
gaactgattctggagctctgtgttctgagatcatg

SEQ ID NO: 82878 - DNA, 35 bp, Artificial Sequence
  Description of Artificial Sequence: Synthetic oligonucleotide
aactgattctggagctctgtgttctgagatcatgc

SEQ ID NO: 82879 - DNA, 34 bp, Artificial Sequence
  Description of Artificial Sequence: Synthetic oligonucleotide
actgattctggagctctgtgttctgagatcatgc

SEQ ID NO: 82880 - DNA, 33 bp, Artificial Sequence
  Description of Artificial Sequence: Synthetic oligonucleotide
ctgattctggagctctgtgttctgagatcatgc

SEQ ID NO: 82881 - DNA, 35 bp, Artificial Sequence
  Description of Artificial Sequence: Synthetic oligonucleotide
tgattctggagctctgtgttctgagatcatgcatc

SEQ ID NO: 82882 - DNA, 34 bp, Artificial Sequence
  Description of Artificial Sequence: Synthetic oligonucleotide
gattctggagctctgtgttctgagatcatgcatc

SEQ ID NO: 82883 - DNA, 35 bp, Artificial Sequence
  Description of Artificial Sequence: Synthetic oligonucleotide
attctggagctctgtgttctgagatcatgcatctc

SEQ ID NO: 82884 - DNA, 34 bp, Artificial Sequence
  Description of Artificial Sequence: Synthetic oligonucleotide
ttctggagctctgtgttctgagatcatgcatctc

SEQ ID NO: 82885 - DNA, 33 bp, Artificial Sequence
  Description of Artificial Sequence: Synthetic oligonucleotide
tctggagctctgtgttctgagatcatgcatctc

SEQ ID NO: 82886 - DNA, 32 bp, Artificial Sequence
  Description of Artificial Sequence: Synthetic oligonucleotide
ctggagctctgtgttctgagatcatgcatctc

SEQ ID NO: 82887 - DNA, 32 bp, Artificial Sequence
  Description of Artificial Sequence: Synthetic oligonucleotide
tggagctctgtgttctgagatcatgcatctcc

SEQ ID NO: 82888 - DNA, 31 bp, Artificial Sequence
  Description of Artificial Sequence: Synthetic oligonucleotide
ggagctctgtgttctgagatcatgcatctcc

SEQ ID NO: 82889 - DNA, 31 bp, Artificial Sequence
  Description of Artificial Sequence: Synthetic oligonucleotide
gagctctgtgttctgagatcatgcatctccc

SEQ ID NO: 82890 - DNA, 32 bp, Artificial Sequence
  Description of Artificial Sequence: Synthetic oligonucleotide
agctctgtgttctgagatcatgcatctcccac

SEQ ID NO: 82891 - DNA, 31 bp, Artificial Sequence
  Description of Artificial Sequence: Synthetic oligonucleotide
gctctgtgttctgagatcatgcatctcccac

SEQ ID NO: 82892 - DNA, 31 bp, Artificial Sequence
  Description of Artificial Sequence: Synthetic oligonucleotide
ctctgtgttctgagatcatgcatctcccacc

SEQ ID NO: 82893 - DNA, 31 bp, Artificial Sequence
  Description of Artificial Sequence: Synthetic oligonucleotide
tctgtgttctgagatcatgcatctcccaccc

SEQ ID NO: 82894 - DNA, 30 bp, Artificial Sequence
  Description of Artificial Sequence: Synthetic oligonucleotide
ctgtgttctgagatcatgcatctcccaccc

SEQ ID NO: 82895 - DNA, 32 bp, Artificial Sequence
  Description of Artificial Sequence: Synthetic oligonucleotide
tgtgttctgagatcatgcatctcccacccatc

SEQ ID NO: 82896 - DNA, 31 bp, Artificial Sequence
  Description of Artificial Sequence: Synthetic oligonucleotide
gtgttctgagatcatgcatctcccacccatc

SEQ ID NO: 82897 - DNA, 32 bp, Artificial Sequence
  Description of Artificial Sequence: Synthetic oligonucleotide
tgttctgagatcatgcatctcccacccatctg

SEQ ID NO: 82898 - DNA, 31 bp, Artificial Sequence
  Description of Artificial Sequence: Synthetic oligonucleotide
gttctgagatcatgcatctcccacccatctg

SEQ ID NO: 82899 - DNA, 31 bp, Artificial Sequence
  Description of Artificial Sequence: Synthetic oligonucleotide
ttctgagatcatgcatctcccacccatctgc

SEQ ID NO: 82900 - DNA, 30 bp, Artificial Sequence
  Description of Artificial Sequence: Synthetic oligonucleotide
tctgagatcatgcatctcccacccatctgc

SEQ ID NO: 82901 - DNA, 29 bp, Artificial Sequence
  Description of Artificial Sequence: Synthetic oligonucleotide
ctgagatcatgcatctcccacccatctgc

SEQ ID NO: 82902 - DNA, 29 bp, Artificial Sequence
  Description of Artificial Sequence: Synthetic oligonucleotide
tgagatcatgcatctcccacccatctgcc

SEQ ID NO: 82903 - DNA, 28 bp, Artificial Sequence
  Description of Artificial Sequence: Synthetic oligonucleotide
gagatcatgcatctcccacccatctgcc

SEQ ID NO: 82904 - DNA, 28 bp, Artificial Sequence
  Description of Artificial Sequence: Synthetic oligonucleotide
agatcatgcatctcccacccatctgccc

SEQ ID NO: 82905 - DNA, 27 bp, Artificial Sequence
  Description of Artificial Sequence: Synthetic oligonucleotide
gatcatgcatctcccacccatctgccc

SEQ ID NO: 82906 - DNA, 29 bp, Artificial Sequence
  Description of Artificial Sequence: Synthetic oligonucleotide
atcatgcatctcccacccatctgcccttc

SEQ ID NO: 82907 - DNA, 28 bp, Artificial Sequence
  Description of Artificial Sequence: Synthetic oligonucleotide
tcatgcatctcccacccatctgcccttc

SEQ ID NO: 82908 - DNA, 27 bp, Artificial Sequence
  Description of Artificial Sequence: Synthetic oligonucleotide
catgcatctcccacccatctgcccttc

SEQ ID NO: 82909 - DNA, 28 bp, Artificial Sequence
  Description of Artificial Sequence: Synthetic oligonucleotide
atgcatctcccacccatctgcccttctc

SEQ ID NO: 82910 - DNA, 27 bp, Artificial Sequence
  Description of Artificial Sequence: Synthetic oligonucleotide
tgcatctcccacccatctgcccttctc

SEQ ID NO: 82911 - DNA, 26 bp, Artificial Sequence
  Description of Artificial Sequence: Synthetic oligonucleotide
gcatctcccacccatctgcccttctc

SEQ ID NO: 82912 - DNA, 26 bp, Artificial Sequence
  Description of Artificial Sequence: Synthetic oligonucleotide
catctcccacccatctgcccttctcc

SEQ ID NO: 82913 - DNA, 27 bp, Artificial Sequence
  Description of Artificial Sequence: Synthetic oligonucleotide
atctcccacccatctgcccttctccct

SEQ ID NO: 82914 - DNA, 27 bp, Artificial Sequence
  Description of Artificial Sequence: Synthetic oligonucleotide
tctcccacccatctgcccttctccctt

SEQ ID NO: 82915 - DNA, 26 bp, Artificial Sequence
  Description of Artificial Sequence: Synthetic oligonucleotide
ctcccacccatctgcccttctccctt

SEQ ID NO: 82916 - DNA, 27 bp, Artificial Sequence
  Description of Artificial Sequence: Synthetic oligonucleotide
tcccacccatctgcccttctcccttct

SEQ ID NO: 82917 - DNA, 27 bp, Artificial Sequence
  Description of Artificial Sequence: Synthetic oligonucleotide
cccacccatctgcccttctcccttcta

SEQ ID NO: 82918 - DNA, 27 bp, Artificial Sequence
  Description of Artificial Sequence: Synthetic oligonucleotide
ccacccatctgcccttctcccttctac

SEQ ID NO: 82919 - DNA, 27 bp, Artificial Sequence
  Description of Artificial Sequence: Synthetic oligonucleotide
cacccatctgcccttctcccttctacg

SEQ ID NO: 82920 - DNA, 28 bp, Artificial Sequence
  Description of Artificial Sequence: Synthetic oligonucleotide
acccatctgcccttctcccttctacgtg

SEQ ID NO: 82921 - DNA, 27 bp, Artificial Sequence
  Description of Artificial Sequence: Synthetic oligonucleotide
cccatctgcccttctcccttctacgtg

SEQ ID NO: 82922 - DNA, 29 bp, Artificial Sequence
  Description of Artificial Sequence: Synthetic oligonucleotide
ccatctgcccttctcccttctacgtgtac

SEQ ID NO: 82923 - DNA, 31 bp, Artificial Sequence
  Description of Artificial Sequence: Synthetic oligonucleotide
catctgcccttctcccttctacgtgtacatc

SEQ ID NO: 82924 - DNA, 37 bp, Artificial Sequence
  Description of Artificial Sequence: Synthetic oligonucleotide
atctgcccttctcccttctacgtgtacatcattaatc

SEQ ID NO: 82925 - DNA, 36 bp, Artificial Sequence
  Description of Artificial Sequence: Synthetic oligonucleotide
tctgcccttctcccttctacgtgtacatcattaatc

SEQ ID NO: 82926 - DNA, 35 bp, Artificial Sequence
  Description of Artificial Sequence: Synthetic oligonucleotide
ctgcccttctcccttctacgtgtacatcattaatc

SEQ ID NO: 82927 - DNA, 35 bp, Artificial Sequence
  Description of Artificial Sequence: Synthetic oligonucleotide
tgcccttctcccttctacgtgtacatcattaatcc

SEQ ID NO: 82928 - DNA, 34 bp, Artificial Sequence
  Description of Artificial Sequence: Synthetic oligonucleotide
gcccttctcccttctacgtgtacatcattaatcc

SEQ ID NO: 82929 - DNA, 34 bp, Artificial Sequence
  Description of Artificial Sequence: Synthetic oligonucleotide
cccttctcccttctacgtgtacatcattaatccc

SEQ ID NO: 82930 - DNA, 34 bp, Artificial Sequence
  Description of Artificial Sequence: Synthetic oligonucleotide
ccttctcccttctacgtgtacatcattaatcccc

SEQ ID NO: 82931 - DNA, 37 bp, Artificial Sequence
  Description of Artificial Sequence: Synthetic oligonucleotide
cttctcccttctacgtgtacatcattaatccccattg

SEQ ID NO: 82932 - DNA, 37 bp, Artificial Sequence
  Description of Artificial Sequence: Synthetic oligonucleotide
ttctcccttctacgtgtacatcattaatccccattgc

SEQ ID NO: 82933 - DNA, 36 bp, Artificial Sequence
  Description of Artificial Sequence: Synthetic oligonucleotide
tctcccttctacgtgtacatcattaatccccattgc

SEQ ID NO: 82934 - DNA, 35 bp, Artificial Sequence
  Description of Artificial Sequence: Synthetic oligonucleotide
ctcccttctacgtgtacatcattaatccccattgc

SEQ ID NO: 82935 - DNA, 35 bp, Artificial Sequence
  Description of Artificial Sequence: Synthetic oligonucleotide
tcccttctacgtgtacatcattaatccccattgcc

SEQ ID NO: 82936 - DNA, 34 bp, Artificial Sequence
  Description of Artificial Sequence: Synthetic oligonucleotide
cccttctacgtgtacatcattaatccccattgcc

SEQ ID NO: 82937 - DNA, 36 bp, Artificial Sequence
  Description of Artificial Sequence: Synthetic oligonucleotide
ccttctacgtgtacatcattaatccccattgccaag

SEQ ID NO: 82938 - DNA, 36 bp, Artificial Sequence
  Description of Artificial Sequence: Synthetic oligonucleotide
cttctacgtgtacatcattaatccccattgccaagg

SEQ ID NO: 82939 - DNA, 36 bp, Artificial Sequence
  Description of Artificial Sequence: Synthetic oligonucleotide
ttctacgtgtacatcattaatccccattgccaaggg

SEQ ID NO: 82940 - DNA, 35 bp, Artificial Sequence
  Description of Artificial Sequence: Synthetic oligonucleotide
tctacgtgtacatcattaatccccattgccaaggg

SEQ ID NO: 82941 - DNA, 34 bp, Artificial Sequence
  Description of Artificial Sequence: Synthetic oligonucleotide
ctacgtgtacatcattaatccccattgccaaggg

SEQ ID NO: 82942 - DNA, 34 bp, Artificial Sequence
  Description of Artificial Sequence: Synthetic oligonucleotide
tacgtgtacatcattaatccccattgccaagggc

SEQ ID NO: 82943 - DNA, 33 bp, Artificial Sequence
  Description of Artificial Sequence: Synthetic oligonucleotide
acgtgtacatcattaatccccattgccaagggc

SEQ ID NO: 82944 - DNA, 32 bp, Artificial Sequence
  Description of Artificial Sequence: Synthetic oligonucleotide
cgtgtacatcattaatccccattgccaagggc

SEQ ID NO: 82945 - DNA, 35 bp, Artificial Sequence
  Description of Artificial Sequence: Synthetic oligonucleotide
gtgtacatcattaatccccattgccaagggcattg

SEQ ID NO: 82946 - DNA, 36 bp, Artificial Sequence
  Description of Artificial Sequence: Synthetic oligonucleotide
tgtacatcattaatccccattgccaagggcattgtc

SEQ ID NO: 82947 - DNA, 35 bp, Artificial Sequence
  Description of Artificial Sequence: Synthetic oligonucleotide
gtacatcattaatccccattgccaagggcattgtc

SEQ ID NO: 82948 - DNA, 35 bp, Artificial Sequence
  Description of Artificial Sequence: Synthetic oligonucleotide
tacatcattaatccccattgccaagggcattgtcc

SEQ ID NO: 82949 - DNA, 34 bp, Artificial Sequence
  Description of Artificial Sequence: Synthetic oligonucleotide
acatcattaatccccattgccaagggcattgtcc

SEQ ID NO: 82950 - DNA, 33 bp, Artificial Sequence
  Description of Artificial Sequence: Synthetic oligonucleotide
catcattaatccccattgccaagggcattgtcc

SEQ ID NO: 82951 - DNA, 34 bp, Artificial Sequence
  Description of Artificial Sequence: Synthetic oligonucleotide
atcattaatccccattgccaagggcattgtccag

SEQ ID NO: 82952 - DNA, 33 bp, Artificial Sequence
  Description of Artificial Sequence: Synthetic oligonucleotide
tcattaatccccattgccaagggcattgtccag

SEQ ID NO: 82953 - DNA, 32 bp, Artificial Sequence
  Description of Artificial Sequence: Synthetic oligonucleotide
cattaatccccattgccaagggcattgtccag

SEQ ID NO: 82954 - DNA, 35 bp, Artificial Sequence
  Description of Artificial Sequence: Synthetic oligonucleotide
attaatccccattgccaagggcattgtccagaaac

SEQ ID NO: 82955 - DNA, 34 bp, Artificial Sequence
  Description of Artificial Sequence: Synthetic oligonucleotide
ttaatccccattgccaagggcattgtccagaaac

SEQ ID NO: 82956 - DNA, 33 bp, Artificial Sequence
  Description of Artificial Sequence: Synthetic oligonucleotide
taatccccattgccaagggcattgtccagaaac

SEQ ID NO: 82957 - DNA, 32 bp, Artificial Sequence
  Description of Artificial Sequence: Synthetic oligonucleotide
aatccccattgccaagggcattgtccagaaac

SEQ ID NO: 82958 - DNA, 31 bp, Artificial Sequence
  Description of Artificial Sequence: Synthetic oligonucleotide
atccccattgccaagggcattgtccagaaac

SEQ ID NO: 82959 - DNA, 30 bp, Artificial Sequence
  Description of Artificial Sequence: Synthetic oligonucleotide
tccccattgccaagggcattgtccagaaac

SEQ ID NO: 82960 - DNA, 29 bp, Artificial Sequence
  Description of Artificial Sequence: Synthetic oligonucleotide
ccccattgccaagggcattgtccagaaac

SEQ ID NO: 82961 - DNA, 30 bp, Artificial Sequence
  Description of Artificial Sequence: Synthetic oligonucleotide
cccattgccaagggcattgtccagaaactc

SEQ ID NO: 82962 - DNA, 30 bp, Artificial Sequence
  Description of Artificial Sequence: Synthetic oligonucleotide
ccattgccaagggcattgtccagaaactcc

SEQ ID NO: 82963 - DNA, 30 bp, Artificial Sequence
  Description of Artificial Sequence: Synthetic oligonucleotide
cattgccaagggcattgtccagaaactccc

SEQ ID NO: 82964 - DNA, 30 bp, Artificial Sequence
  Description of Artificial Sequence: Synthetic oligonucleotide
attgccaagggcattgtccagaaactcccc

SEQ ID NO: 82965 - DNA, 29 bp, Artificial Sequence
  Description of Artificial Sequence: Synthetic oligonucleotide
ttgccaagggcattgtccagaaactcccc

SEQ ID NO: 82966 - DNA, 28 bp, Artificial Sequence
  Description of Artificial Sequence: Synthetic oligonucleotide
tgccaagggcattgtccagaaactcccc

SEQ ID NO: 82967 - DNA, 27 bp, Artificial Sequence
  Description of Artificial Sequence: Synthetic oligonucleotide
gccaagggcattgtccagaaactcccc

SEQ ID NO: 82968 - DNA, 28 bp, Artificial Sequence
  Description of Artificial Sequence: Synthetic oligonucleotide
ccaagggcattgtccagaaactcccctg

SEQ ID NO: 82969 - DNA, 29 bp, Artificial Sequence
  Description of Artificial Sequence: Synthetic oligonucleotide
caagggcattgtccagaaactcccctgag

SEQ ID NO: 82970 - DNA, 30 bp, Artificial Sequence
  Description of Artificial Sequence: Synthetic oligonucleotide
aagggcattgtccagaaactcccctgagac

SEQ ID NO: 82971 - DNA, 29 bp, Artificial Sequence
  Description of Artificial Sequence: Synthetic oligonucleotide
agggcattgtccagaaactcccctgagac

SEQ ID NO: 82972 - DNA, 28 bp, Artificial Sequence
  Description of Artificial Sequence: Synthetic oligonucleotide
gggcattgtccagaaactcccctgagac

SEQ ID NO: 82973 - DNA, 28 bp, Artificial Sequence
  Description of Artificial Sequence: Synthetic oligonucleotide
ggcattgtccagaaactcccctgagacc

SEQ ID NO: 82974 - DNA, 31 bp, Artificial Sequence
  Description of Artificial Sequence: Synthetic oligonucleotide
gcattgtccagaaactcccctgagaccttac

SEQ ID NO: 82975 - DNA, 32 bp, Artificial Sequence
  Description of Artificial Sequence: Synthetic oligonucleotide
cattgtccagaaactcccctgagaccttactc

SEQ ID NO: 82976 - DNA, 32 bp, Artificial Sequence
  Description of Artificial Sequence: Synthetic oligonucleotide
attgtccagaaactcccctgagaccttactcc

SEQ ID NO: 82977 - DNA, 31 bp, Artificial Sequence
  Description of Artificial Sequence: Synthetic oligonucleotide
ttgtccagaaactcccctgagaccttactcc

SEQ ID NO: 82978 - DNA, 30 bp, Artificial Sequence
  Description of Artificial Sequence: Synthetic oligonucleotide
tgtccagaaactcccctgagaccttactcc

SEQ ID NO: 82979 - DNA, 29 bp, Artificial Sequence
  Description of Artificial Sequence: Synthetic oligonucleotide
gtccagaaactcccctgagaccttactcc

SEQ ID NO: 82980 - DNA, 31 bp, Artificial Sequence
  Description of Artificial Sequence: Synthetic oligonucleotide
tccagaaactcccctgagaccttactccttc

SEQ ID NO: 82981 - DNA, 30 bp, Artificial Sequence
  Description of Artificial Sequence: Synthetic oligonucleotide
ccagaaactcccctgagaccttactccttc

SEQ ID NO: 82982 - DNA, 30 bp, Artificial Sequence
  Description of Artificial Sequence: Synthetic oligonucleotide
cagaaactcccctgagaccttactccttcc

SEQ ID NO: 82983 - DNA, 31 bp, Artificial Sequence
  Description of Artificial Sequence: Synthetic oligonucleotide
agaaactcccctgagaccttactccttccag

SEQ ID NO: 82984 - DNA, 30 bp, Artificial Sequence
  Description of Artificial Sequence: Synthetic oligonucleotide
gaaactcccctgagaccttactccttccag

SEQ ID NO: 82985 - DNA, 30 bp, Artificial Sequence
  Description of Artificial Sequence: Synthetic oligonucleotide
aaactcccctgagaccttactccttccagc

SEQ ID NO: 82986 - DNA, 29 bp, Artificial Sequence
  Description of Artificial Sequence: Synthetic oligonucleotide
aactcccctgagaccttactccttccagc

SEQ ID NO: 82987 - DNA, 28 bp, Artificial Sequence
  Description of Artificial Sequence: Synthetic oligonucleotide
actcccctgagaccttactccttccagc

SEQ ID NO: 82988 - DNA, 27 bp, Artificial Sequence
  Description of Artificial Sequence: Synthetic oligonucleotide
ctcccctgagaccttactccttccagc

SEQ ID NO: 82989 - DNA, 27 bp, Artificial Sequence
  Description of Artificial Sequence: Synthetic oligonucleotide
tcccctgagaccttactccttccagcc

SEQ ID NO: 82990 - DNA, 26 bp, Artificial Sequence
  Description of Artificial Sequence: Synthetic oligonucleotide
cccctgagaccttactccttccagcc

SEQ ID NO: 82991 - DNA, 26 bp, Artificial Sequence
  Description of Artificial Sequence: Synthetic oligonucleotide
ccctgagaccttactccttccagccc

SEQ ID NO: 82992 - DNA, 27 bp, Artificial Sequence
  Description of Artificial Sequence: Synthetic oligonucleotide
cctgagaccttactccttccagcccca

SEQ ID NO: 82993 - DNA, 30 bp, Artificial Sequence
  Description of Artificial Sequence: Synthetic oligonucleotide
ctgagaccttactccttccagccccaaatc

SEQ ID NO: 82994 - DNA, 35 bp, Artificial Sequence
  Description of Artificial Sequence: Synthetic oligonucleotide
tgagaccttactccttccagccccaaatcatttac

SEQ ID NO: 82995 - DNA, 34 bp, Artificial Sequence
  Description of Artificial Sequence: Synthetic oligonucleotide
gagaccttactccttccagccccaaatcatttac

SEQ ID NO: 82996 - DNA, 38 bp, Artificial Sequence
  Description of Artificial Sequence: Synthetic oligonucleotide
agaccttactccttccagccccaaatcatttacttttc

SEQ ID NO: 82997 - DNA, 37 bp, Artificial Sequence
  Description of Artificial Sequence: Synthetic oligonucleotide
gaccttactccttccagccccaaatcatttacttttc

SEQ ID NO: 82998 - DNA, 38 bp, Artificial Sequence
  Description of Artificial Sequence: Synthetic oligonucleotide
accttactccttccagccccaaatcatttacttttctg

SEQ ID NO: 82999 - DNA, 37 bp, Artificial Sequence
  Description of Artificial Sequence: Synthetic oligonucleotide
ccttactccttccagccccaaatcatttacttttctg

SEQ ID NO: 83000 - DNA, 38 bp, Artificial Sequence
  Description of Artificial Sequence: Synthetic oligonucleotide
cttactccttccagccccaaatcatttacttttctgtg

SEQ ID NO: 83001 - DNA, 38 bp, Artificial Sequence
  Description of Artificial Sequence: Synthetic oligonucleotide
ttactccttccagccccaaatcatttacttttctgtgg

SEQ ID NO: 83002 - DNA, 37 bp, Artificial Sequence
  Description of Artificial Sequence: Synthetic oligonucleotide
tactccttccagccccaaatcatttacttttctgtgg

SEQ ID NO: 83003 - DNA, 36 bp, Artificial Sequence
  Description of Artificial Sequence: Synthetic oligonucleotide
actccttccagccccaaatcatttacttttctgtgg

SEQ ID NO: 83004 - DNA, 35 bp, Artificial Sequence
  Description of Artificial Sequence: Synthetic oligonucleotide
ctccttccagccccaaatcatttacttttctgtgg

SEQ ID NO: 83005 - DNA, 36 bp, Artificial Sequence
  Description of Artificial Sequence: Synthetic oligonucleotide
tccttccagccccaaatcatttacttttctgtggtc

SEQ ID NO: 83006 - DNA, 35 bp, Artificial Sequence
  Description of Artificial Sequence: Synthetic oligonucleotide
ccttccagccccaaatcatttacttttctgtggtc

SEQ ID NO: 83007 - DNA, 35 bp, Artificial Sequence
  Description of Artificial Sequence: Synthetic oligonucleotide
cttccagccccaaatcatttacttttctgtggtcc

SEQ ID NO: 83008 - DNA, 36 bp, Artificial Sequence
  Description of Artificial Sequence: Synthetic oligonucleotide
ttccagccccaaatcatttacttttctgtggtccag

SEQ ID NO: 83009 - DNA, 35 bp, Artificial Sequence
  Description of Artificial Sequence: Synthetic oligonucleotide
tccagccccaaatcatttacttttctgtggtccag

SEQ ID NO: 83010 - DNA, 34 bp, Artificial Sequence
  Description of Artificial Sequence: Synthetic oligonucleotide
ccagccccaaatcatttacttttctgtggtccag

SEQ ID NO: 83011 - DNA, 34 bp, Artificial Sequence
  Description of Artificial Sequence: Synthetic oligonucleotide
cagccccaaatcatttacttttctgtggtccagc

SEQ ID NO: 83012 - DNA, 34 bp, Artificial Sequence
  Description of Artificial Sequence: Synthetic oligonucleotide
agccccaaatcatttacttttctgtggtccagcc

SEQ ID NO: 83013 - DNA, 33 bp, Artificial Sequence
  Description of Artificial Sequence: Synthetic oligonucleotide
gccccaaatcatttacttttctgtggtccagcc

SEQ ID NO: 83014 - DNA, 33 bp, Artificial Sequence
  Description of Artificial Sequence: Synthetic oligonucleotide
ccccaaatcatttacttttctgtggtccagccc

SEQ ID NO: 83015 - DNA, 35 bp, Artificial Sequence
  Description of Artificial Sequence: Synthetic oligonucleotide
cccaaatcatttacttttctgtggtccagccctac

SEQ ID NO: 83016 - DNA, 36 bp, Artificial Sequence
  Description of Artificial Sequence: Synthetic oligonucleotide
ccaaatcatttacttttctgtggtccagccctactc

SEQ ID NO: 83017 - DNA, 36 bp, Artificial Sequence
  Description of Artificial Sequence: Synthetic oligonucleotide
caaatcatttacttttctgtggtccagccctactcc

SEQ ID NO: 83018 - DNA, 41 bp, Artificial Sequence
  Description of Artificial Sequence: Synthetic oligonucleotide
aaatcatttacttttctgtggtccagccctactcctataag

SEQ ID NO: 83019 - DNA, 40 bp, Artificial Sequence
  Description of Artificial Sequence: Synthetic oligonucleotide
aatcatttacttttctgtggtccagccctactcctataag

SEQ ID NO: 83020 - DNA, 39 bp, Artificial Sequence
  Description of Artificial Sequence: Synthetic oligonucleotide
atcatttacttttctgtggtccagccctactcctataag

SEQ ID NO: 83021 - DNA, 38 bp, Artificial Sequence
  Description of Artificial Sequence: Synthetic oligonucleotide
tcatttacttttctgtggtccagccctactcctataag

SEQ ID NO: 83022 - DNA, 37 bp, Artificial Sequence
  Description of Artificial Sequence: Synthetic oligonucleotide
catttacttttctgtggtccagccctactcctataag

SEQ ID NO: 83023 - DNA, 38 bp, Artificial Sequence
  Description of Artificial Sequence: Synthetic oligonucleotide
atttacttttctgtggtccagccctactcctataagtc

SEQ ID NO: 83024 - DNA, 37 bp, Artificial Sequence
  Description of Artificial Sequence: Synthetic oligonucleotide
tttacttttctgtggtccagccctactcctataagtc

SEQ ID NO: 83025 - DNA, 36 bp, Artificial Sequence
  Description of Artificial Sequence: Synthetic oligonucleotide
ttacttttctgtggtccagccctactcctataagtc

SEQ ID NO: 83026 - DNA, 35 bp, Artificial Sequence
  Description of Artificial Sequence: Synthetic oligonucleotide
tacttttctgtggtccagccctactcctataagtc

SEQ ID NO: 83027 - DNA, 34 bp, Artificial Sequence
  Description of Artificial Sequence: Synthetic oligonucleotide
acttttctgtggtccagccctactcctataagtc

SEQ ID NO: 83028 - DNA, 33 bp, Artificial Sequence
  Description of Artificial Sequence: Synthetic oligonucleotide
cttttctgtggtccagccctactcctataagtc

SEQ ID NO: 83029 - DNA, 35 bp, Artificial Sequence
  Description of Artificial Sequence: Synthetic oligonucleotide
ttttctgtggtccagccctactcctataagtcatg

SEQ ID NO: 83030 - DNA, 34 bp, Artificial Sequence
  Description of Artificial Sequence: Synthetic oligonucleotide
tttctgtggtccagccctactcctataagtcatg

SEQ ID NO: 83031 - DNA, 33 bp, Artificial Sequence
  Description of Artificial Sequence: Synthetic oligonucleotide
ttctgtggtccagccctactcctataagtcatg

SEQ ID NO: 83032 - DNA, 32 bp, Artificial Sequence
  Description of Artificial Sequence: Synthetic oligonucleotide
tctgtggtccagccctactcctataagtcatg

SEQ ID NO: 83033 - DNA, 31 bp, Artificial Sequence
  Description of Artificial Sequence: Synthetic oligonucleotide
ctgtggtccagccctactcctataagtcatg

SEQ ID NO: 83034 - DNA, 33 bp, Artificial Sequence
  Description of Artificial Sequence: Synthetic oligonucleotide
tgtggtccagccctactcctataagtcatgatc

SEQ ID NO: 83035 - DNA, 32 bp, Artificial Sequence
  Description of Artificial Sequence: Synthetic oligonucleotide
gtggtccagccctactcctataagtcatgatc

SEQ ID NO: 83036 - DNA, 33 bp, Artificial Sequence
  Description of Artificial Sequence: Synthetic oligonucleotide
tggtccagccctactcctataagtcatgatctc

SEQ ID NO: 83037 - DNA, 32 bp, Artificial Sequence
  Description of Artificial Sequence: Synthetic oligonucleotide
ggtccagccctactcctataagtcatgatctc

SEQ ID NO: 83038 - DNA, 32 bp, Artificial Sequence
  Description of Artificial Sequence: Synthetic oligonucleotide
gtccagccctactcctataagtcatgatctcc

SEQ ID NO: 83039 - DNA, 35 bp, Artificial Sequence
  Description of Artificial Sequence: Synthetic oligonucleotide
tccagccctactcctataagtcatgatctccaaag

SEQ ID NO: 83040 - DNA, 34 bp, Artificial Sequence
  Description of Artificial Sequence: Synthetic oligonucleotide
ccagccctactcctataagtcatgatctccaaag

SEQ ID NO: 83041 - DNA, 34 bp, Artificial Sequence
  Description of Artificial Sequence: Synthetic oligonucleotide
cagccctactcctataagtcatgatctccaaagc

SEQ ID NO: 83042 - DNA, 37 bp, Artificial Sequence
  Description of Artificial Sequence: Synthetic oligonucleotide
agccctactcctataagtcatgatctccaaagctttc

SEQ ID NO: 83043 - DNA, 36 bp, Artificial Sequence
  Description of Artificial Sequence: Synthetic oligonucleotide
gccctactcctataagtcatgatctccaaagctttc

SEQ ID NO: 83044 - DNA, 37 bp, Artificial Sequence
  Description of Artificial Sequence: Synthetic oligonucleotide
ccctactcctataagtcatgatctccaaagctttctg

SEQ ID NO: 83045 - DNA, 38 bp, Artificial Sequence
  Description of Artificial Sequence: Synthetic oligonucleotide
cctactcctataagtcatgatctccaaagctttctgtc

SEQ ID NO: 83046 - DNA, 40 bp, Artificial Sequence
  Description of Artificial Sequence: Synthetic oligonucleotide
ctactcctataagtcatgatctccaaagctttctgtcttc

SEQ ID NO: 83047 - DNA, 40 bp, Artificial Sequence
  Description of Artificial Sequence: Synthetic oligonucleotide
tactcctataagtcatgatctccaaagctttctgtcttcc

SEQ ID NO: 83048 - DNA, 39 bp, Artificial Sequence
  Description of Artificial Sequence: Synthetic oligonucleotide
actcctataagtcatgatctccaaagctttctgtcttcc

SEQ ID NO: 83049 - DNA, 38 bp, Artificial Sequence
  Description of Artificial Sequence: Synthetic oligonucleotide
ctcctataagtcatgatctccaaagctttctgtcttcc

SEQ ID NO: 83050 - DNA, 40 bp, Artificial Sequence
  Description of Artificial Sequence: Synthetic oligonucleotide
tcctataagtcatgatctccaaagctttctgtcttccaac

SEQ ID NO: 83051 - DNA, 39 bp, Artificial Sequence
  Description of Artificial Sequence: Synthetic oligonucleotide
cctataagtcatgatctccaaagctttctgtcttccaac

SEQ ID NO: 83052 - DNA, 40 bp, Artificial Sequence
  Description of Artificial Sequence: Synthetic oligonucleotide
ctataagtcatgatctccaaagctttctgtcttccaactg

SEQ ID NO: 83053 - DNA, 40 bp, Artificial Sequence
  Description of Artificial Sequence: Synthetic oligonucleotide
tataagtcatgatctccaaagctttctgtcttccaactgc

SEQ ID NO: 83054 - DNA, 39 bp, Artificial Sequence
  Description of Artificial Sequence: Synthetic oligonucleotide
ataagtcatgatctccaaagctttctgtcttccaactgc

SEQ ID NO: 83055 - DNA, 38 bp, Artificial Sequence
  Description of Artificial Sequence: Synthetic oligonucleotide
taagtcatgatctccaaagctttctgtcttccaactgc

SEQ ID NO: 83056 - DNA, 37 bp, Artificial Sequence
  Description of Artificial Sequence: Synthetic oligonucleotide
aagtcatgatctccaaagctttctgtcttccaactgc

SEQ ID NO: 83057 - DNA, 36 bp, Artificial Sequence
  Description of Artificial Sequence: Synthetic oligonucleotide
agtcatgatctccaaagctttctgtcttccaactgc

SEQ ID NO: 83058 - DNA, 35 bp, Artificial Sequence
  Description of Artificial Sequence: Synthetic oligonucleotide
gtcatgatctccaaagctttctgtcttccaactgc

SEQ ID NO: 83059 - DNA, 36 bp, Artificial Sequence
  Description of Artificial Sequence: Synthetic oligonucleotide
tcatgatctccaaagctttctgtcttccaactgcag

SEQ ID NO: 83060 - DNA, 35 bp, Artificial Sequence
  Description of Artificial Sequence: Synthetic oligonucleotide
catgatctccaaagctttctgtcttccaactgcag

SEQ ID NO: 83061 - DNA, 36 bp, Artificial Sequence
  Description of Artificial Sequence: Synthetic oligonucleotide
atgatctccaaagctttctgtcttccaactgcagtc

SEQ ID NO: 83062 - DNA, 35 bp, Artificial Sequence
  Description of Artificial Sequence: Synthetic oligonucleotide
tgatctccaaagctttctgtcttccaactgcagtc

SEQ ID NO: 83063 - DNA, 34 bp, Artificial Sequence
  Description of Artificial Sequence: Synthetic oligonucleotide
gatctccaaagctttctgtcttccaactgcagtc

SEQ ID NO: 83064 - DNA, 35 bp, Artificial Sequence
  Description of Artificial Sequence: Synthetic oligonucleotide
atctccaaagctttctgtcttccaactgcagtctc

SEQ ID NO: 83065 - DNA, 34 bp, Artificial Sequence
  Description of Artificial Sequence: Synthetic oligonucleotide
tctccaaagctttctgtcttccaactgcagtctc

SEQ ID NO: 83066 - DNA, 33 bp, Artificial Sequence
  Description of Artificial Sequence: Synthetic oligonucleotide
ctccaaagctttctgtcttccaactgcagtctc

SEQ ID NO: 83067 - DNA, 33 bp, Artificial Sequence
  Description of Artificial Sequence: Synthetic oligonucleotide
tccaaagctttctgtcttccaactgcagtctcc

SEQ ID NO: 83068 - DNA, 32 bp, Artificial Sequence
  Description of Artificial Sequence: Synthetic oligonucleotide
ccaaagctttctgtcttccaactgcagtctcc

SEQ ID NO: 83069 - DNA, 33 bp, Artificial Sequence
  Description of Artificial Sequence: Synthetic oligonucleotide
caaagctttctgtcttccaactgcagtctccac

SEQ ID NO: 83070 - DNA, 34 bp, Artificial Sequence
  Description of Artificial Sequence: Synthetic oligonucleotide
aaagctttctgtcttccaactgcagtctccacag

SEQ ID NO: 83071 - DNA, 33 bp, Artificial Sequence
  Description of Artificial Sequence: Synthetic oligonucleotide
aagctttctgtcttccaactgcagtctccacag

SEQ ID NO: 83072 - DNA, 32 bp, Artificial Sequence
  Description of Artificial Sequence: Synthetic oligonucleotide
agctttctgtcttccaactgcagtctccacag

SEQ ID NO: 83073 - DNA, 31 bp, Artificial Sequence
  Description of Artificial Sequence: Synthetic oligonucleotide
gctttctgtcttccaactgcagtctccacag

SEQ ID NO: 83074 - DNA, 32 bp, Artificial Sequence
  Description of Artificial Sequence: Synthetic oligonucleotide
ctttctgtcttccaactgcagtctccacagtc

SEQ ID NO: 83075 - DNA, 34 bp, Artificial Sequence
  Description of Artificial Sequence: Synthetic oligonucleotide
tttctgtcttccaactgcagtctccacagtcttc

SEQ ID NO: 83076 - DNA, 33 bp, Artificial Sequence
  Description of Artificial Sequence: Synthetic oligonucleotide
ttctgtcttccaactgcagtctccacagtcttc

SEQ ID NO: 83077 - DNA, 32 bp, Artificial Sequence
  Description of Artificial Sequence: Synthetic oligonucleotide
tctgtcttccaactgcagtctccacagtcttc

SEQ ID NO: 83078 - DNA, 31 bp, Artificial Sequence
  Description of Artificial Sequence: Synthetic oligonucleotide
ctgtcttccaactgcagtctccacagtcttc

SEQ ID NO: 83079 - DNA, 32 bp, Artificial Sequence
  Description of Artificial Sequence: Synthetic oligonucleotide
tgtcttccaactgcagtctccacagtcttcag

SEQ ID NO: 83080 - DNA, 31 bp, Artificial Sequence
  Description of Artificial Sequence: Synthetic oligonucleotide
gtcttccaactgcagtctccacagtcttcag

SEQ ID NO: 83081 - DNA, 33 bp, Artificial Sequence
  Description of Artificial Sequence: Synthetic oligonucleotide
tcttccaactgcagtctccacagtcttcagaag

SEQ ID NO: 83082 - DNA, 32 bp, Artificial Sequence
  Description of Artificial Sequence: Synthetic oligonucleotide
cttccaactgcagtctccacagtcttcagaag

SEQ ID NO: 83083 - DNA, 33 bp, Artificial Sequence
  Description of Artificial Sequence: Synthetic oligonucleotide
ttccaactgcagtctccacagtcttcagaagac

SEQ ID NO: 83084 - DNA, 32 bp, Artificial Sequence
  Description of Artificial Sequence: Synthetic oligonucleotide
tccaactgcagtctccacagtcttcagaagac

SEQ ID NO: 83085 - DNA, 31 bp, Artificial Sequence
  Description of Artificial Sequence: Synthetic oligonucleotide
ccaactgcagtctccacagtcttcagaagac

SEQ ID NO: 83086 - DNA, 35 bp, Artificial Sequence
  Description of Artificial Sequence: Synthetic oligonucleotide
caactgcagtctccacagtcttcagaagacaaatg

SEQ ID NO: 83087 - DNA, 35 bp, Artificial Sequence
  Description of Artificial Sequence: Synthetic oligonucleotide
aactgcagtctccacagtcttcagaagacaaatgc

SEQ ID NO: 83088 - DNA, 34 bp, Artificial Sequence
  Description of Artificial Sequence: Synthetic oligonucleotide
actgcagtctccacagtcttcagaagacaaatgc

SEQ ID NO: 83089 - DNA, 33 bp, Artificial Sequence
  Description of Artificial Sequence: Synthetic oligonucleotide
ctgcagtctccacagtcttcagaagacaaatgc

SEQ ID NO: 83090 - DNA, 34 bp, Artificial Sequence
  Description of Artificial Sequence: Synthetic oligonucleotide
tgcagtctccacagtcttcagaagacaaatgctc

SEQ ID NO: 83091 - DNA, 33 bp, Artificial Sequence
  Description of Artificial Sequence: Synthetic oligonucleotide
gcagtctccacagtcttcagaagacaaatgctc

SEQ ID NO: 83092 - DNA, 34 bp, Artificial Sequence
  Description of Artificial Sequence: Synthetic oligonucleotide
cagtctccacagtcttcagaagacaaatgctcag

SEQ ID NO: 83093 - DNA, 34 bp, Artificial Sequence
  Description of Artificial Sequence: Synthetic oligonucleotide
agtctccacagtcttcagaagacaaatgctcagg

SEQ ID NO: 83094 - DNA, 33 bp, Artificial Sequence
  Description of Artificial Sequence: Synthetic oligonucleotide
gtctccacagtcttcagaagacaaatgctcagg

SEQ ID NO: 83095 - DNA, 35 bp, Artificial Sequence
  Description of Artificial Sequence: Synthetic oligonucleotide
tctccacagtcttcagaagacaaatgctcaggtag

SEQ ID NO: 83096 - DNA, 34 bp, Artificial Sequence
  Description of Artificial Sequence: Synthetic oligonucleotide
ctccacagtcttcagaagacaaatgctcaggtag

SEQ ID NO: 83097 - DNA, 35 bp, Artificial Sequence
  Description of Artificial Sequence: Synthetic oligonucleotide
tccacagtcttcagaagacaaatgctcaggtagtc

SEQ ID NO: 83098 - DNA, 34 bp, Artificial Sequence
  Description of Artificial Sequence: Synthetic oligonucleotide
ccacagtcttcagaagacaaatgctcaggtagtc

SEQ ID NO: 83099 - DNA, 35 bp, Artificial Sequence
  Description of Artificial Sequence: Synthetic oligonucleotide
cacagtcttcagaagacaaatgctcaggtagtcac

SEQ ID NO: 83100 - DNA, 36 bp, Artificial Sequence
  Description of Artificial Sequence: Synthetic oligonucleotide
acagtcttcagaagacaaatgctcaggtagtcactg

SEQ ID NO: 83101 - DNA, 35 bp, Artificial Sequence
  Description of Artificial Sequence: Synthetic oligonucleotide
cagtcttcagaagacaaatgctcaggtagtcactg

SEQ ID NO: 83102 - DNA, 38 bp, Artificial Sequence
  Description of Artificial Sequence: Synthetic oligonucleotide
agtcttcagaagacaaatgctcaggtagtcactgtttc

SEQ ID NO: 83103 - DNA, 37 bp, Artificial Sequence
  Description of Artificial Sequence: Synthetic oligonucleotide
gtcttcagaagacaaatgctcaggtagtcactgtttc

SEQ ID NO: 83104 - DNA, 37 bp, Artificial Sequence
  Description of Artificial Sequence: Synthetic oligonucleotide
tcttcagaagacaaatgctcaggtagtcactgtttcc

SEQ ID NO: 83105 - DNA, 36 bp, Artificial Sequence
  Description of Artificial Sequence: Synthetic oligonucleotide
cttcagaagacaaatgctcaggtagtcactgtttcc

SEQ ID NO: 83106 - DNA, 40 bp, Artificial Sequence
  Description of Artificial Sequence: Synthetic oligonucleotide
ttcagaagacaaatgctcaggtagtcactgtttccttttc

SEQ ID NO: 83107 - DNA, 39 bp, Artificial Sequence
  Description of Artificial Sequence: Synthetic oligonucleotide
tcagaagacaaatgctcaggtagtcactgtttccttttc

SEQ ID NO: 83108 - DNA, 38 bp, Artificial Sequence
  Description of Artificial Sequence: Synthetic oligonucleotide
cagaagacaaatgctcaggtagtcactgtttccttttc

SEQ ID NO: 83109 - DNA, 39 bp, Artificial Sequence
  Description of Artificial Sequence: Synthetic oligonucleotide
agaagacaaatgctcaggtagtcactgtttccttttcac

SEQ ID NO: 83110 - DNA, 38 bp, Artificial Sequence
  Description of Artificial Sequence: Synthetic oligonucleotide
gaagacaaatgctcaggtagtcactgtttccttttcac

SEQ ID NO: 83111 - DNA, 39 bp, Artificial Sequence
  Description of Artificial Sequence: Synthetic oligonucleotide
aagacaaatgctcaggtagtcactgtttccttttcactg

SEQ ID NO: 83112 - DNA, 38 bp, Artificial Sequence
  Description of Artificial Sequence: Synthetic oligonucleotide
agacaaatgctcaggtagtcactgtttccttttcactg

SEQ ID NO: 83113 - DNA, 37 bp, Artificial Sequence
  Description of Artificial Sequence: Synthetic oligonucleotide
gacaaatgctcaggtagtcactgtttccttttcactg

SEQ ID NO: 83114 - DNA, 47 bp, Artificial Sequence
  Description of Artificial Sequence: Synthetic oligonucleotide
acaaatgctcaggtagtcactgtttccttttcactgtttttaaaaac

SEQ ID NO: 83115 - DNA, 46 bp, Artificial Sequence
  Description of Artificial Sequence: Synthetic oligonucleotide
caaatgctcaggtagtcactgtttccttttcactgtttttaaaaac

SEQ ID NO: 83116 - DNA, 46 bp, Artificial Sequence
  Description of Artificial Sequence: Synthetic oligonucleotide
aaatgctcaggtagtcactgtttccttttcactgtttttaaaaacc

SEQ ID NO: 83117 - DNA, 45 bp, Artificial Sequence
  Description of Artificial Sequence: Synthetic oligonucleotide
aatgctcaggtagtcactgtttccttttcactgtttttaaaaacc

SEQ ID NO: 83118 - DNA, 44 bp, Artificial Sequence
  Description of Artificial Sequence: Synthetic oligonucleotide
atgctcaggtagtcactgtttccttttcactgtttttaaaaacc

SEQ ID NO: 83119 - DNA, 43 bp, Artificial Sequence
  Description of Artificial Sequence: Synthetic oligonucleotide
tgctcaggtagtcactgtttccttttcactgtttttaaaaacc

SEQ ID NO: 83120 - DNA, 42 bp, Artificial Sequence
  Description of Artificial Sequence: Synthetic oligonucleotide
gctcaggtagtcactgtttccttttcactgtttttaaaaacc

SEQ ID NO: 83121 - DNA, 49 bp, Artificial Sequence
  Description of Artificial Sequence: Synthetic oligonucleotide
ctcaggtagtcactgtttccttttcactgtttttaaaaaccttttattg

SEQ ID NO: 83122 - DNA, 50 bp, Artificial Sequence
  Description of Artificial Sequence: Synthetic oligonucleotide
tcaggtagtcactgtttccttttcactgtttttaaaaaccttttattgtc

SEQ ID NO: 83123 - DNA, 49 bp, Artificial Sequence
  Description of Artificial Sequence: Synthetic oligonucleotide
caggtagtcactgtttccttttcactgtttttaaaaaccttttattgtc

SEQ ID NO: 83124 - DNA, 58 bp, Artificial Sequence
  Description of Artificial Sequence: Synthetic oligonucleotide
aggtagtcactgtttccttttcactgtttttaaaaaccttttattgtcaaataaaatg

SEQ ID NO: 83125 - DNA, 57 bp, Artificial Sequence
  Description of Artificial Sequence: Synthetic oligonucleotide
ggtagtcactgtttccttttcactgtttttaaaaaccttttattgtcaaataaaatg

SEQ ID NO: 83126 - DNA, 57 bp, Artificial Sequence
  Description of Artificial Sequence: Synthetic oligonucleotide
gtagtcactgtttccttttcactgtttttaaaaaccttttattgtcaaataaaatgg

SEQ ID NO: 83127 - DNA, 58 bp, Artificial Sequence
  Description of Artificial Sequence: Synthetic oligonucleotide
tagtcactgtttccttttcactgtttttaaaaaccttttattgtcaaataaaatggag

SEQ ID NO: 83128 - DNA, 57 bp, Artificial Sequence
  Description of Artificial Sequence: Synthetic oligonucleotide
agtcactgtttccttttcactgtttttaaaaaccttttattgtcaaataaaatggag

SEQ ID NO: 83129 - DNA, 56 bp, Artificial Sequence
  Description of Artificial Sequence: Synthetic oligonucleotide
gtcactgtttccttttcactgtttttaaaaaccttttattgtcaaataaaatggag

SEQ ID NO: 83130 - DNA, 59 bp, Artificial Sequence
  Description of Artificial Sequence: Synthetic oligonucleotide
tcactgtttccttttcactgtttttaaaaaccttttattgtcaaataaaatggagatac

SEQ ID NO: 83131 - DNA, 31 bp, Artificial Sequence
  Description of Artificial Sequence: Synthetic oligonucleotide
aaactcccctgagaccttactccttccagtc

SEQ ID NO: 83132 - DNA, 30 bp, Artificial Sequence
  Description of Artificial Sequence: Synthetic oligonucleotide
aactcccctgagaccttactccttccagtc

SEQ ID NO: 83133 - DNA, 29 bp, Artificial Sequence
  Description of Artificial Sequence: Synthetic oligonucleotide
actcccctgagaccttactccttccagtc

SEQ ID NO: 83134 - DNA, 28 bp, Artificial Sequence
  Description of Artificial Sequence: Synthetic oligonucleotide
ctcccctgagaccttactccttccagtc

SEQ ID NO: 83135 - DNA, 28 bp, Artificial Sequence
  Description of Artificial Sequence: Synthetic oligonucleotide
tcccctgagaccttactccttccagtcc

SEQ ID NO: 83136 - DNA, 27 bp, Artificial Sequence
  Description of Artificial Sequence: Synthetic oligonucleotide
cccctgagaccttactccttccagtcc

SEQ ID NO: 83137 - DNA, 27 bp, Artificial Sequence
  Description of Artificial Sequence: Synthetic oligonucleotide
ccctgagaccttactccttccagtccc

SEQ ID NO: 83138 - DNA, 31 bp, Artificial Sequence
  Description of Artificial Sequence: Synthetic oligonucleotide
cctgagaccttactccttccagtcccaaatc

SEQ ID NO: 83139 - DNA, 36 bp, Artificial Sequence
  Description of Artificial Sequence: Synthetic oligonucleotide
ctgagaccttactccttccagtcccaaatcatttac

SEQ ID NO: 83140 - DNA, 40 bp, Artificial Sequence
  Description of Artificial Sequence: Synthetic oligonucleotide
tgagaccttactccttccagtcccaaatcatttacttttc

SEQ ID NO: 83141 - DNA, 39 bp, Artificial Sequence
  Description of Artificial Sequence: Synthetic oligonucleotide
gagaccttactccttccagtcccaaatcatttacttttc

SEQ ID NO: 83142 - DNA, 40 bp, Artificial Sequence
  Description of Artificial Sequence: Synthetic oligonucleotide
agaccttactccttccagtcccaaatcatttacttttctg

SEQ ID NO: 83143 - DNA, 39 bp, Artificial Sequence
  Description of Artificial Sequence: Synthetic oligonucleotide
gaccttactccttccagtcccaaatcatttacttttctg

SEQ ID NO: 83144 - DNA, 40 bp, Artificial Sequence
  Description of Artificial Sequence: Synthetic oligonucleotide
accttactccttccagtcccaaatcatttacttttctgtg

SEQ ID NO: 83145 - DNA, 39 bp, Artificial Sequence
  Description of Artificial Sequence: Synthetic oligonucleotide
ccttactccttccagtcccaaatcatttacttttctgtg

SEQ ID NO: 83146 - DNA, 39 bp, Artificial Sequence
  Description of Artificial Sequence: Synthetic oligonucleotide
cttactccttccagtcccaaatcatttacttttctgtgg

SEQ ID NO: 83147 - DNA, 40 bp, Artificial Sequence
  Description of Artificial Sequence: Synthetic oligonucleotide
ttactccttccagtcccaaatcatttacttttctgtggtc

SEQ ID NO: 83148 - DNA, 39 bp, Artificial Sequence
  Description of Artificial Sequence: Synthetic oligonucleotide
tactccttccagtcccaaatcatttacttttctgtggtc

SEQ ID NO: 83149 - DNA, 38 bp, Artificial Sequence
  Description of Artificial Sequence: Synthetic oligonucleotide
actccttccagtcccaaatcatttacttttctgtggtc

SEQ ID NO: 83150 - DNA, 37 bp, Artificial Sequence
  Description of Artificial Sequence: Synthetic oligonucleotide
ctccttccagtcccaaatcatttacttttctgtggtc

SEQ ID NO: 83151 - DNA, 37 bp, Artificial Sequence
  Description of Artificial Sequence: Synthetic oligonucleotide
tccttccagtcccaaatcatttacttttctgtggtcc

SEQ ID NO: 83152 - DNA, 36 bp, Artificial Sequence
  Description of Artificial Sequence: Synthetic oligonucleotide
ccttccagtcccaaatcatttacttttctgtggtcc

SEQ ID NO: 83153 - DNA, 37 bp, Artificial Sequence
  Description of Artificial Sequence: Synthetic oligonucleotide
cttccagtcccaaatcatttacttttctgtggtccag

SEQ ID NO: 83154 - DNA, 37 bp, Artificial Sequence
  Description of Artificial Sequence: Synthetic oligonucleotide
ttccagtcccaaatcatttacttttctgtggtccagc

SEQ ID NO: 83155 - DNA, 36 bp, Artificial Sequence
  Description of Artificial Sequence: Synthetic oligonucleotide
tccagtcccaaatcatttacttttctgtggtccagc

SEQ ID NO: 83156 - DNA, 35 bp, Artificial Sequence
  Description of Artificial Sequence: Synthetic oligonucleotide
ccagtcccaaatcatttacttttctgtggtccagc

SEQ ID NO: 83157 - DNA, 35 bp, Artificial Sequence
  Description of Artificial Sequence: Synthetic oligonucleotide
cagtcccaaatcatttacttttctgtggtccagcc

SEQ ID NO: 83158 - DNA, 35 bp, Artificial Sequence
  Description of Artificial Sequence: Synthetic oligonucleotide
agtcccaaatcatttacttttctgtggtccagccc

SEQ ID NO: 83159 - DNA, 34 bp, Artificial Sequence
  Description of Artificial Sequence: Synthetic oligonucleotide
gtcccaaatcatttacttttctgtggtccagccc

SEQ ID NO: 83160 - DNA, 36 bp, Artificial Sequence
  Description of Artificial Sequence: Synthetic oligonucleotide
tcccaaatcatttacttttctgtggtccagccctac

SEQ ID NO: 83161 - DNA, 29 bp, Artificial Sequence
  Description of Artificial Sequence: Synthetic oligonucleotide
tggaacagccggctggatctcttggaaag

SEQ ID NO: 83162 - DNA, 28 bp, Artificial Sequence
  Description of Artificial Sequence: Synthetic oligonucleotide
ggaacagccggctggatctcttggaaag

SEQ ID NO: 83163 - DNA, 28 bp, Artificial Sequence
  Description of Artificial Sequence: Synthetic oligonucleotide
gaacagccggctggatctcttggaaagg

SEQ ID NO: 83164 - DNA, 29 bp, Artificial Sequence
  Description of Artificial Sequence: Synthetic oligonucleotide
aacagccggctggatctcttggaaaggag

SEQ ID NO: 83165 - DNA, 28 bp, Artificial Sequence
  Description of Artificial Sequence: Synthetic oligonucleotide
acagccggctggatctcttggaaaggag

SEQ ID NO: 83166 - DNA, 27 bp, Artificial Sequence
  Description of Artificial Sequence: Synthetic oligonucleotide
cagccggctggatctcttggaaaggag

SEQ ID NO: 83167 - DNA, 27 bp, Artificial Sequence
  Description of Artificial Sequence: Synthetic oligonucleotide
agccggctggatctcttggaaaggagc

SEQ ID NO: 83168 - DNA, 27 bp, Artificial Sequence
  Description of Artificial Sequence: Synthetic oligonucleotide
gccggctggatctcttggaaaggagca

SEQ ID NO: 83169 - DNA, 27 bp, Artificial Sequence
  Description of Artificial Sequence: Synthetic oligonucleotide
ccggctggatctcttggaaaggagcag

SEQ ID NO: 83170 - DNA, 28 bp, Artificial Sequence
  Description of Artificial Sequence: Synthetic oligonucleotide
cggctggatctcttggaaaggagcagac

SEQ ID NO: 83171 - DNA, 29 bp, Artificial Sequence
  Description of Artificial Sequence: Synthetic oligonucleotide
ggctggatctcttggaaaggagcagacag

SEQ ID NO: 83172 - DNA, 29 bp, Artificial Sequence
  Description of Artificial Sequence: Synthetic oligonucleotide
gctggatctcttggaaaggagcagacagg

SEQ ID NO: 83173 - DNA, 29 bp, Artificial Sequence
  Description of Artificial Sequence: Synthetic oligonucleotide
ctggatctcttggaaaggagcagacaggc

SEQ ID NO: 83174 - DNA, 29 bp, Artificial Sequence
  Description of Artificial Sequence: Synthetic oligonucleotide
tggatctcttggaaaggagcagacaggcc

SEQ ID NO: 83175 - DNA, 28 bp, Artificial Sequence
  Description of Artificial Sequence: Synthetic oligonucleotide
ggatctcttggaaaggagcagacaggcc

SEQ ID NO: 83176 - DNA, 28 bp, Artificial Sequence
  Description of Artificial Sequence: Synthetic oligonucleotide
gatctcttggaaaggagcagacaggccg

SEQ ID NO: 83177 - DNA, 29 bp, Artificial Sequence
  Description of Artificial Sequence: Synthetic oligonucleotide
atctcttggaaaggagcagacaggccgtg

SEQ ID NO: 83178 - DNA, 28 bp, Artificial Sequence
  Description of Artificial Sequence: Synthetic oligonucleotide
tctcttggaaaggagcagacaggccgtg

SEQ ID NO: 83179 - DNA, 27 bp, Artificial Sequence
  Description of Artificial Sequence: Synthetic oligonucleotide
ctcttggaaaggagcagacaggccgtg

SEQ ID NO: 83180 - DNA, 27 bp, Artificial Sequence
  Description of Artificial Sequence: Synthetic oligonucleotide
tcttggaaaggagcagacaggccgtgg

SEQ ID NO: 83181 - DNA, 27 bp, Artificial Sequence
  Description of Artificial Sequence: Synthetic oligonucleotide
cttggaaaggagcagacaggccgtgga

SEQ ID NO: 83182 - DNA, 28 bp, Artificial Sequence
  Description of Artificial Sequence: Synthetic oligonucleotide
ttggaaaggagcagacaggccgtggatg

SEQ ID NO: 83183 - DNA, 27 bp, Artificial Sequence
  Description of Artificial Sequence: Synthetic oligonucleotide
tggaaaggagcagacaggccgtggatg

SEQ ID NO: 83184 - DNA, 26 bp, Artificial Sequence
  Description of Artificial Sequence: Synthetic oligonucleotide
ggaaaggagcagacaggccgtggatg

SEQ ID NO: 83185 - DNA, 26 bp, Artificial Sequence
  Description of Artificial Sequence: Synthetic oligonucleotide
gaaaggagcagacaggccgtggatgg

SEQ ID NO: 83186 - DNA, 26 bp, Artificial Sequence
  Description of Artificial Sequence: Synthetic oligonucleotide
aaaggagcagacaggccgtggatggg

SEQ ID NO: 83187 - DNA, 25 bp, Artificial Sequence
  Description of Artificial Sequence: Synthetic oligonucleotide
aaggagcagacaggccgtggatggg

SEQ ID NO: 83188 - DNA, 31 bp, Artificial Sequence
  Description of Artificial Sequence: Synthetic oligonucleotide
catgactcaaggcacagactctccagaagac

SEQ ID NO: 83189 - DNA, 34 bp, Artificial Sequence
  Description of Artificial Sequence: Synthetic oligonucleotide
atgactcaaggcacagactctccagaagactttg

SEQ ID NO: 83190 - DNA, 33 bp, Artificial Sequence
  Description of Artificial Sequence: Synthetic oligonucleotide
tgactcaaggcacagactctccagaagactttg

SEQ ID NO: 83191 - DNA, 32 bp, Artificial Sequence
  Description of Artificial Sequence: Synthetic oligonucleotide
gactcaaggcacagactctccagaagactttg

SEQ ID NO: 83192 - DNA, 33 bp, Artificial Sequence
  Description of Artificial Sequence: Synthetic oligonucleotide
actcaaggcacagactctccagaagactttgtg

SEQ ID NO: 83193 - DNA, 32 bp, Artificial Sequence
  Description of Artificial Sequence: Synthetic oligonucleotide
ctcaaggcacagactctccagaagactttgtg

SEQ ID NO: 83194 - DNA, 35 bp, Artificial Sequence
  Description of Artificial Sequence: Synthetic oligonucleotide
tcaaggcacagactctccagaagactttgtgattc

SEQ ID NO: 83195 - DNA, 34 bp, Artificial Sequence
  Description of Artificial Sequence: Synthetic oligonucleotide
caaggcacagactctccagaagactttgtgattc

SEQ ID NO: 83196 - DNA, 35 bp, Artificial Sequence
  Description of Artificial Sequence: Synthetic oligonucleotide
aaggcacagactctccagaagactttgtgattcag

SEQ ID NO: 83197 - DNA, 34 bp, Artificial Sequence
  Description of Artificial Sequence: Synthetic oligonucleotide
aggcacagactctccagaagactttgtgattcag

SEQ ID NO: 83198 - DNA, 33 bp, Artificial Sequence
  Description of Artificial Sequence: Synthetic oligonucleotide
ggcacagactctccagaagactttgtgattcag

SEQ ID NO: 83199 - DNA, 33 bp, Artificial Sequence
  Description of Artificial Sequence: Synthetic oligonucleotide
gcacagactctccagaagactttgtgattcagg

SEQ ID NO: 83200 - DNA, 33 bp, Artificial Sequence
  Description of Artificial Sequence: Synthetic oligonucleotide
cacagactctccagaagactttgtgattcaggc

SEQ ID NO: 83201 - DNA, 36 bp, Artificial Sequence
  Description of Artificial Sequence: Synthetic oligonucleotide
acagactctccagaagactttgtgattcaggcaaag

SEQ ID NO: 83202 - DNA, 35 bp, Artificial Sequence
  Description of Artificial Sequence: Synthetic oligonucleotide
cagactctccagaagactttgtgattcaggcaaag

SEQ ID NO: 83203 - DNA, 35 bp, Artificial Sequence
  Description of Artificial Sequence: Synthetic oligonucleotide
agactctccagaagactttgtgattcaggcaaagg

SEQ ID NO: 83204 - DNA, 34 bp, Artificial Sequence
  Description of Artificial Sequence: Synthetic oligonucleotide
gactctccagaagactttgtgattcaggcaaagg

SEQ ID NO: 83205 - DNA, 34 bp, Artificial Sequence
  Description of Artificial Sequence: Synthetic oligonucleotide
actctccagaagactttgtgattcaggcaaaggc

SEQ ID NO: 83206 - DNA, 33 bp, Artificial Sequence
  Description of Artificial Sequence: Synthetic oligonucleotide
ctctccagaagactttgtgattcaggcaaaggc

SEQ ID NO: 83207 - DNA, 34 bp, Artificial Sequence
  Description of Artificial Sequence: Synthetic oligonucleotide
tctccagaagactttgtgattcaggcaaaggctg

SEQ ID NO: 83208 - DNA, 33 bp, Artificial Sequence
  Description of Artificial Sequence: Synthetic oligonucleotide
ctccagaagactttgtgattcaggcaaaggctg

SEQ ID NO: 83209 - DNA, 34 bp, Artificial Sequence
  Description of Artificial Sequence: Synthetic oligonucleotide
tccagaagactttgtgattcaggcaaaggctgac

SEQ ID NO: 83210 - DNA, 33 bp, Artificial Sequence
  Description of Artificial Sequence: Synthetic oligonucleotide
ccagaagactttgtgattcaggcaaaggctgac

SEQ ID NO: 83211 - DNA, 34 bp, Artificial Sequence
  Description of Artificial Sequence: Synthetic oligonucleotide
cagaagactttgtgattcaggcaaaggctgactg

SEQ ID NO: 83212 - DNA, 37 bp, Artificial Sequence
  Description of Artificial Sequence: Synthetic oligonucleotide
agaagactttgtgattcaggcaaaggctgactgttac

SEQ ID NO: 83213 - DNA, 36 bp, Artificial Sequence
  Description of Artificial Sequence: Synthetic oligonucleotide
gaagactttgtgattcaggcaaaggctgactgttac

SEQ ID NO: 83214 - DNA, 38 bp, Artificial Sequence
  Description of Artificial Sequence: Synthetic oligonucleotide
aagactttgtgattcaggcaaaggctgactgttacttc

SEQ ID NO: 83215 - DNA, 37 bp, Artificial Sequence
  Description of Artificial Sequence: Synthetic oligonucleotide
agactttgtgattcaggcaaaggctgactgttacttc

SEQ ID NO: 83216 - DNA, 36 bp, Artificial Sequence
  Description of Artificial Sequence: Synthetic oligonucleotide
gactttgtgattcaggcaaaggctgactgttacttc

SEQ ID NO: 83217 - DNA, 37 bp, Artificial Sequence
  Description of Artificial Sequence: Synthetic oligonucleotide
actttgtgattcaggcaaaggctgactgttacttcac

SEQ ID NO: 83218 - DNA, 36 bp, Artificial Sequence
  Description of Artificial Sequence: Synthetic oligonucleotide
ctttgtgattcaggcaaaggctgactgttacttcac

SEQ ID NO: 83219 - DNA, 30 bp, Artificial Sequence
  Description of Artificial Sequence: Synthetic oligonucleotide
tggtggctctgctagtgaatctgacccaac

SEQ ID NO: 83220 - DNA, 29 bp, Artificial Sequence
  Description of Artificial Sequence: Synthetic oligonucleotide
ggtggctctgctagtgaatctgacccaac

SEQ ID NO: 83221 - DNA, 30 bp, Artificial Sequence
  Description of Artificial Sequence: Synthetic oligonucleotide
gtggctctgctagtgaatctgacccaactg

SEQ ID NO: 83222 - DNA, 30 bp, Artificial Sequence
  Description of Artificial Sequence: Synthetic oligonucleotide
tggctctgctagtgaatctgacccaactgg

SEQ ID NO: 83223 - DNA, 29 bp, Artificial Sequence
  Description of Artificial Sequence: Synthetic oligonucleotide
ggctctgctagtgaatctgacccaactgg

SEQ ID NO: 83224 - DNA, 32 bp, Artificial Sequence
  Description of Artificial Sequence: Synthetic oligonucleotide
gctctgctagtgaatctgacccaactggattc

SEQ ID NO: 83225 - DNA, 32 bp, Artificial Sequence
  Description of Artificial Sequence: Synthetic oligonucleotide
ctctgctagtgaatctgacccaactggattcc

SEQ ID NO: 83226 - DNA, 33 bp, Artificial Sequence
  Description of Artificial Sequence: Synthetic oligonucleotide
tctgctagtgaatctgacccaactggattcctc

SEQ ID NO: 83227 - DNA, 32 bp, Artificial Sequence
  Description of Artificial Sequence: Synthetic oligonucleotide
ctgctagtgaatctgacccaactggattcctc

SEQ ID NO: 83228 - DNA, 32 bp, Artificial Sequence
  Description of Artificial Sequence: Synthetic oligonucleotide
tgctagtgaatctgacccaactggattcctcc

SEQ ID NO: 83229 - DNA, 31 bp, Artificial Sequence
  Description of Artificial Sequence: Synthetic oligonucleotide
gctagtgaatctgacccaactggattcctcc

SEQ ID NO: 83230 - DNA, 33 bp, Artificial Sequence
  Description of Artificial Sequence: Synthetic oligonucleotide
ctagtgaatctgacccaactggattcctccatg

SEQ ID NO: 83231 - DNA, 34 bp, Artificial Sequence
  Description of Artificial Sequence: Synthetic oligonucleotide
tagtgaatctgacccaactggattcctccatgac

SEQ ID NO: 83232 - DNA, 33 bp, Artificial Sequence
  Description of Artificial Sequence: Synthetic oligonucleotide
agtgaatctgacccaactggattcctccatgac

SEQ ID NO: 83233 - DNA, 32 bp, Artificial Sequence
  Description of Artificial Sequence: Synthetic oligonucleotide
gtgaatctgacccaactggattcctccatgac

SEQ ID NO: 83234 - DNA, 33 bp, Artificial Sequence
  Description of Artificial Sequence: Synthetic oligonucleotide
tgaatctgacccaactggattcctccatgactc

SEQ ID NO: 83235 - DNA, 32 bp, Artificial Sequence
  Description of Artificial Sequence: Synthetic oligonucleotide
gaatctgacccaactggattcctccatgactc

SEQ ID NO: 83236 - DNA, 34 bp, Artificial Sequence
  Description of Artificial Sequence: Synthetic oligonucleotide
aatctgacccaactggattcctccatgactcaag

SEQ ID NO: 83237 - DNA, 33 bp, Artificial Sequence
  Description of Artificial Sequence: Synthetic oligonucleotide
atctgacccaactggattcctccatgactcaag

SEQ ID NO: 83238 - DNA, 32 bp, Artificial Sequence
  Description of Artificial Sequence: Synthetic oligonucleotide
tctgacccaactggattcctccatgactcaag

SEQ ID NO: 83239 - DNA, 31 bp, Artificial Sequence
  Description of Artificial Sequence: Synthetic oligonucleotide
ctgacccaactggattcctccatgactcaag

SEQ ID NO: 83240 - DNA, 31 bp, Artificial Sequence
  Description of Artificial Sequence: Synthetic oligonucleotide
tgacccaactggattcctccatgactcaagg

SEQ ID NO: 83241 - DNA, 30 bp, Artificial Sequence
  Description of Artificial Sequence: Synthetic oligonucleotide
gacccaactggattcctccatgactcaagg

SEQ ID NO: 83242 - DNA, 30 bp, Artificial Sequence
  Description of Artificial Sequence: Synthetic oligonucleotide
acccaactggattcctccatgactcaaggc

SEQ ID NO: 83243 - DNA, 29 bp, Artificial Sequence
  Description of Artificial Sequence: Synthetic oligonucleotide
cccaactggattcctccatgactcaaggc

SEQ ID NO: 83244 - DNA, 30 bp, Artificial Sequence
  Description of Artificial Sequence: Synthetic oligonucleotide
ccaactggattcctccatgactcaaggcac

SEQ ID NO: 83245 - DNA, 31 bp, Artificial Sequence
  Description of Artificial Sequence: Synthetic oligonucleotide
caactggattcctccatgactcaaggcacag

SEQ ID NO: 83246 - DNA, 32 bp, Artificial Sequence
  Description of Artificial Sequence: Synthetic oligonucleotide
aactggattcctccatgactcaaggcacagac

SEQ ID NO: 83247 - DNA, 35 bp, Artificial Sequence
  Description of Artificial Sequence: Synthetic oligonucleotide
tacttgggctaatcttccttctggtgggaatcatc

SEQ ID NO: 83248 - DNA, 34 bp, Artificial Sequence
  Description of Artificial Sequence: Synthetic oligonucleotide
acttgggctaatcttccttctggtgggaatcatc

SEQ ID NO: 83249 - DNA, 33 bp, Artificial Sequence
  Description of Artificial Sequence: Synthetic oligonucleotide
cttgggctaatcttccttctggtgggaatcatc

SEQ ID NO: 83250 - DNA, 35 bp, Artificial Sequence
  Description of Artificial Sequence: Synthetic oligonucleotide
ttgggctaatcttccttctggtgggaatcatcatc

SEQ ID NO: 83251 - DNA, 34 bp, Artificial Sequence
  Description of Artificial Sequence: Synthetic oligonucleotide
tgggctaatcttccttctggtgggaatcatcatc

SEQ ID NO: 83252 - DNA, 33 bp, Artificial Sequence
  Description of Artificial Sequence: Synthetic oligonucleotide
gggctaatcttccttctggtgggaatcatcatc

SEQ ID NO: 83253 - DNA, 33 bp, Artificial Sequence
  Description of Artificial Sequence: Synthetic oligonucleotide
ggctaatcttccttctggtgggaatcatcatcc

SEQ ID NO: 83254 - DNA, 34 bp, Artificial Sequence
  Description of Artificial Sequence: Synthetic oligonucleotide
gctaatcttccttctggtgggaatcatcatccag

SEQ ID NO: 83255 - DNA, 34 bp, Artificial Sequence
  Description of Artificial Sequence: Synthetic oligonucleotide
ctaatcttccttctggtgggaatcatcatccagc

SEQ ID NO: 83256 - DNA, 37 bp, Artificial Sequence
  Description of Artificial Sequence: Synthetic oligonucleotide
taatcttccttctggtgggaatcatcatccagctaag

SEQ ID NO: 83257 - DNA, 36 bp, Artificial Sequence
  Description of Artificial Sequence: Synthetic oligonucleotide
aatcttccttctggtgggaatcatcatccagctaag

SEQ ID NO: 83258 - DNA, 35 bp, Artificial Sequence
  Description of Artificial Sequence: Synthetic oligonucleotide
atcttccttctggtgggaatcatcatccagctaag

SEQ ID NO: 83259 - DNA, 34 bp, Artificial Sequence
  Description of Artificial Sequence: Synthetic oligonucleotide
tcttccttctggtgggaatcatcatccagctaag

SEQ ID NO: 83260 - DNA, 33 bp, Artificial Sequence
  Description of Artificial Sequence: Synthetic oligonucleotide
cttccttctggtgggaatcatcatccagctaag

SEQ ID NO: 83261 - DNA, 33 bp, Artificial Sequence
  Description of Artificial Sequence: Synthetic oligonucleotide
ttccttctggtgggaatcatcatccagctaagg

SEQ ID NO: 83262 - DNA, 32 bp, Artificial Sequence
  Description of Artificial Sequence: Synthetic oligonucleotide
tccttctggtgggaatcatcatccagctaagg

SEQ ID NO: 83263 - DNA, 31 bp, Artificial Sequence
  Description of Artificial Sequence: Synthetic oligonucleotide
ccttctggtgggaatcatcatccagctaagg

SEQ ID NO: 83264 - DNA, 31 bp, Artificial Sequence
  Description of Artificial Sequence: Synthetic oligonucleotide
cttctggtgggaatcatcatccagctaaggg

SEQ ID NO: 83265 - DNA, 31 bp, Artificial Sequence
  Description of Artificial Sequence: Synthetic oligonucleotide
ttctggtgggaatcatcatccagctaagggc

SEQ ID NO: 83266 - DNA, 30 bp, Artificial Sequence
  Description of Artificial Sequence: Synthetic oligonucleotide
tctggtgggaatcatcatccagctaagggc

SEQ ID NO: 83267 - DNA, 29 bp, Artificial Sequence
  Description of Artificial Sequence: Synthetic oligonucleotide
ctggtgggaatcatcatccagctaagggc

SEQ ID NO: 83268 - DNA, 30 bp, Artificial Sequence
  Description of Artificial Sequence: Synthetic oligonucleotide
tggtgggaatcatcatccagctaagggctc

SEQ ID NO: 83269 - DNA, 29 bp, Artificial Sequence
  Description of Artificial Sequence: Synthetic oligonucleotide
ggtgggaatcatcatccagctaagggctc

SEQ ID NO: 83270 - DNA, 30 bp, Artificial Sequence
  Description of Artificial Sequence: Synthetic oligonucleotide
gtgggaatcatcatccagctaagggctcag

SEQ ID NO: 83271 - DNA, 33 bp, Artificial Sequence
  Description of Artificial Sequence: Synthetic oligonucleotide
tgggaatcatcatccagctaagggctcagaaag

SEQ ID NO: 83272 - DNA, 32 bp, Artificial Sequence
  Description of Artificial Sequence: Synthetic oligonucleotide
gggaatcatcatccagctaagggctcagaaag

SEQ ID NO: 83273 - DNA, 32 bp, Artificial Sequence
  Description of Artificial Sequence: Synthetic oligonucleotide
ggaatcatcatccagctaagggctcagaaagg

SEQ ID NO: 83274 - DNA, 36 bp, Artificial Sequence
  Description of Artificial Sequence: Synthetic oligonucleotide
gaatcatcatccagctaagggctcagaaaggatatg

SEQ ID NO: 83275 - DNA, 37 bp, Artificial Sequence
  Description of Artificial Sequence: Synthetic oligonucleotide
aatcatcatccagctaagggctcagaaaggatatgtg

SEQ ID NO: 83276 - DNA, 36 bp, Artificial Sequence
  Description of Artificial Sequence: Synthetic oligonucleotide
atcatcatccagctaagggctcagaaaggatatgtg

SEQ ID NO: 83277 - DNA, 35 bp, Artificial Sequence
  Description of Artificial Sequence: Synthetic oligonucleotide
tcatcatccagctaagggctcagaaaggatatgtg

SEQ ID NO: 83278 - DNA, 34 bp, Artificial Sequence
  Description of Artificial Sequence: Synthetic oligonucleotide
catcatccagctaagggctcagaaaggatatgtg

SEQ ID NO: 83279 - DNA, 35 bp, Artificial Sequence
  Description of Artificial Sequence: Synthetic oligonucleotide
atcatccagctaagggctcagaaaggatatgtgag

SEQ ID NO: 83280 - DNA, 40 bp, Artificial Sequence
  Description of Artificial Sequence: Synthetic oligonucleotide
tgatgctagaaatgactcctgaacttggacatgtctatac

SEQ ID NO: 83281 - DNA, 39 bp, Artificial Sequence
  Description of Artificial Sequence: Synthetic oligonucleotide
gatgctagaaatgactcctgaacttggacatgtctatac

SEQ ID NO: 83282 - DNA, 39 bp, Artificial Sequence
  Description of Artificial Sequence: Synthetic oligonucleotide
atgctagaaatgactcctgaacttggacatgtctatacc

SEQ ID NO: 83283 - DNA, 38 bp, Artificial Sequence
  Description of Artificial Sequence: Synthetic oligonucleotide
tgctagaaatgactcctgaacttggacatgtctatacc

SEQ ID NO: 83284 - DNA, 37 bp, Artificial Sequence
  Description of Artificial Sequence: Synthetic oligonucleotide
gctagaaatgactcctgaacttggacatgtctatacc

SEQ ID NO: 83285 - DNA, 38 bp, Artificial Sequence
  Description of Artificial Sequence: Synthetic oligonucleotide
ctagaaatgactcctgaacttggacatgtctatacctg

SEQ ID NO: 83286 - DNA, 38 bp, Artificial Sequence
  Description of Artificial Sequence: Synthetic oligonucleotide
tagaaatgactcctgaacttggacatgtctatacctgc

SEQ ID NO: 83287 - DNA, 37 bp, Artificial Sequence
  Description of Artificial Sequence: Synthetic oligonucleotide
agaaatgactcctgaacttggacatgtctatacctgc

SEQ ID NO: 83288 - DNA, 36 bp, Artificial Sequence
  Description of Artificial Sequence: Synthetic oligonucleotide
gaaatgactcctgaacttggacatgtctatacctgc

SEQ ID NO: 83289 - DNA, 36 bp, Artificial Sequence
  Description of Artificial Sequence: Synthetic oligonucleotide
aaatgactcctgaacttggacatgtctatacctgcc

SEQ ID NO: 83290 - DNA, 35 bp, Artificial Sequence
  Description of Artificial Sequence: Synthetic oligonucleotide
aatgactcctgaacttggacatgtctatacctgcc

SEQ ID NO: 83291 - DNA, 34 bp, Artificial Sequence
  Description of Artificial Sequence: Synthetic oligonucleotide
atgactcctgaacttggacatgtctatacctgcc

SEQ ID NO: 83292 - DNA, 33 bp, Artificial Sequence
  Description of Artificial Sequence: Synthetic oligonucleotide
tgactcctgaacttggacatgtctatacctgcc

SEQ ID NO: 83293 - DNA, 32 bp, Artificial Sequence
  Description of Artificial Sequence: Synthetic oligonucleotide
gactcctgaacttggacatgtctatacctgcc

SEQ ID NO: 83294 - DNA, 34 bp, Artificial Sequence
  Description of Artificial Sequence: Synthetic oligonucleotide
actcctgaacttggacatgtctatacctgccttg

SEQ ID NO: 83295 - DNA, 33 bp, Artificial Sequence
  Description of Artificial Sequence: Synthetic oligonucleotide
ctcctgaacttggacatgtctatacctgccttg

SEQ ID NO: 83296 - DNA, 34 bp, Artificial Sequence
  Description of Artificial Sequence: Synthetic oligonucleotide
tcctgaacttggacatgtctatacctgccttgtc

SEQ ID NO: 83297 - DNA, 33 bp, Artificial Sequence
  Description of Artificial Sequence: Synthetic oligonucleotide
cctgaacttggacatgtctatacctgccttgtc

SEQ ID NO: 83298 - DNA, 33 bp, Artificial Sequence
  Description of Artificial Sequence: Synthetic oligonucleotide
ctgaacttggacatgtctatacctgccttgtcg

SEQ ID NO: 83299 - DNA, 35 bp, Artificial Sequence
  Description of Artificial Sequence: Synthetic oligonucleotide
tgaacttggacatgtctatacctgccttgtcgatc

SEQ ID NO: 83300 - DNA, 34 bp, Artificial Sequence
  Description of Artificial Sequence: Synthetic oligonucleotide
gaacttggacatgtctatacctgccttgtcgatc

SEQ ID NO: 83301 - DNA, 35 bp, Artificial Sequence
  Description of Artificial Sequence: Synthetic oligonucleotide
aacttggacatgtctatacctgccttgtcgatcac

SEQ ID NO: 83302 - DNA, 34 bp, Artificial Sequence
  Description of Artificial Sequence: Synthetic oligonucleotide
acttggacatgtctatacctgccttgtcgatcac

SEQ ID NO: 83303 - DNA, 33 bp, Artificial Sequence
  Description of Artificial Sequence: Synthetic oligonucleotide
cttggacatgtctatacctgccttgtcgatcac

SEQ ID NO: 83304 - DNA, 34 bp, Artificial Sequence
  Description of Artificial Sequence: Synthetic oligonucleotide
ttggacatgtctatacctgccttgtcgatcactc

SEQ ID NO: 83305 - DNA, 33 bp, Artificial Sequence
  Description of Artificial Sequence: Synthetic oligonucleotide
tggacatgtctatacctgccttgtcgatcactc

SEQ ID NO: 83306 - DNA, 32 bp, Artificial Sequence
  Description of Artificial Sequence: Synthetic oligonucleotide
ggacatgtctatacctgccttgtcgatcactc

SEQ ID NO: 83307 - DNA, 32 bp, Artificial Sequence
  Description of Artificial Sequence: Synthetic oligonucleotide
gacatgtctatacctgccttgtcgatcactcc

SEQ ID NO: 83308 - DNA, 33 bp, Artificial Sequence
  Description of Artificial Sequence: Synthetic oligonucleotide
acatgtctatacctgccttgtcgatcactccag

SEQ ID NO: 83309 - DNA, 32 bp, Artificial Sequence
  Description of Artificial Sequence: Synthetic oligonucleotide
catgtctatacctgccttgtcgatcactccag

SEQ ID NO: 83310 - DNA, 32 bp, Artificial Sequence
  Description of Artificial Sequence: Synthetic oligonucleotide
atgtctatacctgccttgtcgatcactccagc

SEQ ID NO: 83311 - DNA, 31 bp, Artificial Sequence
  Description of Artificial Sequence: Synthetic oligonucleotide
tgtctatacctgccttgtcgatcactccagc

SEQ ID NO: 83312 - DNA, 30 bp, Artificial Sequence
  Description of Artificial Sequence: Synthetic oligonucleotide
gtctatacctgccttgtcgatcactccagc

SEQ ID NO: 83313 - DNA, 30 bp, Artificial Sequence
  Description of Artificial Sequence: Synthetic oligonucleotide
tctatacctgccttgtcgatcactccagcc

SEQ ID NO: 83314 - DNA, 29 bp, Artificial Sequence
  Description of Artificial Sequence: Synthetic oligonucleotide
ctatacctgccttgtcgatcactccagcc

SEQ ID NO: 83315 - DNA, 30 bp, Artificial Sequence
  Description of Artificial Sequence: Synthetic oligonucleotide
tatacctgccttgtcgatcactccagcctg

SEQ ID NO: 83316 - DNA, 29 bp, Artificial Sequence
  Description of Artificial Sequence: Synthetic oligonucleotide
atacctgccttgtcgatcactccagcctg

SEQ ID NO: 83317 - DNA, 28 bp, Artificial Sequence
  Description of Artificial Sequence: Synthetic oligonucleotide
tacctgccttgtcgatcactccagcctg

SEQ ID NO: 83318 - DNA, 35 bp, Artificial Sequence
  Description of Artificial Sequence: Synthetic oligonucleotide
aaagatgctgagtggcattgcagccttcctatttg

SEQ ID NO: 83319 - DNA, 34 bp, Artificial Sequence
  Description of Artificial Sequence: Synthetic oligonucleotide
aagatgctgagtggcattgcagccttcctatttg

SEQ ID NO: 83320 - DNA, 33 bp, Artificial Sequence
  Description of Artificial Sequence: Synthetic oligonucleotide
agatgctgagtggcattgcagccttcctatttg

SEQ ID NO: 83321 - DNA, 32 bp, Artificial Sequence
  Description of Artificial Sequence: Synthetic oligonucleotide
gatgctgagtggcattgcagccttcctatttg

SEQ ID NO: 83322 - DNA, 32 bp, Artificial Sequence
  Description of Artificial Sequence: Synthetic oligonucleotide
atgctgagtggcattgcagccttcctatttgg

SEQ ID NO: 83323 - DNA, 31 bp, Artificial Sequence
  Description of Artificial Sequence: Synthetic oligonucleotide
tgctgagtggcattgcagccttcctatttgg

SEQ ID NO: 83324 - DNA, 30 bp, Artificial Sequence
  Description of Artificial Sequence: Synthetic oligonucleotide
gctgagtggcattgcagccttcctatttgg

SEQ ID NO: 83325 - DNA, 30 bp, Artificial Sequence
  Description of Artificial Sequence: Synthetic oligonucleotide
ctgagtggcattgcagccttcctatttggg

SEQ ID NO: 83326 - DNA, 30 bp, Artificial Sequence
  Description of Artificial Sequence: Synthetic oligonucleotide
tgagtggcattgcagccttcctatttgggc

SEQ ID NO: 83327 - DNA, 29 bp, Artificial Sequence
  Description of Artificial Sequence: Synthetic oligonucleotide
gagtggcattgcagccttcctatttgggc

SEQ ID NO: 83328 - DNA, 33 bp, Artificial Sequence
  Description of Artificial Sequence: Synthetic oligonucleotide
agtggcattgcagccttcctatttgggctaatc

SEQ ID NO: 83329 - DNA, 32 bp, Artificial Sequence
  Description of Artificial Sequence: Synthetic oligonucleotide
gtggcattgcagccttcctatttgggctaatc

SEQ ID NO: 83330 - DNA, 34 bp, Artificial Sequence
  Description of Artificial Sequence: Synthetic oligonucleotide
tggcattgcagccttcctatttgggctaatcttc

SEQ ID NO: 83331 - DNA, 33 bp, Artificial Sequence
  Description of Artificial Sequence: Synthetic oligonucleotide
ggcattgcagccttcctatttgggctaatcttc

SEQ ID NO: 83332 - DNA, 33 bp, Artificial Sequence
  Description of Artificial Sequence: Synthetic oligonucleotide
gcattgcagccttcctatttgggctaatcttcc

SEQ ID NO: 83333 - DNA, 35 bp, Artificial Sequence
  Description of Artificial Sequence: Synthetic oligonucleotide
cattgcagccttcctatttgggctaatcttccttc

SEQ ID NO: 83334 - DNA, 36 bp, Artificial Sequence
  Description of Artificial Sequence: Synthetic oligonucleotide
attgcagccttcctatttgggctaatcttccttctg

SEQ ID NO: 83335 - DNA, 35 bp, Artificial Sequence
  Description of Artificial Sequence: Synthetic oligonucleotide
ttgcagccttcctatttgggctaatcttccttctg

SEQ ID NO: 83336 - DNA, 34 bp, Artificial Sequence
  Description of Artificial Sequence: Synthetic oligonucleotide
tgcagccttcctatttgggctaatcttccttctg

SEQ ID NO: 83337 - DNA, 33 bp, Artificial Sequence
  Description of Artificial Sequence: Synthetic oligonucleotide
gcagccttcctatttgggctaatcttccttctg

SEQ ID NO: 83338 - DNA, 33 bp, Artificial Sequence
  Description of Artificial Sequence: Synthetic oligonucleotide
cagccttcctatttgggctaatcttccttctgg

SEQ ID NO: 83339 - DNA, 34 bp, Artificial Sequence
  Description of Artificial Sequence: Synthetic oligonucleotide
agccttcctatttgggctaatcttccttctggtg

SEQ ID NO: 83340 - DNA, 33 bp, Artificial Sequence
  Description of Artificial Sequence: Synthetic oligonucleotide
gccttcctatttgggctaatcttccttctggtg

SEQ ID NO: 83341 - DNA, 33 bp, Artificial Sequence
  Description of Artificial Sequence: Synthetic oligonucleotide
ccttcctatttgggctaatcttccttctggtgg

SEQ ID NO: 83342 - DNA, 33 bp, Artificial Sequence
  Description of Artificial Sequence: Synthetic oligonucleotide
cttcctatttgggctaatcttccttctggtggg

SEQ ID NO: 83343 - DNA, 36 bp, Artificial Sequence
  Description of Artificial Sequence: Synthetic oligonucleotide
ttcctatttgggctaatcttccttctggtgggaatc

SEQ ID NO: 83344 - DNA, 35 bp, Artificial Sequence
  Description of Artificial Sequence: Synthetic oligonucleotide
tcctatttgggctaatcttccttctggtgggaatc

SEQ ID NO: 83345 - DNA, 34 bp, Artificial Sequence
  Description of Artificial Sequence: Synthetic oligonucleotide
cctatttgggctaatcttccttctggtgggaatc

SEQ ID NO: 83346 - DNA, 34 bp, Artificial Sequence
  Description of Artificial Sequence: Synthetic oligonucleotide
ctatttgggctaatcttccttctggtgggaatcg

SEQ ID NO: 83347 - DNA, 35 bp, Artificial Sequence
  Description of Artificial Sequence: Synthetic oligonucleotide
tatttgggctaatcttccttctggtgggaatcgtc

SEQ ID NO: 83348 - DNA, 34 bp, Artificial Sequence
  Description of Artificial Sequence: Synthetic oligonucleotide
atttgggctaatcttccttctggtgggaatcgtc

SEQ ID NO: 83349 - DNA, 33 bp, Artificial Sequence
  Description of Artificial Sequence: Synthetic oligonucleotide
tttgggctaatcttccttctggtgggaatcgtc

SEQ ID NO: 83350 - DNA, 31 bp, Artificial Sequence
  Description of Artificial Sequence: Synthetic oligonucleotide
tgggccctgggtgaggtaaaggacatttatg

SEQ ID NO: 83351 - DNA, 30 bp, Artificial Sequence
  Description of Artificial Sequence: Synthetic oligonucleotide
gggccctgggtgaggtaaaggacatttatg

SEQ ID NO: 83352 - DNA, 31 bp, Artificial Sequence
  Description of Artificial Sequence: Synthetic oligonucleotide
ggccctgggtgaggtaaaggacatttatgag

SEQ ID NO: 83353 - DNA, 31 bp, Artificial Sequence
  Description of Artificial Sequence: Synthetic oligonucleotide
gccctgggtgaggtaaaggacatttatgagg

SEQ ID NO: 83354 - DNA, 32 bp, Artificial Sequence
  Description of Artificial Sequence: Synthetic oligonucleotide
ccctgggtgaggtaaaggacatttatgaggtc

SEQ ID NO: 83355 - DNA, 35 bp, Artificial Sequence
  Description of Artificial Sequence: Synthetic oligonucleotide
cctgggtgaggtaaaggacatttatgaggtcaatg

SEQ ID NO: 83356 - DNA, 37 bp, Artificial Sequence
  Description of Artificial Sequence: Synthetic oligonucleotide
ctgggtgaggtaaaggacatttatgaggtcaatgttc

SEQ ID NO: 83357 - DNA, 38 bp, Artificial Sequence
  Description of Artificial Sequence: Synthetic oligonucleotide
tgggtgaggtaaaggacatttatgaggtcaatgttctg

SEQ ID NO: 83358 - DNA, 37 bp, Artificial Sequence
  Description of Artificial Sequence: Synthetic oligonucleotide
gggtgaggtaaaggacatttatgaggtcaatgttctg

SEQ ID NO: 83359 - DNA, 37 bp, Artificial Sequence
  Description of Artificial Sequence: Synthetic oligonucleotide
ggtgaggtaaaggacatttatgaggtcaatgttctgg

SEQ ID NO: 83360 - DNA, 37 bp, Artificial Sequence
  Description of Artificial Sequence: Synthetic oligonucleotide
gtgaggtaaaggacatttatgaggtcaatgttctggg

SEQ ID NO: 83361 - DNA, 42 bp, Artificial Sequence
  Description of Artificial Sequence: Synthetic oligonucleotide
tgaggtaaaggacatttatgaggtcaatgttctgggaataac

SEQ ID NO: 83362 - DNA, 41 bp, Artificial Sequence
  Description of Artificial Sequence: Synthetic oligonucleotide
gaggtaaaggacatttatgaggtcaatgttctgggaataac

SEQ ID NO: 83363 - DNA, 42 bp, Artificial Sequence
  Description of Artificial Sequence: Synthetic oligonucleotide
aggtaaaggacatttatgaggtcaatgttctgggaataactc

SEQ ID NO: 83364 - DNA, 41 bp, Artificial Sequence
  Description of Artificial Sequence: Synthetic oligonucleotide
ggtaaaggacatttatgaggtcaatgttctgggaataactc

SEQ ID NO: 83365 - DNA, 42 bp, Artificial Sequence
  Description of Artificial Sequence: Synthetic oligonucleotide
gtaaaggacatttatgaggtcaatgttctgggaataactctc

SEQ ID NO: 83366 - DNA, 44 bp, Artificial Sequence
  Description of Artificial Sequence: Synthetic oligonucleotide
taaaggacatttatgaggtcaatgttctgggaataactctcttc

SEQ ID NO: 83367 - DNA, 43 bp, Artificial Sequence
  Description of Artificial Sequence: Synthetic oligonucleotide
aaaggacatttatgaggtcaatgttctgggaataactctcttc

SEQ ID NO: 83368 - DNA, 42 bp, Artificial Sequence
  Description of Artificial Sequence: Synthetic oligonucleotide
aaggacatttatgaggtcaatgttctgggaataactctcttc

SEQ ID NO: 83369 - DNA, 41 bp, Artificial Sequence
  Description of Artificial Sequence: Synthetic oligonucleotide
aggacatttatgaggtcaatgttctgggaataactctcttc

SEQ ID NO: 83370 - DNA, 40 bp, Artificial Sequence
  Description of Artificial Sequence: Synthetic oligonucleotide
ggacatttatgaggtcaatgttctgggaataactctcttc

SEQ ID NO: 83371 - DNA, 40 bp, Artificial Sequence
  Description of Artificial Sequence: Synthetic oligonucleotide
gacatttatgaggtcaatgttctgggaataactctcttcc

SEQ ID NO: 83372 - DNA, 40 bp, Artificial Sequence
  Description of Artificial Sequence: Synthetic oligonucleotide
acatttatgaggtcaatgttctgggaataactctcttccc

SEQ ID NO: 83373 - DNA, 39 bp, Artificial Sequence
  Description of Artificial Sequence: Synthetic oligonucleotide
catttatgaggtcaatgttctgggaataactctcttccc

SEQ ID NO: 83374 - DNA, 40 bp, Artificial Sequence
  Description of Artificial Sequence: Synthetic oligonucleotide
atttatgaggtcaatgttctgggaataactctcttccctg

SEQ ID NO: 83375 - DNA, 39 bp, Artificial Sequence
  Description of Artificial Sequence: Synthetic oligonucleotide
tttatgaggtcaatgttctgggaataactctcttccctg

SEQ ID NO: 83376 - DNA, 38 bp, Artificial Sequence
  Description of Artificial Sequence: Synthetic oligonucleotide
ttatgaggtcaatgttctgggaataactctcttccctg

SEQ ID NO: 83377 - DNA, 37 bp, Artificial Sequence
  Description of Artificial Sequence: Synthetic oligonucleotide
tatgaggtcaatgttctgggaataactctcttccctg

SEQ ID NO: 83378 - DNA, 33 bp, Artificial Sequence
  Description of Artificial Sequence: Synthetic oligonucleotide
tggaagggaagtggttgctgtgtatgttactgg

SEQ ID NO: 83379 - DNA, 32 bp, Artificial Sequence
  Description of Artificial Sequence: Synthetic oligonucleotide
ggaagggaagtggttgctgtgtatgttactgg

SEQ ID NO: 83380 - DNA, 33 bp, Artificial Sequence
  Description of Artificial Sequence: Synthetic oligonucleotide
gaagggaagtggttgctgtgtatgttactggtg

SEQ ID NO: 83381 - DNA, 33 bp, Artificial Sequence
  Description of Artificial Sequence: Synthetic oligonucleotide
aagggaagtggttgctgtgtatgttactggtgc

SEQ ID NO: 83382 - DNA, 32 bp, Artificial Sequence
  Description of Artificial Sequence: Synthetic oligonucleotide
agggaagtggttgctgtgtatgttactggtgc

SEQ ID NO: 83383 - DNA, 31 bp, Artificial Sequence
  Description of Artificial Sequence: Synthetic oligonucleotide
gggaagtggttgctgtgtatgttactggtgc

SEQ ID NO: 83384 - DNA, 33 bp, Artificial Sequence
  Description of Artificial Sequence: Synthetic oligonucleotide
ggaagtggttgctgtgtatgttactggtgcttg

SEQ ID NO: 83385 - DNA, 33 bp, Artificial Sequence
  Description of Artificial Sequence: Synthetic oligonucleotide
gaagtggttgctgtgtatgttactggtgcttgg

SEQ ID NO: 83386 - DNA, 35 bp, Artificial Sequence
  Description of Artificial Sequence: Synthetic oligonucleotide
aagtggttgctgtgtatgttactggtgcttggaac

SEQ ID NO: 83387 - DNA, 34 bp, Artificial Sequence
  Description of Artificial Sequence: Synthetic oligonucleotide
agtggttgctgtgtatgttactggtgcttggaac

SEQ ID NO: 83388 - DNA, 33 bp, Artificial Sequence
  Description of Artificial Sequence: Synthetic oligonucleotide
gtggttgctgtgtatgttactggtgcttggaac

SEQ ID NO: 83389 - DNA, 34 bp, Artificial Sequence
  Description of Artificial Sequence: Synthetic oligonucleotide
tggttgctgtgtatgttactggtgcttggaactg

SEQ ID NO: 83390 - DNA, 33 bp, Artificial Sequence
  Description of Artificial Sequence: Synthetic oligonucleotide
ggttgctgtgtatgttactggtgcttggaactg

SEQ ID NO: 83391 - DNA, 33 bp, Artificial Sequence
  Description of Artificial Sequence: Synthetic oligonucleotide
gttgctgtgtatgttactggtgcttggaactgc

SEQ ID NO: 83392 - DNA, 37 bp, Artificial Sequence
  Description of Artificial Sequence: Synthetic oligonucleotide
ttgctgtgtatgttactggtgcttggaactgctattg

SEQ ID NO: 83393 - DNA, 36 bp, Artificial Sequence
  Description of Artificial Sequence: Synthetic oligonucleotide
tgctgtgtatgttactggtgcttggaactgctattg

SEQ ID NO: 83394 - DNA, 35 bp, Artificial Sequence
  Description of Artificial Sequence: Synthetic oligonucleotide
gctgtgtatgttactggtgcttggaactgctattg

SEQ ID NO: 83395 - DNA, 37 bp, Artificial Sequence
  Description of Artificial Sequence: Synthetic oligonucleotide
ctgtgtatgttactggtgcttggaactgctattgttg

SEQ ID NO: 83396 - DNA, 38 bp, Artificial Sequence
  Description of Artificial Sequence: Synthetic oligonucleotide
tgtgtatgttactggtgcttggaactgctattgttgag

SEQ ID NO: 83397 - DNA, 37 bp, Artificial Sequence
  Description of Artificial Sequence: Synthetic oligonucleotide
gtgtatgttactggtgcttggaactgctattgttgag

SEQ ID NO: 83398 - DNA, 37 bp, Artificial Sequence
  Description of Artificial Sequence: Synthetic oligonucleotide
tgtatgttactggtgcttggaactgctattgttgagg

SEQ ID NO: 83399 - DNA, 36 bp, Artificial Sequence
  Description of Artificial Sequence: Synthetic oligonucleotide
gtatgttactggtgcttggaactgctattgttgagg

SEQ ID NO: 83400 - DNA, 36 bp, Artificial Sequence
  Description of Artificial Sequence: Synthetic oligonucleotide
tatgttactggtgcttggaactgctattgttgaggc

SEQ ID NO: 83401 - DNA, 35 bp, Artificial Sequence
  Description of Artificial Sequence: Synthetic oligonucleotide
atgttactggtgcttggaactgctattgttgaggc

SEQ ID NO: 83402 - DNA, 34 bp, Artificial Sequence
  Description of Artificial Sequence: Synthetic oligonucleotide
tgttactggtgcttggaactgctattgttgaggc

SEQ ID NO: 83403 - DNA, 33 bp, Artificial Sequence
  Description of Artificial Sequence: Synthetic oligonucleotide
gttactggtgcttggaactgctattgttgaggc

SEQ ID NO: 83404 - DNA, 34 bp, Artificial Sequence
  Description of Artificial Sequence: Synthetic oligonucleotide
ttactggtgcttggaactgctattgttgaggctc

SEQ ID NO: 83405 - DNA, 33 bp, Artificial Sequence
  Description of Artificial Sequence: Synthetic oligonucleotide
tactggtgcttggaactgctattgttgaggctc

SEQ ID NO: 83406 - DNA, 32 bp, Artificial Sequence
  Description of Artificial Sequence: Synthetic oligonucleotide
actggtgcttggaactgctattgttgaggctc

SEQ ID NO: 83407 - DNA, 31 bp, Artificial Sequence
  Description of Artificial Sequence: Synthetic oligonucleotide
ctggtgcttggaactgctattgttgaggctc

SEQ ID NO: 83408 - DNA, 33 bp, Artificial Sequence
  Description of Artificial Sequence: Synthetic oligonucleotide
tggtgcttggaactgctattgttgaggctcatg

SEQ ID NO: 83409 - DNA, 32 bp, Artificial Sequence
  Description of Artificial Sequence: Synthetic oligonucleotide
ggtgcttggaactgctattgttgaggctcatg

SEQ ID NO: 83410 - DNA, 34 bp, Artificial Sequence
  Description of Artificial Sequence: Synthetic oligonucleotide
gtgcttggaactgctattgttgaggctcatgatg

SEQ ID NO: 83411 - DNA, 34 bp, Artificial Sequence
  Description of Artificial Sequence: Synthetic oligonucleotide
tgcttggaactgctattgttgaggctcatgatgg

SEQ ID NO: 83412 - DNA, 33 bp, Artificial Sequence
  Description of Artificial Sequence: Synthetic oligonucleotide
gcttggaactgctattgttgaggctcatgatgg

SEQ ID NO: 83413 - DNA, 34 bp, Artificial Sequence
  Description of Artificial Sequence: Synthetic oligonucleotide
cttggaactgctattgttgaggctcatgatggac

SEQ ID NO: 83414 - DNA, 36 bp, Artificial Sequence
  Description of Artificial Sequence: Synthetic oligonucleotide
ttggaactgctattgttgaggctcatgatggacatg

SEQ ID NO: 83415 - DNA, 35 bp, Artificial Sequence
  Description of Artificial Sequence: Synthetic oligonucleotide
tggaactgctattgttgaggctcatgatggacatg

SEQ ID NO: 83416 - DNA, 34 bp, Artificial Sequence
  Description of Artificial Sequence: Synthetic oligonucleotide
ggaactgctattgttgaggctcatgatggacatg

SEQ ID NO: 83417 - DNA, 36 bp, Artificial Sequence
  Description of Artificial Sequence: Synthetic oligonucleotide
gaactgctattgttgaggctcatgatggacatgatg

SEQ ID NO: 83418 - DNA, 38 bp, Artificial Sequence
  Description of Artificial Sequence: Synthetic oligonucleotide
aactgctattgttgaggctcatgatggacatgatgatg

SEQ ID NO: 83419 - DNA, 37 bp, Artificial Sequence
  Description of Artificial Sequence: Synthetic oligonucleotide
actgctattgttgaggctcatgatggacatgatgatg

SEQ ID NO: 83420 - DNA, 36 bp, Artificial Sequence
  Description of Artificial Sequence: Synthetic oligonucleotide
ctgctattgttgaggctcatgatggacatgatgatg

SEQ ID NO: 83421 - DNA, 38 bp, Artificial Sequence
  Description of Artificial Sequence: Synthetic oligonucleotide
tgctattgttgaggctcatgatggacatgatgatgatg

SEQ ID NO: 83422 - DNA, 37 bp, Artificial Sequence
  Description of Artificial Sequence: Synthetic oligonucleotide
gctattgttgaggctcatgatggacatgatgatgatg

SEQ ID NO: 83423 - DNA, 38 bp, Artificial Sequence
  Description of Artificial Sequence: Synthetic oligonucleotide
ctattgttgaggctcatgatggacatgatgatgatgtg

SEQ ID NO: 83424 - DNA, 41 bp, Artificial Sequence
  Description of Artificial Sequence: Synthetic oligonucleotide
tattgttgaggctcatgatggacatgatgatgatgtgattg

SEQ ID NO: 83425 - DNA, 40 bp, Artificial Sequence
  Description of Artificial Sequence: Synthetic oligonucleotide
attgttgaggctcatgatggacatgatgatgatgtgattg

SEQ ID NO: 83426 - DNA, 39 bp, Artificial Sequence
  Description of Artificial Sequence: Synthetic oligonucleotide
ttgttgaggctcatgatggacatgatgatgatgtgattg

SEQ ID NO: 83427 - DNA, 38 bp, Artificial Sequence
  Description of Artificial Sequence: Synthetic oligonucleotide
tgttgaggctcatgatggacatgatgatgatgtgattg

SEQ ID NO: 83428 - DNA, 37 bp, Artificial Sequence
  Description of Artificial Sequence: Synthetic oligonucleotide
gttgaggctcatgatggacatgatgatgatgtgattg

SEQ ID NO: 83429 - DNA, 42 bp, Artificial Sequence
  Description of Artificial Sequence: Synthetic oligonucleotide
ttgaggctcatgatggacatgatgatgatgtgattgatattg

SEQ ID NO: 83430 - DNA, 41 bp, Artificial Sequence
  Description of Artificial Sequence: Synthetic oligonucleotide
tgaggctcatgatggacatgatgatgatgtgattgatattg

SEQ ID NO: 83431 - DNA, 40 bp, Artificial Sequence
  Description of Artificial Sequence: Synthetic oligonucleotide
gaggctcatgatggacatgatgatgatgtgattgatattg

SEQ ID NO: 83432 - DNA, 41 bp, Artificial Sequence
  Description of Artificial Sequence: Synthetic oligonucleotide
aggctcatgatggacatgatgatgatgtgattgatattgag

SEQ ID NO: 83433 - DNA, 40 bp, Artificial Sequence
  Description of Artificial Sequence: Synthetic oligonucleotide
ggctcatgatggacatgatgatgatgtgattgatattgag

SEQ ID NO: 83434 - DNA, 40 bp, Artificial Sequence
  Description of Artificial Sequence: Synthetic oligonucleotide
gctcatgatggacatgatgatgatgtgattgatattgagg

SEQ ID NO: 83435 - DNA, 42 bp, Artificial Sequence
  Description of Artificial Sequence: Synthetic oligonucleotide
ctcatgatggacatgatgatgatgtgattgatattgaggatg

SEQ ID NO: 83436 - DNA, 43 bp, Artificial Sequence
  Description of Artificial Sequence: Synthetic oligonucleotide
tcatgatggacatgatgatgatgtgattgatattgaggatgac

SEQ ID NO: 83437 - DNA, 42 bp, Artificial Sequence
  Description of Artificial Sequence: Synthetic oligonucleotide
catgatggacatgatgatgatgtgattgatattgaggatgac

SEQ ID NO: 83438 - DNA, 42 bp, Artificial Sequence
  Description of Artificial Sequence: Synthetic oligonucleotide
atgatggacatgatgatgatgtgattgatattgaggatgacc

SEQ ID NO: 83439 - DNA, 41 bp, Artificial Sequence
  Description of Artificial Sequence: Synthetic oligonucleotide
tgatggacatgatgatgatgtgattgatattgaggatgacc

SEQ ID NO: 83440 - DNA, 40 bp, Artificial Sequence
  Description of Artificial Sequence: Synthetic oligonucleotide
gatggacatgatgatgatgtgattgatattgaggatgacc

SEQ ID NO: 83441 - DNA, 42 bp, Artificial Sequence
  Description of Artificial Sequence: Synthetic oligonucleotide
atggacatgatgatgatgtgattgatattgaggatgaccttg

SEQ ID NO: 83442 - DNA, 41 bp, Artificial Sequence
  Description of Artificial Sequence: Synthetic oligonucleotide
tggacatgatgatgatgtgattgatattgaggatgaccttg

SEQ ID NO: 83443 - DNA, 40 bp, Artificial Sequence
  Description of Artificial Sequence: Synthetic oligonucleotide
ggacatgatgatgatgtgattgatattgaggatgaccttg

SEQ ID NO: 83444 - DNA, 41 bp, Artificial Sequence
  Description of Artificial Sequence: Synthetic oligonucleotide
gacatgatgatgatgtgattgatattgaggatgaccttgac

SEQ ID NO: 83445 - DNA, 41 bp, Artificial Sequence
  Description of Artificial Sequence: Synthetic oligonucleotide
acatgatgatgatgtgattgatattgaggatgaccttgacg

SEQ ID NO: 83446 - DNA, 40 bp, Artificial Sequence
  Description of Artificial Sequence: Synthetic oligonucleotide
catgatgatgatgtgattgatattgaggatgaccttgacg

SEQ ID NO: 83447 - DNA, 42 bp, Artificial Sequence
  Description of Artificial Sequence: Synthetic oligonucleotide
atgatgatgatgtgattgatattgaggatgaccttgacgatg

SEQ ID NO: 83448 - DNA, 41 bp, Artificial Sequence
  Description of Artificial Sequence: Synthetic oligonucleotide
tgatgatgatgtgattgatattgaggatgaccttgacgatg

SEQ ID NO: 83449 - DNA, 40 bp, Artificial Sequence
  Description of Artificial Sequence: Synthetic oligonucleotide
gatgatgatgtgattgatattgaggatgaccttgacgatg

SEQ ID NO: 83450 - DNA, 41 bp, Artificial Sequence
  Description of Artificial Sequence: Synthetic oligonucleotide
atgatgatgtgattgatattgaggatgaccttgacgatgtc

SEQ ID NO: 83451 - DNA, 40 bp, Artificial Sequence
  Description of Artificial Sequence: Synthetic oligonucleotide
tgatgatgtgattgatattgaggatgaccttgacgatgtc

SEQ ID NO: 83452 - DNA, 39 bp, Artificial Sequence
  Description of Artificial Sequence: Synthetic oligonucleotide
gatgatgtgattgatattgaggatgaccttgacgatgtc

SEQ ID NO: 83453 - DNA, 42 bp, Artificial Sequence
  Description of Artificial Sequence: Synthetic oligonucleotide
atgatgtgattgatattgaggatgaccttgacgatgtcattg

SEQ ID NO: 83454 - DNA, 41 bp, Artificial Sequence
  Description of Artificial Sequence: Synthetic oligonucleotide
tgatgtgattgatattgaggatgaccttgacgatgtcattg

SEQ ID NO: 83455 - DNA, 40 bp, Artificial Sequence
  Description of Artificial Sequence: Synthetic oligonucleotide
gatgtgattgatattgaggatgaccttgacgatgtcattg

SEQ ID NO: 83456 - DNA, 42 bp, Artificial Sequence
  Description of Artificial Sequence: Synthetic oligonucleotide
atgtgattgatattgaggatgaccttgacgatgtcattgaag

SEQ ID NO: 83457 - DNA, 41 bp, Artificial Sequence
  Description of Artificial Sequence: Synthetic oligonucleotide
tgtgattgatattgaggatgaccttgacgatgtcattgaag

SEQ ID NO: 83458 - DNA, 40 bp, Artificial Sequence
  Description of Artificial Sequence: Synthetic oligonucleotide
gtgattgatattgaggatgaccttgacgatgtcattgaag

SEQ ID NO: 83459 - DNA, 41 bp, Artificial Sequence
  Description of Artificial Sequence: Synthetic oligonucleotide
tgattgatattgaggatgaccttgacgatgtcattgaagag

SEQ ID NO: 83460 - DNA, 40 bp, Artificial Sequence
  Description of Artificial Sequence: Synthetic oligonucleotide
gattgatattgaggatgaccttgacgatgtcattgaagag

SEQ ID NO: 83461 - DNA, 40 bp, Artificial Sequence
  Description of Artificial Sequence: Synthetic oligonucleotide
attgatattgaggatgaccttgacgatgtcattgaagagg

SEQ ID NO: 83462 - DNA, 39 bp, Artificial Sequence
  Description of Artificial Sequence: Synthetic oligonucleotide
ttgatattgaggatgaccttgacgatgtcattgaagagg

SEQ ID NO: 83463 - DNA, 38 bp, Artificial Sequence
  Description of Artificial Sequence: Synthetic oligonucleotide
tgatattgaggatgaccttgacgatgtcattgaagagg

SEQ ID NO: 83464 - DNA, 37 bp, Artificial Sequence
  Description of Artificial Sequence: Synthetic oligonucleotide
gatattgaggatgaccttgacgatgtcattgaagagg

SEQ ID NO: 83465 - DNA, 39 bp, Artificial Sequence
  Description of Artificial Sequence: Synthetic oligonucleotide
atattgaggatgaccttgacgatgtcattgaagaggtag

SEQ ID NO: 83466 - DNA, 38 bp, Artificial Sequence
  Description of Artificial Sequence: Synthetic oligonucleotide
tattgaggatgaccttgacgatgtcattgaagaggtag

SEQ ID NO: 83467 - DNA, 37 bp, Artificial Sequence
  Description of Artificial Sequence: Synthetic oligonucleotide
attgaggatgaccttgacgatgtcattgaagaggtag

SEQ ID NO: 83468 - DNA, 36 bp, Artificial Sequence
  Description of Artificial Sequence: Synthetic oligonucleotide
ttgaggatgaccttgacgatgtcattgaagaggtag

SEQ ID NO: 83469 - DNA, 35 bp, Artificial Sequence
  Description of Artificial Sequence: Synthetic oligonucleotide
tgaggatgaccttgacgatgtcattgaagaggtag

SEQ ID NO: 83470 - DNA, 34 bp, Artificial Sequence
  Description of Artificial Sequence: Synthetic oligonucleotide
gaggatgaccttgacgatgtcattgaagaggtag

SEQ ID NO: 83471 - DNA, 36 bp, Artificial Sequence
  Description of Artificial Sequence: Synthetic oligonucleotide
aggatgaccttgacgatgtcattgaagaggtagaag

SEQ ID NO: 83472 - DNA, 35 bp, Artificial Sequence
  Description of Artificial Sequence: Synthetic oligonucleotide
ggatgaccttgacgatgtcattgaagaggtagaag

SEQ ID NO: 83473 - DNA, 36 bp, Artificial Sequence
  Description of Artificial Sequence: Synthetic oligonucleotide
gatgaccttgacgatgtcattgaagaggtagaagac

SEQ ID NO: 83474 - DNA, 37 bp, Artificial Sequence
  Description of Artificial Sequence: Synthetic oligonucleotide
atgaccttgacgatgtcattgaagaggtagaagactc

SEQ ID NO: 83475 - DNA, 36 bp, Artificial Sequence
  Description of Artificial Sequence: Synthetic oligonucleotide
tgaccttgacgatgtcattgaagaggtagaagactc

SEQ ID NO: 83476 - DNA, 35 bp, Artificial Sequence
  Description of Artificial Sequence: Synthetic oligonucleotide
gaccttgacgatgtcattgaagaggtagaagactc

SEQ ID NO: 83477 - DNA, 39 bp, Artificial Sequence
  Description of Artificial Sequence: Synthetic oligonucleotide
accttgacgatgtcattgaagaggtagaagactcaaaac

SEQ ID NO: 83478 - DNA, 38 bp, Artificial Sequence
  Description of Artificial Sequence: Synthetic oligonucleotide
ccttgacgatgtcattgaagaggtagaagactcaaaac

SEQ ID NO: 83479 - DNA, 38 bp, Artificial Sequence
  Description of Artificial Sequence: Synthetic oligonucleotide
cttgacgatgtcattgaagaggtagaagactcaaaacc

SEQ ID NO: 83480 - DNA, 39 bp, Artificial Sequence
  Description of Artificial Sequence: Synthetic oligonucleotide
ttgacgatgtcattgaagaggtagaagactcaaaaccag

SEQ ID NO: 83481 - DNA, 38 bp, Artificial Sequence
  Description of Artificial Sequence: Synthetic oligonucleotide
tgacgatgtcattgaagaggtagaagactcaaaaccag

SEQ ID NO: 83482 - DNA, 37 bp, Artificial Sequence
  Description of Artificial Sequence: Synthetic oligonucleotide
gacgatgtcattgaagaggtagaagactcaaaaccag

SEQ ID NO: 83483 - DNA, 40 bp, Artificial Sequence
  Description of Artificial Sequence: Synthetic oligonucleotide
acgatgtcattgaagaggtagaagactcaaaaccagatac

SEQ ID NO: 83484 - DNA, 39 bp, Artificial Sequence
  Description of Artificial Sequence: Synthetic oligonucleotide
cgatgtcattgaagaggtagaagactcaaaaccagatac

SEQ ID NO: 83485 - DNA, 39 bp, Artificial Sequence
  Description of Artificial Sequence: Synthetic oligonucleotide
gatgtcattgaagaggtagaagactcaaaaccagatacc

SEQ ID NO: 83486 - DNA, 40 bp, Artificial Sequence
  Description of Artificial Sequence: Synthetic oligonucleotide
atgtcattgaagaggtagaagactcaaaaccagataccac

SEQ ID NO: 83487 - DNA, 39 bp, Artificial Sequence
  Description of Artificial Sequence: Synthetic oligonucleotide
tgtcattgaagaggtagaagactcaaaaccagataccac

SEQ ID NO: 83488 - DNA, 38 bp, Artificial Sequence
  Description of Artificial Sequence: Synthetic oligonucleotide
gtcattgaagaggtagaagactcaaaaccagataccac

SEQ ID NO: 83489 - DNA, 39 bp, Artificial Sequence
  Description of Artificial Sequence: Synthetic oligonucleotide
tcattgaagaggtagaagactcaaaaccagataccactg

SEQ ID NO: 83490 - DNA, 38 bp, Artificial Sequence
  Description of Artificial Sequence: Synthetic oligonucleotide
cattgaagaggtagaagactcaaaaccagataccactg

SEQ ID NO: 83491 - DNA, 38 bp, Artificial Sequence
  Description of Artificial Sequence: Synthetic oligonucleotide
attgaagaggtagaagactcaaaaccagataccactgc

SEQ ID NO: 83492 - DNA, 37 bp, Artificial Sequence
  Description of Artificial Sequence: Synthetic oligonucleotide
ttgaagaggtagaagactcaaaaccagataccactgc

SEQ ID NO: 83493 - DNA, 36 bp, Artificial Sequence
  Description of Artificial Sequence: Synthetic oligonucleotide
tgaagaggtagaagactcaaaaccagataccactgc

SEQ ID NO: 83494 - DNA, 35 bp, Artificial Sequence
  Description of Artificial Sequence: Synthetic oligonucleotide
gaagaggtagaagactcaaaaccagataccactgc

SEQ ID NO: 83495 - DNA, 36 bp, Artificial Sequence
  Description of Artificial Sequence: Synthetic oligonucleotide
aagaggtagaagactcaaaaccagataccactgctc

SEQ ID NO: 83496 - DNA, 35 bp, Artificial Sequence
  Description of Artificial Sequence: Synthetic oligonucleotide
agaggtagaagactcaaaaccagataccactgctc

SEQ ID NO: 83497 - DNA, 34 bp, Artificial Sequence
  Description of Artificial Sequence: Synthetic oligonucleotide
gaggtagaagactcaaaaccagataccactgctc

SEQ ID NO: 83498 - DNA, 34 bp, Artificial Sequence
  Description of Artificial Sequence: Synthetic oligonucleotide
aggtagaagactcaaaaccagataccactgctcc

SEQ ID NO: 83499 - DNA, 33 bp, Artificial Sequence
  Description of Artificial Sequence: Synthetic oligonucleotide
ggtagaagactcaaaaccagataccactgctcc

SEQ ID NO: 83500 - DNA, 34 bp, Artificial Sequence
  Description of Artificial Sequence: Synthetic oligonucleotide
gtagaagactcaaaaccagataccactgctcctc

SEQ ID NO: 83501 - DNA, 34 bp, Artificial Sequence
  Description of Artificial Sequence: Synthetic oligonucleotide
tagaagactcaaaaccagataccactgctcctcc

SEQ ID NO: 83502 - DNA, 33 bp, Artificial Sequence
  Description of Artificial Sequence: Synthetic oligonucleotide
agaagactcaaaaccagataccactgctcctcc

SEQ ID NO: 83503 - DNA, 32 bp, Artificial Sequence
  Description of Artificial Sequence: Synthetic oligonucleotide
gaagactcaaaaccagataccactgctcctcc

SEQ ID NO: 83504 - DNA, 34 bp, Artificial Sequence
  Description of Artificial Sequence: Synthetic oligonucleotide
aagactcaaaaccagataccactgctcctccttc

SEQ ID NO: 83505 - DNA, 33 bp, Artificial Sequence
  Description of Artificial Sequence: Synthetic oligonucleotide
agactcaaaaccagataccactgctcctccttc

SEQ ID NO: 83506 - DNA, 32 bp, Artificial Sequence
  Description of Artificial Sequence: Synthetic oligonucleotide
gactcaaaaccagataccactgctcctccttc

SEQ ID NO: 83507 - DNA, 34 bp, Artificial Sequence
  Description of Artificial Sequence: Synthetic oligonucleotide
actcaaaaccagataccactgctcctccttcatc

SEQ ID NO: 83508 - DNA, 33 bp, Artificial Sequence
  Description of Artificial Sequence: Synthetic oligonucleotide
ctcaaaaccagataccactgctcctccttcatc

SEQ ID NO: 83509 - DNA, 34 bp, Artificial Sequence
  Description of Artificial Sequence: Synthetic oligonucleotide
tcaaaaccagataccactgctcctccttcatctc

SEQ ID NO: 83510 - DNA, 33 bp, Artificial Sequence
  Description of Artificial Sequence: Synthetic oligonucleotide
caaaaccagataccactgctcctccttcatctc

SEQ ID NO: 83511 - DNA, 33 bp, Artificial Sequence
  Description of Artificial Sequence: Synthetic oligonucleotide
aaaaccagataccactgctcctccttcatctcc

SEQ ID NO: 83512 - DNA, 32 bp, Artificial Sequence
  Description of Artificial Sequence: Synthetic oligonucleotide
aaaccagataccactgctcctccttcatctcc

SEQ ID NO: 83513 - DNA, 31 bp, Artificial Sequence
  Description of Artificial Sequence: Synthetic oligonucleotide
aaccagataccactgctcctccttcatctcc

SEQ ID NO: 83514 - DNA, 30 bp, Artificial Sequence
  Description of Artificial Sequence: Synthetic oligonucleotide
accagataccactgctcctccttcatctcc

SEQ ID NO: 83515 - DNA, 29 bp, Artificial Sequence
  Description of Artificial Sequence: Synthetic oligonucleotide
ccagataccactgctcctccttcatctcc

SEQ ID NO: 83516 - DNA, 29 bp, Artificial Sequence
  Description of Artificial Sequence: Synthetic oligonucleotide
cagataccactgctcctccttcatctccc

SEQ ID NO: 83517 - DNA, 31 bp, Artificial Sequence
  Description of Artificial Sequence: Synthetic oligonucleotide
agataccactgctcctccttcatctcccaag

SEQ ID NO: 83518 - DNA, 30 bp, Artificial Sequence
  Description of Artificial Sequence: Synthetic oligonucleotide
gataccactgctcctccttcatctcccaag

SEQ ID NO: 83519 - DNA, 30 bp, Artificial Sequence
  Description of Artificial Sequence: Synthetic oligonucleotide
ataccactgctcctccttcatctcccaagg

SEQ ID NO: 83520 - DNA, 29 bp, Artificial Sequence
  Description of Artificial Sequence: Synthetic oligonucleotide
taccactgctcctccttcatctcccaagg

SEQ ID NO: 83521 - DNA, 28 bp, Artificial Sequence
  Description of Artificial Sequence: Synthetic oligonucleotide
accactgctcctccttcatctcccaagg

SEQ ID NO: 83522 - DNA, 27 bp, Artificial Sequence
  Description of Artificial Sequence: Synthetic oligonucleotide
ccactgctcctccttcatctcccaagg

SEQ ID NO: 83523 - DNA, 30 bp, Artificial Sequence
  Description of Artificial Sequence: Synthetic oligonucleotide
cactgctcctccttcatctcccaaggttac

SEQ ID NO: 83524 - DNA, 33 bp, Artificial Sequence
  Description of Artificial Sequence: Synthetic oligonucleotide
actgctcctccttcatctcccaaggttacttac

SEQ ID NO: 83525 - DNA, 32 bp, Artificial Sequence
  Description of Artificial Sequence: Synthetic oligonucleotide
ctgctcctccttcatctcccaaggttacttac

SEQ ID NO: 83526 - DNA, 35 bp, Artificial Sequence
  Description of Artificial Sequence: Synthetic oligonucleotide
tgctcctccttcatctcccaaggttacttacaaag

SEQ ID NO: 83527 - DNA, 34 bp, Artificial Sequence
  Description of Artificial Sequence: Synthetic oligonucleotide
gctcctccttcatctcccaaggttacttacaaag

SEQ ID NO: 83528 - DNA, 34 bp, Artificial Sequence
  Description of Artificial Sequence: Synthetic oligonucleotide
ctcctccttcatctcccaaggttacttacaaagc

SEQ ID NO: 83529 - DNA, 35 bp, Artificial Sequence
  Description of Artificial Sequence: Synthetic oligonucleotide
tcctccttcatctcccaaggttacttacaaagctc

SEQ ID NO: 83530 - DNA, 34 bp, Artificial Sequence
  Description of Artificial Sequence: Synthetic oligonucleotide
cctccttcatctcccaaggttacttacaaagctc

SEQ ID NO: 83531 - DNA, 34 bp, Artificial Sequence
  Description of Artificial Sequence: Synthetic oligonucleotide
ctccttcatctcccaaggttacttacaaagctcc

SEQ ID NO: 83532 - DNA, 35 bp, Artificial Sequence
  Description of Artificial Sequence: Synthetic oligonucleotide
tccttcatctcccaaggttacttacaaagctccag

SEQ ID NO: 83533 - DNA, 34 bp, Artificial Sequence
  Description of Artificial Sequence: Synthetic oligonucleotide
ccttcatctcccaaggttacttacaaagctccag

SEQ ID NO: 83534 - DNA, 36 bp, Artificial Sequence
  Description of Artificial Sequence: Synthetic oligonucleotide
cttcatctcccaaggttacttacaaagctccagttc

SEQ ID NO: 83535 - DNA, 36 bp, Artificial Sequence
  Description of Artificial Sequence: Synthetic oligonucleotide
ttcatctcccaaggttacttacaaagctccagttcc

SEQ ID NO: 83536 - DNA, 35 bp, Artificial Sequence
  Description of Artificial Sequence: Synthetic oligonucleotide
tcatctcccaaggttacttacaaagctccagttcc

SEQ ID NO: 83537 - DNA, 34 bp, Artificial Sequence
  Description of Artificial Sequence: Synthetic oligonucleotide
catctcccaaggttacttacaaagctccagttcc

SEQ ID NO: 83538 - DNA, 36 bp, Artificial Sequence
  Description of Artificial Sequence: Synthetic oligonucleotide
atctcccaaggttacttacaaagctccagttccaac

SEQ ID NO: 83539 - DNA, 35 bp, Artificial Sequence
  Description of Artificial Sequence: Synthetic oligonucleotide
tctcccaaggttacttacaaagctccagttccaac

SEQ ID NO: 83540 - DNA, 34 bp, Artificial Sequence
  Description of Artificial Sequence: Synthetic oligonucleotide
ctcccaaggttacttacaaagctccagttccaac

SEQ ID NO: 83541 - DNA, 35 bp, Artificial Sequence
  Description of Artificial Sequence: Synthetic oligonucleotide
tcccaaggttacttacaaagctccagttccaacag

SEQ ID NO: 83542 - DNA, 34 bp, Artificial Sequence
  Description of Artificial Sequence: Synthetic oligonucleotide
cccaaggttacttacaaagctccagttccaacag

SEQ ID NO: 83543 - DNA, 34 bp, Artificial Sequence
  Description of Artificial Sequence: Synthetic oligonucleotide
ccaaggttacttacaaagctccagttccaacagg

SEQ ID NO: 83544 - DNA, 34 bp, Artificial Sequence
  Description of Artificial Sequence: Synthetic oligonucleotide
caaggttacttacaaagctccagttccaacaggg

SEQ ID NO: 83545 - DNA, 34 bp, Artificial Sequence
  Description of Artificial Sequence: Synthetic oligonucleotide
aaggttacttacaaagctccagttccaacagggg

SEQ ID NO: 83546 - DNA, 33 bp, Artificial Sequence
  Description of Artificial Sequence: Synthetic oligonucleotide
aggttacttacaaagctccagttccaacagggg

SEQ ID NO: 83547 - DNA, 32 bp, Artificial Sequence
  Description of Artificial Sequence: Synthetic oligonucleotide
ggttacttacaaagctccagttccaacagggg

SEQ ID NO: 83548 - DNA, 34 bp, Artificial Sequence
  Description of Artificial Sequence: Synthetic oligonucleotide
gttacttacaaagctccagttccaacaggggaag

SEQ ID NO: 83549 - DNA, 42 bp, Artificial Sequence
  Description of Artificial Sequence: Synthetic oligonucleotide
ttacttacaaagctccagttccaacaggggaagtatattttg

SEQ ID NO: 83550 - DNA, 41 bp, Artificial Sequence
  Description of Artificial Sequence: Synthetic oligonucleotide
tacttacaaagctccagttccaacaggggaagtatattttg

SEQ ID NO: 83551 - DNA, 40 bp, Artificial Sequence
  Description of Artificial Sequence: Synthetic oligonucleotide
acttacaaagctccagttccaacaggggaagtatattttg

SEQ ID NO: 83552 - DNA, 39 bp, Artificial Sequence
  Description of Artificial Sequence: Synthetic oligonucleotide
cttacaaagctccagttccaacaggggaagtatattttg

SEQ ID NO: 83553 - DNA, 39 bp, Artificial Sequence
  Description of Artificial Sequence: Synthetic oligonucleotide
ttacaaagctccagttccaacaggggaagtatattttgc

SEQ ID NO: 83554 - DNA, 38 bp, Artificial Sequence
  Description of Artificial Sequence: Synthetic oligonucleotide
tacaaagctccagttccaacaggggaagtatattttgc

SEQ ID NO: 83555 - DNA, 37 bp, Artificial Sequence
  Description of Artificial Sequence: Synthetic oligonucleotide
acaaagctccagttccaacaggggaagtatattttgc

SEQ ID NO: 83556 - DNA, 36 bp, Artificial Sequence
  Description of Artificial Sequence: Synthetic oligonucleotide
caaagctccagttccaacaggggaagtatattttgc

SEQ ID NO: 83557 - DNA, 37 bp, Artificial Sequence
  Description of Artificial Sequence: Synthetic oligonucleotide
aaagctccagttccaacaggggaagtatattttgctg

SEQ ID NO: 83558 - DNA, 36 bp, Artificial Sequence
  Description of Artificial Sequence: Synthetic oligonucleotide
aagctccagttccaacaggggaagtatattttgctg

SEQ ID NO: 83559 - DNA, 35 bp, Artificial Sequence
  Description of Artificial Sequence: Synthetic oligonucleotide
agctccagttccaacaggggaagtatattttgctg

SEQ ID NO: 83560 - DNA, 34 bp, Artificial Sequence
  Description of Artificial Sequence: Synthetic oligonucleotide
gctccagttccaacaggggaagtatattttgctg

SEQ ID NO: 83561 - DNA, 37 bp, Artificial Sequence
  Description of Artificial Sequence: Synthetic oligonucleotide
ctccagttccaacaggggaagtatattttgctgattc

SEQ ID NO: 83562 - DNA, 41 bp, Artificial Sequence
  Description of Artificial Sequence: Synthetic oligonucleotide
tccagttccaacaggggaagtatattttgctgattcttttg

SEQ ID NO: 83563 - DNA, 40 bp, Artificial Sequence
  Description of Artificial Sequence: Synthetic oligonucleotide
ccagttccaacaggggaagtatattttgctgattcttttg

SEQ ID NO: 83564 - DNA, 41 bp, Artificial Sequence
  Description of Artificial Sequence: Synthetic oligonucleotide
cagttccaacaggggaagtatattttgctgattcttttgac

SEQ ID NO: 83565 - DNA, 42 bp, Artificial Sequence
  Description of Artificial Sequence: Synthetic oligonucleotide
agttccaacaggggaagtatattttgctgattcttttgacag

SEQ ID NO: 83566 - DNA, 41 bp, Artificial Sequence
  Description of Artificial Sequence: Synthetic oligonucleotide
gttccaacaggggaagtatattttgctgattcttttgacag

SEQ ID NO: 83567 - DNA, 42 bp, Artificial Sequence
  Description of Artificial Sequence: Synthetic oligonucleotide
ttccaacaggggaagtatattttgctgattcttttgacagag

SEQ ID NO: 83568 - DNA, 41 bp, Artificial Sequence
  Description of Artificial Sequence: Synthetic oligonucleotide
tccaacaggggaagtatattttgctgattcttttgacagag

SEQ ID NO: 83569 - DNA, 40 bp, Artificial Sequence
  Description of Artificial Sequence: Synthetic oligonucleotide
ccaacaggggaagtatattttgctgattcttttgacagag

SEQ ID NO: 83570 - DNA, 40 bp, Artificial Sequence
  Description of Artificial Sequence: Synthetic oligonucleotide
caacaggggaagtatattttgctgattcttttgacagagg

SEQ ID NO: 83571 - DNA, 42 bp, Artificial Sequence
  Description of Artificial Sequence: Synthetic oligonucleotide
aacaggggaagtatattttgctgattcttttgacagaggaac

SEQ ID NO: 83572 - DNA, 41 bp, Artificial Sequence
  Description of Artificial Sequence: Synthetic oligonucleotide
acaggggaagtatattttgctgattcttttgacagaggaac

SEQ ID NO: 83573 - DNA, 40 bp, Artificial Sequence
  Description of Artificial Sequence: Synthetic oligonucleotide
caggggaagtatattttgctgattcttttgacagaggaac

SEQ ID NO: 83574 - DNA, 41 bp, Artificial Sequence
  Description of Artificial Sequence: Synthetic oligonucleotide
aggggaagtatattttgctgattcttttgacagaggaactc

SEQ ID NO: 83575 - DNA, 40 bp, Artificial Sequence
  Description of Artificial Sequence: Synthetic oligonucleotide
ggggaagtatattttgctgattcttttgacagaggaactc

SEQ ID NO: 83576 - DNA, 41 bp, Artificial Sequence
  Description of Artificial Sequence: Synthetic oligonucleotide
gggaagtatattttgctgattcttttgacagaggaactctg

SEQ ID NO: 83577 - DNA, 42 bp, Artificial Sequence
  Description of Artificial Sequence: Synthetic oligonucleotide
ggaagtatattttgctgattcttttgacagaggaactctgtc

SEQ ID NO: 83578 - DNA, 43 bp, Artificial Sequence
  Description of Artificial Sequence: Synthetic oligonucleotide
gaagtatattttgctgattcttttgacagaggaactctgtcag

SEQ ID NO: 83579 - DNA, 43 bp, Artificial Sequence
  Description of Artificial Sequence: Synthetic oligonucleotide
aagtatattttgctgattcttttgacagaggaactctgtcagg

SEQ ID NO: 83580 - DNA, 42 bp, Artificial Sequence
  Description of Artificial Sequence: Synthetic oligonucleotide
agtatattttgctgattcttttgacagaggaactctgtcagg

SEQ ID NO: 83581 - DNA, 41 bp, Artificial Sequence
  Description of Artificial Sequence: Synthetic oligonucleotide
gtatattttgctgattcttttgacagaggaactctgtcagg

SEQ ID NO: 83582 - DNA, 41 bp, Artificial Sequence
  Description of Artificial Sequence: Synthetic oligonucleotide
tatattttgctgattcttttgacagaggaactctgtcaggg

SEQ ID NO: 83583 - DNA, 40 bp, Artificial Sequence
  Description of Artificial Sequence: Synthetic oligonucleotide
atattttgctgattcttttgacagaggaactctgtcaggg

SEQ ID NO: 83584 - DNA, 39 bp, Artificial Sequence
  Description of Artificial Sequence: Synthetic oligonucleotide
tattttgctgattcttttgacagaggaactctgtcaggg

SEQ ID NO: 83585 - DNA, 38 bp, Artificial Sequence
  Description of Artificial Sequence: Synthetic oligonucleotide
attttgctgattcttttgacagaggaactctgtcaggg

SEQ ID NO: 83586 - DNA, 37 bp, Artificial Sequence
  Description of Artificial Sequence: Synthetic oligonucleotide
ttttgctgattcttttgacagaggaactctgtcaggg

SEQ ID NO: 83587 - DNA, 36 bp, Artificial Sequence
  Description of Artificial Sequence: Synthetic oligonucleotide
tttgctgattcttttgacagaggaactctgtcaggg

SEQ ID NO: 83588 - DNA, 35 bp, Artificial Sequence
  Description of Artificial Sequence: Synthetic oligonucleotide
ttgctgattcttttgacagaggaactctgtcaggg

SEQ ID NO: 83589 - DNA, 34 bp, Artificial Sequence
  Description of Artificial Sequence: Synthetic oligonucleotide
tgctgattcttttgacagaggaactctgtcaggg

SEQ ID NO: 83590 - DNA, 33 bp, Artificial Sequence
  Description of Artificial Sequence: Synthetic oligonucleotide
gctgattcttttgacagaggaactctgtcaggg

SEQ ID NO: 83591 - DNA, 34 bp, Artificial Sequence
  Description of Artificial Sequence: Synthetic oligonucleotide
ctgattcttttgacagaggaactctgtcagggtg

SEQ ID NO: 83592 - DNA, 34 bp, Artificial Sequence
  Description of Artificial Sequence: Synthetic oligonucleotide
tgattcttttgacagaggaactctgtcagggtgg

SEQ ID NO: 83593 - DNA, 33 bp, Artificial Sequence
  Description of Artificial Sequence: Synthetic oligonucleotide
gattcttttgacagaggaactctgtcagggtgg

SEQ ID NO: 83594 - DNA, 40 bp, Artificial Sequence
  Description of Artificial Sequence: Synthetic oligonucleotide
attcttttgacagaggaactctgtcagggtggattttatc

SEQ ID NO: 83595 - DNA, 39 bp, Artificial Sequence
  Description of Artificial Sequence: Synthetic oligonucleotide
ttcttttgacagaggaactctgtcagggtggattttatc

SEQ ID NO: 83596 - DNA, 38 bp, Artificial Sequence
  Description of Artificial Sequence: Synthetic oligonucleotide
tcttttgacagaggaactctgtcagggtggattttatc

SEQ ID NO: 83597 - DNA, 37 bp, Artificial Sequence
  Description of Artificial Sequence: Synthetic oligonucleotide
cttttgacagaggaactctgtcagggtggattttatc

SEQ ID NO: 83598 - DNA, 37 bp, Artificial Sequence
  Description of Artificial Sequence: Synthetic oligonucleotide
ttttgacagaggaactctgtcagggtggattttatcc

SEQ ID NO: 83599 - DNA, 36 bp, Artificial Sequence
  Description of Artificial Sequence: Synthetic oligonucleotide
tttgacagaggaactctgtcagggtggattttatcc

SEQ ID NO: 83600 - DNA, 35 bp, Artificial Sequence
  Description of Artificial Sequence: Synthetic oligonucleotide
ttgacagaggaactctgtcagggtggattttatcc

SEQ ID NO: 83601 - DNA, 34 bp, Artificial Sequence
  Description of Artificial Sequence: Synthetic oligonucleotide
tgacagaggaactctgtcagggtggattttatcc

SEQ ID NO: 83602 - DNA, 33 bp, Artificial Sequence
  Description of Artificial Sequence: Synthetic oligonucleotide
gacagaggaactctgtcagggtggattttatcc

SEQ ID NO: 83603 - DNA, 36 bp, Artificial Sequence
  Description of Artificial Sequence: Synthetic oligonucleotide
acagaggaactctgtcagggtggattttatccaaag

SEQ ID NO: 83604 - DNA, 35 bp, Artificial Sequence
  Description of Artificial Sequence: Synthetic oligonucleotide
cagaggaactctgtcagggtggattttatccaaag

SEQ ID NO: 83605 - DNA, 35 bp, Artificial Sequence
  Description of Artificial Sequence: Synthetic oligonucleotide
agaggaactctgtcagggtggattttatccaaagc

SEQ ID NO: 83606 - DNA, 34 bp, Artificial Sequence
  Description of Artificial Sequence: Synthetic oligonucleotide
gaggaactctgtcagggtggattttatccaaagc

SEQ ID NO: 83607 - DNA, 34 bp, Artificial Sequence
  Description of Artificial Sequence: Synthetic oligonucleotide
aggaactctgtcagggtggattttatccaaagcc

SEQ ID NO: 83608 - DNA, 33 bp, Artificial Sequence
  Description of Artificial Sequence: Synthetic oligonucleotide
ggaactctgtcagggtggattttatccaaagcc

SEQ ID NO: 83609 - DNA, 35 bp, Artificial Sequence
  Description of Artificial Sequence: Synthetic oligonucleotide
gaactctgtcagggtggattttatccaaagccaag

SEQ ID NO: 83610 - DNA, 38 bp, Artificial Sequence
  Description of Artificial Sequence: Synthetic oligonucleotide
aactctgtcagggtggattttatccaaagccaagaaag

SEQ ID NO: 83611 - DNA, 37 bp, Artificial Sequence
  Description of Artificial Sequence: Synthetic oligonucleotide
actctgtcagggtggattttatccaaagccaagaaag

SEQ ID NO: 83612 - DNA, 36 bp, Artificial Sequence
  Description of Artificial Sequence: Synthetic oligonucleotide
ctctgtcagggtggattttatccaaagccaagaaag

SEQ ID NO: 83613 - DNA, 37 bp, Artificial Sequence
  Description of Artificial Sequence: Synthetic oligonucleotide
tctgtcagggtggattttatccaaagccaagaaagac

SEQ ID NO: 83614 - DNA, 36 bp, Artificial Sequence
  Description of Artificial Sequence: Synthetic oligonucleotide
ctgtcagggtggattttatccaaagccaagaaagac

SEQ ID NO: 83615 - DNA, 36 bp, Artificial Sequence
  Description of Artificial Sequence: Synthetic oligonucleotide
tgtcagggtggattttatccaaagccaagaaagacg

SEQ ID NO: 83616 - DNA, 35 bp, Artificial Sequence
  Description of Artificial Sequence: Synthetic oligonucleotide
gtcagggtggattttatccaaagccaagaaagacg

SEQ ID NO: 83617 - DNA, 38 bp, Artificial Sequence
  Description of Artificial Sequence: Synthetic oligonucleotide
tcagggtggattttatccaaagccaagaaagacgatac

SEQ ID NO: 83618 - DNA, 37 bp, Artificial Sequence
  Description of Artificial Sequence: Synthetic oligonucleotide
cagggtggattttatccaaagccaagaaagacgatac

SEQ ID NO: 83619 - DNA, 37 bp, Artificial Sequence
  Description of Artificial Sequence: Synthetic oligonucleotide
agggtggattttatccaaagccaagaaagacgatacc

SEQ ID NO: 83620 - DNA, 36 bp, Artificial Sequence
  Description of Artificial Sequence: Synthetic oligonucleotide
gggtggattttatccaaagccaagaaagacgatacc

SEQ ID NO: 83621 - DNA, 36 bp, Artificial Sequence
  Description of Artificial Sequence: Synthetic oligonucleotide
ggtggattttatccaaagccaagaaagacgataccg

SEQ ID NO: 83622 - DNA, 38 bp, Artificial Sequence
  Description of Artificial Sequence: Synthetic oligonucleotide
gtggattttatccaaagccaagaaagacgataccgatg

SEQ ID NO: 83623 - DNA, 40 bp, Artificial Sequence
  Description of Artificial Sequence: Synthetic oligonucleotide
tggattttatccaaagccaagaaagacgataccgatgatg

SEQ ID NO: 83624 - DNA, 39 bp, Artificial Sequence
  Description of Artificial Sequence: Synthetic oligonucleotide
ggattttatccaaagccaagaaagacgataccgatgatg

SEQ ID NO: 83625 - DNA, 44 bp, Artificial Sequence
  Description of Artificial Sequence: Synthetic oligonucleotide
gattttatccaaagccaagaaagacgataccgatgatgaaattg

SEQ ID NO: 83626 - DNA, 44 bp, Artificial Sequence
  Description of Artificial Sequence: Synthetic oligonucleotide
attttatccaaagccaagaaagacgataccgatgatgaaattgc

SEQ ID NO: 83627 - DNA, 43 bp, Artificial Sequence
  Description of Artificial Sequence: Synthetic oligonucleotide
ttttatccaaagccaagaaagacgataccgatgatgaaattgc

SEQ ID NO: 83628 - DNA, 42 bp, Artificial Sequence
  Description of Artificial Sequence: Synthetic oligonucleotide
tttatccaaagccaagaaagacgataccgatgatgaaattgc

SEQ ID NO: 83629 - DNA, 41 bp, Artificial Sequence
  Description of Artificial Sequence: Synthetic oligonucleotide
ttatccaaagccaagaaagacgataccgatgatgaaattgc

SEQ ID NO: 83630 - DNA, 40 bp, Artificial Sequence
  Description of Artificial Sequence: Synthetic oligonucleotide
tatccaaagccaagaaagacgataccgatgatgaaattgc

SEQ ID NO: 83631 - DNA, 39 bp, Artificial Sequence
  Description of Artificial Sequence: Synthetic oligonucleotide
atccaaagccaagaaagacgataccgatgatgaaattgc

SEQ ID NO: 83632 - DNA, 38 bp, Artificial Sequence
  Description of Artificial Sequence: Synthetic oligonucleotide
tccaaagccaagaaagacgataccgatgatgaaattgc

SEQ ID NO: 83633 - DNA, 37 bp, Artificial Sequence
  Description of Artificial Sequence: Synthetic oligonucleotide
ccaaagccaagaaagacgataccgatgatgaaattgc

SEQ ID NO: 83634 - DNA, 37 bp, Artificial Sequence
  Description of Artificial Sequence: Synthetic oligonucleotide
caaagccaagaaagacgataccgatgatgaaattgcc

SEQ ID NO: 83635 - DNA, 43 bp, Artificial Sequence
  Description of Artificial Sequence: Synthetic oligonucleotide
aaagccaagaaagacgataccgatgatgaaattgccaaatatg

SEQ ID NO: 83636 - DNA, 42 bp, Artificial Sequence
  Description of Artificial Sequence: Synthetic oligonucleotide
aagccaagaaagacgataccgatgatgaaattgccaaatatg

SEQ ID NO: 83637 - DNA, 41 bp, Artificial Sequence
  Description of Artificial Sequence: Synthetic oligonucleotide
agccaagaaagacgataccgatgatgaaattgccaaatatg

SEQ ID NO: 83638 - DNA, 40 bp, Artificial Sequence
  Description of Artificial Sequence: Synthetic oligonucleotide
gccaagaaagacgataccgatgatgaaattgccaaatatg

SEQ ID NO: 83639 - DNA, 42 bp, Artificial Sequence
  Description of Artificial Sequence: Synthetic oligonucleotide
ccaagaaagacgataccgatgatgaaattgccaaatatgatg

SEQ ID NO: 83640 - DNA, 42 bp, Artificial Sequence
  Description of Artificial Sequence: Synthetic oligonucleotide
caagaaagacgataccgatgatgaaattgccaaatatgatgg

SEQ ID NO: 83641 - DNA, 45 bp, Artificial Sequence
  Description of Artificial Sequence: Synthetic oligonucleotide
aagaaagacgataccgatgatgaaattgccaaatatgatggaaag

SEQ ID NO: 83642 - DNA, 44 bp, Artificial Sequence
  Description of Artificial Sequence: Synthetic oligonucleotide
agaaagacgataccgatgatgaaattgccaaatatgatggaaag

SEQ ID NO: 83643 - DNA, 43 bp, Artificial Sequence
  Description of Artificial Sequence: Synthetic oligonucleotide
gaaagacgataccgatgatgaaattgccaaatatgatggaaag

SEQ ID NO: 83644 - DNA, 44 bp, Artificial Sequence
  Description of Artificial Sequence: Synthetic oligonucleotide
aaagacgataccgatgatgaaattgccaaatatgatggaaagtg

SEQ ID NO: 83645 - DNA, 43 bp, Artificial Sequence
  Description of Artificial Sequence: Synthetic oligonucleotide
aagacgataccgatgatgaaattgccaaatatgatggaaagtg

SEQ ID NO: 83646 - DNA, 42 bp, Artificial Sequence
  Description of Artificial Sequence: Synthetic oligonucleotide
agacgataccgatgatgaaattgccaaatatgatggaaagtg

SEQ ID NO: 83647 - DNA, 41 bp, Artificial Sequence
  Description of Artificial Sequence: Synthetic oligonucleotide
gacgataccgatgatgaaattgccaaatatgatggaaagtg

SEQ ID NO: 83648 - DNA, 41 bp, Artificial Sequence
  Description of Artificial Sequence: Synthetic oligonucleotide
acgataccgatgatgaaattgccaaatatgatggaaagtgg

SEQ ID NO: 83649 - DNA, 40 bp, Artificial Sequence
  Description of Artificial Sequence: Synthetic oligonucleotide
cgataccgatgatgaaattgccaaatatgatggaaagtgg

SEQ ID NO: 83650 - DNA, 40 bp, Artificial Sequence
  Description of Artificial Sequence: Synthetic oligonucleotide
gataccgatgatgaaattgccaaatatgatggaaagtggg

SEQ ID NO: 83651 - DNA, 41 bp, Artificial Sequence
  Description of Artificial Sequence: Synthetic oligonucleotide
ataccgatgatgaaattgccaaatatgatggaaagtgggag

SEQ ID NO: 83652 - DNA, 40 bp, Artificial Sequence
  Description of Artificial Sequence: Synthetic oligonucleotide
taccgatgatgaaattgccaaatatgatggaaagtgggag

SEQ ID NO: 83653 - DNA, 39 bp, Artificial Sequence
  Description of Artificial Sequence: Synthetic oligonucleotide
accgatgatgaaattgccaaatatgatggaaagtgggag

SEQ ID NO: 83654 - DNA, 38 bp, Artificial Sequence
  Description of Artificial Sequence: Synthetic oligonucleotide
ccgatgatgaaattgccaaatatgatggaaagtgggag

SEQ ID NO: 83655 - DNA, 38 bp, Artificial Sequence
  Description of Artificial Sequence: Synthetic oligonucleotide
cgatgatgaaattgccaaatatgatggaaagtgggagg

SEQ ID NO: 83656 - DNA, 40 bp, Artificial Sequence
  Description of Artificial Sequence: Synthetic oligonucleotide
gatgatgaaattgccaaatatgatggaaagtgggaggtag

SEQ ID NO: 83657 - DNA, 41 bp, Artificial Sequence
  Description of Artificial Sequence: Synthetic oligonucleotide
atgatgaaattgccaaatatgatggaaagtgggaggtagag

SEQ ID NO: 83658 - DNA, 40 bp, Artificial Sequence
  Description of Artificial Sequence: Synthetic oligonucleotide
tgatgaaattgccaaatatgatggaaagtgggaggtagag

SEQ ID NO: 83659 - DNA, 39 bp, Artificial Sequence
  Description of Artificial Sequence: Synthetic oligonucleotide
gatgaaattgccaaatatgatggaaagtgggaggtagag

SEQ ID NO: 83660 - DNA, 39 bp, Artificial Sequence
  Description of Artificial Sequence: Synthetic oligonucleotide
atgaaattgccaaatatgatggaaagtgggaggtagagg

SEQ ID NO: 83661 - DNA, 38 bp, Artificial Sequence
  Description of Artificial Sequence: Synthetic oligonucleotide
tgaaattgccaaatatgatggaaagtgggaggtagagg

SEQ ID NO: 83662 - DNA, 37 bp, Artificial Sequence
  Description of Artificial Sequence: Synthetic oligonucleotide
gaaattgccaaatatgatggaaagtgggaggtagagg

SEQ ID NO: 83663 - DNA, 41 bp, Artificial Sequence
  Description of Artificial Sequence: Synthetic oligonucleotide
aaattgccaaatatgatggaaagtgggaggtagaggaaatg

SEQ ID NO: 83664 - DNA, 40 bp, Artificial Sequence
  Description of Artificial Sequence: Synthetic oligonucleotide
aattgccaaatatgatggaaagtgggaggtagaggaaatg

SEQ ID NO: 83665 - DNA, 39 bp, Artificial Sequence
  Description of Artificial Sequence: Synthetic oligonucleotide
attgccaaatatgatggaaagtgggaggtagaggaaatg

SEQ ID NO: 83666 - DNA, 38 bp, Artificial Sequence
  Description of Artificial Sequence: Synthetic oligonucleotide
ttgccaaatatgatggaaagtgggaggtagaggaaatg

SEQ ID NO: 83667 - DNA, 37 bp, Artificial Sequence
  Description of Artificial Sequence: Synthetic oligonucleotide
tgccaaatatgatggaaagtgggaggtagaggaaatg

SEQ ID NO: 83668 - DNA, 36 bp, Artificial Sequence
  Description of Artificial Sequence: Synthetic oligonucleotide
gccaaatatgatggaaagtgggaggtagaggaaatg

SEQ ID NO: 83669 - DNA, 38 bp, Artificial Sequence
  Description of Artificial Sequence: Synthetic oligonucleotide
ccaaatatgatggaaagtgggaggtagaggaaatgaag

SEQ ID NO: 83670 - DNA, 38 bp, Artificial Sequence
  Description of Artificial Sequence: Synthetic oligonucleotide
caaatatgatggaaagtgggaggtagaggaaatgaagg

SEQ ID NO: 83671 - DNA, 39 bp, Artificial Sequence
  Description of Artificial Sequence: Synthetic oligonucleotide
aaatatgatggaaagtgggaggtagaggaaatgaaggag

SEQ ID NO: 83672 - DNA, 38 bp, Artificial Sequence
  Description of Artificial Sequence: Synthetic oligonucleotide
aatatgatggaaagtgggaggtagaggaaatgaaggag

SEQ ID NO: 83673 - DNA, 37 bp, Artificial Sequence
  Description of Artificial Sequence: Synthetic oligonucleotide
atatgatggaaagtgggaggtagaggaaatgaaggag

SEQ ID NO: 83674 - DNA, 36 bp, Artificial Sequence
  Description of Artificial Sequence: Synthetic oligonucleotide
tatgatggaaagtgggaggtagaggaaatgaaggag

SEQ ID NO: 83675 - DNA, 35 bp, Artificial Sequence
  Description of Artificial Sequence: Synthetic oligonucleotide
atgatggaaagtgggaggtagaggaaatgaaggag

SEQ ID NO: 83676 - DNA, 34 bp, Artificial Sequence
  Description of Artificial Sequence: Synthetic oligonucleotide
tgatggaaagtgggaggtagaggaaatgaaggag

SEQ ID NO: 83677 - DNA, 33 bp, Artificial Sequence
  Description of Artificial Sequence: Synthetic oligonucleotide
gatggaaagtgggaggtagaggaaatgaaggag

SEQ ID NO: 83678 - DNA, 34 bp, Artificial Sequence
  Description of Artificial Sequence: Synthetic oligonucleotide
atggaaagtgggaggtagaggaaatgaaggagtc

SEQ ID NO: 83679 - DNA, 33 bp, Artificial Sequence
  Description of Artificial Sequence: Synthetic oligonucleotide
tggaaagtgggaggtagaggaaatgaaggagtc

SEQ ID NO: 83680 - DNA, 32 bp, Artificial Sequence
  Description of Artificial Sequence: Synthetic oligonucleotide
ggaaagtgggaggtagaggaaatgaaggagtc

SEQ ID NO: 83681 - DNA, 35 bp, Artificial Sequence
  Description of Artificial Sequence: Synthetic oligonucleotide
gaaagtgggaggtagaggaaatgaaggagtcaaag

SEQ ID NO: 83682 - DNA, 35 bp, Artificial Sequence
  Description of Artificial Sequence: Synthetic oligonucleotide
aaagtgggaggtagaggaaatgaaggagtcaaagc

SEQ ID NO: 83683 - DNA, 34 bp, Artificial Sequence
  Description of Artificial Sequence: Synthetic oligonucleotide
aagtgggaggtagaggaaatgaaggagtcaaagc

SEQ ID NO: 83684 - DNA, 33 bp, Artificial Sequence
  Description of Artificial Sequence: Synthetic oligonucleotide
agtgggaggtagaggaaatgaaggagtcaaagc

SEQ ID NO: 83685 - DNA, 32 bp, Artificial Sequence
  Description of Artificial Sequence: Synthetic oligonucleotide
gtgggaggtagaggaaatgaaggagtcaaagc

SEQ ID NO: 83686 - DNA, 34 bp, Artificial Sequence
  Description of Artificial Sequence: Synthetic oligonucleotide
tgggaggtagaggaaatgaaggagtcaaagcttc

SEQ ID NO: 83687 - DNA, 33 bp, Artificial Sequence
  Description of Artificial Sequence: Synthetic oligonucleotide
gggaggtagaggaaatgaaggagtcaaagcttc

SEQ ID NO: 83688 - DNA, 33 bp, Artificial Sequence
  Description of Artificial Sequence: Synthetic oligonucleotide
ggaggtagaggaaatgaaggagtcaaagcttcc

SEQ ID NO: 83689 - DNA, 34 bp, Artificial Sequence
  Description of Artificial Sequence: Synthetic oligonucleotide
gaggtagaggaaatgaaggagtcaaagcttccag

SEQ ID NO: 83690 - DNA, 34 bp, Artificial Sequence
  Description of Artificial Sequence: Synthetic oligonucleotide
aggtagaggaaatgaaggagtcaaagcttccagg

SEQ ID NO: 83691 - DNA, 33 bp, Artificial Sequence
  Description of Artificial Sequence: Synthetic oligonucleotide
ggtagaggaaatgaaggagtcaaagcttccagg

SEQ ID NO: 83692 - DNA, 34 bp, Artificial Sequence
  Description of Artificial Sequence: Synthetic oligonucleotide
gtagaggaaatgaaggagtcaaagcttccaggtg

SEQ ID NO: 83693 - DNA, 39 bp, Artificial Sequence
  Description of Artificial Sequence: Synthetic oligonucleotide
tagaggaaatgaaggagtcaaagcttccaggtgataaag

SEQ ID NO: 83694 - DNA, 38 bp, Artificial Sequence
  Description of Artificial Sequence: Synthetic oligonucleotide
agaggaaatgaaggagtcaaagcttccaggtgataaag

SEQ ID NO: 83695 - DNA, 37 bp, Artificial Sequence
  Description of Artificial Sequence: Synthetic oligonucleotide
gaggaaatgaaggagtcaaagcttccaggtgataaag

SEQ ID NO: 83696 - DNA, 37 bp, Artificial Sequence
  Description of Artificial Sequence: Synthetic oligonucleotide
aggaaatgaaggagtcaaagcttccaggtgataaagg

SEQ ID NO: 83697 - DNA, 36 bp, Artificial Sequence
  Description of Artificial Sequence: Synthetic oligonucleotide
ggaaatgaaggagtcaaagcttccaggtgataaagg

SEQ ID NO: 83698 - DNA, 37 bp, Artificial Sequence
  Description of Artificial Sequence: Synthetic oligonucleotide
gaaatgaaggagtcaaagcttccaggtgataaaggac

SEQ ID NO: 83699 - DNA, 39 bp, Artificial Sequence
  Description of Artificial Sequence: Synthetic oligonucleotide
aaatgaaggagtcaaagcttccaggtgataaaggacttg

SEQ ID NO: 83700 - DNA, 38 bp, Artificial Sequence
  Description of Artificial Sequence: Synthetic oligonucleotide
aatgaaggagtcaaagcttccaggtgataaaggacttg

SEQ ID NO: 83701 - DNA, 37 bp, Artificial Sequence
  Description of Artificial Sequence: Synthetic oligonucleotide
atgaaggagtcaaagcttccaggtgataaaggacttg

SEQ ID NO: 83702 - DNA, 36 bp, Artificial Sequence
  Description of Artificial Sequence: Synthetic oligonucleotide
tgaaggagtcaaagcttccaggtgataaaggacttg

SEQ ID NO: 83703 - DNA, 35 bp, Artificial Sequence
  Description of Artificial Sequence: Synthetic oligonucleotide
gaaggagtcaaagcttccaggtgataaaggacttg

SEQ ID NO: 83704 - DNA, 36 bp, Artificial Sequence
  Description of Artificial Sequence: Synthetic oligonucleotide
aaggagtcaaagcttccaggtgataaaggacttgtg

SEQ ID NO: 83705 - DNA, 35 bp, Artificial Sequence
  Description of Artificial Sequence: Synthetic oligonucleotide
aggagtcaaagcttccaggtgataaaggacttgtg

SEQ ID NO: 83706 - DNA, 34 bp, Artificial Sequence
  Description of Artificial Sequence: Synthetic oligonucleotide
ggagtcaaagcttccaggtgataaaggacttgtg

SEQ ID NO: 83707 - DNA, 36 bp, Artificial Sequence
  Description of Artificial Sequence: Synthetic oligonucleotide
gagtcaaagcttccaggtgataaaggacttgtgttg

SEQ ID NO: 83708 - DNA, 38 bp, Artificial Sequence
  Description of Artificial Sequence: Synthetic oligonucleotide
agtcaaagcttccaggtgataaaggacttgtgttgatg

SEQ ID NO: 83709 - DNA, 37 bp, Artificial Sequence
  Description of Artificial Sequence: Synthetic oligonucleotide
gtcaaagcttccaggtgataaaggacttgtgttgatg

SEQ ID NO: 83710 - DNA, 38 bp, Artificial Sequence
  Description of Artificial Sequence: Synthetic oligonucleotide
tcaaagcttccaggtgataaaggacttgtgttgatgtc

SEQ ID NO: 83711 - DNA, 37 bp, Artificial Sequence
  Description of Artificial Sequence: Synthetic oligonucleotide
caaagcttccaggtgataaaggacttgtgttgatgtc

SEQ ID NO: 83712 - DNA, 38 bp, Artificial Sequence
  Description of Artificial Sequence: Synthetic oligonucleotide
aaagcttccaggtgataaaggacttgtgttgatgtctc

SEQ ID NO: 83713 - DNA, 37 bp, Artificial Sequence
  Description of Artificial Sequence: Synthetic oligonucleotide
aagcttccaggtgataaaggacttgtgttgatgtctc

SEQ ID NO: 83714 - DNA, 36 bp, Artificial Sequence
  Description of Artificial Sequence: Synthetic oligonucleotide
agcttccaggtgataaaggacttgtgttgatgtctc

SEQ ID NO: 83715 - DNA, 35 bp, Artificial Sequence
  Description of Artificial Sequence: Synthetic oligonucleotide
gcttccaggtgataaaggacttgtgttgatgtctc

SEQ ID NO: 83716 - DNA, 35 bp, Artificial Sequence
  Description of Artificial Sequence: Synthetic oligonucleotide
cttccaggtgataaaggacttgtgttgatgtctcg

SEQ ID NO: 83717 - DNA, 35 bp, Artificial Sequence
  Description of Artificial Sequence: Synthetic oligonucleotide
ttccaggtgataaaggacttgtgttgatgtctcgg

SEQ ID NO: 83718 - DNA, 34 bp, Artificial Sequence
  Description of Artificial Sequence: Synthetic oligonucleotide
tccaggtgataaaggacttgtgttgatgtctcgg

SEQ ID NO: 83719 - DNA, 33 bp, Artificial Sequence
  Description of Artificial Sequence: Synthetic oligonucleotide
ccaggtgataaaggacttgtgttgatgtctcgg

SEQ ID NO: 83720 - DNA, 33 bp, Artificial Sequence
  Description of Artificial Sequence: Synthetic oligonucleotide
caggtgataaaggacttgtgttgatgtctcggg

SEQ ID NO: 83721 - DNA, 33 bp, Artificial Sequence
  Description of Artificial Sequence: Synthetic oligonucleotide
aggtgataaaggacttgtgttgatgtctcgggc

SEQ ID NO: 83722 - DNA, 32 bp, Artificial Sequence
  Description of Artificial Sequence: Synthetic oligonucleotide
ggtgataaaggacttgtgttgatgtctcgggc

SEQ ID NO: 83723 - DNA, 32 bp, Artificial Sequence
  Description of Artificial Sequence: Synthetic oligonucleotide
gtgataaaggacttgtgttgatgtctcgggcc

SEQ ID NO: 83724 - DNA, 34 bp, Artificial Sequence
  Description of Artificial Sequence: Synthetic oligonucleotide
tgataaaggacttgtgttgatgtctcgggccaag

SEQ ID NO: 83725 - DNA, 33 bp, Artificial Sequence
  Description of Artificial Sequence: Synthetic oligonucleotide
gataaaggacttgtgttgatgtctcgggccaag

SEQ ID NO: 83726 - DNA, 33 bp, Artificial Sequence
  Description of Artificial Sequence: Synthetic oligonucleotide
ataaaggacttgtgttgatgtctcgggccaagc

SEQ ID NO: 83727 - DNA, 32 bp, Artificial Sequence
  Description of Artificial Sequence: Synthetic oligonucleotide
taaaggacttgtgttgatgtctcgggccaagc

SEQ ID NO: 83728 - DNA, 31 bp, Artificial Sequence
  Description of Artificial Sequence: Synthetic oligonucleotide
aaaggacttgtgttgatgtctcgggccaagc

SEQ ID NO: 83729 - DNA, 30 bp, Artificial Sequence
  Description of Artificial Sequence: Synthetic oligonucleotide
aaggacttgtgttgatgtctcgggccaagc

SEQ ID NO: 83730 - DNA, 29 bp, Artificial Sequence
  Description of Artificial Sequence: Synthetic oligonucleotide
aggacttgtgttgatgtctcgggccaagc

SEQ ID NO: 83731 - DNA, 28 bp, Artificial Sequence
  Description of Artificial Sequence: Synthetic oligonucleotide
ggacttgtgttgatgtctcgggccaagc

SEQ ID NO: 83732 - DNA, 30 bp, Artificial Sequence
  Description of Artificial Sequence: Synthetic oligonucleotide
gacttgtgttgatgtctcgggccaagcatc

SEQ ID NO: 83733 - DNA, 32 bp, Artificial Sequence
  Description of Artificial Sequence: Synthetic oligonucleotide
acttgtgttgatgtctcgggccaagcatcatg

SEQ ID NO: 83734 - DNA, 31 bp, Artificial Sequence
  Description of Artificial Sequence: Synthetic oligonucleotide
cttgtgttgatgtctcgggccaagcatcatg

SEQ ID NO: 83735 - DNA, 31 bp, Artificial Sequence
  Description of Artificial Sequence: Synthetic oligonucleotide
ttgtgttgatgtctcgggccaagcatcatgc

SEQ ID NO: 83736 - DNA, 30 bp, Artificial Sequence
  Description of Artificial Sequence: Synthetic oligonucleotide
tgtgttgatgtctcgggccaagcatcatgc

SEQ ID NO: 83737 - DNA, 29 bp, Artificial Sequence
  Description of Artificial Sequence: Synthetic oligonucleotide
gtgttgatgtctcgggccaagcatcatgc

SEQ ID NO: 83738 - DNA, 29 bp, Artificial Sequence
  Description of Artificial Sequence: Synthetic oligonucleotide
tgttgatgtctcgggccaagcatcatgcc

SEQ ID NO: 83739 - DNA, 28 bp, Artificial Sequence
  Description of Artificial Sequence: Synthetic oligonucleotide
gttgatgtctcgggccaagcatcatgcc

SEQ ID NO: 83740 - DNA, 30 bp, Artificial Sequence
  Description of Artificial Sequence: Synthetic oligonucleotide
ttgatgtctcgggccaagcatcatgccatc

SEQ ID NO: 83741 - DNA, 29 bp, Artificial Sequence
  Description of Artificial Sequence: Synthetic oligonucleotide
tgatgtctcgggccaagcatcatgccatc

SEQ ID NO: 83742 - DNA, 28 bp, Artificial Sequence
  Description of Artificial Sequence: Synthetic oligonucleotide
gatgtctcgggccaagcatcatgccatc

SEQ ID NO: 83743 - DNA, 29 bp, Artificial Sequence
  Description of Artificial Sequence: Synthetic oligonucleotide
atgtctcgggccaagcatcatgccatctc

SEQ ID NO: 83744 - DNA, 28 bp, Artificial Sequence
  Description of Artificial Sequence: Synthetic oligonucleotide
tgtctcgggccaagcatcatgccatctc

SEQ ID NO: 83745 - DNA, 27 bp, Artificial Sequence
  Description of Artificial Sequence: Synthetic oligonucleotide
gtctcgggccaagcatcatgccatctc

SEQ ID NO: 83746 - DNA, 28 bp, Artificial Sequence
  Description of Artificial Sequence: Synthetic oligonucleotide
tctcgggccaagcatcatgccatctctg

SEQ ID NO: 83747 - DNA, 27 bp, Artificial Sequence
  Description of Artificial Sequence: Synthetic oligonucleotide
ctcgggccaagcatcatgccatctctg

SEQ ID NO: 83748 - DNA, 27 bp, Artificial Sequence
  Description of Artificial Sequence: Synthetic oligonucleotide
tcgggccaagcatcatgccatctctgc

SEQ ID NO: 83749 - DNA, 27 bp, Artificial Sequence
  Description of Artificial Sequence: Synthetic oligonucleotide
cgggccaagcatcatgccatctctgct

SEQ ID NO: 83750 - DNA, 30 bp, Artificial Sequence
  Description of Artificial Sequence: Synthetic oligonucleotide
gggccaagcatcatgccatctctgctaaac

SEQ ID NO: 83751 - DNA, 31 bp, Artificial Sequence
  Description of Artificial Sequence: Synthetic oligonucleotide
ggccaagcatcatgccatctctgctaaactg

SEQ ID NO: 83752 - DNA, 33 bp, Artificial Sequence
  Description of Artificial Sequence: Synthetic oligonucleotide
gccaagcatcatgccatctctgctaaactgaac

SEQ ID NO: 83753 - DNA, 35 bp, Artificial Sequence
  Description of Artificial Sequence: Synthetic oligonucleotide
ccaagcatcatgccatctctgctaaactgaacaag

SEQ ID NO: 83754 - DNA, 35 bp, Artificial Sequence
  Description of Artificial Sequence: Synthetic oligonucleotide
caagcatcatgccatctctgctaaactgaacaagc

SEQ ID NO: 83755 - DNA, 35 bp, Artificial Sequence
  Description of Artificial Sequence: Synthetic oligonucleotide
aagcatcatgccatctctgctaaactgaacaagcc

SEQ ID NO: 83756 - DNA, 34 bp, Artificial Sequence
  Description of Artificial Sequence: Synthetic oligonucleotide
agcatcatgccatctctgctaaactgaacaagcc

SEQ ID NO: 83757 - DNA, 33 bp, Artificial Sequence
  Description of Artificial Sequence: Synthetic oligonucleotide
gcatcatgccatctctgctaaactgaacaagcc

SEQ ID NO: 83758 - DNA, 33 bp, Artificial Sequence
  Description of Artificial Sequence: Synthetic oligonucleotide
catcatgccatctctgctaaactgaacaagccc

SEQ ID NO: 83759 - DNA, 35 bp, Artificial Sequence
  Description of Artificial Sequence: Synthetic oligonucleotide
atcatgccatctctgctaaactgaacaagcccttc

SEQ ID NO: 83760 - DNA, 34 bp, Artificial Sequence
  Description of Artificial Sequence: Synthetic oligonucleotide
tcatgccatctctgctaaactgaacaagcccttc

SEQ ID NO: 83761 - DNA, 33 bp, Artificial Sequence
  Description of Artificial Sequence: Synthetic oligonucleotide
catgccatctctgctaaactgaacaagcccttc

SEQ ID NO: 83762 - DNA, 33 bp, Artificial Sequence
  Description of Artificial Sequence: Synthetic oligonucleotide
atgccatctctgctaaactgaacaagcccttcc

SEQ ID NO: 83763 - DNA, 32 bp, Artificial Sequence
  Description of Artificial Sequence: Synthetic oligonucleotide
tgccatctctgctaaactgaacaagcccttcc

SEQ ID NO: 83764 - DNA, 31 bp, Artificial Sequence
  Description of Artificial Sequence: Synthetic oligonucleotide
gccatctctgctaaactgaacaagcccttcc

SEQ ID NO: 83765 - DNA, 32 bp, Artificial Sequence
  Description of Artificial Sequence: Synthetic oligonucleotide
ccatctctgctaaactgaacaagcccttcctg

SEQ ID NO: 83766 - DNA, 35 bp, Artificial Sequence
  Description of Artificial Sequence: Synthetic oligonucleotide
catctctgctaaactgaacaagcccttcctgtttg

SEQ ID NO: 83767 - DNA, 36 bp, Artificial Sequence
  Description of Artificial Sequence: Synthetic oligonucleotide
atctctgctaaactgaacaagcccttcctgtttgac

SEQ ID NO: 83768 - DNA, 35 bp, Artificial Sequence
  Description of Artificial Sequence: Synthetic oligonucleotide
tctctgctaaactgaacaagcccttcctgtttgac

SEQ ID NO: 83769 - DNA, 34 bp, Artificial Sequence
  Description of Artificial Sequence: Synthetic oligonucleotide
ctctgctaaactgaacaagcccttcctgtttgac

SEQ ID NO: 83770 - DNA, 35 bp, Artificial Sequence
  Description of Artificial Sequence: Synthetic oligonucleotide
tctgctaaactgaacaagcccttcctgtttgacac

SEQ ID NO: 83771 - DNA, 34 bp, Artificial Sequence
  Description of Artificial Sequence: Synthetic oligonucleotide
ctgctaaactgaacaagcccttcctgtttgacac

SEQ ID NO: 83772 - DNA, 34 bp, Artificial Sequence
  Description of Artificial Sequence: Synthetic oligonucleotide
tgctaaactgaacaagcccttcctgtttgacacc

SEQ ID NO: 83773 - DNA, 33 bp, Artificial Sequence
  Description of Artificial Sequence: Synthetic oligonucleotide
gctaaactgaacaagcccttcctgtttgacacc

SEQ ID NO: 83774 - DNA, 35 bp, Artificial Sequence
  Description of Artificial Sequence: Synthetic oligonucleotide
ctaaactgaacaagcccttcctgtttgacaccaag

SEQ ID NO: 83775 - DNA, 35 bp, Artificial Sequence
  Description of Artificial Sequence: Synthetic oligonucleotide
taaactgaacaagcccttcctgtttgacaccaagc

SEQ ID NO: 83776 - DNA, 34 bp, Artificial Sequence
  Description of Artificial Sequence: Synthetic oligonucleotide
aaactgaacaagcccttcctgtttgacaccaagc

SEQ ID NO: 83777 - DNA, 33 bp, Artificial Sequence
  Description of Artificial Sequence: Synthetic oligonucleotide
aactgaacaagcccttcctgtttgacaccaagc

SEQ ID NO: 83778 - DNA, 32 bp, Artificial Sequence
  Description of Artificial Sequence: Synthetic oligonucleotide
actgaacaagcccttcctgtttgacaccaagc

SEQ ID NO: 83779 - DNA, 31 bp, Artificial Sequence
  Description of Artificial Sequence: Synthetic oligonucleotide
ctgaacaagcccttcctgtttgacaccaagc

SEQ ID NO: 83780 - DNA, 31 bp, Artificial Sequence
  Description of Artificial Sequence: Synthetic oligonucleotide
tgaacaagcccttcctgtttgacaccaagcc

SEQ ID NO: 83781 - DNA, 30 bp, Artificial Sequence
  Description of Artificial Sequence: Synthetic oligonucleotide
gaacaagcccttcctgtttgacaccaagcc

SEQ ID NO: 83782 - DNA, 31 bp, Artificial Sequence
  Description of Artificial Sequence: Synthetic oligonucleotide
aacaagcccttcctgtttgacaccaagcctc

SEQ ID NO: 83783 - DNA, 30 bp, Artificial Sequence
  Description of Artificial Sequence: Synthetic oligonucleotide
acaagcccttcctgtttgacaccaagcctc

SEQ ID NO: 83784 - DNA, 29 bp, Artificial Sequence
  Description of Artificial Sequence: Synthetic oligonucleotide
caagcccttcctgtttgacaccaagcctc

SEQ ID NO: 83785 - DNA, 30 bp, Artificial Sequence
  Description of Artificial Sequence: Synthetic oligonucleotide
aagcccttcctgtttgacaccaagcctctc

SEQ ID NO: 83786 - DNA, 29 bp, Artificial Sequence
  Description of Artificial Sequence: Synthetic oligonucleotide
agcccttcctgtttgacaccaagcctctc

SEQ ID NO: 83787 - DNA, 28 bp, Artificial Sequence
  Description of Artificial Sequence: Synthetic oligonucleotide
gcccttcctgtttgacaccaagcctctc

SEQ ID NO: 83788 - DNA, 31 bp, Artificial Sequence
  Description of Artificial Sequence: Synthetic oligonucleotide
cccttcctgtttgacaccaagcctctcattg

SEQ ID NO: 83789 - DNA, 33 bp, Artificial Sequence
  Description of Artificial Sequence: Synthetic oligonucleotide
ccttcctgtttgacaccaagcctctcattgttc

SEQ ID NO: 83790 - DNA, 34 bp, Artificial Sequence
  Description of Artificial Sequence: Synthetic oligonucleotide
cttcctgtttgacaccaagcctctcattgttcag

SEQ ID NO: 83791 - DNA, 37 bp, Artificial Sequence
  Description of Artificial Sequence: Synthetic oligonucleotide
ttcctgtttgacaccaagcctctcattgttcagtatg

SEQ ID NO: 83792 - DNA, 36 bp, Artificial Sequence
  Description of Artificial Sequence: Synthetic oligonucleotide
tcctgtttgacaccaagcctctcattgttcagtatg

SEQ ID NO: 83793 - DNA, 35 bp, Artificial Sequence
  Description of Artificial Sequence: Synthetic oligonucleotide
cctgtttgacaccaagcctctcattgttcagtatg

SEQ ID NO: 83794 - DNA, 36 bp, Artificial Sequence
  Description of Artificial Sequence: Synthetic oligonucleotide
ctgtttgacaccaagcctctcattgttcagtatgag

SEQ ID NO: 83795 - DNA, 36 bp, Artificial Sequence
  Description of Artificial Sequence: Synthetic oligonucleotide
tgtttgacaccaagcctctcattgttcagtatgagg

SEQ ID NO: 83796 - DNA, 35 bp, Artificial Sequence
  Description of Artificial Sequence: Synthetic oligonucleotide
gtttgacaccaagcctctcattgttcagtatgagg

SEQ ID NO: 83797 - DNA, 42 bp, Artificial Sequence
  Description of Artificial Sequence: Synthetic oligonucleotide
tttgacaccaagcctctcattgttcagtatgaggttaatttc

SEQ ID NO: 83798 - DNA, 41 bp, Artificial Sequence
  Description of Artificial Sequence: Synthetic oligonucleotide
ttgacaccaagcctctcattgttcagtatgaggttaatttc

SEQ ID NO: 83799 - DNA, 40 bp, Artificial Sequence
  Description of Artificial Sequence: Synthetic oligonucleotide
tgacaccaagcctctcattgttcagtatgaggttaatttc

SEQ ID NO: 83800 - DNA, 39 bp, Artificial Sequence
  Description of Artificial Sequence: Synthetic oligonucleotide
gacaccaagcctctcattgttcagtatgaggttaatttc

SEQ ID NO: 83801 - DNA, 39 bp, Artificial Sequence
  Description of Artificial Sequence: Synthetic oligonucleotide
acaccaagcctctcattgttcagtatgaggttaatttcc

SEQ ID NO: 83802 - DNA, 38 bp, Artificial Sequence
  Description of Artificial Sequence: Synthetic oligonucleotide
caccaagcctctcattgttcagtatgaggttaatttcc

SEQ ID NO: 83803 - DNA, 43 bp, Artificial Sequence
  Description of Artificial Sequence: Synthetic oligonucleotide
accaagcctctcattgttcagtatgaggttaatttccaaaatg

SEQ ID NO: 83804 - DNA, 42 bp, Artificial Sequence
  Description of Artificial Sequence: Synthetic oligonucleotide
ccaagcctctcattgttcagtatgaggttaatttccaaaatg

SEQ ID NO: 83805 - DNA, 42 bp, Artificial Sequence
  Description of Artificial Sequence: Synthetic oligonucleotide
caagcctctcattgttcagtatgaggttaatttccaaaatgg

SEQ ID NO: 83806 - DNA, 46 bp, Artificial Sequence
  Description of Artificial Sequence: Synthetic oligonucleotide
aagcctctcattgttcagtatgaggttaatttccaaaatggaatag

SEQ ID NO: 83807 - DNA, 45 bp, Artificial Sequence
  Description of Artificial Sequence: Synthetic oligonucleotide
agcctctcattgttcagtatgaggttaatttccaaaatggaatag

SEQ ID NO: 83808 - DNA, 44 bp, Artificial Sequence
  Description of Artificial Sequence: Synthetic oligonucleotide
gcctctcattgttcagtatgaggttaatttccaaaatggaatag

SEQ ID NO: 83809 - DNA, 47 bp, Artificial Sequence
  Description of Artificial Sequence: Synthetic oligonucleotide
cctctcattgttcagtatgaggttaatttccaaaatggaatagaatg

SEQ ID NO: 83810 - DNA, 48 bp, Artificial Sequence
  Description of Artificial Sequence: Synthetic oligonucleotide
ctctcattgttcagtatgaggttaatttccaaaatggaatagaatgtg

SEQ ID NO: 83811 - DNA, 48 bp, Artificial Sequence
  Description of Artificial Sequence: Synthetic oligonucleotide
tctcattgttcagtatgaggttaatttccaaaatggaatagaatgtgg

SEQ ID NO: 83812 - DNA, 47 bp, Artificial Sequence
  Description of Artificial Sequence: Synthetic oligonucleotide
ctcattgttcagtatgaggttaatttccaaaatggaatagaatgtgg

SEQ ID NO: 83813 - DNA, 48 bp, Artificial Sequence
  Description of Artificial Sequence: Synthetic oligonucleotide
tcattgttcagtatgaggttaatttccaaaatggaatagaatgtggtg

SEQ ID NO: 83814 - DNA, 47 bp, Artificial Sequence
  Description of Artificial Sequence: Synthetic oligonucleotide
cattgttcagtatgaggttaatttccaaaatggaatagaatgtggtg

SEQ ID NO: 83815 - DNA, 47 bp, Artificial Sequence
  Description of Artificial Sequence: Synthetic oligonucleotide
attgttcagtatgaggttaatttccaaaatggaatagaatgtggtgg

SEQ ID NO: 83816 - DNA, 46 bp, Artificial Sequence
  Description of Artificial Sequence: Synthetic oligonucleotide
ttgttcagtatgaggttaatttccaaaatggaatagaatgtggtgg

SEQ ID NO: 83817 - DNA, 45 bp, Artificial Sequence
  Description of Artificial Sequence: Synthetic oligonucleotide
tgttcagtatgaggttaatttccaaaatggaatagaatgtggtgg

SEQ ID NO: 83818 - DNA, 44 bp, Artificial Sequence
  Description of Artificial Sequence: Synthetic oligonucleotide
gttcagtatgaggttaatttccaaaatggaatagaatgtggtgg

SEQ ID NO: 83819 - DNA, 45 bp, Artificial Sequence
  Description of Artificial Sequence: Synthetic oligonucleotide
ttcagtatgaggttaatttccaaaatggaatagaatgtggtggtg

SEQ ID NO: 83820 - DNA, 44 bp, Artificial Sequence
  Description of Artificial Sequence: Synthetic oligonucleotide
tcagtatgaggttaatttccaaaatggaatagaatgtggtggtg

SEQ ID NO: 83821 - DNA, 43 bp, Artificial Sequence
  Description of Artificial Sequence: Synthetic oligonucleotide
cagtatgaggttaatttccaaaatggaatagaatgtggtggtg

SEQ ID NO: 83822 - DNA, 43 bp, Artificial Sequence
  Description of Artificial Sequence: Synthetic oligonucleotide
agtatgaggttaatttccaaaatggaatagaatgtggtggtgc

SEQ ID NO: 83823 - DNA, 42 bp, Artificial Sequence
  Description of Artificial Sequence: Synthetic oligonucleotide
gtatgaggttaatttccaaaatggaatagaatgtggtggtgc

SEQ ID NO: 83824 - DNA, 42 bp, Artificial Sequence
  Description of Artificial Sequence: Synthetic oligonucleotide
tatgaggttaatttccaaaatggaatagaatgtggtggtgcc

SEQ ID NO: 83825 - DNA, 41 bp, Artificial Sequence
  Description of Artificial Sequence: Synthetic oligonucleotide
atgaggttaatttccaaaatggaatagaatgtggtggtgcc

SEQ ID NO: 83826 - DNA, 40 bp, Artificial Sequence
  Description of Artificial Sequence: Synthetic oligonucleotide
tgaggttaatttccaaaatggaatagaatgtggtggtgcc

SEQ ID NO: 83827 - DNA, 39 bp, Artificial Sequence
  Description of Artificial Sequence: Synthetic oligonucleotide
gaggttaatttccaaaatggaatagaatgtggtggtgcc

SEQ ID NO: 83828 - DNA, 42 bp, Artificial Sequence
  Description of Artificial Sequence: Synthetic oligonucleotide
aggttaatttccaaaatggaatagaatgtggtggtgcctatg

SEQ ID NO: 83829 - DNA, 41 bp, Artificial Sequence
  Description of Artificial Sequence: Synthetic oligonucleotide
ggttaatttccaaaatggaatagaatgtggtggtgcctatg

SEQ ID NO: 83830 - DNA, 42 bp, Artificial Sequence
  Description of Artificial Sequence: Synthetic oligonucleotide
gttaatttccaaaatggaatagaatgtggtggtgcctatgtg

SEQ ID NO: 83831 - DNA, 45 bp, Artificial Sequence
  Description of Artificial Sequence: Synthetic oligonucleotide
ttaatttccaaaatggaatagaatgtggtggtgcctatgtgaaac

SEQ ID NO: 83832 - DNA, 44 bp, Artificial Sequence
  Description of Artificial Sequence: Synthetic oligonucleotide
taatttccaaaatggaatagaatgtggtggtgcctatgtgaaac

SEQ ID NO: 83833 - DNA, 43 bp, Artificial Sequence
  Description of Artificial Sequence: Synthetic oligonucleotide
aatttccaaaatggaatagaatgtggtggtgcctatgtgaaac

SEQ ID NO: 83834 - DNA, 42 bp, Artificial Sequence
  Description of Artificial Sequence: Synthetic oligonucleotide
atttccaaaatggaatagaatgtggtggtgcctatgtgaaac

SEQ ID NO: 83835 - DNA, 41 bp, Artificial Sequence
  Description of Artificial Sequence: Synthetic oligonucleotide
tttccaaaatggaatagaatgtggtggtgcctatgtgaaac

SEQ ID NO: 83836 - DNA, 40 bp, Artificial Sequence
  Description of Artificial Sequence: Synthetic oligonucleotide
ttccaaaatggaatagaatgtggtggtgcctatgtgaaac

SEQ ID NO: 83837 - DNA, 39 bp, Artificial Sequence
  Description of Artificial Sequence: Synthetic oligonucleotide
tccaaaatggaatagaatgtggtggtgcctatgtgaaac

SEQ ID NO: 83838 - DNA, 38 bp, Artificial Sequence
  Description of Artificial Sequence: Synthetic oligonucleotide
ccaaaatggaatagaatgtggtggtgcctatgtgaaac

SEQ ID NO: 83839 - DNA, 39 bp, Artificial Sequence
  Description of Artificial Sequence: Synthetic oligonucleotide
caaaatggaatagaatgtggtggtgcctatgtgaaactg

SEQ ID NO: 83840 - DNA, 39 bp, Artificial Sequence
  Description of Artificial Sequence: Synthetic oligonucleotide
aaaatggaatagaatgtggtggtgcctatgtgaaactgc

SEQ ID NO: 83841 - DNA, 38 bp, Artificial Sequence
  Description of Artificial Sequence: Synthetic oligonucleotide
aaatggaatagaatgtggtggtgcctatgtgaaactgc

SEQ ID NO: 83842 - DNA, 37 bp, Artificial Sequence
  Description of Artificial Sequence: Synthetic oligonucleotide
aatggaatagaatgtggtggtgcctatgtgaaactgc

SEQ ID NO: 83843 - DNA, 36 bp, Artificial Sequence
  Description of Artificial Sequence: Synthetic oligonucleotide
atggaatagaatgtggtggtgcctatgtgaaactgc

SEQ ID NO: 83844 - DNA, 35 bp, Artificial Sequence
  Description of Artificial Sequence: Synthetic oligonucleotide
tggaatagaatgtggtggtgcctatgtgaaactgc

SEQ ID NO: 83845 - DNA, 34 bp, Artificial Sequence
  Description of Artificial Sequence: Synthetic oligonucleotide
ggaatagaatgtggtggtgcctatgtgaaactgc

SEQ ID NO: 83846 - DNA, 37 bp, Artificial Sequence
  Description of Artificial Sequence: Synthetic oligonucleotide
gaatagaatgtggtggtgcctatgtgaaactgctttc

SEQ ID NO: 83847 - DNA, 42 bp, Artificial Sequence
  Description of Artificial Sequence: Synthetic oligonucleotide
aatagaatgtggtggtgcctatgtgaaactgctttctaaaac

SEQ ID NO: 83848 - DNA, 41 bp, Artificial Sequence
  Description of Artificial Sequence: Synthetic oligonucleotide
atagaatgtggtggtgcctatgtgaaactgctttctaaaac

SEQ ID NO: 83849 - DNA, 40 bp, Artificial Sequence
  Description of Artificial Sequence: Synthetic oligonucleotide
tagaatgtggtggtgcctatgtgaaactgctttctaaaac

SEQ ID NO: 83850 - DNA, 39 bp, Artificial Sequence
  Description of Artificial Sequence: Synthetic oligonucleotide
agaatgtggtggtgcctatgtgaaactgctttctaaaac

SEQ ID NO: 83851 - DNA, 38 bp, Artificial Sequence
  Description of Artificial Sequence: Synthetic oligonucleotide
gaatgtggtggtgcctatgtgaaactgctttctaaaac

SEQ ID NO: 83852 - DNA, 39 bp, Artificial Sequence
  Description of Artificial Sequence: Synthetic oligonucleotide
aatgtggtggtgcctatgtgaaactgctttctaaaacac

SEQ ID NO: 83853 - DNA, 38 bp, Artificial Sequence
  Description of Artificial Sequence: Synthetic oligonucleotide
atgtggtggtgcctatgtgaaactgctttctaaaacac

SEQ ID NO: 83854 - DNA, 37 bp, Artificial Sequence
  Description of Artificial Sequence: Synthetic oligonucleotide
tgtggtggtgcctatgtgaaactgctttctaaaacac

SEQ ID NO: 83855 - DNA, 36 bp, Artificial Sequence
  Description of Artificial Sequence: Synthetic oligonucleotide
gtggtggtgcctatgtgaaactgctttctaaaacac

SEQ ID NO: 83856 - DNA, 36 bp, Artificial Sequence
  Description of Artificial Sequence: Synthetic oligonucleotide
tggtggtgcctatgtgaaactgctttctaaaacacc

SEQ ID NO: 83857 - DNA, 35 bp, Artificial Sequence
  Description of Artificial Sequence: Synthetic oligonucleotide
ggtggtgcctatgtgaaactgctttctaaaacacc

SEQ ID NO: 83858 - DNA, 36 bp, Artificial Sequence
  Description of Artificial Sequence: Synthetic oligonucleotide
gtggtgcctatgtgaaactgctttctaaaacaccag

SEQ ID NO: 83859 - DNA, 38 bp, Artificial Sequence
  Description of Artificial Sequence: Synthetic oligonucleotide
tggtgcctatgtgaaactgctttctaaaacaccagaac

SEQ ID NO: 83860 - DNA, 37 bp, Artificial Sequence
  Description of Artificial Sequence: Synthetic oligonucleotide
ggtgcctatgtgaaactgctttctaaaacaccagaac

SEQ ID NO: 83861 - DNA, 38 bp, Artificial Sequence
  Description of Artificial Sequence: Synthetic oligonucleotide
gtgcctatgtgaaactgctttctaaaacaccagaactc

SEQ ID NO: 83862 - DNA, 40 bp, Artificial Sequence
  Description of Artificial Sequence: Synthetic oligonucleotide
tgcctatgtgaaactgctttctaaaacaccagaactcaac

SEQ ID NO: 83863 - DNA, 39 bp, Artificial Sequence
  Description of Artificial Sequence: Synthetic oligonucleotide
gcctatgtgaaactgctttctaaaacaccagaactcaac

SEQ ID NO: 83864 - DNA, 39 bp, Artificial Sequence
  Description of Artificial Sequence: Synthetic oligonucleotide
cctatgtgaaactgctttctaaaacaccagaactcaacc

SEQ ID NO: 83865 - DNA, 40 bp, Artificial Sequence
  Description of Artificial Sequence: Synthetic oligonucleotide
ctatgtgaaactgctttctaaaacaccagaactcaacctg

SEQ ID NO: 83866 - DNA, 40 bp, Artificial Sequence
  Description of Artificial Sequence: Synthetic oligonucleotide
tatgtgaaactgctttctaaaacaccagaactcaacctgg

SEQ ID NO: 83867 - DNA, 39 bp, Artificial Sequence
  Description of Artificial Sequence: Synthetic oligonucleotide
atgtgaaactgctttctaaaacaccagaactcaacctgg

SEQ ID NO: 83868 - DNA, 38 bp, Artificial Sequence
  Description of Artificial Sequence: Synthetic oligonucleotide
tgtgaaactgctttctaaaacaccagaactcaacctgg

SEQ ID NO: 83869 - DNA, 37 bp, Artificial Sequence
  Description of Artificial Sequence: Synthetic oligonucleotide
gtgaaactgctttctaaaacaccagaactcaacctgg

SEQ ID NO: 83870 - DNA, 39 bp, Artificial Sequence
  Description of Artificial Sequence: Synthetic oligonucleotide
tgaaactgctttctaaaacaccagaactcaacctggatc

SEQ ID NO: 83871 - DNA, 38 bp, Artificial Sequence
  Description of Artificial Sequence: Synthetic oligonucleotide
gaaactgctttctaaaacaccagaactcaacctggatc

SEQ ID NO: 83872 - DNA, 39 bp, Artificial Sequence
  Description of Artificial Sequence: Synthetic oligonucleotide
aaactgctttctaaaacaccagaactcaacctggatcag

SEQ ID NO: 83873 - DNA, 38 bp, Artificial Sequence
  Description of Artificial Sequence: Synthetic oligonucleotide
aactgctttctaaaacaccagaactcaacctggatcag

SEQ ID NO: 83874 - DNA, 37 bp, Artificial Sequence
  Description of Artificial Sequence: Synthetic oligonucleotide
actgctttctaaaacaccagaactcaacctggatcag

SEQ ID NO: 83875 - DNA, 36 bp, Artificial Sequence
  Description of Artificial Sequence: Synthetic oligonucleotide
ctgctttctaaaacaccagaactcaacctggatcag

SEQ ID NO: 83876 - DNA, 38 bp, Artificial Sequence
  Description of Artificial Sequence: Synthetic oligonucleotide
tgctttctaaaacaccagaactcaacctggatcagttc

SEQ ID NO: 83877 - DNA, 37 bp, Artificial Sequence
  Description of Artificial Sequence: Synthetic oligonucleotide
gctttctaaaacaccagaactcaacctggatcagttc

SEQ ID NO: 83878 - DNA, 37 bp, Artificial Sequence
  Description of Artificial Sequence: Synthetic oligonucleotide
ctttctaaaacaccagaactcaacctggatcagttcc

SEQ ID NO: 83879 - DNA, 39 bp, Artificial Sequence
  Description of Artificial Sequence: Synthetic oligonucleotide
tttctaaaacaccagaactcaacctggatcagttccatg

SEQ ID NO: 83880 - DNA, 38 bp, Artificial Sequence
  Description of Artificial Sequence: Synthetic oligonucleotide
ttctaaaacaccagaactcaacctggatcagttccatg

SEQ ID NO: 83881 - DNA, 37 bp, Artificial Sequence
  Description of Artificial Sequence: Synthetic oligonucleotide
tctaaaacaccagaactcaacctggatcagttccatg

SEQ ID NO: 83882 - DNA, 36 bp, Artificial Sequence
  Description of Artificial Sequence: Synthetic oligonucleotide
ctaaaacaccagaactcaacctggatcagttccatg

SEQ ID NO: 83883 - DNA, 37 bp, Artificial Sequence
  Description of Artificial Sequence: Synthetic oligonucleotide
taaaacaccagaactcaacctggatcagttccatgac

SEQ ID NO: 83884 - DNA, 36 bp, Artificial Sequence
  Description of Artificial Sequence: Synthetic oligonucleotide
aaaacaccagaactcaacctggatcagttccatgac

SEQ ID NO: 83885 - DNA, 35 bp, Artificial Sequence
  Description of Artificial Sequence: Synthetic oligonucleotide
aaacaccagaactcaacctggatcagttccatgac

SEQ ID NO: 83886 - DNA, 34 bp, Artificial Sequence
  Description of Artificial Sequence: Synthetic oligonucleotide
aacaccagaactcaacctggatcagttccatgac

SEQ ID NO: 83887 - DNA, 33 bp, Artificial Sequence
  Description of Artificial Sequence: Synthetic oligonucleotide
acaccagaactcaacctggatcagttccatgac

SEQ ID NO: 83888 - DNA, 32 bp, Artificial Sequence
  Description of Artificial Sequence: Synthetic oligonucleotide
caccagaactcaacctggatcagttccatgac

SEQ ID NO: 83889 - DNA, 34 bp, Artificial Sequence
  Description of Artificial Sequence: Synthetic oligonucleotide
accagaactcaacctggatcagttccatgacaag

SEQ ID NO: 83890 - DNA, 33 bp, Artificial Sequence
  Description of Artificial Sequence: Synthetic oligonucleotide
ccagaactcaacctggatcagttccatgacaag

SEQ ID NO: 83891 - DNA, 34 bp, Artificial Sequence
  Description of Artificial Sequence: Synthetic oligonucleotide
cagaactcaacctggatcagttccatgacaagac

SEQ ID NO: 83892 - DNA, 34 bp, Artificial Sequence
  Description of Artificial Sequence: Synthetic oligonucleotide
agaactcaacctggatcagttccatgacaagacc

SEQ ID NO: 83893 - DNA, 33 bp, Artificial Sequence
  Description of Artificial Sequence: Synthetic oligonucleotide
gaactcaacctggatcagttccatgacaagacc

SEQ ID NO: 83894 - DNA, 33 bp, Artificial Sequence
  Description of Artificial Sequence: Synthetic oligonucleotide
aactcaacctggatcagttccatgacaagaccc

SEQ ID NO: 83895 - DNA, 32 bp, Artificial Sequence
  Description of Artificial Sequence: Synthetic oligonucleotide
actcaacctggatcagttccatgacaagaccc

SEQ ID NO: 83896 - DNA, 31 bp, Artificial Sequence
  Description of Artificial Sequence: Synthetic oligonucleotide
ctcaacctggatcagttccatgacaagaccc

SEQ ID NO: 83897 - DNA, 31 bp, Artificial Sequence
  Description of Artificial Sequence: Synthetic oligonucleotide
tcaacctggatcagttccatgacaagacccc

SEQ ID NO: 83898 - DNA, 30 bp, Artificial Sequence
  Description of Artificial Sequence: Synthetic oligonucleotide
caacctggatcagttccatgacaagacccc

SEQ ID NO: 83899 - DNA, 35 bp, Artificial Sequence
  Description of Artificial Sequence: Synthetic oligonucleotide
aacctggatcagttccatgacaagaccccttatac

SEQ ID NO: 83900 - DNA, 34 bp, Artificial Sequence
  Description of Artificial Sequence: Synthetic oligonucleotide
acctggatcagttccatgacaagaccccttatac

SEQ ID NO: 83901 - DNA, 33 bp, Artificial Sequence
  Description of Artificial Sequence: Synthetic oligonucleotide
cctggatcagttccatgacaagaccccttatac

SEQ ID NO: 83902 - DNA, 33 bp, Artificial Sequence
  Description of Artificial Sequence: Synthetic oligonucleotide
ctggatcagttccatgacaagaccccttatacg

SEQ ID NO: 83903 - DNA, 38 bp, Artificial Sequence
  Description of Artificial Sequence: Synthetic oligonucleotide
tggatcagttccatgacaagaccccttatacgattatg

SEQ ID NO: 83904 - DNA, 37 bp, Artificial Sequence
  Description of Artificial Sequence: Synthetic oligonucleotide
ggatcagttccatgacaagaccccttatacgattatg

SEQ ID NO: 83905 - DNA, 40 bp, Artificial Sequence
  Description of Artificial Sequence: Synthetic oligonucleotide
gatcagttccatgacaagaccccttatacgattatgtttg

SEQ ID NO: 83906 - DNA, 40 bp, Artificial Sequence
  Description of Artificial Sequence: Synthetic oligonucleotide
atcagttccatgacaagaccccttatacgattatgtttgg

SEQ ID NO: 83907 - DNA, 39 bp, Artificial Sequence
  Description of Artificial Sequence: Synthetic oligonucleotide
tcagttccatgacaagaccccttatacgattatgtttgg

SEQ ID NO: 83908 - DNA, 38 bp, Artificial Sequence
  Description of Artificial Sequence: Synthetic oligonucleotide
cagttccatgacaagaccccttatacgattatgtttgg

SEQ ID NO: 83909 - DNA, 39 bp, Artificial Sequence
  Description of Artificial Sequence: Synthetic oligonucleotide
agttccatgacaagaccccttatacgattatgtttggtc

SEQ ID NO: 83910 - DNA, 38 bp, Artificial Sequence
  Description of Artificial Sequence: Synthetic oligonucleotide
gttccatgacaagaccccttatacgattatgtttggtc

SEQ ID NO: 83911 - DNA, 38 bp, Artificial Sequence
  Description of Artificial Sequence: Synthetic oligonucleotide
ttccatgacaagaccccttatacgattatgtttggtcc

SEQ ID NO: 83912 - DNA, 37 bp, Artificial Sequence
  Description of Artificial Sequence: Synthetic oligonucleotide
tccatgacaagaccccttatacgattatgtttggtcc

SEQ ID NO: 83913 - DNA, 36 bp, Artificial Sequence
  Description of Artificial Sequence: Synthetic oligonucleotide
ccatgacaagaccccttatacgattatgtttggtcc

SEQ ID NO: 83914 - DNA, 37 bp, Artificial Sequence
  Description of Artificial Sequence: Synthetic oligonucleotide
catgacaagaccccttatacgattatgtttggtccag

SEQ ID NO: 83915 - DNA, 43 bp, Artificial Sequence
  Description of Artificial Sequence: Synthetic oligonucleotide
atgacaagaccccttatacgattatgtttggtccagataaatg

SEQ ID NO: 83916 - DNA, 42 bp, Artificial Sequence
  Description of Artificial Sequence: Synthetic oligonucleotide
tgacaagaccccttatacgattatgtttggtccagataaatg

SEQ ID NO: 83917 - DNA, 41 bp, Artificial Sequence
  Description of Artificial Sequence: Synthetic oligonucleotide
gacaagaccccttatacgattatgtttggtccagataaatg

SEQ ID NO: 83918 - DNA, 42 bp, Artificial Sequence
  Description of Artificial Sequence: Synthetic oligonucleotide
acaagaccccttatacgattatgtttggtccagataaatgtg

SEQ ID NO: 83919 - DNA, 41 bp, Artificial Sequence
  Description of Artificial Sequence: Synthetic oligonucleotide
caagaccccttatacgattatgtttggtccagataaatgtg

SEQ ID NO: 83920 - DNA, 41 bp, Artificial Sequence
  Description of Artificial Sequence: Synthetic oligonucleotide
aagaccccttatacgattatgtttggtccagataaatgtgg

SEQ ID NO: 83921 - DNA, 40 bp, Artificial Sequence
  Description of Artificial Sequence: Synthetic oligonucleotide
agaccccttatacgattatgtttggtccagataaatgtgg

SEQ ID NO: 83922 - DNA, 39 bp, Artificial Sequence
  Description of Artificial Sequence: Synthetic oligonucleotide
gaccccttatacgattatgtttggtccagataaatgtgg

SEQ ID NO: 83923 - DNA, 40 bp, Artificial Sequence
  Description of Artificial Sequence: Synthetic oligonucleotide
accccttatacgattatgtttggtccagataaatgtggag

SEQ ID NO: 83924 - DNA, 39 bp, Artificial Sequence
  Description of Artificial Sequence: Synthetic oligonucleotide
ccccttatacgattatgtttggtccagataaatgtggag

SEQ ID NO: 83925 - DNA, 40 bp, Artificial Sequence
  Description of Artificial Sequence: Synthetic oligonucleotide
cccttatacgattatgtttggtccagataaatgtggagag

SEQ ID NO: 83926 - DNA, 40 bp, Artificial Sequence
  Description of Artificial Sequence: Synthetic oligonucleotide
ccttatacgattatgtttggtccagataaatgtggagagg

SEQ ID NO: 83927 - DNA, 41 bp, Artificial Sequence
  Description of Artificial Sequence: Synthetic oligonucleotide
cttatacgattatgtttggtccagataaatgtggagaggac

SEQ ID NO: 83928 - DNA, 47 bp, Artificial Sequence
  Description of Artificial Sequence: Synthetic oligonucleotide
ttatacgattatgtttggtccagataaatgtggagaggactataaac

SEQ ID NO: 83929 - DNA, 46 bp, Artificial Sequence
  Description of Artificial Sequence: Synthetic oligonucleotide
tatacgattatgtttggtccagataaatgtggagaggactataaac

SEQ ID NO: 83930 - DNA, 45 bp, Artificial Sequence
  Description of Artificial Sequence: Synthetic oligonucleotide
atacgattatgtttggtccagataaatgtggagaggactataaac

SEQ ID NO: 83931 - DNA, 44 bp, Artificial Sequence
  Description of Artificial Sequence: Synthetic oligonucleotide
tacgattatgtttggtccagataaatgtggagaggactataaac

SEQ ID NO: 83932 - DNA, 43 bp, Artificial Sequence
  Description of Artificial Sequence: Synthetic oligonucleotide
acgattatgtttggtccagataaatgtggagaggactataaac

SEQ ID NO: 83933 - DNA, 42 bp, Artificial Sequence
  Description of Artificial Sequence: Synthetic oligonucleotide
cgattatgtttggtccagataaatgtggagaggactataaac

SEQ ID NO: 83934 - DNA, 43 bp, Artificial Sequence
  Description of Artificial Sequence: Synthetic oligonucleotide
gattatgtttggtccagataaatgtggagaggactataaactg

SEQ ID NO: 83935 - DNA, 43 bp, Artificial Sequence
  Description of Artificial Sequence: Synthetic oligonucleotide
attatgtttggtccagataaatgtggagaggactataaactgc

SEQ ID NO: 83936 - DNA, 42 bp, Artificial Sequence
  Description of Artificial Sequence: Synthetic oligonucleotide
ttatgtttggtccagataaatgtggagaggactataaactgc

SEQ ID NO: 83937 - DNA, 41 bp, Artificial Sequence
  Description of Artificial Sequence: Synthetic oligonucleotide
tatgtttggtccagataaatgtggagaggactataaactgc

SEQ ID NO: 83938 - DNA, 40 bp, Artificial Sequence
  Description of Artificial Sequence: Synthetic oligonucleotide
atgtttggtccagataaatgtggagaggactataaactgc

SEQ ID NO: 83939 - DNA, 39 bp, Artificial Sequence
  Description of Artificial Sequence: Synthetic oligonucleotide
tgtttggtccagataaatgtggagaggactataaactgc

SEQ ID NO: 83940 - DNA, 38 bp, Artificial Sequence
  Description of Artificial Sequence: Synthetic oligonucleotide
gtttggtccagataaatgtggagaggactataaactgc

SEQ ID NO: 83941 - DNA, 39 bp, Artificial Sequence
  Description of Artificial Sequence: Synthetic oligonucleotide
tttggtccagataaatgtggagaggactataaactgcac

SEQ ID NO: 83942 - DNA, 38 bp, Artificial Sequence
  Description of Artificial Sequence: Synthetic oligonucleotide
ttggtccagataaatgtggagaggactataaactgcac

SEQ ID NO: 83943 - DNA, 37 bp, Artificial Sequence
  Description of Artificial Sequence: Synthetic oligonucleotide
tggtccagataaatgtggagaggactataaactgcac

SEQ ID NO: 83944 - DNA, 36 bp, Artificial Sequence
  Description of Artificial Sequence: Synthetic oligonucleotide
ggtccagataaatgtggagaggactataaactgcac

SEQ ID NO: 83945 - DNA, 38 bp, Artificial Sequence
  Description of Artificial Sequence: Synthetic oligonucleotide
gtccagataaatgtggagaggactataaactgcacttc

SEQ ID NO: 83946 - DNA, 40 bp, Artificial Sequence
  Description of Artificial Sequence: Synthetic oligonucleotide
tccagataaatgtggagaggactataaactgcacttcatc

SEQ ID NO: 83947 - DNA, 39 bp, Artificial Sequence
  Description of Artificial Sequence: Synthetic oligonucleotide
ccagataaatgtggagaggactataaactgcacttcatc

SEQ ID NO: 83948 - DNA, 41 bp, Artificial Sequence
  Description of Artificial Sequence: Synthetic oligonucleotide
cagataaatgtggagaggactataaactgcacttcatcttc

SEQ ID NO: 83949 - DNA, 41 bp, Artificial Sequence
  Description of Artificial Sequence: Synthetic oligonucleotide
agataaatgtggagaggactataaactgcacttcatcttcc

SEQ ID NO: 83950 - DNA, 40 bp, Artificial Sequence
  Description of Artificial Sequence: Synthetic oligonucleotide
gataaatgtggagaggactataaactgcacttcatcttcc

SEQ ID NO: 83951 - DNA, 40 bp, Artificial Sequence
  Description of Artificial Sequence: Synthetic oligonucleotide
ataaatgtggagaggactataaactgcacttcatcttccg

SEQ ID NO: 83952 - DNA, 39 bp, Artificial Sequence
  Description of Artificial Sequence: Synthetic oligonucleotide
taaatgtggagaggactataaactgcacttcatcttccg

SEQ ID NO: 83953 - DNA, 38 bp, Artificial Sequence
  Description of Artificial Sequence: Synthetic oligonucleotide
aaatgtggagaggactataaactgcacttcatcttccg

SEQ ID NO: 83954 - DNA, 37 bp, Artificial Sequence
  Description of Artificial Sequence: Synthetic oligonucleotide
aatgtggagaggactataaactgcacttcatcttccg

SEQ ID NO: 83955 - DNA, 36 bp, Artificial Sequence
  Description of Artificial Sequence: Synthetic oligonucleotide
atgtggagaggactataaactgcacttcatcttccg

SEQ ID NO: 83956 - DNA, 35 bp, Artificial Sequence
  Description of Artificial Sequence: Synthetic oligonucleotide
tgtggagaggactataaactgcacttcatcttccg

SEQ ID NO: 83957 - DNA, 34 bp, Artificial Sequence
  Description of Artificial Sequence: Synthetic oligonucleotide
gtggagaggactataaactgcacttcatcttccg

SEQ ID NO: 83958 - DNA, 35 bp, Artificial Sequence
  Description of Artificial Sequence: Synthetic oligonucleotide
tggagaggactataaactgcacttcatcttccgac

SEQ ID NO: 83959 - DNA, 34 bp, Artificial Sequence
  Description of Artificial Sequence: Synthetic oligonucleotide
ggagaggactataaactgcacttcatcttccgac

SEQ ID NO: 83960 - DNA, 35 bp, Artificial Sequence
  Description of Artificial Sequence: Synthetic oligonucleotide
gagaggactataaactgcacttcatcttccgacac

SEQ ID NO: 83961 - DNA, 40 bp, Artificial Sequence
  Description of Artificial Sequence: Synthetic oligonucleotide
agaggactataaactgcacttcatcttccgacacaaaaac

SEQ ID NO: 83962 - DNA, 39 bp, Artificial Sequence
  Description of Artificial Sequence: Synthetic oligonucleotide
gaggactataaactgcacttcatcttccgacacaaaaac

SEQ ID NO: 83963 - DNA, 39 bp, Artificial Sequence
  Description of Artificial Sequence: Synthetic oligonucleotide
aggactataaactgcacttcatcttccgacacaaaaacc

SEQ ID NO: 83964 - DNA, 38 bp, Artificial Sequence
  Description of Artificial Sequence: Synthetic oligonucleotide
ggactataaactgcacttcatcttccgacacaaaaacc

SEQ ID NO: 83965 - DNA, 38 bp, Artificial Sequence
  Description of Artificial Sequence: Synthetic oligonucleotide
gactataaactgcacttcatcttccgacacaaaaaccc

SEQ ID NO: 83966 - DNA, 38 bp, Artificial Sequence
  Description of Artificial Sequence: Synthetic oligonucleotide
actataaactgcacttcatcttccgacacaaaaacccc

SEQ ID NO: 83967 - DNA, 37 bp, Artificial Sequence
  Description of Artificial Sequence: Synthetic oligonucleotide
ctataaactgcacttcatcttccgacacaaaaacccc

SEQ ID NO: 83968 - DNA, 41 bp, Artificial Sequence
  Description of Artificial Sequence: Synthetic oligonucleotide
tataaactgcacttcatcttccgacacaaaaaccccaaaac

SEQ ID NO: 83969 - DNA, 40 bp, Artificial Sequence
  Description of Artificial Sequence: Synthetic oligonucleotide
ataaactgcacttcatcttccgacacaaaaaccccaaaac

SEQ ID NO: 83970 - DNA, 39 bp, Artificial Sequence
  Description of Artificial Sequence: Synthetic oligonucleotide
taaactgcacttcatcttccgacacaaaaaccccaaaac

SEQ ID NO: 83971 - DNA, 38 bp, Artificial Sequence
  Description of Artificial Sequence: Synthetic oligonucleotide
aaactgcacttcatcttccgacacaaaaaccccaaaac

SEQ ID NO: 83972 - DNA, 37 bp, Artificial Sequence
  Description of Artificial Sequence: Synthetic oligonucleotide
aactgcacttcatcttccgacacaaaaaccccaaaac

SEQ ID NO: 83973 - DNA, 36 bp, Artificial Sequence
  Description of Artificial Sequence: Synthetic oligonucleotide
actgcacttcatcttccgacacaaaaaccccaaaac

SEQ ID NO: 83974 - DNA, 35 bp, Artificial Sequence
  Description of Artificial Sequence: Synthetic oligonucleotide
ctgcacttcatcttccgacacaaaaaccccaaaac

SEQ ID NO: 83975 - DNA, 35 bp, Artificial Sequence
  Description of Artificial Sequence: Synthetic oligonucleotide
tgcacttcatcttccgacacaaaaaccccaaaacg

SEQ ID NO: 83976 - DNA, 34 bp, Artificial Sequence
  Description of Artificial Sequence: Synthetic oligonucleotide
gcacttcatcttccgacacaaaaaccccaaaacg

SEQ ID NO: 83977 - DNA, 34 bp, Artificial Sequence
  Description of Artificial Sequence: Synthetic oligonucleotide
cacttcatcttccgacacaaaaaccccaaaacgg

SEQ ID NO: 83978 - DNA, 34 bp, Artificial Sequence
  Description of Artificial Sequence: Synthetic oligonucleotide
acttcatcttccgacacaaaaaccccaaaacggg

SEQ ID NO: 83979 - DNA, 33 bp, Artificial Sequence
  Description of Artificial Sequence: Synthetic oligonucleotide
cttcatcttccgacacaaaaaccccaaaacggg

SEQ ID NO: 83980 - DNA, 36 bp, Artificial Sequence
  Description of Artificial Sequence: Synthetic oligonucleotide
ttcatcttccgacacaaaaaccccaaaacgggtatc

SEQ ID NO: 83981 - DNA, 35 bp, Artificial Sequence
  Description of Artificial Sequence: Synthetic oligonucleotide
tcatcttccgacacaaaaaccccaaaacgggtatc

SEQ ID NO: 83982 - DNA, 34 bp, Artificial Sequence
  Description of Artificial Sequence: Synthetic oligonucleotide
catcttccgacacaaaaaccccaaaacgggtatc

SEQ ID NO: 83983 - DNA, 37 bp, Artificial Sequence
  Description of Artificial Sequence: Synthetic oligonucleotide
atcttccgacacaaaaaccccaaaacgggtatctatg

SEQ ID NO: 83984 - DNA, 36 bp, Artificial Sequence
  Description of Artificial Sequence: Synthetic oligonucleotide
tcttccgacacaaaaaccccaaaacgggtatctatg

SEQ ID NO: 83985 - DNA, 35 bp, Artificial Sequence
  Description of Artificial Sequence: Synthetic oligonucleotide
cttccgacacaaaaaccccaaaacgggtatctatg

SEQ ID NO: 83986 - DNA, 37 bp, Artificial Sequence
  Description of Artificial Sequence: Synthetic oligonucleotide
ttccgacacaaaaaccccaaaacgggtatctatgaag

SEQ ID NO: 83987 - DNA, 36 bp, Artificial Sequence
  Description of Artificial Sequence: Synthetic oligonucleotide
tccgacacaaaaaccccaaaacgggtatctatgaag

SEQ ID NO: 83988 - DNA, 35 bp, Artificial Sequence
  Description of Artificial Sequence: Synthetic oligonucleotide
ccgacacaaaaaccccaaaacgggtatctatgaag

SEQ ID NO: 83989 - DNA, 40 bp, Artificial Sequence
  Description of Artificial Sequence: Synthetic oligonucleotide
cgacacaaaaaccccaaaacgggtatctatgaagaaaaac

SEQ ID NO: 83990 - DNA, 42 bp, Artificial Sequence
  Description of Artificial Sequence: Synthetic oligonucleotide
gacacaaaaaccccaaaacgggtatctatgaagaaaaacatg

SEQ ID NO: 83991 - DNA, 42 bp, Artificial Sequence
  Description of Artificial Sequence: Synthetic oligonucleotide
acacaaaaaccccaaaacgggtatctatgaagaaaaacatgc

SEQ ID NO: 83992 - DNA, 41 bp, Artificial Sequence
  Description of Artificial Sequence: Synthetic oligonucleotide
cacaaaaaccccaaaacgggtatctatgaagaaaaacatgc

SEQ ID NO: 83993 - DNA, 44 bp, Artificial Sequence
  Description of Artificial Sequence: Synthetic oligonucleotide
acaaaaaccccaaaacgggtatctatgaagaaaaacatgctaag

SEQ ID NO: 83994 - DNA, 43 bp, Artificial Sequence
  Description of Artificial Sequence: Synthetic oligonucleotide
caaaaaccccaaaacgggtatctatgaagaaaaacatgctaag

SEQ ID NO: 83995 - DNA, 44 bp, Artificial Sequence
  Description of Artificial Sequence: Synthetic oligonucleotide
aaaaaccccaaaacgggtatctatgaagaaaaacatgctaagag

SEQ ID NO: 83996 - DNA, 43 bp, Artificial Sequence
  Description of Artificial Sequence: Synthetic oligonucleotide
aaaaccccaaaacgggtatctatgaagaaaaacatgctaagag

SEQ ID NO: 83997 - DNA, 42 bp, Artificial Sequence
  Description of Artificial Sequence: Synthetic oligonucleotide
aaaccccaaaacgggtatctatgaagaaaaacatgctaagag

SEQ ID NO: 83998 - DNA, 41 bp, Artificial Sequence
  Description of Artificial Sequence: Synthetic oligonucleotide
aaccccaaaacgggtatctatgaagaaaaacatgctaagag

SEQ ID NO: 83999 - DNA, 40 bp, Artificial Sequence
  Description of Artificial Sequence: Synthetic oligonucleotide
accccaaaacgggtatctatgaagaaaaacatgctaagag

SEQ ID NO: 84000 - DNA, 39 bp, Artificial Sequence
  Description of Artificial Sequence: Synthetic oligonucleotide
ccccaaaacgggtatctatgaagaaaaacatgctaagag

SEQ ID NO: 84001 - DNA, 39 bp, Artificial Sequence
  Description of Artificial Sequence: Synthetic oligonucleotide
cccaaaacgggtatctatgaagaaaaacatgctaagagg

SEQ ID NO: 84002 - DNA, 39 bp, Artificial Sequence
  Description of Artificial Sequence: Synthetic oligonucleotide
ccaaaacgggtatctatgaagaaaaacatgctaagaggc

SEQ ID NO: 84003 - DNA, 39 bp, Artificial Sequence
  Description of Artificial Sequence: Synthetic oligonucleotide
caaaacgggtatctatgaagaaaaacatgctaagaggcc

SEQ ID NO: 84004 - DNA, 40 bp, Artificial Sequence
  Description of Artificial Sequence: Synthetic oligonucleotide
aaaacgggtatctatgaagaaaaacatgctaagaggccag

SEQ ID NO: 84005 - DNA, 39 bp, Artificial Sequence
  Description of Artificial Sequence: Synthetic oligonucleotide
aaacgggtatctatgaagaaaaacatgctaagaggccag

SEQ ID NO: 84006 - DNA, 38 bp, Artificial Sequence
  Description of Artificial Sequence: Synthetic oligonucleotide
aacgggtatctatgaagaaaaacatgctaagaggccag

SEQ ID NO: 84007 - DNA, 37 bp, Artificial Sequence
  Description of Artificial Sequence: Synthetic oligonucleotide
acgggtatctatgaagaaaaacatgctaagaggccag

SEQ ID NO: 84008 - DNA, 36 bp, Artificial Sequence
  Description of Artificial Sequence: Synthetic oligonucleotide
cgggtatctatgaagaaaaacatgctaagaggccag

SEQ ID NO: 84009 - DNA, 38 bp, Artificial Sequence
  Description of Artificial Sequence: Synthetic oligonucleotide
gggtatctatgaagaaaaacatgctaagaggccagatg

SEQ ID NO: 84010 - DNA, 38 bp, Artificial Sequence
  Description of Artificial Sequence: Synthetic oligonucleotide
ggtatctatgaagaaaaacatgctaagaggccagatgc

SEQ ID NO: 84011 - DNA, 39 bp, Artificial Sequence
  Description of Artificial Sequence: Synthetic oligonucleotide
gtatctatgaagaaaaacatgctaagaggccagatgcag

SEQ ID NO: 84012 - DNA, 41 bp, Artificial Sequence
  Description of Artificial Sequence: Synthetic oligonucleotide
tatctatgaagaaaaacatgctaagaggccagatgcagatc

SEQ ID NO: 84013 - DNA, 40 bp, Artificial Sequence
  Description of Artificial Sequence: Synthetic oligonucleotide
atctatgaagaaaaacatgctaagaggccagatgcagatc

SEQ ID NO: 84014 - DNA, 39 bp, Artificial Sequence
  Description of Artificial Sequence: Synthetic oligonucleotide
tctatgaagaaaaacatgctaagaggccagatgcagatc

SEQ ID NO: 84015 - DNA, 38 bp, Artificial Sequence
  Description of Artificial Sequence: Synthetic oligonucleotide
ctatgaagaaaaacatgctaagaggccagatgcagatc

SEQ ID NO: 84016 - DNA, 39 bp, Artificial Sequence
  Description of Artificial Sequence: Synthetic oligonucleotide
tatgaagaaaaacatgctaagaggccagatgcagatctg

SEQ ID NO: 84017 - DNA, 38 bp, Artificial Sequence
  Description of Artificial Sequence: Synthetic oligonucleotide
atgaagaaaaacatgctaagaggccagatgcagatctg

SEQ ID NO: 84018 - DNA, 37 bp, Artificial Sequence
  Description of Artificial Sequence: Synthetic oligonucleotide
tgaagaaaaacatgctaagaggccagatgcagatctg

SEQ ID NO: 84019 - DNA, 36 bp, Artificial Sequence
  Description of Artificial Sequence: Synthetic oligonucleotide
gaagaaaaacatgctaagaggccagatgcagatctg

SEQ ID NO: 84020 - DNA, 38 bp, Artificial Sequence
  Description of Artificial Sequence: Synthetic oligonucleotide
aagaaaaacatgctaagaggccagatgcagatctgaag

SEQ ID NO: 84021 - DNA, 37 bp, Artificial Sequence
  Description of Artificial Sequence: Synthetic oligonucleotide
agaaaaacatgctaagaggccagatgcagatctgaag

SEQ ID NO: 84022 - DNA, 36 bp, Artificial Sequence
  Description of Artificial Sequence: Synthetic oligonucleotide
gaaaaacatgctaagaggccagatgcagatctgaag

SEQ ID NO: 84023 - DNA, 37 bp, Artificial Sequence
  Description of Artificial Sequence: Synthetic oligonucleotide
aaaaacatgctaagaggccagatgcagatctgaagac

SEQ ID NO: 84024 - DNA, 36 bp, Artificial Sequence
  Description of Artificial Sequence: Synthetic oligonucleotide
aaaacatgctaagaggccagatgcagatctgaagac

SEQ ID NO: 84025 - DNA, 35 bp, Artificial Sequence
  Description of Artificial Sequence: Synthetic oligonucleotide
aaacatgctaagaggccagatgcagatctgaagac

SEQ ID NO: 84026 - DNA, 34 bp, Artificial Sequence
  Description of Artificial Sequence: Synthetic oligonucleotide
aacatgctaagaggccagatgcagatctgaagac

SEQ ID NO: 84027 - DNA, 33 bp, Artificial Sequence
  Description of Artificial Sequence: Synthetic oligonucleotide
acatgctaagaggccagatgcagatctgaagac

SEQ ID NO: 84028 - DNA, 32 bp, Artificial Sequence
  Description of Artificial Sequence: Synthetic oligonucleotide
catgctaagaggccagatgcagatctgaagac

SEQ ID NO: 84029 - DNA, 32 bp, Artificial Sequence
  Description of Artificial Sequence: Synthetic oligonucleotide
atgctaagaggccagatgcagatctgaagacc

SEQ ID NO: 84030 - DNA, 31 bp, Artificial Sequence
  Description of Artificial Sequence: Synthetic oligonucleotide
tgctaagaggccagatgcagatctgaagacc

SEQ ID NO: 84031 - DNA, 30 bp, Artificial Sequence
  Description of Artificial Sequence: Synthetic oligonucleotide
gctaagaggccagatgcagatctgaagacc

SEQ ID NO: 84032 - DNA, 37 bp, Artificial Sequence
  Description of Artificial Sequence: Synthetic oligonucleotide
ctaagaggccagatgcagatctgaagacctattttac

SEQ ID NO: 84033 - DNA, 38 bp, Artificial Sequence
  Description of Artificial Sequence: Synthetic oligonucleotide
taagaggccagatgcagatctgaagacctattttactg

SEQ ID NO: 84034 - DNA, 37 bp, Artificial Sequence
  Description of Artificial Sequence: Synthetic oligonucleotide
aagaggccagatgcagatctgaagacctattttactg

SEQ ID NO: 84035 - DNA, 36 bp, Artificial Sequence
  Description of Artificial Sequence: Synthetic oligonucleotide
agaggccagatgcagatctgaagacctattttactg

SEQ ID NO: 84036 - DNA, 35 bp, Artificial Sequence
  Description of Artificial Sequence: Synthetic oligonucleotide
gaggccagatgcagatctgaagacctattttactg

SEQ ID NO: 84037 - DNA, 39 bp, Artificial Sequence
  Description of Artificial Sequence: Synthetic oligonucleotide
aggccagatgcagatctgaagacctattttactgataag

SEQ ID NO: 84038 - DNA, 38 bp, Artificial Sequence
  Description of Artificial Sequence: Synthetic oligonucleotide
ggccagatgcagatctgaagacctattttactgataag

SEQ ID NO: 84039 - DNA, 42 bp, Artificial Sequence
  Description of Artificial Sequence: Synthetic oligonucleotide
gccagatgcagatctgaagacctattttactgataagaaaac

SEQ ID NO: 84040 - DNA, 43 bp, Artificial Sequence
  Description of Artificial Sequence: Synthetic oligonucleotide
ccagatgcagatctgaagacctattttactgataagaaaacac

SEQ ID NO: 84041 - DNA, 45 bp, Artificial Sequence
  Description of Artificial Sequence: Synthetic oligonucleotide
cagatgcagatctgaagacctattttactgataagaaaacacatc

SEQ ID NO: 84042 - DNA, 49 bp, Artificial Sequence
  Description of Artificial Sequence: Synthetic oligonucleotide
agatgcagatctgaagacctattttactgataagaaaacacatctttac

SEQ ID NO: 84043 - DNA, 48 bp, Artificial Sequence
  Description of Artificial Sequence: Synthetic oligonucleotide
gatgcagatctgaagacctattttactgataagaaaacacatctttac

SEQ ID NO: 84044 - DNA, 49 bp, Artificial Sequence
  Description of Artificial Sequence: Synthetic oligonucleotide
atgcagatctgaagacctattttactgataagaaaacacatctttacac

SEQ ID NO: 84045 - DNA, 48 bp, Artificial Sequence
  Description of Artificial Sequence: Synthetic oligonucleotide
tgcagatctgaagacctattttactgataagaaaacacatctttacac

SEQ ID NO: 84046 - DNA, 47 bp, Artificial Sequence
  Description of Artificial Sequence: Synthetic oligonucleotide
gcagatctgaagacctattttactgataagaaaacacatctttacac

SEQ ID NO: 84047 - DNA, 48 bp, Artificial Sequence
  Description of Artificial Sequence: Synthetic oligonucleotide
cagatctgaagacctattttactgataagaaaacacatctttacacac

SEQ ID NO: 84048 - DNA, 52 bp, Artificial Sequence
  Description of Artificial Sequence: Synthetic oligonucleotide
agatctgaagacctattttactgataagaaaacacatctttacacactaatc

SEQ ID NO: 84049 - DNA, 51 bp, Artificial Sequence
  Description of Artificial Sequence: Synthetic oligonucleotide
gatctgaagacctattttactgataagaaaacacatctttacacactaatc

SEQ ID NO: 84050 - DNA, 53 bp, Artificial Sequence
  Description of Artificial Sequence: Synthetic oligonucleotide
atctgaagacctattttactgataagaaaacacatctttacacactaatcttg

SEQ ID NO: 84051 - DNA, 52 bp, Artificial Sequence
  Description of Artificial Sequence: Synthetic oligonucleotide
tctgaagacctattttactgataagaaaacacatctttacacactaatcttg

SEQ ID NO: 84052 - DNA, 51 bp, Artificial Sequence
  Description of Artificial Sequence: Synthetic oligonucleotide
ctgaagacctattttactgataagaaaacacatctttacacactaatcttg

SEQ ID NO: 84053 - DNA, 54 bp, Artificial Sequence
  Description of Artificial Sequence: Synthetic oligonucleotide
tgaagacctattttactgataagaaaacacatctttacacactaatcttgaatc

SEQ ID NO: 84054 - DNA, 53 bp, Artificial Sequence
  Description of Artificial Sequence: Synthetic oligonucleotide
gaagacctattttactgataagaaaacacatctttacacactaatcttgaatc

SEQ ID NO: 84055 - DNA, 53 bp, Artificial Sequence
  Description of Artificial Sequence: Synthetic oligonucleotide
aagacctattttactgataagaaaacacatctttacacactaatcttgaatcc

SEQ ID NO: 84056 - DNA, 52 bp, Artificial Sequence
  Description of Artificial Sequence: Synthetic oligonucleotide
agacctattttactgataagaaaacacatctttacacactaatcttgaatcc

SEQ ID NO: 84057 - DNA, 51 bp, Artificial Sequence
  Description of Artificial Sequence: Synthetic oligonucleotide
gacctattttactgataagaaaacacatctttacacactaatcttgaatcc

SEQ ID NO: 84058 - DNA, 52 bp, Artificial Sequence
  Description of Artificial Sequence: Synthetic oligonucleotide
acctattttactgataagaaaacacatctttacacactaatcttgaatccag

SEQ ID NO: 84059 - DNA, 51 bp, Artificial Sequence
  Description of Artificial Sequence: Synthetic oligonucleotide
cctattttactgataagaaaacacatctttacacactaatcttgaatccag

SEQ ID NO: 84060 - DNA, 57 bp, Artificial Sequence
  Description of Artificial Sequence: Synthetic oligonucleotide
ctattttactgataagaaaacacatctttacacactaatcttgaatccagataatag

SEQ ID NO: 84061 - DNA, 60 bp, Artificial Sequence
  Description of Artificial Sequence: Synthetic oligonucleotide
tattttactgataagaaaacacatctttacacactaatcttgaatccagataatagtttt

SEQ ID NO: 84062 - DNA, 60 bp, Artificial Sequence
  Description of Artificial Sequence: Synthetic oligonucleotide
attttactgataagaaaacacatctttacacactaatcttgaatccagataatagttttg

SEQ ID NO: 84063 - DNA, 59 bp, Artificial Sequence
  Description of Artificial Sequence: Synthetic oligonucleotide
ttttactgataagaaaacacatctttacacactaatcttgaatccagataatagttttg

SEQ ID NO: 84064 - DNA, 58 bp, Artificial Sequence
  Description of Artificial Sequence: Synthetic oligonucleotide
tttactgataagaaaacacatctttacacactaatcttgaatccagataatagttttg

SEQ ID NO: 84065 - DNA, 57 bp, Artificial Sequence
  Description of Artificial Sequence: Synthetic oligonucleotide
ttactgataagaaaacacatctttacacactaatcttgaatccagataatagttttg

SEQ ID NO: 84066 - DNA, 56 bp, Artificial Sequence
  Description of Artificial Sequence: Synthetic oligonucleotide
tactgataagaaaacacatctttacacactaatcttgaatccagataatagttttg

SEQ ID NO: 84067 - DNA, 55 bp, Artificial Sequence
  Description of Artificial Sequence: Synthetic oligonucleotide
actgataagaaaacacatctttacacactaatcttgaatccagataatagttttg

SEQ ID NO: 84068 - DNA, 54 bp, Artificial Sequence
  Description of Artificial Sequence: Synthetic oligonucleotide
ctgataagaaaacacatctttacacactaatcttgaatccagataatagttttg

SEQ ID NO: 84069 - DNA, 59 bp, Artificial Sequence
  Description of Artificial Sequence: Synthetic oligonucleotide
tgataagaaaacacatctttacacactaatcttgaatccagataatagttttgaaatac

SEQ ID NO: 84070 - DNA, 58 bp, Artificial Sequence
  Description of Artificial Sequence: Synthetic oligonucleotide
gataagaaaacacatctttacacactaatcttgaatccagataatagttttgaaatac

SEQ ID NO: 84071 - DNA, 59 bp, Artificial Sequence
  Description of Artificial Sequence: Synthetic oligonucleotide
ataagaaaacacatctttacacactaatcttgaatccagataatagttttgaaatactg

SEQ ID NO: 84072 - DNA, 58 bp, Artificial Sequence
  Description of Artificial Sequence: Synthetic oligonucleotide
taagaaaacacatctttacacactaatcttgaatccagataatagttttgaaatactg

SEQ ID NO: 84073 - DNA, 57 bp, Artificial Sequence
  Description of Artificial Sequence: Synthetic oligonucleotide
aagaaaacacatctttacacactaatcttgaatccagataatagttttgaaatactg

SEQ ID NO: 84074 - DNA, 56 bp, Artificial Sequence
  Description of Artificial Sequence: Synthetic oligonucleotide
agaaaacacatctttacacactaatcttgaatccagataatagttttgaaatactg

SEQ ID NO: 84075 - DNA, 55 bp, Artificial Sequence
  Description of Artificial Sequence: Synthetic oligonucleotide
gaaaacacatctttacacactaatcttgaatccagataatagttttgaaatactg

SEQ ID NO: 84076 - DNA, 55 bp, Artificial Sequence
  Description of Artificial Sequence: Synthetic oligonucleotide
aaaacacatctttacacactaatcttgaatccagataatagttttgaaatactgg

SEQ ID NO: 84077 - DNA, 54 bp, Artificial Sequence
  Description of Artificial Sequence: Synthetic oligonucleotide
aaacacatctttacacactaatcttgaatccagataatagttttgaaatactgg

SEQ ID NO: 84078 - DNA, 53 bp, Artificial Sequence
  Description of Artificial Sequence: Synthetic oligonucleotide
aacacatctttacacactaatcttgaatccagataatagttttgaaatactgg

SEQ ID NO: 84079 - DNA, 52 bp, Artificial Sequence
  Description of Artificial Sequence: Synthetic oligonucleotide
acacatctttacacactaatcttgaatccagataatagttttgaaatactgg

SEQ ID NO: 84080 - DNA, 51 bp, Artificial Sequence
  Description of Artificial Sequence: Synthetic oligonucleotide
cacatctttacacactaatcttgaatccagataatagttttgaaatactgg

SEQ ID NO: 84081 - DNA, 53 bp, Artificial Sequence
  Description of Artificial Sequence: Synthetic oligonucleotide
acatctttacacactaatcttgaatccagataatagttttgaaatactggttg

SEQ ID NO: 84082 - DNA, 52 bp, Artificial Sequence
  Description of Artificial Sequence: Synthetic oligonucleotide
catctttacacactaatcttgaatccagataatagttttgaaatactggttg

SEQ ID NO: 84083 - DNA, 53 bp, Artificial Sequence
  Description of Artificial Sequence: Synthetic oligonucleotide
atctttacacactaatcttgaatccagataatagttttgaaatactggttgac

SEQ ID NO: 84084 - DNA, 52 bp, Artificial Sequence
  Description of Artificial Sequence: Synthetic oligonucleotide
tctttacacactaatcttgaatccagataatagttttgaaatactggttgac

SEQ ID NO: 84085 - DNA, 51 bp, Artificial Sequence
  Description of Artificial Sequence: Synthetic oligonucleotide
ctttacacactaatcttgaatccagataatagttttgaaatactggttgac

SEQ ID NO: 84086 - DNA, 51 bp, Artificial Sequence
  Description of Artificial Sequence: Synthetic oligonucleotide
tttacacactaatcttgaatccagataatagttttgaaatactggttgacc

SEQ ID NO: 84087 - DNA, 50 bp, Artificial Sequence
  Description of Artificial Sequence: Synthetic oligonucleotide
ttacacactaatcttgaatccagataatagttttgaaatactggttgacc

SEQ ID NO: 84088 - DNA, 49 bp, Artificial Sequence
  Description of Artificial Sequence: Synthetic oligonucleotide
tacacactaatcttgaatccagataatagttttgaaatactggttgacc

SEQ ID NO: 84089 - DNA, 48 bp, Artificial Sequence
  Description of Artificial Sequence: Synthetic oligonucleotide
acacactaatcttgaatccagataatagttttgaaatactggttgacc

SEQ ID NO: 84090 - DNA, 47 bp, Artificial Sequence
  Description of Artificial Sequence: Synthetic oligonucleotide
cacactaatcttgaatccagataatagttttgaaatactggttgacc

SEQ ID NO: 84091 - DNA, 50 bp, Artificial Sequence
  Description of Artificial Sequence: Synthetic oligonucleotide
acactaatcttgaatccagataatagttttgaaatactggttgaccaatc

SEQ ID NO: 84092 - DNA, 49 bp, Artificial Sequence
  Description of Artificial Sequence: Synthetic oligonucleotide
cactaatcttgaatccagataatagttttgaaatactggttgaccaatc

SEQ ID NO: 84093 - DNA, 50 bp, Artificial Sequence
  Description of Artificial Sequence: Synthetic oligonucleotide
actaatcttgaatccagataatagttttgaaatactggttgaccaatctg

SEQ ID NO: 84094 - DNA, 49 bp, Artificial Sequence
  Description of Artificial Sequence: Synthetic oligonucleotide
ctaatcttgaatccagataatagttttgaaatactggttgaccaatctg

SEQ ID NO: 84095 - DNA, 50 bp, Artificial Sequence
  Description of Artificial Sequence: Synthetic oligonucleotide
taatcttgaatccagataatagttttgaaatactggttgaccaatctgtg

SEQ ID NO: 84096 - DNA, 49 bp, Artificial Sequence
  Description of Artificial Sequence: Synthetic oligonucleotide
aatcttgaatccagataatagttttgaaatactggttgaccaatctgtg

SEQ ID NO: 84097 - DNA, 48 bp, Artificial Sequence
  Description of Artificial Sequence: Synthetic oligonucleotide
atcttgaatccagataatagttttgaaatactggttgaccaatctgtg

SEQ ID NO: 84098 - DNA, 47 bp, Artificial Sequence
  Description of Artificial Sequence: Synthetic oligonucleotide
tcttgaatccagataatagttttgaaatactggttgaccaatctgtg

SEQ ID NO: 84099 - DNA, 46 bp, Artificial Sequence
  Description of Artificial Sequence: Synthetic oligonucleotide
cttgaatccagataatagttttgaaatactggttgaccaatctgtg

SEQ ID NO: 84100 - DNA, 46 bp, Artificial Sequence
  Description of Artificial Sequence: Synthetic oligonucleotide
ttgaatccagataatagttttgaaatactggttgaccaatctgtgg

SEQ ID NO: 84101 - DNA, 45 bp, Artificial Sequence
  Description of Artificial Sequence: Synthetic oligonucleotide
tgaatccagataatagttttgaaatactggttgaccaatctgtgg

SEQ ID NO: 84102 - DNA, 44 bp, Artificial Sequence
  Description of Artificial Sequence: Synthetic oligonucleotide
gaatccagataatagttttgaaatactggttgaccaatctgtgg

SEQ ID NO: 84103 - DNA, 45 bp, Artificial Sequence
  Description of Artificial Sequence: Synthetic oligonucleotide
aatccagataatagttttgaaatactggttgaccaatctgtggtg

SEQ ID NO: 84104 - DNA, 44 bp, Artificial Sequence
  Description of Artificial Sequence: Synthetic oligonucleotide
atccagataatagttttgaaatactggttgaccaatctgtggtg

SEQ ID NO: 84105 - DNA, 43 bp, Artificial Sequence
  Description of Artificial Sequence: Synthetic oligonucleotide
tccagataatagttttgaaatactggttgaccaatctgtggtg

SEQ ID NO: 84106 - DNA, 42 bp, Artificial Sequence
  Description of Artificial Sequence: Synthetic oligonucleotide
ccagataatagttttgaaatactggttgaccaatctgtggtg

SEQ ID NO: 84107 - DNA, 46 bp, Artificial Sequence
  Description of Artificial Sequence: Synthetic oligonucleotide
cagataatagttttgaaatactggttgaccaatctgtggtgaatag

SEQ ID NO: 84108 - DNA, 47 bp, Artificial Sequence
  Description of Artificial Sequence: Synthetic oligonucleotide
agataatagttttgaaatactggttgaccaatctgtggtgaatagtg

SEQ ID NO: 84109 - DNA, 46 bp, Artificial Sequence
  Description of Artificial Sequence: Synthetic oligonucleotide
gataatagttttgaaatactggttgaccaatctgtggtgaatagtg

SEQ ID NO: 84110 - DNA, 46 bp, Artificial Sequence
  Description of Artificial Sequence: Synthetic oligonucleotide
ataatagttttgaaatactggttgaccaatctgtggtgaatagtgg

SEQ ID NO: 84111 - DNA, 45 bp, Artificial Sequence
  Description of Artificial Sequence: Synthetic oligonucleotide
taatagttttgaaatactggttgaccaatctgtggtgaatagtgg

SEQ ID NO: 84112 - DNA, 44 bp, Artificial Sequence
  Description of Artificial Sequence: Synthetic oligonucleotide
aatagttttgaaatactggttgaccaatctgtggtgaatagtgg

SEQ ID NO: 84113 - DNA, 43 bp, Artificial Sequence
  Description of Artificial Sequence: Synthetic oligonucleotide
atagttttgaaatactggttgaccaatctgtggtgaatagtgg

SEQ ID NO: 84114 - DNA, 42 bp, Artificial Sequence
  Description of Artificial Sequence: Synthetic oligonucleotide
tagttttgaaatactggttgaccaatctgtggtgaatagtgg

SEQ ID NO: 84115 - DNA, 41 bp, Artificial Sequence
  Description of Artificial Sequence: Synthetic oligonucleotide
agttttgaaatactggttgaccaatctgtggtgaatagtgg

SEQ ID NO: 84116 - DNA, 40 bp, Artificial Sequence
  Description of Artificial Sequence: Synthetic oligonucleotide
gttttgaaatactggttgaccaatctgtggtgaatagtgg

SEQ ID NO: 84117 - DNA, 44 bp, Artificial Sequence
  Description of Artificial Sequence: Synthetic oligonucleotide
ttttgaaatactggttgaccaatctgtggtgaatagtggaaatc

SEQ ID NO: 84118 - DNA, 43 bp, Artificial Sequence
  Description of Artificial Sequence: Synthetic oligonucleotide
tttgaaatactggttgaccaatctgtggtgaatagtggaaatc

SEQ ID NO: 84119 - DNA, 42 bp, Artificial Sequence
  Description of Artificial Sequence: Synthetic oligonucleotide
ttgaaatactggttgaccaatctgtggtgaatagtggaaatc

SEQ ID NO: 84120 - DNA, 41 bp, Artificial Sequence
  Description of Artificial Sequence: Synthetic oligonucleotide
tgaaatactggttgaccaatctgtggtgaatagtggaaatc

SEQ ID NO: 84121 - DNA, 40 bp, Artificial Sequence
  Description of Artificial Sequence: Synthetic oligonucleotide
gaaatactggttgaccaatctgtggtgaatagtggaaatc

SEQ ID NO: 84122 - DNA, 41 bp, Artificial Sequence
  Description of Artificial Sequence: Synthetic oligonucleotide
aaatactggttgaccaatctgtggtgaatagtggaaatctg

SEQ ID NO: 84123 - DNA, 40 bp, Artificial Sequence
  Description of Artificial Sequence: Synthetic oligonucleotide
aatactggttgaccaatctgtggtgaatagtggaaatctg

SEQ ID NO: 84124 - DNA, 39 bp, Artificial Sequence
  Description of Artificial Sequence: Synthetic oligonucleotide
atactggttgaccaatctgtggtgaatagtggaaatctg

SEQ ID NO: 84125 - DNA, 38 bp, Artificial Sequence
  Description of Artificial Sequence: Synthetic oligonucleotide
tactggttgaccaatctgtggtgaatagtggaaatctg

SEQ ID NO: 84126 - DNA, 37 bp, Artificial Sequence
  Description of Artificial Sequence: Synthetic oligonucleotide
actggttgaccaatctgtggtgaatagtggaaatctg

SEQ ID NO: 84127 - DNA, 36 bp, Artificial Sequence
  Description of Artificial Sequence: Synthetic oligonucleotide
ctggttgaccaatctgtggtgaatagtggaaatctg

SEQ ID NO: 84128 - DNA, 36 bp, Artificial Sequence
  Description of Artificial Sequence: Synthetic oligonucleotide
tggttgaccaatctgtggtgaatagtggaaatctgc

SEQ ID NO: 84129 - DNA, 35 bp, Artificial Sequence
  Description of Artificial Sequence: Synthetic oligonucleotide
ggttgaccaatctgtggtgaatagtggaaatctgc

SEQ ID NO: 84130 - DNA, 36 bp, Artificial Sequence
  Description of Artificial Sequence: Synthetic oligonucleotide
gttgaccaatctgtggtgaatagtggaaatctgctc

SEQ ID NO: 84131 - DNA, 39 bp, Artificial Sequence
  Description of Artificial Sequence: Synthetic oligonucleotide
ttgaccaatctgtggtgaatagtggaaatctgctcaatg

SEQ ID NO: 84132 - DNA, 38 bp, Artificial Sequence
  Description of Artificial Sequence: Synthetic oligonucleotide
tgaccaatctgtggtgaatagtggaaatctgctcaatg

SEQ ID NO: 84133 - DNA, 37 bp, Artificial Sequence
  Description of Artificial Sequence: Synthetic oligonucleotide
gaccaatctgtggtgaatagtggaaatctgctcaatg

SEQ ID NO: 84134 - DNA, 38 bp, Artificial Sequence
  Description of Artificial Sequence: Synthetic oligonucleotide
accaatctgtggtgaatagtggaaatctgctcaatgac

SEQ ID NO: 84135 - DNA, 37 bp, Artificial Sequence
  Description of Artificial Sequence: Synthetic oligonucleotide
ccaatctgtggtgaatagtggaaatctgctcaatgac

SEQ ID NO: 84136 - DNA, 39 bp, Artificial Sequence
  Description of Artificial Sequence: Synthetic oligonucleotide
caatctgtggtgaatagtggaaatctgctcaatgacatg

SEQ ID NO: 84137 - DNA, 40 bp, Artificial Sequence
  Description of Artificial Sequence: Synthetic oligonucleotide
aatctgtggtgaatagtggaaatctgctcaatgacatgac

SEQ ID NO: 84138 - DNA, 39 bp, Artificial Sequence
  Description of Artificial Sequence: Synthetic oligonucleotide
atctgtggtgaatagtggaaatctgctcaatgacatgac

SEQ ID NO: 84139 - DNA, 38 bp, Artificial Sequence
  Description of Artificial Sequence: Synthetic oligonucleotide
tctgtggtgaatagtggaaatctgctcaatgacatgac

SEQ ID NO: 84140 - DNA, 37 bp, Artificial Sequence
  Description of Artificial Sequence: Synthetic oligonucleotide
ctgtggtgaatagtggaaatctgctcaatgacatgac

SEQ ID NO: 84141 - DNA, 38 bp, Artificial Sequence
  Description of Artificial Sequence: Synthetic oligonucleotide
tgtggtgaatagtggaaatctgctcaatgacatgactc

SEQ ID NO: 84142 - DNA, 37 bp, Artificial Sequence
  Description of Artificial Sequence: Synthetic oligonucleotide
gtggtgaatagtggaaatctgctcaatgacatgactc

SEQ ID NO: 84143 - DNA, 37 bp, Artificial Sequence
  Description of Artificial Sequence: Synthetic oligonucleotide
tggtgaatagtggaaatctgctcaatgacatgactcc

SEQ ID NO: 84144 - DNA, 36 bp, Artificial Sequence
  Description of Artificial Sequence: Synthetic oligonucleotide
ggtgaatagtggaaatctgctcaatgacatgactcc

SEQ ID NO: 84145 - DNA, 37 bp, Artificial Sequence
  Description of Artificial Sequence: Synthetic oligonucleotide
gtgaatagtggaaatctgctcaatgacatgactcctc

SEQ ID NO: 84146 - DNA, 37 bp, Artificial Sequence
  Description of Artificial Sequence: Synthetic oligonucleotide
tgaatagtggaaatctgctcaatgacatgactcctcc

SEQ ID NO: 84147 - DNA, 36 bp, Artificial Sequence
  Description of Artificial Sequence: Synthetic oligonucleotide
gaatagtggaaatctgctcaatgacatgactcctcc

SEQ ID NO: 84148 - DNA, 37 bp, Artificial Sequence
  Description of Artificial Sequence: Synthetic oligonucleotide
aatagtggaaatctgctcaatgacatgactcctcctg

SEQ ID NO: 84149 - DNA, 36 bp, Artificial Sequence
  Description of Artificial Sequence: Synthetic oligonucleotide
atagtggaaatctgctcaatgacatgactcctcctg

SEQ ID NO: 84150 - DNA, 35 bp, Artificial Sequence
  Description of Artificial Sequence: Synthetic oligonucleotide
tagtggaaatctgctcaatgacatgactcctcctg

SEQ ID NO: 84151 - DNA, 34 bp, Artificial Sequence
  Description of Artificial Sequence: Synthetic oligonucleotide
agtggaaatctgctcaatgacatgactcctcctg

SEQ ID NO: 84152 - DNA, 33 bp, Artificial Sequence
  Description of Artificial Sequence: Synthetic oligonucleotide
gtggaaatctgctcaatgacatgactcctcctg

SEQ ID NO: 84153 - DNA, 38 bp, Artificial Sequence
  Description of Artificial Sequence: Synthetic oligonucleotide
tggaaatctgctcaatgacatgactcctcctgtaaatc

SEQ ID NO: 84154 - DNA, 37 bp, Artificial Sequence
  Description of Artificial Sequence: Synthetic oligonucleotide
ggaaatctgctcaatgacatgactcctcctgtaaatc

SEQ ID NO: 84155 - DNA, 37 bp, Artificial Sequence
  Description of Artificial Sequence: Synthetic oligonucleotide
gaaatctgctcaatgacatgactcctcctgtaaatcc

SEQ ID NO: 84156 - DNA, 39 bp, Artificial Sequence
  Description of Artificial Sequence: Synthetic oligonucleotide
aaatctgctcaatgacatgactcctcctgtaaatccttc

SEQ ID NO: 84157 - DNA, 38 bp, Artificial Sequence
  Description of Artificial Sequence: Synthetic oligonucleotide
aatctgctcaatgacatgactcctcctgtaaatccttc

SEQ ID NO: 84158 - DNA, 37 bp, Artificial Sequence
  Description of Artificial Sequence: Synthetic oligonucleotide
atctgctcaatgacatgactcctcctgtaaatccttc

SEQ ID NO: 84159 - DNA, 36 bp, Artificial Sequence
  Description of Artificial Sequence: Synthetic oligonucleotide
tctgctcaatgacatgactcctcctgtaaatccttc

SEQ ID NO: 84160 - DNA, 35 bp, Artificial Sequence
  Description of Artificial Sequence: Synthetic oligonucleotide
ctgctcaatgacatgactcctcctgtaaatccttc

SEQ ID NO: 84161 - DNA, 36 bp, Artificial Sequence
  Description of Artificial Sequence: Synthetic oligonucleotide
tgctcaatgacatgactcctcctgtaaatccttcac

SEQ ID NO: 84162 - DNA, 35 bp, Artificial Sequence
  Description of Artificial Sequence: Synthetic oligonucleotide
gctcaatgacatgactcctcctgtaaatccttcac

SEQ ID NO: 84163 - DNA, 35 bp, Artificial Sequence
  Description of Artificial Sequence: Synthetic oligonucleotide
ctcaatgacatgactcctcctgtaaatccttcacg

SEQ ID NO: 84164 - DNA, 36 bp, Artificial Sequence
  Description of Artificial Sequence: Synthetic oligonucleotide
tcaatgacatgactcctcctgtaaatccttcacgtg

SEQ ID NO: 84165 - DNA, 35 bp, Artificial Sequence
  Description of Artificial Sequence: Synthetic oligonucleotide
caatgacatgactcctcctgtaaatccttcacgtg

SEQ ID NO: 84166 - DNA, 40 bp, Artificial Sequence
  Description of Artificial Sequence: Synthetic oligonucleotide
aatgacatgactcctcctgtaaatccttcacgtgaaattg

SEQ ID NO: 84167 - DNA, 39 bp, Artificial Sequence
  Description of Artificial Sequence: Synthetic oligonucleotide
atgacatgactcctcctgtaaatccttcacgtgaaattg

SEQ ID NO: 84168 - DNA, 38 bp, Artificial Sequence
  Description of Artificial Sequence: Synthetic oligonucleotide
tgacatgactcctcctgtaaatccttcacgtgaaattg

SEQ ID NO: 84169 - DNA, 37 bp, Artificial Sequence
  Description of Artificial Sequence: Synthetic oligonucleotide
gacatgactcctcctgtaaatccttcacgtgaaattg

SEQ ID NO: 84170 - DNA, 38 bp, Artificial Sequence
  Description of Artificial Sequence: Synthetic oligonucleotide
acatgactcctcctgtaaatccttcacgtgaaattgag

SEQ ID NO: 84171 - DNA, 37 bp, Artificial Sequence
  Description of Artificial Sequence: Synthetic oligonucleotide
catgactcctcctgtaaatccttcacgtgaaattgag

SEQ ID NO: 84172 - DNA, 37 bp, Artificial Sequence
  Description of Artificial Sequence: Synthetic oligonucleotide
atgactcctcctgtaaatccttcacgtgaaattgagg

SEQ ID NO: 84173 - DNA, 36 bp, Artificial Sequence
  Description of Artificial Sequence: Synthetic oligonucleotide
tgactcctcctgtaaatccttcacgtgaaattgagg

SEQ ID NO: 84174 - DNA, 35 bp, Artificial Sequence
  Description of Artificial Sequence: Synthetic oligonucleotide
gactcctcctgtaaatccttcacgtgaaattgagg

SEQ ID NO: 84175 - DNA, 36 bp, Artificial Sequence
  Description of Artificial Sequence: Synthetic oligonucleotide
actcctcctgtaaatccttcacgtgaaattgaggac

SEQ ID NO: 84176 - DNA, 35 bp, Artificial Sequence
  Description of Artificial Sequence: Synthetic oligonucleotide
ctcctcctgtaaatccttcacgtgaaattgaggac

SEQ ID NO: 84177 - DNA, 35 bp, Artificial Sequence
  Description of Artificial Sequence: Synthetic oligonucleotide
tcctcctgtaaatccttcacgtgaaattgaggacc

SEQ ID NO: 84178 - DNA, 34 bp, Artificial Sequence
  Description of Artificial Sequence: Synthetic oligonucleotide
cctcctgtaaatccttcacgtgaaattgaggacc

SEQ ID NO: 84179 - DNA, 34 bp, Artificial Sequence
  Description of Artificial Sequence: Synthetic oligonucleotide
ctcctgtaaatccttcacgtgaaattgaggaccc

SEQ ID NO: 84180 - DNA, 35 bp, Artificial Sequence
  Description of Artificial Sequence: Synthetic oligonucleotide
tcctgtaaatccttcacgtgaaattgaggacccag

SEQ ID NO: 84181 - DNA, 34 bp, Artificial Sequence
  Description of Artificial Sequence: Synthetic oligonucleotide
cctgtaaatccttcacgtgaaattgaggacccag

SEQ ID NO: 84182 - DNA, 36 bp, Artificial Sequence
  Description of Artificial Sequence: Synthetic oligonucleotide
ctgtaaatccttcacgtgaaattgaggacccagaag

SEQ ID NO: 84183 - DNA, 37 bp, Artificial Sequence
  Description of Artificial Sequence: Synthetic oligonucleotide
tgtaaatccttcacgtgaaattgaggacccagaagac

SEQ ID NO: 84184 - DNA, 36 bp, Artificial Sequence
  Description of Artificial Sequence: Synthetic oligonucleotide
gtaaatccttcacgtgaaattgaggacccagaagac

SEQ ID NO: 84185 - DNA, 36 bp, Artificial Sequence
  Description of Artificial Sequence: Synthetic oligonucleotide
taaatccttcacgtgaaattgaggacccagaagacc

SEQ ID NO: 84186 - DNA, 35 bp, Artificial Sequence
  Description of Artificial Sequence: Synthetic oligonucleotide
aaatccttcacgtgaaattgaggacccagaagacc

SEQ ID NO: 84187 - DNA, 34 bp, Artificial Sequence
  Description of Artificial Sequence: Synthetic oligonucleotide
aatccttcacgtgaaattgaggacccagaagacc

SEQ ID NO: 84188 - DNA, 33 bp, Artificial Sequence
  Description of Artificial Sequence: Synthetic oligonucleotide
atccttcacgtgaaattgaggacccagaagacc

SEQ ID NO: 84189 - DNA, 32 bp, Artificial Sequence
  Description of Artificial Sequence: Synthetic oligonucleotide
tccttcacgtgaaattgaggacccagaagacc

SEQ ID NO: 84190 - DNA, 31 bp, Artificial Sequence
  Description of Artificial Sequence: Synthetic oligonucleotide
ccttcacgtgaaattgaggacccagaagacc

SEQ ID NO: 84191 - DNA, 31 bp, Artificial Sequence
  Description of Artificial Sequence: Synthetic oligonucleotide
cttcacgtgaaattgaggacccagaagaccg

SEQ ID NO: 84192 - DNA, 31 bp, Artificial Sequence
  Description of Artificial Sequence: Synthetic oligonucleotide
ttcacgtgaaattgaggacccagaagaccgg

SEQ ID NO: 84193 - DNA, 30 bp, Artificial Sequence
  Description of Artificial Sequence: Synthetic oligonucleotide
tcacgtgaaattgaggacccagaagaccgg

SEQ ID NO: 84194 - DNA, 29 bp, Artificial Sequence
  Description of Artificial Sequence: Synthetic oligonucleotide
cacgtgaaattgaggacccagaagaccgg

SEQ ID NO: 84195 - DNA, 31 bp, Artificial Sequence
  Description of Artificial Sequence: Synthetic oligonucleotide
acgtgaaattgaggacccagaagaccggaag

SEQ ID NO: 84196 - DNA, 30 bp, Artificial Sequence
  Description of Artificial Sequence: Synthetic oligonucleotide
cgtgaaattgaggacccagaagaccggaag

SEQ ID NO: 84197 - DNA, 30 bp, Artificial Sequence
  Description of Artificial Sequence: Synthetic oligonucleotide
gtgaaattgaggacccagaagaccggaagc

SEQ ID NO: 84198 - DNA, 30 bp, Artificial Sequence
  Description of Artificial Sequence: Synthetic oligonucleotide
tgaaattgaggacccagaagaccggaagcc

SEQ ID NO: 84199 - DNA, 29 bp, Artificial Sequence
  Description of Artificial Sequence: Synthetic oligonucleotide
gaaattgaggacccagaagaccggaagcc

SEQ ID NO: 84200 - DNA, 29 bp, Artificial Sequence
  Description of Artificial Sequence: Synthetic oligonucleotide
aaattgaggacccagaagaccggaagccc

SEQ ID NO: 84201 - DNA, 28 bp, Artificial Sequence
  Description of Artificial Sequence: Synthetic oligonucleotide
aattgaggacccagaagaccggaagccc

SEQ ID NO: 84202 - DNA, 27 bp, Artificial Sequence
  Description of Artificial Sequence: Synthetic oligonucleotide
attgaggacccagaagaccggaagccc

SEQ ID NO: 84203 - DNA, 26 bp, Artificial Sequence
  Description of Artificial Sequence: Synthetic oligonucleotide
ttgaggacccagaagaccggaagccc

SEQ ID NO: 84204 - DNA, 25 bp, Artificial Sequence
  Description of Artificial Sequence: Synthetic oligonucleotide
tgaggacccagaagaccggaagccc

SEQ ID NO: 84205 - DNA, 24 bp, Artificial Sequence
  Description of Artificial Sequence: Synthetic oligonucleotide
gaggacccagaagaccggaagccc

SEQ ID NO: 84206 - DNA, 25 bp, Artificial Sequence
  Description of Artificial Sequence: Synthetic oligonucleotide
aggacccagaagaccggaagcccga

SEQ ID NO: 84207 - DNA, 24 bp, Artificial Sequence
  Description of Artificial Sequence: Synthetic oligonucleotide
ggacccagaagaccggaagcccga

SEQ ID NO: 84208 - DNA, 24 bp, Artificial Sequence
  Description of Artificial Sequence: Synthetic oligonucleotide
gacccagaagaccggaagcccgag

SEQ ID NO: 84209 - DNA, 27 bp, Artificial Sequence
  Description of Artificial Sequence: Synthetic oligonucleotide
acccagaagaccggaagcccgaggatt

SEQ ID NO: 84210 - DNA, 26 bp, Artificial Sequence
  Description of Artificial Sequence: Synthetic oligonucleotide
cccagaagaccggaagcccgaggatt

SEQ ID NO: 84211 - DNA, 26 bp, Artificial Sequence
  Description of Artificial Sequence: Synthetic oligonucleotide
ccagaagaccggaagcccgaggattg

SEQ ID NO: 84212 - DNA, 26 bp, Artificial Sequence
  Description of Artificial Sequence: Synthetic oligonucleotide
cagaagaccggaagcccgaggattgg

SEQ ID NO: 84213 - DNA, 27 bp, Artificial Sequence
  Description of Artificial Sequence: Synthetic oligonucleotide
agaagaccggaagcccgaggattggga

SEQ ID NO: 84214 - DNA, 27 bp, Artificial Sequence
  Description of Artificial Sequence: Synthetic oligonucleotide
gaagaccggaagcccgaggattgggat

SEQ ID NO: 84215 - DNA, 27 bp, Artificial Sequence
  Description of Artificial Sequence: Synthetic oligonucleotide
aagaccggaagcccgaggattgggatg

SEQ ID NO: 84216 - DNA, 27 bp, Artificial Sequence
  Description of Artificial Sequence: Synthetic oligonucleotide
agaccggaagcccgaggattgggatga

SEQ ID NO: 84217 - DNA, 27 bp, Artificial Sequence
  Description of Artificial Sequence: Synthetic oligonucleotide
gaccggaagcccgaggattgggatgaa

SEQ ID NO: 84218 - DNA, 28 bp, Artificial Sequence
  Description of Artificial Sequence: Synthetic oligonucleotide
accggaagcccgaggattgggatgaaag

SEQ ID NO: 84219 - DNA, 27 bp, Artificial Sequence
  Description of Artificial Sequence: Synthetic oligonucleotide
ccggaagcccgaggattgggatgaaag

SEQ ID NO: 84220 - DNA, 28 bp, Artificial Sequence
  Description of Artificial Sequence: Synthetic oligonucleotide
cggaagcccgaggattgggatgaaagac

SEQ ID NO: 84221 - DNA, 28 bp, Artificial Sequence
  Description of Artificial Sequence: Synthetic oligonucleotide
ggaagcccgaggattgggatgaaagacc

SEQ ID NO: 84222 - DNA, 34 bp, Artificial Sequence
  Description of Artificial Sequence: Synthetic oligonucleotide
gaagcccgaggattgggatgaaagaccaaaaatc

SEQ ID NO: 84223 - DNA, 34 bp, Artificial Sequence
  Description of Artificial Sequence: Synthetic oligonucleotide
aagcccgaggattgggatgaaagaccaaaaatcc

SEQ ID NO: 84224 - DNA, 33 bp, Artificial Sequence
  Description of Artificial Sequence: Synthetic oligonucleotide
agcccgaggattgggatgaaagaccaaaaatcc

SEQ ID NO: 84225 - DNA, 32 bp, Artificial Sequence
  Description of Artificial Sequence: Synthetic oligonucleotide
gcccgaggattgggatgaaagaccaaaaatcc

SEQ ID NO: 84226 - DNA, 32 bp, Artificial Sequence
  Description of Artificial Sequence: Synthetic oligonucleotide
cccgaggattgggatgaaagaccaaaaatccc

SEQ ID NO: 84227 - DNA, 33 bp, Artificial Sequence
  Description of Artificial Sequence: Synthetic oligonucleotide
ccgaggattgggatgaaagaccaaaaatcccag

SEQ ID NO: 84228 - DNA, 35 bp, Artificial Sequence
  Description of Artificial Sequence: Synthetic oligonucleotide
cgaggattgggatgaaagaccaaaaatcccagatc

SEQ ID NO: 84229 - DNA, 35 bp, Artificial Sequence
  Description of Artificial Sequence: Synthetic oligonucleotide
gaggattgggatgaaagaccaaaaatcccagatcc

SEQ ID NO: 84230 - DNA, 36 bp, Artificial Sequence
  Description of Artificial Sequence: Synthetic oligonucleotide
aggattgggatgaaagaccaaaaatcccagatccag

SEQ ID NO: 84231 - DNA, 35 bp, Artificial Sequence
  Description of Artificial Sequence: Synthetic oligonucleotide
ggattgggatgaaagaccaaaaatcccagatccag

SEQ ID NO: 84232 - DNA, 37 bp, Artificial Sequence
  Description of Artificial Sequence: Synthetic oligonucleotide
gattgggatgaaagaccaaaaatcccagatccagaag

SEQ ID NO: 84233 - DNA, 37 bp, Artificial Sequence
  Description of Artificial Sequence: Synthetic oligonucleotide
attgggatgaaagaccaaaaatcccagatccagaagc

SEQ ID NO: 84234 - DNA, 36 bp, Artificial Sequence
  Description of Artificial Sequence: Synthetic oligonucleotide
ttgggatgaaagaccaaaaatcccagatccagaagc

SEQ ID NO: 84235 - DNA, 35 bp, Artificial Sequence
  Description of Artificial Sequence: Synthetic oligonucleotide
tgggatgaaagaccaaaaatcccagatccagaagc

SEQ ID NO: 84236 - DNA, 34 bp, Artificial Sequence
  Description of Artificial Sequence: Synthetic oligonucleotide
gggatgaaagaccaaaaatcccagatccagaagc

SEQ ID NO: 84237 - DNA, 35 bp, Artificial Sequence
  Description of Artificial Sequence: Synthetic oligonucleotide
ggatgaaagaccaaaaatcccagatccagaagctg

SEQ ID NO: 84238 - DNA, 36 bp, Artificial Sequence
  Description of Artificial Sequence: Synthetic oligonucleotide
gatgaaagaccaaaaatcccagatccagaagctgtc

SEQ ID NO: 84239 - DNA, 38 bp, Artificial Sequence
  Description of Artificial Sequence: Synthetic oligonucleotide
atgaaagaccaaaaatcccagatccagaagctgtcaag

SEQ ID NO: 84240 - DNA, 37 bp, Artificial Sequence
  Description of Artificial Sequence: Synthetic oligonucleotide
tgaaagaccaaaaatcccagatccagaagctgtcaag

SEQ ID NO: 84241 - DNA, 36 bp, Artificial Sequence
  Description of Artificial Sequence: Synthetic oligonucleotide
gaaagaccaaaaatcccagatccagaagctgtcaag

SEQ ID NO: 84242 - DNA, 36 bp, Artificial Sequence
  Description of Artificial Sequence: Synthetic oligonucleotide
aaagaccaaaaatcccagatccagaagctgtcaagc

SEQ ID NO: 84243 - DNA, 35 bp, Artificial Sequence
  Description of Artificial Sequence: Synthetic oligonucleotide
aagaccaaaaatcccagatccagaagctgtcaagc

SEQ ID NO: 84244 - DNA, 34 bp, Artificial Sequence
  Description of Artificial Sequence: Synthetic oligonucleotide
agaccaaaaatcccagatccagaagctgtcaagc

SEQ ID NO: 84245 - DNA, 33 bp, Artificial Sequence
  Description of Artificial Sequence: Synthetic oligonucleotide
gaccaaaaatcccagatccagaagctgtcaagc

SEQ ID NO: 84246 - DNA, 33 bp, Artificial Sequence
  Description of Artificial Sequence: Synthetic oligonucleotide
accaaaaatcccagatccagaagctgtcaagcc

SEQ ID NO: 84247 - DNA, 32 bp, Artificial Sequence
  Description of Artificial Sequence: Synthetic oligonucleotide
ccaaaaatcccagatccagaagctgtcaagcc

SEQ ID NO: 84248 - DNA, 33 bp, Artificial Sequence
  Description of Artificial Sequence: Synthetic oligonucleotide
caaaaatcccagatccagaagctgtcaagccag

SEQ ID NO: 84249 - DNA, 35 bp, Artificial Sequence
  Description of Artificial Sequence: Synthetic oligonucleotide
aaaaatcccagatccagaagctgtcaagccagatg

SEQ ID NO: 84250 - DNA, 34 bp, Artificial Sequence
  Description of Artificial Sequence: Synthetic oligonucleotide
aaaatcccagatccagaagctgtcaagccagatg

SEQ ID NO: 84251 - DNA, 33 bp, Artificial Sequence
  Description of Artificial Sequence: Synthetic oligonucleotide
aaatcccagatccagaagctgtcaagccagatg

SEQ ID NO: 84252 - DNA, 32 bp, Artificial Sequence
  Description of Artificial Sequence: Synthetic oligonucleotide
aatcccagatccagaagctgtcaagccagatg

SEQ ID NO: 84253 - DNA, 31 bp, Artificial Sequence
  Description of Artificial Sequence: Synthetic oligonucleotide
atcccagatccagaagctgtcaagccagatg

SEQ ID NO: 84254 - DNA, 30 bp, Artificial Sequence
  Description of Artificial Sequence: Synthetic oligonucleotide
tcccagatccagaagctgtcaagccagatg

SEQ ID NO: 84255 - DNA, 29 bp, Artificial Sequence
  Description of Artificial Sequence: Synthetic oligonucleotide
cccagatccagaagctgtcaagccagatg

SEQ ID NO: 84256 - DNA, 30 bp, Artificial Sequence
  Description of Artificial Sequence: Synthetic oligonucleotide
ccagatccagaagctgtcaagccagatgac

SEQ ID NO: 84257 - DNA, 31 bp, Artificial Sequence
  Description of Artificial Sequence: Synthetic oligonucleotide
cagatccagaagctgtcaagccagatgactg

SEQ ID NO: 84258 - DNA, 31 bp, Artificial Sequence
  Description of Artificial Sequence: Synthetic oligonucleotide
agatccagaagctgtcaagccagatgactgg

SEQ ID NO: 84259 - DNA, 30 bp, Artificial Sequence
  Description of Artificial Sequence: Synthetic oligonucleotide
gatccagaagctgtcaagccagatgactgg

SEQ ID NO: 84260 - DNA, 30 bp, Artificial Sequence
  Description of Artificial Sequence: Synthetic oligonucleotide
atccagaagctgtcaagccagatgactggg

SEQ ID NO: 84261 - DNA, 29 bp, Artificial Sequence
  Description of Artificial Sequence: Synthetic oligonucleotide
tccagaagctgtcaagccagatgactggg

SEQ ID NO: 84262 - DNA, 28 bp, Artificial Sequence
  Description of Artificial Sequence: Synthetic oligonucleotide
ccagaagctgtcaagccagatgactggg

SEQ ID NO: 84263 - DNA, 30 bp, Artificial Sequence
  Description of Artificial Sequence: Synthetic oligonucleotide
cagaagctgtcaagccagatgactgggatg

SEQ ID NO: 84264 - DNA, 32 bp, Artificial Sequence
  Description of Artificial Sequence: Synthetic oligonucleotide
agaagctgtcaagccagatgactgggatgaag

SEQ ID NO: 84265 - DNA, 31 bp, Artificial Sequence
  Description of Artificial Sequence: Synthetic oligonucleotide
gaagctgtcaagccagatgactgggatgaag

SEQ ID NO: 84266 - DNA, 33 bp, Artificial Sequence
  Description of Artificial Sequence: Synthetic oligonucleotide
aagctgtcaagccagatgactgggatgaagatg

SEQ ID NO: 84267 - DNA, 32 bp, Artificial Sequence
  Description of Artificial Sequence: Synthetic oligonucleotide
agctgtcaagccagatgactgggatgaagatg

SEQ ID NO: 84268 - DNA, 31 bp, Artificial Sequence
  Description of Artificial Sequence: Synthetic oligonucleotide
gctgtcaagccagatgactgggatgaagatg

SEQ ID NO: 84269 - DNA, 31 bp, Artificial Sequence
  Description of Artificial Sequence: Synthetic oligonucleotide
ctgtcaagccagatgactgggatgaagatgc

SEQ ID NO: 84270 - DNA, 31 bp, Artificial Sequence
  Description of Artificial Sequence: Synthetic oligonucleotide
tgtcaagccagatgactgggatgaagatgcc

SEQ ID NO: 84271 - DNA, 30 bp, Artificial Sequence
  Description of Artificial Sequence: Synthetic oligonucleotide
gtcaagccagatgactgggatgaagatgcc

SEQ ID NO: 84272 - DNA, 30 bp, Artificial Sequence
  Description of Artificial Sequence: Synthetic oligonucleotide
tcaagccagatgactgggatgaagatgccc

SEQ ID NO: 84273 - DNA, 29 bp, Artificial Sequence
  Description of Artificial Sequence: Synthetic oligonucleotide
caagccagatgactgggatgaagatgccc

SEQ ID NO: 84274 - DNA, 29 bp, Artificial Sequence
  Description of Artificial Sequence: Synthetic oligonucleotide
aagccagatgactgggatgaagatgcccc

SEQ ID NO: 84275 - DNA, 28 bp, Artificial Sequence
  Description of Artificial Sequence: Synthetic oligonucleotide
agccagatgactgggatgaagatgcccc

SEQ ID NO: 84276 - DNA, 27 bp, Artificial Sequence
  Description of Artificial Sequence: Synthetic oligonucleotide
gccagatgactgggatgaagatgcccc

SEQ ID NO: 84277 - DNA, 28 bp, Artificial Sequence
  Description of Artificial Sequence: Synthetic oligonucleotide
ccagatgactgggatgaagatgcccctg

SEQ ID NO: 84278 - DNA, 28 bp, Artificial Sequence
  Description of Artificial Sequence: Synthetic oligonucleotide
cagatgactgggatgaagatgcccctgc

SEQ ID NO: 84279 - DNA, 31 bp, Artificial Sequence
  Description of Artificial Sequence: Synthetic oligonucleotide
agatgactgggatgaagatgcccctgctaag

SEQ ID NO: 84280 - DNA, 30 bp, Artificial Sequence
  Description of Artificial Sequence: Synthetic oligonucleotide
gatgactgggatgaagatgcccctgctaag

SEQ ID NO: 84281 - DNA, 33 bp, Artificial Sequence
  Description of Artificial Sequence: Synthetic oligonucleotide
atgactgggatgaagatgcccctgctaagattc

SEQ ID NO: 84282 - DNA, 32 bp, Artificial Sequence
  Description of Artificial Sequence: Synthetic oligonucleotide
tgactgggatgaagatgcccctgctaagattc

SEQ ID NO: 84283 - DNA, 31 bp, Artificial Sequence
  Description of Artificial Sequence: Synthetic oligonucleotide
gactgggatgaagatgcccctgctaagattc

SEQ ID NO: 84284 - DNA, 31 bp, Artificial Sequence
  Description of Artificial Sequence: Synthetic oligonucleotide
actgggatgaagatgcccctgctaagattcc

SEQ ID NO: 84285 - DNA, 30 bp, Artificial Sequence
  Description of Artificial Sequence: Synthetic oligonucleotide
ctgggatgaagatgcccctgctaagattcc

SEQ ID NO: 84286 - DNA, 31 bp, Artificial Sequence
  Description of Artificial Sequence: Synthetic oligonucleotide
tgggatgaagatgcccctgctaagattccag

SEQ ID NO: 84287 - DNA, 30 bp, Artificial Sequence
  Description of Artificial Sequence: Synthetic oligonucleotide
gggatgaagatgcccctgctaagattccag

SEQ ID NO: 84288 - DNA, 32 bp, Artificial Sequence
  Description of Artificial Sequence: Synthetic oligonucleotide
ggatgaagatgcccctgctaagattccagatg

SEQ ID NO: 84289 - DNA, 34 bp, Artificial Sequence
  Description of Artificial Sequence: Synthetic oligonucleotide
gatgaagatgcccctgctaagattccagatgaag

SEQ ID NO: 84290 - DNA, 35 bp, Artificial Sequence
  Description of Artificial Sequence: Synthetic oligonucleotide
atgaagatgcccctgctaagattccagatgaagag

SEQ ID NO: 84291 - DNA, 34 bp, Artificial Sequence
  Description of Artificial Sequence: Synthetic oligonucleotide
tgaagatgcccctgctaagattccagatgaagag

SEQ ID NO: 84292 - DNA, 33 bp, Artificial Sequence
  Description of Artificial Sequence: Synthetic oligonucleotide
gaagatgcccctgctaagattccagatgaagag

SEQ ID NO: 84293 - DNA, 33 bp, Artificial Sequence
  Description of Artificial Sequence: Synthetic oligonucleotide
aagatgcccctgctaagattccagatgaagagg

SEQ ID NO: 84294 - DNA, 32 bp, Artificial Sequence
  Description of Artificial Sequence: Synthetic oligonucleotide
agatgcccctgctaagattccagatgaagagg

SEQ ID NO: 84295 - DNA, 31 bp, Artificial Sequence
  Description of Artificial Sequence: Synthetic oligonucleotide
gatgcccctgctaagattccagatgaagagg

SEQ ID NO: 84296 - DNA, 31 bp, Artificial Sequence
  Description of Artificial Sequence: Synthetic oligonucleotide
atgcccctgctaagattccagatgaagaggc

SEQ ID NO: 84297 - DNA, 30 bp, Artificial Sequence
  Description of Artificial Sequence: Synthetic oligonucleotide
tgcccctgctaagattccagatgaagaggc

SEQ ID NO: 84298 - DNA, 29 bp, Artificial Sequence
  Description of Artificial Sequence: Synthetic oligonucleotide
gcccctgctaagattccagatgaagaggc

SEQ ID NO: 84299 - DNA, 29 bp, Artificial Sequence
  Description of Artificial Sequence: Synthetic oligonucleotide
cccctgctaagattccagatgaagaggcc

SEQ ID NO: 84300 - DNA, 30 bp, Artificial Sequence
  Description of Artificial Sequence: Synthetic oligonucleotide
ccctgctaagattccagatgaagaggccac

SEQ ID NO: 84301 - DNA, 34 bp, Artificial Sequence
  Description of Artificial Sequence: Synthetic oligonucleotide
cctgctaagattccagatgaagaggccacaaaac

SEQ ID NO: 84302 - DNA, 34 bp, Artificial Sequence
  Description of Artificial Sequence: Synthetic oligonucleotide
ctgctaagattccagatgaagaggccacaaaacc

SEQ ID NO: 84303 - DNA, 34 bp, Artificial Sequence
  Description of Artificial Sequence: Synthetic oligonucleotide
tgctaagattccagatgaagaggccacaaaaccc

SEQ ID NO: 84304 - DNA, 33 bp, Artificial Sequence
  Description of Artificial Sequence: Synthetic oligonucleotide
gctaagattccagatgaagaggccacaaaaccc

SEQ ID NO: 84305 - DNA, 33 bp, Artificial Sequence
  Description of Artificial Sequence: Synthetic oligonucleotide
ctaagattccagatgaagaggccacaaaacccg

SEQ ID NO: 84306 - DNA, 35 bp, Artificial Sequence
  Description of Artificial Sequence: Synthetic oligonucleotide
taagattccagatgaagaggccacaaaacccgaag

SEQ ID NO: 84307 - DNA, 34 bp, Artificial Sequence
  Description of Artificial Sequence: Synthetic oligonucleotide
aagattccagatgaagaggccacaaaacccgaag

SEQ ID NO: 84308 - DNA, 33 bp, Artificial Sequence
  Description of Artificial Sequence: Synthetic oligonucleotide
agattccagatgaagaggccacaaaacccgaag

SEQ ID NO: 84309 - DNA, 32 bp, Artificial Sequence
  Description of Artificial Sequence: Synthetic oligonucleotide
gattccagatgaagaggccacaaaacccgaag

SEQ ID NO: 84310 - DNA, 32 bp, Artificial Sequence
  Description of Artificial Sequence: Synthetic oligonucleotide
attccagatgaagaggccacaaaacccgaagg

SEQ ID NO: 84311 - DNA, 31 bp, Artificial Sequence
  Description of Artificial Sequence: Synthetic oligonucleotide
ttccagatgaagaggccacaaaacccgaagg

SEQ ID NO: 84312 - DNA, 30 bp, Artificial Sequence
  Description of Artificial Sequence: Synthetic oligonucleotide
tccagatgaagaggccacaaaacccgaagg

SEQ ID NO: 84313 - DNA, 29 bp, Artificial Sequence
  Description of Artificial Sequence: Synthetic oligonucleotide
ccagatgaagaggccacaaaacccgaagg

SEQ ID NO: 84314 - DNA, 29 bp, Artificial Sequence
  Description of Artificial Sequence: Synthetic oligonucleotide
cagatgaagaggccacaaaacccgaaggc

SEQ ID NO: 84315 - DNA, 30 bp, Artificial Sequence
  Description of Artificial Sequence: Synthetic oligonucleotide
agatgaagaggccacaaaacccgaaggctg

SEQ ID NO: 84316 - DNA, 29 bp, Artificial Sequence
  Description of Artificial Sequence: Synthetic oligonucleotide
gatgaagaggccacaaaacccgaaggctg

SEQ ID NO: 84317 - DNA, 29 bp, Artificial Sequence
  Description of Artificial Sequence: Synthetic oligonucleotide
atgaagaggccacaaaacccgaaggctgg

SEQ ID NO: 84318 - DNA, 28 bp, Artificial Sequence
  Description of Artificial Sequence: Synthetic oligonucleotide
tgaagaggccacaaaacccgaaggctgg

SEQ ID NO: 84319 - DNA, 27 bp, Artificial Sequence
  Description of Artificial Sequence: Synthetic oligonucleotide
gaagaggccacaaaacccgaaggctgg

SEQ ID NO: 84320 - DNA, 30 bp, Artificial Sequence
  Description of Artificial Sequence: Synthetic oligonucleotide
aagaggccacaaaacccgaaggctggttag

SEQ ID NO: 84321 - DNA, 29 bp, Artificial Sequence
  Description of Artificial Sequence: Synthetic oligonucleotide
agaggccacaaaacccgaaggctggttag

SEQ ID NO: 84322 - DNA, 28 bp, Artificial Sequence
  Description of Artificial Sequence: Synthetic oligonucleotide
gaggccacaaaacccgaaggctggttag

SEQ ID NO: 84323 - DNA, 30 bp, Artificial Sequence
  Description of Artificial Sequence: Synthetic oligonucleotide
aggccacaaaacccgaaggctggttagatg

SEQ ID NO: 84324 - DNA, 29 bp, Artificial Sequence
  Description of Artificial Sequence: Synthetic oligonucleotide
ggccacaaaacccgaaggctggttagatg

SEQ ID NO: 84325 - DNA, 31 bp, Artificial Sequence
  Description of Artificial Sequence: Synthetic oligonucleotide
gccacaaaacccgaaggctggttagatgatg

SEQ ID NO: 84326 - DNA, 32 bp, Artificial Sequence
  Description of Artificial Sequence: Synthetic oligonucleotide
ccacaaaacccgaaggctggttagatgatgag

SEQ ID NO: 84327 - DNA, 32 bp, Artificial Sequence
  Description of Artificial Sequence: Synthetic oligonucleotide
cacaaaacccgaaggctggttagatgatgagc

SEQ ID NO: 84328 - DNA, 32 bp, Artificial Sequence
  Description of Artificial Sequence: Synthetic oligonucleotide
acaaaacccgaaggctggttagatgatgagcc

SEQ ID NO: 84329 - DNA, 31 bp, Artificial Sequence
  Description of Artificial Sequence: Synthetic oligonucleotide
caaaacccgaaggctggttagatgatgagcc

SEQ ID NO: 84330 - DNA, 32 bp, Artificial Sequence
  Description of Artificial Sequence: Synthetic oligonucleotide
aaaacccgaaggctggttagatgatgagcctg

SEQ ID NO: 84331 - DNA, 31 bp, Artificial Sequence
  Description of Artificial Sequence: Synthetic oligonucleotide
aaacccgaaggctggttagatgatgagcctg

SEQ ID NO: 84332 - DNA, 30 bp, Artificial Sequence
  Description of Artificial Sequence: Synthetic oligonucleotide
aacccgaaggctggttagatgatgagcctg

SEQ ID NO: 84333 - DNA, 29 bp, Artificial Sequence
  Description of Artificial Sequence: Synthetic oligonucleotide
acccgaaggctggttagatgatgagcctg

SEQ ID NO: 84334 - DNA, 28 bp, Artificial Sequence
  Description of Artificial Sequence: Synthetic oligonucleotide
cccgaaggctggttagatgatgagcctg

SEQ ID NO: 84335 - DNA, 29 bp, Artificial Sequence
  Description of Artificial Sequence: Synthetic oligonucleotide
ccgaaggctggttagatgatgagcctgag

SEQ ID NO: 84336 - DNA, 31 bp, Artificial Sequence
  Description of Artificial Sequence: Synthetic oligonucleotide
cgaaggctggttagatgatgagcctgagtac

SEQ ID NO: 84337 - DNA, 31 bp, Artificial Sequence
  Description of Artificial Sequence: Synthetic oligonucleotide
gaaggctggttagatgatgagcctgagtacg

SEQ ID NO: 84338 - DNA, 33 bp, Artificial Sequence
  Description of Artificial Sequence: Synthetic oligonucleotide
aaggctggttagatgatgagcctgagtacgtac

SEQ ID NO: 84339 - DNA, 32 bp, Artificial Sequence
  Description of Artificial Sequence: Synthetic oligonucleotide
aggctggttagatgatgagcctgagtacgtac

SEQ ID NO: 84340 - DNA, 31 bp, Artificial Sequence
  Description of Artificial Sequence: Synthetic oligonucleotide
ggctggttagatgatgagcctgagtacgtac

SEQ ID NO: 84341 - DNA, 31 bp, Artificial Sequence
  Description of Artificial Sequence: Synthetic oligonucleotide
gctggttagatgatgagcctgagtacgtacc

SEQ ID NO: 84342 - DNA, 32 bp, Artificial Sequence
  Description of Artificial Sequence: Synthetic oligonucleotide
ctggttagatgatgagcctgagtacgtacctg

SEQ ID NO: 84343 - DNA, 34 bp, Artificial Sequence
  Description of Artificial Sequence: Synthetic oligonucleotide
tggttagatgatgagcctgagtacgtacctgatc

SEQ ID NO: 84344 - DNA, 33 bp, Artificial Sequence
  Description of Artificial Sequence: Synthetic oligonucleotide
ggttagatgatgagcctgagtacgtacctgatc

SEQ ID NO: 84345 - DNA, 33 bp, Artificial Sequence
  Description of Artificial Sequence: Synthetic oligonucleotide
gttagatgatgagcctgagtacgtacctgatcc

SEQ ID NO: 84346 - DNA, 34 bp, Artificial Sequence
  Description of Artificial Sequence: Synthetic oligonucleotide
ttagatgatgagcctgagtacgtacctgatccag

SEQ ID NO: 84347 - DNA, 33 bp, Artificial Sequence
  Description of Artificial Sequence: Synthetic oligonucleotide
tagatgatgagcctgagtacgtacctgatccag

SEQ ID NO: 84348 - DNA, 32 bp, Artificial Sequence
  Description of Artificial Sequence: Synthetic oligonucleotide
agatgatgagcctgagtacgtacctgatccag

SEQ ID NO: 84349 - DNA, 31 bp, Artificial Sequence
  Description of Artificial Sequence: Synthetic oligonucleotide
gatgatgagcctgagtacgtacctgatccag

SEQ ID NO: 84350 - DNA, 32 bp, Artificial Sequence
  Description of Artificial Sequence: Synthetic oligonucleotide
atgatgagcctgagtacgtacctgatccagac

SEQ ID NO: 84351 - DNA, 31 bp, Artificial Sequence
  Description of Artificial Sequence: Synthetic oligonucleotide
tgatgagcctgagtacgtacctgatccagac

SEQ ID NO: 84352 - DNA, 30 bp, Artificial Sequence
  Description of Artificial Sequence: Synthetic oligonucleotide
gatgagcctgagtacgtacctgatccagac

SEQ ID NO: 84353 - DNA, 30 bp, Artificial Sequence
  Description of Artificial Sequence: Synthetic oligonucleotide
atgagcctgagtacgtacctgatccagacg

SEQ ID NO: 84354 - DNA, 29 bp, Artificial Sequence
  Description of Artificial Sequence: Synthetic oligonucleotide
tgagcctgagtacgtacctgatccagacg

SEQ ID NO: 84355 - DNA, 28 bp, Artificial Sequence
  Description of Artificial Sequence: Synthetic oligonucleotide
gagcctgagtacgtacctgatccagacg

SEQ ID NO: 84356 - DNA, 28 bp, Artificial Sequence
  Description of Artificial Sequence: Synthetic oligonucleotide
agcctgagtacgtacctgatccagacgc

SEQ ID NO: 84357 - DNA, 27 bp, Artificial Sequence
  Description of Artificial Sequence: Synthetic oligonucleotide
gcctgagtacgtacctgatccagacgc

SEQ ID NO: 84358 - DNA, 28 bp, Artificial Sequence
  Description of Artificial Sequence: Synthetic oligonucleotide
cctgagtacgtacctgatccagacgcag

SEQ ID NO: 84359 - DNA, 29 bp, Artificial Sequence
  Description of Artificial Sequence: Synthetic oligonucleotide
ctgagtacgtacctgatccagacgcagag

SEQ ID NO: 84360 - DNA, 32 bp, Artificial Sequence
  Description of Artificial Sequence: Synthetic oligonucleotide
tgagtacgtacctgatccagacgcagagaaac

SEQ ID NO: 84361 - DNA, 31 bp, Artificial Sequence
  Description of Artificial Sequence: Synthetic oligonucleotide
gagtacgtacctgatccagacgcagagaaac

SEQ ID NO: 84362 - DNA, 31 bp, Artificial Sequence
  Description of Artificial Sequence: Synthetic oligonucleotide
agtacgtacctgatccagacgcagagaaacc

SEQ ID NO: 84363 - DNA, 30 bp, Artificial Sequence
  Description of Artificial Sequence: Synthetic oligonucleotide
gtacgtacctgatccagacgcagagaaacc

SEQ ID NO: 84364 - DNA, 31 bp, Artificial Sequence
  Description of Artificial Sequence: Synthetic oligonucleotide
tacgtacctgatccagacgcagagaaacctg

SEQ ID NO: 84365 - DNA, 30 bp, Artificial Sequence
  Description of Artificial Sequence: Synthetic oligonucleotide
acgtacctgatccagacgcagagaaacctg

SEQ ID NO: 84366 - DNA, 29 bp, Artificial Sequence
  Description of Artificial Sequence: Synthetic oligonucleotide
cgtacctgatccagacgcagagaaacctg

SEQ ID NO: 84367 - DNA, 30 bp, Artificial Sequence
  Description of Artificial Sequence: Synthetic oligonucleotide
gtacctgatccagacgcagagaaacctgag

SEQ ID NO: 84368 - DNA, 30 bp, Artificial Sequence
  Description of Artificial Sequence: Synthetic oligonucleotide
tacctgatccagacgcagagaaacctgagg

SEQ ID NO: 84369 - DNA, 29 bp, Artificial Sequence
  Description of Artificial Sequence: Synthetic oligonucleotide
acctgatccagacgcagagaaacctgagg

SEQ ID NO: 84370 - DNA, 28 bp, Artificial Sequence
  Description of Artificial Sequence: Synthetic oligonucleotide
cctgatccagacgcagagaaacctgagg

SEQ ID NO: 84371 - DNA, 31 bp, Artificial Sequence
  Description of Artificial Sequence: Synthetic oligonucleotide
ctgatccagacgcagagaaacctgaggattg

SEQ ID NO: 84372 - DNA, 31 bp, Artificial Sequence
  Description of Artificial Sequence: Synthetic oligonucleotide
tgatccagacgcagagaaacctgaggattgg

SEQ ID NO: 84373 - DNA, 30 bp, Artificial Sequence
  Description of Artificial Sequence: Synthetic oligonucleotide
gatccagacgcagagaaacctgaggattgg

SEQ ID NO: 84374 - DNA, 30 bp, Artificial Sequence
  Description of Artificial Sequence: Synthetic oligonucleotide
atccagacgcagagaaacctgaggattggg

SEQ ID NO: 84375 - DNA, 29 bp, Artificial Sequence
  Description of Artificial Sequence: Synthetic oligonucleotide
tccagacgcagagaaacctgaggattggg

SEQ ID NO: 84376 - DNA, 28 bp, Artificial Sequence
  Description of Artificial Sequence: Synthetic oligonucleotide
ccagacgcagagaaacctgaggattggg

SEQ ID NO: 84377 - DNA, 30 bp, Artificial Sequence
  Description of Artificial Sequence: Synthetic oligonucleotide
cagacgcagagaaacctgaggattgggatg

SEQ ID NO: 84378 - DNA, 32 bp, Artificial Sequence
  Description of Artificial Sequence: Synthetic oligonucleotide
agacgcagagaaacctgaggattgggatgaag

SEQ ID NO: 84379 - DNA, 31 bp, Artificial Sequence
  Description of Artificial Sequence: Synthetic oligonucleotide
gacgcagagaaacctgaggattgggatgaag

SEQ ID NO: 84380 - DNA, 32 bp, Artificial Sequence
  Description of Artificial Sequence: Synthetic oligonucleotide
acgcagagaaacctgaggattgggatgaagac

SEQ ID NO: 84381 - DNA, 31 bp, Artificial Sequence
  Description of Artificial Sequence: Synthetic oligonucleotide
cgcagagaaacctgaggattgggatgaagac

SEQ ID NO: 84382 - DNA, 33 bp, Artificial Sequence
  Description of Artificial Sequence: Synthetic oligonucleotide
gcagagaaacctgaggattgggatgaagacatg

SEQ ID NO: 84383 - DNA, 33 bp, Artificial Sequence
  Description of Artificial Sequence: Synthetic oligonucleotide
cagagaaacctgaggattgggatgaagacatgg

SEQ ID NO: 84384 - DNA, 35 bp, Artificial Sequence
  Description of Artificial Sequence: Synthetic oligonucleotide
agagaaacctgaggattgggatgaagacatggatg

SEQ ID NO: 84385 - DNA, 34 bp, Artificial Sequence
  Description of Artificial Sequence: Synthetic oligonucleotide
gagaaacctgaggattgggatgaagacatggatg

SEQ ID NO: 84386 - DNA, 34 bp, Artificial Sequence
  Description of Artificial Sequence: Synthetic oligonucleotide
agaaacctgaggattgggatgaagacatggatgg

SEQ ID NO: 84387 - DNA, 33 bp, Artificial Sequence
  Description of Artificial Sequence: Synthetic oligonucleotide
gaaacctgaggattgggatgaagacatggatgg

SEQ ID NO: 84388 - DNA, 34 bp, Artificial Sequence
  Description of Artificial Sequence: Synthetic oligonucleotide
aaacctgaggattgggatgaagacatggatggag

SEQ ID NO: 84389 - DNA, 33 bp, Artificial Sequence
  Description of Artificial Sequence: Synthetic oligonucleotide
aacctgaggattgggatgaagacatggatggag

SEQ ID NO: 84390 - DNA, 32 bp, Artificial Sequence
  Description of Artificial Sequence: Synthetic oligonucleotide
acctgaggattgggatgaagacatggatggag

SEQ ID NO: 84391 - DNA, 31 bp, Artificial Sequence
  Description of Artificial Sequence: Synthetic oligonucleotide
cctgaggattgggatgaagacatggatggag

SEQ ID NO: 84392 - DNA, 34 bp, Artificial Sequence
  Description of Artificial Sequence: Synthetic oligonucleotide
ctgaggattgggatgaagacatggatggagaatg

SEQ ID NO: 84393 - DNA, 34 bp, Artificial Sequence
  Description of Artificial Sequence: Synthetic oligonucleotide
tgaggattgggatgaagacatggatggagaatgg

SEQ ID NO: 84394 - DNA, 33 bp, Artificial Sequence
  Description of Artificial Sequence: Synthetic oligonucleotide
gaggattgggatgaagacatggatggagaatgg

SEQ ID NO: 84395 - DNA, 33 bp, Artificial Sequence
  Description of Artificial Sequence: Synthetic oligonucleotide
aggattgggatgaagacatggatggagaatggg

SEQ ID NO: 84396 - DNA, 32 bp, Artificial Sequence
  Description of Artificial Sequence: Synthetic oligonucleotide
ggattgggatgaagacatggatggagaatggg

SEQ ID NO: 84397 - DNA, 33 bp, Artificial Sequence
  Description of Artificial Sequence: Synthetic oligonucleotide
gattgggatgaagacatggatggagaatgggag

SEQ ID NO: 84398 - DNA, 33 bp, Artificial Sequence
  Description of Artificial Sequence: Synthetic oligonucleotide
attgggatgaagacatggatggagaatgggagg

SEQ ID NO: 84399 - DNA, 32 bp, Artificial Sequence
  Description of Artificial Sequence: Synthetic oligonucleotide
ttgggatgaagacatggatggagaatgggagg

SEQ ID NO: 84400 - DNA, 31 bp, Artificial Sequence
  Description of Artificial Sequence: Synthetic oligonucleotide
tgggatgaagacatggatggagaatgggagg

SEQ ID NO: 84401 - DNA, 30 bp, Artificial Sequence
  Description of Artificial Sequence: Synthetic oligonucleotide
gggatgaagacatggatggagaatgggagg

SEQ ID NO: 84402 - DNA, 30 bp, Artificial Sequence
  Description of Artificial Sequence: Synthetic oligonucleotide
ggatgaagacatggatggagaatgggaggc

SEQ ID NO: 84403 - DNA, 31 bp, Artificial Sequence
  Description of Artificial Sequence: Synthetic oligonucleotide
gatgaagacatggatggagaatgggaggctc

SEQ ID NO: 84404 - DNA, 31 bp, Artificial Sequence
  Description of Artificial Sequence: Synthetic oligonucleotide
atgaagacatggatggagaatgggaggctcc

SEQ ID NO: 84405 - DNA, 30 bp, Artificial Sequence
  Description of Artificial Sequence: Synthetic oligonucleotide
tgaagacatggatggagaatgggaggctcc

SEQ ID NO: 84406 - DNA, 29 bp, Artificial Sequence
  Description of Artificial Sequence: Synthetic oligonucleotide
gaagacatggatggagaatgggaggctcc

SEQ ID NO: 84407 - DNA, 30 bp, Artificial Sequence
  Description of Artificial Sequence: Synthetic oligonucleotide
aagacatggatggagaatgggaggctcctc

SEQ ID NO: 84408 - DNA, 29 bp, Artificial Sequence
  Description of Artificial Sequence: Synthetic oligonucleotide
agacatggatggagaatgggaggctcctc

SEQ ID NO: 84409 - DNA, 28 bp, Artificial Sequence
  Description of Artificial Sequence: Synthetic oligonucleotide
gacatggatggagaatgggaggctcctc

SEQ ID NO: 84410 - DNA, 29 bp, Artificial Sequence
  Description of Artificial Sequence: Synthetic oligonucleotide
acatggatggagaatgggaggctcctcag

SEQ ID NO: 84411 - DNA, 28 bp, Artificial Sequence
  Description of Artificial Sequence: Synthetic oligonucleotide
catggatggagaatgggaggctcctcag

SEQ ID NO: 84412 - DNA, 31 bp, Artificial Sequence
  Description of Artificial Sequence: Synthetic oligonucleotide
atggatggagaatgggaggctcctcagattg

SEQ ID NO: 84413 - DNA, 30 bp, Artificial Sequence
  Description of Artificial Sequence: Synthetic oligonucleotide
tggatggagaatgggaggctcctcagattg

SEQ ID NO: 84414 - DNA, 29 bp, Artificial Sequence
  Description of Artificial Sequence: Synthetic oligonucleotide
ggatggagaatgggaggctcctcagattg

SEQ ID NO: 84415 - DNA, 29 bp, Artificial Sequence
  Description of Artificial Sequence: Synthetic oligonucleotide
gatggagaatgggaggctcctcagattgc

SEQ ID NO: 84416 - DNA, 29 bp, Artificial Sequence
  Description of Artificial Sequence: Synthetic oligonucleotide
atggagaatgggaggctcctcagattgcc

SEQ ID NO: 84417 - DNA, 28 bp, Artificial Sequence
  Description of Artificial Sequence: Synthetic oligonucleotide
tggagaatgggaggctcctcagattgcc

SEQ ID NO: 84418 - DNA, 27 bp, Artificial Sequence
  Description of Artificial Sequence: Synthetic oligonucleotide
ggagaatgggaggctcctcagattgcc

SEQ ID NO: 84419 - DNA, 29 bp, Artificial Sequence
  Description of Artificial Sequence: Synthetic oligonucleotide
gagaatgggaggctcctcagattgccaac

SEQ ID NO: 84420 - DNA, 29 bp, Artificial Sequence
  Description of Artificial Sequence: Synthetic oligonucleotide
agaatgggaggctcctcagattgccaacc

SEQ ID NO: 84421 - DNA, 28 bp, Artificial Sequence
  Description of Artificial Sequence: Synthetic oligonucleotide
gaatgggaggctcctcagattgccaacc

SEQ ID NO: 84422 - DNA, 28 bp, Artificial Sequence
  Description of Artificial Sequence: Synthetic oligonucleotide
aatgggaggctcctcagattgccaaccc

SEQ ID NO: 84423 - DNA, 27 bp, Artificial Sequence
  Description of Artificial Sequence: Synthetic oligonucleotide
atgggaggctcctcagattgccaaccc

SEQ ID NO: 84424 - DNA, 27 bp, Artificial Sequence
  Description of Artificial Sequence: Synthetic oligonucleotide
tgggaggctcctcagattgccaaccct

SEQ ID NO: 84425 - DNA, 27 bp, Artificial Sequence
  Description of Artificial Sequence: Synthetic oligonucleotide
gggaggctcctcagattgccaacccta

SEQ ID NO: 84426 - DNA, 27 bp, Artificial Sequence
  Description of Artificial Sequence: Synthetic oligonucleotide
ggaggctcctcagattgccaaccctag

SEQ ID NO: 84427 - DNA, 29 bp, Artificial Sequence
  Description of Artificial Sequence: Synthetic oligonucleotide
gaggctcctcagattgccaaccctagatg

SEQ ID NO: 84428 - DNA, 30 bp, Artificial Sequence
  Description of Artificial Sequence: Synthetic oligonucleotide
aggctcctcagattgccaaccctagatgtg

SEQ ID NO: 84429 - DNA, 29 bp, Artificial Sequence
  Description of Artificial Sequence: Synthetic oligonucleotide
ggctcctcagattgccaaccctagatgtg

SEQ ID NO: 84430 - DNA, 30 bp, Artificial Sequence
  Description of Artificial Sequence: Synthetic oligonucleotide
gctcctcagattgccaaccctagatgtgag

SEQ ID NO: 84431 - DNA, 31 bp, Artificial Sequence
  Description of Artificial Sequence: Synthetic oligonucleotide
ctcctcagattgccaaccctagatgtgagtc

SEQ ID NO: 84432 - DNA, 32 bp, Artificial Sequence
  Description of Artificial Sequence: Synthetic oligonucleotide
tcctcagattgccaaccctagatgtgagtcag

SEQ ID NO: 84433 - DNA, 31 bp, Artificial Sequence
  Description of Artificial Sequence: Synthetic oligonucleotide
cctcagattgccaaccctagatgtgagtcag

SEQ ID NO: 84434 - DNA, 31 bp, Artificial Sequence
  Description of Artificial Sequence: Synthetic oligonucleotide
ctcagattgccaaccctagatgtgagtcagc

SEQ ID NO: 84435 - DNA, 32 bp, Artificial Sequence
  Description of Artificial Sequence: Synthetic oligonucleotide
tcagattgccaaccctagatgtgagtcagctc

SEQ ID NO: 84436 - DNA, 31 bp, Artificial Sequence
  Description of Artificial Sequence: Synthetic oligonucleotide
cagattgccaaccctagatgtgagtcagctc

SEQ ID NO: 84437 - DNA, 31 bp, Artificial Sequence
  Description of Artificial Sequence: Synthetic oligonucleotide
agattgccaaccctagatgtgagtcagctcc

SEQ ID NO: 84438 - DNA, 30 bp, Artificial Sequence
  Description of Artificial Sequence: Synthetic oligonucleotide
gattgccaaccctagatgtgagtcagctcc

SEQ ID NO: 84439 - DNA, 31 bp, Artificial Sequence
  Description of Artificial Sequence: Synthetic oligonucleotide
attgccaaccctagatgtgagtcagctcctg

SEQ ID NO: 84440 - DNA, 30 bp, Artificial Sequence
  Description of Artificial Sequence: Synthetic oligonucleotide
ttgccaaccctagatgtgagtcagctcctg

SEQ ID NO: 84441 - DNA, 29 bp, Artificial Sequence
  Description of Artificial Sequence: Synthetic oligonucleotide
tgccaaccctagatgtgagtcagctcctg

SEQ ID NO: 84442 - DNA, 28 bp, Artificial Sequence
  Description of Artificial Sequence: Synthetic oligonucleotide
gccaaccctagatgtgagtcagctcctg

SEQ ID NO: 84443 - DNA, 28 bp, Artificial Sequence
  Description of Artificial Sequence: Synthetic oligonucleotide
ccaaccctagatgtgagtcagctcctgg

SEQ ID NO: 84444 - DNA, 30 bp, Artificial Sequence
  Description of Artificial Sequence: Synthetic oligonucleotide
caaccctagatgtgagtcagctcctggatg

SEQ ID NO: 84445 - DNA, 31 bp, Artificial Sequence
  Description of Artificial Sequence: Synthetic oligonucleotide
aaccctagatgtgagtcagctcctggatgtg

SEQ ID NO: 84446 - DNA, 30 bp, Artificial Sequence
  Description of Artificial Sequence: Synthetic oligonucleotide
accctagatgtgagtcagctcctggatgtg

SEQ ID NO: 84447 - DNA, 29 bp, Artificial Sequence
  Description of Artificial Sequence: Synthetic oligonucleotide
ccctagatgtgagtcagctcctggatgtg

SEQ ID NO: 84448 - DNA, 29 bp, Artificial Sequence
  Description of Artificial Sequence: Synthetic oligonucleotide
cctagatgtgagtcagctcctggatgtgg

SEQ ID NO: 84449 - DNA, 30 bp, Artificial Sequence
  Description of Artificial Sequence: Synthetic oligonucleotide
ctagatgtgagtcagctcctggatgtggtg

SEQ ID NO: 84450 - DNA, 31 bp, Artificial Sequence
  Description of Artificial Sequence: Synthetic oligonucleotide
tagatgtgagtcagctcctggatgtggtgtc

SEQ ID NO: 84451 - DNA, 30 bp, Artificial Sequence
  Description of Artificial Sequence: Synthetic oligonucleotide
agatgtgagtcagctcctggatgtggtgtc

SEQ ID NO: 84452 - DNA, 29 bp, Artificial Sequence
  Description of Artificial Sequence: Synthetic oligonucleotide
gatgtgagtcagctcctggatgtggtgtc

SEQ ID NO: 84453 - DNA, 30 bp, Artificial Sequence
  Description of Artificial Sequence: Synthetic oligonucleotide
atgtgagtcagctcctggatgtggtgtctg

SEQ ID NO: 84454 - DNA, 29 bp, Artificial Sequence
  Description of Artificial Sequence: Synthetic oligonucleotide
tgtgagtcagctcctggatgtggtgtctg

SEQ ID NO: 84455 - DNA, 28 bp, Artificial Sequence
  Description of Artificial Sequence: Synthetic oligonucleotide
gtgagtcagctcctggatgtggtgtctg

SEQ ID NO: 84456 - DNA, 28 bp, Artificial Sequence
  Description of Artificial Sequence: Synthetic oligonucleotide
tgagtcagctcctggatgtggtgtctgg

SEQ ID NO: 84457 - DNA, 27 bp, Artificial Sequence
  Description of Artificial Sequence: Synthetic oligonucleotide
gagtcagctcctggatgtggtgtctgg

SEQ ID NO: 84458 - DNA, 27 bp, Artificial Sequence
  Description of Artificial Sequence: Synthetic oligonucleotide
agtcagctcctggatgtggtgtctggc

SEQ ID NO: 84459 - DNA, 27 bp, Artificial Sequence
  Description of Artificial Sequence: Synthetic oligonucleotide
gtcagctcctggatgtggtgtctggca

SEQ ID NO: 84460 - DNA, 27 bp, Artificial Sequence
  Description of Artificial Sequence: Synthetic oligonucleotide
tcagctcctggatgtggtgtctggcag

SEQ ID NO: 84461 - DNA, 26 bp, Artificial Sequence
  Description of Artificial Sequence: Synthetic oligonucleotide
cagctcctggatgtggtgtctggcag

SEQ ID NO: 84462 - DNA, 26 bp, Artificial Sequence
  Description of Artificial Sequence: Synthetic oligonucleotide
agctcctggatgtggtgtctggcagc

SEQ ID NO: 84463 - DNA, 25 bp, Artificial Sequence
  Description of Artificial Sequence: Synthetic oligonucleotide
gctcctggatgtggtgtctggcagc

SEQ ID NO: 84464 - DNA, 26 bp, Artificial Sequence
  Description of Artificial Sequence: Synthetic oligonucleotide
ctcctggatgtggtgtctggcagcga

SEQ ID NO: 84465 - DNA, 26 bp, Artificial Sequence
  Description of Artificial Sequence: Synthetic oligonucleotide
tcctggatgtggtgtctggcagcgac

SEQ ID NO: 84466 - DNA, 25 bp, Artificial Sequence
  Description of Artificial Sequence: Synthetic oligonucleotide
cctggatgtggtgtctggcagcgac

SEQ ID NO: 84467 - DNA, 26 bp, Artificial Sequence
  Description of Artificial Sequence: Synthetic oligonucleotide
ctggatgtggtgtctggcagcgacct

SEQ ID NO: 84468 - DNA, 27 bp, Artificial Sequence
  Description of Artificial Sequence: Synthetic oligonucleotide
tggatgtggtgtctggcagcgacctgt

SEQ ID NO: 84469 - DNA, 26 bp, Artificial Sequence
  Description of Artificial Sequence: Synthetic oligonucleotide
ggatgtggtgtctggcagcgacctgt

SEQ ID NO: 84470 - DNA, 27 bp, Artificial Sequence
  Description of Artificial Sequence: Synthetic oligonucleotide
gatgtggtgtctggcagcgacctgtga

SEQ ID NO: 84471 - DNA, 29 bp, Artificial Sequence
  Description of Artificial Sequence: Synthetic oligonucleotide
atgtggtgtctggcagcgacctgtgattg

SEQ ID NO: 84472 - DNA, 28 bp, Artificial Sequence
  Description of Artificial Sequence: Synthetic oligonucleotide
tgtggtgtctggcagcgacctgtgattg

SEQ ID NO: 84473 - DNA, 27 bp, Artificial Sequence
  Description of Artificial Sequence: Synthetic oligonucleotide
gtggtgtctggcagcgacctgtgattg

SEQ ID NO: 84474 - DNA, 28 bp, Artificial Sequence
  Description of Artificial Sequence: Synthetic oligonucleotide
tggtgtctggcagcgacctgtgattgac

SEQ ID NO: 84475 - DNA, 27 bp, Artificial Sequence
  Description of Artificial Sequence: Synthetic oligonucleotide
ggtgtctggcagcgacctgtgattgac

SEQ ID NO: 84476 - DNA, 29 bp, Artificial Sequence
  Description of Artificial Sequence: Synthetic oligonucleotide
gtgtctggcagcgacctgtgattgacaac

SEQ ID NO: 84477 - DNA, 29 bp, Artificial Sequence
  Description of Artificial Sequence: Synthetic oligonucleotide
tgtctggcagcgacctgtgattgacaacc

SEQ ID NO: 84478 - DNA, 28 bp, Artificial Sequence
  Description of Artificial Sequence: Synthetic oligonucleotide
gtctggcagcgacctgtgattgacaacc

SEQ ID NO: 84479 - DNA, 28 bp, Artificial Sequence
  Description of Artificial Sequence: Synthetic oligonucleotide
tctggcagcgacctgtgattgacaaccc

SEQ ID NO: 84480 - DNA, 27 bp, Artificial Sequence
  Description of Artificial Sequence: Synthetic oligonucleotide
ctggcagcgacctgtgattgacaaccc

SEQ ID NO: 84481 - DNA, 27 bp, Artificial Sequence
  Description of Artificial Sequence: Synthetic oligonucleotide
tggcagcgacctgtgattgacaacccc

SEQ ID NO: 84482 - DNA, 27 bp, Artificial Sequence
  Description of Artificial Sequence: Synthetic oligonucleotide
ggcagcgacctgtgattgacaacccca

SEQ ID NO: 84483 - DNA, 35 bp, Artificial Sequence
  Description of Artificial Sequence: Synthetic oligonucleotide
gcagcgacctgtgattgacaaccccaattataaag

SEQ ID NO: 84484 - DNA, 35 bp, Artificial Sequence
  Description of Artificial Sequence: Synthetic oligonucleotide
cagcgacctgtgattgacaaccccaattataaagg

SEQ ID NO: 84485 - DNA, 35 bp, Artificial Sequence
  Description of Artificial Sequence: Synthetic oligonucleotide
agcgacctgtgattgacaaccccaattataaaggc

SEQ ID NO: 84486 - DNA, 34 bp, Artificial Sequence
  Description of Artificial Sequence: Synthetic oligonucleotide
gcgacctgtgattgacaaccccaattataaaggc

SEQ ID NO: 84487 - DNA, 38 bp, Artificial Sequence
  Description of Artificial Sequence: Synthetic oligonucleotide
cgacctgtgattgacaaccccaattataaaggcaaatg

SEQ ID NO: 84488 - DNA, 38 bp, Artificial Sequence
  Description of Artificial Sequence: Synthetic oligonucleotide
gacctgtgattgacaaccccaattataaaggcaaatgg

SEQ ID NO: 84489 - DNA, 40 bp, Artificial Sequence
  Description of Artificial Sequence: Synthetic oligonucleotide
acctgtgattgacaaccccaattataaaggcaaatggaag

SEQ ID NO: 84490 - DNA, 39 bp, Artificial Sequence
  Description of Artificial Sequence: Synthetic oligonucleotide
cctgtgattgacaaccccaattataaaggcaaatggaag

SEQ ID NO: 84491 - DNA, 39 bp, Artificial Sequence
  Description of Artificial Sequence: Synthetic oligonucleotide
ctgtgattgacaaccccaattataaaggcaaatggaagc

SEQ ID NO: 84492 - DNA, 39 bp, Artificial Sequence
  Description of Artificial Sequence: Synthetic oligonucleotide
tgtgattgacaaccccaattataaaggcaaatggaagcc

SEQ ID NO: 84493 - DNA, 38 bp, Artificial Sequence
  Description of Artificial Sequence: Synthetic oligonucleotide
gtgattgacaaccccaattataaaggcaaatggaagcc

SEQ ID NO: 84494 - DNA, 39 bp, Artificial Sequence
  Description of Artificial Sequence: Synthetic oligonucleotide
tgattgacaaccccaattataaaggcaaatggaagcctc

SEQ ID NO: 84495 - DNA, 38 bp, Artificial Sequence
  Description of Artificial Sequence: Synthetic oligonucleotide
gattgacaaccccaattataaaggcaaatggaagcctc

SEQ ID NO: 84496 - DNA, 38 bp, Artificial Sequence
  Description of Artificial Sequence: Synthetic oligonucleotide
attgacaaccccaattataaaggcaaatggaagcctcc

SEQ ID NO: 84497 - DNA, 37 bp, Artificial Sequence
  Description of Artificial Sequence: Synthetic oligonucleotide
ttgacaaccccaattataaaggcaaatggaagcctcc

SEQ ID NO: 84498 - DNA, 36 bp, Artificial Sequence
  Description of Artificial Sequence: Synthetic oligonucleotide
tgacaaccccaattataaaggcaaatggaagcctcc

SEQ ID NO: 84499 - DNA, 35 bp, Artificial Sequence
  Description of Artificial Sequence: Synthetic oligonucleotide
gacaaccccaattataaaggcaaatggaagcctcc

SEQ ID NO: 84500 - DNA, 38 bp, Artificial Sequence
  Description of Artificial Sequence: Synthetic oligonucleotide
acaaccccaattataaaggcaaatggaagcctcctatg

SEQ ID NO: 84501 - DNA, 37 bp, Artificial Sequence
  Description of Artificial Sequence: Synthetic oligonucleotide
caaccccaattataaaggcaaatggaagcctcctatg

SEQ ID NO: 84502 - DNA, 40 bp, Artificial Sequence
  Description of Artificial Sequence: Synthetic oligonucleotide
aaccccaattataaaggcaaatggaagcctcctatgattg

SEQ ID NO: 84503 - DNA, 39 bp, Artificial Sequence
  Description of Artificial Sequence: Synthetic oligonucleotide
accccaattataaaggcaaatggaagcctcctatgattg

SEQ ID NO: 84504 - DNA, 38 bp, Artificial Sequence
  Description of Artificial Sequence: Synthetic oligonucleotide
ccccaattataaaggcaaatggaagcctcctatgattg

SEQ ID NO: 84505 - DNA, 39 bp, Artificial Sequence
  Description of Artificial Sequence: Synthetic oligonucleotide
cccaattataaaggcaaatggaagcctcctatgattgac

SEQ ID NO: 84506 - DNA, 42 bp, Artificial Sequence
  Description of Artificial Sequence: Synthetic oligonucleotide
ccaattataaaggcaaatggaagcctcctatgattgacaatc

SEQ ID NO: 84507 - DNA, 42 bp, Artificial Sequence
  Description of Artificial Sequence: Synthetic oligonucleotide
caattataaaggcaaatggaagcctcctatgattgacaatcc

SEQ ID NO: 84508 - DNA, 42 bp, Artificial Sequence
  Description of Artificial Sequence: Synthetic oligonucleotide
aattataaaggcaaatggaagcctcctatgattgacaatccc

SEQ ID NO: 84509 - DNA, 41 bp, Artificial Sequence
  Description of Artificial Sequence: Synthetic oligonucleotide
attataaaggcaaatggaagcctcctatgattgacaatccc

SEQ ID NO: 84510 - DNA, 40 bp, Artificial Sequence
  Description of Artificial Sequence: Synthetic oligonucleotide
ttataaaggcaaatggaagcctcctatgattgacaatccc

SEQ ID NO: 84511 - DNA, 39 bp, Artificial Sequence
  Description of Artificial Sequence: Synthetic oligonucleotide
tataaaggcaaatggaagcctcctatgattgacaatccc

SEQ ID NO: 84512 - DNA, 38 bp, Artificial Sequence
  Description of Artificial Sequence: Synthetic oligonucleotide
ataaaggcaaatggaagcctcctatgattgacaatccc

SEQ ID NO: 84513 - DNA, 37 bp, Artificial Sequence
  Description of Artificial Sequence: Synthetic oligonucleotide
taaaggcaaatggaagcctcctatgattgacaatccc

SEQ ID NO: 84514 - DNA, 36 bp, Artificial Sequence
  Description of Artificial Sequence: Synthetic oligonucleotide
aaaggcaaatggaagcctcctatgattgacaatccc

SEQ ID NO: 84515 - DNA, 35 bp, Artificial Sequence
  Description of Artificial Sequence: Synthetic oligonucleotide
aaggcaaatggaagcctcctatgattgacaatccc

SEQ ID NO: 84516 - DNA, 34 bp, Artificial Sequence
  Description of Artificial Sequence: Synthetic oligonucleotide
aggcaaatggaagcctcctatgattgacaatccc

SEQ ID NO: 84517 - DNA, 33 bp, Artificial Sequence
  Description of Artificial Sequence: Synthetic oligonucleotide
ggcaaatggaagcctcctatgattgacaatccc

SEQ ID NO: 84518 - DNA, 34 bp, Artificial Sequence
  Description of Artificial Sequence: Synthetic oligonucleotide
gcaaatggaagcctcctatgattgacaatcccag

SEQ ID NO: 84519 - DNA, 37 bp, Artificial Sequence
  Description of Artificial Sequence: Synthetic oligonucleotide
caaatggaagcctcctatgattgacaatcccagttac

SEQ ID NO: 84520 - DNA, 37 bp, Artificial Sequence
  Description of Artificial Sequence: Synthetic oligonucleotide
aaatggaagcctcctatgattgacaatcccagttacc

SEQ ID NO: 84521 - DNA, 36 bp, Artificial Sequence
  Description of Artificial Sequence: Synthetic oligonucleotide
aatggaagcctcctatgattgacaatcccagttacc

SEQ ID NO: 84522 - DNA, 35 bp, Artificial Sequence
  Description of Artificial Sequence: Synthetic oligonucleotide
atggaagcctcctatgattgacaatcccagttacc

SEQ ID NO: 84523 - DNA, 34 bp, Artificial Sequence
  Description of Artificial Sequence: Synthetic oligonucleotide
tggaagcctcctatgattgacaatcccagttacc

SEQ ID NO: 84524 - DNA, 33 bp, Artificial Sequence
  Description of Artificial Sequence: Synthetic oligonucleotide
ggaagcctcctatgattgacaatcccagttacc

SEQ ID NO: 84525 - DNA, 34 bp, Artificial Sequence
  Description of Artificial Sequence: Synthetic oligonucleotide
gaagcctcctatgattgacaatcccagttaccag

SEQ ID NO: 84526 - DNA, 34 bp, Artificial Sequence
  Description of Artificial Sequence: Synthetic oligonucleotide
aagcctcctatgattgacaatcccagttaccagg

SEQ ID NO: 84527 - DNA, 33 bp, Artificial Sequence
  Description of Artificial Sequence: Synthetic oligonucleotide
agcctcctatgattgacaatcccagttaccagg

SEQ ID NO: 84528 - DNA, 32 bp, Artificial Sequence
  Description of Artificial Sequence: Synthetic oligonucleotide
gcctcctatgattgacaatcccagttaccagg

SEQ ID NO: 84529 - DNA, 32 bp, Artificial Sequence
  Description of Artificial Sequence: Synthetic oligonucleotide
cctcctatgattgacaatcccagttaccaggg

SEQ ID NO: 84530 - DNA, 35 bp, Artificial Sequence
  Description of Artificial Sequence: Synthetic oligonucleotide
ctcctatgattgacaatcccagttaccagggaatc

SEQ ID NO: 84531 - DNA, 36 bp, Artificial Sequence
  Description of Artificial Sequence: Synthetic oligonucleotide
tcctatgattgacaatcccagttaccagggaatctg

SEQ ID NO: 84532 - DNA, 35 bp, Artificial Sequence
  Description of Artificial Sequence: Synthetic oligonucleotide
cctatgattgacaatcccagttaccagggaatctg

SEQ ID NO: 84533 - DNA, 35 bp, Artificial Sequence
  Description of Artificial Sequence: Synthetic oligonucleotide
ctatgattgacaatcccagttaccagggaatctgg

SEQ ID NO: 84534 - DNA, 38 bp, Artificial Sequence
  Description of Artificial Sequence: Synthetic oligonucleotide
tatgattgacaatcccagttaccagggaatctggaaac

SEQ ID NO: 84535 - DNA, 37 bp, Artificial Sequence
  Description of Artificial Sequence: Synthetic oligonucleotide
atgattgacaatcccagttaccagggaatctggaaac

SEQ ID NO: 84536 - DNA, 36 bp, Artificial Sequence
  Description of Artificial Sequence: Synthetic oligonucleotide
tgattgacaatcccagttaccagggaatctggaaac

SEQ ID NO: 84537 - DNA, 35 bp, Artificial Sequence
  Description of Artificial Sequence: Synthetic oligonucleotide
gattgacaatcccagttaccagggaatctggaaac

SEQ ID NO: 84538 - DNA, 35 bp, Artificial Sequence
  Description of Artificial Sequence: Synthetic oligonucleotide
attgacaatcccagttaccagggaatctggaaacc

SEQ ID NO: 84539 - DNA, 34 bp, Artificial Sequence
  Description of Artificial Sequence: Synthetic oligonucleotide
ttgacaatcccagttaccagggaatctggaaacc

SEQ ID NO: 84540 - DNA, 33 bp, Artificial Sequence
  Description of Artificial Sequence: Synthetic oligonucleotide
tgacaatcccagttaccagggaatctggaaacc

SEQ ID NO: 84541 - DNA, 32 bp, Artificial Sequence
  Description of Artificial Sequence: Synthetic oligonucleotide
gacaatcccagttaccagggaatctggaaacc

SEQ ID NO: 84542 - DNA, 32 bp, Artificial Sequence
  Description of Artificial Sequence: Synthetic oligonucleotide
acaatcccagttaccagggaatctggaaaccc

SEQ ID NO: 84543 - DNA, 31 bp, Artificial Sequence
  Description of Artificial Sequence: Synthetic oligonucleotide
caatcccagttaccagggaatctggaaaccc

SEQ ID NO: 84544 - DNA, 32 bp, Artificial Sequence
  Description of Artificial Sequence: Synthetic oligonucleotide
aatcccagttaccagggaatctggaaacccag

SEQ ID NO: 84545 - DNA, 31 bp, Artificial Sequence
  Description of Artificial Sequence: Synthetic oligonucleotide
atcccagttaccagggaatctggaaacccag

SEQ ID NO: 84546 - DNA, 30 bp, Artificial Sequence
  Description of Artificial Sequence: Synthetic oligonucleotide
tcccagttaccagggaatctggaaacccag

SEQ ID NO: 84547 - DNA, 29 bp, Artificial Sequence
  Description of Artificial Sequence: Synthetic oligonucleotide
cccagttaccagggaatctggaaacccag

SEQ ID NO: 84548 - DNA, 29 bp, Artificial Sequence
  Description of Artificial Sequence: Synthetic oligonucleotide
ccagttaccagggaatctggaaacccagg

SEQ ID NO: 84549 - DNA, 35 bp, Artificial Sequence
  Description of Artificial Sequence: Synthetic oligonucleotide
cagttaccagggaatctggaaacccaggaaaatac

SEQ ID NO: 84550 - DNA, 35 bp, Artificial Sequence
  Description of Artificial Sequence: Synthetic oligonucleotide
agttaccagggaatctggaaacccaggaaaatacc

SEQ ID NO: 84551 - DNA, 34 bp, Artificial Sequence
  Description of Artificial Sequence: Synthetic oligonucleotide
gttaccagggaatctggaaacccaggaaaatacc

SEQ ID NO: 84552 - DNA, 38 bp, Artificial Sequence
  Description of Artificial Sequence: Synthetic oligonucleotide
ttaccagggaatctggaaacccaggaaaataccaaatc

SEQ ID NO: 84553 - DNA, 37 bp, Artificial Sequence
  Description of Artificial Sequence: Synthetic oligonucleotide
taccagggaatctggaaacccaggaaaataccaaatc

SEQ ID NO: 84554 - DNA, 36 bp, Artificial Sequence
  Description of Artificial Sequence: Synthetic oligonucleotide
accagggaatctggaaacccaggaaaataccaaatc

SEQ ID NO: 84555 - DNA, 35 bp, Artificial Sequence
  Description of Artificial Sequence: Synthetic oligonucleotide
ccagggaatctggaaacccaggaaaataccaaatc

SEQ ID NO: 84556 - DNA, 35 bp, Artificial Sequence
  Description of Artificial Sequence: Synthetic oligonucleotide
cagggaatctggaaacccaggaaaataccaaatcc

SEQ ID NO: 84557 - DNA, 36 bp, Artificial Sequence
  Description of Artificial Sequence: Synthetic oligonucleotide
agggaatctggaaacccaggaaaataccaaatccag

SEQ ID NO: 84558 - DNA, 35 bp, Artificial Sequence
  Description of Artificial Sequence: Synthetic oligonucleotide
gggaatctggaaacccaggaaaataccaaatccag

SEQ ID NO: 84559 - DNA, 39 bp, Artificial Sequence
  Description of Artificial Sequence: Synthetic oligonucleotide
ggaatctggaaacccaggaaaataccaaatccagatttc

SEQ ID NO: 84560 - DNA, 42 bp, Artificial Sequence
  Description of Artificial Sequence: Synthetic oligonucleotide
gaatctggaaacccaggaaaataccaaatccagatttctttg

SEQ ID NO: 84561 - DNA, 44 bp, Artificial Sequence
  Description of Artificial Sequence: Synthetic oligonucleotide
aatctggaaacccaggaaaataccaaatccagatttctttgaag

SEQ ID NO: 84562 - DNA, 43 bp, Artificial Sequence
  Description of Artificial Sequence: Synthetic oligonucleotide
atctggaaacccaggaaaataccaaatccagatttctttgaag

SEQ ID NO: 84563 - DNA, 42 bp, Artificial Sequence
  Description of Artificial Sequence: Synthetic oligonucleotide
tctggaaacccaggaaaataccaaatccagatttctttgaag

SEQ ID NO: 84564 - DNA, 41 bp, Artificial Sequence
  Description of Artificial Sequence: Synthetic oligonucleotide
ctggaaacccaggaaaataccaaatccagatttctttgaag

SEQ ID NO: 84565 - DNA, 43 bp, Artificial Sequence
  Description of Artificial Sequence: Synthetic oligonucleotide
tggaaacccaggaaaataccaaatccagatttctttgaagatc

SEQ ID NO: 84566 - DNA, 42 bp, Artificial Sequence
  Description of Artificial Sequence: Synthetic oligonucleotide
ggaaacccaggaaaataccaaatccagatttctttgaagatc

SEQ ID NO: 84567 - DNA, 43 bp, Artificial Sequence
  Description of Artificial Sequence: Synthetic oligonucleotide
gaaacccaggaaaataccaaatccagatttctttgaagatctg

SEQ ID NO: 84568 - DNA, 43 bp, Artificial Sequence
  Description of Artificial Sequence: Synthetic oligonucleotide
aaacccaggaaaataccaaatccagatttctttgaagatctgg

SEQ ID NO: 84569 - DNA, 42 bp, Artificial Sequence
  Description of Artificial Sequence: Synthetic oligonucleotide
aacccaggaaaataccaaatccagatttctttgaagatctgg

SEQ ID NO: 84570 - DNA, 41 bp, Artificial Sequence
  Description of Artificial Sequence: Synthetic oligonucleotide
acccaggaaaataccaaatccagatttctttgaagatctgg

SEQ ID NO: 84571 - DNA, 40 bp, Artificial Sequence
  Description of Artificial Sequence: Synthetic oligonucleotide
cccaggaaaataccaaatccagatttctttgaagatctgg

SEQ ID NO: 84572 - DNA, 42 bp, Artificial Sequence
  Description of Artificial Sequence: Synthetic oligonucleotide
ccaggaaaataccaaatccagatttctttgaagatctggaac

SEQ ID NO: 84573 - DNA, 42 bp, Artificial Sequence
  Description of Artificial Sequence: Synthetic oligonucleotide
caggaaaataccaaatccagatttctttgaagatctggaacc

SEQ ID NO: 84574 - DNA, 45 bp, Artificial Sequence
  Description of Artificial Sequence: Synthetic oligonucleotide
aggaaaataccaaatccagatttctttgaagatctggaacctttc

SEQ ID NO: 84575 - DNA, 44 bp, Artificial Sequence
  Description of Artificial Sequence: Synthetic oligonucleotide
ggaaaataccaaatccagatttctttgaagatctggaacctttc

SEQ ID NO: 84576 - DNA, 45 bp, Artificial Sequence
  Description of Artificial Sequence: Synthetic oligonucleotide
gaaaataccaaatccagatttctttgaagatctggaacctttcag

SEQ ID NO: 84577 - DNA, 48 bp, Artificial Sequence
  Description of Artificial Sequence: Synthetic oligonucleotide
aaaataccaaatccagatttctttgaagatctggaacctttcagaatg

SEQ ID NO: 84578 - DNA, 47 bp, Artificial Sequence
  Description of Artificial Sequence: Synthetic oligonucleotide
aaataccaaatccagatttctttgaagatctggaacctttcagaatg

SEQ ID NO: 84579 - DNA, 46 bp, Artificial Sequence
  Description of Artificial Sequence: Synthetic oligonucleotide
aataccaaatccagatttctttgaagatctggaacctttcagaatg

SEQ ID NO: 84580 - DNA, 45 bp, Artificial Sequence
  Description of Artificial Sequence: Synthetic oligonucleotide
ataccaaatccagatttctttgaagatctggaacctttcagaatg

SEQ ID NO: 84581 - DNA, 44 bp, Artificial Sequence
  Description of Artificial Sequence: Synthetic oligonucleotide
taccaaatccagatttctttgaagatctggaacctttcagaatg

SEQ ID NO: 84582 - DNA, 43 bp, Artificial Sequence
  Description of Artificial Sequence: Synthetic oligonucleotide
accaaatccagatttctttgaagatctggaacctttcagaatg

SEQ ID NO: 84583 - DNA, 42 bp, Artificial Sequence
  Description of Artificial Sequence: Synthetic oligonucleotide
ccaaatccagatttctttgaagatctggaacctttcagaatg

SEQ ID NO: 84584 - DNA, 43 bp, Artificial Sequence
  Description of Artificial Sequence: Synthetic oligonucleotide
caaatccagatttctttgaagatctggaacctttcagaatgac

SEQ ID NO: 84585 - DNA, 44 bp, Artificial Sequence
  Description of Artificial Sequence: Synthetic oligonucleotide
aaatccagatttctttgaagatctggaacctttcagaatgactc

SEQ ID NO: 84586 - DNA, 43 bp, Artificial Sequence
  Description of Artificial Sequence: Synthetic oligonucleotide
aatccagatttctttgaagatctggaacctttcagaatgactc

SEQ ID NO: 84587 - DNA, 42 bp, Artificial Sequence
  Description of Artificial Sequence: Synthetic oligonucleotide
atccagatttctttgaagatctggaacctttcagaatgactc

SEQ ID NO: 84588 - DNA, 41 bp, Artificial Sequence
  Description of Artificial Sequence: Synthetic oligonucleotide
tccagatttctttgaagatctggaacctttcagaatgactc

SEQ ID NO: 84589 - DNA, 40 bp, Artificial Sequence
  Description of Artificial Sequence: Synthetic oligonucleotide
ccagatttctttgaagatctggaacctttcagaatgactc

SEQ ID NO: 84590 - DNA, 40 bp, Artificial Sequence
  Description of Artificial Sequence: Synthetic oligonucleotide
cagatttctttgaagatctggaacctttcagaatgactcc

SEQ ID NO: 84591 - DNA, 45 bp, Artificial Sequence
  Description of Artificial Sequence: Synthetic oligonucleotide
agatttctttgaagatctggaacctttcagaatgactccttttag

SEQ ID NO: 84592 - DNA, 44 bp, Artificial Sequence
  Description of Artificial Sequence: Synthetic oligonucleotide
gatttctttgaagatctggaacctttcagaatgactccttttag

SEQ ID NO: 84593 - DNA, 45 bp, Artificial Sequence
  Description of Artificial Sequence: Synthetic oligonucleotide
atttctttgaagatctggaacctttcagaatgactccttttagtg

SEQ ID NO: 84594 - DNA, 44 bp, Artificial Sequence
  Description of Artificial Sequence: Synthetic oligonucleotide
tttctttgaagatctggaacctttcagaatgactccttttagtg

SEQ ID NO: 84595 - DNA, 43 bp, Artificial Sequence
  Description of Artificial Sequence: Synthetic oligonucleotide
ttctttgaagatctggaacctttcagaatgactccttttagtg

SEQ ID NO: 84596 - DNA, 42 bp, Artificial Sequence
  Description of Artificial Sequence: Synthetic oligonucleotide
tctttgaagatctggaacctttcagaatgactccttttagtg

SEQ ID NO: 84597 - DNA, 41 bp, Artificial Sequence
  Description of Artificial Sequence: Synthetic oligonucleotide
ctttgaagatctggaacctttcagaatgactccttttagtg

SEQ ID NO: 84598 - DNA, 41 bp, Artificial Sequence
  Description of Artificial Sequence: Synthetic oligonucleotide
tttgaagatctggaacctttcagaatgactccttttagtgc

SEQ ID NO: 84599 - DNA, 40 bp, Artificial Sequence
  Description of Artificial Sequence: Synthetic oligonucleotide
ttgaagatctggaacctttcagaatgactccttttagtgc

SEQ ID NO: 84600 - DNA, 39 bp, Artificial Sequence
  Description of Artificial Sequence: Synthetic oligonucleotide
tgaagatctggaacctttcagaatgactccttttagtgc

SEQ ID NO: 84601 - DNA, 38 bp, Artificial Sequence
  Description of Artificial Sequence: Synthetic oligonucleotide
gaagatctggaacctttcagaatgactccttttagtgc

SEQ ID NO: 84602 - DNA, 42 bp, Artificial Sequence
  Description of Artificial Sequence: Synthetic oligonucleotide
aagatctggaacctttcagaatgactccttttagtgctattg

SEQ ID NO: 84603 - DNA, 41 bp, Artificial Sequence
  Description of Artificial Sequence: Synthetic oligonucleotide
agatctggaacctttcagaatgactccttttagtgctattg

SEQ ID NO: 84604 - DNA, 40 bp, Artificial Sequence
  Description of Artificial Sequence: Synthetic oligonucleotide
gatctggaacctttcagaatgactccttttagtgctattg

SEQ ID NO: 84605 - DNA, 40 bp, Artificial Sequence
  Description of Artificial Sequence: Synthetic oligonucleotide
atctggaacctttcagaatgactccttttagtgctattgg

SEQ ID NO: 84606 - DNA, 39 bp, Artificial Sequence
  Description of Artificial Sequence: Synthetic oligonucleotide
tctggaacctttcagaatgactccttttagtgctattgg

SEQ ID NO: 84607 - DNA, 38 bp, Artificial Sequence
  Description of Artificial Sequence: Synthetic oligonucleotide
ctggaacctttcagaatgactccttttagtgctattgg

SEQ ID NO: 84608 - DNA, 41 bp, Artificial Sequence
  Description of Artificial Sequence: Synthetic oligonucleotide
tggaacctttcagaatgactccttttagtgctattggtttg

SEQ ID NO: 84609 - DNA, 40 bp, Artificial Sequence
  Description of Artificial Sequence: Synthetic oligonucleotide
ggaacctttcagaatgactccttttagtgctattggtttg

SEQ ID NO: 84610 - DNA, 40 bp, Artificial Sequence
  Description of Artificial Sequence: Synthetic oligonucleotide
gaacctttcagaatgactccttttagtgctattggtttgg

SEQ ID NO: 84611 - DNA, 41 bp, Artificial Sequence
  Description of Artificial Sequence: Synthetic oligonucleotide
aacctttcagaatgactccttttagtgctattggtttggag

SEQ ID NO: 84612 - DNA, 40 bp, Artificial Sequence
  Description of Artificial Sequence: Synthetic oligonucleotide
acctttcagaatgactccttttagtgctattggtttggag

SEQ ID NO: 84613 - DNA, 39 bp, Artificial Sequence
  Description of Artificial Sequence: Synthetic oligonucleotide
cctttcagaatgactccttttagtgctattggtttggag

SEQ ID NO: 84614 - DNA, 39 bp, Artificial Sequence
  Description of Artificial Sequence: Synthetic oligonucleotide
ctttcagaatgactccttttagtgctattggtttggagc

SEQ ID NO: 84615 - DNA, 40 bp, Artificial Sequence
  Description of Artificial Sequence: Synthetic oligonucleotide
tttcagaatgactccttttagtgctattggtttggagctg

SEQ ID NO: 84616 - DNA, 39 bp, Artificial Sequence
  Description of Artificial Sequence: Synthetic oligonucleotide
ttcagaatgactccttttagtgctattggtttggagctg

SEQ ID NO: 84617 - DNA, 38 bp, Artificial Sequence
  Description of Artificial Sequence: Synthetic oligonucleotide
tcagaatgactccttttagtgctattggtttggagctg

SEQ ID NO: 84618 - DNA, 37 bp, Artificial Sequence
  Description of Artificial Sequence: Synthetic oligonucleotide
cagaatgactccttttagtgctattggtttggagctg

SEQ ID NO: 84619 - DNA, 38 bp, Artificial Sequence
  Description of Artificial Sequence: Synthetic oligonucleotide
agaatgactccttttagtgctattggtttggagctgtg

SEQ ID NO: 84620 - DNA, 37 bp, Artificial Sequence
  Description of Artificial Sequence: Synthetic oligonucleotide
gaatgactccttttagtgctattggtttggagctgtg

SEQ ID NO: 84621 - DNA, 37 bp, Artificial Sequence
  Description of Artificial Sequence: Synthetic oligonucleotide
aatgactccttttagtgctattggtttggagctgtgg

SEQ ID NO: 84622 - DNA, 36 bp, Artificial Sequence
  Description of Artificial Sequence: Synthetic oligonucleotide
atgactccttttagtgctattggtttggagctgtgg

SEQ ID NO: 84623 - DNA, 35 bp, Artificial Sequence
  Description of Artificial Sequence: Synthetic oligonucleotide
tgactccttttagtgctattggtttggagctgtgg

SEQ ID NO: 84624 - DNA, 34 bp, Artificial Sequence
  Description of Artificial Sequence: Synthetic oligonucleotide
gactccttttagtgctattggtttggagctgtgg

SEQ ID NO: 84625 - DNA, 35 bp, Artificial Sequence
  Description of Artificial Sequence: Synthetic oligonucleotide
actccttttagtgctattggtttggagctgtggtc

SEQ ID NO: 84626 - DNA, 34 bp, Artificial Sequence
  Description of Artificial Sequence: Synthetic oligonucleotide
ctccttttagtgctattggtttggagctgtggtc

SEQ ID NO: 84627 - DNA, 34 bp, Artificial Sequence
  Description of Artificial Sequence: Synthetic oligonucleotide
tccttttagtgctattggtttggagctgtggtcc

SEQ ID NO: 84628 - DNA, 33 bp, Artificial Sequence
  Description of Artificial Sequence: Synthetic oligonucleotide
ccttttagtgctattggtttggagctgtggtcc

SEQ ID NO: 84629 - DNA, 35 bp, Artificial Sequence
  Description of Artificial Sequence: Synthetic oligonucleotide
cttttagtgctattggtttggagctgtggtccatg

SEQ ID NO: 84630 - DNA, 36 bp, Artificial Sequence
  Description of Artificial Sequence: Synthetic oligonucleotide
ttttagtgctattggtttggagctgtggtccatgac

SEQ ID NO: 84631 - DNA, 35 bp, Artificial Sequence
  Description of Artificial Sequence: Synthetic oligonucleotide
tttagtgctattggtttggagctgtggtccatgac

SEQ ID NO: 84632 - DNA, 34 bp, Artificial Sequence
  Description of Artificial Sequence: Synthetic oligonucleotide
ttagtgctattggtttggagctgtggtccatgac

SEQ ID NO: 84633 - DNA, 33 bp, Artificial Sequence
  Description of Artificial Sequence: Synthetic oligonucleotide
tagtgctattggtttggagctgtggtccatgac

SEQ ID NO: 84634 - DNA, 32 bp, Artificial Sequence
  Description of Artificial Sequence: Synthetic oligonucleotide
agtgctattggtttggagctgtggtccatgac

SEQ ID NO: 84635 - DNA, 31 bp, Artificial Sequence
  Description of Artificial Sequence: Synthetic oligonucleotide
gtgctattggtttggagctgtggtccatgac

SEQ ID NO: 84636 - DNA, 31 bp, Artificial Sequence
  Description of Artificial Sequence: Synthetic oligonucleotide
tgctattggtttggagctgtggtccatgacc

SEQ ID NO: 84637 - DNA, 30 bp, Artificial Sequence
  Description of Artificial Sequence: Synthetic oligonucleotide
gctattggtttggagctgtggtccatgacc

SEQ ID NO: 84638 - DNA, 31 bp, Artificial Sequence
  Description of Artificial Sequence: Synthetic oligonucleotide
ctattggtttggagctgtggtccatgacctc

SEQ ID NO: 84639 - DNA, 32 bp, Artificial Sequence
  Description of Artificial Sequence: Synthetic oligonucleotide
tattggtttggagctgtggtccatgacctctg

SEQ ID NO: 84640 - DNA, 31 bp, Artificial Sequence
  Description of Artificial Sequence: Synthetic oligonucleotide
attggtttggagctgtggtccatgacctctg

SEQ ID NO: 84641 - DNA, 30 bp, Artificial Sequence
  Description of Artificial Sequence: Synthetic oligonucleotide
ttggtttggagctgtggtccatgacctctg

SEQ ID NO: 84642 - DNA, 29 bp, Artificial Sequence
  Description of Artificial Sequence: Synthetic oligonucleotide
tggtttggagctgtggtccatgacctctg

SEQ ID NO: 84643 - DNA, 28 bp, Artificial Sequence
  Description of Artificial Sequence: Synthetic oligonucleotide
ggtttggagctgtggtccatgacctctg

SEQ ID NO: 84644 - DNA, 29 bp, Artificial Sequence
  Description of Artificial Sequence: Synthetic oligonucleotide
gtttggagctgtggtccatgacctctgac

SEQ ID NO: 84645 - DNA, 38 bp, Artificial Sequence
  Description of Artificial Sequence: Synthetic oligonucleotide
tttggagctgtggtccatgacctctgacattttttttg

SEQ ID NO: 84646 - DNA, 37 bp, Artificial Sequence
  Description of Artificial Sequence: Synthetic oligonucleotide
ttggagctgtggtccatgacctctgacattttttttg

SEQ ID NO: 84647 - DNA, 36 bp, Artificial Sequence
  Description of Artificial Sequence: Synthetic oligonucleotide
tggagctgtggtccatgacctctgacattttttttg

SEQ ID NO: 84648 - DNA, 35 bp, Artificial Sequence
  Description of Artificial Sequence: Synthetic oligonucleotide
ggagctgtggtccatgacctctgacattttttttg

SEQ ID NO: 84649 - DNA, 36 bp, Artificial Sequence
  Description of Artificial Sequence: Synthetic oligonucleotide
gagctgtggtccatgacctctgacattttttttgac

SEQ ID NO: 84650 - DNA, 38 bp, Artificial Sequence
  Description of Artificial Sequence: Synthetic oligonucleotide
agctgtggtccatgacctctgacattttttttgacaac

SEQ ID NO: 84651 - DNA, 37 bp, Artificial Sequence
  Description of Artificial Sequence: Synthetic oligonucleotide
gctgtggtccatgacctctgacattttttttgacaac

SEQ ID NO: 84652 - DNA, 42 bp, Artificial Sequence
  Description of Artificial Sequence: Synthetic oligonucleotide
ctgtggtccatgacctctgacattttttttgacaactttatc

SEQ ID NO: 84653 - DNA, 46 bp, Artificial Sequence
  Description of Artificial Sequence: Synthetic oligonucleotide
tgtggtccatgacctctgacattttttttgacaactttatcatttg

SEQ ID NO: 84654 - DNA, 45 bp, Artificial Sequence
  Description of Artificial Sequence: Synthetic oligonucleotide
gtggtccatgacctctgacattttttttgacaactttatcatttg

SEQ ID NO: 84655 - DNA, 46 bp, Artificial Sequence
  Description of Artificial Sequence: Synthetic oligonucleotide
tggtccatgacctctgacattttttttgacaactttatcatttgtg

SEQ ID NO: 84656 - DNA, 45 bp, Artificial Sequence
  Description of Artificial Sequence: Synthetic oligonucleotide
ggtccatgacctctgacattttttttgacaactttatcatttgtg

SEQ ID NO: 84657 - DNA, 45 bp, Artificial Sequence
  Description of Artificial Sequence: Synthetic oligonucleotide
gtccatgacctctgacattttttttgacaactttatcatttgtgc

SEQ ID NO: 84658 - DNA, 46 bp, Artificial Sequence
  Description of Artificial Sequence: Synthetic oligonucleotide
tccatgacctctgacattttttttgacaactttatcatttgtgctg

SEQ ID NO: 84659 - DNA, 45 bp, Artificial Sequence
  Description of Artificial Sequence: Synthetic oligonucleotide
ccatgacctctgacattttttttgacaactttatcatttgtgctg

SEQ ID NO: 84660 - DNA, 47 bp, Artificial Sequence
  Description of Artificial Sequence: Synthetic oligonucleotide
catgacctctgacattttttttgacaactttatcatttgtgctgatc

SEQ ID NO: 84661 - DNA, 47 bp, Artificial Sequence
  Description of Artificial Sequence: Synthetic oligonucleotide
atgacctctgacattttttttgacaactttatcatttgtgctgatcg

SEQ ID NO: 84662 - DNA, 46 bp, Artificial Sequence
  Description of Artificial Sequence: Synthetic oligonucleotide
tgacctctgacattttttttgacaactttatcatttgtgctgatcg

SEQ ID NO: 84663 - DNA, 45 bp, Artificial Sequence
  Description of Artificial Sequence: Synthetic oligonucleotide
gacctctgacattttttttgacaactttatcatttgtgctgatcg

SEQ ID NO: 84664 - DNA, 47 bp, Artificial Sequence
  Description of Artificial Sequence: Synthetic oligonucleotide
acctctgacattttttttgacaactttatcatttgtgctgatcgaag

SEQ ID NO: 84665 - DNA, 46 bp, Artificial Sequence
  Description of Artificial Sequence: Synthetic oligonucleotide
cctctgacattttttttgacaactttatcatttgtgctgatcgaag

SEQ ID NO: 84666 - DNA, 50 bp, Artificial Sequence
  Description of Artificial Sequence: Synthetic oligonucleotide
ctctgacattttttttgacaactttatcatttgtgctgatcgaagaatag

SEQ ID NO: 84667 - DNA, 52 bp, Artificial Sequence
  Description of Artificial Sequence: Synthetic oligonucleotide
tctgacattttttttgacaactttatcatttgtgctgatcgaagaatagttg

SEQ ID NO: 84668 - DNA, 51 bp, Artificial Sequence
  Description of Artificial Sequence: Synthetic oligonucleotide
ctgacattttttttgacaactttatcatttgtgctgatcgaagaatagttg

SEQ ID NO: 84669 - DNA, 53 bp, Artificial Sequence
  Description of Artificial Sequence: Synthetic oligonucleotide
tgacattttttttgacaactttatcatttgtgctgatcgaagaatagttgatg

SEQ ID NO: 84670 - DNA, 52 bp, Artificial Sequence
  Description of Artificial Sequence: Synthetic oligonucleotide
gacattttttttgacaactttatcatttgtgctgatcgaagaatagttgatg

SEQ ID NO: 84671 - DNA, 55 bp, Artificial Sequence
  Description of Artificial Sequence: Synthetic oligonucleotide
acattttttttgacaactttatcatttgtgctgatcgaagaatagttgatgattg

SEQ ID NO: 84672 - DNA, 54 bp, Artificial Sequence
  Description of Artificial Sequence: Synthetic oligonucleotide
cattttttttgacaactttatcatttgtgctgatcgaagaatagttgatgattg

SEQ ID NO: 84673 - DNA, 54 bp, Artificial Sequence
  Description of Artificial Sequence: Synthetic oligonucleotide
attttttttgacaactttatcatttgtgctgatcgaagaatagttgatgattgg

SEQ ID NO: 84674 - DNA, 53 bp, Artificial Sequence
  Description of Artificial Sequence: Synthetic oligonucleotide
ttttttttgacaactttatcatttgtgctgatcgaagaatagttgatgattgg

SEQ ID NO: 84675 - DNA, 52 bp, Artificial Sequence
  Description of Artificial Sequence: Synthetic oligonucleotide
tttttttgacaactttatcatttgtgctgatcgaagaatagttgatgattgg

SEQ ID NO: 84676 - DNA, 51 bp, Artificial Sequence
  Description of Artificial Sequence: Synthetic oligonucleotide
ttttttgacaactttatcatttgtgctgatcgaagaatagttgatgattgg

SEQ ID NO: 84677 - DNA, 50 bp, Artificial Sequence
  Description of Artificial Sequence: Synthetic oligonucleotide
tttttgacaactttatcatttgtgctgatcgaagaatagttgatgattgg

SEQ ID NO: 84678 - DNA, 49 bp, Artificial Sequence
  Description of Artificial Sequence: Synthetic oligonucleotide
ttttgacaactttatcatttgtgctgatcgaagaatagttgatgattgg

SEQ ID NO: 84679 - DNA, 48 bp, Artificial Sequence
  Description of Artificial Sequence: Synthetic oligonucleotide
tttgacaactttatcatttgtgctgatcgaagaatagttgatgattgg

SEQ ID NO: 84680 - DNA, 47 bp, Artificial Sequence
  Description of Artificial Sequence: Synthetic oligonucleotide
ttgacaactttatcatttgtgctgatcgaagaatagttgatgattgg

SEQ ID NO: 84681 - DNA, 46 bp, Artificial Sequence
  Description of Artificial Sequence: Synthetic oligonucleotide
tgacaactttatcatttgtgctgatcgaagaatagttgatgattgg

SEQ ID NO: 84682 - DNA, 45 bp, Artificial Sequence
  Description of Artificial Sequence: Synthetic oligonucleotide
gacaactttatcatttgtgctgatcgaagaatagttgatgattgg

SEQ ID NO: 84683 - DNA, 45 bp, Artificial Sequence
  Description of Artificial Sequence: Synthetic oligonucleotide
acaactttatcatttgtgctgatcgaagaatagttgatgattggg

SEQ ID NO: 84684 - DNA, 44 bp, Artificial Sequence
  Description of Artificial Sequence: Synthetic oligonucleotide
caactttatcatttgtgctgatcgaagaatagttgatgattggg

SEQ ID NO: 84685 - DNA, 44 bp, Artificial Sequence
  Description of Artificial Sequence: Synthetic oligonucleotide
aactttatcatttgtgctgatcgaagaatagttgatgattgggc

SEQ ID NO: 84686 - DNA, 43 bp, Artificial Sequence
  Description of Artificial Sequence: Synthetic oligonucleotide
actttatcatttgtgctgatcgaagaatagttgatgattgggc

SEQ ID NO: 84687 - DNA, 42 bp, Artificial Sequence
  Description of Artificial Sequence: Synthetic oligonucleotide
ctttatcatttgtgctgatcgaagaatagttgatgattgggc

SEQ ID NO: 84688 - DNA, 42 bp, Artificial Sequence
  Description of Artificial Sequence: Synthetic oligonucleotide
tttatcatttgtgctgatcgaagaatagttgatgattgggcc

SEQ ID NO: 84689 - DNA, 41 bp, Artificial Sequence
  Description of Artificial Sequence: Synthetic oligonucleotide
ttatcatttgtgctgatcgaagaatagttgatgattgggcc

SEQ ID NO: 84690 - DNA, 40 bp, Artificial Sequence
  Description of Artificial Sequence: Synthetic oligonucleotide
tatcatttgtgctgatcgaagaatagttgatgattgggcc

SEQ ID NO: 84691 - DNA, 39 bp, Artificial Sequence
  Description of Artificial Sequence: Synthetic oligonucleotide
atcatttgtgctgatcgaagaatagttgatgattgggcc

SEQ ID NO: 84692 - DNA, 38 bp, Artificial Sequence
  Description of Artificial Sequence: Synthetic oligonucleotide
tcatttgtgctgatcgaagaatagttgatgattgggcc

SEQ ID NO: 84693 - DNA, 37 bp, Artificial Sequence
  Description of Artificial Sequence: Synthetic oligonucleotide
catttgtgctgatcgaagaatagttgatgattgggcc

SEQ ID NO: 84694 - DNA, 40 bp, Artificial Sequence
  Description of Artificial Sequence: Synthetic oligonucleotide
atttgtgctgatcgaagaatagttgatgattgggccaatg

SEQ ID NO: 84695 - DNA, 39 bp, Artificial Sequence
  Description of Artificial Sequence: Synthetic oligonucleotide
tttgtgctgatcgaagaatagttgatgattgggccaatg

SEQ ID NO: 84696 - DNA, 38 bp, Artificial Sequence
  Description of Artificial Sequence: Synthetic oligonucleotide
ttgtgctgatcgaagaatagttgatgattgggccaatg

SEQ ID NO: 84697 - DNA, 37 bp, Artificial Sequence
  Description of Artificial Sequence: Synthetic oligonucleotide
tgtgctgatcgaagaatagttgatgattgggccaatg

SEQ ID NO: 84698 - DNA, 36 bp, Artificial Sequence
  Description of Artificial Sequence: Synthetic oligonucleotide
gtgctgatcgaagaatagttgatgattgggccaatg

SEQ ID NO: 84699 - DNA, 38 bp, Artificial Sequence
  Description of Artificial Sequence: Synthetic oligonucleotide
tgctgatcgaagaatagttgatgattgggccaatgatg

SEQ ID NO: 84700 - DNA, 37 bp, Artificial Sequence
  Description of Artificial Sequence: Synthetic oligonucleotide
gctgatcgaagaatagttgatgattgggccaatgatg

SEQ ID NO: 84701 - DNA, 37 bp, Artificial Sequence
  Description of Artificial Sequence: Synthetic oligonucleotide
ctgatcgaagaatagttgatgattgggccaatgatgg

SEQ ID NO: 84702 - DNA, 39 bp, Artificial Sequence
  Description of Artificial Sequence: Synthetic oligonucleotide
tgatcgaagaatagttgatgattgggccaatgatggatg

SEQ ID NO: 84703 - DNA, 38 bp, Artificial Sequence
  Description of Artificial Sequence: Synthetic oligonucleotide
gatcgaagaatagttgatgattgggccaatgatggatg

SEQ ID NO: 84704 - DNA, 38 bp, Artificial Sequence
  Description of Artificial Sequence: Synthetic oligonucleotide
atcgaagaatagttgatgattgggccaatgatggatgg

SEQ ID NO: 84705 - DNA, 37 bp, Artificial Sequence
  Description of Artificial Sequence: Synthetic oligonucleotide
tcgaagaatagttgatgattgggccaatgatggatgg

SEQ ID NO: 84706 - DNA, 36 bp, Artificial Sequence
  Description of Artificial Sequence: Synthetic oligonucleotide
cgaagaatagttgatgattgggccaatgatggatgg

SEQ ID NO: 84707 - DNA, 36 bp, Artificial Sequence
  Description of Artificial Sequence: Synthetic oligonucleotide
gaagaatagttgatgattgggccaatgatggatggg

SEQ ID NO: 84708 - DNA, 36 bp, Artificial Sequence
  Description of Artificial Sequence: Synthetic oligonucleotide
aagaatagttgatgattgggccaatgatggatgggg

SEQ ID NO: 84709 - DNA, 35 bp, Artificial Sequence
  Description of Artificial Sequence: Synthetic oligonucleotide
agaatagttgatgattgggccaatgatggatgggg

SEQ ID NO: 84710 - DNA, 34 bp, Artificial Sequence
  Description of Artificial Sequence: Synthetic oligonucleotide
gaatagttgatgattgggccaatgatggatgggg

SEQ ID NO: 84711 - DNA, 34 bp, Artificial Sequence
  Description of Artificial Sequence: Synthetic oligonucleotide
aatagttgatgattgggccaatgatggatggggc

SEQ ID NO: 84712 - DNA, 33 bp, Artificial Sequence
  Description of Artificial Sequence: Synthetic oligonucleotide
atagttgatgattgggccaatgatggatggggc

SEQ ID NO: 84713 - DNA, 32 bp, Artificial Sequence
  Description of Artificial Sequence: Synthetic oligonucleotide
tagttgatgattgggccaatgatggatggggc

SEQ ID NO: 84714 - DNA, 31 bp, Artificial Sequence
  Description of Artificial Sequence: Synthetic oligonucleotide
agttgatgattgggccaatgatggatggggc

SEQ ID NO: 84715 - DNA, 30 bp, Artificial Sequence
  Description of Artificial Sequence: Synthetic oligonucleotide
gttgatgattgggccaatgatggatggggc

SEQ ID NO: 84716 - DNA, 30 bp, Artificial Sequence
  Description of Artificial Sequence: Synthetic oligonucleotide
ttgatgattgggccaatgatggatggggcc

SEQ ID NO: 84717 - DNA, 29 bp, Artificial Sequence
  Description of Artificial Sequence: Synthetic oligonucleotide
tgatgattgggccaatgatggatggggcc

SEQ ID NO: 84718 - DNA, 28 bp, Artificial Sequence
  Description of Artificial Sequence: Synthetic oligonucleotide
gatgattgggccaatgatggatggggcc

SEQ ID NO: 84719 - DNA, 29 bp, Artificial Sequence
  Description of Artificial Sequence: Synthetic oligonucleotide
atgattgggccaatgatggatggggcctg

SEQ ID NO: 84720 - DNA, 28 bp, Artificial Sequence
  Description of Artificial Sequence: Synthetic oligonucleotide
tgattgggccaatgatggatggggcctg

SEQ ID NO: 84721 - DNA, 27 bp, Artificial Sequence
  Description of Artificial Sequence: Synthetic oligonucleotide
gattgggccaatgatggatggggcctg

SEQ ID NO: 84722 - DNA, 29 bp, Artificial Sequence
  Description of Artificial Sequence: Synthetic oligonucleotide
attgggccaatgatggatggggcctgaag

SEQ ID NO: 84723 - DNA, 28 bp, Artificial Sequence
  Description of Artificial Sequence: Synthetic oligonucleotide
ttgggccaatgatggatggggcctgaag

SEQ ID NO: 84724 - DNA, 27 bp, Artificial Sequence
  Description of Artificial Sequence: Synthetic oligonucleotide
tgggccaatgatggatggggcctgaag

SEQ ID NO: 84725 - DNA, 27 bp, Artificial Sequence
  Description of Artificial Sequence: Synthetic oligonucleotide
gggccaatgatggatggggcctgaaga

SEQ ID NO: 84726 - DNA, 29 bp, Artificial Sequence
  Description of Artificial Sequence: Synthetic oligonucleotide
ggccaatgatggatggggcctgaagaaag

SEQ ID NO: 84727 - DNA, 29 bp, Artificial Sequence
  Description of Artificial Sequence: Synthetic oligonucleotide
gccaatgatggatggggcctgaagaaagc

SEQ ID NO: 84728 - DNA, 30 bp, Artificial Sequence
  Description of Artificial Sequence: Synthetic oligonucleotide
ccaatgatggatggggcctgaagaaagctg

SEQ ID NO: 84729 - DNA, 30 bp, Artificial Sequence
  Description of Artificial Sequence: Synthetic oligonucleotide
caatgatggatggggcctgaagaaagctgc

SEQ ID NO: 84730 - DNA, 31 bp, Artificial Sequence
  Description of Artificial Sequence: Synthetic oligonucleotide
aatgatggatggggcctgaagaaagctgctg

SEQ ID NO: 84731 - DNA, 30 bp, Artificial Sequence
  Description of Artificial Sequence: Synthetic oligonucleotide
atgatggatggggcctgaagaaagctgctg

SEQ ID NO: 84732 - DNA, 29 bp, Artificial Sequence
  Description of Artificial Sequence: Synthetic oligonucleotide
tgatggatggggcctgaagaaagctgctg

SEQ ID NO: 84733 - DNA, 28 bp, Artificial Sequence
  Description of Artificial Sequence: Synthetic oligonucleotide
gatggatggggcctgaagaaagctgctg

SEQ ID NO: 84734 - DNA, 30 bp, Artificial Sequence
  Description of Artificial Sequence: Synthetic oligonucleotide
atggatggggcctgaagaaagctgctgatg

SEQ ID NO: 84735 - DNA, 29 bp, Artificial Sequence
  Description of Artificial Sequence: Synthetic oligonucleotide
tggatggggcctgaagaaagctgctgatg

SEQ ID NO: 84736 - DNA, 28 bp, Artificial Sequence
  Description of Artificial Sequence: Synthetic oligonucleotide
ggatggggcctgaagaaagctgctgatg

SEQ ID NO: 84737 - DNA, 28 bp, Artificial Sequence
  Description of Artificial Sequence: Synthetic oligonucleotide
gatggggcctgaagaaagctgctgatgg

SEQ ID NO: 84738 - DNA, 28 bp, Artificial Sequence
  Description of Artificial Sequence: Synthetic oligonucleotide
atggggcctgaagaaagctgctgatggg

SEQ ID NO: 84739 - DNA, 27 bp, Artificial Sequence
  Description of Artificial Sequence: Synthetic oligonucleotide
tggggcctgaagaaagctgctgatggg

SEQ ID NO: 84740 - DNA, 26 bp, Artificial Sequence
  Description of Artificial Sequence: Synthetic oligonucleotide
ggggcctgaagaaagctgctgatggg

SEQ ID NO: 84741 - DNA, 26 bp, Artificial Sequence
  Description of Artificial Sequence: Synthetic oligonucleotide
gggcctgaagaaagctgctgatgggg

SEQ ID NO: 84742 - DNA, 27 bp, Artificial Sequence
  Description of Artificial Sequence: Synthetic oligonucleotide
ggcctgaagaaagctgctgatggggct

SEQ ID NO: 84743 - DNA, 27 bp, Artificial Sequence
  Description of Artificial Sequence: Synthetic oligonucleotide
gcctgaagaaagctgctgatggggctg

SEQ ID NO: 84744 - DNA, 27 bp, Artificial Sequence
  Description of Artificial Sequence: Synthetic oligonucleotide
cctgaagaaagctgctgatggggctgc

SEQ ID NO: 84745 - DNA, 28 bp, Artificial Sequence
  Description of Artificial Sequence: Synthetic oligonucleotide
ctgaagaaagctgctgatggggctgctg

SEQ ID NO: 84746 - DNA, 29 bp, Artificial Sequence
  Description of Artificial Sequence: Synthetic oligonucleotide
tgaagaaagctgctgatggggctgctgag

SEQ ID NO: 84747 - DNA, 28 bp, Artificial Sequence
  Description of Artificial Sequence: Synthetic oligonucleotide
gaagaaagctgctgatggggctgctgag

SEQ ID NO: 84748 - DNA, 28 bp, Artificial Sequence
  Description of Artificial Sequence: Synthetic oligonucleotide
aagaaagctgctgatggggctgctgagc

SEQ ID NO: 84749 - DNA, 27 bp, Artificial Sequence
  Description of Artificial Sequence: Synthetic oligonucleotide
agaaagctgctgatggggctgctgagc

SEQ ID NO: 84750 - DNA, 26 bp, Artificial Sequence
  Description of Artificial Sequence: Synthetic oligonucleotide
gaaagctgctgatggggctgctgagc

SEQ ID NO: 84751 - DNA, 27 bp, Artificial Sequence
  Description of Artificial Sequence: Synthetic oligonucleotide
aaagctgctgatggggctgctgagcca

SEQ ID NO: 84752 - DNA, 26 bp, Artificial Sequence
  Description of Artificial Sequence: Synthetic oligonucleotide
aagctgctgatggggctgctgagcca

SEQ ID NO: 84753 - DNA, 25 bp, Artificial Sequence
  Description of Artificial Sequence: Synthetic oligonucleotide
agctgctgatggggctgctgagcca

SEQ ID NO: 84754 - DNA, 24 bp, Artificial Sequence
  Description of Artificial Sequence: Synthetic oligonucleotide
gctgctgatggggctgctgagcca

SEQ ID NO: 84755 - DNA, 24 bp, Artificial Sequence
  Description of Artificial Sequence: Synthetic oligonucleotide
ctgctgatggggctgctgagccag

SEQ ID NO: 84756 - DNA, 24 bp, Artificial Sequence
  Description of Artificial Sequence: Synthetic oligonucleotide
tgctgatggggctgctgagccagg

SEQ ID NO: 84757 - DNA, 23 bp, Artificial Sequence
  Description of Artificial Sequence: Synthetic oligonucleotide
gctgatggggctgctgagccagg

SEQ ID NO: 84758 - DNA, 23 bp, Artificial Sequence
  Description of Artificial Sequence: Synthetic oligonucleotide
ctgatggggctgctgagccaggc

SEQ ID NO: 84759 - DNA, 25 bp, Artificial Sequence
  Description of Artificial Sequence: Synthetic oligonucleotide
tgatggggctgctgagccaggcgtt

SEQ ID NO: 84760 - DNA, 24 bp, Artificial Sequence
  Description of Artificial Sequence: Synthetic oligonucleotide
gatggggctgctgagccaggcgtt

SEQ ID NO: 84761 - DNA, 25 bp, Artificial Sequence
  Description of Artificial Sequence: Synthetic oligonucleotide
atggggctgctgagccaggcgttgt

SEQ ID NO: 84762 - DNA, 24 bp, Artificial Sequence
  Description of Artificial Sequence: Synthetic oligonucleotide
tggggctgctgagccaggcgttgt

SEQ ID NO: 84763 - DNA, 23 bp, Artificial Sequence
  Description of Artificial Sequence: Synthetic oligonucleotide
ggggctgctgagccaggcgttgt

SEQ ID NO: 84764 - DNA, 23 bp, Artificial Sequence
  Description of Artificial Sequence: Synthetic oligonucleotide
gggctgctgagccaggcgttgtg

SEQ ID NO: 84765 - DNA, 23 bp, Artificial Sequence
  Description of Artificial Sequence: Synthetic oligonucleotide
ggctgctgagccaggcgttgtgg

SEQ ID NO: 84766 - DNA, 23 bp, Artificial Sequence
  Description of Artificial Sequence: Synthetic oligonucleotide
gctgctgagccaggcgttgtggg

SEQ ID NO: 84767 - DNA, 23 bp, Artificial Sequence
  Description of Artificial Sequence: Synthetic oligonucleotide
ctgctgagccaggcgttgtgggg

SEQ ID NO: 84768 - DNA, 24 bp, Artificial Sequence
  Description of Artificial Sequence: Synthetic oligonucleotide
tgctgagccaggcgttgtggggca

SEQ ID NO: 84769 - DNA, 23 bp, Artificial Sequence
  Description of Artificial Sequence: Synthetic oligonucleotide
gctgagccaggcgttgtggggca

SEQ ID NO: 84770 - DNA, 25 bp, Artificial Sequence
  Description of Artificial Sequence: Synthetic oligonucleotide
ctgagccaggcgttgtggggcagat

SEQ ID NO: 84771 - DNA, 27 bp, Artificial Sequence
  Description of Artificial Sequence: Synthetic oligonucleotide
tgagccaggcgttgtggggcagatgat

SEQ ID NO: 84772 - DNA, 26 bp, Artificial Sequence
  Description of Artificial Sequence: Synthetic oligonucleotide
gagccaggcgttgtggggcagatgat

SEQ ID NO: 84773 - DNA, 26 bp, Artificial Sequence
  Description of Artificial Sequence: Synthetic oligonucleotide
agccaggcgttgtggggcagatgatc

SEQ ID NO: 84774 - DNA, 25 bp, Artificial Sequence
  Description of Artificial Sequence: Synthetic oligonucleotide
gccaggcgttgtggggcagatgatc

SEQ ID NO: 84775 - DNA, 26 bp, Artificial Sequence
  Description of Artificial Sequence: Synthetic oligonucleotide
ccaggcgttgtggggcagatgatcga

SEQ ID NO: 84776 - DNA, 26 bp, Artificial Sequence
  Description of Artificial Sequence: Synthetic oligonucleotide
caggcgttgtggggcagatgatcgag

SEQ ID NO: 84777 - DNA, 26 bp, Artificial Sequence
  Description of Artificial Sequence: Synthetic oligonucleotide
aggcgttgtggggcagatgatcgagg

SEQ ID NO: 84778 - DNA, 25 bp, Artificial Sequence
  Description of Artificial Sequence: Synthetic oligonucleotide
ggcgttgtggggcagatgatcgagg

SEQ ID NO: 84779 - DNA, 26 bp, Artificial Sequence
  Description of Artificial Sequence: Synthetic oligonucleotide
gcgttgtggggcagatgatcgaggca

SEQ ID NO: 84780 - DNA, 26 bp, Artificial Sequence
  Description of Artificial Sequence: Synthetic oligonucleotide
cgttgtggggcagatgatcgaggcag

SEQ ID NO: 84781 - DNA, 27 bp, Artificial Sequence
  Description of Artificial Sequence: Synthetic oligonucleotide
gttgtggggcagatgatcgaggcagct

SEQ ID NO: 84782 - DNA, 27 bp, Artificial Sequence
  Description of Artificial Sequence: Synthetic oligonucleotide
ttgtggggcagatgatcgaggcagctg

SEQ ID NO: 84783 - DNA, 27 bp, Artificial Sequence
  Description of Artificial Sequence: Synthetic oligonucleotide
tgtggggcagatgatcgaggcagctga

SEQ ID NO: 84784 - DNA, 27 bp, Artificial Sequence
  Description of Artificial Sequence: Synthetic oligonucleotide
gtggggcagatgatcgaggcagctgaa

SEQ ID NO: 84785 - DNA, 27 bp, Artificial Sequence
  Description of Artificial Sequence: Synthetic oligonucleotide
tggggcagatgatcgaggcagctgaag

SEQ ID NO: 84786 - DNA, 27 bp, Artificial Sequence
  Description of Artificial Sequence: Synthetic oligonucleotide
ggggcagatgatcgaggcagctgaaga

SEQ ID NO: 84787 - DNA, 27 bp, Artificial Sequence
  Description of Artificial Sequence: Synthetic oligonucleotide
gggcagatgatcgaggcagctgaagag

SEQ ID NO: 84788 - DNA, 27 bp, Artificial Sequence
  Description of Artificial Sequence: Synthetic oligonucleotide
ggcagatgatcgaggcagctgaagagc

SEQ ID NO: 84789 - DNA, 27 bp, Artificial Sequence
  Description of Artificial Sequence: Synthetic oligonucleotide
gcagatgatcgaggcagctgaagagcg

SEQ ID NO: 84790 - DNA, 27 bp, Artificial Sequence
  Description of Artificial Sequence: Synthetic oligonucleotide
cagatgatcgaggcagctgaagagcgc

SEQ ID NO: 84791 - DNA, 27 bp, Artificial Sequence
  Description of Artificial Sequence: Synthetic oligonucleotide
agatgatcgaggcagctgaagagcgcc

SEQ ID NO: 84792 - DNA, 26 bp, Artificial Sequence
  Description of Artificial Sequence: Synthetic oligonucleotide
gatgatcgaggcagctgaagagcgcc

SEQ ID NO: 84793 - DNA, 26 bp, Artificial Sequence
  Description of Artificial Sequence: Synthetic oligonucleotide
atgatcgaggcagctgaagagcgccc

SEQ ID NO: 84794 - DNA, 25 bp, Artificial Sequence
  Description of Artificial Sequence: Synthetic oligonucleotide
tgatcgaggcagctgaagagcgccc

SEQ ID NO: 84795 - DNA, 24 bp, Artificial Sequence
  Description of Artificial Sequence: Synthetic oligonucleotide
gatcgaggcagctgaagagcgccc

SEQ ID NO: 84796 - DNA, 25 bp, Artificial Sequence
  Description of Artificial Sequence: Synthetic oligonucleotide
atcgaggcagctgaagagcgcccgt

SEQ ID NO: 84797 - DNA, 24 bp, Artificial Sequence
  Description of Artificial Sequence: Synthetic oligonucleotide
tcgaggcagctgaagagcgcccgt

SEQ ID NO: 84798 - DNA, 23 bp, Artificial Sequence
  Description of Artificial Sequence: Synthetic oligonucleotide
cgaggcagctgaagagcgcccgt

SEQ ID NO: 84799 - DNA, 23 bp, Artificial Sequence
  Description of Artificial Sequence: Synthetic oligonucleotide
gaggcagctgaagagcgcccgtg

SEQ ID NO: 84800 - DNA, 23 bp, Artificial Sequence
  Description of Artificial Sequence: Synthetic oligonucleotide
aggcagctgaagagcgcccgtgg

SEQ ID NO: 84801 - DNA, 22 bp, Artificial Sequence
  Description of Artificial Sequence: Synthetic oligonucleotide
ggcagctgaagagcgcccgtgg

SEQ ID NO: 84802 - DNA, 23 bp, Artificial Sequence
  Description of Artificial Sequence: Synthetic oligonucleotide
gcagctgaagagcgcccgtggct

SEQ ID NO: 84803 - DNA, 24 bp, Artificial Sequence
  Description of Artificial Sequence: Synthetic oligonucleotide
cagctgaagagcgcccgtggctgt

SEQ ID NO: 84804 - DNA, 24 bp, Artificial Sequence
  Description of Artificial Sequence: Synthetic oligonucleotide
agctgaagagcgcccgtggctgtg

SEQ ID NO: 84805 - DNA, 23 bp, Artificial Sequence
  Description of Artificial Sequence: Synthetic oligonucleotide
gctgaagagcgcccgtggctgtg

SEQ ID NO: 84806 - DNA, 23 bp, Artificial Sequence
  Description of Artificial Sequence: Synthetic oligonucleotide
ctgaagagcgcccgtggctgtgg

SEQ ID NO: 84807 - DNA, 25 bp, Artificial Sequence
  Description of Artificial Sequence: Synthetic oligonucleotide
tgaagagcgcccgtggctgtgggta

SEQ ID NO: 84808 - DNA, 24 bp, Artificial Sequence
  Description of Artificial Sequence: Synthetic oligonucleotide
gaagagcgcccgtggctgtgggta

SEQ ID NO: 84809 - DNA, 25 bp, Artificial Sequence
  Description of Artificial Sequence: Synthetic oligonucleotide
aagagcgcccgtggctgtgggtagt

SEQ ID NO: 84810 - DNA, 24 bp, Artificial Sequence
  Description of Artificial Sequence: Synthetic oligonucleotide
agagcgcccgtggctgtgggtagt

SEQ ID NO: 84811 - DNA, 23 bp, Artificial Sequence
  Description of Artificial Sequence: Synthetic oligonucleotide
gagcgcccgtggctgtgggtagt

SEQ ID NO: 84812 - DNA, 27 bp, Artificial Sequence
  Description of Artificial Sequence: Synthetic oligonucleotide
agcgcccgtggctgtgggtagtctata

SEQ ID NO: 84813 - DNA, 27 bp, Artificial Sequence
  Description of Artificial Sequence: Synthetic oligonucleotide
gcgcccgtggctgtgggtagtctatat

SEQ ID NO: 84814 - DNA, 28 bp, Artificial Sequence
  Description of Artificial Sequence: Synthetic oligonucleotide
cgcccgtggctgtgggtagtctatattc

SEQ ID NO: 84815 - DNA, 31 bp, Artificial Sequence
  Description of Artificial Sequence: Synthetic oligonucleotide
gcccgtggctgtgggtagtctatattctaac

SEQ ID NO: 84816 - DNA, 32 bp, Artificial Sequence
  Description of Artificial Sequence: Synthetic oligonucleotide
cccgtggctgtgggtagtctatattctaactg

SEQ ID NO: 84817 - DNA, 34 bp, Artificial Sequence
  Description of Artificial Sequence: Synthetic oligonucleotide
ccgtggctgtgggtagtctatattctaactgtag

SEQ ID NO: 84818 - DNA, 34 bp, Artificial Sequence
  Description of Artificial Sequence: Synthetic oligonucleotide
cgtggctgtgggtagtctatattctaactgtagc

SEQ ID NO: 84819 - DNA, 34 bp, Artificial Sequence
  Description of Artificial Sequence: Synthetic oligonucleotide
gtggctgtgggtagtctatattctaactgtagcc

SEQ ID NO: 84820 - DNA, 34 bp, Artificial Sequence
  Description of Artificial Sequence: Synthetic oligonucleotide
tggctgtgggtagtctatattctaactgtagccc

SEQ ID NO: 84821 - DNA, 33 bp, Artificial Sequence
  Description of Artificial Sequence: Synthetic oligonucleotide
ggctgtgggtagtctatattctaactgtagccc

SEQ ID NO: 84822 - DNA, 35 bp, Artificial Sequence
  Description of Artificial Sequence: Synthetic oligonucleotide
gctgtgggtagtctatattctaactgtagcccttc

SEQ ID NO: 84823 - DNA, 35 bp, Artificial Sequence
  Description of Artificial Sequence: Synthetic oligonucleotide
ctgtgggtagtctatattctaactgtagcccttcc

SEQ ID NO: 84824 - DNA, 36 bp, Artificial Sequence
  Description of Artificial Sequence: Synthetic oligonucleotide
tgtgggtagtctatattctaactgtagcccttcctg

SEQ ID NO: 84825 - DNA, 35 bp, Artificial Sequence
  Description of Artificial Sequence: Synthetic oligonucleotide
gtgggtagtctatattctaactgtagcccttcctg

SEQ ID NO: 84826 - DNA, 36 bp, Artificial Sequence
  Description of Artificial Sequence: Synthetic oligonucleotide
tgggtagtctatattctaactgtagcccttcctgtg

SEQ ID NO: 84827 - DNA, 35 bp, Artificial Sequence
  Description of Artificial Sequence: Synthetic oligonucleotide
gggtagtctatattctaactgtagcccttcctgtg

SEQ ID NO: 84828 - DNA, 37 bp, Artificial Sequence
  Description of Artificial Sequence: Synthetic oligonucleotide
ggtagtctatattctaactgtagcccttcctgtgttc

SEQ ID NO: 84829 - DNA, 37 bp, Artificial Sequence
  Description of Artificial Sequence: Synthetic oligonucleotide
gtagtctatattctaactgtagcccttcctgtgttcc

SEQ ID NO: 84830 - DNA, 38 bp, Artificial Sequence
  Description of Artificial Sequence: Synthetic oligonucleotide
tagtctatattctaactgtagcccttcctgtgttcctg

SEQ ID NO: 84831 - DNA, 37 bp, Artificial Sequence
  Description of Artificial Sequence: Synthetic oligonucleotide
agtctatattctaactgtagcccttcctgtgttcctg

SEQ ID NO: 84832 - DNA, 36 bp, Artificial Sequence
  Description of Artificial Sequence: Synthetic oligonucleotide
gtctatattctaactgtagcccttcctgtgttcctg

SEQ ID NO: 84833 - DNA, 36 bp, Artificial Sequence
  Description of Artificial Sequence: Synthetic oligonucleotide
tctatattctaactgtagcccttcctgtgttcctgg

SEQ ID NO: 84834 - DNA, 35 bp, Artificial Sequence
  Description of Artificial Sequence: Synthetic oligonucleotide
ctatattctaactgtagcccttcctgtgttcctgg

SEQ ID NO: 84835 - DNA, 39 bp, Artificial Sequence
  Description of Artificial Sequence: Synthetic oligonucleotide
tatattctaactgtagcccttcctgtgttcctggttatc

SEQ ID NO: 84836 - DNA, 38 bp, Artificial Sequence
  Description of Artificial Sequence: Synthetic oligonucleotide
atattctaactgtagcccttcctgtgttcctggttatc

SEQ ID NO: 84837 - DNA, 37 bp, Artificial Sequence
  Description of Artificial Sequence: Synthetic oligonucleotide
tattctaactgtagcccttcctgtgttcctggttatc

SEQ ID NO: 84838 - DNA, 36 bp, Artificial Sequence
  Description of Artificial Sequence: Synthetic oligonucleotide
attctaactgtagcccttcctgtgttcctggttatc

SEQ ID NO: 84839 - DNA, 35 bp, Artificial Sequence
  Description of Artificial Sequence: Synthetic oligonucleotide
ttctaactgtagcccttcctgtgttcctggttatc

SEQ ID NO: 84840 - DNA, 34 bp, Artificial Sequence
  Description of Artificial Sequence: Synthetic oligonucleotide
tctaactgtagcccttcctgtgttcctggttatc

SEQ ID NO: 84841 - DNA, 33 bp, Artificial Sequence
  Description of Artificial Sequence: Synthetic oligonucleotide
ctaactgtagcccttcctgtgttcctggttatc

SEQ ID NO: 84842 - DNA, 33 bp, Artificial Sequence
  Description of Artificial Sequence: Synthetic oligonucleotide
taactgtagcccttcctgtgttcctggttatcc

SEQ ID NO: 84843 - DNA, 32 bp, Artificial Sequence
  Description of Artificial Sequence: Synthetic oligonucleotide
aactgtagcccttcctgtgttcctggttatcc

SEQ ID NO: 84844 - DNA, 31 bp, Artificial Sequence
  Description of Artificial Sequence: Synthetic oligonucleotide
actgtagcccttcctgtgttcctggttatcc

SEQ ID NO: 84845 - DNA, 30 bp, Artificial Sequence
  Description of Artificial Sequence: Synthetic oligonucleotide
ctgtagcccttcctgtgttcctggttatcc

SEQ ID NO: 84846 - DNA, 31 bp, Artificial Sequence
  Description of Artificial Sequence: Synthetic oligonucleotide
tgtagcccttcctgtgttcctggttatcctc

SEQ ID NO: 84847 - DNA, 30 bp, Artificial Sequence
  Description of Artificial Sequence: Synthetic oligonucleotide
gtagcccttcctgtgttcctggttatcctc

SEQ ID NO: 84848 - DNA, 32 bp, Artificial Sequence
  Description of Artificial Sequence: Synthetic oligonucleotide
tagcccttcctgtgttcctggttatcctcttc

SEQ ID NO: 84849 - DNA, 31 bp, Artificial Sequence
  Description of Artificial Sequence: Synthetic oligonucleotide
agcccttcctgtgttcctggttatcctcttc

SEQ ID NO: 84850 - DNA, 30 bp, Artificial Sequence
  Description of Artificial Sequence: Synthetic oligonucleotide
gcccttcctgtgttcctggttatcctcttc

SEQ ID NO: 84851 - DNA, 31 bp, Artificial Sequence
  Description of Artificial Sequence: Synthetic oligonucleotide
cccttcctgtgttcctggttatcctcttctg

SEQ ID NO: 84852 - DNA, 31 bp, Artificial Sequence
  Description of Artificial Sequence: Synthetic oligonucleotide
ccttcctgtgttcctggttatcctcttctgc

SEQ ID NO: 84853 - DNA, 32 bp, Artificial Sequence
  Description of Artificial Sequence: Synthetic oligonucleotide
cttcctgtgttcctggttatcctcttctgctg

SEQ ID NO: 84854 - DNA, 34 bp, Artificial Sequence
  Description of Artificial Sequence: Synthetic oligonucleotide
ttcctgtgttcctggttatcctcttctgctgttc

SEQ ID NO: 84855 - DNA, 33 bp, Artificial Sequence
  Description of Artificial Sequence: Synthetic oligonucleotide
tcctgtgttcctggttatcctcttctgctgttc

SEQ ID NO: 84856 - DNA, 32 bp, Artificial Sequence
  Description of Artificial Sequence: Synthetic oligonucleotide
cctgtgttcctggttatcctcttctgctgttc

SEQ ID NO: 84857 - DNA, 33 bp, Artificial Sequence
  Description of Artificial Sequence: Synthetic oligonucleotide
ctgtgttcctggttatcctcttctgctgttctg

SEQ ID NO: 84858 - DNA, 33 bp, Artificial Sequence
  Description of Artificial Sequence: Synthetic oligonucleotide
tgtgttcctggttatcctcttctgctgttctgg

SEQ ID NO: 84859 - DNA, 32 bp, Artificial Sequence
  Description of Artificial Sequence: Synthetic oligonucleotide
gtgttcctggttatcctcttctgctgttctgg

SEQ ID NO: 84860 - DNA, 35 bp, Artificial Sequence
  Description of Artificial Sequence: Synthetic oligonucleotide
tgttcctggttatcctcttctgctgttctggaaag

SEQ ID NO: 84861 - DNA, 34 bp, Artificial Sequence
  Description of Artificial Sequence: Synthetic oligonucleotide
gttcctggttatcctcttctgctgttctggaaag

SEQ ID NO: 84862 - DNA, 37 bp, Artificial Sequence
  Description of Artificial Sequence: Synthetic oligonucleotide
ttcctggttatcctcttctgctgttctggaaagaaac

SEQ ID NO: 84863 - DNA, 36 bp, Artificial Sequence
  Description of Artificial Sequence: Synthetic oligonucleotide
tcctggttatcctcttctgctgttctggaaagaaac

SEQ ID NO: 84864 - DNA, 35 bp, Artificial Sequence
  Description of Artificial Sequence: Synthetic oligonucleotide
cctggttatcctcttctgctgttctggaaagaaac

SEQ ID NO: 84865 - DNA, 36 bp, Artificial Sequence
  Description of Artificial Sequence: Synthetic oligonucleotide
ctggttatcctcttctgctgttctggaaagaaacag

SEQ ID NO: 84866 - DNA, 37 bp, Artificial Sequence
  Description of Artificial Sequence: Synthetic oligonucleotide
tggttatcctcttctgctgttctggaaagaaacagac

SEQ ID NO: 84867 - DNA, 36 bp, Artificial Sequence
  Description of Artificial Sequence: Synthetic oligonucleotide
ggttatcctcttctgctgttctggaaagaaacagac

SEQ ID NO: 84868 - DNA, 36 bp, Artificial Sequence
  Description of Artificial Sequence: Synthetic oligonucleotide
gttatcctcttctgctgttctggaaagaaacagacc

SEQ ID NO: 84869 - DNA, 37 bp, Artificial Sequence
  Description of Artificial Sequence: Synthetic oligonucleotide
ttatcctcttctgctgttctggaaagaaacagaccag

SEQ ID NO: 84870 - DNA, 36 bp, Artificial Sequence
  Description of Artificial Sequence: Synthetic oligonucleotide
tatcctcttctgctgttctggaaagaaacagaccag

SEQ ID NO: 84871 - DNA, 35 bp, Artificial Sequence
  Description of Artificial Sequence: Synthetic oligonucleotide
atcctcttctgctgttctggaaagaaacagaccag

SEQ ID NO: 84872 - DNA, 34 bp, Artificial Sequence
  Description of Artificial Sequence: Synthetic oligonucleotide
tcctcttctgctgttctggaaagaaacagaccag

SEQ ID NO: 84873 - DNA, 33 bp, Artificial Sequence
  Description of Artificial Sequence: Synthetic oligonucleotide
cctcttctgctgttctggaaagaaacagaccag

SEQ ID NO: 84874 - DNA, 34 bp, Artificial Sequence
  Description of Artificial Sequence: Synthetic oligonucleotide
ctcttctgctgttctggaaagaaacagaccagtg

SEQ ID NO: 84875 - DNA, 34 bp, Artificial Sequence
  Description of Artificial Sequence: Synthetic oligonucleotide
tcttctgctgttctggaaagaaacagaccagtgg

SEQ ID NO: 84876 - DNA, 33 bp, Artificial Sequence
  Description of Artificial Sequence: Synthetic oligonucleotide
cttctgctgttctggaaagaaacagaccagtgg

SEQ ID NO: 84877 - DNA, 36 bp, Artificial Sequence
  Description of Artificial Sequence: Synthetic oligonucleotide
ttctgctgttctggaaagaaacagaccagtggtatg

SEQ ID NO: 84878 - DNA, 35 bp, Artificial Sequence
  Description of Artificial Sequence: Synthetic oligonucleotide
tctgctgttctggaaagaaacagaccagtggtatg

SEQ ID NO: 84879 - DNA, 34 bp, Artificial Sequence
  Description of Artificial Sequence: Synthetic oligonucleotide
ctgctgttctggaaagaaacagaccagtggtatg

SEQ ID NO: 84880 - DNA, 34 bp, Artificial Sequence
  Description of Artificial Sequence: Synthetic oligonucleotide
tgctgttctggaaagaaacagaccagtggtatgg

SEQ ID NO: 84881 - DNA, 33 bp, Artificial Sequence
  Description of Artificial Sequence: Synthetic oligonucleotide
gctgttctggaaagaaacagaccagtggtatgg

SEQ ID NO: 84882 - DNA, 34 bp, Artificial Sequence
  Description of Artificial Sequence: Synthetic oligonucleotide
ctgttctggaaagaaacagaccagtggtatggag

SEQ ID NO: 84883 - DNA, 39 bp, Artificial Sequence
  Description of Artificial Sequence: Synthetic oligonucleotide
tgttctggaaagaaacagaccagtggtatggagtataag

SEQ ID NO: 84884 - DNA, 38 bp, Artificial Sequence
  Description of Artificial Sequence: Synthetic oligonucleotide
gttctggaaagaaacagaccagtggtatggagtataag

SEQ ID NO: 84885 - DNA, 42 bp, Artificial Sequence
  Description of Artificial Sequence: Synthetic oligonucleotide
ttctggaaagaaacagaccagtggtatggagtataagaaaac

SEQ ID NO: 84886 - DNA, 41 bp, Artificial Sequence
  Description of Artificial Sequence: Synthetic oligonucleotide
tctggaaagaaacagaccagtggtatggagtataagaaaac

SEQ ID NO: 84887 - DNA, 40 bp, Artificial Sequence
  Description of Artificial Sequence: Synthetic oligonucleotide
ctggaaagaaacagaccagtggtatggagtataagaaaac

SEQ ID NO: 84888 - DNA, 41 bp, Artificial Sequence
  Description of Artificial Sequence: Synthetic oligonucleotide
tggaaagaaacagaccagtggtatggagtataagaaaactg

SEQ ID NO: 84889 - DNA, 40 bp, Artificial Sequence
  Description of Artificial Sequence: Synthetic oligonucleotide
ggaaagaaacagaccagtggtatggagtataagaaaactg

SEQ ID NO: 84890 - DNA, 42 bp, Artificial Sequence
  Description of Artificial Sequence: Synthetic oligonucleotide
gaaagaaacagaccagtggtatggagtataagaaaactgatg

SEQ ID NO: 84891 - DNA, 42 bp, Artificial Sequence
  Description of Artificial Sequence: Synthetic oligonucleotide
aaagaaacagaccagtggtatggagtataagaaaactgatgc

SEQ ID NO: 84892 - DNA, 41 bp, Artificial Sequence
  Description of Artificial Sequence: Synthetic oligonucleotide
aagaaacagaccagtggtatggagtataagaaaactgatgc

SEQ ID NO: 84893 - DNA, 40 bp, Artificial Sequence
  Description of Artificial Sequence: Synthetic oligonucleotide
agaaacagaccagtggtatggagtataagaaaactgatgc

SEQ ID NO: 84894 - DNA, 39 bp, Artificial Sequence
  Description of Artificial Sequence: Synthetic oligonucleotide
gaaacagaccagtggtatggagtataagaaaactgatgc

SEQ ID NO: 84895 - DNA, 40 bp, Artificial Sequence
  Description of Artificial Sequence: Synthetic oligonucleotide
aaacagaccagtggtatggagtataagaaaactgatgcac

SEQ ID NO: 84896 - DNA, 39 bp, Artificial Sequence
  Description of Artificial Sequence: Synthetic oligonucleotide
aacagaccagtggtatggagtataagaaaactgatgcac

SEQ ID NO: 84897 - DNA, 38 bp, Artificial Sequence
  Description of Artificial Sequence: Synthetic oligonucleotide
acagaccagtggtatggagtataagaaaactgatgcac

SEQ ID NO: 84898 - DNA, 37 bp, Artificial Sequence
  Description of Artificial Sequence: Synthetic oligonucleotide
cagaccagtggtatggagtataagaaaactgatgcac

SEQ ID NO: 84899 - DNA, 37 bp, Artificial Sequence
  Description of Artificial Sequence: Synthetic oligonucleotide
agaccagtggtatggagtataagaaaactgatgcacc

SEQ ID NO: 84900 - DNA, 36 bp, Artificial Sequence
  Description of Artificial Sequence: Synthetic oligonucleotide
gaccagtggtatggagtataagaaaactgatgcacc

SEQ ID NO: 84901 - DNA, 37 bp, Artificial Sequence
  Description of Artificial Sequence: Synthetic oligonucleotide
accagtggtatggagtataagaaaactgatgcacctc

SEQ ID NO: 84902 - DNA, 36 bp, Artificial Sequence
  Description of Artificial Sequence: Synthetic oligonucleotide
ccagtggtatggagtataagaaaactgatgcacctc

SEQ ID NO: 84903 - DNA, 38 bp, Artificial Sequence
  Description of Artificial Sequence: Synthetic oligonucleotide
cagtggtatggagtataagaaaactgatgcacctcaac

SEQ ID NO: 84904 - DNA, 38 bp, Artificial Sequence
  Description of Artificial Sequence: Synthetic oligonucleotide
agtggtatggagtataagaaaactgatgcacctcaacc

SEQ ID NO: 84905 - DNA, 37 bp, Artificial Sequence
  Description of Artificial Sequence: Synthetic oligonucleotide
gtggtatggagtataagaaaactgatgcacctcaacc

SEQ ID NO: 84906 - DNA, 37 bp, Artificial Sequence
  Description of Artificial Sequence: Synthetic oligonucleotide
tggtatggagtataagaaaactgatgcacctcaaccg

SEQ ID NO: 84907 - DNA, 36 bp, Artificial Sequence
  Description of Artificial Sequence: Synthetic oligonucleotide
ggtatggagtataagaaaactgatgcacctcaaccg

SEQ ID NO: 84908 - DNA, 36 bp, Artificial Sequence
  Description of Artificial Sequence: Synthetic oligonucleotide
gtatggagtataagaaaactgatgcacctcaaccgg

SEQ ID NO: 84909 - DNA, 38 bp, Artificial Sequence
  Description of Artificial Sequence: Synthetic oligonucleotide
tatggagtataagaaaactgatgcacctcaaccggatg

SEQ ID NO: 84910 - DNA, 37 bp, Artificial Sequence
  Description of Artificial Sequence: Synthetic oligonucleotide
atggagtataagaaaactgatgcacctcaaccggatg

SEQ ID NO: 84911 - DNA, 36 bp, Artificial Sequence
  Description of Artificial Sequence: Synthetic oligonucleotide
tggagtataagaaaactgatgcacctcaaccggatg

SEQ ID NO: 84912 - DNA, 35 bp, Artificial Sequence
  Description of Artificial Sequence: Synthetic oligonucleotide
ggagtataagaaaactgatgcacctcaaccggatg

SEQ ID NO: 84913 - DNA, 36 bp, Artificial Sequence
  Description of Artificial Sequence: Synthetic oligonucleotide
gagtataagaaaactgatgcacctcaaccggatgtg

SEQ ID NO: 84914 - DNA, 38 bp, Artificial Sequence
  Description of Artificial Sequence: Synthetic oligonucleotide
agtataagaaaactgatgcacctcaaccggatgtgaag

SEQ ID NO: 84915 - DNA, 37 bp, Artificial Sequence
  Description of Artificial Sequence: Synthetic oligonucleotide
gtataagaaaactgatgcacctcaaccggatgtgaag

SEQ ID NO: 84916 - DNA, 37 bp, Artificial Sequence
  Description of Artificial Sequence: Synthetic oligonucleotide
tataagaaaactgatgcacctcaaccggatgtgaagg

SEQ ID NO: 84917 - DNA, 36 bp, Artificial Sequence
  Description of Artificial Sequence: Synthetic oligonucleotide
ataagaaaactgatgcacctcaaccggatgtgaagg

SEQ ID NO: 84918 - DNA, 35 bp, Artificial Sequence
  Description of Artificial Sequence: Synthetic oligonucleotide
taagaaaactgatgcacctcaaccggatgtgaagg

SEQ ID NO: 84919 - DNA, 34 bp, Artificial Sequence
  Description of Artificial Sequence: Synthetic oligonucleotide
aagaaaactgatgcacctcaaccggatgtgaagg

SEQ ID NO: 84920 - DNA, 33 bp, Artificial Sequence
  Description of Artificial Sequence: Synthetic oligonucleotide
agaaaactgatgcacctcaaccggatgtgaagg

SEQ ID NO: 84921 - DNA, 32 bp, Artificial Sequence
  Description of Artificial Sequence: Synthetic oligonucleotide
gaaaactgatgcacctcaaccggatgtgaagg

SEQ ID NO: 84922 - DNA, 34 bp, Artificial Sequence
  Description of Artificial Sequence: Synthetic oligonucleotide
aaaactgatgcacctcaaccggatgtgaaggaag

SEQ ID NO: 84923 - DNA, 33 bp, Artificial Sequence
  Description of Artificial Sequence: Synthetic oligonucleotide
aaactgatgcacctcaaccggatgtgaaggaag

SEQ ID NO: 84924 - DNA, 32 bp, Artificial Sequence
  Description of Artificial Sequence: Synthetic oligonucleotide
aactgatgcacctcaaccggatgtgaaggaag

SEQ ID NO: 84925 - DNA, 31 bp, Artificial Sequence
  Description of Artificial Sequence: Synthetic oligonucleotide
actgatgcacctcaaccggatgtgaaggaag

SEQ ID NO: 84926 - DNA, 30 bp, Artificial Sequence
  Description of Artificial Sequence: Synthetic oligonucleotide
ctgatgcacctcaaccggatgtgaaggaag

SEQ ID NO: 84927 - DNA, 31 bp, Artificial Sequence
  Description of Artificial Sequence: Synthetic oligonucleotide
tgatgcacctcaaccggatgtgaaggaagag

SEQ ID NO: 84928 - DNA, 30 bp, Artificial Sequence
  Description of Artificial Sequence: Synthetic oligonucleotide
gatgcacctcaaccggatgtgaaggaagag

SEQ ID NO: 84929 - DNA, 30 bp, Artificial Sequence
  Description of Artificial Sequence: Synthetic oligonucleotide
atgcacctcaaccggatgtgaaggaagagg

SEQ ID NO: 84930 - DNA, 29 bp, Artificial Sequence
  Description of Artificial Sequence: Synthetic oligonucleotide
tgcacctcaaccggatgtgaaggaagagg

SEQ ID NO: 84931 - DNA, 28 bp, Artificial Sequence
  Description of Artificial Sequence: Synthetic oligonucleotide
gcacctcaaccggatgtgaaggaagagg

SEQ ID NO: 84932 - DNA, 30 bp, Artificial Sequence
  Description of Artificial Sequence: Synthetic oligonucleotide
cacctcaaccggatgtgaaggaagaggaag

SEQ ID NO: 84933 - DNA, 32 bp, Artificial Sequence
  Description of Artificial Sequence: Synthetic oligonucleotide
acctcaaccggatgtgaaggaagaggaagaag

SEQ ID NO: 84934 - DNA, 31 bp, Artificial Sequence
  Description of Artificial Sequence: Synthetic oligonucleotide
cctcaaccggatgtgaaggaagaggaagaag

SEQ ID NO: 84935 - DNA, 32 bp, Artificial Sequence
  Description of Artificial Sequence: Synthetic oligonucleotide
ctcaaccggatgtgaaggaagaggaagaagag

SEQ ID NO: 84936 - DNA, 34 bp, Artificial Sequence
  Description of Artificial Sequence: Synthetic oligonucleotide
tcaaccggatgtgaaggaagaggaagaagagaag

SEQ ID NO: 84937 - DNA, 33 bp, Artificial Sequence
  Description of Artificial Sequence: Synthetic oligonucleotide
caaccggatgtgaaggaagaggaagaagagaag

SEQ ID NO: 84938 - DNA, 33 bp, Artificial Sequence
  Description of Artificial Sequence: Synthetic oligonucleotide
aaccggatgtgaaggaagaggaagaagagaagg

SEQ ID NO: 84939 - DNA, 32 bp, Artificial Sequence
  Description of Artificial Sequence: Synthetic oligonucleotide
accggatgtgaaggaagaggaagaagagaagg

SEQ ID NO: 84940 - DNA, 31 bp, Artificial Sequence
  Description of Artificial Sequence: Synthetic oligonucleotide
ccggatgtgaaggaagaggaagaagagaagg

SEQ ID NO: 84941 - DNA, 33 bp, Artificial Sequence
  Description of Artificial Sequence: Synthetic oligonucleotide
cggatgtgaaggaagaggaagaagagaaggaag

SEQ ID NO: 84942 - DNA, 34 bp, Artificial Sequence
  Description of Artificial Sequence: Synthetic oligonucleotide
ggatgtgaaggaagaggaagaagagaaggaagag

SEQ ID NO: 84943 - DNA, 34 bp, Artificial Sequence
  Description of Artificial Sequence: Synthetic oligonucleotide
gatgtgaaggaagaggaagaagagaaggaagagg

SEQ ID NO: 84944 - DNA, 38 bp, Artificial Sequence
  Description of Artificial Sequence: Synthetic oligonucleotide
atgtgaaggaagaggaagaagagaaggaagaggaaaag

SEQ ID NO: 84945 - DNA, 37 bp, Artificial Sequence
  Description of Artificial Sequence: Synthetic oligonucleotide
tgtgaaggaagaggaagaagagaaggaagaggaaaag

SEQ ID NO: 84946 - DNA, 36 bp, Artificial Sequence
  Description of Artificial Sequence: Synthetic oligonucleotide
gtgaaggaagaggaagaagagaaggaagaggaaaag

SEQ ID NO: 84947 - DNA, 36 bp, Artificial Sequence
  Description of Artificial Sequence: Synthetic oligonucleotide
tgaaggaagaggaagaagagaaggaagaggaaaagg

SEQ ID NO: 84948 - DNA, 35 bp, Artificial Sequence
  Description of Artificial Sequence: Synthetic oligonucleotide
gaaggaagaggaagaagagaaggaagaggaaaagg

SEQ ID NO: 84949 - DNA, 36 bp, Artificial Sequence
  Description of Artificial Sequence: Synthetic oligonucleotide
aaggaagaggaagaagagaaggaagaggaaaaggac

SEQ ID NO: 84950 - DNA, 35 bp, Artificial Sequence
  Description of Artificial Sequence: Synthetic oligonucleotide
aggaagaggaagaagagaaggaagaggaaaaggac

SEQ ID NO: 84951 - DNA, 34 bp, Artificial Sequence
  Description of Artificial Sequence: Synthetic oligonucleotide
ggaagaggaagaagagaaggaagaggaaaaggac

SEQ ID NO: 84952 - DNA, 36 bp, Artificial Sequence
  Description of Artificial Sequence: Synthetic oligonucleotide
gaagaggaagaagagaaggaagaggaaaaggacaag

SEQ ID NO: 84953 - DNA, 36 bp, Artificial Sequence
  Description of Artificial Sequence: Synthetic oligonucleotide
aagaggaagaagagaaggaagaggaaaaggacaagg

SEQ ID NO: 84954 - DNA, 35 bp, Artificial Sequence
  Description of Artificial Sequence: Synthetic oligonucleotide
agaggaagaagagaaggaagaggaaaaggacaagg

SEQ ID NO: 84955 - DNA, 34 bp, Artificial Sequence
  Description of Artificial Sequence: Synthetic oligonucleotide
gaggaagaagagaaggaagaggaaaaggacaagg

SEQ ID NO: 84956 - DNA, 34 bp, Artificial Sequence
  Description of Artificial Sequence: Synthetic oligonucleotide
aggaagaagagaaggaagaggaaaaggacaaggg

SEQ ID NO: 84957 - DNA, 33 bp, Artificial Sequence
  Description of Artificial Sequence: Synthetic oligonucleotide
ggaagaagagaaggaagaggaaaaggacaaggg

SEQ ID NO: 84958 - DNA, 34 bp, Artificial Sequence
  Description of Artificial Sequence: Synthetic oligonucleotide
gaagaagagaaggaagaggaaaaggacaagggag

SEQ ID NO: 84959 - DNA, 36 bp, Artificial Sequence
  Description of Artificial Sequence: Synthetic oligonucleotide
aagaagagaaggaagaggaaaaggacaagggagatg

SEQ ID NO: 84960 - DNA, 35 bp, Artificial Sequence
  Description of Artificial Sequence: Synthetic oligonucleotide
agaagagaaggaagaggaaaaggacaagggagatg

SEQ ID NO: 84961 - DNA, 34 bp, Artificial Sequence
  Description of Artificial Sequence: Synthetic oligonucleotide
gaagagaaggaagaggaaaaggacaagggagatg

SEQ ID NO: 84962 - DNA, 35 bp, Artificial Sequence
  Description of Artificial Sequence: Synthetic oligonucleotide
aagagaaggaagaggaaaaggacaagggagatgag

SEQ ID NO: 84963 - DNA, 34 bp, Artificial Sequence
  Description of Artificial Sequence: Synthetic oligonucleotide
agagaaggaagaggaaaaggacaagggagatgag

SEQ ID NO: 84964 - DNA, 33 bp, Artificial Sequence
  Description of Artificial Sequence: Synthetic oligonucleotide
gagaaggaagaggaaaaggacaagggagatgag

SEQ ID NO: 84965 - DNA, 33 bp, Artificial Sequence
  Description of Artificial Sequence: Synthetic oligonucleotide
agaaggaagaggaaaaggacaagggagatgagg

SEQ ID NO: 84966 - DNA, 32 bp, Artificial Sequence
  Description of Artificial Sequence: Synthetic oligonucleotide
gaaggaagaggaaaaggacaagggagatgagg

SEQ ID NO: 84967 - DNA, 33 bp, Artificial Sequence
  Description of Artificial Sequence: Synthetic oligonucleotide
aaggaagaggaaaaggacaagggagatgaggag

SEQ ID NO: 84968 - DNA, 32 bp, Artificial Sequence
  Description of Artificial Sequence: Synthetic oligonucleotide
aggaagaggaaaaggacaagggagatgaggag

SEQ ID NO: 84969 - DNA, 31 bp, Artificial Sequence
  Description of Artificial Sequence: Synthetic oligonucleotide
ggaagaggaaaaggacaagggagatgaggag

SEQ ID NO: 84970 - DNA, 31 bp, Artificial Sequence
  Description of Artificial Sequence: Synthetic oligonucleotide
gaagaggaaaaggacaagggagatgaggagg

SEQ ID NO: 84971 - DNA, 32 bp, Artificial Sequence
  Description of Artificial Sequence: Synthetic oligonucleotide
aagaggaaaaggacaagggagatgaggaggag

SEQ ID NO: 84972 - DNA, 31 bp, Artificial Sequence
  Description of Artificial Sequence: Synthetic oligonucleotide
agaggaaaaggacaagggagatgaggaggag

SEQ ID NO: 84973 - DNA, 30 bp, Artificial Sequence
  Description of Artificial Sequence: Synthetic oligonucleotide
gaggaaaaggacaagggagatgaggaggag

SEQ ID NO: 84974 - DNA, 30 bp, Artificial Sequence
  Description of Artificial Sequence: Synthetic oligonucleotide
aggaaaaggacaagggagatgaggaggagg

SEQ ID NO: 84975 - DNA, 29 bp, Artificial Sequence
  Description of Artificial Sequence: Synthetic oligonucleotide
ggaaaaggacaagggagatgaggaggagg

SEQ ID NO: 84976 - DNA, 31 bp, Artificial Sequence
  Description of Artificial Sequence: Synthetic oligonucleotide
gaaaaggacaagggagatgaggaggaggaag

SEQ ID NO: 84977 - DNA, 31 bp, Artificial Sequence
  Description of Artificial Sequence: Synthetic oligonucleotide
aaaaggacaagggagatgaggaggaggaagg

SEQ ID NO: 84978 - DNA, 30 bp, Artificial Sequence
  Description of Artificial Sequence: Synthetic oligonucleotide
aaaggacaagggagatgaggaggaggaagg

SEQ ID NO: 84979 - DNA, 29 bp, Artificial Sequence
  Description of Artificial Sequence: Synthetic oligonucleotide
aaggacaagggagatgaggaggaggaagg

SEQ ID NO: 84980 - DNA, 28 bp, Artificial Sequence
  Description of Artificial Sequence: Synthetic oligonucleotide
aggacaagggagatgaggaggaggaagg

SEQ ID NO: 84981 - DNA, 27 bp, Artificial Sequence
  Description of Artificial Sequence: Synthetic oligonucleotide
ggacaagggagatgaggaggaggaagg

SEQ ID NO: 84982 - DNA, 28 bp, Artificial Sequence
  Description of Artificial Sequence: Synthetic oligonucleotide
gacaagggagatgaggaggaggaaggag

SEQ ID NO: 84983 - DNA, 30 bp, Artificial Sequence
  Description of Artificial Sequence: Synthetic oligonucleotide
acaagggagatgaggaggaggaaggagaag

SEQ ID NO: 84984 - DNA, 29 bp, Artificial Sequence
  Description of Artificial Sequence: Synthetic oligonucleotide
caagggagatgaggaggaggaaggagaag

SEQ ID NO: 84985 - DNA, 30 bp, Artificial Sequence
  Description of Artificial Sequence: Synthetic oligonucleotide
aagggagatgaggaggaggaaggagaagag

SEQ ID NO: 84986 - DNA, 29 bp, Artificial Sequence
  Description of Artificial Sequence: Synthetic oligonucleotide
agggagatgaggaggaggaaggagaagag

SEQ ID NO: 84987 - DNA, 28 bp, Artificial Sequence
  Description of Artificial Sequence: Synthetic oligonucleotide
gggagatgaggaggaggaaggagaagag

SEQ ID NO: 84988 - DNA, 31 bp, Artificial Sequence
  Description of Artificial Sequence: Synthetic oligonucleotide
ggagatgaggaggaggaaggagaagagaaac

SEQ ID NO: 84989 - DNA, 33 bp, Artificial Sequence
  Description of Artificial Sequence: Synthetic oligonucleotide
gagatgaggaggaggaaggagaagagaaacttg

SEQ ID NO: 84990 - DNA, 35 bp, Artificial Sequence
  Description of Artificial Sequence: Synthetic oligonucleotide
agatgaggaggaggaaggagaagagaaacttgaag

SEQ ID NO: 84991 - DNA, 34 bp, Artificial Sequence
  Description of Artificial Sequence: Synthetic oligonucleotide
gatgaggaggaggaaggagaagagaaacttgaag

SEQ ID NO: 84992 - DNA, 35 bp, Artificial Sequence
  Description of Artificial Sequence: Synthetic oligonucleotide
atgaggaggaggaaggagaagagaaacttgaagag

SEQ ID NO: 84993 - DNA, 34 bp, Artificial Sequence
  Description of Artificial Sequence: Synthetic oligonucleotide
tgaggaggaggaaggagaagagaaacttgaagag

SEQ ID NO: 84994 - DNA, 33 bp, Artificial Sequence
  Description of Artificial Sequence: Synthetic oligonucleotide
gaggaggaggaaggagaagagaaacttgaagag

SEQ ID NO: 84995 - DNA, 36 bp, Artificial Sequence
  Description of Artificial Sequence: Synthetic oligonucleotide
aggaggaggaaggagaagagaaacttgaagagaaac

SEQ ID NO: 84996 - DNA, 35 bp, Artificial Sequence
  Description of Artificial Sequence: Synthetic oligonucleotide
ggaggaggaaggagaagagaaacttgaagagaaac

SEQ ID NO: 84997 - DNA, 36 bp, Artificial Sequence
  Description of Artificial Sequence: Synthetic oligonucleotide
gaggaggaaggagaagagaaacttgaagagaaacag

SEQ ID NO: 84998 - DNA, 40 bp, Artificial Sequence
  Description of Artificial Sequence: Synthetic oligonucleotide
aggaggaaggagaagagaaacttgaagagaaacagaaaag

SEQ ID NO: 84999 - DNA, 39 bp, Artificial Sequence
  Description of Artificial Sequence: Synthetic oligonucleotide
ggaggaaggagaagagaaacttgaagagaaacagaaaag

SEQ ID NO: 85000 - DNA, 40 bp, Artificial Sequence
  Description of Artificial Sequence: Synthetic oligonucleotide
gaggaaggagaagagaaacttgaagagaaacagaaaagtg

SEQ ID NO: 85001 - DNA, 42 bp, Artificial Sequence
  Description of Artificial Sequence: Synthetic oligonucleotide
aggaaggagaagagaaacttgaagagaaacagaaaagtgatg

SEQ ID NO: 85002 - DNA, 41 bp, Artificial Sequence
  Description of Artificial Sequence: Synthetic oligonucleotide
ggaaggagaagagaaacttgaagagaaacagaaaagtgatg

SEQ ID NO: 85003 - DNA, 41 bp, Artificial Sequence
  Description of Artificial Sequence: Synthetic oligonucleotide
gaaggagaagagaaacttgaagagaaacagaaaagtgatgc

SEQ ID NO: 85004 - DNA, 42 bp, Artificial Sequence
  Description of Artificial Sequence: Synthetic oligonucleotide
aaggagaagagaaacttgaagagaaacagaaaagtgatgctg

SEQ ID NO: 85005 - DNA, 41 bp, Artificial Sequence
  Description of Artificial Sequence: Synthetic oligonucleotide
aggagaagagaaacttgaagagaaacagaaaagtgatgctg

SEQ ID NO: 85006 - DNA, 40 bp, Artificial Sequence
  Description of Artificial Sequence: Synthetic oligonucleotide
ggagaagagaaacttgaagagaaacagaaaagtgatgctg

SEQ ID NO: 85007 - DNA, 42 bp, Artificial Sequence
  Description of Artificial Sequence: Synthetic oligonucleotide
gagaagagaaacttgaagagaaacagaaaagtgatgctgaag

SEQ ID NO: 85008 - DNA, 44 bp, Artificial Sequence
  Description of Artificial Sequence: Synthetic oligonucleotide
agaagagaaacttgaagagaaacagaaaagtgatgctgaagaag

SEQ ID NO: 85009 - DNA, 43 bp, Artificial Sequence
  Description of Artificial Sequence: Synthetic oligonucleotide
gaagagaaacttgaagagaaacagaaaagtgatgctgaagaag

SEQ ID NO: 85010 - DNA, 45 bp, Artificial Sequence
  Description of Artificial Sequence: Synthetic oligonucleotide
aagagaaacttgaagagaaacagaaaagtgatgctgaagaagatg

SEQ ID NO: 85011 - DNA, 44 bp, Artificial Sequence
  Description of Artificial Sequence: Synthetic oligonucleotide
agagaaacttgaagagaaacagaaaagtgatgctgaagaagatg

SEQ ID NO: 85012 - DNA, 43 bp, Artificial Sequence
  Description of Artificial Sequence: Synthetic oligonucleotide
gagaaacttgaagagaaacagaaaagtgatgctgaagaagatg

SEQ ID NO: 85013 - DNA, 43 bp, Artificial Sequence
  Description of Artificial Sequence: Synthetic oligonucleotide
agaaacttgaagagaaacagaaaagtgatgctgaagaagatgg

SEQ ID NO: 85014 - DNA, 42 bp, Artificial Sequence
  Description of Artificial Sequence: Synthetic oligonucleotide
gaaacttgaagagaaacagaaaagtgatgctgaagaagatgg

SEQ ID NO: 85015 - DNA, 43 bp, Artificial Sequence
  Description of Artificial Sequence: Synthetic oligonucleotide
aaacttgaagagaaacagaaaagtgatgctgaagaagatggtg

SEQ ID NO: 85016 - DNA, 42 bp, Artificial Sequence
  Description of Artificial Sequence: Synthetic oligonucleotide
aacttgaagagaaacagaaaagtgatgctgaagaagatggtg

SEQ ID NO: 85017 - DNA, 41 bp, Artificial Sequence
  Description of Artificial Sequence: Synthetic oligonucleotide
acttgaagagaaacagaaaagtgatgctgaagaagatggtg

SEQ ID NO: 85018 - DNA, 40 bp, Artificial Sequence
  Description of Artificial Sequence: Synthetic oligonucleotide
cttgaagagaaacagaaaagtgatgctgaagaagatggtg

SEQ ID NO: 85019 - DNA, 40 bp, Artificial Sequence
  Description of Artificial Sequence: Synthetic oligonucleotide
ttgaagagaaacagaaaagtgatgctgaagaagatggtgg

SEQ ID NO: 85020 - DNA, 39 bp, Artificial Sequence
  Description of Artificial Sequence: Synthetic oligonucleotide
tgaagagaaacagaaaagtgatgctgaagaagatggtgg

SEQ ID NO: 85021 - DNA, 38 bp, Artificial Sequence
  Description of Artificial Sequence: Synthetic oligonucleotide
gaagagaaacagaaaagtgatgctgaagaagatggtgg

SEQ ID NO: 85022 - DNA, 38 bp, Artificial Sequence
  Description of Artificial Sequence: Synthetic oligonucleotide
aagagaaacagaaaagtgatgctgaagaagatggtggc

SEQ ID NO: 85023 - DNA, 37 bp, Artificial Sequence
  Description of Artificial Sequence: Synthetic oligonucleotide
agagaaacagaaaagtgatgctgaagaagatggtggc

SEQ ID NO: 85024 - DNA, 36 bp, Artificial Sequence
  Description of Artificial Sequence: Synthetic oligonucleotide
gagaaacagaaaagtgatgctgaagaagatggtggc

SEQ ID NO: 85025 - DNA, 37 bp, Artificial Sequence
  Description of Artificial Sequence: Synthetic oligonucleotide
agaaacagaaaagtgatgctgaagaagatggtggcac

SEQ ID NO: 85026 - DNA, 36 bp, Artificial Sequence
  Description of Artificial Sequence: Synthetic oligonucleotide
gaaacagaaaagtgatgctgaagaagatggtggcac

SEQ ID NO: 85027 - DNA, 37 bp, Artificial Sequence
  Description of Artificial Sequence: Synthetic oligonucleotide
aaacagaaaagtgatgctgaagaagatggtggcactg

SEQ ID NO: 85028 - DNA, 36 bp, Artificial Sequence
  Description of Artificial Sequence: Synthetic oligonucleotide
aacagaaaagtgatgctgaagaagatggtggcactg

SEQ ID NO: 85029 - DNA, 35 bp, Artificial Sequence
  Description of Artificial Sequence: Synthetic oligonucleotide
acagaaaagtgatgctgaagaagatggtggcactg

SEQ ID NO: 85030 - DNA, 34 bp, Artificial Sequence
  Description of Artificial Sequence: Synthetic oligonucleotide
cagaaaagtgatgctgaagaagatggtggcactg

SEQ ID NO: 85031 - DNA, 35 bp, Artificial Sequence
  Description of Artificial Sequence: Synthetic oligonucleotide
agaaaagtgatgctgaagaagatggtggcactgtc

SEQ ID NO: 85032 - DNA, 34 bp, Artificial Sequence
  Description of Artificial Sequence: Synthetic oligonucleotide
gaaaagtgatgctgaagaagatggtggcactgtc

SEQ ID NO: 85033 - DNA, 35 bp, Artificial Sequence
  Description of Artificial Sequence: Synthetic oligonucleotide
aaaagtgatgctgaagaagatggtggcactgtcag

SEQ ID NO: 85034 - DNA, 34 bp, Artificial Sequence
  Description of Artificial Sequence: Synthetic oligonucleotide
aaagtgatgctgaagaagatggtggcactgtcag

SEQ ID NO: 85035 - DNA, 33 bp, Artificial Sequence
  Description of Artificial Sequence: Synthetic oligonucleotide
aagtgatgctgaagaagatggtggcactgtcag

SEQ ID NO: 85036 - DNA, 32 bp, Artificial Sequence
  Description of Artificial Sequence: Synthetic oligonucleotide
agtgatgctgaagaagatggtggcactgtcag

SEQ ID NO: 85037 - DNA, 31 bp, Artificial Sequence
  Description of Artificial Sequence: Synthetic oligonucleotide
gtgatgctgaagaagatggtggcactgtcag

SEQ ID NO: 85038 - DNA, 32 bp, Artificial Sequence
  Description of Artificial Sequence: Synthetic oligonucleotide
tgatgctgaagaagatggtggcactgtcagtc

SEQ ID NO: 85039 - DNA, 31 bp, Artificial Sequence
  Description of Artificial Sequence: Synthetic oligonucleotide
gatgctgaagaagatggtggcactgtcagtc

SEQ ID NO: 85040 - DNA, 33 bp, Artificial Sequence
  Description of Artificial Sequence: Synthetic oligonucleotide
atgctgaagaagatggtggcactgtcagtcaag

SEQ ID NO: 85041 - DNA, 32 bp, Artificial Sequence
  Description of Artificial Sequence: Synthetic oligonucleotide
tgctgaagaagatggtggcactgtcagtcaag

SEQ ID NO: 85042 - DNA, 31 bp, Artificial Sequence
  Description of Artificial Sequence: Synthetic oligonucleotide
gctgaagaagatggtggcactgtcagtcaag

SEQ ID NO: 85043 - DNA, 32 bp, Artificial Sequence
  Description of Artificial Sequence: Synthetic oligonucleotide
ctgaagaagatggtggcactgtcagtcaagag

SEQ ID NO: 85044 - DNA, 32 bp, Artificial Sequence
  Description of Artificial Sequence: Synthetic oligonucleotide
tgaagaagatggtggcactgtcagtcaagagg

SEQ ID NO: 85045 - DNA, 31 bp, Artificial Sequence
  Description of Artificial Sequence: Synthetic oligonucleotide
gaagaagatggtggcactgtcagtcaagagg

SEQ ID NO: 85046 - DNA, 32 bp, Artificial Sequence
  Description of Artificial Sequence: Synthetic oligonucleotide
aagaagatggtggcactgtcagtcaagaggag

SEQ ID NO: 85047 - DNA, 31 bp, Artificial Sequence
  Description of Artificial Sequence: Synthetic oligonucleotide
agaagatggtggcactgtcagtcaagaggag

SEQ ID NO: 85048 - DNA, 30 bp, Artificial Sequence
  Description of Artificial Sequence: Synthetic oligonucleotide
gaagatggtggcactgtcagtcaagaggag

SEQ ID NO: 85049 - DNA, 30 bp, Artificial Sequence
  Description of Artificial Sequence: Synthetic oligonucleotide
aagatggtggcactgtcagtcaagaggagg

SEQ ID NO: 85050 - DNA, 29 bp, Artificial Sequence
  Description of Artificial Sequence: Synthetic oligonucleotide
agatggtggcactgtcagtcaagaggagg

SEQ ID NO: 85051 - DNA, 28 bp, Artificial Sequence
  Description of Artificial Sequence: Synthetic oligonucleotide
gatggtggcactgtcagtcaagaggagg

SEQ ID NO: 85052 - DNA, 30 bp, Artificial Sequence
  Description of Artificial Sequence: Synthetic oligonucleotide
atggtggcactgtcagtcaagaggaggaag

SEQ ID NO: 85053 - DNA, 29 bp, Artificial Sequence
  Description of Artificial Sequence: Synthetic oligonucleotide
tggtggcactgtcagtcaagaggaggaag

SEQ ID NO: 85054 - DNA, 28 bp, Artificial Sequence
  Description of Artificial Sequence: Synthetic oligonucleotide
ggtggcactgtcagtcaagaggaggaag

SEQ ID NO: 85055 - DNA, 29 bp, Artificial Sequence
  Description of Artificial Sequence: Synthetic oligonucleotide
gtggcactgtcagtcaagaggaggaagac

SEQ ID NO: 85056 - DNA, 30 bp, Artificial Sequence
  Description of Artificial Sequence: Synthetic oligonucleotide
tggcactgtcagtcaagaggaggaagacag

SEQ ID NO: 85057 - DNA, 29 bp, Artificial Sequence
  Description of Artificial Sequence: Synthetic oligonucleotide
ggcactgtcagtcaagaggaggaagacag

SEQ ID NO: 85058 - DNA, 33 bp, Artificial Sequence
  Description of Artificial Sequence: Synthetic oligonucleotide
gcactgtcagtcaagaggaggaagacagaaaac

SEQ ID NO: 85059 - DNA, 33 bp, Artificial Sequence
  Description of Artificial Sequence: Synthetic oligonucleotide
cactgtcagtcaagaggaggaagacagaaaacc

SEQ ID NO: 85060 - DNA, 37 bp, Artificial Sequence
  Description of Artificial Sequence: Synthetic oligonucleotide
actgtcagtcaagaggaggaagacagaaaacctaaag

SEQ ID NO: 85061 - DNA, 36 bp, Artificial Sequence
  Description of Artificial Sequence: Synthetic oligonucleotide
ctgtcagtcaagaggaggaagacagaaaacctaaag

SEQ ID NO: 85062 - DNA, 36 bp, Artificial Sequence
  Description of Artificial Sequence: Synthetic oligonucleotide
tgtcagtcaagaggaggaagacagaaaacctaaagc

SEQ ID NO: 85063 - DNA, 35 bp, Artificial Sequence
  Description of Artificial Sequence: Synthetic oligonucleotide
gtcagtcaagaggaggaagacagaaaacctaaagc

SEQ ID NO: 85064 - DNA, 36 bp, Artificial Sequence
  Description of Artificial Sequence: Synthetic oligonucleotide
tcagtcaagaggaggaagacagaaaacctaaagcag

SEQ ID NO: 85065 - DNA, 35 bp, Artificial Sequence
  Description of Artificial Sequence: Synthetic oligonucleotide
cagtcaagaggaggaagacagaaaacctaaagcag

SEQ ID NO: 85066 - DNA, 36 bp, Artificial Sequence
  Description of Artificial Sequence: Synthetic oligonucleotide
agtcaagaggaggaagacagaaaacctaaagcagag

SEQ ID NO: 85067 - DNA, 35 bp, Artificial Sequence
  Description of Artificial Sequence: Synthetic oligonucleotide
gtcaagaggaggaagacagaaaacctaaagcagag

SEQ ID NO: 85068 - DNA, 35 bp, Artificial Sequence
  Description of Artificial Sequence: Synthetic oligonucleotide
tcaagaggaggaagacagaaaacctaaagcagagg

SEQ ID NO: 85069 - DNA, 34 bp, Artificial Sequence
  Description of Artificial Sequence: Synthetic oligonucleotide
caagaggaggaagacagaaaacctaaagcagagg

SEQ ID NO: 85070 - DNA, 35 bp, Artificial Sequence
  Description of Artificial Sequence: Synthetic oligonucleotide
aagaggaggaagacagaaaacctaaagcagaggag

SEQ ID NO: 85071 - DNA, 34 bp, Artificial Sequence
  Description of Artificial Sequence: Synthetic oligonucleotide
agaggaggaagacagaaaacctaaagcagaggag

SEQ ID NO: 85072 - DNA, 33 bp, Artificial Sequence
  Description of Artificial Sequence: Synthetic oligonucleotide
gaggaggaagacagaaaacctaaagcagaggag

SEQ ID NO: 85073 - DNA, 33 bp, Artificial Sequence
  Description of Artificial Sequence: Synthetic oligonucleotide
aggaggaagacagaaaacctaaagcagaggagg

SEQ ID NO: 85074 - DNA, 32 bp, Artificial Sequence
  Description of Artificial Sequence: Synthetic oligonucleotide
ggaggaagacagaaaacctaaagcagaggagg

SEQ ID NO: 85075 - DNA, 34 bp, Artificial Sequence
  Description of Artificial Sequence: Synthetic oligonucleotide
gaggaagacagaaaacctaaagcagaggaggatg

SEQ ID NO: 85076 - DNA, 41 bp, Artificial Sequence
  Description of Artificial Sequence: Synthetic oligonucleotide
aggaagacagaaaacctaaagcagaggaggatgaaattttg

SEQ ID NO: 85077 - DNA, 40 bp, Artificial Sequence
  Description of Artificial Sequence: Synthetic oligonucleotide
ggaagacagaaaacctaaagcagaggaggatgaaattttg

SEQ ID NO: 85078 - DNA, 42 bp, Artificial Sequence
  Description of Artificial Sequence: Synthetic oligonucleotide
gaagacagaaaacctaaagcagaggaggatgaaattttgaac

SEQ ID NO: 85079 - DNA, 43 bp, Artificial Sequence
  Description of Artificial Sequence: Synthetic oligonucleotide
aagacagaaaacctaaagcagaggaggatgaaattttgaacag

SEQ ID NO: 85080 - DNA, 42 bp, Artificial Sequence
  Description of Artificial Sequence: Synthetic oligonucleotide
agacagaaaacctaaagcagaggaggatgaaattttgaacag

SEQ ID NO: 85081 - DNA, 41 bp, Artificial Sequence
  Description of Artificial Sequence: Synthetic oligonucleotide
gacagaaaacctaaagcagaggaggatgaaattttgaacag

SEQ ID NO: 85082 - DNA, 43 bp, Artificial Sequence
  Description of Artificial Sequence: Synthetic oligonucleotide
acagaaaacctaaagcagaggaggatgaaattttgaacagatc

SEQ ID NO: 85083 - DNA, 42 bp, Artificial Sequence
  Description of Artificial Sequence: Synthetic oligonucleotide
cagaaaacctaaagcagaggaggatgaaattttgaacagatc

SEQ ID NO: 85084 - DNA, 43 bp, Artificial Sequence
  Description of Artificial Sequence: Synthetic oligonucleotide
agaaaacctaaagcagaggaggatgaaattttgaacagatcac

SEQ ID NO: 85085 - DNA, 42 bp, Artificial Sequence
  Description of Artificial Sequence: Synthetic oligonucleotide
gaaaacctaaagcagaggaggatgaaattttgaacagatcac

SEQ ID NO: 85086 - DNA, 42 bp, Artificial Sequence
  Description of Artificial Sequence: Synthetic oligonucleotide
aaaacctaaagcagaggaggatgaaattttgaacagatcacc

SEQ ID NO: 85087 - DNA, 41 bp, Artificial Sequence
  Description of Artificial Sequence: Synthetic oligonucleotide
aaacctaaagcagaggaggatgaaattttgaacagatcacc

SEQ ID NO: 85088 - DNA, 40 bp, Artificial Sequence
  Description of Artificial Sequence: Synthetic oligonucleotide
aacctaaagcagaggaggatgaaattttgaacagatcacc

SEQ ID NO: 85089 - DNA, 39 bp, Artificial Sequence
  Description of Artificial Sequence: Synthetic oligonucleotide
acctaaagcagaggaggatgaaattttgaacagatcacc

SEQ ID NO: 85090 - DNA, 38 bp, Artificial Sequence
  Description of Artificial Sequence: Synthetic oligonucleotide
cctaaagcagaggaggatgaaattttgaacagatcacc

SEQ ID NO: 85091 - DNA, 40 bp, Artificial Sequence
  Description of Artificial Sequence: Synthetic oligonucleotide
ctaaagcagaggaggatgaaattttgaacagatcaccaag

SEQ ID NO: 85092 - DNA, 43 bp, Artificial Sequence
  Description of Artificial Sequence: Synthetic oligonucleotide
taaagcagaggaggatgaaattttgaacagatcaccaagaaac

SEQ ID NO: 85093 - DNA, 42 bp, Artificial Sequence
  Description of Artificial Sequence: Synthetic oligonucleotide
aaagcagaggaggatgaaattttgaacagatcaccaagaaac

SEQ ID NO: 85094 - DNA, 41 bp, Artificial Sequence
  Description of Artificial Sequence: Synthetic oligonucleotide
aagcagaggaggatgaaattttgaacagatcaccaagaaac

SEQ ID NO: 85095 - DNA, 40 bp, Artificial Sequence
  Description of Artificial Sequence: Synthetic oligonucleotide
agcagaggaggatgaaattttgaacagatcaccaagaaac

SEQ ID NO: 85096 - DNA, 39 bp, Artificial Sequence
  Description of Artificial Sequence: Synthetic oligonucleotide
gcagaggaggatgaaattttgaacagatcaccaagaaac

SEQ ID NO: 85097 - DNA, 40 bp, Artificial Sequence
  Description of Artificial Sequence: Synthetic oligonucleotide
cagaggaggatgaaattttgaacagatcaccaagaaacag

SEQ ID NO: 85098 - DNA, 43 bp, Artificial Sequence
  Description of Artificial Sequence: Synthetic oligonucleotide
agaggaggatgaaattttgaacagatcaccaagaaacagaaag

SEQ ID NO: 85099 - DNA, 42 bp, Artificial Sequence
  Description of Artificial Sequence: Synthetic oligonucleotide
gaggaggatgaaattttgaacagatcaccaagaaacagaaag

SEQ ID NO: 85100 - DNA, 42 bp, Artificial Sequence
  Description of Artificial Sequence: Synthetic oligonucleotide
aggaggatgaaattttgaacagatcaccaagaaacagaaagc

SEQ ID NO: 85101 - DNA, 41 bp, Artificial Sequence
  Description of Artificial Sequence: Synthetic oligonucleotide
ggaggatgaaattttgaacagatcaccaagaaacagaaagc

SEQ ID NO: 85102 - DNA, 41 bp, Artificial Sequence
  Description of Artificial Sequence: Synthetic oligonucleotide
gaggatgaaattttgaacagatcaccaagaaacagaaagcc

SEQ ID NO: 85103 - DNA, 42 bp, Artificial Sequence
  Description of Artificial Sequence: Synthetic oligonucleotide
aggatgaaattttgaacagatcaccaagaaacagaaagccac

SEQ ID NO: 85104 - DNA, 41 bp, Artificial Sequence
  Description of Artificial Sequence: Synthetic oligonucleotide
ggatgaaattttgaacagatcaccaagaaacagaaagccac

SEQ ID NO: 85105 - DNA, 41 bp, Artificial Sequence
  Description of Artificial Sequence: Synthetic oligonucleotide
gatgaaattttgaacagatcaccaagaaacagaaagccacg

SEQ ID NO: 85106 - DNA, 43 bp, Artificial Sequence
  Description of Artificial Sequence: Synthetic oligonucleotide
atgaaattttgaacagatcaccaagaaacagaaagccacgaag

SEQ ID NO: 85107 - DNA, 42 bp, Artificial Sequence
  Description of Artificial Sequence: Synthetic oligonucleotide
tgaaattttgaacagatcaccaagaaacagaaagccacgaag

SEQ ID NO: 85108 - DNA, 41 bp, Artificial Sequence
  Description of Artificial Sequence: Synthetic oligonucleotide
gaaattttgaacagatcaccaagaaacagaaagccacgaag

SEQ ID NO: 85109 - DNA, 42 bp, Artificial Sequence
  Description of Artificial Sequence: Synthetic oligonucleotide
aaattttgaacagatcaccaagaaacagaaagccacgaagag

SEQ ID NO: 85110 - DNA, 41 bp, Artificial Sequence
  Description of Artificial Sequence: Synthetic oligonucleotide
aattttgaacagatcaccaagaaacagaaagccacgaagag

SEQ ID NO: 85111 - DNA, 40 bp, Artificial Sequence
  Description of Artificial Sequence: Synthetic oligonucleotide
attttgaacagatcaccaagaaacagaaagccacgaagag

SEQ ID NO: 85112 - DNA, 39 bp, Artificial Sequence
  Description of Artificial Sequence: Synthetic oligonucleotide
ttttgaacagatcaccaagaaacagaaagccacgaagag

SEQ ID NO: 85113 - DNA, 38 bp, Artificial Sequence
  Description of Artificial Sequence: Synthetic oligonucleotide
tttgaacagatcaccaagaaacagaaagccacgaagag

SEQ ID NO: 85114 - DNA, 37 bp, Artificial Sequence
  Description of Artificial Sequence: Synthetic oligonucleotide
ttgaacagatcaccaagaaacagaaagccacgaagag

SEQ ID NO: 85115 - DNA, 36 bp, Artificial Sequence
  Description of Artificial Sequence: Synthetic oligonucleotide
tgaacagatcaccaagaaacagaaagccacgaagag

SEQ ID NO: 85116 - DNA, 35 bp, Artificial Sequence
  Description of Artificial Sequence: Synthetic oligonucleotide
gaacagatcaccaagaaacagaaagccacgaagag

SEQ ID NO: 85117 - DNA, 36 bp, Artificial Sequence
  Description of Artificial Sequence: Synthetic oligonucleotide
aacagatcaccaagaaacagaaagccacgaagagag

SEQ ID NO: 85118 - DNA, 35 bp, Artificial Sequence
  Description of Artificial Sequence: Synthetic oligonucleotide
acagatcaccaagaaacagaaagccacgaagagag

SEQ ID NO: 85119 - DNA, 34 bp, Artificial Sequence
  Description of Artificial Sequence: Synthetic oligonucleotide
cagatcaccaagaaacagaaagccacgaagagag

SEQ ID NO: 85120 - DNA, 35 bp, Artificial Sequence
  Description of Artificial Sequence: Synthetic oligonucleotide
agatcaccaagaaacagaaagccacgaagagagtg

SEQ ID NO: 85121 - DNA, 34 bp, Artificial Sequence
  Description of Artificial Sequence: Synthetic oligonucleotide
gatcaccaagaaacagaaagccacgaagagagtg

SEQ ID NO: 85122 - DNA, 31 bp, Artificial Sequence
  Description of Artificial Sequence: Synthetic oligonucleotide
atggtgtttctgcccctcaaatggtcccttg

SEQ ID NO: 85123 - DNA, 30 bp, Artificial Sequence
  Description of Artificial Sequence: Synthetic oligonucleotide
tggtgtttctgcccctcaaatggtcccttg

SEQ ID NO: 85124 - DNA, 29 bp, Artificial Sequence
  Description of Artificial Sequence: Synthetic oligonucleotide
ggtgtttctgcccctcaaatggtcccttg

SEQ ID NO: 85125 - DNA, 29 bp, Artificial Sequence
  Description of Artificial Sequence: Synthetic oligonucleotide
gtgtttctgcccctcaaatggtcccttgc

SEQ ID NO: 85126 - DNA, 31 bp, Artificial Sequence
  Description of Artificial Sequence: Synthetic oligonucleotide
tgtttctgcccctcaaatggtcccttgcaac

SEQ ID NO: 85127 - DNA, 30 bp, Artificial Sequence
  Description of Artificial Sequence: Synthetic oligonucleotide
gtttctgcccctcaaatggtcccttgcaac

SEQ ID NO: 85128 - DNA, 30 bp, Artificial Sequence
  Description of Artificial Sequence: Synthetic oligonucleotide
tttctgcccctcaaatggtcccttgcaacc

SEQ ID NO: 85129 - DNA, 29 bp, Artificial Sequence
  Description of Artificial Sequence: Synthetic oligonucleotide
ttctgcccctcaaatggtcccttgcaacc

SEQ ID NO: 85130 - DNA, 28 bp, Artificial Sequence
  Description of Artificial Sequence: Synthetic oligonucleotide
tctgcccctcaaatggtcccttgcaacc

SEQ ID NO: 85131 - DNA, 27 bp, Artificial Sequence
  Description of Artificial Sequence: Synthetic oligonucleotide
ctgcccctcaaatggtcccttgcaacc

SEQ ID NO: 85132 - DNA, 29 bp, Artificial Sequence
  Description of Artificial Sequence: Synthetic oligonucleotide
tgcccctcaaatggtcccttgcaaccatg

SEQ ID NO: 85133 - DNA, 28 bp, Artificial Sequence
  Description of Artificial Sequence: Synthetic oligonucleotide
gcccctcaaatggtcccttgcaaccatg

SEQ ID NO: 85134 - DNA, 29 bp, Artificial Sequence
  Description of Artificial Sequence: Synthetic oligonucleotide
cccctcaaatggtcccttgcaaccatgtc

SEQ ID NO: 85135 - DNA, 33 bp, Artificial Sequence
  Description of Artificial Sequence: Synthetic oligonucleotide
ccctcaaatggtcccttgcaaccatgtcatttc

SEQ ID NO: 85136 - DNA, 35 bp, Artificial Sequence
  Description of Artificial Sequence: Synthetic oligonucleotide
cctcaaatggtcccttgcaaccatgtcatttctac

SEQ ID NO: 85137 - DNA, 38 bp, Artificial Sequence
  Description of Artificial Sequence: Synthetic oligonucleotide
ctcaaatggtcccttgcaaccatgtcatttctactttc

SEQ ID NO: 85138 - DNA, 38 bp, Artificial Sequence
  Description of Artificial Sequence: Synthetic oligonucleotide
tcaaatggtcccttgcaaccatgtcatttctactttcc

SEQ ID NO: 85139 - DNA, 37 bp, Artificial Sequence
  Description of Artificial Sequence: Synthetic oligonucleotide
caaatggtcccttgcaaccatgtcatttctactttcc

SEQ ID NO: 85140 - DNA, 38 bp, Artificial Sequence
  Description of Artificial Sequence: Synthetic oligonucleotide
aaatggtcccttgcaaccatgtcatttctactttcctc

SEQ ID NO: 85141 - DNA, 37 bp, Artificial Sequence
  Description of Artificial Sequence: Synthetic oligonucleotide
aatggtcccttgcaaccatgtcatttctactttcctc

SEQ ID NO: 85142 - DNA, 36 bp, Artificial Sequence
  Description of Artificial Sequence: Synthetic oligonucleotide
atggtcccttgcaaccatgtcatttctactttcctc

SEQ ID NO: 85143 - DNA, 35 bp, Artificial Sequence
  Description of Artificial Sequence: Synthetic oligonucleotide
tggtcccttgcaaccatgtcatttctactttcctc

SEQ ID NO: 85144 - DNA, 34 bp, Artificial Sequence
  Description of Artificial Sequence: Synthetic oligonucleotide
ggtcccttgcaaccatgtcatttctactttcctc

SEQ ID NO: 85145 - DNA, 35 bp, Artificial Sequence
  Description of Artificial Sequence: Synthetic oligonucleotide
gtcccttgcaaccatgtcatttctactttcctcac

SEQ ID NO: 85146 - DNA, 36 bp, Artificial Sequence
  Description of Artificial Sequence: Synthetic oligonucleotide
tcccttgcaaccatgtcatttctactttcctcactg

SEQ ID NO: 85147 - DNA, 35 bp, Artificial Sequence
  Description of Artificial Sequence: Synthetic oligonucleotide
cccttgcaaccatgtcatttctactttcctcactg

SEQ ID NO: 85148 - DNA, 37 bp, Artificial Sequence
  Description of Artificial Sequence: Synthetic oligonucleotide
ccttgcaaccatgtcatttctactttcctcactgttg

SEQ ID NO: 85149 - DNA, 37 bp, Artificial Sequence
  Description of Artificial Sequence: Synthetic oligonucleotide
cttgcaaccatgtcatttctactttcctcactgttgg

SEQ ID NO: 85150 - DNA, 37 bp, Artificial Sequence
  Description of Artificial Sequence: Synthetic oligonucleotide
ttgcaaccatgtcatttctactttcctcactgttggc

SEQ ID NO: 85151 - DNA, 36 bp, Artificial Sequence
  Description of Artificial Sequence: Synthetic oligonucleotide
tgcaaccatgtcatttctactttcctcactgttggc

SEQ ID NO: 85152 - DNA, 35 bp, Artificial Sequence
  Description of Artificial Sequence: Synthetic oligonucleotide
gcaaccatgtcatttctactttcctcactgttggc

SEQ ID NO: 85153 - DNA, 36 bp, Artificial Sequence
  Description of Artificial Sequence: Synthetic oligonucleotide
caaccatgtcatttctactttcctcactgttggctc

SEQ ID NO: 85154 - DNA, 37 bp, Artificial Sequence
  Description of Artificial Sequence: Synthetic oligonucleotide
aaccatgtcatttctactttcctcactgttggctctc

SEQ ID NO: 85155 - DNA, 36 bp, Artificial Sequence
  Description of Artificial Sequence: Synthetic oligonucleotide
accatgtcatttctactttcctcactgttggctctc

SEQ ID NO: 85156 - DNA, 35 bp, Artificial Sequence
  Description of Artificial Sequence: Synthetic oligonucleotide
ccatgtcatttctactttcctcactgttggctctc

SEQ ID NO: 85157 - DNA, 39 bp, Artificial Sequence
  Description of Artificial Sequence: Synthetic oligonucleotide
catgtcatttctactttcctcactgttggctctcttaac

SEQ ID NO: 85158 - DNA, 40 bp, Artificial Sequence
  Description of Artificial Sequence: Synthetic oligonucleotide
atgtcatttctactttcctcactgttggctctcttaactg

SEQ ID NO: 85159 - DNA, 39 bp, Artificial Sequence
  Description of Artificial Sequence: Synthetic oligonucleotide
tgtcatttctactttcctcactgttggctctcttaactg

SEQ ID NO: 85160 - DNA, 38 bp, Artificial Sequence
  Description of Artificial Sequence: Synthetic oligonucleotide
gtcatttctactttcctcactgttggctctcttaactg

SEQ ID NO: 85161 - DNA, 39 bp, Artificial Sequence
  Description of Artificial Sequence: Synthetic oligonucleotide
tcatttctactttcctcactgttggctctcttaactgtg

SEQ ID NO: 85162 - DNA, 38 bp, Artificial Sequence
  Description of Artificial Sequence: Synthetic oligonucleotide
catttctactttcctcactgttggctctcttaactgtg

SEQ ID NO: 85163 - DNA, 39 bp, Artificial Sequence
  Description of Artificial Sequence: Synthetic oligonucleotide
atttctactttcctcactgttggctctcttaactgtgtc

SEQ ID NO: 85164 - DNA, 38 bp, Artificial Sequence
  Description of Artificial Sequence: Synthetic oligonucleotide
tttctactttcctcactgttggctctcttaactgtgtc

SEQ ID NO: 85165 - DNA, 37 bp, Artificial Sequence
  Description of Artificial Sequence: Synthetic oligonucleotide
ttctactttcctcactgttggctctcttaactgtgtc

SEQ ID NO: 85166 - DNA, 36 bp, Artificial Sequence
  Description of Artificial Sequence: Synthetic oligonucleotide
tctactttcctcactgttggctctcttaactgtgtc

SEQ ID NO: 85167 - DNA, 35 bp, Artificial Sequence
  Description of Artificial Sequence: Synthetic oligonucleotide
ctactttcctcactgttggctctcttaactgtgtc

SEQ ID NO: 85168 - DNA, 35 bp, Artificial Sequence
  Description of Artificial Sequence: Synthetic oligonucleotide
tactttcctcactgttggctctcttaactgtgtcc

SEQ ID NO: 85169 - DNA, 34 bp, Artificial Sequence
  Description of Artificial Sequence: Synthetic oligonucleotide
actttcctcactgttggctctcttaactgtgtcc

SEQ ID NO: 85170 - DNA, 33 bp, Artificial Sequence
  Description of Artificial Sequence: Synthetic oligonucleotide
ctttcctcactgttggctctcttaactgtgtcc

SEQ ID NO: 85171 - DNA, 34 bp, Artificial Sequence
  Description of Artificial Sequence: Synthetic oligonucleotide
tttcctcactgttggctctcttaactgtgtccac

SEQ ID NO: 85172 - DNA, 33 bp, Artificial Sequence
  Description of Artificial Sequence: Synthetic oligonucleotide
ttcctcactgttggctctcttaactgtgtccac

SEQ ID NO: 85173 - DNA, 32 bp, Artificial Sequence
  Description of Artificial Sequence: Synthetic oligonucleotide
tcctcactgttggctctcttaactgtgtccac

SEQ ID NO: 85174 - DNA, 31 bp, Artificial Sequence
  Description of Artificial Sequence: Synthetic oligonucleotide
cctcactgttggctctcttaactgtgtccac

SEQ ID NO: 85175 - DNA, 32 bp, Artificial Sequence
  Description of Artificial Sequence: Synthetic oligonucleotide
ctcactgttggctctcttaactgtgtccactc

SEQ ID NO: 85176 - DNA, 32 bp, Artificial Sequence
  Description of Artificial Sequence: Synthetic oligonucleotide
tcactgttggctctcttaactgtgtccactcc

SEQ ID NO: 85177 - DNA, 31 bp, Artificial Sequence
  Description of Artificial Sequence: Synthetic oligonucleotide
cactgttggctctcttaactgtgtccactcc

SEQ ID NO: 85178 - DNA, 33 bp, Artificial Sequence
  Description of Artificial Sequence: Synthetic oligonucleotide
actgttggctctcttaactgtgtccactccttc

SEQ ID NO: 85179 - DNA, 32 bp, Artificial Sequence
  Description of Artificial Sequence: Synthetic oligonucleotide
ctgttggctctcttaactgtgtccactccttc

SEQ ID NO: 85180 - DNA, 34 bp, Artificial Sequence
  Description of Artificial Sequence: Synthetic oligonucleotide
tgttggctctcttaactgtgtccactccttcatg

SEQ ID NO: 85181 - DNA, 33 bp, Artificial Sequence
  Description of Artificial Sequence: Synthetic oligonucleotide
gttggctctcttaactgtgtccactccttcatg

SEQ ID NO: 85182 - DNA, 33 bp, Artificial Sequence
  Description of Artificial Sequence: Synthetic oligonucleotide
ttggctctcttaactgtgtccactccttcatgg

SEQ ID NO: 85183 - DNA, 32 bp, Artificial Sequence
  Description of Artificial Sequence: Synthetic oligonucleotide
tggctctcttaactgtgtccactccttcatgg

SEQ ID NO: 85184 - DNA, 31 bp, Artificial Sequence
  Description of Artificial Sequence: Synthetic oligonucleotide
ggctctcttaactgtgtccactccttcatgg

SEQ ID NO: 85185 - DNA, 32 bp, Artificial Sequence
  Description of Artificial Sequence: Synthetic oligonucleotide
gctctcttaactgtgtccactccttcatggtg

SEQ ID NO: 85186 - DNA, 33 bp, Artificial Sequence
  Description of Artificial Sequence: Synthetic oligonucleotide
ctctcttaactgtgtccactccttcatggtgtc

SEQ ID NO: 85187 - DNA, 34 bp, Artificial Sequence
  Description of Artificial Sequence: Synthetic oligonucleotide
tctcttaactgtgtccactccttcatggtgtcag

SEQ ID NO: 85188 - DNA, 33 bp, Artificial Sequence
  Description of Artificial Sequence: Synthetic oligonucleotide
ctcttaactgtgtccactccttcatggtgtcag

SEQ ID NO: 85189 - DNA, 34 bp, Artificial Sequence
  Description of Artificial Sequence: Synthetic oligonucleotide
tcttaactgtgtccactccttcatggtgtcagag

SEQ ID NO: 85190 - DNA, 33 bp, Artificial Sequence
  Description of Artificial Sequence: Synthetic oligonucleotide
cttaactgtgtccactccttcatggtgtcagag

SEQ ID NO: 85191 - DNA, 33 bp, Artificial Sequence
  Description of Artificial Sequence: Synthetic oligonucleotide
ttaactgtgtccactccttcatggtgtcagagc

SEQ ID NO: 85192 - DNA, 32 bp, Artificial Sequence
  Description of Artificial Sequence: Synthetic oligonucleotide
taactgtgtccactccttcatggtgtcagagc

SEQ ID NO: 85193 - DNA, 31 bp, Artificial Sequence
  Description of Artificial Sequence: Synthetic oligonucleotide
aactgtgtccactccttcatggtgtcagagc

SEQ ID NO: 85194 - DNA, 30 bp, Artificial Sequence
  Description of Artificial Sequence: Synthetic oligonucleotide
actgtgtccactccttcatggtgtcagagc

SEQ ID NO: 85195 - DNA, 29 bp, Artificial Sequence
  Description of Artificial Sequence: Synthetic oligonucleotide
ctgtgtccactccttcatggtgtcagagc

SEQ ID NO: 85196 - DNA, 30 bp, Artificial Sequence
  Description of Artificial Sequence: Synthetic oligonucleotide
tgtgtccactccttcatggtgtcagagcac

SEQ ID NO: 85197 - DNA, 29 bp, Artificial Sequence
  Description of Artificial Sequence: Synthetic oligonucleotide
gtgtccactccttcatggtgtcagagcac

SEQ ID NO: 85198 - DNA, 30 bp, Artificial Sequence
  Description of Artificial Sequence: Synthetic oligonucleotide
tgtccactccttcatggtgtcagagcactg

SEQ ID NO: 85199 - DNA, 29 bp, Artificial Sequence
  Description of Artificial Sequence: Synthetic oligonucleotide
gtccactccttcatggtgtcagagcactg

SEQ ID NO: 85200 - DNA, 31 bp, Artificial Sequence
  Description of Artificial Sequence: Synthetic oligonucleotide
tccactccttcatggtgtcagagcactgaag

SEQ ID NO: 85201 - DNA, 30 bp, Artificial Sequence
  Description of Artificial Sequence: Synthetic oligonucleotide
ccactccttcatggtgtcagagcactgaag

SEQ ID NO: 85202 - DNA, 30 bp, Artificial Sequence
  Description of Artificial Sequence: Synthetic oligonucleotide
cactccttcatggtgtcagagcactgaagc

SEQ ID NO: 85203 - DNA, 32 bp, Artificial Sequence
  Description of Artificial Sequence: Synthetic oligonucleotide
actccttcatggtgtcagagcactgaagcatc

SEQ ID NO: 85204 - DNA, 31 bp, Artificial Sequence
  Description of Artificial Sequence: Synthetic oligonucleotide
ctccttcatggtgtcagagcactgaagcatc

SEQ ID NO: 85205 - DNA, 32 bp, Artificial Sequence
  Description of Artificial Sequence: Synthetic oligonucleotide
tccttcatggtgtcagagcactgaagcatctc

SEQ ID NO: 85206 - DNA, 31 bp, Artificial Sequence
  Description of Artificial Sequence: Synthetic oligonucleotide
ccttcatggtgtcagagcactgaagcatctc

SEQ ID NO: 85207 - DNA, 31 bp, Artificial Sequence
  Description of Artificial Sequence: Synthetic oligonucleotide
cttcatggtgtcagagcactgaagcatctcc

SEQ ID NO: 85208 - DNA, 35 bp, Artificial Sequence
  Description of Artificial Sequence: Synthetic oligonucleotide
ttcatggtgtcagagcactgaagcatctccaaaac

SEQ ID NO: 85209 - DNA, 34 bp, Artificial Sequence
  Description of Artificial Sequence: Synthetic oligonucleotide
tcatggtgtcagagcactgaagcatctccaaaac

SEQ ID NO: 85210 - DNA, 33 bp, Artificial Sequence
  Description of Artificial Sequence: Synthetic oligonucleotide
catggtgtcagagcactgaagcatctccaaaac

SEQ ID NO: 85211 - DNA, 33 bp, Artificial Sequence
  Description of Artificial Sequence: Synthetic oligonucleotide
atggtgtcagagcactgaagcatctccaaaacg

SEQ ID NO: 85212 - DNA, 32 bp, Artificial Sequence
  Description of Artificial Sequence: Synthetic oligonucleotide
tggtgtcagagcactgaagcatctccaaaacg

SEQ ID NO: 85213 - DNA, 31 bp, Artificial Sequence
  Description of Artificial Sequence: Synthetic oligonucleotide
ggtgtcagagcactgaagcatctccaaaacg

SEQ ID NO: 85214 - DNA, 33 bp, Artificial Sequence
  Description of Artificial Sequence: Synthetic oligonucleotide
gtgtcagagcactgaagcatctccaaaacgtag

SEQ ID NO: 85215 - DNA, 34 bp, Artificial Sequence
  Description of Artificial Sequence: Synthetic oligonucleotide
tgtcagagcactgaagcatctccaaaacgtagtg

SEQ ID NO: 85216 - DNA, 33 bp, Artificial Sequence
  Description of Artificial Sequence: Synthetic oligonucleotide
gtcagagcactgaagcatctccaaaacgtagtg

SEQ ID NO: 85217 - DNA, 35 bp, Artificial Sequence
  Description of Artificial Sequence: Synthetic oligonucleotide
tcagagcactgaagcatctccaaaacgtagtgatg

SEQ ID NO: 85218 - DNA, 34 bp, Artificial Sequence
  Description of Artificial Sequence: Synthetic oligonucleotide
cagagcactgaagcatctccaaaacgtagtgatg

SEQ ID NO: 85219 - DNA, 34 bp, Artificial Sequence
  Description of Artificial Sequence: Synthetic oligonucleotide
agagcactgaagcatctccaaaacgtagtgatgg

SEQ ID NO: 85220 - DNA, 33 bp, Artificial Sequence
  Description of Artificial Sequence: Synthetic oligonucleotide
gagcactgaagcatctccaaaacgtagtgatgg

SEQ ID NO: 85221 - DNA, 33 bp, Artificial Sequence
  Description of Artificial Sequence: Synthetic oligonucleotide
agcactgaagcatctccaaaacgtagtgatggg

SEQ ID NO: 85222 - DNA, 32 bp, Artificial Sequence
  Description of Artificial Sequence: Synthetic oligonucleotide
gcactgaagcatctccaaaacgtagtgatggg

SEQ ID NO: 85223 - DNA, 33 bp, Artificial Sequence
  Description of Artificial Sequence: Synthetic oligonucleotide
cactgaagcatctccaaaacgtagtgatgggac

SEQ ID NO: 85224 - DNA, 34 bp, Artificial Sequence
  Description of Artificial Sequence: Synthetic oligonucleotide
actgaagcatctccaaaacgtagtgatgggacac

SEQ ID NO: 85225 - DNA, 33 bp, Artificial Sequence
  Description of Artificial Sequence: Synthetic oligonucleotide
ctgaagcatctccaaaacgtagtgatgggacac

SEQ ID NO: 85226 - DNA, 33 bp, Artificial Sequence
  Description of Artificial Sequence: Synthetic oligonucleotide
tgaagcatctccaaaacgtagtgatgggacacc

SEQ ID NO: 85227 - DNA, 32 bp, Artificial Sequence
  Description of Artificial Sequence: Synthetic oligonucleotide
gaagcatctccaaaacgtagtgatgggacacc

SEQ ID NO: 85228 - DNA, 36 bp, Artificial Sequence
  Description of Artificial Sequence: Synthetic oligonucleotide
aagcatctccaaaacgtagtgatgggacaccatttc

SEQ ID NO: 85229 - DNA, 35 bp, Artificial Sequence
  Description of Artificial Sequence: Synthetic oligonucleotide
agcatctccaaaacgtagtgatgggacaccatttc

SEQ ID NO: 85230 - DNA, 34 bp, Artificial Sequence
  Description of Artificial Sequence: Synthetic oligonucleotide
gcatctccaaaacgtagtgatgggacaccatttc

SEQ ID NO: 85231 - DNA, 34 bp, Artificial Sequence
  Description of Artificial Sequence: Synthetic oligonucleotide
catctccaaaacgtagtgatgggacaccatttcc

SEQ ID NO: 85232 - DNA, 36 bp, Artificial Sequence
  Description of Artificial Sequence: Synthetic oligonucleotide
atctccaaaacgtagtgatgggacaccatttccttg

SEQ ID NO: 85233 - DNA, 35 bp, Artificial Sequence
  Description of Artificial Sequence: Synthetic oligonucleotide
tctccaaaacgtagtgatgggacaccatttccttg

SEQ ID NO: 85234 - DNA, 34 bp, Artificial Sequence
  Description of Artificial Sequence: Synthetic oligonucleotide
ctccaaaacgtagtgatgggacaccatttccttg

SEQ ID NO: 85235 - DNA, 34 bp, Artificial Sequence
  Description of Artificial Sequence: Synthetic oligonucleotide
tccaaaacgtagtgatgggacaccatttccttgg

SEQ ID NO: 85236 - DNA, 33 bp, Artificial Sequence
  Description of Artificial Sequence: Synthetic oligonucleotide
ccaaaacgtagtgatgggacaccatttccttgg

SEQ ID NO: 85237 - DNA, 42 bp, Artificial Sequence
  Description of Artificial Sequence: Synthetic oligonucleotide
caaaacgtagtgatgggacaccatttccttggaataaaatac

SEQ ID NO: 85238 - DNA, 42 bp, Artificial Sequence
  Description of Artificial Sequence: Synthetic oligonucleotide
aaaacgtagtgatgggacaccatttccttggaataaaatacg

SEQ ID NO: 85239 - DNA, 41 bp, Artificial Sequence
  Description of Artificial Sequence: Synthetic oligonucleotide
aaacgtagtgatgggacaccatttccttggaataaaatacg

SEQ ID NO: 85240 - DNA, 40 bp, Artificial Sequence
  Description of Artificial Sequence: Synthetic oligonucleotide
aacgtagtgatgggacaccatttccttggaataaaatacg

SEQ ID NO: 85241 - DNA, 39 bp, Artificial Sequence
  Description of Artificial Sequence: Synthetic oligonucleotide
acgtagtgatgggacaccatttccttggaataaaatacg

SEQ ID NO: 85242 - DNA, 38 bp, Artificial Sequence
  Description of Artificial Sequence: Synthetic oligonucleotide
cgtagtgatgggacaccatttccttggaataaaatacg

SEQ ID NO: 85243 - DNA, 39 bp, Artificial Sequence
  Description of Artificial Sequence: Synthetic oligonucleotide
gtagtgatgggacaccatttccttggaataaaatacgac

SEQ ID NO: 85244 - DNA, 41 bp, Artificial Sequence
  Description of Artificial Sequence: Synthetic oligonucleotide
tagtgatgggacaccatttccttggaataaaatacgacttc

SEQ ID NO: 85245 - DNA, 40 bp, Artificial Sequence
  Description of Artificial Sequence: Synthetic oligonucleotide
agtgatgggacaccatttccttggaataaaatacgacttc

SEQ ID NO: 85246 - DNA, 39 bp, Artificial Sequence
  Description of Artificial Sequence: Synthetic oligonucleotide
gtgatgggacaccatttccttggaataaaatacgacttc

SEQ ID NO: 85247 - DNA, 39 bp, Artificial Sequence
  Description of Artificial Sequence: Synthetic oligonucleotide
tgatgggacaccatttccttggaataaaatacgacttcc

SEQ ID NO: 85248 - DNA, 38 bp, Artificial Sequence
  Description of Artificial Sequence: Synthetic oligonucleotide
gatgggacaccatttccttggaataaaatacgacttcc

SEQ ID NO: 85249 - DNA, 39 bp, Artificial Sequence
  Description of Artificial Sequence: Synthetic oligonucleotide
atgggacaccatttccttggaataaaatacgacttcctg

SEQ ID NO: 85250 - DNA, 38 bp, Artificial Sequence
  Description of Artificial Sequence: Synthetic oligonucleotide
tgggacaccatttccttggaataaaatacgacttcctg

SEQ ID NO: 85251 - DNA, 37 bp, Artificial Sequence
  Description of Artificial Sequence: Synthetic oligonucleotide
gggacaccatttccttggaataaaatacgacttcctg

SEQ ID NO: 85252 - DNA, 38 bp, Artificial Sequence
  Description of Artificial Sequence: Synthetic oligonucleotide
ggacaccatttccttggaataaaatacgacttcctgag

SEQ ID NO: 85253 - DNA, 40 bp, Artificial Sequence
  Description of Artificial Sequence: Synthetic oligonucleotide
gacaccatttccttggaataaaatacgacttcctgagtac

SEQ ID NO: 85254 - DNA, 40 bp, Artificial Sequence
  Description of Artificial Sequence: Synthetic oligonucleotide
acaccatttccttggaataaaatacgacttcctgagtacg

SEQ ID NO: 85255 - DNA, 39 bp, Artificial Sequence
  Description of Artificial Sequence: Synthetic oligonucleotide
caccatttccttggaataaaatacgacttcctgagtacg

SEQ ID NO: 85256 - DNA, 40 bp, Artificial Sequence
  Description of Artificial Sequence: Synthetic oligonucleotide
accatttccttggaataaaatacgacttcctgagtacgtc

SEQ ID NO: 85257 - DNA, 39 bp, Artificial Sequence
  Description of Artificial Sequence: Synthetic oligonucleotide
ccatttccttggaataaaatacgacttcctgagtacgtc

SEQ ID NO: 85258 - DNA, 41 bp, Artificial Sequence
  Description of Artificial Sequence: Synthetic oligonucleotide
catttccttggaataaaatacgacttcctgagtacgtcatc

SEQ ID NO: 85259 - DNA, 41 bp, Artificial Sequence
  Description of Artificial Sequence: Synthetic oligonucleotide
atttccttggaataaaatacgacttcctgagtacgtcatcc

SEQ ID NO: 85260 - DNA, 40 bp, Artificial Sequence
  Description of Artificial Sequence: Synthetic oligonucleotide
tttccttggaataaaatacgacttcctgagtacgtcatcc

SEQ ID NO: 85261 - DNA, 39 bp, Artificial Sequence
  Description of Artificial Sequence: Synthetic oligonucleotide
ttccttggaataaaatacgacttcctgagtacgtcatcc

SEQ ID NO: 85262 - DNA, 38 bp, Artificial Sequence
  Description of Artificial Sequence: Synthetic oligonucleotide
tccttggaataaaatacgacttcctgagtacgtcatcc

SEQ ID NO: 85263 - DNA, 37 bp, Artificial Sequence
  Description of Artificial Sequence: Synthetic oligonucleotide
ccttggaataaaatacgacttcctgagtacgtcatcc

SEQ ID NO: 85264 - DNA, 37 bp, Artificial Sequence
  Description of Artificial Sequence: Synthetic oligonucleotide
cttggaataaaatacgacttcctgagtacgtcatccc

SEQ ID NO: 85265 - DNA, 38 bp, Artificial Sequence
  Description of Artificial Sequence: Synthetic oligonucleotide
ttggaataaaatacgacttcctgagtacgtcatcccag

SEQ ID NO: 85266 - DNA, 37 bp, Artificial Sequence
  Description of Artificial Sequence: Synthetic oligonucleotide
tggaataaaatacgacttcctgagtacgtcatcccag

SEQ ID NO: 85267 - DNA, 36 bp, Artificial Sequence
  Description of Artificial Sequence: Synthetic oligonucleotide
ggaataaaatacgacttcctgagtacgtcatcccag

SEQ ID NO: 85268 - DNA, 38 bp, Artificial Sequence
  Description of Artificial Sequence: Synthetic oligonucleotide
gaataaaatacgacttcctgagtacgtcatcccagttc

SEQ ID NO: 85269 - DNA, 43 bp, Artificial Sequence
  Description of Artificial Sequence: Synthetic oligonucleotide
aataaaatacgacttcctgagtacgtcatcccagttcattatg

SEQ ID NO: 85270 - DNA, 42 bp, Artificial Sequence
  Description of Artificial Sequence: Synthetic oligonucleotide
ataaaatacgacttcctgagtacgtcatcccagttcattatg

SEQ ID NO: 85271 - DNA, 41 bp, Artificial Sequence
  Description of Artificial Sequence: Synthetic oligonucleotide
taaaatacgacttcctgagtacgtcatcccagttcattatg

SEQ ID NO: 85272 - DNA, 40 bp, Artificial Sequence
  Description of Artificial Sequence: Synthetic oligonucleotide
aaaatacgacttcctgagtacgtcatcccagttcattatg

SEQ ID NO: 85273 - DNA, 39 bp, Artificial Sequence
  Description of Artificial Sequence: Synthetic oligonucleotide
aaatacgacttcctgagtacgtcatcccagttcattatg

SEQ ID NO: 85274 - DNA, 38 bp, Artificial Sequence
  Description of Artificial Sequence: Synthetic oligonucleotide
aatacgacttcctgagtacgtcatcccagttcattatg

SEQ ID NO: 85275 - DNA, 37 bp, Artificial Sequence
  Description of Artificial Sequence: Synthetic oligonucleotide
atacgacttcctgagtacgtcatcccagttcattatg

SEQ ID NO: 85276 - DNA, 36 bp, Artificial Sequence
  Description of Artificial Sequence: Synthetic oligonucleotide
tacgacttcctgagtacgtcatcccagttcattatg

SEQ ID NO: 85277 - DNA, 35 bp, Artificial Sequence
  Description of Artificial Sequence: Synthetic oligonucleotide
acgacttcctgagtacgtcatcccagttcattatg

SEQ ID NO: 85278 - DNA, 34 bp, Artificial Sequence
  Description of Artificial Sequence: Synthetic oligonucleotide
cgacttcctgagtacgtcatcccagttcattatg

SEQ ID NO: 85279 - DNA, 36 bp, Artificial Sequence
  Description of Artificial Sequence: Synthetic oligonucleotide
gacttcctgagtacgtcatcccagttcattatgatc

SEQ ID NO: 85280 - DNA, 37 bp, Artificial Sequence
  Description of Artificial Sequence: Synthetic oligonucleotide
acttcctgagtacgtcatcccagttcattatgatctc

SEQ ID NO: 85281 - DNA, 36 bp, Artificial Sequence
  Description of Artificial Sequence: Synthetic oligonucleotide
cttcctgagtacgtcatcccagttcattatgatctc

SEQ ID NO: 85282 - DNA, 38 bp, Artificial Sequence
  Description of Artificial Sequence: Synthetic oligonucleotide
ttcctgagtacgtcatcccagttcattatgatctcttg

SEQ ID NO: 85283 - DNA, 37 bp, Artificial Sequence
  Description of Artificial Sequence: Synthetic oligonucleotide
tcctgagtacgtcatcccagttcattatgatctcttg

SEQ ID NO: 85284 - DNA, 36 bp, Artificial Sequence
  Description of Artificial Sequence: Synthetic oligonucleotide
cctgagtacgtcatcccagttcattatgatctcttg

SEQ ID NO: 85285 - DNA, 38 bp, Artificial Sequence
  Description of Artificial Sequence: Synthetic oligonucleotide
ctgagtacgtcatcccagttcattatgatctcttgatc

SEQ ID NO: 85286 - DNA, 38 bp, Artificial Sequence
  Description of Artificial Sequence: Synthetic oligonucleotide
tgagtacgtcatcccagttcattatgatctcttgatcc

SEQ ID NO: 85287 - DNA, 37 bp, Artificial Sequence
  Description of Artificial Sequence: Synthetic oligonucleotide
gagtacgtcatcccagttcattatgatctcttgatcc

SEQ ID NO: 85288 - DNA, 39 bp, Artificial Sequence
  Description of Artificial Sequence: Synthetic oligonucleotide
agtacgtcatcccagttcattatgatctcttgatccatg

SEQ ID NO: 85289 - DNA, 38 bp, Artificial Sequence
  Description of Artificial Sequence: Synthetic oligonucleotide
gtacgtcatcccagttcattatgatctcttgatccatg

SEQ ID NO: 85290 - DNA, 38 bp, Artificial Sequence
  Description of Artificial Sequence: Synthetic oligonucleotide
tacgtcatcccagttcattatgatctcttgatccatgc

SEQ ID NO: 85291 - DNA, 37 bp, Artificial Sequence
  Description of Artificial Sequence: Synthetic oligonucleotide
acgtcatcccagttcattatgatctcttgatccatgc

SEQ ID NO: 85292 - DNA, 36 bp, Artificial Sequence
  Description of Artificial Sequence: Synthetic oligonucleotide
cgtcatcccagttcattatgatctcttgatccatgc

SEQ ID NO: 85293 - DNA, 39 bp, Artificial Sequence
  Description of Artificial Sequence: Synthetic oligonucleotide
gtcatcccagttcattatgatctcttgatccatgcaaac

SEQ ID NO: 85294 - DNA, 39 bp, Artificial Sequence
  Description of Artificial Sequence: Synthetic oligonucleotide
tcatcccagttcattatgatctcttgatccatgcaaacc

SEQ ID NO: 85295 - DNA, 38 bp, Artificial Sequence
  Description of Artificial Sequence: Synthetic oligonucleotide
catcccagttcattatgatctcttgatccatgcaaacc

SEQ ID NO: 85296 - DNA, 41 bp, Artificial Sequence
  Description of Artificial Sequence: Synthetic oligonucleotide
atcccagttcattatgatctcttgatccatgcaaaccttac

SEQ ID NO: 85297 - DNA, 40 bp, Artificial Sequence
  Description of Artificial Sequence: Synthetic oligonucleotide
tcccagttcattatgatctcttgatccatgcaaaccttac

SEQ ID NO: 85298 - DNA, 39 bp, Artificial Sequence
  Description of Artificial Sequence: Synthetic oligonucleotide
cccagttcattatgatctcttgatccatgcaaaccttac

SEQ ID NO: 85299 - DNA, 39 bp, Artificial Sequence
  Description of Artificial Sequence: Synthetic oligonucleotide
ccagttcattatgatctcttgatccatgcaaaccttacc

SEQ ID NO: 85300 - DNA, 40 bp, Artificial Sequence
  Description of Artificial Sequence: Synthetic oligonucleotide
cagttcattatgatctcttgatccatgcaaaccttaccac

SEQ ID NO: 85301 - DNA, 40 bp, Artificial Sequence
  Description of Artificial Sequence: Synthetic oligonucleotide
agttcattatgatctcttgatccatgcaaaccttaccacg

SEQ ID NO: 85302 - DNA, 39 bp, Artificial Sequence
  Description of Artificial Sequence: Synthetic oligonucleotide
gttcattatgatctcttgatccatgcaaaccttaccacg

SEQ ID NO: 85303 - DNA, 39 bp, Artificial Sequence
  Description of Artificial Sequence: Synthetic oligonucleotide
ttcattatgatctcttgatccatgcaaaccttaccacgc

SEQ ID NO: 85304 - DNA, 38 bp, Artificial Sequence
  Description of Artificial Sequence: Synthetic oligonucleotide
tcattatgatctcttgatccatgcaaaccttaccacgc

SEQ ID NO: 85305 - DNA, 37 bp, Artificial Sequence
  Description of Artificial Sequence: Synthetic oligonucleotide
cattatgatctcttgatccatgcaaaccttaccacgc

SEQ ID NO: 85306 - DNA, 38 bp, Artificial Sequence
  Description of Artificial Sequence: Synthetic oligonucleotide
attatgatctcttgatccatgcaaaccttaccacgctg

SEQ ID NO: 85307 - DNA, 37 bp, Artificial Sequence
  Description of Artificial Sequence: Synthetic oligonucleotide
ttatgatctcttgatccatgcaaaccttaccacgctg

SEQ ID NO: 85308 - DNA, 36 bp, Artificial Sequence
  Description of Artificial Sequence: Synthetic oligonucleotide
tatgatctcttgatccatgcaaaccttaccacgctg

SEQ ID NO: 85309 - DNA, 35 bp, Artificial Sequence
  Description of Artificial Sequence: Synthetic oligonucleotide
atgatctcttgatccatgcaaaccttaccacgctg

SEQ ID NO: 85310 - DNA, 34 bp, Artificial Sequence
  Description of Artificial Sequence: Synthetic oligonucleotide
tgatctcttgatccatgcaaaccttaccacgctg

SEQ ID NO: 85311 - DNA, 33 bp, Artificial Sequence
  Description of Artificial Sequence: Synthetic oligonucleotide
gatctcttgatccatgcaaaccttaccacgctg

SEQ ID NO: 85312 - DNA, 34 bp, Artificial Sequence
  Description of Artificial Sequence: Synthetic oligonucleotide
atctcttgatccatgcaaaccttaccacgctgac

SEQ ID NO: 85313 - DNA, 33 bp, Artificial Sequence
  Description of Artificial Sequence: Synthetic oligonucleotide
tctcttgatccatgcaaaccttaccacgctgac

SEQ ID NO: 85314 - DNA, 32 bp, Artificial Sequence
  Description of Artificial Sequence: Synthetic oligonucleotide
ctcttgatccatgcaaaccttaccacgctgac

SEQ ID NO: 85315 - DNA, 32 bp, Artificial Sequence
  Description of Artificial Sequence: Synthetic oligonucleotide
tcttgatccatgcaaaccttaccacgctgacc

SEQ ID NO: 85316 - DNA, 31 bp, Artificial Sequence
  Description of Artificial Sequence: Synthetic oligonucleotide
cttgatccatgcaaaccttaccacgctgacc

SEQ ID NO: 85317 - DNA, 33 bp, Artificial Sequence
  Description of Artificial Sequence: Synthetic oligonucleotide
ttgatccatgcaaaccttaccacgctgaccttc

SEQ ID NO: 85318 - DNA, 32 bp, Artificial Sequence
  Description of Artificial Sequence: Synthetic oligonucleotide
tgatccatgcaaaccttaccacgctgaccttc

SEQ ID NO: 85319 - DNA, 31 bp, Artificial Sequence
  Description of Artificial Sequence: Synthetic oligonucleotide
gatccatgcaaaccttaccacgctgaccttc

SEQ ID NO: 85320 - DNA, 32 bp, Artificial Sequence
  Description of Artificial Sequence: Synthetic oligonucleotide
atccatgcaaaccttaccacgctgaccttctg

SEQ ID NO: 85321 - DNA, 31 bp, Artificial Sequence
  Description of Artificial Sequence: Synthetic oligonucleotide
tccatgcaaaccttaccacgctgaccttctg

SEQ ID NO: 85322 - DNA, 30 bp, Artificial Sequence
  Description of Artificial Sequence: Synthetic oligonucleotide
ccatgcaaaccttaccacgctgaccttctg

SEQ ID NO: 85323 - DNA, 30 bp, Artificial Sequence
  Description of Artificial Sequence: Synthetic oligonucleotide
catgcaaaccttaccacgctgaccttctgg

SEQ ID NO: 85324 - DNA, 30 bp, Artificial Sequence
  Description of Artificial Sequence: Synthetic oligonucleotide
atgcaaaccttaccacgctgaccttctggg

SEQ ID NO: 85325 - DNA, 29 bp, Artificial Sequence
  Description of Artificial Sequence: Synthetic oligonucleotide
tgcaaaccttaccacgctgaccttctggg

SEQ ID NO: 85326 - DNA, 28 bp, Artificial Sequence
  Description of Artificial Sequence: Synthetic oligonucleotide
gcaaaccttaccacgctgaccttctggg

SEQ ID NO: 85327 - DNA, 28 bp, Artificial Sequence
  Description of Artificial Sequence: Synthetic oligonucleotide
caaaccttaccacgctgaccttctgggg

SEQ ID NO: 85328 - DNA, 30 bp, Artificial Sequence
  Description of Artificial Sequence: Synthetic oligonucleotide
aaaccttaccacgctgaccttctggggaac

SEQ ID NO: 85329 - DNA, 29 bp, Artificial Sequence
  Description of Artificial Sequence: Synthetic oligonucleotide
aaccttaccacgctgaccttctggggaac

SEQ ID NO: 85330 - DNA, 28 bp, Artificial Sequence
  Description of Artificial Sequence: Synthetic oligonucleotide
accttaccacgctgaccttctggggaac

SEQ ID NO: 85331 - DNA, 27 bp, Artificial Sequence
  Description of Artificial Sequence: Synthetic oligonucleotide
ccttaccacgctgaccttctggggaac

SEQ ID NO: 85332 - DNA, 27 bp, Artificial Sequence
  Description of Artificial Sequence: Synthetic oligonucleotide
cttaccacgctgaccttctggggaacc

SEQ ID NO: 85333 - DNA, 28 bp, Artificial Sequence
  Description of Artificial Sequence: Synthetic oligonucleotide
ttaccacgctgaccttctggggaaccac

SEQ ID NO: 85334 - DNA, 27 bp, Artificial Sequence
  Description of Artificial Sequence: Synthetic oligonucleotide
taccacgctgaccttctggggaaccac

SEQ ID NO: 85335 - DNA, 26 bp, Artificial Sequence
  Description of Artificial Sequence: Synthetic oligonucleotide
accacgctgaccttctggggaaccac

SEQ ID NO: 85336 - DNA, 25 bp, Artificial Sequence
  Description of Artificial Sequence: Synthetic oligonucleotide
ccacgctgaccttctggggaaccac

SEQ ID NO: 85337 - DNA, 27 bp, Artificial Sequence
  Description of Artificial Sequence: Synthetic oligonucleotide
cacgctgaccttctggggaaccacgaa

SEQ ID NO: 85338 - DNA, 28 bp, Artificial Sequence
  Description of Artificial Sequence: Synthetic oligonucleotide
acgctgaccttctggggaaccacgaaag

SEQ ID NO: 85339 - DNA, 27 bp, Artificial Sequence
  Description of Artificial Sequence: Synthetic oligonucleotide
cgctgaccttctggggaaccacgaaag

SEQ ID NO: 85340 - DNA, 29 bp, Artificial Sequence
  Description of Artificial Sequence: Synthetic oligonucleotide
gctgaccttctggggaaccacgaaagtag

SEQ ID NO: 85341 - DNA, 33 bp, Artificial Sequence
  Description of Artificial Sequence: Synthetic oligonucleotide
ctgaccttctggggaaccacgaaagtagaaatc

SEQ ID NO: 85342 - DNA, 34 bp, Artificial Sequence
  Description of Artificial Sequence: Synthetic oligonucleotide
tgaccttctggggaaccacgaaagtagaaatcac

SEQ ID NO: 85343 - DNA, 33 bp, Artificial Sequence
  Description of Artificial Sequence: Synthetic oligonucleotide
gaccttctggggaaccacgaaagtagaaatcac

SEQ ID NO: 85344 - DNA, 34 bp, Artificial Sequence
  Description of Artificial Sequence: Synthetic oligonucleotide
accttctggggaaccacgaaagtagaaatcacag

SEQ ID NO: 85345 - DNA, 33 bp, Artificial Sequence
  Description of Artificial Sequence: Synthetic oligonucleotide
ccttctggggaaccacgaaagtagaaatcacag

SEQ ID NO: 85346 - DNA, 33 bp, Artificial Sequence
  Description of Artificial Sequence: Synthetic oligonucleotide
cttctggggaaccacgaaagtagaaatcacagc

SEQ ID NO: 85347 - DNA, 33 bp, Artificial Sequence
  Description of Artificial Sequence: Synthetic oligonucleotide
ttctggggaaccacgaaagtagaaatcacagcc

SEQ ID NO: 85348 - DNA, 32 bp, Artificial Sequence
  Description of Artificial Sequence: Synthetic oligonucleotide
tctggggaaccacgaaagtagaaatcacagcc

SEQ ID NO: 85349 - DNA, 31 bp, Artificial Sequence
  Description of Artificial Sequence: Synthetic oligonucleotide
ctggggaaccacgaaagtagaaatcacagcc

SEQ ID NO: 85350 - DNA, 32 bp, Artificial Sequence
  Description of Artificial Sequence: Synthetic oligonucleotide
tggggaaccacgaaagtagaaatcacagccag

SEQ ID NO: 85351 - DNA, 31 bp, Artificial Sequence
  Description of Artificial Sequence: Synthetic oligonucleotide
ggggaaccacgaaagtagaaatcacagccag

SEQ ID NO: 85352 - DNA, 32 bp, Artificial Sequence
  Description of Artificial Sequence: Synthetic oligonucleotide
gggaaccacgaaagtagaaatcacagccagtc

SEQ ID NO: 85353 - DNA, 33 bp, Artificial Sequence
  Description of Artificial Sequence: Synthetic oligonucleotide
ggaaccacgaaagtagaaatcacagccagtcag

SEQ ID NO: 85354 - DNA, 33 bp, Artificial Sequence
  Description of Artificial Sequence: Synthetic oligonucleotide
gaaccacgaaagtagaaatcacagccagtcagc

SEQ ID NO: 85355 - DNA, 33 bp, Artificial Sequence
  Description of Artificial Sequence: Synthetic oligonucleotide
aaccacgaaagtagaaatcacagccagtcagcc

SEQ ID NO: 85356 - DNA, 32 bp, Artificial Sequence
  Description of Artificial Sequence: Synthetic oligonucleotide
accacgaaagtagaaatcacagccagtcagcc

SEQ ID NO: 85357 - DNA, 31 bp, Artificial Sequence
  Description of Artificial Sequence: Synthetic oligonucleotide
ccacgaaagtagaaatcacagccagtcagcc

SEQ ID NO: 85358 - DNA, 31 bp, Artificial Sequence
  Description of Artificial Sequence: Synthetic oligonucleotide
cacgaaagtagaaatcacagccagtcagccc

SEQ ID NO: 85359 - DNA, 32 bp, Artificial Sequence
  Description of Artificial Sequence: Synthetic oligonucleotide
acgaaagtagaaatcacagccagtcagcccac

SEQ ID NO: 85360 - DNA, 31 bp, Artificial Sequence
  Description of Artificial Sequence: Synthetic oligonucleotide
cgaaagtagaaatcacagccagtcagcccac

SEQ ID NO: 85361 - DNA, 31 bp, Artificial Sequence
  Description of Artificial Sequence: Synthetic oligonucleotide
gaaagtagaaatcacagccagtcagcccacc

SEQ ID NO: 85362 - DNA, 32 bp, Artificial Sequence
  Description of Artificial Sequence: Synthetic oligonucleotide
aaagtagaaatcacagccagtcagcccaccag

SEQ ID NO: 85363 - DNA, 31 bp, Artificial Sequence
  Description of Artificial Sequence: Synthetic oligonucleotide
aagtagaaatcacagccagtcagcccaccag

SEQ ID NO: 85364 - DNA, 30 bp, Artificial Sequence
  Description of Artificial Sequence: Synthetic oligonucleotide
agtagaaatcacagccagtcagcccaccag

SEQ ID NO: 85365 - DNA, 29 bp, Artificial Sequence
  Description of Artificial Sequence: Synthetic oligonucleotide
gtagaaatcacagccagtcagcccaccag

SEQ ID NO: 85366 - DNA, 29 bp, Artificial Sequence
  Description of Artificial Sequence: Synthetic oligonucleotide
tagaaatcacagccagtcagcccaccagc

SEQ ID NO: 85367 - DNA, 28 bp, Artificial Sequence
  Description of Artificial Sequence: Synthetic oligonucleotide
agaaatcacagccagtcagcccaccagc

SEQ ID NO: 85368 - DNA, 27 bp, Artificial Sequence
  Description of Artificial Sequence: Synthetic oligonucleotide
gaaatcacagccagtcagcccaccagc

SEQ ID NO: 85369 - DNA, 28 bp, Artificial Sequence
  Description of Artificial Sequence: Synthetic oligonucleotide
aaatcacagccagtcagcccaccagcac

SEQ ID NO: 85370 - DNA, 27 bp, Artificial Sequence
  Description of Artificial Sequence: Synthetic oligonucleotide
aatcacagccagtcagcccaccagcac

SEQ ID NO: 85371 - DNA, 26 bp, Artificial Sequence
  Description of Artificial Sequence: Synthetic oligonucleotide
atcacagccagtcagcccaccagcac

SEQ ID NO: 85372 - DNA, 25 bp, Artificial Sequence
  Description of Artificial Sequence: Synthetic oligonucleotide
tcacagccagtcagcccaccagcac

SEQ ID NO: 85373 - DNA, 24 bp, Artificial Sequence
  Description of Artificial Sequence: Synthetic oligonucleotide
cacagccagtcagcccaccagcac

SEQ ID NO: 85374 - DNA, 26 bp, Artificial Sequence
  Description of Artificial Sequence: Synthetic oligonucleotide
acagccagtcagcccaccagcaccat

SEQ ID NO: 85375 - DNA, 25 bp, Artificial Sequence
  Description of Artificial Sequence: Synthetic oligonucleotide
cagccagtcagcccaccagcaccat

SEQ ID NO: 85376 - DNA, 27 bp, Artificial Sequence
  Description of Artificial Sequence: Synthetic oligonucleotide
agccagtcagcccaccagcaccatcat

SEQ ID NO: 85377 - DNA, 26 bp, Artificial Sequence
  Description of Artificial Sequence: Synthetic oligonucleotide
gccagtcagcccaccagcaccatcat

SEQ ID NO: 85378 - DNA, 26 bp, Artificial Sequence
  Description of Artificial Sequence: Synthetic oligonucleotide
ccagtcagcccaccagcaccatcatc

SEQ ID NO: 85379 - DNA, 27 bp, Artificial Sequence
  Description of Artificial Sequence: Synthetic oligonucleotide
cagtcagcccaccagcaccatcatcct

SEQ ID NO: 85380 - DNA, 27 bp, Artificial Sequence
  Description of Artificial Sequence: Synthetic oligonucleotide
agtcagcccaccagcaccatcatcctg

SEQ ID NO: 85381 - DNA, 26 bp, Artificial Sequence
  Description of Artificial Sequence: Synthetic oligonucleotide
gtcagcccaccagcaccatcatcctg

SEQ ID NO: 85382 - DNA, 27 bp, Artificial Sequence
  Description of Artificial Sequence: Synthetic oligonucleotide
tcagcccaccagcaccatcatcctgca

SEQ ID NO: 85383 - DNA, 27 bp, Artificial Sequence
  Description of Artificial Sequence: Synthetic oligonucleotide
cagcccaccagcaccatcatcctgcat

SEQ ID NO: 85384 - DNA, 28 bp, Artificial Sequence
  Description of Artificial Sequence: Synthetic oligonucleotide
agcccaccagcaccatcatcctgcatag

SEQ ID NO: 85385 - DNA, 27 bp, Artificial Sequence
  Description of Artificial Sequence: Synthetic oligonucleotide
gcccaccagcaccatcatcctgcatag

SEQ ID NO: 85386 - DNA, 28 bp, Artificial Sequence
  Description of Artificial Sequence: Synthetic oligonucleotide
cccaccagcaccatcatcctgcatagtc

SEQ ID NO: 85387 - DNA, 29 bp, Artificial Sequence
  Description of Artificial Sequence: Synthetic oligonucleotide
ccaccagcaccatcatcctgcatagtcac

SEQ ID NO: 85388 - DNA, 29 bp, Artificial Sequence
  Description of Artificial Sequence: Synthetic oligonucleotide
caccagcaccatcatcctgcatagtcacc

SEQ ID NO: 85389 - DNA, 30 bp, Artificial Sequence
  Description of Artificial Sequence: Synthetic oligonucleotide
accagcaccatcatcctgcatagtcaccac

SEQ ID NO: 85390 - DNA, 29 bp, Artificial Sequence
  Description of Artificial Sequence: Synthetic oligonucleotide
ccagcaccatcatcctgcatagtcaccac

SEQ ID NO: 85391 - DNA, 29 bp, Artificial Sequence
  Description of Artificial Sequence: Synthetic oligonucleotide
cagcaccatcatcctgcatagtcaccacc

SEQ ID NO: 85392 - DNA, 30 bp, Artificial Sequence
  Description of Artificial Sequence: Synthetic oligonucleotide
agcaccatcatcctgcatagtcaccacctg

SEQ ID NO: 85393 - DNA, 29 bp, Artificial Sequence
  Description of Artificial Sequence: Synthetic oligonucleotide
gcaccatcatcctgcatagtcaccacctg

SEQ ID NO: 85394 - DNA, 29 bp, Artificial Sequence
  Description of Artificial Sequence: Synthetic oligonucleotide
caccatcatcctgcatagtcaccacctgc

SEQ ID NO: 85395 - DNA, 30 bp, Artificial Sequence
  Description of Artificial Sequence: Synthetic oligonucleotide
accatcatcctgcatagtcaccacctgcag

SEQ ID NO: 85396 - DNA, 29 bp, Artificial Sequence
  Description of Artificial Sequence: Synthetic oligonucleotide
ccatcatcctgcatagtcaccacctgcag

SEQ ID NO: 85397 - DNA, 33 bp, Artificial Sequence
  Description of Artificial Sequence: Synthetic oligonucleotide
catcatcctgcatagtcaccacctgcagatatc

SEQ ID NO: 85398 - DNA, 35 bp, Artificial Sequence
  Description of Artificial Sequence: Synthetic oligonucleotide
atcatcctgcatagtcaccacctgcagatatctag

SEQ ID NO: 85399 - DNA, 34 bp, Artificial Sequence
  Description of Artificial Sequence: Synthetic oligonucleotide
tcatcctgcatagtcaccacctgcagatatctag

SEQ ID NO: 85400 - DNA, 33 bp, Artificial Sequence
  Description of Artificial Sequence: Synthetic oligonucleotide
catcctgcatagtcaccacctgcagatatctag

SEQ ID NO: 85401 - DNA, 33 bp, Artificial Sequence
  Description of Artificial Sequence: Synthetic oligonucleotide
atcctgcatagtcaccacctgcagatatctagg

SEQ ID NO: 85402 - DNA, 32 bp, Artificial Sequence
  Description of Artificial Sequence: Synthetic oligonucleotide
tcctgcatagtcaccacctgcagatatctagg

SEQ ID NO: 85403 - DNA, 31 bp, Artificial Sequence
  Description of Artificial Sequence: Synthetic oligonucleotide
cctgcatagtcaccacctgcagatatctagg

SEQ ID NO: 85404 - DNA, 31 bp, Artificial Sequence
  Description of Artificial Sequence: Synthetic oligonucleotide
ctgcatagtcaccacctgcagatatctaggg

SEQ ID NO: 85405 - DNA, 31 bp, Artificial Sequence
  Description of Artificial Sequence: Synthetic oligonucleotide
tgcatagtcaccacctgcagatatctagggc

SEQ ID NO: 85406 - DNA, 30 bp, Artificial Sequence
  Description of Artificial Sequence: Synthetic oligonucleotide
gcatagtcaccacctgcagatatctagggc

SEQ ID NO: 85407 - DNA, 30 bp, Artificial Sequence
  Description of Artificial Sequence: Synthetic oligonucleotide
catagtcaccacctgcagatatctagggcc

SEQ ID NO: 85408 - DNA, 31 bp, Artificial Sequence
  Description of Artificial Sequence: Synthetic oligonucleotide
atagtcaccacctgcagatatctagggccac

SEQ ID NO: 85409 - DNA, 30 bp, Artificial Sequence
  Description of Artificial Sequence: Synthetic oligonucleotide
tagtcaccacctgcagatatctagggccac

SEQ ID NO: 85410 - DNA, 29 bp, Artificial Sequence
  Description of Artificial Sequence: Synthetic oligonucleotide
agtcaccacctgcagatatctagggccac

SEQ ID NO: 85411 - DNA, 28 bp, Artificial Sequence
  Description of Artificial Sequence: Synthetic oligonucleotide
gtcaccacctgcagatatctagggccac

SEQ ID NO: 85412 - DNA, 28 bp, Artificial Sequence
  Description of Artificial Sequence: Synthetic oligonucleotide
tcaccacctgcagatatctagggccacc

SEQ ID NO: 85413 - DNA, 27 bp, Artificial Sequence
  Description of Artificial Sequence: Synthetic oligonucleotide
caccacctgcagatatctagggccacc

SEQ ID NO: 85414 - DNA, 27 bp, Artificial Sequence
  Description of Artificial Sequence: Synthetic oligonucleotide
accacctgcagatatctagggccaccc

SEQ ID NO: 85415 - DNA, 27 bp, Artificial Sequence
  Description of Artificial Sequence: Synthetic oligonucleotide
ccacctgcagatatctagggccaccct

SEQ ID NO: 85416 - DNA, 27 bp, Artificial Sequence
  Description of Artificial Sequence: Synthetic oligonucleotide
cacctgcagatatctagggccaccctc

SEQ ID NO: 85417 - DNA, 28 bp, Artificial Sequence
  Description of Artificial Sequence: Synthetic oligonucleotide
acctgcagatatctagggccaccctcag

SEQ ID NO: 85418 - DNA, 27 bp, Artificial Sequence
  Description of Artificial Sequence: Synthetic oligonucleotide
cctgcagatatctagggccaccctcag

SEQ ID NO: 85419 - DNA, 27 bp, Artificial Sequence
  Description of Artificial Sequence: Synthetic oligonucleotide
ctgcagatatctagggccaccctcagg

SEQ ID NO: 85420 - DNA, 29 bp, Artificial Sequence
  Description of Artificial Sequence: Synthetic oligonucleotide
tgcagatatctagggccaccctcaggaag

SEQ ID NO: 85421 - DNA, 28 bp, Artificial Sequence
  Description of Artificial Sequence: Synthetic oligonucleotide
gcagatatctagggccaccctcaggaag

SEQ ID NO: 85422 - DNA, 28 bp, Artificial Sequence
  Description of Artificial Sequence: Synthetic oligonucleotide
cagatatctagggccaccctcaggaagg

SEQ ID NO: 85423 - DNA, 28 bp, Artificial Sequence
  Description of Artificial Sequence: Synthetic oligonucleotide
agatatctagggccaccctcaggaaggg

SEQ ID NO: 85424 - DNA, 27 bp, Artificial Sequence
  Description of Artificial Sequence: Synthetic oligonucleotide
gatatctagggccaccctcaggaaggg

SEQ ID NO: 85425 - DNA, 28 bp, Artificial Sequence
  Description of Artificial Sequence: Synthetic oligonucleotide
atatctagggccaccctcaggaagggag

SEQ ID NO: 85426 - DNA, 27 bp, Artificial Sequence
  Description of Artificial Sequence: Synthetic oligonucleotide
tatctagggccaccctcaggaagggag

SEQ ID NO: 85427 - DNA, 26 bp, Artificial Sequence
  Description of Artificial Sequence: Synthetic oligonucleotide
atctagggccaccctcaggaagggag

SEQ ID NO: 85428 - DNA, 25 bp, Artificial Sequence
  Description of Artificial Sequence: Synthetic oligonucleotide
tctagggccaccctcaggaagggag

SEQ ID NO: 85429 - DNA, 24 bp, Artificial Sequence
  Description of Artificial Sequence: Synthetic oligonucleotide
ctagggccaccctcaggaagggag

SEQ ID NO: 85430 - DNA, 25 bp, Artificial Sequence
  Description of Artificial Sequence: Synthetic oligonucleotide
tagggccaccctcaggaagggagct

SEQ ID NO: 85431 - DNA, 24 bp, Artificial Sequence
  Description of Artificial Sequence: Synthetic oligonucleotide
agggccaccctcaggaagggagct

SEQ ID NO: 85432 - DNA, 23 bp, Artificial Sequence
  Description of Artificial Sequence: Synthetic oligonucleotide
gggccaccctcaggaagggagct

SEQ ID NO: 85433 - DNA, 23 bp, Artificial Sequence
  Description of Artificial Sequence: Synthetic oligonucleotide
ggccaccctcaggaagggagctg

SEQ ID NO: 85434 - DNA, 24 bp, Artificial Sequence
  Description of Artificial Sequence: Synthetic oligonucleotide
gccaccctcaggaagggagctgga

SEQ ID NO: 85435 - DNA, 25 bp, Artificial Sequence
  Description of Artificial Sequence: Synthetic oligonucleotide
ccaccctcaggaagggagctggaga

SEQ ID NO: 85436 - DNA, 26 bp, Artificial Sequence
  Description of Artificial Sequence: Synthetic oligonucleotide
caccctcaggaagggagctggagaga

SEQ ID NO: 85437 - DNA, 26 bp, Artificial Sequence
  Description of Artificial Sequence: Synthetic oligonucleotide
accctcaggaagggagctggagagag

SEQ ID NO: 85438 - DNA, 25 bp, Artificial Sequence
  Description of Artificial Sequence: Synthetic oligonucleotide
ccctcaggaagggagctggagagag

SEQ ID NO: 85439 - DNA, 25 bp, Artificial Sequence
  Description of Artificial Sequence: Synthetic oligonucleotide
cctcaggaagggagctggagagagg

SEQ ID NO: 85440 - DNA, 27 bp, Artificial Sequence
  Description of Artificial Sequence: Synthetic oligonucleotide
ctcaggaagggagctggagagaggcta

SEQ ID NO: 85441 - DNA, 28 bp, Artificial Sequence
  Description of Artificial Sequence: Synthetic oligonucleotide
tcaggaagggagctggagagaggctatc

SEQ ID NO: 85442 - DNA, 27 bp, Artificial Sequence
  Description of Artificial Sequence: Synthetic oligonucleotide
caggaagggagctggagagaggctatc

SEQ ID NO: 85443 - DNA, 27 bp, Artificial Sequence
  Description of Artificial Sequence: Synthetic oligonucleotide
aggaagggagctggagagaggctatcg

SEQ ID NO: 85444 - DNA, 26 bp, Artificial Sequence
  Description of Artificial Sequence: Synthetic oligonucleotide
ggaagggagctggagagaggctatcg

SEQ ID NO: 85445 - DNA, 27 bp, Artificial Sequence
  Description of Artificial Sequence: Synthetic oligonucleotide
gaagggagctggagagaggctatcgga

SEQ ID NO: 85446 - DNA, 28 bp, Artificial Sequence
  Description of Artificial Sequence: Synthetic oligonucleotide
aagggagctggagagaggctatcggaag

SEQ ID NO: 85447 - DNA, 27 bp, Artificial Sequence
  Description of Artificial Sequence: Synthetic oligonucleotide
agggagctggagagaggctatcggaag

SEQ ID NO: 85448 - DNA, 27 bp, Artificial Sequence
  Description of Artificial Sequence: Synthetic oligonucleotide
gggagctggagagaggctatcggaaga

SEQ ID NO: 85449 - DNA, 28 bp, Artificial Sequence
  Description of Artificial Sequence: Synthetic oligonucleotide
ggagctggagagaggctatcggaagaac

SEQ ID NO: 85450 - DNA, 28 bp, Artificial Sequence
  Description of Artificial Sequence: Synthetic oligonucleotide
gagctggagagaggctatcggaagaacc

SEQ ID NO: 85451 - DNA, 28 bp, Artificial Sequence
  Description of Artificial Sequence: Synthetic oligonucleotide
agctggagagaggctatcggaagaaccc

SEQ ID NO: 85452 - DNA, 27 bp, Artificial Sequence
  Description of Artificial Sequence: Synthetic oligonucleotide
gctggagagaggctatcggaagaaccc

SEQ ID NO: 85453 - DNA, 27 bp, Artificial Sequence
  Description of Artificial Sequence: Synthetic oligonucleotide
ctggagagaggctatcggaagaacccc

SEQ ID NO: 85454 - DNA, 28 bp, Artificial Sequence
  Description of Artificial Sequence: Synthetic oligonucleotide
tggagagaggctatcggaagaacccctg

SEQ ID NO: 85455 - DNA, 27 bp, Artificial Sequence
  Description of Artificial Sequence: Synthetic oligonucleotide
ggagagaggctatcggaagaacccctg

SEQ ID NO: 85456 - DNA, 27 bp, Artificial Sequence
  Description of Artificial Sequence: Synthetic oligonucleotide
gagagaggctatcggaagaacccctgc

SEQ ID NO: 85457 - DNA, 28 bp, Artificial Sequence
  Description of Artificial Sequence: Synthetic oligonucleotide
agagaggctatcggaagaacccctgcag

SEQ ID NO: 85458 - DNA, 27 bp, Artificial Sequence
  Description of Artificial Sequence: Synthetic oligonucleotide
gagaggctatcggaagaacccctgcag

SEQ ID NO: 85459 - DNA, 27 bp, Artificial Sequence
  Description of Artificial Sequence: Synthetic oligonucleotide
agaggctatcggaagaacccctgcagg

SEQ ID NO: 85460 - DNA, 27 bp, Artificial Sequence
  Description of Artificial Sequence: Synthetic oligonucleotide
gaggctatcggaagaacccctgcaggt

SEQ ID NO: 85461 - DNA, 27 bp, Artificial Sequence
  Description of Artificial Sequence: Synthetic oligonucleotide
aggctatcggaagaacccctgcaggtc

SEQ ID NO: 85462 - DNA, 26 bp, Artificial Sequence
  Description of Artificial Sequence: Synthetic oligonucleotide
ggctatcggaagaacccctgcaggtc

SEQ ID NO: 85463 - DNA, 27 bp, Artificial Sequence
  Description of Artificial Sequence: Synthetic oligonucleotide
gctatcggaagaacccctgcaggtcct

SEQ ID NO: 85464 - DNA, 27 bp, Artificial Sequence
  Description of Artificial Sequence: Synthetic oligonucleotide
ctatcggaagaacccctgcaggtcctg

SEQ ID NO: 85465 - DNA, 27 bp, Artificial Sequence
  Description of Artificial Sequence: Synthetic oligonucleotide
tatcggaagaacccctgcaggtcctgg

SEQ ID NO: 85466 - DNA, 27 bp, Artificial Sequence
  Description of Artificial Sequence: Synthetic oligonucleotide
atcggaagaacccctgcaggtcctgga

SEQ ID NO: 85467 - DNA, 27 bp, Artificial Sequence
  Description of Artificial Sequence: Synthetic oligonucleotide
tcggaagaacccctgcaggtcctggaa

SEQ ID NO: 85468 - DNA, 26 bp, Artificial Sequence
  Description of Artificial Sequence: Synthetic oligonucleotide
cggaagaacccctgcaggtcctggaa

SEQ ID NO: 85469 - DNA, 27 bp, Artificial Sequence
  Description of Artificial Sequence: Synthetic oligonucleotide
ggaagaacccctgcaggtcctggaaca

SEQ ID NO: 85470 - DNA, 27 bp, Artificial Sequence
  Description of Artificial Sequence: Synthetic oligonucleotide
gaagaacccctgcaggtcctggaacac

SEQ ID NO: 85471 - DNA, 27 bp, Artificial Sequence
  Description of Artificial Sequence: Synthetic oligonucleotide
aagaacccctgcaggtcctggaacacc

SEQ ID NO: 85472 - DNA, 26 bp, Artificial Sequence
  Description of Artificial Sequence: Synthetic oligonucleotide
agaacccctgcaggtcctggaacacc

SEQ ID NO: 85473 - DNA, 25 bp, Artificial Sequence
  Description of Artificial Sequence: Synthetic oligonucleotide
gaacccctgcaggtcctggaacacc

SEQ ID NO: 85474 - DNA, 25 bp, Artificial Sequence
  Description of Artificial Sequence: Synthetic oligonucleotide
aacccctgcaggtcctggaacaccc

SEQ ID NO: 85475 - DNA, 24 bp, Artificial Sequence
  Description of Artificial Sequence: Synthetic oligonucleotide
acccctgcaggtcctggaacaccc

SEQ ID NO: 85476 - DNA, 23 bp, Artificial Sequence
  Description of Artificial Sequence: Synthetic oligonucleotide
cccctgcaggtcctggaacaccc

SEQ ID NO: 85477 - DNA, 23 bp, Artificial Sequence
  Description of Artificial Sequence: Synthetic oligonucleotide
ccctgcaggtcctggaacacccc

SEQ ID NO: 85478 - DNA, 23 bp, Artificial Sequence
  Description of Artificial Sequence: Synthetic oligonucleotide
cctgcaggtcctggaacaccccc

SEQ ID NO: 85479 - DNA, 24 bp, Artificial Sequence
  Description of Artificial Sequence: Synthetic oligonucleotide
ctgcaggtcctggaacacccccgt

SEQ ID NO: 85480 - DNA, 25 bp, Artificial Sequence
  Description of Artificial Sequence: Synthetic oligonucleotide
tgcaggtcctggaacacccccgtca

SEQ ID NO: 85481 - DNA, 24 bp, Artificial Sequence
  Description of Artificial Sequence: Synthetic oligonucleotide
gcaggtcctggaacacccccgtca

SEQ ID NO: 85482 - DNA, 24 bp, Artificial Sequence
  Description of Artificial Sequence: Synthetic oligonucleotide
caggtcctggaacacccccgtcag

SEQ ID NO: 85483 - DNA, 25 bp, Artificial Sequence
  Description of Artificial Sequence: Synthetic oligonucleotide
aggtcctggaacacccccgtcagga

SEQ ID NO: 85484 - DNA, 24 bp, Artificial Sequence
  Description of Artificial Sequence: Synthetic oligonucleotide
ggtcctggaacacccccgtcagga

SEQ ID NO: 85485 - DNA, 24 bp, Artificial Sequence
  Description of Artificial Sequence: Synthetic oligonucleotide
gtcctggaacacccccgtcaggag

SEQ ID NO: 85486 - DNA, 27 bp, Artificial Sequence
  Description of Artificial Sequence: Synthetic oligonucleotide
tcctggaacacccccgtcaggagcaaa

SEQ ID NO: 85487 - DNA, 27 bp, Artificial Sequence
  Description of Artificial Sequence: Synthetic oligonucleotide
cctggaacacccccgtcaggagcaaat

SEQ ID NO: 85488 - DNA, 28 bp, Artificial Sequence
  Description of Artificial Sequence: Synthetic oligonucleotide
ctggaacacccccgtcaggagcaaattg

SEQ ID NO: 85489 - DNA, 28 bp, Artificial Sequence
  Description of Artificial Sequence: Synthetic oligonucleotide
tggaacacccccgtcaggagcaaattgc

SEQ ID NO: 85490 - DNA, 27 bp, Artificial Sequence
  Description of Artificial Sequence: Synthetic oligonucleotide
ggaacacccccgtcaggagcaaattgc

SEQ ID NO: 85491 - DNA, 28 bp, Artificial Sequence
  Description of Artificial Sequence: Synthetic oligonucleotide
gaacacccccgtcaggagcaaattgcac

SEQ ID NO: 85492 - DNA, 29 bp, Artificial Sequence
  Description of Artificial Sequence: Synthetic oligonucleotide
aacacccccgtcaggagcaaattgcactg

SEQ ID NO: 85493 - DNA, 28 bp, Artificial Sequence
  Description of Artificial Sequence: Synthetic oligonucleotide
acacccccgtcaggagcaaattgcactg

SEQ ID NO: 85494 - DNA, 27 bp, Artificial Sequence
  Description of Artificial Sequence: Synthetic oligonucleotide
cacccccgtcaggagcaaattgcactg

SEQ ID NO: 85495 - DNA, 27 bp, Artificial Sequence
  Description of Artificial Sequence: Synthetic oligonucleotide
acccccgtcaggagcaaattgcactgc

SEQ ID NO: 85496 - DNA, 27 bp, Artificial Sequence
  Description of Artificial Sequence: Synthetic oligonucleotide
cccccgtcaggagcaaattgcactgct

SEQ ID NO: 85497 - DNA, 27 bp, Artificial Sequence
  Description of Artificial Sequence: Synthetic oligonucleotide
ccccgtcaggagcaaattgcactgctg

SEQ ID NO: 85498 - DNA, 27 bp, Artificial Sequence
  Description of Artificial Sequence: Synthetic oligonucleotide
cccgtcaggagcaaattgcactgctgg

SEQ ID NO: 85499 - DNA, 27 bp, Artificial Sequence
  Description of Artificial Sequence: Synthetic oligonucleotide
ccgtcaggagcaaattgcactgctggc

SEQ ID NO: 85500 - DNA, 28 bp, Artificial Sequence
  Description of Artificial Sequence: Synthetic oligonucleotide
cgtcaggagcaaattgcactgctggctc

SEQ ID NO: 85501 - DNA, 28 bp, Artificial Sequence
  Description of Artificial Sequence: Synthetic oligonucleotide
gtcaggagcaaattgcactgctggctcc

SEQ ID NO: 85502 - DNA, 28 bp, Artificial Sequence
  Description of Artificial Sequence: Synthetic oligonucleotide
tcaggagcaaattgcactgctggctccc

SEQ ID NO: 85503 - DNA, 27 bp, Artificial Sequence
  Description of Artificial Sequence: Synthetic oligonucleotide
caggagcaaattgcactgctggctccc

SEQ ID NO: 85504 - DNA, 27 bp, Artificial Sequence
  Description of Artificial Sequence: Synthetic oligonucleotide
aggagcaaattgcactgctggctcccg

SEQ ID NO: 85505 - DNA, 27 bp, Artificial Sequence
  Description of Artificial Sequence: Synthetic oligonucleotide
ggagcaaattgcactgctggctcccga

SEQ ID NO: 85506 - DNA, 27 bp, Artificial Sequence
  Description of Artificial Sequence: Synthetic oligonucleotide
gagcaaattgcactgctggctcccgag

SEQ ID NO: 85507 - DNA, 27 bp, Artificial Sequence
  Description of Artificial Sequence: Synthetic oligonucleotide
agcaaattgcactgctggctcccgagc

SEQ ID NO: 85508 - DNA, 26 bp, Artificial Sequence
  Description of Artificial Sequence: Synthetic oligonucleotide
gcaaattgcactgctggctcccgagc

SEQ ID NO: 85509 - DNA, 26 bp, Artificial Sequence
  Description of Artificial Sequence: Synthetic oligonucleotide
caaattgcactgctggctcccgagcc

SEQ ID NO: 85510 - DNA, 26 bp, Artificial Sequence
  Description of Artificial Sequence: Synthetic oligonucleotide
aaattgcactgctggctcccgagccc

SEQ ID NO: 85511 - DNA, 25 bp, Artificial Sequence
  Description of Artificial Sequence: Synthetic oligonucleotide
aattgcactgctggctcccgagccc

SEQ ID NO: 85512 - DNA, 24 bp, Artificial Sequence
  Description of Artificial Sequence: Synthetic oligonucleotide
attgcactgctggctcccgagccc

SEQ ID NO: 85513 - DNA, 23 bp, Artificial Sequence
  Description of Artificial Sequence: Synthetic oligonucleotide
ttgcactgctggctcccgagccc

SEQ ID NO: 85514 - DNA, 22 bp, Artificial Sequence
  Description of Artificial Sequence: Synthetic oligonucleotide
tgcactgctggctcccgagccc

SEQ ID NO: 85515 - DNA, 21 bp, Artificial Sequence
  Description of Artificial Sequence: Synthetic oligonucleotide
gcactgctggctcccgagccc

SEQ ID NO: 85516 - DNA, 22 bp, Artificial Sequence
  Description of Artificial Sequence: Synthetic oligonucleotide
cactgctggctcccgagcccct

SEQ ID NO: 85517 - DNA, 22 bp, Artificial Sequence
  Description of Artificial Sequence: Synthetic oligonucleotide
actgctggctcccgagcccctc

SEQ ID NO: 85518 - DNA, 21 bp, Artificial Sequence
  Description of Artificial Sequence: Synthetic oligonucleotide
ctgctggctcccgagcccctc

SEQ ID NO: 85519 - DNA, 23 bp, Artificial Sequence
  Description of Artificial Sequence: Synthetic oligonucleotide
tgctggctcccgagcccctcctt

SEQ ID NO: 85520 - DNA, 22 bp, Artificial Sequence
  Description of Artificial Sequence: Synthetic oligonucleotide
gctggctcccgagcccctcctt

SEQ ID NO: 85521 - DNA, 23 bp, Artificial Sequence
  Description of Artificial Sequence: Synthetic oligonucleotide
ctggctcccgagcccctccttgt

SEQ ID NO: 85522 - DNA, 23 bp, Artificial Sequence
  Description of Artificial Sequence: Synthetic oligonucleotide
tggctcccgagcccctccttgtc

SEQ ID NO: 85523 - DNA, 22 bp, Artificial Sequence
  Description of Artificial Sequence: Synthetic oligonucleotide
ggctcccgagcccctccttgtc

SEQ ID NO: 85524 - DNA, 22 bp, Artificial Sequence
  Description of Artificial Sequence: Synthetic oligonucleotide
gctcccgagcccctccttgtcg

SEQ ID NO: 85525 - DNA, 22 bp, Artificial Sequence
  Description of Artificial Sequence: Synthetic oligonucleotide
ctcccgagcccctccttgtcgg

SEQ ID NO: 85526 - DNA, 22 bp, Artificial Sequence
  Description of Artificial Sequence: Synthetic oligonucleotide
tcccgagcccctccttgtcggg

SEQ ID NO: 85527 - DNA, 21 bp, Artificial Sequence
  Description of Artificial Sequence: Synthetic oligonucleotide
cccgagcccctccttgtcggg

SEQ ID NO: 85528 - DNA, 22 bp, Artificial Sequence
  Description of Artificial Sequence: Synthetic oligonucleotide
ccgagcccctccttgtcgggct

SEQ ID NO: 85529 - DNA, 22 bp, Artificial Sequence
  Description of Artificial Sequence: Synthetic oligonucleotide
cgagcccctccttgtcgggctc

SEQ ID NO: 85530 - DNA, 22 bp, Artificial Sequence
  Description of Artificial Sequence: Synthetic oligonucleotide
gagcccctccttgtcgggctcc

SEQ ID NO: 85531 - DNA, 22 bp, Artificial Sequence
  Description of Artificial Sequence: Synthetic oligonucleotide
agcccctccttgtcgggctccc

SEQ ID NO: 85532 - DNA, 21 bp, Artificial Sequence
  Description of Artificial Sequence: Synthetic oligonucleotide
gcccctccttgtcgggctccc

SEQ ID NO: 85533 - DNA, 23 bp, Artificial Sequence
  Description of Artificial Sequence: Synthetic oligonucleotide
cccctccttgtcgggctcccgta

SEQ ID NO: 85534 - DNA, 24 bp, Artificial Sequence
  Description of Artificial Sequence: Synthetic oligonucleotide
ccctccttgtcgggctcccgtaca

SEQ ID NO: 85535 - DNA, 25 bp, Artificial Sequence
  Description of Artificial Sequence: Synthetic oligonucleotide
cctccttgtcgggctcccgtacaca

SEQ ID NO: 85536 - DNA, 27 bp, Artificial Sequence
  Description of Artificial Sequence: Synthetic oligonucleotide
ctccttgtcgggctcccgtacacagtt

SEQ ID NO: 85537 - DNA, 27 bp, Artificial Sequence
  Description of Artificial Sequence: Synthetic oligonucleotide
tccttgtcgggctcccgtacacagttg

SEQ ID NO: 85538 - DNA, 27 bp, Artificial Sequence
  Description of Artificial Sequence: Synthetic oligonucleotide
ccttgtcgggctcccgtacacagttgt

SEQ ID NO: 85539 - DNA, 27 bp, Artificial Sequence
  Description of Artificial Sequence: Synthetic oligonucleotide
cttgtcgggctcccgtacacagttgtc

SEQ ID NO: 85540 - DNA, 30 bp, Artificial Sequence
  Description of Artificial Sequence: Synthetic oligonucleotide
ttgtcgggctcccgtacacagttgtcattc

SEQ ID NO: 85541 - DNA, 29 bp, Artificial Sequence
  Description of Artificial Sequence: Synthetic oligonucleotide
tgtcgggctcccgtacacagttgtcattc

SEQ ID NO: 85542 - DNA, 28 bp, Artificial Sequence
  Description of Artificial Sequence: Synthetic oligonucleotide
gtcgggctcccgtacacagttgtcattc

SEQ ID NO: 85543 - DNA, 29 bp, Artificial Sequence
  Description of Artificial Sequence: Synthetic oligonucleotide
tcgggctcccgtacacagttgtcattcac

SEQ ID NO: 85544 - DNA, 28 bp, Artificial Sequence
  Description of Artificial Sequence: Synthetic oligonucleotide
cgggctcccgtacacagttgtcattcac

SEQ ID NO: 85545 - DNA, 31 bp, Artificial Sequence
  Description of Artificial Sequence: Synthetic oligonucleotide
gggctcccgtacacagttgtcattcactatg

SEQ ID NO: 85546 - DNA, 31 bp, Artificial Sequence
  Description of Artificial Sequence: Synthetic oligonucleotide
ggctcccgtacacagttgtcattcactatgc

SEQ ID NO: 85547 - DNA, 32 bp, Artificial Sequence
  Description of Artificial Sequence: Synthetic oligonucleotide
gctcccgtacacagttgtcattcactatgctg

SEQ ID NO: 85548 - DNA, 32 bp, Artificial Sequence
  Description of Artificial Sequence: Synthetic oligonucleotide
ctcccgtacacagttgtcattcactatgctgg

SEQ ID NO: 85549 - DNA, 32 bp, Artificial Sequence
  Description of Artificial Sequence: Synthetic oligonucleotide
tcccgtacacagttgtcattcactatgctggc

SEQ ID NO: 85550 - DNA, 31 bp, Artificial Sequence
  Description of Artificial Sequence: Synthetic oligonucleotide
cccgtacacagttgtcattcactatgctggc

SEQ ID NO: 85551 - DNA, 34 bp, Artificial Sequence
  Description of Artificial Sequence: Synthetic oligonucleotide
ccgtacacagttgtcattcactatgctggcaatc

SEQ ID NO: 85552 - DNA, 37 bp, Artificial Sequence
  Description of Artificial Sequence: Synthetic oligonucleotide
cgtacacagttgtcattcactatgctggcaatctttc

SEQ ID NO: 85553 - DNA, 37 bp, Artificial Sequence
  Description of Artificial Sequence: Synthetic oligonucleotide
gtacacagttgtcattcactatgctggcaatctttcg

SEQ ID NO: 85554 - DNA, 37 bp, Artificial Sequence
  Description of Artificial Sequence: Synthetic oligonucleotide
tacacagttgtcattcactatgctggcaatctttcgg

SEQ ID NO: 85555 - DNA, 36 bp, Artificial Sequence
  Description of Artificial Sequence: Synthetic oligonucleotide
acacagttgtcattcactatgctggcaatctttcgg

SEQ ID NO: 85556 - DNA, 35 bp, Artificial Sequence
  Description of Artificial Sequence: Synthetic oligonucleotide
cacagttgtcattcactatgctggcaatctttcgg

SEQ ID NO: 85557 - DNA, 36 bp, Artificial Sequence
  Description of Artificial Sequence: Synthetic oligonucleotide
acagttgtcattcactatgctggcaatctttcggag

SEQ ID NO: 85558 - DNA, 35 bp, Artificial Sequence
  Description of Artificial Sequence: Synthetic oligonucleotide
cagttgtcattcactatgctggcaatctttcggag

SEQ ID NO: 85559 - DNA, 36 bp, Artificial Sequence
  Description of Artificial Sequence: Synthetic oligonucleotide
agttgtcattcactatgctggcaatctttcggagac

SEQ ID NO: 85560 - DNA, 35 bp, Artificial Sequence
  Description of Artificial Sequence: Synthetic oligonucleotide
gttgtcattcactatgctggcaatctttcggagac

SEQ ID NO: 85561 - DNA, 38 bp, Artificial Sequence
  Description of Artificial Sequence: Synthetic oligonucleotide
ttgtcattcactatgctggcaatctttcggagactttc

SEQ ID NO: 85562 - DNA, 37 bp, Artificial Sequence
  Description of Artificial Sequence: Synthetic oligonucleotide
tgtcattcactatgctggcaatctttcggagactttc

SEQ ID NO: 85563 - DNA, 36 bp, Artificial Sequence
  Description of Artificial Sequence: Synthetic oligonucleotide
gtcattcactatgctggcaatctttcggagactttc

SEQ ID NO: 85564 - DNA, 36 bp, Artificial Sequence
  Description of Artificial Sequence: Synthetic oligonucleotide
tcattcactatgctggcaatctttcggagactttcc

SEQ ID NO: 85565 - DNA, 35 bp, Artificial Sequence
  Description of Artificial Sequence: Synthetic oligonucleotide
cattcactatgctggcaatctttcggagactttcc

SEQ ID NO: 85566 - DNA, 36 bp, Artificial Sequence
  Description of Artificial Sequence: Synthetic oligonucleotide
attcactatgctggcaatctttcggagactttccac

SEQ ID NO: 85567 - DNA, 35 bp, Artificial Sequence
  Description of Artificial Sequence: Synthetic oligonucleotide
ttcactatgctggcaatctttcggagactttccac

SEQ ID NO: 85568 - DNA, 34 bp, Artificial Sequence
  Description of Artificial Sequence: Synthetic oligonucleotide
tcactatgctggcaatctttcggagactttccac

SEQ ID NO: 85569 - DNA, 33 bp, Artificial Sequence
  Description of Artificial Sequence: Synthetic oligonucleotide
cactatgctggcaatctttcggagactttccac

SEQ ID NO: 85570 - DNA, 33 bp, Artificial Sequence
  Description of Artificial Sequence: Synthetic oligonucleotide
actatgctggcaatctttcggagactttccacg

SEQ ID NO: 85571 - DNA, 32 bp, Artificial Sequence
  Description of Artificial Sequence: Synthetic oligonucleotide
ctatgctggcaatctttcggagactttccacg

SEQ ID NO: 85572 - DNA, 32 bp, Artificial Sequence
  Description of Artificial Sequence: Synthetic oligonucleotide
tatgctggcaatctttcggagactttccacgg

SEQ ID NO: 85573 - DNA, 31 bp, Artificial Sequence
  Description of Artificial Sequence: Synthetic oligonucleotide
atgctggcaatctttcggagactttccacgg

SEQ ID NO: 85574 - DNA, 30 bp, Artificial Sequence
  Description of Artificial Sequence: Synthetic oligonucleotide
tgctggcaatctttcggagactttccacgg

SEQ ID NO: 85575 - DNA, 29 bp, Artificial Sequence
  Description of Artificial Sequence: Synthetic oligonucleotide
gctggcaatctttcggagactttccacgg

SEQ ID NO: 85576 - DNA, 35 bp, Artificial Sequence
  Description of Artificial Sequence: Synthetic oligonucleotide
ctggcaatctttcggagactttccacggattttac

SEQ ID NO: 85577 - DNA, 39 bp, Artificial Sequence
  Description of Artificial Sequence: Synthetic oligonucleotide
tggcaatctttcggagactttccacggattttacaaaag

SEQ ID NO: 85578 - DNA, 38 bp, Artificial Sequence
  Description of Artificial Sequence: Synthetic oligonucleotide
ggcaatctttcggagactttccacggattttacaaaag

SEQ ID NO: 85579 - DNA, 38 bp, Artificial Sequence
  Description of Artificial Sequence: Synthetic oligonucleotide
gcaatctttcggagactttccacggattttacaaaagc

SEQ ID NO: 85580 - DNA, 39 bp, Artificial Sequence
  Description of Artificial Sequence: Synthetic oligonucleotide
caatctttcggagactttccacggattttacaaaagcac

SEQ ID NO: 85581 - DNA, 39 bp, Artificial Sequence
  Description of Artificial Sequence: Synthetic oligonucleotide
aatctttcggagactttccacggattttacaaaagcacc

SEQ ID NO: 85582 - DNA, 38 bp, Artificial Sequence
  Description of Artificial Sequence: Synthetic oligonucleotide
atctttcggagactttccacggattttacaaaagcacc

SEQ ID NO: 85583 - DNA, 37 bp, Artificial Sequence
  Description of Artificial Sequence: Synthetic oligonucleotide
tctttcggagactttccacggattttacaaaagcacc

SEQ ID NO: 85584 - DNA, 36 bp, Artificial Sequence
  Description of Artificial Sequence: Synthetic oligonucleotide
ctttcggagactttccacggattttacaaaagcacc

SEQ ID NO: 85585 - DNA, 38 bp, Artificial Sequence
  Description of Artificial Sequence: Synthetic oligonucleotide
tttcggagactttccacggattttacaaaagcacctac

SEQ ID NO: 85586 - DNA, 37 bp, Artificial Sequence
  Description of Artificial Sequence: Synthetic oligonucleotide
ttcggagactttccacggattttacaaaagcacctac

SEQ ID NO: 85587 - DNA, 36 bp, Artificial Sequence
  Description of Artificial Sequence: Synthetic oligonucleotide
tcggagactttccacggattttacaaaagcacctac

SEQ ID NO: 85588 - DNA, 35 bp, Artificial Sequence
  Description of Artificial Sequence: Synthetic oligonucleotide
cggagactttccacggattttacaaaagcacctac

SEQ ID NO: 85589 - DNA, 36 bp, Artificial Sequence
  Description of Artificial Sequence: Synthetic oligonucleotide
ggagactttccacggattttacaaaagcacctacag

SEQ ID NO: 85590 - DNA, 38 bp, Artificial Sequence
  Description of Artificial Sequence: Synthetic oligonucleotide
gagactttccacggattttacaaaagcacctacagaac

SEQ ID NO: 85591 - DNA, 38 bp, Artificial Sequence
  Description of Artificial Sequence: Synthetic oligonucleotide
agactttccacggattttacaaaagcacctacagaacc

SEQ ID NO: 85592 - DNA, 37 bp, Artificial Sequence
  Description of Artificial Sequence: Synthetic oligonucleotide
gactttccacggattttacaaaagcacctacagaacc

SEQ ID NO: 85593 - DNA, 39 bp, Artificial Sequence
  Description of Artificial Sequence: Synthetic oligonucleotide
actttccacggattttacaaaagcacctacagaaccaag

SEQ ID NO: 85594 - DNA, 38 bp, Artificial Sequence
  Description of Artificial Sequence: Synthetic oligonucleotide
ctttccacggattttacaaaagcacctacagaaccaag

SEQ ID NO: 85595 - DNA, 38 bp, Artificial Sequence
  Description of Artificial Sequence: Synthetic oligonucleotide
tttccacggattttacaaaagcacctacagaaccaagg

SEQ ID NO: 85596 - DNA, 37 bp, Artificial Sequence
  Description of Artificial Sequence: Synthetic oligonucleotide
ttccacggattttacaaaagcacctacagaaccaagg

SEQ ID NO: 85597 - DNA, 36 bp, Artificial Sequence
  Description of Artificial Sequence: Synthetic oligonucleotide
tccacggattttacaaaagcacctacagaaccaagg

SEQ ID NO: 85598 - DNA, 35 bp, Artificial Sequence
  Description of Artificial Sequence: Synthetic oligonucleotide
ccacggattttacaaaagcacctacagaaccaagg

SEQ ID NO: 85599 - DNA, 37 bp, Artificial Sequence
  Description of Artificial Sequence: Synthetic oligonucleotide
cacggattttacaaaagcacctacagaaccaaggaag

SEQ ID NO: 85600 - DNA, 37 bp, Artificial Sequence
  Description of Artificial Sequence: Synthetic oligonucleotide
acggattttacaaaagcacctacagaaccaaggaagg

SEQ ID NO: 85601 - DNA, 36 bp, Artificial Sequence
  Description of Artificial Sequence: Synthetic oligonucleotide
cggattttacaaaagcacctacagaaccaaggaagg

SEQ ID NO: 85602 - DNA, 36 bp, Artificial Sequence
  Description of Artificial Sequence: Synthetic oligonucleotide
ggattttacaaaagcacctacagaaccaaggaaggg

SEQ ID NO: 85603 - DNA, 36 bp, Artificial Sequence
  Description of Artificial Sequence: Synthetic oligonucleotide
gattttacaaaagcacctacagaaccaaggaagggg

SEQ ID NO: 85604 - DNA, 38 bp, Artificial Sequence
  Description of Artificial Sequence: Synthetic oligonucleotide
attttacaaaagcacctacagaaccaaggaaggggaac

SEQ ID NO: 85605 - DNA, 37 bp, Artificial Sequence
  Description of Artificial Sequence: Synthetic oligonucleotide
ttttacaaaagcacctacagaaccaaggaaggggaac

SEQ ID NO: 85606 - DNA, 36 bp, Artificial Sequence
  Description of Artificial Sequence: Synthetic oligonucleotide
tttacaaaagcacctacagaaccaaggaaggggaac

SEQ ID NO: 85607 - DNA, 35 bp, Artificial Sequence
  Description of Artificial Sequence: Synthetic oligonucleotide
ttacaaaagcacctacagaaccaaggaaggggaac

SEQ ID NO: 85608 - DNA, 34 bp, Artificial Sequence
  Description of Artificial Sequence: Synthetic oligonucleotide
tacaaaagcacctacagaaccaaggaaggggaac

SEQ ID NO: 85609 - DNA, 33 bp, Artificial Sequence
  Description of Artificial Sequence: Synthetic oligonucleotide
acaaaagcacctacagaaccaaggaaggggaac

SEQ ID NO: 85610 - DNA, 32 bp, Artificial Sequence
  Description of Artificial Sequence: Synthetic oligonucleotide
caaaagcacctacagaaccaaggaaggggaac

SEQ ID NO: 85611 - DNA, 33 bp, Artificial Sequence
  Description of Artificial Sequence: Synthetic oligonucleotide
aaaagcacctacagaaccaaggaaggggaactg

SEQ ID NO: 85612 - DNA, 32 bp, Artificial Sequence
  Description of Artificial Sequence: Synthetic oligonucleotide
aaagcacctacagaaccaaggaaggggaactg

SEQ ID NO: 85613 - DNA, 31 bp, Artificial Sequence
  Description of Artificial Sequence: Synthetic oligonucleotide
aagcacctacagaaccaaggaaggggaactg

SEQ ID NO: 85614 - DNA, 30 bp, Artificial Sequence
  Description of Artificial Sequence: Synthetic oligonucleotide
agcacctacagaaccaaggaaggggaactg

SEQ ID NO: 85615 - DNA, 29 bp, Artificial Sequence
  Description of Artificial Sequence: Synthetic oligonucleotide
gcacctacagaaccaaggaaggggaactg

SEQ ID NO: 85616 - DNA, 30 bp, Artificial Sequence
  Description of Artificial Sequence: Synthetic oligonucleotide
cacctacagaaccaaggaaggggaactgag

SEQ ID NO: 85617 - DNA, 30 bp, Artificial Sequence
  Description of Artificial Sequence: Synthetic oligonucleotide
acctacagaaccaaggaaggggaactgagg

SEQ ID NO: 85618 - DNA, 29 bp, Artificial Sequence
  Description of Artificial Sequence: Synthetic oligonucleotide
cctacagaaccaaggaaggggaactgagg

SEQ ID NO: 85619 - DNA, 32 bp, Artificial Sequence
  Description of Artificial Sequence: Synthetic oligonucleotide
ctacagaaccaaggaaggggaactgaggatac

SEQ ID NO: 85620 - DNA, 34 bp, Artificial Sequence
  Description of Artificial Sequence: Synthetic oligonucleotide
tacagaaccaaggaaggggaactgaggatactag

SEQ ID NO: 85621 - DNA, 33 bp, Artificial Sequence
  Description of Artificial Sequence: Synthetic oligonucleotide
acagaaccaaggaaggggaactgaggatactag

SEQ ID NO: 85622 - DNA, 32 bp, Artificial Sequence
  Description of Artificial Sequence: Synthetic oligonucleotide
cagaaccaaggaaggggaactgaggatactag

SEQ ID NO: 85623 - DNA, 32 bp, Artificial Sequence
  Description of Artificial Sequence: Synthetic oligonucleotide
agaaccaaggaaggggaactgaggatactagc

SEQ ID NO: 85624 - DNA, 31 bp, Artificial Sequence
  Description of Artificial Sequence: Synthetic oligonucleotide
gaaccaaggaaggggaactgaggatactagc

SEQ ID NO: 85625 - DNA, 33 bp, Artificial Sequence
  Description of Artificial Sequence: Synthetic oligonucleotide
aaccaaggaaggggaactgaggatactagcatc

SEQ ID NO: 85626 - DNA, 32 bp, Artificial Sequence
  Description of Artificial Sequence: Synthetic oligonucleotide
accaaggaaggggaactgaggatactagcatc

SEQ ID NO: 85627 - DNA, 31 bp, Artificial Sequence
  Description of Artificial Sequence: Synthetic oligonucleotide
ccaaggaaggggaactgaggatactagcatc

SEQ ID NO: 85628 - DNA, 33 bp, Artificial Sequence
  Description of Artificial Sequence: Synthetic oligonucleotide
caaggaaggggaactgaggatactagcatcaac

SEQ ID NO: 85629 - DNA, 34 bp, Artificial Sequence
  Description of Artificial Sequence: Synthetic oligonucleotide
aaggaaggggaactgaggatactagcatcaacac

SEQ ID NO: 85630 - DNA, 33 bp, Artificial Sequence
  Description of Artificial Sequence: Synthetic oligonucleotide
aggaaggggaactgaggatactagcatcaacac

SEQ ID NO: 85631 - DNA, 32 bp, Artificial Sequence
  Description of Artificial Sequence: Synthetic oligonucleotide
ggaaggggaactgaggatactagcatcaacac

SEQ ID NO: 85632 - DNA, 37 bp, Artificial Sequence
  Description of Artificial Sequence: Synthetic oligonucleotide
gaaggggaactgaggatactagcatcaacacaatttg

SEQ ID NO: 85633 - DNA, 39 bp, Artificial Sequence
  Description of Artificial Sequence: Synthetic oligonucleotide
aaggggaactgaggatactagcatcaacacaatttgaac

SEQ ID NO: 85634 - DNA, 38 bp, Artificial Sequence
  Description of Artificial Sequence: Synthetic oligonucleotide
aggggaactgaggatactagcatcaacacaatttgaac

SEQ ID NO: 85635 - DNA, 37 bp, Artificial Sequence
  Description of Artificial Sequence: Synthetic oligonucleotide
ggggaactgaggatactagcatcaacacaatttgaac

SEQ ID NO: 85636 - DNA, 37 bp, Artificial Sequence
  Description of Artificial Sequence: Synthetic oligonucleotide
gggaactgaggatactagcatcaacacaatttgaacc

SEQ ID NO: 85637 - DNA, 37 bp, Artificial Sequence
  Description of Artificial Sequence: Synthetic oligonucleotide
ggaactgaggatactagcatcaacacaatttgaaccc

SEQ ID NO: 85638 - DNA, 38 bp, Artificial Sequence
  Description of Artificial Sequence: Synthetic oligonucleotide
gaactgaggatactagcatcaacacaatttgaacccac

SEQ ID NO: 85639 - DNA, 39 bp, Artificial Sequence
  Description of Artificial Sequence: Synthetic oligonucleotide
aactgaggatactagcatcaacacaatttgaacccactg

SEQ ID NO: 85640 - DNA, 38 bp, Artificial Sequence
  Description of Artificial Sequence: Synthetic oligonucleotide
actgaggatactagcatcaacacaatttgaacccactg

SEQ ID NO: 85641 - DNA, 37 bp, Artificial Sequence
  Description of Artificial Sequence: Synthetic oligonucleotide
ctgaggatactagcatcaacacaatttgaacccactg

SEQ ID NO: 85642 - DNA, 37 bp, Artificial Sequence
  Description of Artificial Sequence: Synthetic oligonucleotide
tgaggatactagcatcaacacaatttgaacccactgc

SEQ ID NO: 85643 - DNA, 36 bp, Artificial Sequence
  Description of Artificial Sequence: Synthetic oligonucleotide
gaggatactagcatcaacacaatttgaacccactgc

SEQ ID NO: 85644 - DNA, 37 bp, Artificial Sequence
  Description of Artificial Sequence: Synthetic oligonucleotide
aggatactagcatcaacacaatttgaacccactgcag

SEQ ID NO: 85645 - DNA, 36 bp, Artificial Sequence
  Description of Artificial Sequence: Synthetic oligonucleotide
ggatactagcatcaacacaatttgaacccactgcag

SEQ ID NO: 85646 - DNA, 36 bp, Artificial Sequence
  Description of Artificial Sequence: Synthetic oligonucleotide
gatactagcatcaacacaatttgaacccactgcagc

SEQ ID NO: 85647 - DNA, 38 bp, Artificial Sequence
  Description of Artificial Sequence: Synthetic oligonucleotide
atactagcatcaacacaatttgaacccactgcagctag

SEQ ID NO: 85648 - DNA, 37 bp, Artificial Sequence
  Description of Artificial Sequence: Synthetic oligonucleotide
tactagcatcaacacaatttgaacccactgcagctag

SEQ ID NO: 85649 - DNA, 36 bp, Artificial Sequence
  Description of Artificial Sequence: Synthetic oligonucleotide
actagcatcaacacaatttgaacccactgcagctag

SEQ ID NO: 85650 - DNA, 35 bp, Artificial Sequence
  Description of Artificial Sequence: Synthetic oligonucleotide
ctagcatcaacacaatttgaacccactgcagctag

SEQ ID NO: 85651 - DNA, 38 bp, Artificial Sequence
  Description of Artificial Sequence: Synthetic oligonucleotide
tagcatcaacacaatttgaacccactgcagctagaatg

SEQ ID NO: 85652 - DNA, 37 bp, Artificial Sequence
  Description of Artificial Sequence: Synthetic oligonucleotide
agcatcaacacaatttgaacccactgcagctagaatg

SEQ ID NO: 85653 - DNA, 36 bp, Artificial Sequence
  Description of Artificial Sequence: Synthetic oligonucleotide
gcatcaacacaatttgaacccactgcagctagaatg

SEQ ID NO: 85654 - DNA, 36 bp, Artificial Sequence
  Description of Artificial Sequence: Synthetic oligonucleotide
catcaacacaatttgaacccactgcagctagaatgg

SEQ ID NO: 85655 - DNA, 36 bp, Artificial Sequence
  Description of Artificial Sequence: Synthetic oligonucleotide
atcaacacaatttgaacccactgcagctagaatggc

SEQ ID NO: 85656 - DNA, 35 bp, Artificial Sequence
  Description of Artificial Sequence: Synthetic oligonucleotide
tcaacacaatttgaacccactgcagctagaatggc

SEQ ID NO: 85657 - DNA, 34 bp, Artificial Sequence
  Description of Artificial Sequence: Synthetic oligonucleotide
caacacaatttgaacccactgcagctagaatggc

SEQ ID NO: 85658 - DNA, 34 bp, Artificial Sequence
  Description of Artificial Sequence: Synthetic oligonucleotide
aacacaatttgaacccactgcagctagaatggcc

SEQ ID NO: 85659 - DNA, 33 bp, Artificial Sequence
  Description of Artificial Sequence: Synthetic oligonucleotide
acacaatttgaacccactgcagctagaatggcc

SEQ ID NO: 85660 - DNA, 32 bp, Artificial Sequence
  Description of Artificial Sequence: Synthetic oligonucleotide
cacaatttgaacccactgcagctagaatggcc

SEQ ID NO: 85661 - DNA, 35 bp, Artificial Sequence
  Description of Artificial Sequence: Synthetic oligonucleotide
acaatttgaacccactgcagctagaatggcctttc

SEQ ID NO: 85662 - DNA, 34 bp, Artificial Sequence
  Description of Artificial Sequence: Synthetic oligonucleotide
caatttgaacccactgcagctagaatggcctttc

SEQ ID NO: 85663 - DNA, 34 bp, Artificial Sequence
  Description of Artificial Sequence: Synthetic oligonucleotide
aatttgaacccactgcagctagaatggcctttcc

SEQ ID NO: 85664 - DNA, 33 bp, Artificial Sequence
  Description of Artificial Sequence: Synthetic oligonucleotide
atttgaacccactgcagctagaatggcctttcc

SEQ ID NO: 85665 - DNA, 32 bp, Artificial Sequence
  Description of Artificial Sequence: Synthetic oligonucleotide
tttgaacccactgcagctagaatggcctttcc

SEQ ID NO: 85666 - DNA, 31 bp, Artificial Sequence
  Description of Artificial Sequence: Synthetic oligonucleotide
ttgaacccactgcagctagaatggcctttcc

SEQ ID NO: 85667 - DNA, 30 bp, Artificial Sequence
  Description of Artificial Sequence: Synthetic oligonucleotide
tgaacccactgcagctagaatggcctttcc

SEQ ID NO: 85668 - DNA, 29 bp, Artificial Sequence
  Description of Artificial Sequence: Synthetic oligonucleotide
gaacccactgcagctagaatggcctttcc

SEQ ID NO: 85669 - DNA, 29 bp, Artificial Sequence
  Description of Artificial Sequence: Synthetic oligonucleotide
aacccactgcagctagaatggcctttccc

SEQ ID NO: 85670 - DNA, 28 bp, Artificial Sequence
  Description of Artificial Sequence: Synthetic oligonucleotide
acccactgcagctagaatggcctttccc

SEQ ID NO: 85671 - DNA, 27 bp, Artificial Sequence
  Description of Artificial Sequence: Synthetic oligonucleotide
cccactgcagctagaatggcctttccc

SEQ ID NO: 85672 - DNA, 28 bp, Artificial Sequence
  Description of Artificial Sequence: Synthetic oligonucleotide
ccactgcagctagaatggcctttccctg

SEQ ID NO: 85673 - DNA, 28 bp, Artificial Sequence
  Description of Artificial Sequence: Synthetic oligonucleotide
cactgcagctagaatggcctttccctgc

SEQ ID NO: 85674 - DNA, 31 bp, Artificial Sequence
  Description of Artificial Sequence: Synthetic oligonucleotide
actgcagctagaatggcctttccctgctttg

SEQ ID NO: 85675 - DNA, 30 bp, Artificial Sequence
  Description of Artificial Sequence: Synthetic oligonucleotide
ctgcagctagaatggcctttccctgctttg

SEQ ID NO: 85676 - DNA, 32 bp, Artificial Sequence
  Description of Artificial Sequence: Synthetic oligonucleotide
tgcagctagaatggcctttccctgctttgatg

SEQ ID NO: 85677 - DNA, 31 bp, Artificial Sequence
  Description of Artificial Sequence: Synthetic oligonucleotide
gcagctagaatggcctttccctgctttgatg

SEQ ID NO: 85678 - DNA, 33 bp, Artificial Sequence
  Description of Artificial Sequence: Synthetic oligonucleotide
cagctagaatggcctttccctgctttgatgaac

SEQ ID NO: 85679 - DNA, 33 bp, Artificial Sequence
  Description of Artificial Sequence: Synthetic oligonucleotide
agctagaatggcctttccctgctttgatgaacc

SEQ ID NO: 85680 - DNA, 32 bp, Artificial Sequence
  Description of Artificial Sequence: Synthetic oligonucleotide
gctagaatggcctttccctgctttgatgaacc

SEQ ID NO: 85681 - DNA, 33 bp, Artificial Sequence
  Description of Artificial Sequence: Synthetic oligonucleotide
ctagaatggcctttccctgctttgatgaacctg

SEQ ID NO: 85682 - DNA, 33 bp, Artificial Sequence
  Description of Artificial Sequence: Synthetic oligonucleotide
tagaatggcctttccctgctttgatgaacctgc

SEQ ID NO: 85683 - DNA, 32 bp, Artificial Sequence
  Description of Artificial Sequence: Synthetic oligonucleotide
agaatggcctttccctgctttgatgaacctgc

SEQ ID NO: 85684 - DNA, 31 bp, Artificial Sequence
  Description of Artificial Sequence: Synthetic oligonucleotide
gaatggcctttccctgctttgatgaacctgc

SEQ ID NO: 85685 - DNA, 31 bp, Artificial Sequence
  Description of Artificial Sequence: Synthetic oligonucleotide
aatggcctttccctgctttgatgaacctgcc

SEQ ID NO: 85686 - DNA, 30 bp, Artificial Sequence
  Description of Artificial Sequence: Synthetic oligonucleotide
atggcctttccctgctttgatgaacctgcc

SEQ ID NO: 85687 - DNA, 29 bp, Artificial Sequence
  Description of Artificial Sequence: Synthetic oligonucleotide
tggcctttccctgctttgatgaacctgcc

SEQ ID NO: 85688 - DNA, 28 bp, Artificial Sequence
  Description of Artificial Sequence: Synthetic oligonucleotide
ggcctttccctgctttgatgaacctgcc

SEQ ID NO: 85689 - DNA, 30 bp, Artificial Sequence
  Description of Artificial Sequence: Synthetic oligonucleotide
gcctttccctgctttgatgaacctgccttc

SEQ ID NO: 85690 - DNA, 33 bp, Artificial Sequence
  Description of Artificial Sequence: Synthetic oligonucleotide
cctttccctgctttgatgaacctgccttcaaag

SEQ ID NO: 85691 - DNA, 33 bp, Artificial Sequence
  Description of Artificial Sequence: Synthetic oligonucleotide
ctttccctgctttgatgaacctgccttcaaagc

SEQ ID NO: 85692 - DNA, 35 bp, Artificial Sequence
  Description of Artificial Sequence: Synthetic oligonucleotide
tttccctgctttgatgaacctgccttcaaagcaag

SEQ ID NO: 85693 - DNA, 34 bp, Artificial Sequence
  Description of Artificial Sequence: Synthetic oligonucleotide
ttccctgctttgatgaacctgccttcaaagcaag

SEQ ID NO: 85694 - DNA, 33 bp, Artificial Sequence
  Description of Artificial Sequence: Synthetic oligonucleotide
tccctgctttgatgaacctgccttcaaagcaag

SEQ ID NO: 85695 - DNA, 32 bp, Artificial Sequence
  Description of Artificial Sequence: Synthetic oligonucleotide
ccctgctttgatgaacctgccttcaaagcaag

SEQ ID NO: 85696 - DNA, 35 bp, Artificial Sequence
  Description of Artificial Sequence: Synthetic oligonucleotide
cctgctttgatgaacctgccttcaaagcaagtttc

SEQ ID NO: 85697 - DNA, 36 bp, Artificial Sequence
  Description of Artificial Sequence: Synthetic oligonucleotide
ctgctttgatgaacctgccttcaaagcaagtttctc

SEQ ID NO: 85698 - DNA, 39 bp, Artificial Sequence
  Description of Artificial Sequence: Synthetic oligonucleotide
tgctttgatgaacctgccttcaaagcaagtttctcaatc

SEQ ID NO: 85699 - DNA, 38 bp, Artificial Sequence
  Description of Artificial Sequence: Synthetic oligonucleotide
gctttgatgaacctgccttcaaagcaagtttctcaatc

SEQ ID NO: 85700 - DNA, 45 bp, Artificial Sequence
  Description of Artificial Sequence: Synthetic oligonucleotide
ctttgatgaacctgccttcaaagcaagtttctcaatcaaaattag

SEQ ID NO: 85701 - DNA, 47 bp, Artificial Sequence
  Description of Artificial Sequence: Synthetic oligonucleotide
tttgatgaacctgccttcaaagcaagtttctcaatcaaaattagaag

SEQ ID NO: 85702 - DNA, 46 bp, Artificial Sequence
  Description of Artificial Sequence: Synthetic oligonucleotide
ttgatgaacctgccttcaaagcaagtttctcaatcaaaattagaag

SEQ ID NO: 85703 - DNA, 45 bp, Artificial Sequence
  Description of Artificial Sequence: Synthetic oligonucleotide
tgatgaacctgccttcaaagcaagtttctcaatcaaaattagaag

SEQ ID NO: 85704 - DNA, 44 bp, Artificial Sequence
  Description of Artificial Sequence: Synthetic oligonucleotide
gatgaacctgccttcaaagcaagtttctcaatcaaaattagaag

SEQ ID NO: 85705 - DNA, 45 bp, Artificial Sequence
  Description of Artificial Sequence: Synthetic oligonucleotide
atgaacctgccttcaaagcaagtttctcaatcaaaattagaagag

SEQ ID NO: 85706 - DNA, 44 bp, Artificial Sequence
  Description of Artificial Sequence: Synthetic oligonucleotide
tgaacctgccttcaaagcaagtttctcaatcaaaattagaagag

SEQ ID NO: 85707 - DNA, 43 bp, Artificial Sequence
  Description of Artificial Sequence: Synthetic oligonucleotide
gaacctgccttcaaagcaagtttctcaatcaaaattagaagag

SEQ ID NO: 85708 - DNA, 44 bp, Artificial Sequence
  Description of Artificial Sequence: Synthetic oligonucleotide
aacctgccttcaaagcaagtttctcaatcaaaattagaagagag

SEQ ID NO: 85709 - DNA, 43 bp, Artificial Sequence
  Description of Artificial Sequence: Synthetic oligonucleotide
acctgccttcaaagcaagtttctcaatcaaaattagaagagag

SEQ ID NO: 85710 - DNA, 42 bp, Artificial Sequence
  Description of Artificial Sequence: Synthetic oligonucleotide
cctgccttcaaagcaagtttctcaatcaaaattagaagagag

SEQ ID NO: 85711 - DNA, 42 bp, Artificial Sequence
  Description of Artificial Sequence: Synthetic oligonucleotide
ctgccttcaaagcaagtttctcaatcaaaattagaagagagc

SEQ ID NO: 85712 - DNA, 42 bp, Artificial Sequence
  Description of Artificial Sequence: Synthetic oligonucleotide
tgccttcaaagcaagtttctcaatcaaaattagaagagagcc

SEQ ID NO: 85713 - DNA, 41 bp, Artificial Sequence
  Description of Artificial Sequence: Synthetic oligonucleotide
gccttcaaagcaagtttctcaatcaaaattagaagagagcc

SEQ ID NO: 85714 - DNA, 43 bp, Artificial Sequence
  Description of Artificial Sequence: Synthetic oligonucleotide
ccttcaaagcaagtttctcaatcaaaattagaagagagccaag

SEQ ID NO: 85715 - DNA, 43 bp, Artificial Sequence
  Description of Artificial Sequence: Synthetic oligonucleotide
cttcaaagcaagtttctcaatcaaaattagaagagagccaagg

SEQ ID NO: 85716 - DNA, 43 bp, Artificial Sequence
  Description of Artificial Sequence: Synthetic oligonucleotide
ttcaaagcaagtttctcaatcaaaattagaagagagccaaggc

SEQ ID NO: 85717 - DNA, 42 bp, Artificial Sequence
  Description of Artificial Sequence: Synthetic oligonucleotide
tcaaagcaagtttctcaatcaaaattagaagagagccaaggc

SEQ ID NO: 85718 - DNA, 41 bp, Artificial Sequence
  Description of Artificial Sequence: Synthetic oligonucleotide
caaagcaagtttctcaatcaaaattagaagagagccaaggc

SEQ ID NO: 85719 - DNA, 42 bp, Artificial Sequence
  Description of Artificial Sequence: Synthetic oligonucleotide
aaagcaagtttctcaatcaaaattagaagagagccaaggcac

SEQ ID NO: 85720 - DNA, 41 bp, Artificial Sequence
  Description of Artificial Sequence: Synthetic oligonucleotide
aagcaagtttctcaatcaaaattagaagagagccaaggcac

SEQ ID NO: 85721 - DNA, 40 bp, Artificial Sequence
  Description of Artificial Sequence: Synthetic oligonucleotide
agcaagtttctcaatcaaaattagaagagagccaaggcac

SEQ ID NO: 85722 - DNA, 39 bp, Artificial Sequence
  Description of Artificial Sequence: Synthetic oligonucleotide
gcaagtttctcaatcaaaattagaagagagccaaggcac

SEQ ID NO: 85723 - DNA, 39 bp, Artificial Sequence
  Description of Artificial Sequence: Synthetic oligonucleotide
caagtttctcaatcaaaattagaagagagccaaggcacc

SEQ ID NO: 85724 - DNA, 41 bp, Artificial Sequence
  Description of Artificial Sequence: Synthetic oligonucleotide
aagtttctcaatcaaaattagaagagagccaaggcacctag

SEQ ID NO: 85725 - DNA, 40 bp, Artificial Sequence
  Description of Artificial Sequence: Synthetic oligonucleotide
agtttctcaatcaaaattagaagagagccaaggcacctag

SEQ ID NO: 85726 - DNA, 39 bp, Artificial Sequence
  Description of Artificial Sequence: Synthetic oligonucleotide
gtttctcaatcaaaattagaagagagccaaggcacctag

SEQ ID NO: 85727 - DNA, 39 bp, Artificial Sequence
  Description of Artificial Sequence: Synthetic oligonucleotide
tttctcaatcaaaattagaagagagccaaggcacctagc

SEQ ID NO: 85728 - DNA, 38 bp, Artificial Sequence
  Description of Artificial Sequence: Synthetic oligonucleotide
ttctcaatcaaaattagaagagagccaaggcacctagc

SEQ ID NO: 85729 - DNA, 37 bp, Artificial Sequence
  Description of Artificial Sequence: Synthetic oligonucleotide
tctcaatcaaaattagaagagagccaaggcacctagc

SEQ ID NO: 85730 - DNA, 36 bp, Artificial Sequence
  Description of Artificial Sequence: Synthetic oligonucleotide
ctcaatcaaaattagaagagagccaaggcacctagc

SEQ ID NO: 85731 - DNA, 36 bp, Artificial Sequence
  Description of Artificial Sequence: Synthetic oligonucleotide
tcaatcaaaattagaagagagccaaggcacctagcc

SEQ ID NO: 85732 - DNA, 35 bp, Artificial Sequence
  Description of Artificial Sequence: Synthetic oligonucleotide
caatcaaaattagaagagagccaaggcacctagcc

SEQ ID NO: 85733 - DNA, 37 bp, Artificial Sequence
  Description of Artificial Sequence: Synthetic oligonucleotide
aatcaaaattagaagagagccaaggcacctagccatc

SEQ ID NO: 85734 - DNA, 36 bp, Artificial Sequence
  Description of Artificial Sequence: Synthetic oligonucleotide
atcaaaattagaagagagccaaggcacctagccatc

SEQ ID NO: 85735 - DNA, 35 bp, Artificial Sequence
  Description of Artificial Sequence: Synthetic oligonucleotide
tcaaaattagaagagagccaaggcacctagccatc

SEQ ID NO: 85736 - DNA, 34 bp, Artificial Sequence
  Description of Artificial Sequence: Synthetic oligonucleotide
caaaattagaagagagccaaggcacctagccatc

SEQ ID NO: 85737 - DNA, 35 bp, Artificial Sequence
  Description of Artificial Sequence: Synthetic oligonucleotide
aaaattagaagagagccaaggcacctagccatctc

SEQ ID NO: 85738 - DNA, 34 bp, Artificial Sequence
  Description of Artificial Sequence: Synthetic oligonucleotide
aaattagaagagagccaaggcacctagccatctc

SEQ ID NO: 85739 - DNA, 33 bp, Artificial Sequence
  Description of Artificial Sequence: Synthetic oligonucleotide
aattagaagagagccaaggcacctagccatctc

SEQ ID NO: 85740 - DNA, 32 bp, Artificial Sequence
  Description of Artificial Sequence: Synthetic oligonucleotide
attagaagagagccaaggcacctagccatctc

SEQ ID NO: 85741 - DNA, 31 bp, Artificial Sequence
  Description of Artificial Sequence: Synthetic oligonucleotide
ttagaagagagccaaggcacctagccatctc

SEQ ID NO: 85742 - DNA, 30 bp, Artificial Sequence
  Description of Artificial Sequence: Synthetic oligonucleotide
tagaagagagccaaggcacctagccatctc

SEQ ID NO: 85743 - DNA, 29 bp, Artificial Sequence
  Description of Artificial Sequence: Synthetic oligonucleotide
agaagagagccaaggcacctagccatctc

SEQ ID NO: 85744 - DNA, 28 bp, Artificial Sequence
  Description of Artificial Sequence: Synthetic oligonucleotide
gaagagagccaaggcacctagccatctc

SEQ ID NO: 85745 - DNA, 28 bp, Artificial Sequence
  Description of Artificial Sequence: Synthetic oligonucleotide
aagagagccaaggcacctagccatctcc

SEQ ID NO: 85746 - DNA, 27 bp, Artificial Sequence
  Description of Artificial Sequence: Synthetic oligonucleotide
agagagccaaggcacctagccatctcc

SEQ ID NO: 85747 - DNA, 27 bp, Artificial Sequence
  Description of Artificial Sequence: Synthetic oligonucleotide
gagagccaaggcacctagccatctcca

SEQ ID NO: 85748 - DNA, 31 bp, Artificial Sequence
  Description of Artificial Sequence: Synthetic oligonucleotide
agagccaaggcacctagccatctccaatatg

SEQ ID NO: 85749 - DNA, 30 bp, Artificial Sequence
  Description of Artificial Sequence: Synthetic oligonucleotide
gagccaaggcacctagccatctccaatatg

SEQ ID NO: 85750 - DNA, 30 bp, Artificial Sequence
  Description of Artificial Sequence: Synthetic oligonucleotide
agccaaggcacctagccatctccaatatgc

SEQ ID NO: 85751 - DNA, 29 bp, Artificial Sequence
  Description of Artificial Sequence: Synthetic oligonucleotide
gccaaggcacctagccatctccaatatgc

SEQ ID NO: 85752 - DNA, 29 bp, Artificial Sequence
  Description of Artificial Sequence: Synthetic oligonucleotide
ccaaggcacctagccatctccaatatgcc

SEQ ID NO: 85753 - DNA, 32 bp, Artificial Sequence
  Description of Artificial Sequence: Synthetic oligonucleotide
caaggcacctagccatctccaatatgccattg

SEQ ID NO: 85754 - DNA, 32 bp, Artificial Sequence
  Description of Artificial Sequence: Synthetic oligonucleotide
aaggcacctagccatctccaatatgccattgg

SEQ ID NO: 85755 - DNA, 31 bp, Artificial Sequence
  Description of Artificial Sequence: Synthetic oligonucleotide
aggcacctagccatctccaatatgccattgg

SEQ ID NO: 85756 - DNA, 30 bp, Artificial Sequence
  Description of Artificial Sequence: Synthetic oligonucleotide
ggcacctagccatctccaatatgccattgg

SEQ ID NO: 85757 - DNA, 31 bp, Artificial Sequence
  Description of Artificial Sequence: Synthetic oligonucleotide
gcacctagccatctccaatatgccattggtg

SEQ ID NO: 85758 - DNA, 35 bp, Artificial Sequence
  Description of Artificial Sequence: Synthetic oligonucleotide
cacctagccatctccaatatgccattggtgaaatc

SEQ ID NO: 85759 - DNA, 36 bp, Artificial Sequence
  Description of Artificial Sequence: Synthetic oligonucleotide
acctagccatctccaatatgccattggtgaaatctg

SEQ ID NO: 85760 - DNA, 35 bp, Artificial Sequence
  Description of Artificial Sequence: Synthetic oligonucleotide
cctagccatctccaatatgccattggtgaaatctg

SEQ ID NO: 85761 - DNA, 36 bp, Artificial Sequence
  Description of Artificial Sequence: Synthetic oligonucleotide
ctagccatctccaatatgccattggtgaaatctgtg

SEQ ID NO: 85762 - DNA, 37 bp, Artificial Sequence
  Description of Artificial Sequence: Synthetic oligonucleotide
tagccatctccaatatgccattggtgaaatctgtgac

SEQ ID NO: 85763 - DNA, 36 bp, Artificial Sequence
  Description of Artificial Sequence: Synthetic oligonucleotide
agccatctccaatatgccattggtgaaatctgtgac

SEQ ID NO: 85764 - DNA, 35 bp, Artificial Sequence
  Description of Artificial Sequence: Synthetic oligonucleotide
gccatctccaatatgccattggtgaaatctgtgac

SEQ ID NO: 85765 - DNA, 36 bp, Artificial Sequence
  Description of Artificial Sequence: Synthetic oligonucleotide
ccatctccaatatgccattggtgaaatctgtgactg

SEQ ID NO: 85766 - DNA, 38 bp, Artificial Sequence
  Description of Artificial Sequence: Synthetic oligonucleotide
catctccaatatgccattggtgaaatctgtgactgttg

SEQ ID NO: 85767 - DNA, 38 bp, Artificial Sequence
  Description of Artificial Sequence: Synthetic oligonucleotide
atctccaatatgccattggtgaaatctgtgactgttgc

SEQ ID NO: 85768 - DNA, 37 bp, Artificial Sequence
  Description of Artificial Sequence: Synthetic oligonucleotide
tctccaatatgccattggtgaaatctgtgactgttgc

SEQ ID NO: 85769 - DNA, 36 bp, Artificial Sequence
  Description of Artificial Sequence: Synthetic oligonucleotide
ctccaatatgccattggtgaaatctgtgactgttgc

SEQ ID NO: 85770 - DNA, 37 bp, Artificial Sequence
  Description of Artificial Sequence: Synthetic oligonucleotide
tccaatatgccattggtgaaatctgtgactgttgctg

SEQ ID NO: 85771 - DNA, 36 bp, Artificial Sequence
  Description of Artificial Sequence: Synthetic oligonucleotide
ccaatatgccattggtgaaatctgtgactgttgctg

SEQ ID NO: 85772 - DNA, 38 bp, Artificial Sequence
  Description of Artificial Sequence: Synthetic oligonucleotide
caatatgccattggtgaaatctgtgactgttgctgaag

SEQ ID NO: 85773 - DNA, 38 bp, Artificial Sequence
  Description of Artificial Sequence: Synthetic oligonucleotide
aatatgccattggtgaaatctgtgactgttgctgaagg

SEQ ID NO: 85774 - DNA, 37 bp, Artificial Sequence
  Description of Artificial Sequence: Synthetic oligonucleotide
atatgccattggtgaaatctgtgactgttgctgaagg

SEQ ID NO: 85775 - DNA, 36 bp, Artificial Sequence
  Description of Artificial Sequence: Synthetic oligonucleotide
tatgccattggtgaaatctgtgactgttgctgaagg

SEQ ID NO: 85776 - DNA, 35 bp, Artificial Sequence
  Description of Artificial Sequence: Synthetic oligonucleotide
atgccattggtgaaatctgtgactgttgctgaagg

SEQ ID NO: 85777 - DNA, 34 bp, Artificial Sequence
  Description of Artificial Sequence: Synthetic oligonucleotide
tgccattggtgaaatctgtgactgttgctgaagg

SEQ ID NO: 85778 - DNA, 33 bp, Artificial Sequence
  Description of Artificial Sequence: Synthetic oligonucleotide
gccattggtgaaatctgtgactgttgctgaagg

SEQ ID NO: 85779 - DNA, 34 bp, Artificial Sequence
  Description of Artificial Sequence: Synthetic oligonucleotide
ccattggtgaaatctgtgactgttgctgaaggac

SEQ ID NO: 85780 - DNA, 35 bp, Artificial Sequence
  Description of Artificial Sequence: Synthetic oligonucleotide
cattggtgaaatctgtgactgttgctgaaggactc

SEQ ID NO: 85781 - DNA, 38 bp, Artificial Sequence
  Description of Artificial Sequence: Synthetic oligonucleotide
attggtgaaatctgtgactgttgctgaaggactcatag

SEQ ID NO: 85782 - DNA, 37 bp, Artificial Sequence
  Description of Artificial Sequence: Synthetic oligonucleotide
ttggtgaaatctgtgactgttgctgaaggactcatag

SEQ ID NO: 85783 - DNA, 36 bp, Artificial Sequence
  Description of Artificial Sequence: Synthetic oligonucleotide
tggtgaaatctgtgactgttgctgaaggactcatag

SEQ ID NO: 85784 - DNA, 35 bp, Artificial Sequence
  Description of Artificial Sequence: Synthetic oligonucleotide
ggtgaaatctgtgactgttgctgaaggactcatag

SEQ ID NO: 85785 - DNA, 37 bp, Artificial Sequence
  Description of Artificial Sequence: Synthetic oligonucleotide
gtgaaatctgtgactgttgctgaaggactcatagaag

SEQ ID NO: 85786 - DNA, 38 bp, Artificial Sequence
  Description of Artificial Sequence: Synthetic oligonucleotide
tgaaatctgtgactgttgctgaaggactcatagaagac

SEQ ID NO: 85787 - DNA, 37 bp, Artificial Sequence
  Description of Artificial Sequence: Synthetic oligonucleotide
gaaatctgtgactgttgctgaaggactcatagaagac

SEQ ID NO: 85788 - DNA, 37 bp, Artificial Sequence
  Description of Artificial Sequence: Synthetic oligonucleotide
aaatctgtgactgttgctgaaggactcatagaagacc

SEQ ID NO: 85789 - DNA, 36 bp, Artificial Sequence
  Description of Artificial Sequence: Synthetic oligonucleotide
aatctgtgactgttgctgaaggactcatagaagacc

SEQ ID NO: 85790 - DNA, 35 bp, Artificial Sequence
  Description of Artificial Sequence: Synthetic oligonucleotide
atctgtgactgttgctgaaggactcatagaagacc

SEQ ID NO: 85791 - DNA, 34 bp, Artificial Sequence
  Description of Artificial Sequence: Synthetic oligonucleotide
tctgtgactgttgctgaaggactcatagaagacc

SEQ ID NO: 85792 - DNA, 33 bp, Artificial Sequence
  Description of Artificial Sequence: Synthetic oligonucleotide
ctgtgactgttgctgaaggactcatagaagacc

SEQ ID NO: 85793 - DNA, 38 bp, Artificial Sequence
  Description of Artificial Sequence: Synthetic oligonucleotide
tgtgactgttgctgaaggactcatagaagaccattttg

SEQ ID NO: 85794 - DNA, 37 bp, Artificial Sequence
  Description of Artificial Sequence: Synthetic oligonucleotide
gtgactgttgctgaaggactcatagaagaccattttg

SEQ ID NO: 85795 - DNA, 39 bp, Artificial Sequence
  Description of Artificial Sequence: Synthetic oligonucleotide
tgactgttgctgaaggactcatagaagaccattttgatg

SEQ ID NO: 85796 - DNA, 38 bp, Artificial Sequence
  Description of Artificial Sequence: Synthetic oligonucleotide
gactgttgctgaaggactcatagaagaccattttgatg

SEQ ID NO: 85797 - DNA, 39 bp, Artificial Sequence
  Description of Artificial Sequence: Synthetic oligonucleotide
actgttgctgaaggactcatagaagaccattttgatgtc

SEQ ID NO: 85798 - DNA, 38 bp, Artificial Sequence
  Description of Artificial Sequence: Synthetic oligonucleotide
ctgttgctgaaggactcatagaagaccattttgatgtc

SEQ ID NO: 85799 - DNA, 39 bp, Artificial Sequence
  Description of Artificial Sequence: Synthetic oligonucleotide
tgttgctgaaggactcatagaagaccattttgatgtcac

SEQ ID NO: 85800 - DNA, 38 bp, Artificial Sequence
  Description of Artificial Sequence: Synthetic oligonucleotide
gttgctgaaggactcatagaagaccattttgatgtcac

SEQ ID NO: 85801 - DNA, 39 bp, Artificial Sequence
  Description of Artificial Sequence: Synthetic oligonucleotide
ttgctgaaggactcatagaagaccattttgatgtcactg

SEQ ID NO: 85802 - DNA, 38 bp, Artificial Sequence
  Description of Artificial Sequence: Synthetic oligonucleotide
tgctgaaggactcatagaagaccattttgatgtcactg

SEQ ID NO: 85803 - DNA, 37 bp, Artificial Sequence
  Description of Artificial Sequence: Synthetic oligonucleotide
gctgaaggactcatagaagaccattttgatgtcactg

SEQ ID NO: 85804 - DNA, 38 bp, Artificial Sequence
  Description of Artificial Sequence: Synthetic oligonucleotide
ctgaaggactcatagaagaccattttgatgtcactgtg

SEQ ID NO: 85805 - DNA, 40 bp, Artificial Sequence
  Description of Artificial Sequence: Synthetic oligonucleotide
tgaaggactcatagaagaccattttgatgtcactgtgaag

SEQ ID NO: 85806 - DNA, 39 bp, Artificial Sequence
  Description of Artificial Sequence: Synthetic oligonucleotide
gaaggactcatagaagaccattttgatgtcactgtgaag

SEQ ID NO: 85807 - DNA, 41 bp, Artificial Sequence
  Description of Artificial Sequence: Synthetic oligonucleotide
aaggactcatagaagaccattttgatgtcactgtgaagatg

SEQ ID NO: 85808 - DNA, 40 bp, Artificial Sequence
  Description of Artificial Sequence: Synthetic oligonucleotide
aggactcatagaagaccattttgatgtcactgtgaagatg

SEQ ID NO: 85809 - DNA, 39 bp, Artificial Sequence
  Description of Artificial Sequence: Synthetic oligonucleotide
ggactcatagaagaccattttgatgtcactgtgaagatg

SEQ ID NO: 85810 - DNA, 40 bp, Artificial Sequence
  Description of Artificial Sequence: Synthetic oligonucleotide
gactcatagaagaccattttgatgtcactgtgaagatgag

SEQ ID NO: 85811 - DNA, 40 bp, Artificial Sequence
  Description of Artificial Sequence: Synthetic oligonucleotide
actcatagaagaccattttgatgtcactgtgaagatgagc

SEQ ID NO: 85812 - DNA, 39 bp, Artificial Sequence
  Description of Artificial Sequence: Synthetic oligonucleotide
ctcatagaagaccattttgatgtcactgtgaagatgagc

SEQ ID NO: 85813 - DNA, 40 bp, Artificial Sequence
  Description of Artificial Sequence: Synthetic oligonucleotide
tcatagaagaccattttgatgtcactgtgaagatgagcac

SEQ ID NO: 85814 - DNA, 39 bp, Artificial Sequence
  Description of Artificial Sequence: Synthetic oligonucleotide
catagaagaccattttgatgtcactgtgaagatgagcac

SEQ ID NO: 85815 - DNA, 39 bp, Artificial Sequence
  Description of Artificial Sequence: Synthetic oligonucleotide
atagaagaccattttgatgtcactgtgaagatgagcacc

SEQ ID NO: 85816 - DNA, 38 bp, Artificial Sequence
  Description of Artificial Sequence: Synthetic oligonucleotide
tagaagaccattttgatgtcactgtgaagatgagcacc

SEQ ID NO: 85817 - DNA, 37 bp, Artificial Sequence
  Description of Artificial Sequence: Synthetic oligonucleotide
agaagaccattttgatgtcactgtgaagatgagcacc

SEQ ID NO: 85818 - DNA, 36 bp, Artificial Sequence
  Description of Artificial Sequence: Synthetic oligonucleotide
gaagaccattttgatgtcactgtgaagatgagcacc

SEQ ID NO: 85819 - DNA, 39 bp, Artificial Sequence
  Description of Artificial Sequence: Synthetic oligonucleotide
aagaccattttgatgtcactgtgaagatgagcacctatc

SEQ ID NO: 85820 - DNA, 38 bp, Artificial Sequence
  Description of Artificial Sequence: Synthetic oligonucleotide
agaccattttgatgtcactgtgaagatgagcacctatc

SEQ ID NO: 85821 - DNA, 37 bp, Artificial Sequence
  Description of Artificial Sequence: Synthetic oligonucleotide
gaccattttgatgtcactgtgaagatgagcacctatc

SEQ ID NO: 85822 - DNA, 38 bp, Artificial Sequence
  Description of Artificial Sequence: Synthetic oligonucleotide
accattttgatgtcactgtgaagatgagcacctatctg

SEQ ID NO: 85823 - DNA, 37 bp, Artificial Sequence
  Description of Artificial Sequence: Synthetic oligonucleotide
ccattttgatgtcactgtgaagatgagcacctatctg

SEQ ID NO: 85824 - DNA, 37 bp, Artificial Sequence
  Description of Artificial Sequence: Synthetic oligonucleotide
cattttgatgtcactgtgaagatgagcacctatctgg

SEQ ID NO: 85825 - DNA, 38 bp, Artificial Sequence
  Description of Artificial Sequence: Synthetic oligonucleotide
attttgatgtcactgtgaagatgagcacctatctggtg

SEQ ID NO: 85826 - DNA, 37 bp, Artificial Sequence
  Description of Artificial Sequence: Synthetic oligonucleotide
ttttgatgtcactgtgaagatgagcacctatctggtg

SEQ ID NO: 85827 - DNA, 36 bp, Artificial Sequence
  Description of Artificial Sequence: Synthetic oligonucleotide
tttgatgtcactgtgaagatgagcacctatctggtg

SEQ ID NO: 85828 - DNA, 35 bp, Artificial Sequence
  Description of Artificial Sequence: Synthetic oligonucleotide
ttgatgtcactgtgaagatgagcacctatctggtg

SEQ ID NO: 85829 - DNA, 34 bp, Artificial Sequence
  Description of Artificial Sequence: Synthetic oligonucleotide
tgatgtcactgtgaagatgagcacctatctggtg

SEQ ID NO: 85830 - DNA, 33 bp, Artificial Sequence
  Description of Artificial Sequence: Synthetic oligonucleotide
gatgtcactgtgaagatgagcacctatctggtg

SEQ ID NO: 85831 - DNA, 33 bp, Artificial Sequence
  Description of Artificial Sequence: Synthetic oligonucleotide
atgtcactgtgaagatgagcacctatctggtgg

SEQ ID NO: 85832 - DNA, 32 bp, Artificial Sequence
  Description of Artificial Sequence: Synthetic oligonucleotide
tgtcactgtgaagatgagcacctatctggtgg

SEQ ID NO: 85833 - DNA, 31 bp, Artificial Sequence
  Description of Artificial Sequence: Synthetic oligonucleotide
gtcactgtgaagatgagcacctatctggtgg

SEQ ID NO: 85834 - DNA, 31 bp, Artificial Sequence
  Description of Artificial Sequence: Synthetic oligonucleotide
tcactgtgaagatgagcacctatctggtggc

SEQ ID NO: 85835 - DNA, 30 bp, Artificial Sequence
  Description of Artificial Sequence: Synthetic oligonucleotide
cactgtgaagatgagcacctatctggtggc

SEQ ID NO: 85836 - DNA, 30 bp, Artificial Sequence
  Description of Artificial Sequence: Synthetic oligonucleotide
actgtgaagatgagcacctatctggtggcc

SEQ ID NO: 85837 - DNA, 29 bp, Artificial Sequence
  Description of Artificial Sequence: Synthetic oligonucleotide
ctgtgaagatgagcacctatctggtggcc

SEQ ID NO: 85838 - DNA, 31 bp, Artificial Sequence
  Description of Artificial Sequence: Synthetic oligonucleotide
tgtgaagatgagcacctatctggtggccttc

SEQ ID NO: 85839 - DNA, 30 bp, Artificial Sequence
  Description of Artificial Sequence: Synthetic oligonucleotide
gtgaagatgagcacctatctggtggccttc

SEQ ID NO: 85840 - DNA, 32 bp, Artificial Sequence
  Description of Artificial Sequence: Synthetic oligonucleotide
tgaagatgagcacctatctggtggccttcatc

SEQ ID NO: 85841 - DNA, 31 bp, Artificial Sequence
  Description of Artificial Sequence: Synthetic oligonucleotide
gaagatgagcacctatctggtggccttcatc

SEQ ID NO: 85842 - DNA, 35 bp, Artificial Sequence
  Description of Artificial Sequence: Synthetic oligonucleotide
aagatgagcacctatctggtggccttcatcatttc

SEQ ID NO: 85843 - DNA, 34 bp, Artificial Sequence
  Description of Artificial Sequence: Synthetic oligonucleotide
agatgagcacctatctggtggccttcatcatttc

SEQ ID NO: 85844 - DNA, 33 bp, Artificial Sequence
  Description of Artificial Sequence: Synthetic oligonucleotide
gatgagcacctatctggtggccttcatcatttc

SEQ ID NO: 85845 - DNA, 34 bp, Artificial Sequence
  Description of Artificial Sequence: Synthetic oligonucleotide
atgagcacctatctggtggccttcatcatttcag

SEQ ID NO: 85846 - DNA, 33 bp, Artificial Sequence
  Description of Artificial Sequence: Synthetic oligonucleotide
tgagcacctatctggtggccttcatcatttcag

SEQ ID NO: 85847 - DNA, 32 bp, Artificial Sequence
  Description of Artificial Sequence: Synthetic oligonucleotide
gagcacctatctggtggccttcatcatttcag

SEQ ID NO: 85848 - DNA, 37 bp, Artificial Sequence
  Description of Artificial Sequence: Synthetic oligonucleotide
agcacctatctggtggccttcatcatttcagattttg

SEQ ID NO: 85849 - DNA, 36 bp, Artificial Sequence
  Description of Artificial Sequence: Synthetic oligonucleotide
gcacctatctggtggccttcatcatttcagattttg

SEQ ID NO: 85850 - DNA, 37 bp, Artificial Sequence
  Description of Artificial Sequence: Synthetic oligonucleotide
cacctatctggtggccttcatcatttcagattttgag

SEQ ID NO: 85851 - DNA, 38 bp, Artificial Sequence
  Description of Artificial Sequence: Synthetic oligonucleotide
acctatctggtggccttcatcatttcagattttgagtc

SEQ ID NO: 85852 - DNA, 37 bp, Artificial Sequence
  Description of Artificial Sequence: Synthetic oligonucleotide
cctatctggtggccttcatcatttcagattttgagtc

SEQ ID NO: 85853 - DNA, 38 bp, Artificial Sequence
  Description of Artificial Sequence: Synthetic oligonucleotide
ctatctggtggccttcatcatttcagattttgagtctg

SEQ ID NO: 85854 - DNA, 39 bp, Artificial Sequence
  Description of Artificial Sequence: Synthetic oligonucleotide
tatctggtggccttcatcatttcagattttgagtctgtc

SEQ ID NO: 85855 - DNA, 38 bp, Artificial Sequence
  Description of Artificial Sequence: Synthetic oligonucleotide
atctggtggccttcatcatttcagattttgagtctgtc

SEQ ID NO: 85856 - DNA, 37 bp, Artificial Sequence
  Description of Artificial Sequence: Synthetic oligonucleotide
tctggtggccttcatcatttcagattttgagtctgtc

SEQ ID NO: 85857 - DNA, 36 bp, Artificial Sequence
  Description of Artificial Sequence: Synthetic oligonucleotide
ctggtggccttcatcatttcagattttgagtctgtc

SEQ ID NO: 85858 - DNA, 37 bp, Artificial Sequence
  Description of Artificial Sequence: Synthetic oligonucleotide
tggtggccttcatcatttcagattttgagtctgtcag

SEQ ID NO: 85859 - DNA, 36 bp, Artificial Sequence
  Description of Artificial Sequence: Synthetic oligonucleotide
ggtggccttcatcatttcagattttgagtctgtcag

SEQ ID NO: 85860 - DNA, 36 bp, Artificial Sequence
  Description of Artificial Sequence: Synthetic oligonucleotide
gtggccttcatcatttcagattttgagtctgtcagc

SEQ ID NO: 85861 - DNA, 38 bp, Artificial Sequence
  Description of Artificial Sequence: Synthetic oligonucleotide
tggccttcatcatttcagattttgagtctgtcagcaag

SEQ ID NO: 85862 - DNA, 37 bp, Artificial Sequence
  Description of Artificial Sequence: Synthetic oligonucleotide
ggccttcatcatttcagattttgagtctgtcagcaag

SEQ ID NO: 85863 - DNA, 41 bp, Artificial Sequence
  Description of Artificial Sequence: Synthetic oligonucleotide
gccttcatcatttcagattttgagtctgtcagcaagataac

SEQ ID NO: 85864 - DNA, 41 bp, Artificial Sequence
  Description of Artificial Sequence: Synthetic oligonucleotide
ccttcatcatttcagattttgagtctgtcagcaagataacc

SEQ ID NO: 85865 - DNA, 43 bp, Artificial Sequence
  Description of Artificial Sequence: Synthetic oligonucleotide
cttcatcatttcagattttgagtctgtcagcaagataaccaag

SEQ ID NO: 85866 - DNA, 44 bp, Artificial Sequence
  Description of Artificial Sequence: Synthetic oligonucleotide
ttcatcatttcagattttgagtctgtcagcaagataaccaagag

SEQ ID NO: 85867 - DNA, 43 bp, Artificial Sequence
  Description of Artificial Sequence: Synthetic oligonucleotide
tcatcatttcagattttgagtctgtcagcaagataaccaagag

SEQ ID NO: 85868 - DNA, 42 bp, Artificial Sequence
  Description of Artificial Sequence: Synthetic oligonucleotide
catcatttcagattttgagtctgtcagcaagataaccaagag

SEQ ID NO: 85869 - DNA, 43 bp, Artificial Sequence
  Description of Artificial Sequence: Synthetic oligonucleotide
atcatttcagattttgagtctgtcagcaagataaccaagagtg

SEQ ID NO: 85870 - DNA, 42 bp, Artificial Sequence
  Description of Artificial Sequence: Synthetic oligonucleotide
tcatttcagattttgagtctgtcagcaagataaccaagagtg

SEQ ID NO: 85871 - DNA, 41 bp, Artificial Sequence
  Description of Artificial Sequence: Synthetic oligonucleotide
catttcagattttgagtctgtcagcaagataaccaagagtg

SEQ ID NO: 85872 - DNA, 41 bp, Artificial Sequence
  Description of Artificial Sequence: Synthetic oligonucleotide
atttcagattttgagtctgtcagcaagataaccaagagtgg

SEQ ID NO: 85873 - DNA, 40 bp, Artificial Sequence
  Description of Artificial Sequence: Synthetic oligonucleotide
tttcagattttgagtctgtcagcaagataaccaagagtgg

SEQ ID NO: 85874 - DNA, 39 bp, Artificial Sequence
  Description of Artificial Sequence: Synthetic oligonucleotide
ttcagattttgagtctgtcagcaagataaccaagagtgg

SEQ ID NO: 85875 - DNA, 38 bp, Artificial Sequence
  Description of Artificial Sequence: Synthetic oligonucleotide
tcagattttgagtctgtcagcaagataaccaagagtgg

SEQ ID NO: 85876 - DNA, 37 bp, Artificial Sequence
  Description of Artificial Sequence: Synthetic oligonucleotide
cagattttgagtctgtcagcaagataaccaagagtgg

SEQ ID NO: 85877 - DNA, 38 bp, Artificial Sequence
  Description of Artificial Sequence: Synthetic oligonucleotide
agattttgagtctgtcagcaagataaccaagagtggag

SEQ ID NO: 85878 - DNA, 37 bp, Artificial Sequence
  Description of Artificial Sequence: Synthetic oligonucleotide
gattttgagtctgtcagcaagataaccaagagtggag

SEQ ID NO: 85879 - DNA, 38 bp, Artificial Sequence
  Description of Artificial Sequence: Synthetic oligonucleotide
attttgagtctgtcagcaagataaccaagagtggagtc

SEQ ID NO: 85880 - DNA, 37 bp, Artificial Sequence
  Description of Artificial Sequence: Synthetic oligonucleotide
ttttgagtctgtcagcaagataaccaagagtggagtc

SEQ ID NO: 85881 - DNA, 36 bp, Artificial Sequence
  Description of Artificial Sequence: Synthetic oligonucleotide
tttgagtctgtcagcaagataaccaagagtggagtc

SEQ ID NO: 85882 - DNA, 35 bp, Artificial Sequence
  Description of Artificial Sequence: Synthetic oligonucleotide
ttgagtctgtcagcaagataaccaagagtggagtc

SEQ ID NO: 85883 - DNA, 34 bp, Artificial Sequence
  Description of Artificial Sequence: Synthetic oligonucleotide
tgagtctgtcagcaagataaccaagagtggagtc

SEQ ID NO: 85884 - DNA, 33 bp, Artificial Sequence
  Description of Artificial Sequence: Synthetic oligonucleotide
gagtctgtcagcaagataaccaagagtggagtc

SEQ ID NO: 85885 - DNA, 35 bp, Artificial Sequence
  Description of Artificial Sequence: Synthetic oligonucleotide
agtctgtcagcaagataaccaagagtggagtcaag

SEQ ID NO: 85886 - DNA, 34 bp, Artificial Sequence
  Description of Artificial Sequence: Synthetic oligonucleotide
gtctgtcagcaagataaccaagagtggagtcaag

SEQ ID NO: 85887 - DNA, 34 bp, Artificial Sequence
  Description of Artificial Sequence: Synthetic oligonucleotide
tctgtcagcaagataaccaagagtggagtcaagg

SEQ ID NO: 85888 - DNA, 33 bp, Artificial Sequence
  Description of Artificial Sequence: Synthetic oligonucleotide
ctgtcagcaagataaccaagagtggagtcaagg

SEQ ID NO: 85889 - DNA, 36 bp, Artificial Sequence
  Description of Artificial Sequence: Synthetic oligonucleotide
tgtcagcaagataaccaagagtggagtcaaggtttc

SEQ ID NO: 85890 - DNA, 35 bp, Artificial Sequence
  Description of Artificial Sequence: Synthetic oligonucleotide
gtcagcaagataaccaagagtggagtcaaggtttc

SEQ ID NO: 85891 - DNA, 36 bp, Artificial Sequence
  Description of Artificial Sequence: Synthetic oligonucleotide
tcagcaagataaccaagagtggagtcaaggtttctg

SEQ ID NO: 85892 - DNA, 35 bp, Artificial Sequence
  Description of Artificial Sequence: Synthetic oligonucleotide
cagcaagataaccaagagtggagtcaaggtttctg

SEQ ID NO: 85893 - DNA, 40 bp, Artificial Sequence
  Description of Artificial Sequence: Synthetic oligonucleotide
agcaagataaccaagagtggagtcaaggtttctgtttatg

SEQ ID NO: 85894 - DNA, 39 bp, Artificial Sequence
  Description of Artificial Sequence: Synthetic oligonucleotide
gcaagataaccaagagtggagtcaaggtttctgtttatg

SEQ ID NO: 85895 - DNA, 39 bp, Artificial Sequence
  Description of Artificial Sequence: Synthetic oligonucleotide
caagataaccaagagtggagtcaaggtttctgtttatgc

SEQ ID NO: 85896 - DNA, 40 bp, Artificial Sequence
  Description of Artificial Sequence: Synthetic oligonucleotide
aagataaccaagagtggagtcaaggtttctgtttatgctg

SEQ ID NO: 85897 - DNA, 39 bp, Artificial Sequence
  Description of Artificial Sequence: Synthetic oligonucleotide
agataaccaagagtggagtcaaggtttctgtttatgctg

SEQ ID NO: 85898 - DNA, 38 bp, Artificial Sequence
  Description of Artificial Sequence: Synthetic oligonucleotide
gataaccaagagtggagtcaaggtttctgtttatgctg

SEQ ID NO: 85899 - DNA, 39 bp, Artificial Sequence
  Description of Artificial Sequence: Synthetic oligonucleotide
ataaccaagagtggagtcaaggtttctgtttatgctgtg

SEQ ID NO: 85900 - DNA, 38 bp, Artificial Sequence
  Description of Artificial Sequence: Synthetic oligonucleotide
taaccaagagtggagtcaaggtttctgtttatgctgtg

SEQ ID NO: 85901 - DNA, 37 bp, Artificial Sequence
  Description of Artificial Sequence: Synthetic oligonucleotide
aaccaagagtggagtcaaggtttctgtttatgctgtg

SEQ ID NO: 85902 - DNA, 36 bp, Artificial Sequence
  Description of Artificial Sequence: Synthetic oligonucleotide
accaagagtggagtcaaggtttctgtttatgctgtg

SEQ ID NO: 85903 - DNA, 35 bp, Artificial Sequence
  Description of Artificial Sequence: Synthetic oligonucleotide
ccaagagtggagtcaaggtttctgtttatgctgtg

SEQ ID NO: 85904 - DNA, 35 bp, Artificial Sequence
  Description of Artificial Sequence: Synthetic oligonucleotide
caagagtggagtcaaggtttctgtttatgctgtgc

SEQ ID NO: 85905 - DNA, 35 bp, Artificial Sequence
  Description of Artificial Sequence: Synthetic oligonucleotide
aagagtggagtcaaggtttctgtttatgctgtgcc

SEQ ID NO: 85906 - DNA, 34 bp, Artificial Sequence
  Description of Artificial Sequence: Synthetic oligonucleotide
agagtggagtcaaggtttctgtttatgctgtgcc

SEQ ID NO: 85907 - DNA, 33 bp, Artificial Sequence
  Description of Artificial Sequence: Synthetic oligonucleotide
gagtggagtcaaggtttctgtttatgctgtgcc

SEQ ID NO: 85908 - DNA, 34 bp, Artificial Sequence
  Description of Artificial Sequence: Synthetic oligonucleotide
agtggagtcaaggtttctgtttatgctgtgccag

SEQ ID NO: 85909 - DNA, 33 bp, Artificial Sequence
  Description of Artificial Sequence: Synthetic oligonucleotide
gtggagtcaaggtttctgtttatgctgtgccag

SEQ ID NO: 85910 - DNA, 34 bp, Artificial Sequence
  Description of Artificial Sequence: Synthetic oligonucleotide
tggagtcaaggtttctgtttatgctgtgccagac

SEQ ID NO: 85911 - DNA, 33 bp, Artificial Sequence
  Description of Artificial Sequence: Synthetic oligonucleotide
ggagtcaaggtttctgtttatgctgtgccagac

SEQ ID NO: 85912 - DNA, 35 bp, Artificial Sequence
  Description of Artificial Sequence: Synthetic oligonucleotide
gagtcaaggtttctgtttatgctgtgccagacaag

SEQ ID NO: 85913 - DNA, 41 bp, Artificial Sequence
  Description of Artificial Sequence: Synthetic oligonucleotide
agtcaaggtttctgtttatgctgtgccagacaagataaatc

SEQ ID NO: 85914 - DNA, 40 bp, Artificial Sequence
  Description of Artificial Sequence: Synthetic oligonucleotide
gtcaaggtttctgtttatgctgtgccagacaagataaatc

SEQ ID NO: 85915 - DNA, 42 bp, Artificial Sequence
  Description of Artificial Sequence: Synthetic oligonucleotide
tcaaggtttctgtttatgctgtgccagacaagataaatcaag

SEQ ID NO: 85916 - DNA, 41 bp, Artificial Sequence
  Description of Artificial Sequence: Synthetic oligonucleotide
caaggtttctgtttatgctgtgccagacaagataaatcaag

SEQ ID NO: 85917 - DNA, 41 bp, Artificial Sequence
  Description of Artificial Sequence: Synthetic oligonucleotide
aaggtttctgtttatgctgtgccagacaagataaatcaagc

SEQ ID NO: 85918 - DNA, 40 bp, Artificial Sequence
  Description of Artificial Sequence: Synthetic oligonucleotide
aggtttctgtttatgctgtgccagacaagataaatcaagc

SEQ ID NO: 85919 - DNA, 39 bp, Artificial Sequence
  Description of Artificial Sequence: Synthetic oligonucleotide
ggtttctgtttatgctgtgccagacaagataaatcaagc

SEQ ID NO: 85920 - DNA, 40 bp, Artificial Sequence
  Description of Artificial Sequence: Synthetic oligonucleotide
gtttctgtttatgctgtgccagacaagataaatcaagcag

SEQ ID NO: 85921 - DNA, 45 bp, Artificial Sequence
  Description of Artificial Sequence: Synthetic oligonucleotide
tttctgtttatgctgtgccagacaagataaatcaagcagattatg

SEQ ID NO: 85922 - DNA, 44 bp, Artificial Sequence
  Description of Artificial Sequence: Synthetic oligonucleotide
ttctgtttatgctgtgccagacaagataaatcaagcagattatg

SEQ ID NO: 85923 - DNA, 43 bp, Artificial Sequence
  Description of Artificial Sequence: Synthetic oligonucleotide
tctgtttatgctgtgccagacaagataaatcaagcagattatg

SEQ ID NO: 85924 - DNA, 42 bp, Artificial Sequence
  Description of Artificial Sequence: Synthetic oligonucleotide
ctgtttatgctgtgccagacaagataaatcaagcagattatg

SEQ ID NO: 85925 - DNA, 42 bp, Artificial Sequence
  Description of Artificial Sequence: Synthetic oligonucleotide
tgtttatgctgtgccagacaagataaatcaagcagattatgc

SEQ ID NO: 85926 - DNA, 41 bp, Artificial Sequence
  Description of Artificial Sequence: Synthetic oligonucleotide
gtttatgctgtgccagacaagataaatcaagcagattatgc

SEQ ID NO: 85927 - DNA, 42 bp, Artificial Sequence
  Description of Artificial Sequence: Synthetic oligonucleotide
tttatgctgtgccagacaagataaatcaagcagattatgcac

SEQ ID NO: 85928 - DNA, 41 bp, Artificial Sequence
  Description of Artificial Sequence: Synthetic oligonucleotide
ttatgctgtgccagacaagataaatcaagcagattatgcac

SEQ ID NO: 85929 - DNA, 40 bp, Artificial Sequence
  Description of Artificial Sequence: Synthetic oligonucleotide
tatgctgtgccagacaagataaatcaagcagattatgcac

SEQ ID NO: 85930 - DNA, 39 bp, Artificial Sequence
  Description of Artificial Sequence: Synthetic oligonucleotide
atgctgtgccagacaagataaatcaagcagattatgcac

SEQ ID NO: 85931 - DNA, 38 bp, Artificial Sequence
  Description of Artificial Sequence: Synthetic oligonucleotide
tgctgtgccagacaagataaatcaagcagattatgcac

SEQ ID NO: 85932 - DNA, 37 bp, Artificial Sequence
  Description of Artificial Sequence: Synthetic oligonucleotide
gctgtgccagacaagataaatcaagcagattatgcac

SEQ ID NO: 85933 - DNA, 38 bp, Artificial Sequence
  Description of Artificial Sequence: Synthetic oligonucleotide
ctgtgccagacaagataaatcaagcagattatgcactg

SEQ ID NO: 85934 - DNA, 38 bp, Artificial Sequence
  Description of Artificial Sequence: Synthetic oligonucleotide
tgtgccagacaagataaatcaagcagattatgcactgg

SEQ ID NO: 85935 - DNA, 37 bp, Artificial Sequence
  Description of Artificial Sequence: Synthetic oligonucleotide
gtgccagacaagataaatcaagcagattatgcactgg

SEQ ID NO: 85936 - DNA, 39 bp, Artificial Sequence
  Description of Artificial Sequence: Synthetic oligonucleotide
tgccagacaagataaatcaagcagattatgcactggatg

SEQ ID NO: 85937 - DNA, 38 bp, Artificial Sequence
  Description of Artificial Sequence: Synthetic oligonucleotide
gccagacaagataaatcaagcagattatgcactggatg

SEQ ID NO: 85938 - DNA, 38 bp, Artificial Sequence
  Description of Artificial Sequence: Synthetic oligonucleotide
ccagacaagataaatcaagcagattatgcactggatgc

SEQ ID NO: 85939 - DNA, 39 bp, Artificial Sequence
  Description of Artificial Sequence: Synthetic oligonucleotide
cagacaagataaatcaagcagattatgcactggatgctg

SEQ ID NO: 85940 - DNA, 39 bp, Artificial Sequence
  Description of Artificial Sequence: Synthetic oligonucleotide
agacaagataaatcaagcagattatgcactggatgctgc

SEQ ID NO: 85941 - DNA, 38 bp, Artificial Sequence
  Description of Artificial Sequence: Synthetic oligonucleotide
gacaagataaatcaagcagattatgcactggatgctgc

SEQ ID NO: 85942 - DNA, 38 bp, Artificial Sequence
  Description of Artificial Sequence: Synthetic oligonucleotide
acaagataaatcaagcagattatgcactggatgctgcg

SEQ ID NO: 85943 - DNA, 37 bp, Artificial Sequence
  Description of Artificial Sequence: Synthetic oligonucleotide
caagataaatcaagcagattatgcactggatgctgcg

SEQ ID NO: 85944 - DNA, 37 bp, Artificial Sequence
  Description of Artificial Sequence: Synthetic oligonucleotide
aagataaatcaagcagattatgcactggatgctgcgg

SEQ ID NO: 85945 - DNA, 36 bp, Artificial Sequence
  Description of Artificial Sequence: Synthetic oligonucleotide
agataaatcaagcagattatgcactggatgctgcgg

SEQ ID NO: 85946 - DNA, 35 bp, Artificial Sequence
  Description of Artificial Sequence: Synthetic oligonucleotide
gataaatcaagcagattatgcactggatgctgcgg

SEQ ID NO: 85947 - DNA, 36 bp, Artificial Sequence
  Description of Artificial Sequence: Synthetic oligonucleotide
ataaatcaagcagattatgcactggatgctgcggtg

SEQ ID NO: 85948 - DNA, 35 bp, Artificial Sequence
  Description of Artificial Sequence: Synthetic oligonucleotide
taaatcaagcagattatgcactggatgctgcggtg

SEQ ID NO: 85949 - DNA, 34 bp, Artificial Sequence
  Description of Artificial Sequence: Synthetic oligonucleotide
aaatcaagcagattatgcactggatgctgcggtg

SEQ ID NO: 85950 - DNA, 33 bp, Artificial Sequence
  Description of Artificial Sequence: Synthetic oligonucleotide
aatcaagcagattatgcactggatgctgcggtg

SEQ ID NO: 85951 - DNA, 32 bp, Artificial Sequence
  Description of Artificial Sequence: Synthetic oligonucleotide
atcaagcagattatgcactggatgctgcggtg

SEQ ID NO: 85952 - DNA, 31 bp, Artificial Sequence
  Description of Artificial Sequence: Synthetic oligonucleotide
tcaagcagattatgcactggatgctgcggtg

SEQ ID NO: 85953 - DNA, 30 bp, Artificial Sequence
  Description of Artificial Sequence: Synthetic oligonucleotide
caagcagattatgcactggatgctgcggtg

SEQ ID NO: 85954 - DNA, 31 bp, Artificial Sequence
  Description of Artificial Sequence: Synthetic oligonucleotide
aagcagattatgcactggatgctgcggtgac

SEQ ID NO: 85955 - DNA, 30 bp, Artificial Sequence
  Description of Artificial Sequence: Synthetic oligonucleotide
agcagattatgcactggatgctgcggtgac

SEQ ID NO: 85956 - DNA, 29 bp, Artificial Sequence
  Description of Artificial Sequence: Synthetic oligonucleotide
gcagattatgcactggatgctgcggtgac

SEQ ID NO: 85957 - DNA, 30 bp, Artificial Sequence
  Description of Artificial Sequence: Synthetic oligonucleotide
cagattatgcactggatgctgcggtgactc

SEQ ID NO: 85958 - DNA, 32 bp, Artificial Sequence
  Description of Artificial Sequence: Synthetic oligonucleotide
agattatgcactggatgctgcggtgactcttc

SEQ ID NO: 85959 - DNA, 31 bp, Artificial Sequence
  Description of Artificial Sequence: Synthetic oligonucleotide
gattatgcactggatgctgcggtgactcttc

SEQ ID NO: 85960 - DNA, 33 bp, Artificial Sequence
  Description of Artificial Sequence: Synthetic oligonucleotide
attatgcactggatgctgcggtgactcttctag

SEQ ID NO: 85961 - DNA, 32 bp, Artificial Sequence
  Description of Artificial Sequence: Synthetic oligonucleotide
ttatgcactggatgctgcggtgactcttctag

SEQ ID NO: 85962 - DNA, 31 bp, Artificial Sequence
  Description of Artificial Sequence: Synthetic oligonucleotide
tatgcactggatgctgcggtgactcttctag

SEQ ID NO: 85963 - DNA, 30 bp, Artificial Sequence
  Description of Artificial Sequence: Synthetic oligonucleotide
atgcactggatgctgcggtgactcttctag

SEQ ID NO: 85964 - DNA, 29 bp, Artificial Sequence
  Description of Artificial Sequence: Synthetic oligonucleotide
tgcactggatgctgcggtgactcttctag

SEQ ID NO: 85965 - DNA, 28 bp, Artificial Sequence
  Description of Artificial Sequence: Synthetic oligonucleotide
gcactggatgctgcggtgactcttctag

SEQ ID NO: 85966 - DNA, 36 bp, Artificial Sequence
  Description of Artificial Sequence: Synthetic oligonucleotide
cactggatgctgcggtgactcttctagaattttatg

SEQ ID NO: 85967 - DNA, 37 bp, Artificial Sequence
  Description of Artificial Sequence: Synthetic oligonucleotide
actggatgctgcggtgactcttctagaattttatgag

SEQ ID NO: 85968 - DNA, 36 bp, Artificial Sequence
  Description of Artificial Sequence: Synthetic oligonucleotide
ctggatgctgcggtgactcttctagaattttatgag

SEQ ID NO: 85969 - DNA, 36 bp, Artificial Sequence
  Description of Artificial Sequence: Synthetic oligonucleotide
tggatgctgcggtgactcttctagaattttatgagg

SEQ ID NO: 85970 - DNA, 35 bp, Artificial Sequence
  Description of Artificial Sequence: Synthetic oligonucleotide
ggatgctgcggtgactcttctagaattttatgagg

SEQ ID NO: 85971 - DNA, 42 bp, Artificial Sequence
  Description of Artificial Sequence: Synthetic oligonucleotide
gatgctgcggtgactcttctagaattttatgaggattatttc

SEQ ID NO: 85972 - DNA, 43 bp, Artificial Sequence
  Description of Artificial Sequence: Synthetic oligonucleotide
atgctgcggtgactcttctagaattttatgaggattatttcag

SEQ ID NO: 85973 - DNA, 42 bp, Artificial Sequence
  Description of Artificial Sequence: Synthetic oligonucleotide
tgctgcggtgactcttctagaattttatgaggattatttcag

SEQ ID NO: 85974 - DNA, 41 bp, Artificial Sequence
  Description of Artificial Sequence: Synthetic oligonucleotide
gctgcggtgactcttctagaattttatgaggattatttcag

SEQ ID NO: 85975 - DNA, 41 bp, Artificial Sequence
  Description of Artificial Sequence: Synthetic oligonucleotide
ctgcggtgactcttctagaattttatgaggattatttcagc

SEQ ID NO: 85976 - DNA, 44 bp, Artificial Sequence
  Description of Artificial Sequence: Synthetic oligonucleotide
tgcggtgactcttctagaattttatgaggattatttcagcatac

SEQ ID NO: 85977 - DNA, 43 bp, Artificial Sequence
  Description of Artificial Sequence: Synthetic oligonucleotide
gcggtgactcttctagaattttatgaggattatttcagcatac

SEQ ID NO: 85978 - DNA, 43 bp, Artificial Sequence
  Description of Artificial Sequence: Synthetic oligonucleotide
cggtgactcttctagaattttatgaggattatttcagcatacc

SEQ ID NO: 85979 - DNA, 43 bp, Artificial Sequence
  Description of Artificial Sequence: Synthetic oligonucleotide
ggtgactcttctagaattttatgaggattatttcagcataccg

SEQ ID NO: 85980 - DNA, 46 bp, Artificial Sequence
  Description of Artificial Sequence: Synthetic oligonucleotide
gtgactcttctagaattttatgaggattatttcagcataccgtatc

SEQ ID NO: 85981 - DNA, 46 bp, Artificial Sequence
  Description of Artificial Sequence: Synthetic oligonucleotide
tgactcttctagaattttatgaggattatttcagcataccgtatcc

SEQ ID NO: 85982 - DNA, 45 bp, Artificial Sequence
  Description of Artificial Sequence: Synthetic oligonucleotide
gactcttctagaattttatgaggattatttcagcataccgtatcc

SEQ ID NO: 85983 - DNA, 45 bp, Artificial Sequence
  Description of Artificial Sequence: Synthetic oligonucleotide
actcttctagaattttatgaggattatttcagcataccgtatccc

SEQ ID NO: 85984 - DNA, 44 bp, Artificial Sequence
  Description of Artificial Sequence: Synthetic oligonucleotide
ctcttctagaattttatgaggattatttcagcataccgtatccc

SEQ ID NO: 85985 - DNA, 44 bp, Artificial Sequence
  Description of Artificial Sequence: Synthetic oligonucleotide
tcttctagaattttatgaggattatttcagcataccgtatcccc

SEQ ID NO: 85986 - DNA, 43 bp, Artificial Sequence
  Description of Artificial Sequence: Synthetic oligonucleotide
cttctagaattttatgaggattatttcagcataccgtatcccc

SEQ ID NO: 85987 - DNA, 45 bp, Artificial Sequence
  Description of Artificial Sequence: Synthetic oligonucleotide
ttctagaattttatgaggattatttcagcataccgtatcccctac

SEQ ID NO: 85988 - DNA, 44 bp, Artificial Sequence
  Description of Artificial Sequence: Synthetic oligonucleotide
tctagaattttatgaggattatttcagcataccgtatcccctac

SEQ ID NO: 85989 - DNA, 43 bp, Artificial Sequence
  Description of Artificial Sequence: Synthetic oligonucleotide
ctagaattttatgaggattatttcagcataccgtatcccctac

SEQ ID NO: 85990 - DNA, 43 bp, Artificial Sequence
  Description of Artificial Sequence: Synthetic oligonucleotide
tagaattttatgaggattatttcagcataccgtatcccctacc

SEQ ID NO: 85991 - DNA, 42 bp, Artificial Sequence
  Description of Artificial Sequence: Synthetic oligonucleotide
agaattttatgaggattatttcagcataccgtatcccctacc

SEQ ID NO: 85992 - DNA, 41 bp, Artificial Sequence
  Description of Artificial Sequence: Synthetic oligonucleotide
gaattttatgaggattatttcagcataccgtatcccctacc

SEQ ID NO: 85993 - DNA, 41 bp, Artificial Sequence
  Description of Artificial Sequence: Synthetic oligonucleotide
aattttatgaggattatttcagcataccgtatcccctaccc

SEQ ID NO: 85994 - DNA, 40 bp, Artificial Sequence
  Description of Artificial Sequence: Synthetic oligonucleotide
attttatgaggattatttcagcataccgtatcccctaccc

SEQ ID NO: 85995 - DNA, 39 bp, Artificial Sequence
  Description of Artificial Sequence: Synthetic oligonucleotide
ttttatgaggattatttcagcataccgtatcccctaccc

SEQ ID NO: 85996 - DNA, 38 bp, Artificial Sequence
  Description of Artificial Sequence: Synthetic oligonucleotide
tttatgaggattatttcagcataccgtatcccctaccc

SEQ ID NO: 85997 - DNA, 37 bp, Artificial Sequence
  Description of Artificial Sequence: Synthetic oligonucleotide
ttatgaggattatttcagcataccgtatcccctaccc

SEQ ID NO: 85998 - DNA, 36 bp, Artificial Sequence
  Description of Artificial Sequence: Synthetic oligonucleotide
tatgaggattatttcagcataccgtatcccctaccc

SEQ ID NO: 85999 - DNA, 35 bp, Artificial Sequence
  Description of Artificial Sequence: Synthetic oligonucleotide
atgaggattatttcagcataccgtatcccctaccc

SEQ ID NO: 86000 - DNA, 34 bp, Artificial Sequence
  Description of Artificial Sequence: Synthetic oligonucleotide
tgaggattatttcagcataccgtatcccctaccc

SEQ ID NO: 86001 - DNA, 33 bp, Artificial Sequence
  Description of Artificial Sequence: Synthetic oligonucleotide
gaggattatttcagcataccgtatcccctaccc

SEQ ID NO: 86002 - DNA, 36 bp, Artificial Sequence
  Description of Artificial Sequence: Synthetic oligonucleotide
aggattatttcagcataccgtatcccctacccaaac

SEQ ID NO: 86003 - DNA, 35 bp, Artificial Sequence
  Description of Artificial Sequence: Synthetic oligonucleotide
ggattatttcagcataccgtatcccctacccaaac

SEQ ID NO: 86004 - DNA, 37 bp, Artificial Sequence
  Description of Artificial Sequence: Synthetic oligonucleotide
gattatttcagcataccgtatcccctacccaaacaag

SEQ ID NO: 86005 - DNA, 39 bp, Artificial Sequence
  Description of Artificial Sequence: Synthetic oligonucleotide
attatttcagcataccgtatcccctacccaaacaagatc

SEQ ID NO: 86006 - DNA, 38 bp, Artificial Sequence
  Description of Artificial Sequence: Synthetic oligonucleotide
ttatttcagcataccgtatcccctacccaaacaagatc

SEQ ID NO: 86007 - DNA, 37 bp, Artificial Sequence
  Description of Artificial Sequence: Synthetic oligonucleotide
tatttcagcataccgtatcccctacccaaacaagatc

SEQ ID NO: 86008 - DNA, 36 bp, Artificial Sequence
  Description of Artificial Sequence: Synthetic oligonucleotide
atttcagcataccgtatcccctacccaaacaagatc

SEQ ID NO: 86009 - DNA, 35 bp, Artificial Sequence
  Description of Artificial Sequence: Synthetic oligonucleotide
tttcagcataccgtatcccctacccaaacaagatc

SEQ ID NO: 86010 - DNA, 34 bp, Artificial Sequence
  Description of Artificial Sequence: Synthetic oligonucleotide
ttcagcataccgtatcccctacccaaacaagatc

SEQ ID NO: 86011 - DNA, 33 bp, Artificial Sequence
  Description of Artificial Sequence: Synthetic oligonucleotide
tcagcataccgtatcccctacccaaacaagatc

SEQ ID NO: 86012 - DNA, 32 bp, Artificial Sequence
  Description of Artificial Sequence: Synthetic oligonucleotide
cagcataccgtatcccctacccaaacaagatc

SEQ ID NO: 86013 - DNA, 34 bp, Artificial Sequence
  Description of Artificial Sequence: Synthetic oligonucleotide
agcataccgtatcccctacccaaacaagatcttg

SEQ ID NO: 86014 - DNA, 33 bp, Artificial Sequence
  Description of Artificial Sequence: Synthetic oligonucleotide
gcataccgtatcccctacccaaacaagatcttg

SEQ ID NO: 86015 - DNA, 33 bp, Artificial Sequence
  Description of Artificial Sequence: Synthetic oligonucleotide
cataccgtatcccctacccaaacaagatcttgc

SEQ ID NO: 86016 - DNA, 34 bp, Artificial Sequence
  Description of Artificial Sequence: Synthetic oligonucleotide
ataccgtatcccctacccaaacaagatcttgctg

SEQ ID NO: 86017 - DNA, 33 bp, Artificial Sequence
  Description of Artificial Sequence: Synthetic oligonucleotide
taccgtatcccctacccaaacaagatcttgctg

SEQ ID NO: 86018 - DNA, 32 bp, Artificial Sequence
  Description of Artificial Sequence: Synthetic oligonucleotide
accgtatcccctacccaaacaagatcttgctg

SEQ ID NO: 86019 - DNA, 31 bp, Artificial Sequence
  Description of Artificial Sequence: Synthetic oligonucleotide
ccgtatcccctacccaaacaagatcttgctg

SEQ ID NO: 86020 - DNA, 31 bp, Artificial Sequence
  Description of Artificial Sequence: Synthetic oligonucleotide
cgtatcccctacccaaacaagatcttgctgc

SEQ ID NO: 86021 - DNA, 35 bp, Artificial Sequence
  Description of Artificial Sequence: Synthetic oligonucleotide
gtatcccctacccaaacaagatcttgctgctattc

SEQ ID NO: 86022 - DNA, 35 bp, Artificial Sequence
  Description of Artificial Sequence: Synthetic oligonucleotide
tatcccctacccaaacaagatcttgctgctattcc

SEQ ID NO: 86023 - DNA, 34 bp, Artificial Sequence
  Description of Artificial Sequence: Synthetic oligonucleotide
atcccctacccaaacaagatcttgctgctattcc

SEQ ID NO: 86024 - DNA, 33 bp, Artificial Sequence
  Description of Artificial Sequence: Synthetic oligonucleotide
tcccctacccaaacaagatcttgctgctattcc

SEQ ID NO: 86025 - DNA, 32 bp, Artificial Sequence
  Description of Artificial Sequence: Synthetic oligonucleotide
cccctacccaaacaagatcttgctgctattcc

SEQ ID NO: 86026 - DNA, 32 bp, Artificial Sequence
  Description of Artificial Sequence: Synthetic oligonucleotide
ccctacccaaacaagatcttgctgctattccc

SEQ ID NO: 86027 - DNA, 32 bp, Artificial Sequence
  Description of Artificial Sequence: Synthetic oligonucleotide
cctacccaaacaagatcttgctgctattcccg

SEQ ID NO: 86028 - DNA, 33 bp, Artificial Sequence
  Description of Artificial Sequence: Synthetic oligonucleotide
ctacccaaacaagatcttgctgctattcccgac

SEQ ID NO: 86029 - DNA, 36 bp, Artificial Sequence
  Description of Artificial Sequence: Synthetic oligonucleotide
tacccaaacaagatcttgctgctattcccgactttc

SEQ ID NO: 86030 - DNA, 35 bp, Artificial Sequence
  Description of Artificial Sequence: Synthetic oligonucleotide
acccaaacaagatcttgctgctattcccgactttc

SEQ ID NO: 86031 - DNA, 34 bp, Artificial Sequence
  Description of Artificial Sequence: Synthetic oligonucleotide
cccaaacaagatcttgctgctattcccgactttc

SEQ ID NO: 86032 - DNA, 35 bp, Artificial Sequence
  Description of Artificial Sequence: Synthetic oligonucleotide
ccaaacaagatcttgctgctattcccgactttcag

SEQ ID NO: 86033 - DNA, 36 bp, Artificial Sequence
  Description of Artificial Sequence: Synthetic oligonucleotide
caaacaagatcttgctgctattcccgactttcagtc

SEQ ID NO: 86034 - DNA, 37 bp, Artificial Sequence
  Description of Artificial Sequence: Synthetic oligonucleotide
aaacaagatcttgctgctattcccgactttcagtctg

SEQ ID NO: 86035 - DNA, 36 bp, Artificial Sequence
  Description of Artificial Sequence: Synthetic oligonucleotide
aacaagatcttgctgctattcccgactttcagtctg

SEQ ID NO: 86036 - DNA, 35 bp, Artificial Sequence
  Description of Artificial Sequence: Synthetic oligonucleotide
acaagatcttgctgctattcccgactttcagtctg

SEQ ID NO: 86037 - DNA, 34 bp, Artificial Sequence
  Description of Artificial Sequence: Synthetic oligonucleotide
caagatcttgctgctattcccgactttcagtctg

SEQ ID NO: 86038 - DNA, 34 bp, Artificial Sequence
  Description of Artificial Sequence: Synthetic oligonucleotide
aagatcttgctgctattcccgactttcagtctgg

SEQ ID NO: 86039 - DNA, 33 bp, Artificial Sequence
  Description of Artificial Sequence: Synthetic oligonucleotide
agatcttgctgctattcccgactttcagtctgg

SEQ ID NO: 86040 - DNA, 32 bp, Artificial Sequence
  Description of Artificial Sequence: Synthetic oligonucleotide
gatcttgctgctattcccgactttcagtctgg

SEQ ID NO: 86041 - DNA, 33 bp, Artificial Sequence
  Description of Artificial Sequence: Synthetic oligonucleotide
atcttgctgctattcccgactttcagtctggtg

SEQ ID NO: 86042 - DNA, 32 bp, Artificial Sequence
  Description of Artificial Sequence: Synthetic oligonucleotide
tcttgctgctattcccgactttcagtctggtg

SEQ ID NO: 86043 - DNA, 31 bp, Artificial Sequence
  Description of Artificial Sequence: Synthetic oligonucleotide
cttgctgctattcccgactttcagtctggtg

SEQ ID NO: 86044 - DNA, 31 bp, Artificial Sequence
  Description of Artificial Sequence: Synthetic oligonucleotide
ttgctgctattcccgactttcagtctggtgc

SEQ ID NO: 86045 - DNA, 30 bp, Artificial Sequence
  Description of Artificial Sequence: Synthetic oligonucleotide
tgctgctattcccgactttcagtctggtgc

SEQ ID NO: 86046 - DNA, 29 bp, Artificial Sequence
  Description of Artificial Sequence: Synthetic oligonucleotide
gctgctattcccgactttcagtctggtgc

SEQ ID NO: 86047 - DNA, 32 bp, Artificial Sequence
  Description of Artificial Sequence: Synthetic oligonucleotide
ctgctattcccgactttcagtctggtgctatg

SEQ ID NO: 86048 - DNA, 32 bp, Artificial Sequence
  Description of Artificial Sequence: Synthetic oligonucleotide
tgctattcccgactttcagtctggtgctatgg

SEQ ID NO: 86049 - DNA, 31 bp, Artificial Sequence
  Description of Artificial Sequence: Synthetic oligonucleotide
gctattcccgactttcagtctggtgctatgg

SEQ ID NO: 86050 - DNA, 35 bp, Artificial Sequence
  Description of Artificial Sequence: Synthetic oligonucleotide
ctattcccgactttcagtctggtgctatggaaaac

SEQ ID NO: 86051 - DNA, 36 bp, Artificial Sequence
  Description of Artificial Sequence: Synthetic oligonucleotide
tattcccgactttcagtctggtgctatggaaaactg

SEQ ID NO: 86052 - DNA, 35 bp, Artificial Sequence
  Description of Artificial Sequence: Synthetic oligonucleotide
attcccgactttcagtctggtgctatggaaaactg

SEQ ID NO: 86053 - DNA, 34 bp, Artificial Sequence
  Description of Artificial Sequence: Synthetic oligonucleotide
ttcccgactttcagtctggtgctatggaaaactg

SEQ ID NO: 86054 - DNA, 33 bp, Artificial Sequence
  Description of Artificial Sequence: Synthetic oligonucleotide
tcccgactttcagtctggtgctatggaaaactg

SEQ ID NO: 86055 - DNA, 32 bp, Artificial Sequence
  Description of Artificial Sequence: Synthetic oligonucleotide
cccgactttcagtctggtgctatggaaaactg

SEQ ID NO: 86056 - DNA, 32 bp, Artificial Sequence
  Description of Artificial Sequence: Synthetic oligonucleotide
ccgactttcagtctggtgctatggaaaactgg

SEQ ID NO: 86057 - DNA, 32 bp, Artificial Sequence
  Description of Artificial Sequence: Synthetic oligonucleotide
cgactttcagtctggtgctatggaaaactggg

SEQ ID NO: 86058 - DNA, 32 bp, Artificial Sequence
  Description of Artificial Sequence: Synthetic oligonucleotide
gactttcagtctggtgctatggaaaactgggg

SEQ ID NO: 86059 - DNA, 33 bp, Artificial Sequence
  Description of Artificial Sequence: Synthetic oligonucleotide
actttcagtctggtgctatggaaaactggggac

SEQ ID NO: 86060 - DNA, 32 bp, Artificial Sequence
  Description of Artificial Sequence: Synthetic oligonucleotide
ctttcagtctggtgctatggaaaactggggac

SEQ ID NO: 86061 - DNA, 33 bp, Artificial Sequence
  Description of Artificial Sequence: Synthetic oligonucleotide
tttcagtctggtgctatggaaaactggggactg

SEQ ID NO: 86062 - DNA, 32 bp, Artificial Sequence
  Description of Artificial Sequence: Synthetic oligonucleotide
ttcagtctggtgctatggaaaactggggactg

SEQ ID NO: 86063 - DNA, 31 bp, Artificial Sequence
  Description of Artificial Sequence: Synthetic oligonucleotide
tcagtctggtgctatggaaaactggggactg

SEQ ID NO: 86064 - DNA, 30 bp, Artificial Sequence
  Description of Artificial Sequence: Synthetic oligonucleotide
cagtctggtgctatggaaaactggggactg

SEQ ID NO: 86065 - DNA, 31 bp, Artificial Sequence
  Description of Artificial Sequence: Synthetic oligonucleotide
agtctggtgctatggaaaactggggactgac

SEQ ID NO: 86066 - DNA, 30 bp, Artificial Sequence
  Description of Artificial Sequence: Synthetic oligonucleotide
gtctggtgctatggaaaactggggactgac

SEQ ID NO: 86067 - DNA, 32 bp, Artificial Sequence
  Description of Artificial Sequence: Synthetic oligonucleotide
tctggtgctatggaaaactggggactgacaac

SEQ ID NO: 86068 - DNA, 31 bp, Artificial Sequence
  Description of Artificial Sequence: Synthetic oligonucleotide
ctggtgctatggaaaactggggactgacaac

SEQ ID NO: 86069 - DNA, 36 bp, Artificial Sequence
  Description of Artificial Sequence: Synthetic oligonucleotide
tggtgctatggaaaactggggactgacaacatatag

SEQ ID NO: 86070 - DNA, 35 bp, Artificial Sequence
  Description of Artificial Sequence: Synthetic oligonucleotide
ggtgctatggaaaactggggactgacaacatatag

SEQ ID NO: 86071 - DNA, 36 bp, Artificial Sequence
  Description of Artificial Sequence: Synthetic oligonucleotide
gtgctatggaaaactggggactgacaacatatagag

SEQ ID NO: 86072 - DNA, 39 bp, Artificial Sequence
  Description of Artificial Sequence: Synthetic oligonucleotide
tgctatggaaaactggggactgacaacatatagagaatc

SEQ ID NO: 86073 - DNA, 38 bp, Artificial Sequence
  Description of Artificial Sequence: Synthetic oligonucleotide
gctatggaaaactggggactgacaacatatagagaatc

SEQ ID NO: 86074 - DNA, 39 bp, Artificial Sequence
  Description of Artificial Sequence: Synthetic oligonucleotide
ctatggaaaactggggactgacaacatatagagaatctg

SEQ ID NO: 86075 - DNA, 39 bp, Artificial Sequence
  Description of Artificial Sequence: Synthetic oligonucleotide
tatggaaaactggggactgacaacatatagagaatctgc

SEQ ID NO: 86076 - DNA, 38 bp, Artificial Sequence
  Description of Artificial Sequence: Synthetic oligonucleotide
atggaaaactggggactgacaacatatagagaatctgc

SEQ ID NO: 86077 - DNA, 37 bp, Artificial Sequence
  Description of Artificial Sequence: Synthetic oligonucleotide
tggaaaactggggactgacaacatatagagaatctgc

SEQ ID NO: 86078 - DNA, 36 bp, Artificial Sequence
  Description of Artificial Sequence: Synthetic oligonucleotide
ggaaaactggggactgacaacatatagagaatctgc

SEQ ID NO: 86079 - DNA, 37 bp, Artificial Sequence
  Description of Artificial Sequence: Synthetic oligonucleotide
gaaaactggggactgacaacatatagagaatctgctc

SEQ ID NO: 86080 - DNA, 38 bp, Artificial Sequence
  Description of Artificial Sequence: Synthetic oligonucleotide
aaaactggggactgacaacatatagagaatctgctctg

SEQ ID NO: 86081 - DNA, 37 bp, Artificial Sequence
  Description of Artificial Sequence: Synthetic oligonucleotide
aaactggggactgacaacatatagagaatctgctctg

SEQ ID NO: 86082 - DNA, 36 bp, Artificial Sequence
  Description of Artificial Sequence: Synthetic oligonucleotide
aactggggactgacaacatatagagaatctgctctg

SEQ ID NO: 86083 - DNA, 35 bp, Artificial Sequence
  Description of Artificial Sequence: Synthetic oligonucleotide
actggggactgacaacatatagagaatctgctctg

SEQ ID NO: 86084 - DNA, 34 bp, Artificial Sequence
  Description of Artificial Sequence: Synthetic oligonucleotide
ctggggactgacaacatatagagaatctgctctg

SEQ ID NO: 86085 - DNA, 36 bp, Artificial Sequence
  Description of Artificial Sequence: Synthetic oligonucleotide
tggggactgacaacatatagagaatctgctctgttg

SEQ ID NO: 86086 - DNA, 35 bp, Artificial Sequence
  Description of Artificial Sequence: Synthetic oligonucleotide
ggggactgacaacatatagagaatctgctctgttg

SEQ ID NO: 86087 - DNA, 38 bp, Artificial Sequence
  Description of Artificial Sequence: Synthetic oligonucleotide
gggactgacaacatatagagaatctgctctgttgtttg

SEQ ID NO: 86088 - DNA, 40 bp, Artificial Sequence
  Description of Artificial Sequence: Synthetic oligonucleotide
ggactgacaacatatagagaatctgctctgttgtttgatg

SEQ ID NO: 86089 - DNA, 40 bp, Artificial Sequence
  Description of Artificial Sequence: Synthetic oligonucleotide
gactgacaacatatagagaatctgctctgttgtttgatgc

SEQ ID NO: 86090 - DNA, 41 bp, Artificial Sequence
  Description of Artificial Sequence: Synthetic oligonucleotide
actgacaacatatagagaatctgctctgttgtttgatgcag

SEQ ID NO: 86091 - DNA, 40 bp, Artificial Sequence
  Description of Artificial Sequence: Synthetic oligonucleotide
ctgacaacatatagagaatctgctctgttgtttgatgcag

SEQ ID NO: 86092 - DNA, 44 bp, Artificial Sequence
  Description of Artificial Sequence: Synthetic oligonucleotide
tgacaacatatagagaatctgctctgttgtttgatgcagaaaag

SEQ ID NO: 86093 - DNA, 43 bp, Artificial Sequence
  Description of Artificial Sequence: Synthetic oligonucleotide
gacaacatatagagaatctgctctgttgtttgatgcagaaaag

SEQ ID NO: 86094 - DNA, 44 bp, Artificial Sequence
  Description of Artificial Sequence: Synthetic oligonucleotide
acaacatatagagaatctgctctgttgtttgatgcagaaaagtc

SEQ ID NO: 86095 - DNA, 43 bp, Artificial Sequence
  Description of Artificial Sequence: Synthetic oligonucleotide
caacatatagagaatctgctctgttgtttgatgcagaaaagtc

SEQ ID NO: 86096 - DNA, 45 bp, Artificial Sequence
  Description of Artificial Sequence: Synthetic oligonucleotide
aacatatagagaatctgctctgttgtttgatgcagaaaagtcttc

SEQ ID NO: 86097 - DNA, 44 bp, Artificial Sequence
  Description of Artificial Sequence: Synthetic oligonucleotide
acatatagagaatctgctctgttgtttgatgcagaaaagtcttc

SEQ ID NO: 86098 - DNA, 43 bp, Artificial Sequence
  Description of Artificial Sequence: Synthetic oligonucleotide
catatagagaatctgctctgttgtttgatgcagaaaagtcttc

SEQ ID NO: 86099 - DNA, 44 bp, Artificial Sequence
  Description of Artificial Sequence: Synthetic oligonucleotide
atatagagaatctgctctgttgtttgatgcagaaaagtcttctg

SEQ ID NO: 86100 - DNA, 43 bp, Artificial Sequence
  Description of Artificial Sequence: Synthetic oligonucleotide
tatagagaatctgctctgttgtttgatgcagaaaagtcttctg

SEQ ID NO: 86101 - DNA, 42 bp, Artificial Sequence
  Description of Artificial Sequence: Synthetic oligonucleotide
atagagaatctgctctgttgtttgatgcagaaaagtcttctg

SEQ ID NO: 86102 - DNA, 41 bp, Artificial Sequence
  Description of Artificial Sequence: Synthetic oligonucleotide
tagagaatctgctctgttgtttgatgcagaaaagtcttctg

SEQ ID NO: 86103 - DNA, 40 bp, Artificial Sequence
  Description of Artificial Sequence: Synthetic oligonucleotide
agagaatctgctctgttgtttgatgcagaaaagtcttctg

SEQ ID NO: 86104 - DNA, 39 bp, Artificial Sequence
  Description of Artificial Sequence: Synthetic oligonucleotide
gagaatctgctctgttgtttgatgcagaaaagtcttctg

SEQ ID NO: 86105 - DNA, 39 bp, Artificial Sequence
  Description of Artificial Sequence: Synthetic oligonucleotide
agaatctgctctgttgtttgatgcagaaaagtcttctgc

SEQ ID NO: 86106 - DNA, 38 bp, Artificial Sequence
  Description of Artificial Sequence: Synthetic oligonucleotide
gaatctgctctgttgtttgatgcagaaaagtcttctgc

SEQ ID NO: 86107 - DNA, 40 bp, Artificial Sequence
  Description of Artificial Sequence: Synthetic oligonucleotide
aatctgctctgttgtttgatgcagaaaagtcttctgcatc

SEQ ID NO: 86108 - DNA, 39 bp, Artificial Sequence
  Description of Artificial Sequence: Synthetic oligonucleotide
atctgctctgttgtttgatgcagaaaagtcttctgcatc

SEQ ID NO: 86109 - DNA, 38 bp, Artificial Sequence
  Description of Artificial Sequence: Synthetic oligonucleotide
tctgctctgttgtttgatgcagaaaagtcttctgcatc

SEQ ID NO: 86110 - DNA, 37 bp, Artificial Sequence
  Description of Artificial Sequence: Synthetic oligonucleotide
ctgctctgttgtttgatgcagaaaagtcttctgcatc

SEQ ID NO: 86111 - DNA, 39 bp, Artificial Sequence
  Description of Artificial Sequence: Synthetic oligonucleotide
tgctctgttgtttgatgcagaaaagtcttctgcatcaag

SEQ ID NO: 86112 - DNA, 38 bp, Artificial Sequence
  Description of Artificial Sequence: Synthetic oligonucleotide
gctctgttgtttgatgcagaaaagtcttctgcatcaag

SEQ ID NO: 86113 - DNA, 41 bp, Artificial Sequence
  Description of Artificial Sequence: Synthetic oligonucleotide
ctctgttgtttgatgcagaaaagtcttctgcatcaagtaag

SEQ ID NO: 86114 - DNA, 41 bp, Artificial Sequence
  Description of Artificial Sequence: Synthetic oligonucleotide
tctgttgtttgatgcagaaaagtcttctgcatcaagtaagc

SEQ ID NO: 86115 - DNA, 40 bp, Artificial Sequence
  Description of Artificial Sequence: Synthetic oligonucleotide
ctgttgtttgatgcagaaaagtcttctgcatcaagtaagc

SEQ ID NO: 86116 - DNA, 42 bp, Artificial Sequence
  Description of Artificial Sequence: Synthetic oligonucleotide
tgttgtttgatgcagaaaagtcttctgcatcaagtaagcttg

SEQ ID NO: 86117 - DNA, 41 bp, Artificial Sequence
  Description of Artificial Sequence: Synthetic oligonucleotide
gttgtttgatgcagaaaagtcttctgcatcaagtaagcttg

SEQ ID NO: 86118 - DNA, 41 bp, Artificial Sequence
  Description of Artificial Sequence: Synthetic oligonucleotide
ttgtttgatgcagaaaagtcttctgcatcaagtaagcttgg

SEQ ID NO: 86119 - DNA, 40 bp, Artificial Sequence
  Description of Artificial Sequence: Synthetic oligonucleotide
tgtttgatgcagaaaagtcttctgcatcaagtaagcttgg

SEQ ID NO: 86120 - DNA, 39 bp, Artificial Sequence
  Description of Artificial Sequence: Synthetic oligonucleotide
gtttgatgcagaaaagtcttctgcatcaagtaagcttgg

SEQ ID NO: 86121 - DNA, 39 bp, Artificial Sequence
  Description of Artificial Sequence: Synthetic oligonucleotide
tttgatgcagaaaagtcttctgcatcaagtaagcttggc

SEQ ID NO: 86122 - DNA, 38 bp, Artificial Sequence
  Description of Artificial Sequence: Synthetic oligonucleotide
ttgatgcagaaaagtcttctgcatcaagtaagcttggc

SEQ ID NO: 86123 - DNA, 37 bp, Artificial Sequence
  Description of Artificial Sequence: Synthetic oligonucleotide
tgatgcagaaaagtcttctgcatcaagtaagcttggc

SEQ ID NO: 86124 - DNA, 36 bp, Artificial Sequence
  Description of Artificial Sequence: Synthetic oligonucleotide
gatgcagaaaagtcttctgcatcaagtaagcttggc

SEQ ID NO: 86125 - DNA, 38 bp, Artificial Sequence
  Description of Artificial Sequence: Synthetic oligonucleotide
atgcagaaaagtcttctgcatcaagtaagcttggcatc

SEQ ID NO: 86126 - DNA, 37 bp, Artificial Sequence
  Description of Artificial Sequence: Synthetic oligonucleotide
tgcagaaaagtcttctgcatcaagtaagcttggcatc

SEQ ID NO: 86127 - DNA, 36 bp, Artificial Sequence
  Description of Artificial Sequence: Synthetic oligonucleotide
gcagaaaagtcttctgcatcaagtaagcttggcatc

SEQ ID NO: 86128 - DNA, 37 bp, Artificial Sequence
  Description of Artificial Sequence: Synthetic oligonucleotide
cagaaaagtcttctgcatcaagtaagcttggcatcac

SEQ ID NO: 86129 - DNA, 40 bp, Artificial Sequence
  Description of Artificial Sequence: Synthetic oligonucleotide
agaaaagtcttctgcatcaagtaagcttggcatcacaatg

SEQ ID NO: 86130 - DNA, 39 bp, Artificial Sequence
  Description of Artificial Sequence: Synthetic oligonucleotide
gaaaagtcttctgcatcaagtaagcttggcatcacaatg

SEQ ID NO: 86131 - DNA, 40 bp, Artificial Sequence
  Description of Artificial Sequence: Synthetic oligonucleotide
aaaagtcttctgcatcaagtaagcttggcatcacaatgac

SEQ ID NO: 86132 - DNA, 39 bp, Artificial Sequence
  Description of Artificial Sequence: Synthetic oligonucleotide
aaagtcttctgcatcaagtaagcttggcatcacaatgac

SEQ ID NO: 86133 - DNA, 38 bp, Artificial Sequence
  Description of Artificial Sequence: Synthetic oligonucleotide
aagtcttctgcatcaagtaagcttggcatcacaatgac

SEQ ID NO: 86134 - DNA, 37 bp, Artificial Sequence
  Description of Artificial Sequence: Synthetic oligonucleotide
agtcttctgcatcaagtaagcttggcatcacaatgac

SEQ ID NO: 86135 - DNA, 36 bp, Artificial Sequence
  Description of Artificial Sequence: Synthetic oligonucleotide
gtcttctgcatcaagtaagcttggcatcacaatgac

SEQ ID NO: 86136 - DNA, 37 bp, Artificial Sequence
  Description of Artificial Sequence: Synthetic oligonucleotide
tcttctgcatcaagtaagcttggcatcacaatgactg

SEQ ID NO: 86137 - DNA, 36 bp, Artificial Sequence
  Description of Artificial Sequence: Synthetic oligonucleotide
cttctgcatcaagtaagcttggcatcacaatgactg

SEQ ID NO: 86138 - DNA, 37 bp, Artificial Sequence
  Description of Artificial Sequence: Synthetic oligonucleotide
ttctgcatcaagtaagcttggcatcacaatgactgtg

SEQ ID NO: 86139 - DNA, 36 bp, Artificial Sequence
  Description of Artificial Sequence: Synthetic oligonucleotide
tctgcatcaagtaagcttggcatcacaatgactgtg

SEQ ID NO: 86140 - DNA, 35 bp, Artificial Sequence
  Description of Artificial Sequence: Synthetic oligonucleotide
ctgcatcaagtaagcttggcatcacaatgactgtg

SEQ ID NO: 86141 - DNA, 35 bp, Artificial Sequence
  Description of Artificial Sequence: Synthetic oligonucleotide
tgcatcaagtaagcttggcatcacaatgactgtgg

SEQ ID NO: 86142 - DNA, 34 bp, Artificial Sequence
  Description of Artificial Sequence: Synthetic oligonucleotide
gcatcaagtaagcttggcatcacaatgactgtgg

SEQ ID NO: 86143 - DNA, 34 bp, Artificial Sequence
  Description of Artificial Sequence: Synthetic oligonucleotide
catcaagtaagcttggcatcacaatgactgtggc

SEQ ID NO: 86144 - DNA, 34 bp, Artificial Sequence
  Description of Artificial Sequence: Synthetic oligonucleotide
atcaagtaagcttggcatcacaatgactgtggcc

SEQ ID NO: 86145 - DNA, 33 bp, Artificial Sequence
  Description of Artificial Sequence: Synthetic oligonucleotide
tcaagtaagcttggcatcacaatgactgtggcc

SEQ ID NO: 86146 - DNA, 32 bp, Artificial Sequence
  Description of Artificial Sequence: Synthetic oligonucleotide
caagtaagcttggcatcacaatgactgtggcc

SEQ ID NO: 86147 - DNA, 32 bp, Artificial Sequence
  Description of Artificial Sequence: Synthetic oligonucleotide
aagtaagcttggcatcacaatgactgtggccc

SEQ ID NO: 86148 - DNA, 31 bp, Artificial Sequence
  Description of Artificial Sequence: Synthetic oligonucleotide
agtaagcttggcatcacaatgactgtggccc

SEQ ID NO: 86149 - DNA, 30 bp, Artificial Sequence
  Description of Artificial Sequence: Synthetic oligonucleotide
gtaagcttggcatcacaatgactgtggccc

SEQ ID NO: 86150 - DNA, 32 bp, Artificial Sequence
  Description of Artificial Sequence: Synthetic oligonucleotide
taagcttggcatcacaatgactgtggcccatg

SEQ ID NO: 86151 - DNA, 31 bp, Artificial Sequence
  Description of Artificial Sequence: Synthetic oligonucleotide
aagcttggcatcacaatgactgtggcccatg

SEQ ID NO: 86152 - DNA, 30 bp, Artificial Sequence
  Description of Artificial Sequence: Synthetic oligonucleotide
agcttggcatcacaatgactgtggcccatg

SEQ ID NO: 86153 - DNA, 29 bp, Artificial Sequence
  Description of Artificial Sequence: Synthetic oligonucleotide
gcttggcatcacaatgactgtggcccatg

SEQ ID NO: 86154 - DNA, 31 bp, Artificial Sequence
  Description of Artificial Sequence: Synthetic oligonucleotide
cttggcatcacaatgactgtggcccatgaac

SEQ ID NO: 86155 - DNA, 32 bp, Artificial Sequence
  Description of Artificial Sequence: Synthetic oligonucleotide
ttggcatcacaatgactgtggcccatgaactg

SEQ ID NO: 86156 - DNA, 31 bp, Artificial Sequence
  Description of Artificial Sequence: Synthetic oligonucleotide
tggcatcacaatgactgtggcccatgaactg

SEQ ID NO: 86157 - DNA, 30 bp, Artificial Sequence
  Description of Artificial Sequence: Synthetic oligonucleotide
ggcatcacaatgactgtggcccatgaactg

SEQ ID NO: 86158 - DNA, 30 bp, Artificial Sequence
  Description of Artificial Sequence: Synthetic oligonucleotide
gcatcacaatgactgtggcccatgaactgg

SEQ ID NO: 86159 - DNA, 30 bp, Artificial Sequence
  Description of Artificial Sequence: Synthetic oligonucleotide
catcacaatgactgtggcccatgaactggc

SEQ ID NO: 86160 - DNA, 31 bp, Artificial Sequence
  Description of Artificial Sequence: Synthetic oligonucleotide
atcacaatgactgtggcccatgaactggctc

SEQ ID NO: 86161 - DNA, 30 bp, Artificial Sequence
  Description of Artificial Sequence: Synthetic oligonucleotide
tcacaatgactgtggcccatgaactggctc

SEQ ID NO: 86162 - DNA, 29 bp, Artificial Sequence
  Description of Artificial Sequence: Synthetic oligonucleotide
cacaatgactgtggcccatgaactggctc

SEQ ID NO: 86163 - DNA, 30 bp, Artificial Sequence
  Description of Artificial Sequence: Synthetic oligonucleotide
acaatgactgtggcccatgaactggctcac

SEQ ID NO: 86164 - DNA, 29 bp, Artificial Sequence
  Description of Artificial Sequence: Synthetic oligonucleotide
caatgactgtggcccatgaactggctcac

SEQ ID NO: 86165 - DNA, 29 bp, Artificial Sequence
  Description of Artificial Sequence: Synthetic oligonucleotide
aatgactgtggcccatgaactggctcacc

SEQ ID NO: 86166 - DNA, 28 bp, Artificial Sequence
  Description of Artificial Sequence: Synthetic oligonucleotide
atgactgtggcccatgaactggctcacc

SEQ ID NO: 86167 - DNA, 27 bp, Artificial Sequence
  Description of Artificial Sequence: Synthetic oligonucleotide
tgactgtggcccatgaactggctcacc

SEQ ID NO: 86168 - DNA, 27 bp, Artificial Sequence
  Description of Artificial Sequence: Synthetic oligonucleotide
gactgtggcccatgaactggctcacca

SEQ ID NO: 86169 - DNA, 27 bp, Artificial Sequence
  Description of Artificial Sequence: Synthetic oligonucleotide
actgtggcccatgaactggctcaccag

SEQ ID NO: 86170 - DNA, 27 bp, Artificial Sequence
  Description of Artificial Sequence: Synthetic oligonucleotide
ctgtggcccatgaactggctcaccagt

SEQ ID NO: 86171 - DNA, 27 bp, Artificial Sequence
  Description of Artificial Sequence: Synthetic oligonucleotide
tgtggcccatgaactggctcaccagtg

SEQ ID NO: 86172 - DNA, 26 bp, Artificial Sequence
  Description of Artificial Sequence: Synthetic oligonucleotide
gtggcccatgaactggctcaccagtg

SEQ ID NO: 86173 - DNA, 27 bp, Artificial Sequence
  Description of Artificial Sequence: Synthetic oligonucleotide
tggcccatgaactggctcaccagtggt

SEQ ID NO: 86174 - DNA, 27 bp, Artificial Sequence
  Description of Artificial Sequence: Synthetic oligonucleotide
ggcccatgaactggctcaccagtggtt

SEQ ID NO: 86175 - DNA, 28 bp, Artificial Sequence
  Description of Artificial Sequence: Synthetic oligonucleotide
gcccatgaactggctcaccagtggtttg

SEQ ID NO: 86176 - DNA, 28 bp, Artificial Sequence
  Description of Artificial Sequence: Synthetic oligonucleotide
cccatgaactggctcaccagtggtttgg

SEQ ID NO: 86177 - DNA, 28 bp, Artificial Sequence
  Description of Artificial Sequence: Synthetic oligonucleotide
ccatgaactggctcaccagtggtttggg

SEQ ID NO: 86178 - DNA, 30 bp, Artificial Sequence
  Description of Artificial Sequence: Synthetic oligonucleotide
catgaactggctcaccagtggtttgggaac

SEQ ID NO: 86179 - DNA, 30 bp, Artificial Sequence
  Description of Artificial Sequence: Synthetic oligonucleotide
atgaactggctcaccagtggtttgggaacc

SEQ ID NO: 86180 - DNA, 29 bp, Artificial Sequence
  Description of Artificial Sequence: Synthetic oligonucleotide
tgaactggctcaccagtggtttgggaacc

SEQ ID NO: 86181 - DNA, 28 bp, Artificial Sequence
  Description of Artificial Sequence: Synthetic oligonucleotide
gaactggctcaccagtggtttgggaacc

SEQ ID NO: 86182 - DNA, 29 bp, Artificial Sequence
  Description of Artificial Sequence: Synthetic oligonucleotide
aactggctcaccagtggtttgggaacctg

SEQ ID NO: 86183 - DNA, 28 bp, Artificial Sequence
  Description of Artificial Sequence: Synthetic oligonucleotide
actggctcaccagtggtttgggaacctg

SEQ ID NO: 86184 - DNA, 27 bp, Artificial Sequence
  Description of Artificial Sequence: Synthetic oligonucleotide
ctggctcaccagtggtttgggaacctg

SEQ ID NO: 86185 - DNA, 27 bp, Artificial Sequence
  Description of Artificial Sequence: Synthetic oligonucleotide
tggctcaccagtggtttgggaacctgg

SEQ ID NO: 86186 - DNA, 27 bp, Artificial Sequence
  Description of Artificial Sequence: Synthetic oligonucleotide
ggctcaccagtggtttgggaacctggt

SEQ ID NO: 86187 - DNA, 27 bp, Artificial Sequence
  Description of Artificial Sequence: Synthetic oligonucleotide
gctcaccagtggtttgggaacctggtc

SEQ ID NO: 86188 - DNA, 28 bp, Artificial Sequence
  Description of Artificial Sequence: Synthetic oligonucleotide
ctcaccagtggtttgggaacctggtcac

SEQ ID NO: 86189 - DNA, 31 bp, Artificial Sequence
  Description of Artificial Sequence: Synthetic oligonucleotide
tcaccagtggtttgggaacctggtcactatg

SEQ ID NO: 86190 - DNA, 30 bp, Artificial Sequence
  Description of Artificial Sequence: Synthetic oligonucleotide
caccagtggtttgggaacctggtcactatg

SEQ ID NO: 86191 - DNA, 30 bp, Artificial Sequence
  Description of Artificial Sequence: Synthetic oligonucleotide
accagtggtttgggaacctggtcactatgg

SEQ ID NO: 86192 - DNA, 29 bp, Artificial Sequence
  Description of Artificial Sequence: Synthetic oligonucleotide
ccagtggtttgggaacctggtcactatgg

SEQ ID NO: 86193 - DNA, 32 bp, Artificial Sequence
  Description of Artificial Sequence: Synthetic oligonucleotide
cagtggtttgggaacctggtcactatggaatg

SEQ ID NO: 86194 - DNA, 32 bp, Artificial Sequence
  Description of Artificial Sequence: Synthetic oligonucleotide
agtggtttgggaacctggtcactatggaatgg

SEQ ID NO: 86195 - DNA, 31 bp, Artificial Sequence
  Description of Artificial Sequence: Synthetic oligonucleotide
gtggtttgggaacctggtcactatggaatgg

SEQ ID NO: 86196 - DNA, 32 bp, Artificial Sequence
  Description of Artificial Sequence: Synthetic oligonucleotide
tggtttgggaacctggtcactatggaatggtg

SEQ ID NO: 86197 - DNA, 31 bp, Artificial Sequence
  Description of Artificial Sequence: Synthetic oligonucleotide
ggtttgggaacctggtcactatggaatggtg

SEQ ID NO: 86198 - DNA, 31 bp, Artificial Sequence
  Description of Artificial Sequence: Synthetic oligonucleotide
gtttgggaacctggtcactatggaatggtgg

SEQ ID NO: 86199 - DNA, 34 bp, Artificial Sequence
  Description of Artificial Sequence: Synthetic oligonucleotide
tttgggaacctggtcactatggaatggtggaatg

SEQ ID NO: 86200 - DNA, 33 bp, Artificial Sequence
  Description of Artificial Sequence: Synthetic oligonucleotide
ttgggaacctggtcactatggaatggtggaatg

SEQ ID NO: 86201 - DNA, 32 bp, Artificial Sequence
  Description of Artificial Sequence: Synthetic oligonucleotide
tgggaacctggtcactatggaatggtggaatg

SEQ ID NO: 86202 - DNA, 31 bp, Artificial Sequence
  Description of Artificial Sequence: Synthetic oligonucleotide
gggaacctggtcactatggaatggtggaatg

SEQ ID NO: 86203 - DNA, 33 bp, Artificial Sequence
  Description of Artificial Sequence: Synthetic oligonucleotide
ggaacctggtcactatggaatggtggaatgatc

SEQ ID NO: 86204 - DNA, 36 bp, Artificial Sequence
  Description of Artificial Sequence: Synthetic oligonucleotide
gaacctggtcactatggaatggtggaatgatctttg

SEQ ID NO: 86205 - DNA, 36 bp, Artificial Sequence
  Description of Artificial Sequence: Synthetic oligonucleotide
aacctggtcactatggaatggtggaatgatctttgg

SEQ ID NO: 86206 - DNA, 35 bp, Artificial Sequence
  Description of Artificial Sequence: Synthetic oligonucleotide
acctggtcactatggaatggtggaatgatctttgg

SEQ ID NO: 86207 - DNA, 34 bp, Artificial Sequence
  Description of Artificial Sequence: Synthetic oligonucleotide
cctggtcactatggaatggtggaatgatctttgg

SEQ ID NO: 86208 - DNA, 34 bp, Artificial Sequence
  Description of Artificial Sequence: Synthetic oligonucleotide
ctggtcactatggaatggtggaatgatctttggc

SEQ ID NO: 86209 - DNA, 39 bp, Artificial Sequence
  Description of Artificial Sequence: Synthetic oligonucleotide
tggtcactatggaatggtggaatgatctttggctaaatg

SEQ ID NO: 86210 - DNA, 38 bp, Artificial Sequence
  Description of Artificial Sequence: Synthetic oligonucleotide
ggtcactatggaatggtggaatgatctttggctaaatg

SEQ ID NO: 86211 - DNA, 40 bp, Artificial Sequence
  Description of Artificial Sequence: Synthetic oligonucleotide
gtcactatggaatggtggaatgatctttggctaaatgaag

SEQ ID NO: 86212 - DNA, 40 bp, Artificial Sequence
  Description of Artificial Sequence: Synthetic oligonucleotide
tcactatggaatggtggaatgatctttggctaaatgaagg

SEQ ID NO: 86213 - DNA, 39 bp, Artificial Sequence
  Description of Artificial Sequence: Synthetic oligonucleotide
cactatggaatggtggaatgatctttggctaaatgaagg

SEQ ID NO: 86214 - DNA, 43 bp, Artificial Sequence
  Description of Artificial Sequence: Synthetic oligonucleotide
actatggaatggtggaatgatctttggctaaatgaaggatttg

SEQ ID NO: 86215 - DNA, 42 bp, Artificial Sequence
  Description of Artificial Sequence: Synthetic oligonucleotide
ctatggaatggtggaatgatctttggctaaatgaaggatttg

SEQ ID NO: 86216 - DNA, 42 bp, Artificial Sequence
  Description of Artificial Sequence: Synthetic oligonucleotide
tatggaatggtggaatgatctttggctaaatgaaggatttgc

SEQ ID NO: 86217 - DNA, 41 bp, Artificial Sequence
  Description of Artificial Sequence: Synthetic oligonucleotide
atggaatggtggaatgatctttggctaaatgaaggatttgc

SEQ ID NO: 86218 - DNA, 40 bp, Artificial Sequence
  Description of Artificial Sequence: Synthetic oligonucleotide
tggaatggtggaatgatctttggctaaatgaaggatttgc

SEQ ID NO: 86219 - DNA, 39 bp, Artificial Sequence
  Description of Artificial Sequence: Synthetic oligonucleotide
ggaatggtggaatgatctttggctaaatgaaggatttgc

SEQ ID NO: 86220 - DNA, 39 bp, Artificial Sequence
  Description of Artificial Sequence: Synthetic oligonucleotide
gaatggtggaatgatctttggctaaatgaaggatttgcc

SEQ ID NO: 86221 - DNA, 47 bp, Artificial Sequence
  Description of Artificial Sequence: Synthetic oligonucleotide
aatggtggaatgatctttggctaaatgaaggatttgccaaatttatg

SEQ ID NO: 86222 - DNA, 46 bp, Artificial Sequence
  Description of Artificial Sequence: Synthetic oligonucleotide
atggtggaatgatctttggctaaatgaaggatttgccaaatttatg

SEQ ID NO: 86223 - DNA, 45 bp, Artificial Sequence
  Description of Artificial Sequence: Synthetic oligonucleotide
tggtggaatgatctttggctaaatgaaggatttgccaaatttatg

SEQ ID NO: 86224 - DNA, 44 bp, Artificial Sequence
  Description of Artificial Sequence: Synthetic oligonucleotide
ggtggaatgatctttggctaaatgaaggatttgccaaatttatg

SEQ ID NO: 86225 - DNA, 44 bp, Artificial Sequence
  Description of Artificial Sequence: Synthetic oligonucleotide
gtggaatgatctttggctaaatgaaggatttgccaaatttatgg

SEQ ID NO: 86226 - DNA, 45 bp, Artificial Sequence
  Description of Artificial Sequence: Synthetic oligonucleotide
tggaatgatctttggctaaatgaaggatttgccaaatttatggag

SEQ ID NO: 86227 - DNA, 44 bp, Artificial Sequence
  Description of Artificial Sequence: Synthetic oligonucleotide
ggaatgatctttggctaaatgaaggatttgccaaatttatggag

SEQ ID NO: 86228 - DNA, 47 bp, Artificial Sequence
  Description of Artificial Sequence: Synthetic oligonucleotide
gaatgatctttggctaaatgaaggatttgccaaatttatggagtttg

SEQ ID NO: 86229 - DNA, 48 bp, Artificial Sequence
  Description of Artificial Sequence: Synthetic oligonucleotide
aatgatctttggctaaatgaaggatttgccaaatttatggagtttgtg

SEQ ID NO: 86230 - DNA, 47 bp, Artificial Sequence
  Description of Artificial Sequence: Synthetic oligonucleotide
atgatctttggctaaatgaaggatttgccaaatttatggagtttgtg

SEQ ID NO: 86231 - DNA, 46 bp, Artificial Sequence
  Description of Artificial Sequence: Synthetic oligonucleotide
tgatctttggctaaatgaaggatttgccaaatttatggagtttgtg

SEQ ID NO: 86232 - DNA, 45 bp, Artificial Sequence
  Description of Artificial Sequence: Synthetic oligonucleotide
gatctttggctaaatgaaggatttgccaaatttatggagtttgtg

SEQ ID NO: 86233 - DNA, 46 bp, Artificial Sequence
  Description of Artificial Sequence: Synthetic oligonucleotide
atctttggctaaatgaaggatttgccaaatttatggagtttgtgtc

SEQ ID NO: 86234 - DNA, 45 bp, Artificial Sequence
  Description of Artificial Sequence: Synthetic oligonucleotide
tctttggctaaatgaaggatttgccaaatttatggagtttgtgtc

SEQ ID NO: 86235 - DNA, 44 bp, Artificial Sequence
  Description of Artificial Sequence: Synthetic oligonucleotide
ctttggctaaatgaaggatttgccaaatttatggagtttgtgtc

SEQ ID NO: 86236 - DNA, 45 bp, Artificial Sequence
  Description of Artificial Sequence: Synthetic oligonucleotide
tttggctaaatgaaggatttgccaaatttatggagtttgtgtctg

SEQ ID NO: 86237 - DNA, 44 bp, Artificial Sequence
  Description of Artificial Sequence: Synthetic oligonucleotide
ttggctaaatgaaggatttgccaaatttatggagtttgtgtctg

SEQ ID NO: 86238 - DNA, 43 bp, Artificial Sequence
  Description of Artificial Sequence: Synthetic oligonucleotide
tggctaaatgaaggatttgccaaatttatggagtttgtgtctg

SEQ ID NO: 86239 - DNA, 42 bp, Artificial Sequence
  Description of Artificial Sequence: Synthetic oligonucleotide
ggctaaatgaaggatttgccaaatttatggagtttgtgtctg

SEQ ID NO: 86240 - DNA, 43 bp, Artificial Sequence
  Description of Artificial Sequence: Synthetic oligonucleotide
gctaaatgaaggatttgccaaatttatggagtttgtgtctgtc

SEQ ID NO: 86241 - DNA, 44 bp, Artificial Sequence
  Description of Artificial Sequence: Synthetic oligonucleotide
ctaaatgaaggatttgccaaatttatggagtttgtgtctgtcag

SEQ ID NO: 86242 - DNA, 45 bp, Artificial Sequence
  Description of Artificial Sequence: Synthetic oligonucleotide
taaatgaaggatttgccaaatttatggagtttgtgtctgtcagtg

SEQ ID NO: 86243 - DNA, 44 bp, Artificial Sequence
  Description of Artificial Sequence: Synthetic oligonucleotide
aaatgaaggatttgccaaatttatggagtttgtgtctgtcagtg

SEQ ID NO: 86244 - DNA, 43 bp, Artificial Sequence
  Description of Artificial Sequence: Synthetic oligonucleotide
aatgaaggatttgccaaatttatggagtttgtgtctgtcagtg

SEQ ID NO: 86245 - DNA, 42 bp, Artificial Sequence
  Description of Artificial Sequence: Synthetic oligonucleotide
atgaaggatttgccaaatttatggagtttgtgtctgtcagtg

SEQ ID NO: 86246 - DNA, 41 bp, Artificial Sequence
  Description of Artificial Sequence: Synthetic oligonucleotide
tgaaggatttgccaaatttatggagtttgtgtctgtcagtg

SEQ ID NO: 86247 - DNA, 40 bp, Artificial Sequence
  Description of Artificial Sequence: Synthetic oligonucleotide
gaaggatttgccaaatttatggagtttgtgtctgtcagtg

SEQ ID NO: 86248 - DNA, 41 bp, Artificial Sequence
  Description of Artificial Sequence: Synthetic oligonucleotide
aaggatttgccaaatttatggagtttgtgtctgtcagtgtg

SEQ ID NO: 86249 - DNA, 40 bp, Artificial Sequence
  Description of Artificial Sequence: Synthetic oligonucleotide
aggatttgccaaatttatggagtttgtgtctgtcagtgtg

SEQ ID NO: 86250 - DNA, 39 bp, Artificial Sequence
  Description of Artificial Sequence: Synthetic oligonucleotide
ggatttgccaaatttatggagtttgtgtctgtcagtgtg

SEQ ID NO: 86251 - DNA, 40 bp, Artificial Sequence
  Description of Artificial Sequence: Synthetic oligonucleotide
gatttgccaaatttatggagtttgtgtctgtcagtgtgac

SEQ ID NO: 86252 - DNA, 40 bp, Artificial Sequence
  Description of Artificial Sequence: Synthetic oligonucleotide
atttgccaaatttatggagtttgtgtctgtcagtgtgacc

SEQ ID NO: 86253 - DNA, 39 bp, Artificial Sequence
  Description of Artificial Sequence: Synthetic oligonucleotide
tttgccaaatttatggagtttgtgtctgtcagtgtgacc

SEQ ID NO: 86254 - DNA, 38 bp, Artificial Sequence
  Description of Artificial Sequence: Synthetic oligonucleotide
ttgccaaatttatggagtttgtgtctgtcagtgtgacc

SEQ ID NO: 86255 - DNA, 37 bp, Artificial Sequence
  Description of Artificial Sequence: Synthetic oligonucleotide
tgccaaatttatggagtttgtgtctgtcagtgtgacc

SEQ ID NO: 86256 - DNA, 36 bp, Artificial Sequence
  Description of Artificial Sequence: Synthetic oligonucleotide
gccaaatttatggagtttgtgtctgtcagtgtgacc

SEQ ID NO: 86257 - DNA, 36 bp, Artificial Sequence
  Description of Artificial Sequence: Synthetic oligonucleotide
ccaaatttatggagtttgtgtctgtcagtgtgaccc

SEQ ID NO: 86258 - DNA, 38 bp, Artificial Sequence
  Description of Artificial Sequence: Synthetic oligonucleotide
caaatttatggagtttgtgtctgtcagtgtgacccatc

SEQ ID NO: 86259 - DNA, 38 bp, Artificial Sequence
  Description of Artificial Sequence: Synthetic oligonucleotide
aaatttatggagtttgtgtctgtcagtgtgacccatcc

SEQ ID NO: 86260 - DNA, 37 bp, Artificial Sequence
  Description of Artificial Sequence: Synthetic oligonucleotide
aatttatggagtttgtgtctgtcagtgtgacccatcc

SEQ ID NO: 86261 - DNA, 36 bp, Artificial Sequence
  Description of Artificial Sequence: Synthetic oligonucleotide
atttatggagtttgtgtctgtcagtgtgacccatcc

SEQ ID NO: 86262 - DNA, 35 bp, Artificial Sequence
  Description of Artificial Sequence: Synthetic oligonucleotide
tttatggagtttgtgtctgtcagtgtgacccatcc

SEQ ID NO: 86263 - DNA, 34 bp, Artificial Sequence
  Description of Artificial Sequence: Synthetic oligonucleotide
ttatggagtttgtgtctgtcagtgtgacccatcc

SEQ ID NO: 86264 - DNA, 33 bp, Artificial Sequence
  Description of Artificial Sequence: Synthetic oligonucleotide
tatggagtttgtgtctgtcagtgtgacccatcc

SEQ ID NO: 86265 - DNA, 32 bp, Artificial Sequence
  Description of Artificial Sequence: Synthetic oligonucleotide
atggagtttgtgtctgtcagtgtgacccatcc

SEQ ID NO: 86266 - DNA, 31 bp, Artificial Sequence
  Description of Artificial Sequence: Synthetic oligonucleotide
tggagtttgtgtctgtcagtgtgacccatcc

SEQ ID NO: 86267 - DNA, 30 bp, Artificial Sequence
  Description of Artificial Sequence: Synthetic oligonucleotide
ggagtttgtgtctgtcagtgtgacccatcc

SEQ ID NO: 86268 - DNA, 31 bp, Artificial Sequence
  Description of Artificial Sequence: Synthetic oligonucleotide
gagtttgtgtctgtcagtgtgacccatcctg

SEQ ID NO: 86269 - DNA, 33 bp, Artificial Sequence
  Description of Artificial Sequence: Synthetic oligonucleotide
agtttgtgtctgtcagtgtgacccatcctgaac

SEQ ID NO: 86270 - DNA, 32 bp, Artificial Sequence
  Description of Artificial Sequence: Synthetic oligonucleotide
gtttgtgtctgtcagtgtgacccatcctgaac

SEQ ID NO: 86271 - DNA, 33 bp, Artificial Sequence
  Description of Artificial Sequence: Synthetic oligonucleotide
tttgtgtctgtcagtgtgacccatcctgaactg

SEQ ID NO: 86272 - DNA, 32 bp, Artificial Sequence
  Description of Artificial Sequence: Synthetic oligonucleotide
ttgtgtctgtcagtgtgacccatcctgaactg

SEQ ID NO: 86273 - DNA, 31 bp, Artificial Sequence
  Description of Artificial Sequence: Synthetic oligonucleotide
tgtgtctgtcagtgtgacccatcctgaactg

SEQ ID NO: 86274 - DNA, 30 bp, Artificial Sequence
  Description of Artificial Sequence: Synthetic oligonucleotide
gtgtctgtcagtgtgacccatcctgaactg

SEQ ID NO: 86275 - DNA, 33 bp, Artificial Sequence
  Description of Artificial Sequence: Synthetic oligonucleotide
tgtctgtcagtgtgacccatcctgaactgaaag

SEQ ID NO: 86276 - DNA, 32 bp, Artificial Sequence
  Description of Artificial Sequence: Synthetic oligonucleotide
gtctgtcagtgtgacccatcctgaactgaaag

SEQ ID NO: 86277 - DNA, 34 bp, Artificial Sequence
  Description of Artificial Sequence: Synthetic oligonucleotide
tctgtcagtgtgacccatcctgaactgaaagttg

SEQ ID NO: 86278 - DNA, 33 bp, Artificial Sequence
  Description of Artificial Sequence: Synthetic oligonucleotide
ctgtcagtgtgacccatcctgaactgaaagttg

SEQ ID NO: 86279 - DNA, 33 bp, Artificial Sequence
  Description of Artificial Sequence: Synthetic oligonucleotide
tgtcagtgtgacccatcctgaactgaaagttgg

SEQ ID NO: 86280 - DNA, 32 bp, Artificial Sequence
  Description of Artificial Sequence: Synthetic oligonucleotide
gtcagtgtgacccatcctgaactgaaagttgg

SEQ ID NO: 86281 - DNA, 33 bp, Artificial Sequence
  Description of Artificial Sequence: Synthetic oligonucleotide
tcagtgtgacccatcctgaactgaaagttggag

SEQ ID NO: 86282 - DNA, 32 bp, Artificial Sequence
  Description of Artificial Sequence: Synthetic oligonucleotide
cagtgtgacccatcctgaactgaaagttggag

SEQ ID NO: 86283 - DNA, 39 bp, Artificial Sequence
  Description of Artificial Sequence: Synthetic oligonucleotide
agtgtgacccatcctgaactgaaagttggagattatttc

SEQ ID NO: 86284 - DNA, 38 bp, Artificial Sequence
  Description of Artificial Sequence: Synthetic oligonucleotide
gtgtgacccatcctgaactgaaagttggagattatttc

SEQ ID NO: 86285 - DNA, 41 bp, Artificial Sequence
  Description of Artificial Sequence: Synthetic oligonucleotide
tgtgacccatcctgaactgaaagttggagattatttctttg

SEQ ID NO: 86286 - DNA, 40 bp, Artificial Sequence
  Description of Artificial Sequence: Synthetic oligonucleotide
gtgacccatcctgaactgaaagttggagattatttctttg

SEQ ID NO: 86287 - DNA, 40 bp, Artificial Sequence
  Description of Artificial Sequence: Synthetic oligonucleotide
tgacccatcctgaactgaaagttggagattatttctttgg

SEQ ID NO: 86288 - DNA, 39 bp, Artificial Sequence
  Description of Artificial Sequence: Synthetic oligonucleotide
gacccatcctgaactgaaagttggagattatttctttgg

SEQ ID NO: 86289 - DNA, 39 bp, Artificial Sequence
  Description of Artificial Sequence: Synthetic oligonucleotide
acccatcctgaactgaaagttggagattatttctttggc

SEQ ID NO: 86290 - DNA, 38 bp, Artificial Sequence
  Description of Artificial Sequence: Synthetic oligonucleotide
cccatcctgaactgaaagttggagattatttctttggc

SEQ ID NO: 86291 - DNA, 42 bp, Artificial Sequence
  Description of Artificial Sequence: Synthetic oligonucleotide
ccatcctgaactgaaagttggagattatttctttggcaaatg

SEQ ID NO: 86292 - DNA, 46 bp, Artificial Sequence
  Description of Artificial Sequence: Synthetic oligonucleotide
catcctgaactgaaagttggagattatttctttggcaaatgttttg

SEQ ID NO: 86293 - DNA, 47 bp, Artificial Sequence
  Description of Artificial Sequence: Synthetic oligonucleotide
atcctgaactgaaagttggagattatttctttggcaaatgttttgac

SEQ ID NO: 86294 - DNA, 46 bp, Artificial Sequence
  Description of Artificial Sequence: Synthetic oligonucleotide
tcctgaactgaaagttggagattatttctttggcaaatgttttgac

SEQ ID NO: 86295 - DNA, 45 bp, Artificial Sequence
  Description of Artificial Sequence: Synthetic oligonucleotide
cctgaactgaaagttggagattatttctttggcaaatgttttgac

SEQ ID NO: 86296 - DNA, 45 bp, Artificial Sequence
  Description of Artificial Sequence: Synthetic oligonucleotide
ctgaactgaaagttggagattatttctttggcaaatgttttgacg

SEQ ID NO: 86297 - DNA, 45 bp, Artificial Sequence
  Description of Artificial Sequence: Synthetic oligonucleotide
tgaactgaaagttggagattatttctttggcaaatgttttgacgc

SEQ ID NO: 86298 - DNA, 44 bp, Artificial Sequence
  Description of Artificial Sequence: Synthetic oligonucleotide
gaactgaaagttggagattatttctttggcaaatgttttgacgc

SEQ ID NO: 86299 - DNA, 47 bp, Artificial Sequence
  Description of Artificial Sequence: Synthetic oligonucleotide
aactgaaagttggagattatttctttggcaaatgttttgacgcaatg

SEQ ID NO: 86300 - DNA, 46 bp, Artificial Sequence
  Description of Artificial Sequence: Synthetic oligonucleotide
actgaaagttggagattatttctttggcaaatgttttgacgcaatg

SEQ ID NO: 86301 - DNA, 45 bp, Artificial Sequence
  Description of Artificial Sequence: Synthetic oligonucleotide
ctgaaagttggagattatttctttggcaaatgttttgacgcaatg

SEQ ID NO: 86302 - DNA, 45 bp, Artificial Sequence
  Description of Artificial Sequence: Synthetic oligonucleotide
tgaaagttggagattatttctttggcaaatgttttgacgcaatgg

SEQ ID NO: 86303 - DNA, 44 bp, Artificial Sequence
  Description of Artificial Sequence: Synthetic oligonucleotide
gaaagttggagattatttctttggcaaatgttttgacgcaatgg

SEQ ID NO: 86304 - DNA, 45 bp, Artificial Sequence
  Description of Artificial Sequence: Synthetic oligonucleotide
aaagttggagattatttctttggcaaatgttttgacgcaatggag

SEQ ID NO: 86305 - DNA, 44 bp, Artificial Sequence
  Description of Artificial Sequence: Synthetic oligonucleotide
aagttggagattatttctttggcaaatgttttgacgcaatggag

SEQ ID NO: 86306 - DNA, 43 bp, Artificial Sequence
  Description of Artificial Sequence: Synthetic oligonucleotide
agttggagattatttctttggcaaatgttttgacgcaatggag

SEQ ID NO: 86307 - DNA, 42 bp, Artificial Sequence
  Description of Artificial Sequence: Synthetic oligonucleotide
gttggagattatttctttggcaaatgttttgacgcaatggag

SEQ ID NO: 86308 - DNA, 42 bp, Artificial Sequence
  Description of Artificial Sequence: Synthetic oligonucleotide
ttggagattatttctttggcaaatgttttgacgcaatggagg

SEQ ID NO: 86309 - DNA, 41 bp, Artificial Sequence
  Description of Artificial Sequence: Synthetic oligonucleotide
tggagattatttctttggcaaatgttttgacgcaatggagg

SEQ ID NO: 86310 - DNA, 40 bp, Artificial Sequence
  Description of Artificial Sequence: Synthetic oligonucleotide
ggagattatttctttggcaaatgttttgacgcaatggagg

SEQ ID NO: 86311 - DNA, 42 bp, Artificial Sequence
  Description of Artificial Sequence: Synthetic oligonucleotide
gagattatttctttggcaaatgttttgacgcaatggaggtag

SEQ ID NO: 86312 - DNA, 44 bp, Artificial Sequence
  Description of Artificial Sequence: Synthetic oligonucleotide
agattatttctttggcaaatgttttgacgcaatggaggtagatg

SEQ ID NO: 86313 - DNA, 43 bp, Artificial Sequence
  Description of Artificial Sequence: Synthetic oligonucleotide
gattatttctttggcaaatgttttgacgcaatggaggtagatg

SEQ ID NO: 86314 - DNA, 43 bp, Artificial Sequence
  Description of Artificial Sequence: Synthetic oligonucleotide
attatttctttggcaaatgttttgacgcaatggaggtagatgc

SEQ ID NO: 86315 - DNA, 42 bp, Artificial Sequence
  Description of Artificial Sequence: Synthetic oligonucleotide
ttatttctttggcaaatgttttgacgcaatggaggtagatgc

SEQ ID NO: 86316 - DNA, 41 bp, Artificial Sequence
  Description of Artificial Sequence: Synthetic oligonucleotide
tatttctttggcaaatgttttgacgcaatggaggtagatgc

SEQ ID NO: 86317 - DNA, 40 bp, Artificial Sequence
  Description of Artificial Sequence: Synthetic oligonucleotide
atttctttggcaaatgttttgacgcaatggaggtagatgc

SEQ ID NO: 86318 - DNA, 39 bp, Artificial Sequence
  Description of Artificial Sequence: Synthetic oligonucleotide
tttctttggcaaatgttttgacgcaatggaggtagatgc

SEQ ID NO: 86319 - DNA, 38 bp, Artificial Sequence
  Description of Artificial Sequence: Synthetic oligonucleotide
ttctttggcaaatgttttgacgcaatggaggtagatgc

SEQ ID NO: 86320 - DNA, 37 bp, Artificial Sequence
  Description of Artificial Sequence: Synthetic oligonucleotide
tctttggcaaatgttttgacgcaatggaggtagatgc

SEQ ID NO: 86321 - DNA, 36 bp, Artificial Sequence
  Description of Artificial Sequence: Synthetic oligonucleotide
ctttggcaaatgttttgacgcaatggaggtagatgc

SEQ ID NO: 86322 - DNA, 44 bp, Artificial Sequence
  Description of Artificial Sequence: Synthetic oligonucleotide
tttggcaaatgttttgacgcaatggaggtagatgctttaaattc

SEQ ID NO: 86323 - DNA, 43 bp, Artificial Sequence
  Description of Artificial Sequence: Synthetic oligonucleotide
ttggcaaatgttttgacgcaatggaggtagatgctttaaattc

SEQ ID NO: 86324 - DNA, 42 bp, Artificial Sequence
  Description of Artificial Sequence: Synthetic oligonucleotide
tggcaaatgttttgacgcaatggaggtagatgctttaaattc

SEQ ID NO: 86325 - DNA, 41 bp, Artificial Sequence
  Description of Artificial Sequence: Synthetic oligonucleotide
ggcaaatgttttgacgcaatggaggtagatgctttaaattc

SEQ ID NO: 86326 - DNA, 41 bp, Artificial Sequence
  Description of Artificial Sequence: Synthetic oligonucleotide
gcaaatgttttgacgcaatggaggtagatgctttaaattcc

SEQ ID NO: 86327 - DNA, 42 bp, Artificial Sequence
  Description of Artificial Sequence: Synthetic oligonucleotide
caaatgttttgacgcaatggaggtagatgctttaaattcctc

SEQ ID NO: 86328 - DNA, 43 bp, Artificial Sequence
  Description of Artificial Sequence: Synthetic oligonucleotide
aaatgttttgacgcaatggaggtagatgctttaaattcctcac

SEQ ID NO: 86329 - DNA, 42 bp, Artificial Sequence
  Description of Artificial Sequence: Synthetic oligonucleotide
aatgttttgacgcaatggaggtagatgctttaaattcctcac

SEQ ID NO: 86330 - DNA, 41 bp, Artificial Sequence
  Description of Artificial Sequence: Synthetic oligonucleotide
atgttttgacgcaatggaggtagatgctttaaattcctcac

SEQ ID NO: 86331 - DNA, 40 bp, Artificial Sequence
  Description of Artificial Sequence: Synthetic oligonucleotide
tgttttgacgcaatggaggtagatgctttaaattcctcac

SEQ ID NO: 86332 - DNA, 39 bp, Artificial Sequence
  Description of Artificial Sequence: Synthetic oligonucleotide
gttttgacgcaatggaggtagatgctttaaattcctcac

SEQ ID NO: 86333 - DNA, 40 bp, Artificial Sequence
  Description of Artificial Sequence: Synthetic oligonucleotide
ttttgacgcaatggaggtagatgctttaaattcctcacac

SEQ ID NO: 86334 - DNA, 39 bp, Artificial Sequence
  Description of Artificial Sequence: Synthetic oligonucleotide
tttgacgcaatggaggtagatgctttaaattcctcacac

SEQ ID NO: 86335 - DNA, 38 bp, Artificial Sequence
  Description of Artificial Sequence: Synthetic oligonucleotide
ttgacgcaatggaggtagatgctttaaattcctcacac

SEQ ID NO: 86336 - DNA, 37 bp, Artificial Sequence
  Description of Artificial Sequence: Synthetic oligonucleotide
tgacgcaatggaggtagatgctttaaattcctcacac

SEQ ID NO: 86337 - DNA, 36 bp, Artificial Sequence
  Description of Artificial Sequence: Synthetic oligonucleotide
gacgcaatggaggtagatgctttaaattcctcacac

SEQ ID NO: 86338 - DNA, 36 bp, Artificial Sequence
  Description of Artificial Sequence: Synthetic oligonucleotide
acgcaatggaggtagatgctttaaattcctcacacc

SEQ ID NO: 86339 - DNA, 35 bp, Artificial Sequence
  Description of Artificial Sequence: Synthetic oligonucleotide
cgcaatggaggtagatgctttaaattcctcacacc

SEQ ID NO: 86340 - DNA, 35 bp, Artificial Sequence
  Description of Artificial Sequence: Synthetic oligonucleotide
gcaatggaggtagatgctttaaattcctcacaccc

SEQ ID NO: 86341 - DNA, 36 bp, Artificial Sequence
  Description of Artificial Sequence: Synthetic oligonucleotide
caatggaggtagatgctttaaattcctcacaccctg

SEQ ID NO: 86342 - DNA, 37 bp, Artificial Sequence
  Description of Artificial Sequence: Synthetic oligonucleotide
aatggaggtagatgctttaaattcctcacaccctgtg

SEQ ID NO: 86343 - DNA, 36 bp, Artificial Sequence
  Description of Artificial Sequence: Synthetic oligonucleotide
atggaggtagatgctttaaattcctcacaccctgtg

SEQ ID NO: 86344 - DNA, 35 bp, Artificial Sequence
  Description of Artificial Sequence: Synthetic oligonucleotide
tggaggtagatgctttaaattcctcacaccctgtg

SEQ ID NO: 86345 - DNA, 34 bp, Artificial Sequence
  Description of Artificial Sequence: Synthetic oligonucleotide
ggaggtagatgctttaaattcctcacaccctgtg

SEQ ID NO: 86346 - DNA, 35 bp, Artificial Sequence
  Description of Artificial Sequence: Synthetic oligonucleotide
gaggtagatgctttaaattcctcacaccctgtgtc

SEQ ID NO: 86347 - DNA, 37 bp, Artificial Sequence
  Description of Artificial Sequence: Synthetic oligonucleotide
aggtagatgctttaaattcctcacaccctgtgtctac

SEQ ID NO: 86348 - DNA, 36 bp, Artificial Sequence
  Description of Artificial Sequence: Synthetic oligonucleotide
ggtagatgctttaaattcctcacaccctgtgtctac

SEQ ID NO: 86349 - DNA, 37 bp, Artificial Sequence
  Description of Artificial Sequence: Synthetic oligonucleotide
gtagatgctttaaattcctcacaccctgtgtctacac

SEQ ID NO: 86350 - DNA, 37 bp, Artificial Sequence
  Description of Artificial Sequence: Synthetic oligonucleotide
tagatgctttaaattcctcacaccctgtgtctacacc

SEQ ID NO: 86351 - DNA, 36 bp, Artificial Sequence
  Description of Artificial Sequence: Synthetic oligonucleotide
agatgctttaaattcctcacaccctgtgtctacacc

SEQ ID NO: 86352 - DNA, 35 bp, Artificial Sequence
  Description of Artificial Sequence: Synthetic oligonucleotide
gatgctttaaattcctcacaccctgtgtctacacc

SEQ ID NO: 86353 - DNA, 36 bp, Artificial Sequence
  Description of Artificial Sequence: Synthetic oligonucleotide
atgctttaaattcctcacaccctgtgtctacacctg

SEQ ID NO: 86354 - DNA, 35 bp, Artificial Sequence
  Description of Artificial Sequence: Synthetic oligonucleotide
tgctttaaattcctcacaccctgtgtctacacctg

SEQ ID NO: 86355 - DNA, 34 bp, Artificial Sequence
  Description of Artificial Sequence: Synthetic oligonucleotide
gctttaaattcctcacaccctgtgtctacacctg

SEQ ID NO: 86356 - DNA, 35 bp, Artificial Sequence
  Description of Artificial Sequence: Synthetic oligonucleotide
ctttaaattcctcacaccctgtgtctacacctgtg

SEQ ID NO: 86357 - DNA, 35 bp, Artificial Sequence
  Description of Artificial Sequence: Synthetic oligonucleotide
tttaaattcctcacaccctgtgtctacacctgtgg

SEQ ID NO: 86358 - DNA, 34 bp, Artificial Sequence
  Description of Artificial Sequence: Synthetic oligonucleotide
ttaaattcctcacaccctgtgtctacacctgtgg

SEQ ID NO: 86359 - DNA, 33 bp, Artificial Sequence
  Description of Artificial Sequence: Synthetic oligonucleotide
taaattcctcacaccctgtgtctacacctgtgg

SEQ ID NO: 86360 - DNA, 32 bp, Artificial Sequence
  Description of Artificial Sequence: Synthetic oligonucleotide
aaattcctcacaccctgtgtctacacctgtgg

SEQ ID NO: 86361 - DNA, 31 bp, Artificial Sequence
  Description of Artificial Sequence: Synthetic oligonucleotide
aattcctcacaccctgtgtctacacctgtgg

SEQ ID NO: 86362 - DNA, 30 bp, Artificial Sequence
  Description of Artificial Sequence: Synthetic oligonucleotide
attcctcacaccctgtgtctacacctgtgg

SEQ ID NO: 86363 - DNA, 29 bp, Artificial Sequence
  Description of Artificial Sequence: Synthetic oligonucleotide
ttcctcacaccctgtgtctacacctgtgg

SEQ ID NO: 86364 - DNA, 28 bp, Artificial Sequence
  Description of Artificial Sequence: Synthetic oligonucleotide
tcctcacaccctgtgtctacacctgtgg

SEQ ID NO: 86365 - DNA, 27 bp, Artificial Sequence
  Description of Artificial Sequence: Synthetic oligonucleotide
cctcacaccctgtgtctacacctgtgg

SEQ ID NO: 86366 - DNA, 32 bp, Artificial Sequence
  Description of Artificial Sequence: Synthetic oligonucleotide
ctcacaccctgtgtctacacctgtggaaaatc

SEQ ID NO: 86367 - DNA, 32 bp, Artificial Sequence
  Description of Artificial Sequence: Synthetic oligonucleotide
tcacaccctgtgtctacacctgtggaaaatcc

SEQ ID NO: 86368 - DNA, 31 bp, Artificial Sequence
  Description of Artificial Sequence: Synthetic oligonucleotide
cacaccctgtgtctacacctgtggaaaatcc

SEQ ID NO: 86369 - DNA, 32 bp, Artificial Sequence
  Description of Artificial Sequence: Synthetic oligonucleotide
acaccctgtgtctacacctgtggaaaatcctg

SEQ ID NO: 86370 - DNA, 31 bp, Artificial Sequence
  Description of Artificial Sequence: Synthetic oligonucleotide
caccctgtgtctacacctgtggaaaatcctg

SEQ ID NO: 86371 - DNA, 31 bp, Artificial Sequence
  Description of Artificial Sequence: Synthetic oligonucleotide
accctgtgtctacacctgtggaaaatcctgc

SEQ ID NO: 86372 - DNA, 30 bp, Artificial Sequence
  Description of Artificial Sequence: Synthetic oligonucleotide
ccctgtgtctacacctgtggaaaatcctgc

SEQ ID NO: 86373 - DNA, 31 bp, Artificial Sequence
  Description of Artificial Sequence: Synthetic oligonucleotide
cctgtgtctacacctgtggaaaatcctgctc

SEQ ID NO: 86374 - DNA, 32 bp, Artificial Sequence
  Description of Artificial Sequence: Synthetic oligonucleotide
ctgtgtctacacctgtggaaaatcctgctcag

SEQ ID NO: 86375 - DNA, 34 bp, Artificial Sequence
  Description of Artificial Sequence: Synthetic oligonucleotide
tgtgtctacacctgtggaaaatcctgctcagatc

SEQ ID NO: 86376 - DNA, 33 bp, Artificial Sequence
  Description of Artificial Sequence: Synthetic oligonucleotide
gtgtctacacctgtggaaaatcctgctcagatc

SEQ ID NO: 86377 - DNA, 33 bp, Artificial Sequence
  Description of Artificial Sequence: Synthetic oligonucleotide
tgtctacacctgtggaaaatcctgctcagatcc

SEQ ID NO: 86378 - DNA, 32 bp, Artificial Sequence
  Description of Artificial Sequence: Synthetic oligonucleotide
gtctacacctgtggaaaatcctgctcagatcc

SEQ ID NO: 86379 - DNA, 32 bp, Artificial Sequence
  Description of Artificial Sequence: Synthetic oligonucleotide
tctacacctgtggaaaatcctgctcagatccg

SEQ ID NO: 86380 - DNA, 31 bp, Artificial Sequence
  Description of Artificial Sequence: Synthetic oligonucleotide
ctacacctgtggaaaatcctgctcagatccg

SEQ ID NO: 86381 - DNA, 31 bp, Artificial Sequence
  Description of Artificial Sequence: Synthetic oligonucleotide
tacacctgtggaaaatcctgctcagatccgg

SEQ ID NO: 86382 - DNA, 30 bp, Artificial Sequence
  Description of Artificial Sequence: Synthetic oligonucleotide
acacctgtggaaaatcctgctcagatccgg

SEQ ID NO: 86383 - DNA, 29 bp, Artificial Sequence
  Description of Artificial Sequence: Synthetic oligonucleotide
cacctgtggaaaatcctgctcagatccgg

SEQ ID NO: 86384 - DNA, 29 bp, Artificial Sequence
  Description of Artificial Sequence: Synthetic oligonucleotide
acctgtggaaaatcctgctcagatccggg

SEQ ID NO: 86385 - DNA, 28 bp, Artificial Sequence
  Description of Artificial Sequence: Synthetic oligonucleotide
cctgtggaaaatcctgctcagatccggg

SEQ ID NO: 86386 - DNA, 29 bp, Artificial Sequence
  Description of Artificial Sequence: Synthetic oligonucleotide
ctgtggaaaatcctgctcagatccgggag

SEQ ID NO: 86387 - DNA, 31 bp, Artificial Sequence
  Description of Artificial Sequence: Synthetic oligonucleotide
tgtggaaaatcctgctcagatccgggagatg

SEQ ID NO: 86388 - DNA, 30 bp, Artificial Sequence
  Description of Artificial Sequence: Synthetic oligonucleotide
gtggaaaatcctgctcagatccgggagatg

SEQ ID NO: 86389 - DNA, 33 bp, Artificial Sequence
  Description of Artificial Sequence: Synthetic oligonucleotide
tggaaaatcctgctcagatccgggagatgtttg

SEQ ID NO: 86390 - DNA, 32 bp, Artificial Sequence
  Description of Artificial Sequence: Synthetic oligonucleotide
ggaaaatcctgctcagatccgggagatgtttg

SEQ ID NO: 86391 - DNA, 34 bp, Artificial Sequence
  Description of Artificial Sequence: Synthetic oligonucleotide
gaaaatcctgctcagatccgggagatgtttgatg

SEQ ID NO: 86392 - DNA, 36 bp, Artificial Sequence
  Description of Artificial Sequence: Synthetic oligonucleotide
aaaatcctgctcagatccgggagatgtttgatgatg

SEQ ID NO: 86393 - DNA, 35 bp, Artificial Sequence
  Description of Artificial Sequence: Synthetic oligonucleotide
aaatcctgctcagatccgggagatgtttgatgatg

SEQ ID NO: 86394 - DNA, 34 bp, Artificial Sequence
  Description of Artificial Sequence: Synthetic oligonucleotide
aatcctgctcagatccgggagatgtttgatgatg

SEQ ID NO: 86395 - DNA, 33 bp, Artificial Sequence
  Description of Artificial Sequence: Synthetic oligonucleotide
atcctgctcagatccgggagatgtttgatgatg

SEQ ID NO: 86396 - DNA, 32 bp, Artificial Sequence
  Description of Artificial Sequence: Synthetic oligonucleotide
tcctgctcagatccgggagatgtttgatgatg

SEQ ID NO: 86397 - DNA, 31 bp, Artificial Sequence
  Description of Artificial Sequence: Synthetic oligonucleotide
cctgctcagatccgggagatgtttgatgatg

SEQ ID NO: 86398 - DNA, 34 bp, Artificial Sequence
  Description of Artificial Sequence: Synthetic oligonucleotide
ctgctcagatccgggagatgtttgatgatgtttc

SEQ ID NO: 86399 - DNA, 38 bp, Artificial Sequence
  Description of Artificial Sequence: Synthetic oligonucleotide
tgctcagatccgggagatgtttgatgatgtttcttatg

SEQ ID NO: 86400 - DNA, 37 bp, Artificial Sequence
  Description of Artificial Sequence: Synthetic oligonucleotide
gctcagatccgggagatgtttgatgatgtttcttatg

SEQ ID NO: 86401 - DNA, 41 bp, Artificial Sequence
  Description of Artificial Sequence: Synthetic oligonucleotide
ctcagatccgggagatgtttgatgatgtttcttatgataag

SEQ ID NO: 86402 - DNA, 41 bp, Artificial Sequence
  Description of Artificial Sequence: Synthetic oligonucleotide
tcagatccgggagatgtttgatgatgtttcttatgataagg

SEQ ID NO: 86403 - DNA, 40 bp, Artificial Sequence
  Description of Artificial Sequence: Synthetic oligonucleotide
cagatccgggagatgtttgatgatgtttcttatgataagg

SEQ ID NO: 86404 - DNA, 40 bp, Artificial Sequence
  Description of Artificial Sequence: Synthetic oligonucleotide
agatccgggagatgtttgatgatgtttcttatgataaggg

SEQ ID NO: 86405 - DNA, 39 bp, Artificial Sequence
  Description of Artificial Sequence: Synthetic oligonucleotide
gatccgggagatgtttgatgatgtttcttatgataaggg

SEQ ID NO: 86406 - DNA, 40 bp, Artificial Sequence
  Description of Artificial Sequence: Synthetic oligonucleotide
atccgggagatgtttgatgatgtttcttatgataagggag

SEQ ID NO: 86407 - DNA, 39 bp, Artificial Sequence
  Description of Artificial Sequence: Synthetic oligonucleotide
tccgggagatgtttgatgatgtttcttatgataagggag

SEQ ID NO: 86408 - DNA, 38 bp, Artificial Sequence
  Description of Artificial Sequence: Synthetic oligonucleotide
ccgggagatgtttgatgatgtttcttatgataagggag

SEQ ID NO: 86409 - DNA, 38 bp, Artificial Sequence
  Description of Artificial Sequence: Synthetic oligonucleotide
cgggagatgtttgatgatgtttcttatgataagggagc

SEQ ID NO: 86410 - DNA, 40 bp, Artificial Sequence
  Description of Artificial Sequence: Synthetic oligonucleotide
gggagatgtttgatgatgtttcttatgataagggagcttg

SEQ ID NO: 86411 - DNA, 44 bp, Artificial Sequence
  Description of Artificial Sequence: Synthetic oligonucleotide
ggagatgtttgatgatgtttcttatgataagggagcttgtattc

SEQ ID NO: 86412 - DNA, 45 bp, Artificial Sequence
  Description of Artificial Sequence: Synthetic oligonucleotide
gagatgtttgatgatgtttcttatgataagggagcttgtattctg

SEQ ID NO: 86413 - DNA, 50 bp, Artificial Sequence
  Description of Artificial Sequence: Synthetic oligonucleotide
agatgtttgatgatgtttcttatgataagggagcttgtattctgaatatg

SEQ ID NO: 86414 - DNA, 49 bp, Artificial Sequence
  Description of Artificial Sequence: Synthetic oligonucleotide
gatgtttgatgatgtttcttatgataagggagcttgtattctgaatatg

SEQ ID NO: 86415 - DNA, 49 bp, Artificial Sequence
  Description of Artificial Sequence: Synthetic oligonucleotide
atgtttgatgatgtttcttatgataagggagcttgtattctgaatatgc

SEQ ID NO: 86416 - DNA, 48 bp, Artificial Sequence
  Description of Artificial Sequence: Synthetic oligonucleotide
tgtttgatgatgtttcttatgataagggagcttgtattctgaatatgc

SEQ ID NO: 86417 - DNA, 47 bp, Artificial Sequence
  Description of Artificial Sequence: Synthetic oligonucleotide
gtttgatgatgtttcttatgataagggagcttgtattctgaatatgc

SEQ ID NO: 86418 - DNA, 50 bp, Artificial Sequence
  Description of Artificial Sequence: Synthetic oligonucleotide
tttgatgatgtttcttatgataagggagcttgtattctgaatatgctaag

SEQ ID NO: 86419 - DNA, 49 bp, Artificial Sequence
  Description of Artificial Sequence: Synthetic oligonucleotide
ttgatgatgtttcttatgataagggagcttgtattctgaatatgctaag

SEQ ID NO: 86420 - DNA, 48 bp, Artificial Sequence
  Description of Artificial Sequence: Synthetic oligonucleotide
tgatgatgtttcttatgataagggagcttgtattctgaatatgctaag

SEQ ID NO: 86421 - DNA, 47 bp, Artificial Sequence
  Description of Artificial Sequence: Synthetic oligonucleotide
gatgatgtttcttatgataagggagcttgtattctgaatatgctaag

SEQ ID NO: 86422 - DNA, 47 bp, Artificial Sequence
  Description of Artificial Sequence: Synthetic oligonucleotide
atgatgtttcttatgataagggagcttgtattctgaatatgctaagg

SEQ ID NO: 86423 - DNA, 46 bp, Artificial Sequence
  Description of Artificial Sequence: Synthetic oligonucleotide
tgatgtttcttatgataagggagcttgtattctgaatatgctaagg

SEQ ID NO: 86424 - DNA, 45 bp, Artificial Sequence
  Description of Artificial Sequence: Synthetic oligonucleotide
gatgtttcttatgataagggagcttgtattctgaatatgctaagg

SEQ ID NO: 86425 - DNA, 45 bp, Artificial Sequence
  Description of Artificial Sequence: Synthetic oligonucleotide
atgtttcttatgataagggagcttgtattctgaatatgctaaggg

SEQ ID NO: 86426 - DNA, 44 bp, Artificial Sequence
  Description of Artificial Sequence: Synthetic oligonucleotide
tgtttcttatgataagggagcttgtattctgaatatgctaaggg

SEQ ID NO: 86427 - DNA, 43 bp, Artificial Sequence
  Description of Artificial Sequence: Synthetic oligonucleotide
gtttcttatgataagggagcttgtattctgaatatgctaaggg

SEQ ID NO: 86428 - DNA, 44 bp, Artificial Sequence
  Description of Artificial Sequence: Synthetic oligonucleotide
tttcttatgataagggagcttgtattctgaatatgctaagggag

SEQ ID NO: 86429 - DNA, 43 bp, Artificial Sequence
  Description of Artificial Sequence: Synthetic oligonucleotide
ttcttatgataagggagcttgtattctgaatatgctaagggag

SEQ ID NO: 86430 - DNA, 42 bp, Artificial Sequence
  Description of Artificial Sequence: Synthetic oligonucleotide
tcttatgataagggagcttgtattctgaatatgctaagggag

SEQ ID NO: 86431 - DNA, 41 bp, Artificial Sequence
  Description of Artificial Sequence: Synthetic oligonucleotide
cttatgataagggagcttgtattctgaatatgctaagggag

SEQ ID NO: 86432 - DNA, 44 bp, Artificial Sequence
  Description of Artificial Sequence: Synthetic oligonucleotide
ttatgataagggagcttgtattctgaatatgctaagggagtatc

SEQ ID NO: 86433 - DNA, 43 bp, Artificial Sequence
  Description of Artificial Sequence: Synthetic oligonucleotide
tatgataagggagcttgtattctgaatatgctaagggagtatc

SEQ ID NO: 86434 - DNA, 42 bp, Artificial Sequence
  Description of Artificial Sequence: Synthetic oligonucleotide
atgataagggagcttgtattctgaatatgctaagggagtatc

SEQ ID NO: 86435 - DNA, 41 bp, Artificial Sequence
  Description of Artificial Sequence: Synthetic oligonucleotide
tgataagggagcttgtattctgaatatgctaagggagtatc

SEQ ID NO: 86436 - DNA, 40 bp, Artificial Sequence
  Description of Artificial Sequence: Synthetic oligonucleotide
gataagggagcttgtattctgaatatgctaagggagtatc

SEQ ID NO: 86437 - DNA, 43 bp, Artificial Sequence
  Description of Artificial Sequence: Synthetic oligonucleotide
ataagggagcttgtattctgaatatgctaagggagtatcttag

SEQ ID NO: 86438 - DNA, 42 bp, Artificial Sequence
  Description of Artificial Sequence: Synthetic oligonucleotide
taagggagcttgtattctgaatatgctaagggagtatcttag

SEQ ID NO: 86439 - DNA, 41 bp, Artificial Sequence
  Description of Artificial Sequence: Synthetic oligonucleotide
aagggagcttgtattctgaatatgctaagggagtatcttag

SEQ ID NO: 86440 - DNA, 40 bp, Artificial Sequence
  Description of Artificial Sequence: Synthetic oligonucleotide
agggagcttgtattctgaatatgctaagggagtatcttag

SEQ ID NO: 86441 - DNA, 39 bp, Artificial Sequence
  Description of Artificial Sequence: Synthetic oligonucleotide
gggagcttgtattctgaatatgctaagggagtatcttag

SEQ ID NO: 86442 - DNA, 40 bp, Artificial Sequence
  Description of Artificial Sequence: Synthetic oligonucleotide
ggagcttgtattctgaatatgctaagggagtatcttagtg

SEQ ID NO: 86443 - DNA, 40 bp, Artificial Sequence
  Description of Artificial Sequence: Synthetic oligonucleotide
gagcttgtattctgaatatgctaagggagtatcttagtgc

SEQ ID NO: 86444 - DNA, 41 bp, Artificial Sequence
  Description of Artificial Sequence: Synthetic oligonucleotide
agcttgtattctgaatatgctaagggagtatcttagtgctg

SEQ ID NO: 86445 - DNA, 40 bp, Artificial Sequence
  Description of Artificial Sequence: Synthetic oligonucleotide
gcttgtattctgaatatgctaagggagtatcttagtgctg

SEQ ID NO: 86446 - DNA, 41 bp, Artificial Sequence
  Description of Artificial Sequence: Synthetic oligonucleotide
cttgtattctgaatatgctaagggagtatcttagtgctgac

SEQ ID NO: 86447 - DNA, 41 bp, Artificial Sequence
  Description of Artificial Sequence: Synthetic oligonucleotide
ttgtattctgaatatgctaagggagtatcttagtgctgacg

SEQ ID NO: 86448 - DNA, 40 bp, Artificial Sequence
  Description of Artificial Sequence: Synthetic oligonucleotide
tgtattctgaatatgctaagggagtatcttagtgctgacg

SEQ ID NO: 86449 - DNA, 39 bp, Artificial Sequence
  Description of Artificial Sequence: Synthetic oligonucleotide
gtattctgaatatgctaagggagtatcttagtgctgacg

SEQ ID NO: 86450 - DNA, 39 bp, Artificial Sequence
  Description of Artificial Sequence: Synthetic oligonucleotide
tattctgaatatgctaagggagtatcttagtgctgacgc

SEQ ID NO: 86451 - DNA, 38 bp, Artificial Sequence
  Description of Artificial Sequence: Synthetic oligonucleotide
attctgaatatgctaagggagtatcttagtgctgacgc

SEQ ID NO: 86452 - DNA, 37 bp, Artificial Sequence
  Description of Artificial Sequence: Synthetic oligonucleotide
ttctgaatatgctaagggagtatcttagtgctgacgc

SEQ ID NO: 86453 - DNA, 36 bp, Artificial Sequence
  Description of Artificial Sequence: Synthetic oligonucleotide
tctgaatatgctaagggagtatcttagtgctgacgc

SEQ ID NO: 86454 - DNA, 35 bp, Artificial Sequence
  Description of Artificial Sequence: Synthetic oligonucleotide
ctgaatatgctaagggagtatcttagtgctgacgc

SEQ ID NO: 86455 - DNA, 43 bp, Artificial Sequence
  Description of Artificial Sequence: Synthetic oligonucleotide
tgaatatgctaagggagtatcttagtgctgacgcatttaaaag

SEQ ID NO: 86456 - DNA, 42 bp, Artificial Sequence
  Description of Artificial Sequence: Synthetic oligonucleotide
gaatatgctaagggagtatcttagtgctgacgcatttaaaag

SEQ ID NO: 86457 - DNA, 43 bp, Artificial Sequence
  Description of Artificial Sequence: Synthetic oligonucleotide
aatatgctaagggagtatcttagtgctgacgcatttaaaagtg

SEQ ID NO: 86458 - DNA, 42 bp, Artificial Sequence
  Description of Artificial Sequence: Synthetic oligonucleotide
atatgctaagggagtatcttagtgctgacgcatttaaaagtg

SEQ ID NO: 86459 - DNA, 41 bp, Artificial Sequence
  Description of Artificial Sequence: Synthetic oligonucleotide
tatgctaagggagtatcttagtgctgacgcatttaaaagtg

SEQ ID NO: 86460 - DNA, 40 bp, Artificial Sequence
  Description of Artificial Sequence: Synthetic oligonucleotide
atgctaagggagtatcttagtgctgacgcatttaaaagtg

SEQ ID NO: 86461 - DNA, 39 bp, Artificial Sequence
  Description of Artificial Sequence: Synthetic oligonucleotide
tgctaagggagtatcttagtgctgacgcatttaaaagtg

SEQ ID NO: 86462 - DNA, 38 bp, Artificial Sequence
  Description of Artificial Sequence: Synthetic oligonucleotide
gctaagggagtatcttagtgctgacgcatttaaaagtg

SEQ ID NO: 86463 - DNA, 38 bp, Artificial Sequence
  Description of Artificial Sequence: Synthetic oligonucleotide
ctaagggagtatcttagtgctgacgcatttaaaagtgg

SEQ ID NO: 86464 - DNA, 42 bp, Artificial Sequence
  Description of Artificial Sequence: Synthetic oligonucleotide
taagggagtatcttagtgctgacgcatttaaaagtggtattg

SEQ ID NO: 86465 - DNA, 41 bp, Artificial Sequence
  Description of Artificial Sequence: Synthetic oligonucleotide
aagggagtatcttagtgctgacgcatttaaaagtggtattg

SEQ ID NO: 86466 - DNA, 40 bp, Artificial Sequence
  Description of Artificial Sequence: Synthetic oligonucleotide
agggagtatcttagtgctgacgcatttaaaagtggtattg

SEQ ID NO: 86467 - DNA, 39 bp, Artificial Sequence
  Description of Artificial Sequence: Synthetic oligonucleotide
gggagtatcttagtgctgacgcatttaaaagtggtattg

SEQ ID NO: 86468 - DNA, 41 bp, Artificial Sequence
  Description of Artificial Sequence: Synthetic oligonucleotide
ggagtatcttagtgctgacgcatttaaaagtggtattgtac

SEQ ID NO: 86469 - DNA, 42 bp, Artificial Sequence
  Description of Artificial Sequence: Synthetic oligonucleotide
gagtatcttagtgctgacgcatttaaaagtggtattgtacag

SEQ ID NO: 86470 - DNA, 45 bp, Artificial Sequence
  Description of Artificial Sequence: Synthetic oligonucleotide
agtatcttagtgctgacgcatttaaaagtggtattgtacagtatc

SEQ ID NO: 86471 - DNA, 44 bp, Artificial Sequence
  Description of Artificial Sequence: Synthetic oligonucleotide
gtatcttagtgctgacgcatttaaaagtggtattgtacagtatc

SEQ ID NO: 86472 - DNA, 45 bp, Artificial Sequence
  Description of Artificial Sequence: Synthetic oligonucleotide
tatcttagtgctgacgcatttaaaagtggtattgtacagtatctc

SEQ ID NO: 86473 - DNA, 44 bp, Artificial Sequence
  Description of Artificial Sequence: Synthetic oligonucleotide
atcttagtgctgacgcatttaaaagtggtattgtacagtatctc

SEQ ID NO: 86474 - DNA, 43 bp, Artificial Sequence
  Description of Artificial Sequence: Synthetic oligonucleotide
tcttagtgctgacgcatttaaaagtggtattgtacagtatctc

SEQ ID NO: 86475 - DNA, 42 bp, Artificial Sequence
  Description of Artificial Sequence: Synthetic oligonucleotide
cttagtgctgacgcatttaaaagtggtattgtacagtatctc

SEQ ID NO: 86476 - DNA, 42 bp, Artificial Sequence
  Description of Artificial Sequence: Synthetic oligonucleotide
ttagtgctgacgcatttaaaagtggtattgtacagtatctcc

SEQ ID NO: 86477 - DNA, 41 bp, Artificial Sequence
  Description of Artificial Sequence: Synthetic oligonucleotide
tagtgctgacgcatttaaaagtggtattgtacagtatctcc

SEQ ID NO: 86478 - DNA, 40 bp, Artificial Sequence
  Description of Artificial Sequence: Synthetic oligonucleotide
agtgctgacgcatttaaaagtggtattgtacagtatctcc

SEQ ID NO: 86479 - DNA, 39 bp, Artificial Sequence
  Description of Artificial Sequence: Synthetic oligonucleotide
gtgctgacgcatttaaaagtggtattgtacagtatctcc

SEQ ID NO: 86480 - DNA, 40 bp, Artificial Sequence
  Description of Artificial Sequence: Synthetic oligonucleotide
tgctgacgcatttaaaagtggtattgtacagtatctccag

SEQ ID NO: 86481 - DNA, 39 bp, Artificial Sequence
  Description of Artificial Sequence: Synthetic oligonucleotide
gctgacgcatttaaaagtggtattgtacagtatctccag

SEQ ID NO: 86482 - DNA, 41 bp, Artificial Sequence
  Description of Artificial Sequence: Synthetic oligonucleotide
ctgacgcatttaaaagtggtattgtacagtatctccagaag

SEQ ID NO: 86483 - DNA, 41 bp, Artificial Sequence
  Description of Artificial Sequence: Synthetic oligonucleotide
tgacgcatttaaaagtggtattgtacagtatctccagaagc

SEQ ID NO: 86484 - DNA, 40 bp, Artificial Sequence
  Description of Artificial Sequence: Synthetic oligonucleotide
gacgcatttaaaagtggtattgtacagtatctccagaagc

SEQ ID NO: 86485 - DNA, 43 bp, Artificial Sequence
  Description of Artificial Sequence: Synthetic oligonucleotide
acgcatttaaaagtggtattgtacagtatctccagaagcatag

SEQ ID NO: 86486 - DNA, 42 bp, Artificial Sequence
  Description of Artificial Sequence: Synthetic oligonucleotide
cgcatttaaaagtggtattgtacagtatctccagaagcatag

SEQ ID NO: 86487 - DNA, 42 bp, Artificial Sequence
  Description of Artificial Sequence: Synthetic oligonucleotide
gcatttaaaagtggtattgtacagtatctccagaagcatagc

SEQ ID NO: 86488 - DNA, 52 bp, Artificial Sequence
  Description of Artificial Sequence: Synthetic oligonucleotide
catttaaaagtggtattgtacagtatctccagaagcatagctataaaaatac

SEQ ID NO: 86489 - DNA, 58 bp, Artificial Sequence
  Description of Artificial Sequence: Synthetic oligonucleotide
atttaaaagtggtattgtacagtatctccagaagcatagctataaaaatacaaaaaac

SEQ ID NO: 86490 - DNA, 57 bp, Artificial Sequence
  Description of Artificial Sequence: Synthetic oligonucleotide
tttaaaagtggtattgtacagtatctccagaagcatagctataaaaatacaaaaaac

SEQ ID NO: 86491 - DNA, 56 bp, Artificial Sequence
  Description of Artificial Sequence: Synthetic oligonucleotide
ttaaaagtggtattgtacagtatctccagaagcatagctataaaaatacaaaaaac

SEQ ID NO: 86492 - DNA, 55 bp, Artificial Sequence
  Description of Artificial Sequence: Synthetic oligonucleotide
taaaagtggtattgtacagtatctccagaagcatagctataaaaatacaaaaaac

SEQ ID NO: 86493 - DNA, 54 bp, Artificial Sequence
  Description of Artificial Sequence: Synthetic oligonucleotide
aaaagtggtattgtacagtatctccagaagcatagctataaaaatacaaaaaac

SEQ ID NO: 86494 - DNA, 53 bp, Artificial Sequence
  Description of Artificial Sequence: Synthetic oligonucleotide
aaagtggtattgtacagtatctccagaagcatagctataaaaatacaaaaaac

SEQ ID NO: 86495 - DNA, 52 bp, Artificial Sequence
  Description of Artificial Sequence: Synthetic oligonucleotide
aagtggtattgtacagtatctccagaagcatagctataaaaatacaaaaaac

SEQ ID NO: 86496 - DNA, 51 bp, Artificial Sequence
  Description of Artificial Sequence: Synthetic oligonucleotide
agtggtattgtacagtatctccagaagcatagctataaaaatacaaaaaac

SEQ ID NO: 86497 - DNA, 50 bp, Artificial Sequence
  Description of Artificial Sequence: Synthetic oligonucleotide
gtggtattgtacagtatctccagaagcatagctataaaaatacaaaaaac

SEQ ID NO: 86498 - DNA, 50 bp, Artificial Sequence
  Description of Artificial Sequence: Synthetic oligonucleotide
tggtattgtacagtatctccagaagcatagctataaaaatacaaaaaacg

SEQ ID NO: 86499 - DNA, 49 bp, Artificial Sequence
  Description of Artificial Sequence: Synthetic oligonucleotide
ggtattgtacagtatctccagaagcatagctataaaaatacaaaaaacg

SEQ ID NO: 86500 - DNA, 50 bp, Artificial Sequence
  Description of Artificial Sequence: Synthetic oligonucleotide
gtattgtacagtatctccagaagcatagctataaaaatacaaaaaacgag

SEQ ID NO: 86501 - DNA, 50 bp, Artificial Sequence
  Description of Artificial Sequence: Synthetic oligonucleotide
tattgtacagtatctccagaagcatagctataaaaatacaaaaaacgagg

SEQ ID NO: 86502 - DNA, 49 bp, Artificial Sequence
  Description of Artificial Sequence: Synthetic oligonucleotide
attgtacagtatctccagaagcatagctataaaaatacaaaaaacgagg

SEQ ID NO: 86503 - DNA, 48 bp, Artificial Sequence
  Description of Artificial Sequence: Synthetic oligonucleotide
ttgtacagtatctccagaagcatagctataaaaatacaaaaaacgagg

SEQ ID NO: 86504 - DNA, 47 bp, Artificial Sequence
  Description of Artificial Sequence: Synthetic oligonucleotide
tgtacagtatctccagaagcatagctataaaaatacaaaaaacgagg

SEQ ID NO: 86505 - DNA, 46 bp, Artificial Sequence
  Description of Artificial Sequence: Synthetic oligonucleotide
gtacagtatctccagaagcatagctataaaaatacaaaaaacgagg

SEQ ID NO: 86506 - DNA, 47 bp, Artificial Sequence
  Description of Artificial Sequence: Synthetic oligonucleotide
tacagtatctccagaagcatagctataaaaatacaaaaaacgaggac

SEQ ID NO: 86507 - DNA, 46 bp, Artificial Sequence
  Description of Artificial Sequence: Synthetic oligonucleotide
acagtatctccagaagcatagctataaaaatacaaaaaacgaggac

SEQ ID NO: 86508 - DNA, 45 bp, Artificial Sequence
  Description of Artificial Sequence: Synthetic oligonucleotide
cagtatctccagaagcatagctataaaaatacaaaaaacgaggac

SEQ ID NO: 86509 - DNA, 45 bp, Artificial Sequence
  Description of Artificial Sequence: Synthetic oligonucleotide
agtatctccagaagcatagctataaaaatacaaaaaacgaggacc

SEQ ID NO: 86510 - DNA, 44 bp, Artificial Sequence
  Description of Artificial Sequence: Synthetic oligonucleotide
gtatctccagaagcatagctataaaaatacaaaaaacgaggacc

SEQ ID NO: 86511 - DNA, 45 bp, Artificial Sequence
  Description of Artificial Sequence: Synthetic oligonucleotide
tatctccagaagcatagctataaaaatacaaaaaacgaggacctg

SEQ ID NO: 86512 - DNA, 44 bp, Artificial Sequence
  Description of Artificial Sequence: Synthetic oligonucleotide
atctccagaagcatagctataaaaatacaaaaaacgaggacctg

SEQ ID NO: 86513 - DNA, 43 bp, Artificial Sequence
  Description of Artificial Sequence: Synthetic oligonucleotide
tctccagaagcatagctataaaaatacaaaaaacgaggacctg

SEQ ID NO: 86514 - DNA, 42 bp, Artificial Sequence
  Description of Artificial Sequence: Synthetic oligonucleotide
ctccagaagcatagctataaaaatacaaaaaacgaggacctg

SEQ ID NO: 86515 - DNA, 43 bp, Artificial Sequence
  Description of Artificial Sequence: Synthetic oligonucleotide
tccagaagcatagctataaaaatacaaaaaacgaggacctgtg

SEQ ID NO: 86516 - DNA, 42 bp, Artificial Sequence
  Description of Artificial Sequence: Synthetic oligonucleotide
ccagaagcatagctataaaaatacaaaaaacgaggacctgtg

SEQ ID NO: 86517 - DNA, 42 bp, Artificial Sequence
  Description of Artificial Sequence: Synthetic oligonucleotide
cagaagcatagctataaaaatacaaaaaacgaggacctgtgg

SEQ ID NO: 86518 - DNA, 42 bp, Artificial Sequence
  Description of Artificial Sequence: Synthetic oligonucleotide
agaagcatagctataaaaatacaaaaaacgaggacctgtggg

SEQ ID NO: 86519 - DNA, 41 bp, Artificial Sequence
  Description of Artificial Sequence: Synthetic oligonucleotide
gaagcatagctataaaaatacaaaaaacgaggacctgtggg

SEQ ID NO: 86520 - DNA, 44 bp, Artificial Sequence
  Description of Artificial Sequence: Synthetic oligonucleotide
aagcatagctataaaaatacaaaaaacgaggacctgtgggatag

SEQ ID NO: 86521 - DNA, 43 bp, Artificial Sequence
  Description of Artificial Sequence: Synthetic oligonucleotide
agcatagctataaaaatacaaaaaacgaggacctgtgggatag

SEQ ID NO: 86522 - DNA, 42 bp, Artificial Sequence
  Description of Artificial Sequence: Synthetic oligonucleotide
gcatagctataaaaatacaaaaaacgaggacctgtgggatag

SEQ ID NO: 86523 - DNA, 45 bp, Artificial Sequence
  Description of Artificial Sequence: Synthetic oligonucleotide
catagctataaaaatacaaaaaacgaggacctgtgggatagtatg

SEQ ID NO: 86524 - DNA, 45 bp, Artificial Sequence
  Description of Artificial Sequence: Synthetic oligonucleotide
atagctataaaaatacaaaaaacgaggacctgtgggatagtatgg

SEQ ID NO: 86525 - DNA, 44 bp, Artificial Sequence
  Description of Artificial Sequence: Synthetic oligonucleotide
tagctataaaaatacaaaaaacgaggacctgtgggatagtatgg

SEQ ID NO: 86526 - DNA, 43 bp, Artificial Sequence
  Description of Artificial Sequence: Synthetic oligonucleotide
agctataaaaatacaaaaaacgaggacctgtgggatagtatgg

SEQ ID NO: 86527 - DNA, 42 bp, Artificial Sequence
  Description of Artificial Sequence: Synthetic oligonucleotide
gctataaaaatacaaaaaacgaggacctgtgggatagtatgg

SEQ ID NO: 86528 - DNA, 42 bp, Artificial Sequence
  Description of Artificial Sequence: Synthetic oligonucleotide
ctataaaaatacaaaaaacgaggacctgtgggatagtatggc

SEQ ID NO: 86529 - DNA, 44 bp, Artificial Sequence
  Description of Artificial Sequence: Synthetic oligonucleotide
tataaaaatacaaaaaacgaggacctgtgggatagtatggcaag

SEQ ID NO: 86530 - DNA, 43 bp, Artificial Sequence
  Description of Artificial Sequence: Synthetic oligonucleotide
ataaaaatacaaaaaacgaggacctgtgggatagtatggcaag

SEQ ID NO: 86531 - DNA, 42 bp, Artificial Sequence
  Description of Artificial Sequence: Synthetic oligonucleotide
taaaaatacaaaaaacgaggacctgtgggatagtatggcaag

SEQ ID NO: 86532 - DNA, 41 bp, Artificial Sequence
  Description of Artificial Sequence: Synthetic oligonucleotide
aaaaatacaaaaaacgaggacctgtgggatagtatggcaag

SEQ ID NO: 86533 - DNA, 40 bp, Artificial Sequence
  Description of Artificial Sequence: Synthetic oligonucleotide
aaaatacaaaaaacgaggacctgtgggatagtatggcaag

SEQ ID NO: 86534 - DNA, 39 bp, Artificial Sequence
  Description of Artificial Sequence: Synthetic oligonucleotide
aaatacaaaaaacgaggacctgtgggatagtatggcaag

SEQ ID NO: 86535 - DNA, 38 bp, Artificial Sequence
  Description of Artificial Sequence: Synthetic oligonucleotide
aatacaaaaaacgaggacctgtgggatagtatggcaag

SEQ ID NO: 86536 - DNA, 37 bp, Artificial Sequence
  Description of Artificial Sequence: Synthetic oligonucleotide
atacaaaaaacgaggacctgtgggatagtatggcaag

SEQ ID NO: 86537 - DNA, 36 bp, Artificial Sequence
  Description of Artificial Sequence: Synthetic oligonucleotide
tacaaaaaacgaggacctgtgggatagtatggcaag

SEQ ID NO: 86538 - DNA, 35 bp, Artificial Sequence
  Description of Artificial Sequence: Synthetic oligonucleotide
acaaaaaacgaggacctgtgggatagtatggcaag

SEQ ID NO: 86539 - DNA, 34 bp, Artificial Sequence
  Description of Artificial Sequence: Synthetic oligonucleotide
caaaaaacgaggacctgtgggatagtatggcaag

SEQ ID NO: 86540 - DNA, 39 bp, Artificial Sequence
  Description of Artificial Sequence: Synthetic oligonucleotide
aaaaaacgaggacctgtgggatagtatggcaagtatttg

SEQ ID NO: 86541 - DNA, 38 bp, Artificial Sequence
  Description of Artificial Sequence: Synthetic oligonucleotide
aaaaacgaggacctgtgggatagtatggcaagtatttg

SEQ ID NO: 86542 - DNA, 37 bp, Artificial Sequence
  Description of Artificial Sequence: Synthetic oligonucleotide
aaaacgaggacctgtgggatagtatggcaagtatttg

SEQ ID NO: 86543 - DNA, 36 bp, Artificial Sequence
  Description of Artificial Sequence: Synthetic oligonucleotide
aaacgaggacctgtgggatagtatggcaagtatttg

SEQ ID NO: 86544 - DNA, 35 bp, Artificial Sequence
  Description of Artificial Sequence: Synthetic oligonucleotide
aacgaggacctgtgggatagtatggcaagtatttg

SEQ ID NO: 86545 - DNA, 34 bp, Artificial Sequence
  Description of Artificial Sequence: Synthetic oligonucleotide
acgaggacctgtgggatagtatggcaagtatttg

SEQ ID NO: 86546 - DNA, 33 bp, Artificial Sequence
  Description of Artificial Sequence: Synthetic oligonucleotide
cgaggacctgtgggatagtatggcaagtatttg

SEQ ID NO: 86547 - DNA, 33 bp, Artificial Sequence
  Description of Artificial Sequence: Synthetic oligonucleotide
gaggacctgtgggatagtatggcaagtatttgc

SEQ ID NO: 86548 - DNA, 33 bp, Artificial Sequence
  Description of Artificial Sequence: Synthetic oligonucleotide
aggacctgtgggatagtatggcaagtatttgcc

SEQ ID NO: 86549 - DNA, 32 bp, Artificial Sequence
  Description of Artificial Sequence: Synthetic oligonucleotide
ggacctgtgggatagtatggcaagtatttgcc

SEQ ID NO: 86550 - DNA, 32 bp, Artificial Sequence
  Description of Artificial Sequence: Synthetic oligonucleotide
gacctgtgggatagtatggcaagtatttgccc

SEQ ID NO: 86551 - DNA, 34 bp, Artificial Sequence
  Description of Artificial Sequence: Synthetic oligonucleotide
acctgtgggatagtatggcaagtatttgccctac

SEQ ID NO: 86552 - DNA, 33 bp, Artificial Sequence
  Description of Artificial Sequence: Synthetic oligonucleotide
cctgtgggatagtatggcaagtatttgccctac

SEQ ID NO: 86553 - DNA, 34 bp, Artificial Sequence
  Description of Artificial Sequence: Synthetic oligonucleotide
ctgtgggatagtatggcaagtatttgccctacag

SEQ ID NO: 86554 - DNA, 36 bp, Artificial Sequence
  Description of Artificial Sequence: Synthetic oligonucleotide
tgtgggatagtatggcaagtatttgccctacagatg

SEQ ID NO: 86555 - DNA, 35 bp, Artificial Sequence
  Description of Artificial Sequence: Synthetic oligonucleotide
gtgggatagtatggcaagtatttgccctacagatg

SEQ ID NO: 86556 - DNA, 35 bp, Artificial Sequence
  Description of Artificial Sequence: Synthetic oligonucleotide
tgggatagtatggcaagtatttgccctacagatgg

SEQ ID NO: 86557 - DNA, 34 bp, Artificial Sequence
  Description of Artificial Sequence: Synthetic oligonucleotide
gggatagtatggcaagtatttgccctacagatgg

SEQ ID NO: 86558 - DNA, 35 bp, Artificial Sequence
  Description of Artificial Sequence: Synthetic oligonucleotide
ggatagtatggcaagtatttgccctacagatggtg

SEQ ID NO: 86559 - DNA, 40 bp, Artificial Sequence
  Description of Artificial Sequence: Synthetic oligonucleotide
gatagtatggcaagtatttgccctacagatggtgtaaaag

SEQ ID NO: 86560 - DNA, 40 bp, Artificial Sequence
  Description of Artificial Sequence: Synthetic oligonucleotide
atagtatggcaagtatttgccctacagatggtgtaaaagg

SEQ ID NO: 86561 - DNA, 39 bp, Artificial Sequence
  Description of Artificial Sequence: Synthetic oligonucleotide
tagtatggcaagtatttgccctacagatggtgtaaaagg

SEQ ID NO: 86562 - DNA, 38 bp, Artificial Sequence
  Description of Artificial Sequence: Synthetic oligonucleotide
agtatggcaagtatttgccctacagatggtgtaaaagg

SEQ ID NO: 86563 - DNA, 37 bp, Artificial Sequence
  Description of Artificial Sequence: Synthetic oligonucleotide
gtatggcaagtatttgccctacagatggtgtaaaagg

SEQ ID NO: 86564 - DNA, 37 bp, Artificial Sequence
  Description of Artificial Sequence: Synthetic oligonucleotide
tatggcaagtatttgccctacagatggtgtaaaaggg

SEQ ID NO: 86565 - DNA, 36 bp, Artificial Sequence
  Description of Artificial Sequence: Synthetic oligonucleotide
atggcaagtatttgccctacagatggtgtaaaaggg

SEQ ID NO: 86566 - DNA, 35 bp, Artificial Sequence
  Description of Artificial Sequence: Synthetic oligonucleotide
tggcaagtatttgccctacagatggtgtaaaaggg

SEQ ID NO: 86567 - DNA, 34 bp, Artificial Sequence
  Description of Artificial Sequence: Synthetic oligonucleotide
ggcaagtatttgccctacagatggtgtaaaaggg

SEQ ID NO: 86568 - DNA, 36 bp, Artificial Sequence
  Description of Artificial Sequence: Synthetic oligonucleotide
gcaagtatttgccctacagatggtgtaaaagggatg

SEQ ID NO: 86569 - DNA, 36 bp, Artificial Sequence
  Description of Artificial Sequence: Synthetic oligonucleotide
caagtatttgccctacagatggtgtaaaagggatgg

SEQ ID NO: 86570 - DNA, 38 bp, Artificial Sequence
  Description of Artificial Sequence: Synthetic oligonucleotide
aagtatttgccctacagatggtgtaaaagggatggatg

SEQ ID NO: 86571 - DNA, 37 bp, Artificial Sequence
  Description of Artificial Sequence: Synthetic oligonucleotide
agtatttgccctacagatggtgtaaaagggatggatg

SEQ ID NO: 86572 - DNA, 36 bp, Artificial Sequence
  Description of Artificial Sequence: Synthetic oligonucleotide
gtatttgccctacagatggtgtaaaagggatggatg

SEQ ID NO: 86573 - DNA, 36 bp, Artificial Sequence
  Description of Artificial Sequence: Synthetic oligonucleotide
tatttgccctacagatggtgtaaaagggatggatgg

SEQ ID NO: 86574 - DNA, 35 bp, Artificial Sequence
  Description of Artificial Sequence: Synthetic oligonucleotide
atttgccctacagatggtgtaaaagggatggatgg

SEQ ID NO: 86575 - DNA, 34 bp, Artificial Sequence
  Description of Artificial Sequence: Synthetic oligonucleotide
tttgccctacagatggtgtaaaagggatggatgg

SEQ ID NO: 86576 - DNA, 33 bp, Artificial Sequence
  Description of Artificial Sequence: Synthetic oligonucleotide
ttgccctacagatggtgtaaaagggatggatgg

SEQ ID NO: 86577 - DNA, 32 bp, Artificial Sequence
  Description of Artificial Sequence: Synthetic oligonucleotide
tgccctacagatggtgtaaaagggatggatgg

SEQ ID NO: 86578 - DNA, 31 bp, Artificial Sequence
  Description of Artificial Sequence: Synthetic oligonucleotide
gccctacagatggtgtaaaagggatggatgg

SEQ ID NO: 86579 - DNA, 31 bp, Artificial Sequence
  Description of Artificial Sequence: Synthetic oligonucleotide
ccctacagatggtgtaaaagggatggatggc

SEQ ID NO: 86580 - DNA, 35 bp, Artificial Sequence
  Description of Artificial Sequence: Synthetic oligonucleotide
cctacagatggtgtaaaagggatggatggcttttg

SEQ ID NO: 86581 - DNA, 35 bp, Artificial Sequence
  Description of Artificial Sequence: Synthetic oligonucleotide
ctacagatggtgtaaaagggatggatggcttttgc

SEQ ID NO: 86582 - DNA, 36 bp, Artificial Sequence
  Description of Artificial Sequence: Synthetic oligonucleotide
tacagatggtgtaaaagggatggatggcttttgctc

SEQ ID NO: 86583 - DNA, 35 bp, Artificial Sequence
  Description of Artificial Sequence: Synthetic oligonucleotide
acagatggtgtaaaagggatggatggcttttgctc

SEQ ID NO: 86584 - DNA, 34 bp, Artificial Sequence
  Description of Artificial Sequence: Synthetic oligonucleotide
cagatggtgtaaaagggatggatggcttttgctc

SEQ ID NO: 86585 - DNA, 36 bp, Artificial Sequence
  Description of Artificial Sequence: Synthetic oligonucleotide
agatggtgtaaaagggatggatggcttttgctctag

SEQ ID NO: 86586 - DNA, 35 bp, Artificial Sequence
  Description of Artificial Sequence: Synthetic oligonucleotide
gatggtgtaaaagggatggatggcttttgctctag

SEQ ID NO: 86587 - DNA, 37 bp, Artificial Sequence
  Description of Artificial Sequence: Synthetic oligonucleotide
atggtgtaaaagggatggatggcttttgctctagaag

SEQ ID NO: 86588 - DNA, 36 bp, Artificial Sequence
  Description of Artificial Sequence: Synthetic oligonucleotide
tggtgtaaaagggatggatggcttttgctctagaag

SEQ ID NO: 86589 - DNA, 35 bp, Artificial Sequence
  Description of Artificial Sequence: Synthetic oligonucleotide
ggtgtaaaagggatggatggcttttgctctagaag

SEQ ID NO: 86590 - DNA, 36 bp, Artificial Sequence
  Description of Artificial Sequence: Synthetic oligonucleotide
gtgtaaaagggatggatggcttttgctctagaagtc

SEQ ID NO: 86591 - DNA, 38 bp, Artificial Sequence
  Description of Artificial Sequence: Synthetic oligonucleotide
tgtaaaagggatggatggcttttgctctagaagtcaac

SEQ ID NO: 86592 - DNA, 37 bp, Artificial Sequence
  Description of Artificial Sequence: Synthetic oligonucleotide
gtaaaagggatggatggcttttgctctagaagtcaac

SEQ ID NO: 86593 - DNA, 40 bp, Artificial Sequence
  Description of Artificial Sequence: Synthetic oligonucleotide
taaaagggatggatggcttttgctctagaagtcaacattc

SEQ ID NO: 86594 - DNA, 39 bp, Artificial Sequence
  Description of Artificial Sequence: Synthetic oligonucleotide
aaaagggatggatggcttttgctctagaagtcaacattc

SEQ ID NO: 86595 - DNA, 38 bp, Artificial Sequence
  Description of Artificial Sequence: Synthetic oligonucleotide
aaagggatggatggcttttgctctagaagtcaacattc

SEQ ID NO: 86596 - DNA, 37 bp, Artificial Sequence
  Description of Artificial Sequence: Synthetic oligonucleotide
aagggatggatggcttttgctctagaagtcaacattc

SEQ ID NO: 86597 - DNA, 36 bp, Artificial Sequence
  Description of Artificial Sequence: Synthetic oligonucleotide
agggatggatggcttttgctctagaagtcaacattc

SEQ ID NO: 86598 - DNA, 35 bp, Artificial Sequence
  Description of Artificial Sequence: Synthetic oligonucleotide
gggatggatggcttttgctctagaagtcaacattc

SEQ ID NO: 86599 - DNA, 37 bp, Artificial Sequence
  Description of Artificial Sequence: Synthetic oligonucleotide
ggatggatggcttttgctctagaagtcaacattcatc

SEQ ID NO: 86600 - DNA, 39 bp, Artificial Sequence
  Description of Artificial Sequence: Synthetic oligonucleotide
gatggatggcttttgctctagaagtcaacattcatcttc

SEQ ID NO: 86601 - DNA, 41 bp, Artificial Sequence
  Description of Artificial Sequence: Synthetic oligonucleotide
atggatggcttttgctctagaagtcaacattcatcttcatc

SEQ ID NO: 86602 - DNA, 40 bp, Artificial Sequence
  Description of Artificial Sequence: Synthetic oligonucleotide
tggatggcttttgctctagaagtcaacattcatcttcatc

SEQ ID NO: 86603 - DNA, 39 bp, Artificial Sequence
  Description of Artificial Sequence: Synthetic oligonucleotide
ggatggcttttgctctagaagtcaacattcatcttcatc

SEQ ID NO: 86604 - DNA, 39 bp, Artificial Sequence
  Description of Artificial Sequence: Synthetic oligonucleotide
gatggcttttgctctagaagtcaacattcatcttcatcc

SEQ ID NO: 86605 - DNA, 40 bp, Artificial Sequence
  Description of Artificial Sequence: Synthetic oligonucleotide
atggcttttgctctagaagtcaacattcatcttcatcctc

SEQ ID NO: 86606 - DNA, 39 bp, Artificial Sequence
  Description of Artificial Sequence: Synthetic oligonucleotide
tggcttttgctctagaagtcaacattcatcttcatcctc

SEQ ID NO: 86607 - DNA, 38 bp, Artificial Sequence
  Description of Artificial Sequence: Synthetic oligonucleotide
ggcttttgctctagaagtcaacattcatcttcatcctc

SEQ ID NO: 86608 - DNA, 39 bp, Artificial Sequence
  Description of Artificial Sequence: Synthetic oligonucleotide
gcttttgctctagaagtcaacattcatcttcatcctcac

SEQ ID NO: 86609 - DNA, 42 bp, Artificial Sequence
  Description of Artificial Sequence: Synthetic oligonucleotide
cttttgctctagaagtcaacattcatcttcatcctcacattg

SEQ ID NO: 86610 - DNA, 42 bp, Artificial Sequence
  Description of Artificial Sequence: Synthetic oligonucleotide
ttttgctctagaagtcaacattcatcttcatcctcacattgg

SEQ ID NO: 86611 - DNA, 41 bp, Artificial Sequence
  Description of Artificial Sequence: Synthetic oligonucleotide
tttgctctagaagtcaacattcatcttcatcctcacattgg

SEQ ID NO: 86612 - DNA, 40 bp, Artificial Sequence
  Description of Artificial Sequence: Synthetic oligonucleotide
ttgctctagaagtcaacattcatcttcatcctcacattgg

SEQ ID NO: 86613 - DNA, 39 bp, Artificial Sequence
  Description of Artificial Sequence: Synthetic oligonucleotide
tgctctagaagtcaacattcatcttcatcctcacattgg

SEQ ID NO: 86614 - DNA, 38 bp, Artificial Sequence
  Description of Artificial Sequence: Synthetic oligonucleotide
gctctagaagtcaacattcatcttcatcctcacattgg

SEQ ID NO: 86615 - DNA, 38 bp, Artificial Sequence
  Description of Artificial Sequence: Synthetic oligonucleotide
ctctagaagtcaacattcatcttcatcctcacattggc

SEQ ID NO: 86616 - DNA, 40 bp, Artificial Sequence
  Description of Artificial Sequence: Synthetic oligonucleotide
tctagaagtcaacattcatcttcatcctcacattggcatc

SEQ ID NO: 86617 - DNA, 39 bp, Artificial Sequence
  Description of Artificial Sequence: Synthetic oligonucleotide
ctagaagtcaacattcatcttcatcctcacattggcatc

SEQ ID NO: 86618 - DNA, 40 bp, Artificial Sequence
  Description of Artificial Sequence: Synthetic oligonucleotide
tagaagtcaacattcatcttcatcctcacattggcatcag

SEQ ID NO: 86619 - DNA, 39 bp, Artificial Sequence
  Description of Artificial Sequence: Synthetic oligonucleotide
agaagtcaacattcatcttcatcctcacattggcatcag

SEQ ID NO: 86620 - DNA, 38 bp, Artificial Sequence
  Description of Artificial Sequence: Synthetic oligonucleotide
gaagtcaacattcatcttcatcctcacattggcatcag

SEQ ID NO: 86621 - DNA, 38 bp, Artificial Sequence
  Description of Artificial Sequence: Synthetic oligonucleotide
aagtcaacattcatcttcatcctcacattggcatcagg

SEQ ID NO: 86622 - DNA, 37 bp, Artificial Sequence
  Description of Artificial Sequence: Synthetic oligonucleotide
agtcaacattcatcttcatcctcacattggcatcagg

SEQ ID NO: 86623 - DNA, 36 bp, Artificial Sequence
  Description of Artificial Sequence: Synthetic oligonucleotide
gtcaacattcatcttcatcctcacattggcatcagg

SEQ ID NO: 86624 - DNA, 38 bp, Artificial Sequence
  Description of Artificial Sequence: Synthetic oligonucleotide
tcaacattcatcttcatcctcacattggcatcaggaag

SEQ ID NO: 86625 - DNA, 37 bp, Artificial Sequence
  Description of Artificial Sequence: Synthetic oligonucleotide
caacattcatcttcatcctcacattggcatcaggaag

SEQ ID NO: 86626 - DNA, 37 bp, Artificial Sequence
  Description of Artificial Sequence: Synthetic oligonucleotide
aacattcatcttcatcctcacattggcatcaggaagg

SEQ ID NO: 86627 - DNA, 36 bp, Artificial Sequence
  Description of Artificial Sequence: Synthetic oligonucleotide
acattcatcttcatcctcacattggcatcaggaagg

SEQ ID NO: 86628 - DNA, 35 bp, Artificial Sequence
  Description of Artificial Sequence: Synthetic oligonucleotide
cattcatcttcatcctcacattggcatcaggaagg

SEQ ID NO: 86629 - DNA, 35 bp, Artificial Sequence
  Description of Artificial Sequence: Synthetic oligonucleotide
attcatcttcatcctcacattggcatcaggaaggg

SEQ ID NO: 86630 - DNA, 34 bp, Artificial Sequence
  Description of Artificial Sequence: Synthetic oligonucleotide
ttcatcttcatcctcacattggcatcaggaaggg

SEQ ID NO: 86631 - DNA, 33 bp, Artificial Sequence
  Description of Artificial Sequence: Synthetic oligonucleotide
tcatcttcatcctcacattggcatcaggaaggg

SEQ ID NO: 86632 - DNA, 32 bp, Artificial Sequence
  Description of Artificial Sequence: Synthetic oligonucleotide
catcttcatcctcacattggcatcaggaaggg

SEQ ID NO: 86633 - DNA, 32 bp, Artificial Sequence
  Description of Artificial Sequence: Synthetic oligonucleotide
atcttcatcctcacattggcatcaggaagggg

SEQ ID NO: 86634 - DNA, 31 bp, Artificial Sequence
  Description of Artificial Sequence: Synthetic oligonucleotide
tcttcatcctcacattggcatcaggaagggg

SEQ ID NO: 86635 - DNA, 30 bp, Artificial Sequence
  Description of Artificial Sequence: Synthetic oligonucleotide
cttcatcctcacattggcatcaggaagggg

SEQ ID NO: 86636 - DNA, 31 bp, Artificial Sequence
  Description of Artificial Sequence: Synthetic oligonucleotide
ttcatcctcacattggcatcaggaaggggtg

SEQ ID NO: 86637 - DNA, 30 bp, Artificial Sequence
  Description of Artificial Sequence: Synthetic oligonucleotide
tcatcctcacattggcatcaggaaggggtg

SEQ ID NO: 86638 - DNA, 29 bp, Artificial Sequence
  Description of Artificial Sequence: Synthetic oligonucleotide
catcctcacattggcatcaggaaggggtg

SEQ ID NO: 86639 - DNA, 29 bp, Artificial Sequence
  Description of Artificial Sequence: Synthetic oligonucleotide
atcctcacattggcatcaggaaggggtgg

SEQ ID NO: 86640 - DNA, 28 bp, Artificial Sequence
  Description of Artificial Sequence: Synthetic oligonucleotide
tcctcacattggcatcaggaaggggtgg

SEQ ID NO: 86641 - DNA, 27 bp, Artificial Sequence
  Description of Artificial Sequence: Synthetic oligonucleotide
cctcacattggcatcaggaaggggtgg

SEQ ID NO: 86642 - DNA, 29 bp, Artificial Sequence
  Description of Artificial Sequence: Synthetic oligonucleotide
ctcacattggcatcaggaaggggtggatg

SEQ ID NO: 86643 - DNA, 30 bp, Artificial Sequence
  Description of Artificial Sequence: Synthetic oligonucleotide
tcacattggcatcaggaaggggtggatgtg

SEQ ID NO: 86644 - DNA, 29 bp, Artificial Sequence
  Description of Artificial Sequence: Synthetic oligonucleotide
cacattggcatcaggaaggggtggatgtg

SEQ ID NO: 86645 - DNA, 33 bp, Artificial Sequence
  Description of Artificial Sequence: Synthetic oligonucleotide
acattggcatcaggaaggggtggatgtgaaaac

SEQ ID NO: 86646 - DNA, 32 bp, Artificial Sequence
  Description of Artificial Sequence: Synthetic oligonucleotide
cattggcatcaggaaggggtggatgtgaaaac

SEQ ID NO: 86647 - DNA, 32 bp, Artificial Sequence
  Description of Artificial Sequence: Synthetic oligonucleotide
attggcatcaggaaggggtggatgtgaaaacc

SEQ ID NO: 86648 - DNA, 31 bp, Artificial Sequence
  Description of Artificial Sequence: Synthetic oligonucleotide
ttggcatcaggaaggggtggatgtgaaaacc

SEQ ID NO: 86649 - DNA, 30 bp, Artificial Sequence
  Description of Artificial Sequence: Synthetic oligonucleotide
tggcatcaggaaggggtggatgtgaaaacc

SEQ ID NO: 86650 - DNA, 29 bp, Artificial Sequence
  Description of Artificial Sequence: Synthetic oligonucleotide
ggcatcaggaaggggtggatgtgaaaacc

SEQ ID NO: 86651 - DNA, 31 bp, Artificial Sequence
  Description of Artificial Sequence: Synthetic oligonucleotide
gcatcaggaaggggtggatgtgaaaaccatg

SEQ ID NO: 86652 - DNA, 33 bp, Artificial Sequence
  Description of Artificial Sequence: Synthetic oligonucleotide
catcaggaaggggtggatgtgaaaaccatgatg

SEQ ID NO: 86653 - DNA, 35 bp, Artificial Sequence
  Description of Artificial Sequence: Synthetic oligonucleotide
atcaggaaggggtggatgtgaaaaccatgatgaac

SEQ ID NO: 86654 - DNA, 34 bp, Artificial Sequence
  Description of Artificial Sequence: Synthetic oligonucleotide
tcaggaaggggtggatgtgaaaaccatgatgaac

SEQ ID NO: 86655 - DNA, 33 bp, Artificial Sequence
  Description of Artificial Sequence: Synthetic oligonucleotide
caggaaggggtggatgtgaaaaccatgatgaac

SEQ ID NO: 86656 - DNA, 34 bp, Artificial Sequence
  Description of Artificial Sequence: Synthetic oligonucleotide
aggaaggggtggatgtgaaaaccatgatgaacac

SEQ ID NO: 86657 - DNA, 33 bp, Artificial Sequence
  Description of Artificial Sequence: Synthetic oligonucleotide
ggaaggggtggatgtgaaaaccatgatgaacac

SEQ ID NO: 86658 - DNA, 35 bp, Artificial Sequence
  Description of Artificial Sequence: Synthetic oligonucleotide
gaaggggtggatgtgaaaaccatgatgaacacttg

SEQ ID NO: 86659 - DNA, 35 bp, Artificial Sequence
  Description of Artificial Sequence: Synthetic oligonucleotide
aaggggtggatgtgaaaaccatgatgaacacttgg

SEQ ID NO: 86660 - DNA, 34 bp, Artificial Sequence
  Description of Artificial Sequence: Synthetic oligonucleotide
aggggtggatgtgaaaaccatgatgaacacttgg

SEQ ID NO: 86661 - DNA, 33 bp, Artificial Sequence
  Description of Artificial Sequence: Synthetic oligonucleotide
ggggtggatgtgaaaaccatgatgaacacttgg

SEQ ID NO: 86662 - DNA, 34 bp, Artificial Sequence
  Description of Artificial Sequence: Synthetic oligonucleotide
gggtggatgtgaaaaccatgatgaacacttggac

SEQ ID NO: 86663 - DNA, 35 bp, Artificial Sequence
  Description of Artificial Sequence: Synthetic oligonucleotide
ggtggatgtgaaaaccatgatgaacacttggacac

SEQ ID NO: 86664 - DNA, 36 bp, Artificial Sequence
  Description of Artificial Sequence: Synthetic oligonucleotide
gtggatgtgaaaaccatgatgaacacttggacactg

SEQ ID NO: 86665 - DNA, 36 bp, Artificial Sequence
  Description of Artificial Sequence: Synthetic oligonucleotide
tggatgtgaaaaccatgatgaacacttggacactgc

SEQ ID NO: 86666 - DNA, 35 bp, Artificial Sequence
  Description of Artificial Sequence: Synthetic oligonucleotide
ggatgtgaaaaccatgatgaacacttggacactgc

SEQ ID NO: 86667 - DNA, 36 bp, Artificial Sequence
  Description of Artificial Sequence: Synthetic oligonucleotide
gatgtgaaaaccatgatgaacacttggacactgcag

SEQ ID NO: 86668 - DNA, 38 bp, Artificial Sequence
  Description of Artificial Sequence: Synthetic oligonucleotide
atgtgaaaaccatgatgaacacttggacactgcagaag

SEQ ID NO: 86669 - DNA, 37 bp, Artificial Sequence
  Description of Artificial Sequence: Synthetic oligonucleotide
tgtgaaaaccatgatgaacacttggacactgcagaag

SEQ ID NO: 86670 - DNA, 36 bp, Artificial Sequence
  Description of Artificial Sequence: Synthetic oligonucleotide
gtgaaaaccatgatgaacacttggacactgcagaag

SEQ ID NO: 86671 - DNA, 36 bp, Artificial Sequence
  Description of Artificial Sequence: Synthetic oligonucleotide
tgaaaaccatgatgaacacttggacactgcagaagg

SEQ ID NO: 86672 - DNA, 35 bp, Artificial Sequence
  Description of Artificial Sequence: Synthetic oligonucleotide
gaaaaccatgatgaacacttggacactgcagaagg

SEQ ID NO: 86673 - DNA, 35 bp, Artificial Sequence
  Description of Artificial Sequence: Synthetic oligonucleotide
aaaaccatgatgaacacttggacactgcagaaggg

SEQ ID NO: 86674 - DNA, 34 bp, Artificial Sequence
  Description of Artificial Sequence: Synthetic oligonucleotide
aaaccatgatgaacacttggacactgcagaaggg

SEQ ID NO: 86675 - DNA, 33 bp, Artificial Sequence
  Description of Artificial Sequence: Synthetic oligonucleotide
aaccatgatgaacacttggacactgcagaaggg

SEQ ID NO: 86676 - DNA, 32 bp, Artificial Sequence
  Description of Artificial Sequence: Synthetic oligonucleotide
accatgatgaacacttggacactgcagaaggg

SEQ ID NO: 86677 - DNA, 31 bp, Artificial Sequence
  Description of Artificial Sequence: Synthetic oligonucleotide
ccatgatgaacacttggacactgcagaaggg

SEQ ID NO: 86678 - DNA, 35 bp, Artificial Sequence
  Description of Artificial Sequence: Synthetic oligonucleotide
catgatgaacacttggacactgcagaagggttttc

SEQ ID NO: 86679 - DNA, 35 bp, Artificial Sequence
  Description of Artificial Sequence: Synthetic oligonucleotide
atgatgaacacttggacactgcagaagggttttcc

SEQ ID NO: 86680 - DNA, 34 bp, Artificial Sequence
  Description of Artificial Sequence: Synthetic oligonucleotide
tgatgaacacttggacactgcagaagggttttcc

SEQ ID NO: 86681 - DNA, 33 bp, Artificial Sequence
  Description of Artificial Sequence: Synthetic oligonucleotide
gatgaacacttggacactgcagaagggttttcc

SEQ ID NO: 86682 - DNA, 33 bp, Artificial Sequence
  Description of Artificial Sequence: Synthetic oligonucleotide
atgaacacttggacactgcagaagggttttccc

SEQ ID NO: 86683 - DNA, 32 bp, Artificial Sequence
  Description of Artificial Sequence: Synthetic oligonucleotide
tgaacacttggacactgcagaagggttttccc

SEQ ID NO: 86684 - DNA, 31 bp, Artificial Sequence
  Description of Artificial Sequence: Synthetic oligonucleotide
gaacacttggacactgcagaagggttttccc

SEQ ID NO: 86685 - DNA, 31 bp, Artificial Sequence
  Description of Artificial Sequence: Synthetic oligonucleotide
aacacttggacactgcagaagggttttcccc

SEQ ID NO: 86686 - DNA, 30 bp, Artificial Sequence
  Description of Artificial Sequence: Synthetic oligonucleotide
acacttggacactgcagaagggttttcccc

SEQ ID NO: 86687 - DNA, 29 bp, Artificial Sequence
  Description of Artificial Sequence: Synthetic oligonucleotide
cacttggacactgcagaagggttttcccc

SEQ ID NO: 86688 - DNA, 35 bp, Artificial Sequence
  Description of Artificial Sequence: Synthetic oligonucleotide
acttggacactgcagaagggttttcccctaataac

SEQ ID NO: 86689 - DNA, 34 bp, Artificial Sequence
  Description of Artificial Sequence: Synthetic oligonucleotide
cttggacactgcagaagggttttcccctaataac

SEQ ID NO: 86690 - DNA, 34 bp, Artificial Sequence
  Description of Artificial Sequence: Synthetic oligonucleotide
ttggacactgcagaagggttttcccctaataacc

SEQ ID NO: 86691 - DNA, 33 bp, Artificial Sequence
  Description of Artificial Sequence: Synthetic oligonucleotide
tggacactgcagaagggttttcccctaataacc

SEQ ID NO: 86692 - DNA, 32 bp, Artificial Sequence
  Description of Artificial Sequence: Synthetic oligonucleotide
ggacactgcagaagggttttcccctaataacc

SEQ ID NO: 86693 - DNA, 34 bp, Artificial Sequence
  Description of Artificial Sequence: Synthetic oligonucleotide
gacactgcagaagggttttcccctaataaccatc

SEQ ID NO: 86694 - DNA, 35 bp, Artificial Sequence
  Description of Artificial Sequence: Synthetic oligonucleotide
acactgcagaagggttttcccctaataaccatcac

SEQ ID NO: 86695 - DNA, 34 bp, Artificial Sequence
  Description of Artificial Sequence: Synthetic oligonucleotide
cactgcagaagggttttcccctaataaccatcac

SEQ ID NO: 86696 - DNA, 35 bp, Artificial Sequence
  Description of Artificial Sequence: Synthetic oligonucleotide
actgcagaagggttttcccctaataaccatcacag

SEQ ID NO: 86697 - DNA, 34 bp, Artificial Sequence
  Description of Artificial Sequence: Synthetic oligonucleotide
ctgcagaagggttttcccctaataaccatcacag

SEQ ID NO: 86698 - DNA, 35 bp, Artificial Sequence
  Description of Artificial Sequence: Synthetic oligonucleotide
tgcagaagggttttcccctaataaccatcacagtg

SEQ ID NO: 86699 - DNA, 34 bp, Artificial Sequence
  Description of Artificial Sequence: Synthetic oligonucleotide
gcagaagggttttcccctaataaccatcacagtg

SEQ ID NO: 86700 - DNA, 35 bp, Artificial Sequence
  Description of Artificial Sequence: Synthetic oligonucleotide
cagaagggttttcccctaataaccatcacagtgag

SEQ ID NO: 86701 - DNA, 35 bp, Artificial Sequence
  Description of Artificial Sequence: Synthetic oligonucleotide
agaagggttttcccctaataaccatcacagtgagg

SEQ ID NO: 86702 - DNA, 34 bp, Artificial Sequence
  Description of Artificial Sequence: Synthetic oligonucleotide
gaagggttttcccctaataaccatcacagtgagg

SEQ ID NO: 86703 - DNA, 34 bp, Artificial Sequence
  Description of Artificial Sequence: Synthetic oligonucleotide
aagggttttcccctaataaccatcacagtgaggg

SEQ ID NO: 86704 - DNA, 33 bp, Artificial Sequence
  Description of Artificial Sequence: Synthetic oligonucleotide
agggttttcccctaataaccatcacagtgaggg

SEQ ID NO: 86705 - DNA, 32 bp, Artificial Sequence
  Description of Artificial Sequence: Synthetic oligonucleotide
gggttttcccctaataaccatcacagtgaggg

SEQ ID NO: 86706 - DNA, 32 bp, Artificial Sequence
  Description of Artificial Sequence: Synthetic oligonucleotide
ggttttcccctaataaccatcacagtgagggg

SEQ ID NO: 86707 - DNA, 32 bp, Artificial Sequence
  Description of Artificial Sequence: Synthetic oligonucleotide
gttttcccctaataaccatcacagtgaggggg

SEQ ID NO: 86708 - DNA, 33 bp, Artificial Sequence
  Description of Artificial Sequence: Synthetic oligonucleotide
ttttcccctaataaccatcacagtgagggggag

SEQ ID NO: 86709 - DNA, 32 bp, Artificial Sequence
  Description of Artificial Sequence: Synthetic oligonucleotide
tttcccctaataaccatcacagtgagggggag

SEQ ID NO: 86710 - DNA, 31 bp, Artificial Sequence
  Description of Artificial Sequence: Synthetic oligonucleotide
ttcccctaataaccatcacagtgagggggag

SEQ ID NO: 86711 - DNA, 30 bp, Artificial Sequence
  Description of Artificial Sequence: Synthetic oligonucleotide
tcccctaataaccatcacagtgagggggag

SEQ ID NO: 86712 - DNA, 29 bp, Artificial Sequence
  Description of Artificial Sequence: Synthetic oligonucleotide
cccctaataaccatcacagtgagggggag

SEQ ID NO: 86713 - DNA, 29 bp, Artificial Sequence
  Description of Artificial Sequence: Synthetic oligonucleotide
ccctaataaccatcacagtgagggggagg

SEQ ID NO: 86714 - DNA, 32 bp, Artificial Sequence
  Description of Artificial Sequence: Synthetic oligonucleotide
cctaataaccatcacagtgagggggaggaatg

SEQ ID NO: 86715 - DNA, 34 bp, Artificial Sequence
  Description of Artificial Sequence: Synthetic oligonucleotide
ctaataaccatcacagtgagggggaggaatgtac

SEQ ID NO: 86716 - DNA, 35 bp, Artificial Sequence
  Description of Artificial Sequence: Synthetic oligonucleotide
taataaccatcacagtgagggggaggaatgtacac

SEQ ID NO: 86717 - DNA, 34 bp, Artificial Sequence
  Description of Artificial Sequence: Synthetic oligonucleotide
aataaccatcacagtgagggggaggaatgtacac

SEQ ID NO: 86718 - DNA, 33 bp, Artificial Sequence
  Description of Artificial Sequence: Synthetic oligonucleotide
ataaccatcacagtgagggggaggaatgtacac

SEQ ID NO: 86719 - DNA, 32 bp, Artificial Sequence
  Description of Artificial Sequence: Synthetic oligonucleotide
taaccatcacagtgagggggaggaatgtacac

SEQ ID NO: 86720 - DNA, 31 bp, Artificial Sequence
  Description of Artificial Sequence: Synthetic oligonucleotide
aaccatcacagtgagggggaggaatgtacac

SEQ ID NO: 86721 - DNA, 30 bp, Artificial Sequence
  Description of Artificial Sequence: Synthetic oligonucleotide
accatcacagtgagggggaggaatgtacac

SEQ ID NO: 86722 - DNA, 29 bp, Artificial Sequence
  Description of Artificial Sequence: Synthetic oligonucleotide
ccatcacagtgagggggaggaatgtacac

SEQ ID NO: 86723 - DNA, 31 bp, Artificial Sequence
  Description of Artificial Sequence: Synthetic oligonucleotide
catcacagtgagggggaggaatgtacacatg

SEQ ID NO: 86724 - DNA, 33 bp, Artificial Sequence
  Description of Artificial Sequence: Synthetic oligonucleotide
atcacagtgagggggaggaatgtacacatgaag

SEQ ID NO: 86725 - DNA, 32 bp, Artificial Sequence
  Description of Artificial Sequence: Synthetic oligonucleotide
tcacagtgagggggaggaatgtacacatgaag

SEQ ID NO: 86726 - DNA, 31 bp, Artificial Sequence
  Description of Artificial Sequence: Synthetic oligonucleotide
cacagtgagggggaggaatgtacacatgaag

SEQ ID NO: 86727 - DNA, 31 bp, Artificial Sequence
  Description of Artificial Sequence: Synthetic oligonucleotide
acagtgagggggaggaatgtacacatgaagc

SEQ ID NO: 86728 - DNA, 30 bp, Artificial Sequence
  Description of Artificial Sequence: Synthetic oligonucleotide
cagtgagggggaggaatgtacacatgaagc

SEQ ID NO: 86729 - DNA, 32 bp, Artificial Sequence
  Description of Artificial Sequence: Synthetic oligonucleotide
agtgagggggaggaatgtacacatgaagcaag

SEQ ID NO: 86730 - DNA, 31 bp, Artificial Sequence
  Description of Artificial Sequence: Synthetic oligonucleotide
gtgagggggaggaatgtacacatgaagcaag

SEQ ID NO: 86731 - DNA, 32 bp, Artificial Sequence
  Description of Artificial Sequence: Synthetic oligonucleotide
tgagggggaggaatgtacacatgaagcaagag

SEQ ID NO: 86732 - DNA, 31 bp, Artificial Sequence
  Description of Artificial Sequence: Synthetic oligonucleotide
gagggggaggaatgtacacatgaagcaagag

SEQ ID NO: 86733 - DNA, 31 bp, Artificial Sequence
  Description of Artificial Sequence: Synthetic oligonucleotide
agggggaggaatgtacacatgaagcaagagc

SEQ ID NO: 86734 - DNA, 30 bp, Artificial Sequence
  Description of Artificial Sequence: Synthetic oligonucleotide
gggggaggaatgtacacatgaagcaagagc

SEQ ID NO: 86735 - DNA, 31 bp, Artificial Sequence
  Description of Artificial Sequence: Synthetic oligonucleotide
ggggaggaatgtacacatgaagcaagagcac

SEQ ID NO: 86736 - DNA, 33 bp, Artificial Sequence
  Description of Artificial Sequence: Synthetic oligonucleotide
gggaggaatgtacacatgaagcaagagcactac

SEQ ID NO: 86737 - DNA, 35 bp, Artificial Sequence
  Description of Artificial Sequence: Synthetic oligonucleotide
ggaggaatgtacacatgaagcaagagcactacatg

SEQ ID NO: 86738 - DNA, 37 bp, Artificial Sequence
  Description of Artificial Sequence: Synthetic oligonucleotide
gaggaatgtacacatgaagcaagagcactacatgaag

SEQ ID NO: 86739 - DNA, 37 bp, Artificial Sequence
  Description of Artificial Sequence: Synthetic oligonucleotide
aggaatgtacacatgaagcaagagcactacatgaagg

SEQ ID NO: 86740 - DNA, 36 bp, Artificial Sequence
  Description of Artificial Sequence: Synthetic oligonucleotide
ggaatgtacacatgaagcaagagcactacatgaagg

SEQ ID NO: 86741 - DNA, 36 bp, Artificial Sequence
  Description of Artificial Sequence: Synthetic oligonucleotide
gaatgtacacatgaagcaagagcactacatgaaggg

SEQ ID NO: 86742 - DNA, 36 bp, Artificial Sequence
  Description of Artificial Sequence: Synthetic oligonucleotide
aatgtacacatgaagcaagagcactacatgaagggc

SEQ ID NO: 86743 - DNA, 35 bp, Artificial Sequence
  Description of Artificial Sequence: Synthetic oligonucleotide
atgtacacatgaagcaagagcactacatgaagggc

SEQ ID NO: 86744 - DNA, 34 bp, Artificial Sequence
  Description of Artificial Sequence: Synthetic oligonucleotide
tgtacacatgaagcaagagcactacatgaagggc

SEQ ID NO: 86745 - DNA, 33 bp, Artificial Sequence
  Description of Artificial Sequence: Synthetic oligonucleotide
gtacacatgaagcaagagcactacatgaagggc

SEQ ID NO: 86746 - DNA, 34 bp, Artificial Sequence
  Description of Artificial Sequence: Synthetic oligonucleotide
tacacatgaagcaagagcactacatgaagggctc

SEQ ID NO: 86747 - DNA, 33 bp, Artificial Sequence
  Description of Artificial Sequence: Synthetic oligonucleotide
acacatgaagcaagagcactacatgaagggctc

SEQ ID NO: 86748 - DNA, 32 bp, Artificial Sequence
  Description of Artificial Sequence: Synthetic oligonucleotide
cacatgaagcaagagcactacatgaagggctc

SEQ ID NO: 86749 - DNA, 33 bp, Artificial Sequence
  Description of Artificial Sequence: Synthetic oligonucleotide
acatgaagcaagagcactacatgaagggctctg

SEQ ID NO: 86750 - DNA, 32 bp, Artificial Sequence
  Description of Artificial Sequence: Synthetic oligonucleotide
catgaagcaagagcactacatgaagggctctg

SEQ ID NO: 86751 - DNA, 33 bp, Artificial Sequence
  Description of Artificial Sequence: Synthetic oligonucleotide
atgaagcaagagcactacatgaagggctctgac

SEQ ID NO: 86752 - DNA, 32 bp, Artificial Sequence
  Description of Artificial Sequence: Synthetic oligonucleotide
tgaagcaagagcactacatgaagggctctgac

SEQ ID NO: 86753 - DNA, 31 bp, Artificial Sequence
  Description of Artificial Sequence: Synthetic oligonucleotide
gaagcaagagcactacatgaagggctctgac

SEQ ID NO: 86754 - DNA, 31 bp, Artificial Sequence
  Description of Artificial Sequence: Synthetic oligonucleotide
aagcaagagcactacatgaagggctctgacg

SEQ ID NO: 86755 - DNA, 30 bp, Artificial Sequence
  Description of Artificial Sequence: Synthetic oligonucleotide
agcaagagcactacatgaagggctctgacg

SEQ ID NO: 86756 - DNA, 29 bp, Artificial Sequence
  Description of Artificial Sequence: Synthetic oligonucleotide
gcaagagcactacatgaagggctctgacg

SEQ ID NO: 86757 - DNA, 29 bp, Artificial Sequence
  Description of Artificial Sequence: Synthetic oligonucleotide
caagagcactacatgaagggctctgacgg

SEQ ID NO: 86758 - DNA, 29 bp, Artificial Sequence
  Description of Artificial Sequence: Synthetic oligonucleotide
aagagcactacatgaagggctctgacggc

SEQ ID NO: 86759 - DNA, 28 bp, Artificial Sequence
  Description of Artificial Sequence: Synthetic oligonucleotide
agagcactacatgaagggctctgacggc

SEQ ID NO: 86760 - DNA, 27 bp, Artificial Sequence
  Description of Artificial Sequence: Synthetic oligonucleotide
gagcactacatgaagggctctgacggc

SEQ ID NO: 86761 - DNA, 27 bp, Artificial Sequence
  Description of Artificial Sequence: Synthetic oligonucleotide
agcactacatgaagggctctgacggcg

SEQ ID NO: 86762 - DNA, 26 bp, Artificial Sequence
  Description of Artificial Sequence: Synthetic oligonucleotide
gcactacatgaagggctctgacggcg

SEQ ID NO: 86763 - DNA, 26 bp, Artificial Sequence
  Description of Artificial Sequence: Synthetic oligonucleotide
cactacatgaagggctctgacggcgc

SEQ ID NO: 86764 - DNA, 26 bp, Artificial Sequence
  Description of Artificial Sequence: Synthetic oligonucleotide
actacatgaagggctctgacggcgcc

SEQ ID NO: 86765 - DNA, 25 bp, Artificial Sequence
  Description of Artificial Sequence: Synthetic oligonucleotide
ctacatgaagggctctgacggcgcc

SEQ ID NO: 86766 - DNA, 25 bp, Artificial Sequence
  Description of Artificial Sequence: Synthetic oligonucleotide
tacatgaagggctctgacggcgccc

SEQ ID NO: 86767 - DNA, 24 bp, Artificial Sequence
  Description of Artificial Sequence: Synthetic oligonucleotide
acatgaagggctctgacggcgccc

SEQ ID NO: 86768 - DNA, 23 bp, Artificial Sequence
  Description of Artificial Sequence: Synthetic oligonucleotide
catgaagggctctgacggcgccc

SEQ ID NO: 86769 - DNA, 23 bp, Artificial Sequence
  Description of Artificial Sequence: Synthetic oligonucleotide
atgaagggctctgacggcgcccc

SEQ ID NO: 86770 - DNA, 22 bp, Artificial Sequence
  Description of Artificial Sequence: Synthetic oligonucleotide
tgaagggctctgacggcgcccc

SEQ ID NO: 86771 - DNA, 21 bp, Artificial Sequence
  Description of Artificial Sequence: Synthetic oligonucleotide
gaagggctctgacggcgcccc

SEQ ID NO: 86772 - DNA, 21 bp, Artificial Sequence
  Description of Artificial Sequence: Synthetic oligonucleotide
aagggctctgacggcgccccg

SEQ ID NO: 86773 - DNA, 20 bp, Artificial Sequence
  Description of Artificial Sequence: Synthetic oligonucleotide
agggctctgacggcgccccg

SEQ ID NO: 86774 - DNA, 20 bp, Artificial Sequence
  Description of Artificial Sequence: Synthetic oligonucleotide
gggctctgacggcgccccgt

SEQ ID NO: 86775 - DNA, 20 bp, Artificial Sequence
  Description of Artificial Sequence: Synthetic oligonucleotide
ggctctgacggcgccccgga

SEQ ID NO: 86776 - DNA, 21 bp, Artificial Sequence
  Description of Artificial Sequence: Synthetic oligonucleotide
gctctgacggcgccccggaca

SEQ ID NO: 86777 - DNA, 22 bp, Artificial Sequence
  Description of Artificial Sequence: Synthetic oligonucleotide
ctctgacggcgccccggacact

SEQ ID NO: 86778 - DNA, 22 bp, Artificial Sequence
  Description of Artificial Sequence: Synthetic oligonucleotide
tctgacggcgccccggacactg

SEQ ID NO: 86779 - DNA, 21 bp, Artificial Sequence
  Description of Artificial Sequence: Synthetic oligonucleotide
ctgacggcgccccggacactg

SEQ ID NO: 86780 - DNA, 21 bp, Artificial Sequence
  Description of Artificial Sequence: Synthetic oligonucleotide
tgacggcgccccggacactgg

SEQ ID NO: 86781 - DNA, 20 bp, Artificial Sequence
  Description of Artificial Sequence: Synthetic oligonucleotide
gacggcgccccggacactgg

SEQ ID NO: 86782 - DNA, 22 bp, Artificial Sequence
  Description of Artificial Sequence: Synthetic oligonucleotide
acggcgccccggacactgggta

SEQ ID NO: 86783 - DNA, 21 bp, Artificial Sequence
  Description of Artificial Sequence: Synthetic oligonucleotide
cggcgccccggacactgggta

SEQ ID NO: 86784 - DNA, 21 bp, Artificial Sequence
  Description of Artificial Sequence: Synthetic oligonucleotide
ggcgccccggacactgggtac

SEQ ID NO: 86785 - DNA, 22 bp, Artificial Sequence
  Description of Artificial Sequence: Synthetic oligonucleotide
gcgccccggacactgggtacct

SEQ ID NO: 86786 - DNA, 23 bp, Artificial Sequence
  Description of Artificial Sequence: Synthetic oligonucleotide
cgccccggacactgggtacctgt

SEQ ID NO: 86787 - DNA, 23 bp, Artificial Sequence
  Description of Artificial Sequence: Synthetic oligonucleotide
gccccggacactgggtacctgtg

SEQ ID NO: 86788 - DNA, 23 bp, Artificial Sequence
  Description of Artificial Sequence: Synthetic oligonucleotide
ccccggacactgggtacctgtgg

SEQ ID NO: 86789 - DNA, 25 bp, Artificial Sequence
  Description of Artificial Sequence: Synthetic oligonucleotide
cccggacactgggtacctgtggcat

SEQ ID NO: 86790 - DNA, 27 bp, Artificial Sequence
  Description of Artificial Sequence: Synthetic oligonucleotide
ccggacactgggtacctgtggcatgtt

SEQ ID NO: 86791 - DNA, 27 bp, Artificial Sequence
  Description of Artificial Sequence: Synthetic oligonucleotide
cggacactgggtacctgtggcatgttc

SEQ ID NO: 86792 - DNA, 27 bp, Artificial Sequence
  Description of Artificial Sequence: Synthetic oligonucleotide
ggacactgggtacctgtggcatgttcc

SEQ ID NO: 86793 - DNA, 30 bp, Artificial Sequence
  Description of Artificial Sequence: Synthetic oligonucleotide
gacactgggtacctgtggcatgttccattg

SEQ ID NO: 86794 - DNA, 31 bp, Artificial Sequence
  Description of Artificial Sequence: Synthetic oligonucleotide
acactgggtacctgtggcatgttccattgac

SEQ ID NO: 86795 - DNA, 30 bp, Artificial Sequence
  Description of Artificial Sequence: Synthetic oligonucleotide
cactgggtacctgtggcatgttccattgac

SEQ ID NO: 86796 - DNA, 33 bp, Artificial Sequence
  Description of Artificial Sequence: Synthetic oligonucleotide
actgggtacctgtggcatgttccattgacattc

SEQ ID NO: 86797 - DNA, 32 bp, Artificial Sequence
  Description of Artificial Sequence: Synthetic oligonucleotide
ctgggtacctgtggcatgttccattgacattc

SEQ ID NO: 86798 - DNA, 34 bp, Artificial Sequence
  Description of Artificial Sequence: Synthetic oligonucleotide
tgggtacctgtggcatgttccattgacattcatc

SEQ ID NO: 86799 - DNA, 33 bp, Artificial Sequence
  Description of Artificial Sequence: Synthetic oligonucleotide
gggtacctgtggcatgttccattgacattcatc

SEQ ID NO: 86800 - DNA, 34 bp, Artificial Sequence
  Description of Artificial Sequence: Synthetic oligonucleotide
ggtacctgtggcatgttccattgacattcatcac

SEQ ID NO: 86801 - DNA, 34 bp, Artificial Sequence
  Description of Artificial Sequence: Synthetic oligonucleotide
gtacctgtggcatgttccattgacattcatcacc

SEQ ID NO: 86802 - DNA, 35 bp, Artificial Sequence
  Description of Artificial Sequence: Synthetic oligonucleotide
tacctgtggcatgttccattgacattcatcaccag

SEQ ID NO: 86803 - DNA, 34 bp, Artificial Sequence
  Description of Artificial Sequence: Synthetic oligonucleotide
acctgtggcatgttccattgacattcatcaccag

SEQ ID NO: 86804 - DNA, 33 bp, Artificial Sequence
  Description of Artificial Sequence: Synthetic oligonucleotide
cctgtggcatgttccattgacattcatcaccag

SEQ ID NO: 86805 - DNA, 33 bp, Artificial Sequence
  Description of Artificial Sequence: Synthetic oligonucleotide
ctgtggcatgttccattgacattcatcaccagc

SEQ ID NO: 86806 - DNA, 37 bp, Artificial Sequence
  Description of Artificial Sequence: Synthetic oligonucleotide
tgtggcatgttccattgacattcatcaccagcaaatc

SEQ ID NO: 86807 - DNA, 36 bp, Artificial Sequence
  Description of Artificial Sequence: Synthetic oligonucleotide
gtggcatgttccattgacattcatcaccagcaaatc

SEQ ID NO: 86808 - DNA, 36 bp, Artificial Sequence
  Description of Artificial Sequence: Synthetic oligonucleotide
tggcatgttccattgacattcatcaccagcaaatcc

SEQ ID NO: 86809 - DNA, 35 bp, Artificial Sequence
  Description of Artificial Sequence: Synthetic oligonucleotide
ggcatgttccattgacattcatcaccagcaaatcc

SEQ ID NO: 86810 - DNA, 35 bp, Artificial Sequence
  Description of Artificial Sequence: Synthetic oligonucleotide
gcatgttccattgacattcatcaccagcaaatccg

SEQ ID NO: 86811 - DNA, 36 bp, Artificial Sequence
  Description of Artificial Sequence: Synthetic oligonucleotide
catgttccattgacattcatcaccagcaaatccgac

SEQ ID NO: 86812 - DNA, 38 bp, Artificial Sequence
  Description of Artificial Sequence: Synthetic oligonucleotide
atgttccattgacattcatcaccagcaaatccgacatg

SEQ ID NO: 86813 - DNA, 37 bp, Artificial Sequence
  Description of Artificial Sequence: Synthetic oligonucleotide
tgttccattgacattcatcaccagcaaatccgacatg

SEQ ID NO: 86814 - DNA, 36 bp, Artificial Sequence
  Description of Artificial Sequence: Synthetic oligonucleotide
gttccattgacattcatcaccagcaaatccgacatg

SEQ ID NO: 86815 - DNA, 36 bp, Artificial Sequence
  Description of Artificial Sequence: Synthetic oligonucleotide
ttccattgacattcatcaccagcaaatccgacatgg

SEQ ID NO: 86816 - DNA, 35 bp, Artificial Sequence
  Description of Artificial Sequence: Synthetic oligonucleotide
tccattgacattcatcaccagcaaatccgacatgg

SEQ ID NO: 86817 - DNA, 34 bp, Artificial Sequence
  Description of Artificial Sequence: Synthetic oligonucleotide
ccattgacattcatcaccagcaaatccgacatgg

SEQ ID NO: 86818 - DNA, 35 bp, Artificial Sequence
  Description of Artificial Sequence: Synthetic oligonucleotide
cattgacattcatcaccagcaaatccgacatggtc

SEQ ID NO: 86819 - DNA, 35 bp, Artificial Sequence
  Description of Artificial Sequence: Synthetic oligonucleotide
attgacattcatcaccagcaaatccgacatggtcc

SEQ ID NO: 86820 - DNA, 34 bp, Artificial Sequence
  Description of Artificial Sequence: Synthetic oligonucleotide
ttgacattcatcaccagcaaatccgacatggtcc

SEQ ID NO: 86821 - DNA, 33 bp, Artificial Sequence
  Description of Artificial Sequence: Synthetic oligonucleotide
tgacattcatcaccagcaaatccgacatggtcc

SEQ ID NO: 86822 - DNA, 32 bp, Artificial Sequence
  Description of Artificial Sequence: Synthetic oligonucleotide
gacattcatcaccagcaaatccgacatggtcc

SEQ ID NO: 86823 - DNA, 34 bp, Artificial Sequence
  Description of Artificial Sequence: Synthetic oligonucleotide
acattcatcaccagcaaatccgacatggtccatc

SEQ ID NO: 86824 - DNA, 33 bp, Artificial Sequence
  Description of Artificial Sequence: Synthetic oligonucleotide
cattcatcaccagcaaatccgacatggtccatc

SEQ ID NO: 86825 - DNA, 33 bp, Artificial Sequence
  Description of Artificial Sequence: Synthetic oligonucleotide
attcatcaccagcaaatccgacatggtccatcg

SEQ ID NO: 86826 - DNA, 32 bp, Artificial Sequence
  Description of Artificial Sequence: Synthetic oligonucleotide
ttcatcaccagcaaatccgacatggtccatcg

SEQ ID NO: 86827 - DNA, 31 bp, Artificial Sequence
  Description of Artificial Sequence: Synthetic oligonucleotide
tcatcaccagcaaatccgacatggtccatcg

SEQ ID NO: 86828 - DNA, 30 bp, Artificial Sequence
  Description of Artificial Sequence: Synthetic oligonucleotide
catcaccagcaaatccgacatggtccatcg

SEQ ID NO: 86829 - DNA, 36 bp, Artificial Sequence
  Description of Artificial Sequence: Synthetic oligonucleotide
atcaccagcaaatccgacatggtccatcgatttttg

SEQ ID NO: 86830 - DNA, 35 bp, Artificial Sequence
  Description of Artificial Sequence: Synthetic oligonucleotide
tcaccagcaaatccgacatggtccatcgatttttg

SEQ ID NO: 86831 - DNA, 34 bp, Artificial Sequence
  Description of Artificial Sequence: Synthetic oligonucleotide
caccagcaaatccgacatggtccatcgatttttg

SEQ ID NO: 86832 - DNA, 34 bp, Artificial Sequence
  Description of Artificial Sequence: Synthetic oligonucleotide
accagcaaatccgacatggtccatcgatttttgc

SEQ ID NO: 86833 - DNA, 33 bp, Artificial Sequence
  Description of Artificial Sequence: Synthetic oligonucleotide
ccagcaaatccgacatggtccatcgatttttgc

SEQ ID NO: 86834 - DNA, 39 bp, Artificial Sequence
  Description of Artificial Sequence: Synthetic oligonucleotide
cagcaaatccgacatggtccatcgatttttgctaaaaac

SEQ ID NO: 86835 - DNA, 44 bp, Artificial Sequence
  Description of Artificial Sequence: Synthetic oligonucleotide
agcaaatccgacatggtccatcgatttttgctaaaaacaaaaac

SEQ ID NO: 86836 - DNA, 43 bp, Artificial Sequence
  Description of Artificial Sequence: Synthetic oligonucleotide
gcaaatccgacatggtccatcgatttttgctaaaaacaaaaac

SEQ ID NO: 86837 - DNA, 44 bp, Artificial Sequence
  Description of Artificial Sequence: Synthetic oligonucleotide
caaatccgacatggtccatcgatttttgctaaaaacaaaaacag

SEQ ID NO: 86838 - DNA, 46 bp, Artificial Sequence
  Description of Artificial Sequence: Synthetic oligonucleotide
aaatccgacatggtccatcgatttttgctaaaaacaaaaacagatg

SEQ ID NO: 86839 - DNA, 45 bp, Artificial Sequence
  Description of Artificial Sequence: Synthetic oligonucleotide
aatccgacatggtccatcgatttttgctaaaaacaaaaacagatg

SEQ ID NO: 86840 - DNA, 44 bp, Artificial Sequence
  Description of Artificial Sequence: Synthetic oligonucleotide
atccgacatggtccatcgatttttgctaaaaacaaaaacagatg

SEQ ID NO: 86841 - DNA, 43 bp, Artificial Sequence
  Description of Artificial Sequence: Synthetic oligonucleotide
tccgacatggtccatcgatttttgctaaaaacaaaaacagatg

SEQ ID NO: 86842 - DNA, 42 bp, Artificial Sequence
  Description of Artificial Sequence: Synthetic oligonucleotide
ccgacatggtccatcgatttttgctaaaaacaaaaacagatg

SEQ ID NO: 86843 - DNA, 43 bp, Artificial Sequence
  Description of Artificial Sequence: Synthetic oligonucleotide
cgacatggtccatcgatttttgctaaaaacaaaaacagatgtg

SEQ ID NO: 86844 - DNA, 43 bp, Artificial Sequence
  Description of Artificial Sequence: Synthetic oligonucleotide
gacatggtccatcgatttttgctaaaaacaaaaacagatgtgc

SEQ ID NO: 86845 - DNA, 44 bp, Artificial Sequence
  Description of Artificial Sequence: Synthetic oligonucleotide
acatggtccatcgatttttgctaaaaacaaaaacagatgtgctc

SEQ ID NO: 86846 - DNA, 43 bp, Artificial Sequence
  Description of Artificial Sequence: Synthetic oligonucleotide
catggtccatcgatttttgctaaaaacaaaaacagatgtgctc

SEQ ID NO: 86847 - DNA, 45 bp, Artificial Sequence
  Description of Artificial Sequence: Synthetic oligonucleotide
atggtccatcgatttttgctaaaaacaaaaacagatgtgctcatc

SEQ ID NO: 86848 - DNA, 44 bp, Artificial Sequence
  Description of Artificial Sequence: Synthetic oligonucleotide
tggtccatcgatttttgctaaaaacaaaaacagatgtgctcatc

SEQ ID NO: 86849 - DNA, 43 bp, Artificial Sequence
  Description of Artificial Sequence: Synthetic oligonucleotide
ggtccatcgatttttgctaaaaacaaaaacagatgtgctcatc

SEQ ID NO: 86850 - DNA, 43 bp, Artificial Sequence
  Description of Artificial Sequence: Synthetic oligonucleotide
gtccatcgatttttgctaaaaacaaaaacagatgtgctcatcc

SEQ ID NO: 86851 - DNA, 44 bp, Artificial Sequence
  Description of Artificial Sequence: Synthetic oligonucleotide
tccatcgatttttgctaaaaacaaaaacagatgtgctcatcctc

SEQ ID NO: 86852 - DNA, 43 bp, Artificial Sequence
  Description of Artificial Sequence: Synthetic oligonucleotide
ccatcgatttttgctaaaaacaaaaacagatgtgctcatcctc

SEQ ID NO: 86853 - DNA, 43 bp, Artificial Sequence
  Description of Artificial Sequence: Synthetic oligonucleotide
catcgatttttgctaaaaacaaaaacagatgtgctcatcctcc

SEQ ID NO: 86854 - DNA, 43 bp, Artificial Sequence
  Description of Artificial Sequence: Synthetic oligonucleotide
atcgatttttgctaaaaacaaaaacagatgtgctcatcctccc

SEQ ID NO: 86855 - DNA, 42 bp, Artificial Sequence
  Description of Artificial Sequence: Synthetic oligonucleotide
tcgatttttgctaaaaacaaaaacagatgtgctcatcctccc

SEQ ID NO: 86856 - DNA, 41 bp, Artificial Sequence
  Description of Artificial Sequence: Synthetic oligonucleotide
cgatttttgctaaaaacaaaaacagatgtgctcatcctccc

SEQ ID NO: 86857 - DNA, 42 bp, Artificial Sequence
  Description of Artificial Sequence: Synthetic oligonucleotide
gatttttgctaaaaacaaaaacagatgtgctcatcctcccag

SEQ ID NO: 86858 - DNA, 44 bp, Artificial Sequence
  Description of Artificial Sequence: Synthetic oligonucleotide
atttttgctaaaaacaaaaacagatgtgctcatcctcccagaag

SEQ ID NO: 86859 - DNA, 43 bp, Artificial Sequence
  Description of Artificial Sequence: Synthetic oligonucleotide
tttttgctaaaaacaaaaacagatgtgctcatcctcccagaag

SEQ ID NO: 86860 - DNA, 42 bp, Artificial Sequence
  Description of Artificial Sequence: Synthetic oligonucleotide
ttttgctaaaaacaaaaacagatgtgctcatcctcccagaag

SEQ ID NO: 86861 - DNA, 41 bp, Artificial Sequence
  Description of Artificial Sequence: Synthetic oligonucleotide
tttgctaaaaacaaaaacagatgtgctcatcctcccagaag

SEQ ID NO: 86862 - DNA, 40 bp, Artificial Sequence
  Description of Artificial Sequence: Synthetic oligonucleotide
ttgctaaaaacaaaaacagatgtgctcatcctcccagaag

SEQ ID NO: 86863 - DNA, 39 bp, Artificial Sequence
  Description of Artificial Sequence: Synthetic oligonucleotide
tgctaaaaacaaaaacagatgtgctcatcctcccagaag

SEQ ID NO: 86864 - DNA, 38 bp, Artificial Sequence
  Description of Artificial Sequence: Synthetic oligonucleotide
gctaaaaacaaaaacagatgtgctcatcctcccagaag

SEQ ID NO: 86865 - DNA, 39 bp, Artificial Sequence
  Description of Artificial Sequence: Synthetic oligonucleotide
ctaaaaacaaaaacagatgtgctcatcctcccagaagag

SEQ ID NO: 86866 - DNA, 39 bp, Artificial Sequence
  Description of Artificial Sequence: Synthetic oligonucleotide
taaaaacaaaaacagatgtgctcatcctcccagaagagg

SEQ ID NO: 86867 - DNA, 38 bp, Artificial Sequence
  Description of Artificial Sequence: Synthetic oligonucleotide
aaaaacaaaaacagatgtgctcatcctcccagaagagg

SEQ ID NO: 86868 - DNA, 37 bp, Artificial Sequence
  Description of Artificial Sequence: Synthetic oligonucleotide
aaaacaaaaacagatgtgctcatcctcccagaagagg

SEQ ID NO: 86869 - DNA, 36 bp, Artificial Sequence
  Description of Artificial Sequence: Synthetic oligonucleotide
aaacaaaaacagatgtgctcatcctcccagaagagg

SEQ ID NO: 86870 - DNA, 35 bp, Artificial Sequence
  Description of Artificial Sequence: Synthetic oligonucleotide
aacaaaaacagatgtgctcatcctcccagaagagg

SEQ ID NO: 86871 - DNA, 34 bp, Artificial Sequence
  Description of Artificial Sequence: Synthetic oligonucleotide
acaaaaacagatgtgctcatcctcccagaagagg

SEQ ID NO: 86872 - DNA, 33 bp, Artificial Sequence
  Description of Artificial Sequence: Synthetic oligonucleotide
caaaaacagatgtgctcatcctcccagaagagg

SEQ ID NO: 86873 - DNA, 34 bp, Artificial Sequence
  Description of Artificial Sequence: Synthetic oligonucleotide
aaaaacagatgtgctcatcctcccagaagaggtg

SEQ ID NO: 86874 - DNA, 33 bp, Artificial Sequence
  Description of Artificial Sequence: Synthetic oligonucleotide
aaaacagatgtgctcatcctcccagaagaggtg

SEQ ID NO: 86875 - DNA, 32 bp, Artificial Sequence
  Description of Artificial Sequence: Synthetic oligonucleotide
aaacagatgtgctcatcctcccagaagaggtg

SEQ ID NO: 86876 - DNA, 31 bp, Artificial Sequence
  Description of Artificial Sequence: Synthetic oligonucleotide
aacagatgtgctcatcctcccagaagaggtg

SEQ ID NO: 86877 - DNA, 30 bp, Artificial Sequence
  Description of Artificial Sequence: Synthetic oligonucleotide
acagatgtgctcatcctcccagaagaggtg

SEQ ID NO: 86878 - DNA, 29 bp, Artificial Sequence
  Description of Artificial Sequence: Synthetic oligonucleotide
cagatgtgctcatcctcccagaagaggtg

SEQ ID NO: 86879 - DNA, 29 bp, Artificial Sequence
  Description of Artificial Sequence: Synthetic oligonucleotide
agatgtgctcatcctcccagaagaggtgg

SEQ ID NO: 86880 - DNA, 28 bp, Artificial Sequence
  Description of Artificial Sequence: Synthetic oligonucleotide
gatgtgctcatcctcccagaagaggtgg

SEQ ID NO: 86881 - DNA, 31 bp, Artificial Sequence
  Description of Artificial Sequence: Synthetic oligonucleotide
atgtgctcatcctcccagaagaggtggaatg

SEQ ID NO: 86882 - DNA, 30 bp, Artificial Sequence
  Description of Artificial Sequence: Synthetic oligonucleotide
tgtgctcatcctcccagaagaggtggaatg

SEQ ID NO: 86883 - DNA, 29 bp, Artificial Sequence
  Description of Artificial Sequence: Synthetic oligonucleotide
gtgctcatcctcccagaagaggtggaatg

SEQ ID NO: 86884 - DNA, 29 bp, Artificial Sequence
  Description of Artificial Sequence: Synthetic oligonucleotide
tgctcatcctcccagaagaggtggaatgg

SEQ ID NO: 86885 - DNA, 28 bp, Artificial Sequence
  Description of Artificial Sequence: Synthetic oligonucleotide
gctcatcctcccagaagaggtggaatgg

SEQ ID NO: 86886 - DNA, 30 bp, Artificial Sequence
  Description of Artificial Sequence: Synthetic oligonucleotide
ctcatcctcccagaagaggtggaatggatc

SEQ ID NO: 86887 - DNA, 39 bp, Artificial Sequence
  Description of Artificial Sequence: Synthetic oligonucleotide
tcatcctcccagaagaggtggaatggatcaaatttaatg

SEQ ID NO: 86888 - DNA, 38 bp, Artificial Sequence
  Description of Artificial Sequence: Synthetic oligonucleotide
catcctcccagaagaggtggaatggatcaaatttaatg

SEQ ID NO: 86889 - DNA, 39 bp, Artificial Sequence
  Description of Artificial Sequence: Synthetic oligonucleotide
atcctcccagaagaggtggaatggatcaaatttaatgtg

SEQ ID NO: 86890 - DNA, 38 bp, Artificial Sequence
  Description of Artificial Sequence: Synthetic oligonucleotide
tcctcccagaagaggtggaatggatcaaatttaatgtg

SEQ ID NO: 86891 - DNA, 37 bp, Artificial Sequence
  Description of Artificial Sequence: Synthetic oligonucleotide
cctcccagaagaggtggaatggatcaaatttaatgtg

SEQ ID NO: 86892 - DNA, 37 bp, Artificial Sequence
  Description of Artificial Sequence: Synthetic oligonucleotide
ctcccagaagaggtggaatggatcaaatttaatgtgg

SEQ ID NO: 86893 - DNA, 37 bp, Artificial Sequence
  Description of Artificial Sequence: Synthetic oligonucleotide
tcccagaagaggtggaatggatcaaatttaatgtggg

SEQ ID NO: 86894 - DNA, 36 bp, Artificial Sequence
  Description of Artificial Sequence: Synthetic oligonucleotide
cccagaagaggtggaatggatcaaatttaatgtggg

SEQ ID NO: 86895 - DNA, 36 bp, Artificial Sequence
  Description of Artificial Sequence: Synthetic oligonucleotide
ccagaagaggtggaatggatcaaatttaatgtgggc

SEQ ID NO: 86896 - DNA, 38 bp, Artificial Sequence
  Description of Artificial Sequence: Synthetic oligonucleotide
cagaagaggtggaatggatcaaatttaatgtgggcatg

SEQ ID NO: 86897 - DNA, 41 bp, Artificial Sequence
  Description of Artificial Sequence: Synthetic oligonucleotide
agaagaggtggaatggatcaaatttaatgtgggcatgaatg

SEQ ID NO: 86898 - DNA, 40 bp, Artificial Sequence
  Description of Artificial Sequence: Synthetic oligonucleotide
gaagaggtggaatggatcaaatttaatgtgggcatgaatg

SEQ ID NO: 86899 - DNA, 40 bp, Artificial Sequence
  Description of Artificial Sequence: Synthetic oligonucleotide
aagaggtggaatggatcaaatttaatgtgggcatgaatgg

SEQ ID NO: 86900 - DNA, 39 bp, Artificial Sequence
  Description of Artificial Sequence: Synthetic oligonucleotide
agaggtggaatggatcaaatttaatgtgggcatgaatgg

SEQ ID NO: 86901 - DNA, 38 bp, Artificial Sequence
  Description of Artificial Sequence: Synthetic oligonucleotide
gaggtggaatggatcaaatttaatgtgggcatgaatgg

SEQ ID NO: 86902 - DNA, 38 bp, Artificial Sequence
  Description of Artificial Sequence: Synthetic oligonucleotide
aggtggaatggatcaaatttaatgtgggcatgaatggc

SEQ ID NO: 86903 - DNA, 37 bp, Artificial Sequence
  Description of Artificial Sequence: Synthetic oligonucleotide
ggtggaatggatcaaatttaatgtgggcatgaatggc

SEQ ID NO: 86904 - DNA, 42 bp, Artificial Sequence
  Description of Artificial Sequence: Synthetic oligonucleotide
gtggaatggatcaaatttaatgtgggcatgaatggctattac

SEQ ID NO: 86905 - DNA, 45 bp, Artificial Sequence
  Description of Artificial Sequence: Synthetic oligonucleotide
tggaatggatcaaatttaatgtgggcatgaatggctattacattg

SEQ ID NO: 86906 - DNA, 44 bp, Artificial Sequence
  Description of Artificial Sequence: Synthetic oligonucleotide
ggaatggatcaaatttaatgtgggcatgaatggctattacattg

SEQ ID NO: 86907 - DNA, 45 bp, Artificial Sequence
  Description of Artificial Sequence: Synthetic oligonucleotide
gaatggatcaaatttaatgtgggcatgaatggctattacattgtg

SEQ ID NO: 86908 - DNA, 45 bp, Artificial Sequence
  Description of Artificial Sequence: Synthetic oligonucleotide
aatggatcaaatttaatgtgggcatgaatggctattacattgtgc

SEQ ID NO: 86909 - DNA, 44 bp, Artificial Sequence
  Description of Artificial Sequence: Synthetic oligonucleotide
atggatcaaatttaatgtgggcatgaatggctattacattgtgc

SEQ ID NO: 86910 - DNA, 43 bp, Artificial Sequence
  Description of Artificial Sequence: Synthetic oligonucleotide
tggatcaaatttaatgtgggcatgaatggctattacattgtgc

SEQ ID NO: 86911 - DNA, 42 bp, Artificial Sequence
  Description of Artificial Sequence: Synthetic oligonucleotide
ggatcaaatttaatgtgggcatgaatggctattacattgtgc

SEQ ID NO: 86912 - DNA, 46 bp, Artificial Sequence
  Description of Artificial Sequence: Synthetic oligonucleotide
gatcaaatttaatgtgggcatgaatggctattacattgtgcattac

SEQ ID NO: 86913 - DNA, 46 bp, Artificial Sequence
  Description of Artificial Sequence: Synthetic oligonucleotide
atcaaatttaatgtgggcatgaatggctattacattgtgcattacg

SEQ ID NO: 86914 - DNA, 45 bp, Artificial Sequence
  Description of Artificial Sequence: Synthetic oligonucleotide
tcaaatttaatgtgggcatgaatggctattacattgtgcattacg

SEQ ID NO: 86915 - DNA, 44 bp, Artificial Sequence
  Description of Artificial Sequence: Synthetic oligonucleotide
caaatttaatgtgggcatgaatggctattacattgtgcattacg

SEQ ID NO: 86916 - DNA, 45 bp, Artificial Sequence
  Description of Artificial Sequence: Synthetic oligonucleotide
aaatttaatgtgggcatgaatggctattacattgtgcattacgag

SEQ ID NO: 86917 - DNA, 44 bp, Artificial Sequence
  Description of Artificial Sequence: Synthetic oligonucleotide
aatttaatgtgggcatgaatggctattacattgtgcattacgag

SEQ ID NO: 86918 - DNA, 43 bp, Artificial Sequence
  Description of Artificial Sequence: Synthetic oligonucleotide
atttaatgtgggcatgaatggctattacattgtgcattacgag

SEQ ID NO: 86919 - DNA, 42 bp, Artificial Sequence
  Description of Artificial Sequence: Synthetic oligonucleotide
tttaatgtgggcatgaatggctattacattgtgcattacgag

SEQ ID NO: 86920 - DNA, 41 bp, Artificial Sequence
  Description of Artificial Sequence: Synthetic oligonucleotide
ttaatgtgggcatgaatggctattacattgtgcattacgag

SEQ ID NO: 86921 - DNA, 40 bp, Artificial Sequence
  Description of Artificial Sequence: Synthetic oligonucleotide
taatgtgggcatgaatggctattacattgtgcattacgag

SEQ ID NO: 86922 - DNA, 39 bp, Artificial Sequence
  Description of Artificial Sequence: Synthetic oligonucleotide
aatgtgggcatgaatggctattacattgtgcattacgag

SEQ ID NO: 86923 - DNA, 38 bp, Artificial Sequence
  Description of Artificial Sequence: Synthetic oligonucleotide
atgtgggcatgaatggctattacattgtgcattacgag

SEQ ID NO: 86924 - DNA, 37 bp, Artificial Sequence
  Description of Artificial Sequence: Synthetic oligonucleotide
tgtgggcatgaatggctattacattgtgcattacgag

SEQ ID NO: 86925 - DNA, 36 bp, Artificial Sequence
  Description of Artificial Sequence: Synthetic oligonucleotide
gtgggcatgaatggctattacattgtgcattacgag

SEQ ID NO: 86926 - DNA, 36 bp, Artificial Sequence
  Description of Artificial Sequence: Synthetic oligonucleotide
tgggcatgaatggctattacattgtgcattacgagg

SEQ ID NO: 86927 - DNA, 35 bp, Artificial Sequence
  Description of Artificial Sequence: Synthetic oligonucleotide
gggcatgaatggctattacattgtgcattacgagg

SEQ ID NO: 86928 - DNA, 37 bp, Artificial Sequence
  Description of Artificial Sequence: Synthetic oligonucleotide
ggcatgaatggctattacattgtgcattacgaggatg

SEQ ID NO: 86929 - DNA, 39 bp, Artificial Sequence
  Description of Artificial Sequence: Synthetic oligonucleotide
gcatgaatggctattacattgtgcattacgaggatgatg

SEQ ID NO: 86930 - DNA, 39 bp, Artificial Sequence
  Description of Artificial Sequence: Synthetic oligonucleotide
catgaatggctattacattgtgcattacgaggatgatgg

SEQ ID NO: 86931 - DNA, 41 bp, Artificial Sequence
  Description of Artificial Sequence: Synthetic oligonucleotide
atgaatggctattacattgtgcattacgaggatgatggatg

SEQ ID NO: 86932 - DNA, 40 bp, Artificial Sequence
  Description of Artificial Sequence: Synthetic oligonucleotide
tgaatggctattacattgtgcattacgaggatgatggatg

SEQ ID NO: 86933 - DNA, 39 bp, Artificial Sequence
  Description of Artificial Sequence: Synthetic oligonucleotide
gaatggctattacattgtgcattacgaggatgatggatg

SEQ ID NO: 86934 - DNA, 39 bp, Artificial Sequence
  Description of Artificial Sequence: Synthetic oligonucleotide
aatggctattacattgtgcattacgaggatgatggatgg

SEQ ID NO: 86935 - DNA, 38 bp, Artificial Sequence
  Description of Artificial Sequence: Synthetic oligonucleotide
atggctattacattgtgcattacgaggatgatggatgg

SEQ ID NO: 86936 - DNA, 37 bp, Artificial Sequence
  Description of Artificial Sequence: Synthetic oligonucleotide
tggctattacattgtgcattacgaggatgatggatgg

SEQ ID NO: 86937 - DNA, 36 bp, Artificial Sequence
  Description of Artificial Sequence: Synthetic oligonucleotide
ggctattacattgtgcattacgaggatgatggatgg

SEQ ID NO: 86938 - DNA, 36 bp, Artificial Sequence
  Description of Artificial Sequence: Synthetic oligonucleotide
gctattacattgtgcattacgaggatgatggatggg

SEQ ID NO: 86939 - DNA, 37 bp, Artificial Sequence
  Description of Artificial Sequence: Synthetic oligonucleotide
ctattacattgtgcattacgaggatgatggatgggac

SEQ ID NO: 86940 - DNA, 38 bp, Artificial Sequence
  Description of Artificial Sequence: Synthetic oligonucleotide
tattacattgtgcattacgaggatgatggatgggactc

SEQ ID NO: 86941 - DNA, 37 bp, Artificial Sequence
  Description of Artificial Sequence: Synthetic oligonucleotide
attacattgtgcattacgaggatgatggatgggactc

SEQ ID NO: 86942 - DNA, 36 bp, Artificial Sequence
  Description of Artificial Sequence: Synthetic oligonucleotide
ttacattgtgcattacgaggatgatggatgggactc

SEQ ID NO: 86943 - DNA, 35 bp, Artificial Sequence
  Description of Artificial Sequence: Synthetic oligonucleotide
tacattgtgcattacgaggatgatggatgggactc

SEQ ID NO: 86944 - DNA, 34 bp, Artificial Sequence
  Description of Artificial Sequence: Synthetic oligonucleotide
acattgtgcattacgaggatgatggatgggactc

SEQ ID NO: 86945 - DNA, 33 bp, Artificial Sequence
  Description of Artificial Sequence: Synthetic oligonucleotide
cattgtgcattacgaggatgatggatgggactc

SEQ ID NO: 86946 - DNA, 36 bp, Artificial Sequence
  Description of Artificial Sequence: Synthetic oligonucleotide
attgtgcattacgaggatgatggatgggactctttg

SEQ ID NO: 86947 - DNA, 35 bp, Artificial Sequence
  Description of Artificial Sequence: Synthetic oligonucleotide
ttgtgcattacgaggatgatggatgggactctttg

SEQ ID NO: 86948 - DNA, 34 bp, Artificial Sequence
  Description of Artificial Sequence: Synthetic oligonucleotide
tgtgcattacgaggatgatggatgggactctttg

SEQ ID NO: 86949 - DNA, 33 bp, Artificial Sequence
  Description of Artificial Sequence: Synthetic oligonucleotide
gtgcattacgaggatgatggatgggactctttg

SEQ ID NO: 86950 - DNA, 34 bp, Artificial Sequence
  Description of Artificial Sequence: Synthetic oligonucleotide
tgcattacgaggatgatggatgggactctttgac

SEQ ID NO: 86951 - DNA, 33 bp, Artificial Sequence
  Description of Artificial Sequence: Synthetic oligonucleotide
gcattacgaggatgatggatgggactctttgac

SEQ ID NO: 86952 - DNA, 34 bp, Artificial Sequence
  Description of Artificial Sequence: Synthetic oligonucleotide
cattacgaggatgatggatgggactctttgactg

SEQ ID NO: 86953 - DNA, 34 bp, Artificial Sequence
  Description of Artificial Sequence: Synthetic oligonucleotide
attacgaggatgatggatgggactctttgactgg

SEQ ID NO: 86954 - DNA, 33 bp, Artificial Sequence
  Description of Artificial Sequence: Synthetic oligonucleotide
ttacgaggatgatggatgggactctttgactgg

SEQ ID NO: 86955 - DNA, 32 bp, Artificial Sequence
  Description of Artificial Sequence: Synthetic oligonucleotide
tacgaggatgatggatgggactctttgactgg

SEQ ID NO: 86956 - DNA, 31 bp, Artificial Sequence
  Description of Artificial Sequence: Synthetic oligonucleotide
acgaggatgatggatgggactctttgactgg

SEQ ID NO: 86957 - DNA, 30 bp, Artificial Sequence
  Description of Artificial Sequence: Synthetic oligonucleotide
cgaggatgatggatgggactctttgactgg

SEQ ID NO: 86958 - DNA, 30 bp, Artificial Sequence
  Description of Artificial Sequence: Synthetic oligonucleotide
gaggatgatggatgggactctttgactggc

SEQ ID NO: 86959 - DNA, 30 bp, Artificial Sequence
  Description of Artificial Sequence: Synthetic oligonucleotide
aggatgatggatgggactctttgactggcc

SEQ ID NO: 86960 - DNA, 29 bp, Artificial Sequence
  Description of Artificial Sequence: Synthetic oligonucleotide
ggatgatggatgggactctttgactggcc

SEQ ID NO: 86961 - DNA, 37 bp, Artificial Sequence
  Description of Artificial Sequence: Synthetic oligonucleotide
gatgatggatgggactctttgactggccttttaaaag

SEQ ID NO: 86962 - DNA, 37 bp, Artificial Sequence
  Description of Artificial Sequence: Synthetic oligonucleotide
atgatggatgggactctttgactggccttttaaaagg

SEQ ID NO: 86963 - DNA, 36 bp, Artificial Sequence
  Description of Artificial Sequence: Synthetic oligonucleotide
tgatggatgggactctttgactggccttttaaaagg

SEQ ID NO: 86964 - DNA, 35 bp, Artificial Sequence
  Description of Artificial Sequence: Synthetic oligonucleotide
gatggatgggactctttgactggccttttaaaagg

SEQ ID NO: 86965 - DNA, 37 bp, Artificial Sequence
  Description of Artificial Sequence: Synthetic oligonucleotide
atggatgggactctttgactggccttttaaaaggaac

SEQ ID NO: 86966 - DNA, 36 bp, Artificial Sequence
  Description of Artificial Sequence: Synthetic oligonucleotide
tggatgggactctttgactggccttttaaaaggaac

SEQ ID NO: 86967 - DNA, 35 bp, Artificial Sequence
  Description of Artificial Sequence: Synthetic oligonucleotide
ggatgggactctttgactggccttttaaaaggaac

SEQ ID NO: 86968 - DNA, 36 bp, Artificial Sequence
  Description of Artificial Sequence: Synthetic oligonucleotide
gatgggactctttgactggccttttaaaaggaacac

SEQ ID NO: 86969 - DNA, 37 bp, Artificial Sequence
  Description of Artificial Sequence: Synthetic oligonucleotide
atgggactctttgactggccttttaaaaggaacacac

SEQ ID NO: 86970 - DNA, 36 bp, Artificial Sequence
  Description of Artificial Sequence: Synthetic oligonucleotide
tgggactctttgactggccttttaaaaggaacacac

SEQ ID NO: 86971 - DNA, 35 bp, Artificial Sequence
  Description of Artificial Sequence: Synthetic oligonucleotide
gggactctttgactggccttttaaaaggaacacac

SEQ ID NO: 86972 - DNA, 36 bp, Artificial Sequence
  Description of Artificial Sequence: Synthetic oligonucleotide
ggactctttgactggccttttaaaaggaacacacac

SEQ ID NO: 86973 - DNA, 37 bp, Artificial Sequence
  Description of Artificial Sequence: Synthetic oligonucleotide
gactctttgactggccttttaaaaggaacacacacag

SEQ ID NO: 86974 - DNA, 37 bp, Artificial Sequence
  Description of Artificial Sequence: Synthetic oligonucleotide
actctttgactggccttttaaaaggaacacacacagc

SEQ ID NO: 86975 - DNA, 36 bp, Artificial Sequence
  Description of Artificial Sequence: Synthetic oligonucleotide
ctctttgactggccttttaaaaggaacacacacagc

SEQ ID NO: 86976 - DNA, 37 bp, Artificial Sequence
  Description of Artificial Sequence: Synthetic oligonucleotide
tctttgactggccttttaaaaggaacacacacagcag

SEQ ID NO: 86977 - DNA, 36 bp, Artificial Sequence
  Description of Artificial Sequence: Synthetic oligonucleotide
ctttgactggccttttaaaaggaacacacacagcag

SEQ ID NO: 86978 - DNA, 37 bp, Artificial Sequence
  Description of Artificial Sequence: Synthetic oligonucleotide
tttgactggccttttaaaaggaacacacacagcagtc

SEQ ID NO: 86979 - DNA, 36 bp, Artificial Sequence
  Description of Artificial Sequence: Synthetic oligonucleotide
ttgactggccttttaaaaggaacacacacagcagtc

SEQ ID NO: 86980 - DNA, 35 bp, Artificial Sequence
  Description of Artificial Sequence: Synthetic oligonucleotide
tgactggccttttaaaaggaacacacacagcagtc

SEQ ID NO: 86981 - DNA, 34 bp, Artificial Sequence
  Description of Artificial Sequence: Synthetic oligonucleotide
gactggccttttaaaaggaacacacacagcagtc

SEQ ID NO: 86982 - DNA, 35 bp, Artificial Sequence
  Description of Artificial Sequence: Synthetic oligonucleotide
actggccttttaaaaggaacacacacagcagtcag

SEQ ID NO: 86983 - DNA, 34 bp, Artificial Sequence
  Description of Artificial Sequence: Synthetic oligonucleotide
ctggccttttaaaaggaacacacacagcagtcag

SEQ ID NO: 86984 - DNA, 34 bp, Artificial Sequence
  Description of Artificial Sequence: Synthetic oligonucleotide
tggccttttaaaaggaacacacacagcagtcagc

SEQ ID NO: 86985 - DNA, 33 bp, Artificial Sequence
  Description of Artificial Sequence: Synthetic oligonucleotide
ggccttttaaaaggaacacacacagcagtcagc

SEQ ID NO: 86986 - DNA, 34 bp, Artificial Sequence
  Description of Artificial Sequence: Synthetic oligonucleotide
gccttttaaaaggaacacacacagcagtcagcag

SEQ ID NO: 86987 - DNA, 38 bp, Artificial Sequence
  Description of Artificial Sequence: Synthetic oligonucleotide
ccttttaaaaggaacacacacagcagtcagcagtaatg

SEQ ID NO: 86988 - DNA, 40 bp, Artificial Sequence
  Description of Artificial Sequence: Synthetic oligonucleotide
cttttaaaaggaacacacacagcagtcagcagtaatgatc

SEQ ID NO: 86989 - DNA, 40 bp, Artificial Sequence
  Description of Artificial Sequence: Synthetic oligonucleotide
ttttaaaaggaacacacacagcagtcagcagtaatgatcg

SEQ ID NO: 86990 - DNA, 39 bp, Artificial Sequence
  Description of Artificial Sequence: Synthetic oligonucleotide
tttaaaaggaacacacacagcagtcagcagtaatgatcg

SEQ ID NO: 86991 - DNA, 38 bp, Artificial Sequence
  Description of Artificial Sequence: Synthetic oligonucleotide
ttaaaaggaacacacacagcagtcagcagtaatgatcg

SEQ ID NO: 86992 - DNA, 37 bp, Artificial Sequence
  Description of Artificial Sequence: Synthetic oligonucleotide
taaaaggaacacacacagcagtcagcagtaatgatcg

SEQ ID NO: 86993 - DNA, 36 bp, Artificial Sequence
  Description of Artificial Sequence: Synthetic oligonucleotide
aaaaggaacacacacagcagtcagcagtaatgatcg

SEQ ID NO: 86994 - DNA, 35 bp, Artificial Sequence
  Description of Artificial Sequence: Synthetic oligonucleotide
aaaggaacacacacagcagtcagcagtaatgatcg

SEQ ID NO: 86995 - DNA, 34 bp, Artificial Sequence
  Description of Artificial Sequence: Synthetic oligonucleotide
aaggaacacacacagcagtcagcagtaatgatcg

SEQ ID NO: 86996 - DNA, 33 bp, Artificial Sequence
  Description of Artificial Sequence: Synthetic oligonucleotide
aggaacacacacagcagtcagcagtaatgatcg

SEQ ID NO: 86997 - DNA, 32 bp, Artificial Sequence
  Description of Artificial Sequence: Synthetic oligonucleotide
ggaacacacacagcagtcagcagtaatgatcg

SEQ ID NO: 86998 - DNA, 32 bp, Artificial Sequence
  Description of Artificial Sequence: Synthetic oligonucleotide
gaacacacacagcagtcagcagtaatgatcgg

SEQ ID NO: 86999 - DNA, 32 bp, Artificial Sequence
  Description of Artificial Sequence: Synthetic oligonucleotide
aacacacacagcagtcagcagtaatgatcggg

SEQ ID NO: 87000 - DNA, 31 bp, Artificial Sequence
  Description of Artificial Sequence: Synthetic oligonucleotide
acacacacagcagtcagcagtaatgatcggg

SEQ ID NO: 87001 - DNA, 30 bp, Artificial Sequence
  Description of Artificial Sequence: Synthetic oligonucleotide
cacacacagcagtcagcagtaatgatcggg

SEQ ID NO: 87002 - DNA, 30 bp, Artificial Sequence
  Description of Artificial Sequence: Synthetic oligonucleotide
acacacagcagtcagcagtaatgatcgggc

SEQ ID NO: 87003 - DNA, 29 bp, Artificial Sequence
  Description of Artificial Sequence: Synthetic oligonucleotide
cacacagcagtcagcagtaatgatcgggc

SEQ ID NO: 87004 - DNA, 29 bp, Artificial Sequence
  Description of Artificial Sequence: Synthetic oligonucleotide
acacagcagtcagcagtaatgatcgggcg

SEQ ID NO: 87005 - DNA, 28 bp, Artificial Sequence
  Description of Artificial Sequence: Synthetic oligonucleotide
cacagcagtcagcagtaatgatcgggcg

SEQ ID NO: 87006 - DNA, 29 bp, Artificial Sequence
  Description of Artificial Sequence: Synthetic oligonucleotide
acagcagtcagcagtaatgatcgggcgag

SEQ ID NO: 87007 - DNA, 28 bp, Artificial Sequence
  Description of Artificial Sequence: Synthetic oligonucleotide
cagcagtcagcagtaatgatcgggcgag

SEQ ID NO: 87008 - DNA, 29 bp, Artificial Sequence
  Description of Artificial Sequence: Synthetic oligonucleotide
agcagtcagcagtaatgatcgggcgagtc

SEQ ID NO: 87009 - DNA, 28 bp, Artificial Sequence
  Description of Artificial Sequence: Synthetic oligonucleotide
gcagtcagcagtaatgatcgggcgagtc

SEQ ID NO: 87010 - DNA, 29 bp, Artificial Sequence
  Description of Artificial Sequence: Synthetic oligonucleotide
cagtcagcagtaatgatcgggcgagtctc

SEQ ID NO: 87011 - DNA, 34 bp, Artificial Sequence
  Description of Artificial Sequence: Synthetic oligonucleotide
agtcagcagtaatgatcgggcgagtctcattaac

SEQ ID NO: 87012 - DNA, 33 bp, Artificial Sequence
  Description of Artificial Sequence: Synthetic oligonucleotide
gtcagcagtaatgatcgggcgagtctcattaac

SEQ ID NO: 87013 - DNA, 36 bp, Artificial Sequence
  Description of Artificial Sequence: Synthetic oligonucleotide
tcagcagtaatgatcgggcgagtctcattaacaatg

SEQ ID NO: 87014 - DNA, 35 bp, Artificial Sequence
  Description of Artificial Sequence: Synthetic oligonucleotide
cagcagtaatgatcgggcgagtctcattaacaatg

SEQ ID NO: 87015 - DNA, 35 bp, Artificial Sequence
  Description of Artificial Sequence: Synthetic oligonucleotide
agcagtaatgatcgggcgagtctcattaacaatgc

SEQ ID NO: 87016 - DNA, 34 bp, Artificial Sequence
  Description of Artificial Sequence: Synthetic oligonucleotide
gcagtaatgatcgggcgagtctcattaacaatgc

SEQ ID NO: 87017 - DNA, 38 bp, Artificial Sequence
  Description of Artificial Sequence: Synthetic oligonucleotide
cagtaatgatcgggcgagtctcattaacaatgcatttc

SEQ ID NO: 87018 - DNA, 39 bp, Artificial Sequence
  Description of Artificial Sequence: Synthetic oligonucleotide
agtaatgatcgggcgagtctcattaacaatgcatttcag

SEQ ID NO: 87019 - DNA, 38 bp, Artificial Sequence
  Description of Artificial Sequence: Synthetic oligonucleotide
gtaatgatcgggcgagtctcattaacaatgcatttcag

SEQ ID NO: 87020 - DNA, 38 bp, Artificial Sequence
  Description of Artificial Sequence: Synthetic oligonucleotide
taatgatcgggcgagtctcattaacaatgcatttcagc

SEQ ID NO: 87021 - DNA, 37 bp, Artificial Sequence
  Description of Artificial Sequence: Synthetic oligonucleotide
aatgatcgggcgagtctcattaacaatgcatttcagc

SEQ ID NO: 87022 - DNA, 36 bp, Artificial Sequence
  Description of Artificial Sequence: Synthetic oligonucleotide
atgatcgggcgagtctcattaacaatgcatttcagc

SEQ ID NO: 87023 - DNA, 35 bp, Artificial Sequence
  Description of Artificial Sequence: Synthetic oligonucleotide
tgatcgggcgagtctcattaacaatgcatttcagc

SEQ ID NO: 87024 - DNA, 34 bp, Artificial Sequence
  Description of Artificial Sequence: Synthetic oligonucleotide
gatcgggcgagtctcattaacaatgcatttcagc

SEQ ID NO: 87025 - DNA, 35 bp, Artificial Sequence
  Description of Artificial Sequence: Synthetic oligonucleotide
atcgggcgagtctcattaacaatgcatttcagctc

SEQ ID NO: 87026 - DNA, 34 bp, Artificial Sequence
  Description of Artificial Sequence: Synthetic oligonucleotide
tcgggcgagtctcattaacaatgcatttcagctc

SEQ ID NO: 87027 - DNA, 33 bp, Artificial Sequence
  Description of Artificial Sequence: Synthetic oligonucleotide
cgggcgagtctcattaacaatgcatttcagctc

SEQ ID NO: 87028 - DNA, 33 bp, Artificial Sequence
  Description of Artificial Sequence: Synthetic oligonucleotide
gggcgagtctcattaacaatgcatttcagctcg

SEQ ID NO: 87029 - DNA, 34 bp, Artificial Sequence
  Description of Artificial Sequence: Synthetic oligonucleotide
ggcgagtctcattaacaatgcatttcagctcgtc

SEQ ID NO: 87030 - DNA, 35 bp, Artificial Sequence
  Description of Artificial Sequence: Synthetic oligonucleotide
gcgagtctcattaacaatgcatttcagctcgtcag

SEQ ID NO: 87031 - DNA, 35 bp, Artificial Sequence
  Description of Artificial Sequence: Synthetic oligonucleotide
cgagtctcattaacaatgcatttcagctcgtcagc

SEQ ID NO: 87032 - DNA, 38 bp, Artificial Sequence
  Description of Artificial Sequence: Synthetic oligonucleotide
gagtctcattaacaatgcatttcagctcgtcagcattg

SEQ ID NO: 87033 - DNA, 38 bp, Artificial Sequence
  Description of Artificial Sequence: Synthetic oligonucleotide
agtctcattaacaatgcatttcagctcgtcagcattgg

SEQ ID NO: 87034 - DNA, 37 bp, Artificial Sequence
  Description of Artificial Sequence: Synthetic oligonucleotide
gtctcattaacaatgcatttcagctcgtcagcattgg

SEQ ID NO: 87035 - DNA, 37 bp, Artificial Sequence
  Description of Artificial Sequence: Synthetic oligonucleotide
tctcattaacaatgcatttcagctcgtcagcattggg

SEQ ID NO: 87036 - DNA, 36 bp, Artificial Sequence
  Description of Artificial Sequence: Synthetic oligonucleotide
ctcattaacaatgcatttcagctcgtcagcattggg

SEQ ID NO: 87037 - DNA, 38 bp, Artificial Sequence
  Description of Artificial Sequence: Synthetic oligonucleotide
tcattaacaatgcatttcagctcgtcagcattgggaag

SEQ ID NO: 87038 - DNA, 37 bp, Artificial Sequence
  Description of Artificial Sequence: Synthetic oligonucleotide
cattaacaatgcatttcagctcgtcagcattgggaag

SEQ ID NO: 87039 - DNA, 37 bp, Artificial Sequence
  Description of Artificial Sequence: Synthetic oligonucleotide
attaacaatgcatttcagctcgtcagcattgggaagc

SEQ ID NO: 87040 - DNA, 36 bp, Artificial Sequence
  Description of Artificial Sequence: Synthetic oligonucleotide
ttaacaatgcatttcagctcgtcagcattgggaagc

SEQ ID NO: 87041 - DNA, 35 bp, Artificial Sequence
  Description of Artificial Sequence: Synthetic oligonucleotide
taacaatgcatttcagctcgtcagcattgggaagc

SEQ ID NO: 87042 - DNA, 34 bp, Artificial Sequence
  Description of Artificial Sequence: Synthetic oligonucleotide
aacaatgcatttcagctcgtcagcattgggaagc

SEQ ID NO: 87043 - DNA, 33 bp, Artificial Sequence
  Description of Artificial Sequence: Synthetic oligonucleotide
acaatgcatttcagctcgtcagcattgggaagc

SEQ ID NO: 87044 - DNA, 32 bp, Artificial Sequence
  Description of Artificial Sequence: Synthetic oligonucleotide
caatgcatttcagctcgtcagcattgggaagc

SEQ ID NO: 87045 - DNA, 33 bp, Artificial Sequence
  Description of Artificial Sequence: Synthetic oligonucleotide
aatgcatttcagctcgtcagcattgggaagctg

SEQ ID NO: 87046 - DNA, 32 bp, Artificial Sequence
  Description of Artificial Sequence: Synthetic oligonucleotide
atgcatttcagctcgtcagcattgggaagctg

SEQ ID NO: 87047 - DNA, 31 bp, Artificial Sequence
  Description of Artificial Sequence: Synthetic oligonucleotide
tgcatttcagctcgtcagcattgggaagctg

SEQ ID NO: 87048 - DNA, 30 bp, Artificial Sequence
  Description of Artificial Sequence: Synthetic oligonucleotide
gcatttcagctcgtcagcattgggaagctg

SEQ ID NO: 87049 - DNA, 31 bp, Artificial Sequence
  Description of Artificial Sequence: Synthetic oligonucleotide
catttcagctcgtcagcattgggaagctgtc

SEQ ID NO: 87050 - DNA, 31 bp, Artificial Sequence
  Description of Artificial Sequence: Synthetic oligonucleotide
atttcagctcgtcagcattgggaagctgtcc

SEQ ID NO: 87051 - DNA, 30 bp, Artificial Sequence
  Description of Artificial Sequence: Synthetic oligonucleotide
tttcagctcgtcagcattgggaagctgtcc

SEQ ID NO: 87052 - DNA, 29 bp, Artificial Sequence
  Description of Artificial Sequence: Synthetic oligonucleotide
ttcagctcgtcagcattgggaagctgtcc

SEQ ID NO: 87053 - DNA, 28 bp, Artificial Sequence
  Description of Artificial Sequence: Synthetic oligonucleotide
tcagctcgtcagcattgggaagctgtcc

SEQ ID NO: 87054 - DNA, 27 bp, Artificial Sequence
  Description of Artificial Sequence: Synthetic oligonucleotide
cagctcgtcagcattgggaagctgtcc

SEQ ID NO: 87055 - DNA, 30 bp, Artificial Sequence
  Description of Artificial Sequence: Synthetic oligonucleotide
agctcgtcagcattgggaagctgtccattg

SEQ ID NO: 87056 - DNA, 29 bp, Artificial Sequence
  Description of Artificial Sequence: Synthetic oligonucleotide
gctcgtcagcattgggaagctgtccattg

SEQ ID NO: 87057 - DNA, 33 bp, Artificial Sequence
  Description of Artificial Sequence: Synthetic oligonucleotide
ctcgtcagcattgggaagctgtccattgaaaag

SEQ ID NO: 87058 - DNA, 33 bp, Artificial Sequence
  Description of Artificial Sequence: Synthetic oligonucleotide
tcgtcagcattgggaagctgtccattgaaaagg

SEQ ID NO: 87059 - DNA, 32 bp, Artificial Sequence
  Description of Artificial Sequence: Synthetic oligonucleotide
cgtcagcattgggaagctgtccattgaaaagg

SEQ ID NO: 87060 - DNA, 32 bp, Artificial Sequence
  Description of Artificial Sequence: Synthetic oligonucleotide
gtcagcattgggaagctgtccattgaaaaggc

SEQ ID NO: 87061 - DNA, 32 bp, Artificial Sequence
  Description of Artificial Sequence: Synthetic oligonucleotide
tcagcattgggaagctgtccattgaaaaggcc

SEQ ID NO: 87062 - DNA, 31 bp, Artificial Sequence
  Description of Artificial Sequence: Synthetic oligonucleotide
cagcattgggaagctgtccattgaaaaggcc

SEQ ID NO: 87063 - DNA, 33 bp, Artificial Sequence
  Description of Artificial Sequence: Synthetic oligonucleotide
agcattgggaagctgtccattgaaaaggccttg

SEQ ID NO: 87064 - DNA, 32 bp, Artificial Sequence
  Description of Artificial Sequence: Synthetic oligonucleotide
gcattgggaagctgtccattgaaaaggccttg

SEQ ID NO: 87065 - DNA, 32 bp, Artificial Sequence
  Description of Artificial Sequence: Synthetic oligonucleotide
cattgggaagctgtccattgaaaaggccttgg

SEQ ID NO: 87066 - DNA, 38 bp, Artificial Sequence
  Description of Artificial Sequence: Synthetic oligonucleotide
attgggaagctgtccattgaaaaggccttggatttatc

SEQ ID NO: 87067 - DNA, 37 bp, Artificial Sequence
  Description of Artificial Sequence: Synthetic oligonucleotide
ttgggaagctgtccattgaaaaggccttggatttatc

SEQ ID NO: 87068 - DNA, 36 bp, Artificial Sequence
  Description of Artificial Sequence: Synthetic oligonucleotide
tgggaagctgtccattgaaaaggccttggatttatc

SEQ ID NO: 87069 - DNA, 35 bp, Artificial Sequence
  Description of Artificial Sequence: Synthetic oligonucleotide
gggaagctgtccattgaaaaggccttggatttatc

SEQ ID NO: 87070 - DNA, 35 bp, Artificial Sequence
  Description of Artificial Sequence: Synthetic oligonucleotide
ggaagctgtccattgaaaaggccttggatttatcc

SEQ ID NO: 87071 - DNA, 35 bp, Artificial Sequence
  Description of Artificial Sequence: Synthetic oligonucleotide
gaagctgtccattgaaaaggccttggatttatccc

SEQ ID NO: 87072 - DNA, 36 bp, Artificial Sequence
  Description of Artificial Sequence: Synthetic oligonucleotide
aagctgtccattgaaaaggccttggatttatccctg

SEQ ID NO: 87073 - DNA, 35 bp, Artificial Sequence
  Description of Artificial Sequence: Synthetic oligonucleotide
agctgtccattgaaaaggccttggatttatccctg

SEQ ID NO: 87074 - DNA, 34 bp, Artificial Sequence
  Description of Artificial Sequence: Synthetic oligonucleotide
gctgtccattgaaaaggccttggatttatccctg

SEQ ID NO: 87075 - DNA, 36 bp, Artificial Sequence
  Description of Artificial Sequence: Synthetic oligonucleotide
ctgtccattgaaaaggccttggatttatccctgtac

SEQ ID NO: 87076 - DNA, 38 bp, Artificial Sequence
  Description of Artificial Sequence: Synthetic oligonucleotide
tgtccattgaaaaggccttggatttatccctgtacttg

SEQ ID NO: 87077 - DNA, 37 bp, Artificial Sequence
  Description of Artificial Sequence: Synthetic oligonucleotide
gtccattgaaaaggccttggatttatccctgtacttg

SEQ ID NO: 87078 - DNA, 40 bp, Artificial Sequence
  Description of Artificial Sequence: Synthetic oligonucleotide
tccattgaaaaggccttggatttatccctgtacttgaaac

SEQ ID NO: 87079 - DNA, 39 bp, Artificial Sequence
  Description of Artificial Sequence: Synthetic oligonucleotide
ccattgaaaaggccttggatttatccctgtacttgaaac

SEQ ID NO: 87080 - DNA, 41 bp, Artificial Sequence
  Description of Artificial Sequence: Synthetic oligonucleotide
cattgaaaaggccttggatttatccctgtacttgaaacatg

SEQ ID NO: 87081 - DNA, 44 bp, Artificial Sequence
  Description of Artificial Sequence: Synthetic oligonucleotide
attgaaaaggccttggatttatccctgtacttgaaacatgaaac

SEQ ID NO: 87082 - DNA, 43 bp, Artificial Sequence
  Description of Artificial Sequence: Synthetic oligonucleotide
ttgaaaaggccttggatttatccctgtacttgaaacatgaaac

SEQ ID NO: 87083 - DNA, 42 bp, Artificial Sequence
  Description of Artificial Sequence: Synthetic oligonucleotide
tgaaaaggccttggatttatccctgtacttgaaacatgaaac

SEQ ID NO: 87084 - DNA, 41 bp, Artificial Sequence
  Description of Artificial Sequence: Synthetic oligonucleotide
gaaaaggccttggatttatccctgtacttgaaacatgaaac

SEQ ID NO: 87085 - DNA, 42 bp, Artificial Sequence
  Description of Artificial Sequence: Synthetic oligonucleotide
aaaaggccttggatttatccctgtacttgaaacatgaaactg

SEQ ID NO: 87086 - DNA, 41 bp, Artificial Sequence
  Description of Artificial Sequence: Synthetic oligonucleotide
aaaggccttggatttatccctgtacttgaaacatgaaactg

SEQ ID NO: 87087 - DNA, 40 bp, Artificial Sequence
  Description of Artificial Sequence: Synthetic oligonucleotide
aaggccttggatttatccctgtacttgaaacatgaaactg

SEQ ID NO: 87088 - DNA, 39 bp, Artificial Sequence
  Description of Artificial Sequence: Synthetic oligonucleotide
aggccttggatttatccctgtacttgaaacatgaaactg

SEQ ID NO: 87089 - DNA, 38 bp, Artificial Sequence
  Description of Artificial Sequence: Synthetic oligonucleotide
ggccttggatttatccctgtacttgaaacatgaaactg

SEQ ID NO: 87090 - DNA, 45 bp, Artificial Sequence
  Description of Artificial Sequence: Synthetic oligonucleotide
gccttggatttatccctgtacttgaaacatgaaactgaaattatg

SEQ ID NO: 87091 - DNA, 45 bp, Artificial Sequence
  Description of Artificial Sequence: Synthetic oligonucleotide
ccttggatttatccctgtacttgaaacatgaaactgaaattatgc

SEQ ID NO: 87092 - DNA, 45 bp, Artificial Sequence
  Description of Artificial Sequence: Synthetic oligonucleotide
cttggatttatccctgtacttgaaacatgaaactgaaattatgcc

SEQ ID NO: 87093 - DNA, 45 bp, Artificial Sequence
  Description of Artificial Sequence: Synthetic oligonucleotide
ttggatttatccctgtacttgaaacatgaaactgaaattatgccc

SEQ ID NO: 87094 - DNA, 44 bp, Artificial Sequence
  Description of Artificial Sequence: Synthetic oligonucleotide
tggatttatccctgtacttgaaacatgaaactgaaattatgccc

SEQ ID NO: 87095 - DNA, 43 bp, Artificial Sequence
  Description of Artificial Sequence: Synthetic oligonucleotide
ggatttatccctgtacttgaaacatgaaactgaaattatgccc

SEQ ID NO: 87096 - DNA, 43 bp, Artificial Sequence
  Description of Artificial Sequence: Synthetic oligonucleotide
gatttatccctgtacttgaaacatgaaactgaaattatgcccg

SEQ ID NO: 87097 - DNA, 44 bp, Artificial Sequence
  Description of Artificial Sequence: Synthetic oligonucleotide
atttatccctgtacttgaaacatgaaactgaaattatgcccgtg

SEQ ID NO: 87098 - DNA, 43 bp, Artificial Sequence
  Description of Artificial Sequence: Synthetic oligonucleotide
tttatccctgtacttgaaacatgaaactgaaattatgcccgtg

SEQ ID NO: 87099 - DNA, 42 bp, Artificial Sequence
  Description of Artificial Sequence: Synthetic oligonucleotide
ttatccctgtacttgaaacatgaaactgaaattatgcccgtg

SEQ ID NO: 87100 - DNA, 41 bp, Artificial Sequence
  Description of Artificial Sequence: Synthetic oligonucleotide
tatccctgtacttgaaacatgaaactgaaattatgcccgtg

SEQ ID NO: 87101 - DNA, 40 bp, Artificial Sequence
  Description of Artificial Sequence: Synthetic oligonucleotide
atccctgtacttgaaacatgaaactgaaattatgcccgtg

SEQ ID NO: 87102 - DNA, 39 bp, Artificial Sequence
  Description of Artificial Sequence: Synthetic oligonucleotide
tccctgtacttgaaacatgaaactgaaattatgcccgtg

SEQ ID NO: 87103 - DNA, 38 bp, Artificial Sequence
  Description of Artificial Sequence: Synthetic oligonucleotide
ccctgtacttgaaacatgaaactgaaattatgcccgtg

SEQ ID NO: 87104 - DNA, 41 bp, Artificial Sequence
  Description of Artificial Sequence: Synthetic oligonucleotide
cctgtacttgaaacatgaaactgaaattatgcccgtgtttc

SEQ ID NO: 87105 - DNA, 43 bp, Artificial Sequence
  Description of Artificial Sequence: Synthetic oligonucleotide
ctgtacttgaaacatgaaactgaaattatgcccgtgtttcaag

SEQ ID NO: 87106 - DNA, 43 bp, Artificial Sequence
  Description of Artificial Sequence: Synthetic oligonucleotide
tgtacttgaaacatgaaactgaaattatgcccgtgtttcaagg

SEQ ID NO: 87107 - DNA, 42 bp, Artificial Sequence
  Description of Artificial Sequence: Synthetic oligonucleotide
gtacttgaaacatgaaactgaaattatgcccgtgtttcaagg

SEQ ID NO: 87108 - DNA, 45 bp, Artificial Sequence
  Description of Artificial Sequence: Synthetic oligonucleotide
tacttgaaacatgaaactgaaattatgcccgtgtttcaaggtttg

SEQ ID NO: 87109 - DNA, 44 bp, Artificial Sequence
  Description of Artificial Sequence: Synthetic oligonucleotide
acttgaaacatgaaactgaaattatgcccgtgtttcaaggtttg

SEQ ID NO: 87110 - DNA, 43 bp, Artificial Sequence
  Description of Artificial Sequence: Synthetic oligonucleotide
cttgaaacatgaaactgaaattatgcccgtgtttcaaggtttg

SEQ ID NO: 87111 - DNA, 46 bp, Artificial Sequence
  Description of Artificial Sequence: Synthetic oligonucleotide
ttgaaacatgaaactgaaattatgcccgtgtttcaaggtttgaatg

SEQ ID NO: 87112 - DNA, 45 bp, Artificial Sequence
  Description of Artificial Sequence: Synthetic oligonucleotide
tgaaacatgaaactgaaattatgcccgtgtttcaaggtttgaatg

SEQ ID NO: 87113 - DNA, 44 bp, Artificial Sequence
  Description of Artificial Sequence: Synthetic oligonucleotide
gaaacatgaaactgaaattatgcccgtgtttcaaggtttgaatg

SEQ ID NO: 87114 - DNA, 45 bp, Artificial Sequence
  Description of Artificial Sequence: Synthetic oligonucleotide
aaacatgaaactgaaattatgcccgtgtttcaaggtttgaatgag

SEQ ID NO: 87115 - DNA, 44 bp, Artificial Sequence
  Description of Artificial Sequence: Synthetic oligonucleotide
aacatgaaactgaaattatgcccgtgtttcaaggtttgaatgag

SEQ ID NO: 87116 - DNA, 43 bp, Artificial Sequence
  Description of Artificial Sequence: Synthetic oligonucleotide
acatgaaactgaaattatgcccgtgtttcaaggtttgaatgag

SEQ ID NO: 87117 - DNA, 42 bp, Artificial Sequence
  Description of Artificial Sequence: Synthetic oligonucleotide
catgaaactgaaattatgcccgtgtttcaaggtttgaatgag

SEQ ID NO: 87118 - DNA, 42 bp, Artificial Sequence
  Description of Artificial Sequence: Synthetic oligonucleotide
atgaaactgaaattatgcccgtgtttcaaggtttgaatgagc

SEQ ID NO: 87119 - DNA, 41 bp, Artificial Sequence
  Description of Artificial Sequence: Synthetic oligonucleotide
tgaaactgaaattatgcccgtgtttcaaggtttgaatgagc

SEQ ID NO: 87120 - DNA, 40 bp, Artificial Sequence
  Description of Artificial Sequence: Synthetic oligonucleotide
gaaactgaaattatgcccgtgtttcaaggtttgaatgagc

SEQ ID NO: 87121 - DNA, 41 bp, Artificial Sequence
  Description of Artificial Sequence: Synthetic oligonucleotide
aaactgaaattatgcccgtgtttcaaggtttgaatgagctg

SEQ ID NO: 87122 - DNA, 40 bp, Artificial Sequence
  Description of Artificial Sequence: Synthetic oligonucleotide
aactgaaattatgcccgtgtttcaaggtttgaatgagctg

SEQ ID NO: 87123 - DNA, 39 bp, Artificial Sequence
  Description of Artificial Sequence: Synthetic oligonucleotide
actgaaattatgcccgtgtttcaaggtttgaatgagctg

SEQ ID NO: 87124 - DNA, 38 bp, Artificial Sequence
  Description of Artificial Sequence: Synthetic oligonucleotide
ctgaaattatgcccgtgtttcaaggtttgaatgagctg

SEQ ID NO: 87125 - DNA, 41 bp, Artificial Sequence
  Description of Artificial Sequence: Synthetic oligonucleotide
tgaaattatgcccgtgtttcaaggtttgaatgagctgattc

SEQ ID NO: 87126 - DNA, 40 bp, Artificial Sequence
  Description of Artificial Sequence: Synthetic oligonucleotide
gaaattatgcccgtgtttcaaggtttgaatgagctgattc

SEQ ID NO: 87127 - DNA, 40 bp, Artificial Sequence
  Description of Artificial Sequence: Synthetic oligonucleotide
aaattatgcccgtgtttcaaggtttgaatgagctgattcc

SEQ ID NO: 87128 - DNA, 39 bp, Artificial Sequence
  Description of Artificial Sequence: Synthetic oligonucleotide
aattatgcccgtgtttcaaggtttgaatgagctgattcc

SEQ ID NO: 87129 - DNA, 38 bp, Artificial Sequence
  Description of Artificial Sequence: Synthetic oligonucleotide
attatgcccgtgtttcaaggtttgaatgagctgattcc

SEQ ID NO: 87130 - DNA, 37 bp, Artificial Sequence
  Description of Artificial Sequence: Synthetic oligonucleotide
ttatgcccgtgtttcaaggtttgaatgagctgattcc

SEQ ID NO: 87131 - DNA, 36 bp, Artificial Sequence
  Description of Artificial Sequence: Synthetic oligonucleotide
tatgcccgtgtttcaaggtttgaatgagctgattcc

SEQ ID NO: 87132 - DNA, 35 bp, Artificial Sequence
  Description of Artificial Sequence: Synthetic oligonucleotide
atgcccgtgtttcaaggtttgaatgagctgattcc

SEQ ID NO: 87133 - DNA, 34 bp, Artificial Sequence
  Description of Artificial Sequence: Synthetic oligonucleotide
tgcccgtgtttcaaggtttgaatgagctgattcc

SEQ ID NO: 87134 - DNA, 33 bp, Artificial Sequence
  Description of Artificial Sequence: Synthetic oligonucleotide
gcccgtgtttcaaggtttgaatgagctgattcc

SEQ ID NO: 87135 - DNA, 36 bp, Artificial Sequence
  Description of Artificial Sequence: Synthetic oligonucleotide
cccgtgtttcaaggtttgaatgagctgattcctatg

SEQ ID NO: 87136 - DNA, 41 bp, Artificial Sequence
  Description of Artificial Sequence: Synthetic oligonucleotide
ccgtgtttcaaggtttgaatgagctgattcctatgtataag

SEQ ID NO: 87137 - DNA, 46 bp, Artificial Sequence
  Description of Artificial Sequence: Synthetic oligonucleotide
cgtgtttcaaggtttgaatgagctgattcctatgtataagttaatg

SEQ ID NO: 87138 - DNA, 46 bp, Artificial Sequence
  Description of Artificial Sequence: Synthetic oligonucleotide
gtgtttcaaggtttgaatgagctgattcctatgtataagttaatgg

SEQ ID NO: 87139 - DNA, 47 bp, Artificial Sequence
  Description of Artificial Sequence: Synthetic oligonucleotide
tgtttcaaggtttgaatgagctgattcctatgtataagttaatggag

SEQ ID NO: 87140 - DNA, 46 bp, Artificial Sequence
  Description of Artificial Sequence: Synthetic oligonucleotide
gtttcaaggtttgaatgagctgattcctatgtataagttaatggag

SEQ ID NO: 87141 - DNA, 50 bp, Artificial Sequence
  Description of Artificial Sequence: Synthetic oligonucleotide
tttcaaggtttgaatgagctgattcctatgtataagttaatggagaaaag

SEQ ID NO: 87142 - DNA, 49 bp, Artificial Sequence
  Description of Artificial Sequence: Synthetic oligonucleotide
ttcaaggtttgaatgagctgattcctatgtataagttaatggagaaaag

SEQ ID NO: 87143 - DNA, 48 bp, Artificial Sequence
  Description of Artificial Sequence: Synthetic oligonucleotide
tcaaggtttgaatgagctgattcctatgtataagttaatggagaaaag

SEQ ID NO: 87144 - DNA, 47 bp, Artificial Sequence
  Description of Artificial Sequence: Synthetic oligonucleotide
caaggtttgaatgagctgattcctatgtataagttaatggagaaaag

SEQ ID NO: 87145 - DNA, 48 bp, Artificial Sequence
  Description of Artificial Sequence: Synthetic oligonucleotide
aaggtttgaatgagctgattcctatgtataagttaatggagaaaagag

SEQ ID NO: 87146 - DNA, 47 bp, Artificial Sequence
  Description of Artificial Sequence: Synthetic oligonucleotide
aggtttgaatgagctgattcctatgtataagttaatggagaaaagag

SEQ ID NO: 87147 - DNA, 46 bp, Artificial Sequence
  Description of Artificial Sequence: Synthetic oligonucleotide
ggtttgaatgagctgattcctatgtataagttaatggagaaaagag

SEQ ID NO: 87148 - DNA, 50 bp, Artificial Sequence
  Description of Artificial Sequence: Synthetic oligonucleotide
gtttgaatgagctgattcctatgtataagttaatggagaaaagagatatg

SEQ ID NO: 87149 - DNA, 53 bp, Artificial Sequence
  Description of Artificial Sequence: Synthetic oligonucleotide
tttgaatgagctgattcctatgtataagttaatggagaaaagagatatgaatg

SEQ ID NO: 87150 - DNA, 52 bp, Artificial Sequence
  Description of Artificial Sequence: Synthetic oligonucleotide
ttgaatgagctgattcctatgtataagttaatggagaaaagagatatgaatg

SEQ ID NO: 87151 - DNA, 51 bp, Artificial Sequence
  Description of Artificial Sequence: Synthetic oligonucleotide
tgaatgagctgattcctatgtataagttaatggagaaaagagatatgaatg

SEQ ID NO: 87152 - DNA, 50 bp, Artificial Sequence
  Description of Artificial Sequence: Synthetic oligonucleotide
gaatgagctgattcctatgtataagttaatggagaaaagagatatgaatg

SEQ ID NO: 87153 - DNA, 52 bp, Artificial Sequence
  Description of Artificial Sequence: Synthetic oligonucleotide
aatgagctgattcctatgtataagttaatggagaaaagagatatgaatgaag

SEQ ID NO: 87154 - DNA, 51 bp, Artificial Sequence
  Description of Artificial Sequence: Synthetic oligonucleotide
atgagctgattcctatgtataagttaatggagaaaagagatatgaatgaag

SEQ ID NO: 87155 - DNA, 50 bp, Artificial Sequence
  Description of Artificial Sequence: Synthetic oligonucleotide
tgagctgattcctatgtataagttaatggagaaaagagatatgaatgaag

SEQ ID NO: 87156 - DNA, 49 bp, Artificial Sequence
  Description of Artificial Sequence: Synthetic oligonucleotide
gagctgattcctatgtataagttaatggagaaaagagatatgaatgaag

SEQ ID NO: 87157 - DNA, 50 bp, Artificial Sequence
  Description of Artificial Sequence: Synthetic oligonucleotide
agctgattcctatgtataagttaatggagaaaagagatatgaatgaagtg

SEQ ID NO: 87158 - DNA, 49 bp, Artificial Sequence
  Description of Artificial Sequence: Synthetic oligonucleotide
gctgattcctatgtataagttaatggagaaaagagatatgaatgaagtg

SEQ ID NO: 87159 - DNA, 49 bp, Artificial Sequence
  Description of Artificial Sequence: Synthetic oligonucleotide
ctgattcctatgtataagttaatggagaaaagagatatgaatgaagtgg

SEQ ID NO: 87160 - DNA, 52 bp, Artificial Sequence
  Description of Artificial Sequence: Synthetic oligonucleotide
tgattcctatgtataagttaatggagaaaagagatatgaatgaagtggaaac

SEQ ID NO: 87161 - DNA, 51 bp, Artificial Sequence
  Description of Artificial Sequence: Synthetic oligonucleotide
gattcctatgtataagttaatggagaaaagagatatgaatgaagtggaaac

SEQ ID NO: 87162 - DNA, 52 bp, Artificial Sequence
  Description of Artificial Sequence: Synthetic oligonucleotide
attcctatgtataagttaatggagaaaagagatatgaatgaagtggaaactc

SEQ ID NO: 87163 - DNA, 51 bp, Artificial Sequence
  Description of Artificial Sequence: Synthetic oligonucleotide
ttcctatgtataagttaatggagaaaagagatatgaatgaagtggaaactc

SEQ ID NO: 87164 - DNA, 50 bp, Artificial Sequence
  Description of Artificial Sequence: Synthetic oligonucleotide
tcctatgtataagttaatggagaaaagagatatgaatgaagtggaaactc

SEQ ID NO: 87165 - DNA, 49 bp, Artificial Sequence
  Description of Artificial Sequence: Synthetic oligonucleotide
cctatgtataagttaatggagaaaagagatatgaatgaagtggaaactc

SEQ ID NO: 87166 - DNA, 53 bp, Artificial Sequence
  Description of Artificial Sequence: Synthetic oligonucleotide
ctatgtataagttaatggagaaaagagatatgaatgaagtggaaactcaattc

SEQ ID NO: 87167 - DNA, 55 bp, Artificial Sequence
  Description of Artificial Sequence: Synthetic oligonucleotide
tatgtataagttaatggagaaaagagatatgaatgaagtggaaactcaattcaag

SEQ ID NO: 87168 - DNA, 54 bp, Artificial Sequence
  Description of Artificial Sequence: Synthetic oligonucleotide
atgtataagttaatggagaaaagagatatgaatgaagtggaaactcaattcaag

SEQ ID NO: 87169 - DNA, 53 bp, Artificial Sequence
  Description of Artificial Sequence: Synthetic oligonucleotide
tgtataagttaatggagaaaagagatatgaatgaagtggaaactcaattcaag

SEQ ID NO: 87170 - DNA, 52 bp, Artificial Sequence
  Description of Artificial Sequence: Synthetic oligonucleotide
gtataagttaatggagaaaagagatatgaatgaagtggaaactcaattcaag

SEQ ID NO: 87171 - DNA, 52 bp, Artificial Sequence
  Description of Artificial Sequence: Synthetic oligonucleotide
tataagttaatggagaaaagagatatgaatgaagtggaaactcaattcaagg

SEQ ID NO: 87172 - DNA, 51 bp, Artificial Sequence
  Description of Artificial Sequence: Synthetic oligonucleotide
ataagttaatggagaaaagagatatgaatgaagtggaaactcaattcaagg

SEQ ID NO: 87173 - DNA, 50 bp, Artificial Sequence
  Description of Artificial Sequence: Synthetic oligonucleotide
taagttaatggagaaaagagatatgaatgaagtggaaactcaattcaagg

SEQ ID NO: 87174 - DNA, 49 bp, Artificial Sequence
  Description of Artificial Sequence: Synthetic oligonucleotide
aagttaatggagaaaagagatatgaatgaagtggaaactcaattcaagg

SEQ ID NO: 87175 - DNA, 48 bp, Artificial Sequence
  Description of Artificial Sequence: Synthetic oligonucleotide
agttaatggagaaaagagatatgaatgaagtggaaactcaattcaagg

SEQ ID NO: 87176 - DNA, 47 bp, Artificial Sequence
  Description of Artificial Sequence: Synthetic oligonucleotide
gttaatggagaaaagagatatgaatgaagtggaaactcaattcaagg

SEQ ID NO: 87177 - DNA, 47 bp, Artificial Sequence
  Description of Artificial Sequence: Synthetic oligonucleotide
ttaatggagaaaagagatatgaatgaagtggaaactcaattcaaggc

SEQ ID NO: 87178 - DNA, 46 bp, Artificial Sequence
  Description of Artificial Sequence: Synthetic oligonucleotide
taatggagaaaagagatatgaatgaagtggaaactcaattcaaggc

SEQ ID NO: 87179 - DNA, 45 bp, Artificial Sequence
  Description of Artificial Sequence: Synthetic oligonucleotide
aatggagaaaagagatatgaatgaagtggaaactcaattcaaggc

SEQ ID NO: 87180 - DNA, 44 bp, Artificial Sequence
  Description of Artificial Sequence: Synthetic oligonucleotide
atggagaaaagagatatgaatgaagtggaaactcaattcaaggc

SEQ ID NO: 87181 - DNA, 43 bp, Artificial Sequence
  Description of Artificial Sequence: Synthetic oligonucleotide
tggagaaaagagatatgaatgaagtggaaactcaattcaaggc

SEQ ID NO: 87182 - DNA, 42 bp, Artificial Sequence
  Description of Artificial Sequence: Synthetic oligonucleotide
ggagaaaagagatatgaatgaagtggaaactcaattcaaggc

SEQ ID NO: 87183 - DNA, 42 bp, Artificial Sequence
  Description of Artificial Sequence: Synthetic oligonucleotide
gagaaaagagatatgaatgaagtggaaactcaattcaaggcc

SEQ ID NO: 87184 - DNA, 44 bp, Artificial Sequence
  Description of Artificial Sequence: Synthetic oligonucleotide
agaaaagagatatgaatgaagtggaaactcaattcaaggccttc

SEQ ID NO: 87185 - DNA, 43 bp, Artificial Sequence
  Description of Artificial Sequence: Synthetic oligonucleotide
gaaaagagatatgaatgaagtggaaactcaattcaaggccttc

SEQ ID NO: 87186 - DNA, 43 bp, Artificial Sequence
  Description of Artificial Sequence: Synthetic oligonucleotide
aaaagagatatgaatgaagtggaaactcaattcaaggccttcc

SEQ ID NO: 87187 - DNA, 42 bp, Artificial Sequence
  Description of Artificial Sequence: Synthetic oligonucleotide
aaagagatatgaatgaagtggaaactcaattcaaggccttcc

SEQ ID NO: 87188 - DNA, 41 bp, Artificial Sequence
  Description of Artificial Sequence: Synthetic oligonucleotide
aagagatatgaatgaagtggaaactcaattcaaggccttcc

SEQ ID NO: 87189 - DNA, 40 bp, Artificial Sequence
  Description of Artificial Sequence: Synthetic oligonucleotide
agagatatgaatgaagtggaaactcaattcaaggccttcc

SEQ ID NO: 87190 - DNA, 39 bp, Artificial Sequence
  Description of Artificial Sequence: Synthetic oligonucleotide
gagatatgaatgaagtggaaactcaattcaaggccttcc

SEQ ID NO: 87191 - DNA, 40 bp, Artificial Sequence
  Description of Artificial Sequence: Synthetic oligonucleotide
agatatgaatgaagtggaaactcaattcaaggccttcctc

SEQ ID NO: 87192 - DNA, 39 bp, Artificial Sequence
  Description of Artificial Sequence: Synthetic oligonucleotide
gatatgaatgaagtggaaactcaattcaaggccttcctc

SEQ ID NO: 87193 - DNA, 41 bp, Artificial Sequence
  Description of Artificial Sequence: Synthetic oligonucleotide
atatgaatgaagtggaaactcaattcaaggccttcctcatc

SEQ ID NO: 87194 - DNA, 40 bp, Artificial Sequence
  Description of Artificial Sequence: Synthetic oligonucleotide
tatgaatgaagtggaaactcaattcaaggccttcctcatc

SEQ ID NO: 87195 - DNA, 39 bp, Artificial Sequence
  Description of Artificial Sequence: Synthetic oligonucleotide
atgaatgaagtggaaactcaattcaaggccttcctcatc

SEQ ID NO: 87196 - DNA, 38 bp, Artificial Sequence
  Description of Artificial Sequence: Synthetic oligonucleotide
tgaatgaagtggaaactcaattcaaggccttcctcatc

SEQ ID NO: 87197 - DNA, 37 bp, Artificial Sequence
  Description of Artificial Sequence: Synthetic oligonucleotide
gaatgaagtggaaactcaattcaaggccttcctcatc

SEQ ID NO: 87198 - DNA, 38 bp, Artificial Sequence
  Description of Artificial Sequence: Synthetic oligonucleotide
aatgaagtggaaactcaattcaaggccttcctcatcag

SEQ ID NO: 87199 - DNA, 37 bp, Artificial Sequence
  Description of Artificial Sequence: Synthetic oligonucleotide
atgaagtggaaactcaattcaaggccttcctcatcag

SEQ ID NO: 87200 - DNA, 36 bp, Artificial Sequence
  Description of Artificial Sequence: Synthetic oligonucleotide
tgaagtggaaactcaattcaaggccttcctcatcag

SEQ ID NO: 87201 - DNA, 35 bp, Artificial Sequence
  Description of Artificial Sequence: Synthetic oligonucleotide
gaagtggaaactcaattcaaggccttcctcatcag

SEQ ID NO: 87202 - DNA, 35 bp, Artificial Sequence
  Description of Artificial Sequence: Synthetic oligonucleotide
aagtggaaactcaattcaaggccttcctcatcagg

SEQ ID NO: 87203 - DNA, 34 bp, Artificial Sequence
  Description of Artificial Sequence: Synthetic oligonucleotide
agtggaaactcaattcaaggccttcctcatcagg

SEQ ID NO: 87204 - DNA, 33 bp, Artificial Sequence
  Description of Artificial Sequence: Synthetic oligonucleotide
gtggaaactcaattcaaggccttcctcatcagg

SEQ ID NO: 87205 - DNA, 33 bp, Artificial Sequence
  Description of Artificial Sequence: Synthetic oligonucleotide
tggaaactcaattcaaggccttcctcatcaggc

SEQ ID NO: 87206 - DNA, 32 bp, Artificial Sequence
  Description of Artificial Sequence: Synthetic oligonucleotide
ggaaactcaattcaaggccttcctcatcaggc

SEQ ID NO: 87207 - DNA, 33 bp, Artificial Sequence
  Description of Artificial Sequence: Synthetic oligonucleotide
gaaactcaattcaaggccttcctcatcaggctg

SEQ ID NO: 87208 - DNA, 33 bp, Artificial Sequence
  Description of Artificial Sequence: Synthetic oligonucleotide
aaactcaattcaaggccttcctcatcaggctgc

SEQ ID NO: 87209 - DNA, 32 bp, Artificial Sequence
  Description of Artificial Sequence: Synthetic oligonucleotide
aactcaattcaaggccttcctcatcaggctgc

SEQ ID NO: 87210 - DNA, 31 bp, Artificial Sequence
  Description of Artificial Sequence: Synthetic oligonucleotide
actcaattcaaggccttcctcatcaggctgc

SEQ ID NO: 87211 - DNA, 30 bp, Artificial Sequence
  Description of Artificial Sequence: Synthetic oligonucleotide
ctcaattcaaggccttcctcatcaggctgc

SEQ ID NO: 87212 - DNA, 33 bp, Artificial Sequence
  Description of Artificial Sequence: Synthetic oligonucleotide
tcaattcaaggccttcctcatcaggctgctaag

SEQ ID NO: 87213 - DNA, 32 bp, Artificial Sequence
  Description of Artificial Sequence: Synthetic oligonucleotide
caattcaaggccttcctcatcaggctgctaag

SEQ ID NO: 87214 - DNA, 32 bp, Artificial Sequence
  Description of Artificial Sequence: Synthetic oligonucleotide
aattcaaggccttcctcatcaggctgctaagg

SEQ ID NO: 87215 - DNA, 31 bp, Artificial Sequence
  Description of Artificial Sequence: Synthetic oligonucleotide
attcaaggccttcctcatcaggctgctaagg

SEQ ID NO: 87216 - DNA, 30 bp, Artificial Sequence
  Description of Artificial Sequence: Synthetic oligonucleotide
ttcaaggccttcctcatcaggctgctaagg

SEQ ID NO: 87217 - DNA, 29 bp, Artificial Sequence
  Description of Artificial Sequence: Synthetic oligonucleotide
tcaaggccttcctcatcaggctgctaagg

SEQ ID NO: 87218 - DNA, 28 bp, Artificial Sequence
  Description of Artificial Sequence: Synthetic oligonucleotide
caaggccttcctcatcaggctgctaagg

SEQ ID NO: 87219 - DNA, 28 bp, Artificial Sequence
  Description of Artificial Sequence: Synthetic oligonucleotide
aaggccttcctcatcaggctgctaaggg

SEQ ID NO: 87220 - DNA, 27 bp, Artificial Sequence
  Description of Artificial Sequence: Synthetic oligonucleotide
aggccttcctcatcaggctgctaaggg

SEQ ID NO: 87221 - DNA, 27 bp, Artificial Sequence
  Description of Artificial Sequence: Synthetic oligonucleotide
ggccttcctcatcaggctgctaaggga

SEQ ID NO: 87222 - DNA, 27 bp, Artificial Sequence
  Description of Artificial Sequence: Synthetic oligonucleotide
gccttcctcatcaggctgctaagggac

SEQ ID NO: 87223 - DNA, 27 bp, Artificial Sequence
  Description of Artificial Sequence: Synthetic oligonucleotide
ccttcctcatcaggctgctaagggacc

SEQ ID NO: 87224 - DNA, 28 bp, Artificial Sequence
  Description of Artificial Sequence: Synthetic oligonucleotide
cttcctcatcaggctgctaagggacctc

SEQ ID NO: 87225 - DNA, 31 bp, Artificial Sequence
  Description of Artificial Sequence: Synthetic oligonucleotide
ttcctcatcaggctgctaagggacctcattg

SEQ ID NO: 87226 - DNA, 30 bp, Artificial Sequence
  Description of Artificial Sequence: Synthetic oligonucleotide
tcctcatcaggctgctaagggacctcattg

SEQ ID NO: 87227 - DNA, 29 bp, Artificial Sequence
  Description of Artificial Sequence: Synthetic oligonucleotide
cctcatcaggctgctaagggacctcattg

SEQ ID NO: 87228 - DNA, 33 bp, Artificial Sequence
  Description of Artificial Sequence: Synthetic oligonucleotide
ctcatcaggctgctaagggacctcattgataag

SEQ ID NO: 87229 - DNA, 33 bp, Artificial Sequence
  Description of Artificial Sequence: Synthetic oligonucleotide
tcatcaggctgctaagggacctcattgataagc

SEQ ID NO: 87230 - DNA, 32 bp, Artificial Sequence
  Description of Artificial Sequence: Synthetic oligonucleotide
catcaggctgctaagggacctcattgataagc

SEQ ID NO: 87231 - DNA, 33 bp, Artificial Sequence
  Description of Artificial Sequence: Synthetic oligonucleotide
atcaggctgctaagggacctcattgataagcag

SEQ ID NO: 87232 - DNA, 32 bp, Artificial Sequence
  Description of Artificial Sequence: Synthetic oligonucleotide
tcaggctgctaagggacctcattgataagcag

SEQ ID NO: 87233 - DNA, 31 bp, Artificial Sequence
  Description of Artificial Sequence: Synthetic oligonucleotide
caggctgctaagggacctcattgataagcag

SEQ ID NO: 87234 - DNA, 32 bp, Artificial Sequence
  Description of Artificial Sequence: Synthetic oligonucleotide
aggctgctaagggacctcattgataagcagac

SEQ ID NO: 87235 - DNA, 31 bp, Artificial Sequence
  Description of Artificial Sequence: Synthetic oligonucleotide
ggctgctaagggacctcattgataagcagac

SEQ ID NO: 87236 - DNA, 33 bp, Artificial Sequence
  Description of Artificial Sequence: Synthetic oligonucleotide
gctgctaagggacctcattgataagcagacatg

SEQ ID NO: 87237 - DNA, 33 bp, Artificial Sequence
  Description of Artificial Sequence: Synthetic oligonucleotide
ctgctaagggacctcattgataagcagacatgg

SEQ ID NO: 87238 - DNA, 34 bp, Artificial Sequence
  Description of Artificial Sequence: Synthetic oligonucleotide
tgctaagggacctcattgataagcagacatggac

SEQ ID NO: 87239 - DNA, 33 bp, Artificial Sequence
  Description of Artificial Sequence: Synthetic oligonucleotide
gctaagggacctcattgataagcagacatggac

SEQ ID NO: 87240 - DNA, 34 bp, Artificial Sequence
  Description of Artificial Sequence: Synthetic oligonucleotide
ctaagggacctcattgataagcagacatggacag

SEQ ID NO: 87241 - DNA, 35 bp, Artificial Sequence
  Description of Artificial Sequence: Synthetic oligonucleotide
taagggacctcattgataagcagacatggacagac

SEQ ID NO: 87242 - DNA, 34 bp, Artificial Sequence
  Description of Artificial Sequence: Synthetic oligonucleotide
aagggacctcattgataagcagacatggacagac

SEQ ID NO: 87243 - DNA, 33 bp, Artificial Sequence
  Description of Artificial Sequence: Synthetic oligonucleotide
agggacctcattgataagcagacatggacagac

SEQ ID NO: 87244 - DNA, 32 bp, Artificial Sequence
  Description of Artificial Sequence: Synthetic oligonucleotide
gggacctcattgataagcagacatggacagac

SEQ ID NO: 87245 - DNA, 32 bp, Artificial Sequence
  Description of Artificial Sequence: Synthetic oligonucleotide
ggacctcattgataagcagacatggacagacg

SEQ ID NO: 87246 - DNA, 33 bp, Artificial Sequence
  Description of Artificial Sequence: Synthetic oligonucleotide
gacctcattgataagcagacatggacagacgag

SEQ ID NO: 87247 - DNA, 33 bp, Artificial Sequence
  Description of Artificial Sequence: Synthetic oligonucleotide
acctcattgataagcagacatggacagacgagg

SEQ ID NO: 87248 - DNA, 32 bp, Artificial Sequence
  Description of Artificial Sequence: Synthetic oligonucleotide
cctcattgataagcagacatggacagacgagg

SEQ ID NO: 87249 - DNA, 32 bp, Artificial Sequence
  Description of Artificial Sequence: Synthetic oligonucleotide
ctcattgataagcagacatggacagacgaggg

SEQ ID NO: 87250 - DNA, 32 bp, Artificial Sequence
  Description of Artificial Sequence: Synthetic oligonucleotide
tcattgataagcagacatggacagacgagggc

SEQ ID NO: 87251 - DNA, 31 bp, Artificial Sequence
  Description of Artificial Sequence: Synthetic oligonucleotide
cattgataagcagacatggacagacgagggc

SEQ ID NO: 87252 - DNA, 32 bp, Artificial Sequence
  Description of Artificial Sequence: Synthetic oligonucleotide
attgataagcagacatggacagacgagggctc

SEQ ID NO: 87253 - DNA, 31 bp, Artificial Sequence
  Description of Artificial Sequence: Synthetic oligonucleotide
ttgataagcagacatggacagacgagggctc

SEQ ID NO: 87254 - DNA, 30 bp, Artificial Sequence
  Description of Artificial Sequence: Synthetic oligonucleotide
tgataagcagacatggacagacgagggctc

SEQ ID NO: 87255 - DNA, 29 bp, Artificial Sequence
  Description of Artificial Sequence: Synthetic oligonucleotide
gataagcagacatggacagacgagggctc

SEQ ID NO: 87256 - DNA, 30 bp, Artificial Sequence
  Description of Artificial Sequence: Synthetic oligonucleotide
ataagcagacatggacagacgagggctcag

SEQ ID NO: 87257 - DNA, 29 bp, Artificial Sequence
  Description of Artificial Sequence: Synthetic oligonucleotide
taagcagacatggacagacgagggctcag

SEQ ID NO: 87258 - DNA, 28 bp, Artificial Sequence
  Description of Artificial Sequence: Synthetic oligonucleotide
aagcagacatggacagacgagggctcag

SEQ ID NO: 87259 - DNA, 27 bp, Artificial Sequence
  Description of Artificial Sequence: Synthetic oligonucleotide
agcagacatggacagacgagggctcag

SEQ ID NO: 87260 - DNA, 27 bp, Artificial Sequence
  Description of Artificial Sequence: Synthetic oligonucleotide
gcagacatggacagacgagggctcagt

SEQ ID NO: 87261 - DNA, 27 bp, Artificial Sequence
  Description of Artificial Sequence: Synthetic oligonucleotide
cagacatggacagacgagggctcagtc

SEQ ID NO: 87262 - DNA, 28 bp, Artificial Sequence
  Description of Artificial Sequence: Synthetic oligonucleotide
agacatggacagacgagggctcagtctc

SEQ ID NO: 87263 - DNA, 27 bp, Artificial Sequence
  Description of Artificial Sequence: Synthetic oligonucleotide
gacatggacagacgagggctcagtctc

SEQ ID NO: 87264 - DNA, 28 bp, Artificial Sequence
  Description of Artificial Sequence: Synthetic oligonucleotide
acatggacagacgagggctcagtctcag

SEQ ID NO: 87265 - DNA, 27 bp, Artificial Sequence
  Description of Artificial Sequence: Synthetic oligonucleotide
catggacagacgagggctcagtctcag

SEQ ID NO: 87266 - DNA, 28 bp, Artificial Sequence
  Description of Artificial Sequence: Synthetic oligonucleotide
atggacagacgagggctcagtctcagag

SEQ ID NO: 87267 - DNA, 27 bp, Artificial Sequence
  Description of Artificial Sequence: Synthetic oligonucleotide
tggacagacgagggctcagtctcagag

SEQ ID NO: 87268 - DNA, 26 bp, Artificial Sequence
  Description of Artificial Sequence: Synthetic oligonucleotide
ggacagacgagggctcagtctcagag

SEQ ID NO: 87269 - DNA, 26 bp, Artificial Sequence
  Description of Artificial Sequence: Synthetic oligonucleotide
gacagacgagggctcagtctcagagc

SEQ ID NO: 87270 - DNA, 27 bp, Artificial Sequence
  Description of Artificial Sequence: Synthetic oligonucleotide
acagacgagggctcagtctcagagcga

SEQ ID NO: 87271 - DNA, 27 bp, Artificial Sequence
  Description of Artificial Sequence: Synthetic oligonucleotide
cagacgagggctcagtctcagagcgaa

SEQ ID NO: 87272 - DNA, 28 bp, Artificial Sequence
  Description of Artificial Sequence: Synthetic oligonucleotide
agacgagggctcagtctcagagcgaatg

SEQ ID NO: 87273 - DNA, 27 bp, Artificial Sequence
  Description of Artificial Sequence: Synthetic oligonucleotide
gacgagggctcagtctcagagcgaatg

SEQ ID NO: 87274 - DNA, 27 bp, Artificial Sequence
  Description of Artificial Sequence: Synthetic oligonucleotide
acgagggctcagtctcagagcgaatgc

SEQ ID NO: 87275 - DNA, 27 bp, Artificial Sequence
  Description of Artificial Sequence: Synthetic oligonucleotide
cgagggctcagtctcagagcgaatgct

SEQ ID NO: 87276 - DNA, 27 bp, Artificial Sequence
  Description of Artificial Sequence: Synthetic oligonucleotide
gagggctcagtctcagagcgaatgctg

SEQ ID NO: 87277 - DNA, 27 bp, Artificial Sequence
  Description of Artificial Sequence: Synthetic oligonucleotide
agggctcagtctcagagcgaatgctgc

SEQ ID NO: 87278 - DNA, 26 bp, Artificial Sequence
  Description of Artificial Sequence: Synthetic oligonucleotide
gggctcagtctcagagcgaatgctgc

SEQ ID NO: 87279 - DNA, 26 bp, Artificial Sequence
  Description of Artificial Sequence: Synthetic oligonucleotide
ggctcagtctcagagcgaatgctgcg

SEQ ID NO: 87280 - DNA, 27 bp, Artificial Sequence
  Description of Artificial Sequence: Synthetic oligonucleotide
gctcagtctcagagcgaatgctgcgga

SEQ ID NO: 87281 - DNA, 27 bp, Artificial Sequence
  Description of Artificial Sequence: Synthetic oligonucleotide
ctcagtctcagagcgaatgctgcggag

SEQ ID NO: 87282 - DNA, 28 bp, Artificial Sequence
  Description of Artificial Sequence: Synthetic oligonucleotide
tcagtctcagagcgaatgctgcggagtc

SEQ ID NO: 87283 - DNA, 27 bp, Artificial Sequence
  Description of Artificial Sequence: Synthetic oligonucleotide
cagtctcagagcgaatgctgcggagtc

SEQ ID NO: 87284 - DNA, 29 bp, Artificial Sequence
  Description of Artificial Sequence: Synthetic oligonucleotide
agtctcagagcgaatgctgcggagtcaac

SEQ ID NO: 87285 - DNA, 28 bp, Artificial Sequence
  Description of Artificial Sequence: Synthetic oligonucleotide
gtctcagagcgaatgctgcggagtcaac

SEQ ID NO: 87286 - DNA, 30 bp, Artificial Sequence
  Description of Artificial Sequence: Synthetic oligonucleotide
tctcagagcgaatgctgcggagtcaactac

SEQ ID NO: 87287 - DNA, 29 bp, Artificial Sequence
  Description of Artificial Sequence: Synthetic oligonucleotide
ctcagagcgaatgctgcggagtcaactac

SEQ ID NO: 87288 - DNA, 31 bp, Artificial Sequence
  Description of Artificial Sequence: Synthetic oligonucleotide
tcagagcgaatgctgcggagtcaactactac

SEQ ID NO: 87289 - DNA, 30 bp, Artificial Sequence
  Description of Artificial Sequence: Synthetic oligonucleotide
cagagcgaatgctgcggagtcaactactac

SEQ ID NO: 87290 - DNA, 31 bp, Artificial Sequence
  Description of Artificial Sequence: Synthetic oligonucleotide
agagcgaatgctgcggagtcaactactactc

SEQ ID NO: 87291 - DNA, 30 bp, Artificial Sequence
  Description of Artificial Sequence: Synthetic oligonucleotide
gagcgaatgctgcggagtcaactactactc

SEQ ID NO: 87292 - DNA, 30 bp, Artificial Sequence
  Description of Artificial Sequence: Synthetic oligonucleotide
agcgaatgctgcggagtcaactactactcc

SEQ ID NO: 87293 - DNA, 29 bp, Artificial Sequence
  Description of Artificial Sequence: Synthetic oligonucleotide
gcgaatgctgcggagtcaactactactcc

SEQ ID NO: 87294 - DNA, 30 bp, Artificial Sequence
  Description of Artificial Sequence: Synthetic oligonucleotide
cgaatgctgcggagtcaactactactcctc

SEQ ID NO: 87295 - DNA, 30 bp, Artificial Sequence
  Description of Artificial Sequence: Synthetic oligonucleotide
gaatgctgcggagtcaactactactcctcg

SEQ ID NO: 87296 - DNA, 30 bp, Artificial Sequence
  Description of Artificial Sequence: Synthetic oligonucleotide
aatgctgcggagtcaactactactcctcgc

SEQ ID NO: 87297 - DNA, 29 bp, Artificial Sequence
  Description of Artificial Sequence: Synthetic oligonucleotide
atgctgcggagtcaactactactcctcgc

SEQ ID NO: 87298 - DNA, 28 bp, Artificial Sequence
  Description of Artificial Sequence: Synthetic oligonucleotide
tgctgcggagtcaactactactcctcgc

SEQ ID NO: 87299 - DNA, 27 bp, Artificial Sequence
  Description of Artificial Sequence: Synthetic oligonucleotide
gctgcggagtcaactactactcctcgc

SEQ ID NO: 87300 - DNA, 27 bp, Artificial Sequence
  Description of Artificial Sequence: Synthetic oligonucleotide
ctgcggagtcaactactactcctcgcc

SEQ ID NO: 87301 - DNA, 28 bp, Artificial Sequence
  Description of Artificial Sequence: Synthetic oligonucleotide
tgcggagtcaactactactcctcgcctg

SEQ ID NO: 87302 - DNA, 27 bp, Artificial Sequence
  Description of Artificial Sequence: Synthetic oligonucleotide
gcggagtcaactactactcctcgcctg

SEQ ID NO: 87303 - DNA, 28 bp, Artificial Sequence
  Description of Artificial Sequence: Synthetic oligonucleotide
cggagtcaactactactcctcgcctgtg

SEQ ID NO: 87304 - DNA, 29 bp, Artificial Sequence
  Description of Artificial Sequence: Synthetic oligonucleotide
ggagtcaactactactcctcgcctgtgtg

SEQ ID NO: 87305 - DNA, 29 bp, Artificial Sequence
  Description of Artificial Sequence: Synthetic oligonucleotide
gagtcaactactactcctcgcctgtgtgc

SEQ ID NO: 87306 - DNA, 30 bp, Artificial Sequence
  Description of Artificial Sequence: Synthetic oligonucleotide
agtcaactactactcctcgcctgtgtgcac

SEQ ID NO: 87307 - DNA, 29 bp, Artificial Sequence
  Description of Artificial Sequence: Synthetic oligonucleotide
gtcaactactactcctcgcctgtgtgcac

SEQ ID NO: 87308 - DNA, 31 bp, Artificial Sequence
  Description of Artificial Sequence: Synthetic oligonucleotide
tcaactactactcctcgcctgtgtgcacaac

SEQ ID NO: 87309 - DNA, 30 bp, Artificial Sequence
  Description of Artificial Sequence: Synthetic oligonucleotide
caactactactcctcgcctgtgtgcacaac

SEQ ID NO: 87310 - DNA, 33 bp, Artificial Sequence
  Description of Artificial Sequence: Synthetic oligonucleotide
aactactactcctcgcctgtgtgcacaactatc

SEQ ID NO: 87311 - DNA, 32 bp, Artificial Sequence
  Description of Artificial Sequence: Synthetic oligonucleotide
actactactcctcgcctgtgtgcacaactatc

SEQ ID NO: 87312 - DNA, 31 bp, Artificial Sequence
  Description of Artificial Sequence: Synthetic oligonucleotide
ctactactcctcgcctgtgtgcacaactatc

SEQ ID NO: 87313 - DNA, 32 bp, Artificial Sequence
  Description of Artificial Sequence: Synthetic oligonucleotide
tactactcctcgcctgtgtgcacaactatcag

SEQ ID NO: 87314 - DNA, 31 bp, Artificial Sequence
  Description of Artificial Sequence: Synthetic oligonucleotide
actactcctcgcctgtgtgcacaactatcag

SEQ ID NO: 87315 - DNA, 30 bp, Artificial Sequence
  Description of Artificial Sequence: Synthetic oligonucleotide
ctactcctcgcctgtgtgcacaactatcag

SEQ ID NO: 87316 - DNA, 30 bp, Artificial Sequence
  Description of Artificial Sequence: Synthetic oligonucleotide
tactcctcgcctgtgtgcacaactatcagc

SEQ ID NO: 87317 - DNA, 29 bp, Artificial Sequence
  Description of Artificial Sequence: Synthetic oligonucleotide
actcctcgcctgtgtgcacaactatcagc

SEQ ID NO: 87318 - DNA, 28 bp, Artificial Sequence
  Description of Artificial Sequence: Synthetic oligonucleotide
ctcctcgcctgtgtgcacaactatcagc

SEQ ID NO: 87319 - DNA, 28 bp, Artificial Sequence
  Description of Artificial Sequence: Synthetic oligonucleotide
tcctcgcctgtgtgcacaactatcagcc

SEQ ID NO: 87320 - DNA, 27 bp, Artificial Sequence
  Description of Artificial Sequence: Synthetic oligonucleotide
cctcgcctgtgtgcacaactatcagcc

SEQ ID NO: 87321 - DNA, 27 bp, Artificial Sequence
  Description of Artificial Sequence: Synthetic oligonucleotide
ctcgcctgtgtgcacaactatcagccg

SEQ ID NO: 87322 - DNA, 28 bp, Artificial Sequence
  Description of Artificial Sequence: Synthetic oligonucleotide
tcgcctgtgtgcacaactatcagccgtg

SEQ ID NO: 87323 - DNA, 27 bp, Artificial Sequence
  Description of Artificial Sequence: Synthetic oligonucleotide
cgcctgtgtgcacaactatcagccgtg

SEQ ID NO: 87324 - DNA, 27 bp, Artificial Sequence
  Description of Artificial Sequence: Synthetic oligonucleotide
gcctgtgtgcacaactatcagccgtgc

SEQ ID NO: 87325 - DNA, 27 bp, Artificial Sequence
  Description of Artificial Sequence: Synthetic oligonucleotide
cctgtgtgcacaactatcagccgtgcg

SEQ ID NO: 87326 - DNA, 29 bp, Artificial Sequence
  Description of Artificial Sequence: Synthetic oligonucleotide
ctgtgtgcacaactatcagccgtgcgtac

SEQ ID NO: 87327 - DNA, 30 bp, Artificial Sequence
  Description of Artificial Sequence: Synthetic oligonucleotide
tgtgtgcacaactatcagccgtgcgtacag

SEQ ID NO: 87328 - DNA, 29 bp, Artificial Sequence
  Description of Artificial Sequence: Synthetic oligonucleotide
gtgtgcacaactatcagccgtgcgtacag

SEQ ID NO: 87329 - DNA, 30 bp, Artificial Sequence
  Description of Artificial Sequence: Synthetic oligonucleotide
tgtgcacaactatcagccgtgcgtacagag

SEQ ID NO: 87330 - DNA, 29 bp, Artificial Sequence
  Description of Artificial Sequence: Synthetic oligonucleotide
gtgcacaactatcagccgtgcgtacagag

SEQ ID NO: 87331 - DNA, 29 bp, Artificial Sequence
  Description of Artificial Sequence: Synthetic oligonucleotide
tgcacaactatcagccgtgcgtacagagg

SEQ ID NO: 87332 - DNA, 28 bp, Artificial Sequence
  Description of Artificial Sequence: Synthetic oligonucleotide
gcacaactatcagccgtgcgtacagagg

SEQ ID NO: 87333 - DNA, 28 bp, Artificial Sequence
  Description of Artificial Sequence: Synthetic oligonucleotide
cacaactatcagccgtgcgtacagaggg

SEQ ID NO: 87334 - DNA, 28 bp, Artificial Sequence
  Description of Artificial Sequence: Synthetic oligonucleotide
acaactatcagccgtgcgtacagagggc

SEQ ID NO: 87335 - DNA, 27 bp, Artificial Sequence
  Description of Artificial Sequence: Synthetic oligonucleotide
caactatcagccgtgcgtacagagggc

SEQ ID NO: 87336 - DNA, 28 bp, Artificial Sequence
  Description of Artificial Sequence: Synthetic oligonucleotide
aactatcagccgtgcgtacagagggcag

SEQ ID NO: 87337 - DNA, 27 bp, Artificial Sequence
  Description of Artificial Sequence: Synthetic oligonucleotide
actatcagccgtgcgtacagagggcag

SEQ ID NO: 87338 - DNA, 27 bp, Artificial Sequence
  Description of Artificial Sequence: Synthetic oligonucleotide
ctatcagccgtgcgtacagagggcaga

SEQ ID NO: 87339 - DNA, 28 bp, Artificial Sequence
  Description of Artificial Sequence: Synthetic oligonucleotide
tatcagccgtgcgtacagagggcagaag

SEQ ID NO: 87340 - DNA, 27 bp, Artificial Sequence
  Description of Artificial Sequence: Synthetic oligonucleotide
atcagccgtgcgtacagagggcagaag

SEQ ID NO: 87341 - DNA, 26 bp, Artificial Sequence
  Description of Artificial Sequence: Synthetic oligonucleotide
tcagccgtgcgtacagagggcagaag

SEQ ID NO: 87342 - DNA, 25 bp, Artificial Sequence
  Description of Artificial Sequence: Synthetic oligonucleotide
cagccgtgcgtacagagggcagaag

SEQ ID NO: 87343 - DNA, 25 bp, Artificial Sequence
  Description of Artificial Sequence: Synthetic oligonucleotide
agccgtgcgtacagagggcagaagg

SEQ ID NO: 87344 - DNA, 24 bp, Artificial Sequence
  Description of Artificial Sequence: Synthetic oligonucleotide
gccgtgcgtacagagggcagaagg

SEQ ID NO: 87345 - DNA, 27 bp, Artificial Sequence
  Description of Artificial Sequence: Synthetic oligonucleotide
ccgtgcgtacagagggcagaaggctat

SEQ ID NO: 87346 - DNA, 29 bp, Artificial Sequence
  Description of Artificial Sequence: Synthetic oligonucleotide
cgtgcgtacagagggcagaaggctatttc

SEQ ID NO: 87347 - DNA, 30 bp, Artificial Sequence
  Description of Artificial Sequence: Synthetic oligonucleotide
gtgcgtacagagggcagaaggctatttcag

SEQ ID NO: 87348 - DNA, 33 bp, Artificial Sequence
  Description of Artificial Sequence: Synthetic oligonucleotide
tgcgtacagagggcagaaggctatttcagaaag

SEQ ID NO: 87349 - DNA, 32 bp, Artificial Sequence
  Description of Artificial Sequence: Synthetic oligonucleotide
gcgtacagagggcagaaggctatttcagaaag

SEQ ID NO: 87350 - DNA, 33 bp, Artificial Sequence
  Description of Artificial Sequence: Synthetic oligonucleotide
cgtacagagggcagaaggctatttcagaaagtg

SEQ ID NO: 87351 - DNA, 33 bp, Artificial Sequence
  Description of Artificial Sequence: Synthetic oligonucleotide
gtacagagggcagaaggctatttcagaaagtgg

SEQ ID NO: 87352 - DNA, 35 bp, Artificial Sequence
  Description of Artificial Sequence: Synthetic oligonucleotide
tacagagggcagaaggctatttcagaaagtggaag

SEQ ID NO: 87353 - DNA, 34 bp, Artificial Sequence
  Description of Artificial Sequence: Synthetic oligonucleotide
acagagggcagaaggctatttcagaaagtggaag

SEQ ID NO: 87354 - DNA, 33 bp, Artificial Sequence
  Description of Artificial Sequence: Synthetic oligonucleotide
cagagggcagaaggctatttcagaaagtggaag

SEQ ID NO: 87355 - DNA, 33 bp, Artificial Sequence
  Description of Artificial Sequence: Synthetic oligonucleotide
agagggcagaaggctatttcagaaagtggaagg

SEQ ID NO: 87356 - DNA, 32 bp, Artificial Sequence
  Description of Artificial Sequence: Synthetic oligonucleotide
gagggcagaaggctatttcagaaagtggaagg

SEQ ID NO: 87357 - DNA, 35 bp, Artificial Sequence
  Description of Artificial Sequence: Synthetic oligonucleotide
agggcagaaggctatttcagaaagtggaaggaatc

SEQ ID NO: 87358 - DNA, 34 bp, Artificial Sequence
  Description of Artificial Sequence: Synthetic oligonucleotide
gggcagaaggctatttcagaaagtggaaggaatc

SEQ ID NO: 87359 - DNA, 34 bp, Artificial Sequence
  Description of Artificial Sequence: Synthetic oligonucleotide
ggcagaaggctatttcagaaagtggaaggaatcc

SEQ ID NO: 87360 - DNA, 37 bp, Artificial Sequence
  Description of Artificial Sequence: Synthetic oligonucleotide
gcagaaggctatttcagaaagtggaaggaatccaatg

SEQ ID NO: 87361 - DNA, 37 bp, Artificial Sequence
  Description of Artificial Sequence: Synthetic oligonucleotide
cagaaggctatttcagaaagtggaaggaatccaatgg

SEQ ID NO: 87362 - DNA, 40 bp, Artificial Sequence
  Description of Artificial Sequence: Synthetic oligonucleotide
agaaggctatttcagaaagtggaaggaatccaatggaaac

SEQ ID NO: 87363 - DNA, 39 bp, Artificial Sequence
  Description of Artificial Sequence: Synthetic oligonucleotide
gaaggctatttcagaaagtggaaggaatccaatggaaac

SEQ ID NO: 87364 - DNA, 41 bp, Artificial Sequence
  Description of Artificial Sequence: Synthetic oligonucleotide
aaggctatttcagaaagtggaaggaatccaatggaaacttg

SEQ ID NO: 87365 - DNA, 40 bp, Artificial Sequence
  Description of Artificial Sequence: Synthetic oligonucleotide
aggctatttcagaaagtggaaggaatccaatggaaacttg

SEQ ID NO: 87366 - DNA, 39 bp, Artificial Sequence
  Description of Artificial Sequence: Synthetic oligonucleotide
ggctatttcagaaagtggaaggaatccaatggaaacttg

SEQ ID NO: 87367 - DNA, 40 bp, Artificial Sequence
  Description of Artificial Sequence: Synthetic oligonucleotide
gctatttcagaaagtggaaggaatccaatggaaacttgag

SEQ ID NO: 87368 - DNA, 40 bp, Artificial Sequence
  Description of Artificial Sequence: Synthetic oligonucleotide
ctatttcagaaagtggaaggaatccaatggaaacttgagc

SEQ ID NO: 87369 - DNA, 40 bp, Artificial Sequence
  Description of Artificial Sequence: Synthetic oligonucleotide
tatttcagaaagtggaaggaatccaatggaaacttgagcc

SEQ ID NO: 87370 - DNA, 39 bp, Artificial Sequence
  Description of Artificial Sequence: Synthetic oligonucleotide
atttcagaaagtggaaggaatccaatggaaacttgagcc

SEQ ID NO: 87371 - DNA, 38 bp, Artificial Sequence
  Description of Artificial Sequence: Synthetic oligonucleotide
tttcagaaagtggaaggaatccaatggaaacttgagcc

SEQ ID NO: 87372 - DNA, 37 bp, Artificial Sequence
  Description of Artificial Sequence: Synthetic oligonucleotide
ttcagaaagtggaaggaatccaatggaaacttgagcc

SEQ ID NO: 87373 - DNA, 36 bp, Artificial Sequence
  Description of Artificial Sequence: Synthetic oligonucleotide
tcagaaagtggaaggaatccaatggaaacttgagcc

SEQ ID NO: 87374 - DNA, 35 bp, Artificial Sequence
  Description of Artificial Sequence: Synthetic oligonucleotide
cagaaagtggaaggaatccaatggaaacttgagcc

SEQ ID NO: 87375 - DNA, 36 bp, Artificial Sequence
  Description of Artificial Sequence: Synthetic oligonucleotide
agaaagtggaaggaatccaatggaaacttgagcctg

SEQ ID NO: 87376 - DNA, 35 bp, Artificial Sequence
  Description of Artificial Sequence: Synthetic oligonucleotide
gaaagtggaaggaatccaatggaaacttgagcctg

SEQ ID NO: 87377 - DNA, 35 bp, Artificial Sequence
  Description of Artificial Sequence: Synthetic oligonucleotide
aaagtggaaggaatccaatggaaacttgagcctgc

SEQ ID NO: 87378 - DNA, 34 bp, Artificial Sequence
  Description of Artificial Sequence: Synthetic oligonucleotide
aagtggaaggaatccaatggaaacttgagcctgc

SEQ ID NO: 87379 - DNA, 33 bp, Artificial Sequence
  Description of Artificial Sequence: Synthetic oligonucleotide
agtggaaggaatccaatggaaacttgagcctgc

SEQ ID NO: 87380 - DNA, 32 bp, Artificial Sequence
  Description of Artificial Sequence: Synthetic oligonucleotide
gtggaaggaatccaatggaaacttgagcctgc

SEQ ID NO: 87381 - DNA, 32 bp, Artificial Sequence
  Description of Artificial Sequence: Synthetic oligonucleotide
tggaaggaatccaatggaaacttgagcctgcc

SEQ ID NO: 87382 - DNA, 31 bp, Artificial Sequence
  Description of Artificial Sequence: Synthetic oligonucleotide
ggaaggaatccaatggaaacttgagcctgcc

SEQ ID NO: 87383 - DNA, 32 bp, Artificial Sequence
  Description of Artificial Sequence: Synthetic oligonucleotide
gaaggaatccaatggaaacttgagcctgcctg

SEQ ID NO: 87384 - DNA, 33 bp, Artificial Sequence
  Description of Artificial Sequence: Synthetic oligonucleotide
aaggaatccaatggaaacttgagcctgcctgtc

SEQ ID NO: 87385 - DNA, 32 bp, Artificial Sequence
  Description of Artificial Sequence: Synthetic oligonucleotide
aggaatccaatggaaacttgagcctgcctgtc

SEQ ID NO: 87386 - DNA, 31 bp, Artificial Sequence
  Description of Artificial Sequence: Synthetic oligonucleotide
ggaatccaatggaaacttgagcctgcctgtc

SEQ ID NO: 87387 - DNA, 31 bp, Artificial Sequence
  Description of Artificial Sequence: Synthetic oligonucleotide
gaatccaatggaaacttgagcctgcctgtcg

SEQ ID NO: 87388 - DNA, 32 bp, Artificial Sequence
  Description of Artificial Sequence: Synthetic oligonucleotide
aatccaatggaaacttgagcctgcctgtcgac

SEQ ID NO: 87389 - DNA, 31 bp, Artificial Sequence
  Description of Artificial Sequence: Synthetic oligonucleotide
atccaatggaaacttgagcctgcctgtcgac

SEQ ID NO: 87390 - DNA, 30 bp, Artificial Sequence
  Description of Artificial Sequence: Synthetic oligonucleotide
tccaatggaaacttgagcctgcctgtcgac

SEQ ID NO: 87391 - DNA, 29 bp, Artificial Sequence
  Description of Artificial Sequence: Synthetic oligonucleotide
ccaatggaaacttgagcctgcctgtcgac

SEQ ID NO: 87392 - DNA, 29 bp, Artificial Sequence
  Description of Artificial Sequence: Synthetic oligonucleotide
caatggaaacttgagcctgcctgtcgacg

SEQ ID NO: 87393 - DNA, 30 bp, Artificial Sequence
  Description of Artificial Sequence: Synthetic oligonucleotide
aatggaaacttgagcctgcctgtcgacgtg

SEQ ID NO: 87394 - DNA, 29 bp, Artificial Sequence
  Description of Artificial Sequence: Synthetic oligonucleotide
atggaaacttgagcctgcctgtcgacgtg

SEQ ID NO: 87395 - DNA, 28 bp, Artificial Sequence
  Description of Artificial Sequence: Synthetic oligonucleotide
tggaaacttgagcctgcctgtcgacgtg

SEQ ID NO: 87396 - DNA, 27 bp, Artificial Sequence
  Description of Artificial Sequence: Synthetic oligonucleotide
ggaaacttgagcctgcctgtcgacgtg

SEQ ID NO: 87397 - DNA, 28 bp, Artificial Sequence
  Description of Artificial Sequence: Synthetic oligonucleotide
gaaacttgagcctgcctgtcgacgtgac

SEQ ID NO: 87398 - DNA, 28 bp, Artificial Sequence
  Description of Artificial Sequence: Synthetic oligonucleotide
aaacttgagcctgcctgtcgacgtgacc

SEQ ID NO: 87399 - DNA, 27 bp, Artificial Sequence
  Description of Artificial Sequence: Synthetic oligonucleotide
aacttgagcctgcctgtcgacgtgacc

SEQ ID NO: 87400 - DNA, 27 bp, Artificial Sequence
  Description of Artificial Sequence: Synthetic oligonucleotide
acttgagcctgcctgtcgacgtgacct

SEQ ID NO: 87401 - DNA, 27 bp, Artificial Sequence
  Description of Artificial Sequence: Synthetic oligonucleotide
cttgagcctgcctgtcgacgtgacctt

SEQ ID NO: 87402 - DNA, 27 bp, Artificial Sequence
  Description of Artificial Sequence: Synthetic oligonucleotide
ttgagcctgcctgtcgacgtgaccttg

SEQ ID NO: 87403 - DNA, 26 bp, Artificial Sequence
  Description of Artificial Sequence: Synthetic oligonucleotide
tgagcctgcctgtcgacgtgaccttg

SEQ ID NO: 87404 - DNA, 25 bp, Artificial Sequence
  Description of Artificial Sequence: Synthetic oligonucleotide
gagcctgcctgtcgacgtgaccttg

SEQ ID NO: 87405 - DNA, 25 bp, Artificial Sequence
  Description of Artificial Sequence: Synthetic oligonucleotide
agcctgcctgtcgacgtgaccttgg

SEQ ID NO: 87406 - DNA, 24 bp, Artificial Sequence
  Description of Artificial Sequence: Synthetic oligonucleotide
gcctgcctgtcgacgtgaccttgg

SEQ ID NO: 87407 - DNA, 25 bp, Artificial Sequence
  Description of Artificial Sequence: Synthetic oligonucleotide
cctgcctgtcgacgtgaccttggca

SEQ ID NO: 87408 - DNA, 26 bp, Artificial Sequence
  Description of Artificial Sequence: Synthetic oligonucleotide
ctgcctgtcgacgtgaccttggcagt

SEQ ID NO: 87409 - DNA, 27 bp, Artificial Sequence
  Description of Artificial Sequence: Synthetic oligonucleotide
tgcctgtcgacgtgaccttggcagtgt

SEQ ID NO: 87410 - DNA, 27 bp, Artificial Sequence
  Description of Artificial Sequence: Synthetic oligonucleotide
gcctgtcgacgtgaccttggcagtgtt

SEQ ID NO: 87411 - DNA, 28 bp, Artificial Sequence
  Description of Artificial Sequence: Synthetic oligonucleotide
cctgtcgacgtgaccttggcagtgtttg

SEQ ID NO: 87412 - DNA, 28 bp, Artificial Sequence
  Description of Artificial Sequence: Synthetic oligonucleotide
ctgtcgacgtgaccttggcagtgtttgc

SEQ ID NO: 87413 - DNA, 29 bp, Artificial Sequence
  Description of Artificial Sequence: Synthetic oligonucleotide
tgtcgacgtgaccttggcagtgtttgctg

SEQ ID NO: 87414 - DNA, 28 bp, Artificial Sequence
  Description of Artificial Sequence: Synthetic oligonucleotide
gtcgacgtgaccttggcagtgtttgctg

SEQ ID NO: 87415 - DNA, 29 bp, Artificial Sequence
  Description of Artificial Sequence: Synthetic oligonucleotide
tcgacgtgaccttggcagtgtttgctgtg

SEQ ID NO: 87416 - DNA, 28 bp, Artificial Sequence
  Description of Artificial Sequence: Synthetic oligonucleotide
cgacgtgaccttggcagtgtttgctgtg

SEQ ID NO: 87417 - DNA, 28 bp, Artificial Sequence
  Description of Artificial Sequence: Synthetic oligonucleotide
gacgtgaccttggcagtgtttgctgtgg

SEQ ID NO: 87418 - DNA, 28 bp, Artificial Sequence
  Description of Artificial Sequence: Synthetic oligonucleotide
acgtgaccttggcagtgtttgctgtggg

SEQ ID NO: 87419 - DNA, 27 bp, Artificial Sequence
  Description of Artificial Sequence: Synthetic oligonucleotide
cgtgaccttggcagtgtttgctgtggg

SEQ ID NO: 87420 - DNA, 27 bp, Artificial Sequence
  Description of Artificial Sequence: Synthetic oligonucleotide
gtgaccttggcagtgtttgctgtgggg

SEQ ID NO: 87421 - DNA, 27 bp, Artificial Sequence
  Description of Artificial Sequence: Synthetic oligonucleotide
tgaccttggcagtgtttgctgtggggg

SEQ ID NO: 87422 - DNA, 26 bp, Artificial Sequence
  Description of Artificial Sequence: Synthetic oligonucleotide
gaccttggcagtgtttgctgtggggg

SEQ ID NO: 87423 - DNA, 26 bp, Artificial Sequence
  Description of Artificial Sequence: Synthetic oligonucleotide
accttggcagtgtttgctgtgggggc

SEQ ID NO: 87424 - DNA, 25 bp, Artificial Sequence
  Description of Artificial Sequence: Synthetic oligonucleotide
ccttggcagtgtttgctgtgggggc

SEQ ID NO: 87425 - DNA, 25 bp, Artificial Sequence
  Description of Artificial Sequence: Synthetic oligonucleotide
cttggcagtgtttgctgtgggggcc

SEQ ID NO: 87426 - DNA, 26 bp, Artificial Sequence
  Description of Artificial Sequence: Synthetic oligonucleotide
ttggcagtgtttgctgtgggggccca

SEQ ID NO: 87427 - DNA, 25 bp, Artificial Sequence
  Description of Artificial Sequence: Synthetic oligonucleotide
tggcagtgtttgctgtgggggccca

SEQ ID NO: 87428 - DNA, 24 bp, Artificial Sequence
  Description of Artificial Sequence: Synthetic oligonucleotide
ggcagtgtttgctgtgggggccca

SEQ ID NO: 87429 - DNA, 25 bp, Artificial Sequence
  Description of Artificial Sequence: Synthetic oligonucleotide
gcagtgtttgctgtgggggcccaga

SEQ ID NO: 87430 - DNA, 25 bp, Artificial Sequence
  Description of Artificial Sequence: Synthetic oligonucleotide
cagtgtttgctgtgggggcccagag

SEQ ID NO: 87431 - DNA, 26 bp, Artificial Sequence
  Description of Artificial Sequence: Synthetic oligonucleotide
agtgtttgctgtgggggcccagagca

SEQ ID NO: 87432 - DNA, 25 bp, Artificial Sequence
  Description of Artificial Sequence: Synthetic oligonucleotide
gtgtttgctgtgggggcccagagca

SEQ ID NO: 87433 - DNA, 26 bp, Artificial Sequence
  Description of Artificial Sequence: Synthetic oligonucleotide
tgtttgctgtgggggcccagagcaca

SEQ ID NO: 87434 - DNA, 25 bp, Artificial Sequence
  Description of Artificial Sequence: Synthetic oligonucleotide
gtttgctgtgggggcccagagcaca

SEQ ID NO: 87435 - DNA, 27 bp, Artificial Sequence
  Description of Artificial Sequence: Synthetic oligonucleotide
tttgctgtgggggcccagagcacagaa

SEQ ID NO: 87436 - DNA, 26 bp, Artificial Sequence
  Description of Artificial Sequence: Synthetic oligonucleotide
ttgctgtgggggcccagagcacagaa

SEQ ID NO: 87437 - DNA, 25 bp, Artificial Sequence
  Description of Artificial Sequence: Synthetic oligonucleotide
tgctgtgggggcccagagcacagaa

SEQ ID NO: 87438 - DNA, 24 bp, Artificial Sequence
  Description of Artificial Sequence: Synthetic oligonucleotide
gctgtgggggcccagagcacagaa

SEQ ID NO: 87439 - DNA, 24 bp, Artificial Sequence
  Description of Artificial Sequence: Synthetic oligonucleotide
ctgtgggggcccagagcacagaag

SEQ ID NO: 87440 - DNA, 24 bp, Artificial Sequence
  Description of Artificial Sequence: Synthetic oligonucleotide
tgtgggggcccagagcacagaagg

SEQ ID NO: 87441 - DNA, 23 bp, Artificial Sequence
  Description of Artificial Sequence: Synthetic oligonucleotide
gtgggggcccagagcacagaagg

SEQ ID NO: 87442 - DNA, 24 bp, Artificial Sequence
  Description of Artificial Sequence: Synthetic oligonucleotide
tgggggcccagagcacagaaggct

SEQ ID NO: 87443 - DNA, 23 bp, Artificial Sequence
  Description of Artificial Sequence: Synthetic oligonucleotide
gggggcccagagcacagaaggct

SEQ ID NO: 87444 - DNA, 23 bp, Artificial Sequence
  Description of Artificial Sequence: Synthetic oligonucleotide
ggggcccagagcacagaaggctg

SEQ ID NO: 87445 - DNA, 23 bp, Artificial Sequence
  Description of Artificial Sequence: Synthetic oligonucleotide
gggcccagagcacagaaggctgg

SEQ ID NO: 87446 - DNA, 27 bp, Artificial Sequence
  Description of Artificial Sequence: Synthetic oligonucleotide
ggcccagagcacagaaggctgggattt

SEQ ID NO: 87447 - DNA, 28 bp, Artificial Sequence
  Description of Artificial Sequence: Synthetic oligonucleotide
gcccagagcacagaaggctgggattttc

SEQ ID NO: 87448 - DNA, 34 bp, Artificial Sequence
  Description of Artificial Sequence: Synthetic oligonucleotide
cccagagcacagaaggctgggattttctttatag

SEQ ID NO: 87449 - DNA, 41 bp, Artificial Sequence
  Description of Artificial Sequence: Synthetic oligonucleotide
ccagagcacagaaggctgggattttctttatagtaaatatc

SEQ ID NO: 87450 - DNA, 42 bp, Artificial Sequence
  Description of Artificial Sequence: Synthetic oligonucleotide
cagagcacagaaggctgggattttctttatagtaaatatcag

SEQ ID NO: 87451 - DNA, 46 bp, Artificial Sequence
  Description of Artificial Sequence: Synthetic oligonucleotide
agagcacagaaggctgggattttctttatagtaaatatcagttttc

SEQ ID NO: 87452 - DNA, 45 bp, Artificial Sequence
  Description of Artificial Sequence: Synthetic oligonucleotide
gagcacagaaggctgggattttctttatagtaaatatcagttttc

SEQ ID NO: 87453 - DNA, 48 bp, Artificial Sequence
  Description of Artificial Sequence: Synthetic oligonucleotide
agcacagaaggctgggattttctttatagtaaatatcagttttctttg

SEQ ID NO: 87454 - DNA, 47 bp, Artificial Sequence
  Description of Artificial Sequence: Synthetic oligonucleotide
gcacagaaggctgggattttctttatagtaaatatcagttttctttg

SEQ ID NO: 87455 - DNA, 48 bp, Artificial Sequence
  Description of Artificial Sequence: Synthetic oligonucleotide
cacagaaggctgggattttctttatagtaaatatcagttttctttgtc

SEQ ID NO: 87456 - DNA, 48 bp, Artificial Sequence
  Description of Artificial Sequence: Synthetic oligonucleotide
acagaaggctgggattttctttatagtaaatatcagttttctttgtcc

SEQ ID NO: 87457 - DNA, 47 bp, Artificial Sequence
  Description of Artificial Sequence: Synthetic oligonucleotide
cagaaggctgggattttctttatagtaaatatcagttttctttgtcc

SEQ ID NO: 87458 - DNA, 48 bp, Artificial Sequence
  Description of Artificial Sequence: Synthetic oligonucleotide
agaaggctgggattttctttatagtaaatatcagttttctttgtccag

SEQ ID NO: 87459 - DNA, 47 bp, Artificial Sequence
  Description of Artificial Sequence: Synthetic oligonucleotide
gaaggctgggattttctttatagtaaatatcagttttctttgtccag

SEQ ID NO: 87460 - DNA, 49 bp, Artificial Sequence
  Description of Artificial Sequence: Synthetic oligonucleotide
aaggctgggattttctttatagtaaatatcagttttctttgtccagtac

SEQ ID NO: 87461 - DNA, 48 bp, Artificial Sequence
  Description of Artificial Sequence: Synthetic oligonucleotide
aggctgggattttctttatagtaaatatcagttttctttgtccagtac

SEQ ID NO: 87462 - DNA, 47 bp, Artificial Sequence
  Description of Artificial Sequence: Synthetic oligonucleotide
ggctgggattttctttatagtaaatatcagttttctttgtccagtac

SEQ ID NO: 87463 - DNA, 48 bp, Artificial Sequence
  Description of Artificial Sequence: Synthetic oligonucleotide
gctgggattttctttatagtaaatatcagttttctttgtccagtactg

SEQ ID NO: 87464 - DNA, 49 bp, Artificial Sequence
  Description of Artificial Sequence: Synthetic oligonucleotide
ctgggattttctttatagtaaatatcagttttctttgtccagtactgag

SEQ ID NO: 87465 - DNA, 53 bp, Artificial Sequence
  Description of Artificial Sequence: Synthetic oligonucleotide
tgggattttctttatagtaaatatcagttttctttgtccagtactgagaaaag

SEQ ID NO: 87466 - DNA, 52 bp, Artificial Sequence
  Description of Artificial Sequence: Synthetic oligonucleotide
gggattttctttatagtaaatatcagttttctttgtccagtactgagaaaag

SEQ ID NO: 87467 - DNA, 52 bp, Artificial Sequence
  Description of Artificial Sequence: Synthetic oligonucleotide
ggattttctttatagtaaatatcagttttctttgtccagtactgagaaaagc

SEQ ID NO: 87468 - DNA, 52 bp, Artificial Sequence
  Description of Artificial Sequence: Synthetic oligonucleotide
gattttctttatagtaaatatcagttttctttgtccagtactgagaaaagcc

SEQ ID NO: 87469 - DNA, 57 bp, Artificial Sequence
  Description of Artificial Sequence: Synthetic oligonucleotide
attttctttatagtaaatatcagttttctttgtccagtactgagaaaagccaaattg

SEQ ID NO: 87470 - DNA, 56 bp, Artificial Sequence
  Description of Artificial Sequence: Synthetic oligonucleotide
ttttctttatagtaaatatcagttttctttgtccagtactgagaaaagccaaattg

SEQ ID NO: 87471 - DNA, 55 bp, Artificial Sequence
  Description of Artificial Sequence: Synthetic oligonucleotide
tttctttatagtaaatatcagttttctttgtccagtactgagaaaagccaaattg

SEQ ID NO: 87472 - DNA, 54 bp, Artificial Sequence
  Description of Artificial Sequence: Synthetic oligonucleotide
ttctttatagtaaatatcagttttctttgtccagtactgagaaaagccaaattg

SEQ ID NO: 87473 - DNA, 53 bp, Artificial Sequence
  Description of Artificial Sequence: Synthetic oligonucleotide
tctttatagtaaatatcagttttctttgtccagtactgagaaaagccaaattg

SEQ ID NO: 87474 - DNA, 52 bp, Artificial Sequence
  Description of Artificial Sequence: Synthetic oligonucleotide
ctttatagtaaatatcagttttctttgtccagtactgagaaaagccaaattg

SEQ ID NO: 87475 - DNA, 57 bp, Artificial Sequence
  Description of Artificial Sequence: Synthetic oligonucleotide
tttatagtaaatatcagttttctttgtccagtactgagaaaagccaaattgaatttg

SEQ ID NO: 87476 - DNA, 56 bp, Artificial Sequence
  Description of Artificial Sequence: Synthetic oligonucleotide
ttatagtaaatatcagttttctttgtccagtactgagaaaagccaaattgaatttg

SEQ ID NO: 87477 - DNA, 55 bp, Artificial Sequence
  Description of Artificial Sequence: Synthetic oligonucleotide
tatagtaaatatcagttttctttgtccagtactgagaaaagccaaattgaatttg

SEQ ID NO: 87478 - DNA, 54 bp, Artificial Sequence
  Description of Artificial Sequence: Synthetic oligonucleotide
atagtaaatatcagttttctttgtccagtactgagaaaagccaaattgaatttg

SEQ ID NO: 87479 - DNA, 53 bp, Artificial Sequence
  Description of Artificial Sequence: Synthetic oligonucleotide
tagtaaatatcagttttctttgtccagtactgagaaaagccaaattgaatttg

SEQ ID NO: 87480 - DNA, 52 bp, Artificial Sequence
  Description of Artificial Sequence: Synthetic oligonucleotide
agtaaatatcagttttctttgtccagtactgagaaaagccaaattgaatttg

SEQ ID NO: 87481 - DNA, 51 bp, Artificial Sequence
  Description of Artificial Sequence: Synthetic oligonucleotide
gtaaatatcagttttctttgtccagtactgagaaaagccaaattgaatttg

SEQ ID NO: 87482 - DNA, 51 bp, Artificial Sequence
  Description of Artificial Sequence: Synthetic oligonucleotide
taaatatcagttttctttgtccagtactgagaaaagccaaattgaatttgc

SEQ ID NO: 87483 - DNA, 50 bp, Artificial Sequence
  Description of Artificial Sequence: Synthetic oligonucleotide
aaatatcagttttctttgtccagtactgagaaaagccaaattgaatttgc

SEQ ID NO: 87484 - DNA, 49 bp, Artificial Sequence
  Description of Artificial Sequence: Synthetic oligonucleotide
aatatcagttttctttgtccagtactgagaaaagccaaattgaatttgc

SEQ ID NO: 87485 - DNA, 48 bp, Artificial Sequence
  Description of Artificial Sequence: Synthetic oligonucleotide
atatcagttttctttgtccagtactgagaaaagccaaattgaatttgc

SEQ ID NO: 87486 - DNA, 47 bp, Artificial Sequence
  Description of Artificial Sequence: Synthetic oligonucleotide
tatcagttttctttgtccagtactgagaaaagccaaattgaatttgc

SEQ ID NO: 87487 - DNA, 46 bp, Artificial Sequence
  Description of Artificial Sequence: Synthetic oligonucleotide
atcagttttctttgtccagtactgagaaaagccaaattgaatttgc

SEQ ID NO: 87488 - DNA, 45 bp, Artificial Sequence
  Description of Artificial Sequence: Synthetic oligonucleotide
tcagttttctttgtccagtactgagaaaagccaaattgaatttgc

SEQ ID NO: 87489 - DNA, 44 bp, Artificial Sequence
  Description of Artificial Sequence: Synthetic oligonucleotide
cagttttctttgtccagtactgagaaaagccaaattgaatttgc

SEQ ID NO: 87490 - DNA, 44 bp, Artificial Sequence
  Description of Artificial Sequence: Synthetic oligonucleotide
agttttctttgtccagtactgagaaaagccaaattgaatttgcc

SEQ ID NO: 87491 - DNA, 43 bp, Artificial Sequence
  Description of Artificial Sequence: Synthetic oligonucleotide
gttttctttgtccagtactgagaaaagccaaattgaatttgcc

SEQ ID NO: 87492 - DNA, 43 bp, Artificial Sequence
  Description of Artificial Sequence: Synthetic oligonucleotide
ttttctttgtccagtactgagaaaagccaaattgaatttgccc

SEQ ID NO: 87493 - DNA, 42 bp, Artificial Sequence
  Description of Artificial Sequence: Synthetic oligonucleotide
tttctttgtccagtactgagaaaagccaaattgaatttgccc

SEQ ID NO: 87494 - DNA, 41 bp, Artificial Sequence
  Description of Artificial Sequence: Synthetic oligonucleotide
ttctttgtccagtactgagaaaagccaaattgaatttgccc

SEQ ID NO: 87495 - DNA, 40 bp, Artificial Sequence
  Description of Artificial Sequence: Synthetic oligonucleotide
tctttgtccagtactgagaaaagccaaattgaatttgccc

SEQ ID NO: 87496 - DNA, 39 bp, Artificial Sequence
  Description of Artificial Sequence: Synthetic oligonucleotide
ctttgtccagtactgagaaaagccaaattgaatttgccc

SEQ ID NO: 87497 - DNA, 40 bp, Artificial Sequence
  Description of Artificial Sequence: Synthetic oligonucleotide
tttgtccagtactgagaaaagccaaattgaatttgccctc

SEQ ID NO: 87498 - DNA, 39 bp, Artificial Sequence
  Description of Artificial Sequence: Synthetic oligonucleotide
ttgtccagtactgagaaaagccaaattgaatttgccctc

SEQ ID NO: 87499 - DNA, 38 bp, Artificial Sequence
  Description of Artificial Sequence: Synthetic oligonucleotide
tgtccagtactgagaaaagccaaattgaatttgccctc

SEQ ID NO: 87500 - DNA, 37 bp, Artificial Sequence
  Description of Artificial Sequence: Synthetic oligonucleotide
gtccagtactgagaaaagccaaattgaatttgccctc

SEQ ID NO: 87501 - DNA, 38 bp, Artificial Sequence
  Description of Artificial Sequence: Synthetic oligonucleotide
tccagtactgagaaaagccaaattgaatttgccctctg

SEQ ID NO: 87502 - DNA, 37 bp, Artificial Sequence
  Description of Artificial Sequence: Synthetic oligonucleotide
ccagtactgagaaaagccaaattgaatttgccctctg

SEQ ID NO: 87503 - DNA, 37 bp, Artificial Sequence
  Description of Artificial Sequence: Synthetic oligonucleotide
cagtactgagaaaagccaaattgaatttgccctctgc

SEQ ID NO: 87504 - DNA, 38 bp, Artificial Sequence
  Description of Artificial Sequence: Synthetic oligonucleotide
agtactgagaaaagccaaattgaatttgccctctgcag

SEQ ID NO: 87505 - DNA, 37 bp, Artificial Sequence
  Description of Artificial Sequence: Synthetic oligonucleotide
gtactgagaaaagccaaattgaatttgccctctgcag

SEQ ID NO: 87506 - DNA, 39 bp, Artificial Sequence
  Description of Artificial Sequence: Synthetic oligonucleotide
tactgagaaaagccaaattgaatttgccctctgcagaac

SEQ ID NO: 87507 - DNA, 38 bp, Artificial Sequence
  Description of Artificial Sequence: Synthetic oligonucleotide
actgagaaaagccaaattgaatttgccctctgcagaac

SEQ ID NO: 87508 - DNA, 37 bp, Artificial Sequence
  Description of Artificial Sequence: Synthetic oligonucleotide
ctgagaaaagccaaattgaatttgccctctgcagaac

SEQ ID NO: 87509 - DNA, 37 bp, Artificial Sequence
  Description of Artificial Sequence: Synthetic oligonucleotide
tgagaaaagccaaattgaatttgccctctgcagaacc

SEQ ID NO: 87510 - DNA, 36 bp, Artificial Sequence
  Description of Artificial Sequence: Synthetic oligonucleotide
gagaaaagccaaattgaatttgccctctgcagaacc

SEQ ID NO: 87511 - DNA, 36 bp, Artificial Sequence
  Description of Artificial Sequence: Synthetic oligonucleotide
agaaaagccaaattgaatttgccctctgcagaaccc

SEQ ID NO: 87512 - DNA, 35 bp, Artificial Sequence
  Description of Artificial Sequence: Synthetic oligonucleotide
gaaaagccaaattgaatttgccctctgcagaaccc

SEQ ID NO: 87513 - DNA, 42 bp, Artificial Sequence
  Description of Artificial Sequence: Synthetic oligonucleotide
aaaagccaaattgaatttgccctctgcagaacccaaaataag

SEQ ID NO: 87514 - DNA, 41 bp, Artificial Sequence
  Description of Artificial Sequence: Synthetic oligonucleotide
aaagccaaattgaatttgccctctgcagaacccaaaataag

SEQ ID NO: 87515 - DNA, 40 bp, Artificial Sequence
  Description of Artificial Sequence: Synthetic oligonucleotide
aagccaaattgaatttgccctctgcagaacccaaaataag

SEQ ID NO: 87516 - DNA, 39 bp, Artificial Sequence
  Description of Artificial Sequence: Synthetic oligonucleotide
agccaaattgaatttgccctctgcagaacccaaaataag

SEQ ID NO: 87517 - DNA, 38 bp, Artificial Sequence
  Description of Artificial Sequence: Synthetic oligonucleotide
gccaaattgaatttgccctctgcagaacccaaaataag

SEQ ID NO: 87518 - DNA, 38 bp, Artificial Sequence
  Description of Artificial Sequence: Synthetic oligonucleotide
ccaaattgaatttgccctctgcagaacccaaaataagg

SEQ ID NO: 87519 - DNA, 42 bp, Artificial Sequence
  Description of Artificial Sequence: Synthetic oligonucleotide
caaattgaatttgccctctgcagaacccaaaataaggaaaag

SEQ ID NO: 87520 - DNA, 42 bp, Artificial Sequence
  Description of Artificial Sequence: Synthetic oligonucleotide
aaattgaatttgccctctgcagaacccaaaataaggaaaagc

SEQ ID NO: 87521 - DNA, 41 bp, Artificial Sequence
  Description of Artificial Sequence: Synthetic oligonucleotide
aattgaatttgccctctgcagaacccaaaataaggaaaagc

SEQ ID NO: 87522 - DNA, 40 bp, Artificial Sequence
  Description of Artificial Sequence: Synthetic oligonucleotide
attgaatttgccctctgcagaacccaaaataaggaaaagc

SEQ ID NO: 87523 - DNA, 39 bp, Artificial Sequence
  Description of Artificial Sequence: Synthetic oligonucleotide
ttgaatttgccctctgcagaacccaaaataaggaaaagc

SEQ ID NO: 87524 - DNA, 38 bp, Artificial Sequence
  Description of Artificial Sequence: Synthetic oligonucleotide
tgaatttgccctctgcagaacccaaaataaggaaaagc

SEQ ID NO: 87525 - DNA, 37 bp, Artificial Sequence
  Description of Artificial Sequence: Synthetic oligonucleotide
gaatttgccctctgcagaacccaaaataaggaaaagc

SEQ ID NO: 87526 - DNA, 39 bp, Artificial Sequence
  Description of Artificial Sequence: Synthetic oligonucleotide
aatttgccctctgcagaacccaaaataaggaaaagcttc

SEQ ID NO: 87527 - DNA, 38 bp, Artificial Sequence
  Description of Artificial Sequence: Synthetic oligonucleotide
atttgccctctgcagaacccaaaataaggaaaagcttc

SEQ ID NO: 87528 - DNA, 37 bp, Artificial Sequence
  Description of Artificial Sequence: Synthetic oligonucleotide
tttgccctctgcagaacccaaaataaggaaaagcttc

SEQ ID NO: 87529 - DNA, 36 bp, Artificial Sequence
  Description of Artificial Sequence: Synthetic oligonucleotide
ttgccctctgcagaacccaaaataaggaaaagcttc

SEQ ID NO: 87530 - DNA, 35 bp, Artificial Sequence
  Description of Artificial Sequence: Synthetic oligonucleotide
tgccctctgcagaacccaaaataaggaaaagcttc

SEQ ID NO: 87531 - DNA, 34 bp, Artificial Sequence
  Description of Artificial Sequence: Synthetic oligonucleotide
gccctctgcagaacccaaaataaggaaaagcttc

SEQ ID NO: 87532 - DNA, 37 bp, Artificial Sequence
  Description of Artificial Sequence: Synthetic oligonucleotide
ccctctgcagaacccaaaataaggaaaagcttcaatg

SEQ ID NO: 87533 - DNA, 37 bp, Artificial Sequence
  Description of Artificial Sequence: Synthetic oligonucleotide
cctctgcagaacccaaaataaggaaaagcttcaatgg

SEQ ID NO: 87534 - DNA, 37 bp, Artificial Sequence
  Description of Artificial Sequence: Synthetic oligonucleotide
ctctgcagaacccaaaataaggaaaagcttcaatggc

SEQ ID NO: 87535 - DNA, 39 bp, Artificial Sequence
  Description of Artificial Sequence: Synthetic oligonucleotide
tctgcagaacccaaaataaggaaaagcttcaatggctac

SEQ ID NO: 87536 - DNA, 38 bp, Artificial Sequence
  Description of Artificial Sequence: Synthetic oligonucleotide
ctgcagaacccaaaataaggaaaagcttcaatggctac

SEQ ID NO: 87537 - DNA, 40 bp, Artificial Sequence
  Description of Artificial Sequence: Synthetic oligonucleotide
tgcagaacccaaaataaggaaaagcttcaatggctactag

SEQ ID NO: 87538 - DNA, 39 bp, Artificial Sequence
  Description of Artificial Sequence: Synthetic oligonucleotide
gcagaacccaaaataaggaaaagcttcaatggctactag

SEQ ID NO: 87539 - DNA, 41 bp, Artificial Sequence
  Description of Artificial Sequence: Synthetic oligonucleotide
cagaacccaaaataaggaaaagcttcaatggctactagatg

SEQ ID NO: 87540 - DNA, 44 bp, Artificial Sequence
  Description of Artificial Sequence: Synthetic oligonucleotide
agaacccaaaataaggaaaagcttcaatggctactagatgaaag

SEQ ID NO: 87541 - DNA, 43 bp, Artificial Sequence
  Description of Artificial Sequence: Synthetic oligonucleotide
gaacccaaaataaggaaaagcttcaatggctactagatgaaag

SEQ ID NO: 87542 - DNA, 43 bp, Artificial Sequence
  Description of Artificial Sequence: Synthetic oligonucleotide
aacccaaaataaggaaaagcttcaatggctactagatgaaagc

SEQ ID NO: 87543 - DNA, 42 bp, Artificial Sequence
  Description of Artificial Sequence: Synthetic oligonucleotide
acccaaaataaggaaaagcttcaatggctactagatgaaagc

SEQ ID NO: 87544 - DNA, 41 bp, Artificial Sequence
  Description of Artificial Sequence: Synthetic oligonucleotide
cccaaaataaggaaaagcttcaatggctactagatgaaagc

SEQ ID NO: 87545 - DNA, 46 bp, Artificial Sequence
  Description of Artificial Sequence: Synthetic oligonucleotide
ccaaaataaggaaaagcttcaatggctactagatgaaagctttaag

SEQ ID NO: 87546 - DNA, 46 bp, Artificial Sequence
  Description of Artificial Sequence: Synthetic oligonucleotide
caaaataaggaaaagcttcaatggctactagatgaaagctttaagg

SEQ ID NO: 87547 - DNA, 46 bp, Artificial Sequence
  Description of Artificial Sequence: Synthetic oligonucleotide
aaaataaggaaaagcttcaatggctactagatgaaagctttaaggg

SEQ ID NO: 87548 - DNA, 45 bp, Artificial Sequence
  Description of Artificial Sequence: Synthetic oligonucleotide
aaataaggaaaagcttcaatggctactagatgaaagctttaaggg

SEQ ID NO: 87549 - DNA, 44 bp, Artificial Sequence
  Description of Artificial Sequence: Synthetic oligonucleotide
aataaggaaaagcttcaatggctactagatgaaagctttaaggg

SEQ ID NO: 87550 - DNA, 43 bp, Artificial Sequence
  Description of Artificial Sequence: Synthetic oligonucleotide
ataaggaaaagcttcaatggctactagatgaaagctttaaggg

SEQ ID NO: 87551 - DNA, 42 bp, Artificial Sequence
  Description of Artificial Sequence: Synthetic oligonucleotide
taaggaaaagcttcaatggctactagatgaaagctttaaggg

SEQ ID NO: 87552 - DNA, 41 bp, Artificial Sequence
  Description of Artificial Sequence: Synthetic oligonucleotide
aaggaaaagcttcaatggctactagatgaaagctttaaggg

SEQ ID NO: 87553 - DNA, 40 bp, Artificial Sequence
  Description of Artificial Sequence: Synthetic oligonucleotide
aggaaaagcttcaatggctactagatgaaagctttaaggg

SEQ ID NO: 87554 - DNA, 39 bp, Artificial Sequence
  Description of Artificial Sequence: Synthetic oligonucleotide
ggaaaagcttcaatggctactagatgaaagctttaaggg

SEQ ID NO: 87555 - DNA, 40 bp, Artificial Sequence
  Description of Artificial Sequence: Synthetic oligonucleotide
gaaaagcttcaatggctactagatgaaagctttaagggag

SEQ ID NO: 87556 - DNA, 52 bp, Artificial Sequence
  Description of Artificial Sequence: Synthetic oligonucleotide
aaaagcttcaatggctactagatgaaagctttaagggagataaaataaaaac

SEQ ID NO: 87557 - DNA, 51 bp, Artificial Sequence
  Description of Artificial Sequence: Synthetic oligonucleotide
aaagcttcaatggctactagatgaaagctttaagggagataaaataaaaac

SEQ ID NO: 87558 - DNA, 50 bp, Artificial Sequence
  Description of Artificial Sequence: Synthetic oligonucleotide
aagcttcaatggctactagatgaaagctttaagggagataaaataaaaac

SEQ ID NO: 87559 - DNA, 49 bp, Artificial Sequence
  Description of Artificial Sequence: Synthetic oligonucleotide
agcttcaatggctactagatgaaagctttaagggagataaaataaaaac

SEQ ID NO: 87560 - DNA, 48 bp, Artificial Sequence
  Description of Artificial Sequence: Synthetic oligonucleotide
gcttcaatggctactagatgaaagctttaagggagataaaataaaaac

SEQ ID NO: 87561 - DNA, 49 bp, Artificial Sequence
  Description of Artificial Sequence: Synthetic oligonucleotide
cttcaatggctactagatgaaagctttaagggagataaaataaaaactc

SEQ ID NO: 87562 - DNA, 50 bp, Artificial Sequence
  Description of Artificial Sequence: Synthetic oligonucleotide
ttcaatggctactagatgaaagctttaagggagataaaataaaaactcag

SEQ ID NO: 87563 - DNA, 49 bp, Artificial Sequence
  Description of Artificial Sequence: Synthetic oligonucleotide
tcaatggctactagatgaaagctttaagggagataaaataaaaactcag

SEQ ID NO: 87564 - DNA, 48 bp, Artificial Sequence
  Description of Artificial Sequence: Synthetic oligonucleotide
caatggctactagatgaaagctttaagggagataaaataaaaactcag

SEQ ID NO: 87565 - DNA, 48 bp, Artificial Sequence
  Description of Artificial Sequence: Synthetic oligonucleotide
aatggctactagatgaaagctttaagggagataaaataaaaactcagg

SEQ ID NO: 87566 - DNA, 47 bp, Artificial Sequence
  Description of Artificial Sequence: Synthetic oligonucleotide
atggctactagatgaaagctttaagggagataaaataaaaactcagg

SEQ ID NO: 87567 - DNA, 46 bp, Artificial Sequence
  Description of Artificial Sequence: Synthetic oligonucleotide
tggctactagatgaaagctttaagggagataaaataaaaactcagg

SEQ ID NO: 87568 - DNA, 45 bp, Artificial Sequence
  Description of Artificial Sequence: Synthetic oligonucleotide
ggctactagatgaaagctttaagggagataaaataaaaactcagg

SEQ ID NO: 87569 - DNA, 46 bp, Artificial Sequence
  Description of Artificial Sequence: Synthetic oligonucleotide
gctactagatgaaagctttaagggagataaaataaaaactcaggag

SEQ ID NO: 87570 - DNA, 49 bp, Artificial Sequence
  Description of Artificial Sequence: Synthetic oligonucleotide
ctactagatgaaagctttaagggagataaaataaaaactcaggagtttc

SEQ ID NO: 87571 - DNA, 49 bp, Artificial Sequence
  Description of Artificial Sequence: Synthetic oligonucleotide
tactagatgaaagctttaagggagataaaataaaaactcaggagtttcc

SEQ ID NO: 87572 - DNA, 48 bp, Artificial Sequence
  Description of Artificial Sequence: Synthetic oligonucleotide
actagatgaaagctttaagggagataaaataaaaactcaggagtttcc

SEQ ID NO: 87573 - DNA, 47 bp, Artificial Sequence
  Description of Artificial Sequence: Synthetic oligonucleotide
ctagatgaaagctttaagggagataaaataaaaactcaggagtttcc

SEQ ID NO: 87574 - DNA, 48 bp, Artificial Sequence
  Description of Artificial Sequence: Synthetic oligonucleotide
tagatgaaagctttaagggagataaaataaaaactcaggagtttccac

SEQ ID NO: 87575 - DNA, 47 bp, Artificial Sequence
  Description of Artificial Sequence: Synthetic oligonucleotide
agatgaaagctttaagggagataaaataaaaactcaggagtttccac

SEQ ID NO: 87576 - DNA, 46 bp, Artificial Sequence
  Description of Artificial Sequence: Synthetic oligonucleotide
gatgaaagctttaagggagataaaataaaaactcaggagtttccac

SEQ ID NO: 87577 - DNA, 51 bp, Artificial Sequence
  Description of Artificial Sequence: Synthetic oligonucleotide
atgaaagctttaagggagataaaataaaaactcaggagtttccacaaattc

SEQ ID NO: 87578 - DNA, 50 bp, Artificial Sequence
  Description of Artificial Sequence: Synthetic oligonucleotide
tgaaagctttaagggagataaaataaaaactcaggagtttccacaaattc

SEQ ID NO: 87579 - DNA, 49 bp, Artificial Sequence
  Description of Artificial Sequence: Synthetic oligonucleotide
gaaagctttaagggagataaaataaaaactcaggagtttccacaaattc

SEQ ID NO: 87580 - DNA, 52 bp, Artificial Sequence
  Description of Artificial Sequence: Synthetic oligonucleotide
aaagctttaagggagataaaataaaaactcaggagtttccacaaattcttac

SEQ ID NO: 87581 - DNA, 51 bp, Artificial Sequence
  Description of Artificial Sequence: Synthetic oligonucleotide
aagctttaagggagataaaataaaaactcaggagtttccacaaattcttac

SEQ ID NO: 87582 - DNA, 50 bp, Artificial Sequence
  Description of Artificial Sequence: Synthetic oligonucleotide
agctttaagggagataaaataaaaactcaggagtttccacaaattcttac

SEQ ID NO: 87583 - DNA, 49 bp, Artificial Sequence
  Description of Artificial Sequence: Synthetic oligonucleotide
gctttaagggagataaaataaaaactcaggagtttccacaaattcttac

SEQ ID NO: 87584 - DNA, 50 bp, Artificial Sequence
  Description of Artificial Sequence: Synthetic oligonucleotide
ctttaagggagataaaataaaaactcaggagtttccacaaattcttacac

SEQ ID NO: 87585 - DNA, 51 bp, Artificial Sequence
  Description of Artificial Sequence: Synthetic oligonucleotide
tttaagggagataaaataaaaactcaggagtttccacaaattcttacactc

SEQ ID NO: 87586 - DNA, 50 bp, Artificial Sequence
  Description of Artificial Sequence: Synthetic oligonucleotide
ttaagggagataaaataaaaactcaggagtttccacaaattcttacactc

SEQ ID NO: 87587 - DNA, 49 bp, Artificial Sequence
  Description of Artificial Sequence: Synthetic oligonucleotide
taagggagataaaataaaaactcaggagtttccacaaattcttacactc

SEQ ID NO: 87588 - DNA, 48 bp, Artificial Sequence
  Description of Artificial Sequence: Synthetic oligonucleotide
aagggagataaaataaaaactcaggagtttccacaaattcttacactc

SEQ ID NO: 87589 - DNA, 47 bp, Artificial Sequence
  Description of Artificial Sequence: Synthetic oligonucleotide
agggagataaaataaaaactcaggagtttccacaaattcttacactc

SEQ ID NO: 87590 - DNA, 46 bp, Artificial Sequence
  Description of Artificial Sequence: Synthetic oligonucleotide
gggagataaaataaaaactcaggagtttccacaaattcttacactc

SEQ ID NO: 87591 - DNA, 49 bp, Artificial Sequence
  Description of Artificial Sequence: Synthetic oligonucleotide
ggagataaaataaaaactcaggagtttccacaaattcttacactcattg

SEQ ID NO: 87592 - DNA, 49 bp, Artificial Sequence
  Description of Artificial Sequence: Synthetic oligonucleotide
gagataaaataaaaactcaggagtttccacaaattcttacactcattgg

SEQ ID NO: 87593 - DNA, 49 bp, Artificial Sequence
  Description of Artificial Sequence: Synthetic oligonucleotide
agataaaataaaaactcaggagtttccacaaattcttacactcattggc

SEQ ID NO: 87594 - DNA, 48 bp, Artificial Sequence
  Description of Artificial Sequence: Synthetic oligonucleotide
gataaaataaaaactcaggagtttccacaaattcttacactcattggc

SEQ ID NO: 87595 - DNA, 49 bp, Artificial Sequence
  Description of Artificial Sequence: Synthetic oligonucleotide
ataaaataaaaactcaggagtttccacaaattcttacactcattggcag

SEQ ID NO: 87596 - DNA, 48 bp, Artificial Sequence
  Description of Artificial Sequence: Synthetic oligonucleotide
taaaataaaaactcaggagtttccacaaattcttacactcattggcag

SEQ ID NO: 87597 - DNA, 47 bp, Artificial Sequence
  Description of Artificial Sequence: Synthetic oligonucleotide
aaaataaaaactcaggagtttccacaaattcttacactcattggcag

SEQ ID NO: 87598 - DNA, 46 bp, Artificial Sequence
  Description of Artificial Sequence: Synthetic oligonucleotide
aaataaaaactcaggagtttccacaaattcttacactcattggcag

SEQ ID NO: 87599 - DNA, 45 bp, Artificial Sequence
  Description of Artificial Sequence: Synthetic oligonucleotide
aataaaaactcaggagtttccacaaattcttacactcattggcag

SEQ ID NO: 87600 - DNA, 44 bp, Artificial Sequence
  Description of Artificial Sequence: Synthetic oligonucleotide
ataaaaactcaggagtttccacaaattcttacactcattggcag

SEQ ID NO: 87601 - DNA, 43 bp, Artificial Sequence
  Description of Artificial Sequence: Synthetic oligonucleotide
taaaaactcaggagtttccacaaattcttacactcattggcag

SEQ ID NO: 87602 - DNA, 42 bp, Artificial Sequence
  Description of Artificial Sequence: Synthetic oligonucleotide
aaaaactcaggagtttccacaaattcttacactcattggcag

SEQ ID NO: 87603 - DNA, 41 bp, Artificial Sequence
  Description of Artificial Sequence: Synthetic oligonucleotide
aaaactcaggagtttccacaaattcttacactcattggcag

SEQ ID NO: 87604 - DNA, 40 bp, Artificial Sequence
  Description of Artificial Sequence: Synthetic oligonucleotide
aaactcaggagtttccacaaattcttacactcattggcag

SEQ ID NO: 87605 - DNA, 39 bp, Artificial Sequence
  Description of Artificial Sequence: Synthetic oligonucleotide
aactcaggagtttccacaaattcttacactcattggcag

SEQ ID NO: 87606 - DNA, 38 bp, Artificial Sequence
  Description of Artificial Sequence: Synthetic oligonucleotide
actcaggagtttccacaaattcttacactcattggcag

SEQ ID NO: 87607 - DNA, 37 bp, Artificial Sequence
  Description of Artificial Sequence: Synthetic oligonucleotide
ctcaggagtttccacaaattcttacactcattggcag

SEQ ID NO: 87608 - DNA, 37 bp, Artificial Sequence
  Description of Artificial Sequence: Synthetic oligonucleotide
tcaggagtttccacaaattcttacactcattggcagg

SEQ ID NO: 87609 - DNA, 36 bp, Artificial Sequence
  Description of Artificial Sequence: Synthetic oligonucleotide
caggagtttccacaaattcttacactcattggcagg

SEQ ID NO: 87610 - DNA, 38 bp, Artificial Sequence
  Description of Artificial Sequence: Synthetic oligonucleotide
aggagtttccacaaattcttacactcattggcaggaac

SEQ ID NO: 87611 - DNA, 37 bp, Artificial Sequence
  Description of Artificial Sequence: Synthetic oligonucleotide
ggagtttccacaaattcttacactcattggcaggaac

SEQ ID NO: 87612 - DNA, 37 bp, Artificial Sequence
  Description of Artificial Sequence: Synthetic oligonucleotide
gagtttccacaaattcttacactcattggcaggaacc

SEQ ID NO: 87613 - DNA, 37 bp, Artificial Sequence
  Description of Artificial Sequence: Synthetic oligonucleotide
agtttccacaaattcttacactcattggcaggaaccc

SEQ ID NO: 87614 - DNA, 36 bp, Artificial Sequence
  Description of Artificial Sequence: Synthetic oligonucleotide
gtttccacaaattcttacactcattggcaggaaccc

SEQ ID NO: 87615 - DNA, 37 bp, Artificial Sequence
  Description of Artificial Sequence: Synthetic oligonucleotide
tttccacaaattcttacactcattggcaggaacccag

SEQ ID NO: 87616 - DNA, 36 bp, Artificial Sequence
  Description of Artificial Sequence: Synthetic oligonucleotide
ttccacaaattcttacactcattggcaggaacccag

SEQ ID NO: 87617 - DNA, 35 bp, Artificial Sequence
  Description of Artificial Sequence: Synthetic oligonucleotide
tccacaaattcttacactcattggcaggaacccag

SEQ ID NO: 87618 - DNA, 34 bp, Artificial Sequence
  Description of Artificial Sequence: Synthetic oligonucleotide
ccacaaattcttacactcattggcaggaacccag

SEQ ID NO: 87619 - DNA, 36 bp, Artificial Sequence
  Description of Artificial Sequence: Synthetic oligonucleotide
cacaaattcttacactcattggcaggaacccagtag

SEQ ID NO: 87620 - DNA, 36 bp, Artificial Sequence
  Description of Artificial Sequence: Synthetic oligonucleotide
acaaattcttacactcattggcaggaacccagtagg

SEQ ID NO: 87621 - DNA, 35 bp, Artificial Sequence
  Description of Artificial Sequence: Synthetic oligonucleotide
caaattcttacactcattggcaggaacccagtagg

SEQ ID NO: 87622 - DNA, 38 bp, Artificial Sequence
  Description of Artificial Sequence: Synthetic oligonucleotide
aaattcttacactcattggcaggaacccagtaggatac

SEQ ID NO: 87623 - DNA, 37 bp, Artificial Sequence
  Description of Artificial Sequence: Synthetic oligonucleotide
aattcttacactcattggcaggaacccagtaggatac

SEQ ID NO: 87624 - DNA, 36 bp, Artificial Sequence
  Description of Artificial Sequence: Synthetic oligonucleotide
attcttacactcattggcaggaacccagtaggatac

SEQ ID NO: 87625 - DNA, 35 bp, Artificial Sequence
  Description of Artificial Sequence: Synthetic oligonucleotide
ttcttacactcattggcaggaacccagtaggatac

SEQ ID NO: 87626 - DNA, 34 bp, Artificial Sequence
  Description of Artificial Sequence: Synthetic oligonucleotide
tcttacactcattggcaggaacccagtaggatac

SEQ ID NO: 87627 - DNA, 33 bp, Artificial Sequence
  Description of Artificial Sequence: Synthetic oligonucleotide
cttacactcattggcaggaacccagtaggatac

SEQ ID NO: 87628 - DNA, 33 bp, Artificial Sequence
  Description of Artificial Sequence: Synthetic oligonucleotide
ttacactcattggcaggaacccagtaggatacc

SEQ ID NO: 87629 - DNA, 32 bp, Artificial Sequence
  Description of Artificial Sequence: Synthetic oligonucleotide
tacactcattggcaggaacccagtaggatacc

SEQ ID NO: 87630 - DNA, 31 bp, Artificial Sequence
  Description of Artificial Sequence: Synthetic oligonucleotide
acactcattggcaggaacccagtaggatacc

SEQ ID NO: 87631 - DNA, 30 bp, Artificial Sequence
  Description of Artificial Sequence: Synthetic oligonucleotide
cactcattggcaggaacccagtaggatacc

SEQ ID NO: 87632 - DNA, 30 bp, Artificial Sequence
  Description of Artificial Sequence: Synthetic oligonucleotide
actcattggcaggaacccagtaggataccc

SEQ ID NO: 87633 - DNA, 29 bp, Artificial Sequence
  Description of Artificial Sequence: Synthetic oligonucleotide
ctcattggcaggaacccagtaggataccc

SEQ ID NO: 87634 - DNA, 30 bp, Artificial Sequence
  Description of Artificial Sequence: Synthetic oligonucleotide
tcattggcaggaacccagtaggatacccac

SEQ ID NO: 87635 - DNA, 29 bp, Artificial Sequence
  Description of Artificial Sequence: Synthetic oligonucleotide
cattggcaggaacccagtaggatacccac

SEQ ID NO: 87636 - DNA, 30 bp, Artificial Sequence
  Description of Artificial Sequence: Synthetic oligonucleotide
attggcaggaacccagtaggatacccactg

SEQ ID NO: 87637 - DNA, 29 bp, Artificial Sequence
  Description of Artificial Sequence: Synthetic oligonucleotide
ttggcaggaacccagtaggatacccactg

SEQ ID NO: 87638 - DNA, 28 bp, Artificial Sequence
  Description of Artificial Sequence: Synthetic oligonucleotide
tggcaggaacccagtaggatacccactg

SEQ ID NO: 87639 - DNA, 27 bp, Artificial Sequence
  Description of Artificial Sequence: Synthetic oligonucleotide
ggcaggaacccagtaggatacccactg

SEQ ID NO: 87640 - DNA, 27 bp, Artificial Sequence
  Description of Artificial Sequence: Synthetic oligonucleotide
gcaggaacccagtaggatacccactgg

SEQ ID NO: 87641 - DNA, 27 bp, Artificial Sequence
  Description of Artificial Sequence: Synthetic oligonucleotide
caggaacccagtaggatacccactggc

SEQ ID NO: 87642 - DNA, 27 bp, Artificial Sequence
  Description of Artificial Sequence: Synthetic oligonucleotide
aggaacccagtaggatacccactggcc

SEQ ID NO: 87643 - DNA, 27 bp, Artificial Sequence
  Description of Artificial Sequence: Synthetic oligonucleotide
ggaacccagtaggatacccactggcct

SEQ ID NO: 87644 - DNA, 27 bp, Artificial Sequence
  Description of Artificial Sequence: Synthetic oligonucleotide
gaacccagtaggatacccactggcctg

SEQ ID NO: 87645 - DNA, 27 bp, Artificial Sequence
  Description of Artificial Sequence: Synthetic oligonucleotide
aacccagtaggatacccactggcctgg

SEQ ID NO: 87646 - DNA, 26 bp, Artificial Sequence
  Description of Artificial Sequence: Synthetic oligonucleotide
acccagtaggatacccactggcctgg

SEQ ID NO: 87647 - DNA, 25 bp, Artificial Sequence
  Description of Artificial Sequence: Synthetic oligonucleotide
cccagtaggatacccactggcctgg

SEQ ID NO: 87648 - DNA, 27 bp, Artificial Sequence
  Description of Artificial Sequence: Synthetic oligonucleotide
ccagtaggatacccactggcctggcaa

SEQ ID NO: 87649 - DNA, 30 bp, Artificial Sequence
  Description of Artificial Sequence: Synthetic oligonucleotide
cagtaggatacccactggcctggcaatttc

SEQ ID NO: 87650 - DNA, 31 bp, Artificial Sequence
  Description of Artificial Sequence: Synthetic oligonucleotide
agtaggatacccactggcctggcaatttctg

SEQ ID NO: 87651 - DNA, 30 bp, Artificial Sequence
  Description of Artificial Sequence: Synthetic oligonucleotide
gtaggatacccactggcctggcaatttctg

SEQ ID NO: 87652 - DNA, 31 bp, Artificial Sequence
  Description of Artificial Sequence: Synthetic oligonucleotide
taggatacccactggcctggcaatttctgag

SEQ ID NO: 87653 - DNA, 30 bp, Artificial Sequence
  Description of Artificial Sequence: Synthetic oligonucleotide
aggatacccactggcctggcaatttctgag

SEQ ID NO: 87654 - DNA, 29 bp, Artificial Sequence
  Description of Artificial Sequence: Synthetic oligonucleotide
ggatacccactggcctggcaatttctgag

SEQ ID NO: 87655 - DNA, 29 bp, Artificial Sequence
  Description of Artificial Sequence: Synthetic oligonucleotide
gatacccactggcctggcaatttctgagg

SEQ ID NO: 87656 - DNA, 34 bp, Artificial Sequence
  Description of Artificial Sequence: Synthetic oligonucleotide
atacccactggcctggcaatttctgaggaaaaac

SEQ ID NO: 87657 - DNA, 33 bp, Artificial Sequence
  Description of Artificial Sequence: Synthetic oligonucleotide
tacccactggcctggcaatttctgaggaaaaac

SEQ ID NO: 87658 - DNA, 32 bp, Artificial Sequence
  Description of Artificial Sequence: Synthetic oligonucleotide
acccactggcctggcaatttctgaggaaaaac

SEQ ID NO: 87659 - DNA, 31 bp, Artificial Sequence
  Description of Artificial Sequence: Synthetic oligonucleotide
cccactggcctggcaatttctgaggaaaaac

SEQ ID NO: 87660 - DNA, 32 bp, Artificial Sequence
  Description of Artificial Sequence: Synthetic oligonucleotide
ccactggcctggcaatttctgaggaaaaactg

SEQ ID NO: 87661 - DNA, 32 bp, Artificial Sequence
  Description of Artificial Sequence: Synthetic oligonucleotide
cactggcctggcaatttctgaggaaaaactgg

SEQ ID NO: 87662 - DNA, 34 bp, Artificial Sequence
  Description of Artificial Sequence: Synthetic oligonucleotide
actggcctggcaatttctgaggaaaaactggaac

SEQ ID NO: 87663 - DNA, 33 bp, Artificial Sequence
  Description of Artificial Sequence: Synthetic oligonucleotide
ctggcctggcaatttctgaggaaaaactggaac

SEQ ID NO: 87664 - DNA, 36 bp, Artificial Sequence
  Description of Artificial Sequence: Synthetic oligonucleotide
tggcctggcaatttctgaggaaaaactggaacaaac

SEQ ID NO: 87665 - DNA, 35 bp, Artificial Sequence
  Description of Artificial Sequence: Synthetic oligonucleotide
ggcctggcaatttctgaggaaaaactggaacaaac

SEQ ID NO: 87666 - DNA, 37 bp, Artificial Sequence
  Description of Artificial Sequence: Synthetic oligonucleotide
gcctggcaatttctgaggaaaaactggaacaaacttg

SEQ ID NO: 87667 - DNA, 39 bp, Artificial Sequence
  Description of Artificial Sequence: Synthetic oligonucleotide
cctggcaatttctgaggaaaaactggaacaaacttgtac

SEQ ID NO: 87668 - DNA, 43 bp, Artificial Sequence
  Description of Artificial Sequence: Synthetic oligonucleotide
ctggcaatttctgaggaaaaactggaacaaacttgtacaaaag

SEQ ID NO: 87669 - DNA, 46 bp, Artificial Sequence
  Description of Artificial Sequence: Synthetic oligonucleotide
tggcaatttctgaggaaaaactggaacaaacttgtacaaaagtttg

SEQ ID NO: 87670 - DNA, 45 bp, Artificial Sequence
  Description of Artificial Sequence: Synthetic oligonucleotide
ggcaatttctgaggaaaaactggaacaaacttgtacaaaagtttg

SEQ ID NO: 87671 - DNA, 47 bp, Artificial Sequence
  Description of Artificial Sequence: Synthetic oligonucleotide
gcaatttctgaggaaaaactggaacaaacttgtacaaaagtttgaac

SEQ ID NO: 87672 - DNA, 49 bp, Artificial Sequence
  Description of Artificial Sequence: Synthetic oligonucleotide
caatttctgaggaaaaactggaacaaacttgtacaaaagtttgaacttg

SEQ ID NO: 87673 - DNA, 49 bp, Artificial Sequence
  Description of Artificial Sequence: Synthetic oligonucleotide
aatttctgaggaaaaactggaacaaacttgtacaaaagtttgaacttgg

SEQ ID NO: 87674 - DNA, 48 bp, Artificial Sequence
  Description of Artificial Sequence: Synthetic oligonucleotide
atttctgaggaaaaactggaacaaacttgtacaaaagtttgaacttgg

SEQ ID NO: 87675 - DNA, 47 bp, Artificial Sequence
  Description of Artificial Sequence: Synthetic oligonucleotide
tttctgaggaaaaactggaacaaacttgtacaaaagtttgaacttgg

SEQ ID NO: 87676 - DNA, 46 bp, Artificial Sequence
  Description of Artificial Sequence: Synthetic oligonucleotide
ttctgaggaaaaactggaacaaacttgtacaaaagtttgaacttgg

SEQ ID NO: 87677 - DNA, 45 bp, Artificial Sequence
  Description of Artificial Sequence: Synthetic oligonucleotide
tctgaggaaaaactggaacaaacttgtacaaaagtttgaacttgg

SEQ ID NO: 87678 - DNA, 44 bp, Artificial Sequence
  Description of Artificial Sequence: Synthetic oligonucleotide
ctgaggaaaaactggaacaaacttgtacaaaagtttgaacttgg

SEQ ID NO: 87679 - DNA, 44 bp, Artificial Sequence
  Description of Artificial Sequence: Synthetic oligonucleotide
tgaggaaaaactggaacaaacttgtacaaaagtttgaacttggc

SEQ ID NO: 87680 - DNA, 43 bp, Artificial Sequence
  Description of Artificial Sequence: Synthetic oligonucleotide
gaggaaaaactggaacaaacttgtacaaaagtttgaacttggc

SEQ ID NO: 87681 - DNA, 44 bp, Artificial Sequence
  Description of Artificial Sequence: Synthetic oligonucleotide
aggaaaaactggaacaaacttgtacaaaagtttgaacttggctc

SEQ ID NO: 87682 - DNA, 43 bp, Artificial Sequence
  Description of Artificial Sequence: Synthetic oligonucleotide
ggaaaaactggaacaaacttgtacaaaagtttgaacttggctc

SEQ ID NO: 87683 - DNA, 45 bp, Artificial Sequence
  Description of Artificial Sequence: Synthetic oligonucleotide
gaaaaactggaacaaacttgtacaaaagtttgaacttggctcatc

SEQ ID NO: 87684 - DNA, 47 bp, Artificial Sequence
  Description of Artificial Sequence: Synthetic oligonucleotide
aaaaactggaacaaacttgtacaaaagtttgaacttggctcatcttc

SEQ ID NO: 87685 - DNA, 46 bp, Artificial Sequence
  Description of Artificial Sequence: Synthetic oligonucleotide
aaaactggaacaaacttgtacaaaagtttgaacttggctcatcttc

SEQ ID NO: 87686 - DNA, 45 bp, Artificial Sequence
  Description of Artificial Sequence: Synthetic oligonucleotide
aaactggaacaaacttgtacaaaagtttgaacttggctcatcttc

SEQ ID NO: 87687 - DNA, 44 bp, Artificial Sequence
  Description of Artificial Sequence: Synthetic oligonucleotide
aactggaacaaacttgtacaaaagtttgaacttggctcatcttc

SEQ ID NO: 87688 - DNA, 43 bp, Artificial Sequence
  Description of Artificial Sequence: Synthetic oligonucleotide
actggaacaaacttgtacaaaagtttgaacttggctcatcttc

SEQ ID NO: 87689 - DNA, 42 bp, Artificial Sequence
  Description of Artificial Sequence: Synthetic oligonucleotide
ctggaacaaacttgtacaaaagtttgaacttggctcatcttc

SEQ ID NO: 87690 - DNA, 42 bp, Artificial Sequence
  Description of Artificial Sequence: Synthetic oligonucleotide
tggaacaaacttgtacaaaagtttgaacttggctcatcttcc

SEQ ID NO: 87691 - DNA, 41 bp, Artificial Sequence
  Description of Artificial Sequence: Synthetic oligonucleotide
ggaacaaacttgtacaaaagtttgaacttggctcatcttcc

SEQ ID NO: 87692 - DNA, 44 bp, Artificial Sequence
  Description of Artificial Sequence: Synthetic oligonucleotide
gaacaaacttgtacaaaagtttgaacttggctcatcttccatag

SEQ ID NO: 87693 - DNA, 44 bp, Artificial Sequence
  Description of Artificial Sequence: Synthetic oligonucleotide
aacaaacttgtacaaaagtttgaacttggctcatcttccatagc

SEQ ID NO: 87694 - DNA, 43 bp, Artificial Sequence
  Description of Artificial Sequence: Synthetic oligonucleotide
acaaacttgtacaaaagtttgaacttggctcatcttccatagc

SEQ ID NO: 87695 - DNA, 42 bp, Artificial Sequence
  Description of Artificial Sequence: Synthetic oligonucleotide
caaacttgtacaaaagtttgaacttggctcatcttccatagc

SEQ ID NO: 87696 - DNA, 42 bp, Artificial Sequence
  Description of Artificial Sequence: Synthetic oligonucleotide
aaacttgtacaaaagtttgaacttggctcatcttccatagcc

SEQ ID NO: 87697 - DNA, 41 bp, Artificial Sequence
  Description of Artificial Sequence: Synthetic oligonucleotide
aacttgtacaaaagtttgaacttggctcatcttccatagcc

SEQ ID NO: 87698 - DNA, 40 bp, Artificial Sequence
  Description of Artificial Sequence: Synthetic oligonucleotide
acttgtacaaaagtttgaacttggctcatcttccatagcc

SEQ ID NO: 87699 - DNA, 39 bp, Artificial Sequence
  Description of Artificial Sequence: Synthetic oligonucleotide
cttgtacaaaagtttgaacttggctcatcttccatagcc

SEQ ID NO: 87700 - DNA, 39 bp, Artificial Sequence
  Description of Artificial Sequence: Synthetic oligonucleotide
ttgtacaaaagtttgaacttggctcatcttccatagccc

SEQ ID NO: 87701 - DNA, 38 bp, Artificial Sequence
  Description of Artificial Sequence: Synthetic oligonucleotide
tgtacaaaagtttgaacttggctcatcttccatagccc

SEQ ID NO: 87702 - DNA, 37 bp, Artificial Sequence
  Description of Artificial Sequence: Synthetic oligonucleotide
gtacaaaagtttgaacttggctcatcttccatagccc

SEQ ID NO: 87703 - DNA, 38 bp, Artificial Sequence
  Description of Artificial Sequence: Synthetic oligonucleotide
tacaaaagtttgaacttggctcatcttccatagcccac

SEQ ID NO: 87704 - DNA, 37 bp, Artificial Sequence
  Description of Artificial Sequence: Synthetic oligonucleotide
acaaaagtttgaacttggctcatcttccatagcccac

SEQ ID NO: 87705 - DNA, 36 bp, Artificial Sequence
  Description of Artificial Sequence: Synthetic oligonucleotide
caaaagtttgaacttggctcatcttccatagcccac

SEQ ID NO: 87706 - DNA, 38 bp, Artificial Sequence
  Description of Artificial Sequence: Synthetic oligonucleotide
aaaagtttgaacttggctcatcttccatagcccacatg

SEQ ID NO: 87707 - DNA, 37 bp, Artificial Sequence
  Description of Artificial Sequence: Synthetic oligonucleotide
aaagtttgaacttggctcatcttccatagcccacatg

SEQ ID NO: 87708 - DNA, 36 bp, Artificial Sequence
  Description of Artificial Sequence: Synthetic oligonucleotide
aagtttgaacttggctcatcttccatagcccacatg

SEQ ID NO: 87709 - DNA, 35 bp, Artificial Sequence
  Description of Artificial Sequence: Synthetic oligonucleotide
agtttgaacttggctcatcttccatagcccacatg

SEQ ID NO: 87710 - DNA, 34 bp, Artificial Sequence
  Description of Artificial Sequence: Synthetic oligonucleotide
gtttgaacttggctcatcttccatagcccacatg

SEQ ID NO: 87711 - DNA, 34 bp, Artificial Sequence
  Description of Artificial Sequence: Synthetic oligonucleotide
tttgaacttggctcatcttccatagcccacatgg

SEQ ID NO: 87712 - DNA, 33 bp, Artificial Sequence
  Description of Artificial Sequence: Synthetic oligonucleotide
ttgaacttggctcatcttccatagcccacatgg

SEQ ID NO: 87713 - DNA, 32 bp, Artificial Sequence
  Description of Artificial Sequence: Synthetic oligonucleotide
tgaacttggctcatcttccatagcccacatgg

SEQ ID NO: 87714 - DNA, 31 bp, Artificial Sequence
  Description of Artificial Sequence: Synthetic oligonucleotide
gaacttggctcatcttccatagcccacatgg

SEQ ID NO: 87715 - DNA, 35 bp, Artificial Sequence
  Description of Artificial Sequence: Synthetic oligonucleotide
aacttggctcatcttccatagcccacatggtaatg

SEQ ID NO: 87716 - DNA, 34 bp, Artificial Sequence
  Description of Artificial Sequence: Synthetic oligonucleotide
acttggctcatcttccatagcccacatggtaatg

SEQ ID NO: 87717 - DNA, 33 bp, Artificial Sequence
  Description of Artificial Sequence: Synthetic oligonucleotide
cttggctcatcttccatagcccacatggtaatg

SEQ ID NO: 87718 - DNA, 33 bp, Artificial Sequence
  Description of Artificial Sequence: Synthetic oligonucleotide
ttggctcatcttccatagcccacatggtaatgg

SEQ ID NO: 87719 - DNA, 32 bp, Artificial Sequence
  Description of Artificial Sequence: Synthetic oligonucleotide
tggctcatcttccatagcccacatggtaatgg

SEQ ID NO: 87720 - DNA, 31 bp, Artificial Sequence
  Description of Artificial Sequence: Synthetic oligonucleotide
ggctcatcttccatagcccacatggtaatgg

SEQ ID NO: 87721 - DNA, 31 bp, Artificial Sequence
  Description of Artificial Sequence: Synthetic oligonucleotide
gctcatcttccatagcccacatggtaatggg

SEQ ID NO: 87722 - DNA, 33 bp, Artificial Sequence
  Description of Artificial Sequence: Synthetic oligonucleotide
ctcatcttccatagcccacatggtaatgggtac

SEQ ID NO: 87723 - DNA, 35 bp, Artificial Sequence
  Description of Artificial Sequence: Synthetic oligonucleotide
tcatcttccatagcccacatggtaatgggtacaac

SEQ ID NO: 87724 - DNA, 34 bp, Artificial Sequence
  Description of Artificial Sequence: Synthetic oligonucleotide
catcttccatagcccacatggtaatgggtacaac

SEQ ID NO: 87725 - DNA, 38 bp, Artificial Sequence
  Description of Artificial Sequence: Synthetic oligonucleotide
atcttccatagcccacatggtaatgggtacaacaaatc

SEQ ID NO: 87726 - DNA, 37 bp, Artificial Sequence
  Description of Artificial Sequence: Synthetic oligonucleotide
tcttccatagcccacatggtaatgggtacaacaaatc

SEQ ID NO: 87727 - DNA, 36 bp, Artificial Sequence
  Description of Artificial Sequence: Synthetic oligonucleotide
cttccatagcccacatggtaatgggtacaacaaatc

SEQ ID NO: 87728 - DNA, 40 bp, Artificial Sequence
  Description of Artificial Sequence: Synthetic oligonucleotide
ttccatagcccacatggtaatgggtacaacaaatcaattc

SEQ ID NO: 87729 - DNA, 39 bp, Artificial Sequence
  Description of Artificial Sequence: Synthetic oligonucleotide
tccatagcccacatggtaatgggtacaacaaatcaattc

SEQ ID NO: 87730 - DNA, 38 bp, Artificial Sequence
  Description of Artificial Sequence: Synthetic oligonucleotide
ccatagcccacatggtaatgggtacaacaaatcaattc

SEQ ID NO: 87731 - DNA, 39 bp, Artificial Sequence
  Description of Artificial Sequence: Synthetic oligonucleotide
catagcccacatggtaatgggtacaacaaatcaattctc

SEQ ID NO: 87732 - DNA, 39 bp, Artificial Sequence
  Description of Artificial Sequence: Synthetic oligonucleotide
atagcccacatggtaatgggtacaacaaatcaattctcc

SEQ ID NO: 87733 - DNA, 38 bp, Artificial Sequence
  Description of Artificial Sequence: Synthetic oligonucleotide
tagcccacatggtaatgggtacaacaaatcaattctcc

SEQ ID NO: 87734 - DNA, 37 bp, Artificial Sequence
  Description of Artificial Sequence: Synthetic oligonucleotide
agcccacatggtaatgggtacaacaaatcaattctcc

SEQ ID NO: 87735 - DNA, 36 bp, Artificial Sequence
  Description of Artificial Sequence: Synthetic oligonucleotide
gcccacatggtaatgggtacaacaaatcaattctcc

SEQ ID NO: 87736 - DNA, 37 bp, Artificial Sequence
  Description of Artificial Sequence: Synthetic oligonucleotide
cccacatggtaatgggtacaacaaatcaattctccac

SEQ ID NO: 87737 - DNA, 39 bp, Artificial Sequence
  Description of Artificial Sequence: Synthetic oligonucleotide
ccacatggtaatgggtacaacaaatcaattctccacaag

SEQ ID NO: 87738 - DNA, 41 bp, Artificial Sequence
  Description of Artificial Sequence: Synthetic oligonucleotide
cacatggtaatgggtacaacaaatcaattctccacaagaac

SEQ ID NO: 87739 - DNA, 42 bp, Artificial Sequence
  Description of Artificial Sequence: Synthetic oligonucleotide
acatggtaatgggtacaacaaatcaattctccacaagaacac

SEQ ID NO: 87740 - DNA, 41 bp, Artificial Sequence
  Description of Artificial Sequence: Synthetic oligonucleotide
catggtaatgggtacaacaaatcaattctccacaagaacac

SEQ ID NO: 87741 - DNA, 41 bp, Artificial Sequence
  Description of Artificial Sequence: Synthetic oligonucleotide
atggtaatgggtacaacaaatcaattctccacaagaacacg

SEQ ID NO: 87742 - DNA, 40 bp, Artificial Sequence
  Description of Artificial Sequence: Synthetic oligonucleotide
tggtaatgggtacaacaaatcaattctccacaagaacacg

SEQ ID NO: 87743 - DNA, 39 bp, Artificial Sequence
  Description of Artificial Sequence: Synthetic oligonucleotide
ggtaatgggtacaacaaatcaattctccacaagaacacg

SEQ ID NO: 87744 - DNA, 39 bp, Artificial Sequence
  Description of Artificial Sequence: Synthetic oligonucleotide
gtaatgggtacaacaaatcaattctccacaagaacacgg

SEQ ID NO: 87745 - DNA, 39 bp, Artificial Sequence
  Description of Artificial Sequence: Synthetic oligonucleotide
taatgggtacaacaaatcaattctccacaagaacacggc

SEQ ID NO: 87746 - DNA, 38 bp, Artificial Sequence
  Description of Artificial Sequence: Synthetic oligonucleotide
aatgggtacaacaaatcaattctccacaagaacacggc

SEQ ID NO: 87747 - DNA, 37 bp, Artificial Sequence
  Description of Artificial Sequence: Synthetic oligonucleotide
atgggtacaacaaatcaattctccacaagaacacggc

SEQ ID NO: 87748 - DNA, 36 bp, Artificial Sequence
  Description of Artificial Sequence: Synthetic oligonucleotide
tgggtacaacaaatcaattctccacaagaacacggc

SEQ ID NO: 87749 - DNA, 35 bp, Artificial Sequence
  Description of Artificial Sequence: Synthetic oligonucleotide
gggtacaacaaatcaattctccacaagaacacggc

SEQ ID NO: 87750 - DNA, 37 bp, Artificial Sequence
  Description of Artificial Sequence: Synthetic oligonucleotide
ggtacaacaaatcaattctccacaagaacacggcttg

SEQ ID NO: 87751 - DNA, 39 bp, Artificial Sequence
  Description of Artificial Sequence: Synthetic oligonucleotide
gtacaacaaatcaattctccacaagaacacggcttgaag

SEQ ID NO: 87752 - DNA, 40 bp, Artificial Sequence
  Description of Artificial Sequence: Synthetic oligonucleotide
tacaacaaatcaattctccacaagaacacggcttgaagag

SEQ ID NO: 87753 - DNA, 39 bp, Artificial Sequence
  Description of Artificial Sequence: Synthetic oligonucleotide
acaacaaatcaattctccacaagaacacggcttgaagag

SEQ ID NO: 87754 - DNA, 38 bp, Artificial Sequence
  Description of Artificial Sequence: Synthetic oligonucleotide
caacaaatcaattctccacaagaacacggcttgaagag

SEQ ID NO: 87755 - DNA, 38 bp, Artificial Sequence
  Description of Artificial Sequence: Synthetic oligonucleotide
aacaaatcaattctccacaagaacacggcttgaagagg

SEQ ID NO: 87756 - DNA, 37 bp, Artificial Sequence
  Description of Artificial Sequence: Synthetic oligonucleotide
acaaatcaattctccacaagaacacggcttgaagagg

SEQ ID NO: 87757 - DNA, 36 bp, Artificial Sequence
  Description of Artificial Sequence: Synthetic oligonucleotide
caaatcaattctccacaagaacacggcttgaagagg

SEQ ID NO: 87758 - DNA, 41 bp, Artificial Sequence
  Description of Artificial Sequence: Synthetic oligonucleotide
aaatcaattctccacaagaacacggcttgaagaggtaaaag

SEQ ID NO: 87759 - DNA, 40 bp, Artificial Sequence
  Description of Artificial Sequence: Synthetic oligonucleotide
aatcaattctccacaagaacacggcttgaagaggtaaaag

SEQ ID NO: 87760 - DNA, 39 bp, Artificial Sequence
  Description of Artificial Sequence: Synthetic oligonucleotide
atcaattctccacaagaacacggcttgaagaggtaaaag

SEQ ID NO: 87761 - DNA, 38 bp, Artificial Sequence
  Description of Artificial Sequence: Synthetic oligonucleotide
tcaattctccacaagaacacggcttgaagaggtaaaag

SEQ ID NO: 87762 - DNA, 37 bp, Artificial Sequence
  Description of Artificial Sequence: Synthetic oligonucleotide
caattctccacaagaacacggcttgaagaggtaaaag

SEQ ID NO: 87763 - DNA, 37 bp, Artificial Sequence
  Description of Artificial Sequence: Synthetic oligonucleotide
aattctccacaagaacacggcttgaagaggtaaaagg

SEQ ID NO: 87764 - DNA, 36 bp, Artificial Sequence
  Description of Artificial Sequence: Synthetic oligonucleotide
attctccacaagaacacggcttgaagaggtaaaagg

SEQ ID NO: 87765 - DNA, 35 bp, Artificial Sequence
  Description of Artificial Sequence: Synthetic oligonucleotide
ttctccacaagaacacggcttgaagaggtaaaagg

SEQ ID NO: 87766 - DNA, 34 bp, Artificial Sequence
  Description of Artificial Sequence: Synthetic oligonucleotide
tctccacaagaacacggcttgaagaggtaaaagg

SEQ ID NO: 87767 - DNA, 33 bp, Artificial Sequence
  Description of Artificial Sequence: Synthetic oligonucleotide
ctccacaagaacacggcttgaagaggtaaaagg

SEQ ID NO: 87768 - DNA, 36 bp, Artificial Sequence
  Description of Artificial Sequence: Synthetic oligonucleotide
tccacaagaacacggcttgaagaggtaaaaggattc

SEQ ID NO: 87769 - DNA, 35 bp, Artificial Sequence
  Description of Artificial Sequence: Synthetic oligonucleotide
ccacaagaacacggcttgaagaggtaaaaggattc

SEQ ID NO: 87770 - DNA, 37 bp, Artificial Sequence
  Description of Artificial Sequence: Synthetic oligonucleotide
cacaagaacacggcttgaagaggtaaaaggattcttc

SEQ ID NO: 87771 - DNA, 38 bp, Artificial Sequence
  Description of Artificial Sequence: Synthetic oligonucleotide
acaagaacacggcttgaagaggtaaaaggattcttcag

SEQ ID NO: 87772 - DNA, 37 bp, Artificial Sequence
  Description of Artificial Sequence: Synthetic oligonucleotide
caagaacacggcttgaagaggtaaaaggattcttcag

SEQ ID NO: 87773 - DNA, 37 bp, Artificial Sequence
  Description of Artificial Sequence: Synthetic oligonucleotide
aagaacacggcttgaagaggtaaaaggattcttcagc

SEQ ID NO: 87774 - DNA, 36 bp, Artificial Sequence
  Description of Artificial Sequence: Synthetic oligonucleotide
agaacacggcttgaagaggtaaaaggattcttcagc

SEQ ID NO: 87775 - DNA, 35 bp, Artificial Sequence
  Description of Artificial Sequence: Synthetic oligonucleotide
gaacacggcttgaagaggtaaaaggattcttcagc

SEQ ID NO: 87776 - DNA, 36 bp, Artificial Sequence
  Description of Artificial Sequence: Synthetic oligonucleotide
aacacggcttgaagaggtaaaaggattcttcagctc

SEQ ID NO: 87777 - DNA, 35 bp, Artificial Sequence
  Description of Artificial Sequence: Synthetic oligonucleotide
acacggcttgaagaggtaaaaggattcttcagctc

SEQ ID NO: 87778 - DNA, 34 bp, Artificial Sequence
  Description of Artificial Sequence: Synthetic oligonucleotide
cacggcttgaagaggtaaaaggattcttcagctc

SEQ ID NO: 87779 - DNA, 37 bp, Artificial Sequence
  Description of Artificial Sequence: Synthetic oligonucleotide
acggcttgaagaggtaaaaggattcttcagctctttg

SEQ ID NO: 87780 - DNA, 36 bp, Artificial Sequence
  Description of Artificial Sequence: Synthetic oligonucleotide
cggcttgaagaggtaaaaggattcttcagctctttg

SEQ ID NO: 87781 - DNA, 39 bp, Artificial Sequence
  Description of Artificial Sequence: Synthetic oligonucleotide
ggcttgaagaggtaaaaggattcttcagctctttgaaag

SEQ ID NO: 87782 - DNA, 44 bp, Artificial Sequence
  Description of Artificial Sequence: Synthetic oligonucleotide
gcttgaagaggtaaaaggattcttcagctctttgaaagaaaatg

SEQ ID NO: 87783 - DNA, 44 bp, Artificial Sequence
  Description of Artificial Sequence: Synthetic oligonucleotide
cttgaagaggtaaaaggattcttcagctctttgaaagaaaatgg

SEQ ID NO: 87784 - DNA, 46 bp, Artificial Sequence
  Description of Artificial Sequence: Synthetic oligonucleotide
ttgaagaggtaaaaggattcttcagctctttgaaagaaaatggttc

SEQ ID NO: 87785 - DNA, 45 bp, Artificial Sequence
  Description of Artificial Sequence: Synthetic oligonucleotide
tgaagaggtaaaaggattcttcagctctttgaaagaaaatggttc

SEQ ID NO: 87786 - DNA, 44 bp, Artificial Sequence
  Description of Artificial Sequence: Synthetic oligonucleotide
gaagaggtaaaaggattcttcagctctttgaaagaaaatggttc

SEQ ID NO: 87787 - DNA, 45 bp, Artificial Sequence
  Description of Artificial Sequence: Synthetic oligonucleotide
aagaggtaaaaggattcttcagctctttgaaagaaaatggttctc

SEQ ID NO: 87788 - DNA, 44 bp, Artificial Sequence
  Description of Artificial Sequence: Synthetic oligonucleotide
agaggtaaaaggattcttcagctctttgaaagaaaatggttctc

SEQ ID NO: 87789 - DNA, 43 bp, Artificial Sequence
  Description of Artificial Sequence: Synthetic oligonucleotide
gaggtaaaaggattcttcagctctttgaaagaaaatggttctc

SEQ ID NO: 87790 - DNA, 44 bp, Artificial Sequence
  Description of Artificial Sequence: Synthetic oligonucleotide
aggtaaaaggattcttcagctctttgaaagaaaatggttctcag

SEQ ID NO: 87791 - DNA, 43 bp, Artificial Sequence
  Description of Artificial Sequence: Synthetic oligonucleotide
ggtaaaaggattcttcagctctttgaaagaaaatggttctcag

SEQ ID NO: 87792 - DNA, 43 bp, Artificial Sequence
  Description of Artificial Sequence: Synthetic oligonucleotide
gtaaaaggattcttcagctctttgaaagaaaatggttctcagc

SEQ ID NO: 87793 - DNA, 44 bp, Artificial Sequence
  Description of Artificial Sequence: Synthetic oligonucleotide
taaaaggattcttcagctctttgaaagaaaatggttctcagctc

SEQ ID NO: 87794 - DNA, 43 bp, Artificial Sequence
  Description of Artificial Sequence: Synthetic oligonucleotide
aaaaggattcttcagctctttgaaagaaaatggttctcagctc

SEQ ID NO: 87795 - DNA, 42 bp, Artificial Sequence
  Description of Artificial Sequence: Synthetic oligonucleotide
aaaggattcttcagctctttgaaagaaaatggttctcagctc

SEQ ID NO: 87796 - DNA, 41 bp, Artificial Sequence
  Description of Artificial Sequence: Synthetic oligonucleotide
aaggattcttcagctctttgaaagaaaatggttctcagctc

SEQ ID NO: 87797 - DNA, 40 bp, Artificial Sequence
  Description of Artificial Sequence: Synthetic oligonucleotide
aggattcttcagctctttgaaagaaaatggttctcagctc

SEQ ID NO: 87798 - DNA, 39 bp, Artificial Sequence
  Description of Artificial Sequence: Synthetic oligonucleotide
ggattcttcagctctttgaaagaaaatggttctcagctc

SEQ ID NO: 87799 - DNA, 39 bp, Artificial Sequence
  Description of Artificial Sequence: Synthetic oligonucleotide
gattcttcagctctttgaaagaaaatggttctcagctcc

SEQ ID NO: 87800 - DNA, 39 bp, Artificial Sequence
  Description of Artificial Sequence: Synthetic oligonucleotide
attcttcagctctttgaaagaaaatggttctcagctccg

SEQ ID NO: 87801 - DNA, 38 bp, Artificial Sequence
  Description of Artificial Sequence: Synthetic oligonucleotide
ttcttcagctctttgaaagaaaatggttctcagctccg

SEQ ID NO: 87802 - DNA, 37 bp, Artificial Sequence
  Description of Artificial Sequence: Synthetic oligonucleotide
tcttcagctctttgaaagaaaatggttctcagctccg

SEQ ID NO: 87803 - DNA, 36 bp, Artificial Sequence
  Description of Artificial Sequence: Synthetic oligonucleotide
cttcagctctttgaaagaaaatggttctcagctccg

SEQ ID NO: 87804 - DNA, 38 bp, Artificial Sequence
  Description of Artificial Sequence: Synthetic oligonucleotide
ttcagctctttgaaagaaaatggttctcagctccgttg

SEQ ID NO: 87805 - DNA, 37 bp, Artificial Sequence
  Description of Artificial Sequence: Synthetic oligonucleotide
tcagctctttgaaagaaaatggttctcagctccgttg

SEQ ID NO: 87806 - DNA, 36 bp, Artificial Sequence
  Description of Artificial Sequence: Synthetic oligonucleotide
cagctctttgaaagaaaatggttctcagctccgttg

SEQ ID NO: 87807 - DNA, 37 bp, Artificial Sequence
  Description of Artificial Sequence: Synthetic oligonucleotide
agctctttgaaagaaaatggttctcagctccgttgtg

SEQ ID NO: 87808 - DNA, 36 bp, Artificial Sequence
  Description of Artificial Sequence: Synthetic oligonucleotide
gctctttgaaagaaaatggttctcagctccgttgtg

SEQ ID NO: 87809 - DNA, 37 bp, Artificial Sequence
  Description of Artificial Sequence: Synthetic oligonucleotide
ctctttgaaagaaaatggttctcagctccgttgtgtc

SEQ ID NO: 87810 - DNA, 37 bp, Artificial Sequence
  Description of Artificial Sequence: Synthetic oligonucleotide
tctttgaaagaaaatggttctcagctccgttgtgtcc

SEQ ID NO: 87811 - DNA, 36 bp, Artificial Sequence
  Description of Artificial Sequence: Synthetic oligonucleotide
ctttgaaagaaaatggttctcagctccgttgtgtcc

SEQ ID NO: 87812 - DNA, 38 bp, Artificial Sequence
  Description of Artificial Sequence: Synthetic oligonucleotide
tttgaaagaaaatggttctcagctccgttgtgtccaac

SEQ ID NO: 87813 - DNA, 37 bp, Artificial Sequence
  Description of Artificial Sequence: Synthetic oligonucleotide
ttgaaagaaaatggttctcagctccgttgtgtccaac

SEQ ID NO: 87814 - DNA, 36 bp, Artificial Sequence
  Description of Artificial Sequence: Synthetic oligonucleotide
tgaaagaaaatggttctcagctccgttgtgtccaac

SEQ ID NO: 87815 - DNA, 35 bp, Artificial Sequence
  Description of Artificial Sequence: Synthetic oligonucleotide
gaaagaaaatggttctcagctccgttgtgtccaac

SEQ ID NO: 87816 - DNA, 36 bp, Artificial Sequence
  Description of Artificial Sequence: Synthetic oligonucleotide
aaagaaaatggttctcagctccgttgtgtccaacag

SEQ ID NO: 87817 - DNA, 35 bp, Artificial Sequence
  Description of Artificial Sequence: Synthetic oligonucleotide
aagaaaatggttctcagctccgttgtgtccaacag

SEQ ID NO: 87818 - DNA, 34 bp, Artificial Sequence
  Description of Artificial Sequence: Synthetic oligonucleotide
agaaaatggttctcagctccgttgtgtccaacag

SEQ ID NO: 87819 - DNA, 33 bp, Artificial Sequence
  Description of Artificial Sequence: Synthetic oligonucleotide
gaaaatggttctcagctccgttgtgtccaacag

SEQ ID NO: 87820 - DNA, 34 bp, Artificial Sequence
  Description of Artificial Sequence: Synthetic oligonucleotide
aaaatggttctcagctccgttgtgtccaacagac

SEQ ID NO: 87821 - DNA, 33 bp, Artificial Sequence
  Description of Artificial Sequence: Synthetic oligonucleotide
aaatggttctcagctccgttgtgtccaacagac

SEQ ID NO: 87822 - DNA, 32 bp, Artificial Sequence
  Description of Artificial Sequence: Synthetic oligonucleotide
aatggttctcagctccgttgtgtccaacagac

SEQ ID NO: 87823 - DNA, 31 bp, Artificial Sequence
  Description of Artificial Sequence: Synthetic oligonucleotide
atggttctcagctccgttgtgtccaacagac

SEQ ID NO: 87824 - DNA, 30 bp, Artificial Sequence
  Description of Artificial Sequence: Synthetic oligonucleotide
tggttctcagctccgttgtgtccaacagac

SEQ ID NO: 87825 - DNA, 29 bp, Artificial Sequence
  Description of Artificial Sequence: Synthetic oligonucleotide
ggttctcagctccgttgtgtccaacagac

SEQ ID NO: 87826 - DNA, 33 bp, Artificial Sequence
  Description of Artificial Sequence: Synthetic oligonucleotide
gttctcagctccgttgtgtccaacagacaattg

SEQ ID NO: 87827 - DNA, 36 bp, Artificial Sequence
  Description of Artificial Sequence: Synthetic oligonucleotide
ttctcagctccgttgtgtccaacagacaattgaaac

SEQ ID NO: 87828 - DNA, 35 bp, Artificial Sequence
  Description of Artificial Sequence: Synthetic oligonucleotide
tctcagctccgttgtgtccaacagacaattgaaac

SEQ ID NO: 87829 - DNA, 34 bp, Artificial Sequence
  Description of Artificial Sequence: Synthetic oligonucleotide
ctcagctccgttgtgtccaacagacaattgaaac

SEQ ID NO: 87830 - DNA, 34 bp, Artificial Sequence
  Description of Artificial Sequence: Synthetic oligonucleotide
tcagctccgttgtgtccaacagacaattgaaacc

SEQ ID NO: 87831 - DNA, 33 bp, Artificial Sequence
  Description of Artificial Sequence: Synthetic oligonucleotide
cagctccgttgtgtccaacagacaattgaaacc

SEQ ID NO: 87832 - DNA, 36 bp, Artificial Sequence
  Description of Artificial Sequence: Synthetic oligonucleotide
agctccgttgtgtccaacagacaattgaaaccattg

SEQ ID NO: 87833 - DNA, 35 bp, Artificial Sequence
  Description of Artificial Sequence: Synthetic oligonucleotide
gctccgttgtgtccaacagacaattgaaaccattg

SEQ ID NO: 87834 - DNA, 37 bp, Artificial Sequence
  Description of Artificial Sequence: Synthetic oligonucleotide
ctccgttgtgtccaacagacaattgaaaccattgaag

SEQ ID NO: 87835 - DNA, 41 bp, Artificial Sequence
  Description of Artificial Sequence: Synthetic oligonucleotide
tccgttgtgtccaacagacaattgaaaccattgaagaaaac

SEQ ID NO: 87836 - DNA, 40 bp, Artificial Sequence
  Description of Artificial Sequence: Synthetic oligonucleotide
ccgttgtgtccaacagacaattgaaaccattgaagaaaac

SEQ ID NO: 87837 - DNA, 42 bp, Artificial Sequence
  Description of Artificial Sequence: Synthetic oligonucleotide
cgttgtgtccaacagacaattgaaaccattgaagaaaacatc

SEQ ID NO: 87838 - DNA, 42 bp, Artificial Sequence
  Description of Artificial Sequence: Synthetic oligonucleotide
gttgtgtccaacagacaattgaaaccattgaagaaaacatcg

SEQ ID NO: 87839 - DNA, 42 bp, Artificial Sequence
  Description of Artificial Sequence: Synthetic oligonucleotide
ttgtgtccaacagacaattgaaaccattgaagaaaacatcgg

SEQ ID NO: 87840 - DNA, 41 bp, Artificial Sequence
  Description of Artificial Sequence: Synthetic oligonucleotide
tgtgtccaacagacaattgaaaccattgaagaaaacatcgg

SEQ ID NO: 87841 - DNA, 40 bp, Artificial Sequence
  Description of Artificial Sequence: Synthetic oligonucleotide
gtgtccaacagacaattgaaaccattgaagaaaacatcgg

SEQ ID NO: 87842 - DNA, 42 bp, Artificial Sequence
  Description of Artificial Sequence: Synthetic oligonucleotide
tgtccaacagacaattgaaaccattgaagaaaacatcggttg

SEQ ID NO: 87843 - DNA, 41 bp, Artificial Sequence
  Description of Artificial Sequence: Synthetic oligonucleotide
gtccaacagacaattgaaaccattgaagaaaacatcggttg

SEQ ID NO: 87844 - DNA, 41 bp, Artificial Sequence
  Description of Artificial Sequence: Synthetic oligonucleotide
tccaacagacaattgaaaccattgaagaaaacatcggttgg

SEQ ID NO: 87845 - DNA, 40 bp, Artificial Sequence
  Description of Artificial Sequence: Synthetic oligonucleotide
ccaacagacaattgaaaccattgaagaaaacatcggttgg

SEQ ID NO: 87846 - DNA, 42 bp, Artificial Sequence
  Description of Artificial Sequence: Synthetic oligonucleotide
caacagacaattgaaaccattgaagaaaacatcggttggatg

SEQ ID NO: 87847 - DNA, 42 bp, Artificial Sequence
  Description of Artificial Sequence: Synthetic oligonucleotide
aacagacaattgaaaccattgaagaaaacatcggttggatgg

SEQ ID NO: 87848 - DNA, 41 bp, Artificial Sequence
  Description of Artificial Sequence: Synthetic oligonucleotide
acagacaattgaaaccattgaagaaaacatcggttggatgg

SEQ ID NO: 87849 - DNA, 40 bp, Artificial Sequence
  Description of Artificial Sequence: Synthetic oligonucleotide
cagacaattgaaaccattgaagaaaacatcggttggatgg

SEQ ID NO: 87850 - DNA, 44 bp, Artificial Sequence
  Description of Artificial Sequence: Synthetic oligonucleotide
agacaattgaaaccattgaagaaaacatcggttggatggataag

SEQ ID NO: 87851 - DNA, 43 bp, Artificial Sequence
  Description of Artificial Sequence: Synthetic oligonucleotide
gacaattgaaaccattgaagaaaacatcggttggatggataag

SEQ ID NO: 87852 - DNA, 49 bp, Artificial Sequence
  Description of Artificial Sequence: Synthetic oligonucleotide
acaattgaaaccattgaagaaaacatcggttggatggataagaattttg

SEQ ID NO: 87853 - DNA, 48 bp, Artificial Sequence
  Description of Artificial Sequence: Synthetic oligonucleotide
caattgaaaccattgaagaaaacatcggttggatggataagaattttg

SEQ ID NO: 87854 - DNA, 55 bp, Artificial Sequence
  Description of Artificial Sequence: Synthetic oligonucleotide
aattgaaaccattgaagaaaacatcggttggatggataagaattttgataaaatc

SEQ ID NO: 87855 - DNA, 54 bp, Artificial Sequence
  Description of Artificial Sequence: Synthetic oligonucleotide
attgaaaccattgaagaaaacatcggttggatggataagaattttgataaaatc

SEQ ID NO: 87856 - DNA, 53 bp, Artificial Sequence
  Description of Artificial Sequence: Synthetic oligonucleotide
ttgaaaccattgaagaaaacatcggttggatggataagaattttgataaaatc

SEQ ID NO: 87857 - DNA, 52 bp, Artificial Sequence
  Description of Artificial Sequence: Synthetic oligonucleotide
tgaaaccattgaagaaaacatcggttggatggataagaattttgataaaatc

SEQ ID NO: 87858 - DNA, 51 bp, Artificial Sequence
  Description of Artificial Sequence: Synthetic oligonucleotide
gaaaccattgaagaaaacatcggttggatggataagaattttgataaaatc

SEQ ID NO: 87859 - DNA, 52 bp, Artificial Sequence
  Description of Artificial Sequence: Synthetic oligonucleotide
aaaccattgaagaaaacatcggttggatggataagaattttgataaaatcag

SEQ ID NO: 87860 - DNA, 51 bp, Artificial Sequence
  Description of Artificial Sequence: Synthetic oligonucleotide
aaccattgaagaaaacatcggttggatggataagaattttgataaaatcag

SEQ ID NO: 87861 - DNA, 50 bp, Artificial Sequence
  Description of Artificial Sequence: Synthetic oligonucleotide
accattgaagaaaacatcggttggatggataagaattttgataaaatcag

SEQ ID NO: 87862 - DNA, 49 bp, Artificial Sequence
  Description of Artificial Sequence: Synthetic oligonucleotide
ccattgaagaaaacatcggttggatggataagaattttgataaaatcag

SEQ ID NO: 87863 - DNA, 50 bp, Artificial Sequence
  Description of Artificial Sequence: Synthetic oligonucleotide
cattgaagaaaacatcggttggatggataagaattttgataaaatcagag

SEQ ID NO: 87864 - DNA, 51 bp, Artificial Sequence
  Description of Artificial Sequence: Synthetic oligonucleotide
attgaagaaaacatcggttggatggataagaattttgataaaatcagagtg

SEQ ID NO: 87865 - DNA, 50 bp, Artificial Sequence
  Description of Artificial Sequence: Synthetic oligonucleotide
ttgaagaaaacatcggttggatggataagaattttgataaaatcagagtg

SEQ ID NO: 87866 - DNA, 49 bp, Artificial Sequence
  Description of Artificial Sequence: Synthetic oligonucleotide
tgaagaaaacatcggttggatggataagaattttgataaaatcagagtg

SEQ ID NO: 87867 - DNA, 48 bp, Artificial Sequence
  Description of Artificial Sequence: Synthetic oligonucleotide
gaagaaaacatcggttggatggataagaattttgataaaatcagagtg

SEQ ID NO: 87868 - DNA, 49 bp, Artificial Sequence
  Description of Artificial Sequence: Synthetic oligonucleotide
aagaaaacatcggttggatggataagaattttgataaaatcagagtgtg

SEQ ID NO: 87869 - DNA, 48 bp, Artificial Sequence
  Description of Artificial Sequence: Synthetic oligonucleotide
agaaaacatcggttggatggataagaattttgataaaatcagagtgtg

SEQ ID NO: 87870 - DNA, 47 bp, Artificial Sequence
  Description of Artificial Sequence: Synthetic oligonucleotide
gaaaacatcggttggatggataagaattttgataaaatcagagtgtg

SEQ ID NO: 87871 - DNA, 47 bp, Artificial Sequence
  Description of Artificial Sequence: Synthetic oligonucleotide
aaaacatcggttggatggataagaattttgataaaatcagagtgtgg

SEQ ID NO: 87872 - DNA, 46 bp, Artificial Sequence
  Description of Artificial Sequence: Synthetic oligonucleotide
aaacatcggttggatggataagaattttgataaaatcagagtgtgg

SEQ ID NO: 87873 - DNA, 45 bp, Artificial Sequence
  Description of Artificial Sequence: Synthetic oligonucleotide
aacatcggttggatggataagaattttgataaaatcagagtgtgg

SEQ ID NO: 87874 - DNA, 44 bp, Artificial Sequence
  Description of Artificial Sequence: Synthetic oligonucleotide
acatcggttggatggataagaattttgataaaatcagagtgtgg

SEQ ID NO: 87875 - DNA, 43 bp, Artificial Sequence
  Description of Artificial Sequence: Synthetic oligonucleotide
catcggttggatggataagaattttgataaaatcagagtgtgg

SEQ ID NO: 87876 - DNA, 43 bp, Artificial Sequence
  Description of Artificial Sequence: Synthetic oligonucleotide
atcggttggatggataagaattttgataaaatcagagtgtggc

SEQ ID NO: 87877 - DNA, 42 bp, Artificial Sequence
  Description of Artificial Sequence: Synthetic oligonucleotide
tcggttggatggataagaattttgataaaatcagagtgtggc

SEQ ID NO: 87878 - DNA, 41 bp, Artificial Sequence
  Description of Artificial Sequence: Synthetic oligonucleotide
cggttggatggataagaattttgataaaatcagagtgtggc

SEQ ID NO: 87879 - DNA, 42 bp, Artificial Sequence
  Description of Artificial Sequence: Synthetic oligonucleotide
ggttggatggataagaattttgataaaatcagagtgtggctg

SEQ ID NO: 87880 - DNA, 42 bp, Artificial Sequence
  Description of Artificial Sequence: Synthetic oligonucleotide
gttggatggataagaattttgataaaatcagagtgtggctgc

SEQ ID NO: 87881 - DNA, 45 bp, Artificial Sequence
  Description of Artificial Sequence: Synthetic oligonucleotide
ttggatggataagaattttgataaaatcagagtgtggctgcaaag

SEQ ID NO: 87882 - DNA, 44 bp, Artificial Sequence
  Description of Artificial Sequence: Synthetic oligonucleotide
tggatggataagaattttgataaaatcagagtgtggctgcaaag

SEQ ID NO: 87883 - DNA, 43 bp, Artificial Sequence
  Description of Artificial Sequence: Synthetic oligonucleotide
ggatggataagaattttgataaaatcagagtgtggctgcaaag

SEQ ID NO: 87884 - DNA, 44 bp, Artificial Sequence
  Description of Artificial Sequence: Synthetic oligonucleotide
gatggataagaattttgataaaatcagagtgtggctgcaaagtg

SEQ ID NO: 87885 - DNA, 48 bp, Artificial Sequence
  Description of Artificial Sequence: Synthetic oligonucleotide
atggataagaattttgataaaatcagagtgtggctgcaaagtgaaaag

SEQ ID NO: 87886 - DNA, 47 bp, Artificial Sequence
  Description of Artificial Sequence: Synthetic oligonucleotide
tggataagaattttgataaaatcagagtgtggctgcaaagtgaaaag

SEQ ID NO: 87887 - DNA, 46 bp, Artificial Sequence
  Description of Artificial Sequence: Synthetic oligonucleotide
ggataagaattttgataaaatcagagtgtggctgcaaagtgaaaag

SEQ ID NO: 87888 - DNA, 46 bp, Artificial Sequence
  Description of Artificial Sequence: Synthetic oligonucleotide
gataagaattttgataaaatcagagtgtggctgcaaagtgaaaagc

SEQ ID NO: 87889 - DNA, 48 bp, Artificial Sequence
  Description of Artificial Sequence: Synthetic oligonucleotide
ataagaattttgataaaatcagagtgtggctgcaaagtgaaaagcttg

SEQ ID NO: 87890 - DNA, 47 bp, Artificial Sequence
  Description of Artificial Sequence: Synthetic oligonucleotide
taagaattttgataaaatcagagtgtggctgcaaagtgaaaagcttg

SEQ ID NO: 87891 - DNA, 46 bp, Artificial Sequence
  Description of Artificial Sequence: Synthetic oligonucleotide
aagaattttgataaaatcagagtgtggctgcaaagtgaaaagcttg

SEQ ID NO: 87892 - DNA, 45 bp, Artificial Sequence
  Description of Artificial Sequence: Synthetic oligonucleotide
agaattttgataaaatcagagtgtggctgcaaagtgaaaagcttg

SEQ ID NO: 87893 - DNA, 44 bp, Artificial Sequence
  Description of Artificial Sequence: Synthetic oligonucleotide
gaattttgataaaatcagagtgtggctgcaaagtgaaaagcttg

SEQ ID NO: 87894 - DNA, 46 bp, Artificial Sequence
  Description of Artificial Sequence: Synthetic oligonucleotide
aattttgataaaatcagagtgtggctgcaaagtgaaaagcttgaac

SEQ ID NO: 87895 - DNA, 45 bp, Artificial Sequence
  Description of Artificial Sequence: Synthetic oligonucleotide
attttgataaaatcagagtgtggctgcaaagtgaaaagcttgaac

SEQ ID NO: 87896 - DNA, 44 bp, Artificial Sequence
  Description of Artificial Sequence: Synthetic oligonucleotide
ttttgataaaatcagagtgtggctgcaaagtgaaaagcttgaac

SEQ ID NO: 87897 - DNA, 43 bp, Artificial Sequence
  Description of Artificial Sequence: Synthetic oligonucleotide
tttgataaaatcagagtgtggctgcaaagtgaaaagcttgaac

SEQ ID NO: 87898 - DNA, 42 bp, Artificial Sequence
  Description of Artificial Sequence: Synthetic oligonucleotide
ttgataaaatcagagtgtggctgcaaagtgaaaagcttgaac

SEQ ID NO: 87899 - DNA, 41 bp, Artificial Sequence
  Description of Artificial Sequence: Synthetic oligonucleotide
tgataaaatcagagtgtggctgcaaagtgaaaagcttgaac

SEQ ID NO: 87900 - DNA, 40 bp, Artificial Sequence
  Description of Artificial Sequence: Synthetic oligonucleotide
gataaaatcagagtgtggctgcaaagtgaaaagcttgaac

SEQ ID NO: 87901 - DNA, 42 bp, Artificial Sequence
  Description of Artificial Sequence: Synthetic oligonucleotide
ataaaatcagagtgtggctgcaaagtgaaaagcttgaacatg

SEQ ID NO: 87902 - DNA, 41 bp, Artificial Sequence
  Description of Artificial Sequence: Synthetic oligonucleotide
taaaatcagagtgtggctgcaaagtgaaaagcttgaacatg

SEQ ID NO: 87903 - DNA, 40 bp, Artificial Sequence
  Description of Artificial Sequence: Synthetic oligonucleotide
aaaatcagagtgtggctgcaaagtgaaaagcttgaacatg

SEQ ID NO: 87904 - DNA, 39 bp, Artificial Sequence
  Description of Artificial Sequence: Synthetic oligonucleotide
aaatcagagtgtggctgcaaagtgaaaagcttgaacatg

SEQ ID NO: 87905 - DNA, 38 bp, Artificial Sequence
  Description of Artificial Sequence: Synthetic oligonucleotide
aatcagagtgtggctgcaaagtgaaaagcttgaacatg

SEQ ID NO: 87906 - DNA, 37 bp, Artificial Sequence
  Description of Artificial Sequence: Synthetic oligonucleotide
atcagagtgtggctgcaaagtgaaaagcttgaacatg

SEQ ID NO: 87907 - DNA, 36 bp, Artificial Sequence
  Description of Artificial Sequence: Synthetic oligonucleotide
tcagagtgtggctgcaaagtgaaaagcttgaacatg

SEQ ID NO: 87908 - DNA, 35 bp, Artificial Sequence
  Description of Artificial Sequence: Synthetic oligonucleotide
cagagtgtggctgcaaagtgaaaagcttgaacatg

SEQ ID NO: 87909 - DNA, 37 bp, Artificial Sequence
  Description of Artificial Sequence: Synthetic oligonucleotide
agagtgtggctgcaaagtgaaaagcttgaacatgatc

SEQ ID NO: 87910 - DNA, 36 bp, Artificial Sequence
  Description of Artificial Sequence: Synthetic oligonucleotide
gagtgtggctgcaaagtgaaaagcttgaacatgatc

SEQ ID NO: 87911 - DNA, 36 bp, Artificial Sequence
  Description of Artificial Sequence: Synthetic oligonucleotide
agtgtggctgcaaagtgaaaagcttgaacatgatcc

SEQ ID NO: 87912 - DNA, 35 bp, Artificial Sequence
  Description of Artificial Sequence: Synthetic oligonucleotide
gtgtggctgcaaagtgaaaagcttgaacatgatcc

SEQ ID NO: 87913 - DNA, 36 bp, Artificial Sequence
  Description of Artificial Sequence: Synthetic oligonucleotide
tgtggctgcaaagtgaaaagcttgaacatgatcctg

SEQ ID NO: 87914 - DNA, 35 bp, Artificial Sequence
  Description of Artificial Sequence: Synthetic oligonucleotide
gtggctgcaaagtgaaaagcttgaacatgatcctg

SEQ ID NO: 87915 - DNA, 37 bp, Artificial Sequence
  Description of Artificial Sequence: Synthetic oligonucleotide
tggctgcaaagtgaaaagcttgaacatgatcctgaag

SEQ ID NO: 87916 - DNA, 36 bp, Artificial Sequence
  Description of Artificial Sequence: Synthetic oligonucleotide
ggctgcaaagtgaaaagcttgaacatgatcctgaag

SEQ ID NO: 87917 - DNA, 36 bp, Artificial Sequence
  Description of Artificial Sequence: Synthetic oligonucleotide
gctgcaaagtgaaaagcttgaacatgatcctgaagc

SEQ ID NO: 87918 - DNA, 37 bp, Artificial Sequence
  Description of Artificial Sequence: Synthetic oligonucleotide
ctgcaaagtgaaaagcttgaacatgatcctgaagctg

SEQ ID NO: 87919 - DNA, 38 bp, Artificial Sequence
  Description of Artificial Sequence: Synthetic oligonucleotide
tgcaaagtgaaaagcttgaacatgatcctgaagctgac

SEQ ID NO: 87920 - DNA, 37 bp, Artificial Sequence
  Description of Artificial Sequence: Synthetic oligonucleotide
gcaaagtgaaaagcttgaacatgatcctgaagctgac

SEQ ID NO: 87921 - DNA, 37 bp, Artificial Sequence
  Description of Artificial Sequence: Synthetic oligonucleotide
caaagtgaaaagcttgaacatgatcctgaagctgacg

SEQ ID NO: 87922 - DNA, 37 bp, Artificial Sequence
  Description of Artificial Sequence: Synthetic oligonucleotide
aaagtgaaaagcttgaacatgatcctgaagctgacgc

SEQ ID NO: 87923 - DNA, 36 bp, Artificial Sequence
  Description of Artificial Sequence: Synthetic oligonucleotide
aagtgaaaagcttgaacatgatcctgaagctgacgc

SEQ ID NO: 87924 - DNA, 35 bp, Artificial Sequence
  Description of Artificial Sequence: Synthetic oligonucleotide
agtgaaaagcttgaacatgatcctgaagctgacgc

SEQ ID NO: 87925 - DNA, 34 bp, Artificial Sequence
  Description of Artificial Sequence: Synthetic oligonucleotide
gtgaaaagcttgaacatgatcctgaagctgacgc

SEQ ID NO: 87926 - DNA, 36 bp, Artificial Sequence
  Description of Artificial Sequence: Synthetic oligonucleotide
tgaaaagcttgaacatgatcctgaagctgacgcaac

SEQ ID NO: 87927 - DNA, 35 bp, Artificial Sequence
  Description of Artificial Sequence: Synthetic oligonucleotide
gaaaagcttgaacatgatcctgaagctgacgcaac

SEQ ID NO: 87928 - DNA, 36 bp, Artificial Sequence
  Description of Artificial Sequence: Synthetic oligonucleotide
aaaagcttgaacatgatcctgaagctgacgcaacag

SEQ ID NO: 87929 - DNA, 35 bp, Artificial Sequence
  Description of Artificial Sequence: Synthetic oligonucleotide
aaagcttgaacatgatcctgaagctgacgcaacag

SEQ ID NO: 87930 - DNA, 34 bp, Artificial Sequence
  Description of Artificial Sequence: Synthetic oligonucleotide
aagcttgaacatgatcctgaagctgacgcaacag

SEQ ID NO: 87931 - DNA, 33 bp, Artificial Sequence
  Description of Artificial Sequence: Synthetic oligonucleotide
agcttgaacatgatcctgaagctgacgcaacag

SEQ ID NO: 87932 - DNA, 32 bp, Artificial Sequence
  Description of Artificial Sequence: Synthetic oligonucleotide
gcttgaacatgatcctgaagctgacgcaacag

SEQ ID NO: 87933 - DNA, 32 bp, Artificial Sequence
  Description of Artificial Sequence: Synthetic oligonucleotide
cttgaacatgatcctgaagctgacgcaacagg

SEQ ID NO: 87934 - DNA, 34 bp, Artificial Sequence
  Description of Artificial Sequence: Synthetic oligonucleotide
ttgaacatgatcctgaagctgacgcaacaggatg

SEQ ID NO: 87935 - DNA, 33 bp, Artificial Sequence
  Description of Artificial Sequence: Synthetic oligonucleotide
tgaacatgatcctgaagctgacgcaacaggatg

SEQ ID NO: 87936 - DNA, 32 bp, Artificial Sequence
  Description of Artificial Sequence: Synthetic oligonucleotide
gaacatgatcctgaagctgacgcaacaggatg

SEQ ID NO: 87937 - DNA, 27 bp, Artificial Sequence
  Description of Artificial Sequence: Synthetic oligonucleotide
atgtctcgctccgtggccttagctgtg

SEQ ID NO: 87938 - DNA, 26 bp, Artificial Sequence
  Description of Artificial Sequence: Synthetic oligonucleotide
tgtctcgctccgtggccttagctgtg

SEQ ID NO: 87939 - DNA, 25 bp, Artificial Sequence
  Description of Artificial Sequence: Synthetic oligonucleotide
gtctcgctccgtggccttagctgtg

SEQ ID NO: 87940 - DNA, 26 bp, Artificial Sequence
  Description of Artificial Sequence: Synthetic oligonucleotide
tctcgctccgtggccttagctgtgct

SEQ ID NO: 87941 - DNA, 25 bp, Artificial Sequence
  Description of Artificial Sequence: Synthetic oligonucleotide
ctcgctccgtggccttagctgtgct

SEQ ID NO: 87942 - DNA, 25 bp, Artificial Sequence
  Description of Artificial Sequence: Synthetic oligonucleotide
tcgctccgtggccttagctgtgctc

SEQ ID NO: 87943 - DNA, 24 bp, Artificial Sequence
  Description of Artificial Sequence: Synthetic oligonucleotide
cgctccgtggccttagctgtgctc

SEQ ID NO: 87944 - DNA, 24 bp, Artificial Sequence
  Description of Artificial Sequence: Synthetic oligonucleotide
gctccgtggccttagctgtgctcg

SEQ ID NO: 87945 - DNA, 24 bp, Artificial Sequence
  Description of Artificial Sequence: Synthetic oligonucleotide
ctccgtggccttagctgtgctcgc

SEQ ID NO: 87946 - DNA, 24 bp, Artificial Sequence
  Description of Artificial Sequence: Synthetic oligonucleotide
tccgtggccttagctgtgctcgcg

SEQ ID NO: 87947 - DNA, 23 bp, Artificial Sequence
  Description of Artificial Sequence: Synthetic oligonucleotide
ccgtggccttagctgtgctcgcg

SEQ ID NO: 87948 - DNA, 25 bp, Artificial Sequence
  Description of Artificial Sequence: Synthetic oligonucleotide
cgtggccttagctgtgctcgcgcta

SEQ ID NO: 87949 - DNA, 26 bp, Artificial Sequence
  Description of Artificial Sequence: Synthetic oligonucleotide
gtggccttagctgtgctcgcgctact

SEQ ID NO: 87950 - DNA, 27 bp, Artificial Sequence
  Description of Artificial Sequence: Synthetic oligonucleotide
tggccttagctgtgctcgcgctactct

SEQ ID NO: 87951 - DNA, 26 bp, Artificial Sequence
  Description of Artificial Sequence: Synthetic oligonucleotide
ggccttagctgtgctcgcgctactct

SEQ ID NO: 87952 - DNA, 27 bp, Artificial Sequence
  Description of Artificial Sequence: Synthetic oligonucleotide
gccttagctgtgctcgcgctactctct

SEQ ID NO: 87953 - DNA, 27 bp, Artificial Sequence
  Description of Artificial Sequence: Synthetic oligonucleotide
ccttagctgtgctcgcgctactctctc

SEQ ID NO: 87954 - DNA, 30 bp, Artificial Sequence
  Description of Artificial Sequence: Synthetic oligonucleotide
cttagctgtgctcgcgctactctctctttc

SEQ ID NO: 87955 - DNA, 31 bp, Artificial Sequence
  Description of Artificial Sequence: Synthetic oligonucleotide
ttagctgtgctcgcgctactctctctttctg

SEQ ID NO: 87956 - DNA, 30 bp, Artificial Sequence
  Description of Artificial Sequence: Synthetic oligonucleotide
tagctgtgctcgcgctactctctctttctg

SEQ ID NO: 87957 - DNA, 29 bp, Artificial Sequence
  Description of Artificial Sequence: Synthetic oligonucleotide
agctgtgctcgcgctactctctctttctg

SEQ ID NO: 87958 - DNA, 28 bp, Artificial Sequence
  Description of Artificial Sequence: Synthetic oligonucleotide
gctgtgctcgcgctactctctctttctg

SEQ ID NO: 87959 - DNA, 28 bp, Artificial Sequence
  Description of Artificial Sequence: Synthetic oligonucleotide
ctgtgctcgcgctactctctctttctgg

SEQ ID NO: 87960 - DNA, 28 bp, Artificial Sequence
  Description of Artificial Sequence: Synthetic oligonucleotide
tgtgctcgcgctactctctctttctggc

SEQ ID NO: 87961 - DNA, 27 bp, Artificial Sequence
  Description of Artificial Sequence: Synthetic oligonucleotide
gtgctcgcgctactctctctttctggc

SEQ ID NO: 87962 - DNA, 27 bp, Artificial Sequence
  Description of Artificial Sequence: Synthetic oligonucleotide
tgctcgcgctactctctctttctggcc

SEQ ID NO: 87963 - DNA, 27 bp, Artificial Sequence
  Description of Artificial Sequence: Synthetic oligonucleotide
gctcgcgctactctctctttctggcct

SEQ ID NO: 87964 - DNA, 27 bp, Artificial Sequence
  Description of Artificial Sequence: Synthetic oligonucleotide
ctcgcgctactctctctttctggcctg

SEQ ID NO: 87965 - DNA, 27 bp, Artificial Sequence
  Description of Artificial Sequence: Synthetic oligonucleotide
tcgcgctactctctctttctggcctgg

SEQ ID NO: 87966 - DNA, 27 bp, Artificial Sequence
  Description of Artificial Sequence: Synthetic oligonucleotide
cgcgctactctctctttctggcctgga

SEQ ID NO: 87967 - DNA, 27 bp, Artificial Sequence
  Description of Artificial Sequence: Synthetic oligonucleotide
gcgctactctctctttctggcctggag

SEQ ID NO: 87968 - DNA, 27 bp, Artificial Sequence
  Description of Artificial Sequence: Synthetic oligonucleotide
cgctactctctctttctggcctggagg

SEQ ID NO: 87969 - DNA, 27 bp, Artificial Sequence
  Description of Artificial Sequence: Synthetic oligonucleotide
gctactctctctttctggcctggaggc

SEQ ID NO: 87970 - DNA, 30 bp, Artificial Sequence
  Description of Artificial Sequence: Synthetic oligonucleotide
ctactctctctttctggcctggaggctatc

SEQ ID NO: 87971 - DNA, 30 bp, Artificial Sequence
  Description of Artificial Sequence: Synthetic oligonucleotide
tactctctctttctggcctggaggctatcc

SEQ ID NO: 87972 - DNA, 29 bp, Artificial Sequence
  Description of Artificial Sequence: Synthetic oligonucleotide
actctctctttctggcctggaggctatcc

SEQ ID NO: 87973 - DNA, 28 bp, Artificial Sequence
  Description of Artificial Sequence: Synthetic oligonucleotide
ctctctctttctggcctggaggctatcc

SEQ ID NO: 87974 - DNA, 29 bp, Artificial Sequence
  Description of Artificial Sequence: Synthetic oligonucleotide
tctctctttctggcctggaggctatccag

SEQ ID NO: 87975 - DNA, 28 bp, Artificial Sequence
  Description of Artificial Sequence: Synthetic oligonucleotide
ctctctttctggcctggaggctatccag

SEQ ID NO: 87976 - DNA, 28 bp, Artificial Sequence
  Description of Artificial Sequence: Synthetic oligonucleotide
tctctttctggcctggaggctatccagc

SEQ ID NO: 87977 - DNA, 27 bp, Artificial Sequence
  Description of Artificial Sequence: Synthetic oligonucleotide
ctctttctggcctggaggctatccagc

SEQ ID NO: 87978 - DNA, 27 bp, Artificial Sequence
  Description of Artificial Sequence: Synthetic oligonucleotide
tctttctggcctggaggctatccagcg

SEQ ID NO: 87979 - DNA, 27 bp, Artificial Sequence
  Description of Artificial Sequence: Synthetic oligonucleotide
ctttctggcctggaggctatccagcgt

SEQ ID NO: 87980 - DNA, 28 bp, Artificial Sequence
  Description of Artificial Sequence: Synthetic oligonucleotide
tttctggcctggaggctatccagcgtac

SEQ ID NO: 87981 - DNA, 27 bp, Artificial Sequence
  Description of Artificial Sequence: Synthetic oligonucleotide
ttctggcctggaggctatccagcgtac

SEQ ID NO: 87982 - DNA, 27 bp, Artificial Sequence
  Description of Artificial Sequence: Synthetic oligonucleotide
tctggcctggaggctatccagcgtact

SEQ ID NO: 87983 - DNA, 26 bp, Artificial Sequence
  Description of Artificial Sequence: Synthetic oligonucleotide
ctggcctggaggctatccagcgtact

SEQ ID NO: 87984 - DNA, 26 bp, Artificial Sequence
  Description of Artificial Sequence: Synthetic oligonucleotide
tggcctggaggctatccagcgtactc

SEQ ID NO: 87985 - DNA, 25 bp, Artificial Sequence
  Description of Artificial Sequence: Synthetic oligonucleotide
ggcctggaggctatccagcgtactc

SEQ ID NO: 87986 - DNA, 27 bp, Artificial Sequence
  Description of Artificial Sequence: Synthetic oligonucleotide
gcctggaggctatccagcgtactccaa

SEQ ID NO: 87987 - DNA, 28 bp, Artificial Sequence
  Description of Artificial Sequence: Synthetic oligonucleotide
cctggaggctatccagcgtactccaaag

SEQ ID NO: 87988 - DNA, 31 bp, Artificial Sequence
  Description of Artificial Sequence: Synthetic oligonucleotide
ctggaggctatccagcgtactccaaagattc

SEQ ID NO: 87989 - DNA, 32 bp, Artificial Sequence
  Description of Artificial Sequence: Synthetic oligonucleotide
tggaggctatccagcgtactccaaagattcag

SEQ ID NO: 87990 - DNA, 31 bp, Artificial Sequence
  Description of Artificial Sequence: Synthetic oligonucleotide
ggaggctatccagcgtactccaaagattcag

SEQ ID NO: 87991 - DNA, 31 bp, Artificial Sequence
  Description of Artificial Sequence: Synthetic oligonucleotide
gaggctatccagcgtactccaaagattcagg

SEQ ID NO: 87992 - DNA, 35 bp, Artificial Sequence
  Description of Artificial Sequence: Synthetic oligonucleotide
aggctatccagcgtactccaaagattcaggtttac

SEQ ID NO: 87993 - DNA, 34 bp, Artificial Sequence
  Description of Artificial Sequence: Synthetic oligonucleotide
ggctatccagcgtactccaaagattcaggtttac

SEQ ID NO: 87994 - DNA, 35 bp, Artificial Sequence
  Description of Artificial Sequence: Synthetic oligonucleotide
gctatccagcgtactccaaagattcaggtttactc

SEQ ID NO: 87995 - DNA, 36 bp, Artificial Sequence
  Description of Artificial Sequence: Synthetic oligonucleotide
ctatccagcgtactccaaagattcaggtttactcac

SEQ ID NO: 87996 - DNA, 36 bp, Artificial Sequence
  Description of Artificial Sequence: Synthetic oligonucleotide
tatccagcgtactccaaagattcaggtttactcacg

SEQ ID NO: 87997 - DNA, 35 bp, Artificial Sequence
  Description of Artificial Sequence: Synthetic oligonucleotide
atccagcgtactccaaagattcaggtttactcacg

SEQ ID NO: 87998 - DNA, 34 bp, Artificial Sequence
  Description of Artificial Sequence: Synthetic oligonucleotide
tccagcgtactccaaagattcaggtttactcacg

SEQ ID NO: 87999 - DNA, 33 bp, Artificial Sequence
  Description of Artificial Sequence: Synthetic oligonucleotide
ccagcgtactccaaagattcaggtttactcacg

SEQ ID NO: 88000 - DNA, 34 bp, Artificial Sequence
  Description of Artificial Sequence: Synthetic oligonucleotide
cagcgtactccaaagattcaggtttactcacgtc

SEQ ID NO: 88001 - DNA, 36 bp, Artificial Sequence
  Description of Artificial Sequence: Synthetic oligonucleotide
agcgtactccaaagattcaggtttactcacgtcatc

SEQ ID NO: 88002 - DNA, 35 bp, Artificial Sequence
  Description of Artificial Sequence: Synthetic oligonucleotide
gcgtactccaaagattcaggtttactcacgtcatc

SEQ ID NO: 88003 - DNA, 35 bp, Artificial Sequence
  Description of Artificial Sequence: Synthetic oligonucleotide
cgtactccaaagattcaggtttactcacgtcatcc

SEQ ID NO: 88004 - DNA, 36 bp, Artificial Sequence
  Description of Artificial Sequence: Synthetic oligonucleotide
gtactccaaagattcaggtttactcacgtcatccag

SEQ ID NO: 88005 - DNA, 36 bp, Artificial Sequence
  Description of Artificial Sequence: Synthetic oligonucleotide
tactccaaagattcaggtttactcacgtcatccagc

SEQ ID NO: 88006 - DNA, 35 bp, Artificial Sequence
  Description of Artificial Sequence: Synthetic oligonucleotide
actccaaagattcaggtttactcacgtcatccagc

SEQ ID NO: 88007 - DNA, 34 bp, Artificial Sequence
  Description of Artificial Sequence: Synthetic oligonucleotide
ctccaaagattcaggtttactcacgtcatccagc

SEQ ID NO: 88008 - DNA, 35 bp, Artificial Sequence
  Description of Artificial Sequence: Synthetic oligonucleotide
tccaaagattcaggtttactcacgtcatccagcag

SEQ ID NO: 88009 - DNA, 34 bp, Artificial Sequence
  Description of Artificial Sequence: Synthetic oligonucleotide
ccaaagattcaggtttactcacgtcatccagcag

SEQ ID NO: 88010 - DNA, 35 bp, Artificial Sequence
  Description of Artificial Sequence: Synthetic oligonucleotide
caaagattcaggtttactcacgtcatccagcagag

SEQ ID NO: 88011 - DNA, 38 bp, Artificial Sequence
  Description of Artificial Sequence: Synthetic oligonucleotide
aaagattcaggtttactcacgtcatccagcagagaatg

SEQ ID NO: 88012 - DNA, 37 bp, Artificial Sequence
  Description of Artificial Sequence: Synthetic oligonucleotide
aagattcaggtttactcacgtcatccagcagagaatg

SEQ ID NO: 88013 - DNA, 36 bp, Artificial Sequence
  Description of Artificial Sequence: Synthetic oligonucleotide
agattcaggtttactcacgtcatccagcagagaatg

SEQ ID NO: 88014 - DNA, 35 bp, Artificial Sequence
  Description of Artificial Sequence: Synthetic oligonucleotide
gattcaggtttactcacgtcatccagcagagaatg

SEQ ID NO: 88015 - DNA, 35 bp, Artificial Sequence
  Description of Artificial Sequence: Synthetic oligonucleotide
attcaggtttactcacgtcatccagcagagaatgg

SEQ ID NO: 88016 - DNA, 34 bp, Artificial Sequence
  Description of Artificial Sequence: Synthetic oligonucleotide
ttcaggtttactcacgtcatccagcagagaatgg

SEQ ID NO: 88017 - DNA, 33 bp, Artificial Sequence
  Description of Artificial Sequence: Synthetic oligonucleotide
tcaggtttactcacgtcatccagcagagaatgg

SEQ ID NO: 88018 - DNA, 32 bp, Artificial Sequence
  Description of Artificial Sequence: Synthetic oligonucleotide
caggtttactcacgtcatccagcagagaatgg

SEQ ID NO: 88019 - DNA, 35 bp, Artificial Sequence
  Description of Artificial Sequence: Synthetic oligonucleotide
aggtttactcacgtcatccagcagagaatggaaag

SEQ ID NO: 88020 - DNA, 34 bp, Artificial Sequence
  Description of Artificial Sequence: Synthetic oligonucleotide
ggtttactcacgtcatccagcagagaatggaaag

SEQ ID NO: 88021 - DNA, 35 bp, Artificial Sequence
  Description of Artificial Sequence: Synthetic oligonucleotide
gtttactcacgtcatccagcagagaatggaaagtc

SEQ ID NO: 88022 - DNA, 41 bp, Artificial Sequence
  Description of Artificial Sequence: Synthetic oligonucleotide
tttactcacgtcatccagcagagaatggaaagtcaaatttc

SEQ ID NO: 88023 - DNA, 40 bp, Artificial Sequence
  Description of Artificial Sequence: Synthetic oligonucleotide
ttactcacgtcatccagcagagaatggaaagtcaaatttc

SEQ ID NO: 88024 - DNA, 39 bp, Artificial Sequence
  Description of Artificial Sequence: Synthetic oligonucleotide
tactcacgtcatccagcagagaatggaaagtcaaatttc

SEQ ID NO: 88025 - DNA, 38 bp, Artificial Sequence
  Description of Artificial Sequence: Synthetic oligonucleotide
actcacgtcatccagcagagaatggaaagtcaaatttc

SEQ ID NO: 88026 - DNA, 37 bp, Artificial Sequence
  Description of Artificial Sequence: Synthetic oligonucleotide
ctcacgtcatccagcagagaatggaaagtcaaatttc

SEQ ID NO: 88027 - DNA, 37 bp, Artificial Sequence
  Description of Artificial Sequence: Synthetic oligonucleotide
tcacgtcatccagcagagaatggaaagtcaaatttcc

SEQ ID NO: 88028 - DNA, 36 bp, Artificial Sequence
  Description of Artificial Sequence: Synthetic oligonucleotide
cacgtcatccagcagagaatggaaagtcaaatttcc

SEQ ID NO: 88029 - DNA, 37 bp, Artificial Sequence
  Description of Artificial Sequence: Synthetic oligonucleotide
acgtcatccagcagagaatggaaagtcaaatttcctg

SEQ ID NO: 88030 - DNA, 36 bp, Artificial Sequence
  Description of Artificial Sequence: Synthetic oligonucleotide
cgtcatccagcagagaatggaaagtcaaatttcctg

SEQ ID NO: 88031 - DNA, 40 bp, Artificial Sequence
  Description of Artificial Sequence: Synthetic oligonucleotide
gtcatccagcagagaatggaaagtcaaatttcctgaattg

SEQ ID NO: 88032 - DNA, 40 bp, Artificial Sequence
  Description of Artificial Sequence: Synthetic oligonucleotide
tcatccagcagagaatggaaagtcaaatttcctgaattgc

SEQ ID NO: 88033 - DNA, 39 bp, Artificial Sequence
  Description of Artificial Sequence: Synthetic oligonucleotide
catccagcagagaatggaaagtcaaatttcctgaattgc

SEQ ID NO: 88034 - DNA, 42 bp, Artificial Sequence
  Description of Artificial Sequence: Synthetic oligonucleotide
atccagcagagaatggaaagtcaaatttcctgaattgctatg

SEQ ID NO: 88035 - DNA, 41 bp, Artificial Sequence
  Description of Artificial Sequence: Synthetic oligonucleotide
tccagcagagaatggaaagtcaaatttcctgaattgctatg

SEQ ID NO: 88036 - DNA, 40 bp, Artificial Sequence
  Description of Artificial Sequence: Synthetic oligonucleotide
ccagcagagaatggaaagtcaaatttcctgaattgctatg

SEQ ID NO: 88037 - DNA, 41 bp, Artificial Sequence
  Description of Artificial Sequence: Synthetic oligonucleotide
cagcagagaatggaaagtcaaatttcctgaattgctatgtg

SEQ ID NO: 88038 - DNA, 42 bp, Artificial Sequence
  Description of Artificial Sequence: Synthetic oligonucleotide
agcagagaatggaaagtcaaatttcctgaattgctatgtgtc

SEQ ID NO: 88039 - DNA, 41 bp, Artificial Sequence
  Description of Artificial Sequence: Synthetic oligonucleotide
gcagagaatggaaagtcaaatttcctgaattgctatgtgtc

SEQ ID NO: 88040 - DNA, 42 bp, Artificial Sequence
  Description of Artificial Sequence: Synthetic oligonucleotide
cagagaatggaaagtcaaatttcctgaattgctatgtgtctg

SEQ ID NO: 88041 - DNA, 42 bp, Artificial Sequence
  Description of Artificial Sequence: Synthetic oligonucleotide
agagaatggaaagtcaaatttcctgaattgctatgtgtctgg

SEQ ID NO: 88042 - DNA, 41 bp, Artificial Sequence
  Description of Artificial Sequence: Synthetic oligonucleotide
gagaatggaaagtcaaatttcctgaattgctatgtgtctgg

SEQ ID NO: 88043 - DNA, 41 bp, Artificial Sequence
  Description of Artificial Sequence: Synthetic oligonucleotide
agaatggaaagtcaaatttcctgaattgctatgtgtctggg

SEQ ID NO: 88044 - DNA, 40 bp, Artificial Sequence
  Description of Artificial Sequence: Synthetic oligonucleotide
gaatggaaagtcaaatttcctgaattgctatgtgtctggg

SEQ ID NO: 88045 - DNA, 43 bp, Artificial Sequence
  Description of Artificial Sequence: Synthetic oligonucleotide
aatggaaagtcaaatttcctgaattgctatgtgtctgggtttc

SEQ ID NO: 88046 - DNA, 42 bp, Artificial Sequence
  Description of Artificial Sequence: Synthetic oligonucleotide
atggaaagtcaaatttcctgaattgctatgtgtctgggtttc

SEQ ID NO: 88047 - DNA, 41 bp, Artificial Sequence
  Description of Artificial Sequence: Synthetic oligonucleotide
tggaaagtcaaatttcctgaattgctatgtgtctgggtttc

SEQ ID NO: 88048 - DNA, 40 bp, Artificial Sequence
  Description of Artificial Sequence: Synthetic oligonucleotide
ggaaagtcaaatttcctgaattgctatgtgtctgggtttc

SEQ ID NO: 88049 - DNA, 42 bp, Artificial Sequence
  Description of Artificial Sequence: Synthetic oligonucleotide
gaaagtcaaatttcctgaattgctatgtgtctgggtttcatc

SEQ ID NO: 88050 - DNA, 42 bp, Artificial Sequence
  Description of Artificial Sequence: Synthetic oligonucleotide
aaagtcaaatttcctgaattgctatgtgtctgggtttcatcc

SEQ ID NO: 88051 - DNA, 41 bp, Artificial Sequence
  Description of Artificial Sequence: Synthetic oligonucleotide
aagtcaaatttcctgaattgctatgtgtctgggtttcatcc

SEQ ID NO: 88052 - DNA, 40 bp, Artificial Sequence
  Description of Artificial Sequence: Synthetic oligonucleotide
agtcaaatttcctgaattgctatgtgtctgggtttcatcc

SEQ ID NO: 88053 - DNA, 39 bp, Artificial Sequence
  Description of Artificial Sequence: Synthetic oligonucleotide
gtcaaatttcctgaattgctatgtgtctgggtttcatcc

SEQ ID NO: 88054 - DNA, 41 bp, Artificial Sequence
  Description of Artificial Sequence: Synthetic oligonucleotide
tcaaatttcctgaattgctatgtgtctgggtttcatccatc

SEQ ID NO: 88055 - DNA, 40 bp, Artificial Sequence
  Description of Artificial Sequence: Synthetic oligonucleotide
caaatttcctgaattgctatgtgtctgggtttcatccatc

SEQ ID NO: 88056 - DNA, 40 bp, Artificial Sequence
  Description of Artificial Sequence: Synthetic oligonucleotide
aaatttcctgaattgctatgtgtctgggtttcatccatcc

SEQ ID NO: 88057 - DNA, 39 bp, Artificial Sequence
  Description of Artificial Sequence: Synthetic oligonucleotide
aatttcctgaattgctatgtgtctgggtttcatccatcc

SEQ ID NO: 88058 - DNA, 38 bp, Artificial Sequence
  Description of Artificial Sequence: Synthetic oligonucleotide
atttcctgaattgctatgtgtctgggtttcatccatcc

SEQ ID NO: 88059 - DNA, 37 bp, Artificial Sequence
  Description of Artificial Sequence: Synthetic oligonucleotide
tttcctgaattgctatgtgtctgggtttcatccatcc

SEQ ID NO: 88060 - DNA, 36 bp, Artificial Sequence
  Description of Artificial Sequence: Synthetic oligonucleotide
ttcctgaattgctatgtgtctgggtttcatccatcc

SEQ ID NO: 88061 - DNA, 35 bp, Artificial Sequence
  Description of Artificial Sequence: Synthetic oligonucleotide
tcctgaattgctatgtgtctgggtttcatccatcc

SEQ ID NO: 88062 - DNA, 34 bp, Artificial Sequence
  Description of Artificial Sequence: Synthetic oligonucleotide
cctgaattgctatgtgtctgggtttcatccatcc

SEQ ID NO: 88063 - DNA, 34 bp, Artificial Sequence
  Description of Artificial Sequence: Synthetic oligonucleotide
ctgaattgctatgtgtctgggtttcatccatccg

SEQ ID NO: 88064 - DNA, 35 bp, Artificial Sequence
  Description of Artificial Sequence: Synthetic oligonucleotide
tgaattgctatgtgtctgggtttcatccatccgac

SEQ ID NO: 88065 - DNA, 34 bp, Artificial Sequence
  Description of Artificial Sequence: Synthetic oligonucleotide
gaattgctatgtgtctgggtttcatccatccgac

SEQ ID NO: 88066 - DNA, 37 bp, Artificial Sequence
  Description of Artificial Sequence: Synthetic oligonucleotide
aattgctatgtgtctgggtttcatccatccgacattg

SEQ ID NO: 88067 - DNA, 36 bp, Artificial Sequence
  Description of Artificial Sequence: Synthetic oligonucleotide
attgctatgtgtctgggtttcatccatccgacattg

SEQ ID NO: 88068 - DNA, 35 bp, Artificial Sequence
  Description of Artificial Sequence: Synthetic oligonucleotide
ttgctatgtgtctgggtttcatccatccgacattg

SEQ ID NO: 88069 - DNA, 34 bp, Artificial Sequence
  Description of Artificial Sequence: Synthetic oligonucleotide
tgctatgtgtctgggtttcatccatccgacattg

SEQ ID NO: 88070 - DNA, 33 bp, Artificial Sequence
  Description of Artificial Sequence: Synthetic oligonucleotide
gctatgtgtctgggtttcatccatccgacattg

SEQ ID NO: 88071 - DNA, 35 bp, Artificial Sequence
  Description of Artificial Sequence: Synthetic oligonucleotide
ctatgtgtctgggtttcatccatccgacattgaag

SEQ ID NO: 88072 - DNA, 37 bp, Artificial Sequence
  Description of Artificial Sequence: Synthetic oligonucleotide
tatgtgtctgggtttcatccatccgacattgaagttg

SEQ ID NO: 88073 - DNA, 36 bp, Artificial Sequence
  Description of Artificial Sequence: Synthetic oligonucleotide
atgtgtctgggtttcatccatccgacattgaagttg

SEQ ID NO: 88074 - DNA, 35 bp, Artificial Sequence
  Description of Artificial Sequence: Synthetic oligonucleotide
tgtgtctgggtttcatccatccgacattgaagttg

SEQ ID NO: 88075 - DNA, 34 bp, Artificial Sequence
  Description of Artificial Sequence: Synthetic oligonucleotide
gtgtctgggtttcatccatccgacattgaagttg

SEQ ID NO: 88076 - DNA, 35 bp, Artificial Sequence
  Description of Artificial Sequence: Synthetic oligonucleotide
tgtctgggtttcatccatccgacattgaagttgac

SEQ ID NO: 88077 - DNA, 34 bp, Artificial Sequence
  Description of Artificial Sequence: Synthetic oligonucleotide
gtctgggtttcatccatccgacattgaagttgac

SEQ ID NO: 88078 - DNA, 37 bp, Artificial Sequence
  Description of Artificial Sequence: Synthetic oligonucleotide
tctgggtttcatccatccgacattgaagttgacttac

SEQ ID NO: 88079 - DNA, 36 bp, Artificial Sequence
  Description of Artificial Sequence: Synthetic oligonucleotide
ctgggtttcatccatccgacattgaagttgacttac

SEQ ID NO: 88080 - DNA, 37 bp, Artificial Sequence
  Description of Artificial Sequence: Synthetic oligonucleotide
tgggtttcatccatccgacattgaagttgacttactg

SEQ ID NO: 88081 - DNA, 36 bp, Artificial Sequence
  Description of Artificial Sequence: Synthetic oligonucleotide
gggtttcatccatccgacattgaagttgacttactg

SEQ ID NO: 88082 - DNA, 38 bp, Artificial Sequence
  Description of Artificial Sequence: Synthetic oligonucleotide
ggtttcatccatccgacattgaagttgacttactgaag

SEQ ID NO: 88083 - DNA, 41 bp, Artificial Sequence
  Description of Artificial Sequence: Synthetic oligonucleotide
gtttcatccatccgacattgaagttgacttactgaagaatg

SEQ ID NO: 88084 - DNA, 41 bp, Artificial Sequence
  Description of Artificial Sequence: Synthetic oligonucleotide
tttcatccatccgacattgaagttgacttactgaagaatgg

SEQ ID NO: 88085 - DNA, 40 bp, Artificial Sequence
  Description of Artificial Sequence: Synthetic oligonucleotide
ttcatccatccgacattgaagttgacttactgaagaatgg

SEQ ID NO: 88086 - DNA, 39 bp, Artificial Sequence
  Description of Artificial Sequence: Synthetic oligonucleotide
tcatccatccgacattgaagttgacttactgaagaatgg

SEQ ID NO: 88087 - DNA, 38 bp, Artificial Sequence
  Description of Artificial Sequence: Synthetic oligonucleotide
catccatccgacattgaagttgacttactgaagaatgg

SEQ ID NO: 88088 - DNA, 39 bp, Artificial Sequence
  Description of Artificial Sequence: Synthetic oligonucleotide
atccatccgacattgaagttgacttactgaagaatggag

SEQ ID NO: 88089 - DNA, 38 bp, Artificial Sequence
  Description of Artificial Sequence: Synthetic oligonucleotide
tccatccgacattgaagttgacttactgaagaatggag

SEQ ID NO: 88090 - DNA, 37 bp, Artificial Sequence
  Description of Artificial Sequence: Synthetic oligonucleotide
ccatccgacattgaagttgacttactgaagaatggag

SEQ ID NO: 88091 - DNA, 38 bp, Artificial Sequence
  Description of Artificial Sequence: Synthetic oligonucleotide
catccgacattgaagttgacttactgaagaatggagag

SEQ ID NO: 88092 - DNA, 39 bp, Artificial Sequence
  Description of Artificial Sequence: Synthetic oligonucleotide
atccgacattgaagttgacttactgaagaatggagagag

SEQ ID NO: 88093 - DNA, 38 bp, Artificial Sequence
  Description of Artificial Sequence: Synthetic oligonucleotide
tccgacattgaagttgacttactgaagaatggagagag

SEQ ID NO: 88094 - DNA, 37 bp, Artificial Sequence
  Description of Artificial Sequence: Synthetic oligonucleotide
ccgacattgaagttgacttactgaagaatggagagag

SEQ ID NO: 88095 - DNA, 41 bp, Artificial Sequence
  Description of Artificial Sequence: Synthetic oligonucleotide
cgacattgaagttgacttactgaagaatggagagagaattg

SEQ ID NO: 88096 - DNA, 46 bp, Artificial Sequence
  Description of Artificial Sequence: Synthetic oligonucleotide
gacattgaagttgacttactgaagaatggagagagaattgaaaaag

SEQ ID NO: 88097 - DNA, 47 bp, Artificial Sequence
  Description of Artificial Sequence: Synthetic oligonucleotide
acattgaagttgacttactgaagaatggagagagaattgaaaaagtg

SEQ ID NO: 88098 - DNA, 46 bp, Artificial Sequence
  Description of Artificial Sequence: Synthetic oligonucleotide
cattgaagttgacttactgaagaatggagagagaattgaaaaagtg

SEQ ID NO: 88099 - DNA, 46 bp, Artificial Sequence
  Description of Artificial Sequence: Synthetic oligonucleotide
attgaagttgacttactgaagaatggagagagaattgaaaaagtgg

SEQ ID NO: 88100 - DNA, 45 bp, Artificial Sequence
  Description of Artificial Sequence: Synthetic oligonucleotide
ttgaagttgacttactgaagaatggagagagaattgaaaaagtgg

SEQ ID NO: 88101 - DNA, 44 bp, Artificial Sequence
  Description of Artificial Sequence: Synthetic oligonucleotide
tgaagttgacttactgaagaatggagagagaattgaaaaagtgg

SEQ ID NO: 88102 - DNA, 43 bp, Artificial Sequence
  Description of Artificial Sequence: Synthetic oligonucleotide
gaagttgacttactgaagaatggagagagaattgaaaaagtgg

SEQ ID NO: 88103 - DNA, 44 bp, Artificial Sequence
  Description of Artificial Sequence: Synthetic oligonucleotide
aagttgacttactgaagaatggagagagaattgaaaaagtggag

SEQ ID NO: 88104 - DNA, 43 bp, Artificial Sequence
  Description of Artificial Sequence: Synthetic oligonucleotide
agttgacttactgaagaatggagagagaattgaaaaagtggag

SEQ ID NO: 88105 - DNA, 42 bp, Artificial Sequence
  Description of Artificial Sequence: Synthetic oligonucleotide
gttgacttactgaagaatggagagagaattgaaaaagtggag

SEQ ID NO: 88106 - DNA, 42 bp, Artificial Sequence
  Description of Artificial Sequence: Synthetic oligonucleotide
ttgacttactgaagaatggagagagaattgaaaaagtggagc

SEQ ID NO: 88107 - DNA, 41 bp, Artificial Sequence
  Description of Artificial Sequence: Synthetic oligonucleotide
tgacttactgaagaatggagagagaattgaaaaagtggagc

SEQ ID NO: 88108 - DNA, 40 bp, Artificial Sequence
  Description of Artificial Sequence: Synthetic oligonucleotide
gacttactgaagaatggagagagaattgaaaaagtggagc

SEQ ID NO: 88109 - DNA, 43 bp, Artificial Sequence
  Description of Artificial Sequence: Synthetic oligonucleotide
acttactgaagaatggagagagaattgaaaaagtggagcattc

SEQ ID NO: 88110 - DNA, 42 bp, Artificial Sequence
  Description of Artificial Sequence: Synthetic oligonucleotide
cttactgaagaatggagagagaattgaaaaagtggagcattc

SEQ ID NO: 88111 - DNA, 43 bp, Artificial Sequence
  Description of Artificial Sequence: Synthetic oligonucleotide
ttactgaagaatggagagagaattgaaaaagtggagcattcag

SEQ ID NO: 88112 - DNA, 42 bp, Artificial Sequence
  Description of Artificial Sequence: Synthetic oligonucleotide
tactgaagaatggagagagaattgaaaaagtggagcattcag

SEQ ID NO: 88113 - DNA, 41 bp, Artificial Sequence
  Description of Artificial Sequence: Synthetic oligonucleotide
actgaagaatggagagagaattgaaaaagtggagcattcag

SEQ ID NO: 88114 - DNA, 40 bp, Artificial Sequence
  Description of Artificial Sequence: Synthetic oligonucleotide
ctgaagaatggagagagaattgaaaaagtggagcattcag

SEQ ID NO: 88115 - DNA, 41 bp, Artificial Sequence
  Description of Artificial Sequence: Synthetic oligonucleotide
tgaagaatggagagagaattgaaaaagtggagcattcagac

SEQ ID NO: 88116 - DNA, 40 bp, Artificial Sequence
  Description of Artificial Sequence: Synthetic oligonucleotide
gaagaatggagagagaattgaaaaagtggagcattcagac

SEQ ID NO: 88117 - DNA, 42 bp, Artificial Sequence
  Description of Artificial Sequence: Synthetic oligonucleotide
aagaatggagagagaattgaaaaagtggagcattcagacttg

SEQ ID NO: 88118 - DNA, 41 bp, Artificial Sequence
  Description of Artificial Sequence: Synthetic oligonucleotide
agaatggagagagaattgaaaaagtggagcattcagacttg

SEQ ID NO: 88119 - DNA, 40 bp, Artificial Sequence
  Description of Artificial Sequence: Synthetic oligonucleotide
gaatggagagagaattgaaaaagtggagcattcagacttg

SEQ ID NO: 88120 - DNA, 41 bp, Artificial Sequence
  Description of Artificial Sequence: Synthetic oligonucleotide
aatggagagagaattgaaaaagtggagcattcagacttgtc

SEQ ID NO: 88121 - DNA, 40 bp, Artificial Sequence
  Description of Artificial Sequence: Synthetic oligonucleotide
atggagagagaattgaaaaagtggagcattcagacttgtc

SEQ ID NO: 88122 - DNA, 39 bp, Artificial Sequence
  Description of Artificial Sequence: Synthetic oligonucleotide
tggagagagaattgaaaaagtggagcattcagacttgtc

SEQ ID NO: 88123 - DNA, 38 bp, Artificial Sequence
  Description of Artificial Sequence: Synthetic oligonucleotide
ggagagagaattgaaaaagtggagcattcagacttgtc

SEQ ID NO: 88124 - DNA, 41 bp, Artificial Sequence
  Description of Artificial Sequence: Synthetic oligonucleotide
gagagagaattgaaaaagtggagcattcagacttgtctttc

SEQ ID NO: 88125 - DNA, 42 bp, Artificial Sequence
  Description of Artificial Sequence: Synthetic oligonucleotide
agagagaattgaaaaagtggagcattcagacttgtctttcag

SEQ ID NO: 88126 - DNA, 41 bp, Artificial Sequence
  Description of Artificial Sequence: Synthetic oligonucleotide
gagagaattgaaaaagtggagcattcagacttgtctttcag

SEQ ID NO: 88127 - DNA, 41 bp, Artificial Sequence
  Description of Artificial Sequence: Synthetic oligonucleotide
agagaattgaaaaagtggagcattcagacttgtctttcagc

SEQ ID NO: 88128 - DNA, 40 bp, Artificial Sequence
  Description of Artificial Sequence: Synthetic oligonucleotide
gagaattgaaaaagtggagcattcagacttgtctttcagc

SEQ ID NO: 88129 - DNA, 42 bp, Artificial Sequence
  Description of Artificial Sequence: Synthetic oligonucleotide
agaattgaaaaagtggagcattcagacttgtctttcagcaag

SEQ ID NO: 88130 - DNA, 41 bp, Artificial Sequence
  Description of Artificial Sequence: Synthetic oligonucleotide
gaattgaaaaagtggagcattcagacttgtctttcagcaag

SEQ ID NO: 88131 - DNA, 41 bp, Artificial Sequence
  Description of Artificial Sequence: Synthetic oligonucleotide
aattgaaaaagtggagcattcagacttgtctttcagcaagg

SEQ ID NO: 88132 - DNA, 40 bp, Artificial Sequence
  Description of Artificial Sequence: Synthetic oligonucleotide
attgaaaaagtggagcattcagacttgtctttcagcaagg

SEQ ID NO: 88133 - DNA, 39 bp, Artificial Sequence
  Description of Artificial Sequence: Synthetic oligonucleotide
ttgaaaaagtggagcattcagacttgtctttcagcaagg

SEQ ID NO: 88134 - DNA, 38 bp, Artificial Sequence
  Description of Artificial Sequence: Synthetic oligonucleotide
tgaaaaagtggagcattcagacttgtctttcagcaagg

SEQ ID NO: 88135 - DNA, 37 bp, Artificial Sequence
  Description of Artificial Sequence: Synthetic oligonucleotide
gaaaaagtggagcattcagacttgtctttcagcaagg

SEQ ID NO: 88136 - DNA, 38 bp, Artificial Sequence
  Description of Artificial Sequence: Synthetic oligonucleotide
aaaaagtggagcattcagacttgtctttcagcaaggac

SEQ ID NO: 88137 - DNA, 37 bp, Artificial Sequence
  Description of Artificial Sequence: Synthetic oligonucleotide
aaaagtggagcattcagacttgtctttcagcaaggac

SEQ ID NO: 88138 - DNA, 36 bp, Artificial Sequence
  Description of Artificial Sequence: Synthetic oligonucleotide
aaagtggagcattcagacttgtctttcagcaaggac

SEQ ID NO: 88139 - DNA, 35 bp, Artificial Sequence
  Description of Artificial Sequence: Synthetic oligonucleotide
aagtggagcattcagacttgtctttcagcaaggac

SEQ ID NO: 88140 - DNA, 34 bp, Artificial Sequence
  Description of Artificial Sequence: Synthetic oligonucleotide
agtggagcattcagacttgtctttcagcaaggac

SEQ ID NO: 88141 - DNA, 33 bp, Artificial Sequence
  Description of Artificial Sequence: Synthetic oligonucleotide
gtggagcattcagacttgtctttcagcaaggac

SEQ ID NO: 88142 - DNA, 34 bp, Artificial Sequence
  Description of Artificial Sequence: Synthetic oligonucleotide
tggagcattcagacttgtctttcagcaaggactg

SEQ ID NO: 88143 - DNA, 33 bp, Artificial Sequence
  Description of Artificial Sequence: Synthetic oligonucleotide
ggagcattcagacttgtctttcagcaaggactg

SEQ ID NO: 88144 - DNA, 33 bp, Artificial Sequence
  Description of Artificial Sequence: Synthetic oligonucleotide
gagcattcagacttgtctttcagcaaggactgg

SEQ ID NO: 88145 - DNA, 34 bp, Artificial Sequence
  Description of Artificial Sequence: Synthetic oligonucleotide
agcattcagacttgtctttcagcaaggactggtc

SEQ ID NO: 88146 - DNA, 33 bp, Artificial Sequence
  Description of Artificial Sequence: Synthetic oligonucleotide
gcattcagacttgtctttcagcaaggactggtc

SEQ ID NO: 88147 - DNA, 36 bp, Artificial Sequence
  Description of Artificial Sequence: Synthetic oligonucleotide
cattcagacttgtctttcagcaaggactggtctttc

SEQ ID NO: 88148 - DNA, 39 bp, Artificial Sequence
  Description of Artificial Sequence: Synthetic oligonucleotide
attcagacttgtctttcagcaaggactggtctttctatc

SEQ ID NO: 88149 - DNA, 38 bp, Artificial Sequence
  Description of Artificial Sequence: Synthetic oligonucleotide
ttcagacttgtctttcagcaaggactggtctttctatc

SEQ ID NO: 88150 - DNA, 37 bp, Artificial Sequence
  Description of Artificial Sequence: Synthetic oligonucleotide
tcagacttgtctttcagcaaggactggtctttctatc

SEQ ID NO: 88151 - DNA, 36 bp, Artificial Sequence
  Description of Artificial Sequence: Synthetic oligonucleotide
cagacttgtctttcagcaaggactggtctttctatc

SEQ ID NO: 88152 - DNA, 37 bp, Artificial Sequence
  Description of Artificial Sequence: Synthetic oligonucleotide
agacttgtctttcagcaaggactggtctttctatctc

SEQ ID NO: 88153 - DNA, 36 bp, Artificial Sequence
  Description of Artificial Sequence: Synthetic oligonucleotide
gacttgtctttcagcaaggactggtctttctatctc

SEQ ID NO: 88154 - DNA, 38 bp, Artificial Sequence
  Description of Artificial Sequence: Synthetic oligonucleotide
acttgtctttcagcaaggactggtctttctatctcttg

SEQ ID NO: 88155 - DNA, 37 bp, Artificial Sequence
  Description of Artificial Sequence: Synthetic oligonucleotide
cttgtctttcagcaaggactggtctttctatctcttg

SEQ ID NO: 88156 - DNA, 39 bp, Artificial Sequence
  Description of Artificial Sequence: Synthetic oligonucleotide
ttgtctttcagcaaggactggtctttctatctcttgtac

SEQ ID NO: 88157 - DNA, 38 bp, Artificial Sequence
  Description of Artificial Sequence: Synthetic oligonucleotide
tgtctttcagcaaggactggtctttctatctcttgtac

SEQ ID NO: 88158 - DNA, 37 bp, Artificial Sequence
  Description of Artificial Sequence: Synthetic oligonucleotide
gtctttcagcaaggactggtctttctatctcttgtac

SEQ ID NO: 88159 - DNA, 39 bp, Artificial Sequence
  Description of Artificial Sequence: Synthetic oligonucleotide
tctttcagcaaggactggtctttctatctcttgtactac

SEQ ID NO: 88160 - DNA, 38 bp, Artificial Sequence
  Description of Artificial Sequence: Synthetic oligonucleotide
ctttcagcaaggactggtctttctatctcttgtactac

SEQ ID NO: 88161 - DNA, 39 bp, Artificial Sequence
  Description of Artificial Sequence: Synthetic oligonucleotide
tttcagcaaggactggtctttctatctcttgtactacac

SEQ ID NO: 88162 - DNA, 38 bp, Artificial Sequence
  Description of Artificial Sequence: Synthetic oligonucleotide
ttcagcaaggactggtctttctatctcttgtactacac

SEQ ID NO: 88163 - DNA, 37 bp, Artificial Sequence
  Description of Artificial Sequence: Synthetic oligonucleotide
tcagcaaggactggtctttctatctcttgtactacac

SEQ ID NO: 88164 - DNA, 36 bp, Artificial Sequence
  Description of Artificial Sequence: Synthetic oligonucleotide
cagcaaggactggtctttctatctcttgtactacac

SEQ ID NO: 88165 - DNA, 37 bp, Artificial Sequence
  Description of Artificial Sequence: Synthetic oligonucleotide
agcaaggactggtctttctatctcttgtactacactg

SEQ ID NO: 88166 - DNA, 36 bp, Artificial Sequence
  Description of Artificial Sequence: Synthetic oligonucleotide
gcaaggactggtctttctatctcttgtactacactg

SEQ ID NO: 88167 - DNA, 40 bp, Artificial Sequence
  Description of Artificial Sequence: Synthetic oligonucleotide
caaggactggtctttctatctcttgtactacactgaattc

SEQ ID NO: 88168 - DNA, 41 bp, Artificial Sequence
  Description of Artificial Sequence: Synthetic oligonucleotide
aaggactggtctttctatctcttgtactacactgaattcac

SEQ ID NO: 88169 - DNA, 40 bp, Artificial Sequence
  Description of Artificial Sequence: Synthetic oligonucleotide
aggactggtctttctatctcttgtactacactgaattcac

SEQ ID NO: 88170 - DNA, 39 bp, Artificial Sequence
  Description of Artificial Sequence: Synthetic oligonucleotide
ggactggtctttctatctcttgtactacactgaattcac

SEQ ID NO: 88171 - DNA, 39 bp, Artificial Sequence
  Description of Artificial Sequence: Synthetic oligonucleotide
gactggtctttctatctcttgtactacactgaattcacc

SEQ ID NO: 88172 - DNA, 39 bp, Artificial Sequence
  Description of Artificial Sequence: Synthetic oligonucleotide
actggtctttctatctcttgtactacactgaattcaccc

SEQ ID NO: 88173 - DNA, 38 bp, Artificial Sequence
  Description of Artificial Sequence: Synthetic oligonucleotide
ctggtctttctatctcttgtactacactgaattcaccc

SEQ ID NO: 88174 - DNA, 38 bp, Artificial Sequence
  Description of Artificial Sequence: Synthetic oligonucleotide
tggtctttctatctcttgtactacactgaattcacccc

SEQ ID NO: 88175 - DNA, 37 bp, Artificial Sequence
  Description of Artificial Sequence: Synthetic oligonucleotide
ggtctttctatctcttgtactacactgaattcacccc

SEQ ID NO: 88176 - DNA, 37 bp, Artificial Sequence
  Description of Artificial Sequence: Synthetic oligonucleotide
gtctttctatctcttgtactacactgaattcaccccc

SEQ ID NO: 88177 - DNA, 38 bp, Artificial Sequence
  Description of Artificial Sequence: Synthetic oligonucleotide
tctttctatctcttgtactacactgaattcacccccac

SEQ ID NO: 88178 - DNA, 37 bp, Artificial Sequence
  Description of Artificial Sequence: Synthetic oligonucleotide
ctttctatctcttgtactacactgaattcacccccac

SEQ ID NO: 88179 - DNA, 38 bp, Artificial Sequence
  Description of Artificial Sequence: Synthetic oligonucleotide
tttctatctcttgtactacactgaattcacccccactg

SEQ ID NO: 88180 - DNA, 37 bp, Artificial Sequence
  Description of Artificial Sequence: Synthetic oligonucleotide
ttctatctcttgtactacactgaattcacccccactg

SEQ ID NO: 88181 - DNA, 36 bp, Artificial Sequence
  Description of Artificial Sequence: Synthetic oligonucleotide
tctatctcttgtactacactgaattcacccccactg

SEQ ID NO: 88182 - DNA, 35 bp, Artificial Sequence
  Description of Artificial Sequence: Synthetic oligonucleotide
ctatctcttgtactacactgaattcacccccactg

SEQ ID NO: 88183 - DNA, 40 bp, Artificial Sequence
  Description of Artificial Sequence: Synthetic oligonucleotide
tatctcttgtactacactgaattcacccccactgaaaaag

SEQ ID NO: 88184 - DNA, 39 bp, Artificial Sequence
  Description of Artificial Sequence: Synthetic oligonucleotide
atctcttgtactacactgaattcacccccactgaaaaag

SEQ ID NO: 88185 - DNA, 38 bp, Artificial Sequence
  Description of Artificial Sequence: Synthetic oligonucleotide
tctcttgtactacactgaattcacccccactgaaaaag

SEQ ID NO: 88186 - DNA, 37 bp, Artificial Sequence
  Description of Artificial Sequence: Synthetic oligonucleotide
ctcttgtactacactgaattcacccccactgaaaaag

SEQ ID NO: 88187 - DNA, 39 bp, Artificial Sequence
  Description of Artificial Sequence: Synthetic oligonucleotide
tcttgtactacactgaattcacccccactgaaaaagatg

SEQ ID NO: 88188 - DNA, 38 bp, Artificial Sequence
  Description of Artificial Sequence: Synthetic oligonucleotide
cttgtactacactgaattcacccccactgaaaaagatg

SEQ ID NO: 88189 - DNA, 39 bp, Artificial Sequence
  Description of Artificial Sequence: Synthetic oligonucleotide
ttgtactacactgaattcacccccactgaaaaagatgag

SEQ ID NO: 88190 - DNA, 38 bp, Artificial Sequence
  Description of Artificial Sequence: Synthetic oligonucleotide
tgtactacactgaattcacccccactgaaaaagatgag

SEQ ID NO: 88191 - DNA, 37 bp, Artificial Sequence
  Description of Artificial Sequence: Synthetic oligonucleotide
gtactacactgaattcacccccactgaaaaagatgag

SEQ ID NO: 88192 - DNA, 40 bp, Artificial Sequence
  Description of Artificial Sequence: Synthetic oligonucleotide
tactacactgaattcacccccactgaaaaagatgagtatg

SEQ ID NO: 88193 - DNA, 39 bp, Artificial Sequence
  Description of Artificial Sequence: Synthetic oligonucleotide
actacactgaattcacccccactgaaaaagatgagtatg

SEQ ID NO: 88194 - DNA, 38 bp, Artificial Sequence
  Description of Artificial Sequence: Synthetic oligonucleotide
ctacactgaattcacccccactgaaaaagatgagtatg

SEQ ID NO: 88195 - DNA, 38 bp, Artificial Sequence
  Description of Artificial Sequence: Synthetic oligonucleotide
tacactgaattcacccccactgaaaaagatgagtatgc

SEQ ID NO: 88196 - DNA, 37 bp, Artificial Sequence
  Description of Artificial Sequence: Synthetic oligonucleotide
acactgaattcacccccactgaaaaagatgagtatgc

SEQ ID NO: 88197 - DNA, 36 bp, Artificial Sequence
  Description of Artificial Sequence: Synthetic oligonucleotide
cactgaattcacccccactgaaaaagatgagtatgc

SEQ ID NO: 88198 - DNA, 36 bp, Artificial Sequence
  Description of Artificial Sequence: Synthetic oligonucleotide
actgaattcacccccactgaaaaagatgagtatgcc

SEQ ID NO: 88199 - DNA, 35 bp, Artificial Sequence
  Description of Artificial Sequence: Synthetic oligonucleotide
ctgaattcacccccactgaaaaagatgagtatgcc

SEQ ID NO: 88200 - DNA, 36 bp, Artificial Sequence
  Description of Artificial Sequence: Synthetic oligonucleotide
tgaattcacccccactgaaaaagatgagtatgcctg

SEQ ID NO: 88201 - DNA, 35 bp, Artificial Sequence
  Description of Artificial Sequence: Synthetic oligonucleotide
gaattcacccccactgaaaaagatgagtatgcctg

SEQ ID NO: 88202 - DNA, 35 bp, Artificial Sequence
  Description of Artificial Sequence: Synthetic oligonucleotide
aattcacccccactgaaaaagatgagtatgcctgc

SEQ ID NO: 88203 - DNA, 34 bp, Artificial Sequence
  Description of Artificial Sequence: Synthetic oligonucleotide
attcacccccactgaaaaagatgagtatgcctgc

SEQ ID NO: 88204 - DNA, 33 bp, Artificial Sequence
  Description of Artificial Sequence: Synthetic oligonucleotide
ttcacccccactgaaaaagatgagtatgcctgc

SEQ ID NO: 88205 - DNA, 32 bp, Artificial Sequence
  Description of Artificial Sequence: Synthetic oligonucleotide
tcacccccactgaaaaagatgagtatgcctgc

SEQ ID NO: 88206 - DNA, 31 bp, Artificial Sequence
  Description of Artificial Sequence: Synthetic oligonucleotide
cacccccactgaaaaagatgagtatgcctgc

SEQ ID NO: 88207 - DNA, 31 bp, Artificial Sequence
  Description of Artificial Sequence: Synthetic oligonucleotide
acccccactgaaaaagatgagtatgcctgcc

SEQ ID NO: 88208 - DNA, 30 bp, Artificial Sequence
  Description of Artificial Sequence: Synthetic oligonucleotide
cccccactgaaaaagatgagtatgcctgcc

SEQ ID NO: 88209 - DNA, 30 bp, Artificial Sequence
  Description of Artificial Sequence: Synthetic oligonucleotide
ccccactgaaaaagatgagtatgcctgccg

SEQ ID NO: 88210 - DNA, 31 bp, Artificial Sequence
  Description of Artificial Sequence: Synthetic oligonucleotide
cccactgaaaaagatgagtatgcctgccgtg

SEQ ID NO: 88211 - DNA, 32 bp, Artificial Sequence
  Description of Artificial Sequence: Synthetic oligonucleotide
ccactgaaaaagatgagtatgcctgccgtgtg

SEQ ID NO: 88212 - DNA, 34 bp, Artificial Sequence
  Description of Artificial Sequence: Synthetic oligonucleotide
cactgaaaaagatgagtatgcctgccgtgtgaac

SEQ ID NO: 88213 - DNA, 34 bp, Artificial Sequence
  Description of Artificial Sequence: Synthetic oligonucleotide
actgaaaaagatgagtatgcctgccgtgtgaacc

SEQ ID NO: 88214 - DNA, 33 bp, Artificial Sequence
  Description of Artificial Sequence: Synthetic oligonucleotide
ctgaaaaagatgagtatgcctgccgtgtgaacc

SEQ ID NO: 88215 - DNA, 35 bp, Artificial Sequence
  Description of Artificial Sequence: Synthetic oligonucleotide
tgaaaaagatgagtatgcctgccgtgtgaaccatg

SEQ ID NO: 88216 - DNA, 34 bp, Artificial Sequence
  Description of Artificial Sequence: Synthetic oligonucleotide
gaaaaagatgagtatgcctgccgtgtgaaccatg

SEQ ID NO: 88217 - DNA, 35 bp, Artificial Sequence
  Description of Artificial Sequence: Synthetic oligonucleotide
aaaaagatgagtatgcctgccgtgtgaaccatgtg

SEQ ID NO: 88218 - DNA, 34 bp, Artificial Sequence
  Description of Artificial Sequence: Synthetic oligonucleotide
aaaagatgagtatgcctgccgtgtgaaccatgtg

SEQ ID NO: 88219 - DNA, 33 bp, Artificial Sequence
  Description of Artificial Sequence: Synthetic oligonucleotide
aaagatgagtatgcctgccgtgtgaaccatgtg

SEQ ID NO: 88220 - DNA, 32 bp, Artificial Sequence
  Description of Artificial Sequence: Synthetic oligonucleotide
aagatgagtatgcctgccgtgtgaaccatgtg

SEQ ID NO: 88221 - DNA, 31 bp, Artificial Sequence
  Description of Artificial Sequence: Synthetic oligonucleotide
agatgagtatgcctgccgtgtgaaccatgtg

SEQ ID NO: 88222 - DNA, 30 bp, Artificial Sequence
  Description of Artificial Sequence: Synthetic oligonucleotide
gatgagtatgcctgccgtgtgaaccatgtg

SEQ ID NO: 88223 - DNA, 31 bp, Artificial Sequence
  Description of Artificial Sequence: Synthetic oligonucleotide
atgagtatgcctgccgtgtgaaccatgtgac

SEQ ID NO: 88224 - DNA, 30 bp, Artificial Sequence
  Description of Artificial Sequence: Synthetic oligonucleotide
tgagtatgcctgccgtgtgaaccatgtgac

SEQ ID NO: 88225 - DNA, 29 bp, Artificial Sequence
  Description of Artificial Sequence: Synthetic oligonucleotide
gagtatgcctgccgtgtgaaccatgtgac

SEQ ID NO: 88226 - DNA, 32 bp, Artificial Sequence
  Description of Artificial Sequence: Synthetic oligonucleotide
agtatgcctgccgtgtgaaccatgtgactttg

SEQ ID NO: 88227 - DNA, 31 bp, Artificial Sequence
  Description of Artificial Sequence: Synthetic oligonucleotide
gtatgcctgccgtgtgaaccatgtgactttg

SEQ ID NO: 88228 - DNA, 32 bp, Artificial Sequence
  Description of Artificial Sequence: Synthetic oligonucleotide
tatgcctgccgtgtgaaccatgtgactttgtc

SEQ ID NO: 88229 - DNA, 31 bp, Artificial Sequence
  Description of Artificial Sequence: Synthetic oligonucleotide
atgcctgccgtgtgaaccatgtgactttgtc

SEQ ID NO: 88230 - DNA, 30 bp, Artificial Sequence
  Description of Artificial Sequence: Synthetic oligonucleotide
tgcctgccgtgtgaaccatgtgactttgtc

SEQ ID NO: 88231 - DNA, 29 bp, Artificial Sequence
  Description of Artificial Sequence: Synthetic oligonucleotide
gcctgccgtgtgaaccatgtgactttgtc

SEQ ID NO: 88232 - DNA, 30 bp, Artificial Sequence
  Description of Artificial Sequence: Synthetic oligonucleotide
cctgccgtgtgaaccatgtgactttgtcac

SEQ ID NO: 88233 - DNA, 31 bp, Artificial Sequence
  Description of Artificial Sequence: Synthetic oligonucleotide
ctgccgtgtgaaccatgtgactttgtcacag

SEQ ID NO: 88234 - DNA, 31 bp, Artificial Sequence
  Description of Artificial Sequence: Synthetic oligonucleotide
tgccgtgtgaaccatgtgactttgtcacagc

SEQ ID NO: 88235 - DNA, 30 bp, Artificial Sequence
  Description of Artificial Sequence: Synthetic oligonucleotide
gccgtgtgaaccatgtgactttgtcacagc

SEQ ID NO: 88236 - DNA, 30 bp, Artificial Sequence
  Description of Artificial Sequence: Synthetic oligonucleotide
ccgtgtgaaccatgtgactttgtcacagcc

SEQ ID NO: 88237 - DNA, 30 bp, Artificial Sequence
  Description of Artificial Sequence: Synthetic oligonucleotide
cgtgtgaaccatgtgactttgtcacagccc

SEQ ID NO: 88238 - DNA, 32 bp, Artificial Sequence
  Description of Artificial Sequence: Synthetic oligonucleotide
gtgtgaaccatgtgactttgtcacagcccaag

SEQ ID NO: 88239 - DNA, 35 bp, Artificial Sequence
  Description of Artificial Sequence: Synthetic oligonucleotide
tgtgaaccatgtgactttgtcacagcccaagatag

SEQ ID NO: 88240 - DNA, 34 bp, Artificial Sequence
  Description of Artificial Sequence: Synthetic oligonucleotide
gtgaaccatgtgactttgtcacagcccaagatag

SEQ ID NO: 88241 - DNA, 38 bp, Artificial Sequence
  Description of Artificial Sequence: Synthetic oligonucleotide
tgaaccatgtgactttgtcacagcccaagatagttaag

SEQ ID NO: 88242 - DNA, 37 bp, Artificial Sequence
  Description of Artificial Sequence: Synthetic oligonucleotide
gaaccatgtgactttgtcacagcccaagatagttaag

SEQ ID NO: 88243 - DNA, 38 bp, Artificial Sequence
  Description of Artificial Sequence: Synthetic oligonucleotide
aaccatgtgactttgtcacagcccaagatagttaagtg

SEQ ID NO: 88244 - DNA, 37 bp, Artificial Sequence
  Description of Artificial Sequence: Synthetic oligonucleotide
accatgtgactttgtcacagcccaagatagttaagtg

SEQ ID NO: 88245 - DNA, 36 bp, Artificial Sequence
  Description of Artificial Sequence: Synthetic oligonucleotide
ccatgtgactttgtcacagcccaagatagttaagtg

SEQ ID NO: 88246 - DNA, 36 bp, Artificial Sequence
  Description of Artificial Sequence: Synthetic oligonucleotide
catgtgactttgtcacagcccaagatagttaagtgg

SEQ ID NO: 88247 - DNA, 36 bp, Artificial Sequence
  Description of Artificial Sequence: Synthetic oligonucleotide
atgtgactttgtcacagcccaagatagttaagtggg

SEQ ID NO: 88248 - DNA, 35 bp, Artificial Sequence
  Description of Artificial Sequence: Synthetic oligonucleotide
tgtgactttgtcacagcccaagatagttaagtggg

SEQ ID NO: 88249 - DNA, 34 bp, Artificial Sequence
  Description of Artificial Sequence: Synthetic oligonucleotide
gtgactttgtcacagcccaagatagttaagtggg

SEQ ID NO: 88250 - DNA, 36 bp, Artificial Sequence
  Description of Artificial Sequence: Synthetic oligonucleotide
tgactttgtcacagcccaagatagttaagtgggatc

SEQ ID NO: 88251 - DNA, 35 bp, Artificial Sequence
  Description of Artificial Sequence: Synthetic oligonucleotide
gactttgtcacagcccaagatagttaagtgggatc

SEQ ID NO: 88252 - DNA, 35 bp, Artificial Sequence
  Description of Artificial Sequence: Synthetic oligonucleotide
actttgtcacagcccaagatagttaagtgggatcg

SEQ ID NO: 88253 - DNA, 34 bp, Artificial Sequence
  Description of Artificial Sequence: Synthetic oligonucleotide
ctttgtcacagcccaagatagttaagtgggatcg

SEQ ID NO: 88254 - DNA, 35 bp, Artificial Sequence
  Description of Artificial Sequence: Synthetic oligonucleotide
tttgtcacagcccaagatagttaagtgggatcgag

SEQ ID NO: 88255 - DNA, 34 bp, Artificial Sequence
  Description of Artificial Sequence: Synthetic oligonucleotide
ttgtcacagcccaagatagttaagtgggatcgag

SEQ ID NO: 88256 - DNA, 33 bp, Artificial Sequence
  Description of Artificial Sequence: Synthetic oligonucleotide
tgtcacagcccaagatagttaagtgggatcgag

SEQ ID NO: 88257 - DNA, 32 bp, Artificial Sequence
  Description of Artificial Sequence: Synthetic oligonucleotide
gtcacagcccaagatagttaagtgggatcgag

SEQ ID NO: 88258 - DNA, 33 bp, Artificial Sequence
  Description of Artificial Sequence: Synthetic oligonucleotide
tcacagcccaagatagttaagtgggatcgagac

SEQ ID NO: 88259 - DNA, 32 bp, Artificial Sequence
  Description of Artificial Sequence: Synthetic oligonucleotide
cacagcccaagatagttaagtgggatcgagac

SEQ ID NO: 88260 - DNA, 34 bp, Artificial Sequence
  Description of Artificial Sequence: Synthetic oligonucleotide
acagcccaagatagttaagtgggatcgagacatg

SEQ ID NO: 88261 - DNA, 33 bp, Artificial Sequence
  Description of Artificial Sequence: Synthetic oligonucleotide
cagcccaagatagttaagtgggatcgagacatg

SEQ ID NO: 88262 - DNA, 26 bp, Artificial Sequence
  Description of Artificial Sequence: Synthetic oligonucleotide
atgctgctatccgtgccgctgctgct

SEQ ID NO: 88263 - DNA, 25 bp, Artificial Sequence
  Description of Artificial Sequence: Synthetic oligonucleotide
tgctgctatccgtgccgctgctgct

SEQ ID NO: 88264 - DNA, 24 bp, Artificial Sequence
  Description of Artificial Sequence: Synthetic oligonucleotide
gctgctatccgtgccgctgctgct

SEQ ID NO: 88265 - DNA, 24 bp, Artificial Sequence
  Description of Artificial Sequence: Synthetic oligonucleotide
ctgctatccgtgccgctgctgctc

SEQ ID NO: 88266 - DNA, 24 bp, Artificial Sequence
  Description of Artificial Sequence: Synthetic oligonucleotide
tgctatccgtgccgctgctgctcg

SEQ ID NO: 88267 - DNA, 23 bp, Artificial Sequence
  Description of Artificial Sequence: Synthetic oligonucleotide
gctatccgtgccgctgctgctcg

SEQ ID NO: 88268 - DNA, 23 bp, Artificial Sequence
  Description of Artificial Sequence: Synthetic oligonucleotide
ctatccgtgccgctgctgctcgg

SEQ ID NO: 88269 - DNA, 23 bp, Artificial Sequence
  Description of Artificial Sequence: Synthetic oligonucleotide
tatccgtgccgctgctgctcggc

SEQ ID NO: 88270 - DNA, 22 bp, Artificial Sequence
  Description of Artificial Sequence: Synthetic oligonucleotide
atccgtgccgctgctgctcggc

SEQ ID NO: 88271 - DNA, 21 bp, Artificial Sequence
  Description of Artificial Sequence: Synthetic oligonucleotide
tccgtgccgctgctgctcggc

SEQ ID NO: 88272 - DNA, 20 bp, Artificial Sequence
  Description of Artificial Sequence: Synthetic oligonucleotide
ccgtgccgctgctgctcggc

SEQ ID NO: 88273 - DNA, 21 bp, Artificial Sequence
  Description of Artificial Sequence: Synthetic oligonucleotide
cgtgccgctgctgctcggcct

SEQ ID NO: 88274 - DNA, 21 bp, Artificial Sequence
  Description of Artificial Sequence: Synthetic oligonucleotide
gtgccgctgctgctcggcctc

SEQ ID NO: 88275 - DNA, 22 bp, Artificial Sequence
  Description of Artificial Sequence: Synthetic oligonucleotide
tgccgctgctgctcggcctcct

SEQ ID NO: 88276 - DNA, 21 bp, Artificial Sequence
  Description of Artificial Sequence: Synthetic oligonucleotide
gccgctgctgctcggcctcct

SEQ ID NO: 88277 - DNA, 21 bp, Artificial Sequence
  Description of Artificial Sequence: Synthetic oligonucleotide
ccgctgctgctcggcctcctc

SEQ ID NO: 88278 - DNA, 21 bp, Artificial Sequence
  Description of Artificial Sequence: Synthetic oligonucleotide
cgctgctgctcggcctcctcg

SEQ ID NO: 88279 - DNA, 21 bp, Artificial Sequence
  Description of Artificial Sequence: Synthetic oligonucleotide
gctgctgctcggcctcctcgg

SEQ ID NO: 88280 - DNA, 21 bp, Artificial Sequence
  Description of Artificial Sequence: Synthetic oligonucleotide
ctgctgctcggcctcctcggc

SEQ ID NO: 88281 - DNA, 22 bp, Artificial Sequence
  Description of Artificial Sequence: Synthetic oligonucleotide
tgctgctcggcctcctcggcct

SEQ ID NO: 88282 - DNA, 21 bp, Artificial Sequence
  Description of Artificial Sequence: Synthetic oligonucleotide
gctgctcggcctcctcggcct

SEQ ID NO: 88283 - DNA, 21 bp, Artificial Sequence
  Description of Artificial Sequence: Synthetic oligonucleotide
ctgctcggcctcctcggcctg

SEQ ID NO: 88284 - DNA, 21 bp, Artificial Sequence
  Description of Artificial Sequence: Synthetic oligonucleotide
tgctcggcctcctcggcctgg

SEQ ID NO: 88285 - DNA, 20 bp, Artificial Sequence
  Description of Artificial Sequence: Synthetic oligonucleotide
gctcggcctcctcggcctgg

SEQ ID NO: 88286 - DNA, 20 bp, Artificial Sequence
  Description of Artificial Sequence: Synthetic oligonucleotide
ctcggcctcctcggcctggc

SEQ ID NO: 88287 - DNA, 20 bp, Artificial Sequence
  Description of Artificial Sequence: Synthetic oligonucleotide
tcggcctcctcggcctggcc

SEQ ID NO: 88288 - DNA, 20 bp, Artificial Sequence
  Description of Artificial Sequence: Synthetic oligonucleotide
cggcctcctcggcctggcct

SEQ ID NO: 88289 - DNA, 20 bp, Artificial Sequence
  Description of Artificial Sequence: Synthetic oligonucleotide
ggcctcctcggcctggccgt

SEQ ID NO: 88290 - DNA, 20 bp, Artificial Sequence
  Description of Artificial Sequence: Synthetic oligonucleotide
gcctcctcggcctggccgtc

SEQ ID NO: 88291 - DNA, 20 bp, Artificial Sequence
  Description of Artificial Sequence: Synthetic oligonucleotide
cctcctcggcctggccgtcg

SEQ ID NO: 88292 - DNA, 20 bp, Artificial Sequence
  Description of Artificial Sequence: Synthetic oligonucleotide
ctcctcggcctggccgtcgc

SEQ ID NO: 88293 - DNA, 20 bp, Artificial Sequence
  Description of Artificial Sequence: Synthetic oligonucleotide
tcctcggcctggccgtcgcc

SEQ ID NO: 88294 - DNA, 20 bp, Artificial Sequence
  Description of Artificial Sequence: Synthetic oligonucleotide
cctcggcctggccgtcgcct

SEQ ID NO: 88295 - DNA, 20 bp, Artificial Sequence
  Description of Artificial Sequence: Synthetic oligonucleotide
ctcggcctggccgtcgccga

SEQ ID NO: 88296 - DNA, 20 bp, Artificial Sequence
  Description of Artificial Sequence: Synthetic oligonucleotide
tcggcctggccgtcgccgag

SEQ ID NO: 88297 - DNA, 20 bp, Artificial Sequence
  Description of Artificial Sequence: Synthetic oligonucleotide
cggcctggccgtcgccgagt

SEQ ID NO: 88298 - DNA, 20 bp, Artificial Sequence
  Description of Artificial Sequence: Synthetic oligonucleotide
ggcctggccgtcgccgagct

SEQ ID NO: 88299 - DNA, 20 bp, Artificial Sequence
  Description of Artificial Sequence: Synthetic oligonucleotide
gcctggccgtcgccgagcct

SEQ ID NO: 88300 - DNA, 20 bp, Artificial Sequence
  Description of Artificial Sequence: Synthetic oligonucleotide
cctggccgtcgccgagcctg

SEQ ID NO: 88301 - DNA, 20 bp, Artificial Sequence
  Description of Artificial Sequence: Synthetic oligonucleotide
ctggccgtcgccgagcctgc

SEQ ID NO: 88302 - DNA, 20 bp, Artificial Sequence
  Description of Artificial Sequence: Synthetic oligonucleotide
tggccgtcgccgagcctgcc

SEQ ID NO: 88303 - DNA, 20 bp, Artificial Sequence
  Description of Artificial Sequence: Synthetic oligonucleotide
ggccgtcgccgagcctgcct

SEQ ID NO: 88304 - DNA, 20 bp, Artificial Sequence
  Description of Artificial Sequence: Synthetic oligonucleotide
gccgtcgccgagcctgccgt

SEQ ID NO: 88305 - DNA, 22 bp, Artificial Sequence
  Description of Artificial Sequence: Synthetic oligonucleotide
ccgtcgccgagcctgccgtcta

SEQ ID NO: 88306 - DNA, 24 bp, Artificial Sequence
  Description of Artificial Sequence: Synthetic oligonucleotide
cgtcgccgagcctgccgtctactt

SEQ ID NO: 88307 - DNA, 26 bp, Artificial Sequence
  Description of Artificial Sequence: Synthetic oligonucleotide
gtcgccgagcctgccgtctacttcaa

SEQ ID NO: 88308 - DNA, 26 bp, Artificial Sequence
  Description of Artificial Sequence: Synthetic oligonucleotide
tcgccgagcctgccgtctacttcaag

SEQ ID NO: 88309 - DNA, 25 bp, Artificial Sequence
  Description of Artificial Sequence: Synthetic oligonucleotide
cgccgagcctgccgtctacttcaag

SEQ ID NO: 88310 - DNA, 26 bp, Artificial Sequence
  Description of Artificial Sequence: Synthetic oligonucleotide
gccgagcctgccgtctacttcaagga

SEQ ID NO: 88311 - DNA, 26 bp, Artificial Sequence
  Description of Artificial Sequence: Synthetic oligonucleotide
ccgagcctgccgtctacttcaaggag

SEQ ID NO: 88312 - DNA, 27 bp, Artificial Sequence
  Description of Artificial Sequence: Synthetic oligonucleotide
cgagcctgccgtctacttcaaggagca

SEQ ID NO: 88313 - DNA, 27 bp, Artificial Sequence
  Description of Artificial Sequence: Synthetic oligonucleotide
gagcctgccgtctacttcaaggagcag

SEQ ID NO: 88314 - DNA, 30 bp, Artificial Sequence
  Description of Artificial Sequence: Synthetic oligonucleotide
agcctgccgtctacttcaaggagcagtttc

SEQ ID NO: 88315 - DNA, 29 bp, Artificial Sequence
  Description of Artificial Sequence: Synthetic oligonucleotide
gcctgccgtctacttcaaggagcagtttc

SEQ ID NO: 88316 - DNA, 30 bp, Artificial Sequence
  Description of Artificial Sequence: Synthetic oligonucleotide
cctgccgtctacttcaaggagcagtttctg

SEQ ID NO: 88317 - DNA, 30 bp, Artificial Sequence
  Description of Artificial Sequence: Synthetic oligonucleotide
ctgccgtctacttcaaggagcagtttctgg

SEQ ID NO: 88318 - DNA, 31 bp, Artificial Sequence
  Description of Artificial Sequence: Synthetic oligonucleotide
tgccgtctacttcaaggagcagtttctggac

SEQ ID NO: 88319 - DNA, 30 bp, Artificial Sequence
  Description of Artificial Sequence: Synthetic oligonucleotide
gccgtctacttcaaggagcagtttctggac

SEQ ID NO: 88320 - DNA, 30 bp, Artificial Sequence
  Description of Artificial Sequence: Synthetic oligonucleotide
ccgtctacttcaaggagcagtttctggacg

SEQ ID NO: 88321 - DNA, 30 bp, Artificial Sequence
  Description of Artificial Sequence: Synthetic oligonucleotide
cgtctacttcaaggagcagtttctggacgg

SEQ ID NO: 88322 - DNA, 31 bp, Artificial Sequence
  Description of Artificial Sequence: Synthetic oligonucleotide
gtctacttcaaggagcagtttctggacggag

SEQ ID NO: 88323 - DNA, 32 bp, Artificial Sequence
  Description of Artificial Sequence: Synthetic oligonucleotide
tctacttcaaggagcagtttctggacggagac

SEQ ID NO: 88324 - DNA, 31 bp, Artificial Sequence
  Description of Artificial Sequence: Synthetic oligonucleotide
ctacttcaaggagcagtttctggacggagac

SEQ ID NO: 88325 - DNA, 31 bp, Artificial Sequence
  Description of Artificial Sequence: Synthetic oligonucleotide
tacttcaaggagcagtttctggacggagacg

SEQ ID NO: 88326 - DNA, 30 bp, Artificial Sequence
  Description of Artificial Sequence: Synthetic oligonucleotide
acttcaaggagcagtttctggacggagacg

SEQ ID NO: 88327 - DNA, 29 bp, Artificial Sequence
  Description of Artificial Sequence: Synthetic oligonucleotide
cttcaaggagcagtttctggacggagacg

SEQ ID NO: 88328 - DNA, 29 bp, Artificial Sequence
  Description of Artificial Sequence: Synthetic oligonucleotide
ttcaaggagcagtttctggacggagacgg

SEQ ID NO: 88329 - DNA, 28 bp, Artificial Sequence
  Description of Artificial Sequence: Synthetic oligonucleotide
tcaaggagcagtttctggacggagacgg

SEQ ID NO: 88330 - DNA, 27 bp, Artificial Sequence
  Description of Artificial Sequence: Synthetic oligonucleotide
caaggagcagtttctggacggagacgg

SEQ ID NO: 88331 - DNA, 27 bp, Artificial Sequence
  Description of Artificial Sequence: Synthetic oligonucleotide
aaggagcagtttctggacggagacggg

SEQ ID NO: 88332 - DNA, 27 bp, Artificial Sequence
  Description of Artificial Sequence: Synthetic oligonucleotide
aggagcagtttctggacggagacgggt

SEQ ID NO: 88333 - DNA, 26 bp, Artificial Sequence
  Description of Artificial Sequence: Synthetic oligonucleotide
ggagcagtttctggacggagacgggt

SEQ ID NO: 88334 - DNA, 26 bp, Artificial Sequence
  Description of Artificial Sequence: Synthetic oligonucleotide
gagcagtttctggacggagacgggtg

SEQ ID NO: 88335 - DNA, 27 bp, Artificial Sequence
  Description of Artificial Sequence: Synthetic oligonucleotide
agcagtttctggacggagacgggtgga

SEQ ID NO: 88336 - DNA, 26 bp, Artificial Sequence
  Description of Artificial Sequence: Synthetic oligonucleotide
gcagtttctggacggagacgggtgga

SEQ ID NO: 88337 - DNA, 27 bp, Artificial Sequence
  Description of Artificial Sequence: Synthetic oligonucleotide
cagtttctggacggagacgggtggact

SEQ ID NO: 88338 - DNA, 28 bp, Artificial Sequence
  Description of Artificial Sequence: Synthetic oligonucleotide
agtttctggacggagacgggtggacttc

SEQ ID NO: 88339 - DNA, 27 bp, Artificial Sequence
  Description of Artificial Sequence: Synthetic oligonucleotide
gtttctggacggagacgggtggacttc

SEQ ID NO: 88340 - DNA, 27 bp, Artificial Sequence
  Description of Artificial Sequence: Synthetic oligonucleotide
tttctggacggagacgggtggacttcc

SEQ ID NO: 88341 - DNA, 26 bp, Artificial Sequence
  Description of Artificial Sequence: Synthetic oligonucleotide
ttctggacggagacgggtggacttcc

SEQ ID NO: 88342 - DNA, 25 bp, Artificial Sequence
  Description of Artificial Sequence: Synthetic oligonucleotide
tctggacggagacgggtggacttcc

SEQ ID NO: 88343 - DNA, 24 bp, Artificial Sequence
  Description of Artificial Sequence: Synthetic oligonucleotide
ctggacggagacgggtggacttcc

SEQ ID NO: 88344 - DNA, 24 bp, Artificial Sequence
  Description of Artificial Sequence: Synthetic oligonucleotide
tggacggagacgggtggacttccc

SEQ ID NO: 88345 - DNA, 23 bp, Artificial Sequence
  Description of Artificial Sequence: Synthetic oligonucleotide
ggacggagacgggtggacttccc

SEQ ID NO: 88346 - DNA, 23 bp, Artificial Sequence
  Description of Artificial Sequence: Synthetic oligonucleotide
gacggagacgggtggacttcccg

SEQ ID NO: 88347 - DNA, 24 bp, Artificial Sequence
  Description of Artificial Sequence: Synthetic oligonucleotide
acggagacgggtggacttcccgct

SEQ ID NO: 88348 - DNA, 23 bp, Artificial Sequence
  Description of Artificial Sequence: Synthetic oligonucleotide
cggagacgggtggacttcccgct

SEQ ID NO: 88349 - DNA, 23 bp, Artificial Sequence
  Description of Artificial Sequence: Synthetic oligonucleotide
ggagacgggtggacttcccgctg

SEQ ID NO: 88350 - DNA, 25 bp, Artificial Sequence
  Description of Artificial Sequence: Synthetic oligonucleotide
gagacgggtggacttcccgctggat

SEQ ID NO: 88351 - DNA, 25 bp, Artificial Sequence
  Description of Artificial Sequence: Synthetic oligonucleotide
agacgggtggacttcccgctggatc

SEQ ID NO: 88352 - DNA, 24 bp, Artificial Sequence
  Description of Artificial Sequence: Synthetic oligonucleotide
gacgggtggacttcccgctggatc

SEQ ID NO: 88353 - DNA, 27 bp, Artificial Sequence
  Description of Artificial Sequence: Synthetic oligonucleotide
acgggtggacttcccgctggatcgaat

SEQ ID NO: 88354 - DNA, 26 bp, Artificial Sequence
  Description of Artificial Sequence: Synthetic oligonucleotide
cgggtggacttcccgctggatcgaat

SEQ ID NO: 88355 - DNA, 26 bp, Artificial Sequence
  Description of Artificial Sequence: Synthetic oligonucleotide
gggtggacttcccgctggatcgaatc

SEQ ID NO: 88356 - DNA, 27 bp, Artificial Sequence
  Description of Artificial Sequence: Synthetic oligonucleotide
ggtggacttcccgctggatcgaatcca

SEQ ID NO: 88357 - DNA, 29 bp, Artificial Sequence
  Description of Artificial Sequence: Synthetic oligonucleotide
gtggacttcccgctggatcgaatccaaac

SEQ ID NO: 88358 - DNA, 30 bp, Artificial Sequence
  Description of Artificial Sequence: Synthetic oligonucleotide
tggacttcccgctggatcgaatccaaacac

SEQ ID NO: 88359 - DNA, 29 bp, Artificial Sequence
  Description of Artificial Sequence: Synthetic oligonucleotide
ggacttcccgctggatcgaatccaaacac

SEQ ID NO: 88360 - DNA, 31 bp, Artificial Sequence
  Description of Artificial Sequence: Synthetic oligonucleotide
gacttcccgctggatcgaatccaaacacaag

SEQ ID NO: 88361 - DNA, 32 bp, Artificial Sequence
  Description of Artificial Sequence: Synthetic oligonucleotide
acttcccgctggatcgaatccaaacacaagtc

SEQ ID NO: 88362 - DNA, 31 bp, Artificial Sequence
  Description of Artificial Sequence: Synthetic oligonucleotide
cttcccgctggatcgaatccaaacacaagtc

SEQ ID NO: 88363 - DNA, 32 bp, Artificial Sequence
  Description of Artificial Sequence: Synthetic oligonucleotide
ttcccgctggatcgaatccaaacacaagtcag

SEQ ID NO: 88364 - DNA, 31 bp, Artificial Sequence
  Description of Artificial Sequence: Synthetic oligonucleotide
tcccgctggatcgaatccaaacacaagtcag

SEQ ID NO: 88365 - DNA, 30 bp, Artificial Sequence
  Description of Artificial Sequence: Synthetic oligonucleotide
cccgctggatcgaatccaaacacaagtcag

SEQ ID NO: 88366 - DNA, 35 bp, Artificial Sequence
  Description of Artificial Sequence: Synthetic oligonucleotide
ccgctggatcgaatccaaacacaagtcagattttg

SEQ ID NO: 88367 - DNA, 35 bp, Artificial Sequence
  Description of Artificial Sequence: Synthetic oligonucleotide
cgctggatcgaatccaaacacaagtcagattttgg

SEQ ID NO: 88368 - DNA, 35 bp, Artificial Sequence
  Description of Artificial Sequence: Synthetic oligonucleotide
gctggatcgaatccaaacacaagtcagattttggc

SEQ ID NO: 88369 - DNA, 40 bp, Artificial Sequence
  Description of Artificial Sequence: Synthetic oligonucleotide
ctggatcgaatccaaacacaagtcagattttggcaaattc

SEQ ID NO: 88370 - DNA, 40 bp, Artificial Sequence
  Description of Artificial Sequence: Synthetic oligonucleotide
tggatcgaatccaaacacaagtcagattttggcaaattcg

SEQ ID NO: 88371 - DNA, 39 bp, Artificial Sequence
  Description of Artificial Sequence: Synthetic oligonucleotide
ggatcgaatccaaacacaagtcagattttggcaaattcg

SEQ ID NO: 88372 - DNA, 41 bp, Artificial Sequence
  Description of Artificial Sequence: Synthetic oligonucleotide
gatcgaatccaaacacaagtcagattttggcaaattcgttc

SEQ ID NO: 88373 - DNA, 42 bp, Artificial Sequence
  Description of Artificial Sequence: Synthetic oligonucleotide
atcgaatccaaacacaagtcagattttggcaaattcgttctc

SEQ ID NO: 88374 - DNA, 41 bp, Artificial Sequence
  Description of Artificial Sequence: Synthetic oligonucleotide
tcgaatccaaacacaagtcagattttggcaaattcgttctc

SEQ ID NO: 88375 - DNA, 40 bp, Artificial Sequence
  Description of Artificial Sequence: Synthetic oligonucleotide
cgaatccaaacacaagtcagattttggcaaattcgttctc

SEQ ID NO: 88376 - DNA, 41 bp, Artificial Sequence
  Description of Artificial Sequence: Synthetic oligonucleotide
gaatccaaacacaagtcagattttggcaaattcgttctcag

SEQ ID NO: 88377 - DNA, 43 bp, Artificial Sequence
  Description of Artificial Sequence: Synthetic oligonucleotide
aatccaaacacaagtcagattttggcaaattcgttctcagttc

SEQ ID NO: 88378 - DNA, 42 bp, Artificial Sequence
  Description of Artificial Sequence: Synthetic oligonucleotide
atccaaacacaagtcagattttggcaaattcgttctcagttc

SEQ ID NO: 88379 - DNA, 41 bp, Artificial Sequence
  Description of Artificial Sequence: Synthetic oligonucleotide
tccaaacacaagtcagattttggcaaattcgttctcagttc

SEQ ID NO: 88380 - DNA, 40 bp, Artificial Sequence
  Description of Artificial Sequence: Synthetic oligonucleotide
ccaaacacaagtcagattttggcaaattcgttctcagttc

SEQ ID NO: 88381 - DNA, 40 bp, Artificial Sequence
  Description of Artificial Sequence: Synthetic oligonucleotide
caaacacaagtcagattttggcaaattcgttctcagttcc

SEQ ID NO: 88382 - DNA, 40 bp, Artificial Sequence
  Description of Artificial Sequence: Synthetic oligonucleotide
aaacacaagtcagattttggcaaattcgttctcagttccg

SEQ ID NO: 88383 - DNA, 39 bp, Artificial Sequence
  Description of Artificial Sequence: Synthetic oligonucleotide
aacacaagtcagattttggcaaattcgttctcagttccg

SEQ ID NO: 88384 - DNA, 38 bp, Artificial Sequence
  Description of Artificial Sequence: Synthetic oligonucleotide
acacaagtcagattttggcaaattcgttctcagttccg

SEQ ID NO: 88385 - DNA, 37 bp, Artificial Sequence
  Description of Artificial Sequence: Synthetic oligonucleotide
cacaagtcagattttggcaaattcgttctcagttccg

SEQ ID NO: 88386 - DNA, 37 bp, Artificial Sequence
  Description of Artificial Sequence: Synthetic oligonucleotide
acaagtcagattttggcaaattcgttctcagttccgg

SEQ ID NO: 88387 - DNA, 36 bp, Artificial Sequence
  Description of Artificial Sequence: Synthetic oligonucleotide
caagtcagattttggcaaattcgttctcagttccgg

SEQ ID NO: 88388 - DNA, 36 bp, Artificial Sequence
  Description of Artificial Sequence: Synthetic oligonucleotide
aagtcagattttggcaaattcgttctcagttccggc

SEQ ID NO: 88389 - DNA, 35 bp, Artificial Sequence
  Description of Artificial Sequence: Synthetic oligonucleotide
agtcagattttggcaaattcgttctcagttccggc

SEQ ID NO: 88390 - DNA, 34 bp, Artificial Sequence
  Description of Artificial Sequence: Synthetic oligonucleotide
gtcagattttggcaaattcgttctcagttccggc

SEQ ID NO: 88391 - DNA, 36 bp, Artificial Sequence
  Description of Artificial Sequence: Synthetic oligonucleotide
tcagattttggcaaattcgttctcagttccggcaag

SEQ ID NO: 88392 - DNA, 35 bp, Artificial Sequence
  Description of Artificial Sequence: Synthetic oligonucleotide
cagattttggcaaattcgttctcagttccggcaag

SEQ ID NO: 88393 - DNA, 37 bp, Artificial Sequence
  Description of Artificial Sequence: Synthetic oligonucleotide
agattttggcaaattcgttctcagttccggcaagttc

SEQ ID NO: 88394 - DNA, 36 bp, Artificial Sequence
  Description of Artificial Sequence: Synthetic oligonucleotide
gattttggcaaattcgttctcagttccggcaagttc

SEQ ID NO: 88395 - DNA, 38 bp, Artificial Sequence
  Description of Artificial Sequence: Synthetic oligonucleotide
attttggcaaattcgttctcagttccggcaagttctac

SEQ ID NO: 88396 - DNA, 37 bp, Artificial Sequence
  Description of Artificial Sequence: Synthetic oligonucleotide
ttttggcaaattcgttctcagttccggcaagttctac

SEQ ID NO: 88397 - DNA, 36 bp, Artificial Sequence
  Description of Artificial Sequence: Synthetic oligonucleotide
tttggcaaattcgttctcagttccggcaagttctac

SEQ ID NO: 88398 - DNA, 35 bp, Artificial Sequence
  Description of Artificial Sequence: Synthetic oligonucleotide
ttggcaaattcgttctcagttccggcaagttctac

SEQ ID NO: 88399 - DNA, 34 bp, Artificial Sequence
  Description of Artificial Sequence: Synthetic oligonucleotide
tggcaaattcgttctcagttccggcaagttctac

SEQ ID NO: 88400 - DNA, 33 bp, Artificial Sequence
  Description of Artificial Sequence: Synthetic oligonucleotide
ggcaaattcgttctcagttccggcaagttctac

SEQ ID NO: 88401 - DNA, 33 bp, Artificial Sequence
  Description of Artificial Sequence: Synthetic oligonucleotide
gcaaattcgttctcagttccggcaagttctacg

SEQ ID NO: 88402 - DNA, 33 bp, Artificial Sequence
  Description of Artificial Sequence: Synthetic oligonucleotide
caaattcgttctcagttccggcaagttctacgg

SEQ ID NO: 88403 - DNA, 34 bp, Artificial Sequence
  Description of Artificial Sequence: Synthetic oligonucleotide
aaattcgttctcagttccggcaagttctacggtg

SEQ ID NO: 88404 - DNA, 33 bp, Artificial Sequence
  Description of Artificial Sequence: Synthetic oligonucleotide
aattcgttctcagttccggcaagttctacggtg

SEQ ID NO: 88405 - DNA, 32 bp, Artificial Sequence
  Description of Artificial Sequence: Synthetic oligonucleotide
attcgttctcagttccggcaagttctacggtg

SEQ ID NO: 88406 - DNA, 31 bp, Artificial Sequence
  Description of Artificial Sequence: Synthetic oligonucleotide
ttcgttctcagttccggcaagttctacggtg

SEQ ID NO: 88407 - DNA, 30 bp, Artificial Sequence
  Description of Artificial Sequence: Synthetic oligonucleotide
tcgttctcagttccggcaagttctacggtg

SEQ ID NO: 88408 - DNA, 29 bp, Artificial Sequence
  Description of Artificial Sequence: Synthetic oligonucleotide
cgttctcagttccggcaagttctacggtg

SEQ ID NO: 88409 - DNA, 30 bp, Artificial Sequence
  Description of Artificial Sequence: Synthetic oligonucleotide
gttctcagttccggcaagttctacggtgac

SEQ ID NO: 88410 - DNA, 30 bp, Artificial Sequence
  Description of Artificial Sequence: Synthetic oligonucleotide
ttctcagttccggcaagttctacggtgacg

SEQ ID NO: 88411 - DNA, 29 bp, Artificial Sequence
  Description of Artificial Sequence: Synthetic oligonucleotide
tctcagttccggcaagttctacggtgacg

SEQ ID NO: 88412 - DNA, 28 bp, Artificial Sequence
  Description of Artificial Sequence: Synthetic oligonucleotide
ctcagttccggcaagttctacggtgacg

SEQ ID NO: 88413 - DNA, 29 bp, Artificial Sequence
  Description of Artificial Sequence: Synthetic oligonucleotide
tcagttccggcaagttctacggtgacgag

SEQ ID NO: 88414 - DNA, 28 bp, Artificial Sequence
  Description of Artificial Sequence: Synthetic oligonucleotide
cagttccggcaagttctacggtgacgag

SEQ ID NO: 88415 - DNA, 28 bp, Artificial Sequence
  Description of Artificial Sequence: Synthetic oligonucleotide
agttccggcaagttctacggtgacgagg

SEQ ID NO: 88416 - DNA, 27 bp, Artificial Sequence
  Description of Artificial Sequence: Synthetic oligonucleotide
gttccggcaagttctacggtgacgagg

SEQ ID NO: 88417 - DNA, 28 bp, Artificial Sequence
  Description of Artificial Sequence: Synthetic oligonucleotide
ttccggcaagttctacggtgacgaggag

SEQ ID NO: 88418 - DNA, 27 bp, Artificial Sequence
  Description of Artificial Sequence: Synthetic oligonucleotide
tccggcaagttctacggtgacgaggag

SEQ ID NO: 88419 - DNA, 27 bp, Artificial Sequence
  Description of Artificial Sequence: Synthetic oligonucleotide
ccggcaagttctacggtgacgaggaga

SEQ ID NO: 88420 - DNA, 29 bp, Artificial Sequence
  Description of Artificial Sequence: Synthetic oligonucleotide
cggcaagttctacggtgacgaggagaaag

SEQ ID NO: 88421 - DNA, 34 bp, Artificial Sequence
  Description of Artificial Sequence: Synthetic oligonucleotide
ggcaagttctacggtgacgaggagaaagataaag

SEQ ID NO: 88422 - DNA, 34 bp, Artificial Sequence
  Description of Artificial Sequence: Synthetic oligonucleotide
gcaagttctacggtgacgaggagaaagataaagg

SEQ ID NO: 88423 - DNA, 37 bp, Artificial Sequence
  Description of Artificial Sequence: Synthetic oligonucleotide
caagttctacggtgacgaggagaaagataaaggtttg

SEQ ID NO: 88424 - DNA, 37 bp, Artificial Sequence
  Description of Artificial Sequence: Synthetic oligonucleotide
aagttctacggtgacgaggagaaagataaaggtttgc

SEQ ID NO: 88425 - DNA, 36 bp, Artificial Sequence
  Description of Artificial Sequence: Synthetic oligonucleotide
agttctacggtgacgaggagaaagataaaggtttgc

SEQ ID NO: 88426 - DNA, 35 bp, Artificial Sequence
  Description of Artificial Sequence: Synthetic oligonucleotide
gttctacggtgacgaggagaaagataaaggtttgc

SEQ ID NO: 88427 - DNA, 36 bp, Artificial Sequence
  Description of Artificial Sequence: Synthetic oligonucleotide
ttctacggtgacgaggagaaagataaaggtttgcag

SEQ ID NO: 88428 - DNA, 35 bp, Artificial Sequence
  Description of Artificial Sequence: Synthetic oligonucleotide
tctacggtgacgaggagaaagataaaggtttgcag

SEQ ID NO: 88429 - DNA, 34 bp, Artificial Sequence
  Description of Artificial Sequence: Synthetic oligonucleotide
ctacggtgacgaggagaaagataaaggtttgcag

SEQ ID NO: 88430 - DNA, 35 bp, Artificial Sequence
  Description of Artificial Sequence: Synthetic oligonucleotide
tacggtgacgaggagaaagataaaggtttgcagac

SEQ ID NO: 88431 - DNA, 34 bp, Artificial Sequence
  Description of Artificial Sequence: Synthetic oligonucleotide
acggtgacgaggagaaagataaaggtttgcagac

SEQ ID NO: 88432 - DNA, 33 bp, Artificial Sequence
  Description of Artificial Sequence: Synthetic oligonucleotide
cggtgacgaggagaaagataaaggtttgcagac

SEQ ID NO: 88433 - DNA, 35 bp, Artificial Sequence
  Description of Artificial Sequence: Synthetic oligonucleotide
ggtgacgaggagaaagataaaggtttgcagacaag

SEQ ID NO: 88434 - DNA, 35 bp, Artificial Sequence
  Description of Artificial Sequence: Synthetic oligonucleotide
gtgacgaggagaaagataaaggtttgcagacaagc

SEQ ID NO: 88435 - DNA, 35 bp, Artificial Sequence
  Description of Artificial Sequence: Synthetic oligonucleotide
tgacgaggagaaagataaaggtttgcagacaagcc

SEQ ID NO: 88436 - DNA, 34 bp, Artificial Sequence
  Description of Artificial Sequence: Synthetic oligonucleotide
gacgaggagaaagataaaggtttgcagacaagcc

SEQ ID NO: 88437 - DNA, 35 bp, Artificial Sequence
  Description of Artificial Sequence: Synthetic oligonucleotide
acgaggagaaagataaaggtttgcagacaagccag

SEQ ID NO: 88438 - DNA, 34 bp, Artificial Sequence
  Description of Artificial Sequence: Synthetic oligonucleotide
cgaggagaaagataaaggtttgcagacaagccag

SEQ ID NO: 88439 - DNA, 34 bp, Artificial Sequence
  Description of Artificial Sequence: Synthetic oligonucleotide
gaggagaaagataaaggtttgcagacaagccagg

SEQ ID NO: 88440 - DNA, 36 bp, Artificial Sequence
  Description of Artificial Sequence: Synthetic oligonucleotide
aggagaaagataaaggtttgcagacaagccaggatg

SEQ ID NO: 88441 - DNA, 35 bp, Artificial Sequence
  Description of Artificial Sequence: Synthetic oligonucleotide
ggagaaagataaaggtttgcagacaagccaggatg

SEQ ID NO: 88442 - DNA, 35 bp, Artificial Sequence
  Description of Artificial Sequence: Synthetic oligonucleotide
gagaaagataaaggtttgcagacaagccaggatgc

SEQ ID NO: 88443 - DNA, 36 bp, Artificial Sequence
  Description of Artificial Sequence: Synthetic oligonucleotide
agaaagataaaggtttgcagacaagccaggatgcac

SEQ ID NO: 88444 - DNA, 35 bp, Artificial Sequence
  Description of Artificial Sequence: Synthetic oligonucleotide
gaaagataaaggtttgcagacaagccaggatgcac

SEQ ID NO: 88445 - DNA, 35 bp, Artificial Sequence
  Description of Artificial Sequence: Synthetic oligonucleotide
aaagataaaggtttgcagacaagccaggatgcacg

SEQ ID NO: 88446 - DNA, 34 bp, Artificial Sequence
  Description of Artificial Sequence: Synthetic oligonucleotide
aagataaaggtttgcagacaagccaggatgcacg

SEQ ID NO: 88447 - DNA, 33 bp, Artificial Sequence
  Description of Artificial Sequence: Synthetic oligonucleotide
agataaaggtttgcagacaagccaggatgcacg

SEQ ID NO: 88448 - DNA, 32 bp, Artificial Sequence
  Description of Artificial Sequence: Synthetic oligonucleotide
gataaaggtttgcagacaagccaggatgcacg

SEQ ID NO: 88449 - DNA, 32 bp, Artificial Sequence
  Description of Artificial Sequence: Synthetic oligonucleotide
ataaaggtttgcagacaagccaggatgcacgc

SEQ ID NO: 88450 - DNA, 31 bp, Artificial Sequence
  Description of Artificial Sequence: Synthetic oligonucleotide
taaaggtttgcagacaagccaggatgcacgc

SEQ ID NO: 88451 - DNA, 30 bp, Artificial Sequence
  Description of Artificial Sequence: Synthetic oligonucleotide
aaaggtttgcagacaagccaggatgcacgc

SEQ ID NO: 88452 - DNA, 29 bp, Artificial Sequence
  Description of Artificial Sequence: Synthetic oligonucleotide
aaggtttgcagacaagccaggatgcacgc

SEQ ID NO: 88453 - DNA, 28 bp, Artificial Sequence
  Description of Artificial Sequence: Synthetic oligonucleotide
aggtttgcagacaagccaggatgcacgc

SEQ ID NO: 88454 - DNA, 27 bp, Artificial Sequence
  Description of Artificial Sequence: Synthetic oligonucleotide
ggtttgcagacaagccaggatgcacgc

SEQ ID NO: 88455 - DNA, 33 bp, Artificial Sequence
  Description of Artificial Sequence: Synthetic oligonucleotide
gtttgcagacaagccaggatgcacgcttttatg

SEQ ID NO: 88456 - DNA, 33 bp, Artificial Sequence
  Description of Artificial Sequence: Synthetic oligonucleotide
tttgcagacaagccaggatgcacgcttttatgc

SEQ ID NO: 88457 - DNA, 32 bp, Artificial Sequence
  Description of Artificial Sequence: Synthetic oligonucleotide
ttgcagacaagccaggatgcacgcttttatgc

SEQ ID NO: 88458 - DNA, 31 bp, Artificial Sequence
  Description of Artificial Sequence: Synthetic oligonucleotide
tgcagacaagccaggatgcacgcttttatgc

SEQ ID NO: 88459 - DNA, 30 bp, Artificial Sequence
  Description of Artificial Sequence: Synthetic oligonucleotide
gcagacaagccaggatgcacgcttttatgc

SEQ ID NO: 88460 - DNA, 31 bp, Artificial Sequence
  Description of Artificial Sequence: Synthetic oligonucleotide
cagacaagccaggatgcacgcttttatgctc

SEQ ID NO: 88461 - DNA, 32 bp, Artificial Sequence
  Description of Artificial Sequence: Synthetic oligonucleotide
agacaagccaggatgcacgcttttatgctctg

SEQ ID NO: 88462 - DNA, 31 bp, Artificial Sequence
  Description of Artificial Sequence: Synthetic oligonucleotide
gacaagccaggatgcacgcttttatgctctg

SEQ ID NO: 88463 - DNA, 32 bp, Artificial Sequence
  Description of Artificial Sequence: Synthetic oligonucleotide
acaagccaggatgcacgcttttatgctctgtc

SEQ ID NO: 88464 - DNA, 31 bp, Artificial Sequence
  Description of Artificial Sequence: Synthetic oligonucleotide
caagccaggatgcacgcttttatgctctgtc

SEQ ID NO: 88465 - DNA, 31 bp, Artificial Sequence
  Description of Artificial Sequence: Synthetic oligonucleotide
aagccaggatgcacgcttttatgctctgtcg

SEQ ID NO: 88466 - DNA, 30 bp, Artificial Sequence
  Description of Artificial Sequence: Synthetic oligonucleotide
agccaggatgcacgcttttatgctctgtcg

SEQ ID NO: 88467 - DNA, 29 bp, Artificial Sequence
  Description of Artificial Sequence: Synthetic oligonucleotide
gccaggatgcacgcttttatgctctgtcg

SEQ ID NO: 88468 - DNA, 29 bp, Artificial Sequence
  Description of Artificial Sequence: Synthetic oligonucleotide
ccaggatgcacgcttttatgctctgtcgg

SEQ ID NO: 88469 - DNA, 29 bp, Artificial Sequence
  Description of Artificial Sequence: Synthetic oligonucleotide
caggatgcacgcttttatgctctgtcggc

SEQ ID NO: 88470 - DNA, 29 bp, Artificial Sequence
  Description of Artificial Sequence: Synthetic oligonucleotide
aggatgcacgcttttatgctctgtcggcc

SEQ ID NO: 88471 - DNA, 28 bp, Artificial Sequence
  Description of Artificial Sequence: Synthetic oligonucleotide
ggatgcacgcttttatgctctgtcggcc

SEQ ID NO: 88472 - DNA, 29 bp, Artificial Sequence
  Description of Artificial Sequence: Synthetic oligonucleotide
gatgcacgcttttatgctctgtcggccag

SEQ ID NO: 88473 - DNA, 32 bp, Artificial Sequence
  Description of Artificial Sequence: Synthetic oligonucleotide
atgcacgcttttatgctctgtcggccagtttc

SEQ ID NO: 88474 - DNA, 31 bp, Artificial Sequence
  Description of Artificial Sequence: Synthetic oligonucleotide
tgcacgcttttatgctctgtcggccagtttc

SEQ ID NO: 88475 - DNA, 30 bp, Artificial Sequence
  Description of Artificial Sequence: Synthetic oligonucleotide
gcacgcttttatgctctgtcggccagtttc

SEQ ID NO: 88476 - DNA, 30 bp, Artificial Sequence
  Description of Artificial Sequence: Synthetic oligonucleotide
cacgcttttatgctctgtcggccagtttcg

SEQ ID NO: 88477 - DNA, 31 bp, Artificial Sequence
  Description of Artificial Sequence: Synthetic oligonucleotide
acgcttttatgctctgtcggccagtttcgag

SEQ ID NO: 88478 - DNA, 30 bp, Artificial Sequence
  Description of Artificial Sequence: Synthetic oligonucleotide
cgcttttatgctctgtcggccagtttcgag

SEQ ID NO: 88479 - DNA, 30 bp, Artificial Sequence
  Description of Artificial Sequence: Synthetic oligonucleotide
gcttttatgctctgtcggccagtttcgagc

SEQ ID NO: 88480 - DNA, 30 bp, Artificial Sequence
  Description of Artificial Sequence: Synthetic oligonucleotide
cttttatgctctgtcggccagtttcgagcc

SEQ ID NO: 88481 - DNA, 33 bp, Artificial Sequence
  Description of Artificial Sequence: Synthetic oligonucleotide
ttttatgctctgtcggccagtttcgagcctttc

SEQ ID NO: 88482 - DNA, 32 bp, Artificial Sequence
  Description of Artificial Sequence: Synthetic oligonucleotide
tttatgctctgtcggccagtttcgagcctttc

SEQ ID NO: 88483 - DNA, 31 bp, Artificial Sequence
  Description of Artificial Sequence: Synthetic oligonucleotide
ttatgctctgtcggccagtttcgagcctttc

SEQ ID NO: 88484 - DNA, 30 bp, Artificial Sequence
  Description of Artificial Sequence: Synthetic oligonucleotide
tatgctctgtcggccagtttcgagcctttc

SEQ ID NO: 88485 - DNA, 29 bp, Artificial Sequence
  Description of Artificial Sequence: Synthetic oligonucleotide
atgctctgtcggccagtttcgagcctttc

SEQ ID NO: 88486 - DNA, 28 bp, Artificial Sequence
  Description of Artificial Sequence: Synthetic oligonucleotide
tgctctgtcggccagtttcgagcctttc

SEQ ID NO: 88487 - DNA, 27 bp, Artificial Sequence
  Description of Artificial Sequence: Synthetic oligonucleotide
gctctgtcggccagtttcgagcctttc

SEQ ID NO: 88488 - DNA, 28 bp, Artificial Sequence
  Description of Artificial Sequence: Synthetic oligonucleotide
ctctgtcggccagtttcgagcctttcag

SEQ ID NO: 88489 - DNA, 28 bp, Artificial Sequence
  Description of Artificial Sequence: Synthetic oligonucleotide
tctgtcggccagtttcgagcctttcagc

SEQ ID NO: 88490 - DNA, 27 bp, Artificial Sequence
  Description of Artificial Sequence: Synthetic oligonucleotide
ctgtcggccagtttcgagcctttcagc

SEQ ID NO: 88491 - DNA, 29 bp, Artificial Sequence
  Description of Artificial Sequence: Synthetic oligonucleotide
tgtcggccagtttcgagcctttcagcaac

SEQ ID NO: 88492 - DNA, 28 bp, Artificial Sequence
  Description of Artificial Sequence: Synthetic oligonucleotide
gtcggccagtttcgagcctttcagcaac

SEQ ID NO: 88493 - DNA, 31 bp, Artificial Sequence
  Description of Artificial Sequence: Synthetic oligonucleotide
tcggccagtttcgagcctttcagcaacaaag

SEQ ID NO: 88494 - DNA, 30 bp, Artificial Sequence
  Description of Artificial Sequence: Synthetic oligonucleotide
cggccagtttcgagcctttcagcaacaaag

SEQ ID NO: 88495 - DNA, 30 bp, Artificial Sequence
  Description of Artificial Sequence: Synthetic oligonucleotide
ggccagtttcgagcctttcagcaacaaagg

SEQ ID NO: 88496 - DNA, 30 bp, Artificial Sequence
  Description of Artificial Sequence: Synthetic oligonucleotide
gccagtttcgagcctttcagcaacaaaggc

SEQ ID NO: 88497 - DNA, 30 bp, Artificial Sequence
  Description of Artificial Sequence: Synthetic oligonucleotide
ccagtttcgagcctttcagcaacaaaggcc

SEQ ID NO: 88498 - DNA, 31 bp, Artificial Sequence
  Description of Artificial Sequence: Synthetic oligonucleotide
cagtttcgagcctttcagcaacaaaggccag

SEQ ID NO: 88499 - DNA, 32 bp, Artificial Sequence
  Description of Artificial Sequence: Synthetic oligonucleotide
agtttcgagcctttcagcaacaaaggccagac

SEQ ID NO: 88500 - DNA, 31 bp, Artificial Sequence
  Description of Artificial Sequence: Synthetic oligonucleotide
gtttcgagcctttcagcaacaaaggccagac

SEQ ID NO: 88501 - DNA, 31 bp, Artificial Sequence
  Description of Artificial Sequence: Synthetic oligonucleotide
tttcgagcctttcagcaacaaaggccagacg

SEQ ID NO: 88502 - DNA, 30 bp, Artificial Sequence
  Description of Artificial Sequence: Synthetic oligonucleotide
ttcgagcctttcagcaacaaaggccagacg

SEQ ID NO: 88503 - DNA, 29 bp, Artificial Sequence
  Description of Artificial Sequence: Synthetic oligonucleotide
tcgagcctttcagcaacaaaggccagacg

SEQ ID NO: 88504 - DNA, 28 bp, Artificial Sequence
  Description of Artificial Sequence: Synthetic oligonucleotide
cgagcctttcagcaacaaaggccagacg

SEQ ID NO: 88505 - DNA, 28 bp, Artificial Sequence
  Description of Artificial Sequence: Synthetic oligonucleotide
gagcctttcagcaacaaaggccagacgc

SEQ ID NO: 88506 - DNA, 29 bp, Artificial Sequence
  Description of Artificial Sequence: Synthetic oligonucleotide
agcctttcagcaacaaaggccagacgctg

SEQ ID NO: 88507 - DNA, 28 bp, Artificial Sequence
  Description of Artificial Sequence: Synthetic oligonucleotide
gcctttcagcaacaaaggccagacgctg

SEQ ID NO: 88508 - DNA, 28 bp, Artificial Sequence
  Description of Artificial Sequence: Synthetic oligonucleotide
cctttcagcaacaaaggccagacgctgg

SEQ ID NO: 88509 - DNA, 29 bp, Artificial Sequence
  Description of Artificial Sequence: Synthetic oligonucleotide
ctttcagcaacaaaggccagacgctggtg

SEQ ID NO: 88510 - DNA, 29 bp, Artificial Sequence
  Description of Artificial Sequence: Synthetic oligonucleotide
tttcagcaacaaaggccagacgctggtgg

SEQ ID NO: 88511 - DNA, 28 bp, Artificial Sequence
  Description of Artificial Sequence: Synthetic oligonucleotide
ttcagcaacaaaggccagacgctggtgg

SEQ ID NO: 88512 - DNA, 27 bp, Artificial Sequence
  Description of Artificial Sequence: Synthetic oligonucleotide
tcagcaacaaaggccagacgctggtgg

SEQ ID NO: 88513 - DNA, 27 bp, Artificial Sequence
  Description of Artificial Sequence: Synthetic oligonucleotide
cagcaacaaaggccagacgctggtggt

SEQ ID NO: 88514 - DNA, 27 bp, Artificial Sequence
  Description of Artificial Sequence: Synthetic oligonucleotide
agcaacaaaggccagacgctggtggtg

SEQ ID NO: 88515 - DNA, 26 bp, Artificial Sequence
  Description of Artificial Sequence: Synthetic oligonucleotide
gcaacaaaggccagacgctggtggtg

SEQ ID NO: 88516 - DNA, 27 bp, Artificial Sequence
  Description of Artificial Sequence: Synthetic oligonucleotide
caacaaaggccagacgctggtggtgca

SEQ ID NO: 88517 - DNA, 27 bp, Artificial Sequence
  Description of Artificial Sequence: Synthetic oligonucleotide
aacaaaggccagacgctggtggtgcag

SEQ ID NO: 88518 - DNA, 27 bp, Artificial Sequence
  Description of Artificial Sequence: Synthetic oligonucleotide
acaaaggccagacgctggtggtgcagt

SEQ ID NO: 88519 - DNA, 27 bp, Artificial Sequence
  Description of Artificial Sequence: Synthetic oligonucleotide
caaaggccagacgctggtggtgcagtt

SEQ ID NO: 88520 - DNA, 27 bp, Artificial Sequence
  Description of Artificial Sequence: Synthetic oligonucleotide
aaaggccagacgctggtggtgcagttc

SEQ ID NO: 88521 - DNA, 27 bp, Artificial Sequence
  Description of Artificial Sequence: Synthetic oligonucleotide
aaggccagacgctggtggtgcagttca

SEQ ID NO: 88522 - DNA, 26 bp, Artificial Sequence
  Description of Artificial Sequence: Synthetic oligonucleotide
aggccagacgctggtggtgcagttca

SEQ ID NO: 88523 - DNA, 25 bp, Artificial Sequence
  Description of Artificial Sequence: Synthetic oligonucleotide
ggccagacgctggtggtgcagttca

SEQ ID NO: 88524 - DNA, 25 bp, Artificial Sequence
  Description of Artificial Sequence: Synthetic oligonucleotide
gccagacgctggtggtgcagttcac

SEQ ID NO: 88525 - DNA, 25 bp, Artificial Sequence
  Description of Artificial Sequence: Synthetic oligonucleotide
ccagacgctggtggtgcagttcacg

SEQ ID NO: 88526 - DNA, 26 bp, Artificial Sequence
  Description of Artificial Sequence: Synthetic oligonucleotide
cagacgctggtggtgcagttcacggt

SEQ ID NO: 88527 - DNA, 27 bp, Artificial Sequence
  Description of Artificial Sequence: Synthetic oligonucleotide
agacgctggtggtgcagttcacggtga

SEQ ID NO: 88528 - DNA, 27 bp, Artificial Sequence
  Description of Artificial Sequence: Synthetic oligonucleotide
gacgctggtggtgcagttcacggtgaa

SEQ ID NO: 88529 - DNA, 28 bp, Artificial Sequence
  Description of Artificial Sequence: Synthetic oligonucleotide
acgctggtggtgcagttcacggtgaaac

SEQ ID NO: 88530 - DNA, 27 bp, Artificial Sequence
  Description of Artificial Sequence: Synthetic oligonucleotide
cgctggtggtgcagttcacggtgaaac

SEQ ID NO: 88531 - DNA, 29 bp, Artificial Sequence
  Description of Artificial Sequence: Synthetic oligonucleotide
gctggtggtgcagttcacggtgaaacatg

SEQ ID NO: 88532 - DNA, 30 bp, Artificial Sequence
  Description of Artificial Sequence: Synthetic oligonucleotide
ctggtggtgcagttcacggtgaaacatgag

SEQ ID NO: 88533 - DNA, 30 bp, Artificial Sequence
  Description of Artificial Sequence: Synthetic oligonucleotide
tggtggtgcagttcacggtgaaacatgagc

SEQ ID NO: 88534 - DNA, 29 bp, Artificial Sequence
  Description of Artificial Sequence: Synthetic oligonucleotide
ggtggtgcagttcacggtgaaacatgagc

SEQ ID NO: 88535 - DNA, 30 bp, Artificial Sequence
  Description of Artificial Sequence: Synthetic oligonucleotide
gtggtgcagttcacggtgaaacatgagcag

SEQ ID NO: 88536 - DNA, 32 bp, Artificial Sequence
  Description of Artificial Sequence: Synthetic oligonucleotide
tggtgcagttcacggtgaaacatgagcagaac

SEQ ID NO: 88537 - DNA, 31 bp, Artificial Sequence
  Description of Artificial Sequence: Synthetic oligonucleotide
ggtgcagttcacggtgaaacatgagcagaac

SEQ ID NO: 88538 - DNA, 33 bp, Artificial Sequence
  Description of Artificial Sequence: Synthetic oligonucleotide
gtgcagttcacggtgaaacatgagcagaacatc

SEQ ID NO: 88539 - DNA, 33 bp, Artificial Sequence
  Description of Artificial Sequence: Synthetic oligonucleotide
tgcagttcacggtgaaacatgagcagaacatcg

SEQ ID NO: 88540 - DNA, 32 bp, Artificial Sequence
  Description of Artificial Sequence: Synthetic oligonucleotide
gcagttcacggtgaaacatgagcagaacatcg

SEQ ID NO: 88541 - DNA, 33 bp, Artificial Sequence
  Description of Artificial Sequence: Synthetic oligonucleotide
cagttcacggtgaaacatgagcagaacatcgac

SEQ ID NO: 88542 - DNA, 34 bp, Artificial Sequence
  Description of Artificial Sequence: Synthetic oligonucleotide
agttcacggtgaaacatgagcagaacatcgactg

SEQ ID NO: 88543 - DNA, 33 bp, Artificial Sequence
  Description of Artificial Sequence: Synthetic oligonucleotide
gttcacggtgaaacatgagcagaacatcgactg

SEQ ID NO: 88544 - DNA, 34 bp, Artificial Sequence
  Description of Artificial Sequence: Synthetic oligonucleotide
ttcacggtgaaacatgagcagaacatcgactgtg

SEQ ID NO: 88545 - DNA, 33 bp, Artificial Sequence
  Description of Artificial Sequence: Synthetic oligonucleotide
tcacggtgaaacatgagcagaacatcgactgtg

SEQ ID NO: 88546 - DNA, 32 bp, Artificial Sequence
  Description of Artificial Sequence: Synthetic oligonucleotide
cacggtgaaacatgagcagaacatcgactgtg

SEQ ID NO: 88547 - DNA, 32 bp, Artificial Sequence
  Description of Artificial Sequence: Synthetic oligonucleotide
acggtgaaacatgagcagaacatcgactgtgg

SEQ ID NO: 88548 - DNA, 31 bp, Artificial Sequence
  Description of Artificial Sequence: Synthetic oligonucleotide
cggtgaaacatgagcagaacatcgactgtgg

SEQ ID NO: 88549 - DNA, 31 bp, Artificial Sequence
  Description of Artificial Sequence: Synthetic oligonucleotide
ggtgaaacatgagcagaacatcgactgtggg

SEQ ID NO: 88550 - DNA, 31 bp, Artificial Sequence
  Description of Artificial Sequence: Synthetic oligonucleotide
gtgaaacatgagcagaacatcgactgtgggg

SEQ ID NO: 88551 - DNA, 31 bp, Artificial Sequence
  Description of Artificial Sequence: Synthetic oligonucleotide
tgaaacatgagcagaacatcgactgtggggg

SEQ ID NO: 88552 - DNA, 30 bp, Artificial Sequence
  Description of Artificial Sequence: Synthetic oligonucleotide
gaaacatgagcagaacatcgactgtggggg

SEQ ID NO: 88553 - DNA, 30 bp, Artificial Sequence
  Description of Artificial Sequence: Synthetic oligonucleotide
aaacatgagcagaacatcgactgtgggggc

SEQ ID NO: 88554 - DNA, 29 bp, Artificial Sequence
  Description of Artificial Sequence: Synthetic oligonucleotide
aacatgagcagaacatcgactgtgggggc

SEQ ID NO: 88555 - DNA, 28 bp, Artificial Sequence
  Description of Artificial Sequence: Synthetic oligonucleotide
acatgagcagaacatcgactgtgggggc

SEQ ID NO: 88556 - DNA, 27 bp, Artificial Sequence
  Description of Artificial Sequence: Synthetic oligonucleotide
catgagcagaacatcgactgtgggggc

SEQ ID NO: 88557 - DNA, 27 bp, Artificial Sequence
  Description of Artificial Sequence: Synthetic oligonucleotide
atgagcagaacatcgactgtgggggcg

SEQ ID NO: 88558 - DNA, 26 bp, Artificial Sequence
  Description of Artificial Sequence: Synthetic oligonucleotide
tgagcagaacatcgactgtgggggcg

SEQ ID NO: 88559 - DNA, 25 bp, Artificial Sequence
  Description of Artificial Sequence: Synthetic oligonucleotide
gagcagaacatcgactgtgggggcg

SEQ ID NO: 88560 - DNA, 25 bp, Artificial Sequence
  Description of Artificial Sequence: Synthetic oligonucleotide
agcagaacatcgactgtgggggcgg

SEQ ID NO: 88561 - DNA, 24 bp, Artificial Sequence
  Description of Artificial Sequence: Synthetic oligonucleotide
gcagaacatcgactgtgggggcgg

SEQ ID NO: 88562 - DNA, 27 bp, Artificial Sequence
  Description of Artificial Sequence: Synthetic oligonucleotide
cagaacatcgactgtgggggcggctat

SEQ ID NO: 88563 - DNA, 27 bp, Artificial Sequence
  Description of Artificial Sequence: Synthetic oligonucleotide
agaacatcgactgtgggggcggctatg

SEQ ID NO: 88564 - DNA, 27 bp, Artificial Sequence
  Description of Artificial Sequence: Synthetic oligonucleotide
gaacatcgactgtgggggcggctatgt

SEQ ID NO: 88565 - DNA, 27 bp, Artificial Sequence
  Description of Artificial Sequence: Synthetic oligonucleotide
aacatcgactgtgggggcggctatgtg

SEQ ID NO: 88566 - DNA, 27 bp, Artificial Sequence
  Description of Artificial Sequence: Synthetic oligonucleotide
acatcgactgtgggggcggctatgtga

SEQ ID NO: 88567 - DNA, 27 bp, Artificial Sequence
  Description of Artificial Sequence: Synthetic oligonucleotide
catcgactgtgggggcggctatgtgaa

SEQ ID NO: 88568 - DNA, 27 bp, Artificial Sequence
  Description of Artificial Sequence: Synthetic oligonucleotide
atcgactgtgggggcggctatgtgaag

SEQ ID NO: 88569 - DNA, 26 bp, Artificial Sequence
  Description of Artificial Sequence: Synthetic oligonucleotide
tcgactgtgggggcggctatgtgaag

SEQ ID NO: 88570 - DNA, 25 bp, Artificial Sequence
  Description of Artificial Sequence: Synthetic oligonucleotide
cgactgtgggggcggctatgtgaag

SEQ ID NO: 88571 - DNA, 26 bp, Artificial Sequence
  Description of Artificial Sequence: Synthetic oligonucleotide
gactgtgggggcggctatgtgaagct

SEQ ID NO: 88572 - DNA, 27 bp, Artificial Sequence
  Description of Artificial Sequence: Synthetic oligonucleotide
actgtgggggcggctatgtgaagctgt

SEQ ID NO: 88573 - DNA, 27 bp, Artificial Sequence
  Description of Artificial Sequence: Synthetic oligonucleotide
ctgtgggggcggctatgtgaagctgtt

SEQ ID NO: 88574 - DNA, 28 bp, Artificial Sequence
  Description of Artificial Sequence: Synthetic oligonucleotide
tgtgggggcggctatgtgaagctgtttc

SEQ ID NO: 88575 - DNA, 27 bp, Artificial Sequence
  Description of Artificial Sequence: Synthetic oligonucleotide
gtgggggcggctatgtgaagctgtttc

SEQ ID NO: 88576 - DNA, 27 bp, Artificial Sequence
  Description of Artificial Sequence: Synthetic oligonucleotide
tgggggcggctatgtgaagctgtttcc

SEQ ID NO: 88577 - DNA, 27 bp, Artificial Sequence
  Description of Artificial Sequence: Synthetic oligonucleotide
gggggcggctatgtgaagctgtttcct

SEQ ID NO: 88578 - DNA, 31 bp, Artificial Sequence
  Description of Artificial Sequence: Synthetic oligonucleotide
ggggcggctatgtgaagctgtttcctaatag

SEQ ID NO: 88579 - DNA, 34 bp, Artificial Sequence
  Description of Artificial Sequence: Synthetic oligonucleotide
gggcggctatgtgaagctgtttcctaatagtttg

SEQ ID NO: 88580 - DNA, 34 bp, Artificial Sequence
  Description of Artificial Sequence: Synthetic oligonucleotide
ggcggctatgtgaagctgtttcctaatagtttgg

SEQ ID NO: 88581 - DNA, 35 bp, Artificial Sequence
  Description of Artificial Sequence: Synthetic oligonucleotide
gcggctatgtgaagctgtttcctaatagtttggac

SEQ ID NO: 88582 - DNA, 35 bp, Artificial Sequence
  Description of Artificial Sequence: Synthetic oligonucleotide
cggctatgtgaagctgtttcctaatagtttggacc

SEQ ID NO: 88583 - DNA, 36 bp, Artificial Sequence
  Description of Artificial Sequence: Synthetic oligonucleotide
ggctatgtgaagctgtttcctaatagtttggaccag

SEQ ID NO: 88584 - DNA, 37 bp, Artificial Sequence
  Description of Artificial Sequence: Synthetic oligonucleotide
gctatgtgaagctgtttcctaatagtttggaccagac

SEQ ID NO: 88585 - DNA, 38 bp, Artificial Sequence
  Description of Artificial Sequence: Synthetic oligonucleotide
ctatgtgaagctgtttcctaatagtttggaccagacag

SEQ ID NO: 88586 - DNA, 39 bp, Artificial Sequence
  Description of Artificial Sequence: Synthetic oligonucleotide
tatgtgaagctgtttcctaatagtttggaccagacagac

SEQ ID NO: 88587 - DNA, 38 bp, Artificial Sequence
  Description of Artificial Sequence: Synthetic oligonucleotide
atgtgaagctgtttcctaatagtttggaccagacagac

SEQ ID NO: 88588 - DNA, 37 bp, Artificial Sequence
  Description of Artificial Sequence: Synthetic oligonucleotide
tgtgaagctgtttcctaatagtttggaccagacagac

SEQ ID NO: 88589 - DNA, 36 bp, Artificial Sequence
  Description of Artificial Sequence: Synthetic oligonucleotide
gtgaagctgtttcctaatagtttggaccagacagac

SEQ ID NO: 88590 - DNA, 38 bp, Artificial Sequence
  Description of Artificial Sequence: Synthetic oligonucleotide
tgaagctgtttcctaatagtttggaccagacagacatg

SEQ ID NO: 88591 - DNA, 37 bp, Artificial Sequence
  Description of Artificial Sequence: Synthetic oligonucleotide
gaagctgtttcctaatagtttggaccagacagacatg

SEQ ID NO: 88592 - DNA, 37 bp, Artificial Sequence
  Description of Artificial Sequence: Synthetic oligonucleotide
aagctgtttcctaatagtttggaccagacagacatgc

SEQ ID NO: 88593 - DNA, 36 bp, Artificial Sequence
  Description of Artificial Sequence: Synthetic oligonucleotide
agctgtttcctaatagtttggaccagacagacatgc

SEQ ID NO: 88594 - DNA, 35 bp, Artificial Sequence
  Description of Artificial Sequence: Synthetic oligonucleotide
gctgtttcctaatagtttggaccagacagacatgc

SEQ ID NO: 88595 - DNA, 36 bp, Artificial Sequence
  Description of Artificial Sequence: Synthetic oligonucleotide
ctgtttcctaatagtttggaccagacagacatgcac

SEQ ID NO: 88596 - DNA, 36 bp, Artificial Sequence
  Description of Artificial Sequence: Synthetic oligonucleotide
tgtttcctaatagtttggaccagacagacatgcacg

SEQ ID NO: 88597 - DNA, 35 bp, Artificial Sequence
  Description of Artificial Sequence: Synthetic oligonucleotide
gtttcctaatagtttggaccagacagacatgcacg

SEQ ID NO: 88598 - DNA, 35 bp, Artificial Sequence
  Description of Artificial Sequence: Synthetic oligonucleotide
tttcctaatagtttggaccagacagacatgcacgg

SEQ ID NO: 88599 - DNA, 34 bp, Artificial Sequence
  Description of Artificial Sequence: Synthetic oligonucleotide
ttcctaatagtttggaccagacagacatgcacgg

SEQ ID NO: 88600 - DNA, 33 bp, Artificial Sequence
  Description of Artificial Sequence: Synthetic oligonucleotide
tcctaatagtttggaccagacagacatgcacgg

SEQ ID NO: 88601 - DNA, 32 bp, Artificial Sequence
  Description of Artificial Sequence: Synthetic oligonucleotide
cctaatagtttggaccagacagacatgcacgg

SEQ ID NO: 88602 - DNA, 33 bp, Artificial Sequence
  Description of Artificial Sequence: Synthetic oligonucleotide
ctaatagtttggaccagacagacatgcacggag

SEQ ID NO: 88603 - DNA, 34 bp, Artificial Sequence
  Description of Artificial Sequence: Synthetic oligonucleotide
taatagtttggaccagacagacatgcacggagac

SEQ ID NO: 88604 - DNA, 33 bp, Artificial Sequence
  Description of Artificial Sequence: Synthetic oligonucleotide
aatagtttggaccagacagacatgcacggagac

SEQ ID NO: 88605 - DNA, 32 bp, Artificial Sequence
  Description of Artificial Sequence: Synthetic oligonucleotide
atagtttggaccagacagacatgcacggagac

SEQ ID NO: 88606 - DNA, 31 bp, Artificial Sequence
  Description of Artificial Sequence: Synthetic oligonucleotide
tagtttggaccagacagacatgcacggagac

SEQ ID NO: 88607 - DNA, 30 bp, Artificial Sequence
  Description of Artificial Sequence: Synthetic oligonucleotide
agtttggaccagacagacatgcacggagac

SEQ ID NO: 88608 - DNA, 29 bp, Artificial Sequence
  Description of Artificial Sequence: Synthetic oligonucleotide
gtttggaccagacagacatgcacggagac

SEQ ID NO: 88609 - DNA, 30 bp, Artificial Sequence
  Description of Artificial Sequence: Synthetic oligonucleotide
tttggaccagacagacatgcacggagactc

SEQ ID NO: 88610 - DNA, 29 bp, Artificial Sequence
  Description of Artificial Sequence: Synthetic oligonucleotide
ttggaccagacagacatgcacggagactc

SEQ ID NO: 88611 - DNA, 28 bp, Artificial Sequence
  Description of Artificial Sequence: Synthetic oligonucleotide
tggaccagacagacatgcacggagactc

SEQ ID NO: 88612 - DNA, 27 bp, Artificial Sequence
  Description of Artificial Sequence: Synthetic oligonucleotide
ggaccagacagacatgcacggagactc

SEQ ID NO: 88613 - DNA, 28 bp, Artificial Sequence
  Description of Artificial Sequence: Synthetic oligonucleotide
gaccagacagacatgcacggagactcag

SEQ ID NO: 88614 - DNA, 32 bp, Artificial Sequence
  Description of Artificial Sequence: Synthetic oligonucleotide
accagacagacatgcacggagactcagaatac

SEQ ID NO: 88615 - DNA, 31 bp, Artificial Sequence
  Description of Artificial Sequence: Synthetic oligonucleotide
ccagacagacatgcacggagactcagaatac

SEQ ID NO: 88616 - DNA, 33 bp, Artificial Sequence
  Description of Artificial Sequence: Synthetic oligonucleotide
cagacagacatgcacggagactcagaatacaac

SEQ ID NO: 88617 - DNA, 35 bp, Artificial Sequence
  Description of Artificial Sequence: Synthetic oligonucleotide
agacagacatgcacggagactcagaatacaacatc

SEQ ID NO: 88618 - DNA, 34 bp, Artificial Sequence
  Description of Artificial Sequence: Synthetic oligonucleotide
gacagacatgcacggagactcagaatacaacatc

SEQ ID NO: 88619 - DNA, 36 bp, Artificial Sequence
  Description of Artificial Sequence: Synthetic oligonucleotide
acagacatgcacggagactcagaatacaacatcatg

SEQ ID NO: 88620 - DNA, 35 bp, Artificial Sequence
  Description of Artificial Sequence: Synthetic oligonucleotide
cagacatgcacggagactcagaatacaacatcatg

SEQ ID NO: 88621 - DNA, 38 bp, Artificial Sequence
  Description of Artificial Sequence: Synthetic oligonucleotide
agacatgcacggagactcagaatacaacatcatgtttg

SEQ ID NO: 88622 - DNA, 37 bp, Artificial Sequence
  Description of Artificial Sequence: Synthetic oligonucleotide
gacatgcacggagactcagaatacaacatcatgtttg

SEQ ID NO: 88623 - DNA, 37 bp, Artificial Sequence
  Description of Artificial Sequence: Synthetic oligonucleotide
acatgcacggagactcagaatacaacatcatgtttgg

SEQ ID NO: 88624 - DNA, 36 bp, Artificial Sequence
  Description of Artificial Sequence: Synthetic oligonucleotide
catgcacggagactcagaatacaacatcatgtttgg

SEQ ID NO: 88625 - DNA, 37 bp, Artificial Sequence
  Description of Artificial Sequence: Synthetic oligonucleotide
atgcacggagactcagaatacaacatcatgtttggtc

SEQ ID NO: 88626 - DNA, 36 bp, Artificial Sequence
  Description of Artificial Sequence: Synthetic oligonucleotide
tgcacggagactcagaatacaacatcatgtttggtc

SEQ ID NO: 88627 - DNA, 35 bp, Artificial Sequence
  Description of Artificial Sequence: Synthetic oligonucleotide
gcacggagactcagaatacaacatcatgtttggtc

SEQ ID NO: 88628 - DNA, 35 bp, Artificial Sequence
  Description of Artificial Sequence: Synthetic oligonucleotide
cacggagactcagaatacaacatcatgtttggtcc

SEQ ID NO: 88629 - DNA, 35 bp, Artificial Sequence
  Description of Artificial Sequence: Synthetic oligonucleotide
acggagactcagaatacaacatcatgtttggtccc

SEQ ID NO: 88630 - DNA, 34 bp, Artificial Sequence
  Description of Artificial Sequence: Synthetic oligonucleotide
cggagactcagaatacaacatcatgtttggtccc

SEQ ID NO: 88631 - DNA, 34 bp, Artificial Sequence
  Description of Artificial Sequence: Synthetic oligonucleotide
ggagactcagaatacaacatcatgtttggtcccg

SEQ ID NO: 88632 - DNA, 35 bp, Artificial Sequence
  Description of Artificial Sequence: Synthetic oligonucleotide
gagactcagaatacaacatcatgtttggtcccgac

SEQ ID NO: 88633 - DNA, 37 bp, Artificial Sequence
  Description of Artificial Sequence: Synthetic oligonucleotide
agactcagaatacaacatcatgtttggtcccgacatc

SEQ ID NO: 88634 - DNA, 36 bp, Artificial Sequence
  Description of Artificial Sequence: Synthetic oligonucleotide
gactcagaatacaacatcatgtttggtcccgacatc

SEQ ID NO: 88635 - DNA, 37 bp, Artificial Sequence
  Description of Artificial Sequence: Synthetic oligonucleotide
actcagaatacaacatcatgtttggtcccgacatctg

SEQ ID NO: 88636 - DNA, 36 bp, Artificial Sequence
  Description of Artificial Sequence: Synthetic oligonucleotide
ctcagaatacaacatcatgtttggtcccgacatctg

SEQ ID NO: 88637 - DNA, 37 bp, Artificial Sequence
  Description of Artificial Sequence: Synthetic oligonucleotide
tcagaatacaacatcatgtttggtcccgacatctgtg

SEQ ID NO: 88638 - DNA, 36 bp, Artificial Sequence
  Description of Artificial Sequence: Synthetic oligonucleotide
cagaatacaacatcatgtttggtcccgacatctgtg

SEQ ID NO: 88639 - DNA, 36 bp, Artificial Sequence
  Description of Artificial Sequence: Synthetic oligonucleotide
agaatacaacatcatgtttggtcccgacatctgtgg

SEQ ID NO: 88640 - DNA, 35 bp, Artificial Sequence
  Description of Artificial Sequence: Synthetic oligonucleotide
gaatacaacatcatgtttggtcccgacatctgtgg

SEQ ID NO: 88641 - DNA, 35 bp, Artificial Sequence
  Description of Artificial Sequence: Synthetic oligonucleotide
aatacaacatcatgtttggtcccgacatctgtggc

SEQ ID NO: 88642 - DNA, 34 bp, Artificial Sequence
  Description of Artificial Sequence: Synthetic oligonucleotide
atacaacatcatgtttggtcccgacatctgtggc

SEQ ID NO: 88643 - DNA, 33 bp, Artificial Sequence
  Description of Artificial Sequence: Synthetic oligonucleotide
tacaacatcatgtttggtcccgacatctgtggc

SEQ ID NO: 88644 - DNA, 32 bp, Artificial Sequence
  Description of Artificial Sequence: Synthetic oligonucleotide
acaacatcatgtttggtcccgacatctgtggc

SEQ ID NO: 88645 - DNA, 31 bp, Artificial Sequence
  Description of Artificial Sequence: Synthetic oligonucleotide
caacatcatgtttggtcccgacatctgtggc

SEQ ID NO: 88646 - DNA, 31 bp, Artificial Sequence
  Description of Artificial Sequence: Synthetic oligonucleotide
aacatcatgtttggtcccgacatctgtggcc

SEQ ID NO: 88647 - DNA, 30 bp, Artificial Sequence
  Description of Artificial Sequence: Synthetic oligonucleotide
acatcatgtttggtcccgacatctgtggcc

SEQ ID NO: 88648 - DNA, 29 bp, Artificial Sequence
  Description of Artificial Sequence: Synthetic oligonucleotide
catcatgtttggtcccgacatctgtggcc

SEQ ID NO: 88649 - DNA, 29 bp, Artificial Sequence
  Description of Artificial Sequence: Synthetic oligonucleotide
atcatgtttggtcccgacatctgtggccc

SEQ ID NO: 88650 - DNA, 28 bp, Artificial Sequence
  Description of Artificial Sequence: Synthetic oligonucleotide
tcatgtttggtcccgacatctgtggccc

SEQ ID NO: 88651 - DNA, 27 bp, Artificial Sequence
  Description of Artificial Sequence: Synthetic oligonucleotide
catgtttggtcccgacatctgtggccc

SEQ ID NO: 88652 - DNA, 28 bp, Artificial Sequence
  Description of Artificial Sequence: Synthetic oligonucleotide
atgtttggtcccgacatctgtggccctg

SEQ ID NO: 88653 - DNA, 27 bp, Artificial Sequence
  Description of Artificial Sequence: Synthetic oligonucleotide
tgtttggtcccgacatctgtggccctg

SEQ ID NO: 88654 - DNA, 26 bp, Artificial Sequence
  Description of Artificial Sequence: Synthetic oligonucleotide
gtttggtcccgacatctgtggccctg

SEQ ID NO: 88655 - DNA, 26 bp, Artificial Sequence
  Description of Artificial Sequence: Synthetic oligonucleotide
tttggtcccgacatctgtggccctgg

SEQ ID NO: 88656 - DNA, 25 bp, Artificial Sequence
  Description of Artificial Sequence: Synthetic oligonucleotide
ttggtcccgacatctgtggccctgg

SEQ ID NO: 88657 - DNA, 24 bp, Artificial Sequence
  Description of Artificial Sequence: Synthetic oligonucleotide
tggtcccgacatctgtggccctgg

SEQ ID NO: 88658 - DNA, 23 bp, Artificial Sequence
  Description of Artificial Sequence: Synthetic oligonucleotide
ggtcccgacatctgtggccctgg

SEQ ID NO: 88659 - DNA, 24 bp, Artificial Sequence
  Description of Artificial Sequence: Synthetic oligonucleotide
gtcccgacatctgtggccctggca

SEQ ID NO: 88660 - DNA, 24 bp, Artificial Sequence
  Description of Artificial Sequence: Synthetic oligonucleotide
tcccgacatctgtggccctggcac

SEQ ID NO: 88661 - DNA, 23 bp, Artificial Sequence
  Description of Artificial Sequence: Synthetic oligonucleotide
cccgacatctgtggccctggcac

SEQ ID NO: 88662 - DNA, 25 bp, Artificial Sequence
  Description of Artificial Sequence: Synthetic oligonucleotide
ccgacatctgtggccctggcaccaa

SEQ ID NO: 88663 - DNA, 27 bp, Artificial Sequence
  Description of Artificial Sequence: Synthetic oligonucleotide
cgacatctgtggccctggcaccaagaa

SEQ ID NO: 88664 - DNA, 27 bp, Artificial Sequence
  Description of Artificial Sequence: Synthetic oligonucleotide
gacatctgtggccctggcaccaagaag

SEQ ID NO: 88665 - DNA, 27 bp, Artificial Sequence
  Description of Artificial Sequence: Synthetic oligonucleotide
acatctgtggccctggcaccaagaagg

SEQ ID NO: 88666 - DNA, 27 bp, Artificial Sequence
  Description of Artificial Sequence: Synthetic oligonucleotide
catctgtggccctggcaccaagaaggt

SEQ ID NO: 88667 - DNA, 28 bp, Artificial Sequence
  Description of Artificial Sequence: Synthetic oligonucleotide
atctgtggccctggcaccaagaaggttc

SEQ ID NO: 88668 - DNA, 27 bp, Artificial Sequence
  Description of Artificial Sequence: Synthetic oligonucleotide
tctgtggccctggcaccaagaaggttc

SEQ ID NO: 88669 - DNA, 27 bp, Artificial Sequence
  Description of Artificial Sequence: Synthetic oligonucleotide
ctgtggccctggcaccaagaaggttca

SEQ ID NO: 88670 - DNA, 28 bp, Artificial Sequence
  Description of Artificial Sequence: Synthetic oligonucleotide
tgtggccctggcaccaagaaggttcatg

SEQ ID NO: 88671 - DNA, 27 bp, Artificial Sequence
  Description of Artificial Sequence: Synthetic oligonucleotide
gtggccctggcaccaagaaggttcatg

SEQ ID NO: 88672 - DNA, 28 bp, Artificial Sequence
  Description of Artificial Sequence: Synthetic oligonucleotide
tggccctggcaccaagaaggttcatgtc

SEQ ID NO: 88673 - DNA, 27 bp, Artificial Sequence
  Description of Artificial Sequence: Synthetic oligonucleotide
ggccctggcaccaagaaggttcatgtc

SEQ ID NO: 88674 - DNA, 29 bp, Artificial Sequence
  Description of Artificial Sequence: Synthetic oligonucleotide
gccctggcaccaagaaggttcatgtcatc

SEQ ID NO: 88675 - DNA, 31 bp, Artificial Sequence
  Description of Artificial Sequence: Synthetic oligonucleotide
ccctggcaccaagaaggttcatgtcatcttc

SEQ ID NO: 88676 - DNA, 33 bp, Artificial Sequence
  Description of Artificial Sequence: Synthetic oligonucleotide
cctggcaccaagaaggttcatgtcatcttcaac

SEQ ID NO: 88677 - DNA, 35 bp, Artificial Sequence
  Description of Artificial Sequence: Synthetic oligonucleotide
ctggcaccaagaaggttcatgtcatcttcaactac

SEQ ID NO: 88678 - DNA, 37 bp, Artificial Sequence
  Description of Artificial Sequence: Synthetic oligonucleotide
tggcaccaagaaggttcatgtcatcttcaactacaag

SEQ ID NO: 88679 - DNA, 36 bp, Artificial Sequence
  Description of Artificial Sequence: Synthetic oligonucleotide
ggcaccaagaaggttcatgtcatcttcaactacaag

SEQ ID NO: 88680 - DNA, 36 bp, Artificial Sequence
  Description of Artificial Sequence: Synthetic oligonucleotide
gcaccaagaaggttcatgtcatcttcaactacaagg

SEQ ID NO: 88681 - DNA, 36 bp, Artificial Sequence
  Description of Artificial Sequence: Synthetic oligonucleotide
caccaagaaggttcatgtcatcttcaactacaaggg

SEQ ID NO: 88682 - DNA, 36 bp, Artificial Sequence
  Description of Artificial Sequence: Synthetic oligonucleotide
accaagaaggttcatgtcatcttcaactacaagggc

SEQ ID NO: 88683 - DNA, 35 bp, Artificial Sequence
  Description of Artificial Sequence: Synthetic oligonucleotide
ccaagaaggttcatgtcatcttcaactacaagggc

SEQ ID NO: 88684 - DNA, 37 bp, Artificial Sequence
  Description of Artificial Sequence: Synthetic oligonucleotide
caagaaggttcatgtcatcttcaactacaagggcaag

SEQ ID NO: 88685 - DNA, 39 bp, Artificial Sequence
  Description of Artificial Sequence: Synthetic oligonucleotide
aagaaggttcatgtcatcttcaactacaagggcaagaac

SEQ ID NO: 88686 - DNA, 38 bp, Artificial Sequence
  Description of Artificial Sequence: Synthetic oligonucleotide
agaaggttcatgtcatcttcaactacaagggcaagaac

SEQ ID NO: 88687 - DNA, 37 bp, Artificial Sequence
  Description of Artificial Sequence: Synthetic oligonucleotide
gaaggttcatgtcatcttcaactacaagggcaagaac

SEQ ID NO: 88688 - DNA, 37 bp, Artificial Sequence
  Description of Artificial Sequence: Synthetic oligonucleotide
aaggttcatgtcatcttcaactacaagggcaagaacg

SEQ ID NO: 88689 - DNA, 36 bp, Artificial Sequence
  Description of Artificial Sequence: Synthetic oligonucleotide
aggttcatgtcatcttcaactacaagggcaagaacg

SEQ ID NO: 88690 - DNA, 35 bp, Artificial Sequence
  Description of Artificial Sequence: Synthetic oligonucleotide
ggttcatgtcatcttcaactacaagggcaagaacg

SEQ ID NO: 88691 - DNA, 36 bp, Artificial Sequence
  Description of Artificial Sequence: Synthetic oligonucleotide
gttcatgtcatcttcaactacaagggcaagaacgtg

SEQ ID NO: 88692 - DNA, 36 bp, Artificial Sequence
  Description of Artificial Sequence: Synthetic oligonucleotide
ttcatgtcatcttcaactacaagggcaagaacgtgc

SEQ ID NO: 88693 - DNA, 35 bp, Artificial Sequence
  Description of Artificial Sequence: Synthetic oligonucleotide
tcatgtcatcttcaactacaagggcaagaacgtgc

SEQ ID NO: 88694 - DNA, 34 bp, Artificial Sequence
  Description of Artificial Sequence: Synthetic oligonucleotide
catgtcatcttcaactacaagggcaagaacgtgc

SEQ ID NO: 88695 - DNA, 35 bp, Artificial Sequence
  Description of Artificial Sequence: Synthetic oligonucleotide
atgtcatcttcaactacaagggcaagaacgtgctg

SEQ ID NO: 88696 - DNA, 34 bp, Artificial Sequence
  Description of Artificial Sequence: Synthetic oligonucleotide
tgtcatcttcaactacaagggcaagaacgtgctg

SEQ ID NO: 88697 - DNA, 33 bp, Artificial Sequence
  Description of Artificial Sequence: Synthetic oligonucleotide
gtcatcttcaactacaagggcaagaacgtgctg

SEQ ID NO: 88698 - DNA, 35 bp, Artificial Sequence
  Description of Artificial Sequence: Synthetic oligonucleotide
tcatcttcaactacaagggcaagaacgtgctgatc

SEQ ID NO: 88699 - DNA, 34 bp, Artificial Sequence
  Description of Artificial Sequence: Synthetic oligonucleotide
catcttcaactacaagggcaagaacgtgctgatc

SEQ ID NO: 88700 - DNA, 36 bp, Artificial Sequence
  Description of Artificial Sequence: Synthetic oligonucleotide
atcttcaactacaagggcaagaacgtgctgatcaac

SEQ ID NO: 88701 - DNA, 35 bp, Artificial Sequence
  Description of Artificial Sequence: Synthetic oligonucleotide
tcttcaactacaagggcaagaacgtgctgatcaac

SEQ ID NO: 88702 - DNA, 34 bp, Artificial Sequence
  Description of Artificial Sequence: Synthetic oligonucleotide
cttcaactacaagggcaagaacgtgctgatcaac

SEQ ID NO: 88703 - DNA, 36 bp, Artificial Sequence
  Description of Artificial Sequence: Synthetic oligonucleotide
ttcaactacaagggcaagaacgtgctgatcaacaag

SEQ ID NO: 88704 - DNA, 35 bp, Artificial Sequence
  Description of Artificial Sequence: Synthetic oligonucleotide
tcaactacaagggcaagaacgtgctgatcaacaag

SEQ ID NO: 88705 - DNA, 34 bp, Artificial Sequence
  Description of Artificial Sequence: Synthetic oligonucleotide
caactacaagggcaagaacgtgctgatcaacaag

SEQ ID NO: 88706 - DNA, 34 bp, Artificial Sequence
  Description of Artificial Sequence: Synthetic oligonucleotide
aactacaagggcaagaacgtgctgatcaacaagg

SEQ ID NO: 88707 - DNA, 33 bp, Artificial Sequence
  Description of Artificial Sequence: Synthetic oligonucleotide
actacaagggcaagaacgtgctgatcaacaagg

SEQ ID NO: 88708 - DNA, 32 bp, Artificial Sequence
  Description of Artificial Sequence: Synthetic oligonucleotide
ctacaagggcaagaacgtgctgatcaacaagg

SEQ ID NO: 88709 - DNA, 33 bp, Artificial Sequence
  Description of Artificial Sequence: Synthetic oligonucleotide
tacaagggcaagaacgtgctgatcaacaaggac

SEQ ID NO: 88710 - DNA, 32 bp, Artificial Sequence
  Description of Artificial Sequence: Synthetic oligonucleotide
acaagggcaagaacgtgctgatcaacaaggac

SEQ ID NO: 88711 - DNA, 31 bp, Artificial Sequence
  Description of Artificial Sequence: Synthetic oligonucleotide
caagggcaagaacgtgctgatcaacaaggac

SEQ ID NO: 88712 - DNA, 33 bp, Artificial Sequence
  Description of Artificial Sequence: Synthetic oligonucleotide
aagggcaagaacgtgctgatcaacaaggacatc

SEQ ID NO: 88713 - DNA, 32 bp, Artificial Sequence
  Description of Artificial Sequence: Synthetic oligonucleotide
agggcaagaacgtgctgatcaacaaggacatc

SEQ ID NO: 88714 - DNA, 31 bp, Artificial Sequence
  Description of Artificial Sequence: Synthetic oligonucleotide
gggcaagaacgtgctgatcaacaaggacatc

SEQ ID NO: 88715 - DNA, 31 bp, Artificial Sequence
  Description of Artificial Sequence: Synthetic oligonucleotide
ggcaagaacgtgctgatcaacaaggacatcc

SEQ ID NO: 88716 - DNA, 31 bp, Artificial Sequence
  Description of Artificial Sequence: Synthetic oligonucleotide
gcaagaacgtgctgatcaacaaggacatccg

SEQ ID NO: 88717 - DNA, 33 bp, Artificial Sequence
  Description of Artificial Sequence: Synthetic oligonucleotide
caagaacgtgctgatcaacaaggacatccgttg

SEQ ID NO: 88718 - DNA, 33 bp, Artificial Sequence
  Description of Artificial Sequence: Synthetic oligonucleotide
aagaacgtgctgatcaacaaggacatccgttgc

SEQ ID NO: 88719 - DNA, 32 bp, Artificial Sequence
  Description of Artificial Sequence: Synthetic oligonucleotide
agaacgtgctgatcaacaaggacatccgttgc

SEQ ID NO: 88720 - DNA, 31 bp, Artificial Sequence
  Description of Artificial Sequence: Synthetic oligonucleotide
gaacgtgctgatcaacaaggacatccgttgc

SEQ ID NO: 88721 - DNA, 33 bp, Artificial Sequence
  Description of Artificial Sequence: Synthetic oligonucleotide
aacgtgctgatcaacaaggacatccgttgcaag

SEQ ID NO: 88722 - DNA, 32 bp, Artificial Sequence
  Description of Artificial Sequence: Synthetic oligonucleotide
acgtgctgatcaacaaggacatccgttgcaag

SEQ ID NO: 88723 - DNA, 31 bp, Artificial Sequence
  Description of Artificial Sequence: Synthetic oligonucleotide
cgtgctgatcaacaaggacatccgttgcaag

SEQ ID NO: 88724 - DNA, 31 bp, Artificial Sequence
  Description of Artificial Sequence: Synthetic oligonucleotide
gtgctgatcaacaaggacatccgttgcaagg

SEQ ID NO: 88725 - DNA, 33 bp, Artificial Sequence
  Description of Artificial Sequence: Synthetic oligonucleotide
tgctgatcaacaaggacatccgttgcaaggatg

SEQ ID NO: 88726 - DNA, 32 bp, Artificial Sequence
  Description of Artificial Sequence: Synthetic oligonucleotide
gctgatcaacaaggacatccgttgcaaggatg

SEQ ID NO: 88727 - DNA, 34 bp, Artificial Sequence
  Description of Artificial Sequence: Synthetic oligonucleotide
ctgatcaacaaggacatccgttgcaaggatgatg

SEQ ID NO: 88728 - DNA, 35 bp, Artificial Sequence
  Description of Artificial Sequence: Synthetic oligonucleotide
tgatcaacaaggacatccgttgcaaggatgatgag

SEQ ID NO: 88729 - DNA, 34 bp, Artificial Sequence
  Description of Artificial Sequence: Synthetic oligonucleotide
gatcaacaaggacatccgttgcaaggatgatgag

SEQ ID NO: 88730 - DNA, 38 bp, Artificial Sequence
  Description of Artificial Sequence: Synthetic oligonucleotide
atcaacaaggacatccgttgcaaggatgatgagtttac

SEQ ID NO: 88731 - DNA, 37 bp, Artificial Sequence
  Description of Artificial Sequence: Synthetic oligonucleotide
tcaacaaggacatccgttgcaaggatgatgagtttac

SEQ ID NO: 88732 - DNA, 36 bp, Artificial Sequence
  Description of Artificial Sequence: Synthetic oligonucleotide
caacaaggacatccgttgcaaggatgatgagtttac

SEQ ID NO: 88733 - DNA, 37 bp, Artificial Sequence
  Description of Artificial Sequence: Synthetic oligonucleotide
aacaaggacatccgttgcaaggatgatgagtttacac

SEQ ID NO: 88734 - DNA, 36 bp, Artificial Sequence
  Description of Artificial Sequence: Synthetic oligonucleotide
acaaggacatccgttgcaaggatgatgagtttacac

SEQ ID NO: 88735 - DNA, 35 bp, Artificial Sequence
  Description of Artificial Sequence: Synthetic oligonucleotide
caaggacatccgttgcaaggatgatgagtttacac

SEQ ID NO: 88736 - DNA, 36 bp, Artificial Sequence
  Description of Artificial Sequence: Synthetic oligonucleotide
aaggacatccgttgcaaggatgatgagtttacacac

SEQ ID NO: 88737 - DNA, 35 bp, Artificial Sequence
  Description of Artificial Sequence: Synthetic oligonucleotide
aggacatccgttgcaaggatgatgagtttacacac

SEQ ID NO: 88738 - DNA, 34 bp, Artificial Sequence
  Description of Artificial Sequence: Synthetic oligonucleotide
ggacatccgttgcaaggatgatgagtttacacac

SEQ ID NO: 88739 - DNA, 34 bp, Artificial Sequence
  Description of Artificial Sequence: Synthetic oligonucleotide
gacatccgttgcaaggatgatgagtttacacacc

SEQ ID NO: 88740 - DNA, 35 bp, Artificial Sequence
  Description of Artificial Sequence: Synthetic oligonucleotide
acatccgttgcaaggatgatgagtttacacacctg

SEQ ID NO: 88741 - DNA, 34 bp, Artificial Sequence
  Description of Artificial Sequence: Synthetic oligonucleotide
catccgttgcaaggatgatgagtttacacacctg

SEQ ID NO: 88742 - DNA, 36 bp, Artificial Sequence
  Description of Artificial Sequence: Synthetic oligonucleotide
atccgttgcaaggatgatgagtttacacacctgtac

SEQ ID NO: 88743 - DNA, 35 bp, Artificial Sequence
  Description of Artificial Sequence: Synthetic oligonucleotide
tccgttgcaaggatgatgagtttacacacctgtac

SEQ ID NO: 88744 - DNA, 34 bp, Artificial Sequence
  Description of Artificial Sequence: Synthetic oligonucleotide
ccgttgcaaggatgatgagtttacacacctgtac

SEQ ID NO: 88745 - DNA, 35 bp, Artificial Sequence
  Description of Artificial Sequence: Synthetic oligonucleotide
cgttgcaaggatgatgagtttacacacctgtacac

SEQ ID NO: 88746 - DNA, 36 bp, Artificial Sequence
  Description of Artificial Sequence: Synthetic oligonucleotide
gttgcaaggatgatgagtttacacacctgtacacac

SEQ ID NO: 88747 - DNA, 37 bp, Artificial Sequence
  Description of Artificial Sequence: Synthetic oligonucleotide
ttgcaaggatgatgagtttacacacctgtacacactg

SEQ ID NO: 88748 - DNA, 36 bp, Artificial Sequence
  Description of Artificial Sequence: Synthetic oligonucleotide
tgcaaggatgatgagtttacacacctgtacacactg

SEQ ID NO: 88749 - DNA, 35 bp, Artificial Sequence
  Description of Artificial Sequence: Synthetic oligonucleotide
gcaaggatgatgagtttacacacctgtacacactg

SEQ ID NO: 88750 - DNA, 38 bp, Artificial Sequence
  Description of Artificial Sequence: Synthetic oligonucleotide
caaggatgatgagtttacacacctgtacacactgattg

SEQ ID NO: 88751 - DNA, 39 bp, Artificial Sequence
  Description of Artificial Sequence: Synthetic oligonucleotide
aaggatgatgagtttacacacctgtacacactgattgtg

SEQ ID NO: 88752 - DNA, 38 bp, Artificial Sequence
  Description of Artificial Sequence: Synthetic oligonucleotide
aggatgatgagtttacacacctgtacacactgattgtg

SEQ ID NO: 88753 - DNA, 37 bp, Artificial Sequence
  Description of Artificial Sequence: Synthetic oligonucleotide
ggatgatgagtttacacacctgtacacactgattgtg

SEQ ID NO: 88754 - DNA, 37 bp, Artificial Sequence
  Description of Artificial Sequence: Synthetic oligonucleotide
gatgatgagtttacacacctgtacacactgattgtgc

SEQ ID NO: 88755 - DNA, 37 bp, Artificial Sequence
  Description of Artificial Sequence: Synthetic oligonucleotide
atgatgagtttacacacctgtacacactgattgtgcg

SEQ ID NO: 88756 - DNA, 36 bp, Artificial Sequence
  Description of Artificial Sequence: Synthetic oligonucleotide
tgatgagtttacacacctgtacacactgattgtgcg

SEQ ID NO: 88757 - DNA, 35 bp, Artificial Sequence
  Description of Artificial Sequence: Synthetic oligonucleotide
gatgagtttacacacctgtacacactgattgtgcg

SEQ ID NO: 88758 - DNA, 35 bp, Artificial Sequence
  Description of Artificial Sequence: Synthetic oligonucleotide
atgagtttacacacctgtacacactgattgtgcgg

SEQ ID NO: 88759 - DNA, 34 bp, Artificial Sequence
  Description of Artificial Sequence: Synthetic oligonucleotide
tgagtttacacacctgtacacactgattgtgcgg

SEQ ID NO: 88760 - DNA, 33 bp, Artificial Sequence
  Description of Artificial Sequence: Synthetic oligonucleotide
gagtttacacacctgtacacactgattgtgcgg

SEQ ID NO: 88761 - DNA, 33 bp, Artificial Sequence
  Description of Artificial Sequence: Synthetic oligonucleotide
agtttacacacctgtacacactgattgtgcggc

SEQ ID NO: 88762 - DNA, 32 bp, Artificial Sequence
  Description of Artificial Sequence: Synthetic oligonucleotide
gtttacacacctgtacacactgattgtgcggc

SEQ ID NO: 88763 - DNA, 32 bp, Artificial Sequence
  Description of Artificial Sequence: Synthetic oligonucleotide
tttacacacctgtacacactgattgtgcggcc

SEQ ID NO: 88764 - DNA, 31 bp, Artificial Sequence
  Description of Artificial Sequence: Synthetic oligonucleotide
ttacacacctgtacacactgattgtgcggcc

SEQ ID NO: 88765 - DNA, 30 bp, Artificial Sequence
  Description of Artificial Sequence: Synthetic oligonucleotide
tacacacctgtacacactgattgtgcggcc

SEQ ID NO: 88766 - DNA, 29 bp, Artificial Sequence
  Description of Artificial Sequence: Synthetic oligonucleotide
acacacctgtacacactgattgtgcggcc

SEQ ID NO: 88767 - DNA, 28 bp, Artificial Sequence
  Description of Artificial Sequence: Synthetic oligonucleotide
cacacctgtacacactgattgtgcggcc

SEQ ID NO: 88768 - DNA, 29 bp, Artificial Sequence
  Description of Artificial Sequence: Synthetic oligonucleotide
acacctgtacacactgattgtgcggccag

SEQ ID NO: 88769 - DNA, 28 bp, Artificial Sequence
  Description of Artificial Sequence: Synthetic oligonucleotide
cacctgtacacactgattgtgcggccag

SEQ ID NO: 88770 - DNA, 29 bp, Artificial Sequence
  Description of Artificial Sequence: Synthetic oligonucleotide
acctgtacacactgattgtgcggccagac

SEQ ID NO: 88771 - DNA, 28 bp, Artificial Sequence
  Description of Artificial Sequence: Synthetic oligonucleotide
cctgtacacactgattgtgcggccagac

SEQ ID NO: 88772 - DNA, 30 bp, Artificial Sequence
  Description of Artificial Sequence: Synthetic oligonucleotide
ctgtacacactgattgtgcggccagacaac

SEQ ID NO: 88773 - DNA, 31 bp, Artificial Sequence
  Description of Artificial Sequence: Synthetic oligonucleotide
tgtacacactgattgtgcggccagacaacac

SEQ ID NO: 88774 - DNA, 30 bp, Artificial Sequence
  Description of Artificial Sequence: Synthetic oligonucleotide
gtacacactgattgtgcggccagacaacac

SEQ ID NO: 88775 - DNA, 30 bp, Artificial Sequence
  Description of Artificial Sequence: Synthetic oligonucleotide
tacacactgattgtgcggccagacaacacc

SEQ ID NO: 88776 - DNA, 29 bp, Artificial Sequence
  Description of Artificial Sequence: Synthetic oligonucleotide
acacactgattgtgcggccagacaacacc

SEQ ID NO: 88777 - DNA, 28 bp, Artificial Sequence
  Description of Artificial Sequence: Synthetic oligonucleotide
cacactgattgtgcggccagacaacacc

SEQ ID NO: 88778 - DNA, 31 bp, Artificial Sequence
  Description of Artificial Sequence: Synthetic oligonucleotide
acactgattgtgcggccagacaacacctatg

SEQ ID NO: 88779 - DNA, 30 bp, Artificial Sequence
  Description of Artificial Sequence: Synthetic oligonucleotide
cactgattgtgcggccagacaacacctatg

SEQ ID NO: 88780 - DNA, 31 bp, Artificial Sequence
  Description of Artificial Sequence: Synthetic oligonucleotide
actgattgtgcggccagacaacacctatgag

SEQ ID NO: 88781 - DNA, 30 bp, Artificial Sequence
  Description of Artificial Sequence: Synthetic oligonucleotide
ctgattgtgcggccagacaacacctatgag

SEQ ID NO: 88782 - DNA, 30 bp, Artificial Sequence
  Description of Artificial Sequence: Synthetic oligonucleotide
tgattgtgcggccagacaacacctatgagg

SEQ ID NO: 88783 - DNA, 29 bp, Artificial Sequence
  Description of Artificial Sequence: Synthetic oligonucleotide
gattgtgcggccagacaacacctatgagg

SEQ ID NO: 88784 - DNA, 30 bp, Artificial Sequence
  Description of Artificial Sequence: Synthetic oligonucleotide
attgtgcggccagacaacacctatgaggtg

SEQ ID NO: 88785 - DNA, 29 bp, Artificial Sequence
  Description of Artificial Sequence: Synthetic oligonucleotide
ttgtgcggccagacaacacctatgaggtg

SEQ ID NO: 88786 - DNA, 28 bp, Artificial Sequence
  Description of Artificial Sequence: Synthetic oligonucleotide
tgtgcggccagacaacacctatgaggtg

SEQ ID NO: 88787 - DNA, 27 bp, Artificial Sequence
  Description of Artificial Sequence: Synthetic oligonucleotide
gtgcggccagacaacacctatgaggtg

SEQ ID NO: 88788 - DNA, 29 bp, Artificial Sequence
  Description of Artificial Sequence: Synthetic oligonucleotide
tgcggccagacaacacctatgaggtgaag

SEQ ID NO: 88789 - DNA, 28 bp, Artificial Sequence
  Description of Artificial Sequence: Synthetic oligonucleotide
gcggccagacaacacctatgaggtgaag

SEQ ID NO: 88790 - DNA, 31 bp, Artificial Sequence
  Description of Artificial Sequence: Synthetic oligonucleotide
cggccagacaacacctatgaggtgaagattg

SEQ ID NO: 88791 - DNA, 32 bp, Artificial Sequence
  Description of Artificial Sequence: Synthetic oligonucleotide
ggccagacaacacctatgaggtgaagattgac

SEQ ID NO: 88792 - DNA, 34 bp, Artificial Sequence
  Description of Artificial Sequence: Synthetic oligonucleotide
gccagacaacacctatgaggtgaagattgacaac

SEQ ID NO: 88793 - DNA, 35 bp, Artificial Sequence
  Description of Artificial Sequence: Synthetic oligonucleotide
ccagacaacacctatgaggtgaagattgacaacag

SEQ ID NO: 88794 - DNA, 35 bp, Artificial Sequence
  Description of Artificial Sequence: Synthetic oligonucleotide
cagacaacacctatgaggtgaagattgacaacagc

SEQ ID NO: 88795 - DNA, 35 bp, Artificial Sequence
  Description of Artificial Sequence: Synthetic oligonucleotide
agacaacacctatgaggtgaagattgacaacagcc

SEQ ID NO: 88796 - DNA, 34 bp, Artificial Sequence
  Description of Artificial Sequence: Synthetic oligonucleotide
gacaacacctatgaggtgaagattgacaacagcc

SEQ ID NO: 88797 - DNA, 35 bp, Artificial Sequence
  Description of Artificial Sequence: Synthetic oligonucleotide
acaacacctatgaggtgaagattgacaacagccag

SEQ ID NO: 88798 - DNA, 34 bp, Artificial Sequence
  Description of Artificial Sequence: Synthetic oligonucleotide
caacacctatgaggtgaagattgacaacagccag

SEQ ID NO: 88799 - DNA, 34 bp, Artificial Sequence
  Description of Artificial Sequence: Synthetic oligonucleotide
aacacctatgaggtgaagattgacaacagccagg

SEQ ID NO: 88800 - DNA, 33 bp, Artificial Sequence
  Description of Artificial Sequence: Synthetic oligonucleotide
acacctatgaggtgaagattgacaacagccagg

SEQ ID NO: 88801 - DNA, 32 bp, Artificial Sequence
  Description of Artificial Sequence: Synthetic oligonucleotide
cacctatgaggtgaagattgacaacagccagg

SEQ ID NO: 88802 - DNA, 33 bp, Artificial Sequence
  Description of Artificial Sequence: Synthetic oligonucleotide
acctatgaggtgaagattgacaacagccaggtg

SEQ ID NO: 88803 - DNA, 32 bp, Artificial Sequence
  Description of Artificial Sequence: Synthetic oligonucleotide
cctatgaggtgaagattgacaacagccaggtg

SEQ ID NO: 88804 - DNA, 32 bp, Artificial Sequence
  Description of Artificial Sequence: Synthetic oligonucleotide
ctatgaggtgaagattgacaacagccaggtgg

SEQ ID NO: 88805 - DNA, 33 bp, Artificial Sequence
  Description of Artificial Sequence: Synthetic oligonucleotide
tatgaggtgaagattgacaacagccaggtggag

SEQ ID NO: 88806 - DNA, 32 bp, Artificial Sequence
  Description of Artificial Sequence: Synthetic oligonucleotide
atgaggtgaagattgacaacagccaggtggag

SEQ ID NO: 88807 - DNA, 31 bp, Artificial Sequence
  Description of Artificial Sequence: Synthetic oligonucleotide
tgaggtgaagattgacaacagccaggtggag

SEQ ID NO: 88808 - DNA, 30 bp, Artificial Sequence
  Description of Artificial Sequence: Synthetic oligonucleotide
gaggtgaagattgacaacagccaggtggag

SEQ ID NO: 88809 - DNA, 31 bp, Artificial Sequence
  Description of Artificial Sequence: Synthetic oligonucleotide
aggtgaagattgacaacagccaggtggagtc

SEQ ID NO: 88810 - DNA, 30 bp, Artificial Sequence
  Description of Artificial Sequence: Synthetic oligonucleotide
ggtgaagattgacaacagccaggtggagtc

SEQ ID NO: 88811 - DNA, 30 bp, Artificial Sequence
  Description of Artificial Sequence: Synthetic oligonucleotide
gtgaagattgacaacagccaggtggagtcc

SEQ ID NO: 88812 - DNA, 30 bp, Artificial Sequence
  Description of Artificial Sequence: Synthetic oligonucleotide
tgaagattgacaacagccaggtggagtccg

SEQ ID NO: 88813 - DNA, 29 bp, Artificial Sequence
  Description of Artificial Sequence: Synthetic oligonucleotide
gaagattgacaacagccaggtggagtccg

SEQ ID NO: 88814 - DNA, 29 bp, Artificial Sequence
  Description of Artificial Sequence: Synthetic oligonucleotide
aagattgacaacagccaggtggagtccgg

SEQ ID NO: 88815 - DNA, 28 bp, Artificial Sequence
  Description of Artificial Sequence: Synthetic oligonucleotide
agattgacaacagccaggtggagtccgg

SEQ ID NO: 88816 - DNA, 27 bp, Artificial Sequence
  Description of Artificial Sequence: Synthetic oligonucleotide
gattgacaacagccaggtggagtccgg

SEQ ID NO: 88817 - DNA, 27 bp, Artificial Sequence
  Description of Artificial Sequence: Synthetic oligonucleotide
attgacaacagccaggtggagtccggc

SEQ ID NO: 88818 - DNA, 27 bp, Artificial Sequence
  Description of Artificial Sequence: Synthetic oligonucleotide
ttgacaacagccaggtggagtccggct

SEQ ID NO: 88819 - DNA, 26 bp, Artificial Sequence
  Description of Artificial Sequence: Synthetic oligonucleotide
tgacaacagccaggtggagtccggct

SEQ ID NO: 88820 - DNA, 25 bp, Artificial Sequence
  Description of Artificial Sequence: Synthetic oligonucleotide
gacaacagccaggtggagtccggct

SEQ ID NO: 88821 - DNA, 25 bp, Artificial Sequence
  Description of Artificial Sequence: Synthetic oligonucleotide
acaacagccaggtggagtccggctc

SEQ ID NO: 88822 - DNA, 24 bp, Artificial Sequence
  Description of Artificial Sequence: Synthetic oligonucleotide
caacagccaggtggagtccggctc

SEQ ID NO: 88823 - DNA, 26 bp, Artificial Sequence
  Description of Artificial Sequence: Synthetic oligonucleotide
aacagccaggtggagtccggctcctt

SEQ ID NO: 88824 - DNA, 25 bp, Artificial Sequence
  Description of Artificial Sequence: Synthetic oligonucleotide
acagccaggtggagtccggctcctt

SEQ ID NO: 88825 - DNA, 24 bp, Artificial Sequence
  Description of Artificial Sequence: Synthetic oligonucleotide
cagccaggtggagtccggctcctt

SEQ ID NO: 88826 - DNA, 24 bp, Artificial Sequence
  Description of Artificial Sequence: Synthetic oligonucleotide
agccaggtggagtccggctccttg

SEQ ID NO: 88827 - DNA, 23 bp, Artificial Sequence
  Description of Artificial Sequence: Synthetic oligonucleotide
gccaggtggagtccggctccttg

SEQ ID NO: 88828 - DNA, 25 bp, Artificial Sequence
  Description of Artificial Sequence: Synthetic oligonucleotide
ccaggtggagtccggctccttggaa

SEQ ID NO: 88829 - DNA, 26 bp, Artificial Sequence
  Description of Artificial Sequence: Synthetic oligonucleotide
caggtggagtccggctccttggaaga

SEQ ID NO: 88830 - DNA, 26 bp, Artificial Sequence
  Description of Artificial Sequence: Synthetic oligonucleotide
aggtggagtccggctccttggaagac

SEQ ID NO: 88831 - DNA, 25 bp, Artificial Sequence
  Description of Artificial Sequence: Synthetic oligonucleotide
ggtggagtccggctccttggaagac

SEQ ID NO: 88832 - DNA, 27 bp, Artificial Sequence
  Description of Artificial Sequence: Synthetic oligonucleotide
gtggagtccggctccttggaagacgat

SEQ ID NO: 88833 - DNA, 28 bp, Artificial Sequence
  Description of Artificial Sequence: Synthetic oligonucleotide
tggagtccggctccttggaagacgattg

SEQ ID NO: 88834 - DNA, 27 bp, Artificial Sequence
  Description of Artificial Sequence: Synthetic oligonucleotide
ggagtccggctccttggaagacgattg

SEQ ID NO: 88835 - DNA, 27 bp, Artificial Sequence
  Description of Artificial Sequence: Synthetic oligonucleotide
gagtccggctccttggaagacgattgg

SEQ ID NO: 88836 - DNA, 27 bp, Artificial Sequence
  Description of Artificial Sequence: Synthetic oligonucleotide
agtccggctccttggaagacgattggg

SEQ ID NO: 88837 - DNA, 27 bp, Artificial Sequence
  Description of Artificial Sequence: Synthetic oligonucleotide
gtccggctccttggaagacgattggga

SEQ ID NO: 88838 - DNA, 27 bp, Artificial Sequence
  Description of Artificial Sequence: Synthetic oligonucleotide
tccggctccttggaagacgattgggac

SEQ ID NO: 88839 - DNA, 27 bp, Artificial Sequence
  Description of Artificial Sequence: Synthetic oligonucleotide
ccggctccttggaagacgattgggact

SEQ ID NO: 88840 - DNA, 28 bp, Artificial Sequence
  Description of Artificial Sequence: Synthetic oligonucleotide
cggctccttggaagacgattgggacttc

SEQ ID NO: 88841 - DNA, 28 bp, Artificial Sequence
  Description of Artificial Sequence: Synthetic oligonucleotide
ggctccttggaagacgattgggacttcc

SEQ ID NO: 88842 - DNA, 29 bp, Artificial Sequence
  Description of Artificial Sequence: Synthetic oligonucleotide
gctccttggaagacgattgggacttcctg

SEQ ID NO: 88843 - DNA, 29 bp, Artificial Sequence
  Description of Artificial Sequence: Synthetic oligonucleotide
ctccttggaagacgattgggacttcctgc

SEQ ID NO: 88844 - DNA, 29 bp, Artificial Sequence
  Description of Artificial Sequence: Synthetic oligonucleotide
tccttggaagacgattgggacttcctgcc

SEQ ID NO: 88845 - DNA, 28 bp, Artificial Sequence
  Description of Artificial Sequence: Synthetic oligonucleotide
ccttggaagacgattgggacttcctgcc

SEQ ID NO: 88846 - DNA, 29 bp, Artificial Sequence
  Description of Artificial Sequence: Synthetic oligonucleotide
cttggaagacgattgggacttcctgccac

SEQ ID NO: 88847 - DNA, 29 bp, Artificial Sequence
  Description of Artificial Sequence: Synthetic oligonucleotide
ttggaagacgattgggacttcctgccacc

SEQ ID NO: 88848 - DNA, 28 bp, Artificial Sequence
  Description of Artificial Sequence: Synthetic oligonucleotide
tggaagacgattgggacttcctgccacc

SEQ ID NO: 88849 - DNA, 27 bp, Artificial Sequence
  Description of Artificial Sequence: Synthetic oligonucleotide
ggaagacgattgggacttcctgccacc

SEQ ID NO: 88850 - DNA, 27 bp, Artificial Sequence
  Description of Artificial Sequence: Synthetic oligonucleotide
gaagacgattgggacttcctgccaccc

SEQ ID NO: 88851 - DNA, 29 bp, Artificial Sequence
  Description of Artificial Sequence: Synthetic oligonucleotide
aagacgattgggacttcctgccacccaag

SEQ ID NO: 88852 - DNA, 28 bp, Artificial Sequence
  Description of Artificial Sequence: Synthetic oligonucleotide
agacgattgggacttcctgccacccaag

SEQ ID NO: 88853 - DNA, 27 bp, Artificial Sequence
  Description of Artificial Sequence: Synthetic oligonucleotide
gacgattgggacttcctgccacccaag

SEQ ID NO: 88854 - DNA, 29 bp, Artificial Sequence
  Description of Artificial Sequence: Synthetic oligonucleotide
acgattgggacttcctgccacccaagaag

SEQ ID NO: 88855 - DNA, 28 bp, Artificial Sequence
  Description of Artificial Sequence: Synthetic oligonucleotide
cgattgggacttcctgccacccaagaag

SEQ ID NO: 88856 - DNA, 33 bp, Artificial Sequence
  Description of Artificial Sequence: Synthetic oligonucleotide
gattgggacttcctgccacccaagaagataaag

SEQ ID NO: 88857 - DNA, 33 bp, Artificial Sequence
  Description of Artificial Sequence: Synthetic oligonucleotide
attgggacttcctgccacccaagaagataaagg

SEQ ID NO: 88858 - DNA, 32 bp, Artificial Sequence
  Description of Artificial Sequence: Synthetic oligonucleotide
ttgggacttcctgccacccaagaagataaagg

SEQ ID NO: 88859 - DNA, 31 bp, Artificial Sequence
  Description of Artificial Sequence: Synthetic oligonucleotide
tgggacttcctgccacccaagaagataaagg

SEQ ID NO: 88860 - DNA, 30 bp, Artificial Sequence
  Description of Artificial Sequence: Synthetic oligonucleotide
gggacttcctgccacccaagaagataaagg

SEQ ID NO: 88861 - DNA, 32 bp, Artificial Sequence
  Description of Artificial Sequence: Synthetic oligonucleotide
ggacttcctgccacccaagaagataaaggatc

SEQ ID NO: 88862 - DNA, 32 bp, Artificial Sequence
  Description of Artificial Sequence: Synthetic oligonucleotide
gacttcctgccacccaagaagataaaggatcc

SEQ ID NO: 88863 - DNA, 33 bp, Artificial Sequence
  Description of Artificial Sequence: Synthetic oligonucleotide
acttcctgccacccaagaagataaaggatcctg

SEQ ID NO: 88864 - DNA, 32 bp, Artificial Sequence
  Description of Artificial Sequence: Synthetic oligonucleotide
cttcctgccacccaagaagataaaggatcctg

SEQ ID NO: 88865 - DNA, 34 bp, Artificial Sequence
  Description of Artificial Sequence: Synthetic oligonucleotide
ttcctgccacccaagaagataaaggatcctgatg

SEQ ID NO: 88866 - DNA, 33 bp, Artificial Sequence
  Description of Artificial Sequence: Synthetic oligonucleotide
tcctgccacccaagaagataaaggatcctgatg

SEQ ID NO: 88867 - DNA, 32 bp, Artificial Sequence
  Description of Artificial Sequence: Synthetic oligonucleotide
cctgccacccaagaagataaaggatcctgatg

SEQ ID NO: 88868 - DNA, 32 bp, Artificial Sequence
  Description of Artificial Sequence: Synthetic oligonucleotide
ctgccacccaagaagataaaggatcctgatgc

SEQ ID NO: 88869 - DNA, 34 bp, Artificial Sequence
  Description of Artificial Sequence: Synthetic oligonucleotide
tgccacccaagaagataaaggatcctgatgcttc

SEQ ID NO: 88870 - DNA, 33 bp, Artificial Sequence
  Description of Artificial Sequence: Synthetic oligonucleotide
gccacccaagaagataaaggatcctgatgcttc

SEQ ID NO: 88871 - DNA, 37 bp, Artificial Sequence
  Description of Artificial Sequence: Synthetic oligonucleotide
ccacccaagaagataaaggatcctgatgcttcaaaac

SEQ ID NO: 88872 - DNA, 37 bp, Artificial Sequence
  Description of Artificial Sequence: Synthetic oligonucleotide
cacccaagaagataaaggatcctgatgcttcaaaacc

SEQ ID NO: 88873 - DNA, 37 bp, Artificial Sequence
  Description of Artificial Sequence: Synthetic oligonucleotide
acccaagaagataaaggatcctgatgcttcaaaaccg

SEQ ID NO: 88874 - DNA, 36 bp, Artificial Sequence
  Description of Artificial Sequence: Synthetic oligonucleotide
cccaagaagataaaggatcctgatgcttcaaaaccg

SEQ ID NO: 88875 - DNA, 36 bp, Artificial Sequence
  Description of Artificial Sequence: Synthetic oligonucleotide
ccaagaagataaaggatcctgatgcttcaaaaccgg

SEQ ID NO: 88876 - DNA, 38 bp, Artificial Sequence
  Description of Artificial Sequence: Synthetic oligonucleotide
caagaagataaaggatcctgatgcttcaaaaccggaag

SEQ ID NO: 88877 - DNA, 39 bp, Artificial Sequence
  Description of Artificial Sequence: Synthetic oligonucleotide
aagaagataaaggatcctgatgcttcaaaaccggaagac

SEQ ID NO: 88878 - DNA, 38 bp, Artificial Sequence
  Description of Artificial Sequence: Synthetic oligonucleotide
agaagataaaggatcctgatgcttcaaaaccggaagac

SEQ ID NO: 88879 - DNA, 37 bp, Artificial Sequence
  Description of Artificial Sequence: Synthetic oligonucleotide
gaagataaaggatcctgatgcttcaaaaccggaagac

SEQ ID NO: 88880 - DNA, 38 bp, Artificial Sequence
  Description of Artificial Sequence: Synthetic oligonucleotide
aagataaaggatcctgatgcttcaaaaccggaagactg

SEQ ID NO: 88881 - DNA, 37 bp, Artificial Sequence
  Description of Artificial Sequence: Synthetic oligonucleotide
agataaaggatcctgatgcttcaaaaccggaagactg

SEQ ID NO: 88882 - DNA, 36 bp, Artificial Sequence
  Description of Artificial Sequence: Synthetic oligonucleotide
gataaaggatcctgatgcttcaaaaccggaagactg

SEQ ID NO: 88883 - DNA, 36 bp, Artificial Sequence
  Description of Artificial Sequence: Synthetic oligonucleotide
ataaaggatcctgatgcttcaaaaccggaagactgg

SEQ ID NO: 88884 - DNA, 35 bp, Artificial Sequence
  Description of Artificial Sequence: Synthetic oligonucleotide
taaaggatcctgatgcttcaaaaccggaagactgg

SEQ ID NO: 88885 - DNA, 34 bp, Artificial Sequence
  Description of Artificial Sequence: Synthetic oligonucleotide
aaaggatcctgatgcttcaaaaccggaagactgg

SEQ ID NO: 88886 - DNA, 33 bp, Artificial Sequence
  Description of Artificial Sequence: Synthetic oligonucleotide
aaggatcctgatgcttcaaaaccggaagactgg

SEQ ID NO: 88887 - DNA, 32 bp, Artificial Sequence
  Description of Artificial Sequence: Synthetic oligonucleotide
aggatcctgatgcttcaaaaccggaagactgg

SEQ ID NO: 88888 - DNA, 31 bp, Artificial Sequence
  Description of Artificial Sequence: Synthetic oligonucleotide
ggatcctgatgcttcaaaaccggaagactgg

SEQ ID NO: 88889 - DNA, 31 bp, Artificial Sequence
  Description of Artificial Sequence: Synthetic oligonucleotide
gatcctgatgcttcaaaaccggaagactggg

SEQ ID NO: 88890 - DNA, 33 bp, Artificial Sequence
  Description of Artificial Sequence: Synthetic oligonucleotide
atcctgatgcttcaaaaccggaagactgggatg

SEQ ID NO: 88891 - DNA, 32 bp, Artificial Sequence
  Description of Artificial Sequence: Synthetic oligonucleotide
tcctgatgcttcaaaaccggaagactgggatg

SEQ ID NO: 88892 - DNA, 31 bp, Artificial Sequence
  Description of Artificial Sequence: Synthetic oligonucleotide
cctgatgcttcaaaaccggaagactgggatg

SEQ ID NO: 88893 - DNA, 32 bp, Artificial Sequence
  Description of Artificial Sequence: Synthetic oligonucleotide
ctgatgcttcaaaaccggaagactgggatgag

SEQ ID NO: 88894 - DNA, 32 bp, Artificial Sequence
  Description of Artificial Sequence: Synthetic oligonucleotide
tgatgcttcaaaaccggaagactgggatgagc

SEQ ID NO: 88895 - DNA, 31 bp, Artificial Sequence
  Description of Artificial Sequence: Synthetic oligonucleotide
gatgcttcaaaaccggaagactgggatgagc

SEQ ID NO: 88896 - DNA, 31 bp, Artificial Sequence
  Description of Artificial Sequence: Synthetic oligonucleotide
atgcttcaaaaccggaagactgggatgagcg

SEQ ID NO: 88897 - DNA, 30 bp, Artificial Sequence
  Description of Artificial Sequence: Synthetic oligonucleotide
tgcttcaaaaccggaagactgggatgagcg

SEQ ID NO: 88898 - DNA, 29 bp, Artificial Sequence
  Description of Artificial Sequence: Synthetic oligonucleotide
gcttcaaaaccggaagactgggatgagcg

SEQ ID NO: 88899 - DNA, 29 bp, Artificial Sequence
  Description of Artificial Sequence: Synthetic oligonucleotide
cttcaaaaccggaagactgggatgagcgg

SEQ ID NO: 88900 - DNA, 29 bp, Artificial Sequence
  Description of Artificial Sequence: Synthetic oligonucleotide
ttcaaaaccggaagactgggatgagcggg

SEQ ID NO: 88901 - DNA, 28 bp, Artificial Sequence
  Description of Artificial Sequence: Synthetic oligonucleotide
tcaaaaccggaagactgggatgagcggg

SEQ ID NO: 88902 - DNA, 27 bp, Artificial Sequence
  Description of Artificial Sequence: Synthetic oligonucleotide
caaaaccggaagactgggatgagcggg

SEQ ID NO: 88903 - DNA, 27 bp, Artificial Sequence
  Description of Artificial Sequence: Synthetic oligonucleotide
aaaaccggaagactgggatgagcgggc

SEQ ID NO: 88904 - DNA, 26 bp, Artificial Sequence
  Description of Artificial Sequence: Synthetic oligonucleotide
aaaccggaagactgggatgagcgggc

SEQ ID NO: 88905 - DNA, 25 bp, Artificial Sequence
  Description of Artificial Sequence: Synthetic oligonucleotide
aaccggaagactgggatgagcgggc

SEQ ID NO: 88906 - DNA, 24 bp, Artificial Sequence
  Description of Artificial Sequence: Synthetic oligonucleotide
accggaagactgggatgagcgggc

SEQ ID NO: 88907 - DNA, 23 bp, Artificial Sequence
  Description of Artificial Sequence: Synthetic oligonucleotide
ccggaagactgggatgagcgggc

SEQ ID NO: 88908 - DNA, 25 bp, Artificial Sequence
  Description of Artificial Sequence: Synthetic oligonucleotide
cggaagactgggatgagcgggccaa

SEQ ID NO: 88909 - DNA, 27 bp, Artificial Sequence
  Description of Artificial Sequence: Synthetic oligonucleotide
ggaagactgggatgagcgggccaagat

SEQ ID NO: 88910 - DNA, 27 bp, Artificial Sequence
  Description of Artificial Sequence: Synthetic oligonucleotide
gaagactgggatgagcgggccaagatc

SEQ ID NO: 88911 - DNA, 27 bp, Artificial Sequence
  Description of Artificial Sequence: Synthetic oligonucleotide
aagactgggatgagcgggccaagatcg

SEQ ID NO: 88912 - DNA, 27 bp, Artificial Sequence
  Description of Artificial Sequence: Synthetic oligonucleotide
agactgggatgagcgggccaagatcga

SEQ ID NO: 88913 - DNA, 27 bp, Artificial Sequence
  Description of Artificial Sequence: Synthetic oligonucleotide
gactgggatgagcgggccaagatcgat

SEQ ID NO: 88914 - DNA, 27 bp, Artificial Sequence
  Description of Artificial Sequence: Synthetic oligonucleotide
actgggatgagcgggccaagatcgatg

SEQ ID NO: 88915 - DNA, 27 bp, Artificial Sequence
  Description of Artificial Sequence: Synthetic oligonucleotide
ctgggatgagcgggccaagatcgatga

SEQ ID NO: 88916 - DNA, 28 bp, Artificial Sequence
  Description of Artificial Sequence: Synthetic oligonucleotide
tgggatgagcgggccaagatcgatgatc

SEQ ID NO: 88917 - DNA, 27 bp, Artificial Sequence
  Description of Artificial Sequence: Synthetic oligonucleotide
gggatgagcgggccaagatcgatgatc

SEQ ID NO: 88918 - DNA, 27 bp, Artificial Sequence
  Description of Artificial Sequence: Synthetic oligonucleotide
ggatgagcgggccaagatcgatgatcc

SEQ ID NO: 88919 - DNA, 27 bp, Artificial Sequence
  Description of Artificial Sequence: Synthetic oligonucleotide
gatgagcgggccaagatcgatgatccc

SEQ ID NO: 88920 - DNA, 28 bp, Artificial Sequence
  Description of Artificial Sequence: Synthetic oligonucleotide
atgagcgggccaagatcgatgatcccac

SEQ ID NO: 88921 - DNA, 27 bp, Artificial Sequence
  Description of Artificial Sequence: Synthetic oligonucleotide
tgagcgggccaagatcgatgatcccac

SEQ ID NO: 88922 - DNA, 27 bp, Artificial Sequence
  Description of Artificial Sequence: Synthetic oligonucleotide
gagcgggccaagatcgatgatcccaca

SEQ ID NO: 88923 - DNA, 27 bp, Artificial Sequence
  Description of Artificial Sequence: Synthetic oligonucleotide
agcgggccaagatcgatgatcccacag

SEQ ID NO: 88924 - DNA, 27 bp, Artificial Sequence
  Description of Artificial Sequence: Synthetic oligonucleotide
gcgggccaagatcgatgatcccacaga

SEQ ID NO: 88925 - DNA, 27 bp, Artificial Sequence
  Description of Artificial Sequence: Synthetic oligonucleotide
cgggccaagatcgatgatcccacagac

SEQ ID NO: 88926 - DNA, 28 bp, Artificial Sequence
  Description of Artificial Sequence: Synthetic oligonucleotide
gggccaagatcgatgatcccacagactc

SEQ ID NO: 88927 - DNA, 28 bp, Artificial Sequence
  Description of Artificial Sequence: Synthetic oligonucleotide
ggccaagatcgatgatcccacagactcc

SEQ ID NO: 88928 - DNA, 30 bp, Artificial Sequence
  Description of Artificial Sequence: Synthetic oligonucleotide
gccaagatcgatgatcccacagactccaag

SEQ ID NO: 88929 - DNA, 30 bp, Artificial Sequence
  Description of Artificial Sequence: Synthetic oligonucleotide
ccaagatcgatgatcccacagactccaagc

SEQ ID NO: 88930 - DNA, 30 bp, Artificial Sequence
  Description of Artificial Sequence: Synthetic oligonucleotide
caagatcgatgatcccacagactccaagcc

SEQ ID NO: 88931 - DNA, 31 bp, Artificial Sequence
  Description of Artificial Sequence: Synthetic oligonucleotide
aagatcgatgatcccacagactccaagcctg

SEQ ID NO: 88932 - DNA, 30 bp, Artificial Sequence
  Description of Artificial Sequence: Synthetic oligonucleotide
agatcgatgatcccacagactccaagcctg

SEQ ID NO: 88933 - DNA, 29 bp, Artificial Sequence
  Description of Artificial Sequence: Synthetic oligonucleotide
gatcgatgatcccacagactccaagcctg

SEQ ID NO: 88934 - DNA, 30 bp, Artificial Sequence
  Description of Artificial Sequence: Synthetic oligonucleotide
atcgatgatcccacagactccaagcctgag

SEQ ID NO: 88935 - DNA, 29 bp, Artificial Sequence
  Description of Artificial Sequence: Synthetic oligonucleotide
tcgatgatcccacagactccaagcctgag

SEQ ID NO: 88936 - DNA, 28 bp, Artificial Sequence
  Description of Artificial Sequence: Synthetic oligonucleotide
cgatgatcccacagactccaagcctgag

SEQ ID NO: 88937 - DNA, 28 bp, Artificial Sequence
  Description of Artificial Sequence: Synthetic oligonucleotide
gatgatcccacagactccaagcctgagg

SEQ ID NO: 88938 - DNA, 29 bp, Artificial Sequence
  Description of Artificial Sequence: Synthetic oligonucleotide
atgatcccacagactccaagcctgaggac

SEQ ID NO: 88939 - DNA, 28 bp, Artificial Sequence
  Description of Artificial Sequence: Synthetic oligonucleotide
tgatcccacagactccaagcctgaggac

SEQ ID NO: 88940 - DNA, 27 bp, Artificial Sequence
  Description of Artificial Sequence: Synthetic oligonucleotide
gatcccacagactccaagcctgaggac

SEQ ID NO: 88941 - DNA, 28 bp, Artificial Sequence
  Description of Artificial Sequence: Synthetic oligonucleotide
atcccacagactccaagcctgaggactg

SEQ ID NO: 88942 - DNA, 27 bp, Artificial Sequence
  Description of Artificial Sequence: Synthetic oligonucleotide
tcccacagactccaagcctgaggactg

SEQ ID NO: 88943 - DNA, 26 bp, Artificial Sequence
  Description of Artificial Sequence: Synthetic oligonucleotide
cccacagactccaagcctgaggactg

SEQ ID NO: 88944 - DNA, 26 bp, Artificial Sequence
  Description of Artificial Sequence: Synthetic oligonucleotide
ccacagactccaagcctgaggactgg

SEQ ID NO: 88945 - DNA, 27 bp, Artificial Sequence
  Description of Artificial Sequence: Synthetic oligonucleotide
cacagactccaagcctgaggactggga

SEQ ID NO: 88946 - DNA, 27 bp, Artificial Sequence
  Description of Artificial Sequence: Synthetic oligonucleotide
acagactccaagcctgaggactgggac

SEQ ID NO: 88947 - DNA, 27 bp, Artificial Sequence
  Description of Artificial Sequence: Synthetic oligonucleotide
cagactccaagcctgaggactgggaca

SEQ ID NO: 88948 - DNA, 28 bp, Artificial Sequence
  Description of Artificial Sequence: Synthetic oligonucleotide
agactccaagcctgaggactgggacaag

SEQ ID NO: 88949 - DNA, 27 bp, Artificial Sequence
  Description of Artificial Sequence: Synthetic oligonucleotide
gactccaagcctgaggactgggacaag

SEQ ID NO: 88950 - DNA, 27 bp, Artificial Sequence
  Description of Artificial Sequence: Synthetic oligonucleotide
actccaagcctgaggactgggacaagc

SEQ ID NO: 88951 - DNA, 26 bp, Artificial Sequence
  Description of Artificial Sequence: Synthetic oligonucleotide
ctccaagcctgaggactgggacaagc

SEQ ID NO: 88952 - DNA, 26 bp, Artificial Sequence
  Description of Artificial Sequence: Synthetic oligonucleotide
tccaagcctgaggactgggacaagcc

SEQ ID NO: 88953 - DNA, 25 bp, Artificial Sequence
  Description of Artificial Sequence: Synthetic oligonucleotide
ccaagcctgaggactgggacaagcc

SEQ ID NO: 88954 - DNA, 25 bp, Artificial Sequence
  Description of Artificial Sequence: Synthetic oligonucleotide
caagcctgaggactgggacaagccc

SEQ ID NO: 88955 - DNA, 26 bp, Artificial Sequence
  Description of Artificial Sequence: Synthetic oligonucleotide
aagcctgaggactgggacaagcccga

SEQ ID NO: 88956 - DNA, 25 bp, Artificial Sequence
  Description of Artificial Sequence: Synthetic oligonucleotide
agcctgaggactgggacaagcccga

SEQ ID NO: 88957 - DNA, 24 bp, Artificial Sequence
  Description of Artificial Sequence: Synthetic oligonucleotide
gcctgaggactgggacaagcccga

SEQ ID NO: 88958 - DNA, 24 bp, Artificial Sequence
  Description of Artificial Sequence: Synthetic oligonucleotide
cctgaggactgggacaagcccgag

SEQ ID NO: 88959 - DNA, 27 bp, Artificial Sequence
  Description of Artificial Sequence: Synthetic oligonucleotide
ctgaggactgggacaagcccgagcata

SEQ ID NO: 88960 - DNA, 28 bp, Artificial Sequence
  Description of Artificial Sequence: Synthetic oligonucleotide
tgaggactgggacaagcccgagcatatc

SEQ ID NO: 88961 - DNA, 27 bp, Artificial Sequence
  Description of Artificial Sequence: Synthetic oligonucleotide
gaggactgggacaagcccgagcatatc

SEQ ID NO: 88962 - DNA, 27 bp, Artificial Sequence
  Description of Artificial Sequence: Synthetic oligonucleotide
aggactgggacaagcccgagcatatcc

SEQ ID NO: 88963 - DNA, 26 bp, Artificial Sequence
  Description of Artificial Sequence: Synthetic oligonucleotide
ggactgggacaagcccgagcatatcc

SEQ ID NO: 88964 - DNA, 27 bp, Artificial Sequence
  Description of Artificial Sequence: Synthetic oligonucleotide
gactgggacaagcccgagcatatccct

SEQ ID NO: 88965 - DNA, 27 bp, Artificial Sequence
  Description of Artificial Sequence: Synthetic oligonucleotide
actgggacaagcccgagcatatccctg

SEQ ID NO: 88966 - DNA, 27 bp, Artificial Sequence
  Description of Artificial Sequence: Synthetic oligonucleotide
ctgggacaagcccgagcatatccctga

SEQ ID NO: 88967 - DNA, 27 bp, Artificial Sequence
  Description of Artificial Sequence: Synthetic oligonucleotide
tgggacaagcccgagcatatccctgac

SEQ ID NO: 88968 - DNA, 26 bp, Artificial Sequence
  Description of Artificial Sequence: Synthetic oligonucleotide
gggacaagcccgagcatatccctgac

SEQ ID NO: 88969 - DNA, 26 bp, Artificial Sequence
  Description of Artificial Sequence: Synthetic oligonucleotide
ggacaagcccgagcatatccctgacc

SEQ ID NO: 88970 - DNA, 27 bp, Artificial Sequence
  Description of Artificial Sequence: Synthetic oligonucleotide
gacaagcccgagcatatccctgaccct

SEQ ID NO: 88971 - DNA, 27 bp, Artificial Sequence
  Description of Artificial Sequence: Synthetic oligonucleotide
acaagcccgagcatatccctgaccctg

SEQ ID NO: 88972 - DNA, 27 bp, Artificial Sequence
  Description of Artificial Sequence: Synthetic oligonucleotide
caagcccgagcatatccctgaccctga

SEQ ID NO: 88973 - DNA, 28 bp, Artificial Sequence
  Description of Artificial Sequence: Synthetic oligonucleotide
aagcccgagcatatccctgaccctgatg

SEQ ID NO: 88974 - DNA, 27 bp, Artificial Sequence
  Description of Artificial Sequence: Synthetic oligonucleotide
agcccgagcatatccctgaccctgatg

SEQ ID NO: 88975 - DNA, 26 bp, Artificial Sequence
  Description of Artificial Sequence: Synthetic oligonucleotide
gcccgagcatatccctgaccctgatg

SEQ ID NO: 88976 - DNA, 27 bp, Artificial Sequence
  Description of Artificial Sequence: Synthetic oligonucleotide
cccgagcatatccctgaccctgatgct

SEQ ID NO: 88977 - DNA, 29 bp, Artificial Sequence
  Description of Artificial Sequence: Synthetic oligonucleotide
ccgagcatatccctgaccctgatgctaag

SEQ ID NO: 88978 - DNA, 31 bp, Artificial Sequence
  Description of Artificial Sequence: Synthetic oligonucleotide
cgagcatatccctgaccctgatgctaagaag

SEQ ID NO: 88979 - DNA, 31 bp, Artificial Sequence
  Description of Artificial Sequence: Synthetic oligonucleotide
gagcatatccctgaccctgatgctaagaagc

SEQ ID NO: 88980 - DNA, 31 bp, Artificial Sequence
  Description of Artificial Sequence: Synthetic oligonucleotide
agcatatccctgaccctgatgctaagaagcc

SEQ ID NO: 88981 - DNA, 30 bp, Artificial Sequence
  Description of Artificial Sequence: Synthetic oligonucleotide
gcatatccctgaccctgatgctaagaagcc

SEQ ID NO: 88982 - DNA, 30 bp, Artificial Sequence
  Description of Artificial Sequence: Synthetic oligonucleotide
catatccctgaccctgatgctaagaagccc

SEQ ID NO: 88983 - DNA, 30 bp, Artificial Sequence
  Description of Artificial Sequence: Synthetic oligonucleotide
atatccctgaccctgatgctaagaagcccg

SEQ ID NO: 88984 - DNA, 29 bp, Artificial Sequence
  Description of Artificial Sequence: Synthetic oligonucleotide
tatccctgaccctgatgctaagaagcccg

SEQ ID NO: 88985 - DNA, 28 bp, Artificial Sequence
  Description of Artificial Sequence: Synthetic oligonucleotide
atccctgaccctgatgctaagaagcccg

SEQ ID NO: 88986 - DNA, 27 bp, Artificial Sequence
  Description of Artificial Sequence: Synthetic oligonucleotide
tccctgaccctgatgctaagaagcccg

SEQ ID NO: 88987 - DNA, 27 bp, Artificial Sequence
  Description of Artificial Sequence: Synthetic oligonucleotide
ccctgaccctgatgctaagaagcccga

SEQ ID NO: 88988 - DNA, 27 bp, Artificial Sequence
  Description of Artificial Sequence: Synthetic oligonucleotide
cctgaccctgatgctaagaagcccgag

SEQ ID NO: 88989 - DNA, 27 bp, Artificial Sequence
  Description of Artificial Sequence: Synthetic oligonucleotide
ctgaccctgatgctaagaagcccgagg

SEQ ID NO: 88990 - DNA, 28 bp, Artificial Sequence
  Description of Artificial Sequence: Synthetic oligonucleotide
tgaccctgatgctaagaagcccgaggac

SEQ ID NO: 88991 - DNA, 27 bp, Artificial Sequence
  Description of Artificial Sequence: Synthetic oligonucleotide
gaccctgatgctaagaagcccgaggac

SEQ ID NO: 88992 - DNA, 28 bp, Artificial Sequence
  Description of Artificial Sequence: Synthetic oligonucleotide
accctgatgctaagaagcccgaggactg

SEQ ID NO: 88993 - DNA, 27 bp, Artificial Sequence
  Description of Artificial Sequence: Synthetic oligonucleotide
ccctgatgctaagaagcccgaggactg

SEQ ID NO: 88994 - DNA, 27 bp, Artificial Sequence
  Description of Artificial Sequence: Synthetic oligonucleotide
cctgatgctaagaagcccgaggactgg

SEQ ID NO: 88995 - DNA, 27 bp, Artificial Sequence
  Description of Artificial Sequence: Synthetic oligonucleotide
ctgatgctaagaagcccgaggactggg

SEQ ID NO: 88996 - DNA, 29 bp, Artificial Sequence
  Description of Artificial Sequence: Synthetic oligonucleotide
tgatgctaagaagcccgaggactgggatg

SEQ ID NO: 88997 - DNA, 28 bp, Artificial Sequence
  Description of Artificial Sequence: Synthetic oligonucleotide
gatgctaagaagcccgaggactgggatg

SEQ ID NO: 88998 - DNA, 30 bp, Artificial Sequence
  Description of Artificial Sequence: Synthetic oligonucleotide
atgctaagaagcccgaggactgggatgaag

SEQ ID NO: 88999 - DNA, 29 bp, Artificial Sequence
  Description of Artificial Sequence: Synthetic oligonucleotide
tgctaagaagcccgaggactgggatgaag

SEQ ID NO: 89000 - DNA, 28 bp, Artificial Sequence
  Description of Artificial Sequence: Synthetic oligonucleotide
gctaagaagcccgaggactgggatgaag

SEQ ID NO: 89001 - DNA, 29 bp, Artificial Sequence
  Description of Artificial Sequence: Synthetic oligonucleotide
ctaagaagcccgaggactgggatgaagag

SEQ ID NO: 89002 - DNA, 31 bp, Artificial Sequence
  Description of Artificial Sequence: Synthetic oligonucleotide
taagaagcccgaggactgggatgaagagatg

SEQ ID NO: 89003 - DNA, 30 bp, Artificial Sequence
  Description of Artificial Sequence: Synthetic oligonucleotide
aagaagcccgaggactgggatgaagagatg

SEQ ID NO: 89004 - DNA, 29 bp, Artificial Sequence
  Description of Artificial Sequence: Synthetic oligonucleotide
agaagcccgaggactgggatgaagagatg

SEQ ID NO: 89005 - DNA, 28 bp, Artificial Sequence
  Description of Artificial Sequence: Synthetic oligonucleotide
gaagcccgaggactgggatgaagagatg

SEQ ID NO: 89006 - DNA, 28 bp, Artificial Sequence
  Description of Artificial Sequence: Synthetic oligonucleotide
aagcccgaggactgggatgaagagatgg

SEQ ID NO: 89007 - DNA, 27 bp, Artificial Sequence
  Description of Artificial Sequence: Synthetic oligonucleotide
agcccgaggactgggatgaagagatgg

SEQ ID NO: 89008 - DNA, 27 bp, Artificial Sequence
  Description of Artificial Sequence: Synthetic oligonucleotide
gcccgaggactgggatgaagagatgga

SEQ ID NO: 89009 - DNA, 27 bp, Artificial Sequence
  Description of Artificial Sequence: Synthetic oligonucleotide
cccgaggactgggatgaagagatggac

SEQ ID NO: 89010 - DNA, 27 bp, Artificial Sequence
  Description of Artificial Sequence: Synthetic oligonucleotide
ccgaggactgggatgaagagatggacg

SEQ ID NO: 89011 - DNA, 27 bp, Artificial Sequence
  Description of Artificial Sequence: Synthetic oligonucleotide
cgaggactgggatgaagagatggacgg

SEQ ID NO: 89012 - DNA, 28 bp, Artificial Sequence
  Description of Artificial Sequence: Synthetic oligonucleotide
gaggactgggatgaagagatggacggag

SEQ ID NO: 89013 - DNA, 29 bp, Artificial Sequence
  Description of Artificial Sequence: Synthetic oligonucleotide
aggactgggatgaagagatggacggagag

SEQ ID NO: 89014 - DNA, 28 bp, Artificial Sequence
  Description of Artificial Sequence: Synthetic oligonucleotide
ggactgggatgaagagatggacggagag

SEQ ID NO: 89015 - DNA, 29 bp, Artificial Sequence
  Description of Artificial Sequence: Synthetic oligonucleotide
gactgggatgaagagatggacggagagtg

SEQ ID NO: 89016 - DNA, 29 bp, Artificial Sequence
  Description of Artificial Sequence: Synthetic oligonucleotide
actgggatgaagagatggacggagagtgg

SEQ ID NO: 89017 - DNA, 28 bp, Artificial Sequence
  Description of Artificial Sequence: Synthetic oligonucleotide
ctgggatgaagagatggacggagagtgg

SEQ ID NO: 89018 - DNA, 28 bp, Artificial Sequence
  Description of Artificial Sequence: Synthetic oligonucleotide
tgggatgaagagatggacggagagtggg

SEQ ID NO: 89019 - DNA, 27 bp, Artificial Sequence
  Description of Artificial Sequence: Synthetic oligonucleotide
gggatgaagagatggacggagagtggg

SEQ ID NO: 89020 - DNA, 29 bp, Artificial Sequence
  Description of Artificial Sequence: Synthetic oligonucleotide
ggatgaagagatggacggagagtgggaac

SEQ ID NO: 89021 - DNA, 29 bp, Artificial Sequence
  Description of Artificial Sequence: Synthetic oligonucleotide
gatgaagagatggacggagagtgggaacc

SEQ ID NO: 89022 - DNA, 29 bp, Artificial Sequence
  Description of Artificial Sequence: Synthetic oligonucleotide
atgaagagatggacggagagtgggaaccc

SEQ ID NO: 89023 - DNA, 28 bp, Artificial Sequence
  Description of Artificial Sequence: Synthetic oligonucleotide
tgaagagatggacggagagtgggaaccc

SEQ ID NO: 89024 - DNA, 27 bp, Artificial Sequence
  Description of Artificial Sequence: Synthetic oligonucleotide
gaagagatggacggagagtgggaaccc

SEQ ID NO: 89025 - DNA, 27 bp, Artificial Sequence
  Description of Artificial Sequence: Synthetic oligonucleotide
aagagatggacggagagtgggaacccc

SEQ ID NO: 89026 - DNA, 26 bp, Artificial Sequence
  Description of Artificial Sequence: Synthetic oligonucleotide
agagatggacggagagtgggaacccc

SEQ ID NO: 89027 - DNA, 25 bp, Artificial Sequence
  Description of Artificial Sequence: Synthetic oligonucleotide
gagatggacggagagtgggaacccc

SEQ ID NO: 89028 - DNA, 26 bp, Artificial Sequence
  Description of Artificial Sequence: Synthetic oligonucleotide
agatggacggagagtgggaaccccca

SEQ ID NO: 89029 - DNA, 25 bp, Artificial Sequence
  Description of Artificial Sequence: Synthetic oligonucleotide
gatggacggagagtgggaaccccca

SEQ ID NO: 89030 - DNA, 26 bp, Artificial Sequence
  Description of Artificial Sequence: Synthetic oligonucleotide
atggacggagagtgggaacccccagt

SEQ ID NO: 89031 - DNA, 25 bp, Artificial Sequence
  Description of Artificial Sequence: Synthetic oligonucleotide
tggacggagagtgggaacccccagt

SEQ ID NO: 89032 - DNA, 24 bp, Artificial Sequence
  Description of Artificial Sequence: Synthetic oligonucleotide
ggacggagagtgggaacccccagt

SEQ ID NO: 89033 - DNA, 27 bp, Artificial Sequence
  Description of Artificial Sequence: Synthetic oligonucleotide
gacggagagtgggaacccccagtgatt

SEQ ID NO: 89034 - DNA, 27 bp, Artificial Sequence
  Description of Artificial Sequence: Synthetic oligonucleotide
acggagagtgggaacccccagtgattc

SEQ ID NO: 89035 - DNA, 27 bp, Artificial Sequence
  Description of Artificial Sequence: Synthetic oligonucleotide
cggagagtgggaacccccagtgattca

SEQ ID NO: 89036 - DNA, 27 bp, Artificial Sequence
  Description of Artificial Sequence: Synthetic oligonucleotide
ggagagtgggaacccccagtgattcag

SEQ ID NO: 89037 - DNA, 29 bp, Artificial Sequence
  Description of Artificial Sequence: Synthetic oligonucleotide
gagagtgggaacccccagtgattcagaac

SEQ ID NO: 89038 - DNA, 29 bp, Artificial Sequence
  Description of Artificial Sequence: Synthetic oligonucleotide
agagtgggaacccccagtgattcagaacc

SEQ ID NO: 89039 - DNA, 28 bp, Artificial Sequence
  Description of Artificial Sequence: Synthetic oligonucleotide
gagtgggaacccccagtgattcagaacc

SEQ ID NO: 89040 - DNA, 28 bp, Artificial Sequence
  Description of Artificial Sequence: Synthetic oligonucleotide
agtgggaacccccagtgattcagaaccc

SEQ ID NO: 89041 - DNA, 27 bp, Artificial Sequence
  Description of Artificial Sequence: Synthetic oligonucleotide
gtgggaacccccagtgattcagaaccc

SEQ ID NO: 89042 - DNA, 28 bp, Artificial Sequence
  Description of Artificial Sequence: Synthetic oligonucleotide
tgggaacccccagtgattcagaaccctg

SEQ ID NO: 89043 - DNA, 27 bp, Artificial Sequence
  Description of Artificial Sequence: Synthetic oligonucleotide
gggaacccccagtgattcagaaccctg

SEQ ID NO: 89044 - DNA, 28 bp, Artificial Sequence
  Description of Artificial Sequence: Synthetic oligonucleotide
ggaacccccagtgattcagaaccctgag

SEQ ID NO: 89045 - DNA, 30 bp, Artificial Sequence
  Description of Artificial Sequence: Synthetic oligonucleotide
gaacccccagtgattcagaaccctgagtac

SEQ ID NO: 89046 - DNA, 32 bp, Artificial Sequence
  Description of Artificial Sequence: Synthetic oligonucleotide
aacccccagtgattcagaaccctgagtacaag

SEQ ID NO: 89047 - DNA, 31 bp, Artificial Sequence
  Description of Artificial Sequence: Synthetic oligonucleotide
acccccagtgattcagaaccctgagtacaag

SEQ ID NO: 89048 - DNA, 30 bp, Artificial Sequence
  Description of Artificial Sequence: Synthetic oligonucleotide
cccccagtgattcagaaccctgagtacaag

SEQ ID NO: 89049 - DNA, 30 bp, Artificial Sequence
  Description of Artificial Sequence: Synthetic oligonucleotide
ccccagtgattcagaaccctgagtacaagg

SEQ ID NO: 89050 - DNA, 30 bp, Artificial Sequence
  Description of Artificial Sequence: Synthetic oligonucleotide
cccagtgattcagaaccctgagtacaaggg

SEQ ID NO: 89051 - DNA, 31 bp, Artificial Sequence
  Description of Artificial Sequence: Synthetic oligonucleotide
ccagtgattcagaaccctgagtacaagggtg

SEQ ID NO: 89052 - DNA, 32 bp, Artificial Sequence
  Description of Artificial Sequence: Synthetic oligonucleotide
cagtgattcagaaccctgagtacaagggtgag

SEQ ID NO: 89053 - DNA, 33 bp, Artificial Sequence
  Description of Artificial Sequence: Synthetic oligonucleotide
agtgattcagaaccctgagtacaagggtgagtg

SEQ ID NO: 89054 - DNA, 32 bp, Artificial Sequence
  Description of Artificial Sequence: Synthetic oligonucleotide
gtgattcagaaccctgagtacaagggtgagtg

SEQ ID NO: 89055 - DNA, 32 bp, Artificial Sequence
  Description of Artificial Sequence: Synthetic oligonucleotide
tgattcagaaccctgagtacaagggtgagtgg

SEQ ID NO: 89056 - DNA, 31 bp, Artificial Sequence
  Description of Artificial Sequence: Synthetic oligonucleotide
gattcagaaccctgagtacaagggtgagtgg

SEQ ID NO: 89057 - DNA, 33 bp, Artificial Sequence
  Description of Artificial Sequence: Synthetic oligonucleotide
attcagaaccctgagtacaagggtgagtggaag

SEQ ID NO: 89058 - DNA, 32 bp, Artificial Sequence
  Description of Artificial Sequence: Synthetic oligonucleotide
ttcagaaccctgagtacaagggtgagtggaag

SEQ ID NO: 89059 - DNA, 31 bp, Artificial Sequence
  Description of Artificial Sequence: Synthetic oligonucleotide
tcagaaccctgagtacaagggtgagtggaag

SEQ ID NO: 89060 - DNA, 30 bp, Artificial Sequence
  Description of Artificial Sequence: Synthetic oligonucleotide
cagaaccctgagtacaagggtgagtggaag

SEQ ID NO: 89061 - DNA, 30 bp, Artificial Sequence
  Description of Artificial Sequence: Synthetic oligonucleotide
agaaccctgagtacaagggtgagtggaagc

SEQ ID NO: 89062 - DNA, 29 bp, Artificial Sequence
  Description of Artificial Sequence: Synthetic oligonucleotide
gaaccctgagtacaagggtgagtggaagc

SEQ ID NO: 89063 - DNA, 29 bp, Artificial Sequence
  Description of Artificial Sequence: Synthetic oligonucleotide
aaccctgagtacaagggtgagtggaagcc

SEQ ID NO: 89064 - DNA, 28 bp, Artificial Sequence
  Description of Artificial Sequence: Synthetic oligonucleotide
accctgagtacaagggtgagtggaagcc

SEQ ID NO: 89065 - DNA, 27 bp, Artificial Sequence
  Description of Artificial Sequence: Synthetic oligonucleotide
ccctgagtacaagggtgagtggaagcc

SEQ ID NO: 89066 - DNA, 27 bp, Artificial Sequence
  Description of Artificial Sequence: Synthetic oligonucleotide
cctgagtacaagggtgagtggaagccc

SEQ ID NO: 89067 - DNA, 27 bp, Artificial Sequence
  Description of Artificial Sequence: Synthetic oligonucleotide
ctgagtacaagggtgagtggaagcccc

SEQ ID NO: 89068 - DNA, 27 bp, Artificial Sequence
  Description of Artificial Sequence: Synthetic oligonucleotide
tgagtacaagggtgagtggaagccccg

SEQ ID NO: 89069 - DNA, 26 bp, Artificial Sequence
  Description of Artificial Sequence: Synthetic oligonucleotide
gagtacaagggtgagtggaagccccg

SEQ ID NO: 89070 - DNA, 26 bp, Artificial Sequence
  Description of Artificial Sequence: Synthetic oligonucleotide
agtacaagggtgagtggaagccccgg

SEQ ID NO: 89071 - DNA, 25 bp, Artificial Sequence
  Description of Artificial Sequence: Synthetic oligonucleotide
gtacaagggtgagtggaagccccgg

SEQ ID NO: 89072 - DNA, 26 bp, Artificial Sequence
  Description of Artificial Sequence: Synthetic oligonucleotide
tacaagggtgagtggaagccccggca

SEQ ID NO: 89073 - DNA, 25 bp, Artificial Sequence
  Description of Artificial Sequence: Synthetic oligonucleotide
acaagggtgagtggaagccccggca

SEQ ID NO: 89074 - DNA, 24 bp, Artificial Sequence
  Description of Artificial Sequence: Synthetic oligonucleotide
caagggtgagtggaagccccggca

SEQ ID NO: 89075 - DNA, 26 bp, Artificial Sequence
  Description of Artificial Sequence: Synthetic oligonucleotide
aagggtgagtggaagccccggcagat

SEQ ID NO: 89076 - DNA, 25 bp, Artificial Sequence
  Description of Artificial Sequence: Synthetic oligonucleotide
agggtgagtggaagccccggcagat

SEQ ID NO: 89077 - DNA, 24 bp, Artificial Sequence
  Description of Artificial Sequence: Synthetic oligonucleotide
gggtgagtggaagccccggcagat

SEQ ID NO: 89078 - DNA, 24 bp, Artificial Sequence
  Description of Artificial Sequence: Synthetic oligonucleotide
ggtgagtggaagccccggcagatc

SEQ ID NO: 89079 - DNA, 25 bp, Artificial Sequence
  Description of Artificial Sequence: Synthetic oligonucleotide
gtgagtggaagccccggcagatcga

SEQ ID NO: 89080 - DNA, 27 bp, Artificial Sequence
  Description of Artificial Sequence: Synthetic oligonucleotide
tgagtggaagccccggcagatcgacaa

SEQ ID NO: 89081 - DNA, 26 bp, Artificial Sequence
  Description of Artificial Sequence: Synthetic oligonucleotide
gagtggaagccccggcagatcgacaa

SEQ ID NO: 89082 - DNA, 26 bp, Artificial Sequence
  Description of Artificial Sequence: Synthetic oligonucleotide
agtggaagccccggcagatcgacaac

SEQ ID NO: 89083 - DNA, 25 bp, Artificial Sequence
  Description of Artificial Sequence: Synthetic oligonucleotide
gtggaagccccggcagatcgacaac

SEQ ID NO: 89084 - DNA, 25 bp, Artificial Sequence
  Description of Artificial Sequence: Synthetic oligonucleotide
tggaagccccggcagatcgacaacc

SEQ ID NO: 89085 - DNA, 24 bp, Artificial Sequence
  Description of Artificial Sequence: Synthetic oligonucleotide
ggaagccccggcagatcgacaacc

SEQ ID NO: 89086 - DNA, 25 bp, Artificial Sequence
  Description of Artificial Sequence: Synthetic oligonucleotide
gaagccccggcagatcgacaaccca

SEQ ID NO: 89087 - DNA, 27 bp, Artificial Sequence
  Description of Artificial Sequence: Synthetic oligonucleotide
aagccccggcagatcgacaacccagat

SEQ ID NO: 89088 - DNA, 27 bp, Artificial Sequence
  Description of Artificial Sequence: Synthetic oligonucleotide
agccccggcagatcgacaacccagatt

SEQ ID NO: 89089 - DNA, 27 bp, Artificial Sequence
  Description of Artificial Sequence: Synthetic oligonucleotide
gccccggcagatcgacaacccagatta

SEQ ID NO: 89090 - DNA, 27 bp, Artificial Sequence
  Description of Artificial Sequence: Synthetic oligonucleotide
ccccggcagatcgacaacccagattac

SEQ ID NO: 89091 - DNA, 29 bp, Artificial Sequence
  Description of Artificial Sequence: Synthetic oligonucleotide
cccggcagatcgacaacccagattacaag

SEQ ID NO: 89092 - DNA, 29 bp, Artificial Sequence
  Description of Artificial Sequence: Synthetic oligonucleotide
ccggcagatcgacaacccagattacaagg

SEQ ID NO: 89093 - DNA, 29 bp, Artificial Sequence
  Description of Artificial Sequence: Synthetic oligonucleotide
cggcagatcgacaacccagattacaaggg

SEQ ID NO: 89094 - DNA, 29 bp, Artificial Sequence
  Description of Artificial Sequence: Synthetic oligonucleotide
ggcagatcgacaacccagattacaagggc

SEQ ID NO: 89095 - DNA, 30 bp, Artificial Sequence
  Description of Artificial Sequence: Synthetic oligonucleotide
gcagatcgacaacccagattacaagggcac

SEQ ID NO: 89096 - DNA, 32 bp, Artificial Sequence
  Description of Artificial Sequence: Synthetic oligonucleotide
cagatcgacaacccagattacaagggcacttg

SEQ ID NO: 89097 - DNA, 32 bp, Artificial Sequence
  Description of Artificial Sequence: Synthetic oligonucleotide
agatcgacaacccagattacaagggcacttgg

SEQ ID NO: 89098 - DNA, 31 bp, Artificial Sequence
  Description of Artificial Sequence: Synthetic oligonucleotide
gatcgacaacccagattacaagggcacttgg

SEQ ID NO: 89099 - DNA, 33 bp, Artificial Sequence
  Description of Artificial Sequence: Synthetic oligonucleotide
atcgacaacccagattacaagggcacttggatc

SEQ ID NO: 89100 - DNA, 32 bp, Artificial Sequence
  Description of Artificial Sequence: Synthetic oligonucleotide
tcgacaacccagattacaagggcacttggatc

SEQ ID NO: 89101 - DNA, 31 bp, Artificial Sequence
  Description of Artificial Sequence: Synthetic oligonucleotide
cgacaacccagattacaagggcacttggatc

SEQ ID NO: 89102 - DNA, 31 bp, Artificial Sequence
  Description of Artificial Sequence: Synthetic oligonucleotide
gacaacccagattacaagggcacttggatcc

SEQ ID NO: 89103 - DNA, 32 bp, Artificial Sequence
  Description of Artificial Sequence: Synthetic oligonucleotide
acaacccagattacaagggcacttggatccac

SEQ ID NO: 89104 - DNA, 31 bp, Artificial Sequence
  Description of Artificial Sequence: Synthetic oligonucleotide
caacccagattacaagggcacttggatccac

SEQ ID NO: 89105 - DNA, 31 bp, Artificial Sequence
  Description of Artificial Sequence: Synthetic oligonucleotide
aacccagattacaagggcacttggatccacc

SEQ ID NO: 89106 - DNA, 30 bp, Artificial Sequence
  Description of Artificial Sequence: Synthetic oligonucleotide
acccagattacaagggcacttggatccacc

SEQ ID NO: 89107 - DNA, 29 bp, Artificial Sequence
  Description of Artificial Sequence: Synthetic oligonucleotide
cccagattacaagggcacttggatccacc

SEQ ID NO: 89108 - DNA, 29 bp, Artificial Sequence
  Description of Artificial Sequence: Synthetic oligonucleotide
ccagattacaagggcacttggatccaccc

SEQ ID NO: 89109 - DNA, 30 bp, Artificial Sequence
  Description of Artificial Sequence: Synthetic oligonucleotide
cagattacaagggcacttggatccacccag

SEQ ID NO: 89110 - DNA, 35 bp, Artificial Sequence
  Description of Artificial Sequence: Synthetic oligonucleotide
agattacaagggcacttggatccacccagaaattg

SEQ ID NO: 89111 - DNA, 34 bp, Artificial Sequence
  Description of Artificial Sequence: Synthetic oligonucleotide
gattacaagggcacttggatccacccagaaattg

SEQ ID NO: 89112 - DNA, 35 bp, Artificial Sequence
  Description of Artificial Sequence: Synthetic oligonucleotide
attacaagggcacttggatccacccagaaattgac

SEQ ID NO: 89113 - DNA, 34 bp, Artificial Sequence
  Description of Artificial Sequence: Synthetic oligonucleotide
ttacaagggcacttggatccacccagaaattgac

SEQ ID NO: 89114 - DNA, 33 bp, Artificial Sequence
  Description of Artificial Sequence: Synthetic oligonucleotide
tacaagggcacttggatccacccagaaattgac

SEQ ID NO: 89115 - DNA, 32 bp, Artificial Sequence
  Description of Artificial Sequence: Synthetic oligonucleotide
acaagggcacttggatccacccagaaattgac

SEQ ID NO: 89116 - DNA, 31 bp, Artificial Sequence
  Description of Artificial Sequence: Synthetic oligonucleotide
caagggcacttggatccacccagaaattgac

SEQ ID NO: 89117 - DNA, 33 bp, Artificial Sequence
  Description of Artificial Sequence: Synthetic oligonucleotide
aagggcacttggatccacccagaaattgacaac

SEQ ID NO: 89118 - DNA, 32 bp, Artificial Sequence
  Description of Artificial Sequence: Synthetic oligonucleotide
agggcacttggatccacccagaaattgacaac

SEQ ID NO: 89119 - DNA, 31 bp, Artificial Sequence
  Description of Artificial Sequence: Synthetic oligonucleotide
gggcacttggatccacccagaaattgacaac

SEQ ID NO: 89120 - DNA, 31 bp, Artificial Sequence
  Description of Artificial Sequence: Synthetic oligonucleotide
ggcacttggatccacccagaaattgacaacc

SEQ ID NO: 89121 - DNA, 31 bp, Artificial Sequence
  Description of Artificial Sequence: Synthetic oligonucleotide
gcacttggatccacccagaaattgacaaccc

SEQ ID NO: 89122 - DNA, 31 bp, Artificial Sequence
  Description of Artificial Sequence: Synthetic oligonucleotide
cacttggatccacccagaaattgacaacccc

SEQ ID NO: 89123 - DNA, 31 bp, Artificial Sequence
  Description of Artificial Sequence: Synthetic oligonucleotide
acttggatccacccagaaattgacaaccccg

SEQ ID NO: 89124 - DNA, 30 bp, Artificial Sequence
  Description of Artificial Sequence: Synthetic oligonucleotide
cttggatccacccagaaattgacaaccccg

SEQ ID NO: 89125 - DNA, 31 bp, Artificial Sequence
  Description of Artificial Sequence: Synthetic oligonucleotide
ttggatccacccagaaattgacaaccccgag

SEQ ID NO: 89126 - DNA, 30 bp, Artificial Sequence
  Description of Artificial Sequence: Synthetic oligonucleotide
tggatccacccagaaattgacaaccccgag

SEQ ID NO: 89127 - DNA, 29 bp, Artificial Sequence
  Description of Artificial Sequence: Synthetic oligonucleotide
ggatccacccagaaattgacaaccccgag

SEQ ID NO: 89128 - DNA, 33 bp, Artificial Sequence
  Description of Artificial Sequence: Synthetic oligonucleotide
gatccacccagaaattgacaaccccgagtattc

SEQ ID NO: 89129 - DNA, 34 bp, Artificial Sequence
  Description of Artificial Sequence: Synthetic oligonucleotide
atccacccagaaattgacaaccccgagtattctc

SEQ ID NO: 89130 - DNA, 33 bp, Artificial Sequence
  Description of Artificial Sequence: Synthetic oligonucleotide
tccacccagaaattgacaaccccgagtattctc

SEQ ID NO: 89131 - DNA, 32 bp, Artificial Sequence
  Description of Artificial Sequence: Synthetic oligonucleotide
ccacccagaaattgacaaccccgagtattctc

SEQ ID NO: 89132 - DNA, 32 bp, Artificial Sequence
  Description of Artificial Sequence: Synthetic oligonucleotide
cacccagaaattgacaaccccgagtattctcc

SEQ ID NO: 89133 - DNA, 32 bp, Artificial Sequence
  Description of Artificial Sequence: Synthetic oligonucleotide
acccagaaattgacaaccccgagtattctccc

SEQ ID NO: 89134 - DNA, 31 bp, Artificial Sequence
  Description of Artificial Sequence: Synthetic oligonucleotide
cccagaaattgacaaccccgagtattctccc

SEQ ID NO: 89135 - DNA, 31 bp, Artificial Sequence
  Description of Artificial Sequence: Synthetic oligonucleotide
ccagaaattgacaaccccgagtattctcccg

SEQ ID NO: 89136 - DNA, 33 bp, Artificial Sequence
  Description of Artificial Sequence: Synthetic oligonucleotide
cagaaattgacaaccccgagtattctcccgatc

SEQ ID NO: 89137 - DNA, 33 bp, Artificial Sequence
  Description of Artificial Sequence: Synthetic oligonucleotide
agaaattgacaaccccgagtattctcccgatcc

SEQ ID NO: 89138 - DNA, 32 bp, Artificial Sequence
  Description of Artificial Sequence: Synthetic oligonucleotide
gaaattgacaaccccgagtattctcccgatcc

SEQ ID NO: 89139 - DNA, 32 bp, Artificial Sequence
  Description of Artificial Sequence: Synthetic oligonucleotide
aaattgacaaccccgagtattctcccgatccc

SEQ ID NO: 89140 - DNA, 31 bp, Artificial Sequence
  Description of Artificial Sequence: Synthetic oligonucleotide
aattgacaaccccgagtattctcccgatccc

SEQ ID NO: 89141 - DNA, 30 bp, Artificial Sequence
  Description of Artificial Sequence: Synthetic oligonucleotide
attgacaaccccgagtattctcccgatccc

SEQ ID NO: 89142 - DNA, 29 bp, Artificial Sequence
  Description of Artificial Sequence: Synthetic oligonucleotide
ttgacaaccccgagtattctcccgatccc

SEQ ID NO: 89143 - DNA, 28 bp, Artificial Sequence
  Description of Artificial Sequence: Synthetic oligonucleotide
tgacaaccccgagtattctcccgatccc

SEQ ID NO: 89144 - DNA, 27 bp, Artificial Sequence
  Description of Artificial Sequence: Synthetic oligonucleotide
gacaaccccgagtattctcccgatccc

SEQ ID NO: 89145 - DNA, 28 bp, Artificial Sequence
  Description of Artificial Sequence: Synthetic oligonucleotide
acaaccccgagtattctcccgatcccag

SEQ ID NO: 89146 - DNA, 27 bp, Artificial Sequence
  Description of Artificial Sequence: Synthetic oligonucleotide
caaccccgagtattctcccgatcccag

SEQ ID NO: 89147 - DNA, 30 bp, Artificial Sequence
  Description of Artificial Sequence: Synthetic oligonucleotide
aaccccgagtattctcccgatcccagtatc

SEQ ID NO: 89148 - DNA, 29 bp, Artificial Sequence
  Description of Artificial Sequence: Synthetic oligonucleotide
accccgagtattctcccgatcccagtatc

SEQ ID NO: 89149 - DNA, 28 bp, Artificial Sequence
  Description of Artificial Sequence: Synthetic oligonucleotide
ccccgagtattctcccgatcccagtatc

SEQ ID NO: 89150 - DNA, 31 bp, Artificial Sequence
  Description of Artificial Sequence: Synthetic oligonucleotide
cccgagtattctcccgatcccagtatctatg

SEQ ID NO: 89151 - DNA, 31 bp, Artificial Sequence
  Description of Artificial Sequence: Synthetic oligonucleotide
ccgagtattctcccgatcccagtatctatgc

SEQ ID NO: 89152 - DNA, 31 bp, Artificial Sequence
  Description of Artificial Sequence: Synthetic oligonucleotide
cgagtattctcccgatcccagtatctatgcc

SEQ ID NO: 89153 - DNA, 34 bp, Artificial Sequence
  Description of Artificial Sequence: Synthetic oligonucleotide
gagtattctcccgatcccagtatctatgcctatg

SEQ ID NO: 89154 - DNA, 38 bp, Artificial Sequence
  Description of Artificial Sequence: Synthetic oligonucleotide
agtattctcccgatcccagtatctatgcctatgataac

SEQ ID NO: 89155 - DNA, 37 bp, Artificial Sequence
  Description of Artificial Sequence: Synthetic oligonucleotide
gtattctcccgatcccagtatctatgcctatgataac

SEQ ID NO: 89156 - DNA, 40 bp, Artificial Sequence
  Description of Artificial Sequence: Synthetic oligonucleotide
tattctcccgatcccagtatctatgcctatgataactttg

SEQ ID NO: 89157 - DNA, 39 bp, Artificial Sequence
  Description of Artificial Sequence: Synthetic oligonucleotide
attctcccgatcccagtatctatgcctatgataactttg

SEQ ID NO: 89158 - DNA, 38 bp, Artificial Sequence
  Description of Artificial Sequence: Synthetic oligonucleotide
ttctcccgatcccagtatctatgcctatgataactttg

SEQ ID NO: 89159 - DNA, 37 bp, Artificial Sequence
  Description of Artificial Sequence: Synthetic oligonucleotide
tctcccgatcccagtatctatgcctatgataactttg

SEQ ID NO: 89160 - DNA, 36 bp, Artificial Sequence
  Description of Artificial Sequence: Synthetic oligonucleotide
ctcccgatcccagtatctatgcctatgataactttg

SEQ ID NO: 89161 - DNA, 36 bp, Artificial Sequence
  Description of Artificial Sequence: Synthetic oligonucleotide
tcccgatcccagtatctatgcctatgataactttgg

SEQ ID NO: 89162 - DNA, 35 bp, Artificial Sequence
  Description of Artificial Sequence: Synthetic oligonucleotide
cccgatcccagtatctatgcctatgataactttgg

SEQ ID NO: 89163 - DNA, 35 bp, Artificial Sequence
  Description of Artificial Sequence: Synthetic oligonucleotide
ccgatcccagtatctatgcctatgataactttggc

SEQ ID NO: 89164 - DNA, 35 bp, Artificial Sequence
  Description of Artificial Sequence: Synthetic oligonucleotide
cgatcccagtatctatgcctatgataactttggcg

SEQ ID NO: 89165 - DNA, 36 bp, Artificial Sequence
  Description of Artificial Sequence: Synthetic oligonucleotide
gatcccagtatctatgcctatgataactttggcgtg

SEQ ID NO: 89166 - DNA, 36 bp, Artificial Sequence
  Description of Artificial Sequence: Synthetic oligonucleotide
atcccagtatctatgcctatgataactttggcgtgc

SEQ ID NO: 89167 - DNA, 35 bp, Artificial Sequence
  Description of Artificial Sequence: Synthetic oligonucleotide
tcccagtatctatgcctatgataactttggcgtgc

SEQ ID NO: 89168 - DNA, 34 bp, Artificial Sequence
  Description of Artificial Sequence: Synthetic oligonucleotide
cccagtatctatgcctatgataactttggcgtgc

SEQ ID NO: 89169 - DNA, 35 bp, Artificial Sequence
  Description of Artificial Sequence: Synthetic oligonucleotide
ccagtatctatgcctatgataactttggcgtgctg

SEQ ID NO: 89170 - DNA, 35 bp, Artificial Sequence
  Description of Artificial Sequence: Synthetic oligonucleotide
cagtatctatgcctatgataactttggcgtgctgg

SEQ ID NO: 89171 - DNA, 35 bp, Artificial Sequence
  Description of Artificial Sequence: Synthetic oligonucleotide
agtatctatgcctatgataactttggcgtgctggg

SEQ ID NO: 89172 - DNA, 34 bp, Artificial Sequence
  Description of Artificial Sequence: Synthetic oligonucleotide
gtatctatgcctatgataactttggcgtgctggg

SEQ ID NO: 89173 - DNA, 34 bp, Artificial Sequence
  Description of Artificial Sequence: Synthetic oligonucleotide
tatctatgcctatgataactttggcgtgctgggc

SEQ ID NO: 89174 - DNA, 33 bp, Artificial Sequence
  Description of Artificial Sequence: Synthetic oligonucleotide
atctatgcctatgataactttggcgtgctgggc

SEQ ID NO: 89175 - DNA, 32 bp, Artificial Sequence
  Description of Artificial Sequence: Synthetic oligonucleotide
tctatgcctatgataactttggcgtgctgggc

SEQ ID NO: 89176 - DNA, 31 bp, Artificial Sequence
  Description of Artificial Sequence: Synthetic oligonucleotide
ctatgcctatgataactttggcgtgctgggc

SEQ ID NO: 89177 - DNA, 31 bp, Artificial Sequence
  Description of Artificial Sequence: Synthetic oligonucleotide
tatgcctatgataactttggcgtgctgggcc

SEQ ID NO: 89178 - DNA, 30 bp, Artificial Sequence
  Description of Artificial Sequence: Synthetic oligonucleotide
atgcctatgataactttggcgtgctgggcc

SEQ ID NO: 89179 - DNA, 29 bp, Artificial Sequence
  Description of Artificial Sequence: Synthetic oligonucleotide
tgcctatgataactttggcgtgctgggcc

SEQ ID NO: 89180 - DNA, 28 bp, Artificial Sequence
  Description of Artificial Sequence: Synthetic oligonucleotide
gcctatgataactttggcgtgctgggcc

SEQ ID NO: 89181 - DNA, 29 bp, Artificial Sequence
  Description of Artificial Sequence: Synthetic oligonucleotide
cctatgataactttggcgtgctgggcctg

SEQ ID NO: 89182 - DNA, 29 bp, Artificial Sequence
  Description of Artificial Sequence: Synthetic oligonucleotide
ctatgataactttggcgtgctgggcctgg

SEQ ID NO: 89183 - DNA, 30 bp, Artificial Sequence
  Description of Artificial Sequence: Synthetic oligonucleotide
tatgataactttggcgtgctgggcctggac

SEQ ID NO: 89184 - DNA, 29 bp, Artificial Sequence
  Description of Artificial Sequence: Synthetic oligonucleotide
atgataactttggcgtgctgggcctggac

SEQ ID NO: 89185 - DNA, 28 bp, Artificial Sequence
  Description of Artificial Sequence: Synthetic oligonucleotide
tgataactttggcgtgctgggcctggac

SEQ ID NO: 89186 - DNA, 27 bp, Artificial Sequence
  Description of Artificial Sequence: Synthetic oligonucleotide
gataactttggcgtgctgggcctggac

SEQ ID NO: 89187 - DNA, 27 bp, Artificial Sequence
  Description of Artificial Sequence: Synthetic oligonucleotide
ataactttggcgtgctgggcctggacc

SEQ ID NO: 89188 - DNA, 27 bp, Artificial Sequence
  Description of Artificial Sequence: Synthetic oligonucleotide
taactttggcgtgctgggcctggacct

SEQ ID NO: 89189 - DNA, 26 bp, Artificial Sequence
  Description of Artificial Sequence: Synthetic oligonucleotide
aactttggcgtgctgggcctggacct

SEQ ID NO: 89190 - DNA, 25 bp, Artificial Sequence
  Description of Artificial Sequence: Synthetic oligonucleotide
actttggcgtgctgggcctggacct

SEQ ID NO: 89191 - DNA, 24 bp, Artificial Sequence
  Description of Artificial Sequence: Synthetic oligonucleotide
ctttggcgtgctgggcctggacct

SEQ ID NO: 89192 - DNA, 25 bp, Artificial Sequence
  Description of Artificial Sequence: Synthetic oligonucleotide
tttggcgtgctgggcctggacctct

SEQ ID NO: 89193 - DNA, 24 bp, Artificial Sequence
  Description of Artificial Sequence: Synthetic oligonucleotide
ttggcgtgctgggcctggacctct

SEQ ID NO: 89194 - DNA, 23 bp, Artificial Sequence
  Description of Artificial Sequence: Synthetic oligonucleotide
tggcgtgctgggcctggacctct

SEQ ID NO: 89195 - DNA, 22 bp, Artificial Sequence
  Description of Artificial Sequence: Synthetic oligonucleotide
ggcgtgctgggcctggacctct

SEQ ID NO: 89196 - DNA, 22 bp, Artificial Sequence
  Description of Artificial Sequence: Synthetic oligonucleotide
gcgtgctgggcctggacctctg

SEQ ID NO: 89197 - DNA, 22 bp, Artificial Sequence
  Description of Artificial Sequence: Synthetic oligonucleotide
cgtgctgggcctggacctctgg

SEQ ID NO: 89198 - DNA, 23 bp, Artificial Sequence
  Description of Artificial Sequence: Synthetic oligonucleotide
gtgctgggcctggacctctggca

SEQ ID NO: 89199 - DNA, 23 bp, Artificial Sequence
  Description of Artificial Sequence: Synthetic oligonucleotide
tgctgggcctggacctctggcag

SEQ ID NO: 89200 - DNA, 22 bp, Artificial Sequence
  Description of Artificial Sequence: Synthetic oligonucleotide
gctgggcctggacctctggcag

SEQ ID NO: 89201 - DNA, 23 bp, Artificial Sequence
  Description of Artificial Sequence: Synthetic oligonucleotide
ctgggcctggacctctggcaggt

SEQ ID NO: 89202 - DNA, 25 bp, Artificial Sequence
  Description of Artificial Sequence: Synthetic oligonucleotide
tgggcctggacctctggcaggtcaa

SEQ ID NO: 89203 - DNA, 24 bp, Artificial Sequence
  Description of Artificial Sequence: Synthetic oligonucleotide
gggcctggacctctggcaggtcaa

SEQ ID NO: 89204 - DNA, 25 bp, Artificial Sequence
  Description of Artificial Sequence: Synthetic oligonucleotide
ggcctggacctctggcaggtcaagt

SEQ ID NO: 89205 - DNA, 26 bp, Artificial Sequence
  Description of Artificial Sequence: Synthetic oligonucleotide
gcctggacctctggcaggtcaagtct

SEQ ID NO: 89206 - DNA, 26 bp, Artificial Sequence
  Description of Artificial Sequence: Synthetic oligonucleotide
cctggacctctggcaggtcaagtctg

SEQ ID NO: 89207 - DNA, 26 bp, Artificial Sequence
  Description of Artificial Sequence: Synthetic oligonucleotide
ctggacctctggcaggtcaagtctgg

SEQ ID NO: 89208 - DNA, 27 bp, Artificial Sequence
  Description of Artificial Sequence: Synthetic oligonucleotide
tggacctctggcaggtcaagtctggca

SEQ ID NO: 89209 - DNA, 26 bp, Artificial Sequence
  Description of Artificial Sequence: Synthetic oligonucleotide
ggacctctggcaggtcaagtctggca

SEQ ID NO: 89210 - DNA, 26 bp, Artificial Sequence
  Description of Artificial Sequence: Synthetic oligonucleotide
gacctctggcaggtcaagtctggcac

SEQ ID NO: 89211 - DNA, 27 bp, Artificial Sequence
  Description of Artificial Sequence: Synthetic oligonucleotide
acctctggcaggtcaagtctggcacca

SEQ ID NO: 89212 - DNA, 27 bp, Artificial Sequence
  Description of Artificial Sequence: Synthetic oligonucleotide
cctctggcaggtcaagtctggcaccat

SEQ ID NO: 89213 - DNA, 27 bp, Artificial Sequence
  Description of Artificial Sequence: Synthetic oligonucleotide
ctctggcaggtcaagtctggcaccatc

SEQ ID NO: 89214 - DNA, 30 bp, Artificial Sequence
  Description of Artificial Sequence: Synthetic oligonucleotide
tctggcaggtcaagtctggcaccatctttg

SEQ ID NO: 89215 - DNA, 29 bp, Artificial Sequence
  Description of Artificial Sequence: Synthetic oligonucleotide
ctggcaggtcaagtctggcaccatctttg

SEQ ID NO: 89216 - DNA, 30 bp, Artificial Sequence
  Description of Artificial Sequence: Synthetic oligonucleotide
tggcaggtcaagtctggcaccatctttgac

SEQ ID NO: 89217 - DNA, 29 bp, Artificial Sequence
  Description of Artificial Sequence: Synthetic oligonucleotide
ggcaggtcaagtctggcaccatctttgac

SEQ ID NO: 89218 - DNA, 31 bp, Artificial Sequence
  Description of Artificial Sequence: Synthetic oligonucleotide
gcaggtcaagtctggcaccatctttgacaac

SEQ ID NO: 89219 - DNA, 33 bp, Artificial Sequence
  Description of Artificial Sequence: Synthetic oligonucleotide
caggtcaagtctggcaccatctttgacaacttc

SEQ ID NO: 89220 - DNA, 33 bp, Artificial Sequence
  Description of Artificial Sequence: Synthetic oligonucleotide
aggtcaagtctggcaccatctttgacaacttcc

SEQ ID NO: 89221 - DNA, 32 bp, Artificial Sequence
  Description of Artificial Sequence: Synthetic oligonucleotide
ggtcaagtctggcaccatctttgacaacttcc

SEQ ID NO: 89222 - DNA, 33 bp, Artificial Sequence
  Description of Artificial Sequence: Synthetic oligonucleotide
gtcaagtctggcaccatctttgacaacttcctc

SEQ ID NO: 89223 - DNA, 35 bp, Artificial Sequence
  Description of Artificial Sequence: Synthetic oligonucleotide
tcaagtctggcaccatctttgacaacttcctcatc

SEQ ID NO: 89224 - DNA, 34 bp, Artificial Sequence
  Description of Artificial Sequence: Synthetic oligonucleotide
caagtctggcaccatctttgacaacttcctcatc

SEQ ID NO: 89225 - DNA, 35 bp, Artificial Sequence
  Description of Artificial Sequence: Synthetic oligonucleotide
aagtctggcaccatctttgacaacttcctcatcac

SEQ ID NO: 89226 - DNA, 34 bp, Artificial Sequence
  Description of Artificial Sequence: Synthetic oligonucleotide
agtctggcaccatctttgacaacttcctcatcac

SEQ ID NO: 89227 - DNA, 33 bp, Artificial Sequence
  Description of Artificial Sequence: Synthetic oligonucleotide
gtctggcaccatctttgacaacttcctcatcac

SEQ ID NO: 89228 - DNA, 33 bp, Artificial Sequence
  Description of Artificial Sequence: Synthetic oligonucleotide
tctggcaccatctttgacaacttcctcatcacc

SEQ ID NO: 89229 - DNA, 32 bp, Artificial Sequence
  Description of Artificial Sequence: Synthetic oligonucleotide
ctggcaccatctttgacaacttcctcatcacc

SEQ ID NO: 89230 - DNA, 34 bp, Artificial Sequence
  Description of Artificial Sequence: Synthetic oligonucleotide
tggcaccatctttgacaacttcctcatcaccaac

SEQ ID NO: 89231 - DNA, 33 bp, Artificial Sequence
  Description of Artificial Sequence: Synthetic oligonucleotide
ggcaccatctttgacaacttcctcatcaccaac

SEQ ID NO: 89232 - DNA, 33 bp, Artificial Sequence
  Description of Artificial Sequence: Synthetic oligonucleotide
gcaccatctttgacaacttcctcatcaccaacg

SEQ ID NO: 89233 - DNA, 35 bp, Artificial Sequence
  Description of Artificial Sequence: Synthetic oligonucleotide
caccatctttgacaacttcctcatcaccaacgatg

SEQ ID NO: 89234 - DNA, 36 bp, Artificial Sequence
  Description of Artificial Sequence: Synthetic oligonucleotide
accatctttgacaacttcctcatcaccaacgatgag

SEQ ID NO: 89235 - DNA, 35 bp, Artificial Sequence
  Description of Artificial Sequence: Synthetic oligonucleotide
ccatctttgacaacttcctcatcaccaacgatgag

SEQ ID NO: 89236 - DNA, 35 bp, Artificial Sequence
  Description of Artificial Sequence: Synthetic oligonucleotide
catctttgacaacttcctcatcaccaacgatgagg

SEQ ID NO: 89237 - DNA, 35 bp, Artificial Sequence
  Description of Artificial Sequence: Synthetic oligonucleotide
atctttgacaacttcctcatcaccaacgatgaggc

SEQ ID NO: 89238 - DNA, 34 bp, Artificial Sequence
  Description of Artificial Sequence: Synthetic oligonucleotide
tctttgacaacttcctcatcaccaacgatgaggc

SEQ ID NO: 89239 - DNA, 33 bp, Artificial Sequence
  Description of Artificial Sequence: Synthetic oligonucleotide
ctttgacaacttcctcatcaccaacgatgaggc

SEQ ID NO: 89240 - DNA, 36 bp, Artificial Sequence
  Description of Artificial Sequence: Synthetic oligonucleotide
tttgacaacttcctcatcaccaacgatgaggcatac

SEQ ID NO: 89241 - DNA, 35 bp, Artificial Sequence
  Description of Artificial Sequence: Synthetic oligonucleotide
ttgacaacttcctcatcaccaacgatgaggcatac

SEQ ID NO: 89242 - DNA, 34 bp, Artificial Sequence
  Description of Artificial Sequence: Synthetic oligonucleotide
tgacaacttcctcatcaccaacgatgaggcatac

SEQ ID NO: 89243 - DNA, 33 bp, Artificial Sequence
  Description of Artificial Sequence: Synthetic oligonucleotide
gacaacttcctcatcaccaacgatgaggcatac

SEQ ID NO: 89244 - DNA, 33 bp, Artificial Sequence
  Description of Artificial Sequence: Synthetic oligonucleotide
acaacttcctcatcaccaacgatgaggcatacg

SEQ ID NO: 89245 - DNA, 32 bp, Artificial Sequence
  Description of Artificial Sequence: Synthetic oligonucleotide
caacttcctcatcaccaacgatgaggcatacg

SEQ ID NO: 89246 - DNA, 32 bp, Artificial Sequence
  Description of Artificial Sequence: Synthetic oligonucleotide
aacttcctcatcaccaacgatgaggcatacgc

SEQ ID NO: 89247 - DNA, 31 bp, Artificial Sequence
  Description of Artificial Sequence: Synthetic oligonucleotide
acttcctcatcaccaacgatgaggcatacgc

SEQ ID NO: 89248 - DNA, 30 bp, Artificial Sequence
  Description of Artificial Sequence: Synthetic oligonucleotide
cttcctcatcaccaacgatgaggcatacgc

SEQ ID NO: 89249 - DNA, 31 bp, Artificial Sequence
  Description of Artificial Sequence: Synthetic oligonucleotide
ttcctcatcaccaacgatgaggcatacgctg

SEQ ID NO: 89250 - DNA, 30 bp, Artificial Sequence
  Description of Artificial Sequence: Synthetic oligonucleotide
tcctcatcaccaacgatgaggcatacgctg

SEQ ID NO: 89251 - DNA, 29 bp, Artificial Sequence
  Description of Artificial Sequence: Synthetic oligonucleotide
cctcatcaccaacgatgaggcatacgctg

SEQ ID NO: 89252 - DNA, 30 bp, Artificial Sequence
  Description of Artificial Sequence: Synthetic oligonucleotide
ctcatcaccaacgatgaggcatacgctgag

SEQ ID NO: 89253 - DNA, 30 bp, Artificial Sequence
  Description of Artificial Sequence: Synthetic oligonucleotide
tcatcaccaacgatgaggcatacgctgagg

SEQ ID NO: 89254 - DNA, 29 bp, Artificial Sequence
  Description of Artificial Sequence: Synthetic oligonucleotide
catcaccaacgatgaggcatacgctgagg

SEQ ID NO: 89255 - DNA, 30 bp, Artificial Sequence
  Description of Artificial Sequence: Synthetic oligonucleotide
atcaccaacgatgaggcatacgctgaggag

SEQ ID NO: 89256 - DNA, 29 bp, Artificial Sequence
  Description of Artificial Sequence: Synthetic oligonucleotide
tcaccaacgatgaggcatacgctgaggag

SEQ ID NO: 89257 - DNA, 28 bp, Artificial Sequence
  Description of Artificial Sequence: Synthetic oligonucleotide
caccaacgatgaggcatacgctgaggag

SEQ ID NO: 89258 - DNA, 31 bp, Artificial Sequence
  Description of Artificial Sequence: Synthetic oligonucleotide
accaacgatgaggcatacgctgaggagtttg

SEQ ID NO: 89259 - DNA, 30 bp, Artificial Sequence
  Description of Artificial Sequence: Synthetic oligonucleotide
ccaacgatgaggcatacgctgaggagtttg

SEQ ID NO: 89260 - DNA, 30 bp, Artificial Sequence
  Description of Artificial Sequence: Synthetic oligonucleotide
caacgatgaggcatacgctgaggagtttgg

SEQ ID NO: 89261 - DNA, 30 bp, Artificial Sequence
  Description of Artificial Sequence: Synthetic oligonucleotide
aacgatgaggcatacgctgaggagtttggc

SEQ ID NO: 89262 - DNA, 29 bp, Artificial Sequence
  Description of Artificial Sequence: Synthetic oligonucleotide
acgatgaggcatacgctgaggagtttggc

SEQ ID NO: 89263 - DNA, 28 bp, Artificial Sequence
  Description of Artificial Sequence: Synthetic oligonucleotide
cgatgaggcatacgctgaggagtttggc

SEQ ID NO: 89264 - DNA, 30 bp, Artificial Sequence
  Description of Artificial Sequence: Synthetic oligonucleotide
gatgaggcatacgctgaggagtttggcaac

SEQ ID NO: 89265 - DNA, 30 bp, Artificial Sequence
  Description of Artificial Sequence: Synthetic oligonucleotide
atgaggcatacgctgaggagtttggcaacg

SEQ ID NO: 89266 - DNA, 29 bp, Artificial Sequence
  Description of Artificial Sequence: Synthetic oligonucleotide
tgaggcatacgctgaggagtttggcaacg

SEQ ID NO: 89267 - DNA, 28 bp, Artificial Sequence
  Description of Artificial Sequence: Synthetic oligonucleotide
gaggcatacgctgaggagtttggcaacg

SEQ ID NO: 89268 - DNA, 29 bp, Artificial Sequence
  Description of Artificial Sequence: Synthetic oligonucleotide
aggcatacgctgaggagtttggcaacgag

SEQ ID NO: 89269 - DNA, 28 bp, Artificial Sequence
  Description of Artificial Sequence: Synthetic oligonucleotide
ggcatacgctgaggagtttggcaacgag

SEQ ID NO: 89270 - DNA, 29 bp, Artificial Sequence
  Description of Artificial Sequence: Synthetic oligonucleotide
gcatacgctgaggagtttggcaacgagac

SEQ ID NO: 89271 - DNA, 29 bp, Artificial Sequence
  Description of Artificial Sequence: Synthetic oligonucleotide
catacgctgaggagtttggcaacgagacg

SEQ ID NO: 89272 - DNA, 30 bp, Artificial Sequence
  Description of Artificial Sequence: Synthetic oligonucleotide
atacgctgaggagtttggcaacgagacgtg

SEQ ID NO: 89273 - DNA, 29 bp, Artificial Sequence
  Description of Artificial Sequence: Synthetic oligonucleotide
tacgctgaggagtttggcaacgagacgtg

SEQ ID NO: 89274 - DNA, 28 bp, Artificial Sequence
  Description of Artificial Sequence: Synthetic oligonucleotide
acgctgaggagtttggcaacgagacgtg

SEQ ID NO: 89275 - DNA, 27 bp, Artificial Sequence
  Description of Artificial Sequence: Synthetic oligonucleotide
cgctgaggagtttggcaacgagacgtg

SEQ ID NO: 89276 - DNA, 27 bp, Artificial Sequence
  Description of Artificial Sequence: Synthetic oligonucleotide
gctgaggagtttggcaacgagacgtgg

SEQ ID NO: 89277 - DNA, 27 bp, Artificial Sequence
  Description of Artificial Sequence: Synthetic oligonucleotide
ctgaggagtttggcaacgagacgtggg

SEQ ID NO: 89278 - DNA, 27 bp, Artificial Sequence
  Description of Artificial Sequence: Synthetic oligonucleotide
tgaggagtttggcaacgagacgtgggg

SEQ ID NO: 89279 - DNA, 26 bp, Artificial Sequence
  Description of Artificial Sequence: Synthetic oligonucleotide
gaggagtttggcaacgagacgtgggg

SEQ ID NO: 89280 - DNA, 26 bp, Artificial Sequence
  Description of Artificial Sequence: Synthetic oligonucleotide
aggagtttggcaacgagacgtggggc

SEQ ID NO: 89281 - DNA, 25 bp, Artificial Sequence
  Description of Artificial Sequence: Synthetic oligonucleotide
ggagtttggcaacgagacgtggggc

SEQ ID NO: 89282 - DNA, 27 bp, Artificial Sequence
  Description of Artificial Sequence: Synthetic oligonucleotide
gagtttggcaacgagacgtggggcgta

SEQ ID NO: 89283 - DNA, 28 bp, Artificial Sequence
  Description of Artificial Sequence: Synthetic oligonucleotide
agtttggcaacgagacgtggggcgtaac

SEQ ID NO: 89284 - DNA, 27 bp, Artificial Sequence
  Description of Artificial Sequence: Synthetic oligonucleotide
gtttggcaacgagacgtggggcgtaac

SEQ ID NO: 89285 - DNA, 30 bp, Artificial Sequence
  Description of Artificial Sequence: Synthetic oligonucleotide
tttggcaacgagacgtggggcgtaacaaag

SEQ ID NO: 89286 - DNA, 29 bp, Artificial Sequence
  Description of Artificial Sequence: Synthetic oligonucleotide
ttggcaacgagacgtggggcgtaacaaag

SEQ ID NO: 89287 - DNA, 28 bp, Artificial Sequence
  Description of Artificial Sequence: Synthetic oligonucleotide
tggcaacgagacgtggggcgtaacaaag

SEQ ID NO: 89288 - DNA, 27 bp, Artificial Sequence
  Description of Artificial Sequence: Synthetic oligonucleotide
ggcaacgagacgtggggcgtaacaaag

SEQ ID NO: 89289 - DNA, 27 bp, Artificial Sequence
  Description of Artificial Sequence: Synthetic oligonucleotide
gcaacgagacgtggggcgtaacaaagg

SEQ ID NO: 89290 - DNA, 27 bp, Artificial Sequence
  Description of Artificial Sequence: Synthetic oligonucleotide
caacgagacgtggggcgtaacaaaggc

SEQ ID NO: 89291 - DNA, 28 bp, Artificial Sequence
  Description of Artificial Sequence: Synthetic oligonucleotide
aacgagacgtggggcgtaacaaaggcag

SEQ ID NO: 89292 - DNA, 27 bp, Artificial Sequence
  Description of Artificial Sequence: Synthetic oligonucleotide
acgagacgtggggcgtaacaaaggcag

SEQ ID NO: 89293 - DNA, 26 bp, Artificial Sequence
  Description of Artificial Sequence: Synthetic oligonucleotide
cgagacgtggggcgtaacaaaggcag

SEQ ID NO: 89294 - DNA, 27 bp, Artificial Sequence
  Description of Artificial Sequence: Synthetic oligonucleotide
gagacgtggggcgtaacaaaggcagca

SEQ ID NO: 89295 - DNA, 27 bp, Artificial Sequence
  Description of Artificial Sequence: Synthetic oligonucleotide
agacgtggggcgtaacaaaggcagcag

SEQ ID NO: 89296 - DNA, 27 bp, Artificial Sequence
  Description of Artificial Sequence: Synthetic oligonucleotide
gacgtggggcgtaacaaaggcagcaga

SEQ ID NO: 89297 - DNA, 27 bp, Artificial Sequence
  Description of Artificial Sequence: Synthetic oligonucleotide
acgtggggcgtaacaaaggcagcagag

SEQ ID NO: 89298 - DNA, 27 bp, Artificial Sequence
  Description of Artificial Sequence: Synthetic oligonucleotide
cgtggggcgtaacaaaggcagcagaga

SEQ ID NO: 89299 - DNA, 29 bp, Artificial Sequence
  Description of Artificial Sequence: Synthetic oligonucleotide
gtggggcgtaacaaaggcagcagagaaac

SEQ ID NO: 89300 - DNA, 33 bp, Artificial Sequence
  Description of Artificial Sequence: Synthetic oligonucleotide
tggggcgtaacaaaggcagcagagaaacaaatg

SEQ ID NO: 89301 - DNA, 32 bp, Artificial Sequence
  Description of Artificial Sequence: Synthetic oligonucleotide
ggggcgtaacaaaggcagcagagaaacaaatg

SEQ ID NO: 89302 - DNA, 34 bp, Artificial Sequence
  Description of Artificial Sequence: Synthetic oligonucleotide
gggcgtaacaaaggcagcagagaaacaaatgaag

SEQ ID NO: 89303 - DNA, 34 bp, Artificial Sequence
  Description of Artificial Sequence: Synthetic oligonucleotide
ggcgtaacaaaggcagcagagaaacaaatgaagg

SEQ ID NO: 89304 - DNA, 35 bp, Artificial Sequence
  Description of Artificial Sequence: Synthetic oligonucleotide
gcgtaacaaaggcagcagagaaacaaatgaaggac

SEQ ID NO: 89305 - DNA, 38 bp, Artificial Sequence
  Description of Artificial Sequence: Synthetic oligonucleotide
cgtaacaaaggcagcagagaaacaaatgaaggacaaac

SEQ ID NO: 89306 - DNA, 39 bp, Artificial Sequence
  Description of Artificial Sequence: Synthetic oligonucleotide
gtaacaaaggcagcagagaaacaaatgaaggacaaacag

SEQ ID NO: 89307 - DNA, 39 bp, Artificial Sequence
  Description of Artificial Sequence: Synthetic oligonucleotide
taacaaaggcagcagagaaacaaatgaaggacaaacagg

SEQ ID NO: 89308 - DNA, 38 bp, Artificial Sequence
  Description of Artificial Sequence: Synthetic oligonucleotide
aacaaaggcagcagagaaacaaatgaaggacaaacagg

SEQ ID NO: 89309 - DNA, 37 bp, Artificial Sequence
  Description of Artificial Sequence: Synthetic oligonucleotide
acaaaggcagcagagaaacaaatgaaggacaaacagg

SEQ ID NO: 89310 - DNA, 36 bp, Artificial Sequence
  Description of Artificial Sequence: Synthetic oligonucleotide
caaaggcagcagagaaacaaatgaaggacaaacagg

SEQ ID NO: 89311 - DNA, 37 bp, Artificial Sequence
  Description of Artificial Sequence: Synthetic oligonucleotide
aaaggcagcagagaaacaaatgaaggacaaacaggac

SEQ ID NO: 89312 - DNA, 36 bp, Artificial Sequence
  Description of Artificial Sequence: Synthetic oligonucleotide
aaggcagcagagaaacaaatgaaggacaaacaggac

SEQ ID NO: 89313 - DNA, 35 bp, Artificial Sequence
  Description of Artificial Sequence: Synthetic oligonucleotide
aggcagcagagaaacaaatgaaggacaaacaggac

SEQ ID NO: 89314 - DNA, 34 bp, Artificial Sequence
  Description of Artificial Sequence: Synthetic oligonucleotide
ggcagcagagaaacaaatgaaggacaaacaggac

SEQ ID NO: 89315 - DNA, 34 bp, Artificial Sequence
  Description of Artificial Sequence: Synthetic oligonucleotide
gcagcagagaaacaaatgaaggacaaacaggacg

SEQ ID NO: 89316 - DNA, 35 bp, Artificial Sequence
  Description of Artificial Sequence: Synthetic oligonucleotide
cagcagagaaacaaatgaaggacaaacaggacgag

SEQ ID NO: 89317 - DNA, 35 bp, Artificial Sequence
  Description of Artificial Sequence: Synthetic oligonucleotide
agcagagaaacaaatgaaggacaaacaggacgagg

SEQ ID NO: 89318 - DNA, 34 bp, Artificial Sequence
  Description of Artificial Sequence: Synthetic oligonucleotide
gcagagaaacaaatgaaggacaaacaggacgagg

SEQ ID NO: 89319 - DNA, 35 bp, Artificial Sequence
  Description of Artificial Sequence: Synthetic oligonucleotide
cagagaaacaaatgaaggacaaacaggacgaggag

SEQ ID NO: 89320 - DNA, 35 bp, Artificial Sequence
  Description of Artificial Sequence: Synthetic oligonucleotide
agagaaacaaatgaaggacaaacaggacgaggagc

SEQ ID NO: 89321 - DNA, 34 bp, Artificial Sequence
  Description of Artificial Sequence: Synthetic oligonucleotide
gagaaacaaatgaaggacaaacaggacgaggagc

SEQ ID NO: 89322 - DNA, 35 bp, Artificial Sequence
  Description of Artificial Sequence: Synthetic oligonucleotide
agaaacaaatgaaggacaaacaggacgaggagcag

SEQ ID NO: 89323 - DNA, 34 bp, Artificial Sequence
  Description of Artificial Sequence: Synthetic oligonucleotide
gaaacaaatgaaggacaaacaggacgaggagcag

SEQ ID NO: 89324 - DNA, 35 bp, Artificial Sequence
  Description of Artificial Sequence: Synthetic oligonucleotide
aaacaaatgaaggacaaacaggacgaggagcagag

SEQ ID NO: 89325 - DNA, 34 bp, Artificial Sequence
  Description of Artificial Sequence: Synthetic oligonucleotide
aacaaatgaaggacaaacaggacgaggagcagag

SEQ ID NO: 89326 - DNA, 33 bp, Artificial Sequence
  Description of Artificial Sequence: Synthetic oligonucleotide
acaaatgaaggacaaacaggacgaggagcagag

SEQ ID NO: 89327 - DNA, 32 bp, Artificial Sequence
  Description of Artificial Sequence: Synthetic oligonucleotide
caaatgaaggacaaacaggacgaggagcagag

SEQ ID NO: 89328 - DNA, 32 bp, Artificial Sequence
  Description of Artificial Sequence: Synthetic oligonucleotide
aaatgaaggacaaacaggacgaggagcagagg

SEQ ID NO: 89329 - DNA, 31 bp, Artificial Sequence
  Description of Artificial Sequence: Synthetic oligonucleotide
aatgaaggacaaacaggacgaggagcagagg

SEQ ID NO: 89330 - DNA, 30 bp, Artificial Sequence
  Description of Artificial Sequence: Synthetic oligonucleotide
atgaaggacaaacaggacgaggagcagagg

SEQ ID NO: 89331 - DNA, 29 bp, Artificial Sequence
  Description of Artificial Sequence: Synthetic oligonucleotide
tgaaggacaaacaggacgaggagcagagg

SEQ ID NO: 89332 - DNA, 28 bp, Artificial Sequence
  Description of Artificial Sequence: Synthetic oligonucleotide
gaaggacaaacaggacgaggagcagagg

SEQ ID NO: 89333 - DNA, 28 bp, Artificial Sequence
  Description of Artificial Sequence: Synthetic oligonucleotide
aaggacaaacaggacgaggagcagaggc

SEQ ID NO: 89334 - DNA, 27 bp, Artificial Sequence
  Description of Artificial Sequence: Synthetic oligonucleotide
aggacaaacaggacgaggagcagaggc

SEQ ID NO: 89335 - DNA, 27 bp, Artificial Sequence
  Description of Artificial Sequence: Synthetic oligonucleotide
ggacaaacaggacgaggagcagaggct

SEQ ID NO: 89336 - DNA, 30 bp, Artificial Sequence
  Description of Artificial Sequence: Synthetic oligonucleotide
gacaaacaggacgaggagcagaggcttaag

SEQ ID NO: 89337 - DNA, 30 bp, Artificial Sequence
  Description of Artificial Sequence: Synthetic oligonucleotide
acaaacaggacgaggagcagaggcttaagg

SEQ ID NO: 89338 - DNA, 29 bp, Artificial Sequence
  Description of Artificial Sequence: Synthetic oligonucleotide
caaacaggacgaggagcagaggcttaagg

SEQ ID NO: 89339 - DNA, 30 bp, Artificial Sequence
  Description of Artificial Sequence: Synthetic oligonucleotide
aaacaggacgaggagcagaggcttaaggag

SEQ ID NO: 89340 - DNA, 29 bp, Artificial Sequence
  Description of Artificial Sequence: Synthetic oligonucleotide
aacaggacgaggagcagaggcttaaggag

SEQ ID NO: 89341 - DNA, 28 bp, Artificial Sequence
  Description of Artificial Sequence: Synthetic oligonucleotide
acaggacgaggagcagaggcttaaggag

SEQ ID NO: 89342 - DNA, 27 bp, Artificial Sequence
  Description of Artificial Sequence: Synthetic oligonucleotide
caggacgaggagcagaggcttaaggag

SEQ ID NO: 89343 - DNA, 27 bp, Artificial Sequence
  Description of Artificial Sequence: Synthetic oligonucleotide
aggacgaggagcagaggcttaaggagg

SEQ ID NO: 89344 - DNA, 27 bp, Artificial Sequence
  Description of Artificial Sequence: Synthetic oligonucleotide
ggacgaggagcagaggcttaaggagga

SEQ ID NO: 89345 - DNA, 27 bp, Artificial Sequence
  Description of Artificial Sequence: Synthetic oligonucleotide
gacgaggagcagaggcttaaggaggag

SEQ ID NO: 89346 - DNA, 27 bp, Artificial Sequence
  Description of Artificial Sequence: Synthetic oligonucleotide
acgaggagcagaggcttaaggaggagg

SEQ ID NO: 89347 - DNA, 27 bp, Artificial Sequence
  Description of Artificial Sequence: Synthetic oligonucleotide
cgaggagcagaggcttaaggaggagga

SEQ ID NO: 89348 - DNA, 28 bp, Artificial Sequence
  Description of Artificial Sequence: Synthetic oligonucleotide
gaggagcagaggcttaaggaggaggaag

SEQ ID NO: 89349 - DNA, 30 bp, Artificial Sequence
  Description of Artificial Sequence: Synthetic oligonucleotide
aggagcagaggcttaaggaggaggaagaag

SEQ ID NO: 89350 - DNA, 29 bp, Artificial Sequence
  Description of Artificial Sequence: Synthetic oligonucleotide
ggagcagaggcttaaggaggaggaagaag

SEQ ID NO: 89351 - DNA, 30 bp, Artificial Sequence
  Description of Artificial Sequence: Synthetic oligonucleotide
gagcagaggcttaaggaggaggaagaagac

SEQ ID NO: 89352 - DNA, 32 bp, Artificial Sequence
  Description of Artificial Sequence: Synthetic oligonucleotide
agcagaggcttaaggaggaggaagaagacaag

SEQ ID NO: 89353 - DNA, 31 bp, Artificial Sequence
  Description of Artificial Sequence: Synthetic oligonucleotide
gcagaggcttaaggaggaggaagaagacaag

SEQ ID NO: 89354 - DNA, 34 bp, Artificial Sequence
  Description of Artificial Sequence: Synthetic oligonucleotide
cagaggcttaaggaggaggaagaagacaagaaac

SEQ ID NO: 89355 - DNA, 34 bp, Artificial Sequence
  Description of Artificial Sequence: Synthetic oligonucleotide
agaggcttaaggaggaggaagaagacaagaaacg

SEQ ID NO: 89356 - DNA, 33 bp, Artificial Sequence
  Description of Artificial Sequence: Synthetic oligonucleotide
gaggcttaaggaggaggaagaagacaagaaacg

SEQ ID NO: 89357 - DNA, 33 bp, Artificial Sequence
  Description of Artificial Sequence: Synthetic oligonucleotide
aggcttaaggaggaggaagaagacaagaaacgc

SEQ ID NO: 89358 - DNA, 32 bp, Artificial Sequence
  Description of Artificial Sequence: Synthetic oligonucleotide
ggcttaaggaggaggaagaagacaagaaacgc

SEQ ID NO: 89359 - DNA, 35 bp, Artificial Sequence
  Description of Artificial Sequence: Synthetic oligonucleotide
gcttaaggaggaggaagaagacaagaaacgcaaag

SEQ ID NO: 89360 - DNA, 36 bp, Artificial Sequence
  Description of Artificial Sequence: Synthetic oligonucleotide
cttaaggaggaggaagaagacaagaaacgcaaagag

SEQ ID NO: 89361 - DNA, 36 bp, Artificial Sequence
  Description of Artificial Sequence: Synthetic oligonucleotide
ttaaggaggaggaagaagacaagaaacgcaaagagg

SEQ ID NO: 89362 - DNA, 35 bp, Artificial Sequence
  Description of Artificial Sequence: Synthetic oligonucleotide
taaggaggaggaagaagacaagaaacgcaaagagg

SEQ ID NO: 89363 - DNA, 34 bp, Artificial Sequence
  Description of Artificial Sequence: Synthetic oligonucleotide
aaggaggaggaagaagacaagaaacgcaaagagg

SEQ ID NO: 89364 - DNA, 33 bp, Artificial Sequence
  Description of Artificial Sequence: Synthetic oligonucleotide
aggaggaggaagaagacaagaaacgcaaagagg

SEQ ID NO: 89365 - DNA, 32 bp, Artificial Sequence
  Description of Artificial Sequence: Synthetic oligonucleotide
ggaggaggaagaagacaagaaacgcaaagagg

SEQ ID NO: 89366 - DNA, 33 bp, Artificial Sequence
  Description of Artificial Sequence: Synthetic oligonucleotide
gaggaggaagaagacaagaaacgcaaagaggag

SEQ ID NO: 89367 - DNA, 33 bp, Artificial Sequence
  Description of Artificial Sequence: Synthetic oligonucleotide
aggaggaagaagacaagaaacgcaaagaggagg

SEQ ID NO: 89368 - DNA, 32 bp, Artificial Sequence
  Description of Artificial Sequence: Synthetic oligonucleotide
ggaggaagaagacaagaaacgcaaagaggagg

SEQ ID NO: 89369 - DNA, 33 bp, Artificial Sequence
  Description of Artificial Sequence: Synthetic oligonucleotide
gaggaagaagacaagaaacgcaaagaggaggag

SEQ ID NO: 89370 - DNA, 33 bp, Artificial Sequence
  Description of Artificial Sequence: Synthetic oligonucleotide
aggaagaagacaagaaacgcaaagaggaggagg

SEQ ID NO: 89371 - DNA, 32 bp, Artificial Sequence
  Description of Artificial Sequence: Synthetic oligonucleotide
ggaagaagacaagaaacgcaaagaggaggagg

SEQ ID NO: 89372 - DNA, 33 bp, Artificial Sequence
  Description of Artificial Sequence: Synthetic oligonucleotide
gaagaagacaagaaacgcaaagaggaggaggag

SEQ ID NO: 89373 - DNA, 33 bp, Artificial Sequence
  Description of Artificial Sequence: Synthetic oligonucleotide
aagaagacaagaaacgcaaagaggaggaggagg

SEQ ID NO: 89374 - DNA, 32 bp, Artificial Sequence
  Description of Artificial Sequence: Synthetic oligonucleotide
agaagacaagaaacgcaaagaggaggaggagg

SEQ ID NO: 89375 - DNA, 31 bp, Artificial Sequence
  Description of Artificial Sequence: Synthetic oligonucleotide
gaagacaagaaacgcaaagaggaggaggagg

SEQ ID NO: 89376 - DNA, 31 bp, Artificial Sequence
  Description of Artificial Sequence: Synthetic oligonucleotide
aagacaagaaacgcaaagaggaggaggaggc

SEQ ID NO: 89377 - DNA, 30 bp, Artificial Sequence
  Description of Artificial Sequence: Synthetic oligonucleotide
agacaagaaacgcaaagaggaggaggaggc

SEQ ID NO: 89378 - DNA, 29 bp, Artificial Sequence
  Description of Artificial Sequence: Synthetic oligonucleotide
gacaagaaacgcaaagaggaggaggaggc

SEQ ID NO: 89379 - DNA, 30 bp, Artificial Sequence
  Description of Artificial Sequence: Synthetic oligonucleotide
acaagaaacgcaaagaggaggaggaggcag

SEQ ID NO: 89380 - DNA, 29 bp, Artificial Sequence
  Description of Artificial Sequence: Synthetic oligonucleotide
caagaaacgcaaagaggaggaggaggcag

SEQ ID NO: 89381 - DNA, 30 bp, Artificial Sequence
  Description of Artificial Sequence: Synthetic oligonucleotide
aagaaacgcaaagaggaggaggaggcagag

SEQ ID NO: 89382 - DNA, 29 bp, Artificial Sequence
  Description of Artificial Sequence: Synthetic oligonucleotide
agaaacgcaaagaggaggaggaggcagag

SEQ ID NO: 89383 - DNA, 28 bp, Artificial Sequence
  Description of Artificial Sequence: Synthetic oligonucleotide
gaaacgcaaagaggaggaggaggcagag

SEQ ID NO: 89384 - DNA, 28 bp, Artificial Sequence
  Description of Artificial Sequence: Synthetic oligonucleotide
aaacgcaaagaggaggaggaggcagagg

SEQ ID NO: 89385 - DNA, 27 bp, Artificial Sequence
  Description of Artificial Sequence: Synthetic oligonucleotide
aacgcaaagaggaggaggaggcagagg

SEQ ID NO: 89386 - DNA, 27 bp, Artificial Sequence
  Description of Artificial Sequence: Synthetic oligonucleotide
acgcaaagaggaggaggaggcagagga

SEQ ID NO: 89387 - DNA, 26 bp, Artificial Sequence
  Description of Artificial Sequence: Synthetic oligonucleotide
cgcaaagaggaggaggaggcagagga

SEQ ID NO: 89388 - DNA, 27 bp, Artificial Sequence
  Description of Artificial Sequence: Synthetic oligonucleotide
gcaaagaggaggaggaggcagaggaca

SEQ ID NO: 89389 - DNA, 28 bp, Artificial Sequence
  Description of Artificial Sequence: Synthetic oligonucleotide
caaagaggaggaggaggcagaggacaag

SEQ ID NO: 89390 - DNA, 28 bp, Artificial Sequence
  Description of Artificial Sequence: Synthetic oligonucleotide
aaagaggaggaggaggcagaggacaagg

SEQ ID NO: 89391 - DNA, 27 bp, Artificial Sequence
  Description of Artificial Sequence: Synthetic oligonucleotide
aagaggaggaggaggcagaggacaagg

SEQ ID NO: 89392 - DNA, 27 bp, Artificial Sequence
  Description of Artificial Sequence: Synthetic oligonucleotide
agaggaggaggaggcagaggacaagga

SEQ ID NO: 89393 - DNA, 26 bp, Artificial Sequence
  Description of Artificial Sequence: Synthetic oligonucleotide
gaggaggaggaggcagaggacaagga

SEQ ID NO: 89394 - DNA, 26 bp, Artificial Sequence
  Description of Artificial Sequence: Synthetic oligonucleotide
aggaggaggaggcagaggacaaggag

SEQ ID NO: 89395 - DNA, 25 bp, Artificial Sequence
  Description of Artificial Sequence: Synthetic oligonucleotide
ggaggaggaggcagaggacaaggag

SEQ ID NO: 89396 - DNA, 27 bp, Artificial Sequence
  Description of Artificial Sequence: Synthetic oligonucleotide
gaggaggaggcagaggacaaggaggat

SEQ ID NO: 89397 - DNA, 27 bp, Artificial Sequence
  Description of Artificial Sequence: Synthetic oligonucleotide
aggaggaggcagaggacaaggaggatg

SEQ ID NO: 89398 - DNA, 27 bp, Artificial Sequence
  Description of Artificial Sequence: Synthetic oligonucleotide
ggaggaggcagaggacaaggaggatga

SEQ ID NO: 89399 - DNA, 28 bp, Artificial Sequence
  Description of Artificial Sequence: Synthetic oligonucleotide
gaggaggcagaggacaaggaggatgatg

SEQ ID NO: 89400 - DNA, 29 bp, Artificial Sequence
  Description of Artificial Sequence: Synthetic oligonucleotide
aggaggcagaggacaaggaggatgatgag

SEQ ID NO: 89401 - DNA, 28 bp, Artificial Sequence
  Description of Artificial Sequence: Synthetic oligonucleotide
ggaggcagaggacaaggaggatgatgag

SEQ ID NO: 89402 - DNA, 28 bp, Artificial Sequence
  Description of Artificial Sequence: Synthetic oligonucleotide
gaggcagaggacaaggaggatgatgagg

SEQ ID NO: 89403 - DNA, 29 bp, Artificial Sequence
  Description of Artificial Sequence: Synthetic oligonucleotide
aggcagaggacaaggaggatgatgaggac

SEQ ID NO: 89404 - DNA, 28 bp, Artificial Sequence
  Description of Artificial Sequence: Synthetic oligonucleotide
ggcagaggacaaggaggatgatgaggac

SEQ ID NO: 89405 - DNA, 31 bp, Artificial Sequence
  Description of Artificial Sequence: Synthetic oligonucleotide
gcagaggacaaggaggatgatgaggacaaag

SEQ ID NO: 89406 - DNA, 33 bp, Artificial Sequence
  Description of Artificial Sequence: Synthetic oligonucleotide
cagaggacaaggaggatgatgaggacaaagatg

SEQ ID NO: 89407 - DNA, 34 bp, Artificial Sequence
  Description of Artificial Sequence: Synthetic oligonucleotide
agaggacaaggaggatgatgaggacaaagatgag

SEQ ID NO: 89408 - DNA, 33 bp, Artificial Sequence
  Description of Artificial Sequence: Synthetic oligonucleotide
gaggacaaggaggatgatgaggacaaagatgag

SEQ ID NO: 89409 - DNA, 33 bp, Artificial Sequence
  Description of Artificial Sequence: Synthetic oligonucleotide
aggacaaggaggatgatgaggacaaagatgagg

SEQ ID NO: 89410 - DNA, 32 bp, Artificial Sequence
  Description of Artificial Sequence: Synthetic oligonucleotide
ggacaaggaggatgatgaggacaaagatgagg

SEQ ID NO: 89411 - DNA, 34 bp, Artificial Sequence
  Description of Artificial Sequence: Synthetic oligonucleotide
gacaaggaggatgatgaggacaaagatgaggatg

SEQ ID NO: 89412 - DNA, 35 bp, Artificial Sequence
  Description of Artificial Sequence: Synthetic oligonucleotide
acaaggaggatgatgaggacaaagatgaggatgag

SEQ ID NO: 89413 - DNA, 34 bp, Artificial Sequence
  Description of Artificial Sequence: Synthetic oligonucleotide
caaggaggatgatgaggacaaagatgaggatgag

SEQ ID NO: 89414 - DNA, 34 bp, Artificial Sequence
  Description of Artificial Sequence: Synthetic oligonucleotide
aaggaggatgatgaggacaaagatgaggatgagg

SEQ ID NO: 89415 - DNA, 33 bp, Artificial Sequence
  Description of Artificial Sequence: Synthetic oligonucleotide
aggaggatgatgaggacaaagatgaggatgagg

SEQ ID NO: 89416 - DNA, 32 bp, Artificial Sequence
  Description of Artificial Sequence: Synthetic oligonucleotide
ggaggatgatgaggacaaagatgaggatgagg

SEQ ID NO: 89417 - DNA, 33 bp, Artificial Sequence
  Description of Artificial Sequence: Synthetic oligonucleotide
gaggatgatgaggacaaagatgaggatgaggag

SEQ ID NO: 89418 - DNA, 33 bp, Artificial Sequence
  Description of Artificial Sequence: Synthetic oligonucleotide
aggatgatgaggacaaagatgaggatgaggagg

SEQ ID NO: 89419 - DNA, 32 bp, Artificial Sequence
  Description of Artificial Sequence: Synthetic oligonucleotide
ggatgatgaggacaaagatgaggatgaggagg

SEQ ID NO: 89420 - DNA, 34 bp, Artificial Sequence
  Description of Artificial Sequence: Synthetic oligonucleotide
gatgatgaggacaaagatgaggatgaggaggatg

SEQ ID NO: 89421 - DNA, 35 bp, Artificial Sequence
  Description of Artificial Sequence: Synthetic oligonucleotide
atgatgaggacaaagatgaggatgaggaggatgag

SEQ ID NO: 89422 - DNA, 34 bp, Artificial Sequence
  Description of Artificial Sequence: Synthetic oligonucleotide
tgatgaggacaaagatgaggatgaggaggatgag

SEQ ID NO: 89423 - DNA, 33 bp, Artificial Sequence
  Description of Artificial Sequence: Synthetic oligonucleotide
gatgaggacaaagatgaggatgaggaggatgag

SEQ ID NO: 89424 - DNA, 33 bp, Artificial Sequence
  Description of Artificial Sequence: Synthetic oligonucleotide
atgaggacaaagatgaggatgaggaggatgagg

SEQ ID NO: 89425 - DNA, 32 bp, Artificial Sequence
  Description of Artificial Sequence: Synthetic oligonucleotide
tgaggacaaagatgaggatgaggaggatgagg

SEQ ID NO: 89426 - DNA, 31 bp, Artificial Sequence
  Description of Artificial Sequence: Synthetic oligonucleotide
gaggacaaagatgaggatgaggaggatgagg

SEQ ID NO: 89427 - DNA, 32 bp, Artificial Sequence
  Description of Artificial Sequence: Synthetic oligonucleotide
aggacaaagatgaggatgaggaggatgaggag

SEQ ID NO: 89428 - DNA, 31 bp, Artificial Sequence
  Description of Artificial Sequence: Synthetic oligonucleotide
ggacaaagatgaggatgaggaggatgaggag

SEQ ID NO: 89429 - DNA, 31 bp, Artificial Sequence
  Description of Artificial Sequence: Synthetic oligonucleotide
gacaaagatgaggatgaggaggatgaggagg

SEQ ID NO: 89430 - DNA, 32 bp, Artificial Sequence
  Description of Artificial Sequence: Synthetic oligonucleotide
acaaagatgaggatgaggaggatgaggaggac

SEQ ID NO: 89431 - DNA, 31 bp, Artificial Sequence
  Description of Artificial Sequence: Synthetic oligonucleotide
caaagatgaggatgaggaggatgaggaggac

SEQ ID NO: 89432 - DNA, 33 bp, Artificial Sequence
  Description of Artificial Sequence: Synthetic oligonucleotide
aaagatgaggatgaggaggatgaggaggacaag

SEQ ID NO: 89433 - DNA, 32 bp, Artificial Sequence
  Description of Artificial Sequence: Synthetic oligonucleotide
aagatgaggatgaggaggatgaggaggacaag

SEQ ID NO: 89434 - DNA, 31 bp, Artificial Sequence
  Description of Artificial Sequence: Synthetic oligonucleotide
agatgaggatgaggaggatgaggaggacaag

SEQ ID NO: 89435 - DNA, 30 bp, Artificial Sequence
  Description of Artificial Sequence: Synthetic oligonucleotide
gatgaggatgaggaggatgaggaggacaag

SEQ ID NO: 89436 - DNA, 30 bp, Artificial Sequence
  Description of Artificial Sequence: Synthetic oligonucleotide
atgaggatgaggaggatgaggaggacaagg

SEQ ID NO: 89437 - DNA, 29 bp, Artificial Sequence
  Description of Artificial Sequence: Synthetic oligonucleotide
tgaggatgaggaggatgaggaggacaagg

SEQ ID NO: 89438 - DNA, 28 bp, Artificial Sequence
  Description of Artificial Sequence: Synthetic oligonucleotide
gaggatgaggaggatgaggaggacaagg

SEQ ID NO: 89439 - DNA, 29 bp, Artificial Sequence
  Description of Artificial Sequence: Synthetic oligonucleotide
aggatgaggaggatgaggaggacaaggag

SEQ ID NO: 89440 - DNA, 28 bp, Artificial Sequence
  Description of Artificial Sequence: Synthetic oligonucleotide
ggatgaggaggatgaggaggacaaggag

SEQ ID NO: 89441 - DNA, 28 bp, Artificial Sequence
  Description of Artificial Sequence: Synthetic oligonucleotide
gatgaggaggatgaggaggacaaggagg

SEQ ID NO: 89442 - DNA, 30 bp, Artificial Sequence
  Description of Artificial Sequence: Synthetic oligonucleotide
atgaggaggatgaggaggacaaggaggaag

SEQ ID NO: 89443 - DNA, 29 bp, Artificial Sequence
  Description of Artificial Sequence: Synthetic oligonucleotide
tgaggaggatgaggaggacaaggaggaag

SEQ ID NO: 89444 - DNA, 28 bp, Artificial Sequence
  Description of Artificial Sequence: Synthetic oligonucleotide
gaggaggatgaggaggacaaggaggaag

SEQ ID NO: 89445 - DNA, 30 bp, Artificial Sequence
  Description of Artificial Sequence: Synthetic oligonucleotide
aggaggatgaggaggacaaggaggaagatg

SEQ ID NO: 89446 - DNA, 29 bp, Artificial Sequence
  Description of Artificial Sequence: Synthetic oligonucleotide
ggaggatgaggaggacaaggaggaagatg

SEQ ID NO: 89447 - DNA, 30 bp, Artificial Sequence
  Description of Artificial Sequence: Synthetic oligonucleotide
gaggatgaggaggacaaggaggaagatgag

SEQ ID NO: 89448 - DNA, 30 bp, Artificial Sequence
  Description of Artificial Sequence: Synthetic oligonucleotide
aggatgaggaggacaaggaggaagatgagg

SEQ ID NO: 89449 - DNA, 29 bp, Artificial Sequence
  Description of Artificial Sequence: Synthetic oligonucleotide
ggatgaggaggacaaggaggaagatgagg

SEQ ID NO: 89450 - DNA, 30 bp, Artificial Sequence
  Description of Artificial Sequence: Synthetic oligonucleotide
gatgaggaggacaaggaggaagatgaggag

SEQ ID NO: 89451 - DNA, 30 bp, Artificial Sequence
  Description of Artificial Sequence: Synthetic oligonucleotide
atgaggaggacaaggaggaagatgaggagg

SEQ ID NO: 89452 - DNA, 29 bp, Artificial Sequence
  Description of Artificial Sequence: Synthetic oligonucleotide
tgaggaggacaaggaggaagatgaggagg

SEQ ID NO: 89453 - DNA, 28 bp, Artificial Sequence
  Description of Artificial Sequence: Synthetic oligonucleotide
gaggaggacaaggaggaagatgaggagg

SEQ ID NO: 89454 - DNA, 30 bp, Artificial Sequence
  Description of Artificial Sequence: Synthetic oligonucleotide
aggaggacaaggaggaagatgaggaggaag

SEQ ID NO: 89455 - DNA, 29 bp, Artificial Sequence
  Description of Artificial Sequence: Synthetic oligonucleotide
ggaggacaaggaggaagatgaggaggaag

SEQ ID NO: 89456 - DNA, 31 bp, Artificial Sequence
  Description of Artificial Sequence: Synthetic oligonucleotide
gaggacaaggaggaagatgaggaggaagatg

SEQ ID NO: 89457 - DNA, 32 bp, Artificial Sequence
  Description of Artificial Sequence: Synthetic oligonucleotide
aggacaaggaggaagatgaggaggaagatgtc

SEQ ID NO: 89458 - DNA, 31 bp, Artificial Sequence
  Description of Artificial Sequence: Synthetic oligonucleotide
ggacaaggaggaagatgaggaggaagatgtc

SEQ ID NO: 89459 - DNA, 31 bp, Artificial Sequence
  Description of Artificial Sequence: Synthetic oligonucleotide
gacaaggaggaagatgaggaggaagatgtcc

SEQ ID NO: 89460 - DNA, 31 bp, Artificial Sequence
  Description of Artificial Sequence: Synthetic oligonucleotide
acaaggaggaagatgaggaggaagatgtccc

SEQ ID NO: 89461 - DNA, 30 bp, Artificial Sequence
  Description of Artificial Sequence: Synthetic oligonucleotide
caaggaggaagatgaggaggaagatgtccc

SEQ ID NO: 89462 - DNA, 30 bp, Artificial Sequence
  Description of Artificial Sequence: Synthetic oligonucleotide
aaggaggaagatgaggaggaagatgtcccc

SEQ ID NO: 89463 - DNA, 29 bp, Artificial Sequence
  Description of Artificial Sequence: Synthetic oligonucleotide
aggaggaagatgaggaggaagatgtcccc

SEQ ID NO: 89464 - DNA, 28 bp, Artificial Sequence
  Description of Artificial Sequence: Synthetic oligonucleotide
ggaggaagatgaggaggaagatgtcccc

SEQ ID NO: 89465 - DNA, 28 bp, Artificial Sequence
  Description of Artificial Sequence: Synthetic oligonucleotide
gaggaagatgaggaggaagatgtccccg

SEQ ID NO: 89466 - DNA, 28 bp, Artificial Sequence
  Description of Artificial Sequence: Synthetic oligonucleotide
aggaagatgaggaggaagatgtccccgg

SEQ ID NO: 89467 - DNA, 27 bp, Artificial Sequence
  Description of Artificial Sequence: Synthetic oligonucleotide
ggaagatgaggaggaagatgtccccgg

SEQ ID NO: 89468 - DNA, 27 bp, Artificial Sequence
  Description of Artificial Sequence: Synthetic oligonucleotide
gaagatgaggaggaagatgtccccggc

SEQ ID NO: 89469 - DNA, 27 bp, Artificial Sequence
  Description of Artificial Sequence: Synthetic oligonucleotide
aagatgaggaggaagatgtccccggcc

SEQ ID NO: 89470 - DNA, 27 bp, Artificial Sequence
  Description of Artificial Sequence: Synthetic oligonucleotide
agatgaggaggaagatgtccccggcca

SEQ ID NO: 89471 - DNA, 26 bp, Artificial Sequence
  Description of Artificial Sequence: Synthetic oligonucleotide
gatgaggaggaagatgtccccggcca

SEQ ID NO: 89472 - DNA, 26 bp, Artificial Sequence
  Description of Artificial Sequence: Synthetic oligonucleotide
atgaggaggaagatgtccccggccag

SEQ ID NO: 89473 - DNA, 25 bp, Artificial Sequence
  Description of Artificial Sequence: Synthetic oligonucleotide
tgaggaggaagatgtccccggccag

SEQ ID NO: 89474 - DNA, 24 bp, Artificial Sequence
  Description of Artificial Sequence: Synthetic oligonucleotide
gaggaggaagatgtccccggccag

SEQ ID NO: 89475 - DNA, 24 bp, Artificial Sequence
  Description of Artificial Sequence: Synthetic oligonucleotide
aggaggaagatgtccccggccagg

SEQ ID NO: 89476 - DNA, 23 bp, Artificial Sequence
  Description of Artificial Sequence: Synthetic oligonucleotide
ggaggaagatgtccccggccagg

SEQ ID NO: 89477 - DNA, 23 bp, Artificial Sequence
  Description of Artificial Sequence: Synthetic oligonucleotide
gaggaagatgtccccggccaggc

SEQ ID NO: 89478 - DNA, 25 bp, Artificial Sequence
  Description of Artificial Sequence: Synthetic oligonucleotide
aggaagatgtccccggccaggccaa

SEQ ID NO: 89479 - DNA, 24 bp, Artificial Sequence
  Description of Artificial Sequence: Synthetic oligonucleotide
ggaagatgtccccggccaggccaa

SEQ ID NO: 89480 - DNA, 24 bp, Artificial Sequence
  Description of Artificial Sequence: Synthetic oligonucleotide
gaagatgtccccggccaggccaag

SEQ ID NO: 89481 - DNA, 25 bp, Artificial Sequence
  Description of Artificial Sequence: Synthetic oligonucleotide
aagatgtccccggccaggccaagga

SEQ ID NO: 89482 - DNA, 24 bp, Artificial Sequence
  Description of Artificial Sequence: Synthetic oligonucleotide
agatgtccccggccaggccaagga

SEQ ID NO: 89483 - DNA, 23 bp, Artificial Sequence
  Description of Artificial Sequence: Synthetic oligonucleotide
gatgtccccggccaggccaagga

SEQ ID NO: 89484 - DNA, 23 bp, Artificial Sequence
  Description of Artificial Sequence: Synthetic oligonucleotide
atgtccccggccaggccaaggac

SEQ ID NO: 89485 - DNA, 22 bp, Artificial Sequence
  Description of Artificial Sequence: Synthetic oligonucleotide
tgtccccggccaggccaaggac

SEQ ID NO: 89486 - DNA, 21 bp, Artificial Sequence
  Description of Artificial Sequence: Synthetic oligonucleotide
gtccccggccaggccaaggac

SEQ ID NO: 89487 - DNA, 22 bp, Artificial Sequence
  Description of Artificial Sequence: Synthetic oligonucleotide
tccccggccaggccaaggacga

SEQ ID NO: 89488 - DNA, 21 bp, Artificial Sequence
  Description of Artificial Sequence: Synthetic oligonucleotide
ccccggccaggccaaggacga

SEQ ID NO: 89489 - DNA, 21 bp, Artificial Sequence
  Description of Artificial Sequence: Synthetic oligonucleotide
cccggccaggccaaggacgag

SEQ ID NO: 89490 - DNA, 22 bp, Artificial Sequence
  Description of Artificial Sequence: Synthetic oligonucleotide
ccggccaggccaaggacgagct

SEQ ID NO: 89491 - DNA, 24 bp, Artificial Sequence
  Description of Artificial Sequence: Synthetic oligonucleotide
cggccaggccaaggacgagctgta

SEQ ID NO: 89492 - DNA, 24 bp, Artificial Sequence
  Description of Artificial Sequence: Synthetic oligonucleotide
ggccaggccaaggacgagctgtag

SEQ ID NO: 89493 - DNA, 27 bp, Artificial Sequence
  Description of Artificial Sequence: Synthetic oligonucleotide
atgagccgccagcttctgcctgtactg

SEQ ID NO: 89494 - DNA, 26 bp, Artificial Sequence
  Description of Artificial Sequence: Synthetic oligonucleotide
tgagccgccagcttctgcctgtactg

SEQ ID NO: 89495 - DNA, 25 bp, Artificial Sequence
  Description of Artificial Sequence: Synthetic oligonucleotide
gagccgccagcttctgcctgtactg

SEQ ID NO: 89496 - DNA, 26 bp, Artificial Sequence
  Description of Artificial Sequence: Synthetic oligonucleotide
agccgccagcttctgcctgtactgct

SEQ ID NO: 89497 - DNA, 25 bp, Artificial Sequence
  Description of Artificial Sequence: Synthetic oligonucleotide
gccgccagcttctgcctgtactgct

SEQ ID NO: 89498 - DNA, 25 bp, Artificial Sequence
  Description of Artificial Sequence: Synthetic oligonucleotide
ccgccagcttctgcctgtactgctg

SEQ ID NO: 89499 - DNA, 26 bp, Artificial Sequence
  Description of Artificial Sequence: Synthetic oligonucleotide
cgccagcttctgcctgtactgctgct

SEQ ID NO: 89500 - DNA, 26 bp, Artificial Sequence
  Description of Artificial Sequence: Synthetic oligonucleotide
gccagcttctgcctgtactgctgctg

SEQ ID NO: 89501 - DNA, 27 bp, Artificial Sequence
  Description of Artificial Sequence: Synthetic oligonucleotide
ccagcttctgcctgtactgctgctgct

SEQ ID NO: 89502 - DNA, 27 bp, Artificial Sequence
  Description of Artificial Sequence: Synthetic oligonucleotide
cagcttctgcctgtactgctgctgctg

SEQ ID NO: 89503 - DNA, 27 bp, Artificial Sequence
  Description of Artificial Sequence: Synthetic oligonucleotide
agcttctgcctgtactgctgctgctgc

SEQ ID NO: 89504 - DNA, 27 bp, Artificial Sequence
  Description of Artificial Sequence: Synthetic oligonucleotide
gcttctgcctgtactgctgctgctgct

SEQ ID NO: 89505 - DNA, 27 bp, Artificial Sequence
  Description of Artificial Sequence: Synthetic oligonucleotide
cttctgcctgtactgctgctgctgctg

SEQ ID NO: 89506 - DNA, 27 bp, Artificial Sequence
  Description of Artificial Sequence: Synthetic oligonucleotide
ttctgcctgtactgctgctgctgctgc

SEQ ID NO: 89507 - DNA, 27 bp, Artificial Sequence
  Description of Artificial Sequence: Synthetic oligonucleotide
tctgcctgtactgctgctgctgctgct

SEQ ID NO: 89508 - DNA, 26 bp, Artificial Sequence
  Description of Artificial Sequence: Synthetic oligonucleotide
ctgcctgtactgctgctgctgctgct

SEQ ID NO: 89509 - DNA, 27 bp, Artificial Sequence
  Description of Artificial Sequence: Synthetic oligonucleotide
tgcctgtactgctgctgctgctgctca

SEQ ID NO: 89510 - DNA, 26 bp, Artificial Sequence
  Description of Artificial Sequence: Synthetic oligonucleotide
gcctgtactgctgctgctgctgctca

SEQ ID NO: 89511 - DNA, 26 bp, Artificial Sequence
  Description of Artificial Sequence: Synthetic oligonucleotide
cctgtactgctgctgctgctgctcag

SEQ ID NO: 89512 - DNA, 26 bp, Artificial Sequence
  Description of Artificial Sequence: Synthetic oligonucleotide
ctgtactgctgctgctgctgctcagg

SEQ ID NO: 89513 - DNA, 26 bp, Artificial Sequence
  Description of Artificial Sequence: Synthetic oligonucleotide
tgtactgctgctgctgctgctcaggg

SEQ ID NO: 89514 - DNA, 25 bp, Artificial Sequence
  Description of Artificial Sequence: Synthetic oligonucleotide
gtactgctgctgctgctgctcaggg

SEQ ID NO: 89515 - DNA, 27 bp, Artificial Sequence
  Description of Artificial Sequence: Synthetic oligonucleotide
tactgctgctgctgctgctcagggctt

SEQ ID NO: 89516 - DNA, 26 bp, Artificial Sequence
  Description of Artificial Sequence: Synthetic oligonucleotide
actgctgctgctgctgctcagggctt

SEQ ID NO: 89517 - DNA, 25 bp, Artificial Sequence
  Description of Artificial Sequence: Synthetic oligonucleotide
ctgctgctgctgctgctcagggctt

SEQ ID NO: 89518 - DNA, 25 bp, Artificial Sequence
  Description of Artificial Sequence: Synthetic oligonucleotide
tgctgctgctgctgctcagggcttc

SEQ ID NO: 89519 - DNA, 24 bp, Artificial Sequence
  Description of Artificial Sequence: Synthetic oligonucleotide
gctgctgctgctgctcagggcttc

SEQ ID NO: 89520 - DNA, 25 bp, Artificial Sequence
  Description of Artificial Sequence: Synthetic oligonucleotide
ctgctgctgctgctcagggcttcgt

SEQ ID NO: 89521 - DNA, 25 bp, Artificial Sequence
  Description of Artificial Sequence: Synthetic oligonucleotide
tgctgctgctgctcagggcttcgtg

SEQ ID NO: 89522 - DNA, 24 bp, Artificial Sequence
  Description of Artificial Sequence: Synthetic oligonucleotide
gctgctgctgctcagggcttcgtg

SEQ ID NO: 89523 - DNA, 24 bp, Artificial Sequence
  Description of Artificial Sequence: Synthetic oligonucleotide
ctgctgctgctcagggcttcgtgc

SEQ ID NO: 89524 - DNA, 24 bp, Artificial Sequence
  Description of Artificial Sequence: Synthetic oligonucleotide
tgctgctgctcagggcttcgtgcc

SEQ ID NO: 89525 - DNA, 23 bp, Artificial Sequence
  Description of Artificial Sequence: Synthetic oligonucleotide
gctgctgctcagggcttcgtgcc

SEQ ID NO: 89526 - DNA, 25 bp, Artificial Sequence
  Description of Artificial Sequence: Synthetic oligonucleotide
ctgctgctcagggcttcgtgcccat

SEQ ID NO: 89527 - DNA, 25 bp, Artificial Sequence
  Description of Artificial Sequence: Synthetic oligonucleotide
tgctgctcagggcttcgtgcccatg

SEQ ID NO: 89528 - DNA, 24 bp, Artificial Sequence
  Description of Artificial Sequence: Synthetic oligonucleotide
gctgctcagggcttcgtgcccatg

SEQ ID NO: 89529 - DNA, 24 bp, Artificial Sequence
  Description of Artificial Sequence: Synthetic oligonucleotide
ctgctcagggcttcgtgcccatgg

SEQ ID NO: 89530 - DNA, 24 bp, Artificial Sequence
  Description of Artificial Sequence: Synthetic oligonucleotide
tgctcagggcttcgtgcccatggg

SEQ ID NO: 89531 - DNA, 23 bp, Artificial Sequence
  Description of Artificial Sequence: Synthetic oligonucleotide
gctcagggcttcgtgcccatggg

SEQ ID NO: 89532 - DNA, 24 bp, Artificial Sequence
  Description of Artificial Sequence: Synthetic oligonucleotide
ctcagggcttcgtgcccatggggt

SEQ ID NO: 89533 - DNA, 25 bp, Artificial Sequence
  Description of Artificial Sequence: Synthetic oligonucleotide
tcagggcttcgtgcccatggggtca

SEQ ID NO: 89534 - DNA, 24 bp, Artificial Sequence
  Description of Artificial Sequence: Synthetic oligonucleotide
cagggcttcgtgcccatggggtca

SEQ ID NO: 89535 - DNA, 24 bp, Artificial Sequence
  Description of Artificial Sequence: Synthetic oligonucleotide
agggcttcgtgcccatggggtcag

SEQ ID NO: 89536 - DNA, 23 bp, Artificial Sequence
  Description of Artificial Sequence: Synthetic oligonucleotide
gggcttcgtgcccatggggtcag

SEQ ID NO: 89537 - DNA, 25 bp, Artificial Sequence
  Description of Artificial Sequence: Synthetic oligonucleotide
ggcttcgtgcccatggggtcaggaa

SEQ ID NO: 89538 - DNA, 26 bp, Artificial Sequence
  Description of Artificial Sequence: Synthetic oligonucleotide
gcttcgtgcccatggggtcaggaaca

SEQ ID NO: 89539 - DNA, 26 bp, Artificial Sequence
  Description of Artificial Sequence: Synthetic oligonucleotide
cttcgtgcccatggggtcaggaacag

SEQ ID NO: 89540 - DNA, 26 bp, Artificial Sequence
  Description of Artificial Sequence: Synthetic oligonucleotide
ttcgtgcccatggggtcaggaacagg

SEQ ID NO: 89541 - DNA, 25 bp, Artificial Sequence
  Description of Artificial Sequence: Synthetic oligonucleotide
tcgtgcccatggggtcaggaacagg

SEQ ID NO: 89542 - DNA, 24 bp, Artificial Sequence
  Description of Artificial Sequence: Synthetic oligonucleotide
cgtgcccatggggtcaggaacagg

SEQ ID NO: 89543 - DNA, 25 bp, Artificial Sequence
  Description of Artificial Sequence: Synthetic oligonucleotide
gtgcccatggggtcaggaacaggga

SEQ ID NO: 89544 - DNA, 25 bp, Artificial Sequence
  Description of Artificial Sequence: Synthetic oligonucleotide
tgcccatggggtcaggaacagggag

SEQ ID NO: 89545 - DNA, 24 bp, Artificial Sequence
  Description of Artificial Sequence: Synthetic oligonucleotide
gcccatggggtcaggaacagggag

SEQ ID NO: 89546 - DNA, 24 bp, Artificial Sequence
  Description of Artificial Sequence: Synthetic oligonucleotide
cccatggggtcaggaacagggagc

SEQ ID NO: 89547 - DNA, 25 bp, Artificial Sequence
  Description of Artificial Sequence: Synthetic oligonucleotide
ccatggggtcaggaacagggagcga

SEQ ID NO: 89548 - DNA, 25 bp, Artificial Sequence
  Description of Artificial Sequence: Synthetic oligonucleotide
catggggtcaggaacagggagcgag

SEQ ID NO: 89549 - DNA, 26 bp, Artificial Sequence
  Description of Artificial Sequence: Synthetic oligonucleotide
atggggtcaggaacagggagcgagga

SEQ ID NO: 89550 - DNA, 25 bp, Artificial Sequence
  Description of Artificial Sequence: Synthetic oligonucleotide
tggggtcaggaacagggagcgagga

SEQ ID NO: 89551 - DNA, 24 bp, Artificial Sequence
  Description of Artificial Sequence: Synthetic oligonucleotide
ggggtcaggaacagggagcgagga

SEQ ID NO: 89552 - DNA, 24 bp, Artificial Sequence
  Description of Artificial Sequence: Synthetic oligonucleotide
gggtcaggaacagggagcgaggag

SEQ ID NO: 89553 - DNA, 24 bp, Artificial Sequence
  Description of Artificial Sequence: Synthetic oligonucleotide
ggtcaggaacagggagcgaggagc

SEQ ID NO: 89554 - DNA, 24 bp, Artificial Sequence
  Description of Artificial Sequence: Synthetic oligonucleotide
gtcaggaacagggagcgaggagcc

SEQ ID NO: 89555 - DNA, 24 bp, Artificial Sequence
  Description of Artificial Sequence: Synthetic oligonucleotide
tcaggaacagggagcgaggagccc

SEQ ID NO: 89556 - DNA, 23 bp, Artificial Sequence
  Description of Artificial Sequence: Synthetic oligonucleotide
caggaacagggagcgaggagccc

SEQ ID NO: 89557 - DNA, 24 bp, Artificial Sequence
  Description of Artificial Sequence: Synthetic oligonucleotide
aggaacagggagcgaggagcccct

SEQ ID NO: 89558 - DNA, 23 bp, Artificial Sequence
  Description of Artificial Sequence: Synthetic oligonucleotide
ggaacagggagcgaggagcccct

SEQ ID NO: 89559 - DNA, 23 bp, Artificial Sequence
  Description of Artificial Sequence: Synthetic oligonucleotide
gaacagggagcgaggagcccctc

SEQ ID NO: 89560 - DNA, 23 bp, Artificial Sequence
  Description of Artificial Sequence: Synthetic oligonucleotide
aacagggagcgaggagcccctcg

SEQ ID NO: 89561 - DNA, 22 bp, Artificial Sequence
  Description of Artificial Sequence: Synthetic oligonucleotide
acagggagcgaggagcccctcg

SEQ ID NO: 89562 - DNA, 21 bp, Artificial Sequence
  Description of Artificial Sequence: Synthetic oligonucleotide
cagggagcgaggagcccctcg

SEQ ID NO: 89563 - DNA, 22 bp, Artificial Sequence
  Description of Artificial Sequence: Synthetic oligonucleotide
agggagcgaggagcccctcgga

SEQ ID NO: 89564 - DNA, 21 bp, Artificial Sequence
  Description of Artificial Sequence: Synthetic oligonucleotide
gggagcgaggagcccctcgga

SEQ ID NO: 89565 - DNA, 21 bp, Artificial Sequence
  Description of Artificial Sequence: Synthetic oligonucleotide
ggagcgaggagcccctcggag

SEQ ID NO: 89566 - DNA, 22 bp, Artificial Sequence
  Description of Artificial Sequence: Synthetic oligonucleotide
gagcgaggagcccctcggagga

SEQ ID NO: 89567 - DNA, 22 bp, Artificial Sequence
  Description of Artificial Sequence: Synthetic oligonucleotide
agcgaggagcccctcggaggag

SEQ ID NO: 89568 - DNA, 21 bp, Artificial Sequence
  Description of Artificial Sequence: Synthetic oligonucleotide
gcgaggagcccctcggaggag

SEQ ID NO: 89569 - DNA, 21 bp, Artificial Sequence
  Description of Artificial Sequence: Synthetic oligonucleotide
cgaggagcccctcggaggagc

SEQ ID NO: 89570 - DNA, 22 bp, Artificial Sequence
  Description of Artificial Sequence: Synthetic oligonucleotide
gaggagcccctcggaggagcct

SEQ ID NO: 89571 - DNA, 22 bp, Artificial Sequence
  Description of Artificial Sequence: Synthetic oligonucleotide
aggagcccctcggaggagcctc

SEQ ID NO: 89572 - DNA, 21 bp, Artificial Sequence
  Description of Artificial Sequence: Synthetic oligonucleotide
ggagcccctcggaggagcctc

SEQ ID NO: 89573 - DNA, 22 bp, Artificial Sequence
  Description of Artificial Sequence: Synthetic oligonucleotide
gagcccctcggaggagcctcca

SEQ ID NO: 89574 - DNA, 23 bp, Artificial Sequence
  Description of Artificial Sequence: Synthetic oligonucleotide
agcccctcggaggagcctccaga

SEQ ID NO: 89575 - DNA, 22 bp, Artificial Sequence
  Description of Artificial Sequence: Synthetic oligonucleotide
gcccctcggaggagcctccaga

SEQ ID NO: 89576 - DNA, 22 bp, Artificial Sequence
  Description of Artificial Sequence: Synthetic oligonucleotide
cccctcggaggagcctccagag

SEQ ID NO: 89577 - DNA, 23 bp, Artificial Sequence
  Description of Artificial Sequence: Synthetic oligonucleotide
ccctcggaggagcctccagagga

SEQ ID NO: 89578 - DNA, 23 bp, Artificial Sequence
  Description of Artificial Sequence: Synthetic oligonucleotide
cctcggaggagcctccagaggag

SEQ ID NO: 89579 - DNA, 27 bp, Artificial Sequence
  Description of Artificial Sequence: Synthetic oligonucleotide
ctcggaggagcctccagaggaggaaat

SEQ ID NO: 89580 - DNA, 27 bp, Artificial Sequence
  Description of Artificial Sequence: Synthetic oligonucleotide
tcggaggagcctccagaggaggaaatc

SEQ ID NO: 89581 - DNA, 26 bp, Artificial Sequence
  Description of Artificial Sequence: Synthetic oligonucleotide
cggaggagcctccagaggaggaaatc

SEQ ID NO: 89582 - DNA, 26 bp, Artificial Sequence
  Description of Artificial Sequence: Synthetic oligonucleotide
ggaggagcctccagaggaggaaatcc

SEQ ID NO: 89583 - DNA, 26 bp, Artificial Sequence
  Description of Artificial Sequence: Synthetic oligonucleotide
gaggagcctccagaggaggaaatccc

SEQ ID NO: 89584 - DNA, 27 bp, Artificial Sequence
  Description of Artificial Sequence: Synthetic oligonucleotide
aggagcctccagaggaggaaatcccca

SEQ ID NO: 89585 - DNA, 27 bp, Artificial Sequence
  Description of Artificial Sequence: Synthetic oligonucleotide
ggagcctccagaggaggaaatccccaa

SEQ ID NO: 89586 - DNA, 27 bp, Artificial Sequence
  Description of Artificial Sequence: Synthetic oligonucleotide
gagcctccagaggaggaaatccccaag

SEQ ID NO: 89587 - DNA, 27 bp, Artificial Sequence
  Description of Artificial Sequence: Synthetic oligonucleotide
agcctccagaggaggaaatccccaagg

SEQ ID NO: 89588 - DNA, 27 bp, Artificial Sequence
  Description of Artificial Sequence: Synthetic oligonucleotide
gcctccagaggaggaaatccccaagga

SEQ ID NO: 89589 - DNA, 27 bp, Artificial Sequence
  Description of Artificial Sequence: Synthetic oligonucleotide
cctccagaggaggaaatccccaaggag

SEQ ID NO: 89590 - DNA, 27 bp, Artificial Sequence
  Description of Artificial Sequence: Synthetic oligonucleotide
ctccagaggaggaaatccccaaggagg

SEQ ID NO: 89591 - DNA, 29 bp, Artificial Sequence
  Description of Artificial Sequence: Synthetic oligonucleotide
tccagaggaggaaatccccaaggaggatg

SEQ ID NO: 89592 - DNA, 28 bp, Artificial Sequence
  Description of Artificial Sequence: Synthetic oligonucleotide
ccagaggaggaaatccccaaggaggatg

SEQ ID NO: 89593 - DNA, 28 bp, Artificial Sequence
  Description of Artificial Sequence: Synthetic oligonucleotide
cagaggaggaaatccccaaggaggatgg

SEQ ID NO: 89594 - DNA, 28 bp, Artificial Sequence
  Description of Artificial Sequence: Synthetic oligonucleotide
agaggaggaaatccccaaggaggatggg

SEQ ID NO: 89595 - DNA, 27 bp, Artificial Sequence
  Description of Artificial Sequence: Synthetic oligonucleotide
gaggaggaaatccccaaggaggatggg

SEQ ID NO: 89596 - DNA, 29 bp, Artificial Sequence
  Description of Artificial Sequence: Synthetic oligonucleotide
aggaggaaatccccaaggaggatgggatc

SEQ ID NO: 89597 - DNA, 28 bp, Artificial Sequence
  Description of Artificial Sequence: Synthetic oligonucleotide
ggaggaaatccccaaggaggatgggatc

SEQ ID NO: 89598 - DNA, 30 bp, Artificial Sequence
  Description of Artificial Sequence: Synthetic oligonucleotide
gaggaaatccccaaggaggatgggatcttg

SEQ ID NO: 89599 - DNA, 30 bp, Artificial Sequence
  Description of Artificial Sequence: Synthetic oligonucleotide
aggaaatccccaaggaggatgggatcttgg

SEQ ID NO: 89600 - DNA, 29 bp, Artificial Sequence
  Description of Artificial Sequence: Synthetic oligonucleotide
ggaaatccccaaggaggatgggatcttgg

SEQ ID NO: 89601 - DNA, 30 bp, Artificial Sequence
  Description of Artificial Sequence: Synthetic oligonucleotide
gaaatccccaaggaggatgggatcttggtg

SEQ ID NO: 89602 - DNA, 30 bp, Artificial Sequence
  Description of Artificial Sequence: Synthetic oligonucleotide
aaatccccaaggaggatgggatcttggtgc

SEQ ID NO: 89603 - DNA, 29 bp, Artificial Sequence
  Description of Artificial Sequence: Synthetic oligonucleotide
aatccccaaggaggatgggatcttggtgc

SEQ ID NO: 89604 - DNA, 28 bp, Artificial Sequence
  Description of Artificial Sequence: Synthetic oligonucleotide
atccccaaggaggatgggatcttggtgc

SEQ ID NO: 89605 - DNA, 27 bp, Artificial Sequence
  Description of Artificial Sequence: Synthetic oligonucleotide
tccccaaggaggatgggatcttggtgc

SEQ ID NO: 89606 - DNA, 27 bp, Artificial Sequence
  Description of Artificial Sequence: Synthetic oligonucleotide
ccccaaggaggatgggatcttggtgct

SEQ ID NO: 89607 - DNA, 27 bp, Artificial Sequence
  Description of Artificial Sequence: Synthetic oligonucleotide
cccaaggaggatgggatcttggtgctg

SEQ ID NO: 89608 - DNA, 28 bp, Artificial Sequence
  Description of Artificial Sequence: Synthetic oligonucleotide
ccaaggaggatgggatcttggtgctgag

SEQ ID NO: 89609 - DNA, 28 bp, Artificial Sequence
  Description of Artificial Sequence: Synthetic oligonucleotide
caaggaggatgggatcttggtgctgagc

SEQ ID NO: 89610 - DNA, 28 bp, Artificial Sequence
  Description of Artificial Sequence: Synthetic oligonucleotide
aaggaggatgggatcttggtgctgagcc

SEQ ID NO: 89611 - DNA, 27 bp, Artificial Sequence
  Description of Artificial Sequence: Synthetic oligonucleotide
aggaggatgggatcttggtgctgagcc

SEQ ID NO: 89612 - DNA, 26 bp, Artificial Sequence
  Description of Artificial Sequence: Synthetic oligonucleotide
ggaggatgggatcttggtgctgagcc

SEQ ID NO: 89613 - DNA, 26 bp, Artificial Sequence
  Description of Artificial Sequence: Synthetic oligonucleotide
gaggatgggatcttggtgctgagccg

SEQ ID NO: 89614 - DNA, 26 bp, Artificial Sequence
  Description of Artificial Sequence: Synthetic oligonucleotide
aggatgggatcttggtgctgagccgc

SEQ ID NO: 89615 - DNA, 25 bp, Artificial Sequence
  Description of Artificial Sequence: Synthetic oligonucleotide
ggatgggatcttggtgctgagccgc

SEQ ID NO: 89616 - DNA, 26 bp, Artificial Sequence
  Description of Artificial Sequence: Synthetic oligonucleotide
gatgggatcttggtgctgagccgcca

SEQ ID NO: 89617 - DNA, 27 bp, Artificial Sequence
  Description of Artificial Sequence: Synthetic oligonucleotide
atgggatcttggtgctgagccgccaca

SEQ ID NO: 89618 - DNA, 26 bp, Artificial Sequence
  Description of Artificial Sequence: Synthetic oligonucleotide
tgggatcttggtgctgagccgccaca

SEQ ID NO: 89619 - DNA, 25 bp, Artificial Sequence
  Description of Artificial Sequence: Synthetic oligonucleotide
gggatcttggtgctgagccgccaca

SEQ ID NO: 89620 - DNA, 25 bp, Artificial Sequence
  Description of Artificial Sequence: Synthetic oligonucleotide
ggatcttggtgctgagccgccacac

SEQ ID NO: 89621 - DNA, 25 bp, Artificial Sequence
  Description of Artificial Sequence: Synthetic oligonucleotide
gatcttggtgctgagccgccacacc

SEQ ID NO: 89622 - DNA, 26 bp, Artificial Sequence
  Description of Artificial Sequence: Synthetic oligonucleotide
atcttggtgctgagccgccacaccct

SEQ ID NO: 89623 - DNA, 25 bp, Artificial Sequence
  Description of Artificial Sequence: Synthetic oligonucleotide
tcttggtgctgagccgccacaccct

SEQ ID NO: 89624 - DNA, 24 bp, Artificial Sequence
  Description of Artificial Sequence: Synthetic oligonucleotide
cttggtgctgagccgccacaccct

SEQ ID NO: 89625 - DNA, 24 bp, Artificial Sequence
  Description of Artificial Sequence: Synthetic oligonucleotide
ttggtgctgagccgccacaccctg

SEQ ID NO: 89626 - DNA, 23 bp, Artificial Sequence
  Description of Artificial Sequence: Synthetic oligonucleotide
tggtgctgagccgccacaccctg

SEQ ID NO: 89627 - DNA, 22 bp, Artificial Sequence
  Description of Artificial Sequence: Synthetic oligonucleotide
ggtgctgagccgccacaccctg

SEQ ID NO: 89628 - DNA, 22 bp, Artificial Sequence
  Description of Artificial Sequence: Synthetic oligonucleotide
gtgctgagccgccacaccctgg

SEQ ID NO: 89629 - DNA, 22 bp, Artificial Sequence
  Description of Artificial Sequence: Synthetic oligonucleotide
tgctgagccgccacaccctggg

SEQ ID NO: 89630 - DNA, 21 bp, Artificial Sequence
  Description of Artificial Sequence: Synthetic oligonucleotide
gctgagccgccacaccctggg

SEQ ID NO: 89631 - DNA, 21 bp, Artificial Sequence
  Description of Artificial Sequence: Synthetic oligonucleotide
ctgagccgccacaccctgggc

SEQ ID NO: 89632 - DNA, 22 bp, Artificial Sequence
  Description of Artificial Sequence: Synthetic oligonucleotide
tgagccgccacaccctgggcct

SEQ ID NO: 89633 - DNA, 21 bp, Artificial Sequence
  Description of Artificial Sequence: Synthetic oligonucleotide
gagccgccacaccctgggcct

SEQ ID NO: 89634 - DNA, 21 bp, Artificial Sequence
  Description of Artificial Sequence: Synthetic oligonucleotide
agccgccacaccctgggcctg

SEQ ID NO: 89635 - DNA, 20 bp, Artificial Sequence
  Description of Artificial Sequence: Synthetic oligonucleotide
gccgccacaccctgggcctg

SEQ ID NO: 89636 - DNA, 20 bp, Artificial Sequence
  Description of Artificial Sequence: Synthetic oligonucleotide
ccgccacaccctgggcctgg

SEQ ID NO: 89637 - DNA, 20 bp, Artificial Sequence
  Description of Artificial Sequence: Synthetic oligonucleotide
cgccacaccctgggcctggc

SEQ ID NO: 89638 - DNA, 20 bp, Artificial Sequence
  Description of Artificial Sequence: Synthetic oligonucleotide
gccacaccctgggcctggcc

SEQ ID NO: 89639 - DNA, 21 bp, Artificial Sequence
  Description of Artificial Sequence: Synthetic oligonucleotide
ccacaccctgggcctggccct

SEQ ID NO: 89640 - DNA, 21 bp, Artificial Sequence
  Description of Artificial Sequence: Synthetic oligonucleotide
cacaccctgggcctggccctg

SEQ ID NO: 89641 - DNA, 21 bp, Artificial Sequence
  Description of Artificial Sequence: Synthetic oligonucleotide
acaccctgggcctggccctgc

SEQ ID NO: 89642 - DNA, 20 bp, Artificial Sequence
  Description of Artificial Sequence: Synthetic oligonucleotide
caccctgggcctggccctgc

SEQ ID NO: 89643 - DNA, 20 bp, Artificial Sequence
  Description of Artificial Sequence: Synthetic oligonucleotide
accctgggcctggccctgcg

SEQ ID NO: 89644 - DNA, 20 bp, Artificial Sequence
  Description of Artificial Sequence: Synthetic oligonucleotide
ccctgggcctggccctgcgt

SEQ ID NO: 89645 - DNA, 20 bp, Artificial Sequence
  Description of Artificial Sequence: Synthetic oligonucleotide
cctgggcctggccctgcggt

SEQ ID NO: 89646 - DNA, 20 bp, Artificial Sequence
  Description of Artificial Sequence: Synthetic oligonucleotide
ctgggcctggccctgcggga

SEQ ID NO: 89647 - DNA, 20 bp, Artificial Sequence
  Description of Artificial Sequence: Synthetic oligonucleotide
tgggcctggccctgcgggag

SEQ ID NO: 89648 - DNA, 20 bp, Artificial Sequence
  Description of Artificial Sequence: Synthetic oligonucleotide
gggcctggccctgcgggagt

SEQ ID NO: 89649 - DNA, 20 bp, Artificial Sequence
  Description of Artificial Sequence: Synthetic oligonucleotide
ggcctggccctgcgggagca

SEQ ID NO: 89650 - DNA, 20 bp, Artificial Sequence
  Description of Artificial Sequence: Synthetic oligonucleotide
gcctggccctgcgggagcac

SEQ ID NO: 89651 - DNA, 20 bp, Artificial Sequence
  Description of Artificial Sequence: Synthetic oligonucleotide
cctggccctgcgggagcacc

SEQ ID NO: 89652 - DNA, 21 bp, Artificial Sequence
  Description of Artificial Sequence: Synthetic oligonucleotide
ctggccctgcgggagcaccct

SEQ ID NO: 89653 - DNA, 21 bp, Artificial Sequence
  Description of Artificial Sequence: Synthetic oligonucleotide
tggccctgcgggagcaccctg

SEQ ID NO: 89654 - DNA, 20 bp, Artificial Sequence
  Description of Artificial Sequence: Synthetic oligonucleotide
ggccctgcgggagcaccctg

SEQ ID NO: 89655 - DNA, 20 bp, Artificial Sequence
  Description of Artificial Sequence: Synthetic oligonucleotide
gccctgcgggagcaccctgc

SEQ ID NO: 89656 - DNA, 20 bp, Artificial Sequence
  Description of Artificial Sequence: Synthetic oligonucleotide
ccctgcgggagcaccctgcc

SEQ ID NO: 89657 - DNA, 21 bp, Artificial Sequence
  Description of Artificial Sequence: Synthetic oligonucleotide
cctgcgggagcaccctgccct

SEQ ID NO: 89658 - DNA, 21 bp, Artificial Sequence
  Description of Artificial Sequence: Synthetic oligonucleotide
ctgcgggagcaccctgccctg

SEQ ID NO: 89659 - DNA, 22 bp, Artificial Sequence
  Description of Artificial Sequence: Synthetic oligonucleotide
tgcgggagcaccctgccctgct

SEQ ID NO: 89660 - DNA, 21 bp, Artificial Sequence
  Description of Artificial Sequence: Synthetic oligonucleotide
gcgggagcaccctgccctgct

SEQ ID NO: 89661 - DNA, 21 bp, Artificial Sequence
  Description of Artificial Sequence: Synthetic oligonucleotide
cgggagcaccctgccctgctg

SEQ ID NO: 89662 - DNA, 22 bp, Artificial Sequence
  Description of Artificial Sequence: Synthetic oligonucleotide
gggagcaccctgccctgctggt

SEQ ID NO: 89663 - DNA, 22 bp, Artificial Sequence
  Description of Artificial Sequence: Synthetic oligonucleotide
ggagcaccctgccctgctggtg

SEQ ID NO: 89664 - DNA, 26 bp, Artificial Sequence
  Description of Artificial Sequence: Synthetic oligonucleotide
gagcaccctgccctgctggtggaatt

SEQ ID NO: 89665 - DNA, 27 bp, Artificial Sequence
  Description of Artificial Sequence: Synthetic oligonucleotide
agcaccctgccctgctggtggaattct

SEQ ID NO: 89666 - DNA, 27 bp, Artificial Sequence
  Description of Artificial Sequence: Synthetic oligonucleotide
gcaccctgccctgctggtggaattcta

SEQ ID NO: 89667 - DNA, 28 bp, Artificial Sequence
  Description of Artificial Sequence: Synthetic oligonucleotide
caccctgccctgctggtggaattctatg

SEQ ID NO: 89668 - DNA, 28 bp, Artificial Sequence
  Description of Artificial Sequence: Synthetic oligonucleotide
accctgccctgctggtggaattctatgc

SEQ ID NO: 89669 - DNA, 27 bp, Artificial Sequence
  Description of Artificial Sequence: Synthetic oligonucleotide
ccctgccctgctggtggaattctatgc

SEQ ID NO: 89670 - DNA, 27 bp, Artificial Sequence
  Description of Artificial Sequence: Synthetic oligonucleotide
cctgccctgctggtggaattctatgcc

SEQ ID NO: 89671 - DNA, 27 bp, Artificial Sequence
  Description of Artificial Sequence: Synthetic oligonucleotide
ctgccctgctggtggaattctatgccc

SEQ ID NO: 89672 - DNA, 27 bp, Artificial Sequence
  Description of Artificial Sequence: Synthetic oligonucleotide
tgccctgctggtggaattctatgcccc

SEQ ID NO: 89673 - DNA, 26 bp, Artificial Sequence
  Description of Artificial Sequence: Synthetic oligonucleotide
gccctgctggtggaattctatgcccc

SEQ ID NO: 89674 - DNA, 27 bp, Artificial Sequence
  Description of Artificial Sequence: Synthetic oligonucleotide
ccctgctggtggaattctatgccccgt

SEQ ID NO: 89675 - DNA, 27 bp, Artificial Sequence
  Description of Artificial Sequence: Synthetic oligonucleotide
cctgctggtggaattctatgccccgtg

SEQ ID NO: 89676 - DNA, 27 bp, Artificial Sequence
  Description of Artificial Sequence: Synthetic oligonucleotide
ctgctggtggaattctatgccccgtgg

SEQ ID NO: 89677 - DNA, 28 bp, Artificial Sequence
  Description of Artificial Sequence: Synthetic oligonucleotide
tgctggtggaattctatgccccgtggtg

SEQ ID NO: 89678 - DNA, 27 bp, Artificial Sequence
  Description of Artificial Sequence: Synthetic oligonucleotide
gctggtggaattctatgccccgtggtg

SEQ ID NO: 89679 - DNA, 28 bp, Artificial Sequence
  Description of Artificial Sequence: Synthetic oligonucleotide
ctggtggaattctatgccccgtggtgtg

SEQ ID NO: 89680 - DNA, 28 bp, Artificial Sequence
  Description of Artificial Sequence: Synthetic oligonucleotide
tggtggaattctatgccccgtggtgtgg

SEQ ID NO: 89681 - DNA, 27 bp, Artificial Sequence
  Description of Artificial Sequence: Synthetic oligonucleotide
ggtggaattctatgccccgtggtgtgg

SEQ ID NO: 89682 - DNA, 27 bp, Artificial Sequence
  Description of Artificial Sequence: Synthetic oligonucleotide
gtggaattctatgccccgtggtgtggg

SEQ ID NO: 89683 - DNA, 27 bp, Artificial Sequence
  Description of Artificial Sequence: Synthetic oligonucleotide
tggaattctatgccccgtggtgtgggc

SEQ ID NO: 89684 - DNA, 27 bp, Artificial Sequence
  Description of Artificial Sequence: Synthetic oligonucleotide
ggaattctatgccccgtggtgtgggca

SEQ ID NO: 89685 - DNA, 27 bp, Artificial Sequence
  Description of Artificial Sequence: Synthetic oligonucleotide
gaattctatgccccgtggtgtgggcac

SEQ ID NO: 89686 - DNA, 28 bp, Artificial Sequence
  Description of Artificial Sequence: Synthetic oligonucleotide
aattctatgccccgtggtgtgggcactg

SEQ ID NO: 89687 - DNA, 27 bp, Artificial Sequence
  Description of Artificial Sequence: Synthetic oligonucleotide
attctatgccccgtggtgtgggcactg

SEQ ID NO: 89688 - DNA, 26 bp, Artificial Sequence
  Description of Artificial Sequence: Synthetic oligonucleotide
ttctatgccccgtggtgtgggcactg

SEQ ID NO: 89689 - DNA, 25 bp, Artificial Sequence
  Description of Artificial Sequence: Synthetic oligonucleotide
tctatgccccgtggtgtgggcactg

SEQ ID NO: 89690 - DNA, 24 bp, Artificial Sequence
  Description of Artificial Sequence: Synthetic oligonucleotide
ctatgccccgtggtgtgggcactg

SEQ ID NO: 89691 - DNA, 24 bp, Artificial Sequence
  Description of Artificial Sequence: Synthetic oligonucleotide
tatgccccgtggtgtgggcactgc

SEQ ID NO: 89692 - DNA, 23 bp, Artificial Sequence
  Description of Artificial Sequence: Synthetic oligonucleotide
atgccccgtggtgtgggcactgc

SEQ ID NO: 89693 - DNA, 22 bp, Artificial Sequence
  Description of Artificial Sequence: Synthetic oligonucleotide
tgccccgtggtgtgggcactgc

SEQ ID NO: 89694 - DNA, 21 bp, Artificial Sequence
  Description of Artificial Sequence: Synthetic oligonucleotide
gccccgtggtgtgggcactgc

SEQ ID NO: 89695 - DNA, 22 bp, Artificial Sequence
  Description of Artificial Sequence: Synthetic oligonucleotide
ccccgtggtgtgggcactgcca

SEQ ID NO: 89696 - DNA, 22 bp, Artificial Sequence
  Description of Artificial Sequence: Synthetic oligonucleotide
cccgtggtgtgggcactgccag

SEQ ID NO: 89697 - DNA, 22 bp, Artificial Sequence
  Description of Artificial Sequence: Synthetic oligonucleotide
ccgtggtgtgggcactgccagg

SEQ ID NO: 89698 - DNA, 22 bp, Artificial Sequence
  Description of Artificial Sequence: Synthetic oligonucleotide
cgtggtgtgggcactgccaggc

SEQ ID NO: 89699 - DNA, 22 bp, Artificial Sequence
  Description of Artificial Sequence: Synthetic oligonucleotide
gtggtgtgggcactgccaggcc

SEQ ID NO: 89700 - DNA, 23 bp, Artificial Sequence
  Description of Artificial Sequence: Synthetic oligonucleotide
tggtgtgggcactgccaggccct

SEQ ID NO: 89701 - DNA, 22 bp, Artificial Sequence
  Description of Artificial Sequence: Synthetic oligonucleotide
ggtgtgggcactgccaggccct

SEQ ID NO: 89702 - DNA, 22 bp, Artificial Sequence
  Description of Artificial Sequence: Synthetic oligonucleotide
gtgtgggcactgccaggccctg

SEQ ID NO: 89703 - DNA, 22 bp, Artificial Sequence
  Description of Artificial Sequence: Synthetic oligonucleotide
tgtgggcactgccaggccctgg

SEQ ID NO: 89704 - DNA, 21 bp, Artificial Sequence
  Description of Artificial Sequence: Synthetic oligonucleotide
gtgggcactgccaggccctgg

SEQ ID NO: 89705 - DNA, 21 bp, Artificial Sequence
  Description of Artificial Sequence: Synthetic oligonucleotide
tgggcactgccaggccctggc

SEQ ID NO: 89706 - DNA, 20 bp, Artificial Sequence
  Description of Artificial Sequence: Synthetic oligonucleotide
gggcactgccaggccctggc

SEQ ID NO: 89707 - DNA, 20 bp, Artificial Sequence
  Description of Artificial Sequence: Synthetic oligonucleotide
ggcactgccaggccctggcc

SEQ ID NO: 89708 - DNA, 20 bp, Artificial Sequence
  Description of Artificial Sequence: Synthetic oligonucleotide
gcactgccaggccctggccc

SEQ ID NO: 89709 - DNA, 20 bp, Artificial Sequence
  Description of Artificial Sequence: Synthetic oligonucleotide
cactgccaggccctggcccc

SEQ ID NO: 89710 - DNA, 20 bp, Artificial Sequence
  Description of Artificial Sequence: Synthetic oligonucleotide
actgccaggccctggccccc

SEQ ID NO: 89711 - DNA, 20 bp, Artificial Sequence
  Description of Artificial Sequence: Synthetic oligonucleotide
ctgccaggccctggccccct

SEQ ID NO: 89712 - DNA, 20 bp, Artificial Sequence
  Description of Artificial Sequence: Synthetic oligonucleotide
tgccaggccctggcccccga

SEQ ID NO: 89713 - DNA, 20 bp, Artificial Sequence
  Description of Artificial Sequence: Synthetic oligonucleotide
gccaggccctggcccccgat

SEQ ID NO: 89714 - DNA, 21 bp, Artificial Sequence
  Description of Artificial Sequence: Synthetic oligonucleotide
ccaggccctggcccccgagta

SEQ ID NO: 89715 - DNA, 22 bp, Artificial Sequence
  Description of Artificial Sequence: Synthetic oligonucleotide
caggccctggcccccgagtaca

SEQ ID NO: 89716 - DNA, 22 bp, Artificial Sequence
  Description of Artificial Sequence: Synthetic oligonucleotide
aggccctggcccccgagtacag

SEQ ID NO: 89717 - DNA, 21 bp, Artificial Sequence
  Description of Artificial Sequence: Synthetic oligonucleotide
ggccctggcccccgagtacag

SEQ ID NO: 89718 - DNA, 23 bp, Artificial Sequence
  Description of Artificial Sequence: Synthetic oligonucleotide
gccctggcccccgagtacagcaa

SEQ ID NO: 89719 - DNA, 23 bp, Artificial Sequence
  Description of Artificial Sequence: Synthetic oligonucleotide
ccctggcccccgagtacagcaag

SEQ ID NO: 89720 - DNA, 23 bp, Artificial Sequence
  Description of Artificial Sequence: Synthetic oligonucleotide
cctggcccccgagtacagcaagg

SEQ ID NO: 89721 - DNA, 24 bp, Artificial Sequence
  Description of Artificial Sequence: Synthetic oligonucleotide
ctggcccccgagtacagcaaggca

SEQ ID NO: 89722 - DNA, 24 bp, Artificial Sequence
  Description of Artificial Sequence: Synthetic oligonucleotide
tggcccccgagtacagcaaggcag

SEQ ID NO: 89723 - DNA, 23 bp, Artificial Sequence
  Description of Artificial Sequence: Synthetic oligonucleotide
ggcccccgagtacagcaaggcag

SEQ ID NO: 89724 - DNA, 24 bp, Artificial Sequence
  Description of Artificial Sequence: Synthetic oligonucleotide
gcccccgagtacagcaaggcagct

SEQ ID NO: 89725 - DNA, 24 bp, Artificial Sequence
  Description of Artificial Sequence: Synthetic oligonucleotide
cccccgagtacagcaaggcagctg

SEQ ID NO: 89726 - DNA, 24 bp, Artificial Sequence
  Description of Artificial Sequence: Synthetic oligonucleotide
ccccgagtacagcaaggcagctgc

SEQ ID NO: 89727 - DNA, 24 bp, Artificial Sequence
  Description of Artificial Sequence: Synthetic oligonucleotide
cccgagtacagcaaggcagctgcc

SEQ ID NO: 89728 - DNA, 25 bp, Artificial Sequence
  Description of Artificial Sequence: Synthetic oligonucleotide
ccgagtacagcaaggcagctgccgt

SEQ ID NO: 89729 - DNA, 25 bp, Artificial Sequence
  Description of Artificial Sequence: Synthetic oligonucleotide
cgagtacagcaaggcagctgccgtg

SEQ ID NO: 89730 - DNA, 26 bp, Artificial Sequence
  Description of Artificial Sequence: Synthetic oligonucleotide
gagtacagcaaggcagctgccgtgct

SEQ ID NO: 89731 - DNA, 26 bp, Artificial Sequence
  Description of Artificial Sequence: Synthetic oligonucleotide
agtacagcaaggcagctgccgtgctc

SEQ ID NO: 89732 - DNA, 25 bp, Artificial Sequence
  Description of Artificial Sequence: Synthetic oligonucleotide
gtacagcaaggcagctgccgtgctc

SEQ ID NO: 89733 - DNA, 25 bp, Artificial Sequence
  Description of Artificial Sequence: Synthetic oligonucleotide
tacagcaaggcagctgccgtgctcg

SEQ ID NO: 89734 - DNA, 24 bp, Artificial Sequence
  Description of Artificial Sequence: Synthetic oligonucleotide
acagcaaggcagctgccgtgctcg

SEQ ID NO: 89735 - DNA, 23 bp, Artificial Sequence
  Description of Artificial Sequence: Synthetic oligonucleotide
cagcaaggcagctgccgtgctcg

SEQ ID NO: 89736 - DNA, 23 bp, Artificial Sequence
  Description of Artificial Sequence: Synthetic oligonucleotide
agcaaggcagctgccgtgctcgc

SEQ ID NO: 89737 - DNA, 22 bp, Artificial Sequence
  Description of Artificial Sequence: Synthetic oligonucleotide
gcaaggcagctgccgtgctcgc

SEQ ID NO: 89738 - DNA, 22 bp, Artificial Sequence
  Description of Artificial Sequence: Synthetic oligonucleotide
caaggcagctgccgtgctcgcg

SEQ ID NO: 89739 - DNA, 22 bp, Artificial Sequence
  Description of Artificial Sequence: Synthetic oligonucleotide
aaggcagctgccgtgctcgcgg

SEQ ID NO: 89740 - DNA, 21 bp, Artificial Sequence
  Description of Artificial Sequence: Synthetic oligonucleotide
aggcagctgccgtgctcgcgg

SEQ ID NO: 89741 - DNA, 20 bp, Artificial Sequence
  Description of Artificial Sequence: Synthetic oligonucleotide
ggcagctgccgtgctcgcgg

SEQ ID NO: 89742 - DNA, 20 bp, Artificial Sequence
  Description of Artificial Sequence: Synthetic oligonucleotide
gcagctgccgtgctcgcggc

SEQ ID NO: 89743 - DNA, 20 bp, Artificial Sequence
  Description of Artificial Sequence: Synthetic oligonucleotide
cagctgccgtgctcgcggcc

SEQ ID NO: 89744 - DNA, 21 bp, Artificial Sequence
  Description of Artificial Sequence: Synthetic oligonucleotide
agctgccgtgctcgcggccga

SEQ ID NO: 89745 - DNA, 20 bp, Artificial Sequence
  Description of Artificial Sequence: Synthetic oligonucleotide
gctgccgtgctcgcggccga

SEQ ID NO: 89746 - DNA, 21 bp, Artificial Sequence
  Description of Artificial Sequence: Synthetic oligonucleotide
ctgccgtgctcgcggccgagt

SEQ ID NO: 89747 - DNA, 24 bp, Artificial Sequence
  Description of Artificial Sequence: Synthetic oligonucleotide
tgccgtgctcgcggccgagtcaat

SEQ ID NO: 89748 - DNA, 23 bp, Artificial Sequence
  Description of Artificial Sequence: Synthetic oligonucleotide
gccgtgctcgcggccgagtcaat

SEQ ID NO: 89749 - DNA, 23 bp, Artificial Sequence
  Description of Artificial Sequence: Synthetic oligonucleotide
ccgtgctcgcggccgagtcaatg

SEQ ID NO: 89750 - DNA, 24 bp, Artificial Sequence
  Description of Artificial Sequence: Synthetic oligonucleotide
cgtgctcgcggccgagtcaatggt

SEQ ID NO: 89751 - DNA, 24 bp, Artificial Sequence
  Description of Artificial Sequence: Synthetic oligonucleotide
gtgctcgcggccgagtcaatggtg

SEQ ID NO: 89752 - DNA, 25 bp, Artificial Sequence
  Description of Artificial Sequence: Synthetic oligonucleotide
tgctcgcggccgagtcaatggtggt

SEQ ID NO: 89753 - DNA, 24 bp, Artificial Sequence
  Description of Artificial Sequence: Synthetic oligonucleotide
gctcgcggccgagtcaatggtggt

SEQ ID NO: 89754 - DNA, 25 bp, Artificial Sequence
  Description of Artificial Sequence: Synthetic oligonucleotide
ctcgcggccgagtcaatggtggtca

SEQ ID NO: 89755 - DNA, 25 bp, Artificial Sequence
  Description of Artificial Sequence: Synthetic oligonucleotide
tcgcggccgagtcaatggtggtcac

SEQ ID NO: 89756 - DNA, 24 bp, Artificial Sequence
  Description of Artificial Sequence: Synthetic oligonucleotide
cgcggccgagtcaatggtggtcac

SEQ ID NO: 89757 - DNA, 24 bp, Artificial Sequence
  Description of Artificial Sequence: Synthetic oligonucleotide
gcggccgagtcaatggtggtcacg

SEQ ID NO: 89758 - DNA, 25 bp, Artificial Sequence
  Description of Artificial Sequence: Synthetic oligonucleotide
cggccgagtcaatggtggtcacgct

SEQ ID NO: 89759 - DNA, 25 bp, Artificial Sequence
  Description of Artificial Sequence: Synthetic oligonucleotide
ggccgagtcaatggtggtcacgctg

SEQ ID NO: 89760 - DNA, 25 bp, Artificial Sequence
  Description of Artificial Sequence: Synthetic oligonucleotide
gccgagtcaatggtggtcacgctgg

SEQ ID NO: 89761 - DNA, 25 bp, Artificial Sequence
  Description of Artificial Sequence: Synthetic oligonucleotide
ccgagtcaatggtggtcacgctggc

SEQ ID NO: 89762 - DNA, 27 bp, Artificial Sequence
  Description of Artificial Sequence: Synthetic oligonucleotide
cgagtcaatggtggtcacgctggccaa

SEQ ID NO: 89763 - DNA, 27 bp, Artificial Sequence
  Description of Artificial Sequence: Synthetic oligonucleotide
gagtcaatggtggtcacgctggccaag

SEQ ID NO: 89764 - DNA, 27 bp, Artificial Sequence
  Description of Artificial Sequence: Synthetic oligonucleotide
agtcaatggtggtcacgctggccaagg

SEQ ID NO: 89765 - DNA, 27 bp, Artificial Sequence
  Description of Artificial Sequence: Synthetic oligonucleotide
gtcaatggtggtcacgctggccaaggt

SEQ ID NO: 89766 - DNA, 27 bp, Artificial Sequence
  Description of Artificial Sequence: Synthetic oligonucleotide
tcaatggtggtcacgctggccaaggtg

SEQ ID NO: 89767 - DNA, 26 bp, Artificial Sequence
  Description of Artificial Sequence: Synthetic oligonucleotide
caatggtggtcacgctggccaaggtg

SEQ ID NO: 89768 - DNA, 27 bp, Artificial Sequence
  Description of Artificial Sequence: Synthetic oligonucleotide
aatggtggtcacgctggccaaggtgga

SEQ ID NO: 89769 - DNA, 27 bp, Artificial Sequence
  Description of Artificial Sequence: Synthetic oligonucleotide
atggtggtcacgctggccaaggtggat

SEQ ID NO: 89770 - DNA, 26 bp, Artificial Sequence
  Description of Artificial Sequence: Synthetic oligonucleotide
tggtggtcacgctggccaaggtggat

SEQ ID NO: 89771 - DNA, 25 bp, Artificial Sequence
  Description of Artificial Sequence: Synthetic oligonucleotide
ggtggtcacgctggccaaggtggat

SEQ ID NO: 89772 - DNA, 25 bp, Artificial Sequence
  Description of Artificial Sequence: Synthetic oligonucleotide
gtggtcacgctggccaaggtggatg

SEQ ID NO: 89773 - DNA, 25 bp, Artificial Sequence
  Description of Artificial Sequence: Synthetic oligonucleotide
tggtcacgctggccaaggtggatgg

SEQ ID NO: 89774 - DNA, 24 bp, Artificial Sequence
  Description of Artificial Sequence: Synthetic oligonucleotide
ggtcacgctggccaaggtggatgg

SEQ ID NO: 89775 - DNA, 24 bp, Artificial Sequence
  Description of Artificial Sequence: Synthetic oligonucleotide
gtcacgctggccaaggtggatggg

SEQ ID NO: 89776 - DNA, 24 bp, Artificial Sequence
  Description of Artificial Sequence: Synthetic oligonucleotide
tcacgctggccaaggtggatgggc

SEQ ID NO: 89777 - DNA, 23 bp, Artificial Sequence
  Description of Artificial Sequence: Synthetic oligonucleotide
cacgctggccaaggtggatgggc

SEQ ID NO: 89778 - DNA, 23 bp, Artificial Sequence
  Description of Artificial Sequence: Synthetic oligonucleotide
acgctggccaaggtggatgggcc

SEQ ID NO: 89779 - DNA, 22 bp, Artificial Sequence
  Description of Artificial Sequence: Synthetic oligonucleotide
cgctggccaaggtggatgggcc

SEQ ID NO: 89780 - DNA, 22 bp, Artificial Sequence
  Description of Artificial Sequence: Synthetic oligonucleotide
gctggccaaggtggatgggccc

SEQ ID NO: 89781 - DNA, 22 bp, Artificial Sequence
  Description of Artificial Sequence: Synthetic oligonucleotide
ctggccaaggtggatgggcccg

SEQ ID NO: 89782 - DNA, 22 bp, Artificial Sequence
  Description of Artificial Sequence: Synthetic oligonucleotide
tggccaaggtggatgggcccgc

SEQ ID NO: 89783 - DNA, 21 bp, Artificial Sequence
  Description of Artificial Sequence: Synthetic oligonucleotide
ggccaaggtggatgggcccgc

SEQ ID NO: 89784 - DNA, 21 bp, Artificial Sequence
  Description of Artificial Sequence: Synthetic oligonucleotide
gccaaggtggatgggcccgcg

SEQ ID NO: 89785 - DNA, 22 bp, Artificial Sequence
  Description of Artificial Sequence: Synthetic oligonucleotide
ccaaggtggatgggcccgcgca

SEQ ID NO: 89786 - DNA, 22 bp, Artificial Sequence
  Description of Artificial Sequence: Synthetic oligonucleotide
caaggtggatgggcccgcgcag

SEQ ID NO: 89787 - DNA, 22 bp, Artificial Sequence
  Description of Artificial Sequence: Synthetic oligonucleotide
aaggtggatgggcccgcgcagc

SEQ ID NO: 89788 - DNA, 21 bp, Artificial Sequence
  Description of Artificial Sequence: Synthetic oligonucleotide
aggtggatgggcccgcgcagc

SEQ ID NO: 89789 - DNA, 20 bp, Artificial Sequence
  Description of Artificial Sequence: Synthetic oligonucleotide
ggtggatgggcccgcgcagc

SEQ ID NO: 89790 - DNA, 20 bp, Artificial Sequence
  Description of Artificial Sequence: Synthetic oligonucleotide
gtggatgggcccgcgcagcg

SEQ ID NO: 89791 - DNA, 20 bp, Artificial Sequence
  Description of Artificial Sequence: Synthetic oligonucleotide
tggatgggcccgcgcagcgc

SEQ ID NO: 89792 - DNA, 20 bp, Artificial Sequence
  Description of Artificial Sequence: Synthetic oligonucleotide
ggatgggcccgcgcagcgct

SEQ ID NO: 89793 - DNA, 20 bp, Artificial Sequence
  Description of Artificial Sequence: Synthetic oligonucleotide
gatgggcccgcgcagcgcga

SEQ ID NO: 89794 - DNA, 20 bp, Artificial Sequence
  Description of Artificial Sequence: Synthetic oligonucleotide
atgggcccgcgcagcgcgag

SEQ ID NO: 89795 - DNA, 20 bp, Artificial Sequence
  Description of Artificial Sequence: Synthetic oligonucleotide
tgggcccgcgcagcgcgagt

SEQ ID NO: 89796 - DNA, 20 bp, Artificial Sequence
  Description of Artificial Sequence: Synthetic oligonucleotide
gggcccgcgcagcgcgagtt

SEQ ID NO: 89797 - DNA, 20 bp, Artificial Sequence
  Description of Artificial Sequence: Synthetic oligonucleotide
ggcccgcgcagcgcgagctt

SEQ ID NO: 89798 - DNA, 20 bp, Artificial Sequence
  Description of Artificial Sequence: Synthetic oligonucleotide
gcccgcgcagcgcgagctgt

SEQ ID NO: 89799 - DNA, 20 bp, Artificial Sequence
  Description of Artificial Sequence: Synthetic oligonucleotide
cccgcgcagcgcgagctggt

SEQ ID NO: 89800 - DNA, 20 bp, Artificial Sequence
  Description of Artificial Sequence: Synthetic oligonucleotide
ccgcgcagcgcgagctggct

SEQ ID NO: 89801 - DNA, 21 bp, Artificial Sequence
  Description of Artificial Sequence: Synthetic oligonucleotide
cgcgcagcgcgagctggctga

SEQ ID NO: 89802 - DNA, 21 bp, Artificial Sequence
  Description of Artificial Sequence: Synthetic oligonucleotide
gcgcagcgcgagctggctgag

SEQ ID NO: 89803 - DNA, 22 bp, Artificial Sequence
  Description of Artificial Sequence: Synthetic oligonucleotide
cgcagcgcgagctggctgagga

SEQ ID NO: 89804 - DNA, 25 bp, Artificial Sequence
  Description of Artificial Sequence: Synthetic oligonucleotide
gcagcgcgagctggctgaggagttt

SEQ ID NO: 89805 - DNA, 25 bp, Artificial Sequence
  Description of Artificial Sequence: Synthetic oligonucleotide
cagcgcgagctggctgaggagtttg

SEQ ID NO: 89806 - DNA, 26 bp, Artificial Sequence
  Description of Artificial Sequence: Synthetic oligonucleotide
agcgcgagctggctgaggagtttggt

SEQ ID NO: 89807 - DNA, 25 bp, Artificial Sequence
  Description of Artificial Sequence: Synthetic oligonucleotide
gcgcgagctggctgaggagtttggt

SEQ ID NO: 89808 - DNA, 26 bp, Artificial Sequence
  Description of Artificial Sequence: Synthetic oligonucleotide
cgcgagctggctgaggagtttggtgt

SEQ ID NO: 89809 - DNA, 27 bp, Artificial Sequence
  Description of Artificial Sequence: Synthetic oligonucleotide
gcgagctggctgaggagtttggtgtga

SEQ ID NO: 89810 - DNA, 27 bp, Artificial Sequence
  Description of Artificial Sequence: Synthetic oligonucleotide
cgagctggctgaggagtttggtgtgac

SEQ ID NO: 89811 - DNA, 27 bp, Artificial Sequence
  Description of Artificial Sequence: Synthetic oligonucleotide
gagctggctgaggagtttggtgtgacg

SEQ ID NO: 89812 - DNA, 27 bp, Artificial Sequence
  Description of Artificial Sequence: Synthetic oligonucleotide
agctggctgaggagtttggtgtgacgg

SEQ ID NO: 89813 - DNA, 27 bp, Artificial Sequence
  Description of Artificial Sequence: Synthetic oligonucleotide
gctggctgaggagtttggtgtgacgga

SEQ ID NO: 89814 - DNA, 27 bp, Artificial Sequence
  Description of Artificial Sequence: Synthetic oligonucleotide
ctggctgaggagtttggtgtgacggag

SEQ ID NO: 89815 - DNA, 29 bp, Artificial Sequence
  Description of Artificial Sequence: Synthetic oligonucleotide
tggctgaggagtttggtgtgacggagtac

SEQ ID NO: 89816 - DNA, 28 bp, Artificial Sequence
  Description of Artificial Sequence: Synthetic oligonucleotide
ggctgaggagtttggtgtgacggagtac

SEQ ID NO: 89817 - DNA, 28 bp, Artificial Sequence
  Description of Artificial Sequence: Synthetic oligonucleotide
gctgaggagtttggtgtgacggagtacc

SEQ ID NO: 89818 - DNA, 28 bp, Artificial Sequence
  Description of Artificial Sequence: Synthetic oligonucleotide
ctgaggagtttggtgtgacggagtaccc

SEQ ID NO: 89819 - DNA, 30 bp, Artificial Sequence
  Description of Artificial Sequence: Synthetic oligonucleotide
tgaggagtttggtgtgacggagtaccctac

SEQ ID NO: 89820 - DNA, 29 bp, Artificial Sequence
  Description of Artificial Sequence: Synthetic oligonucleotide
gaggagtttggtgtgacggagtaccctac

SEQ ID NO: 89821 - DNA, 29 bp, Artificial Sequence
  Description of Artificial Sequence: Synthetic oligonucleotide
aggagtttggtgtgacggagtaccctacg

SEQ ID NO: 89822 - DNA, 28 bp, Artificial Sequence
  Description of Artificial Sequence: Synthetic oligonucleotide
ggagtttggtgtgacggagtaccctacg

SEQ ID NO: 89823 - DNA, 28 bp, Artificial Sequence
  Description of Artificial Sequence: Synthetic oligonucleotide
gagtttggtgtgacggagtaccctacgc

SEQ ID NO: 89824 - DNA, 29 bp, Artificial Sequence
  Description of Artificial Sequence: Synthetic oligonucleotide
agtttggtgtgacggagtaccctacgctc

SEQ ID NO: 89825 - DNA, 28 bp, Artificial Sequence
  Description of Artificial Sequence: Synthetic oligonucleotide
gtttggtgtgacggagtaccctacgctc

SEQ ID NO: 89826 - DNA, 30 bp, Artificial Sequence
  Description of Artificial Sequence: Synthetic oligonucleotide
tttggtgtgacggagtaccctacgctcaag

SEQ ID NO: 89827 - DNA, 29 bp, Artificial Sequence
  Description of Artificial Sequence: Synthetic oligonucleotide
ttggtgtgacggagtaccctacgctcaag

SEQ ID NO: 89828 - DNA, 28 bp, Artificial Sequence
  Description of Artificial Sequence: Synthetic oligonucleotide
tggtgtgacggagtaccctacgctcaag

SEQ ID NO: 89829 - DNA, 27 bp, Artificial Sequence
  Description of Artificial Sequence: Synthetic oligonucleotide
ggtgtgacggagtaccctacgctcaag

SEQ ID NO: 89830 - DNA, 29 bp, Artificial Sequence
  Description of Artificial Sequence: Synthetic oligonucleotide
gtgtgacggagtaccctacgctcaagttc

SEQ ID NO: 89831 - DNA, 31 bp, Artificial Sequence
  Description of Artificial Sequence: Synthetic oligonucleotide
tgtgacggagtaccctacgctcaagttcttc

SEQ ID NO: 89832 - DNA, 30 bp, Artificial Sequence
  Description of Artificial Sequence: Synthetic oligonucleotide
gtgacggagtaccctacgctcaagttcttc

SEQ ID NO: 89833 - DNA, 30 bp, Artificial Sequence
  Description of Artificial Sequence: Synthetic oligonucleotide
tgacggagtaccctacgctcaagttcttcc

SEQ ID NO: 89834 - DNA, 29 bp, Artificial Sequence
  Description of Artificial Sequence: Synthetic oligonucleotide
gacggagtaccctacgctcaagttcttcc

SEQ ID NO: 89835 - DNA, 29 bp, Artificial Sequence
  Description of Artificial Sequence: Synthetic oligonucleotide
acggagtaccctacgctcaagttcttccg

SEQ ID NO: 89836 - DNA, 28 bp, Artificial Sequence
  Description of Artificial Sequence: Synthetic oligonucleotide
cggagtaccctacgctcaagttcttccg

SEQ ID NO: 89837 - DNA, 28 bp, Artificial Sequence
  Description of Artificial Sequence: Synthetic oligonucleotide
ggagtaccctacgctcaagttcttccgc

SEQ ID NO: 89838 - DNA, 31 bp, Artificial Sequence
  Description of Artificial Sequence: Synthetic oligonucleotide
gagtaccctacgctcaagttcttccgcaatg

SEQ ID NO: 89839 - DNA, 31 bp, Artificial Sequence
  Description of Artificial Sequence: Synthetic oligonucleotide
agtaccctacgctcaagttcttccgcaatgg

SEQ ID NO: 89840 - DNA, 30 bp, Artificial Sequence
  Description of Artificial Sequence: Synthetic oligonucleotide
gtaccctacgctcaagttcttccgcaatgg

SEQ ID NO: 89841 - DNA, 30 bp, Artificial Sequence
  Description of Artificial Sequence: Synthetic oligonucleotide
taccctacgctcaagttcttccgcaatggg

SEQ ID NO: 89842 - DNA, 29 bp, Artificial Sequence
  Description of Artificial Sequence: Synthetic oligonucleotide
accctacgctcaagttcttccgcaatggg

SEQ ID NO: 89843 - DNA, 28 bp, Artificial Sequence
  Description of Artificial Sequence: Synthetic oligonucleotide
ccctacgctcaagttcttccgcaatggg

SEQ ID NO: 89844 - DNA, 30 bp, Artificial Sequence
  Description of Artificial Sequence: Synthetic oligonucleotide
cctacgctcaagttcttccgcaatgggaac

SEQ ID NO: 89845 - DNA, 30 bp, Artificial Sequence
  Description of Artificial Sequence: Synthetic oligonucleotide
ctacgctcaagttcttccgcaatgggaacc

SEQ ID NO: 89846 - DNA, 30 bp, Artificial Sequence
  Description of Artificial Sequence: Synthetic oligonucleotide
tacgctcaagttcttccgcaatgggaaccg

SEQ ID NO: 89847 - DNA, 29 bp, Artificial Sequence
  Description of Artificial Sequence: Synthetic oligonucleotide
acgctcaagttcttccgcaatgggaaccg

SEQ ID NO: 89848 - DNA, 28 bp, Artificial Sequence
  Description of Artificial Sequence: Synthetic oligonucleotide
cgctcaagttcttccgcaatgggaaccg

SEQ ID NO: 89849 - DNA, 28 bp, Artificial Sequence
  Description of Artificial Sequence: Synthetic oligonucleotide
gctcaagttcttccgcaatgggaaccgc

SEQ ID NO: 89850 - DNA, 29 bp, Artificial Sequence
  Description of Artificial Sequence: Synthetic oligonucleotide
ctcaagttcttccgcaatgggaaccgcac

SEQ ID NO: 89851 - DNA, 29 bp, Artificial Sequence
  Description of Artificial Sequence: Synthetic oligonucleotide
tcaagttcttccgcaatgggaaccgcacg

SEQ ID NO: 89852 - DNA, 28 bp, Artificial Sequence
  Description of Artificial Sequence: Synthetic oligonucleotide
caagttcttccgcaatgggaaccgcacg

SEQ ID NO: 89853 - DNA, 28 bp, Artificial Sequence
  Description of Artificial Sequence: Synthetic oligonucleotide
aagttcttccgcaatgggaaccgcacgc

SEQ ID NO: 89854 - DNA, 27 bp, Artificial Sequence
  Description of Artificial Sequence: Synthetic oligonucleotide
agttcttccgcaatgggaaccgcacgc

SEQ ID NO: 89855 - DNA, 27 bp, Artificial Sequence
  Description of Artificial Sequence: Synthetic oligonucleotide
gttcttccgcaatgggaaccgcacgca

SEQ ID NO: 89856 - DNA, 27 bp, Artificial Sequence
  Description of Artificial Sequence: Synthetic oligonucleotide
ttcttccgcaatgggaaccgcacgcac

SEQ ID NO: 89857 - DNA, 26 bp, Artificial Sequence
  Description of Artificial Sequence: Synthetic oligonucleotide
tcttccgcaatgggaaccgcacgcac

SEQ ID NO: 89858 - DNA, 25 bp, Artificial Sequence
  Description of Artificial Sequence: Synthetic oligonucleotide
cttccgcaatgggaaccgcacgcac

SEQ ID NO: 89859 - DNA, 25 bp, Artificial Sequence
  Description of Artificial Sequence: Synthetic oligonucleotide
ttccgcaatgggaaccgcacgcacc

SEQ ID NO: 89860 - DNA, 24 bp, Artificial Sequence
  Description of Artificial Sequence: Synthetic oligonucleotide
tccgcaatgggaaccgcacgcacc

SEQ ID NO: 89861 - DNA, 23 bp, Artificial Sequence
  Description of Artificial Sequence: Synthetic oligonucleotide
ccgcaatgggaaccgcacgcacc

SEQ ID NO: 89862 - DNA, 23 bp, Artificial Sequence
  Description of Artificial Sequence: Synthetic oligonucleotide
cgcaatgggaaccgcacgcaccc

SEQ ID NO: 89863 - DNA, 23 bp, Artificial Sequence
  Description of Artificial Sequence: Synthetic oligonucleotide
gcaatgggaaccgcacgcacccg

SEQ ID NO: 89864 - DNA, 24 bp, Artificial Sequence
  Description of Artificial Sequence: Synthetic oligonucleotide
caatgggaaccgcacgcacccgga

SEQ ID NO: 89865 - DNA, 24 bp, Artificial Sequence
  Description of Artificial Sequence: Synthetic oligonucleotide
aatgggaaccgcacgcacccggag

SEQ ID NO: 89866 - DNA, 23 bp, Artificial Sequence
  Description of Artificial Sequence: Synthetic oligonucleotide
atgggaaccgcacgcacccggag

SEQ ID NO: 89867 - DNA, 22 bp, Artificial Sequence
  Description of Artificial Sequence: Synthetic oligonucleotide
tgggaaccgcacgcacccggag

SEQ ID NO: 89868 - DNA, 21 bp, Artificial Sequence
  Description of Artificial Sequence: Synthetic oligonucleotide
gggaaccgcacgcacccggag

SEQ ID NO: 89869 - DNA, 22 bp, Artificial Sequence
  Description of Artificial Sequence: Synthetic oligonucleotide
ggaaccgcacgcacccggagga

SEQ ID NO: 89870 - DNA, 24 bp, Artificial Sequence
  Description of Artificial Sequence: Synthetic oligonucleotide
gaaccgcacgcacccggaggagta

SEQ ID NO: 89871 - DNA, 25 bp, Artificial Sequence
  Description of Artificial Sequence: Synthetic oligonucleotide
aaccgcacgcacccggaggagtaca

SEQ ID NO: 89872 - DNA, 24 bp, Artificial Sequence
  Description of Artificial Sequence: Synthetic oligonucleotide
accgcacgcacccggaggagtaca

SEQ ID NO: 89873 - DNA, 23 bp, Artificial Sequence
  Description of Artificial Sequence: Synthetic oligonucleotide
ccgcacgcacccggaggagtaca

SEQ ID NO: 89874 - DNA, 24 bp, Artificial Sequence
  Description of Artificial Sequence: Synthetic oligonucleotide
cgcacgcacccggaggagtacaca

SEQ ID NO: 89875 - DNA, 24 bp, Artificial Sequence
  Description of Artificial Sequence: Synthetic oligonucleotide
gcacgcacccggaggagtacacag

SEQ ID NO: 89876 - DNA, 25 bp, Artificial Sequence
  Description of Artificial Sequence: Synthetic oligonucleotide
cacgcacccggaggagtacacagga

SEQ ID NO: 89877 - DNA, 25 bp, Artificial Sequence
  Description of Artificial Sequence: Synthetic oligonucleotide
acgcacccggaggagtacacaggac

SEQ ID NO: 89878 - DNA, 24 bp, Artificial Sequence
  Description of Artificial Sequence: Synthetic oligonucleotide
cgcacccggaggagtacacaggac

SEQ ID NO: 89879 - DNA, 25 bp, Artificial Sequence
  Description of Artificial Sequence: Synthetic oligonucleotide
gcacccggaggagtacacaggacca

SEQ ID NO: 89880 - DNA, 25 bp, Artificial Sequence
  Description of Artificial Sequence: Synthetic oligonucleotide
cacccggaggagtacacaggaccac

SEQ ID NO: 89881 - DNA, 25 bp, Artificial Sequence
  Description of Artificial Sequence: Synthetic oligonucleotide
acccggaggagtacacaggaccacg

SEQ ID NO: 89882 - DNA, 24 bp, Artificial Sequence
  Description of Artificial Sequence: Synthetic oligonucleotide
cccggaggagtacacaggaccacg

SEQ ID NO: 89883 - DNA, 24 bp, Artificial Sequence
  Description of Artificial Sequence: Synthetic oligonucleotide
ccggaggagtacacaggaccacgg

SEQ ID NO: 89884 - DNA, 25 bp, Artificial Sequence
  Description of Artificial Sequence: Synthetic oligonucleotide
cggaggagtacacaggaccacggga

SEQ ID NO: 89885 - DNA, 25 bp, Artificial Sequence
  Description of Artificial Sequence: Synthetic oligonucleotide
ggaggagtacacaggaccacgggac

SEQ ID NO: 89886 - DNA, 25 bp, Artificial Sequence
  Description of Artificial Sequence: Synthetic oligonucleotide
gaggagtacacaggaccacgggacg

SEQ ID NO: 89887 - DNA, 26 bp, Artificial Sequence
  Description of Artificial Sequence: Synthetic oligonucleotide
aggagtacacaggaccacgggacgct

SEQ ID NO: 89888 - DNA, 25 bp, Artificial Sequence
  Description of Artificial Sequence: Synthetic oligonucleotide
ggagtacacaggaccacgggacgct

SEQ ID NO: 89889 - DNA, 26 bp, Artificial Sequence
  Description of Artificial Sequence: Synthetic oligonucleotide
gagtacacaggaccacgggacgctga

SEQ ID NO: 89890 - DNA, 26 bp, Artificial Sequence
  Description of Artificial Sequence: Synthetic oligonucleotide
agtacacaggaccacgggacgctgag

SEQ ID NO: 89891 - DNA, 25 bp, Artificial Sequence
  Description of Artificial Sequence: Synthetic oligonucleotide
gtacacaggaccacgggacgctgag

SEQ ID NO: 89892 - DNA, 25 bp, Artificial Sequence
  Description of Artificial Sequence: Synthetic oligonucleotide
tacacaggaccacgggacgctgagg

SEQ ID NO: 89893 - DNA, 24 bp, Artificial Sequence
  Description of Artificial Sequence: Synthetic oligonucleotide
acacaggaccacgggacgctgagg

SEQ ID NO: 89894 - DNA, 23 bp, Artificial Sequence
  Description of Artificial Sequence: Synthetic oligonucleotide
cacaggaccacgggacgctgagg

SEQ ID NO: 89895 - DNA, 23 bp, Artificial Sequence
  Description of Artificial Sequence: Synthetic oligonucleotide
acaggaccacgggacgctgaggg

SEQ ID NO: 89896 - DNA, 22 bp, Artificial Sequence
  Description of Artificial Sequence: Synthetic oligonucleotide
caggaccacgggacgctgaggg

SEQ ID NO: 89897 - DNA, 25 bp, Artificial Sequence
  Description of Artificial Sequence: Synthetic oligonucleotide
aggaccacgggacgctgagggcatt

SEQ ID NO: 89898 - DNA, 24 bp, Artificial Sequence
  Description of Artificial Sequence: Synthetic oligonucleotide
ggaccacgggacgctgagggcatt

SEQ ID NO: 89899 - DNA, 24 bp, Artificial Sequence
  Description of Artificial Sequence: Synthetic oligonucleotide
gaccacgggacgctgagggcattg

SEQ ID NO: 89900 - DNA, 24 bp, Artificial Sequence
  Description of Artificial Sequence: Synthetic oligonucleotide
accacgggacgctgagggcattgc

SEQ ID NO: 89901 - DNA, 23 bp, Artificial Sequence
  Description of Artificial Sequence: Synthetic oligonucleotide
ccacgggacgctgagggcattgc

SEQ ID NO: 89902 - DNA, 23 bp, Artificial Sequence
  Description of Artificial Sequence: Synthetic oligonucleotide
cacgggacgctgagggcattgcc

SEQ ID NO: 89903 - DNA, 24 bp, Artificial Sequence
  Description of Artificial Sequence: Synthetic oligonucleotide
acgggacgctgagggcattgccga

SEQ ID NO: 89904 - DNA, 23 bp, Artificial Sequence
  Description of Artificial Sequence: Synthetic oligonucleotide
cgggacgctgagggcattgccga

SEQ ID NO: 89905 - DNA, 24 bp, Artificial Sequence
  Description of Artificial Sequence: Synthetic oligonucleotide
gggacgctgagggcattgccgagt

SEQ ID NO: 89906 - DNA, 24 bp, Artificial Sequence
  Description of Artificial Sequence: Synthetic oligonucleotide
ggacgctgagggcattgccgagtg

SEQ ID NO: 89907 - DNA, 24 bp, Artificial Sequence
  Description of Artificial Sequence: Synthetic oligonucleotide
gacgctgagggcattgccgagtgg

SEQ ID NO: 89908 - DNA, 25 bp, Artificial Sequence
  Description of Artificial Sequence: Synthetic oligonucleotide
acgctgagggcattgccgagtggct

SEQ ID NO: 89909 - DNA, 24 bp, Artificial Sequence
  Description of Artificial Sequence: Synthetic oligonucleotide
cgctgagggcattgccgagtggct

SEQ ID NO: 89910 - DNA, 24 bp, Artificial Sequence
  Description of Artificial Sequence: Synthetic oligonucleotide
gctgagggcattgccgagtggctg

SEQ ID NO: 89911 - DNA, 24 bp, Artificial Sequence
  Description of Artificial Sequence: Synthetic oligonucleotide
ctgagggcattgccgagtggctgc

SEQ ID NO: 89912 - DNA, 25 bp, Artificial Sequence
  Description of Artificial Sequence: Synthetic oligonucleotide
tgagggcattgccgagtggctgcga

SEQ ID NO: 89913 - DNA, 24 bp, Artificial Sequence
  Description of Artificial Sequence: Synthetic oligonucleotide
gagggcattgccgagtggctgcga

SEQ ID NO: 89914 - DNA, 24 bp, Artificial Sequence
  Description of Artificial Sequence: Synthetic oligonucleotide
agggcattgccgagtggctgcgac

SEQ ID NO: 89915 - DNA, 23 bp, Artificial Sequence
  Description of Artificial Sequence: Synthetic oligonucleotide
gggcattgccgagtggctgcgac

SEQ ID NO: 89916 - DNA, 23 bp, Artificial Sequence
  Description of Artificial Sequence: Synthetic oligonucleotide
ggcattgccgagtggctgcgacg

SEQ ID NO: 89917 - DNA, 23 bp, Artificial Sequence
  Description of Artificial Sequence: Synthetic oligonucleotide
gcattgccgagtggctgcgacgg

SEQ ID NO: 89918 - DNA, 23 bp, Artificial Sequence
  Description of Artificial Sequence: Synthetic oligonucleotide
cattgccgagtggctgcgacggc

SEQ ID NO: 89919 - DNA, 23 bp, Artificial Sequence
  Description of Artificial Sequence: Synthetic oligonucleotide
attgccgagtggctgcgacggcg

SEQ ID NO: 89920 - DNA, 22 bp, Artificial Sequence
  Description of Artificial Sequence: Synthetic oligonucleotide
ttgccgagtggctgcgacggcg

SEQ ID NO: 89921 - DNA, 21 bp, Artificial Sequence
  Description of Artificial Sequence: Synthetic oligonucleotide
tgccgagtggctgcgacggcg

SEQ ID NO: 89922 - DNA, 20 bp, Artificial Sequence
  Description of Artificial Sequence: Synthetic oligonucleotide
gccgagtggctgcgacggcg

SEQ ID NO: 89923 - DNA, 20 bp, Artificial Sequence
  Description of Artificial Sequence: Synthetic oligonucleotide
ccgagtggctgcgacggcgg

SEQ ID NO: 89924 - DNA, 21 bp, Artificial Sequence
  Description of Artificial Sequence: Synthetic oligonucleotide
cgagtggctgcgacggcgggt

SEQ ID NO: 89925 - DNA, 21 bp, Artificial Sequence
  Description of Artificial Sequence: Synthetic oligonucleotide
gagtggctgcgacggcgggtg

SEQ ID NO: 89926 - DNA, 21 bp, Artificial Sequence
  Description of Artificial Sequence: Synthetic oligonucleotide
agtggctgcgacggcgggtgg

SEQ ID NO: 89927 - DNA, 20 bp, Artificial Sequence
  Description of Artificial Sequence: Synthetic oligonucleotide
gtggctgcgacggcgggtgg

SEQ ID NO: 89928 - DNA, 20 bp, Artificial Sequence
  Description of Artificial Sequence: Synthetic oligonucleotide
tggctgcgacggcgggtggg

SEQ ID NO: 89929 - DNA, 20 bp, Artificial Sequence
  Description of Artificial Sequence: Synthetic oligonucleotide
ggctgcgacggcgggtgggt

SEQ ID NO: 89930 - DNA, 20 bp, Artificial Sequence
  Description of Artificial Sequence: Synthetic oligonucleotide
gctgcgacggcgggtggggt

SEQ ID NO: 89931 - DNA, 20 bp, Artificial Sequence
  Description of Artificial Sequence: Synthetic oligonucleotide
ctgcgacggcgggtggggct

SEQ ID NO: 89932 - DNA, 20 bp, Artificial Sequence
  Description of Artificial Sequence: Synthetic oligonucleotide
tgcgacggcgggtggggcct

SEQ ID NO: 89933 - DNA, 20 bp, Artificial Sequence
  Description of Artificial Sequence: Synthetic oligonucleotide
gcgacggcgggtggggcctt

SEQ ID NO: 89934 - DNA, 20 bp, Artificial Sequence
  Description of Artificial Sequence: Synthetic oligonucleotide
cgacggcgggtggggcccat

SEQ ID NO: 89935 - DNA, 20 bp, Artificial Sequence
  Description of Artificial Sequence: Synthetic oligonucleotide
gacggcgggtggggcccagt

SEQ ID NO: 89936 - DNA, 20 bp, Artificial Sequence
  Description of Artificial Sequence: Synthetic oligonucleotide
acggcgggtggggcccagtg

SEQ ID NO: 89937 - DNA, 20 bp, Artificial Sequence
  Description of Artificial Sequence: Synthetic oligonucleotide
cggcgggtggggcccagtgt

SEQ ID NO: 89938 - DNA, 20 bp, Artificial Sequence
  Description of Artificial Sequence: Synthetic oligonucleotide
ggcgggtggggcccagtgct

SEQ ID NO: 89939 - DNA, 21 bp, Artificial Sequence
  Description of Artificial Sequence: Synthetic oligonucleotide
gcgggtggggcccagtgccat

SEQ ID NO: 89940 - DNA, 21 bp, Artificial Sequence
  Description of Artificial Sequence: Synthetic oligonucleotide
cgggtggggcccagtgccatg

SEQ ID NO: 89941 - DNA, 21 bp, Artificial Sequence
  Description of Artificial Sequence: Synthetic oligonucleotide
gggtggggcccagtgccatgc

SEQ ID NO: 89942 - DNA, 21 bp, Artificial Sequence
  Description of Artificial Sequence: Synthetic oligonucleotide
ggtggggcccagtgccatgcg

SEQ ID NO: 89943 - DNA, 21 bp, Artificial Sequence
  Description of Artificial Sequence: Synthetic oligonucleotide
gtggggcccagtgccatgcgg

SEQ ID NO: 89944 - DNA, 22 bp, Artificial Sequence
  Description of Artificial Sequence: Synthetic oligonucleotide
tggggcccagtgccatgcggct

SEQ ID NO: 89945 - DNA, 21 bp, Artificial Sequence
  Description of Artificial Sequence: Synthetic oligonucleotide
ggggcccagtgccatgcggct

SEQ ID NO: 89946 - DNA, 21 bp, Artificial Sequence
  Description of Artificial Sequence: Synthetic oligonucleotide
gggcccagtgccatgcggctg

SEQ ID NO: 89947 - DNA, 22 bp, Artificial Sequence
  Description of Artificial Sequence: Synthetic oligonucleotide
ggcccagtgccatgcggctgga

SEQ ID NO: 89948 - DNA, 22 bp, Artificial Sequence
  Description of Artificial Sequence: Synthetic oligonucleotide
gcccagtgccatgcggctggag

SEQ ID NO: 89949 - DNA, 23 bp, Artificial Sequence
  Description of Artificial Sequence: Synthetic oligonucleotide
cccagtgccatgcggctggagga

SEQ ID NO: 89950 - DNA, 23 bp, Artificial Sequence
  Description of Artificial Sequence: Synthetic oligonucleotide
ccagtgccatgcggctggaggac

SEQ ID NO: 89951 - DNA, 24 bp, Artificial Sequence
  Description of Artificial Sequence: Synthetic oligonucleotide
cagtgccatgcggctggaggacga

SEQ ID NO: 89952 - DNA, 24 bp, Artificial Sequence
  Description of Artificial Sequence: Synthetic oligonucleotide
agtgccatgcggctggaggacgag

SEQ ID NO: 89953 - DNA, 23 bp, Artificial Sequence
  Description of Artificial Sequence: Synthetic oligonucleotide
gtgccatgcggctggaggacgag

SEQ ID NO: 89954 - DNA, 23 bp, Artificial Sequence
  Description of Artificial Sequence: Synthetic oligonucleotide
tgccatgcggctggaggacgagg

SEQ ID NO: 89955 - DNA, 22 bp, Artificial Sequence
  Description of Artificial Sequence: Synthetic oligonucleotide
gccatgcggctggaggacgagg

SEQ ID NO: 89956 - DNA, 22 bp, Artificial Sequence
  Description of Artificial Sequence: Synthetic oligonucleotide
ccatgcggctggaggacgaggc

SEQ ID NO: 89957 - DNA, 22 bp, Artificial Sequence
  Description of Artificial Sequence: Synthetic oligonucleotide
catgcggctggaggacgaggcg

SEQ ID NO: 89958 - DNA, 22 bp, Artificial Sequence
  Description of Artificial Sequence: Synthetic oligonucleotide
atgcggctggaggacgaggcgg

SEQ ID NO: 89959 - DNA, 21 bp, Artificial Sequence
  Description of Artificial Sequence: Synthetic oligonucleotide
tgcggctggaggacgaggcgg

SEQ ID NO: 89960 - DNA, 20 bp, Artificial Sequence
  Description of Artificial Sequence: Synthetic oligonucleotide
gcggctggaggacgaggcgg

SEQ ID NO: 89961 - DNA, 20 bp, Artificial Sequence
  Description of Artificial Sequence: Synthetic oligonucleotide
cggctggaggacgaggcggc

SEQ ID NO: 89962 - DNA, 20 bp, Artificial Sequence
  Description of Artificial Sequence: Synthetic oligonucleotide
ggctggaggacgaggcggcc

SEQ ID NO: 89963 - DNA, 20 bp, Artificial Sequence
  Description of Artificial Sequence: Synthetic oligonucleotide
gctggaggacgaggcggccg

SEQ ID NO: 89964 - DNA, 20 bp, Artificial Sequence
  Description of Artificial Sequence: Synthetic oligonucleotide
ctggaggacgaggcggccgc

SEQ ID NO: 89965 - DNA, 20 bp, Artificial Sequence
  Description of Artificial Sequence: Synthetic oligonucleotide
tggaggacgaggcggccgcc

SEQ ID NO: 89966 - DNA, 20 bp, Artificial Sequence
  Description of Artificial Sequence: Synthetic oligonucleotide
ggaggacgaggcggccgcct

SEQ ID NO: 89967 - DNA, 20 bp, Artificial Sequence
  Description of Artificial Sequence: Synthetic oligonucleotide
gaggacgaggcggccgccca

SEQ ID NO: 89968 - DNA, 20 bp, Artificial Sequence
  Description of Artificial Sequence: Synthetic oligonucleotide
aggacgaggcggccgcccag

SEQ ID NO: 89969 - DNA, 20 bp, Artificial Sequence
  Description of Artificial Sequence: Synthetic oligonucleotide
ggacgaggcggccgcccagt

SEQ ID NO: 89970 - DNA, 20 bp, Artificial Sequence
  Description of Artificial Sequence: Synthetic oligonucleotide
gacgaggcggccgcccaggt

SEQ ID NO: 89971 - DNA, 20 bp, Artificial Sequence
  Description of Artificial Sequence: Synthetic oligonucleotide
acgaggcggccgcccaggct

SEQ ID NO: 89972 - DNA, 20 bp, Artificial Sequence
  Description of Artificial Sequence: Synthetic oligonucleotide
cgaggcggccgcccaggctt

SEQ ID NO: 89973 - DNA, 20 bp, Artificial Sequence
  Description of Artificial Sequence: Synthetic oligonucleotide
gaggcggccgcccaggcgtt

SEQ ID NO: 89974 - DNA, 20 bp, Artificial Sequence
  Description of Artificial Sequence: Synthetic oligonucleotide
aggcggccgcccaggcgctt

SEQ ID NO: 89975 - DNA, 20 bp, Artificial Sequence
  Description of Artificial Sequence: Synthetic oligonucleotide
ggcggccgcccaggcgcttt

SEQ ID NO: 89976 - DNA, 20 bp, Artificial Sequence
  Description of Artificial Sequence: Synthetic oligonucleotide
gcggccgcccaggcgctgat

SEQ ID NO: 89977 - DNA, 20 bp, Artificial Sequence
  Description of Artificial Sequence: Synthetic oligonucleotide
cggccgcccaggcgctgatc

SEQ ID NO: 89978 - DNA, 20 bp, Artificial Sequence
  Description of Artificial Sequence: Synthetic oligonucleotide
ggccgcccaggcgctgatcg

SEQ ID NO: 89979 - DNA, 21 bp, Artificial Sequence
  Description of Artificial Sequence: Synthetic oligonucleotide
gccgcccaggcgctgatcggt

SEQ ID NO: 89980 - DNA, 21 bp, Artificial Sequence
  Description of Artificial Sequence: Synthetic oligonucleotide
ccgcccaggcgctgatcggtg

SEQ ID NO: 89981 - DNA, 21 bp, Artificial Sequence
  Description of Artificial Sequence: Synthetic oligonucleotide
cgcccaggcgctgatcggtgg

SEQ ID NO: 89982 - DNA, 21 bp, Artificial Sequence
  Description of Artificial Sequence: Synthetic oligonucleotide
gcccaggcgctgatcggtggc

SEQ ID NO: 89983 - DNA, 21 bp, Artificial Sequence
  Description of Artificial Sequence: Synthetic oligonucleotide
cccaggcgctgatcggtggcc

SEQ ID NO: 89984 - DNA, 21 bp, Artificial Sequence
  Description of Artificial Sequence: Synthetic oligonucleotide
ccaggcgctgatcggtggccg

SEQ ID NO: 89985 - DNA, 21 bp, Artificial Sequence
  Description of Artificial Sequence: Synthetic oligonucleotide
caggcgctgatcggtggccgg

SEQ ID NO: 89986 - DNA, 22 bp, Artificial Sequence
  Description of Artificial Sequence: Synthetic oligonucleotide
aggcgctgatcggtggccggga

SEQ ID NO: 89987 - DNA, 21 bp, Artificial Sequence
  Description of Artificial Sequence: Synthetic oligonucleotide
ggcgctgatcggtggccggga

SEQ ID NO: 89988 - DNA, 21 bp, Artificial Sequence
  Description of Artificial Sequence: Synthetic oligonucleotide
gcgctgatcggtggccgggac

SEQ ID NO: 89989 - DNA, 23 bp, Artificial Sequence
  Description of Artificial Sequence: Synthetic oligonucleotide
cgctgatcggtggccgggaccta

SEQ ID NO: 89990 - DNA, 24 bp, Artificial Sequence
  Description of Artificial Sequence: Synthetic oligonucleotide
gctgatcggtggccgggacctagt

SEQ ID NO: 89991 - DNA, 24 bp, Artificial Sequence
  Description of Artificial Sequence: Synthetic oligonucleotide
ctgatcggtggccgggacctagtg

SEQ ID NO: 89992 - DNA, 25 bp, Artificial Sequence
  Description of Artificial Sequence: Synthetic oligonucleotide
tgatcggtggccgggacctagtggt

SEQ ID NO: 89993 - DNA, 24 bp, Artificial Sequence
  Description of Artificial Sequence: Synthetic oligonucleotide
gatcggtggccgggacctagtggt

SEQ ID NO: 89994 - DNA, 27 bp, Artificial Sequence
  Description of Artificial Sequence: Synthetic oligonucleotide
atcggtggccgggacctagtggtcatt

SEQ ID NO: 89995 - DNA, 26 bp, Artificial Sequence
  Description of Artificial Sequence: Synthetic oligonucleotide
tcggtggccgggacctagtggtcatt

SEQ ID NO: 89996 - DNA, 25 bp, Artificial Sequence
  Description of Artificial Sequence: Synthetic oligonucleotide
cggtggccgggacctagtggtcatt

SEQ ID NO: 89997 - DNA, 25 bp, Artificial Sequence
  Description of Artificial Sequence: Synthetic oligonucleotide
ggtggccgggacctagtggtcattg

SEQ ID NO: 89998 - DNA, 25 bp, Artificial Sequence
  Description of Artificial Sequence: Synthetic oligonucleotide
gtggccgggacctagtggtcattgg

SEQ ID NO: 89999 - DNA, 27 bp, Artificial Sequence
  Description of Artificial Sequence: Synthetic oligonucleotide
tggccgggacctagtggtcattggctt

SEQ ID NO: 90000 - DNA, 26 bp, Artificial Sequence
  Description of Artificial Sequence: Synthetic oligonucleotide
ggccgggacctagtggtcattggctt

SEQ ID NO: 90001 - DNA, 27 bp, Artificial Sequence
  Description of Artificial Sequence: Synthetic oligonucleotide
gccgggacctagtggtcattggcttct

SEQ ID NO: 90002 - DNA, 28 bp, Artificial Sequence
  Description of Artificial Sequence: Synthetic oligonucleotide
ccgggacctagtggtcattggcttcttc

SEQ ID NO: 90003 - DNA, 28 bp, Artificial Sequence
  Description of Artificial Sequence: Synthetic oligonucleotide
cgggacctagtggtcattggcttcttcc

SEQ ID NO: 90004 - DNA, 29 bp, Artificial Sequence
  Description of Artificial Sequence: Synthetic oligonucleotide
gggacctagtggtcattggcttcttccag

SEQ ID NO: 90005 - DNA, 29 bp, Artificial Sequence
  Description of Artificial Sequence: Synthetic oligonucleotide
ggacctagtggtcattggcttcttccagg

SEQ ID NO: 90006 - DNA, 30 bp, Artificial Sequence
  Description of Artificial Sequence: Synthetic oligonucleotide
gacctagtggtcattggcttcttccaggac

SEQ ID NO: 90007 - DNA, 30 bp, Artificial Sequence
  Description of Artificial Sequence: Synthetic oligonucleotide
acctagtggtcattggcttcttccaggacc

SEQ ID NO: 90008 - DNA, 29 bp, Artificial Sequence
  Description of Artificial Sequence: Synthetic oligonucleotide
cctagtggtcattggcttcttccaggacc

SEQ ID NO: 90009 - DNA, 30 bp, Artificial Sequence
  Description of Artificial Sequence: Synthetic oligonucleotide
ctagtggtcattggcttcttccaggacctg

SEQ ID NO: 90010 - DNA, 30 bp, Artificial Sequence
  Description of Artificial Sequence: Synthetic oligonucleotide
tagtggtcattggcttcttccaggacctgc

SEQ ID NO: 90011 - DNA, 29 bp, Artificial Sequence
  Description of Artificial Sequence: Synthetic oligonucleotide
agtggtcattggcttcttccaggacctgc

SEQ ID NO: 90012 - DNA, 28 bp, Artificial Sequence
  Description of Artificial Sequence: Synthetic oligonucleotide
gtggtcattggcttcttccaggacctgc

SEQ ID NO: 90013 - DNA, 29 bp, Artificial Sequence
  Description of Artificial Sequence: Synthetic oligonucleotide
tggtcattggcttcttccaggacctgcag

SEQ ID NO: 90014 - DNA, 28 bp, Artificial Sequence
  Description of Artificial Sequence: Synthetic oligonucleotide
ggtcattggcttcttccaggacctgcag

SEQ ID NO: 90015 - DNA, 28 bp, Artificial Sequence
  Description of Artificial Sequence: Synthetic oligonucleotide
gtcattggcttcttccaggacctgcagg

SEQ ID NO: 90016 - DNA, 29 bp, Artificial Sequence
  Description of Artificial Sequence: Synthetic oligonucleotide
tcattggcttcttccaggacctgcaggac

SEQ ID NO: 90017 - DNA, 28 bp, Artificial Sequence
  Description of Artificial Sequence: Synthetic oligonucleotide
cattggcttcttccaggacctgcaggac

SEQ ID NO: 90018 - DNA, 28 bp, Artificial Sequence
  Description of Artificial Sequence: Synthetic oligonucleotide
attggcttcttccaggacctgcaggacg

SEQ ID NO: 90019 - DNA, 27 bp, Artificial Sequence
  Description of Artificial Sequence: Synthetic oligonucleotide
ttggcttcttccaggacctgcaggacg

SEQ ID NO: 90020 - DNA, 27 bp, Artificial Sequence
  Description of Artificial Sequence: Synthetic oligonucleotide
tggcttcttccaggacctgcaggacga

SEQ ID NO: 90021 - DNA, 26 bp, Artificial Sequence
  Description of Artificial Sequence: Synthetic oligonucleotide
ggcttcttccaggacctgcaggacga

SEQ ID NO: 90022 - DNA, 26 bp, Artificial Sequence
  Description of Artificial Sequence: Synthetic oligonucleotide
gcttcttccaggacctgcaggacgag

SEQ ID NO: 90023 - DNA, 27 bp, Artificial Sequence
  Description of Artificial Sequence: Synthetic oligonucleotide
cttcttccaggacctgcaggacgagga

SEQ ID NO: 90024 - DNA, 27 bp, Artificial Sequence
  Description of Artificial Sequence: Synthetic oligonucleotide
ttcttccaggacctgcaggacgaggac

SEQ ID NO: 90025 - DNA, 26 bp, Artificial Sequence
  Description of Artificial Sequence: Synthetic oligonucleotide
tcttccaggacctgcaggacgaggac

SEQ ID NO: 90026 - DNA, 25 bp, Artificial Sequence
  Description of Artificial Sequence: Synthetic oligonucleotide
cttccaggacctgcaggacgaggac

SEQ ID NO: 90027 - DNA, 26 bp, Artificial Sequence
  Description of Artificial Sequence: Synthetic oligonucleotide
ttccaggacctgcaggacgaggacgt

SEQ ID NO: 90028 - DNA, 25 bp, Artificial Sequence
  Description of Artificial Sequence: Synthetic oligonucleotide
tccaggacctgcaggacgaggacgt

SEQ ID NO: 90029 - DNA, 24 bp, Artificial Sequence
  Description of Artificial Sequence: Synthetic oligonucleotide
ccaggacctgcaggacgaggacgt

SEQ ID NO: 90030 - DNA, 24 bp, Artificial Sequence
  Description of Artificial Sequence: Synthetic oligonucleotide
caggacctgcaggacgaggacgtg

SEQ ID NO: 90031 - DNA, 24 bp, Artificial Sequence
  Description of Artificial Sequence: Synthetic oligonucleotide
aggacctgcaggacgaggacgtgg

SEQ ID NO: 90032 - DNA, 23 bp, Artificial Sequence
  Description of Artificial Sequence: Synthetic oligonucleotide
ggacctgcaggacgaggacgtgg

SEQ ID NO: 90033 - DNA, 23 bp, Artificial Sequence
  Description of Artificial Sequence: Synthetic oligonucleotide
gacctgcaggacgaggacgtggc

SEQ ID NO: 90034 - DNA, 24 bp, Artificial Sequence
  Description of Artificial Sequence: Synthetic oligonucleotide
acctgcaggacgaggacgtggcca

SEQ ID NO: 90035 - DNA, 23 bp, Artificial Sequence
  Description of Artificial Sequence: Synthetic oligonucleotide
cctgcaggacgaggacgtggcca

SEQ ID NO: 90036 - DNA, 23 bp, Artificial Sequence
  Description of Artificial Sequence: Synthetic oligonucleotide
ctgcaggacgaggacgtggccac

SEQ ID NO: 90037 - DNA, 25 bp, Artificial Sequence
  Description of Artificial Sequence: Synthetic oligonucleotide
tgcaggacgaggacgtggccacctt

SEQ ID NO: 90038 - DNA, 24 bp, Artificial Sequence
  Description of Artificial Sequence: Synthetic oligonucleotide
gcaggacgaggacgtggccacctt

SEQ ID NO: 90039 - DNA, 26 bp, Artificial Sequence
  Description of Artificial Sequence: Synthetic oligonucleotide
caggacgaggacgtggccaccttctt

SEQ ID NO: 90040 - DNA, 26 bp, Artificial Sequence
  Description of Artificial Sequence: Synthetic oligonucleotide
aggacgaggacgtggccaccttcttg

SEQ ID NO: 90041 - DNA, 25 bp, Artificial Sequence
  Description of Artificial Sequence: Synthetic oligonucleotide
ggacgaggacgtggccaccttcttg

SEQ ID NO: 90042 - DNA, 25 bp, Artificial Sequence
  Description of Artificial Sequence: Synthetic oligonucleotide
gacgaggacgtggccaccttcttgg

SEQ ID NO: 90043 - DNA, 25 bp, Artificial Sequence
  Description of Artificial Sequence: Synthetic oligonucleotide
acgaggacgtggccaccttcttggc

SEQ ID NO: 90044 - DNA, 24 bp, Artificial Sequence
  Description of Artificial Sequence: Synthetic oligonucleotide
cgaggacgtggccaccttcttggc

SEQ ID NO: 90045 - DNA, 26 bp, Artificial Sequence
  Description of Artificial Sequence: Synthetic oligonucleotide
gaggacgtggccaccttcttggcctt

SEQ ID NO: 90046 - DNA, 26 bp, Artificial Sequence
  Description of Artificial Sequence: Synthetic oligonucleotide
aggacgtggccaccttcttggccttg

SEQ ID NO: 90047 - DNA, 25 bp, Artificial Sequence
  Description of Artificial Sequence: Synthetic oligonucleotide
ggacgtggccaccttcttggccttg

SEQ ID NO: 90048 - DNA, 25 bp, Artificial Sequence
  Description of Artificial Sequence: Synthetic oligonucleotide
gacgtggccaccttcttggccttgg

SEQ ID NO: 90049 - DNA, 25 bp, Artificial Sequence
  Description of Artificial Sequence: Synthetic oligonucleotide
acgtggccaccttcttggccttggc

SEQ ID NO: 90050 - DNA, 24 bp, Artificial Sequence
  Description of Artificial Sequence: Synthetic oligonucleotide
cgtggccaccttcttggccttggc

SEQ ID NO: 90051 - DNA, 24 bp, Artificial Sequence
  Description of Artificial Sequence: Synthetic oligonucleotide
gtggccaccttcttggccttggcc

SEQ ID NO: 90052 - DNA, 25 bp, Artificial Sequence
  Description of Artificial Sequence: Synthetic oligonucleotide
tggccaccttcttggccttggccca

SEQ ID NO: 90053 - DNA, 24 bp, Artificial Sequence
  Description of Artificial Sequence: Synthetic oligonucleotide
ggccaccttcttggccttggccca

SEQ ID NO: 90054 - DNA, 24 bp, Artificial Sequence
  Description of Artificial Sequence: Synthetic oligonucleotide
gccaccttcttggccttggcccag

SEQ ID NO: 90055 - DNA, 25 bp, Artificial Sequence
  Description of Artificial Sequence: Synthetic oligonucleotide
ccaccttcttggccttggcccagga

SEQ ID NO: 90056 - DNA, 25 bp, Artificial Sequence
  Description of Artificial Sequence: Synthetic oligonucleotide
caccttcttggccttggcccaggac

SEQ ID NO: 90057 - DNA, 25 bp, Artificial Sequence
  Description of Artificial Sequence: Synthetic oligonucleotide
accttcttggccttggcccaggacg

SEQ ID NO: 90058 - DNA, 24 bp, Artificial Sequence
  Description of Artificial Sequence: Synthetic oligonucleotide
ccttcttggccttggcccaggacg

SEQ ID NO: 90059 - DNA, 24 bp, Artificial Sequence
  Description of Artificial Sequence: Synthetic oligonucleotide
cttcttggccttggcccaggacgc

SEQ ID NO: 90060 - DNA, 24 bp, Artificial Sequence
  Description of Artificial Sequence: Synthetic oligonucleotide
ttcttggccttggcccaggacgcc

SEQ ID NO: 90061 - DNA, 23 bp, Artificial Sequence
  Description of Artificial Sequence: Synthetic oligonucleotide
tcttggccttggcccaggacgcc

SEQ ID NO: 90062 - DNA, 22 bp, Artificial Sequence
  Description of Artificial Sequence: Synthetic oligonucleotide
cttggccttggcccaggacgcc

SEQ ID NO: 90063 - DNA, 23 bp, Artificial Sequence
  Description of Artificial Sequence: Synthetic oligonucleotide
ttggccttggcccaggacgccct

SEQ ID NO: 90064 - DNA, 22 bp, Artificial Sequence
  Description of Artificial Sequence: Synthetic oligonucleotide
tggccttggcccaggacgccct

SEQ ID NO: 90065 - DNA, 21 bp, Artificial Sequence
  Description of Artificial Sequence: Synthetic oligonucleotide
ggccttggcccaggacgccct

SEQ ID NO: 90066 - DNA, 21 bp, Artificial Sequence
  Description of Artificial Sequence: Synthetic oligonucleotide
gccttggcccaggacgccctg

SEQ ID NO: 90067 - DNA, 22 bp, Artificial Sequence
  Description of Artificial Sequence: Synthetic oligonucleotide
ccttggcccaggacgccctgga

SEQ ID NO: 90068 - DNA, 24 bp, Artificial Sequence
  Description of Artificial Sequence: Synthetic oligonucleotide
cttggcccaggacgccctggacat

SEQ ID NO: 90069 - DNA, 25 bp, Artificial Sequence
  Description of Artificial Sequence: Synthetic oligonucleotide
ttggcccaggacgccctggacatga

SEQ ID NO: 90070 - DNA, 24 bp, Artificial Sequence
  Description of Artificial Sequence: Synthetic oligonucleotide
tggcccaggacgccctggacatga

SEQ ID NO: 90071 - DNA, 23 bp, Artificial Sequence
  Description of Artificial Sequence: Synthetic oligonucleotide
ggcccaggacgccctggacatga

SEQ ID NO: 90072 - DNA, 23 bp, Artificial Sequence
  Description of Artificial Sequence: Synthetic oligonucleotide
gcccaggacgccctggacatgac

SEQ ID NO: 90073 - DNA, 26 bp, Artificial Sequence
  Description of Artificial Sequence: Synthetic oligonucleotide
cccaggacgccctggacatgaccttt

SEQ ID NO: 90074 - DNA, 26 bp, Artificial Sequence
  Description of Artificial Sequence: Synthetic oligonucleotide
ccaggacgccctggacatgacctttg

SEQ ID NO: 90075 - DNA, 26 bp, Artificial Sequence
  Description of Artificial Sequence: Synthetic oligonucleotide
caggacgccctggacatgacctttgg

SEQ ID NO: 90076 - DNA, 26 bp, Artificial Sequence
  Description of Artificial Sequence: Synthetic oligonucleotide
aggacgccctggacatgacctttggc

SEQ ID NO: 90077 - DNA, 25 bp, Artificial Sequence
  Description of Artificial Sequence: Synthetic oligonucleotide
ggacgccctggacatgacctttggc

SEQ ID NO: 90078 - DNA, 26 bp, Artificial Sequence
  Description of Artificial Sequence: Synthetic oligonucleotide
gacgccctggacatgacctttggcct

SEQ ID NO: 90079 - DNA, 27 bp, Artificial Sequence
  Description of Artificial Sequence: Synthetic oligonucleotide
acgccctggacatgacctttggcctca

SEQ ID NO: 90080 - DNA, 26 bp, Artificial Sequence
  Description of Artificial Sequence: Synthetic oligonucleotide
cgccctggacatgacctttggcctca

SEQ ID NO: 90081 - DNA, 27 bp, Artificial Sequence
  Description of Artificial Sequence: Synthetic oligonucleotide
gccctggacatgacctttggcctcaca

SEQ ID NO: 90082 - DNA, 27 bp, Artificial Sequence
  Description of Artificial Sequence: Synthetic oligonucleotide
ccctggacatgacctttggcctcacag

SEQ ID NO: 90083 - DNA, 28 bp, Artificial Sequence
  Description of Artificial Sequence: Synthetic oligonucleotide
cctggacatgacctttggcctcacagac

SEQ ID NO: 90084 - DNA, 28 bp, Artificial Sequence
  Description of Artificial Sequence: Synthetic oligonucleotide
ctggacatgacctttggcctcacagacc

SEQ ID NO: 90085 - DNA, 28 bp, Artificial Sequence
  Description of Artificial Sequence: Synthetic oligonucleotide
tggacatgacctttggcctcacagaccg

SEQ ID NO: 90086 - DNA, 27 bp, Artificial Sequence
  Description of Artificial Sequence: Synthetic oligonucleotide
ggacatgacctttggcctcacagaccg

SEQ ID NO: 90087 - DNA, 27 bp, Artificial Sequence
  Description of Artificial Sequence: Synthetic oligonucleotide
gacatgacctttggcctcacagaccgg

SEQ ID NO: 90088 - DNA, 27 bp, Artificial Sequence
  Description of Artificial Sequence: Synthetic oligonucleotide
acatgacctttggcctcacagaccggc

SEQ ID NO: 90089 - DNA, 26 bp, Artificial Sequence
  Description of Artificial Sequence: Synthetic oligonucleotide
catgacctttggcctcacagaccggc

SEQ ID NO: 90090 - DNA, 26 bp, Artificial Sequence
  Description of Artificial Sequence: Synthetic oligonucleotide
atgacctttggcctcacagaccggcc

SEQ ID NO: 90091 - DNA, 25 bp, Artificial Sequence
  Description of Artificial Sequence: Synthetic oligonucleotide
tgacctttggcctcacagaccggcc

SEQ ID NO: 90092 - DNA, 24 bp, Artificial Sequence
  Description of Artificial Sequence: Synthetic oligonucleotide
gacctttggcctcacagaccggcc

SEQ ID NO: 90093 - DNA, 24 bp, Artificial Sequence
  Description of Artificial Sequence: Synthetic oligonucleotide
acctttggcctcacagaccggccg

SEQ ID NO: 90094 - DNA, 23 bp, Artificial Sequence
  Description of Artificial Sequence: Synthetic oligonucleotide
cctttggcctcacagaccggccg

SEQ ID NO: 90095 - DNA, 23 bp, Artificial Sequence
  Description of Artificial Sequence: Synthetic oligonucleotide
ctttggcctcacagaccggccgc

SEQ ID NO: 90096 - DNA, 23 bp, Artificial Sequence
  Description of Artificial Sequence: Synthetic oligonucleotide
tttggcctcacagaccggccgcg

SEQ ID NO: 90097 - DNA, 22 bp, Artificial Sequence
  Description of Artificial Sequence: Synthetic oligonucleotide
ttggcctcacagaccggccgcg

SEQ ID NO: 90098 - DNA, 21 bp, Artificial Sequence
  Description of Artificial Sequence: Synthetic oligonucleotide
tggcctcacagaccggccgcg

SEQ ID NO: 90099 - DNA, 20 bp, Artificial Sequence
  Description of Artificial Sequence: Synthetic oligonucleotide
ggcctcacagaccggccgcg

SEQ ID NO: 90100 - DNA, 20 bp, Artificial Sequence
  Description of Artificial Sequence: Synthetic oligonucleotide
gcctcacagaccggccgcgg

SEQ ID NO: 90101 - DNA, 21 bp, Artificial Sequence
  Description of Artificial Sequence: Synthetic oligonucleotide
cctcacagaccggccgcggct

SEQ ID NO: 90102 - DNA, 24 bp, Artificial Sequence
  Description of Artificial Sequence: Synthetic oligonucleotide
ctcacagaccggccgcggctcttt

SEQ ID NO: 90103 - DNA, 25 bp, Artificial Sequence
  Description of Artificial Sequence: Synthetic oligonucleotide
tcacagaccggccgcggctctttca

SEQ ID NO: 90104 - DNA, 24 bp, Artificial Sequence
  Description of Artificial Sequence: Synthetic oligonucleotide
cacagaccggccgcggctctttca

SEQ ID NO: 90105 - DNA, 24 bp, Artificial Sequence
  Description of Artificial Sequence: Synthetic oligonucleotide
acagaccggccgcggctctttcag

SEQ ID NO: 90106 - DNA, 23 bp, Artificial Sequence
  Description of Artificial Sequence: Synthetic oligonucleotide
cagaccggccgcggctctttcag

SEQ ID NO: 90107 - DNA, 24 bp, Artificial Sequence
  Description of Artificial Sequence: Synthetic oligonucleotide
agaccggccgcggctctttcagca

SEQ ID NO: 90108 - DNA, 23 bp, Artificial Sequence
  Description of Artificial Sequence: Synthetic oligonucleotide
gaccggccgcggctctttcagca

SEQ ID NO: 90109 - DNA, 26 bp, Artificial Sequence
  Description of Artificial Sequence: Synthetic oligonucleotide
accggccgcggctctttcagcagttt

SEQ ID NO: 90110 - DNA, 25 bp, Artificial Sequence
  Description of Artificial Sequence: Synthetic oligonucleotide
ccggccgcggctctttcagcagttt

SEQ ID NO: 90111 - DNA, 25 bp, Artificial Sequence
  Description of Artificial Sequence: Synthetic oligonucleotide
cggccgcggctctttcagcagtttg

SEQ ID NO: 90112 - DNA, 25 bp, Artificial Sequence
  Description of Artificial Sequence: Synthetic oligonucleotide
ggccgcggctctttcagcagtttgg

SEQ ID NO: 90113 - DNA, 25 bp, Artificial Sequence
  Description of Artificial Sequence: Synthetic oligonucleotide
gccgcggctctttcagcagtttggc

SEQ ID NO: 90114 - DNA, 26 bp, Artificial Sequence
  Description of Artificial Sequence: Synthetic oligonucleotide
ccgcggctctttcagcagtttggcct

SEQ ID NO: 90115 - DNA, 27 bp, Artificial Sequence
  Description of Artificial Sequence: Synthetic oligonucleotide
cgcggctctttcagcagtttggcctca

SEQ ID NO: 90116 - DNA, 27 bp, Artificial Sequence
  Description of Artificial Sequence: Synthetic oligonucleotide
gcggctctttcagcagtttggcctcac

SEQ ID NO: 90117 - DNA, 27 bp, Artificial Sequence
  Description of Artificial Sequence: Synthetic oligonucleotide
cggctctttcagcagtttggcctcacc

SEQ ID NO: 90118 - DNA, 29 bp, Artificial Sequence
  Description of Artificial Sequence: Synthetic oligonucleotide
ggctctttcagcagtttggcctcaccaag

SEQ ID NO: 90119 - DNA, 29 bp, Artificial Sequence
  Description of Artificial Sequence: Synthetic oligonucleotide
gctctttcagcagtttggcctcaccaagg

SEQ ID NO: 90120 - DNA, 30 bp, Artificial Sequence
  Description of Artificial Sequence: Synthetic oligonucleotide
ctctttcagcagtttggcctcaccaaggac

SEQ ID NO: 90121 - DNA, 31 bp, Artificial Sequence
  Description of Artificial Sequence: Synthetic oligonucleotide
tctttcagcagtttggcctcaccaaggacac

SEQ ID NO: 90122 - DNA, 30 bp, Artificial Sequence
  Description of Artificial Sequence: Synthetic oligonucleotide
ctttcagcagtttggcctcaccaaggacac

SEQ ID NO: 90123 - DNA, 31 bp, Artificial Sequence
  Description of Artificial Sequence: Synthetic oligonucleotide
tttcagcagtttggcctcaccaaggacactg

SEQ ID NO: 90124 - DNA, 30 bp, Artificial Sequence
  Description of Artificial Sequence: Synthetic oligonucleotide
ttcagcagtttggcctcaccaaggacactg

SEQ ID NO: 90125 - DNA, 29 bp, Artificial Sequence
  Description of Artificial Sequence: Synthetic oligonucleotide
tcagcagtttggcctcaccaaggacactg

SEQ ID NO: 90126 - DNA, 28 bp, Artificial Sequence
  Description of Artificial Sequence: Synthetic oligonucleotide
cagcagtttggcctcaccaaggacactg

SEQ ID NO: 90127 - DNA, 29 bp, Artificial Sequence
  Description of Artificial Sequence: Synthetic oligonucleotide
agcagtttggcctcaccaaggacactgtg

SEQ ID NO: 90128 - DNA, 28 bp, Artificial Sequence
  Description of Artificial Sequence: Synthetic oligonucleotide
gcagtttggcctcaccaaggacactgtg

SEQ ID NO: 90129 - DNA, 28 bp, Artificial Sequence
  Description of Artificial Sequence: Synthetic oligonucleotide
cagtttggcctcaccaaggacactgtgg

SEQ ID NO: 90130 - DNA, 30 bp, Artificial Sequence
  Description of Artificial Sequence: Synthetic oligonucleotide
agtttggcctcaccaaggacactgtggttc

SEQ ID NO: 90131 - DNA, 29 bp, Artificial Sequence
  Description of Artificial Sequence: Synthetic oligonucleotide
gtttggcctcaccaaggacactgtggttc

SEQ ID NO: 90132 - DNA, 30 bp, Artificial Sequence
  Description of Artificial Sequence: Synthetic oligonucleotide
tttggcctcaccaaggacactgtggttctc

SEQ ID NO: 90133 - DNA, 29 bp, Artificial Sequence
  Description of Artificial Sequence: Synthetic oligonucleotide
ttggcctcaccaaggacactgtggttctc

SEQ ID NO: 90134 - DNA, 28 bp, Artificial Sequence
  Description of Artificial Sequence: Synthetic oligonucleotide
tggcctcaccaaggacactgtggttctc

SEQ ID NO: 90135 - DNA, 27 bp, Artificial Sequence
  Description of Artificial Sequence: Synthetic oligonucleotide
ggcctcaccaaggacactgtggttctc

SEQ ID NO: 90136 - DNA, 29 bp, Artificial Sequence
  Description of Artificial Sequence: Synthetic oligonucleotide
gcctcaccaaggacactgtggttctcttc

SEQ ID NO: 90137 - DNA, 31 bp, Artificial Sequence
  Description of Artificial Sequence: Synthetic oligonucleotide
cctcaccaaggacactgtggttctcttcaag

SEQ ID NO: 90138 - DNA, 33 bp, Artificial Sequence
  Description of Artificial Sequence: Synthetic oligonucleotide
ctcaccaaggacactgtggttctcttcaagaag

SEQ ID NO: 90139 - DNA, 36 bp, Artificial Sequence
  Description of Artificial Sequence: Synthetic oligonucleotide
tcaccaaggacactgtggttctcttcaagaagtttg

SEQ ID NO: 90140 - DNA, 35 bp, Artificial Sequence
  Description of Artificial Sequence: Synthetic oligonucleotide
caccaaggacactgtggttctcttcaagaagtttg

SEQ ID NO: 90141 - DNA, 37 bp, Artificial Sequence
  Description of Artificial Sequence: Synthetic oligonucleotide
accaaggacactgtggttctcttcaagaagtttgatg

SEQ ID NO: 90142 - DNA, 36 bp, Artificial Sequence
  Description of Artificial Sequence: Synthetic oligonucleotide
ccaaggacactgtggttctcttcaagaagtttgatg

SEQ ID NO: 90143 - DNA, 37 bp, Artificial Sequence
  Description of Artificial Sequence: Synthetic oligonucleotide
caaggacactgtggttctcttcaagaagtttgatgag

SEQ ID NO: 90144 - DNA, 37 bp, Artificial Sequence
  Description of Artificial Sequence: Synthetic oligonucleotide
aaggacactgtggttctcttcaagaagtttgatgagg

SEQ ID NO: 90145 - DNA, 36 bp, Artificial Sequence
  Description of Artificial Sequence: Synthetic oligonucleotide
aggacactgtggttctcttcaagaagtttgatgagg

SEQ ID NO: 90146 - DNA, 35 bp, Artificial Sequence
  Description of Artificial Sequence: Synthetic oligonucleotide
ggacactgtggttctcttcaagaagtttgatgagg

SEQ ID NO: 90147 - DNA, 35 bp, Artificial Sequence
  Description of Artificial Sequence: Synthetic oligonucleotide
gacactgtggttctcttcaagaagtttgatgaggg

SEQ ID NO: 90148 - DNA, 35 bp, Artificial Sequence
  Description of Artificial Sequence: Synthetic oligonucleotide
acactgtggttctcttcaagaagtttgatgagggg

SEQ ID NO: 90149 - DNA, 34 bp, Artificial Sequence
  Description of Artificial Sequence: Synthetic oligonucleotide
cactgtggttctcttcaagaagtttgatgagggg

SEQ ID NO: 90150 - DNA, 34 bp, Artificial Sequence
  Description of Artificial Sequence: Synthetic oligonucleotide
actgtggttctcttcaagaagtttgatgaggggc

SEQ ID NO: 90151 - DNA, 33 bp, Artificial Sequence
  Description of Artificial Sequence: Synthetic oligonucleotide
ctgtggttctcttcaagaagtttgatgaggggc

SEQ ID NO: 90152 - DNA, 33 bp, Artificial Sequence
  Description of Artificial Sequence: Synthetic oligonucleotide
tgtggttctcttcaagaagtttgatgaggggcg

SEQ ID NO: 90153 - DNA, 32 bp, Artificial Sequence
  Description of Artificial Sequence: Synthetic oligonucleotide
gtggttctcttcaagaagtttgatgaggggcg

SEQ ID NO: 90154 - DNA, 32 bp, Artificial Sequence
  Description of Artificial Sequence: Synthetic oligonucleotide
tggttctcttcaagaagtttgatgaggggcgg

SEQ ID NO: 90155 - DNA, 31 bp, Artificial Sequence
  Description of Artificial Sequence: Synthetic oligonucleotide
ggttctcttcaagaagtttgatgaggggcgg

SEQ ID NO: 90156 - DNA, 31 bp, Artificial Sequence
  Description of Artificial Sequence: Synthetic oligonucleotide
gttctcttcaagaagtttgatgaggggcggg

SEQ ID NO: 90157 - DNA, 31 bp, Artificial Sequence
  Description of Artificial Sequence: Synthetic oligonucleotide
ttctcttcaagaagtttgatgaggggcgggc

SEQ ID NO: 90158 - DNA, 30 bp, Artificial Sequence
  Description of Artificial Sequence: Synthetic oligonucleotide
tctcttcaagaagtttgatgaggggcgggc

SEQ ID NO: 90159 - DNA, 29 bp, Artificial Sequence
  Description of Artificial Sequence: Synthetic oligonucleotide
ctcttcaagaagtttgatgaggggcgggc

SEQ ID NO: 90160 - DNA, 30 bp, Artificial Sequence
  Description of Artificial Sequence: Synthetic oligonucleotide
tcttcaagaagtttgatgaggggcgggcag

SEQ ID NO: 90161 - DNA, 29 bp, Artificial Sequence
  Description of Artificial Sequence: Synthetic oligonucleotide
cttcaagaagtttgatgaggggcgggcag

SEQ ID NO: 90162 - DNA, 30 bp, Artificial Sequence
  Description of Artificial Sequence: Synthetic oligonucleotide
ttcaagaagtttgatgaggggcgggcagac

SEQ ID NO: 90163 - DNA, 29 bp, Artificial Sequence
  Description of Artificial Sequence: Synthetic oligonucleotide
tcaagaagtttgatgaggggcgggcagac

SEQ ID NO: 90164 - DNA, 28 bp, Artificial Sequence
  Description of Artificial Sequence: Synthetic oligonucleotide
caagaagtttgatgaggggcgggcagac

SEQ ID NO: 90165 - DNA, 30 bp, Artificial Sequence
  Description of Artificial Sequence: Synthetic oligonucleotide
aagaagtttgatgaggggcgggcagacttc

SEQ ID NO: 90166 - DNA, 29 bp, Artificial Sequence
  Description of Artificial Sequence: Synthetic oligonucleotide
agaagtttgatgaggggcgggcagacttc

SEQ ID NO: 90167 - DNA, 28 bp, Artificial Sequence
  Description of Artificial Sequence: Synthetic oligonucleotide
gaagtttgatgaggggcgggcagacttc

SEQ ID NO: 90168 - DNA, 28 bp, Artificial Sequence
  Description of Artificial Sequence: Synthetic oligonucleotide
aagtttgatgaggggcgggcagacttcc

SEQ ID NO: 90169 - DNA, 27 bp, Artificial Sequence
  Description of Artificial Sequence: Synthetic oligonucleotide
agtttgatgaggggcgggcagacttcc

SEQ ID NO: 90170 - DNA, 26 bp, Artificial Sequence
  Description of Artificial Sequence: Synthetic oligonucleotide
gtttgatgaggggcgggcagacttcc

SEQ ID NO: 90171 - DNA, 26 bp, Artificial Sequence
  Description of Artificial Sequence: Synthetic oligonucleotide
tttgatgaggggcgggcagacttccc

SEQ ID NO: 90172 - DNA, 25 bp, Artificial Sequence
  Description of Artificial Sequence: Synthetic oligonucleotide
ttgatgaggggcgggcagacttccc

SEQ ID NO: 90173 - DNA, 24 bp, Artificial Sequence
  Description of Artificial Sequence: Synthetic oligonucleotide
tgatgaggggcgggcagacttccc

SEQ ID NO: 90174 - DNA, 23 bp, Artificial Sequence
  Description of Artificial Sequence: Synthetic oligonucleotide
gatgaggggcgggcagacttccc

SEQ ID NO: 90175 - DNA, 23 bp, Artificial Sequence
  Description of Artificial Sequence: Synthetic oligonucleotide
atgaggggcgggcagacttcccc

SEQ ID NO: 90176 - DNA, 22 bp, Artificial Sequence
  Description of Artificial Sequence: Synthetic oligonucleotide
tgaggggcgggcagacttcccc

SEQ ID NO: 90177 - DNA, 21 bp, Artificial Sequence
  Description of Artificial Sequence: Synthetic oligonucleotide
gaggggcgggcagacttcccc

SEQ ID NO: 90178 - DNA, 22 bp, Artificial Sequence
  Description of Artificial Sequence: Synthetic oligonucleotide
aggggcgggcagacttccccgt

SEQ ID NO: 90179 - DNA, 21 bp, Artificial Sequence
  Description of Artificial Sequence: Synthetic oligonucleotide
ggggcgggcagacttccccgt

SEQ ID NO: 90180 - DNA, 21 bp, Artificial Sequence
  Description of Artificial Sequence: Synthetic oligonucleotide
gggcgggcagacttccccgtg

SEQ ID NO: 90181 - DNA, 22 bp, Artificial Sequence
  Description of Artificial Sequence: Synthetic oligonucleotide
ggcgggcagacttccccgtgga

SEQ ID NO: 90182 - DNA, 22 bp, Artificial Sequence
  Description of Artificial Sequence: Synthetic oligonucleotide
gcgggcagacttccccgtggac

SEQ ID NO: 90183 - DNA, 23 bp, Artificial Sequence
  Description of Artificial Sequence: Synthetic oligonucleotide
cgggcagacttccccgtggacga

SEQ ID NO: 90184 - DNA, 23 bp, Artificial Sequence
  Description of Artificial Sequence: Synthetic oligonucleotide
gggcagacttccccgtggacgag

SEQ ID NO: 90185 - DNA, 24 bp, Artificial Sequence
  Description of Artificial Sequence: Synthetic oligonucleotide
ggcagacttccccgtggacgagga

SEQ ID NO: 90186 - DNA, 24 bp, Artificial Sequence
  Description of Artificial Sequence: Synthetic oligonucleotide
gcagacttccccgtggacgaggag

SEQ ID NO: 90187 - DNA, 26 bp, Artificial Sequence
  Description of Artificial Sequence: Synthetic oligonucleotide
cagacttccccgtggacgaggagctt

SEQ ID NO: 90188 - DNA, 26 bp, Artificial Sequence
  Description of Artificial Sequence: Synthetic oligonucleotide
agacttccccgtggacgaggagcttg

SEQ ID NO: 90189 - DNA, 25 bp, Artificial Sequence
  Description of Artificial Sequence: Synthetic oligonucleotide
gacttccccgtggacgaggagcttg

SEQ ID NO: 90190 - DNA, 25 bp, Artificial Sequence
  Description of Artificial Sequence: Synthetic oligonucleotide
acttccccgtggacgaggagcttgg

SEQ ID NO: 90191 - DNA, 24 bp, Artificial Sequence
  Description of Artificial Sequence: Synthetic oligonucleotide
cttccccgtggacgaggagcttgg

SEQ ID NO: 90192 - DNA, 24 bp, Artificial Sequence
  Description of Artificial Sequence: Synthetic oligonucleotide
ttccccgtggacgaggagcttggc

SEQ ID NO: 90193 - DNA, 23 bp, Artificial Sequence
  Description of Artificial Sequence: Synthetic oligonucleotide
tccccgtggacgaggagcttggc

SEQ ID NO: 90194 - DNA, 22 bp, Artificial Sequence
  Description of Artificial Sequence: Synthetic oligonucleotide
ccccgtggacgaggagcttggc

SEQ ID NO: 90195 - DNA, 23 bp, Artificial Sequence
  Description of Artificial Sequence: Synthetic oligonucleotide
cccgtggacgaggagcttggcct

SEQ ID NO: 90196 - DNA, 23 bp, Artificial Sequence
  Description of Artificial Sequence: Synthetic oligonucleotide
ccgtggacgaggagcttggcctg

SEQ ID NO: 90197 - DNA, 24 bp, Artificial Sequence
  Description of Artificial Sequence: Synthetic oligonucleotide
cgtggacgaggagcttggcctgga

SEQ ID NO: 90198 - DNA, 24 bp, Artificial Sequence
  Description of Artificial Sequence: Synthetic oligonucleotide
gtggacgaggagcttggcctggac

SEQ ID NO: 90199 - DNA, 25 bp, Artificial Sequence
  Description of Artificial Sequence: Synthetic oligonucleotide
tggacgaggagcttggcctggacct

SEQ ID NO: 90200 - DNA, 24 bp, Artificial Sequence
  Description of Artificial Sequence: Synthetic oligonucleotide
ggacgaggagcttggcctggacct

SEQ ID NO: 90201 - DNA, 24 bp, Artificial Sequence
  Description of Artificial Sequence: Synthetic oligonucleotide
gacgaggagcttggcctggacctg

SEQ ID NO: 90202 - DNA, 24 bp, Artificial Sequence
  Description of Artificial Sequence: Synthetic oligonucleotide
acgaggagcttggcctggacctgg

SEQ ID NO: 90203 - DNA, 23 bp, Artificial Sequence
  Description of Artificial Sequence: Synthetic oligonucleotide
cgaggagcttggcctggacctgg

SEQ ID NO: 90204 - DNA, 23 bp, Artificial Sequence
  Description of Artificial Sequence: Synthetic oligonucleotide
gaggagcttggcctggacctggg

SEQ ID NO: 90205 - DNA, 23 bp, Artificial Sequence
  Description of Artificial Sequence: Synthetic oligonucleotide
aggagcttggcctggacctgggg

SEQ ID NO: 90206 - DNA, 22 bp, Artificial Sequence
  Description of Artificial Sequence: Synthetic oligonucleotide
ggagcttggcctggacctgggg

SEQ ID NO: 90207 - DNA, 24 bp, Artificial Sequence
  Description of Artificial Sequence: Synthetic oligonucleotide
gagcttggcctggacctgggggat

SEQ ID NO: 90208 - DNA, 25 bp, Artificial Sequence
  Description of Artificial Sequence: Synthetic oligonucleotide
agcttggcctggacctgggggatct

SEQ ID NO: 90209 - DNA, 24 bp, Artificial Sequence
  Description of Artificial Sequence: Synthetic oligonucleotide
gcttggcctggacctgggggatct

SEQ ID NO: 90210 - DNA, 25 bp, Artificial Sequence
  Description of Artificial Sequence: Synthetic oligonucleotide
cttggcctggacctgggggatctgt

SEQ ID NO: 90211 - DNA, 25 bp, Artificial Sequence
  Description of Artificial Sequence: Synthetic oligonucleotide
ttggcctggacctgggggatctgtc

SEQ ID NO: 90212 - DNA, 24 bp, Artificial Sequence
  Description of Artificial Sequence: Synthetic oligonucleotide
tggcctggacctgggggatctgtc

SEQ ID NO: 90213 - DNA, 23 bp, Artificial Sequence
  Description of Artificial Sequence: Synthetic oligonucleotide
ggcctggacctgggggatctgtc

SEQ ID NO: 90214 - DNA, 23 bp, Artificial Sequence
  Description of Artificial Sequence: Synthetic oligonucleotide
gcctggacctgggggatctgtcg

SEQ ID NO: 90215 - DNA, 23 bp, Artificial Sequence
  Description of Artificial Sequence: Synthetic oligonucleotide
cctggacctgggggatctgtcgc

SEQ ID NO: 90216 - DNA, 23 bp, Artificial Sequence
  Description of Artificial Sequence: Synthetic oligonucleotide
ctggacctgggggatctgtcgcg

SEQ ID NO: 90217 - DNA, 25 bp, Artificial Sequence
  Description of Artificial Sequence: Synthetic oligonucleotide
tggacctgggggatctgtcgcgctt

SEQ ID NO: 90218 - DNA, 24 bp, Artificial Sequence
  Description of Artificial Sequence: Synthetic oligonucleotide
ggacctgggggatctgtcgcgctt

SEQ ID NO: 90219 - DNA, 24 bp, Artificial Sequence
  Description of Artificial Sequence: Synthetic oligonucleotide
gacctgggggatctgtcgcgcttc

SEQ ID NO: 90220 - DNA, 25 bp, Artificial Sequence
  Description of Artificial Sequence: Synthetic oligonucleotide
acctgggggatctgtcgcgcttcct

SEQ ID NO: 90221 - DNA, 24 bp, Artificial Sequence
  Description of Artificial Sequence: Synthetic oligonucleotide
cctgggggatctgtcgcgcttcct

SEQ ID NO: 90222 - DNA, 24 bp, Artificial Sequence
  Description of Artificial Sequence: Synthetic oligonucleotide
ctgggggatctgtcgcgcttcctg

SEQ ID NO: 90223 - DNA, 25 bp, Artificial Sequence
  Description of Artificial Sequence: Synthetic oligonucleotide
tgggggatctgtcgcgcttcctggt

SEQ ID NO: 90224 - DNA, 24 bp, Artificial Sequence
  Description of Artificial Sequence: Synthetic oligonucleotide
gggggatctgtcgcgcttcctggt

SEQ ID NO: 90225 - DNA, 25 bp, Artificial Sequence
  Description of Artificial Sequence: Synthetic oligonucleotide
ggggatctgtcgcgcttcctggtca

SEQ ID NO: 90226 - DNA, 26 bp, Artificial Sequence
  Description of Artificial Sequence: Synthetic oligonucleotide
gggatctgtcgcgcttcctggtcaca

SEQ ID NO: 90227 - DNA, 27 bp, Artificial Sequence
  Description of Artificial Sequence: Synthetic oligonucleotide
ggatctgtcgcgcttcctggtcacaca

SEQ ID NO: 90228 - DNA, 27 bp, Artificial Sequence
  Description of Artificial Sequence: Synthetic oligonucleotide
gatctgtcgcgcttcctggtcacacac

SEQ ID NO: 90229 - DNA, 28 bp, Artificial Sequence
  Description of Artificial Sequence: Synthetic oligonucleotide
atctgtcgcgcttcctggtcacacacag

SEQ ID NO: 90230 - DNA, 27 bp, Artificial Sequence
  Description of Artificial Sequence: Synthetic oligonucleotide
tctgtcgcgcttcctggtcacacacag

SEQ ID NO: 90231 - DNA, 26 bp, Artificial Sequence
  Description of Artificial Sequence: Synthetic oligonucleotide
ctgtcgcgcttcctggtcacacacag

SEQ ID NO: 90232 - DNA, 27 bp, Artificial Sequence
  Description of Artificial Sequence: Synthetic oligonucleotide
tgtcgcgcttcctggtcacacacagca

SEQ ID NO: 90233 - DNA, 27 bp, Artificial Sequence
  Description of Artificial Sequence: Synthetic oligonucleotide
gtcgcgcttcctggtcacacacagcat

SEQ ID NO: 90234 - DNA, 27 bp, Artificial Sequence
  Description of Artificial Sequence: Synthetic oligonucleotide
tcgcgcttcctggtcacacacagcatg

SEQ ID NO: 90235 - DNA, 26 bp, Artificial Sequence
  Description of Artificial Sequence: Synthetic oligonucleotide
cgcgcttcctggtcacacacagcatg

SEQ ID NO: 90236 - DNA, 26 bp, Artificial Sequence
  Description of Artificial Sequence: Synthetic oligonucleotide
gcgcttcctggtcacacacagcatgc

SEQ ID NO: 90237 - DNA, 26 bp, Artificial Sequence
  Description of Artificial Sequence: Synthetic oligonucleotide
cgcttcctggtcacacacagcatgcg

SEQ ID NO: 90238 - DNA, 26 bp, Artificial Sequence
  Description of Artificial Sequence: Synthetic oligonucleotide
gcttcctggtcacacacagcatgcgc

SEQ ID NO: 90239 - DNA, 27 bp, Artificial Sequence
  Description of Artificial Sequence: Synthetic oligonucleotide
cttcctggtcacacacagcatgcgcct

SEQ ID NO: 90240 - DNA, 27 bp, Artificial Sequence
  Description of Artificial Sequence: Synthetic oligonucleotide
ttcctggtcacacacagcatgcgcctg

SEQ ID NO: 90241 - DNA, 26 bp, Artificial Sequence
  Description of Artificial Sequence: Synthetic oligonucleotide
tcctggtcacacacagcatgcgcctg

SEQ ID NO: 90242 - DNA, 25 bp, Artificial Sequence
  Description of Artificial Sequence: Synthetic oligonucleotide
cctggtcacacacagcatgcgcctg

SEQ ID NO: 90243 - DNA, 26 bp, Artificial Sequence
  Description of Artificial Sequence: Synthetic oligonucleotide
ctggtcacacacagcatgcgcctggt

SEQ ID NO: 90244 - DNA, 27 bp, Artificial Sequence
  Description of Artificial Sequence: Synthetic oligonucleotide
tggtcacacacagcatgcgcctggtca

SEQ ID NO: 90245 - DNA, 26 bp, Artificial Sequence
  Description of Artificial Sequence: Synthetic oligonucleotide
ggtcacacacagcatgcgcctggtca

SEQ ID NO: 90246 - DNA, 26 bp, Artificial Sequence
  Description of Artificial Sequence: Synthetic oligonucleotide
gtcacacacagcatgcgcctggtcac

SEQ ID NO: 90247 - DNA, 26 bp, Artificial Sequence
  Description of Artificial Sequence: Synthetic oligonucleotide
tcacacacagcatgcgcctggtcacg

SEQ ID NO: 90248 - DNA, 25 bp, Artificial Sequence
  Description of Artificial Sequence: Synthetic oligonucleotide
cacacacagcatgcgcctggtcacg

SEQ ID NO: 90249 - DNA, 26 bp, Artificial Sequence
  Description of Artificial Sequence: Synthetic oligonucleotide
acacacagcatgcgcctggtcacgga

SEQ ID NO: 90250 - DNA, 25 bp, Artificial Sequence
  Description of Artificial Sequence: Synthetic oligonucleotide
cacacagcatgcgcctggtcacgga

SEQ ID NO: 90251 - DNA, 27 bp, Artificial Sequence
  Description of Artificial Sequence: Synthetic oligonucleotide
acacagcatgcgcctggtcacggagtt

SEQ ID NO: 90252 - DNA, 26 bp, Artificial Sequence
  Description of Artificial Sequence: Synthetic oligonucleotide
cacagcatgcgcctggtcacggagtt

SEQ ID NO: 90253 - DNA, 27 bp, Artificial Sequence
  Description of Artificial Sequence: Synthetic oligonucleotide
acagcatgcgcctggtcacggagttca

SEQ ID NO: 90254 - DNA, 27 bp, Artificial Sequence
  Description of Artificial Sequence: Synthetic oligonucleotide
cagcatgcgcctggtcacggagttcaa

SEQ ID NO: 90255 - DNA, 27 bp, Artificial Sequence
  Description of Artificial Sequence: Synthetic oligonucleotide
agcatgcgcctggtcacggagttcaac

SEQ ID NO: 90256 - DNA, 27 bp, Artificial Sequence
  Description of Artificial Sequence: Synthetic oligonucleotide
gcatgcgcctggtcacggagttcaaca

SEQ ID NO: 90257 - DNA, 27 bp, Artificial Sequence
  Description of Artificial Sequence: Synthetic oligonucleotide
catgcgcctggtcacggagttcaacag

SEQ ID NO: 90258 - DNA, 27 bp, Artificial Sequence
  Description of Artificial Sequence: Synthetic oligonucleotide
atgcgcctggtcacggagttcaacagc

SEQ ID NO: 90259 - DNA, 26 bp, Artificial Sequence
  Description of Artificial Sequence: Synthetic oligonucleotide
tgcgcctggtcacggagttcaacagc

SEQ ID NO: 90260 - DNA, 25 bp, Artificial Sequence
  Description of Artificial Sequence: Synthetic oligonucleotide
gcgcctggtcacggagttcaacagc

SEQ ID NO: 90261 - DNA, 26 bp, Artificial Sequence
  Description of Artificial Sequence: Synthetic oligonucleotide
cgcctggtcacggagttcaacagcca

SEQ ID NO: 90262 - DNA, 27 bp, Artificial Sequence
  Description of Artificial Sequence: Synthetic oligonucleotide
gcctggtcacggagttcaacagccaga

SEQ ID NO: 90263 - DNA, 27 bp, Artificial Sequence
  Description of Artificial Sequence: Synthetic oligonucleotide
cctggtcacggagttcaacagccagac

SEQ ID NO: 90264 - DNA, 27 bp, Artificial Sequence
  Description of Artificial Sequence: Synthetic oligonucleotide
ctggtcacggagttcaacagccagacg

SEQ ID NO: 90265 - DNA, 28 bp, Artificial Sequence
  Description of Artificial Sequence: Synthetic oligonucleotide
tggtcacggagttcaacagccagacgtc

SEQ ID NO: 90266 - DNA, 27 bp, Artificial Sequence
  Description of Artificial Sequence: Synthetic oligonucleotide
ggtcacggagttcaacagccagacgtc

SEQ ID NO: 90267 - DNA, 28 bp, Artificial Sequence
  Description of Artificial Sequence: Synthetic oligonucleotide
gtcacggagttcaacagccagacgtctg

SEQ ID NO: 90268 - DNA, 28 bp, Artificial Sequence
  Description of Artificial Sequence: Synthetic oligonucleotide
tcacggagttcaacagccagacgtctgc

SEQ ID NO: 90269 - DNA, 27 bp, Artificial Sequence
  Description of Artificial Sequence: Synthetic oligonucleotide
cacggagttcaacagccagacgtctgc

SEQ ID NO: 90270 - DNA, 27 bp, Artificial Sequence
  Description of Artificial Sequence: Synthetic oligonucleotide
acggagttcaacagccagacgtctgcc

SEQ ID NO: 90271 - DNA, 27 bp, Artificial Sequence
  Description of Artificial Sequence: Synthetic oligonucleotide
cggagttcaacagccagacgtctgcca

SEQ ID NO: 90272 - DNA, 28 bp, Artificial Sequence
  Description of Artificial Sequence: Synthetic oligonucleotide
ggagttcaacagccagacgtctgccaag

SEQ ID NO: 90273 - DNA, 30 bp, Artificial Sequence
  Description of Artificial Sequence: Synthetic oligonucleotide
gagttcaacagccagacgtctgccaagatc

SEQ ID NO: 90274 - DNA, 32 bp, Artificial Sequence
  Description of Artificial Sequence: Synthetic oligonucleotide
agttcaacagccagacgtctgccaagatcttc

SEQ ID NO: 90275 - DNA, 31 bp, Artificial Sequence
  Description of Artificial Sequence: Synthetic oligonucleotide
gttcaacagccagacgtctgccaagatcttc

SEQ ID NO: 90276 - DNA, 31 bp, Artificial Sequence
  Description of Artificial Sequence: Synthetic oligonucleotide
ttcaacagccagacgtctgccaagatcttcg

SEQ ID NO: 90277 - DNA, 30 bp, Artificial Sequence
  Description of Artificial Sequence: Synthetic oligonucleotide
tcaacagccagacgtctgccaagatcttcg

SEQ ID NO: 90278 - DNA, 29 bp, Artificial Sequence
  Description of Artificial Sequence: Synthetic oligonucleotide
caacagccagacgtctgccaagatcttcg

SEQ ID NO: 90279 - DNA, 29 bp, Artificial Sequence
  Description of Artificial Sequence: Synthetic oligonucleotide
aacagccagacgtctgccaagatcttcgc

SEQ ID NO: 90280 - DNA, 28 bp, Artificial Sequence
  Description of Artificial Sequence: Synthetic oligonucleotide
acagccagacgtctgccaagatcttcgc

SEQ ID NO: 90281 - DNA, 27 bp, Artificial Sequence
  Description of Artificial Sequence: Synthetic oligonucleotide
cagccagacgtctgccaagatcttcgc

SEQ ID NO: 90282 - DNA, 27 bp, Artificial Sequence
  Description of Artificial Sequence: Synthetic oligonucleotide
agccagacgtctgccaagatcttcgcg

SEQ ID NO: 90283 - DNA, 26 bp, Artificial Sequence
  Description of Artificial Sequence: Synthetic oligonucleotide
gccagacgtctgccaagatcttcgcg

SEQ ID NO: 90284 - DNA, 26 bp, Artificial Sequence
  Description of Artificial Sequence: Synthetic oligonucleotide
ccagacgtctgccaagatcttcgcgg

SEQ ID NO: 90285 - DNA, 26 bp, Artificial Sequence
  Description of Artificial Sequence: Synthetic oligonucleotide
cagacgtctgccaagatcttcgcggc

SEQ ID NO: 90286 - DNA, 27 bp, Artificial Sequence
  Description of Artificial Sequence: Synthetic oligonucleotide
agacgtctgccaagatcttcgcggcca

SEQ ID NO: 90287 - DNA, 26 bp, Artificial Sequence
  Description of Artificial Sequence: Synthetic oligonucleotide
gacgtctgccaagatcttcgcggcca

SEQ ID NO: 90288 - DNA, 26 bp, Artificial Sequence
  Description of Artificial Sequence: Synthetic oligonucleotide
acgtctgccaagatcttcgcggccag

SEQ ID NO: 90289 - DNA, 25 bp, Artificial Sequence
  Description of Artificial Sequence: Synthetic oligonucleotide
cgtctgccaagatcttcgcggccag

SEQ ID NO: 90290 - DNA, 27 bp, Artificial Sequence
  Description of Artificial Sequence: Synthetic oligonucleotide
gtctgccaagatcttcgcggccaggat

SEQ ID NO: 90291 - DNA, 27 bp, Artificial Sequence
  Description of Artificial Sequence: Synthetic oligonucleotide
tctgccaagatcttcgcggccaggatc

SEQ ID NO: 90292 - DNA, 26 bp, Artificial Sequence
  Description of Artificial Sequence: Synthetic oligonucleotide
ctgccaagatcttcgcggccaggatc

SEQ ID NO: 90293 - DNA, 27 bp, Artificial Sequence
  Description of Artificial Sequence: Synthetic oligonucleotide
tgccaagatcttcgcggccaggatcct

SEQ ID NO: 90294 - DNA, 26 bp, Artificial Sequence
  Description of Artificial Sequence: Synthetic oligonucleotide
gccaagatcttcgcggccaggatcct

SEQ ID NO: 90295 - DNA, 27 bp, Artificial Sequence
  Description of Artificial Sequence: Synthetic oligonucleotide
ccaagatcttcgcggccaggatcctca

SEQ ID NO: 90296 - DNA, 28 bp, Artificial Sequence
  Description of Artificial Sequence: Synthetic oligonucleotide
caagatcttcgcggccaggatcctcaac

SEQ ID NO: 90297 - DNA, 28 bp, Artificial Sequence
  Description of Artificial Sequence: Synthetic oligonucleotide
aagatcttcgcggccaggatcctcaacc

SEQ ID NO: 90298 - DNA, 27 bp, Artificial Sequence
  Description of Artificial Sequence: Synthetic oligonucleotide
agatcttcgcggccaggatcctcaacc

SEQ ID NO: 90299 - DNA, 27 bp, Artificial Sequence
  Description of Artificial Sequence: Synthetic oligonucleotide
gatcttcgcggccaggatcctcaacca

SEQ ID NO: 90300 - DNA, 27 bp, Artificial Sequence
  Description of Artificial Sequence: Synthetic oligonucleotide
atcttcgcggccaggatcctcaaccac

SEQ ID NO: 90301 - DNA, 26 bp, Artificial Sequence
  Description of Artificial Sequence: Synthetic oligonucleotide
tcttcgcggccaggatcctcaaccac

SEQ ID NO: 90302 - DNA, 25 bp, Artificial Sequence
  Description of Artificial Sequence: Synthetic oligonucleotide
cttcgcggccaggatcctcaaccac

SEQ ID NO: 90303 - DNA, 26 bp, Artificial Sequence
  Description of Artificial Sequence: Synthetic oligonucleotide
ttcgcggccaggatcctcaaccacct

SEQ ID NO: 90304 - DNA, 25 bp, Artificial Sequence
  Description of Artificial Sequence: Synthetic oligonucleotide
tcgcggccaggatcctcaaccacct

SEQ ID NO: 90305 - DNA, 24 bp, Artificial Sequence
  Description of Artificial Sequence: Synthetic oligonucleotide
cgcggccaggatcctcaaccacct

SEQ ID NO: 90306 - DNA, 24 bp, Artificial Sequence
  Description of Artificial Sequence: Synthetic oligonucleotide
gcggccaggatcctcaaccacctg

SEQ ID NO: 90307 - DNA, 25 bp, Artificial Sequence
  Description of Artificial Sequence: Synthetic oligonucleotide
cggccaggatcctcaaccacctgct

SEQ ID NO: 90308 - DNA, 25 bp, Artificial Sequence
  Description of Artificial Sequence: Synthetic oligonucleotide
ggccaggatcctcaaccacctgctg

SEQ ID NO: 90309 - DNA, 26 bp, Artificial Sequence
  Description of Artificial Sequence: Synthetic oligonucleotide
gccaggatcctcaaccacctgctgct

SEQ ID NO: 90310 - DNA, 27 bp, Artificial Sequence
  Description of Artificial Sequence: Synthetic oligonucleotide
ccaggatcctcaaccacctgctgctgt

SEQ ID NO: 90311 - DNA, 29 bp, Artificial Sequence
  Description of Artificial Sequence: Synthetic oligonucleotide
caggatcctcaaccacctgctgctgtttg

SEQ ID NO: 90312 - DNA, 30 bp, Artificial Sequence
  Description of Artificial Sequence: Synthetic oligonucleotide
aggatcctcaaccacctgctgctgtttgtc

SEQ ID NO: 90313 - DNA, 29 bp, Artificial Sequence
  Description of Artificial Sequence: Synthetic oligonucleotide
ggatcctcaaccacctgctgctgtttgtc

SEQ ID NO: 90314 - DNA, 31 bp, Artificial Sequence
  Description of Artificial Sequence: Synthetic oligonucleotide
gatcctcaaccacctgctgctgtttgtcaac

SEQ ID NO: 90315 - DNA, 31 bp, Artificial Sequence
  Description of Artificial Sequence: Synthetic oligonucleotide
atcctcaaccacctgctgctgtttgtcaacc

SEQ ID NO: 90316 - DNA, 30 bp, Artificial Sequence
  Description of Artificial Sequence: Synthetic oligonucleotide
tcctcaaccacctgctgctgtttgtcaacc

SEQ ID NO: 90317 - DNA, 29 bp, Artificial Sequence
  Description of Artificial Sequence: Synthetic oligonucleotide
cctcaaccacctgctgctgtttgtcaacc

SEQ ID NO: 90318 - DNA, 30 bp, Artificial Sequence
  Description of Artificial Sequence: Synthetic oligonucleotide
ctcaaccacctgctgctgtttgtcaaccag

SEQ ID NO: 90319 - DNA, 31 bp, Artificial Sequence
  Description of Artificial Sequence: Synthetic oligonucleotide
tcaaccacctgctgctgtttgtcaaccagac

SEQ ID NO: 90320 - DNA, 30 bp, Artificial Sequence
  Description of Artificial Sequence: Synthetic oligonucleotide
caaccacctgctgctgtttgtcaaccagac

SEQ ID NO: 90321 - DNA, 30 bp, Artificial Sequence
  Description of Artificial Sequence: Synthetic oligonucleotide
aaccacctgctgctgtttgtcaaccagacg

SEQ ID NO: 90322 - DNA, 29 bp, Artificial Sequence
  Description of Artificial Sequence: Synthetic oligonucleotide
accacctgctgctgtttgtcaaccagacg

SEQ ID NO: 90323 - DNA, 28 bp, Artificial Sequence
  Description of Artificial Sequence: Synthetic oligonucleotide
ccacctgctgctgtttgtcaaccagacg

SEQ ID NO: 90324 - DNA, 28 bp, Artificial Sequence
  Description of Artificial Sequence: Synthetic oligonucleotide
cacctgctgctgtttgtcaaccagacgc

SEQ ID NO: 90325 - DNA, 29 bp, Artificial Sequence
  Description of Artificial Sequence: Synthetic oligonucleotide
acctgctgctgtttgtcaaccagacgctg

SEQ ID NO: 90326 - DNA, 28 bp, Artificial Sequence
  Description of Artificial Sequence: Synthetic oligonucleotide
cctgctgctgtttgtcaaccagacgctg

SEQ ID NO: 90327 - DNA, 28 bp, Artificial Sequence
  Description of Artificial Sequence: Synthetic oligonucleotide
ctgctgctgtttgtcaaccagacgctgg

SEQ ID NO: 90328 - DNA, 28 bp, Artificial Sequence
  Description of Artificial Sequence: Synthetic oligonucleotide
tgctgctgtttgtcaaccagacgctggc

SEQ ID NO: 90329 - DNA, 27 bp, Artificial Sequence
  Description of Artificial Sequence: Synthetic oligonucleotide
gctgctgtttgtcaaccagacgctggc

SEQ ID NO: 90330 - DNA, 28 bp, Artificial Sequence
  Description of Artificial Sequence: Synthetic oligonucleotide
ctgctgtttgtcaaccagacgctggctg

SEQ ID NO: 90331 - DNA, 28 bp, Artificial Sequence
  Description of Artificial Sequence: Synthetic oligonucleotide
tgctgtttgtcaaccagacgctggctgc

SEQ ID NO: 90332 - DNA, 27 bp, Artificial Sequence
  Description of Artificial Sequence: Synthetic oligonucleotide
gctgtttgtcaaccagacgctggctgc

SEQ ID NO: 90333 - DNA, 27 bp, Artificial Sequence
  Description of Artificial Sequence: Synthetic oligonucleotide
ctgtttgtcaaccagacgctggctgcg

SEQ ID NO: 90334 - DNA, 27 bp, Artificial Sequence
  Description of Artificial Sequence: Synthetic oligonucleotide
tgtttgtcaaccagacgctggctgcgc

SEQ ID NO: 90335 - DNA, 27 bp, Artificial Sequence
  Description of Artificial Sequence: Synthetic oligonucleotide
gtttgtcaaccagacgctggctgcgca

SEQ ID NO: 90336 - DNA, 27 bp, Artificial Sequence
  Description of Artificial Sequence: Synthetic oligonucleotide
tttgtcaaccagacgctggctgcgcac

SEQ ID NO: 90337 - DNA, 26 bp, Artificial Sequence
  Description of Artificial Sequence: Synthetic oligonucleotide
ttgtcaaccagacgctggctgcgcac

SEQ ID NO: 90338 - DNA, 25 bp, Artificial Sequence
  Description of Artificial Sequence: Synthetic oligonucleotide
tgtcaaccagacgctggctgcgcac

SEQ ID NO: 90339 - DNA, 24 bp, Artificial Sequence
  Description of Artificial Sequence: Synthetic oligonucleotide
gtcaaccagacgctggctgcgcac

SEQ ID NO: 90340 - DNA, 24 bp, Artificial Sequence
  Description of Artificial Sequence: Synthetic oligonucleotide
tcaaccagacgctggctgcgcacc

SEQ ID NO: 90341 - DNA, 23 bp, Artificial Sequence
  Description of Artificial Sequence: Synthetic oligonucleotide
caaccagacgctggctgcgcacc

SEQ ID NO: 90342 - DNA, 23 bp, Artificial Sequence
  Description of Artificial Sequence: Synthetic oligonucleotide
aaccagacgctggctgcgcaccg

SEQ ID NO: 90343 - DNA, 22 bp, Artificial Sequence
  Description of Artificial Sequence: Synthetic oligonucleotide
accagacgctggctgcgcaccg

SEQ ID NO: 90344 - DNA, 21 bp, Artificial Sequence
  Description of Artificial Sequence: Synthetic oligonucleotide
ccagacgctggctgcgcaccg

SEQ ID NO: 90345 - DNA, 21 bp, Artificial Sequence
  Description of Artificial Sequence: Synthetic oligonucleotide
cagacgctggctgcgcaccgg

SEQ ID NO: 90346 - DNA, 22 bp, Artificial Sequence
  Description of Artificial Sequence: Synthetic oligonucleotide
agacgctggctgcgcaccggga

SEQ ID NO: 90347 - DNA, 21 bp, Artificial Sequence
  Description of Artificial Sequence: Synthetic oligonucleotide
gacgctggctgcgcaccggga

SEQ ID NO: 90348 - DNA, 21 bp, Artificial Sequence
  Description of Artificial Sequence: Synthetic oligonucleotide
acgctggctgcgcaccgggag

SEQ ID NO: 90349 - DNA, 20 bp, Artificial Sequence
  Description of Artificial Sequence: Synthetic oligonucleotide
cgctggctgcgcaccgggag

SEQ ID NO: 90350 - DNA, 21 bp, Artificial Sequence
  Description of Artificial Sequence: Synthetic oligonucleotide
gctggctgcgcaccgggagct

SEQ ID NO: 90351 - DNA, 21 bp, Artificial Sequence
  Description of Artificial Sequence: Synthetic oligonucleotide
ctggctgcgcaccgggagctc

SEQ ID NO: 90352 - DNA, 23 bp, Artificial Sequence
  Description of Artificial Sequence: Synthetic oligonucleotide
tggctgcgcaccgggagctccta

SEQ ID NO: 90353 - DNA, 22 bp, Artificial Sequence
  Description of Artificial Sequence: Synthetic oligonucleotide
ggctgcgcaccgggagctccta

SEQ ID NO: 90354 - DNA, 22 bp, Artificial Sequence
  Description of Artificial Sequence: Synthetic oligonucleotide
gctgcgcaccgggagctcctag

SEQ ID NO: 90355 - DNA, 22 bp, Artificial Sequence
  Description of Artificial Sequence: Synthetic oligonucleotide
ctgcgcaccgggagctcctagc

SEQ ID NO: 90356 - DNA, 22 bp, Artificial Sequence
  Description of Artificial Sequence: Synthetic oligonucleotide
tgcgcaccgggagctcctagcg

SEQ ID NO: 90357 - DNA, 21 bp, Artificial Sequence
  Description of Artificial Sequence: Synthetic oligonucleotide
gcgcaccgggagctcctagcg

SEQ ID NO: 90358 - DNA, 21 bp, Artificial Sequence
  Description of Artificial Sequence: Synthetic oligonucleotide
cgcaccgggagctcctagcgg

SEQ ID NO: 90359 - DNA, 21 bp, Artificial Sequence
  Description of Artificial Sequence: Synthetic oligonucleotide
gcaccgggagctcctagcggg

SEQ ID NO: 90360 - DNA, 24 bp, Artificial Sequence
  Description of Artificial Sequence: Synthetic oligonucleotide
caccgggagctcctagcgggcttt

SEQ ID NO: 90361 - DNA, 24 bp, Artificial Sequence
  Description of Artificial Sequence: Synthetic oligonucleotide
accgggagctcctagcgggctttg

SEQ ID NO: 90362 - DNA, 23 bp, Artificial Sequence
  Description of Artificial Sequence: Synthetic oligonucleotide
ccgggagctcctagcgggctttg

SEQ ID NO: 90363 - DNA, 23 bp, Artificial Sequence
  Description of Artificial Sequence: Synthetic oligonucleotide
cgggagctcctagcgggctttgg

SEQ ID NO: 90364 - DNA, 23 bp, Artificial Sequence
  Description of Artificial Sequence: Synthetic oligonucleotide
gggagctcctagcgggctttggg

SEQ ID NO: 90365 - DNA, 24 bp, Artificial Sequence
  Description of Artificial Sequence: Synthetic oligonucleotide
ggagctcctagcgggctttgggga

SEQ ID NO: 90366 - DNA, 24 bp, Artificial Sequence
  Description of Artificial Sequence: Synthetic oligonucleotide
gagctcctagcgggctttggggag

SEQ ID NO: 90367 - DNA, 24 bp, Artificial Sequence
  Description of Artificial Sequence: Synthetic oligonucleotide
agctcctagcgggctttggggagg

SEQ ID NO: 90368 - DNA, 23 bp, Artificial Sequence
  Description of Artificial Sequence: Synthetic oligonucleotide
gctcctagcgggctttggggagg

SEQ ID NO: 90369 - DNA, 24 bp, Artificial Sequence
  Description of Artificial Sequence: Synthetic oligonucleotide
ctcctagcgggctttggggaggca

SEQ ID NO: 90370 - DNA, 24 bp, Artificial Sequence
  Description of Artificial Sequence: Synthetic oligonucleotide
tcctagcgggctttggggaggcag

SEQ ID NO: 90371 - DNA, 23 bp, Artificial Sequence
  Description of Artificial Sequence: Synthetic oligonucleotide
cctagcgggctttggggaggcag

SEQ ID NO: 90372 - DNA, 24 bp, Artificial Sequence
  Description of Artificial Sequence: Synthetic oligonucleotide
ctagcgggctttggggaggcagct

SEQ ID NO: 90373 - DNA, 24 bp, Artificial Sequence
  Description of Artificial Sequence: Synthetic oligonucleotide
tagcgggctttggggaggcagctc

SEQ ID NO: 90374 - DNA, 23 bp, Artificial Sequence
  Description of Artificial Sequence: Synthetic oligonucleotide
agcgggctttggggaggcagctc

SEQ ID NO: 90375 - DNA, 22 bp, Artificial Sequence
  Description of Artificial Sequence: Synthetic oligonucleotide
gcgggctttggggaggcagctc

SEQ ID NO: 90376 - DNA, 22 bp, Artificial Sequence
  Description of Artificial Sequence: Synthetic oligonucleotide
cgggctttggggaggcagctcc

SEQ ID NO: 90377 - DNA, 22 bp, Artificial Sequence
  Description of Artificial Sequence: Synthetic oligonucleotide
gggctttggggaggcagctccc

SEQ ID NO: 90378 - DNA, 22 bp, Artificial Sequence
  Description of Artificial Sequence: Synthetic oligonucleotide
ggctttggggaggcagctcccc

SEQ ID NO: 90379 - DNA, 22 bp, Artificial Sequence
  Description of Artificial Sequence: Synthetic oligonucleotide
gctttggggaggcagctccccg

SEQ ID NO: 90380 - DNA, 24 bp, Artificial Sequence
  Description of Artificial Sequence: Synthetic oligonucleotide
ctttggggaggcagctccccgctt

SEQ ID NO: 90381 - DNA, 24 bp, Artificial Sequence
  Description of Artificial Sequence: Synthetic oligonucleotide
tttggggaggcagctccccgcttc

SEQ ID NO: 90382 - DNA, 23 bp, Artificial Sequence
  Description of Artificial Sequence: Synthetic oligonucleotide
ttggggaggcagctccccgcttc

SEQ ID NO: 90383 - DNA, 22 bp, Artificial Sequence
  Description of Artificial Sequence: Synthetic oligonucleotide
tggggaggcagctccccgcttc

SEQ ID NO: 90384 - DNA, 21 bp, Artificial Sequence
  Description of Artificial Sequence: Synthetic oligonucleotide
ggggaggcagctccccgcttc

SEQ ID NO: 90385 - DNA, 21 bp, Artificial Sequence
  Description of Artificial Sequence: Synthetic oligonucleotide
gggaggcagctccccgcttcc

SEQ ID NO: 90386 - DNA, 21 bp, Artificial Sequence
  Description of Artificial Sequence: Synthetic oligonucleotide
ggaggcagctccccgcttccg

SEQ ID NO: 90387 - DNA, 21 bp, Artificial Sequence
  Description of Artificial Sequence: Synthetic oligonucleotide
gaggcagctccccgcttccgg

SEQ ID NO: 90388 - DNA, 21 bp, Artificial Sequence
  Description of Artificial Sequence: Synthetic oligonucleotide
aggcagctccccgcttccggg

SEQ ID NO: 90389 - DNA, 20 bp, Artificial Sequence
  Description of Artificial Sequence: Synthetic oligonucleotide
ggcagctccccgcttccggg

SEQ ID NO: 90390 - DNA, 20 bp, Artificial Sequence
  Description of Artificial Sequence: Synthetic oligonucleotide
gcagctccccgcttccgggg

SEQ ID NO: 90391 - DNA, 20 bp, Artificial Sequence
  Description of Artificial Sequence: Synthetic oligonucleotide
cagctccccgcttccggggg

SEQ ID NO: 90392 - DNA, 21 bp, Artificial Sequence
  Description of Artificial Sequence: Synthetic oligonucleotide
agctccccgcttccgggggca

SEQ ID NO: 90393 - DNA, 20 bp, Artificial Sequence
  Description of Artificial Sequence: Synthetic oligonucleotide
gctccccgcttccgggggca

SEQ ID NO: 90394 - DNA, 20 bp, Artificial Sequence
  Description of Artificial Sequence: Synthetic oligonucleotide
ctccccgcttccgggggcag

SEQ ID NO: 90395 - DNA, 21 bp, Artificial Sequence
  Description of Artificial Sequence: Synthetic oligonucleotide
tccccgcttccgggggcaggt

SEQ ID NO: 90396 - DNA, 20 bp, Artificial Sequence
  Description of Artificial Sequence: Synthetic oligonucleotide
ccccgcttccgggggcaggt

SEQ ID NO: 90397 - DNA, 20 bp, Artificial Sequence
  Description of Artificial Sequence: Synthetic oligonucleotide
cccgcttccgggggcaggtg

SEQ ID NO: 90398 - DNA, 21 bp, Artificial Sequence
  Description of Artificial Sequence: Synthetic oligonucleotide
ccgcttccgggggcaggtgct

SEQ ID NO: 90399 - DNA, 23 bp, Artificial Sequence
  Description of Artificial Sequence: Synthetic oligonucleotide
cgcttccgggggcaggtgctgtt

SEQ ID NO: 90400 - DNA, 23 bp, Artificial Sequence
  Description of Artificial Sequence: Synthetic oligonucleotide
gcttccgggggcaggtgctgttc

SEQ ID NO: 90401 - DNA, 24 bp, Artificial Sequence
  Description of Artificial Sequence: Synthetic oligonucleotide
cttccgggggcaggtgctgttcgt

SEQ ID NO: 90402 - DNA, 24 bp, Artificial Sequence
  Description of Artificial Sequence: Synthetic oligonucleotide
ttccgggggcaggtgctgttcgtg

SEQ ID NO: 90403 - DNA, 23 bp, Artificial Sequence
  Description of Artificial Sequence: Synthetic oligonucleotide
tccgggggcaggtgctgttcgtg

SEQ ID NO: 90404 - DNA, 22 bp, Artificial Sequence
  Description of Artificial Sequence: Synthetic oligonucleotide
ccgggggcaggtgctgttcgtg

SEQ ID NO: 90405 - DNA, 23 bp, Artificial Sequence
  Description of Artificial Sequence: Synthetic oligonucleotide
cgggggcaggtgctgttcgtggt

SEQ ID NO: 90406 - DNA, 23 bp, Artificial Sequence
  Description of Artificial Sequence: Synthetic oligonucleotide
gggggcaggtgctgttcgtggtg

SEQ ID NO: 90407 - DNA, 24 bp, Artificial Sequence
  Description of Artificial Sequence: Synthetic oligonucleotide
ggggcaggtgctgttcgtggtggt

SEQ ID NO: 90408 - DNA, 24 bp, Artificial Sequence
  Description of Artificial Sequence: Synthetic oligonucleotide
gggcaggtgctgttcgtggtggtg

SEQ ID NO: 90409 - DNA, 25 bp, Artificial Sequence
  Description of Artificial Sequence: Synthetic oligonucleotide
ggcaggtgctgttcgtggtggtgga

SEQ ID NO: 90410 - DNA, 25 bp, Artificial Sequence
  Description of Artificial Sequence: Synthetic oligonucleotide
gcaggtgctgttcgtggtggtggac

SEQ ID NO: 90411 - DNA, 26 bp, Artificial Sequence
  Description of Artificial Sequence: Synthetic oligonucleotide
caggtgctgttcgtggtggtggacgt

SEQ ID NO: 90412 - DNA, 26 bp, Artificial Sequence
  Description of Artificial Sequence: Synthetic oligonucleotide
aggtgctgttcgtggtggtggacgtg

SEQ ID NO: 90413 - DNA, 25 bp, Artificial Sequence
  Description of Artificial Sequence: Synthetic oligonucleotide
ggtgctgttcgtggtggtggacgtg

SEQ ID NO: 90414 - DNA, 25 bp, Artificial Sequence
  Description of Artificial Sequence: Synthetic oligonucleotide
gtgctgttcgtggtggtggacgtgg

SEQ ID NO: 90415 - DNA, 25 bp, Artificial Sequence
  Description of Artificial Sequence: Synthetic oligonucleotide
tgctgttcgtggtggtggacgtggc

SEQ ID NO: 90416 - DNA, 24 bp, Artificial Sequence
  Description of Artificial Sequence: Synthetic oligonucleotide
gctgttcgtggtggtggacgtggc

SEQ ID NO: 90417 - DNA, 24 bp, Artificial Sequence
  Description of Artificial Sequence: Synthetic oligonucleotide
ctgttcgtggtggtggacgtggcg

SEQ ID NO: 90418 - DNA, 24 bp, Artificial Sequence
  Description of Artificial Sequence: Synthetic oligonucleotide
tgttcgtggtggtggacgtggcgg

SEQ ID NO: 90419 - DNA, 23 bp, Artificial Sequence
  Description of Artificial Sequence: Synthetic oligonucleotide
gttcgtggtggtggacgtggcgg

SEQ ID NO: 90420 - DNA, 23 bp, Artificial Sequence
  Description of Artificial Sequence: Synthetic oligonucleotide
ttcgtggtggtggacgtggcggc

SEQ ID NO: 90421 - DNA, 22 bp, Artificial Sequence
  Description of Artificial Sequence: Synthetic oligonucleotide
tcgtggtggtggacgtggcggc

SEQ ID NO: 90422 - DNA, 21 bp, Artificial Sequence
  Description of Artificial Sequence: Synthetic oligonucleotide
cgtggtggtggacgtggcggc

SEQ ID NO: 90423 - DNA, 21 bp, Artificial Sequence
  Description of Artificial Sequence: Synthetic oligonucleotide
gtggtggtggacgtggcggcc

SEQ ID NO: 90424 - DNA, 22 bp, Artificial Sequence
  Description of Artificial Sequence: Synthetic oligonucleotide
tggtggtggacgtggcggccga

SEQ ID NO: 90425 - DNA, 21 bp, Artificial Sequence
  Description of Artificial Sequence: Synthetic oligonucleotide
ggtggtggacgtggcggccga

SEQ ID NO: 90426 - DNA, 24 bp, Artificial Sequence
  Description of Artificial Sequence: Synthetic oligonucleotide
gtggtggacgtggcggccgacaat

SEQ ID NO: 90427 - DNA, 25 bp, Artificial Sequence
  Description of Artificial Sequence: Synthetic oligonucleotide
tggtggacgtggcggccgacaatga

SEQ ID NO: 90428 - DNA, 24 bp, Artificial Sequence
  Description of Artificial Sequence: Synthetic oligonucleotide
ggtggacgtggcggccgacaatga

SEQ ID NO: 90429 - DNA, 24 bp, Artificial Sequence
  Description of Artificial Sequence: Synthetic oligonucleotide
gtggacgtggcggccgacaatgag

SEQ ID NO: 90430 - DNA, 25 bp, Artificial Sequence
  Description of Artificial Sequence: Synthetic oligonucleotide
tggacgtggcggccgacaatgagca

SEQ ID NO: 90431 - DNA, 24 bp, Artificial Sequence
  Description of Artificial Sequence: Synthetic oligonucleotide
ggacgtggcggccgacaatgagca

SEQ ID NO: 90432 - DNA, 24 bp, Artificial Sequence
  Description of Artificial Sequence: Synthetic oligonucleotide
gacgtggcggccgacaatgagcac

SEQ ID NO: 90433 - DNA, 25 bp, Artificial Sequence
  Description of Artificial Sequence: Synthetic oligonucleotide
acgtggcggccgacaatgagcacgt

SEQ ID NO: 90434 - DNA, 24 bp, Artificial Sequence
  Description of Artificial Sequence: Synthetic oligonucleotide
cgtggcggccgacaatgagcacgt

SEQ ID NO: 90435 - DNA, 24 bp, Artificial Sequence
  Description of Artificial Sequence: Synthetic oligonucleotide
gtggcggccgacaatgagcacgtg

SEQ ID NO: 90436 - DNA, 25 bp, Artificial Sequence
  Description of Artificial Sequence: Synthetic oligonucleotide
tggcggccgacaatgagcacgtgct

SEQ ID NO: 90437 - DNA, 24 bp, Artificial Sequence
  Description of Artificial Sequence: Synthetic oligonucleotide
ggcggccgacaatgagcacgtgct

SEQ ID NO: 90438 - DNA, 24 bp, Artificial Sequence
  Description of Artificial Sequence: Synthetic oligonucleotide
gcggccgacaatgagcacgtgctg

SEQ ID NO: 90439 - DNA, 25 bp, Artificial Sequence
  Description of Artificial Sequence: Synthetic oligonucleotide
cggccgacaatgagcacgtgctgca

SEQ ID NO: 90440 - DNA, 27 bp, Artificial Sequence
  Description of Artificial Sequence: Synthetic oligonucleotide
ggccgacaatgagcacgtgctgcagta

SEQ ID NO: 90441 - DNA, 27 bp, Artificial Sequence
  Description of Artificial Sequence: Synthetic oligonucleotide
gccgacaatgagcacgtgctgcagtac

SEQ ID NO: 90442 - DNA, 30 bp, Artificial Sequence
  Description of Artificial Sequence: Synthetic oligonucleotide
ccgacaatgagcacgtgctgcagtactttg

SEQ ID NO: 90443 - DNA, 30 bp, Artificial Sequence
  Description of Artificial Sequence: Synthetic oligonucleotide
cgacaatgagcacgtgctgcagtactttgg

SEQ ID NO: 90444 - DNA, 31 bp, Artificial Sequence
  Description of Artificial Sequence: Synthetic oligonucleotide
gacaatgagcacgtgctgcagtactttggac

SEQ ID NO: 90445 - DNA, 32 bp, Artificial Sequence
  Description of Artificial Sequence: Synthetic oligonucleotide
acaatgagcacgtgctgcagtactttggactc

SEQ ID NO: 90446 - DNA, 31 bp, Artificial Sequence
  Description of Artificial Sequence: Synthetic oligonucleotide
caatgagcacgtgctgcagtactttggactc

SEQ ID NO: 90447 - DNA, 33 bp, Artificial Sequence
  Description of Artificial Sequence: Synthetic oligonucleotide
aatgagcacgtgctgcagtactttggactcaag

SEQ ID NO: 90448 - DNA, 32 bp, Artificial Sequence
  Description of Artificial Sequence: Synthetic oligonucleotide
atgagcacgtgctgcagtactttggactcaag

SEQ ID NO: 90449 - DNA, 31 bp, Artificial Sequence
  Description of Artificial Sequence: Synthetic oligonucleotide
tgagcacgtgctgcagtactttggactcaag

SEQ ID NO: 90450 - DNA, 30 bp, Artificial Sequence
  Description of Artificial Sequence: Synthetic oligonucleotide
gagcacgtgctgcagtactttggactcaag

SEQ ID NO: 90451 - DNA, 30 bp, Artificial Sequence
  Description of Artificial Sequence: Synthetic oligonucleotide
agcacgtgctgcagtactttggactcaagg

SEQ ID NO: 90452 - DNA, 29 bp, Artificial Sequence
  Description of Artificial Sequence: Synthetic oligonucleotide
gcacgtgctgcagtactttggactcaagg

SEQ ID NO: 90453 - DNA, 29 bp, Artificial Sequence
  Description of Artificial Sequence: Synthetic oligonucleotide
cacgtgctgcagtactttggactcaaggc

SEQ ID NO: 90454 - DNA, 30 bp, Artificial Sequence
  Description of Artificial Sequence: Synthetic oligonucleotide
acgtgctgcagtactttggactcaaggctg

SEQ ID NO: 90455 - DNA, 29 bp, Artificial Sequence
  Description of Artificial Sequence: Synthetic oligonucleotide
cgtgctgcagtactttggactcaaggctg

SEQ ID NO: 90456 - DNA, 30 bp, Artificial Sequence
  Description of Artificial Sequence: Synthetic oligonucleotide
gtgctgcagtactttggactcaaggctgag

SEQ ID NO: 90457 - DNA, 30 bp, Artificial Sequence
  Description of Artificial Sequence: Synthetic oligonucleotide
tgctgcagtactttggactcaaggctgagg

SEQ ID NO: 90458 - DNA, 29 bp, Artificial Sequence
  Description of Artificial Sequence: Synthetic oligonucleotide
gctgcagtactttggactcaaggctgagg

SEQ ID NO: 90459 - DNA, 29 bp, Artificial Sequence
  Description of Artificial Sequence: Synthetic oligonucleotide
ctgcagtactttggactcaaggctgaggc

SEQ ID NO: 90460 - DNA, 30 bp, Artificial Sequence
  Description of Artificial Sequence: Synthetic oligonucleotide
tgcagtactttggactcaaggctgaggcag

SEQ ID NO: 90461 - DNA, 29 bp, Artificial Sequence
  Description of Artificial Sequence: Synthetic oligonucleotide
gcagtactttggactcaaggctgaggcag

SEQ ID NO: 90462 - DNA, 29 bp, Artificial Sequence
  Description of Artificial Sequence: Synthetic oligonucleotide
cagtactttggactcaaggctgaggcagc

SEQ ID NO: 90463 - DNA, 29 bp, Artificial Sequence
  Description of Artificial Sequence: Synthetic oligonucleotide
agtactttggactcaaggctgaggcagcc

SEQ ID NO: 90464 - DNA, 28 bp, Artificial Sequence
  Description of Artificial Sequence: Synthetic oligonucleotide
gtactttggactcaaggctgaggcagcc

SEQ ID NO: 90465 - DNA, 28 bp, Artificial Sequence
  Description of Artificial Sequence: Synthetic oligonucleotide
tactttggactcaaggctgaggcagccc

SEQ ID NO: 90466 - DNA, 27 bp, Artificial Sequence
  Description of Artificial Sequence: Synthetic oligonucleotide
actttggactcaaggctgaggcagccc

SEQ ID NO: 90467 - DNA, 26 bp, Artificial Sequence
  Description of Artificial Sequence: Synthetic oligonucleotide
ctttggactcaaggctgaggcagccc

SEQ ID NO: 90468 - DNA, 26 bp, Artificial Sequence
  Description of Artificial Sequence: Synthetic oligonucleotide
tttggactcaaggctgaggcagcccc

SEQ ID NO: 90469 - DNA, 25 bp, Artificial Sequence
  Description of Artificial Sequence: Synthetic oligonucleotide
ttggactcaaggctgaggcagcccc

SEQ ID NO: 90470 - DNA, 24 bp, Artificial Sequence
  Description of Artificial Sequence: Synthetic oligonucleotide
tggactcaaggctgaggcagcccc

SEQ ID NO: 90471 - DNA, 23 bp, Artificial Sequence
  Description of Artificial Sequence: Synthetic oligonucleotide
ggactcaaggctgaggcagcccc

SEQ ID NO: 90472 - DNA, 24 bp, Artificial Sequence
  Description of Artificial Sequence: Synthetic oligonucleotide
gactcaaggctgaggcagccccca

SEQ ID NO: 90473 - DNA, 25 bp, Artificial Sequence
  Description of Artificial Sequence: Synthetic oligonucleotide
actcaaggctgaggcagcccccact

SEQ ID NO: 90474 - DNA, 24 bp, Artificial Sequence
  Description of Artificial Sequence: Synthetic oligonucleotide
ctcaaggctgaggcagcccccact

SEQ ID NO: 90475 - DNA, 25 bp, Artificial Sequence
  Description of Artificial Sequence: Synthetic oligonucleotide
tcaaggctgaggcagcccccactct

SEQ ID NO: 90476 - DNA, 24 bp, Artificial Sequence
  Description of Artificial Sequence: Synthetic oligonucleotide
caaggctgaggcagcccccactct

SEQ ID NO: 90477 - DNA, 24 bp, Artificial Sequence
  Description of Artificial Sequence: Synthetic oligonucleotide
aaggctgaggcagcccccactctg

SEQ ID NO: 90478 - DNA, 23 bp, Artificial Sequence
  Description of Artificial Sequence: Synthetic oligonucleotide
aggctgaggcagcccccactctg

SEQ ID NO: 90479 - DNA, 22 bp, Artificial Sequence
  Description of Artificial Sequence: Synthetic oligonucleotide
ggctgaggcagcccccactctg

SEQ ID NO: 90480 - DNA, 22 bp, Artificial Sequence
  Description of Artificial Sequence: Synthetic oligonucleotide
gctgaggcagcccccactctgc

SEQ ID NO: 90481 - DNA, 22 bp, Artificial Sequence
  Description of Artificial Sequence: Synthetic oligonucleotide
ctgaggcagcccccactctgcg

SEQ ID NO: 90482 - DNA, 24 bp, Artificial Sequence
  Description of Artificial Sequence: Synthetic oligonucleotide
tgaggcagcccccactctgcgctt

SEQ ID NO: 90483 - DNA, 23 bp, Artificial Sequence
  Description of Artificial Sequence: Synthetic oligonucleotide
gaggcagcccccactctgcgctt

SEQ ID NO: 90484 - DNA, 23 bp, Artificial Sequence
  Description of Artificial Sequence: Synthetic oligonucleotide
aggcagcccccactctgcgcttg

SEQ ID NO: 90485 - DNA, 22 bp, Artificial Sequence
  Description of Artificial Sequence: Synthetic oligonucleotide
ggcagcccccactctgcgcttg

SEQ ID NO: 90486 - DNA, 23 bp, Artificial Sequence
  Description of Artificial Sequence: Synthetic oligonucleotide
gcagcccccactctgcgcttggt

SEQ ID NO: 90487 - DNA, 25 bp, Artificial Sequence
  Description of Artificial Sequence: Synthetic oligonucleotide
cagcccccactctgcgcttggtcaa

SEQ ID NO: 90488 - DNA, 25 bp, Artificial Sequence
  Description of Artificial Sequence: Synthetic oligonucleotide
agcccccactctgcgcttggtcaac

SEQ ID NO: 90489 - DNA, 24 bp, Artificial Sequence
  Description of Artificial Sequence: Synthetic oligonucleotide
gcccccactctgcgcttggtcaac

SEQ ID NO: 90490 - DNA, 26 bp, Artificial Sequence
  Description of Artificial Sequence: Synthetic oligonucleotide
cccccactctgcgcttggtcaacctt

SEQ ID NO: 90491 - DNA, 27 bp, Artificial Sequence
  Description of Artificial Sequence: Synthetic oligonucleotide
ccccactctgcgcttggtcaaccttga

SEQ ID NO: 90492 - DNA, 29 bp, Artificial Sequence
  Description of Artificial Sequence: Synthetic oligonucleotide
cccactctgcgcttggtcaaccttgaaac

SEQ ID NO: 90493 - DNA, 29 bp, Artificial Sequence
  Description of Artificial Sequence: Synthetic oligonucleotide
ccactctgcgcttggtcaaccttgaaacc

SEQ ID NO: 90494 - DNA, 30 bp, Artificial Sequence
  Description of Artificial Sequence: Synthetic oligonucleotide
cactctgcgcttggtcaaccttgaaaccac

SEQ ID NO: 90495 - DNA, 33 bp, Artificial Sequence
  Description of Artificial Sequence: Synthetic oligonucleotide
actctgcgcttggtcaaccttgaaaccactaag

SEQ ID NO: 90496 - DNA, 32 bp, Artificial Sequence
  Description of Artificial Sequence: Synthetic oligonucleotide
ctctgcgcttggtcaaccttgaaaccactaag

SEQ ID NO: 90497 - DNA, 34 bp, Artificial Sequence
  Description of Artificial Sequence: Synthetic oligonucleotide
tctgcgcttggtcaaccttgaaaccactaagaag

SEQ ID NO: 90498 - DNA, 33 bp, Artificial Sequence
  Description of Artificial Sequence: Synthetic oligonucleotide
ctgcgcttggtcaaccttgaaaccactaagaag

SEQ ID NO: 90499 - DNA, 36 bp, Artificial Sequence
  Description of Artificial Sequence: Synthetic oligonucleotide
tgcgcttggtcaaccttgaaaccactaagaagtatg

SEQ ID NO: 90500 - DNA, 35 bp, Artificial Sequence
  Description of Artificial Sequence: Synthetic oligonucleotide
gcgcttggtcaaccttgaaaccactaagaagtatg

SEQ ID NO: 90501 - DNA, 35 bp, Artificial Sequence
  Description of Artificial Sequence: Synthetic oligonucleotide
cgcttggtcaaccttgaaaccactaagaagtatgc

SEQ ID NO: 90502 - DNA, 35 bp, Artificial Sequence
  Description of Artificial Sequence: Synthetic oligonucleotide
gcttggtcaaccttgaaaccactaagaagtatgcg

SEQ ID NO: 90503 - DNA, 35 bp, Artificial Sequence
  Description of Artificial Sequence: Synthetic oligonucleotide
cttggtcaaccttgaaaccactaagaagtatgcgc

SEQ ID NO: 90504 - DNA, 35 bp, Artificial Sequence
  Description of Artificial Sequence: Synthetic oligonucleotide
ttggtcaaccttgaaaccactaagaagtatgcgcc

SEQ ID NO: 90505 - DNA, 34 bp, Artificial Sequence
  Description of Artificial Sequence: Synthetic oligonucleotide
tggtcaaccttgaaaccactaagaagtatgcgcc

SEQ ID NO: 90506 - DNA, 33 bp, Artificial Sequence
  Description of Artificial Sequence: Synthetic oligonucleotide
ggtcaaccttgaaaccactaagaagtatgcgcc

SEQ ID NO: 90507 - DNA, 34 bp, Artificial Sequence
  Description of Artificial Sequence: Synthetic oligonucleotide
gtcaaccttgaaaccactaagaagtatgcgcctg

SEQ ID NO: 90508 - DNA, 35 bp, Artificial Sequence
  Description of Artificial Sequence: Synthetic oligonucleotide
tcaaccttgaaaccactaagaagtatgcgcctgtg

SEQ ID NO: 90509 - DNA, 34 bp, Artificial Sequence
  Description of Artificial Sequence: Synthetic oligonucleotide
caaccttgaaaccactaagaagtatgcgcctgtg

SEQ ID NO: 90510 - DNA, 34 bp, Artificial Sequence
  Description of Artificial Sequence: Synthetic oligonucleotide
aaccttgaaaccactaagaagtatgcgcctgtgg

SEQ ID NO: 90511 - DNA, 33 bp, Artificial Sequence
  Description of Artificial Sequence: Synthetic oligonucleotide
accttgaaaccactaagaagtatgcgcctgtgg

SEQ ID NO: 90512 - DNA, 32 bp, Artificial Sequence
  Description of Artificial Sequence: Synthetic oligonucleotide
ccttgaaaccactaagaagtatgcgcctgtgg

SEQ ID NO: 90513 - DNA, 34 bp, Artificial Sequence
  Description of Artificial Sequence: Synthetic oligonucleotide
cttgaaaccactaagaagtatgcgcctgtggatg

SEQ ID NO: 90514 - DNA, 34 bp, Artificial Sequence
  Description of Artificial Sequence: Synthetic oligonucleotide
ttgaaaccactaagaagtatgcgcctgtggatgg

SEQ ID NO: 90515 - DNA, 33 bp, Artificial Sequence
  Description of Artificial Sequence: Synthetic oligonucleotide
tgaaaccactaagaagtatgcgcctgtggatgg

SEQ ID NO: 90516 - DNA, 32 bp, Artificial Sequence
  Description of Artificial Sequence: Synthetic oligonucleotide
gaaaccactaagaagtatgcgcctgtggatgg

SEQ ID NO: 90517 - DNA, 32 bp, Artificial Sequence
  Description of Artificial Sequence: Synthetic oligonucleotide
aaaccactaagaagtatgcgcctgtggatggg

SEQ ID NO: 90518 - DNA, 31 bp, Artificial Sequence
  Description of Artificial Sequence: Synthetic oligonucleotide
aaccactaagaagtatgcgcctgtggatggg

SEQ ID NO: 90519 - DNA, 30 bp, Artificial Sequence
  Description of Artificial Sequence: Synthetic oligonucleotide
accactaagaagtatgcgcctgtggatggg

SEQ ID NO: 90520 - DNA, 29 bp, Artificial Sequence
  Description of Artificial Sequence: Synthetic oligonucleotide
ccactaagaagtatgcgcctgtggatggg

SEQ ID NO: 90521 - DNA, 29 bp, Artificial Sequence
  Description of Artificial Sequence: Synthetic oligonucleotide
cactaagaagtatgcgcctgtggatgggg

SEQ ID NO: 90522 - DNA, 29 bp, Artificial Sequence
  Description of Artificial Sequence: Synthetic oligonucleotide
actaagaagtatgcgcctgtggatggggg

SEQ ID NO: 90523 - DNA, 28 bp, Artificial Sequence
  Description of Artificial Sequence: Synthetic oligonucleotide
ctaagaagtatgcgcctgtggatggggg

SEQ ID NO: 90524 - DNA, 28 bp, Artificial Sequence
  Description of Artificial Sequence: Synthetic oligonucleotide
taagaagtatgcgcctgtggatgggggc

SEQ ID NO: 90525 - DNA, 27 bp, Artificial Sequence
  Description of Artificial Sequence: Synthetic oligonucleotide
aagaagtatgcgcctgtggatgggggc

SEQ ID NO: 90526 - DNA, 26 bp, Artificial Sequence
  Description of Artificial Sequence: Synthetic oligonucleotide
agaagtatgcgcctgtggatgggggc

SEQ ID NO: 90527 - DNA, 25 bp, Artificial Sequence
  Description of Artificial Sequence: Synthetic oligonucleotide
gaagtatgcgcctgtggatgggggc

SEQ ID NO: 90528 - DNA, 25 bp, Artificial Sequence
  Description of Artificial Sequence: Synthetic oligonucleotide
aagtatgcgcctgtggatgggggcc

SEQ ID NO: 90529 - DNA, 24 bp, Artificial Sequence
  Description of Artificial Sequence: Synthetic oligonucleotide
agtatgcgcctgtggatgggggcc

SEQ ID NO: 90530 - DNA, 23 bp, Artificial Sequence
  Description of Artificial Sequence: Synthetic oligonucleotide
gtatgcgcctgtggatgggggcc

SEQ ID NO: 90531 - DNA, 24 bp, Artificial Sequence
  Description of Artificial Sequence: Synthetic oligonucleotide
tatgcgcctgtggatgggggccct

SEQ ID NO: 90532 - DNA, 23 bp, Artificial Sequence
  Description of Artificial Sequence: Synthetic oligonucleotide
atgcgcctgtggatgggggccct

SEQ ID NO: 90533 - DNA, 22 bp, Artificial Sequence
  Description of Artificial Sequence: Synthetic oligonucleotide
tgcgcctgtggatgggggccct

SEQ ID NO: 90534 - DNA, 21 bp, Artificial Sequence
  Description of Artificial Sequence: Synthetic oligonucleotide
gcgcctgtggatgggggccct

SEQ ID NO: 90535 - DNA, 22 bp, Artificial Sequence
  Description of Artificial Sequence: Synthetic oligonucleotide
cgcctgtggatgggggccctgt

SEQ ID NO: 90536 - DNA, 23 bp, Artificial Sequence
  Description of Artificial Sequence: Synthetic oligonucleotide
gcctgtggatgggggccctgtca

SEQ ID NO: 90537 - DNA, 23 bp, Artificial Sequence
  Description of Artificial Sequence: Synthetic oligonucleotide
cctgtggatgggggccctgtcac

SEQ ID NO: 90538 - DNA, 23 bp, Artificial Sequence
  Description of Artificial Sequence: Synthetic oligonucleotide
ctgtggatgggggccctgtcacc

SEQ ID NO: 90539 - DNA, 23 bp, Artificial Sequence
  Description of Artificial Sequence: Synthetic oligonucleotide
tgtggatgggggccctgtcaccg

SEQ ID NO: 90540 - DNA, 22 bp, Artificial Sequence
  Description of Artificial Sequence: Synthetic oligonucleotide
gtggatgggggccctgtcaccg

SEQ ID NO: 90541 - DNA, 23 bp, Artificial Sequence
  Description of Artificial Sequence: Synthetic oligonucleotide
tggatgggggccctgtcaccgca

SEQ ID NO: 90542 - DNA, 22 bp, Artificial Sequence
  Description of Artificial Sequence: Synthetic oligonucleotide
ggatgggggccctgtcaccgca

SEQ ID NO: 90543 - DNA, 22 bp, Artificial Sequence
  Description of Artificial Sequence: Synthetic oligonucleotide
gatgggggccctgtcaccgcag

SEQ ID NO: 90544 - DNA, 22 bp, Artificial Sequence
  Description of Artificial Sequence: Synthetic oligonucleotide
atgggggccctgtcaccgcagc

SEQ ID NO: 90545 - DNA, 21 bp, Artificial Sequence
  Description of Artificial Sequence: Synthetic oligonucleotide
tgggggccctgtcaccgcagc

SEQ ID NO: 90546 - DNA, 20 bp, Artificial Sequence
  Description of Artificial Sequence: Synthetic oligonucleotide
gggggccctgtcaccgcagc

SEQ ID NO: 90547 - DNA, 21 bp, Artificial Sequence
  Description of Artificial Sequence: Synthetic oligonucleotide
ggggccctgtcaccgcagcgt

SEQ ID NO: 90548 - DNA, 21 bp, Artificial Sequence
  Description of Artificial Sequence: Synthetic oligonucleotide
gggccctgtcaccgcagcgtc

SEQ ID NO: 90549 - DNA, 23 bp, Artificial Sequence
  Description of Artificial Sequence: Synthetic oligonucleotide
ggccctgtcaccgcagcgtccat

SEQ ID NO: 90550 - DNA, 24 bp, Artificial Sequence
  Description of Artificial Sequence: Synthetic oligonucleotide
gccctgtcaccgcagcgtccatca

SEQ ID NO: 90551 - DNA, 25 bp, Artificial Sequence
  Description of Artificial Sequence: Synthetic oligonucleotide
ccctgtcaccgcagcgtccatcact

SEQ ID NO: 90552 - DNA, 25 bp, Artificial Sequence
  Description of Artificial Sequence: Synthetic oligonucleotide
cctgtcaccgcagcgtccatcactg

SEQ ID NO: 90553 - DNA, 27 bp, Artificial Sequence
  Description of Artificial Sequence: Synthetic oligonucleotide
ctgtcaccgcagcgtccatcactgctt

SEQ ID NO: 90554 - DNA, 28 bp, Artificial Sequence
  Description of Artificial Sequence: Synthetic oligonucleotide
tgtcaccgcagcgtccatcactgctttc

SEQ ID NO: 90555 - DNA, 27 bp, Artificial Sequence
  Description of Artificial Sequence: Synthetic oligonucleotide
gtcaccgcagcgtccatcactgctttc

SEQ ID NO: 90556 - DNA, 28 bp, Artificial Sequence
  Description of Artificial Sequence: Synthetic oligonucleotide
tcaccgcagcgtccatcactgctttctg

SEQ ID NO: 90557 - DNA, 27 bp, Artificial Sequence
  Description of Artificial Sequence: Synthetic oligonucleotide
caccgcagcgtccatcactgctttctg

SEQ ID NO: 90558 - DNA, 27 bp, Artificial Sequence
  Description of Artificial Sequence: Synthetic oligonucleotide
accgcagcgtccatcactgctttctgc

SEQ ID NO: 90559 - DNA, 26 bp, Artificial Sequence
  Description of Artificial Sequence: Synthetic oligonucleotide
ccgcagcgtccatcactgctttctgc

SEQ ID NO: 90560 - DNA, 27 bp, Artificial Sequence
  Description of Artificial Sequence: Synthetic oligonucleotide
cgcagcgtccatcactgctttctgcca

SEQ ID NO: 90561 - DNA, 28 bp, Artificial Sequence
  Description of Artificial Sequence: Synthetic oligonucleotide
gcagcgtccatcactgctttctgccatg

SEQ ID NO: 90562 - DNA, 28 bp, Artificial Sequence
  Description of Artificial Sequence: Synthetic oligonucleotide
cagcgtccatcactgctttctgccatgc

SEQ ID NO: 90563 - DNA, 29 bp, Artificial Sequence
  Description of Artificial Sequence: Synthetic oligonucleotide
agcgtccatcactgctttctgccatgcag

SEQ ID NO: 90564 - DNA, 28 bp, Artificial Sequence
  Description of Artificial Sequence: Synthetic oligonucleotide
gcgtccatcactgctttctgccatgcag

SEQ ID NO: 90565 - DNA, 29 bp, Artificial Sequence
  Description of Artificial Sequence: Synthetic oligonucleotide
cgtccatcactgctttctgccatgcagtc

SEQ ID NO: 90566 - DNA, 29 bp, Artificial Sequence
  Description of Artificial Sequence: Synthetic oligonucleotide
gtccatcactgctttctgccatgcagtcc

SEQ ID NO: 90567 - DNA, 30 bp, Artificial Sequence
  Description of Artificial Sequence: Synthetic oligonucleotide
tccatcactgctttctgccatgcagtcctc

SEQ ID NO: 90568 - DNA, 29 bp, Artificial Sequence
  Description of Artificial Sequence: Synthetic oligonucleotide
ccatcactgctttctgccatgcagtcctc

SEQ ID NO: 90569 - DNA, 31 bp, Artificial Sequence
  Description of Artificial Sequence: Synthetic oligonucleotide
catcactgctttctgccatgcagtcctcaac

SEQ ID NO: 90570 - DNA, 31 bp, Artificial Sequence
  Description of Artificial Sequence: Synthetic oligonucleotide
atcactgctttctgccatgcagtcctcaacg

SEQ ID NO: 90571 - DNA, 30 bp, Artificial Sequence
  Description of Artificial Sequence: Synthetic oligonucleotide
tcactgctttctgccatgcagtcctcaacg

SEQ ID NO: 90572 - DNA, 29 bp, Artificial Sequence
  Description of Artificial Sequence: Synthetic oligonucleotide
cactgctttctgccatgcagtcctcaacg

SEQ ID NO: 90573 - DNA, 29 bp, Artificial Sequence
  Description of Artificial Sequence: Synthetic oligonucleotide
actgctttctgccatgcagtcctcaacgg

SEQ ID NO: 90574 - DNA, 28 bp, Artificial Sequence
  Description of Artificial Sequence: Synthetic oligonucleotide
ctgctttctgccatgcagtcctcaacgg

SEQ ID NO: 90575 - DNA, 28 bp, Artificial Sequence
  Description of Artificial Sequence: Synthetic oligonucleotide
tgctttctgccatgcagtcctcaacggc

SEQ ID NO: 90576 - DNA, 27 bp, Artificial Sequence
  Description of Artificial Sequence: Synthetic oligonucleotide
gctttctgccatgcagtcctcaacggc

SEQ ID NO: 90577 - DNA, 27 bp, Artificial Sequence
  Description of Artificial Sequence: Synthetic oligonucleotide
ctttctgccatgcagtcctcaacggcc

SEQ ID NO: 90578 - DNA, 29 bp, Artificial Sequence
  Description of Artificial Sequence: Synthetic oligonucleotide
tttctgccatgcagtcctcaacggccaag

SEQ ID NO: 90579 - DNA, 28 bp, Artificial Sequence
  Description of Artificial Sequence: Synthetic oligonucleotide
ttctgccatgcagtcctcaacggccaag

SEQ ID NO: 90580 - DNA, 27 bp, Artificial Sequence
  Description of Artificial Sequence: Synthetic oligonucleotide
tctgccatgcagtcctcaacggccaag

SEQ ID NO: 90581 - DNA, 27 bp, Artificial Sequence
  Description of Artificial Sequence: Synthetic oligonucleotide
ctgccatgcagtcctcaacggccaagt

SEQ ID NO: 90582 - DNA, 27 bp, Artificial Sequence
  Description of Artificial Sequence: Synthetic oligonucleotide
tgccatgcagtcctcaacggccaagtc

SEQ ID NO: 90583 - DNA, 27 bp, Artificial Sequence
  Description of Artificial Sequence: Synthetic oligonucleotide
gccatgcagtcctcaacggccaagtca

SEQ ID NO: 90584 - DNA, 28 bp, Artificial Sequence
  Description of Artificial Sequence: Synthetic oligonucleotide
ccatgcagtcctcaacggccaagtcaag

SEQ ID NO: 90585 - DNA, 28 bp, Artificial Sequence
  Description of Artificial Sequence: Synthetic oligonucleotide
catgcagtcctcaacggccaagtcaagc

SEQ ID NO: 90586 - DNA, 28 bp, Artificial Sequence
  Description of Artificial Sequence: Synthetic oligonucleotide
atgcagtcctcaacggccaagtcaagcc

SEQ ID NO: 90587 - DNA, 27 bp, Artificial Sequence
  Description of Artificial Sequence: Synthetic oligonucleotide
tgcagtcctcaacggccaagtcaagcc

SEQ ID NO: 90588 - DNA, 26 bp, Artificial Sequence
  Description of Artificial Sequence: Synthetic oligonucleotide
gcagtcctcaacggccaagtcaagcc

SEQ ID NO: 90589 - DNA, 27 bp, Artificial Sequence
  Description of Artificial Sequence: Synthetic oligonucleotide
cagtcctcaacggccaagtcaagccct

SEQ ID NO: 90590 - DNA, 29 bp, Artificial Sequence
  Description of Artificial Sequence: Synthetic oligonucleotide
agtcctcaacggccaagtcaagccctatc

SEQ ID NO: 90591 - DNA, 28 bp, Artificial Sequence
  Description of Artificial Sequence: Synthetic oligonucleotide
gtcctcaacggccaagtcaagccctatc

SEQ ID NO: 90592 - DNA, 29 bp, Artificial Sequence
  Description of Artificial Sequence: Synthetic oligonucleotide
tcctcaacggccaagtcaagccctatctc

SEQ ID NO: 90593 - DNA, 28 bp, Artificial Sequence
  Description of Artificial Sequence: Synthetic oligonucleotide
cctcaacggccaagtcaagccctatctc

SEQ ID NO: 90594 - DNA, 28 bp, Artificial Sequence
  Description of Artificial Sequence: Synthetic oligonucleotide
ctcaacggccaagtcaagccctatctcc

SEQ ID NO: 90595 - DNA, 29 bp, Artificial Sequence
  Description of Artificial Sequence: Synthetic oligonucleotide
tcaacggccaagtcaagccctatctcctg

SEQ ID NO: 90596 - DNA, 28 bp, Artificial Sequence
  Description of Artificial Sequence: Synthetic oligonucleotide
caacggccaagtcaagccctatctcctg

SEQ ID NO: 90597 - DNA, 29 bp, Artificial Sequence
  Description of Artificial Sequence: Synthetic oligonucleotide
aacggccaagtcaagccctatctcctgag

SEQ ID NO: 90598 - DNA, 28 bp, Artificial Sequence
  Description of Artificial Sequence: Synthetic oligonucleotide
acggccaagtcaagccctatctcctgag

SEQ ID NO: 90599 - DNA, 27 bp, Artificial Sequence
  Description of Artificial Sequence: Synthetic oligonucleotide
cggccaagtcaagccctatctcctgag

SEQ ID NO: 90600 - DNA, 27 bp, Artificial Sequence
  Description of Artificial Sequence: Synthetic oligonucleotide
ggccaagtcaagccctatctcctgagc

SEQ ID NO: 90601 - DNA, 27 bp, Artificial Sequence
  Description of Artificial Sequence: Synthetic oligonucleotide
gccaagtcaagccctatctcctgagcc

SEQ ID NO: 90602 - DNA, 28 bp, Artificial Sequence
  Description of Artificial Sequence: Synthetic oligonucleotide
ccaagtcaagccctatctcctgagccag

SEQ ID NO: 90603 - DNA, 28 bp, Artificial Sequence
  Description of Artificial Sequence: Synthetic oligonucleotide
caagtcaagccctatctcctgagccagg

SEQ ID NO: 90604 - DNA, 29 bp, Artificial Sequence
  Description of Artificial Sequence: Synthetic oligonucleotide
aagtcaagccctatctcctgagccaggag

SEQ ID NO: 90605 - DNA, 28 bp, Artificial Sequence
  Description of Artificial Sequence: Synthetic oligonucleotide
agtcaagccctatctcctgagccaggag

SEQ ID NO: 90606 - DNA, 27 bp, Artificial Sequence
  Description of Artificial Sequence: Synthetic oligonucleotide
gtcaagccctatctcctgagccaggag

SEQ ID NO: 90607 - DNA, 30 bp, Artificial Sequence
  Description of Artificial Sequence: Synthetic oligonucleotide
tcaagccctatctcctgagccaggagatac

SEQ ID NO: 90608 - DNA, 29 bp, Artificial Sequence
  Description of Artificial Sequence: Synthetic oligonucleotide
caagccctatctcctgagccaggagatac

SEQ ID NO: 90609 - DNA, 29 bp, Artificial Sequence
  Description of Artificial Sequence: Synthetic oligonucleotide
aagccctatctcctgagccaggagatacc

SEQ ID NO: 90610 - DNA, 28 bp, Artificial Sequence
  Description of Artificial Sequence: Synthetic oligonucleotide
agccctatctcctgagccaggagatacc

SEQ ID NO: 90611 - DNA, 27 bp, Artificial Sequence
  Description of Artificial Sequence: Synthetic oligonucleotide
gccctatctcctgagccaggagatacc

SEQ ID NO: 90612 - DNA, 27 bp, Artificial Sequence
  Description of Artificial Sequence: Synthetic oligonucleotide
ccctatctcctgagccaggagataccc

SEQ ID NO: 90613 - DNA, 27 bp, Artificial Sequence
  Description of Artificial Sequence: Synthetic oligonucleotide
cctatctcctgagccaggagatacccc

SEQ ID NO: 90614 - DNA, 27 bp, Artificial Sequence
  Description of Artificial Sequence: Synthetic oligonucleotide
ctatctcctgagccaggagataccccc

SEQ ID NO: 90615 - DNA, 28 bp, Artificial Sequence
  Description of Artificial Sequence: Synthetic oligonucleotide
tatctcctgagccaggagataccccctg

SEQ ID NO: 90616 - DNA, 27 bp, Artificial Sequence
  Description of Artificial Sequence: Synthetic oligonucleotide
atctcctgagccaggagataccccctg

SEQ ID NO: 90617 - DNA, 27 bp, Artificial Sequence
  Description of Artificial Sequence: Synthetic oligonucleotide
tctcctgagccaggagataccccctga

SEQ ID NO: 90618 - DNA, 27 bp, Artificial Sequence
  Description of Artificial Sequence: Synthetic oligonucleotide
ctcctgagccaggagataccccctgat

SEQ ID NO: 90619 - DNA, 28 bp, Artificial Sequence
  Description of Artificial Sequence: Synthetic oligonucleotide
tcctgagccaggagataccccctgattg

SEQ ID NO: 90620 - DNA, 27 bp, Artificial Sequence
  Description of Artificial Sequence: Synthetic oligonucleotide
cctgagccaggagataccccctgattg

SEQ ID NO: 90621 - DNA, 27 bp, Artificial Sequence
  Description of Artificial Sequence: Synthetic oligonucleotide
ctgagccaggagataccccctgattgg

SEQ ID NO: 90622 - DNA, 27 bp, Artificial Sequence
  Description of Artificial Sequence: Synthetic oligonucleotide
tgagccaggagataccccctgattggg

SEQ ID NO: 90623 - DNA, 27 bp, Artificial Sequence
  Description of Artificial Sequence: Synthetic oligonucleotide
gagccaggagataccccctgattggga

SEQ ID NO: 90624 - DNA, 28 bp, Artificial Sequence
  Description of Artificial Sequence: Synthetic oligonucleotide
agccaggagataccccctgattgggatc

SEQ ID NO: 90625 - DNA, 27 bp, Artificial Sequence
  Description of Artificial Sequence: Synthetic oligonucleotide
gccaggagataccccctgattgggatc

SEQ ID NO: 90626 - DNA, 28 bp, Artificial Sequence
  Description of Artificial Sequence: Synthetic oligonucleotide
ccaggagataccccctgattgggatcag

SEQ ID NO: 90627 - DNA, 28 bp, Artificial Sequence
  Description of Artificial Sequence: Synthetic oligonucleotide
caggagataccccctgattgggatcagc

SEQ ID NO: 90628 - DNA, 28 bp, Artificial Sequence
  Description of Artificial Sequence: Synthetic oligonucleotide
aggagataccccctgattgggatcagcg

SEQ ID NO: 90629 - DNA, 27 bp, Artificial Sequence
  Description of Artificial Sequence: Synthetic oligonucleotide
ggagataccccctgattgggatcagcg

SEQ ID NO: 90630 - DNA, 27 bp, Artificial Sequence
  Description of Artificial Sequence: Synthetic oligonucleotide
gagataccccctgattgggatcagcgg

SEQ ID NO: 90631 - DNA, 27 bp, Artificial Sequence
  Description of Artificial Sequence: Synthetic oligonucleotide
agataccccctgattgggatcagcggc

SEQ ID NO: 90632 - DNA, 26 bp, Artificial Sequence
  Description of Artificial Sequence: Synthetic oligonucleotide
gataccccctgattgggatcagcggc

SEQ ID NO: 90633 - DNA, 27 bp, Artificial Sequence
  Description of Artificial Sequence: Synthetic oligonucleotide
ataccccctgattgggatcagcggcca

SEQ ID NO: 90634 - DNA, 26 bp, Artificial Sequence
  Description of Artificial Sequence: Synthetic oligonucleotide
taccccctgattgggatcagcggcca

SEQ ID NO: 90635 - DNA, 25 bp, Artificial Sequence
  Description of Artificial Sequence: Synthetic oligonucleotide
accccctgattgggatcagcggcca

SEQ ID NO: 90636 - DNA, 24 bp, Artificial Sequence
  Description of Artificial Sequence: Synthetic oligonucleotide
ccccctgattgggatcagcggcca

SEQ ID NO: 90637 - DNA, 27 bp, Artificial Sequence
  Description of Artificial Sequence: Synthetic oligonucleotide
cccctgattgggatcagcggccagtta

SEQ ID NO: 90638 - DNA, 28 bp, Artificial Sequence
  Description of Artificial Sequence: Synthetic oligonucleotide
ccctgattgggatcagcggccagttaag

SEQ ID NO: 90639 - DNA, 29 bp, Artificial Sequence
  Description of Artificial Sequence: Synthetic oligonucleotide
cctgattgggatcagcggccagttaagac

SEQ ID NO: 90640 - DNA, 29 bp, Artificial Sequence
  Description of Artificial Sequence: Synthetic oligonucleotide
ctgattgggatcagcggccagttaagacc

SEQ ID NO: 90641 - DNA, 29 bp, Artificial Sequence
  Description of Artificial Sequence: Synthetic oligonucleotide
tgattgggatcagcggccagttaagaccc

SEQ ID NO: 90642 - DNA, 28 bp, Artificial Sequence
  Description of Artificial Sequence: Synthetic oligonucleotide
gattgggatcagcggccagttaagaccc

SEQ ID NO: 90643 - DNA, 29 bp, Artificial Sequence
  Description of Artificial Sequence: Synthetic oligonucleotide
attgggatcagcggccagttaagaccctc

SEQ ID NO: 90644 - DNA, 28 bp, Artificial Sequence
  Description of Artificial Sequence: Synthetic oligonucleotide
ttgggatcagcggccagttaagaccctc

SEQ ID NO: 90645 - DNA, 27 bp, Artificial Sequence
  Description of Artificial Sequence: Synthetic oligonucleotide
tgggatcagcggccagttaagaccctc

SEQ ID NO: 90646 - DNA, 26 bp, Artificial Sequence
  Description of Artificial Sequence: Synthetic oligonucleotide
gggatcagcggccagttaagaccctc

SEQ ID NO: 90647 - DNA, 27 bp, Artificial Sequence
  Description of Artificial Sequence: Synthetic oligonucleotide
ggatcagcggccagttaagaccctcgt

SEQ ID NO: 90648 - DNA, 27 bp, Artificial Sequence
  Description of Artificial Sequence: Synthetic oligonucleotide
gatcagcggccagttaagaccctcgtg

SEQ ID NO: 90649 - DNA, 27 bp, Artificial Sequence
  Description of Artificial Sequence: Synthetic oligonucleotide
atcagcggccagttaagaccctcgtgg

SEQ ID NO: 90650 - DNA, 26 bp, Artificial Sequence
  Description of Artificial Sequence: Synthetic oligonucleotide
tcagcggccagttaagaccctcgtgg

SEQ ID NO: 90651 - DNA, 25 bp, Artificial Sequence
  Description of Artificial Sequence: Synthetic oligonucleotide
cagcggccagttaagaccctcgtgg

SEQ ID NO: 90652 - DNA, 25 bp, Artificial Sequence
  Description of Artificial Sequence: Synthetic oligonucleotide
agcggccagttaagaccctcgtggg

SEQ ID NO: 90653 - DNA, 24 bp, Artificial Sequence
  Description of Artificial Sequence: Synthetic oligonucleotide
gcggccagttaagaccctcgtggg

SEQ ID NO: 90654 - DNA, 26 bp, Artificial Sequence
  Description of Artificial Sequence: Synthetic oligonucleotide
cggccagttaagaccctcgtgggcaa

SEQ ID NO: 90655 - DNA, 27 bp, Artificial Sequence
  Description of Artificial Sequence: Synthetic oligonucleotide
ggccagttaagaccctcgtgggcaaga

SEQ ID NO: 90656 - DNA, 32 bp, Artificial Sequence
  Description of Artificial Sequence: Synthetic oligonucleotide
gccagttaagaccctcgtgggcaagaattttg

SEQ ID NO: 90657 - DNA, 33 bp, Artificial Sequence
  Description of Artificial Sequence: Synthetic oligonucleotide
ccagttaagaccctcgtgggcaagaattttgag

SEQ ID NO: 90658 - DNA, 33 bp, Artificial Sequence
  Description of Artificial Sequence: Synthetic oligonucleotide
cagttaagaccctcgtgggcaagaattttgagc

SEQ ID NO: 90659 - DNA, 34 bp, Artificial Sequence
  Description of Artificial Sequence: Synthetic oligonucleotide
agttaagaccctcgtgggcaagaattttgagcag

SEQ ID NO: 90660 - DNA, 33 bp, Artificial Sequence
  Description of Artificial Sequence: Synthetic oligonucleotide
gttaagaccctcgtgggcaagaattttgagcag

SEQ ID NO: 90661 - DNA, 33 bp, Artificial Sequence
  Description of Artificial Sequence: Synthetic oligonucleotide
ttaagaccctcgtgggcaagaattttgagcagg

SEQ ID NO: 90662 - DNA, 32 bp, Artificial Sequence
  Description of Artificial Sequence: Synthetic oligonucleotide
taagaccctcgtgggcaagaattttgagcagg

SEQ ID NO: 90663 - DNA, 31 bp, Artificial Sequence
  Description of Artificial Sequence: Synthetic oligonucleotide
aagaccctcgtgggcaagaattttgagcagg

SEQ ID NO: 90664 - DNA, 30 bp, Artificial Sequence
  Description of Artificial Sequence: Synthetic oligonucleotide
agaccctcgtgggcaagaattttgagcagg

SEQ ID NO: 90665 - DNA, 29 bp, Artificial Sequence
  Description of Artificial Sequence: Synthetic oligonucleotide
gaccctcgtgggcaagaattttgagcagg

SEQ ID NO: 90666 - DNA, 30 bp, Artificial Sequence
  Description of Artificial Sequence: Synthetic oligonucleotide
accctcgtgggcaagaattttgagcaggtg

SEQ ID NO: 90667 - DNA, 29 bp, Artificial Sequence
  Description of Artificial Sequence: Synthetic oligonucleotide
ccctcgtgggcaagaattttgagcaggtg

SEQ ID NO: 90668 - DNA, 29 bp, Artificial Sequence
  Description of Artificial Sequence: Synthetic oligonucleotide
cctcgtgggcaagaattttgagcaggtgg

SEQ ID NO: 90669 - DNA, 29 bp, Artificial Sequence
  Description of Artificial Sequence: Synthetic oligonucleotide
ctcgtgggcaagaattttgagcaggtggc

SEQ ID NO: 90670 - DNA, 33 bp, Artificial Sequence
  Description of Artificial Sequence: Synthetic oligonucleotide
tcgtgggcaagaattttgagcaggtggcttttg

SEQ ID NO: 90671 - DNA, 32 bp, Artificial Sequence
  Description of Artificial Sequence: Synthetic oligonucleotide
cgtgggcaagaattttgagcaggtggcttttg

SEQ ID NO: 90672 - DNA, 33 bp, Artificial Sequence
  Description of Artificial Sequence: Synthetic oligonucleotide
gtgggcaagaattttgagcaggtggcttttgac

SEQ ID NO: 90673 - DNA, 33 bp, Artificial Sequence
  Description of Artificial Sequence: Synthetic oligonucleotide
tgggcaagaattttgagcaggtggcttttgacg

SEQ ID NO: 90674 - DNA, 32 bp, Artificial Sequence
  Description of Artificial Sequence: Synthetic oligonucleotide
gggcaagaattttgagcaggtggcttttgacg

SEQ ID NO: 90675 - DNA, 35 bp, Artificial Sequence
  Description of Artificial Sequence: Synthetic oligonucleotide
ggcaagaattttgagcaggtggcttttgacgaaac

SEQ ID NO: 90676 - DNA, 35 bp, Artificial Sequence
  Description of Artificial Sequence: Synthetic oligonucleotide
gcaagaattttgagcaggtggcttttgacgaaacc

SEQ ID NO: 90677 - DNA, 37 bp, Artificial Sequence
  Description of Artificial Sequence: Synthetic oligonucleotide
caagaattttgagcaggtggcttttgacgaaaccaag

SEQ ID NO: 90678 - DNA, 40 bp, Artificial Sequence
  Description of Artificial Sequence: Synthetic oligonucleotide
aagaattttgagcaggtggcttttgacgaaaccaagaatg

SEQ ID NO: 90679 - DNA, 39 bp, Artificial Sequence
  Description of Artificial Sequence: Synthetic oligonucleotide
agaattttgagcaggtggcttttgacgaaaccaagaatg

SEQ ID NO: 90680 - DNA, 38 bp, Artificial Sequence
  Description of Artificial Sequence: Synthetic oligonucleotide
gaattttgagcaggtggcttttgacgaaaccaagaatg

SEQ ID NO: 90681 - DNA, 39 bp, Artificial Sequence
  Description of Artificial Sequence: Synthetic oligonucleotide
aattttgagcaggtggcttttgacgaaaccaagaatgtg

SEQ ID NO: 90682 - DNA, 38 bp, Artificial Sequence
  Description of Artificial Sequence: Synthetic oligonucleotide
attttgagcaggtggcttttgacgaaaccaagaatgtg

SEQ ID NO: 90683 - DNA, 37 bp, Artificial Sequence
  Description of Artificial Sequence: Synthetic oligonucleotide
ttttgagcaggtggcttttgacgaaaccaagaatgtg

SEQ ID NO: 90684 - DNA, 36 bp, Artificial Sequence
  Description of Artificial Sequence: Synthetic oligonucleotide
tttgagcaggtggcttttgacgaaaccaagaatgtg

SEQ ID NO: 90685 - DNA, 35 bp, Artificial Sequence
  Description of Artificial Sequence: Synthetic oligonucleotide
ttgagcaggtggcttttgacgaaaccaagaatgtg

SEQ ID NO: 90686 - DNA, 34 bp, Artificial Sequence
  Description of Artificial Sequence: Synthetic oligonucleotide
tgagcaggtggcttttgacgaaaccaagaatgtg

SEQ ID NO: 90687 - DNA, 33 bp, Artificial Sequence
  Description of Artificial Sequence: Synthetic oligonucleotide
gagcaggtggcttttgacgaaaccaagaatgtg

SEQ ID NO: 90688 - DNA, 36 bp, Artificial Sequence
  Description of Artificial Sequence: Synthetic oligonucleotide
agcaggtggcttttgacgaaaccaagaatgtgtttg

SEQ ID NO: 90689 - DNA, 35 bp, Artificial Sequence
  Description of Artificial Sequence: Synthetic oligonucleotide
gcaggtggcttttgacgaaaccaagaatgtgtttg

SEQ ID NO: 90690 - DNA, 36 bp, Artificial Sequence
  Description of Artificial Sequence: Synthetic oligonucleotide
caggtggcttttgacgaaaccaagaatgtgtttgtc

SEQ ID NO: 90691 - DNA, 38 bp, Artificial Sequence
  Description of Artificial Sequence: Synthetic oligonucleotide
aggtggcttttgacgaaaccaagaatgtgtttgtcaag

SEQ ID NO: 90692 - DNA, 37 bp, Artificial Sequence
  Description of Artificial Sequence: Synthetic oligonucleotide
ggtggcttttgacgaaaccaagaatgtgtttgtcaag

SEQ ID NO: 90693 - DNA, 39 bp, Artificial Sequence
  Description of Artificial Sequence: Synthetic oligonucleotide
gtggcttttgacgaaaccaagaatgtgtttgtcaagttc

SEQ ID NO: 90694 - DNA, 42 bp, Artificial Sequence
  Description of Artificial Sequence: Synthetic oligonucleotide
tggcttttgacgaaaccaagaatgtgtttgtcaagttctatg

SEQ ID NO: 90695 - DNA, 41 bp, Artificial Sequence
  Description of Artificial Sequence: Synthetic oligonucleotide
ggcttttgacgaaaccaagaatgtgtttgtcaagttctatg

SEQ ID NO: 90696 - DNA, 41 bp, Artificial Sequence
  Description of Artificial Sequence: Synthetic oligonucleotide
gcttttgacgaaaccaagaatgtgtttgtcaagttctatgc

SEQ ID NO: 90697 - DNA, 41 bp, Artificial Sequence
  Description of Artificial Sequence: Synthetic oligonucleotide
cttttgacgaaaccaagaatgtgtttgtcaagttctatgcc

SEQ ID NO: 90698 - DNA, 41 bp, Artificial Sequence
  Description of Artificial Sequence: Synthetic oligonucleotide
ttttgacgaaaccaagaatgtgtttgtcaagttctatgccc

SEQ ID NO: 90699 - DNA, 40 bp, Artificial Sequence
  Description of Artificial Sequence: Synthetic oligonucleotide
tttgacgaaaccaagaatgtgtttgtcaagttctatgccc

SEQ ID NO: 90700 - DNA, 39 bp, Artificial Sequence
  Description of Artificial Sequence: Synthetic oligonucleotide
ttgacgaaaccaagaatgtgtttgtcaagttctatgccc

SEQ ID NO: 90701 - DNA, 38 bp, Artificial Sequence
  Description of Artificial Sequence: Synthetic oligonucleotide
tgacgaaaccaagaatgtgtttgtcaagttctatgccc

SEQ ID NO: 90702 - DNA, 37 bp, Artificial Sequence
  Description of Artificial Sequence: Synthetic oligonucleotide
gacgaaaccaagaatgtgtttgtcaagttctatgccc

SEQ ID NO: 90703 - DNA, 37 bp, Artificial Sequence
  Description of Artificial Sequence: Synthetic oligonucleotide
acgaaaccaagaatgtgtttgtcaagttctatgcccc

SEQ ID NO: 90704 - DNA, 36 bp, Artificial Sequence
  Description of Artificial Sequence: Synthetic oligonucleotide
cgaaaccaagaatgtgtttgtcaagttctatgcccc

SEQ ID NO: 90705 - DNA, 36 bp, Artificial Sequence
  Description of Artificial Sequence: Synthetic oligonucleotide
gaaaccaagaatgtgtttgtcaagttctatgccccg

SEQ ID NO: 90706 - DNA, 37 bp, Artificial Sequence
  Description of Artificial Sequence: Synthetic oligonucleotide
aaaccaagaatgtgtttgtcaagttctatgccccgtg

SEQ ID NO: 90707 - DNA, 36 bp, Artificial Sequence
  Description of Artificial Sequence: Synthetic oligonucleotide
aaccaagaatgtgtttgtcaagttctatgccccgtg

SEQ ID NO: 90708 - DNA, 35 bp, Artificial Sequence
  Description of Artificial Sequence: Synthetic oligonucleotide
accaagaatgtgtttgtcaagttctatgccccgtg

SEQ ID NO: 90709 - DNA, 34 bp, Artificial Sequence
  Description of Artificial Sequence: Synthetic oligonucleotide
ccaagaatgtgtttgtcaagttctatgccccgtg

SEQ ID NO: 90710 - DNA, 34 bp, Artificial Sequence
  Description of Artificial Sequence: Synthetic oligonucleotide
caagaatgtgtttgtcaagttctatgccccgtgg

SEQ ID NO: 90711 - DNA, 35 bp, Artificial Sequence
  Description of Artificial Sequence: Synthetic oligonucleotide
aagaatgtgtttgtcaagttctatgccccgtggtg

SEQ ID NO: 90712 - DNA, 34 bp, Artificial Sequence
  Description of Artificial Sequence: Synthetic oligonucleotide
agaatgtgtttgtcaagttctatgccccgtggtg

SEQ ID NO: 90713 - DNA, 33 bp, Artificial Sequence
  Description of Artificial Sequence: Synthetic oligonucleotide
gaatgtgtttgtcaagttctatgccccgtggtg

SEQ ID NO: 90714 - DNA, 33 bp, Artificial Sequence
  Description of Artificial Sequence: Synthetic oligonucleotide
aatgtgtttgtcaagttctatgccccgtggtgc

SEQ ID NO: 90715 - DNA, 32 bp, Artificial Sequence
  Description of Artificial Sequence: Synthetic oligonucleotide
atgtgtttgtcaagttctatgccccgtggtgc

SEQ ID NO: 90716 - DNA, 31 bp, Artificial Sequence
  Description of Artificial Sequence: Synthetic oligonucleotide
tgtgtttgtcaagttctatgccccgtggtgc

SEQ ID NO: 90717 - DNA, 30 bp, Artificial Sequence
  Description of Artificial Sequence: Synthetic oligonucleotide
gtgtttgtcaagttctatgccccgtggtgc

SEQ ID NO: 90718 - DNA, 31 bp, Artificial Sequence
  Description of Artificial Sequence: Synthetic oligonucleotide
tgtttgtcaagttctatgccccgtggtgcac

SEQ ID NO: 90719 - DNA, 30 bp, Artificial Sequence
  Description of Artificial Sequence: Synthetic oligonucleotide
gtttgtcaagttctatgccccgtggtgcac

SEQ ID NO: 90720 - DNA, 30 bp, Artificial Sequence
  Description of Artificial Sequence: Synthetic oligonucleotide
tttgtcaagttctatgccccgtggtgcacc

SEQ ID NO: 90721 - DNA, 29 bp, Artificial Sequence
  Description of Artificial Sequence: Synthetic oligonucleotide
ttgtcaagttctatgccccgtggtgcacc

SEQ ID NO: 90722 - DNA, 28 bp, Artificial Sequence
  Description of Artificial Sequence: Synthetic oligonucleotide
tgtcaagttctatgccccgtggtgcacc

SEQ ID NO: 90723 - DNA, 27 bp, Artificial Sequence
  Description of Artificial Sequence: Synthetic oligonucleotide
gtcaagttctatgccccgtggtgcacc

SEQ ID NO: 90724 - DNA, 27 bp, Artificial Sequence
  Description of Artificial Sequence: Synthetic oligonucleotide
tcaagttctatgccccgtggtgcaccc

SEQ ID NO: 90725 - DNA, 27 bp, Artificial Sequence
  Description of Artificial Sequence: Synthetic oligonucleotide
caagttctatgccccgtggtgcaccca

SEQ ID NO: 90726 - DNA, 27 bp, Artificial Sequence
  Description of Artificial Sequence: Synthetic oligonucleotide
aagttctatgccccgtggtgcacccac

SEQ ID NO: 90727 - DNA, 27 bp, Artificial Sequence
  Description of Artificial Sequence: Synthetic oligonucleotide
agttctatgccccgtggtgcacccact

SEQ ID NO: 90728 - DNA, 26 bp, Artificial Sequence
  Description of Artificial Sequence: Synthetic oligonucleotide
gttctatgccccgtggtgcacccact

SEQ ID NO: 90729 - DNA, 26 bp, Artificial Sequence
  Description of Artificial Sequence: Synthetic oligonucleotide
ttctatgccccgtggtgcacccactg

SEQ ID NO: 90730 - DNA, 25 bp, Artificial Sequence
  Description of Artificial Sequence: Synthetic oligonucleotide
tctatgccccgtggtgcacccactg

SEQ ID NO: 90731 - DNA, 24 bp, Artificial Sequence
  Description of Artificial Sequence: Synthetic oligonucleotide
ctatgccccgtggtgcacccactg

SEQ ID NO: 90732 - DNA, 26 bp, Artificial Sequence
  Description of Artificial Sequence: Synthetic oligonucleotide
tatgccccgtggtgcacccactgcaa

SEQ ID NO: 90733 - DNA, 25 bp, Artificial Sequence
  Description of Artificial Sequence: Synthetic oligonucleotide
atgccccgtggtgcacccactgcaa

SEQ ID NO: 90734 - DNA, 24 bp, Artificial Sequence
  Description of Artificial Sequence: Synthetic oligonucleotide
tgccccgtggtgcacccactgcaa

SEQ ID NO: 90735 - DNA, 23 bp, Artificial Sequence
  Description of Artificial Sequence: Synthetic oligonucleotide
gccccgtggtgcacccactgcaa

SEQ ID NO: 90736 - DNA, 23 bp, Artificial Sequence
  Description of Artificial Sequence: Synthetic oligonucleotide
ccccgtggtgcacccactgcaag

SEQ ID NO: 90737 - DNA, 24 bp, Artificial Sequence
  Description of Artificial Sequence: Synthetic oligonucleotide
cccgtggtgcacccactgcaagga

SEQ ID NO: 90738 - DNA, 26 bp, Artificial Sequence
  Description of Artificial Sequence: Synthetic oligonucleotide
ccgtggtgcacccactgcaaggagat

SEQ ID NO: 90739 - DNA, 26 bp, Artificial Sequence
  Description of Artificial Sequence: Synthetic oligonucleotide
cgtggtgcacccactgcaaggagatg

SEQ ID NO: 90740 - DNA, 26 bp, Artificial Sequence
  Description of Artificial Sequence: Synthetic oligonucleotide
gtggtgcacccactgcaaggagatgg

SEQ ID NO: 90741 - DNA, 26 bp, Artificial Sequence
  Description of Artificial Sequence: Synthetic oligonucleotide
tggtgcacccactgcaaggagatggc

SEQ ID NO: 90742 - DNA, 25 bp, Artificial Sequence
  Description of Artificial Sequence: Synthetic oligonucleotide
ggtgcacccactgcaaggagatggc

SEQ ID NO: 90743 - DNA, 25 bp, Artificial Sequence
  Description of Artificial Sequence: Synthetic oligonucleotide
gtgcacccactgcaaggagatggcc

SEQ ID NO: 90744 - DNA, 25 bp, Artificial Sequence
  Description of Artificial Sequence: Synthetic oligonucleotide
tgcacccactgcaaggagatggccc

SEQ ID NO: 90745 - DNA, 24 bp, Artificial Sequence
  Description of Artificial Sequence: Synthetic oligonucleotide
gcacccactgcaaggagatggccc

SEQ ID NO: 90746 - DNA, 25 bp, Artificial Sequence
  Description of Artificial Sequence: Synthetic oligonucleotide
cacccactgcaaggagatggcccct

SEQ ID NO: 90747 - DNA, 25 bp, Artificial Sequence
  Description of Artificial Sequence: Synthetic oligonucleotide
acccactgcaaggagatggcccctg

SEQ ID NO: 90748 - DNA, 24 bp, Artificial Sequence
  Description of Artificial Sequence: Synthetic oligonucleotide
cccactgcaaggagatggcccctg

SEQ ID NO: 90749 - DNA, 24 bp, Artificial Sequence
  Description of Artificial Sequence: Synthetic oligonucleotide
ccactgcaaggagatggcccctgc

SEQ ID NO: 90750 - DNA, 25 bp, Artificial Sequence
  Description of Artificial Sequence: Synthetic oligonucleotide
cactgcaaggagatggcccctgcct

SEQ ID NO: 90751 - DNA, 25 bp, Artificial Sequence
  Description of Artificial Sequence: Synthetic oligonucleotide
actgcaaggagatggcccctgcctg

SEQ ID NO: 90752 - DNA, 24 bp, Artificial Sequence
  Description of Artificial Sequence: Synthetic oligonucleotide
ctgcaaggagatggcccctgcctg

SEQ ID NO: 90753 - DNA, 24 bp, Artificial Sequence
  Description of Artificial Sequence: Synthetic oligonucleotide
tgcaaggagatggcccctgcctgg

SEQ ID NO: 90754 - DNA, 23 bp, Artificial Sequence
  Description of Artificial Sequence: Synthetic oligonucleotide
gcaaggagatggcccctgcctgg

SEQ ID NO: 90755 - DNA, 24 bp, Artificial Sequence
  Description of Artificial Sequence: Synthetic oligonucleotide
caaggagatggcccctgcctggga

SEQ ID NO: 90756 - DNA, 24 bp, Artificial Sequence
  Description of Artificial Sequence: Synthetic oligonucleotide
aaggagatggcccctgcctgggag

SEQ ID NO: 90757 - DNA, 23 bp, Artificial Sequence
  Description of Artificial Sequence: Synthetic oligonucleotide
aggagatggcccctgcctgggag

SEQ ID NO: 90758 - DNA, 22 bp, Artificial Sequence
  Description of Artificial Sequence: Synthetic oligonucleotide
ggagatggcccctgcctgggag

SEQ ID NO: 90759 - DNA, 22 bp, Artificial Sequence
  Description of Artificial Sequence: Synthetic oligonucleotide
gagatggcccctgcctgggagg

SEQ ID NO: 90760 - DNA, 25 bp, Artificial Sequence
  Description of Artificial Sequence: Synthetic oligonucleotide
agatggcccctgcctgggaggcatt

SEQ ID NO: 90761 - DNA, 24 bp, Artificial Sequence
  Description of Artificial Sequence: Synthetic oligonucleotide
gatggcccctgcctgggaggcatt

SEQ ID NO: 90762 - DNA, 24 bp, Artificial Sequence
  Description of Artificial Sequence: Synthetic oligonucleotide
atggcccctgcctgggaggcattg

SEQ ID NO: 90763 - DNA, 23 bp, Artificial Sequence
  Description of Artificial Sequence: Synthetic oligonucleotide
tggcccctgcctgggaggcattg

SEQ ID NO: 90764 - DNA, 22 bp, Artificial Sequence
  Description of Artificial Sequence: Synthetic oligonucleotide
ggcccctgcctgggaggcattg

SEQ ID NO: 90765 - DNA, 22 bp, Artificial Sequence
  Description of Artificial Sequence: Synthetic oligonucleotide
gcccctgcctgggaggcattgg

SEQ ID NO: 90766 - DNA, 23 bp, Artificial Sequence
  Description of Artificial Sequence: Synthetic oligonucleotide
cccctgcctgggaggcattggct

SEQ ID NO: 90767 - DNA, 24 bp, Artificial Sequence
  Description of Artificial Sequence: Synthetic oligonucleotide
ccctgcctgggaggcattggctga

SEQ ID NO: 90768 - DNA, 26 bp, Artificial Sequence
  Description of Artificial Sequence: Synthetic oligonucleotide
cctgcctgggaggcattggctgagaa

SEQ ID NO: 90769 - DNA, 27 bp, Artificial Sequence
  Description of Artificial Sequence: Synthetic oligonucleotide
ctgcctgggaggcattggctgagaagt

SEQ ID NO: 90770 - DNA, 28 bp, Artificial Sequence
  Description of Artificial Sequence: Synthetic oligonucleotide
tgcctgggaggcattggctgagaagtac

SEQ ID NO: 90771 - DNA, 27 bp, Artificial Sequence
  Description of Artificial Sequence: Synthetic oligonucleotide
gcctgggaggcattggctgagaagtac

SEQ ID NO: 90772 - DNA, 27 bp, Artificial Sequence
  Description of Artificial Sequence: Synthetic oligonucleotide
cctgggaggcattggctgagaagtacc

SEQ ID NO: 90773 - DNA, 29 bp, Artificial Sequence
  Description of Artificial Sequence: Synthetic oligonucleotide
ctgggaggcattggctgagaagtaccaag

SEQ ID NO: 90774 - DNA, 30 bp, Artificial Sequence
  Description of Artificial Sequence: Synthetic oligonucleotide
tgggaggcattggctgagaagtaccaagac

SEQ ID NO: 90775 - DNA, 29 bp, Artificial Sequence
  Description of Artificial Sequence: Synthetic oligonucleotide
gggaggcattggctgagaagtaccaagac

SEQ ID NO: 90776 - DNA, 29 bp, Artificial Sequence
  Description of Artificial Sequence: Synthetic oligonucleotide
ggaggcattggctgagaagtaccaagacc

SEQ ID NO: 90777 - DNA, 30 bp, Artificial Sequence
  Description of Artificial Sequence: Synthetic oligonucleotide
gaggcattggctgagaagtaccaagaccac

SEQ ID NO: 90778 - DNA, 30 bp, Artificial Sequence
  Description of Artificial Sequence: Synthetic oligonucleotide
aggcattggctgagaagtaccaagaccacg

SEQ ID NO: 90779 - DNA, 29 bp, Artificial Sequence
  Description of Artificial Sequence: Synthetic oligonucleotide
ggcattggctgagaagtaccaagaccacg

SEQ ID NO: 90780 - DNA, 30 bp, Artificial Sequence
  Description of Artificial Sequence: Synthetic oligonucleotide
gcattggctgagaagtaccaagaccacgag

SEQ ID NO: 90781 - DNA, 30 bp, Artificial Sequence
  Description of Artificial Sequence: Synthetic oligonucleotide
cattggctgagaagtaccaagaccacgagg

SEQ ID NO: 90782 - DNA, 31 bp, Artificial Sequence
  Description of Artificial Sequence: Synthetic oligonucleotide
attggctgagaagtaccaagaccacgaggac

SEQ ID NO: 90783 - DNA, 30 bp, Artificial Sequence
  Description of Artificial Sequence: Synthetic oligonucleotide
ttggctgagaagtaccaagaccacgaggac

SEQ ID NO: 90784 - DNA, 29 bp, Artificial Sequence
  Description of Artificial Sequence: Synthetic oligonucleotide
tggctgagaagtaccaagaccacgaggac

SEQ ID NO: 90785 - DNA, 28 bp, Artificial Sequence
  Description of Artificial Sequence: Synthetic oligonucleotide
ggctgagaagtaccaagaccacgaggac

SEQ ID NO: 90786 - DNA, 30 bp, Artificial Sequence
  Description of Artificial Sequence: Synthetic oligonucleotide
gctgagaagtaccaagaccacgaggacatc

SEQ ID NO: 90787 - DNA, 32 bp, Artificial Sequence
  Description of Artificial Sequence: Synthetic oligonucleotide
ctgagaagtaccaagaccacgaggacatcatc

SEQ ID NO: 90788 - DNA, 35 bp, Artificial Sequence
  Description of Artificial Sequence: Synthetic oligonucleotide
tgagaagtaccaagaccacgaggacatcatcattg

SEQ ID NO: 90789 - DNA, 34 bp, Artificial Sequence
  Description of Artificial Sequence: Synthetic oligonucleotide
gagaagtaccaagaccacgaggacatcatcattg

SEQ ID NO: 90790 - DNA, 34 bp, Artificial Sequence
  Description of Artificial Sequence: Synthetic oligonucleotide
agaagtaccaagaccacgaggacatcatcattgc

SEQ ID NO: 90791 - DNA, 33 bp, Artificial Sequence
  Description of Artificial Sequence: Synthetic oligonucleotide
gaagtaccaagaccacgaggacatcatcattgc

SEQ ID NO: 90792 - DNA, 34 bp, Artificial Sequence
  Description of Artificial Sequence: Synthetic oligonucleotide
aagtaccaagaccacgaggacatcatcattgctg

SEQ ID NO: 90793 - DNA, 33 bp, Artificial Sequence
  Description of Artificial Sequence: Synthetic oligonucleotide
agtaccaagaccacgaggacatcatcattgctg

SEQ ID NO: 90794 - DNA, 32 bp, Artificial Sequence
  Description of Artificial Sequence: Synthetic oligonucleotide
gtaccaagaccacgaggacatcatcattgctg

SEQ ID NO: 90795 - DNA, 33 bp, Artificial Sequence
  Description of Artificial Sequence: Synthetic oligonucleotide
taccaagaccacgaggacatcatcattgctgag

SEQ ID NO: 90796 - DNA, 32 bp, Artificial Sequence
  Description of Artificial Sequence: Synthetic oligonucleotide
accaagaccacgaggacatcatcattgctgag

SEQ ID NO: 90797 - DNA, 31 bp, Artificial Sequence
  Description of Artificial Sequence: Synthetic oligonucleotide
ccaagaccacgaggacatcatcattgctgag

SEQ ID NO: 90798 - DNA, 31 bp, Artificial Sequence
  Description of Artificial Sequence: Synthetic oligonucleotide
caagaccacgaggacatcatcattgctgagc

SEQ ID NO: 90799 - DNA, 32 bp, Artificial Sequence
  Description of Artificial Sequence: Synthetic oligonucleotide
aagaccacgaggacatcatcattgctgagctg

SEQ ID NO: 90800 - DNA, 31 bp, Artificial Sequence
  Description of Artificial Sequence: Synthetic oligonucleotide
agaccacgaggacatcatcattgctgagctg

SEQ ID NO: 90801 - DNA, 30 bp, Artificial Sequence
  Description of Artificial Sequence: Synthetic oligonucleotide
gaccacgaggacatcatcattgctgagctg

SEQ ID NO: 90802 - DNA, 30 bp, Artificial Sequence
  Description of Artificial Sequence: Synthetic oligonucleotide
accacgaggacatcatcattgctgagctgg

SEQ ID NO: 90803 - DNA, 29 bp, Artificial Sequence
  Description of Artificial Sequence: Synthetic oligonucleotide
ccacgaggacatcatcattgctgagctgg

SEQ ID NO: 90804 - DNA, 31 bp, Artificial Sequence
  Description of Artificial Sequence: Synthetic oligonucleotide
cacgaggacatcatcattgctgagctggatg

SEQ ID NO: 90805 - DNA, 31 bp, Artificial Sequence
  Description of Artificial Sequence: Synthetic oligonucleotide
acgaggacatcatcattgctgagctggatgc

SEQ ID NO: 90806 - DNA, 30 bp, Artificial Sequence
  Description of Artificial Sequence: Synthetic oligonucleotide
cgaggacatcatcattgctgagctggatgc

SEQ ID NO: 90807 - DNA, 30 bp, Artificial Sequence
  Description of Artificial Sequence: Synthetic oligonucleotide
gaggacatcatcattgctgagctggatgcc

SEQ ID NO: 90808 - DNA, 31 bp, Artificial Sequence
  Description of Artificial Sequence: Synthetic oligonucleotide
aggacatcatcattgctgagctggatgccac

SEQ ID NO: 90809 - DNA, 30 bp, Artificial Sequence
  Description of Artificial Sequence: Synthetic oligonucleotide
ggacatcatcattgctgagctggatgccac

SEQ ID NO: 90810 - DNA, 30 bp, Artificial Sequence
  Description of Artificial Sequence: Synthetic oligonucleotide
gacatcatcattgctgagctggatgccacg

SEQ ID NO: 90811 - DNA, 30 bp, Artificial Sequence
  Description of Artificial Sequence: Synthetic oligonucleotide
acatcatcattgctgagctggatgccacgg

SEQ ID NO: 90812 - DNA, 29 bp, Artificial Sequence
  Description of Artificial Sequence: Synthetic oligonucleotide
catcatcattgctgagctggatgccacgg

SEQ ID NO: 90813 - DNA, 29 bp, Artificial Sequence
  Description of Artificial Sequence: Synthetic oligonucleotide
atcatcattgctgagctggatgccacggc

SEQ ID NO: 90814 - DNA, 28 bp, Artificial Sequence
  Description of Artificial Sequence: Synthetic oligonucleotide
tcatcattgctgagctggatgccacggc

SEQ ID NO: 90815 - DNA, 27 bp, Artificial Sequence
  Description of Artificial Sequence: Synthetic oligonucleotide
catcattgctgagctggatgccacggc

SEQ ID NO: 90816 - DNA, 27 bp, Artificial Sequence
  Description of Artificial Sequence: Synthetic oligonucleotide
atcattgctgagctggatgccacggcc

SEQ ID NO: 90817 - DNA, 27 bp, Artificial Sequence
  Description of Artificial Sequence: Synthetic oligonucleotide
tcattgctgagctggatgccacggcca

SEQ ID NO: 90818 - DNA, 27 bp, Artificial Sequence
  Description of Artificial Sequence: Synthetic oligonucleotide
cattgctgagctggatgccacggccaa

SEQ ID NO: 90819 - DNA, 27 bp, Artificial Sequence
  Description of Artificial Sequence: Synthetic oligonucleotide
attgctgagctggatgccacggccaac

SEQ ID NO: 90820 - DNA, 26 bp, Artificial Sequence
  Description of Artificial Sequence: Synthetic oligonucleotide
ttgctgagctggatgccacggccaac

SEQ ID NO: 90821 - DNA, 25 bp, Artificial Sequence
  Description of Artificial Sequence: Synthetic oligonucleotide
tgctgagctggatgccacggccaac

SEQ ID NO: 90822 - DNA, 24 bp, Artificial Sequence
  Description of Artificial Sequence: Synthetic oligonucleotide
gctgagctggatgccacggccaac

SEQ ID NO: 90823 - DNA, 25 bp, Artificial Sequence
  Description of Artificial Sequence: Synthetic oligonucleotide
ctgagctggatgccacggccaacga

SEQ ID NO: 90824 - DNA, 25 bp, Artificial Sequence
  Description of Artificial Sequence: Synthetic oligonucleotide
tgagctggatgccacggccaacgag

SEQ ID NO: 90825 - DNA, 24 bp, Artificial Sequence
  Description of Artificial Sequence: Synthetic oligonucleotide
gagctggatgccacggccaacgag

SEQ ID NO: 90826 - DNA, 25 bp, Artificial Sequence
  Description of Artificial Sequence: Synthetic oligonucleotide
agctggatgccacggccaacgagct

SEQ ID NO: 90827 - DNA, 24 bp, Artificial Sequence
  Description of Artificial Sequence: Synthetic oligonucleotide
gctggatgccacggccaacgagct

SEQ ID NO: 90828 - DNA, 24 bp, Artificial Sequence
  Description of Artificial Sequence: Synthetic oligonucleotide
ctggatgccacggccaacgagctg

SEQ ID NO: 90829 - DNA, 26 bp, Artificial Sequence
  Description of Artificial Sequence: Synthetic oligonucleotide
tggatgccacggccaacgagctggat

SEQ ID NO: 90830 - DNA, 25 bp, Artificial Sequence
  Description of Artificial Sequence: Synthetic oligonucleotide
ggatgccacggccaacgagctggat

SEQ ID NO: 90831 - DNA, 25 bp, Artificial Sequence
  Description of Artificial Sequence: Synthetic oligonucleotide
gatgccacggccaacgagctggatg

SEQ ID NO: 90832 - DNA, 25 bp, Artificial Sequence
  Description of Artificial Sequence: Synthetic oligonucleotide
atgccacggccaacgagctggatgc

SEQ ID NO: 90833 - DNA, 24 bp, Artificial Sequence
  Description of Artificial Sequence: Synthetic oligonucleotide
tgccacggccaacgagctggatgc

SEQ ID NO: 90834 - DNA, 23 bp, Artificial Sequence
  Description of Artificial Sequence: Synthetic oligonucleotide
gccacggccaacgagctggatgc

SEQ ID NO: 90835 - DNA, 25 bp, Artificial Sequence
  Description of Artificial Sequence: Synthetic oligonucleotide
ccacggccaacgagctggatgcctt

SEQ ID NO: 90836 - DNA, 25 bp, Artificial Sequence
  Description of Artificial Sequence: Synthetic oligonucleotide
cacggccaacgagctggatgccttc

SEQ ID NO: 90837 - DNA, 25 bp, Artificial Sequence
  Description of Artificial Sequence: Synthetic oligonucleotide
acggccaacgagctggatgccttcg

SEQ ID NO: 90838 - DNA, 24 bp, Artificial Sequence
  Description of Artificial Sequence: Synthetic oligonucleotide
cggccaacgagctggatgccttcg

SEQ ID NO: 90839 - DNA, 25 bp, Artificial Sequence
  Description of Artificial Sequence: Synthetic oligonucleotide
ggccaacgagctggatgccttcgct

SEQ ID NO: 90840 - DNA, 26 bp, Artificial Sequence
  Description of Artificial Sequence: Synthetic oligonucleotide
gccaacgagctggatgccttcgctgt

SEQ ID NO: 90841 - DNA, 26 bp, Artificial Sequence
  Description of Artificial Sequence: Synthetic oligonucleotide
ccaacgagctggatgccttcgctgtg

SEQ ID NO: 90842 - DNA, 27 bp, Artificial Sequence
  Description of Artificial Sequence: Synthetic oligonucleotide
caacgagctggatgccttcgctgtgca

SEQ ID NO: 90843 - DNA, 27 bp, Artificial Sequence
  Description of Artificial Sequence: Synthetic oligonucleotide
aacgagctggatgccttcgctgtgcac

SEQ ID NO: 90844 - DNA, 26 bp, Artificial Sequence
  Description of Artificial Sequence: Synthetic oligonucleotide
acgagctggatgccttcgctgtgcac

SEQ ID NO: 90845 - DNA, 25 bp, Artificial Sequence
  Description of Artificial Sequence: Synthetic oligonucleotide
cgagctggatgccttcgctgtgcac

SEQ ID NO: 90846 - DNA, 25 bp, Artificial Sequence
  Description of Artificial Sequence: Synthetic oligonucleotide
gagctggatgccttcgctgtgcacg

SEQ ID NO: 90847 - DNA, 25 bp, Artificial Sequence
  Description of Artificial Sequence: Synthetic oligonucleotide
agctggatgccttcgctgtgcacgg

SEQ ID NO: 90848 - DNA, 24 bp, Artificial Sequence
  Description of Artificial Sequence: Synthetic oligonucleotide
gctggatgccttcgctgtgcacgg

SEQ ID NO: 90849 - DNA, 26 bp, Artificial Sequence
  Description of Artificial Sequence: Synthetic oligonucleotide
ctggatgccttcgctgtgcacggctt

SEQ ID NO: 90850 - DNA, 26 bp, Artificial Sequence
  Description of Artificial Sequence: Synthetic oligonucleotide
tggatgccttcgctgtgcacggcttc

SEQ ID NO: 90851 - DNA, 25 bp, Artificial Sequence
  Description of Artificial Sequence: Synthetic oligonucleotide
ggatgccttcgctgtgcacggcttc

SEQ ID NO: 90852 - DNA, 25 bp, Artificial Sequence
  Description of Artificial Sequence: Synthetic oligonucleotide
gatgccttcgctgtgcacggcttcc

SEQ ID NO: 90853 - DNA, 27 bp, Artificial Sequence
  Description of Artificial Sequence: Synthetic oligonucleotide
atgccttcgctgtgcacggcttcccta

SEQ ID NO: 90854 - DNA, 26 bp, Artificial Sequence
  Description of Artificial Sequence: Synthetic oligonucleotide
tgccttcgctgtgcacggcttcccta

SEQ ID NO: 90855 - DNA, 25 bp, Artificial Sequence
  Description of Artificial Sequence: Synthetic oligonucleotide
gccttcgctgtgcacggcttcccta

SEQ ID NO: 90856 - DNA, 26 bp, Artificial Sequence
  Description of Artificial Sequence: Synthetic oligonucleotide
ccttcgctgtgcacggcttccctact

SEQ ID NO: 90857 - DNA, 27 bp, Artificial Sequence
  Description of Artificial Sequence: Synthetic oligonucleotide
cttcgctgtgcacggcttccctactct

SEQ ID NO: 90858 - DNA, 27 bp, Artificial Sequence
  Description of Artificial Sequence: Synthetic oligonucleotide
ttcgctgtgcacggcttccctactctc

SEQ ID NO: 90859 - DNA, 27 bp, Artificial Sequence
  Description of Artificial Sequence: Synthetic oligonucleotide
tcgctgtgcacggcttccctactctca

SEQ ID NO: 90860 - DNA, 27 bp, Artificial Sequence
  Description of Artificial Sequence: Synthetic oligonucleotide
cgctgtgcacggcttccctactctcaa

SEQ ID NO: 90861 - DNA, 27 bp, Artificial Sequence
  Description of Artificial Sequence: Synthetic oligonucleotide
gctgtgcacggcttccctactctcaag

SEQ ID NO: 90862 - DNA, 29 bp, Artificial Sequence
  Description of Artificial Sequence: Synthetic oligonucleotide
ctgtgcacggcttccctactctcaagtac

SEQ ID NO: 90863 - DNA, 31 bp, Artificial Sequence
  Description of Artificial Sequence: Synthetic oligonucleotide
tgtgcacggcttccctactctcaagtacttc

SEQ ID NO: 90864 - DNA, 30 bp, Artificial Sequence
  Description of Artificial Sequence: Synthetic oligonucleotide
gtgcacggcttccctactctcaagtacttc

SEQ ID NO: 90865 - DNA, 30 bp, Artificial Sequence
  Description of Artificial Sequence: Synthetic oligonucleotide
tgcacggcttccctactctcaagtacttcc

SEQ ID NO: 90866 - DNA, 29 bp, Artificial Sequence
  Description of Artificial Sequence: Synthetic oligonucleotide
gcacggcttccctactctcaagtacttcc

SEQ ID NO: 90867 - DNA, 29 bp, Artificial Sequence
  Description of Artificial Sequence: Synthetic oligonucleotide
cacggcttccctactctcaagtacttccc

SEQ ID NO: 90868 - DNA, 30 bp, Artificial Sequence
  Description of Artificial Sequence: Synthetic oligonucleotide
acggcttccctactctcaagtacttcccag

SEQ ID NO: 90869 - DNA, 29 bp, Artificial Sequence
  Description of Artificial Sequence: Synthetic oligonucleotide
cggcttccctactctcaagtacttcccag

SEQ ID NO: 90870 - DNA, 29 bp, Artificial Sequence
  Description of Artificial Sequence: Synthetic oligonucleotide
ggcttccctactctcaagtacttcccagc

SEQ ID NO: 90871 - DNA, 30 bp, Artificial Sequence
  Description of Artificial Sequence: Synthetic oligonucleotide
gcttccctactctcaagtacttcccagcag

SEQ ID NO: 90872 - DNA, 30 bp, Artificial Sequence
  Description of Artificial Sequence: Synthetic oligonucleotide
cttccctactctcaagtacttcccagcagg

SEQ ID NO: 90873 - DNA, 30 bp, Artificial Sequence
  Description of Artificial Sequence: Synthetic oligonucleotide
ttccctactctcaagtacttcccagcaggg

SEQ ID NO: 90874 - DNA, 29 bp, Artificial Sequence
  Description of Artificial Sequence: Synthetic oligonucleotide
tccctactctcaagtacttcccagcaggg

SEQ ID NO: 90875 - DNA, 28 bp, Artificial Sequence
  Description of Artificial Sequence: Synthetic oligonucleotide
ccctactctcaagtacttcccagcaggg

SEQ ID NO: 90876 - DNA, 28 bp, Artificial Sequence
  Description of Artificial Sequence: Synthetic oligonucleotide
cctactctcaagtacttcccagcagggc

SEQ ID NO: 90877 - DNA, 28 bp, Artificial Sequence
  Description of Artificial Sequence: Synthetic oligonucleotide
ctactctcaagtacttcccagcagggcc

SEQ ID NO: 90878 - DNA, 29 bp, Artificial Sequence
  Description of Artificial Sequence: Synthetic oligonucleotide
tactctcaagtacttcccagcagggccag

SEQ ID NO: 90879 - DNA, 28 bp, Artificial Sequence
  Description of Artificial Sequence: Synthetic oligonucleotide
actctcaagtacttcccagcagggccag

SEQ ID NO: 90880 - DNA, 27 bp, Artificial Sequence
  Description of Artificial Sequence: Synthetic oligonucleotide
ctctcaagtacttcccagcagggccag

SEQ ID NO: 90881 - DNA, 27 bp, Artificial Sequence
  Description of Artificial Sequence: Synthetic oligonucleotide
tctcaagtacttcccagcagggccagg

SEQ ID NO: 90882 - DNA, 27 bp, Artificial Sequence
  Description of Artificial Sequence: Synthetic oligonucleotide
ctcaagtacttcccagcagggccaggt

SEQ ID NO: 90883 - DNA, 27 bp, Artificial Sequence
  Description of Artificial Sequence: Synthetic oligonucleotide
tcaagtacttcccagcagggccaggtc

SEQ ID NO: 90884 - DNA, 26 bp, Artificial Sequence
  Description of Artificial Sequence: Synthetic oligonucleotide
caagtacttcccagcagggccaggtc

SEQ ID NO: 90885 - DNA, 26 bp, Artificial Sequence
  Description of Artificial Sequence: Synthetic oligonucleotide
aagtacttcccagcagggccaggtcg

SEQ ID NO: 90886 - DNA, 25 bp, Artificial Sequence
  Description of Artificial Sequence: Synthetic oligonucleotide
agtacttcccagcagggccaggtcg

SEQ ID NO: 90887 - DNA, 24 bp, Artificial Sequence
  Description of Artificial Sequence: Synthetic oligonucleotide
gtacttcccagcagggccaggtcg

SEQ ID NO: 90888 - DNA, 26 bp, Artificial Sequence
  Description of Artificial Sequence: Synthetic oligonucleotide
tacttcccagcagggccaggtcggaa

SEQ ID NO: 90889 - DNA, 25 bp, Artificial Sequence
  Description of Artificial Sequence: Synthetic oligonucleotide
acttcccagcagggccaggtcggaa

SEQ ID NO: 90890 - DNA, 24 bp, Artificial Sequence
  Description of Artificial Sequence: Synthetic oligonucleotide
cttcccagcagggccaggtcggaa

SEQ ID NO: 90891 - DNA, 24 bp, Artificial Sequence
  Description of Artificial Sequence: Synthetic oligonucleotide
ttcccagcagggccaggtcggaag

SEQ ID NO: 90892 - DNA, 23 bp, Artificial Sequence
  Description of Artificial Sequence: Synthetic oligonucleotide
tcccagcagggccaggtcggaag

SEQ ID NO: 90893 - DNA, 22 bp, Artificial Sequence
  Description of Artificial Sequence: Synthetic oligonucleotide
cccagcagggccaggtcggaag

SEQ ID NO: 90894 - DNA, 23 bp, Artificial Sequence
  Description of Artificial Sequence: Synthetic oligonucleotide
ccagcagggccaggtcggaaggt

SEQ ID NO: 90895 - DNA, 26 bp, Artificial Sequence
  Description of Artificial Sequence: Synthetic oligonucleotide
cagcagggccaggtcggaaggtgatt

SEQ ID NO: 90896 - DNA, 27 bp, Artificial Sequence
  Description of Artificial Sequence: Synthetic oligonucleotide
agcagggccaggtcggaaggtgattga

SEQ ID NO: 90897 - DNA, 27 bp, Artificial Sequence
  Description of Artificial Sequence: Synthetic oligonucleotide
gcagggccaggtcggaaggtgattgaa

SEQ ID NO: 90898 - DNA, 29 bp, Artificial Sequence
  Description of Artificial Sequence: Synthetic oligonucleotide
cagggccaggtcggaaggtgattgaatac

SEQ ID NO: 90899 - DNA, 33 bp, Artificial Sequence
  Description of Artificial Sequence: Synthetic oligonucleotide
agggccaggtcggaaggtgattgaatacaaaag

SEQ ID NO: 90900 - DNA, 32 bp, Artificial Sequence
  Description of Artificial Sequence: Synthetic oligonucleotide
gggccaggtcggaaggtgattgaatacaaaag

SEQ ID NO: 90901 - DNA, 32 bp, Artificial Sequence
  Description of Artificial Sequence: Synthetic oligonucleotide
ggccaggtcggaaggtgattgaatacaaaagc

SEQ ID NO: 90902 - DNA, 33 bp, Artificial Sequence
  Description of Artificial Sequence: Synthetic oligonucleotide
gccaggtcggaaggtgattgaatacaaaagcac

SEQ ID NO: 90903 - DNA, 33 bp, Artificial Sequence
  Description of Artificial Sequence: Synthetic oligonucleotide
ccaggtcggaaggtgattgaatacaaaagcacc

SEQ ID NO: 90904 - DNA, 34 bp, Artificial Sequence
  Description of Artificial Sequence: Synthetic oligonucleotide
caggtcggaaggtgattgaatacaaaagcaccag

SEQ ID NO: 90905 - DNA, 34 bp, Artificial Sequence
  Description of Artificial Sequence: Synthetic oligonucleotide
aggtcggaaggtgattgaatacaaaagcaccagg

SEQ ID NO: 90906 - DNA, 33 bp, Artificial Sequence
  Description of Artificial Sequence: Synthetic oligonucleotide
ggtcggaaggtgattgaatacaaaagcaccagg

SEQ ID NO: 90907 - DNA, 33 bp, Artificial Sequence
  Description of Artificial Sequence: Synthetic oligonucleotide
gtcggaaggtgattgaatacaaaagcaccaggg

SEQ ID NO: 90908 - DNA, 34 bp, Artificial Sequence
  Description of Artificial Sequence: Synthetic oligonucleotide
tcggaaggtgattgaatacaaaagcaccagggac

SEQ ID NO: 90909 - DNA, 33 bp, Artificial Sequence
  Description of Artificial Sequence: Synthetic oligonucleotide
cggaaggtgattgaatacaaaagcaccagggac

SEQ ID NO: 90910 - DNA, 33 bp, Artificial Sequence
  Description of Artificial Sequence: Synthetic oligonucleotide
ggaaggtgattgaatacaaaagcaccagggacc

SEQ ID NO: 90911 - DNA, 34 bp, Artificial Sequence
  Description of Artificial Sequence: Synthetic oligonucleotide
gaaggtgattgaatacaaaagcaccagggacctg

SEQ ID NO: 90912 - DNA, 34 bp, Artificial Sequence
  Description of Artificial Sequence: Synthetic oligonucleotide
aaggtgattgaatacaaaagcaccagggacctgg

SEQ ID NO: 90913 - DNA, 33 bp, Artificial Sequence
  Description of Artificial Sequence: Synthetic oligonucleotide
aggtgattgaatacaaaagcaccagggacctgg

SEQ ID NO: 90914 - DNA, 32 bp, Artificial Sequence
  Description of Artificial Sequence: Synthetic oligonucleotide
ggtgattgaatacaaaagcaccagggacctgg

SEQ ID NO: 90915 - DNA, 33 bp, Artificial Sequence
  Description of Artificial Sequence: Synthetic oligonucleotide
gtgattgaatacaaaagcaccagggacctggag

SEQ ID NO: 90916 - DNA, 34 bp, Artificial Sequence
  Description of Artificial Sequence: Synthetic oligonucleotide
tgattgaatacaaaagcaccagggacctggagac

SEQ ID NO: 90917 - DNA, 33 bp, Artificial Sequence
  Description of Artificial Sequence: Synthetic oligonucleotide
gattgaatacaaaagcaccagggacctggagac

SEQ ID NO: 90918 - DNA, 36 bp, Artificial Sequence
  Description of Artificial Sequence: Synthetic oligonucleotide
attgaatacaaaagcaccagggacctggagactttc

SEQ ID NO: 90919 - DNA, 35 bp, Artificial Sequence
  Description of Artificial Sequence: Synthetic oligonucleotide
ttgaatacaaaagcaccagggacctggagactttc

SEQ ID NO: 90920 - DNA, 34 bp, Artificial Sequence
  Description of Artificial Sequence: Synthetic oligonucleotide
tgaatacaaaagcaccagggacctggagactttc

SEQ ID NO: 90921 - DNA, 33 bp, Artificial Sequence
  Description of Artificial Sequence: Synthetic oligonucleotide
gaatacaaaagcaccagggacctggagactttc

SEQ ID NO: 90922 - DNA, 34 bp, Artificial Sequence
  Description of Artificial Sequence: Synthetic oligonucleotide
aatacaaaagcaccagggacctggagactttctc

SEQ ID NO: 90923 - DNA, 33 bp, Artificial Sequence
  Description of Artificial Sequence: Synthetic oligonucleotide
atacaaaagcaccagggacctggagactttctc

SEQ ID NO: 90924 - DNA, 32 bp, Artificial Sequence
  Description of Artificial Sequence: Synthetic oligonucleotide
tacaaaagcaccagggacctggagactttctc

SEQ ID NO: 90925 - DNA, 31 bp, Artificial Sequence
  Description of Artificial Sequence: Synthetic oligonucleotide
acaaaagcaccagggacctggagactttctc

SEQ ID NO: 90926 - DNA, 30 bp, Artificial Sequence
  Description of Artificial Sequence: Synthetic oligonucleotide
caaaagcaccagggacctggagactttctc

SEQ ID NO: 90927 - DNA, 30 bp, Artificial Sequence
  Description of Artificial Sequence: Synthetic oligonucleotide
aaaagcaccagggacctggagactttctcc

SEQ ID NO: 90928 - DNA, 29 bp, Artificial Sequence
  Description of Artificial Sequence: Synthetic oligonucleotide
aaagcaccagggacctggagactttctcc

SEQ ID NO: 90929 - DNA, 28 bp, Artificial Sequence
  Description of Artificial Sequence: Synthetic oligonucleotide
aagcaccagggacctggagactttctcc

SEQ ID NO: 90930 - DNA, 27 bp, Artificial Sequence
  Description of Artificial Sequence: Synthetic oligonucleotide
agcaccagggacctggagactttctcc

SEQ ID NO: 90931 - DNA, 27 bp, Artificial Sequence
  Description of Artificial Sequence: Synthetic oligonucleotide
gcaccagggacctggagactttctcca

SEQ ID NO: 90932 - DNA, 28 bp, Artificial Sequence
  Description of Artificial Sequence: Synthetic oligonucleotide
caccagggacctggagactttctccaag

SEQ ID NO: 90933 - DNA, 30 bp, Artificial Sequence
  Description of Artificial Sequence: Synthetic oligonucleotide
accagggacctggagactttctccaagttc

SEQ ID NO: 90934 - DNA, 29 bp, Artificial Sequence
  Description of Artificial Sequence: Synthetic oligonucleotide
ccagggacctggagactttctccaagttc

SEQ ID NO: 90935 - DNA, 29 bp, Artificial Sequence
  Description of Artificial Sequence: Synthetic oligonucleotide
cagggacctggagactttctccaagttcc

SEQ ID NO: 90936 - DNA, 30 bp, Artificial Sequence
  Description of Artificial Sequence: Synthetic oligonucleotide
agggacctggagactttctccaagttcctg

SEQ ID NO: 90937 - DNA, 29 bp, Artificial Sequence
  Description of Artificial Sequence: Synthetic oligonucleotide
gggacctggagactttctccaagttcctg

SEQ ID NO: 90938 - DNA, 29 bp, Artificial Sequence
  Description of Artificial Sequence: Synthetic oligonucleotide
ggacctggagactttctccaagttcctgg

SEQ ID NO: 90939 - DNA, 30 bp, Artificial Sequence
  Description of Artificial Sequence: Synthetic oligonucleotide
gacctggagactttctccaagttcctggac

SEQ ID NO: 90940 - DNA, 32 bp, Artificial Sequence
  Description of Artificial Sequence: Synthetic oligonucleotide
acctggagactttctccaagttcctggacaac

SEQ ID NO: 90941 - DNA, 31 bp, Artificial Sequence
  Description of Artificial Sequence: Synthetic oligonucleotide
cctggagactttctccaagttcctggacaac

SEQ ID NO: 90942 - DNA, 31 bp, Artificial Sequence
  Description of Artificial Sequence: Synthetic oligonucleotide
ctggagactttctccaagttcctggacaacg

SEQ ID NO: 90943 - DNA, 31 bp, Artificial Sequence
  Description of Artificial Sequence: Synthetic oligonucleotide
tggagactttctccaagttcctggacaacgg

SEQ ID NO: 90944 - DNA, 30 bp, Artificial Sequence
  Description of Artificial Sequence: Synthetic oligonucleotide
ggagactttctccaagttcctggacaacgg

SEQ ID NO: 90945 - DNA, 30 bp, Artificial Sequence
  Description of Artificial Sequence: Synthetic oligonucleotide
gagactttctccaagttcctggacaacggg

SEQ ID NO: 90946 - DNA, 30 bp, Artificial Sequence
  Description of Artificial Sequence: Synthetic oligonucleotide
agactttctccaagttcctggacaacgggg

SEQ ID NO: 90947 - DNA, 29 bp, Artificial Sequence
  Description of Artificial Sequence: Synthetic oligonucleotide
gactttctccaagttcctggacaacgggg

SEQ ID NO: 90948 - DNA, 29 bp, Artificial Sequence
  Description of Artificial Sequence: Synthetic oligonucleotide
actttctccaagttcctggacaacggggg

SEQ ID NO: 90949 - DNA, 28 bp, Artificial Sequence
  Description of Artificial Sequence: Synthetic oligonucleotide
ctttctccaagttcctggacaacggggg

SEQ ID NO: 90950 - DNA, 28 bp, Artificial Sequence
  Description of Artificial Sequence: Synthetic oligonucleotide
tttctccaagttcctggacaacgggggc

SEQ ID NO: 90951 - DNA, 27 bp, Artificial Sequence
  Description of Artificial Sequence: Synthetic oligonucleotide
ttctccaagttcctggacaacgggggc

SEQ ID NO: 90952 - DNA, 26 bp, Artificial Sequence
  Description of Artificial Sequence: Synthetic oligonucleotide
tctccaagttcctggacaacgggggc

SEQ ID NO: 90953 - DNA, 25 bp, Artificial Sequence
  Description of Artificial Sequence: Synthetic oligonucleotide
ctccaagttcctggacaacgggggc

SEQ ID NO: 90954 - DNA, 26 bp, Artificial Sequence
  Description of Artificial Sequence: Synthetic oligonucleotide
tccaagttcctggacaacgggggcgt

SEQ ID NO: 90955 - DNA, 25 bp, Artificial Sequence
  Description of Artificial Sequence: Synthetic oligonucleotide
ccaagttcctggacaacgggggcgt

SEQ ID NO: 90956 - DNA, 25 bp, Artificial Sequence
  Description of Artificial Sequence: Synthetic oligonucleotide
caagttcctggacaacgggggcgtg

SEQ ID NO: 90957 - DNA, 26 bp, Artificial Sequence
  Description of Artificial Sequence: Synthetic oligonucleotide
aagttcctggacaacgggggcgtgct

SEQ ID NO: 90958 - DNA, 25 bp, Artificial Sequence
  Description of Artificial Sequence: Synthetic oligonucleotide
agttcctggacaacgggggcgtgct

SEQ ID NO: 90959 - DNA, 24 bp, Artificial Sequence
  Description of Artificial Sequence: Synthetic oligonucleotide
gttcctggacaacgggggcgtgct

SEQ ID NO: 90960 - DNA, 24 bp, Artificial Sequence
  Description of Artificial Sequence: Synthetic oligonucleotide
ttcctggacaacgggggcgtgctg

SEQ ID NO: 90961 - DNA, 23 bp, Artificial Sequence
  Description of Artificial Sequence: Synthetic oligonucleotide
tcctggacaacgggggcgtgctg

SEQ ID NO: 90962 - DNA, 22 bp, Artificial Sequence
  Description of Artificial Sequence: Synthetic oligonucleotide
cctggacaacgggggcgtgctg

SEQ ID NO: 90963 - DNA, 22 bp, Artificial Sequence
  Description of Artificial Sequence: Synthetic oligonucleotide
ctggacaacgggggcgtgctgc

SEQ ID NO: 90964 - DNA, 22 bp, Artificial Sequence
  Description of Artificial Sequence: Synthetic oligonucleotide
tggacaacgggggcgtgctgcc

SEQ ID NO: 90965 - DNA, 21 bp, Artificial Sequence
  Description of Artificial Sequence: Synthetic oligonucleotide
ggacaacgggggcgtgctgcc

SEQ ID NO: 90966 - DNA, 22 bp, Artificial Sequence
  Description of Artificial Sequence: Synthetic oligonucleotide
gacaacgggggcgtgctgccca

SEQ ID NO: 90967 - DNA, 22 bp, Artificial Sequence
  Description of Artificial Sequence: Synthetic oligonucleotide
acaacgggggcgtgctgcccac

SEQ ID NO: 90968 - DNA, 21 bp, Artificial Sequence
  Description of Artificial Sequence: Synthetic oligonucleotide
caacgggggcgtgctgcccac

SEQ ID NO: 90969 - DNA, 21 bp, Artificial Sequence
  Description of Artificial Sequence: Synthetic oligonucleotide
aacgggggcgtgctgcccacg

SEQ ID NO: 90970 - DNA, 20 bp, Artificial Sequence
  Description of Artificial Sequence: Synthetic oligonucleotide
acgggggcgtgctgcccacg

SEQ ID NO: 90971 - DNA, 20 bp, Artificial Sequence
  Description of Artificial Sequence: Synthetic oligonucleotide
cgggggcgtgctgcccacgt

SEQ ID NO: 90972 - DNA, 20 bp, Artificial Sequence
  Description of Artificial Sequence: Synthetic oligonucleotide
gggggcgtgctgcccacgga

SEQ ID NO: 90973 - DNA, 20 bp, Artificial Sequence
  Description of Artificial Sequence: Synthetic oligonucleotide
ggggcgtgctgcccacggag

SEQ ID NO: 90974 - DNA, 21 bp, Artificial Sequence
  Description of Artificial Sequence: Synthetic oligonucleotide
gggcgtgctgcccacggagga

SEQ ID NO: 90975 - DNA, 21 bp, Artificial Sequence
  Description of Artificial Sequence: Synthetic oligonucleotide
ggcgtgctgcccacggaggag

SEQ ID NO: 90976 - DNA, 21 bp, Artificial Sequence
  Description of Artificial Sequence: Synthetic oligonucleotide
gcgtgctgcccacggaggagc

SEQ ID NO: 90977 - DNA, 21 bp, Artificial Sequence
  Description of Artificial Sequence: Synthetic oligonucleotide
cgtgctgcccacggaggagcc

SEQ ID NO: 90978 - DNA, 21 bp, Artificial Sequence
  Description of Artificial Sequence: Synthetic oligonucleotide
gtgctgcccacggaggagccc

SEQ ID NO: 90979 - DNA, 21 bp, Artificial Sequence
  Description of Artificial Sequence: Synthetic oligonucleotide
tgctgcccacggaggagcccc

SEQ ID NO: 90980 - DNA, 20 bp, Artificial Sequence
  Description of Artificial Sequence: Synthetic oligonucleotide
gctgcccacggaggagcccc

SEQ ID NO: 90981 - DNA, 20 bp, Artificial Sequence
  Description of Artificial Sequence: Synthetic oligonucleotide
ctgcccacggaggagccccc

SEQ ID NO: 90982 - DNA, 20 bp, Artificial Sequence
  Description of Artificial Sequence: Synthetic oligonucleotide
tgcccacggaggagcccccg

SEQ ID NO: 90983 - DNA, 20 bp, Artificial Sequence
  Description of Artificial Sequence: Synthetic oligonucleotide
gcccacggaggagcccccgt

SEQ ID NO: 90984 - DNA, 20 bp, Artificial Sequence
  Description of Artificial Sequence: Synthetic oligonucleotide
cccacggaggagcccccgga

SEQ ID NO: 90985 - DNA, 20 bp, Artificial Sequence
  Description of Artificial Sequence: Synthetic oligonucleotide
ccacggaggagcccccggag

SEQ ID NO: 90986 - DNA, 21 bp, Artificial Sequence
  Description of Artificial Sequence: Synthetic oligonucleotide
cacggaggagcccccggagga

SEQ ID NO: 90987 - DNA, 21 bp, Artificial Sequence
  Description of Artificial Sequence: Synthetic oligonucleotide
acggaggagcccccggaggag

SEQ ID NO: 90988 - DNA, 20 bp, Artificial Sequence
  Description of Artificial Sequence: Synthetic oligonucleotide
cggaggagcccccggaggag

SEQ ID NO: 90989 - DNA, 20 bp, Artificial Sequence
  Description of Artificial Sequence: Synthetic oligonucleotide
ggaggagcccccggaggagc

SEQ ID NO: 90990 - DNA, 21 bp, Artificial Sequence
  Description of Artificial Sequence: Synthetic oligonucleotide
gaggagcccccggaggagcca

SEQ ID NO: 90991 - DNA, 21 bp, Artificial Sequence
  Description of Artificial Sequence: Synthetic oligonucleotide
aggagcccccggaggagccag

SEQ ID NO: 90992 - DNA, 20 bp, Artificial Sequence
  Description of Artificial Sequence: Synthetic oligonucleotide
ggagcccccggaggagccag

SEQ ID NO: 90993 - DNA, 21 bp, Artificial Sequence
  Description of Artificial Sequence: Synthetic oligonucleotide
gagcccccggaggagccagca

SEQ ID NO: 90994 - DNA, 21 bp, Artificial Sequence
  Description of Artificial Sequence: Synthetic oligonucleotide
agcccccggaggagccagcag

SEQ ID NO: 90995 - DNA, 20 bp, Artificial Sequence
  Description of Artificial Sequence: Synthetic oligonucleotide
gcccccggaggagccagcag

SEQ ID NO: 90996 - DNA, 20 bp, Artificial Sequence
  Description of Artificial Sequence: Synthetic oligonucleotide
cccccggaggagccagcagc

SEQ ID NO: 90997 - DNA, 20 bp, Artificial Sequence
  Description of Artificial Sequence: Synthetic oligonucleotide
ccccggaggagccagcagcc

SEQ ID NO: 90998 - DNA, 20 bp, Artificial Sequence
  Description of Artificial Sequence: Synthetic oligonucleotide
cccggaggagccagcagccc

SEQ ID NO: 90999 - DNA, 20 bp, Artificial Sequence
  Description of Artificial Sequence: Synthetic oligonucleotide
ccggaggagccagcagcccc

SEQ ID NO: 91000 - DNA, 22 bp, Artificial Sequence
  Description of Artificial Sequence: Synthetic oligonucleotide
cggaggagccagcagccccgtt

SEQ ID NO: 91001 - DNA, 22 bp, Artificial Sequence
  Description of Artificial Sequence: Synthetic oligonucleotide
ggaggagccagcagccccgttc

SEQ ID NO: 91002 - DNA, 22 bp, Artificial Sequence
  Description of Artificial Sequence: Synthetic oligonucleotide
gaggagccagcagccccgttcc

SEQ ID NO: 91003 - DNA, 22 bp, Artificial Sequence
  Description of Artificial Sequence: Synthetic oligonucleotide
aggagccagcagccccgttccc

SEQ ID NO: 91004 - DNA, 21 bp, Artificial Sequence
  Description of Artificial Sequence: Synthetic oligonucleotide
ggagccagcagccccgttccc

SEQ ID NO: 91005 - DNA, 21 bp, Artificial Sequence
  Description of Artificial Sequence: Synthetic oligonucleotide
gagccagcagccccgttcccg

SEQ ID NO: 91006 - DNA, 22 bp, Artificial Sequence
  Description of Artificial Sequence: Synthetic oligonucleotide
agccagcagccccgttcccgga

SEQ ID NO: 91007 - DNA, 21 bp, Artificial Sequence
  Description of Artificial Sequence: Synthetic oligonucleotide
gccagcagccccgttcccgga

SEQ ID NO: 91008 - DNA, 21 bp, Artificial Sequence
  Description of Artificial Sequence: Synthetic oligonucleotide
ccagcagccccgttcccggag

SEQ ID NO: 91009 - DNA, 21 bp, Artificial Sequence
  Description of Artificial Sequence: Synthetic oligonucleotide
cagcagccccgttcccggagc

SEQ ID NO: 91010 - DNA, 22 bp, Artificial Sequence
  Description of Artificial Sequence: Synthetic oligonucleotide
agcagccccgttcccggagcca

SEQ ID NO: 91011 - DNA, 21 bp, Artificial Sequence
  Description of Artificial Sequence: Synthetic oligonucleotide
gcagccccgttcccggagcca

SEQ ID NO: 91012 - DNA, 21 bp, Artificial Sequence
  Description of Artificial Sequence: Synthetic oligonucleotide
cagccccgttcccggagccac

SEQ ID NO: 91013 - DNA, 21 bp, Artificial Sequence
  Description of Artificial Sequence: Synthetic oligonucleotide
agccccgttcccggagccacc

SEQ ID NO: 91014 - DNA, 20 bp, Artificial Sequence
  Description of Artificial Sequence: Synthetic oligonucleotide
gccccgttcccggagccacc

SEQ ID NO: 91015 - DNA, 20 bp, Artificial Sequence
  Description of Artificial Sequence: Synthetic oligonucleotide
ccccgttcccggagccaccg

SEQ ID NO: 91016 - DNA, 20 bp, Artificial Sequence
  Description of Artificial Sequence: Synthetic oligonucleotide
cccgttcccggagccaccgg

SEQ ID NO: 91017 - DNA, 20 bp, Artificial Sequence
  Description of Artificial Sequence: Synthetic oligonucleotide
ccgttcccggagccaccggc

SEQ ID NO: 91018 - DNA, 22 bp, Artificial Sequence
  Description of Artificial Sequence: Synthetic oligonucleotide
cgttcccggagccaccggccaa

SEQ ID NO: 91019 - DNA, 23 bp, Artificial Sequence
  Description of Artificial Sequence: Synthetic oligonucleotide
gttcccggagccaccggccaact

SEQ ID NO: 91020 - DNA, 23 bp, Artificial Sequence
  Description of Artificial Sequence: Synthetic oligonucleotide
ttcccggagccaccggccaactc

SEQ ID NO: 91021 - DNA, 22 bp, Artificial Sequence
  Description of Artificial Sequence: Synthetic oligonucleotide
tcccggagccaccggccaactc

SEQ ID NO: 91022 - DNA, 21 bp, Artificial Sequence
  Description of Artificial Sequence: Synthetic oligonucleotide
cccggagccaccggccaactc

SEQ ID NO: 91023 - DNA, 22 bp, Artificial Sequence
  Description of Artificial Sequence: Synthetic oligonucleotide
ccggagccaccggccaactcca

SEQ ID NO: 91024 - DNA, 25 bp, Artificial Sequence
  Description of Artificial Sequence: Synthetic oligonucleotide
cggagccaccggccaactccactat

SEQ ID NO: 91025 - DNA, 25 bp, Artificial Sequence
  Description of Artificial Sequence: Synthetic oligonucleotide
ggagccaccggccaactccactatg

SEQ ID NO: 91026 - DNA, 25 bp, Artificial Sequence
  Description of Artificial Sequence: Synthetic oligonucleotide
gagccaccggccaactccactatgg

SEQ ID NO: 91027 - DNA, 25 bp, Artificial Sequence
  Description of Artificial Sequence: Synthetic oligonucleotide
agccaccggccaactccactatggg

SEQ ID NO: 91028 - DNA, 24 bp, Artificial Sequence
  Description of Artificial Sequence: Synthetic oligonucleotide
gccaccggccaactccactatggg

SEQ ID NO: 91029 - DNA, 25 bp, Artificial Sequence
  Description of Artificial Sequence: Synthetic oligonucleotide
ccaccggccaactccactatggggt

SEQ ID NO: 91030 - DNA, 25 bp, Artificial Sequence
  Description of Artificial Sequence: Synthetic oligonucleotide
caccggccaactccactatggggtc

SEQ ID NO: 91031 - DNA, 27 bp, Artificial Sequence
  Description of Artificial Sequence: Synthetic oligonucleotide
accggccaactccactatggggtccaa

SEQ ID NO: 91032 - DNA, 26 bp, Artificial Sequence
  Description of Artificial Sequence: Synthetic oligonucleotide
ccggccaactccactatggggtccaa

SEQ ID NO: 91033 - DNA, 26 bp, Artificial Sequence
  Description of Artificial Sequence: Synthetic oligonucleotide
cggccaactccactatggggtccaag

SEQ ID NO: 91034 - DNA, 27 bp, Artificial Sequence
  Description of Artificial Sequence: Synthetic oligonucleotide
ggccaactccactatggggtccaagga

SEQ ID NO: 91035 - DNA, 27 bp, Artificial Sequence
  Description of Artificial Sequence: Synthetic oligonucleotide
gccaactccactatggggtccaaggag

SEQ ID NO: 91036 - DNA, 27 bp, Artificial Sequence
  Description of Artificial Sequence: Synthetic oligonucleotide
ccaactccactatggggtccaaggagg

SEQ ID NO: 91037 - DNA, 29 bp, Artificial Sequence
  Description of Artificial Sequence: Synthetic oligonucleotide
caactccactatggggtccaaggaggaac

SEQ ID NO: 91038 - DNA, 30 bp, Artificial Sequence
  Description of Artificial Sequence: Synthetic oligonucleotide
aactccactatggggtccaaggaggaactg

SEQ ID NO: 91039 - DNA, 29 bp, Artificial Sequence
  Description of Artificial Sequence: Synthetic oligonucleotide
actccactatggggtccaaggaggaactg

SEQ ID NO: 91040 - DNA, 28 bp, Artificial Sequence
  Description of Artificial Sequence: Synthetic oligonucleotide
ctccactatggggtccaaggaggaactg

SEQ ID NO: 91041 - DNA, 30 bp, Artificial Sequence
  Description of Artificial Sequence: Synthetic oligonucleotide
tccactatggggtccaaggaggaactgtag

SEQ ID NO: 91042 - DNA, 21 bp, Artificial Sequence
  Description of Artificial Sequence: Synthetic oligonucleotide
atgcgcctccgccgcctagcg

SEQ ID NO: 91043 - DNA, 20 bp, Artificial Sequence
  Description of Artificial Sequence: Synthetic oligonucleotide
tgcgcctccgccgcctagcg

SEQ ID NO: 91044 - DNA, 20 bp, Artificial Sequence
  Description of Artificial Sequence: Synthetic oligonucleotide
gcgcctccgccgcctagcgt

SEQ ID NO: 91045 - DNA, 20 bp, Artificial Sequence
  Description of Artificial Sequence: Synthetic oligonucleotide
cgcctccgccgcctagcgct

SEQ ID NO: 91046 - DNA, 22 bp, Artificial Sequence
  Description of Artificial Sequence: Synthetic oligonucleotide
gcctccgccgcctagcgctgtt

SEQ ID NO: 91047 - DNA, 22 bp, Artificial Sequence
  Description of Artificial Sequence: Synthetic oligonucleotide
cctccgccgcctagcgctgttc

SEQ ID NO: 91048 - DNA, 22 bp, Artificial Sequence
  Description of Artificial Sequence: Synthetic oligonucleotide
ctccgccgcctagcgctgttcc

SEQ ID NO: 91049 - DNA, 22 bp, Artificial Sequence
  Description of Artificial Sequence: Synthetic oligonucleotide
tccgccgcctagcgctgttccc

SEQ ID NO: 91050 - DNA, 21 bp, Artificial Sequence
  Description of Artificial Sequence: Synthetic oligonucleotide
ccgccgcctagcgctgttccc

SEQ ID NO: 91051 - DNA, 21 bp, Artificial Sequence
  Description of Artificial Sequence: Synthetic oligonucleotide
cgccgcctagcgctgttcccg

SEQ ID NO: 91052 - DNA, 21 bp, Artificial Sequence
  Description of Artificial Sequence: Synthetic oligonucleotide
gccgcctagcgctgttcccgg

SEQ ID NO: 91053 - DNA, 22 bp, Artificial Sequence
  Description of Artificial Sequence: Synthetic oligonucleotide
ccgcctagcgctgttcccgggt

SEQ ID NO: 91054 - DNA, 23 bp, Artificial Sequence
  Description of Artificial Sequence: Synthetic oligonucleotide
cgcctagcgctgttcccgggtgt

SEQ ID NO: 91055 - DNA, 23 bp, Artificial Sequence
  Description of Artificial Sequence: Synthetic oligonucleotide
gcctagcgctgttcccgggtgtg

SEQ ID NO: 91056 - DNA, 23 bp, Artificial Sequence
  Description of Artificial Sequence: Synthetic oligonucleotide
cctagcgctgttcccgggtgtgg

SEQ ID NO: 91057 - DNA, 23 bp, Artificial Sequence
  Description of Artificial Sequence: Synthetic oligonucleotide
ctagcgctgttcccgggtgtggc

SEQ ID NO: 91058 - DNA, 23 bp, Artificial Sequence
  Description of Artificial Sequence: Synthetic oligonucleotide
tagcgctgttcccgggtgtggcg

SEQ ID NO: 91059 - DNA, 22 bp, Artificial Sequence
  Description of Artificial Sequence: Synthetic oligonucleotide
agcgctgttcccgggtgtggcg

SEQ ID NO: 91060 - DNA, 21 bp, Artificial Sequence
  Description of Artificial Sequence: Synthetic oligonucleotide
gcgctgttcccgggtgtggcg

SEQ ID NO: 91061 - DNA, 22 bp, Artificial Sequence
  Description of Artificial Sequence: Synthetic oligonucleotide
cgctgttcccgggtgtggcgct

SEQ ID NO: 91062 - DNA, 22 bp, Artificial Sequence
  Description of Artificial Sequence: Synthetic oligonucleotide
gctgttcccgggtgtggcgctg

SEQ ID NO: 91063 - DNA, 24 bp, Artificial Sequence
  Description of Artificial Sequence: Synthetic oligonucleotide
ctgttcccgggtgtggcgctgctt

SEQ ID NO: 91064 - DNA, 26 bp, Artificial Sequence
  Description of Artificial Sequence: Synthetic oligonucleotide
tgttcccgggtgtggcgctgcttctt

SEQ ID NO: 91065 - DNA, 25 bp, Artificial Sequence
  Description of Artificial Sequence: Synthetic oligonucleotide
gttcccgggtgtggcgctgcttctt

SEQ ID NO: 91066 - DNA, 25 bp, Artificial Sequence
  Description of Artificial Sequence: Synthetic oligonucleotide
ttcccgggtgtggcgctgcttcttg

SEQ ID NO: 91067 - DNA, 24 bp, Artificial Sequence
  Description of Artificial Sequence: Synthetic oligonucleotide
tcccgggtgtggcgctgcttcttg

SEQ ID NO: 91068 - DNA, 23 bp, Artificial Sequence
  Description of Artificial Sequence: Synthetic oligonucleotide
cccgggtgtggcgctgcttcttg

SEQ ID NO: 91069 - DNA, 23 bp, Artificial Sequence
  Description of Artificial Sequence: Synthetic oligonucleotide
ccgggtgtggcgctgcttcttgc

SEQ ID NO: 91070 - DNA, 23 bp, Artificial Sequence
  Description of Artificial Sequence: Synthetic oligonucleotide
cgggtgtggcgctgcttcttgcc

SEQ ID NO: 91071 - DNA, 23 bp, Artificial Sequence
  Description of Artificial Sequence: Synthetic oligonucleotide
gggtgtggcgctgcttcttgccg

SEQ ID NO: 91072 - DNA, 23 bp, Artificial Sequence
  Description of Artificial Sequence: Synthetic oligonucleotide
ggtgtggcgctgcttcttgccgc

SEQ ID NO: 91073 - DNA, 23 bp, Artificial Sequence
  Description of Artificial Sequence: Synthetic oligonucleotide
gtgtggcgctgcttcttgccgcg

SEQ ID NO: 91074 - DNA, 23 bp, Artificial Sequence
  Description of Artificial Sequence: Synthetic oligonucleotide
tgtggcgctgcttcttgccgcgg

SEQ ID NO: 91075 - DNA, 22 bp, Artificial Sequence
  Description of Artificial Sequence: Synthetic oligonucleotide
gtggcgctgcttcttgccgcgg

SEQ ID NO: 91076 - DNA, 22 bp, Artificial Sequence
  Description of Artificial Sequence: Synthetic oligonucleotide
tggcgctgcttcttgccgcggc

SEQ ID NO: 91077 - DNA, 21 bp, Artificial Sequence
  Description of Artificial Sequence: Synthetic oligonucleotide
ggcgctgcttcttgccgcggc

SEQ ID NO: 91078 - DNA, 21 bp, Artificial Sequence
  Description of Artificial Sequence: Synthetic oligonucleotide
gcgctgcttcttgccgcggcc

SEQ ID NO: 91079 - DNA, 21 bp, Artificial Sequence
  Description of Artificial Sequence: Synthetic oligonucleotide
cgctgcttcttgccgcggccc

SEQ ID NO: 91080 - DNA, 21 bp, Artificial Sequence
  Description of Artificial Sequence: Synthetic oligonucleotide
gctgcttcttgccgcggcccg

SEQ ID NO: 91081 - DNA, 21 bp, Artificial Sequence
  Description of Artificial Sequence: Synthetic oligonucleotide
ctgcttcttgccgcggcccgc

SEQ ID NO: 91082 - DNA, 22 bp, Artificial Sequence
  Description of Artificial Sequence: Synthetic oligonucleotide
tgcttcttgccgcggcccgcct

SEQ ID NO: 91083 - DNA, 21 bp, Artificial Sequence
  Description of Artificial Sequence: Synthetic oligonucleotide
gcttcttgccgcggcccgcct

SEQ ID NO: 91084 - DNA, 21 bp, Artificial Sequence
  Description of Artificial Sequence: Synthetic oligonucleotide
cttcttgccgcggcccgcctc

SEQ ID NO: 91085 - DNA, 21 bp, Artificial Sequence
  Description of Artificial Sequence: Synthetic oligonucleotide
ttcttgccgcggcccgcctcg

SEQ ID NO: 91086 - DNA, 20 bp, Artificial Sequence
  Description of Artificial Sequence: Synthetic oligonucleotide
tcttgccgcggcccgcctcg

SEQ ID NO: 91087 - DNA, 20 bp, Artificial Sequence
  Description of Artificial Sequence: Synthetic oligonucleotide
cttgccgcggcccgcctcgt

SEQ ID NO: 91088 - DNA, 20 bp, Artificial Sequence
  Description of Artificial Sequence: Synthetic oligonucleotide
ttgccgcggcccgcctcgct

SEQ ID NO: 91089 - DNA, 20 bp, Artificial Sequence
  Description of Artificial Sequence: Synthetic oligonucleotide
tgccgcggcccgcctcgctt

SEQ ID NO: 91090 - DNA, 20 bp, Artificial Sequence
  Description of Artificial Sequence: Synthetic oligonucleotide
gccgcggcccgcctcgcttt

SEQ ID NO: 91091 - DNA, 20 bp, Artificial Sequence
  Description of Artificial Sequence: Synthetic oligonucleotide
ccgcggcccgcctcgccttt

SEQ ID NO: 91092 - DNA, 20 bp, Artificial Sequence
  Description of Artificial Sequence: Synthetic oligonucleotide
cgcggcccgcctcgccgttt

SEQ ID NO: 91093 - DNA, 20 bp, Artificial Sequence
  Description of Artificial Sequence: Synthetic oligonucleotide
gcggcccgcctcgccgcttt

SEQ ID NO: 91094 - DNA, 20 bp, Artificial Sequence
  Description of Artificial Sequence: Synthetic oligonucleotide
cggcccgcctcgccgctgtt

SEQ ID NO: 91095 - DNA, 20 bp, Artificial Sequence
  Description of Artificial Sequence: Synthetic oligonucleotide
ggcccgcctcgccgctgctt

SEQ ID NO: 91096 - DNA, 20 bp, Artificial Sequence
  Description of Artificial Sequence: Synthetic oligonucleotide
gcccgcctcgccgctgcctt

SEQ ID NO: 91097 - DNA, 20 bp, Artificial Sequence
  Description of Artificial Sequence: Synthetic oligonucleotide
cccgcctcgccgctgcctct

SEQ ID NO: 91098 - DNA, 20 bp, Artificial Sequence
  Description of Artificial Sequence: Synthetic oligonucleotide
ccgcctcgccgctgcctcct

SEQ ID NO: 91099 - DNA, 20 bp, Artificial Sequence
  Description of Artificial Sequence: Synthetic oligonucleotide
cgcctcgccgctgcctccga

SEQ ID NO: 91100 - DNA, 20 bp, Artificial Sequence
  Description of Artificial Sequence: Synthetic oligonucleotide
gcctcgccgctgcctccgac

SEQ ID NO: 91101 - DNA, 21 bp, Artificial Sequence
  Description of Artificial Sequence: Synthetic oligonucleotide
cctcgccgctgcctccgacgt

SEQ ID NO: 91102 - DNA, 21 bp, Artificial Sequence
  Description of Artificial Sequence: Synthetic oligonucleotide
ctcgccgctgcctccgacgtg

SEQ ID NO: 91103 - DNA, 23 bp, Artificial Sequence
  Description of Artificial Sequence: Synthetic oligonucleotide
tcgccgctgcctccgacgtgcta

SEQ ID NO: 91104 - DNA, 22 bp, Artificial Sequence
  Description of Artificial Sequence: Synthetic oligonucleotide
cgccgctgcctccgacgtgcta

SEQ ID NO: 91105 - DNA, 24 bp, Artificial Sequence
  Description of Artificial Sequence: Synthetic oligonucleotide
gccgctgcctccgacgtgctagaa

SEQ ID NO: 91106 - DNA, 25 bp, Artificial Sequence
  Description of Artificial Sequence: Synthetic oligonucleotide
ccgctgcctccgacgtgctagaact

SEQ ID NO: 91107 - DNA, 26 bp, Artificial Sequence
  Description of Artificial Sequence: Synthetic oligonucleotide
cgctgcctccgacgtgctagaactca

SEQ ID NO: 91108 - DNA, 26 bp, Artificial Sequence
  Description of Artificial Sequence: Synthetic oligonucleotide
gctgcctccgacgtgctagaactcac

SEQ ID NO: 91109 - DNA, 26 bp, Artificial Sequence
  Description of Artificial Sequence: Synthetic oligonucleotide
ctgcctccgacgtgctagaactcacg

SEQ ID NO: 91110 - DNA, 27 bp, Artificial Sequence
  Description of Artificial Sequence: Synthetic oligonucleotide
tgcctccgacgtgctagaactcacgga

SEQ ID NO: 91111 - DNA, 26 bp, Artificial Sequence
  Description of Artificial Sequence: Synthetic oligonucleotide
gcctccgacgtgctagaactcacgga

SEQ ID NO: 91112 - DNA, 26 bp, Artificial Sequence
  Description of Artificial Sequence: Synthetic oligonucleotide
cctccgacgtgctagaactcacggac

SEQ ID NO: 91113 - DNA, 27 bp, Artificial Sequence
  Description of Artificial Sequence: Synthetic oligonucleotide
ctccgacgtgctagaactcacggacga

SEQ ID NO: 91114 - DNA, 27 bp, Artificial Sequence
  Description of Artificial Sequence: Synthetic oligonucleotide
tccgacgtgctagaactcacggacgac

SEQ ID NO: 91115 - DNA, 27 bp, Artificial Sequence
  Description of Artificial Sequence: Synthetic oligonucleotide
ccgacgtgctagaactcacggacgaca

SEQ ID NO: 91116 - DNA, 28 bp, Artificial Sequence
  Description of Artificial Sequence: Synthetic oligonucleotide
cgacgtgctagaactcacggacgacaac

SEQ ID NO: 91117 - DNA, 30 bp, Artificial Sequence
  Description of Artificial Sequence: Synthetic oligonucleotide
gacgtgctagaactcacggacgacaacttc

SEQ ID NO: 91118 - DNA, 30 bp, Artificial Sequence
  Description of Artificial Sequence: Synthetic oligonucleotide
acgtgctagaactcacggacgacaacttcg

SEQ ID NO: 91119 - DNA, 29 bp, Artificial Sequence
  Description of Artificial Sequence: Synthetic oligonucleotide
cgtgctagaactcacggacgacaacttcg

SEQ ID NO: 91120 - DNA, 30 bp, Artificial Sequence
  Description of Artificial Sequence: Synthetic oligonucleotide
gtgctagaactcacggacgacaacttcgag

SEQ ID NO: 91121 - DNA, 31 bp, Artificial Sequence
  Description of Artificial Sequence: Synthetic oligonucleotide
tgctagaactcacggacgacaacttcgagag

SEQ ID NO: 91122 - DNA, 30 bp, Artificial Sequence
  Description of Artificial Sequence: Synthetic oligonucleotide
gctagaactcacggacgacaacttcgagag

SEQ ID NO: 91123 - DNA, 31 bp, Artificial Sequence
  Description of Artificial Sequence: Synthetic oligonucleotide
ctagaactcacggacgacaacttcgagagtc

SEQ ID NO: 91124 - DNA, 31 bp, Artificial Sequence
  Description of Artificial Sequence: Synthetic oligonucleotide
tagaactcacggacgacaacttcgagagtcg

SEQ ID NO: 91125 - DNA, 30 bp, Artificial Sequence
  Description of Artificial Sequence: Synthetic oligonucleotide
agaactcacggacgacaacttcgagagtcg

SEQ ID NO: 91126 - DNA, 29 bp, Artificial Sequence
  Description of Artificial Sequence: Synthetic oligonucleotide
gaactcacggacgacaacttcgagagtcg

SEQ ID NO: 91127 - DNA, 29 bp, Artificial Sequence
  Description of Artificial Sequence: Synthetic oligonucleotide
aactcacggacgacaacttcgagagtcgc

SEQ ID NO: 91128 - DNA, 28 bp, Artificial Sequence
  Description of Artificial Sequence: Synthetic oligonucleotide
actcacggacgacaacttcgagagtcgc

SEQ ID NO: 91129 - DNA, 27 bp, Artificial Sequence
  Description of Artificial Sequence: Synthetic oligonucleotide
ctcacggacgacaacttcgagagtcgc

SEQ ID NO: 91130 - DNA, 29 bp, Artificial Sequence
  Description of Artificial Sequence: Synthetic oligonucleotide
tcacggacgacaacttcgagagtcgcatc

SEQ ID NO: 91131 - DNA, 28 bp, Artificial Sequence
  Description of Artificial Sequence: Synthetic oligonucleotide
cacggacgacaacttcgagagtcgcatc

SEQ ID NO: 91132 - DNA, 29 bp, Artificial Sequence
  Description of Artificial Sequence: Synthetic oligonucleotide
acggacgacaacttcgagagtcgcatctc

SEQ ID NO: 91133 - DNA, 28 bp, Artificial Sequence
  Description of Artificial Sequence: Synthetic oligonucleotide
cggacgacaacttcgagagtcgcatctc

SEQ ID NO: 91134 - DNA, 28 bp, Artificial Sequence
  Description of Artificial Sequence: Synthetic oligonucleotide
ggacgacaacttcgagagtcgcatctcc

SEQ ID NO: 91135 - DNA, 28 bp, Artificial Sequence
  Description of Artificial Sequence: Synthetic oligonucleotide
gacgacaacttcgagagtcgcatctccg

SEQ ID NO: 91136 - DNA, 29 bp, Artificial Sequence
  Description of Artificial Sequence: Synthetic oligonucleotide
acgacaacttcgagagtcgcatctccgac

SEQ ID NO: 91137 - DNA, 28 bp, Artificial Sequence
  Description of Artificial Sequence: Synthetic oligonucleotide
cgacaacttcgagagtcgcatctccgac

SEQ ID NO: 91138 - DNA, 29 bp, Artificial Sequence
  Description of Artificial Sequence: Synthetic oligonucleotide
gacaacttcgagagtcgcatctccgacac

SEQ ID NO: 91139 - DNA, 29 bp, Artificial Sequence
  Description of Artificial Sequence: Synthetic oligonucleotide
acaacttcgagagtcgcatctccgacacg

SEQ ID NO: 91140 - DNA, 28 bp, Artificial Sequence
  Description of Artificial Sequence: Synthetic oligonucleotide
caacttcgagagtcgcatctccgacacg

SEQ ID NO: 91141 - DNA, 28 bp, Artificial Sequence
  Description of Artificial Sequence: Synthetic oligonucleotide
aacttcgagagtcgcatctccgacacgg

SEQ ID NO: 91142 - DNA, 27 bp, Artificial Sequence
  Description of Artificial Sequence: Synthetic oligonucleotide
acttcgagagtcgcatctccgacacgg

SEQ ID NO: 91143 - DNA, 26 bp, Artificial Sequence
  Description of Artificial Sequence: Synthetic oligonucleotide
cttcgagagtcgcatctccgacacgg

SEQ ID NO: 91144 - DNA, 26 bp, Artificial Sequence
  Description of Artificial Sequence: Synthetic oligonucleotide
ttcgagagtcgcatctccgacacggg

SEQ ID NO: 91145 - DNA, 25 bp, Artificial Sequence
  Description of Artificial Sequence: Synthetic oligonucleotide
tcgagagtcgcatctccgacacggg

SEQ ID NO: 91146 - DNA, 24 bp, Artificial Sequence
  Description of Artificial Sequence: Synthetic oligonucleotide
cgagagtcgcatctccgacacggg

SEQ ID NO: 91147 - DNA, 25 bp, Artificial Sequence
  Description of Artificial Sequence: Synthetic oligonucleotide
gagagtcgcatctccgacacgggct

SEQ ID NO: 91148 - DNA, 26 bp, Artificial Sequence
  Description of Artificial Sequence: Synthetic oligonucleotide
agagtcgcatctccgacacgggctct

SEQ ID NO: 91149 - DNA, 25 bp, Artificial Sequence
  Description of Artificial Sequence: Synthetic oligonucleotide
gagtcgcatctccgacacgggctct

SEQ ID NO: 91150 - DNA, 25 bp, Artificial Sequence
  Description of Artificial Sequence: Synthetic oligonucleotide
agtcgcatctccgacacgggctctg

SEQ ID NO: 91151 - DNA, 24 bp, Artificial Sequence
  Description of Artificial Sequence: Synthetic oligonucleotide
gtcgcatctccgacacgggctctg

SEQ ID NO: 91152 - DNA, 24 bp, Artificial Sequence
  Description of Artificial Sequence: Synthetic oligonucleotide
tcgcatctccgacacgggctctgc

SEQ ID NO: 91153 - DNA, 23 bp, Artificial Sequence
  Description of Artificial Sequence: Synthetic oligonucleotide
cgcatctccgacacgggctctgc

SEQ ID NO: 91154 - DNA, 23 bp, Artificial Sequence
  Description of Artificial Sequence: Synthetic oligonucleotide
gcatctccgacacgggctctgcg

SEQ ID NO: 91155 - DNA, 23 bp, Artificial Sequence
  Description of Artificial Sequence: Synthetic oligonucleotide
catctccgacacgggctctgcgg

SEQ ID NO: 91156 - DNA, 23 bp, Artificial Sequence
  Description of Artificial Sequence: Synthetic oligonucleotide
atctccgacacgggctctgcggg

SEQ ID NO: 91157 - DNA, 22 bp, Artificial Sequence
  Description of Artificial Sequence: Synthetic oligonucleotide
tctccgacacgggctctgcggg

SEQ ID NO: 91158 - DNA, 21 bp, Artificial Sequence
  Description of Artificial Sequence: Synthetic oligonucleotide
ctccgacacgggctctgcggg

SEQ ID NO: 91159 - DNA, 21 bp, Artificial Sequence
  Description of Artificial Sequence: Synthetic oligonucleotide
tccgacacgggctctgcgggc

SEQ ID NO: 91160 - DNA, 20 bp, Artificial Sequence
  Description of Artificial Sequence: Synthetic oligonucleotide
ccgacacgggctctgcgggc

SEQ ID NO: 91161 - DNA, 21 bp, Artificial Sequence
  Description of Artificial Sequence: Synthetic oligonucleotide
cgacacgggctctgcgggcct

SEQ ID NO: 91162 - DNA, 23 bp, Artificial Sequence
  Description of Artificial Sequence: Synthetic oligonucleotide
gacacgggctctgcgggcctcat

SEQ ID NO: 91163 - DNA, 23 bp, Artificial Sequence
  Description of Artificial Sequence: Synthetic oligonucleotide
acacgggctctgcgggcctcatg

SEQ ID NO: 91164 - DNA, 22 bp, Artificial Sequence
  Description of Artificial Sequence: Synthetic oligonucleotide
cacgggctctgcgggcctcatg

SEQ ID NO: 91165 - DNA, 23 bp, Artificial Sequence
  Description of Artificial Sequence: Synthetic oligonucleotide
acgggctctgcgggcctcatgct

SEQ ID NO: 91166 - DNA, 22 bp, Artificial Sequence
  Description of Artificial Sequence: Synthetic oligonucleotide
cgggctctgcgggcctcatgct

SEQ ID NO: 91167 - DNA, 22 bp, Artificial Sequence
  Description of Artificial Sequence: Synthetic oligonucleotide
gggctctgcgggcctcatgctc

SEQ ID NO: 91168 - DNA, 23 bp, Artificial Sequence
  Description of Artificial Sequence: Synthetic oligonucleotide
ggctctgcgggcctcatgctcgt

SEQ ID NO: 91169 - DNA, 23 bp, Artificial Sequence
  Description of Artificial Sequence: Synthetic oligonucleotide
gctctgcgggcctcatgctcgtc

SEQ ID NO: 91170 - DNA, 24 bp, Artificial Sequence
  Description of Artificial Sequence: Synthetic oligonucleotide
ctctgcgggcctcatgctcgtcga

SEQ ID NO: 91171 - DNA, 26 bp, Artificial Sequence
  Description of Artificial Sequence: Synthetic oligonucleotide
tctgcgggcctcatgctcgtcgagtt

SEQ ID NO: 91172 - DNA, 25 bp, Artificial Sequence
  Description of Artificial Sequence: Synthetic oligonucleotide
ctgcgggcctcatgctcgtcgagtt

SEQ ID NO: 91173 - DNA, 27 bp, Artificial Sequence
  Description of Artificial Sequence: Synthetic oligonucleotide
tgcgggcctcatgctcgtcgagttctt

SEQ ID NO: 91174 - DNA, 26 bp, Artificial Sequence
  Description of Artificial Sequence: Synthetic oligonucleotide
gcgggcctcatgctcgtcgagttctt

SEQ ID NO: 91175 - DNA, 26 bp, Artificial Sequence
  Description of Artificial Sequence: Synthetic oligonucleotide
cgggcctcatgctcgtcgagttcttc

SEQ ID NO: 91176 - DNA, 26 bp, Artificial Sequence
  Description of Artificial Sequence: Synthetic oligonucleotide
gggcctcatgctcgtcgagttcttcg

SEQ ID NO: 91177 - DNA, 26 bp, Artificial Sequence
  Description of Artificial Sequence: Synthetic oligonucleotide
ggcctcatgctcgtcgagttcttcgc

SEQ ID NO: 91178 - DNA, 26 bp, Artificial Sequence
  Description of Artificial Sequence: Synthetic oligonucleotide
gcctcatgctcgtcgagttcttcgcc

SEQ ID NO: 91179 - DNA, 26 bp, Artificial Sequence
  Description of Artificial Sequence: Synthetic oligonucleotide
cctcatgctcgtcgagttcttcgccc

SEQ ID NO: 91180 - DNA, 26 bp, Artificial Sequence
  Description of Artificial Sequence: Synthetic oligonucleotide
ctcatgctcgtcgagttcttcgcccc

SEQ ID NO: 91181 - DNA, 27 bp, Artificial Sequence
  Description of Artificial Sequence: Synthetic oligonucleotide
tcatgctcgtcgagttcttcgccccct

SEQ ID NO: 91182 - DNA, 26 bp, Artificial Sequence
  Description of Artificial Sequence: Synthetic oligonucleotide
catgctcgtcgagttcttcgccccct

SEQ ID NO: 91183 - DNA, 26 bp, Artificial Sequence
  Description of Artificial Sequence: Synthetic oligonucleotide
atgctcgtcgagttcttcgccccctg

SEQ ID NO: 91184 - DNA, 25 bp, Artificial Sequence
  Description of Artificial Sequence: Synthetic oligonucleotide
tgctcgtcgagttcttcgccccctg

SEQ ID NO: 91185 - DNA, 24 bp, Artificial Sequence
  Description of Artificial Sequence: Synthetic oligonucleotide
gctcgtcgagttcttcgccccctg

SEQ ID NO: 91186 - DNA, 25 bp, Artificial Sequence
  Description of Artificial Sequence: Synthetic oligonucleotide
ctcgtcgagttcttcgccccctggt

SEQ ID NO: 91187 - DNA, 26 bp, Artificial Sequence
  Description of Artificial Sequence: Synthetic oligonucleotide
tcgtcgagttcttcgccccctggtgt

SEQ ID NO: 91188 - DNA, 25 bp, Artificial Sequence
  Description of Artificial Sequence: Synthetic oligonucleotide
cgtcgagttcttcgccccctggtgt

SEQ ID NO: 91189 - DNA, 25 bp, Artificial Sequence
  Description of Artificial Sequence: Synthetic oligonucleotide
gtcgagttcttcgccccctggtgtg

SEQ ID NO: 91190 - DNA, 26 bp, Artificial Sequence
  Description of Artificial Sequence: Synthetic oligonucleotide
tcgagttcttcgccccctggtgtgga

SEQ ID NO: 91191 - DNA, 25 bp, Artificial Sequence
  Description of Artificial Sequence: Synthetic oligonucleotide
cgagttcttcgccccctggtgtgga

SEQ ID NO: 91192 - DNA, 26 bp, Artificial Sequence
  Description of Artificial Sequence: Synthetic oligonucleotide
gagttcttcgccccctggtgtggaca

SEQ ID NO: 91193 - DNA, 27 bp, Artificial Sequence
  Description of Artificial Sequence: Synthetic oligonucleotide
agttcttcgccccctggtgtggacact

SEQ ID NO: 91194 - DNA, 26 bp, Artificial Sequence
  Description of Artificial Sequence: Synthetic oligonucleotide
gttcttcgccccctggtgtggacact

SEQ ID NO: 91195 - DNA, 26 bp, Artificial Sequence
  Description of Artificial Sequence: Synthetic oligonucleotide
ttcttcgccccctggtgtggacactg

SEQ ID NO: 91196 - DNA, 25 bp, Artificial Sequence
  Description of Artificial Sequence: Synthetic oligonucleotide
tcttcgccccctggtgtggacactg

SEQ ID NO: 91197 - DNA, 24 bp, Artificial Sequence
  Description of Artificial Sequence: Synthetic oligonucleotide
cttcgccccctggtgtggacactg

SEQ ID NO: 91198 - DNA, 26 bp, Artificial Sequence
  Description of Artificial Sequence: Synthetic oligonucleotide
ttcgccccctggtgtggacactgcaa

SEQ ID NO: 91199 - DNA, 25 bp, Artificial Sequence
  Description of Artificial Sequence: Synthetic oligonucleotide
tcgccccctggtgtggacactgcaa

SEQ ID NO: 91200 - DNA, 24 bp, Artificial Sequence
  Description of Artificial Sequence: Synthetic oligonucleotide
cgccccctggtgtggacactgcaa

SEQ ID NO: 91201 - DNA, 25 bp, Artificial Sequence
  Description of Artificial Sequence: Synthetic oligonucleotide
gccccctggtgtggacactgcaaga

SEQ ID NO: 91202 - DNA, 26 bp, Artificial Sequence
  Description of Artificial Sequence: Synthetic oligonucleotide
ccccctggtgtggacactgcaagaga

SEQ ID NO: 91203 - DNA, 27 bp, Artificial Sequence
  Description of Artificial Sequence: Synthetic oligonucleotide
cccctggtgtggacactgcaagagact

SEQ ID NO: 91204 - DNA, 28 bp, Artificial Sequence
  Description of Artificial Sequence: Synthetic oligonucleotide
ccctggtgtggacactgcaagagacttg

SEQ ID NO: 91205 - DNA, 28 bp, Artificial Sequence
  Description of Artificial Sequence: Synthetic oligonucleotide
cctggtgtggacactgcaagagacttgc

SEQ ID NO: 91206 - DNA, 29 bp, Artificial Sequence
  Description of Artificial Sequence: Synthetic oligonucleotide
ctggtgtggacactgcaagagacttgcac

SEQ ID NO: 91207 - DNA, 29 bp, Artificial Sequence
  Description of Artificial Sequence: Synthetic oligonucleotide
tggtgtggacactgcaagagacttgcacc

SEQ ID NO: 91208 - DNA, 28 bp, Artificial Sequence
  Description of Artificial Sequence: Synthetic oligonucleotide
ggtgtggacactgcaagagacttgcacc

SEQ ID NO: 91209 - DNA, 29 bp, Artificial Sequence
  Description of Artificial Sequence: Synthetic oligonucleotide
gtgtggacactgcaagagacttgcacctg

SEQ ID NO: 91210 - DNA, 30 bp, Artificial Sequence
  Description of Artificial Sequence: Synthetic oligonucleotide
tgtggacactgcaagagacttgcacctgag

SEQ ID NO: 91211 - DNA, 29 bp, Artificial Sequence
  Description of Artificial Sequence: Synthetic oligonucleotide
gtggacactgcaagagacttgcacctgag

SEQ ID NO: 91212 - DNA, 32 bp, Artificial Sequence
  Description of Artificial Sequence: Synthetic oligonucleotide
tggacactgcaagagacttgcacctgagtatg

SEQ ID NO: 91213 - DNA, 31 bp, Artificial Sequence
  Description of Artificial Sequence: Synthetic oligonucleotide
ggacactgcaagagacttgcacctgagtatg

SEQ ID NO: 91214 - DNA, 33 bp, Artificial Sequence
  Description of Artificial Sequence: Synthetic oligonucleotide
gacactgcaagagacttgcacctgagtatgaag

SEQ ID NO: 91215 - DNA, 33 bp, Artificial Sequence
  Description of Artificial Sequence: Synthetic oligonucleotide
acactgcaagagacttgcacctgagtatgaagc

SEQ ID NO: 91216 - DNA, 32 bp, Artificial Sequence
  Description of Artificial Sequence: Synthetic oligonucleotide
cactgcaagagacttgcacctgagtatgaagc

SEQ ID NO: 91217 - DNA, 33 bp, Artificial Sequence
  Description of Artificial Sequence: Synthetic oligonucleotide
actgcaagagacttgcacctgagtatgaagctg

SEQ ID NO: 91218 - DNA, 32 bp, Artificial Sequence
  Description of Artificial Sequence: Synthetic oligonucleotide
ctgcaagagacttgcacctgagtatgaagctg

SEQ ID NO: 91219 - DNA, 32 bp, Artificial Sequence
  Description of Artificial Sequence: Synthetic oligonucleotide
tgcaagagacttgcacctgagtatgaagctgc

SEQ ID NO: 91220 - DNA, 31 bp, Artificial Sequence
  Description of Artificial Sequence: Synthetic oligonucleotide
gcaagagacttgcacctgagtatgaagctgc

SEQ ID NO: 91221 - DNA, 32 bp, Artificial Sequence
  Description of Artificial Sequence: Synthetic oligonucleotide
caagagacttgcacctgagtatgaagctgcag

SEQ ID NO: 91222 - DNA, 32 bp, Artificial Sequence
  Description of Artificial Sequence: Synthetic oligonucleotide
aagagacttgcacctgagtatgaagctgcagc

SEQ ID NO: 91223 - DNA, 31 bp, Artificial Sequence
  Description of Artificial Sequence: Synthetic oligonucleotide
agagacttgcacctgagtatgaagctgcagc

SEQ ID NO: 91224 - DNA, 30 bp, Artificial Sequence
  Description of Artificial Sequence: Synthetic oligonucleotide
gagacttgcacctgagtatgaagctgcagc

SEQ ID NO: 91225 - DNA, 32 bp, Artificial Sequence
  Description of Artificial Sequence: Synthetic oligonucleotide
agacttgcacctgagtatgaagctgcagctac

SEQ ID NO: 91226 - DNA, 31 bp, Artificial Sequence
  Description of Artificial Sequence: Synthetic oligonucleotide
gacttgcacctgagtatgaagctgcagctac

SEQ ID NO: 91227 - DNA, 31 bp, Artificial Sequence
  Description of Artificial Sequence: Synthetic oligonucleotide
acttgcacctgagtatgaagctgcagctacc

SEQ ID NO: 91228 - DNA, 30 bp, Artificial Sequence
  Description of Artificial Sequence: Synthetic oligonucleotide
cttgcacctgagtatgaagctgcagctacc

SEQ ID NO: 91229 - DNA, 31 bp, Artificial Sequence
  Description of Artificial Sequence: Synthetic oligonucleotide
ttgcacctgagtatgaagctgcagctaccag

SEQ ID NO: 91230 - DNA, 30 bp, Artificial Sequence
  Description of Artificial Sequence: Synthetic oligonucleotide
tgcacctgagtatgaagctgcagctaccag

SEQ ID NO: 91231 - DNA, 29 bp, Artificial Sequence
  Description of Artificial Sequence: Synthetic oligonucleotide
gcacctgagtatgaagctgcagctaccag

SEQ ID NO: 91232 - DNA, 36 bp, Artificial Sequence
  Description of Artificial Sequence: Synthetic oligonucleotide
cacctgagtatgaagctgcagctaccagattaaaag

SEQ ID NO: 91233 - DNA, 36 bp, Artificial Sequence
  Description of Artificial Sequence: Synthetic oligonucleotide
acctgagtatgaagctgcagctaccagattaaaagg

SEQ ID NO: 91234 - DNA, 35 bp, Artificial Sequence
  Description of Artificial Sequence: Synthetic oligonucleotide
cctgagtatgaagctgcagctaccagattaaaagg

SEQ ID NO: 91235 - DNA, 39 bp, Artificial Sequence
  Description of Artificial Sequence: Synthetic oligonucleotide
ctgagtatgaagctgcagctaccagattaaaaggaatag

SEQ ID NO: 91236 - DNA, 40 bp, Artificial Sequence
  Description of Artificial Sequence: Synthetic oligonucleotide
tgagtatgaagctgcagctaccagattaaaaggaatagtc

SEQ ID NO: 91237 - DNA, 39 bp, Artificial Sequence
  Description of Artificial Sequence: Synthetic oligonucleotide
gagtatgaagctgcagctaccagattaaaaggaatagtc

SEQ ID NO: 91238 - DNA, 39 bp, Artificial Sequence
  Description of Artificial Sequence: Synthetic oligonucleotide
agtatgaagctgcagctaccagattaaaaggaatagtcc

SEQ ID NO: 91239 - DNA, 38 bp, Artificial Sequence
  Description of Artificial Sequence: Synthetic oligonucleotide
gtatgaagctgcagctaccagattaaaaggaatagtcc

SEQ ID NO: 91240 - DNA, 38 bp, Artificial Sequence
  Description of Artificial Sequence: Synthetic oligonucleotide
tatgaagctgcagctaccagattaaaaggaatagtccc

SEQ ID NO: 91241 - DNA, 37 bp, Artificial Sequence
  Description of Artificial Sequence: Synthetic oligonucleotide
atgaagctgcagctaccagattaaaaggaatagtccc

SEQ ID NO: 91242 - DNA, 36 bp, Artificial Sequence
  Description of Artificial Sequence: Synthetic oligonucleotide
tgaagctgcagctaccagattaaaaggaatagtccc

SEQ ID NO: 91243 - DNA, 35 bp, Artificial Sequence
  Description of Artificial Sequence: Synthetic oligonucleotide
gaagctgcagctaccagattaaaaggaatagtccc

SEQ ID NO: 91244 - DNA, 39 bp, Artificial Sequence
  Description of Artificial Sequence: Synthetic oligonucleotide
aagctgcagctaccagattaaaaggaatagtcccattag

SEQ ID NO: 91245 - DNA, 38 bp, Artificial Sequence
  Description of Artificial Sequence: Synthetic oligonucleotide
agctgcagctaccagattaaaaggaatagtcccattag

SEQ ID NO: 91246 - DNA, 37 bp, Artificial Sequence
  Description of Artificial Sequence: Synthetic oligonucleotide
gctgcagctaccagattaaaaggaatagtcccattag

SEQ ID NO: 91247 - DNA, 37 bp, Artificial Sequence
  Description of Artificial Sequence: Synthetic oligonucleotide
ctgcagctaccagattaaaaggaatagtcccattagc

SEQ ID NO: 91248 - DNA, 40 bp, Artificial Sequence
  Description of Artificial Sequence: Synthetic oligonucleotide
tgcagctaccagattaaaaggaatagtcccattagcaaag

SEQ ID NO: 91249 - DNA, 39 bp, Artificial Sequence
  Description of Artificial Sequence: Synthetic oligonucleotide
gcagctaccagattaaaaggaatagtcccattagcaaag

SEQ ID NO: 91250 - DNA, 39 bp, Artificial Sequence
  Description of Artificial Sequence: Synthetic oligonucleotide
cagctaccagattaaaaggaatagtcccattagcaaagg

SEQ ID NO: 91251 - DNA, 41 bp, Artificial Sequence
  Description of Artificial Sequence: Synthetic oligonucleotide
agctaccagattaaaaggaatagtcccattagcaaaggttg

SEQ ID NO: 91252 - DNA, 40 bp, Artificial Sequence
  Description of Artificial Sequence: Synthetic oligonucleotide
gctaccagattaaaaggaatagtcccattagcaaaggttg

SEQ ID NO: 91253 - DNA, 43 bp, Artificial Sequence
  Description of Artificial Sequence: Synthetic oligonucleotide
ctaccagattaaaaggaatagtcccattagcaaaggttgattg

SEQ ID NO: 91254 - DNA, 43 bp, Artificial Sequence
  Description of Artificial Sequence: Synthetic oligonucleotide
taccagattaaaaggaatagtcccattagcaaaggttgattgc

SEQ ID NO: 91255 - DNA, 42 bp, Artificial Sequence
  Description of Artificial Sequence: Synthetic oligonucleotide
accagattaaaaggaatagtcccattagcaaaggttgattgc

SEQ ID NO: 91256 - DNA, 41 bp, Artificial Sequence
  Description of Artificial Sequence: Synthetic oligonucleotide
ccagattaaaaggaatagtcccattagcaaaggttgattgc

SEQ ID NO: 91257 - DNA, 42 bp, Artificial Sequence
  Description of Artificial Sequence: Synthetic oligonucleotide
cagattaaaaggaatagtcccattagcaaaggttgattgcac

SEQ ID NO: 91258 - DNA, 43 bp, Artificial Sequence
  Description of Artificial Sequence: Synthetic oligonucleotide
agattaaaaggaatagtcccattagcaaaggttgattgcactg

SEQ ID NO: 91259 - DNA, 42 bp, Artificial Sequence
  Description of Artificial Sequence: Synthetic oligonucleotide
gattaaaaggaatagtcccattagcaaaggttgattgcactg

SEQ ID NO: 91260 - DNA, 42 bp, Artificial Sequence
  Description of Artificial Sequence: Synthetic oligonucleotide
attaaaaggaatagtcccattagcaaaggttgattgcactgc

SEQ ID NO: 91261 - DNA, 41 bp, Artificial Sequence
  Description of Artificial Sequence: Synthetic oligonucleotide
ttaaaaggaatagtcccattagcaaaggttgattgcactgc

SEQ ID NO: 91262 - DNA, 40 bp, Artificial Sequence
  Description of Artificial Sequence: Synthetic oligonucleotide
taaaaggaatagtcccattagcaaaggttgattgcactgc

SEQ ID NO: 91263 - DNA, 39 bp, Artificial Sequence
  Description of Artificial Sequence: Synthetic oligonucleotide
aaaaggaatagtcccattagcaaaggttgattgcactgc

SEQ ID NO: 91264 - DNA, 38 bp, Artificial Sequence
  Description of Artificial Sequence: Synthetic oligonucleotide
aaaggaatagtcccattagcaaaggttgattgcactgc

SEQ ID NO: 91265 - DNA, 37 bp, Artificial Sequence
  Description of Artificial Sequence: Synthetic oligonucleotide
aaggaatagtcccattagcaaaggttgattgcactgc

SEQ ID NO: 91266 - DNA, 36 bp, Artificial Sequence
  Description of Artificial Sequence: Synthetic oligonucleotide
aggaatagtcccattagcaaaggttgattgcactgc

SEQ ID NO: 91267 - DNA, 35 bp, Artificial Sequence
  Description of Artificial Sequence: Synthetic oligonucleotide
ggaatagtcccattagcaaaggttgattgcactgc

SEQ ID NO: 91268 - DNA, 35 bp, Artificial Sequence
  Description of Artificial Sequence: Synthetic oligonucleotide
gaatagtcccattagcaaaggttgattgcactgcc

SEQ ID NO: 91269 - DNA, 37 bp, Artificial Sequence
  Description of Artificial Sequence: Synthetic oligonucleotide
aatagtcccattagcaaaggttgattgcactgccaac

SEQ ID NO: 91270 - DNA, 36 bp, Artificial Sequence
  Description of Artificial Sequence: Synthetic oligonucleotide
atagtcccattagcaaaggttgattgcactgccaac

SEQ ID NO: 91271 - DNA, 35 bp, Artificial Sequence
  Description of Artificial Sequence: Synthetic oligonucleotide
tagtcccattagcaaaggttgattgcactgccaac

SEQ ID NO: 91272 - DNA, 34 bp, Artificial Sequence
  Description of Artificial Sequence: Synthetic oligonucleotide
agtcccattagcaaaggttgattgcactgccaac

SEQ ID NO: 91273 - DNA, 33 bp, Artificial Sequence
  Description of Artificial Sequence: Synthetic oligonucleotide
gtcccattagcaaaggttgattgcactgccaac

SEQ ID NO: 91274 - DNA, 34 bp, Artificial Sequence
  Description of Artificial Sequence: Synthetic oligonucleotide
tcccattagcaaaggttgattgcactgccaacac

SEQ ID NO: 91275 - DNA, 33 bp, Artificial Sequence
  Description of Artificial Sequence: Synthetic oligonucleotide
cccattagcaaaggttgattgcactgccaacac

SEQ ID NO: 91276 - DNA, 36 bp, Artificial Sequence
  Description of Artificial Sequence: Synthetic oligonucleotide
ccattagcaaaggttgattgcactgccaacactaac

SEQ ID NO: 91277 - DNA, 37 bp, Artificial Sequence
  Description of Artificial Sequence: Synthetic oligonucleotide
cattagcaaaggttgattgcactgccaacactaacac

SEQ ID NO: 91278 - DNA, 37 bp, Artificial Sequence
  Description of Artificial Sequence: Synthetic oligonucleotide
attagcaaaggttgattgcactgccaacactaacacc

SEQ ID NO: 91279 - DNA, 36 bp, Artificial Sequence
  Description of Artificial Sequence: Synthetic oligonucleotide
ttagcaaaggttgattgcactgccaacactaacacc

SEQ ID NO: 91280 - DNA, 35 bp, Artificial Sequence
  Description of Artificial Sequence: Synthetic oligonucleotide
tagcaaaggttgattgcactgccaacactaacacc

SEQ ID NO: 91281 - DNA, 34 bp, Artificial Sequence
  Description of Artificial Sequence: Synthetic oligonucleotide
agcaaaggttgattgcactgccaacactaacacc

SEQ ID NO: 91282 - DNA, 33 bp, Artificial Sequence
  Description of Artificial Sequence: Synthetic oligonucleotide
gcaaaggttgattgcactgccaacactaacacc

SEQ ID NO: 91283 - DNA, 34 bp, Artificial Sequence
  Description of Artificial Sequence: Synthetic oligonucleotide
caaaggttgattgcactgccaacactaacacctg

SEQ ID NO: 91284 - DNA, 44 bp, Artificial Sequence
  Description of Artificial Sequence: Synthetic oligonucleotide
aaaggttgattgcactgccaacactaacacctgtaataaatatg

SEQ ID NO: 91285 - DNA, 43 bp, Artificial Sequence
  Description of Artificial Sequence: Synthetic oligonucleotide
aaggttgattgcactgccaacactaacacctgtaataaatatg

SEQ ID NO: 91286 - DNA, 42 bp, Artificial Sequence
  Description of Artificial Sequence: Synthetic oligonucleotide
aggttgattgcactgccaacactaacacctgtaataaatatg

SEQ ID NO: 91287 - DNA, 41 bp, Artificial Sequence
  Description of Artificial Sequence: Synthetic oligonucleotide
ggttgattgcactgccaacactaacacctgtaataaatatg

SEQ ID NO: 91288 - DNA, 41 bp, Artificial Sequence
  Description of Artificial Sequence: Synthetic oligonucleotide
gttgattgcactgccaacactaacacctgtaataaatatgg

SEQ ID NO: 91289 - DNA, 42 bp, Artificial Sequence
  Description of Artificial Sequence: Synthetic oligonucleotide
ttgattgcactgccaacactaacacctgtaataaatatggag

SEQ ID NO: 91290 - DNA, 41 bp, Artificial Sequence
  Description of Artificial Sequence: Synthetic oligonucleotide
tgattgcactgccaacactaacacctgtaataaatatggag

SEQ ID NO: 91291 - DNA, 40 bp, Artificial Sequence
  Description of Artificial Sequence: Synthetic oligonucleotide
gattgcactgccaacactaacacctgtaataaatatggag

SEQ ID NO: 91292 - DNA, 41 bp, Artificial Sequence
  Description of Artificial Sequence: Synthetic oligonucleotide
attgcactgccaacactaacacctgtaataaatatggagtc

SEQ ID NO: 91293 - DNA, 40 bp, Artificial Sequence
  Description of Artificial Sequence: Synthetic oligonucleotide
ttgcactgccaacactaacacctgtaataaatatggagtc

SEQ ID NO: 91294 - DNA, 39 bp, Artificial Sequence
  Description of Artificial Sequence: Synthetic oligonucleotide
tgcactgccaacactaacacctgtaataaatatggagtc

SEQ ID NO: 91295 - DNA, 38 bp, Artificial Sequence
  Description of Artificial Sequence: Synthetic oligonucleotide
gcactgccaacactaacacctgtaataaatatggagtc

SEQ ID NO: 91296 - DNA, 39 bp, Artificial Sequence
  Description of Artificial Sequence: Synthetic oligonucleotide
cactgccaacactaacacctgtaataaatatggagtcag

SEQ ID NO: 91297 - DNA, 40 bp, Artificial Sequence
  Description of Artificial Sequence: Synthetic oligonucleotide
actgccaacactaacacctgtaataaatatggagtcagtg

SEQ ID NO: 91298 - DNA, 39 bp, Artificial Sequence
  Description of Artificial Sequence: Synthetic oligonucleotide
ctgccaacactaacacctgtaataaatatggagtcagtg

SEQ ID NO: 91299 - DNA, 39 bp, Artificial Sequence
  Description of Artificial Sequence: Synthetic oligonucleotide
tgccaacactaacacctgtaataaatatggagtcagtgg

SEQ ID NO: 91300 - DNA, 38 bp, Artificial Sequence
  Description of Artificial Sequence: Synthetic oligonucleotide
gccaacactaacacctgtaataaatatggagtcagtgg

SEQ ID NO: 91301 - DNA, 42 bp, Artificial Sequence
  Description of Artificial Sequence: Synthetic oligonucleotide
ccaacactaacacctgtaataaatatggagtcagtggatatc

SEQ ID NO: 91302 - DNA, 42 bp, Artificial Sequence
  Description of Artificial Sequence: Synthetic oligonucleotide
caacactaacacctgtaataaatatggagtcagtggatatcc

SEQ ID NO: 91303 - DNA, 44 bp, Artificial Sequence
  Description of Artificial Sequence: Synthetic oligonucleotide
aacactaacacctgtaataaatatggagtcagtggatatccaac

SEQ ID NO: 91304 - DNA, 43 bp, Artificial Sequence
  Description of Artificial Sequence: Synthetic oligonucleotide
acactaacacctgtaataaatatggagtcagtggatatccaac

SEQ ID NO: 91305 - DNA, 42 bp, Artificial Sequence
  Description of Artificial Sequence: Synthetic oligonucleotide
cactaacacctgtaataaatatggagtcagtggatatccaac

SEQ ID NO: 91306 - DNA, 42 bp, Artificial Sequence
  Description of Artificial Sequence: Synthetic oligonucleotide
actaacacctgtaataaatatggagtcagtggatatccaacc

SEQ ID NO: 91307 - DNA, 41 bp, Artificial Sequence
  Description of Artificial Sequence: Synthetic oligonucleotide
ctaacacctgtaataaatatggagtcagtggatatccaacc

SEQ ID NO: 91308 - DNA, 41 bp, Artificial Sequence
  Description of Artificial Sequence: Synthetic oligonucleotide
taacacctgtaataaatatggagtcagtggatatccaaccc

SEQ ID NO: 91309 - DNA, 40 bp, Artificial Sequence
  Description of Artificial Sequence: Synthetic oligonucleotide
aacacctgtaataaatatggagtcagtggatatccaaccc

SEQ ID NO: 91310 - DNA, 39 bp, Artificial Sequence
  Description of Artificial Sequence: Synthetic oligonucleotide
acacctgtaataaatatggagtcagtggatatccaaccc

SEQ ID NO: 91311 - DNA, 38 bp, Artificial Sequence
  Description of Artificial Sequence: Synthetic oligonucleotide
cacctgtaataaatatggagtcagtggatatccaaccc

SEQ ID NO: 91312 - DNA, 39 bp, Artificial Sequence
  Description of Artificial Sequence: Synthetic oligonucleotide
acctgtaataaatatggagtcagtggatatccaaccctg

SEQ ID NO: 91313 - DNA, 38 bp, Artificial Sequence
  Description of Artificial Sequence: Synthetic oligonucleotide
cctgtaataaatatggagtcagtggatatccaaccctg

SEQ ID NO: 91314 - DNA, 40 bp, Artificial Sequence
  Description of Artificial Sequence: Synthetic oligonucleotide
ctgtaataaatatggagtcagtggatatccaaccctgaag

SEQ ID NO: 91315 - DNA, 47 bp, Artificial Sequence
  Description of Artificial Sequence: Synthetic oligonucleotide
tgtaataaatatggagtcagtggatatccaaccctgaagatatttag

SEQ ID NO: 91316 - DNA, 46 bp, Artificial Sequence
  Description of Artificial Sequence: Synthetic oligonucleotide
gtaataaatatggagtcagtggatatccaaccctgaagatatttag

SEQ ID NO: 91317 - DNA, 47 bp, Artificial Sequence
  Description of Artificial Sequence: Synthetic oligonucleotide
taataaatatggagtcagtggatatccaaccctgaagatatttagag

SEQ ID NO: 91318 - DNA, 46 bp, Artificial Sequence
  Description of Artificial Sequence: Synthetic oligonucleotide
aataaatatggagtcagtggatatccaaccctgaagatatttagag

SEQ ID NO: 91319 - DNA, 45 bp, Artificial Sequence
  Description of Artificial Sequence: Synthetic oligonucleotide
ataaatatggagtcagtggatatccaaccctgaagatatttagag

SEQ ID NO: 91320 - DNA, 44 bp, Artificial Sequence
  Description of Artificial Sequence: Synthetic oligonucleotide
taaatatggagtcagtggatatccaaccctgaagatatttagag

SEQ ID NO: 91321 - DNA, 43 bp, Artificial Sequence
  Description of Artificial Sequence: Synthetic oligonucleotide
aaatatggagtcagtggatatccaaccctgaagatatttagag

SEQ ID NO: 91322 - DNA, 42 bp, Artificial Sequence
  Description of Artificial Sequence: Synthetic oligonucleotide
aatatggagtcagtggatatccaaccctgaagatatttagag

SEQ ID NO: 91323 - DNA, 41 bp, Artificial Sequence
  Description of Artificial Sequence: Synthetic oligonucleotide
atatggagtcagtggatatccaaccctgaagatatttagag

SEQ ID NO: 91324 - DNA, 40 bp, Artificial Sequence
  Description of Artificial Sequence: Synthetic oligonucleotide
tatggagtcagtggatatccaaccctgaagatatttagag

SEQ ID NO: 91325 - DNA, 39 bp, Artificial Sequence
  Description of Artificial Sequence: Synthetic oligonucleotide
atggagtcagtggatatccaaccctgaagatatttagag

SEQ ID NO: 91326 - DNA, 38 bp, Artificial Sequence
  Description of Artificial Sequence: Synthetic oligonucleotide
tggagtcagtggatatccaaccctgaagatatttagag

SEQ ID NO: 91327 - DNA, 37 bp, Artificial Sequence
  Description of Artificial Sequence: Synthetic oligonucleotide
ggagtcagtggatatccaaccctgaagatatttagag

SEQ ID NO: 91328 - DNA, 39 bp, Artificial Sequence
  Description of Artificial Sequence: Synthetic oligonucleotide
gagtcagtggatatccaaccctgaagatatttagagatg

SEQ ID NO: 91329 - DNA, 39 bp, Artificial Sequence
  Description of Artificial Sequence: Synthetic oligonucleotide
agtcagtggatatccaaccctgaagatatttagagatgg

SEQ ID NO: 91330 - DNA, 38 bp, Artificial Sequence
  Description of Artificial Sequence: Synthetic oligonucleotide
gtcagtggatatccaaccctgaagatatttagagatgg

SEQ ID NO: 91331 - DNA, 39 bp, Artificial Sequence
  Description of Artificial Sequence: Synthetic oligonucleotide
tcagtggatatccaaccctgaagatatttagagatggtg

SEQ ID NO: 91332 - DNA, 38 bp, Artificial Sequence
  Description of Artificial Sequence: Synthetic oligonucleotide
cagtggatatccaaccctgaagatatttagagatggtg

SEQ ID NO: 91333 - DNA, 40 bp, Artificial Sequence
  Description of Artificial Sequence: Synthetic oligonucleotide
agtggatatccaaccctgaagatatttagagatggtgaag

SEQ ID NO: 91334 - DNA, 39 bp, Artificial Sequence
  Description of Artificial Sequence: Synthetic oligonucleotide
gtggatatccaaccctgaagatatttagagatggtgaag

SEQ ID NO: 91335 - DNA, 41 bp, Artificial Sequence
  Description of Artificial Sequence: Synthetic oligonucleotide
tggatatccaaccctgaagatatttagagatggtgaagaag

SEQ ID NO: 91336 - DNA, 40 bp, Artificial Sequence
  Description of Artificial Sequence: Synthetic oligonucleotide
ggatatccaaccctgaagatatttagagatggtgaagaag

SEQ ID NO: 91337 - DNA, 40 bp, Artificial Sequence
  Description of Artificial Sequence: Synthetic oligonucleotide
gatatccaaccctgaagatatttagagatggtgaagaagc

SEQ ID NO: 91338 - DNA, 41 bp, Artificial Sequence
  Description of Artificial Sequence: Synthetic oligonucleotide
atatccaaccctgaagatatttagagatggtgaagaagcag

SEQ ID NO: 91339 - DNA, 40 bp, Artificial Sequence
  Description of Artificial Sequence: Synthetic oligonucleotide
tatccaaccctgaagatatttagagatggtgaagaagcag

SEQ ID NO: 91340 - DNA, 39 bp, Artificial Sequence
  Description of Artificial Sequence: Synthetic oligonucleotide
atccaaccctgaagatatttagagatggtgaagaagcag

SEQ ID NO: 91341 - DNA, 38 bp, Artificial Sequence
  Description of Artificial Sequence: Synthetic oligonucleotide
tccaaccctgaagatatttagagatggtgaagaagcag

SEQ ID NO: 91342 - DNA, 37 bp, Artificial Sequence
  Description of Artificial Sequence: Synthetic oligonucleotide
ccaaccctgaagatatttagagatggtgaagaagcag

SEQ ID NO: 91343 - DNA, 37 bp, Artificial Sequence
  Description of Artificial Sequence: Synthetic oligonucleotide
caaccctgaagatatttagagatggtgaagaagcagg

SEQ ID NO: 91344 - DNA, 38 bp, Artificial Sequence
  Description of Artificial Sequence: Synthetic oligonucleotide
aaccctgaagatatttagagatggtgaagaagcaggtg

SEQ ID NO: 91345 - DNA, 37 bp, Artificial Sequence
  Description of Artificial Sequence: Synthetic oligonucleotide
accctgaagatatttagagatggtgaagaagcaggtg

SEQ ID NO: 91346 - DNA, 36 bp, Artificial Sequence
  Description of Artificial Sequence: Synthetic oligonucleotide
ccctgaagatatttagagatggtgaagaagcaggtg

SEQ ID NO: 91347 - DNA, 36 bp, Artificial Sequence
  Description of Artificial Sequence: Synthetic oligonucleotide
cctgaagatatttagagatggtgaagaagcaggtgc

SEQ ID NO: 91348 - DNA, 40 bp, Artificial Sequence
  Description of Artificial Sequence: Synthetic oligonucleotide
ctgaagatatttagagatggtgaagaagcaggtgcttatg

SEQ ID NO: 91349 - DNA, 42 bp, Artificial Sequence
  Description of Artificial Sequence: Synthetic oligonucleotide
tgaagatatttagagatggtgaagaagcaggtgcttatgatg

SEQ ID NO: 91350 - DNA, 41 bp, Artificial Sequence
  Description of Artificial Sequence: Synthetic oligonucleotide
gaagatatttagagatggtgaagaagcaggtgcttatgatg

SEQ ID NO: 91351 - DNA, 41 bp, Artificial Sequence
  Description of Artificial Sequence: Synthetic oligonucleotide
aagatatttagagatggtgaagaagcaggtgcttatgatgg

SEQ ID NO: 91352 - DNA, 40 bp, Artificial Sequence
  Description of Artificial Sequence: Synthetic oligonucleotide
agatatttagagatggtgaagaagcaggtgcttatgatgg

SEQ ID NO: 91353 - DNA, 39 bp, Artificial Sequence
  Description of Artificial Sequence: Synthetic oligonucleotide
gatatttagagatggtgaagaagcaggtgcttatgatgg

SEQ ID NO: 91354 - DNA, 40 bp, Artificial Sequence
  Description of Artificial Sequence: Synthetic oligonucleotide
atatttagagatggtgaagaagcaggtgcttatgatggac

SEQ ID NO: 91355 - DNA, 39 bp, Artificial Sequence
  Description of Artificial Sequence: Synthetic oligonucleotide
tatttagagatggtgaagaagcaggtgcttatgatggac

SEQ ID NO: 91356 - DNA, 38 bp, Artificial Sequence
  Description of Artificial Sequence: Synthetic oligonucleotide
atttagagatggtgaagaagcaggtgcttatgatggac

SEQ ID NO: 91357 - DNA, 37 bp, Artificial Sequence
  Description of Artificial Sequence: Synthetic oligonucleotide
tttagagatggtgaagaagcaggtgcttatgatggac

SEQ ID NO: 91358 - DNA, 36 bp, Artificial Sequence
  Description of Artificial Sequence: Synthetic oligonucleotide
ttagagatggtgaagaagcaggtgcttatgatggac

SEQ ID NO: 91359 - DNA, 35 bp, Artificial Sequence
  Description of Artificial Sequence: Synthetic oligonucleotide
tagagatggtgaagaagcaggtgcttatgatggac

SEQ ID NO: 91360 - DNA, 34 bp, Artificial Sequence
  Description of Artificial Sequence: Synthetic oligonucleotide
agagatggtgaagaagcaggtgcttatgatggac

SEQ ID NO: 91361 - DNA, 33 bp, Artificial Sequence
  Description of Artificial Sequence: Synthetic oligonucleotide
gagatggtgaagaagcaggtgcttatgatggac

SEQ ID NO: 91362 - DNA, 33 bp, Artificial Sequence
  Description of Artificial Sequence: Synthetic oligonucleotide
agatggtgaagaagcaggtgcttatgatggacc

SEQ ID NO: 91363 - DNA, 32 bp, Artificial Sequence
  Description of Artificial Sequence: Synthetic oligonucleotide
gatggtgaagaagcaggtgcttatgatggacc

SEQ ID NO: 91364 - DNA, 34 bp, Artificial Sequence
  Description of Artificial Sequence: Synthetic oligonucleotide
atggtgaagaagcaggtgcttatgatggacctag

SEQ ID NO: 91365 - DNA, 33 bp, Artificial Sequence
  Description of Artificial Sequence: Synthetic oligonucleotide
tggtgaagaagcaggtgcttatgatggacctag

SEQ ID NO: 91366 - DNA, 32 bp, Artificial Sequence
  Description of Artificial Sequence: Synthetic oligonucleotide
ggtgaagaagcaggtgcttatgatggacctag

SEQ ID NO: 91367 - DNA, 32 bp, Artificial Sequence
  Description of Artificial Sequence: Synthetic oligonucleotide
gtgaagaagcaggtgcttatgatggacctagg

SEQ ID NO: 91368 - DNA, 33 bp, Artificial Sequence
  Description of Artificial Sequence: Synthetic oligonucleotide
tgaagaagcaggtgcttatgatggacctaggac

SEQ ID NO: 91369 - DNA, 32 bp, Artificial Sequence
  Description of Artificial Sequence: Synthetic oligonucleotide
gaagaagcaggtgcttatgatggacctaggac

SEQ ID NO: 91370 - DNA, 33 bp, Artificial Sequence
  Description of Artificial Sequence: Synthetic oligonucleotide
aagaagcaggtgcttatgatggacctaggactg

SEQ ID NO: 91371 - DNA, 32 bp, Artificial Sequence
  Description of Artificial Sequence: Synthetic oligonucleotide
agaagcaggtgcttatgatggacctaggactg

SEQ ID NO: 91372 - DNA, 31 bp, Artificial Sequence
  Description of Artificial Sequence: Synthetic oligonucleotide
gaagcaggtgcttatgatggacctaggactg

SEQ ID NO: 91373 - DNA, 31 bp, Artificial Sequence
  Description of Artificial Sequence: Synthetic oligonucleotide
aagcaggtgcttatgatggacctaggactgc

SEQ ID NO: 91374 - DNA, 30 bp, Artificial Sequence
  Description of Artificial Sequence: Synthetic oligonucleotide
agcaggtgcttatgatggacctaggactgc

SEQ ID NO: 91375 - DNA, 29 bp, Artificial Sequence
  Description of Artificial Sequence: Synthetic oligonucleotide
gcaggtgcttatgatggacctaggactgc

SEQ ID NO: 91376 - DNA, 30 bp, Artificial Sequence
  Description of Artificial Sequence: Synthetic oligonucleotide
caggtgcttatgatggacctaggactgctg

SEQ ID NO: 91377 - DNA, 32 bp, Artificial Sequence
  Description of Artificial Sequence: Synthetic oligonucleotide
aggtgcttatgatggacctaggactgctgatg

SEQ ID NO: 91378 - DNA, 31 bp, Artificial Sequence
  Description of Artificial Sequence: Synthetic oligonucleotide
ggtgcttatgatggacctaggactgctgatg

SEQ ID NO: 91379 - DNA, 31 bp, Artificial Sequence
  Description of Artificial Sequence: Synthetic oligonucleotide
gtgcttatgatggacctaggactgctgatgg

SEQ ID NO: 91380 - DNA, 35 bp, Artificial Sequence
  Description of Artificial Sequence: Synthetic oligonucleotide
tgcttatgatggacctaggactgctgatggaattg

SEQ ID NO: 91381 - DNA, 34 bp, Artificial Sequence
  Description of Artificial Sequence: Synthetic oligonucleotide
gcttatgatggacctaggactgctgatggaattg

SEQ ID NO: 91382 - DNA, 35 bp, Artificial Sequence
  Description of Artificial Sequence: Synthetic oligonucleotide
cttatgatggacctaggactgctgatggaattgtc

SEQ ID NO: 91383 - DNA, 36 bp, Artificial Sequence
  Description of Artificial Sequence: Synthetic oligonucleotide
ttatgatggacctaggactgctgatggaattgtcag

SEQ ID NO: 91384 - DNA, 35 bp, Artificial Sequence
  Description of Artificial Sequence: Synthetic oligonucleotide
tatgatggacctaggactgctgatggaattgtcag

SEQ ID NO: 91385 - DNA, 34 bp, Artificial Sequence
  Description of Artificial Sequence: Synthetic oligonucleotide
atgatggacctaggactgctgatggaattgtcag

SEQ ID NO: 91386 - DNA, 33 bp, Artificial Sequence
  Description of Artificial Sequence: Synthetic oligonucleotide
tgatggacctaggactgctgatggaattgtcag

SEQ ID NO: 91387 - DNA, 32 bp, Artificial Sequence
  Description of Artificial Sequence: Synthetic oligonucleotide
gatggacctaggactgctgatggaattgtcag

SEQ ID NO: 91388 - DNA, 32 bp, Artificial Sequence
  Description of Artificial Sequence: Synthetic oligonucleotide
atggacctaggactgctgatggaattgtcagc

SEQ ID NO: 91389 - DNA, 31 bp, Artificial Sequence
  Description of Artificial Sequence: Synthetic oligonucleotide
tggacctaggactgctgatggaattgtcagc

SEQ ID NO: 91390 - DNA, 30 bp, Artificial Sequence
  Description of Artificial Sequence: Synthetic oligonucleotide
ggacctaggactgctgatggaattgtcagc

SEQ ID NO: 91391 - DNA, 30 bp, Artificial Sequence
  Description of Artificial Sequence: Synthetic oligonucleotide
gacctaggactgctgatggaattgtcagcc

SEQ ID NO: 91392 - DNA, 31 bp, Artificial Sequence
  Description of Artificial Sequence: Synthetic oligonucleotide
acctaggactgctgatggaattgtcagccac

SEQ ID NO: 91393 - DNA, 30 bp, Artificial Sequence
  Description of Artificial Sequence: Synthetic oligonucleotide
cctaggactgctgatggaattgtcagccac

SEQ ID NO: 91394 - DNA, 32 bp, Artificial Sequence
  Description of Artificial Sequence: Synthetic oligonucleotide
ctaggactgctgatggaattgtcagccacttg

SEQ ID NO: 91395 - DNA, 34 bp, Artificial Sequence
  Description of Artificial Sequence: Synthetic oligonucleotide
taggactgctgatggaattgtcagccacttgaag

SEQ ID NO: 91396 - DNA, 33 bp, Artificial Sequence
  Description of Artificial Sequence: Synthetic oligonucleotide
aggactgctgatggaattgtcagccacttgaag

SEQ ID NO: 91397 - DNA, 32 bp, Artificial Sequence
  Description of Artificial Sequence: Synthetic oligonucleotide
ggactgctgatggaattgtcagccacttgaag

SEQ ID NO: 91398 - DNA, 34 bp, Artificial Sequence
  Description of Artificial Sequence: Synthetic oligonucleotide
gactgctgatggaattgtcagccacttgaagaag

SEQ ID NO: 91399 - DNA, 34 bp, Artificial Sequence
  Description of Artificial Sequence: Synthetic oligonucleotide
actgctgatggaattgtcagccacttgaagaagc

SEQ ID NO: 91400 - DNA, 33 bp, Artificial Sequence
  Description of Artificial Sequence: Synthetic oligonucleotide
ctgctgatggaattgtcagccacttgaagaagc

SEQ ID NO: 91401 - DNA, 34 bp, Artificial Sequence
  Description of Artificial Sequence: Synthetic oligonucleotide
tgctgatggaattgtcagccacttgaagaagcag

SEQ ID NO: 91402 - DNA, 33 bp, Artificial Sequence
  Description of Artificial Sequence: Synthetic oligonucleotide
gctgatggaattgtcagccacttgaagaagcag

SEQ ID NO: 91403 - DNA, 33 bp, Artificial Sequence
  Description of Artificial Sequence: Synthetic oligonucleotide
ctgatggaattgtcagccacttgaagaagcagg

SEQ ID NO: 91404 - DNA, 33 bp, Artificial Sequence
  Description of Artificial Sequence: Synthetic oligonucleotide
tgatggaattgtcagccacttgaagaagcaggc

SEQ ID NO: 91405 - DNA, 32 bp, Artificial Sequence
  Description of Artificial Sequence: Synthetic oligonucleotide
gatggaattgtcagccacttgaagaagcaggc

SEQ ID NO: 91406 - DNA, 33 bp, Artificial Sequence
  Description of Artificial Sequence: Synthetic oligonucleotide
atggaattgtcagccacttgaagaagcaggcag

SEQ ID NO: 91407 - DNA, 32 bp, Artificial Sequence
  Description of Artificial Sequence: Synthetic oligonucleotide
tggaattgtcagccacttgaagaagcaggcag

SEQ ID NO: 91408 - DNA, 31 bp, Artificial Sequence
  Description of Artificial Sequence: Synthetic oligonucleotide
ggaattgtcagccacttgaagaagcaggcag

SEQ ID NO: 91409 - DNA, 31 bp, Artificial Sequence
  Description of Artificial Sequence: Synthetic oligonucleotide
gaattgtcagccacttgaagaagcaggcagg

SEQ ID NO: 91410 - DNA, 32 bp, Artificial Sequence
  Description of Artificial Sequence: Synthetic oligonucleotide
aattgtcagccacttgaagaagcaggcaggac

SEQ ID NO: 91411 - DNA, 31 bp, Artificial Sequence
  Description of Artificial Sequence: Synthetic oligonucleotide
attgtcagccacttgaagaagcaggcaggac

SEQ ID NO: 91412 - DNA, 30 bp, Artificial Sequence
  Description of Artificial Sequence: Synthetic oligonucleotide
ttgtcagccacttgaagaagcaggcaggac

SEQ ID NO: 91413 - DNA, 29 bp, Artificial Sequence
  Description of Artificial Sequence: Synthetic oligonucleotide
tgtcagccacttgaagaagcaggcaggac

SEQ ID NO: 91414 - DNA, 28 bp, Artificial Sequence
  Description of Artificial Sequence: Synthetic oligonucleotide
gtcagccacttgaagaagcaggcaggac

SEQ ID NO: 91415 - DNA, 28 bp, Artificial Sequence
  Description of Artificial Sequence: Synthetic oligonucleotide
tcagccacttgaagaagcaggcaggacc

SEQ ID NO: 91416 - DNA, 27 bp, Artificial Sequence
  Description of Artificial Sequence: Synthetic oligonucleotide
cagccacttgaagaagcaggcaggacc

SEQ ID NO: 91417 - DNA, 28 bp, Artificial Sequence
  Description of Artificial Sequence: Synthetic oligonucleotide
agccacttgaagaagcaggcaggaccag

SEQ ID NO: 91418 - DNA, 27 bp, Artificial Sequence
  Description of Artificial Sequence: Synthetic oligonucleotide
gccacttgaagaagcaggcaggaccag

SEQ ID NO: 91419 - DNA, 27 bp, Artificial Sequence
  Description of Artificial Sequence: Synthetic oligonucleotide
ccacttgaagaagcaggcaggaccagc

SEQ ID NO: 91420 - DNA, 29 bp, Artificial Sequence
  Description of Artificial Sequence: Synthetic oligonucleotide
cacttgaagaagcaggcaggaccagcttc

SEQ ID NO: 91421 - DNA, 30 bp, Artificial Sequence
  Description of Artificial Sequence: Synthetic oligonucleotide
acttgaagaagcaggcaggaccagcttcag

SEQ ID NO: 91422 - DNA, 29 bp, Artificial Sequence
  Description of Artificial Sequence: Synthetic oligonucleotide
cttgaagaagcaggcaggaccagcttcag

SEQ ID NO: 91423 - DNA, 30 bp, Artificial Sequence
  Description of Artificial Sequence: Synthetic oligonucleotide
ttgaagaagcaggcaggaccagcttcagtg

SEQ ID NO: 91424 - DNA, 29 bp, Artificial Sequence
  Description of Artificial Sequence: Synthetic oligonucleotide
tgaagaagcaggcaggaccagcttcagtg

SEQ ID NO: 91425 - DNA, 28 bp, Artificial Sequence
  Description of Artificial Sequence: Synthetic oligonucleotide
gaagaagcaggcaggaccagcttcagtg

SEQ ID NO: 91426 - DNA, 28 bp, Artificial Sequence
  Description of Artificial Sequence: Synthetic oligonucleotide
aagaagcaggcaggaccagcttcagtgc

SEQ ID NO: 91427 - DNA, 27 bp, Artificial Sequence
  Description of Artificial Sequence: Synthetic oligonucleotide
agaagcaggcaggaccagcttcagtgc

SEQ ID NO: 91428 - DNA, 26 bp, Artificial Sequence
  Description of Artificial Sequence: Synthetic oligonucleotide
gaagcaggcaggaccagcttcagtgc

SEQ ID NO: 91429 - DNA, 27 bp, Artificial Sequence
  Description of Artificial Sequence: Synthetic oligonucleotide
aagcaggcaggaccagcttcagtgcct

SEQ ID NO: 91430 - DNA, 26 bp, Artificial Sequence
  Description of Artificial Sequence: Synthetic oligonucleotide
agcaggcaggaccagcttcagtgcct

SEQ ID NO: 91431 - DNA, 25 bp, Artificial Sequence
  Description of Artificial Sequence: Synthetic oligonucleotide
gcaggcaggaccagcttcagtgcct

SEQ ID NO: 91432 - DNA, 26 bp, Artificial Sequence
  Description of Artificial Sequence: Synthetic oligonucleotide
caggcaggaccagcttcagtgcctct

SEQ ID NO: 91433 - DNA, 27 bp, Artificial Sequence
  Description of Artificial Sequence: Synthetic oligonucleotide
aggcaggaccagcttcagtgcctctca

SEQ ID NO: 91434 - DNA, 26 bp, Artificial Sequence
  Description of Artificial Sequence: Synthetic oligonucleotide
ggcaggaccagcttcagtgcctctca

SEQ ID NO: 91435 - DNA, 26 bp, Artificial Sequence
  Description of Artificial Sequence: Synthetic oligonucleotide
gcaggaccagcttcagtgcctctcag

SEQ ID NO: 91436 - DNA, 27 bp, Artificial Sequence
  Description of Artificial Sequence: Synthetic oligonucleotide
caggaccagcttcagtgcctctcagga

SEQ ID NO: 91437 - DNA, 27 bp, Artificial Sequence
  Description of Artificial Sequence: Synthetic oligonucleotide
aggaccagcttcagtgcctctcaggac

SEQ ID NO: 91438 - DNA, 27 bp, Artificial Sequence
  Description of Artificial Sequence: Synthetic oligonucleotide
ggaccagcttcagtgcctctcaggact

SEQ ID NO: 91439 - DNA, 27 bp, Artificial Sequence
  Description of Artificial Sequence: Synthetic oligonucleotide
gaccagcttcagtgcctctcaggactg

SEQ ID NO: 91440 - DNA, 28 bp, Artificial Sequence
  Description of Artificial Sequence: Synthetic oligonucleotide
accagcttcagtgcctctcaggactgag

SEQ ID NO: 91441 - DNA, 27 bp, Artificial Sequence
  Description of Artificial Sequence: Synthetic oligonucleotide
ccagcttcagtgcctctcaggactgag

SEQ ID NO: 91442 - DNA, 27 bp, Artificial Sequence
  Description of Artificial Sequence: Synthetic oligonucleotide
cagcttcagtgcctctcaggactgagg

SEQ ID NO: 91443 - DNA, 29 bp, Artificial Sequence
  Description of Artificial Sequence: Synthetic oligonucleotide
agcttcagtgcctctcaggactgaggaag

SEQ ID NO: 91444 - DNA, 28 bp, Artificial Sequence
  Description of Artificial Sequence: Synthetic oligonucleotide
gcttcagtgcctctcaggactgaggaag

SEQ ID NO: 91445 - DNA, 35 bp, Artificial Sequence
  Description of Artificial Sequence: Synthetic oligonucleotide
cttcagtgcctctcaggactgaggaagaatttaag

SEQ ID NO: 91446 - DNA, 40 bp, Artificial Sequence
  Description of Artificial Sequence: Synthetic oligonucleotide
ttcagtgcctctcaggactgaggaagaatttaagaaattc

SEQ ID NO: 91447 - DNA, 39 bp, Artificial Sequence
  Description of Artificial Sequence: Synthetic oligonucleotide
tcagtgcctctcaggactgaggaagaatttaagaaattc

SEQ ID NO: 91448 - DNA, 38 bp, Artificial Sequence
  Description of Artificial Sequence: Synthetic oligonucleotide
cagtgcctctcaggactgaggaagaatttaagaaattc

SEQ ID NO: 91449 - DNA, 42 bp, Artificial Sequence
  Description of Artificial Sequence: Synthetic oligonucleotide
agtgcctctcaggactgaggaagaatttaagaaattcattag

SEQ ID NO: 91450 - DNA, 41 bp, Artificial Sequence
  Description of Artificial Sequence: Synthetic oligonucleotide
gtgcctctcaggactgaggaagaatttaagaaattcattag

SEQ ID NO: 91451 - DNA, 42 bp, Artificial Sequence
  Description of Artificial Sequence: Synthetic oligonucleotide
tgcctctcaggactgaggaagaatttaagaaattcattagtg

SEQ ID NO: 91452 - DNA, 41 bp, Artificial Sequence
  Description of Artificial Sequence: Synthetic oligonucleotide
gcctctcaggactgaggaagaatttaagaaattcattagtg

SEQ ID NO: 91453 - DNA, 46 bp, Artificial Sequence
  Description of Artificial Sequence: Synthetic oligonucleotide
cctctcaggactgaggaagaatttaagaaattcattagtgataaag

SEQ ID NO: 91454 - DNA, 48 bp, Artificial Sequence
  Description of Artificial Sequence: Synthetic oligonucleotide
ctctcaggactgaggaagaatttaagaaattcattagtgataaagatg

SEQ ID NO: 91455 - DNA, 48 bp, Artificial Sequence
  Description of Artificial Sequence: Synthetic oligonucleotide
tctcaggactgaggaagaatttaagaaattcattagtgataaagatgc

SEQ ID NO: 91456 - DNA, 47 bp, Artificial Sequence
  Description of Artificial Sequence: Synthetic oligonucleotide
ctcaggactgaggaagaatttaagaaattcattagtgataaagatgc

SEQ ID NO: 91457 - DNA, 47 bp, Artificial Sequence
  Description of Artificial Sequence: Synthetic oligonucleotide
tcaggactgaggaagaatttaagaaattcattagtgataaagatgcc

SEQ ID NO: 91458 - DNA, 46 bp, Artificial Sequence
  Description of Artificial Sequence: Synthetic oligonucleotide
caggactgaggaagaatttaagaaattcattagtgataaagatgcc

SEQ ID NO: 91459 - DNA, 47 bp, Artificial Sequence
  Description of Artificial Sequence: Synthetic oligonucleotide
aggactgaggaagaatttaagaaattcattagtgataaagatgcctc

SEQ ID NO: 91460 - DNA, 46 bp, Artificial Sequence
  Description of Artificial Sequence: Synthetic oligonucleotide
ggactgaggaagaatttaagaaattcattagtgataaagatgcctc

SEQ ID NO: 91461 - DNA, 50 bp, Artificial Sequence
  Description of Artificial Sequence: Synthetic oligonucleotide
gactgaggaagaatttaagaaattcattagtgataaagatgcctctatag

SEQ ID NO: 91462 - DNA, 52 bp, Artificial Sequence
  Description of Artificial Sequence: Synthetic oligonucleotide
actgaggaagaatttaagaaattcattagtgataaagatgcctctatagtag

SEQ ID NO: 91463 - DNA, 51 bp, Artificial Sequence
  Description of Artificial Sequence: Synthetic oligonucleotide
ctgaggaagaatttaagaaattcattagtgataaagatgcctctatagtag

SEQ ID NO: 91464 - DNA, 51 bp, Artificial Sequence
  Description of Artificial Sequence: Synthetic oligonucleotide
tgaggaagaatttaagaaattcattagtgataaagatgcctctatagtagg

SEQ ID NO: 91465 - DNA, 50 bp, Artificial Sequence
  Description of Artificial Sequence: Synthetic oligonucleotide
gaggaagaatttaagaaattcattagtgataaagatgcctctatagtagg

SEQ ID NO: 91466 - DNA, 56 bp, Artificial Sequence
  Description of Artificial Sequence: Synthetic oligonucleotide
aggaagaatttaagaaattcattagtgataaagatgcctctatagtaggttttttc

SEQ ID NO: 91467 - DNA, 55 bp, Artificial Sequence
  Description of Artificial Sequence: Synthetic oligonucleotide
ggaagaatttaagaaattcattagtgataaagatgcctctatagtaggttttttc

SEQ ID NO: 91468 - DNA, 55 bp, Artificial Sequence
  Description of Artificial Sequence: Synthetic oligonucleotide
gaagaatttaagaaattcattagtgataaagatgcctctatagtaggttttttcg

SEQ ID NO: 91469 - DNA, 57 bp, Artificial Sequence
  Description of Artificial Sequence: Synthetic oligonucleotide
aagaatttaagaaattcattagtgataaagatgcctctatagtaggttttttcgatg

SEQ ID NO: 91470 - DNA, 56 bp, Artificial Sequence
  Description of Artificial Sequence: Synthetic oligonucleotide
agaatttaagaaattcattagtgataaagatgcctctatagtaggttttttcgatg

SEQ ID NO: 91471 - DNA, 55 bp, Artificial Sequence
  Description of Artificial Sequence: Synthetic oligonucleotide
gaatttaagaaattcattagtgataaagatgcctctatagtaggttttttcgatg

SEQ ID NO: 91472 - DNA, 58 bp, Artificial Sequence
  Description of Artificial Sequence: Synthetic oligonucleotide
aatttaagaaattcattagtgataaagatgcctctatagtaggttttttcgatgattc

SEQ ID NO: 91473 - DNA, 57 bp, Artificial Sequence
  Description of Artificial Sequence: Synthetic oligonucleotide
atttaagaaattcattagtgataaagatgcctctatagtaggttttttcgatgattc

SEQ ID NO: 91474 - DNA, 56 bp, Artificial Sequence
  Description of Artificial Sequence: Synthetic oligonucleotide
tttaagaaattcattagtgataaagatgcctctatagtaggttttttcgatgattc

SEQ ID NO: 91475 - DNA, 55 bp, Artificial Sequence
  Description of Artificial Sequence: Synthetic oligonucleotide
ttaagaaattcattagtgataaagatgcctctatagtaggttttttcgatgattc

SEQ ID NO: 91476 - DNA, 54 bp, Artificial Sequence
  Description of Artificial Sequence: Synthetic oligonucleotide
taagaaattcattagtgataaagatgcctctatagtaggttttttcgatgattc

SEQ ID NO: 91477 - DNA, 53 bp, Artificial Sequence
  Description of Artificial Sequence: Synthetic oligonucleotide
aagaaattcattagtgataaagatgcctctatagtaggttttttcgatgattc

SEQ ID NO: 91478 - DNA, 52 bp, Artificial Sequence
  Description of Artificial Sequence: Synthetic oligonucleotide
agaaattcattagtgataaagatgcctctatagtaggttttttcgatgattc

SEQ ID NO: 91479 - DNA, 51 bp, Artificial Sequence
  Description of Artificial Sequence: Synthetic oligonucleotide
gaaattcattagtgataaagatgcctctatagtaggttttttcgatgattc

SEQ ID NO: 91480 - DNA, 54 bp, Artificial Sequence
  Description of Artificial Sequence: Synthetic oligonucleotide
aaattcattagtgataaagatgcctctatagtaggttttttcgatgattcattc

SEQ ID NO: 91481 - DNA, 53 bp, Artificial Sequence
  Description of Artificial Sequence: Synthetic oligonucleotide
aattcattagtgataaagatgcctctatagtaggttttttcgatgattcattc

SEQ ID NO: 91482 - DNA, 52 bp, Artificial Sequence
  Description of Artificial Sequence: Synthetic oligonucleotide
attcattagtgataaagatgcctctatagtaggttttttcgatgattcattc

SEQ ID NO: 91483 - DNA, 51 bp, Artificial Sequence
  Description of Artificial Sequence: Synthetic oligonucleotide
ttcattagtgataaagatgcctctatagtaggttttttcgatgattcattc

SEQ ID NO: 91484 - DNA, 50 bp, Artificial Sequence
  Description of Artificial Sequence: Synthetic oligonucleotide
tcattagtgataaagatgcctctatagtaggttttttcgatgattcattc

SEQ ID NO: 91485 - DNA, 49 bp, Artificial Sequence
  Description of Artificial Sequence: Synthetic oligonucleotide
cattagtgataaagatgcctctatagtaggttttttcgatgattcattc

SEQ ID NO: 91486 - DNA, 50 bp, Artificial Sequence
  Description of Artificial Sequence: Synthetic oligonucleotide
attagtgataaagatgcctctatagtaggttttttcgatgattcattcag

SEQ ID NO: 91487 - DNA, 49 bp, Artificial Sequence
  Description of Artificial Sequence: Synthetic oligonucleotide
ttagtgataaagatgcctctatagtaggttttttcgatgattcattcag

SEQ ID NO: 91488 - DNA, 48 bp, Artificial Sequence
  Description of Artificial Sequence: Synthetic oligonucleotide
tagtgataaagatgcctctatagtaggttttttcgatgattcattcag

SEQ ID NO: 91489 - DNA, 47 bp, Artificial Sequence
  Description of Artificial Sequence: Synthetic oligonucleotide
agtgataaagatgcctctatagtaggttttttcgatgattcattcag

SEQ ID NO: 91490 - DNA, 46 bp, Artificial Sequence
  Description of Artificial Sequence: Synthetic oligonucleotide
gtgataaagatgcctctatagtaggttttttcgatgattcattcag

SEQ ID NO: 91491 - DNA, 47 bp, Artificial Sequence
  Description of Artificial Sequence: Synthetic oligonucleotide
tgataaagatgcctctatagtaggttttttcgatgattcattcagtg

SEQ ID NO: 91492 - DNA, 46 bp, Artificial Sequence
  Description of Artificial Sequence: Synthetic oligonucleotide
gataaagatgcctctatagtaggttttttcgatgattcattcagtg

SEQ ID NO: 91493 - DNA, 47 bp, Artificial Sequence
  Description of Artificial Sequence: Synthetic oligonucleotide
ataaagatgcctctatagtaggttttttcgatgattcattcagtgag

SEQ ID NO: 91494 - DNA, 46 bp, Artificial Sequence
  Description of Artificial Sequence: Synthetic oligonucleotide
taaagatgcctctatagtaggttttttcgatgattcattcagtgag

SEQ ID NO: 91495 - DNA, 45 bp, Artificial Sequence
  Description of Artificial Sequence: Synthetic oligonucleotide
aaagatgcctctatagtaggttttttcgatgattcattcagtgag

SEQ ID NO: 91496 - DNA, 44 bp, Artificial Sequence
  Description of Artificial Sequence: Synthetic oligonucleotide
aagatgcctctatagtaggttttttcgatgattcattcagtgag

SEQ ID NO: 91497 - DNA, 43 bp, Artificial Sequence
  Description of Artificial Sequence: Synthetic oligonucleotide
agatgcctctatagtaggttttttcgatgattcattcagtgag

SEQ ID NO: 91498 - DNA, 42 bp, Artificial Sequence
  Description of Artificial Sequence: Synthetic oligonucleotide
gatgcctctatagtaggttttttcgatgattcattcagtgag

SEQ ID NO: 91499 - DNA, 42 bp, Artificial Sequence
  Description of Artificial Sequence: Synthetic oligonucleotide
atgcctctatagtaggttttttcgatgattcattcagtgagg

SEQ ID NO: 91500 - DNA, 41 bp, Artificial Sequence
  Description of Artificial Sequence: Synthetic oligonucleotide
tgcctctatagtaggttttttcgatgattcattcagtgagg

SEQ ID NO: 91501 - DNA, 40 bp, Artificial Sequence
  Description of Artificial Sequence: Synthetic oligonucleotide
gcctctatagtaggttttttcgatgattcattcagtgagg

SEQ ID NO: 91502 - DNA, 40 bp, Artificial Sequence
  Description of Artificial Sequence: Synthetic oligonucleotide
cctctatagtaggttttttcgatgattcattcagtgaggc

SEQ ID NO: 91503 - DNA, 41 bp, Artificial Sequence
  Description of Artificial Sequence: Synthetic oligonucleotide
ctctatagtaggttttttcgatgattcattcagtgaggctc

SEQ ID NO: 91504 - DNA, 42 bp, Artificial Sequence
  Description of Artificial Sequence: Synthetic oligonucleotide
tctatagtaggttttttcgatgattcattcagtgaggctcac

SEQ ID NO: 91505 - DNA, 41 bp, Artificial Sequence
  Description of Artificial Sequence: Synthetic oligonucleotide
ctatagtaggttttttcgatgattcattcagtgaggctcac

SEQ ID NO: 91506 - DNA, 42 bp, Artificial Sequence
  Description of Artificial Sequence: Synthetic oligonucleotide
tatagtaggttttttcgatgattcattcagtgaggctcactc

SEQ ID NO: 91507 - DNA, 41 bp, Artificial Sequence
  Description of Artificial Sequence: Synthetic oligonucleotide
atagtaggttttttcgatgattcattcagtgaggctcactc

SEQ ID NO: 91508 - DNA, 40 bp, Artificial Sequence
  Description of Artificial Sequence: Synthetic oligonucleotide
tagtaggttttttcgatgattcattcagtgaggctcactc

SEQ ID NO: 91509 - DNA, 39 bp, Artificial Sequence
  Description of Artificial Sequence: Synthetic oligonucleotide
agtaggttttttcgatgattcattcagtgaggctcactc

SEQ ID NO: 91510 - DNA, 38 bp, Artificial Sequence
  Description of Artificial Sequence: Synthetic oligonucleotide
gtaggttttttcgatgattcattcagtgaggctcactc

SEQ ID NO: 91511 - DNA, 38 bp, Artificial Sequence
  Description of Artificial Sequence: Synthetic oligonucleotide
taggttttttcgatgattcattcagtgaggctcactcc

SEQ ID NO: 91512 - DNA, 37 bp, Artificial Sequence
  Description of Artificial Sequence: Synthetic oligonucleotide
aggttttttcgatgattcattcagtgaggctcactcc

SEQ ID NO: 91513 - DNA, 36 bp, Artificial Sequence
  Description of Artificial Sequence: Synthetic oligonucleotide
ggttttttcgatgattcattcagtgaggctcactcc

SEQ ID NO: 91514 - DNA, 36 bp, Artificial Sequence
  Description of Artificial Sequence: Synthetic oligonucleotide
gttttttcgatgattcattcagtgaggctcactccg

SEQ ID NO: 91515 - DNA, 37 bp, Artificial Sequence
  Description of Artificial Sequence: Synthetic oligonucleotide
ttttttcgatgattcattcagtgaggctcactccgag

SEQ ID NO: 91516 - DNA, 36 bp, Artificial Sequence
  Description of Artificial Sequence: Synthetic oligonucleotide
tttttcgatgattcattcagtgaggctcactccgag

SEQ ID NO: 91517 - DNA, 35 bp, Artificial Sequence
  Description of Artificial Sequence: Synthetic oligonucleotide
ttttcgatgattcattcagtgaggctcactccgag

SEQ ID NO: 91518 - DNA, 34 bp, Artificial Sequence
  Description of Artificial Sequence: Synthetic oligonucleotide
tttcgatgattcattcagtgaggctcactccgag

SEQ ID NO: 91519 - DNA, 33 bp, Artificial Sequence
  Description of Artificial Sequence: Synthetic oligonucleotide
ttcgatgattcattcagtgaggctcactccgag

SEQ ID NO: 91520 - DNA, 32 bp, Artificial Sequence
  Description of Artificial Sequence: Synthetic oligonucleotide
tcgatgattcattcagtgaggctcactccgag

SEQ ID NO: 91521 - DNA, 31 bp, Artificial Sequence
  Description of Artificial Sequence: Synthetic oligonucleotide
cgatgattcattcagtgaggctcactccgag

SEQ ID NO: 91522 - DNA, 33 bp, Artificial Sequence
  Description of Artificial Sequence: Synthetic oligonucleotide
gatgattcattcagtgaggctcactccgagttc

SEQ ID NO: 91523 - DNA, 33 bp, Artificial Sequence
  Description of Artificial Sequence: Synthetic oligonucleotide
atgattcattcagtgaggctcactccgagttcc

SEQ ID NO: 91524 - DNA, 32 bp, Artificial Sequence
  Description of Artificial Sequence: Synthetic oligonucleotide
tgattcattcagtgaggctcactccgagttcc

SEQ ID NO: 91525 - DNA, 31 bp, Artificial Sequence
  Description of Artificial Sequence: Synthetic oligonucleotide
gattcattcagtgaggctcactccgagttcc

SEQ ID NO: 91526 - DNA, 36 bp, Artificial Sequence
  Description of Artificial Sequence: Synthetic oligonucleotide
attcattcagtgaggctcactccgagttcctaaaag

SEQ ID NO: 91527 - DNA, 35 bp, Artificial Sequence
  Description of Artificial Sequence: Synthetic oligonucleotide
ttcattcagtgaggctcactccgagttcctaaaag

SEQ ID NO: 91528 - DNA, 34 bp, Artificial Sequence
  Description of Artificial Sequence: Synthetic oligonucleotide
tcattcagtgaggctcactccgagttcctaaaag

SEQ ID NO: 91529 - DNA, 33 bp, Artificial Sequence
  Description of Artificial Sequence: Synthetic oligonucleotide
cattcagtgaggctcactccgagttcctaaaag

SEQ ID NO: 91530 - DNA, 33 bp, Artificial Sequence
  Description of Artificial Sequence: Synthetic oligonucleotide
attcagtgaggctcactccgagttcctaaaagc

SEQ ID NO: 91531 - DNA, 32 bp, Artificial Sequence
  Description of Artificial Sequence: Synthetic oligonucleotide
ttcagtgaggctcactccgagttcctaaaagc

SEQ ID NO: 91532 - DNA, 31 bp, Artificial Sequence
  Description of Artificial Sequence: Synthetic oligonucleotide
tcagtgaggctcactccgagttcctaaaagc

SEQ ID NO: 91533 - DNA, 30 bp, Artificial Sequence
  Description of Artificial Sequence: Synthetic oligonucleotide
cagtgaggctcactccgagttcctaaaagc

SEQ ID NO: 91534 - DNA, 31 bp, Artificial Sequence
  Description of Artificial Sequence: Synthetic oligonucleotide
agtgaggctcactccgagttcctaaaagcag

SEQ ID NO: 91535 - DNA, 30 bp, Artificial Sequence
  Description of Artificial Sequence: Synthetic oligonucleotide
gtgaggctcactccgagttcctaaaagcag

SEQ ID NO: 91536 - DNA, 30 bp, Artificial Sequence
  Description of Artificial Sequence: Synthetic oligonucleotide
tgaggctcactccgagttcctaaaagcagc

SEQ ID NO: 91537 - DNA, 29 bp, Artificial Sequence
  Description of Artificial Sequence: Synthetic oligonucleotide
gaggctcactccgagttcctaaaagcagc

SEQ ID NO: 91538 - DNA, 29 bp, Artificial Sequence
  Description of Artificial Sequence: Synthetic oligonucleotide
aggctcactccgagttcctaaaagcagcc

SEQ ID NO: 91539 - DNA, 28 bp, Artificial Sequence
  Description of Artificial Sequence: Synthetic oligonucleotide
ggctcactccgagttcctaaaagcagcc

SEQ ID NO: 91540 - DNA, 29 bp, Artificial Sequence
  Description of Artificial Sequence: Synthetic oligonucleotide
gctcactccgagttcctaaaagcagccag

SEQ ID NO: 91541 - DNA, 29 bp, Artificial Sequence
  Description of Artificial Sequence: Synthetic oligonucleotide
ctcactccgagttcctaaaagcagccagc

SEQ ID NO: 91542 - DNA, 31 bp, Artificial Sequence
  Description of Artificial Sequence: Synthetic oligonucleotide
tcactccgagttcctaaaagcagccagcaac

SEQ ID NO: 91543 - DNA, 30 bp, Artificial Sequence
  Description of Artificial Sequence: Synthetic oligonucleotide
cactccgagttcctaaaagcagccagcaac

SEQ ID NO: 91544 - DNA, 32 bp, Artificial Sequence
  Description of Artificial Sequence: Synthetic oligonucleotide
actccgagttcctaaaagcagccagcaacttg

SEQ ID NO: 91545 - DNA, 31 bp, Artificial Sequence
  Description of Artificial Sequence: Synthetic oligonucleotide
ctccgagttcctaaaagcagccagcaacttg

SEQ ID NO: 91546 - DNA, 32 bp, Artificial Sequence
  Description of Artificial Sequence: Synthetic oligonucleotide
tccgagttcctaaaagcagccagcaacttgag

SEQ ID NO: 91547 - DNA, 31 bp, Artificial Sequence
  Description of Artificial Sequence: Synthetic oligonucleotide
ccgagttcctaaaagcagccagcaacttgag

SEQ ID NO: 91548 - DNA, 31 bp, Artificial Sequence
  Description of Artificial Sequence: Synthetic oligonucleotide
cgagttcctaaaagcagccagcaacttgagg

SEQ ID NO: 91549 - DNA, 31 bp, Artificial Sequence
  Description of Artificial Sequence: Synthetic oligonucleotide
gagttcctaaaagcagccagcaacttgaggg

SEQ ID NO: 91550 - DNA, 35 bp, Artificial Sequence
  Description of Artificial Sequence: Synthetic oligonucleotide
agttcctaaaagcagccagcaacttgagggataac

SEQ ID NO: 91551 - DNA, 34 bp, Artificial Sequence
  Description of Artificial Sequence: Synthetic oligonucleotide
gttcctaaaagcagccagcaacttgagggataac

SEQ ID NO: 91552 - DNA, 36 bp, Artificial Sequence
  Description of Artificial Sequence: Synthetic oligonucleotide
ttcctaaaagcagccagcaacttgagggataactac

SEQ ID NO: 91553 - DNA, 35 bp, Artificial Sequence
  Description of Artificial Sequence: Synthetic oligonucleotide
tcctaaaagcagccagcaacttgagggataactac

SEQ ID NO: 91554 - DNA, 34 bp, Artificial Sequence
  Description of Artificial Sequence: Synthetic oligonucleotide
cctaaaagcagccagcaacttgagggataactac

SEQ ID NO: 91555 - DNA, 34 bp, Artificial Sequence
  Description of Artificial Sequence: Synthetic oligonucleotide
ctaaaagcagccagcaacttgagggataactacc

SEQ ID NO: 91556 - DNA, 34 bp, Artificial Sequence
  Description of Artificial Sequence: Synthetic oligonucleotide
taaaagcagccagcaacttgagggataactaccg

SEQ ID NO: 91557 - DNA, 33 bp, Artificial Sequence
  Description of Artificial Sequence: Synthetic oligonucleotide
aaaagcagccagcaacttgagggataactaccg

SEQ ID NO: 91558 - DNA, 32 bp, Artificial Sequence
  Description of Artificial Sequence: Synthetic oligonucleotide
aaagcagccagcaacttgagggataactaccg

SEQ ID NO: 91559 - DNA, 31 bp, Artificial Sequence
  Description of Artificial Sequence: Synthetic oligonucleotide
aagcagccagcaacttgagggataactaccg

SEQ ID NO: 91560 - DNA, 30 bp, Artificial Sequence
  Description of Artificial Sequence: Synthetic oligonucleotide
agcagccagcaacttgagggataactaccg

SEQ ID NO: 91561 - DNA, 29 bp, Artificial Sequence
  Description of Artificial Sequence: Synthetic oligonucleotide
gcagccagcaacttgagggataactaccg

SEQ ID NO: 91562 - DNA, 33 bp, Artificial Sequence
  Description of Artificial Sequence: Synthetic oligonucleotide
cagccagcaacttgagggataactaccgatttg

SEQ ID NO: 91563 - DNA, 33 bp, Artificial Sequence
  Description of Artificial Sequence: Synthetic oligonucleotide
agccagcaacttgagggataactaccgatttgc

SEQ ID NO: 91564 - DNA, 32 bp, Artificial Sequence
  Description of Artificial Sequence: Synthetic oligonucleotide
gccagcaacttgagggataactaccgatttgc

SEQ ID NO: 91565 - DNA, 33 bp, Artificial Sequence
  Description of Artificial Sequence: Synthetic oligonucleotide
ccagcaacttgagggataactaccgatttgcac

SEQ ID NO: 91566 - DNA, 36 bp, Artificial Sequence
  Description of Artificial Sequence: Synthetic oligonucleotide
cagcaacttgagggataactaccgatttgcacatac

SEQ ID NO: 91567 - DNA, 36 bp, Artificial Sequence
  Description of Artificial Sequence: Synthetic oligonucleotide
agcaacttgagggataactaccgatttgcacatacg

SEQ ID NO: 91568 - DNA, 35 bp, Artificial Sequence
  Description of Artificial Sequence: Synthetic oligonucleotide
gcaacttgagggataactaccgatttgcacatacg

SEQ ID NO: 91569 - DNA, 38 bp, Artificial Sequence
  Description of Artificial Sequence: Synthetic oligonucleotide
caacttgagggataactaccgatttgcacatacgaatg

SEQ ID NO: 91570 - DNA, 40 bp, Artificial Sequence
  Description of Artificial Sequence: Synthetic oligonucleotide
aacttgagggataactaccgatttgcacatacgaatgttg

SEQ ID NO: 91571 - DNA, 39 bp, Artificial Sequence
  Description of Artificial Sequence: Synthetic oligonucleotide
acttgagggataactaccgatttgcacatacgaatgttg

SEQ ID NO: 91572 - DNA, 38 bp, Artificial Sequence
  Description of Artificial Sequence: Synthetic oligonucleotide
cttgagggataactaccgatttgcacatacgaatgttg

SEQ ID NO: 91573 - DNA, 39 bp, Artificial Sequence
  Description of Artificial Sequence: Synthetic oligonucleotide
ttgagggataactaccgatttgcacatacgaatgttgag

SEQ ID NO: 91574 - DNA, 38 bp, Artificial Sequence
  Description of Artificial Sequence: Synthetic oligonucleotide
tgagggataactaccgatttgcacatacgaatgttgag

SEQ ID NO: 91575 - DNA, 37 bp, Artificial Sequence
  Description of Artificial Sequence: Synthetic oligonucleotide
gagggataactaccgatttgcacatacgaatgttgag

SEQ ID NO: 91576 - DNA, 38 bp, Artificial Sequence
  Description of Artificial Sequence: Synthetic oligonucleotide
agggataactaccgatttgcacatacgaatgttgagtc

SEQ ID NO: 91577 - DNA, 37 bp, Artificial Sequence
  Description of Artificial Sequence: Synthetic oligonucleotide
gggataactaccgatttgcacatacgaatgttgagtc

SEQ ID NO: 91578 - DNA, 38 bp, Artificial Sequence
  Description of Artificial Sequence: Synthetic oligonucleotide
ggataactaccgatttgcacatacgaatgttgagtctc

SEQ ID NO: 91579 - DNA, 39 bp, Artificial Sequence
  Description of Artificial Sequence: Synthetic oligonucleotide
gataactaccgatttgcacatacgaatgttgagtctctg

SEQ ID NO: 91580 - DNA, 39 bp, Artificial Sequence
  Description of Artificial Sequence: Synthetic oligonucleotide
ataactaccgatttgcacatacgaatgttgagtctctgg

SEQ ID NO: 91581 - DNA, 38 bp, Artificial Sequence
  Description of Artificial Sequence: Synthetic oligonucleotide
taactaccgatttgcacatacgaatgttgagtctctgg

SEQ ID NO: 91582 - DNA, 37 bp, Artificial Sequence
  Description of Artificial Sequence: Synthetic oligonucleotide
aactaccgatttgcacatacgaatgttgagtctctgg

SEQ ID NO: 91583 - DNA, 36 bp, Artificial Sequence
  Description of Artificial Sequence: Synthetic oligonucleotide
actaccgatttgcacatacgaatgttgagtctctgg

SEQ ID NO: 91584 - DNA, 35 bp, Artificial Sequence
  Description of Artificial Sequence: Synthetic oligonucleotide
ctaccgatttgcacatacgaatgttgagtctctgg

SEQ ID NO: 91585 - DNA, 36 bp, Artificial Sequence
  Description of Artificial Sequence: Synthetic oligonucleotide
taccgatttgcacatacgaatgttgagtctctggtg

SEQ ID NO: 91586 - DNA, 35 bp, Artificial Sequence
  Description of Artificial Sequence: Synthetic oligonucleotide
accgatttgcacatacgaatgttgagtctctggtg

SEQ ID NO: 91587 - DNA, 34 bp, Artificial Sequence
  Description of Artificial Sequence: Synthetic oligonucleotide
ccgatttgcacatacgaatgttgagtctctggtg

SEQ ID NO: 91588 - DNA, 36 bp, Artificial Sequence
  Description of Artificial Sequence: Synthetic oligonucleotide
cgatttgcacatacgaatgttgagtctctggtgaac

SEQ ID NO: 91589 - DNA, 36 bp, Artificial Sequence
  Description of Artificial Sequence: Synthetic oligonucleotide
gatttgcacatacgaatgttgagtctctggtgaacg

SEQ ID NO: 91590 - DNA, 37 bp, Artificial Sequence
  Description of Artificial Sequence: Synthetic oligonucleotide
atttgcacatacgaatgttgagtctctggtgaacgag

SEQ ID NO: 91591 - DNA, 36 bp, Artificial Sequence
  Description of Artificial Sequence: Synthetic oligonucleotide
tttgcacatacgaatgttgagtctctggtgaacgag

SEQ ID NO: 91592 - DNA, 35 bp, Artificial Sequence
  Description of Artificial Sequence: Synthetic oligonucleotide
ttgcacatacgaatgttgagtctctggtgaacgag

SEQ ID NO: 91593 - DNA, 34 bp, Artificial Sequence
  Description of Artificial Sequence: Synthetic oligonucleotide
tgcacatacgaatgttgagtctctggtgaacgag

SEQ ID NO: 91594 - DNA, 33 bp, Artificial Sequence
  Description of Artificial Sequence: Synthetic oligonucleotide
gcacatacgaatgttgagtctctggtgaacgag

SEQ ID NO: 91595 - DNA, 36 bp, Artificial Sequence
  Description of Artificial Sequence: Synthetic oligonucleotide
cacatacgaatgttgagtctctggtgaacgagtatg

SEQ ID NO: 91596 - DNA, 38 bp, Artificial Sequence
  Description of Artificial Sequence: Synthetic oligonucleotide
acatacgaatgttgagtctctggtgaacgagtatgatg

SEQ ID NO: 91597 - DNA, 37 bp, Artificial Sequence
  Description of Artificial Sequence: Synthetic oligonucleotide
catacgaatgttgagtctctggtgaacgagtatgatg

SEQ ID NO: 91598 - DNA, 42 bp, Artificial Sequence
  Description of Artificial Sequence: Synthetic oligonucleotide
atacgaatgttgagtctctggtgaacgagtatgatgataatg

SEQ ID NO: 91599 - DNA, 41 bp, Artificial Sequence
  Description of Artificial Sequence: Synthetic oligonucleotide
tacgaatgttgagtctctggtgaacgagtatgatgataatg

SEQ ID NO: 91600 - DNA, 40 bp, Artificial Sequence
  Description of Artificial Sequence: Synthetic oligonucleotide
acgaatgttgagtctctggtgaacgagtatgatgataatg

SEQ ID NO: 91601 - DNA, 39 bp, Artificial Sequence
  Description of Artificial Sequence: Synthetic oligonucleotide
cgaatgttgagtctctggtgaacgagtatgatgataatg

SEQ ID NO: 91602 - DNA, 39 bp, Artificial Sequence
  Description of Artificial Sequence: Synthetic oligonucleotide
gaatgttgagtctctggtgaacgagtatgatgataatgg

SEQ ID NO: 91603 - DNA, 40 bp, Artificial Sequence
  Description of Artificial Sequence: Synthetic oligonucleotide
aatgttgagtctctggtgaacgagtatgatgataatggag

SEQ ID NO: 91604 - DNA, 39 bp, Artificial Sequence
  Description of Artificial Sequence: Synthetic oligonucleotide
atgttgagtctctggtgaacgagtatgatgataatggag

SEQ ID NO: 91605 - DNA, 38 bp, Artificial Sequence
  Description of Artificial Sequence: Synthetic oligonucleotide
tgttgagtctctggtgaacgagtatgatgataatggag

SEQ ID NO: 91606 - DNA, 37 bp, Artificial Sequence
  Description of Artificial Sequence: Synthetic oligonucleotide
gttgagtctctggtgaacgagtatgatgataatggag

SEQ ID NO: 91607 - DNA, 38 bp, Artificial Sequence
  Description of Artificial Sequence: Synthetic oligonucleotide
ttgagtctctggtgaacgagtatgatgataatggagag

SEQ ID NO: 91608 - DNA, 37 bp, Artificial Sequence
  Description of Artificial Sequence: Synthetic oligonucleotide
tgagtctctggtgaacgagtatgatgataatggagag

SEQ ID NO: 91609 - DNA, 36 bp, Artificial Sequence
  Description of Artificial Sequence: Synthetic oligonucleotide
gagtctctggtgaacgagtatgatgataatggagag

SEQ ID NO: 91610 - DNA, 36 bp, Artificial Sequence
  Description of Artificial Sequence: Synthetic oligonucleotide
agtctctggtgaacgagtatgatgataatggagagg

SEQ ID NO: 91611 - DNA, 35 bp, Artificial Sequence
  Description of Artificial Sequence: Synthetic oligonucleotide
gtctctggtgaacgagtatgatgataatggagagg

SEQ ID NO: 91612 - DNA, 35 bp, Artificial Sequence
  Description of Artificial Sequence: Synthetic oligonucleotide
tctctggtgaacgagtatgatgataatggagaggg

SEQ ID NO: 91613 - DNA, 34 bp, Artificial Sequence
  Description of Artificial Sequence: Synthetic oligonucleotide
ctctggtgaacgagtatgatgataatggagaggg

SEQ ID NO: 91614 - DNA, 37 bp, Artificial Sequence
  Description of Artificial Sequence: Synthetic oligonucleotide
tctggtgaacgagtatgatgataatggagagggtatc

SEQ ID NO: 91615 - DNA, 36 bp, Artificial Sequence
  Description of Artificial Sequence: Synthetic oligonucleotide
ctggtgaacgagtatgatgataatggagagggtatc

SEQ ID NO: 91616 - DNA, 38 bp, Artificial Sequence
  Description of Artificial Sequence: Synthetic oligonucleotide
tggtgaacgagtatgatgataatggagagggtatcatc

SEQ ID NO: 91617 - DNA, 37 bp, Artificial Sequence
  Description of Artificial Sequence: Synthetic oligonucleotide
ggtgaacgagtatgatgataatggagagggtatcatc

SEQ ID NO: 91618 - DNA, 43 bp, Artificial Sequence
  Description of Artificial Sequence: Synthetic oligonucleotide
gtgaacgagtatgatgataatggagagggtatcatcttatttc

SEQ ID NO: 91619 - DNA, 43 bp, Artificial Sequence
  Description of Artificial Sequence: Synthetic oligonucleotide
tgaacgagtatgatgataatggagagggtatcatcttatttcg

SEQ ID NO: 91620 - DNA, 42 bp, Artificial Sequence
  Description of Artificial Sequence: Synthetic oligonucleotide
gaacgagtatgatgataatggagagggtatcatcttatttcg

SEQ ID NO: 91621 - DNA, 43 bp, Artificial Sequence
  Description of Artificial Sequence: Synthetic oligonucleotide
aacgagtatgatgataatggagagggtatcatcttatttcgtc

SEQ ID NO: 91622 - DNA, 42 bp, Artificial Sequence
  Description of Artificial Sequence: Synthetic oligonucleotide
acgagtatgatgataatggagagggtatcatcttatttcgtc

SEQ ID NO: 91623 - DNA, 41 bp, Artificial Sequence
  Description of Artificial Sequence: Synthetic oligonucleotide
cgagtatgatgataatggagagggtatcatcttatttcgtc

SEQ ID NO: 91624 - DNA, 41 bp, Artificial Sequence
  Description of Artificial Sequence: Synthetic oligonucleotide
gagtatgatgataatggagagggtatcatcttatttcgtcc

SEQ ID NO: 91625 - DNA, 43 bp, Artificial Sequence
  Description of Artificial Sequence: Synthetic oligonucleotide
agtatgatgataatggagagggtatcatcttatttcgtccttc

SEQ ID NO: 91626 - DNA, 42 bp, Artificial Sequence
  Description of Artificial Sequence: Synthetic oligonucleotide
gtatgatgataatggagagggtatcatcttatttcgtccttc

SEQ ID NO: 91627 - DNA, 43 bp, Artificial Sequence
  Description of Artificial Sequence: Synthetic oligonucleotide
tatgatgataatggagagggtatcatcttatttcgtccttcac

SEQ ID NO: 91628 - DNA, 42 bp, Artificial Sequence
  Description of Artificial Sequence: Synthetic oligonucleotide
atgatgataatggagagggtatcatcttatttcgtccttcac

SEQ ID NO: 91629 - DNA, 41 bp, Artificial Sequence
  Description of Artificial Sequence: Synthetic oligonucleotide
tgatgataatggagagggtatcatcttatttcgtccttcac

SEQ ID NO: 91630 - DNA, 40 bp, Artificial Sequence
  Description of Artificial Sequence: Synthetic oligonucleotide
gatgataatggagagggtatcatcttatttcgtccttcac

SEQ ID NO: 91631 - DNA, 42 bp, Artificial Sequence
  Description of Artificial Sequence: Synthetic oligonucleotide
atgataatggagagggtatcatcttatttcgtccttcacatc

SEQ ID NO: 91632 - DNA, 41 bp, Artificial Sequence
  Description of Artificial Sequence: Synthetic oligonucleotide
tgataatggagagggtatcatcttatttcgtccttcacatc

SEQ ID NO: 91633 - DNA, 40 bp, Artificial Sequence
  Description of Artificial Sequence: Synthetic oligonucleotide
gataatggagagggtatcatcttatttcgtccttcacatc

SEQ ID NO: 91634 - DNA, 41 bp, Artificial Sequence
  Description of Artificial Sequence: Synthetic oligonucleotide
ataatggagagggtatcatcttatttcgtccttcacatctc

SEQ ID NO: 91635 - DNA, 40 bp, Artificial Sequence
  Description of Artificial Sequence: Synthetic oligonucleotide
taatggagagggtatcatcttatttcgtccttcacatctc

SEQ ID NO: 91636 - DNA, 39 bp, Artificial Sequence
  Description of Artificial Sequence: Synthetic oligonucleotide
aatggagagggtatcatcttatttcgtccttcacatctc

SEQ ID NO: 91637 - DNA, 38 bp, Artificial Sequence
  Description of Artificial Sequence: Synthetic oligonucleotide
atggagagggtatcatcttatttcgtccttcacatctc

SEQ ID NO: 91638 - DNA, 37 bp, Artificial Sequence
  Description of Artificial Sequence: Synthetic oligonucleotide
tggagagggtatcatcttatttcgtccttcacatctc

SEQ ID NO: 91639 - DNA, 36 bp, Artificial Sequence
  Description of Artificial Sequence: Synthetic oligonucleotide
ggagagggtatcatcttatttcgtccttcacatctc

SEQ ID NO: 91640 - DNA, 37 bp, Artificial Sequence
  Description of Artificial Sequence: Synthetic oligonucleotide
gagagggtatcatcttatttcgtccttcacatctcac

SEQ ID NO: 91641 - DNA, 40 bp, Artificial Sequence
  Description of Artificial Sequence: Synthetic oligonucleotide
agagggtatcatcttatttcgtccttcacatctcactaac

SEQ ID NO: 91642 - DNA, 39 bp, Artificial Sequence
  Description of Artificial Sequence: Synthetic oligonucleotide
gagggtatcatcttatttcgtccttcacatctcactaac

SEQ ID NO: 91643 - DNA, 41 bp, Artificial Sequence
  Description of Artificial Sequence: Synthetic oligonucleotide
agggtatcatcttatttcgtccttcacatctcactaacaag

SEQ ID NO: 91644 - DNA, 40 bp, Artificial Sequence
  Description of Artificial Sequence: Synthetic oligonucleotide
gggtatcatcttatttcgtccttcacatctcactaacaag

SEQ ID NO: 91645 - DNA, 43 bp, Artificial Sequence
  Description of Artificial Sequence: Synthetic oligonucleotide
ggtatcatcttatttcgtccttcacatctcactaacaagtttg

SEQ ID NO: 91646 - DNA, 44 bp, Artificial Sequence
  Description of Artificial Sequence: Synthetic oligonucleotide
gtatcatcttatttcgtccttcacatctcactaacaagtttgag

SEQ ID NO: 91647 - DNA, 44 bp, Artificial Sequence
  Description of Artificial Sequence: Synthetic oligonucleotide
tatcatcttatttcgtccttcacatctcactaacaagtttgagg

SEQ ID NO: 91648 - DNA, 43 bp, Artificial Sequence
  Description of Artificial Sequence: Synthetic oligonucleotide
atcatcttatttcgtccttcacatctcactaacaagtttgagg

SEQ ID NO: 91649 - DNA, 42 bp, Artificial Sequence
  Description of Artificial Sequence: Synthetic oligonucleotide
tcatcttatttcgtccttcacatctcactaacaagtttgagg

SEQ ID NO: 91650 - DNA, 41 bp, Artificial Sequence
  Description of Artificial Sequence: Synthetic oligonucleotide
catcttatttcgtccttcacatctcactaacaagtttgagg

SEQ ID NO: 91651 - DNA, 42 bp, Artificial Sequence
  Description of Artificial Sequence: Synthetic oligonucleotide
atcttatttcgtccttcacatctcactaacaagtttgaggac

SEQ ID NO: 91652 - DNA, 41 bp, Artificial Sequence
  Description of Artificial Sequence: Synthetic oligonucleotide
tcttatttcgtccttcacatctcactaacaagtttgaggac

SEQ ID NO: 91653 - DNA, 40 bp, Artificial Sequence
  Description of Artificial Sequence: Synthetic oligonucleotide
cttatttcgtccttcacatctcactaacaagtttgaggac

SEQ ID NO: 91654 - DNA, 42 bp, Artificial Sequence
  Description of Artificial Sequence: Synthetic oligonucleotide
ttatttcgtccttcacatctcactaacaagtttgaggacaag

SEQ ID NO: 91655 - DNA, 41 bp, Artificial Sequence
  Description of Artificial Sequence: Synthetic oligonucleotide
tatttcgtccttcacatctcactaacaagtttgaggacaag

SEQ ID NO: 91656 - DNA, 40 bp, Artificial Sequence
  Description of Artificial Sequence: Synthetic oligonucleotide
atttcgtccttcacatctcactaacaagtttgaggacaag

SEQ ID NO: 91657 - DNA, 39 bp, Artificial Sequence
  Description of Artificial Sequence: Synthetic oligonucleotide
tttcgtccttcacatctcactaacaagtttgaggacaag

SEQ ID NO: 91658 - DNA, 38 bp, Artificial Sequence
  Description of Artificial Sequence: Synthetic oligonucleotide
ttcgtccttcacatctcactaacaagtttgaggacaag

SEQ ID NO: 91659 - DNA, 37 bp, Artificial Sequence
  Description of Artificial Sequence: Synthetic oligonucleotide
tcgtccttcacatctcactaacaagtttgaggacaag

SEQ ID NO: 91660 - DNA, 36 bp, Artificial Sequence
  Description of Artificial Sequence: Synthetic oligonucleotide
cgtccttcacatctcactaacaagtttgaggacaag

SEQ ID NO: 91661 - DNA, 37 bp, Artificial Sequence
  Description of Artificial Sequence: Synthetic oligonucleotide
gtccttcacatctcactaacaagtttgaggacaagac

SEQ ID NO: 91662 - DNA, 38 bp, Artificial Sequence
  Description of Artificial Sequence: Synthetic oligonucleotide
tccttcacatctcactaacaagtttgaggacaagactg

SEQ ID NO: 91663 - DNA, 37 bp, Artificial Sequence
  Description of Artificial Sequence: Synthetic oligonucleotide
ccttcacatctcactaacaagtttgaggacaagactg

SEQ ID NO: 91664 - DNA, 38 bp, Artificial Sequence
  Description of Artificial Sequence: Synthetic oligonucleotide
cttcacatctcactaacaagtttgaggacaagactgtg

SEQ ID NO: 91665 - DNA, 38 bp, Artificial Sequence
  Description of Artificial Sequence: Synthetic oligonucleotide
ttcacatctcactaacaagtttgaggacaagactgtgg

SEQ ID NO: 91666 - DNA, 37 bp, Artificial Sequence
  Description of Artificial Sequence: Synthetic oligonucleotide
tcacatctcactaacaagtttgaggacaagactgtgg

SEQ ID NO: 91667 - DNA, 36 bp, Artificial Sequence
  Description of Artificial Sequence: Synthetic oligonucleotide
cacatctcactaacaagtttgaggacaagactgtgg

SEQ ID NO: 91668 - DNA, 36 bp, Artificial Sequence
  Description of Artificial Sequence: Synthetic oligonucleotide
acatctcactaacaagtttgaggacaagactgtggc

SEQ ID NO: 91669 - DNA, 35 bp, Artificial Sequence
  Description of Artificial Sequence: Synthetic oligonucleotide
catctcactaacaagtttgaggacaagactgtggc

SEQ ID NO: 91670 - DNA, 40 bp, Artificial Sequence
  Description of Artificial Sequence: Synthetic oligonucleotide
atctcactaacaagtttgaggacaagactgtggcatatac

SEQ ID NO: 91671 - DNA, 39 bp, Artificial Sequence
  Description of Artificial Sequence: Synthetic oligonucleotide
tctcactaacaagtttgaggacaagactgtggcatatac

SEQ ID NO: 91672 - DNA, 38 bp, Artificial Sequence
  Description of Artificial Sequence: Synthetic oligonucleotide
ctcactaacaagtttgaggacaagactgtggcatatac

SEQ ID NO: 91673 - DNA, 39 bp, Artificial Sequence
  Description of Artificial Sequence: Synthetic oligonucleotide
tcactaacaagtttgaggacaagactgtggcatatacag

SEQ ID NO: 91674 - DNA, 38 bp, Artificial Sequence
  Description of Artificial Sequence: Synthetic oligonucleotide
cactaacaagtttgaggacaagactgtggcatatacag

SEQ ID NO: 91675 - DNA, 39 bp, Artificial Sequence
  Description of Artificial Sequence: Synthetic oligonucleotide
actaacaagtttgaggacaagactgtggcatatacagag

SEQ ID NO: 91676 - DNA, 38 bp, Artificial Sequence
  Description of Artificial Sequence: Synthetic oligonucleotide
ctaacaagtttgaggacaagactgtggcatatacagag

SEQ ID NO: 91677 - DNA, 38 bp, Artificial Sequence
  Description of Artificial Sequence: Synthetic oligonucleotide
taacaagtttgaggacaagactgtggcatatacagagc

SEQ ID NO: 91678 - DNA, 37 bp, Artificial Sequence
  Description of Artificial Sequence: Synthetic oligonucleotide
aacaagtttgaggacaagactgtggcatatacagagc

SEQ ID NO: 91679 - DNA, 36 bp, Artificial Sequence
  Description of Artificial Sequence: Synthetic oligonucleotide
acaagtttgaggacaagactgtggcatatacagagc

SEQ ID NO: 91680 - DNA, 35 bp, Artificial Sequence
  Description of Artificial Sequence: Synthetic oligonucleotide
caagtttgaggacaagactgtggcatatacagagc

SEQ ID NO: 91681 - DNA, 42 bp, Artificial Sequence
  Description of Artificial Sequence: Synthetic oligonucleotide
aagtttgaggacaagactgtggcatatacagagcaaaaaatg

SEQ ID NO: 91682 - DNA, 41 bp, Artificial Sequence
  Description of Artificial Sequence: Synthetic oligonucleotide
agtttgaggacaagactgtggcatatacagagcaaaaaatg

SEQ ID NO: 91683 - DNA, 40 bp, Artificial Sequence
  Description of Artificial Sequence: Synthetic oligonucleotide
gtttgaggacaagactgtggcatatacagagcaaaaaatg

SEQ ID NO: 91684 - DNA, 41 bp, Artificial Sequence
  Description of Artificial Sequence: Synthetic oligonucleotide
tttgaggacaagactgtggcatatacagagcaaaaaatgac

SEQ ID NO: 91685 - DNA, 40 bp, Artificial Sequence
  Description of Artificial Sequence: Synthetic oligonucleotide
ttgaggacaagactgtggcatatacagagcaaaaaatgac

SEQ ID NO: 91686 - DNA, 39 bp, Artificial Sequence
  Description of Artificial Sequence: Synthetic oligonucleotide
tgaggacaagactgtggcatatacagagcaaaaaatgac

SEQ ID NO: 91687 - DNA, 38 bp, Artificial Sequence
  Description of Artificial Sequence: Synthetic oligonucleotide
gaggacaagactgtggcatatacagagcaaaaaatgac

SEQ ID NO: 91688 - DNA, 38 bp, Artificial Sequence
  Description of Artificial Sequence: Synthetic oligonucleotide
aggacaagactgtggcatatacagagcaaaaaatgacc

SEQ ID NO: 91689 - DNA, 37 bp, Artificial Sequence
  Description of Artificial Sequence: Synthetic oligonucleotide
ggacaagactgtggcatatacagagcaaaaaatgacc

SEQ ID NO: 91690 - DNA, 38 bp, Artificial Sequence
  Description of Artificial Sequence: Synthetic oligonucleotide
gacaagactgtggcatatacagagcaaaaaatgaccag

SEQ ID NO: 91691 - DNA, 39 bp, Artificial Sequence
  Description of Artificial Sequence: Synthetic oligonucleotide
acaagactgtggcatatacagagcaaaaaatgaccagtg

SEQ ID NO: 91692 - DNA, 38 bp, Artificial Sequence
  Description of Artificial Sequence: Synthetic oligonucleotide
caagactgtggcatatacagagcaaaaaatgaccagtg

SEQ ID NO: 91693 - DNA, 38 bp, Artificial Sequence
  Description of Artificial Sequence: Synthetic oligonucleotide
aagactgtggcatatacagagcaaaaaatgaccagtgg

SEQ ID NO: 91694 - DNA, 37 bp, Artificial Sequence
  Description of Artificial Sequence: Synthetic oligonucleotide
agactgtggcatatacagagcaaaaaatgaccagtgg

SEQ ID NO: 91695 - DNA, 36 bp, Artificial Sequence
  Description of Artificial Sequence: Synthetic oligonucleotide
gactgtggcatatacagagcaaaaaatgaccagtgg

SEQ ID NO: 91696 - DNA, 36 bp, Artificial Sequence
  Description of Artificial Sequence: Synthetic oligonucleotide
actgtggcatatacagagcaaaaaatgaccagtggc

SEQ ID NO: 91697 - DNA, 35 bp, Artificial Sequence
  Description of Artificial Sequence: Synthetic oligonucleotide
ctgtggcatatacagagcaaaaaatgaccagtggc

SEQ ID NO: 91698 - DNA, 46 bp, Artificial Sequence
  Description of Artificial Sequence: Synthetic oligonucleotide
tgtggcatatacagagcaaaaaatgaccagtggcaaaattaaaaag

SEQ ID NO: 91699 - DNA, 45 bp, Artificial Sequence
  Description of Artificial Sequence: Synthetic oligonucleotide
gtggcatatacagagcaaaaaatgaccagtggcaaaattaaaaag

SEQ ID NO: 91700 - DNA, 50 bp, Artificial Sequence
  Description of Artificial Sequence: Synthetic oligonucleotide
tggcatatacagagcaaaaaatgaccagtggcaaaattaaaaagtttatc

SEQ ID NO: 91701 - DNA, 49 bp, Artificial Sequence
  Description of Artificial Sequence: Synthetic oligonucleotide
ggcatatacagagcaaaaaatgaccagtggcaaaattaaaaagtttatc

SEQ ID NO: 91702 - DNA, 49 bp, Artificial Sequence
  Description of Artificial Sequence: Synthetic oligonucleotide
gcatatacagagcaaaaaatgaccagtggcaaaattaaaaagtttatcc

SEQ ID NO: 91703 - DNA, 50 bp, Artificial Sequence
  Description of Artificial Sequence: Synthetic oligonucleotide
catatacagagcaaaaaatgaccagtggcaaaattaaaaagtttatccag

SEQ ID NO: 91704 - DNA, 50 bp, Artificial Sequence
  Description of Artificial Sequence: Synthetic oligonucleotide
atatacagagcaaaaaatgaccagtggcaaaattaaaaagtttatccagg

SEQ ID NO: 91705 - DNA, 49 bp, Artificial Sequence
  Description of Artificial Sequence: Synthetic oligonucleotide
tatacagagcaaaaaatgaccagtggcaaaattaaaaagtttatccagg

SEQ ID NO: 91706 - DNA, 48 bp, Artificial Sequence
  Description of Artificial Sequence: Synthetic oligonucleotide
atacagagcaaaaaatgaccagtggcaaaattaaaaagtttatccagg

SEQ ID NO: 91707 - DNA, 47 bp, Artificial Sequence
  Description of Artificial Sequence: Synthetic oligonucleotide
tacagagcaaaaaatgaccagtggcaaaattaaaaagtttatccagg

SEQ ID NO: 91708 - DNA, 46 bp, Artificial Sequence
  Description of Artificial Sequence: Synthetic oligonucleotide
acagagcaaaaaatgaccagtggcaaaattaaaaagtttatccagg

SEQ ID NO: 91709 - DNA, 45 bp, Artificial Sequence
  Description of Artificial Sequence: Synthetic oligonucleotide
cagagcaaaaaatgaccagtggcaaaattaaaaagtttatccagg

SEQ ID NO: 91710 - DNA, 49 bp, Artificial Sequence
  Description of Artificial Sequence: Synthetic oligonucleotide
agagcaaaaaatgaccagtggcaaaattaaaaagtttatccaggaaaac

SEQ ID NO: 91711 - DNA, 48 bp, Artificial Sequence
  Description of Artificial Sequence: Synthetic oligonucleotide
gagcaaaaaatgaccagtggcaaaattaaaaagtttatccaggaaaac

SEQ ID NO: 91712 - DNA, 54 bp, Artificial Sequence
  Description of Artificial Sequence: Synthetic oligonucleotide
agcaaaaaatgaccagtggcaaaattaaaaagtttatccaggaaaacatttttg

SEQ ID NO: 91713 - DNA, 53 bp, Artificial Sequence
  Description of Artificial Sequence: Synthetic oligonucleotide
gcaaaaaatgaccagtggcaaaattaaaaagtttatccaggaaaacatttttg

SEQ ID NO: 91714 - DNA, 53 bp, Artificial Sequence
  Description of Artificial Sequence: Synthetic oligonucleotide
caaaaaatgaccagtggcaaaattaaaaagtttatccaggaaaacatttttgg

SEQ ID NO: 91715 - DNA, 56 bp, Artificial Sequence
  Description of Artificial Sequence: Synthetic oligonucleotide
aaaaaatgaccagtggcaaaattaaaaagtttatccaggaaaacatttttggtatc

SEQ ID NO: 91716 - DNA, 55 bp, Artificial Sequence
  Description of Artificial Sequence: Synthetic oligonucleotide
aaaaatgaccagtggcaaaattaaaaagtttatccaggaaaacatttttggtatc

SEQ ID NO: 91717 - DNA, 54 bp, Artificial Sequence
  Description of Artificial Sequence: Synthetic oligonucleotide
aaaatgaccagtggcaaaattaaaaagtttatccaggaaaacatttttggtatc

SEQ ID NO: 91718 - DNA, 53 bp, Artificial Sequence
  Description of Artificial Sequence: Synthetic oligonucleotide
aaatgaccagtggcaaaattaaaaagtttatccaggaaaacatttttggtatc

SEQ ID NO: 91719 - DNA, 52 bp, Artificial Sequence
  Description of Artificial Sequence: Synthetic oligonucleotide
aatgaccagtggcaaaattaaaaagtttatccaggaaaacatttttggtatc

SEQ ID NO: 91720 - DNA, 51 bp, Artificial Sequence
  Description of Artificial Sequence: Synthetic oligonucleotide
atgaccagtggcaaaattaaaaagtttatccaggaaaacatttttggtatc

SEQ ID NO: 91721 - DNA, 50 bp, Artificial Sequence
  Description of Artificial Sequence: Synthetic oligonucleotide
tgaccagtggcaaaattaaaaagtttatccaggaaaacatttttggtatc

SEQ ID NO: 91722 - DNA, 49 bp, Artificial Sequence
  Description of Artificial Sequence: Synthetic oligonucleotide
gaccagtggcaaaattaaaaagtttatccaggaaaacatttttggtatc

SEQ ID NO: 91723 - DNA, 50 bp, Artificial Sequence
  Description of Artificial Sequence: Synthetic oligonucleotide
accagtggcaaaattaaaaagtttatccaggaaaacatttttggtatctg

SEQ ID NO: 91724 - DNA, 49 bp, Artificial Sequence
  Description of Artificial Sequence: Synthetic oligonucleotide
ccagtggcaaaattaaaaagtttatccaggaaaacatttttggtatctg

SEQ ID NO: 91725 - DNA, 49 bp, Artificial Sequence
  Description of Artificial Sequence: Synthetic oligonucleotide
cagtggcaaaattaaaaagtttatccaggaaaacatttttggtatctgc

SEQ ID NO: 91726 - DNA, 49 bp, Artificial Sequence
  Description of Artificial Sequence: Synthetic oligonucleotide
agtggcaaaattaaaaagtttatccaggaaaacatttttggtatctgcc

SEQ ID NO: 91727 - DNA, 48 bp, Artificial Sequence
  Description of Artificial Sequence: Synthetic oligonucleotide
gtggcaaaattaaaaagtttatccaggaaaacatttttggtatctgcc

SEQ ID NO: 91728 - DNA, 48 bp, Artificial Sequence
  Description of Artificial Sequence: Synthetic oligonucleotide
tggcaaaattaaaaagtttatccaggaaaacatttttggtatctgccc

SEQ ID NO: 91729 - DNA, 47 bp, Artificial Sequence
  Description of Artificial Sequence: Synthetic oligonucleotide
ggcaaaattaaaaagtttatccaggaaaacatttttggtatctgccc

SEQ ID NO: 91730 - DNA, 48 bp, Artificial Sequence
  Description of Artificial Sequence: Synthetic oligonucleotide
gcaaaattaaaaagtttatccaggaaaacatttttggtatctgccctc

SEQ ID NO: 91731 - DNA, 49 bp, Artificial Sequence
  Description of Artificial Sequence: Synthetic oligonucleotide
caaaattaaaaagtttatccaggaaaacatttttggtatctgccctcac

SEQ ID NO: 91732 - DNA, 51 bp, Artificial Sequence
  Description of Artificial Sequence: Synthetic oligonucleotide
aaaattaaaaagtttatccaggaaaacatttttggtatctgccctcacatg

SEQ ID NO: 91733 - DNA, 50 bp, Artificial Sequence
  Description of Artificial Sequence: Synthetic oligonucleotide
aaattaaaaagtttatccaggaaaacatttttggtatctgccctcacatg

SEQ ID NO: 91734 - DNA, 49 bp, Artificial Sequence
  Description of Artificial Sequence: Synthetic oligonucleotide
aattaaaaagtttatccaggaaaacatttttggtatctgccctcacatg

SEQ ID NO: 91735 - DNA, 48 bp, Artificial Sequence
  Description of Artificial Sequence: Synthetic oligonucleotide
attaaaaagtttatccaggaaaacatttttggtatctgccctcacatg

SEQ ID NO: 91736 - DNA, 47 bp, Artificial Sequence
  Description of Artificial Sequence: Synthetic oligonucleotide
ttaaaaagtttatccaggaaaacatttttggtatctgccctcacatg

SEQ ID NO: 91737 - DNA, 46 bp, Artificial Sequence
  Description of Artificial Sequence: Synthetic oligonucleotide
taaaaagtttatccaggaaaacatttttggtatctgccctcacatg

SEQ ID NO: 91738 - DNA, 45 bp, Artificial Sequence
  Description of Artificial Sequence: Synthetic oligonucleotide
aaaaagtttatccaggaaaacatttttggtatctgccctcacatg

SEQ ID NO: 91739 - DNA, 44 bp, Artificial Sequence
  Description of Artificial Sequence: Synthetic oligonucleotide
aaaagtttatccaggaaaacatttttggtatctgccctcacatg

SEQ ID NO: 91740 - DNA, 43 bp, Artificial Sequence
  Description of Artificial Sequence: Synthetic oligonucleotide
aaagtttatccaggaaaacatttttggtatctgccctcacatg

SEQ ID NO: 91741 - DNA, 42 bp, Artificial Sequence
  Description of Artificial Sequence: Synthetic oligonucleotide
aagtttatccaggaaaacatttttggtatctgccctcacatg

SEQ ID NO: 91742 - DNA, 41 bp, Artificial Sequence
  Description of Artificial Sequence: Synthetic oligonucleotide
agtttatccaggaaaacatttttggtatctgccctcacatg

SEQ ID NO: 91743 - DNA, 40 bp, Artificial Sequence
  Description of Artificial Sequence: Synthetic oligonucleotide
gtttatccaggaaaacatttttggtatctgccctcacatg

SEQ ID NO: 91744 - DNA, 41 bp, Artificial Sequence
  Description of Artificial Sequence: Synthetic oligonucleotide
tttatccaggaaaacatttttggtatctgccctcacatgac

SEQ ID NO: 91745 - DNA, 40 bp, Artificial Sequence
  Description of Artificial Sequence: Synthetic oligonucleotide
ttatccaggaaaacatttttggtatctgccctcacatgac

SEQ ID NO: 91746 - DNA, 39 bp, Artificial Sequence
  Description of Artificial Sequence: Synthetic oligonucleotide
tatccaggaaaacatttttggtatctgccctcacatgac

SEQ ID NO: 91747 - DNA, 38 bp, Artificial Sequence
  Description of Artificial Sequence: Synthetic oligonucleotide
atccaggaaaacatttttggtatctgccctcacatgac

SEQ ID NO: 91748 - DNA, 37 bp, Artificial Sequence
  Description of Artificial Sequence: Synthetic oligonucleotide
tccaggaaaacatttttggtatctgccctcacatgac

SEQ ID NO: 91749 - DNA, 36 bp, Artificial Sequence
  Description of Artificial Sequence: Synthetic oligonucleotide
ccaggaaaacatttttggtatctgccctcacatgac

SEQ ID NO: 91750 - DNA, 37 bp, Artificial Sequence
  Description of Artificial Sequence: Synthetic oligonucleotide
caggaaaacatttttggtatctgccctcacatgacag

SEQ ID NO: 91751 - DNA, 39 bp, Artificial Sequence
  Description of Artificial Sequence: Synthetic oligonucleotide
aggaaaacatttttggtatctgccctcacatgacagaag

SEQ ID NO: 91752 - DNA, 38 bp, Artificial Sequence
  Description of Artificial Sequence: Synthetic oligonucleotide
ggaaaacatttttggtatctgccctcacatgacagaag

SEQ ID NO: 91753 - DNA, 39 bp, Artificial Sequence
  Description of Artificial Sequence: Synthetic oligonucleotide
gaaaacatttttggtatctgccctcacatgacagaagac

SEQ ID NO: 91754 - DNA, 45 bp, Artificial Sequence
  Description of Artificial Sequence: Synthetic oligonucleotide
aaaacatttttggtatctgccctcacatgacagaagacaataaag

SEQ ID NO: 91755 - DNA, 44 bp, Artificial Sequence
  Description of Artificial Sequence: Synthetic oligonucleotide
aaacatttttggtatctgccctcacatgacagaagacaataaag

SEQ ID NO: 91756 - DNA, 43 bp, Artificial Sequence
  Description of Artificial Sequence: Synthetic oligonucleotide
aacatttttggtatctgccctcacatgacagaagacaataaag

SEQ ID NO: 91757 - DNA, 42 bp, Artificial Sequence
  Description of Artificial Sequence: Synthetic oligonucleotide
acatttttggtatctgccctcacatgacagaagacaataaag

SEQ ID NO: 91758 - DNA, 41 bp, Artificial Sequence
  Description of Artificial Sequence: Synthetic oligonucleotide
catttttggtatctgccctcacatgacagaagacaataaag

SEQ ID NO: 91759 - DNA, 45 bp, Artificial Sequence
  Description of Artificial Sequence: Synthetic oligonucleotide
atttttggtatctgccctcacatgacagaagacaataaagatttg

SEQ ID NO: 91760 - DNA, 44 bp, Artificial Sequence
  Description of Artificial Sequence: Synthetic oligonucleotide
tttttggtatctgccctcacatgacagaagacaataaagatttg

SEQ ID NO: 91761 - DNA, 43 bp, Artificial Sequence
  Description of Artificial Sequence: Synthetic oligonucleotide
ttttggtatctgccctcacatgacagaagacaataaagatttg

SEQ ID NO: 91762 - DNA, 42 bp, Artificial Sequence
  Description of Artificial Sequence: Synthetic oligonucleotide
tttggtatctgccctcacatgacagaagacaataaagatttg

SEQ ID NO: 91763 - DNA, 41 bp, Artificial Sequence
  Description of Artificial Sequence: Synthetic oligonucleotide
ttggtatctgccctcacatgacagaagacaataaagatttg

SEQ ID NO: 91764 - DNA, 40 bp, Artificial Sequence
  Description of Artificial Sequence: Synthetic oligonucleotide
tggtatctgccctcacatgacagaagacaataaagatttg

SEQ ID NO: 91765 - DNA, 39 bp, Artificial Sequence
  Description of Artificial Sequence: Synthetic oligonucleotide
ggtatctgccctcacatgacagaagacaataaagatttg

SEQ ID NO: 91766 - DNA, 42 bp, Artificial Sequence
  Description of Artificial Sequence: Synthetic oligonucleotide
gtatctgccctcacatgacagaagacaataaagatttgatac

SEQ ID NO: 91767 - DNA, 43 bp, Artificial Sequence
  Description of Artificial Sequence: Synthetic oligonucleotide
tatctgccctcacatgacagaagacaataaagatttgatacag

SEQ ID NO: 91768 - DNA, 42 bp, Artificial Sequence
  Description of Artificial Sequence: Synthetic oligonucleotide
atctgccctcacatgacagaagacaataaagatttgatacag

SEQ ID NO: 91769 - DNA, 41 bp, Artificial Sequence
  Description of Artificial Sequence: Synthetic oligonucleotide
tctgccctcacatgacagaagacaataaagatttgatacag

SEQ ID NO: 91770 - DNA, 40 bp, Artificial Sequence
  Description of Artificial Sequence: Synthetic oligonucleotide
ctgccctcacatgacagaagacaataaagatttgatacag

SEQ ID NO: 91771 - DNA, 40 bp, Artificial Sequence
  Description of Artificial Sequence: Synthetic oligonucleotide
tgccctcacatgacagaagacaataaagatttgatacagg

SEQ ID NO: 91772 - DNA, 39 bp, Artificial Sequence
  Description of Artificial Sequence: Synthetic oligonucleotide
gccctcacatgacagaagacaataaagatttgatacagg

SEQ ID NO: 91773 - DNA, 39 bp, Artificial Sequence
  Description of Artificial Sequence: Synthetic oligonucleotide
ccctcacatgacagaagacaataaagatttgatacaggg

SEQ ID NO: 91774 - DNA, 39 bp, Artificial Sequence
  Description of Artificial Sequence: Synthetic oligonucleotide
cctcacatgacagaagacaataaagatttgatacagggc

SEQ ID NO: 91775 - DNA, 41 bp, Artificial Sequence
  Description of Artificial Sequence: Synthetic oligonucleotide
ctcacatgacagaagacaataaagatttgatacagggcaag

SEQ ID NO: 91776 - DNA, 41 bp, Artificial Sequence
  Description of Artificial Sequence: Synthetic oligonucleotide
tcacatgacagaagacaataaagatttgatacagggcaagg

SEQ ID NO: 91777 - DNA, 40 bp, Artificial Sequence
  Description of Artificial Sequence: Synthetic oligonucleotide
cacatgacagaagacaataaagatttgatacagggcaagg

SEQ ID NO: 91778 - DNA, 41 bp, Artificial Sequence
  Description of Artificial Sequence: Synthetic oligonucleotide
acatgacagaagacaataaagatttgatacagggcaaggac

SEQ ID NO: 91779 - DNA, 40 bp, Artificial Sequence
  Description of Artificial Sequence: Synthetic oligonucleotide
catgacagaagacaataaagatttgatacagggcaaggac

SEQ ID NO: 91780 - DNA, 43 bp, Artificial Sequence
  Description of Artificial Sequence: Synthetic oligonucleotide
atgacagaagacaataaagatttgatacagggcaaggacttac

SEQ ID NO: 91781 - DNA, 42 bp, Artificial Sequence
  Description of Artificial Sequence: Synthetic oligonucleotide
tgacagaagacaataaagatttgatacagggcaaggacttac

SEQ ID NO: 91782 - DNA, 41 bp, Artificial Sequence
  Description of Artificial Sequence: Synthetic oligonucleotide
gacagaagacaataaagatttgatacagggcaaggacttac

SEQ ID NO: 91783 - DNA, 46 bp, Artificial Sequence
  Description of Artificial Sequence: Synthetic oligonucleotide
acagaagacaataaagatttgatacagggcaaggacttacttattg

SEQ ID NO: 91784 - DNA, 45 bp, Artificial Sequence
  Description of Artificial Sequence: Synthetic oligonucleotide
cagaagacaataaagatttgatacagggcaaggacttacttattg

SEQ ID NO: 91785 - DNA, 45 bp, Artificial Sequence
  Description of Artificial Sequence: Synthetic oligonucleotide
agaagacaataaagatttgatacagggcaaggacttacttattgc

SEQ ID NO: 91786 - DNA, 44 bp, Artificial Sequence
  Description of Artificial Sequence: Synthetic oligonucleotide
gaagacaataaagatttgatacagggcaaggacttacttattgc

SEQ ID NO: 91787 - DNA, 47 bp, Artificial Sequence
  Description of Artificial Sequence: Synthetic oligonucleotide
aagacaataaagatttgatacagggcaaggacttacttattgcttac

SEQ ID NO: 91788 - DNA, 46 bp, Artificial Sequence
  Description of Artificial Sequence: Synthetic oligonucleotide
agacaataaagatttgatacagggcaaggacttacttattgcttac

SEQ ID NO: 91789 - DNA, 45 bp, Artificial Sequence
  Description of Artificial Sequence: Synthetic oligonucleotide
gacaataaagatttgatacagggcaaggacttacttattgcttac

SEQ ID NO: 91790 - DNA, 48 bp, Artificial Sequence
  Description of Artificial Sequence: Synthetic oligonucleotide
acaataaagatttgatacagggcaaggacttacttattgcttactatg

SEQ ID NO: 91791 - DNA, 47 bp, Artificial Sequence
  Description of Artificial Sequence: Synthetic oligonucleotide
caataaagatttgatacagggcaaggacttacttattgcttactatg

SEQ ID NO: 91792 - DNA, 49 bp, Artificial Sequence
  Description of Artificial Sequence: Synthetic oligonucleotide
aataaagatttgatacagggcaaggacttacttattgcttactatgatg

SEQ ID NO: 91793 - DNA, 48 bp, Artificial Sequence
  Description of Artificial Sequence: Synthetic oligonucleotide
ataaagatttgatacagggcaaggacttacttattgcttactatgatg

SEQ ID NO: 91794 - DNA, 47 bp, Artificial Sequence
  Description of Artificial Sequence: Synthetic oligonucleotide
taaagatttgatacagggcaaggacttacttattgcttactatgatg

SEQ ID NO: 91795 - DNA, 46 bp, Artificial Sequence
  Description of Artificial Sequence: Synthetic oligonucleotide
aaagatttgatacagggcaaggacttacttattgcttactatgatg

SEQ ID NO: 91796 - DNA, 45 bp, Artificial Sequence
  Description of Artificial Sequence: Synthetic oligonucleotide
aagatttgatacagggcaaggacttacttattgcttactatgatg

SEQ ID NO: 91797 - DNA, 44 bp, Artificial Sequence
  Description of Artificial Sequence: Synthetic oligonucleotide
agatttgatacagggcaaggacttacttattgcttactatgatg

SEQ ID NO: 91798 - DNA, 43 bp, Artificial Sequence
  Description of Artificial Sequence: Synthetic oligonucleotide
gatttgatacagggcaaggacttacttattgcttactatgatg

SEQ ID NO: 91799 - DNA, 44 bp, Artificial Sequence
  Description of Artificial Sequence: Synthetic oligonucleotide
atttgatacagggcaaggacttacttattgcttactatgatgtg

SEQ ID NO: 91800 - DNA, 43 bp, Artificial Sequence
  Description of Artificial Sequence: Synthetic oligonucleotide
tttgatacagggcaaggacttacttattgcttactatgatgtg

SEQ ID NO: 91801 - DNA, 42 bp, Artificial Sequence
  Description of Artificial Sequence: Synthetic oligonucleotide
ttgatacagggcaaggacttacttattgcttactatgatgtg

SEQ ID NO: 91802 - DNA, 41 bp, Artificial Sequence
  Description of Artificial Sequence: Synthetic oligonucleotide
tgatacagggcaaggacttacttattgcttactatgatgtg

SEQ ID NO: 91803 - DNA, 40 bp, Artificial Sequence
  Description of Artificial Sequence: Synthetic oligonucleotide
gatacagggcaaggacttacttattgcttactatgatgtg

SEQ ID NO: 91804 - DNA, 40 bp, Artificial Sequence
  Description of Artificial Sequence: Synthetic oligonucleotide
atacagggcaaggacttacttattgcttactatgatgtgg

SEQ ID NO: 91805 - DNA, 39 bp, Artificial Sequence
  Description of Artificial Sequence: Synthetic oligonucleotide
tacagggcaaggacttacttattgcttactatgatgtgg

SEQ ID NO: 91806 - DNA, 38 bp, Artificial Sequence
  Description of Artificial Sequence: Synthetic oligonucleotide
acagggcaaggacttacttattgcttactatgatgtgg

SEQ ID NO: 91807 - DNA, 37 bp, Artificial Sequence
  Description of Artificial Sequence: Synthetic oligonucleotide
cagggcaaggacttacttattgcttactatgatgtgg

SEQ ID NO: 91808 - DNA, 38 bp, Artificial Sequence
  Description of Artificial Sequence: Synthetic oligonucleotide
agggcaaggacttacttattgcttactatgatgtggac

SEQ ID NO: 91809 - DNA, 37 bp, Artificial Sequence
  Description of Artificial Sequence: Synthetic oligonucleotide
gggcaaggacttacttattgcttactatgatgtggac

SEQ ID NO: 91810 - DNA, 40 bp, Artificial Sequence
  Description of Artificial Sequence: Synthetic oligonucleotide
ggcaaggacttacttattgcttactatgatgtggactatg

SEQ ID NO: 91811 - DNA, 44 bp, Artificial Sequence
  Description of Artificial Sequence: Synthetic oligonucleotide
gcaaggacttacttattgcttactatgatgtggactatgaaaag

SEQ ID NO: 91812 - DNA, 46 bp, Artificial Sequence
  Description of Artificial Sequence: Synthetic oligonucleotide
caaggacttacttattgcttactatgatgtggactatgaaaagaac

SEQ ID NO: 91813 - DNA, 46 bp, Artificial Sequence
  Description of Artificial Sequence: Synthetic oligonucleotide
aaggacttacttattgcttactatgatgtggactatgaaaagaacg

SEQ ID NO: 91814 - DNA, 45 bp, Artificial Sequence
  Description of Artificial Sequence: Synthetic oligonucleotide
aggacttacttattgcttactatgatgtggactatgaaaagaacg

SEQ ID NO: 91815 - DNA, 44 bp, Artificial Sequence
  Description of Artificial Sequence: Synthetic oligonucleotide
ggacttacttattgcttactatgatgtggactatgaaaagaacg

SEQ ID NO: 91816 - DNA, 44 bp, Artificial Sequence
  Description of Artificial Sequence: Synthetic oligonucleotide
gacttacttattgcttactatgatgtggactatgaaaagaacgc

SEQ ID NO: 91817 - DNA, 48 bp, Artificial Sequence
  Description of Artificial Sequence: Synthetic oligonucleotide
acttacttattgcttactatgatgtggactatgaaaagaacgctaaag

SEQ ID NO: 91818 - DNA, 47 bp, Artificial Sequence
  Description of Artificial Sequence: Synthetic oligonucleotide
cttacttattgcttactatgatgtggactatgaaaagaacgctaaag

SEQ ID NO: 91819 - DNA, 47 bp, Artificial Sequence
  Description of Artificial Sequence: Synthetic oligonucleotide
ttacttattgcttactatgatgtggactatgaaaagaacgctaaagg

SEQ ID NO: 91820 - DNA, 46 bp, Artificial Sequence
  Description of Artificial Sequence: Synthetic oligonucleotide
tacttattgcttactatgatgtggactatgaaaagaacgctaaagg

SEQ ID NO: 91821 - DNA, 45 bp, Artificial Sequence
  Description of Artificial Sequence: Synthetic oligonucleotide
acttattgcttactatgatgtggactatgaaaagaacgctaaagg

SEQ ID NO: 91822 - DNA, 44 bp, Artificial Sequence
  Description of Artificial Sequence: Synthetic oligonucleotide
cttattgcttactatgatgtggactatgaaaagaacgctaaagg

SEQ ID NO: 91823 - DNA, 46 bp, Artificial Sequence
  Description of Artificial Sequence: Synthetic oligonucleotide
ttattgcttactatgatgtggactatgaaaagaacgctaaaggttc

SEQ ID NO: 91824 - DNA, 45 bp, Artificial Sequence
  Description of Artificial Sequence: Synthetic oligonucleotide
tattgcttactatgatgtggactatgaaaagaacgctaaaggttc

SEQ ID NO: 91825 - DNA, 44 bp, Artificial Sequence
  Description of Artificial Sequence: Synthetic oligonucleotide
attgcttactatgatgtggactatgaaaagaacgctaaaggttc

SEQ ID NO: 91826 - DNA, 43 bp, Artificial Sequence
  Description of Artificial Sequence: Synthetic oligonucleotide
ttgcttactatgatgtggactatgaaaagaacgctaaaggttc

SEQ ID NO: 91827 - DNA, 42 bp, Artificial Sequence
  Description of Artificial Sequence: Synthetic oligonucleotide
tgcttactatgatgtggactatgaaaagaacgctaaaggttc

SEQ ID NO: 91828 - DNA, 41 bp, Artificial Sequence
  Description of Artificial Sequence: Synthetic oligonucleotide
gcttactatgatgtggactatgaaaagaacgctaaaggttc

SEQ ID NO: 91829 - DNA, 41 bp, Artificial Sequence
  Description of Artificial Sequence: Synthetic oligonucleotide
cttactatgatgtggactatgaaaagaacgctaaaggttcc

SEQ ID NO: 91830 - DNA, 43 bp, Artificial Sequence
  Description of Artificial Sequence: Synthetic oligonucleotide
ttactatgatgtggactatgaaaagaacgctaaaggttccaac

SEQ ID NO: 91831 - DNA, 42 bp, Artificial Sequence
  Description of Artificial Sequence: Synthetic oligonucleotide
tactatgatgtggactatgaaaagaacgctaaaggttccaac

SEQ ID NO: 91832 - DNA, 41 bp, Artificial Sequence
  Description of Artificial Sequence: Synthetic oligonucleotide
actatgatgtggactatgaaaagaacgctaaaggttccaac

SEQ ID NO: 91833 - DNA, 40 bp, Artificial Sequence
  Description of Artificial Sequence: Synthetic oligonucleotide
ctatgatgtggactatgaaaagaacgctaaaggttccaac

SEQ ID NO: 91834 - DNA, 42 bp, Artificial Sequence
  Description of Artificial Sequence: Synthetic oligonucleotide
tatgatgtggactatgaaaagaacgctaaaggttccaactac

SEQ ID NO: 91835 - DNA, 41 bp, Artificial Sequence
  Description of Artificial Sequence: Synthetic oligonucleotide
atgatgtggactatgaaaagaacgctaaaggttccaactac

SEQ ID NO: 91836 - DNA, 40 bp, Artificial Sequence
  Description of Artificial Sequence: Synthetic oligonucleotide
tgatgtggactatgaaaagaacgctaaaggttccaactac

SEQ ID NO: 91837 - DNA, 39 bp, Artificial Sequence
  Description of Artificial Sequence: Synthetic oligonucleotide
gatgtggactatgaaaagaacgctaaaggttccaactac

SEQ ID NO: 91838 - DNA, 40 bp, Artificial Sequence
  Description of Artificial Sequence: Synthetic oligonucleotide
atgtggactatgaaaagaacgctaaaggttccaactactg

SEQ ID NO: 91839 - DNA, 39 bp, Artificial Sequence
  Description of Artificial Sequence: Synthetic oligonucleotide
tgtggactatgaaaagaacgctaaaggttccaactactg

SEQ ID NO: 91840 - DNA, 38 bp, Artificial Sequence
  Description of Artificial Sequence: Synthetic oligonucleotide
gtggactatgaaaagaacgctaaaggttccaactactg

SEQ ID NO: 91841 - DNA, 38 bp, Artificial Sequence
  Description of Artificial Sequence: Synthetic oligonucleotide
tggactatgaaaagaacgctaaaggttccaactactgg

SEQ ID NO: 91842 - DNA, 37 bp, Artificial Sequence
  Description of Artificial Sequence: Synthetic oligonucleotide
ggactatgaaaagaacgctaaaggttccaactactgg

SEQ ID NO: 91843 - DNA, 38 bp, Artificial Sequence
  Description of Artificial Sequence: Synthetic oligonucleotide
gactatgaaaagaacgctaaaggttccaactactggag

SEQ ID NO: 91844 - DNA, 41 bp, Artificial Sequence
  Description of Artificial Sequence: Synthetic oligonucleotide
actatgaaaagaacgctaaaggttccaactactggagaaac

SEQ ID NO: 91845 - DNA, 40 bp, Artificial Sequence
  Description of Artificial Sequence: Synthetic oligonucleotide
ctatgaaaagaacgctaaaggttccaactactggagaaac

SEQ ID NO: 91846 - DNA, 41 bp, Artificial Sequence
  Description of Artificial Sequence: Synthetic oligonucleotide
tatgaaaagaacgctaaaggttccaactactggagaaacag

SEQ ID NO: 91847 - DNA, 40 bp, Artificial Sequence
  Description of Artificial Sequence: Synthetic oligonucleotide
atgaaaagaacgctaaaggttccaactactggagaaacag

SEQ ID NO: 91848 - DNA, 39 bp, Artificial Sequence
  Description of Artificial Sequence: Synthetic oligonucleotide
tgaaaagaacgctaaaggttccaactactggagaaacag

SEQ ID NO: 91849 - DNA, 38 bp, Artificial Sequence
  Description of Artificial Sequence: Synthetic oligonucleotide
gaaaagaacgctaaaggttccaactactggagaaacag

SEQ ID NO: 91850 - DNA, 38 bp, Artificial Sequence
  Description of Artificial Sequence: Synthetic oligonucleotide
aaaagaacgctaaaggttccaactactggagaaacagg

SEQ ID NO: 91851 - DNA, 37 bp, Artificial Sequence
  Description of Artificial Sequence: Synthetic oligonucleotide
aaagaacgctaaaggttccaactactggagaaacagg

SEQ ID NO: 91852 - DNA, 36 bp, Artificial Sequence
  Description of Artificial Sequence: Synthetic oligonucleotide
aagaacgctaaaggttccaactactggagaaacagg

SEQ ID NO: 91853 - DNA, 35 bp, Artificial Sequence
  Description of Artificial Sequence: Synthetic oligonucleotide
agaacgctaaaggttccaactactggagaaacagg

SEQ ID NO: 91854 - DNA, 34 bp, Artificial Sequence
  Description of Artificial Sequence: Synthetic oligonucleotide
gaacgctaaaggttccaactactggagaaacagg

SEQ ID NO: 91855 - DNA, 34 bp, Artificial Sequence
  Description of Artificial Sequence: Synthetic oligonucleotide
aacgctaaaggttccaactactggagaaacaggg

SEQ ID NO: 91856 - DNA, 33 bp, Artificial Sequence
  Description of Artificial Sequence: Synthetic oligonucleotide
acgctaaaggttccaactactggagaaacaggg

SEQ ID NO: 91857 - DNA, 32 bp, Artificial Sequence
  Description of Artificial Sequence: Synthetic oligonucleotide
cgctaaaggttccaactactggagaaacaggg

SEQ ID NO: 91858 - DNA, 36 bp, Artificial Sequence
  Description of Artificial Sequence: Synthetic oligonucleotide
gctaaaggttccaactactggagaaacagggtaatg

SEQ ID NO: 91859 - DNA, 38 bp, Artificial Sequence
  Description of Artificial Sequence: Synthetic oligonucleotide
ctaaaggttccaactactggagaaacagggtaatgatg

SEQ ID NO: 91860 - DNA, 38 bp, Artificial Sequence
  Description of Artificial Sequence: Synthetic oligonucleotide
taaaggttccaactactggagaaacagggtaatgatgg

SEQ ID NO: 91861 - DNA, 37 bp, Artificial Sequence
  Description of Artificial Sequence: Synthetic oligonucleotide
aaaggttccaactactggagaaacagggtaatgatgg

SEQ ID NO: 91862 - DNA, 36 bp, Artificial Sequence
  Description of Artificial Sequence: Synthetic oligonucleotide
aaggttccaactactggagaaacagggtaatgatgg

SEQ ID NO: 91863 - DNA, 35 bp, Artificial Sequence
  Description of Artificial Sequence: Synthetic oligonucleotide
aggttccaactactggagaaacagggtaatgatgg

SEQ ID NO: 91864 - DNA, 34 bp, Artificial Sequence
  Description of Artificial Sequence: Synthetic oligonucleotide
ggttccaactactggagaaacagggtaatgatgg

SEQ ID NO: 91865 - DNA, 35 bp, Artificial Sequence
  Description of Artificial Sequence: Synthetic oligonucleotide
gttccaactactggagaaacagggtaatgatggtg

SEQ ID NO: 91866 - DNA, 35 bp, Artificial Sequence
  Description of Artificial Sequence: Synthetic oligonucleotide
ttccaactactggagaaacagggtaatgatggtgg

SEQ ID NO: 91867 - DNA, 34 bp, Artificial Sequence
  Description of Artificial Sequence: Synthetic oligonucleotide
tccaactactggagaaacagggtaatgatggtgg

SEQ ID NO: 91868 - DNA, 33 bp, Artificial Sequence
  Description of Artificial Sequence: Synthetic oligonucleotide
ccaactactggagaaacagggtaatgatggtgg

SEQ ID NO: 91869 - DNA, 33 bp, Artificial Sequence
  Description of Artificial Sequence: Synthetic oligonucleotide
caactactggagaaacagggtaatgatggtggc

SEQ ID NO: 91870 - DNA, 36 bp, Artificial Sequence
  Description of Artificial Sequence: Synthetic oligonucleotide
aactactggagaaacagggtaatgatggtggcaaag

SEQ ID NO: 91871 - DNA, 35 bp, Artificial Sequence
  Description of Artificial Sequence: Synthetic oligonucleotide
actactggagaaacagggtaatgatggtggcaaag

SEQ ID NO: 91872 - DNA, 34 bp, Artificial Sequence
  Description of Artificial Sequence: Synthetic oligonucleotide
ctactggagaaacagggtaatgatggtggcaaag

SEQ ID NO: 91873 - DNA, 39 bp, Artificial Sequence
  Description of Artificial Sequence: Synthetic oligonucleotide
tactggagaaacagggtaatgatggtggcaaagaaattc

SEQ ID NO: 91874 - DNA, 38 bp, Artificial Sequence
  Description of Artificial Sequence: Synthetic oligonucleotide
actggagaaacagggtaatgatggtggcaaagaaattc

SEQ ID NO: 91875 - DNA, 37 bp, Artificial Sequence
  Description of Artificial Sequence: Synthetic oligonucleotide
ctggagaaacagggtaatgatggtggcaaagaaattc

SEQ ID NO: 91876 - DNA, 37 bp, Artificial Sequence
  Description of Artificial Sequence: Synthetic oligonucleotide
tggagaaacagggtaatgatggtggcaaagaaattcc

SEQ ID NO: 91877 - DNA, 36 bp, Artificial Sequence
  Description of Artificial Sequence: Synthetic oligonucleotide
ggagaaacagggtaatgatggtggcaaagaaattcc

SEQ ID NO: 91878 - DNA, 37 bp, Artificial Sequence
  Description of Artificial Sequence: Synthetic oligonucleotide
gagaaacagggtaatgatggtggcaaagaaattcctg

SEQ ID NO: 91879 - DNA, 37 bp, Artificial Sequence
  Description of Artificial Sequence: Synthetic oligonucleotide
agaaacagggtaatgatggtggcaaagaaattcctgg

SEQ ID NO: 91880 - DNA, 36 bp, Artificial Sequence
  Description of Artificial Sequence: Synthetic oligonucleotide
gaaacagggtaatgatggtggcaaagaaattcctgg

SEQ ID NO: 91881 - DNA, 38 bp, Artificial Sequence
  Description of Artificial Sequence: Synthetic oligonucleotide
aaacagggtaatgatggtggcaaagaaattcctggatg

SEQ ID NO: 91882 - DNA, 37 bp, Artificial Sequence
  Description of Artificial Sequence: Synthetic oligonucleotide
aacagggtaatgatggtggcaaagaaattcctggatg

SEQ ID NO: 91883 - DNA, 36 bp, Artificial Sequence
  Description of Artificial Sequence: Synthetic oligonucleotide
acagggtaatgatggtggcaaagaaattcctggatg

SEQ ID NO: 91884 - DNA, 35 bp, Artificial Sequence
  Description of Artificial Sequence: Synthetic oligonucleotide
cagggtaatgatggtggcaaagaaattcctggatg

SEQ ID NO: 91885 - DNA, 35 bp, Artificial Sequence
  Description of Artificial Sequence: Synthetic oligonucleotide
agggtaatgatggtggcaaagaaattcctggatgc

SEQ ID NO: 91886 - DNA, 34 bp, Artificial Sequence
  Description of Artificial Sequence: Synthetic oligonucleotide
gggtaatgatggtggcaaagaaattcctggatgc

SEQ ID NO: 91887 - DNA, 35 bp, Artificial Sequence
  Description of Artificial Sequence: Synthetic oligonucleotide
ggtaatgatggtggcaaagaaattcctggatgctg

SEQ ID NO: 91888 - DNA, 35 bp, Artificial Sequence
  Description of Artificial Sequence: Synthetic oligonucleotide
gtaatgatggtggcaaagaaattcctggatgctgg

SEQ ID NO: 91889 - DNA, 35 bp, Artificial Sequence
  Description of Artificial Sequence: Synthetic oligonucleotide
taatgatggtggcaaagaaattcctggatgctggg

SEQ ID NO: 91890 - DNA, 34 bp, Artificial Sequence
  Description of Artificial Sequence: Synthetic oligonucleotide
aatgatggtggcaaagaaattcctggatgctggg

SEQ ID NO: 91891 - DNA, 33 bp, Artificial Sequence
  Description of Artificial Sequence: Synthetic oligonucleotide
atgatggtggcaaagaaattcctggatgctggg

SEQ ID NO: 91892 - DNA, 32 bp, Artificial Sequence
  Description of Artificial Sequence: Synthetic oligonucleotide
tgatggtggcaaagaaattcctggatgctggg

SEQ ID NO: 91893 - DNA, 31 bp, Artificial Sequence
  Description of Artificial Sequence: Synthetic oligonucleotide
gatggtggcaaagaaattcctggatgctggg

SEQ ID NO: 91894 - DNA, 31 bp, Artificial Sequence
  Description of Artificial Sequence: Synthetic oligonucleotide
atggtggcaaagaaattcctggatgctgggc

SEQ ID NO: 91895 - DNA, 30 bp, Artificial Sequence
  Description of Artificial Sequence: Synthetic oligonucleotide
tggtggcaaagaaattcctggatgctgggc

SEQ ID NO: 91896 - DNA, 29 bp, Artificial Sequence
  Description of Artificial Sequence: Synthetic oligonucleotide
ggtggcaaagaaattcctggatgctgggc

SEQ ID NO: 91897 - DNA, 30 bp, Artificial Sequence
  Description of Artificial Sequence: Synthetic oligonucleotide
gtggcaaagaaattcctggatgctgggcac

SEQ ID NO: 91898 - DNA, 33 bp, Artificial Sequence
  Description of Artificial Sequence: Synthetic oligonucleotide
tggcaaagaaattcctggatgctgggcacaaac

SEQ ID NO: 91899 - DNA, 32 bp, Artificial Sequence
  Description of Artificial Sequence: Synthetic oligonucleotide
ggcaaagaaattcctggatgctgggcacaaac

SEQ ID NO: 91900 - DNA, 33 bp, Artificial Sequence
  Description of Artificial Sequence: Synthetic oligonucleotide
gcaaagaaattcctggatgctgggcacaaactc

SEQ ID NO: 91901 - DNA, 35 bp, Artificial Sequence
  Description of Artificial Sequence: Synthetic oligonucleotide
caaagaaattcctggatgctgggcacaaactcaac

SEQ ID NO: 91902 - DNA, 38 bp, Artificial Sequence
  Description of Artificial Sequence: Synthetic oligonucleotide
aaagaaattcctggatgctgggcacaaactcaactttg

SEQ ID NO: 91903 - DNA, 37 bp, Artificial Sequence
  Description of Artificial Sequence: Synthetic oligonucleotide
aagaaattcctggatgctgggcacaaactcaactttg

SEQ ID NO: 91904 - DNA, 36 bp, Artificial Sequence
  Description of Artificial Sequence: Synthetic oligonucleotide
agaaattcctggatgctgggcacaaactcaactttg

SEQ ID NO: 91905 - DNA, 35 bp, Artificial Sequence
  Description of Artificial Sequence: Synthetic oligonucleotide
gaaattcctggatgctgggcacaaactcaactttg

SEQ ID NO: 91906 - DNA, 35 bp, Artificial Sequence
  Description of Artificial Sequence: Synthetic oligonucleotide
aaattcctggatgctgggcacaaactcaactttgc

SEQ ID NO: 91907 - DNA, 34 bp, Artificial Sequence
  Description of Artificial Sequence: Synthetic oligonucleotide
aattcctggatgctgggcacaaactcaactttgc

SEQ ID NO: 91908 - DNA, 33 bp, Artificial Sequence
  Description of Artificial Sequence: Synthetic oligonucleotide
attcctggatgctgggcacaaactcaactttgc

SEQ ID NO: 91909 - DNA, 32 bp, Artificial Sequence
  Description of Artificial Sequence: Synthetic oligonucleotide
ttcctggatgctgggcacaaactcaactttgc

SEQ ID NO: 91910 - DNA, 31 bp, Artificial Sequence
  Description of Artificial Sequence: Synthetic oligonucleotide
tcctggatgctgggcacaaactcaactttgc

SEQ ID NO: 91911 - DNA, 30 bp, Artificial Sequence
  Description of Artificial Sequence: Synthetic oligonucleotide
cctggatgctgggcacaaactcaactttgc

SEQ ID NO: 91912 - DNA, 31 bp, Artificial Sequence
  Description of Artificial Sequence: Synthetic oligonucleotide
ctggatgctgggcacaaactcaactttgctg

SEQ ID NO: 91913 - DNA, 33 bp, Artificial Sequence
  Description of Artificial Sequence: Synthetic oligonucleotide
tggatgctgggcacaaactcaactttgctgtag

SEQ ID NO: 91914 - DNA, 32 bp, Artificial Sequence
  Description of Artificial Sequence: Synthetic oligonucleotide
ggatgctgggcacaaactcaactttgctgtag

SEQ ID NO: 91915 - DNA, 32 bp, Artificial Sequence
  Description of Artificial Sequence: Synthetic oligonucleotide
gatgctgggcacaaactcaactttgctgtagc

SEQ ID NO: 91916 - DNA, 34 bp, Artificial Sequence
  Description of Artificial Sequence: Synthetic oligonucleotide
atgctgggcacaaactcaactttgctgtagctag

SEQ ID NO: 91917 - DNA, 33 bp, Artificial Sequence
  Description of Artificial Sequence: Synthetic oligonucleotide
tgctgggcacaaactcaactttgctgtagctag

SEQ ID NO: 91918 - DNA, 32 bp, Artificial Sequence
  Description of Artificial Sequence: Synthetic oligonucleotide
gctgggcacaaactcaactttgctgtagctag

SEQ ID NO: 91919 - DNA, 32 bp, Artificial Sequence
  Description of Artificial Sequence: Synthetic oligonucleotide
ctgggcacaaactcaactttgctgtagctagc

SEQ ID NO: 91920 - DNA, 32 bp, Artificial Sequence
  Description of Artificial Sequence: Synthetic oligonucleotide
tgggcacaaactcaactttgctgtagctagcc

SEQ ID NO: 91921 - DNA, 31 bp, Artificial Sequence
  Description of Artificial Sequence: Synthetic oligonucleotide
gggcacaaactcaactttgctgtagctagcc

SEQ ID NO: 91922 - DNA, 31 bp, Artificial Sequence
  Description of Artificial Sequence: Synthetic oligonucleotide
ggcacaaactcaactttgctgtagctagccg

SEQ ID NO: 91923 - DNA, 31 bp, Artificial Sequence
  Description of Artificial Sequence: Synthetic oligonucleotide
gcacaaactcaactttgctgtagctagccgc

SEQ ID NO: 91924 - DNA, 35 bp, Artificial Sequence
  Description of Artificial Sequence: Synthetic oligonucleotide
cacaaactcaactttgctgtagctagccgcaaaac

SEQ ID NO: 91925 - DNA, 35 bp, Artificial Sequence
  Description of Artificial Sequence: Synthetic oligonucleotide
acaaactcaactttgctgtagctagccgcaaaacc

SEQ ID NO: 91926 - DNA, 34 bp, Artificial Sequence
  Description of Artificial Sequence: Synthetic oligonucleotide
caaactcaactttgctgtagctagccgcaaaacc

SEQ ID NO: 91927 - DNA, 38 bp, Artificial Sequence
  Description of Artificial Sequence: Synthetic oligonucleotide
aaactcaactttgctgtagctagccgcaaaacctttag

SEQ ID NO: 91928 - DNA, 37 bp, Artificial Sequence
  Description of Artificial Sequence: Synthetic oligonucleotide
aactcaactttgctgtagctagccgcaaaacctttag

SEQ ID NO: 91929 - DNA, 36 bp, Artificial Sequence
  Description of Artificial Sequence: Synthetic oligonucleotide
actcaactttgctgtagctagccgcaaaacctttag

SEQ ID NO: 91930 - DNA, 35 bp, Artificial Sequence
  Description of Artificial Sequence: Synthetic oligonucleotide
ctcaactttgctgtagctagccgcaaaacctttag

SEQ ID NO: 91931 - DNA, 35 bp, Artificial Sequence
  Description of Artificial Sequence: Synthetic oligonucleotide
tcaactttgctgtagctagccgcaaaacctttagc

SEQ ID NO: 91932 - DNA, 34 bp, Artificial Sequence
  Description of Artificial Sequence: Synthetic oligonucleotide
caactttgctgtagctagccgcaaaacctttagc

SEQ ID NO: 91933 - DNA, 34 bp, Artificial Sequence
  Description of Artificial Sequence: Synthetic oligonucleotide
aactttgctgtagctagccgcaaaacctttagcc

SEQ ID NO: 91934 - DNA, 33 bp, Artificial Sequence
  Description of Artificial Sequence: Synthetic oligonucleotide
actttgctgtagctagccgcaaaacctttagcc

SEQ ID NO: 91935 - DNA, 32 bp, Artificial Sequence
  Description of Artificial Sequence: Synthetic oligonucleotide
ctttgctgtagctagccgcaaaacctttagcc

SEQ ID NO: 91936 - DNA, 34 bp, Artificial Sequence
  Description of Artificial Sequence: Synthetic oligonucleotide
tttgctgtagctagccgcaaaacctttagccatg

SEQ ID NO: 91937 - DNA, 33 bp, Artificial Sequence
  Description of Artificial Sequence: Synthetic oligonucleotide
ttgctgtagctagccgcaaaacctttagccatg

SEQ ID NO: 91938 - DNA, 32 bp, Artificial Sequence
  Description of Artificial Sequence: Synthetic oligonucleotide
tgctgtagctagccgcaaaacctttagccatg

SEQ ID NO: 91939 - DNA, 31 bp, Artificial Sequence
  Description of Artificial Sequence: Synthetic oligonucleotide
gctgtagctagccgcaaaacctttagccatg

SEQ ID NO: 91940 - DNA, 33 bp, Artificial Sequence
  Description of Artificial Sequence: Synthetic oligonucleotide
ctgtagctagccgcaaaacctttagccatgaac

SEQ ID NO: 91941 - DNA, 36 bp, Artificial Sequence
  Description of Artificial Sequence: Synthetic oligonucleotide
tgtagctagccgcaaaacctttagccatgaactttc

SEQ ID NO: 91942 - DNA, 35 bp, Artificial Sequence
  Description of Artificial Sequence: Synthetic oligonucleotide
gtagctagccgcaaaacctttagccatgaactttc

SEQ ID NO: 91943 - DNA, 36 bp, Artificial Sequence
  Description of Artificial Sequence: Synthetic oligonucleotide
tagctagccgcaaaacctttagccatgaactttctg

SEQ ID NO: 91944 - DNA, 35 bp, Artificial Sequence
  Description of Artificial Sequence: Synthetic oligonucleotide
agctagccgcaaaacctttagccatgaactttctg

SEQ ID NO: 91945 - DNA, 34 bp, Artificial Sequence
  Description of Artificial Sequence: Synthetic oligonucleotide
gctagccgcaaaacctttagccatgaactttctg

SEQ ID NO: 91946 - DNA, 39 bp, Artificial Sequence
  Description of Artificial Sequence: Synthetic oligonucleotide
ctagccgcaaaacctttagccatgaactttctgattttg

SEQ ID NO: 91947 - DNA, 39 bp, Artificial Sequence
  Description of Artificial Sequence: Synthetic oligonucleotide
tagccgcaaaacctttagccatgaactttctgattttgg

SEQ ID NO: 91948 - DNA, 38 bp, Artificial Sequence
  Description of Artificial Sequence: Synthetic oligonucleotide
agccgcaaaacctttagccatgaactttctgattttgg

SEQ ID NO: 91949 - DNA, 37 bp, Artificial Sequence
  Description of Artificial Sequence: Synthetic oligonucleotide
gccgcaaaacctttagccatgaactttctgattttgg

SEQ ID NO: 91950 - DNA, 37 bp, Artificial Sequence
  Description of Artificial Sequence: Synthetic oligonucleotide
ccgcaaaacctttagccatgaactttctgattttggc

SEQ ID NO: 91951 - DNA, 39 bp, Artificial Sequence
  Description of Artificial Sequence: Synthetic oligonucleotide
cgcaaaacctttagccatgaactttctgattttggcttg

SEQ ID NO: 91952 - DNA, 39 bp, Artificial Sequence
  Description of Artificial Sequence: Synthetic oligonucleotide
gcaaaacctttagccatgaactttctgattttggcttgg

SEQ ID NO: 91953 - DNA, 40 bp, Artificial Sequence
  Description of Artificial Sequence: Synthetic oligonucleotide
caaaacctttagccatgaactttctgattttggcttggag

SEQ ID NO: 91954 - DNA, 41 bp, Artificial Sequence
  Description of Artificial Sequence: Synthetic oligonucleotide
aaaacctttagccatgaactttctgattttggcttggagag

SEQ ID NO: 91955 - DNA, 40 bp, Artificial Sequence
  Description of Artificial Sequence: Synthetic oligonucleotide
aaacctttagccatgaactttctgattttggcttggagag

SEQ ID NO: 91956 - DNA, 39 bp, Artificial Sequence
  Description of Artificial Sequence: Synthetic oligonucleotide
aacctttagccatgaactttctgattttggcttggagag

SEQ ID NO: 91957 - DNA, 38 bp, Artificial Sequence
  Description of Artificial Sequence: Synthetic oligonucleotide
acctttagccatgaactttctgattttggcttggagag

SEQ ID NO: 91958 - DNA, 37 bp, Artificial Sequence
  Description of Artificial Sequence: Synthetic oligonucleotide
cctttagccatgaactttctgattttggcttggagag

SEQ ID NO: 91959 - DNA, 37 bp, Artificial Sequence
  Description of Artificial Sequence: Synthetic oligonucleotide
ctttagccatgaactttctgattttggcttggagagc

SEQ ID NO: 91960 - DNA, 38 bp, Artificial Sequence
  Description of Artificial Sequence: Synthetic oligonucleotide
tttagccatgaactttctgattttggcttggagagcac

SEQ ID NO: 91961 - DNA, 37 bp, Artificial Sequence
  Description of Artificial Sequence: Synthetic oligonucleotide
ttagccatgaactttctgattttggcttggagagcac

SEQ ID NO: 91962 - DNA, 36 bp, Artificial Sequence
  Description of Artificial Sequence: Synthetic oligonucleotide
tagccatgaactttctgattttggcttggagagcac

SEQ ID NO: 91963 - DNA, 35 bp, Artificial Sequence
  Description of Artificial Sequence: Synthetic oligonucleotide
agccatgaactttctgattttggcttggagagcac

SEQ ID NO: 91964 - DNA, 34 bp, Artificial Sequence
  Description of Artificial Sequence: Synthetic oligonucleotide
gccatgaactttctgattttggcttggagagcac

SEQ ID NO: 91965 - DNA, 35 bp, Artificial Sequence
  Description of Artificial Sequence: Synthetic oligonucleotide
ccatgaactttctgattttggcttggagagcactg

SEQ ID NO: 91966 - DNA, 35 bp, Artificial Sequence
  Description of Artificial Sequence: Synthetic oligonucleotide
catgaactttctgattttggcttggagagcactgc

SEQ ID NO: 91967 - DNA, 36 bp, Artificial Sequence
  Description of Artificial Sequence: Synthetic oligonucleotide
atgaactttctgattttggcttggagagcactgctg

SEQ ID NO: 91968 - DNA, 35 bp, Artificial Sequence
  Description of Artificial Sequence: Synthetic oligonucleotide
tgaactttctgattttggcttggagagcactgctg

SEQ ID NO: 91969 - DNA, 34 bp, Artificial Sequence
  Description of Artificial Sequence: Synthetic oligonucleotide
gaactttctgattttggcttggagagcactgctg

SEQ ID NO: 91970 - DNA, 34 bp, Artificial Sequence
  Description of Artificial Sequence: Synthetic oligonucleotide
aactttctgattttggcttggagagcactgctgg

SEQ ID NO: 91971 - DNA, 33 bp, Artificial Sequence
  Description of Artificial Sequence: Synthetic oligonucleotide
actttctgattttggcttggagagcactgctgg

SEQ ID NO: 91972 - DNA, 32 bp, Artificial Sequence
  Description of Artificial Sequence: Synthetic oligonucleotide
ctttctgattttggcttggagagcactgctgg

SEQ ID NO: 91973 - DNA, 33 bp, Artificial Sequence
  Description of Artificial Sequence: Synthetic oligonucleotide
tttctgattttggcttggagagcactgctggag

SEQ ID NO: 91974 - DNA, 32 bp, Artificial Sequence
  Description of Artificial Sequence: Synthetic oligonucleotide
ttctgattttggcttggagagcactgctggag

SEQ ID NO: 91975 - DNA, 31 bp, Artificial Sequence
  Description of Artificial Sequence: Synthetic oligonucleotide
tctgattttggcttggagagcactgctggag

SEQ ID NO: 91976 - DNA, 30 bp, Artificial Sequence
  Description of Artificial Sequence: Synthetic oligonucleotide
ctgattttggcttggagagcactgctggag

SEQ ID NO: 91977 - DNA, 31 bp, Artificial Sequence
  Description of Artificial Sequence: Synthetic oligonucleotide
tgattttggcttggagagcactgctggagag

SEQ ID NO: 91978 - DNA, 30 bp, Artificial Sequence
  Description of Artificial Sequence: Synthetic oligonucleotide
gattttggcttggagagcactgctggagag

SEQ ID NO: 91979 - DNA, 33 bp, Artificial Sequence
  Description of Artificial Sequence: Synthetic oligonucleotide
attttggcttggagagcactgctggagagattc

SEQ ID NO: 91980 - DNA, 32 bp, Artificial Sequence
  Description of Artificial Sequence: Synthetic oligonucleotide
ttttggcttggagagcactgctggagagattc

SEQ ID NO: 91981 - DNA, 31 bp, Artificial Sequence
  Description of Artificial Sequence: Synthetic oligonucleotide
tttggcttggagagcactgctggagagattc

SEQ ID NO: 91982 - DNA, 30 bp, Artificial Sequence
  Description of Artificial Sequence: Synthetic oligonucleotide
ttggcttggagagcactgctggagagattc

SEQ ID NO: 91983 - DNA, 29 bp, Artificial Sequence
  Description of Artificial Sequence: Synthetic oligonucleotide
tggcttggagagcactgctggagagattc

SEQ ID NO: 91984 - DNA, 28 bp, Artificial Sequence
  Description of Artificial Sequence: Synthetic oligonucleotide
ggcttggagagcactgctggagagattc

SEQ ID NO: 91985 - DNA, 28 bp, Artificial Sequence
  Description of Artificial Sequence: Synthetic oligonucleotide
gcttggagagcactgctggagagattcc

SEQ ID NO: 91986 - DNA, 29 bp, Artificial Sequence
  Description of Artificial Sequence: Synthetic oligonucleotide
cttggagagcactgctggagagattcctg

SEQ ID NO: 91987 - DNA, 31 bp, Artificial Sequence
  Description of Artificial Sequence: Synthetic oligonucleotide
ttggagagcactgctggagagattcctgttg

SEQ ID NO: 91988 - DNA, 30 bp, Artificial Sequence
  Description of Artificial Sequence: Synthetic oligonucleotide
tggagagcactgctggagagattcctgttg

SEQ ID NO: 91989 - DNA, 29 bp, Artificial Sequence
  Description of Artificial Sequence: Synthetic oligonucleotide
ggagagcactgctggagagattcctgttg

SEQ ID NO: 91990 - DNA, 31 bp, Artificial Sequence
  Description of Artificial Sequence: Synthetic oligonucleotide
gagagcactgctggagagattcctgttgttg

SEQ ID NO: 91991 - DNA, 31 bp, Artificial Sequence
  Description of Artificial Sequence: Synthetic oligonucleotide
agagcactgctggagagattcctgttgttgc

SEQ ID NO: 91992 - DNA, 30 bp, Artificial Sequence
  Description of Artificial Sequence: Synthetic oligonucleotide
gagcactgctggagagattcctgttgttgc

SEQ ID NO: 91993 - DNA, 33 bp, Artificial Sequence
  Description of Artificial Sequence: Synthetic oligonucleotide
agcactgctggagagattcctgttgttgctatc

SEQ ID NO: 91994 - DNA, 32 bp, Artificial Sequence
  Description of Artificial Sequence: Synthetic oligonucleotide
gcactgctggagagattcctgttgttgctatc

SEQ ID NO: 91995 - DNA, 33 bp, Artificial Sequence
  Description of Artificial Sequence: Synthetic oligonucleotide
cactgctggagagattcctgttgttgctatcag

SEQ ID NO: 91996 - DNA, 35 bp, Artificial Sequence
  Description of Artificial Sequence: Synthetic oligonucleotide
actgctggagagattcctgttgttgctatcagaac

SEQ ID NO: 91997 - DNA, 34 bp, Artificial Sequence
  Description of Artificial Sequence: Synthetic oligonucleotide
ctgctggagagattcctgttgttgctatcagaac

SEQ ID NO: 91998 - DNA, 35 bp, Artificial Sequence
  Description of Artificial Sequence: Synthetic oligonucleotide
tgctggagagattcctgttgttgctatcagaactg

SEQ ID NO: 91999 - DNA, 34 bp, Artificial Sequence
  Description of Artificial Sequence: Synthetic oligonucleotide
gctggagagattcctgttgttgctatcagaactg

SEQ ID NO: 92000 - DNA, 34 bp, Artificial Sequence
  Description of Artificial Sequence: Synthetic oligonucleotide
ctggagagattcctgttgttgctatcagaactgc

SEQ ID NO: 92001 - DNA, 38 bp, Artificial Sequence
  Description of Artificial Sequence: Synthetic oligonucleotide
tggagagattcctgttgttgctatcagaactgctaaag

SEQ ID NO: 92002 - DNA, 37 bp, Artificial Sequence
  Description of Artificial Sequence: Synthetic oligonucleotide
ggagagattcctgttgttgctatcagaactgctaaag

SEQ ID NO: 92003 - DNA, 37 bp, Artificial Sequence
  Description of Artificial Sequence: Synthetic oligonucleotide
gagagattcctgttgttgctatcagaactgctaaagg

SEQ ID NO: 92004 - DNA, 38 bp, Artificial Sequence
  Description of Artificial Sequence: Synthetic oligonucleotide
agagattcctgttgttgctatcagaactgctaaaggag

SEQ ID NO: 92005 - DNA, 37 bp, Artificial Sequence
  Description of Artificial Sequence: Synthetic oligonucleotide
gagattcctgttgttgctatcagaactgctaaaggag

SEQ ID NO: 92006 - DNA, 38 bp, Artificial Sequence
  Description of Artificial Sequence: Synthetic oligonucleotide
agattcctgttgttgctatcagaactgctaaaggagag

SEQ ID NO: 92007 - DNA, 37 bp, Artificial Sequence
  Description of Artificial Sequence: Synthetic oligonucleotide
gattcctgttgttgctatcagaactgctaaaggagag

SEQ ID NO: 92008 - DNA, 39 bp, Artificial Sequence
  Description of Artificial Sequence: Synthetic oligonucleotide
attcctgttgttgctatcagaactgctaaaggagagaag

SEQ ID NO: 92009 - DNA, 38 bp, Artificial Sequence
  Description of Artificial Sequence: Synthetic oligonucleotide
ttcctgttgttgctatcagaactgctaaaggagagaag

SEQ ID NO: 92010 - DNA, 37 bp, Artificial Sequence
  Description of Artificial Sequence: Synthetic oligonucleotide
tcctgttgttgctatcagaactgctaaaggagagaag

SEQ ID NO: 92011 - DNA, 36 bp, Artificial Sequence
  Description of Artificial Sequence: Synthetic oligonucleotide
cctgttgttgctatcagaactgctaaaggagagaag

SEQ ID NO: 92012 - DNA, 39 bp, Artificial Sequence
  Description of Artificial Sequence: Synthetic oligonucleotide
ctgttgttgctatcagaactgctaaaggagagaagtttg

SEQ ID NO: 92013 - DNA, 40 bp, Artificial Sequence
  Description of Artificial Sequence: Synthetic oligonucleotide
tgttgttgctatcagaactgctaaaggagagaagtttgtc

SEQ ID NO: 92014 - DNA, 39 bp, Artificial Sequence
  Description of Artificial Sequence: Synthetic oligonucleotide
gttgttgctatcagaactgctaaaggagagaagtttgtc

SEQ ID NO: 92015 - DNA, 41 bp, Artificial Sequence
  Description of Artificial Sequence: Synthetic oligonucleotide
ttgttgctatcagaactgctaaaggagagaagtttgtcatg

SEQ ID NO: 92016 - DNA, 40 bp, Artificial Sequence
  Description of Artificial Sequence: Synthetic oligonucleotide
tgttgctatcagaactgctaaaggagagaagtttgtcatg

SEQ ID NO: 92017 - DNA, 39 bp, Artificial Sequence
  Description of Artificial Sequence: Synthetic oligonucleotide
gttgctatcagaactgctaaaggagagaagtttgtcatg

SEQ ID NO: 92018 - DNA, 39 bp, Artificial Sequence
  Description of Artificial Sequence: Synthetic oligonucleotide
ttgctatcagaactgctaaaggagagaagtttgtcatgc

SEQ ID NO: 92019 - DNA, 38 bp, Artificial Sequence
  Description of Artificial Sequence: Synthetic oligonucleotide
tgctatcagaactgctaaaggagagaagtttgtcatgc

SEQ ID NO: 92020 - DNA, 37 bp, Artificial Sequence
  Description of Artificial Sequence: Synthetic oligonucleotide
gctatcagaactgctaaaggagagaagtttgtcatgc

SEQ ID NO: 92021 - DNA, 38 bp, Artificial Sequence
  Description of Artificial Sequence: Synthetic oligonucleotide
ctatcagaactgctaaaggagagaagtttgtcatgcag

SEQ ID NO: 92022 - DNA, 38 bp, Artificial Sequence
  Description of Artificial Sequence: Synthetic oligonucleotide
tatcagaactgctaaaggagagaagtttgtcatgcagg

SEQ ID NO: 92023 - DNA, 37 bp, Artificial Sequence
  Description of Artificial Sequence: Synthetic oligonucleotide
atcagaactgctaaaggagagaagtttgtcatgcagg

SEQ ID NO: 92024 - DNA, 36 bp, Artificial Sequence
  Description of Artificial Sequence: Synthetic oligonucleotide
tcagaactgctaaaggagagaagtttgtcatgcagg

SEQ ID NO: 92025 - DNA, 35 bp, Artificial Sequence
  Description of Artificial Sequence: Synthetic oligonucleotide
cagaactgctaaaggagagaagtttgtcatgcagg

SEQ ID NO: 92026 - DNA, 36 bp, Artificial Sequence
  Description of Artificial Sequence: Synthetic oligonucleotide
agaactgctaaaggagagaagtttgtcatgcaggag

SEQ ID NO: 92027 - DNA, 35 bp, Artificial Sequence
  Description of Artificial Sequence: Synthetic oligonucleotide
gaactgctaaaggagagaagtttgtcatgcaggag

SEQ ID NO: 92028 - DNA, 35 bp, Artificial Sequence
  Description of Artificial Sequence: Synthetic oligonucleotide
aactgctaaaggagagaagtttgtcatgcaggagg

SEQ ID NO: 92029 - DNA, 34 bp, Artificial Sequence
  Description of Artificial Sequence: Synthetic oligonucleotide
actgctaaaggagagaagtttgtcatgcaggagg

SEQ ID NO: 92030 - DNA, 33 bp, Artificial Sequence
  Description of Artificial Sequence: Synthetic oligonucleotide
ctgctaaaggagagaagtttgtcatgcaggagg

SEQ ID NO: 92031 - DNA, 34 bp, Artificial Sequence
  Description of Artificial Sequence: Synthetic oligonucleotide
tgctaaaggagagaagtttgtcatgcaggaggag

SEQ ID NO: 92032 - DNA, 33 bp, Artificial Sequence
  Description of Artificial Sequence: Synthetic oligonucleotide
gctaaaggagagaagtttgtcatgcaggaggag

SEQ ID NO: 92033 - DNA, 35 bp, Artificial Sequence
  Description of Artificial Sequence: Synthetic oligonucleotide
ctaaaggagagaagtttgtcatgcaggaggagttc

SEQ ID NO: 92034 - DNA, 36 bp, Artificial Sequence
  Description of Artificial Sequence: Synthetic oligonucleotide
taaaggagagaagtttgtcatgcaggaggagttctc

SEQ ID NO: 92035 - DNA, 35 bp, Artificial Sequence
  Description of Artificial Sequence: Synthetic oligonucleotide
aaaggagagaagtttgtcatgcaggaggagttctc

SEQ ID NO: 92036 - DNA, 34 bp, Artificial Sequence
  Description of Artificial Sequence: Synthetic oligonucleotide
aaggagagaagtttgtcatgcaggaggagttctc

SEQ ID NO: 92037 - DNA, 33 bp, Artificial Sequence
  Description of Artificial Sequence: Synthetic oligonucleotide
aggagagaagtttgtcatgcaggaggagttctc

SEQ ID NO: 92038 - DNA, 32 bp, Artificial Sequence
  Description of Artificial Sequence: Synthetic oligonucleotide
ggagagaagtttgtcatgcaggaggagttctc

SEQ ID NO: 92039 - DNA, 32 bp, Artificial Sequence
  Description of Artificial Sequence: Synthetic oligonucleotide
gagagaagtttgtcatgcaggaggagttctcg

SEQ ID NO: 92040 - DNA, 32 bp, Artificial Sequence
  Description of Artificial Sequence: Synthetic oligonucleotide
agagaagtttgtcatgcaggaggagttctcgc

SEQ ID NO: 92041 - DNA, 31 bp, Artificial Sequence
  Description of Artificial Sequence: Synthetic oligonucleotide
gagaagtttgtcatgcaggaggagttctcgc

SEQ ID NO: 92042 - DNA, 31 bp, Artificial Sequence
  Description of Artificial Sequence: Synthetic oligonucleotide
agaagtttgtcatgcaggaggagttctcgcg

SEQ ID NO: 92043 - DNA, 30 bp, Artificial Sequence
  Description of Artificial Sequence: Synthetic oligonucleotide
gaagtttgtcatgcaggaggagttctcgcg

SEQ ID NO: 92044 - DNA, 31 bp, Artificial Sequence
  Description of Artificial Sequence: Synthetic oligonucleotide
aagtttgtcatgcaggaggagttctcgcgtg

SEQ ID NO: 92045 - DNA, 30 bp, Artificial Sequence
  Description of Artificial Sequence: Synthetic oligonucleotide
agtttgtcatgcaggaggagttctcgcgtg

SEQ ID NO: 92046 - DNA, 29 bp, Artificial Sequence
  Description of Artificial Sequence: Synthetic oligonucleotide
gtttgtcatgcaggaggagttctcgcgtg

SEQ ID NO: 92047 - DNA, 31 bp, Artificial Sequence
  Description of Artificial Sequence: Synthetic oligonucleotide
tttgtcatgcaggaggagttctcgcgtgatg

SEQ ID NO: 92048 - DNA, 30 bp, Artificial Sequence
  Description of Artificial Sequence: Synthetic oligonucleotide
ttgtcatgcaggaggagttctcgcgtgatg

SEQ ID NO: 92049 - DNA, 29 bp, Artificial Sequence
  Description of Artificial Sequence: Synthetic oligonucleotide
tgtcatgcaggaggagttctcgcgtgatg

SEQ ID NO: 92050 - DNA, 28 bp, Artificial Sequence
  Description of Artificial Sequence: Synthetic oligonucleotide
gtcatgcaggaggagttctcgcgtgatg

SEQ ID NO: 92051 - DNA, 28 bp, Artificial Sequence
  Description of Artificial Sequence: Synthetic oligonucleotide
tcatgcaggaggagttctcgcgtgatgg

SEQ ID NO: 92052 - DNA, 27 bp, Artificial Sequence
  Description of Artificial Sequence: Synthetic oligonucleotide
catgcaggaggagttctcgcgtgatgg

SEQ ID NO: 92053 - DNA, 27 bp, Artificial Sequence
  Description of Artificial Sequence: Synthetic oligonucleotide
atgcaggaggagttctcgcgtgatggg

SEQ ID NO: 92054 - DNA, 27 bp, Artificial Sequence
  Description of Artificial Sequence: Synthetic oligonucleotide
tgcaggaggagttctcgcgtgatggga

SEQ ID NO: 92055 - DNA, 27 bp, Artificial Sequence
  Description of Artificial Sequence: Synthetic oligonucleotide
gcaggaggagttctcgcgtgatgggaa

SEQ ID NO: 92056 - DNA, 27 bp, Artificial Sequence
  Description of Artificial Sequence: Synthetic oligonucleotide
caggaggagttctcgcgtgatgggaag

SEQ ID NO: 92057 - DNA, 27 bp, Artificial Sequence
  Description of Artificial Sequence: Synthetic oligonucleotide
aggaggagttctcgcgtgatgggaagg

SEQ ID NO: 92058 - DNA, 26 bp, Artificial Sequence
  Description of Artificial Sequence: Synthetic oligonucleotide
ggaggagttctcgcgtgatgggaagg

SEQ ID NO: 92059 - DNA, 27 bp, Artificial Sequence
  Description of Artificial Sequence: Synthetic oligonucleotide
gaggagttctcgcgtgatgggaaggct

SEQ ID NO: 92060 - DNA, 27 bp, Artificial Sequence
  Description of Artificial Sequence: Synthetic oligonucleotide
aggagttctcgcgtgatgggaaggctc

SEQ ID NO: 92061 - DNA, 27 bp, Artificial Sequence
  Description of Artificial Sequence: Synthetic oligonucleotide
ggagttctcgcgtgatgggaaggctct

SEQ ID NO: 92062 - DNA, 27 bp, Artificial Sequence
  Description of Artificial Sequence: Synthetic oligonucleotide
gagttctcgcgtgatgggaaggctctg

SEQ ID NO: 92063 - DNA, 27 bp, Artificial Sequence
  Description of Artificial Sequence: Synthetic oligonucleotide
agttctcgcgtgatgggaaggctctgg

SEQ ID NO: 92064 - DNA, 27 bp, Artificial Sequence
  Description of Artificial Sequence: Synthetic oligonucleotide
gttctcgcgtgatgggaaggctctgga

SEQ ID NO: 92065 - DNA, 27 bp, Artificial Sequence
  Description of Artificial Sequence: Synthetic oligonucleotide
ttctcgcgtgatgggaaggctctggag

SEQ ID NO: 92066 - DNA, 27 bp, Artificial Sequence
  Description of Artificial Sequence: Synthetic oligonucleotide
tctcgcgtgatgggaaggctctggaga

SEQ ID NO: 92067 - DNA, 26 bp, Artificial Sequence
  Description of Artificial Sequence: Synthetic oligonucleotide
ctcgcgtgatgggaaggctctggaga

SEQ ID NO: 92068 - DNA, 26 bp, Artificial Sequence
  Description of Artificial Sequence: Synthetic oligonucleotide
tcgcgtgatgggaaggctctggagag

SEQ ID NO: 92069 - DNA, 25 bp, Artificial Sequence
  Description of Artificial Sequence: Synthetic oligonucleotide
cgcgtgatgggaaggctctggagag

SEQ ID NO: 92070 - DNA, 27 bp, Artificial Sequence
  Description of Artificial Sequence: Synthetic oligonucleotide
gcgtgatgggaaggctctggagaggtt

SEQ ID NO: 92071 - DNA, 27 bp, Artificial Sequence
  Description of Artificial Sequence: Synthetic oligonucleotide
cgtgatgggaaggctctggagaggttc

SEQ ID NO: 92072 - DNA, 27 bp, Artificial Sequence
  Description of Artificial Sequence: Synthetic oligonucleotide
gtgatgggaaggctctggagaggttcc

SEQ ID NO: 92073 - DNA, 28 bp, Artificial Sequence
  Description of Artificial Sequence: Synthetic oligonucleotide
tgatgggaaggctctggagaggttcctg

SEQ ID NO: 92074 - DNA, 27 bp, Artificial Sequence
  Description of Artificial Sequence: Synthetic oligonucleotide
gatgggaaggctctggagaggttcctg

SEQ ID NO: 92075 - DNA, 27 bp, Artificial Sequence
  Description of Artificial Sequence: Synthetic oligonucleotide
atgggaaggctctggagaggttcctgc

SEQ ID NO: 92076 - DNA, 27 bp, Artificial Sequence
  Description of Artificial Sequence: Synthetic oligonucleotide
tgggaaggctctggagaggttcctgca

SEQ ID NO: 92077 - DNA, 26 bp, Artificial Sequence
  Description of Artificial Sequence: Synthetic oligonucleotide
gggaaggctctggagaggttcctgca

SEQ ID NO: 92078 - DNA, 26 bp, Artificial Sequence
  Description of Artificial Sequence: Synthetic oligonucleotide
ggaaggctctggagaggttcctgcag

SEQ ID NO: 92079 - DNA, 27 bp, Artificial Sequence
  Description of Artificial Sequence: Synthetic oligonucleotide
gaaggctctggagaggttcctgcagga

SEQ ID NO: 92080 - DNA, 30 bp, Artificial Sequence
  Description of Artificial Sequence: Synthetic oligonucleotide
aaggctctggagaggttcctgcaggattac

SEQ ID NO: 92081 - DNA, 29 bp, Artificial Sequence
  Description of Artificial Sequence: Synthetic oligonucleotide
aggctctggagaggttcctgcaggattac

SEQ ID NO: 92082 - DNA, 28 bp, Artificial Sequence
  Description of Artificial Sequence: Synthetic oligonucleotide
ggctctggagaggttcctgcaggattac

SEQ ID NO: 92083 - DNA, 31 bp, Artificial Sequence
  Description of Artificial Sequence: Synthetic oligonucleotide
gctctggagaggttcctgcaggattactttg

SEQ ID NO: 92084 - DNA, 33 bp, Artificial Sequence
  Description of Artificial Sequence: Synthetic oligonucleotide
ctctggagaggttcctgcaggattactttgatg

SEQ ID NO: 92085 - DNA, 33 bp, Artificial Sequence
  Description of Artificial Sequence: Synthetic oligonucleotide
tctggagaggttcctgcaggattactttgatgg

SEQ ID NO: 92086 - DNA, 32 bp, Artificial Sequence
  Description of Artificial Sequence: Synthetic oligonucleotide
ctggagaggttcctgcaggattactttgatgg

SEQ ID NO: 92087 - DNA, 32 bp, Artificial Sequence
  Description of Artificial Sequence: Synthetic oligonucleotide
tggagaggttcctgcaggattactttgatggc

SEQ ID NO: 92088 - DNA, 31 bp, Artificial Sequence
  Description of Artificial Sequence: Synthetic oligonucleotide
ggagaggttcctgcaggattactttgatggc

SEQ ID NO: 92089 - DNA, 34 bp, Artificial Sequence
  Description of Artificial Sequence: Synthetic oligonucleotide
gagaggttcctgcaggattactttgatggcaatc

SEQ ID NO: 92090 - DNA, 35 bp, Artificial Sequence
  Description of Artificial Sequence: Synthetic oligonucleotide
agaggttcctgcaggattactttgatggcaatctg

SEQ ID NO: 92091 - DNA, 34 bp, Artificial Sequence
  Description of Artificial Sequence: Synthetic oligonucleotide
gaggttcctgcaggattactttgatggcaatctg

SEQ ID NO: 92092 - DNA, 36 bp, Artificial Sequence
  Description of Artificial Sequence: Synthetic oligonucleotide
aggttcctgcaggattactttgatggcaatctgaag

SEQ ID NO: 92093 - DNA, 35 bp, Artificial Sequence
  Description of Artificial Sequence: Synthetic oligonucleotide
ggttcctgcaggattactttgatggcaatctgaag

SEQ ID NO: 92094 - DNA, 36 bp, Artificial Sequence
  Description of Artificial Sequence: Synthetic oligonucleotide
gttcctgcaggattactttgatggcaatctgaagag

SEQ ID NO: 92095 - DNA, 39 bp, Artificial Sequence
  Description of Artificial Sequence: Synthetic oligonucleotide
ttcctgcaggattactttgatggcaatctgaagagatac

SEQ ID NO: 92096 - DNA, 38 bp, Artificial Sequence
  Description of Artificial Sequence: Synthetic oligonucleotide
tcctgcaggattactttgatggcaatctgaagagatac

SEQ ID NO: 92097 - DNA, 37 bp, Artificial Sequence
  Description of Artificial Sequence: Synthetic oligonucleotide
cctgcaggattactttgatggcaatctgaagagatac

SEQ ID NO: 92098 - DNA, 37 bp, Artificial Sequence
  Description of Artificial Sequence: Synthetic oligonucleotide
ctgcaggattactttgatggcaatctgaagagatacc

SEQ ID NO: 92099 - DNA, 38 bp, Artificial Sequence
  Description of Artificial Sequence: Synthetic oligonucleotide
tgcaggattactttgatggcaatctgaagagatacctg

SEQ ID NO: 92100 - DNA, 37 bp, Artificial Sequence
  Description of Artificial Sequence: Synthetic oligonucleotide
gcaggattactttgatggcaatctgaagagatacctg

SEQ ID NO: 92101 - DNA, 39 bp, Artificial Sequence
  Description of Artificial Sequence: Synthetic oligonucleotide
caggattactttgatggcaatctgaagagatacctgaag

SEQ ID NO: 92102 - DNA, 40 bp, Artificial Sequence
  Description of Artificial Sequence: Synthetic oligonucleotide
aggattactttgatggcaatctgaagagatacctgaagtc

SEQ ID NO: 92103 - DNA, 39 bp, Artificial Sequence
  Description of Artificial Sequence: Synthetic oligonucleotide
ggattactttgatggcaatctgaagagatacctgaagtc

SEQ ID NO: 92104 - DNA, 40 bp, Artificial Sequence
  Description of Artificial Sequence: Synthetic oligonucleotide
gattactttgatggcaatctgaagagatacctgaagtctg

SEQ ID NO: 92105 - DNA, 42 bp, Artificial Sequence
  Description of Artificial Sequence: Synthetic oligonucleotide
attactttgatggcaatctgaagagatacctgaagtctgaac

SEQ ID NO: 92106 - DNA, 41 bp, Artificial Sequence
  Description of Artificial Sequence: Synthetic oligonucleotide
ttactttgatggcaatctgaagagatacctgaagtctgaac

SEQ ID NO: 92107 - DNA, 40 bp, Artificial Sequence
  Description of Artificial Sequence: Synthetic oligonucleotide
tactttgatggcaatctgaagagatacctgaagtctgaac

SEQ ID NO: 92108 - DNA, 39 bp, Artificial Sequence
  Description of Artificial Sequence: Synthetic oligonucleotide
actttgatggcaatctgaagagatacctgaagtctgaac

SEQ ID NO: 92109 - DNA, 38 bp, Artificial Sequence
  Description of Artificial Sequence: Synthetic oligonucleotide
ctttgatggcaatctgaagagatacctgaagtctgaac

SEQ ID NO: 92110 - DNA, 38 bp, Artificial Sequence
  Description of Artificial Sequence: Synthetic oligonucleotide
tttgatggcaatctgaagagatacctgaagtctgaacc

SEQ ID NO: 92111 - DNA, 37 bp, Artificial Sequence
  Description of Artificial Sequence: Synthetic oligonucleotide
ttgatggcaatctgaagagatacctgaagtctgaacc

SEQ ID NO: 92112 - DNA, 36 bp, Artificial Sequence
  Description of Artificial Sequence: Synthetic oligonucleotide
tgatggcaatctgaagagatacctgaagtctgaacc

SEQ ID NO: 92113 - DNA, 35 bp, Artificial Sequence
  Description of Artificial Sequence: Synthetic oligonucleotide
gatggcaatctgaagagatacctgaagtctgaacc

SEQ ID NO: 92114 - DNA, 38 bp, Artificial Sequence
  Description of Artificial Sequence: Synthetic oligonucleotide
atggcaatctgaagagatacctgaagtctgaacctatc

SEQ ID NO: 92115 - DNA, 37 bp, Artificial Sequence
  Description of Artificial Sequence: Synthetic oligonucleotide
tggcaatctgaagagatacctgaagtctgaacctatc

SEQ ID NO: 92116 - DNA, 36 bp, Artificial Sequence
  Description of Artificial Sequence: Synthetic oligonucleotide
ggcaatctgaagagatacctgaagtctgaacctatc

SEQ ID NO: 92117 - DNA, 36 bp, Artificial Sequence
  Description of Artificial Sequence: Synthetic oligonucleotide
gcaatctgaagagatacctgaagtctgaacctatcc

SEQ ID NO: 92118 - DNA, 36 bp, Artificial Sequence
  Description of Artificial Sequence: Synthetic oligonucleotide
caatctgaagagatacctgaagtctgaacctatccc

SEQ ID NO: 92119 - DNA, 37 bp, Artificial Sequence
  Description of Artificial Sequence: Synthetic oligonucleotide
aatctgaagagatacctgaagtctgaacctatcccag

SEQ ID NO: 92120 - DNA, 36 bp, Artificial Sequence
  Description of Artificial Sequence: Synthetic oligonucleotide
atctgaagagatacctgaagtctgaacctatcccag

SEQ ID NO: 92121 - DNA, 35 bp, Artificial Sequence
  Description of Artificial Sequence: Synthetic oligonucleotide
tctgaagagatacctgaagtctgaacctatcccag

SEQ ID NO: 92122 - DNA, 34 bp, Artificial Sequence
  Description of Artificial Sequence: Synthetic oligonucleotide
ctgaagagatacctgaagtctgaacctatcccag

SEQ ID NO: 92123 - DNA, 35 bp, Artificial Sequence
  Description of Artificial Sequence: Synthetic oligonucleotide
tgaagagatacctgaagtctgaacctatcccagag

SEQ ID NO: 92124 - DNA, 34 bp, Artificial Sequence
  Description of Artificial Sequence: Synthetic oligonucleotide
gaagagatacctgaagtctgaacctatcccagag

SEQ ID NO: 92125 - DNA, 35 bp, Artificial Sequence
  Description of Artificial Sequence: Synthetic oligonucleotide
aagagatacctgaagtctgaacctatcccagagag

SEQ ID NO: 92126 - DNA, 34 bp, Artificial Sequence
  Description of Artificial Sequence: Synthetic oligonucleotide
agagatacctgaagtctgaacctatcccagagag

SEQ ID NO: 92127 - DNA, 33 bp, Artificial Sequence
  Description of Artificial Sequence: Synthetic oligonucleotide
gagatacctgaagtctgaacctatcccagagag

SEQ ID NO: 92128 - DNA, 33 bp, Artificial Sequence
  Description of Artificial Sequence: Synthetic oligonucleotide
agatacctgaagtctgaacctatcccagagagc

SEQ ID NO: 92129 - DNA, 32 bp, Artificial Sequence
  Description of Artificial Sequence: Synthetic oligonucleotide
gatacctgaagtctgaacctatcccagagagc

SEQ ID NO: 92130 - DNA, 35 bp, Artificial Sequence
  Description of Artificial Sequence: Synthetic oligonucleotide
atacctgaagtctgaacctatcccagagagcaatg

SEQ ID NO: 92131 - DNA, 34 bp, Artificial Sequence
  Description of Artificial Sequence: Synthetic oligonucleotide
tacctgaagtctgaacctatcccagagagcaatg

SEQ ID NO: 92132 - DNA, 33 bp, Artificial Sequence
  Description of Artificial Sequence: Synthetic oligonucleotide
acctgaagtctgaacctatcccagagagcaatg

SEQ ID NO: 92133 - DNA, 32 bp, Artificial Sequence
  Description of Artificial Sequence: Synthetic oligonucleotide
cctgaagtctgaacctatcccagagagcaatg

SEQ ID NO: 92134 - DNA, 34 bp, Artificial Sequence
  Description of Artificial Sequence: Synthetic oligonucleotide
ctgaagtctgaacctatcccagagagcaatgatg

SEQ ID NO: 92135 - DNA, 34 bp, Artificial Sequence
  Description of Artificial Sequence: Synthetic oligonucleotide
tgaagtctgaacctatcccagagagcaatgatgg

SEQ ID NO: 92136 - DNA, 33 bp, Artificial Sequence
  Description of Artificial Sequence: Synthetic oligonucleotide
gaagtctgaacctatcccagagagcaatgatgg

SEQ ID NO: 92137 - DNA, 33 bp, Artificial Sequence
  Description of Artificial Sequence: Synthetic oligonucleotide
aagtctgaacctatcccagagagcaatgatggg

SEQ ID NO: 92138 - DNA, 32 bp, Artificial Sequence
  Description of Artificial Sequence: Synthetic oligonucleotide
agtctgaacctatcccagagagcaatgatggg

SEQ ID NO: 92139 - DNA, 31 bp, Artificial Sequence
  Description of Artificial Sequence: Synthetic oligonucleotide
gtctgaacctatcccagagagcaatgatggg

SEQ ID NO: 92140 - DNA, 31 bp, Artificial Sequence
  Description of Artificial Sequence: Synthetic oligonucleotide
tctgaacctatcccagagagcaatgatgggc

SEQ ID NO: 92141 - DNA, 30 bp, Artificial Sequence
  Description of Artificial Sequence: Synthetic oligonucleotide
ctgaacctatcccagagagcaatgatgggc

SEQ ID NO: 92142 - DNA, 30 bp, Artificial Sequence
  Description of Artificial Sequence: Synthetic oligonucleotide
tgaacctatcccagagagcaatgatgggcc

SEQ ID NO: 92143 - DNA, 29 bp, Artificial Sequence
  Description of Artificial Sequence: Synthetic oligonucleotide
gaacctatcccagagagcaatgatgggcc

SEQ ID NO: 92144 - DNA, 30 bp, Artificial Sequence
  Description of Artificial Sequence: Synthetic oligonucleotide
aacctatcccagagagcaatgatgggcctg

SEQ ID NO: 92145 - DNA, 29 bp, Artificial Sequence
  Description of Artificial Sequence: Synthetic oligonucleotide
acctatcccagagagcaatgatgggcctg

SEQ ID NO: 92146 - DNA, 28 bp, Artificial Sequence
  Description of Artificial Sequence: Synthetic oligonucleotide
cctatcccagagagcaatgatgggcctg

SEQ ID NO: 92147 - DNA, 29 bp, Artificial Sequence
  Description of Artificial Sequence: Synthetic oligonucleotide
ctatcccagagagcaatgatgggcctgtg

SEQ ID NO: 92148 - DNA, 31 bp, Artificial Sequence
  Description of Artificial Sequence: Synthetic oligonucleotide
tatcccagagagcaatgatgggcctgtgaag

SEQ ID NO: 92149 - DNA, 30 bp, Artificial Sequence
  Description of Artificial Sequence: Synthetic oligonucleotide
atcccagagagcaatgatgggcctgtgaag

SEQ ID NO: 92150 - DNA, 29 bp, Artificial Sequence
  Description of Artificial Sequence: Synthetic oligonucleotide
tcccagagagcaatgatgggcctgtgaag

SEQ ID NO: 92151 - DNA, 28 bp, Artificial Sequence
  Description of Artificial Sequence: Synthetic oligonucleotide
cccagagagcaatgatgggcctgtgaag

SEQ ID NO: 92152 - DNA, 28 bp, Artificial Sequence
  Description of Artificial Sequence: Synthetic oligonucleotide
ccagagagcaatgatgggcctgtgaagg

SEQ ID NO: 92153 - DNA, 30 bp, Artificial Sequence
  Description of Artificial Sequence: Synthetic oligonucleotide
cagagagcaatgatgggcctgtgaaggtag

SEQ ID NO: 92154 - DNA, 31 bp, Artificial Sequence
  Description of Artificial Sequence: Synthetic oligonucleotide
agagagcaatgatgggcctgtgaaggtagtg

SEQ ID NO: 92155 - DNA, 30 bp, Artificial Sequence
  Description of Artificial Sequence: Synthetic oligonucleotide
gagagcaatgatgggcctgtgaaggtagtg

SEQ ID NO: 92156 - DNA, 30 bp, Artificial Sequence
  Description of Artificial Sequence: Synthetic oligonucleotide
agagcaatgatgggcctgtgaaggtagtgg

SEQ ID NO: 92157 - DNA, 29 bp, Artificial Sequence
  Description of Artificial Sequence: Synthetic oligonucleotide
gagcaatgatgggcctgtgaaggtagtgg

SEQ ID NO: 92158 - DNA, 31 bp, Artificial Sequence
  Description of Artificial Sequence: Synthetic oligonucleotide
agcaatgatgggcctgtgaaggtagtggtag

SEQ ID NO: 92159 - DNA, 30 bp, Artificial Sequence
  Description of Artificial Sequence: Synthetic oligonucleotide
gcaatgatgggcctgtgaaggtagtggtag

SEQ ID NO: 92160 - DNA, 30 bp, Artificial Sequence
  Description of Artificial Sequence: Synthetic oligonucleotide
caatgatgggcctgtgaaggtagtggtagc

SEQ ID NO: 92161 - DNA, 31 bp, Artificial Sequence
  Description of Artificial Sequence: Synthetic oligonucleotide
aatgatgggcctgtgaaggtagtggtagcag

SEQ ID NO: 92162 - DNA, 30 bp, Artificial Sequence
  Description of Artificial Sequence: Synthetic oligonucleotide
atgatgggcctgtgaaggtagtggtagcag

SEQ ID NO: 92163 - DNA, 29 bp, Artificial Sequence
  Description of Artificial Sequence: Synthetic oligonucleotide
tgatgggcctgtgaaggtagtggtagcag

SEQ ID NO: 92164 - DNA, 28 bp, Artificial Sequence
  Description of Artificial Sequence: Synthetic oligonucleotide
gatgggcctgtgaaggtagtggtagcag

SEQ ID NO: 92165 - DNA, 29 bp, Artificial Sequence
  Description of Artificial Sequence: Synthetic oligonucleotide
atgggcctgtgaaggtagtggtagcagag

SEQ ID NO: 92166 - DNA, 28 bp, Artificial Sequence
  Description of Artificial Sequence: Synthetic oligonucleotide
tgggcctgtgaaggtagtggtagcagag

SEQ ID NO: 92167 - DNA, 27 bp, Artificial Sequence
  Description of Artificial Sequence: Synthetic oligonucleotide
gggcctgtgaaggtagtggtagcagag

SEQ ID NO: 92168 - DNA, 33 bp, Artificial Sequence
  Description of Artificial Sequence: Synthetic oligonucleotide
ggcctgtgaaggtagtggtagcagagaattttg

SEQ ID NO: 92169 - DNA, 35 bp, Artificial Sequence
  Description of Artificial Sequence: Synthetic oligonucleotide
gcctgtgaaggtagtggtagcagagaattttgatg

SEQ ID NO: 92170 - DNA, 40 bp, Artificial Sequence
  Description of Artificial Sequence: Synthetic oligonucleotide
cctgtgaaggtagtggtagcagagaattttgatgaaatag

SEQ ID NO: 92171 - DNA, 41 bp, Artificial Sequence
  Description of Artificial Sequence: Synthetic oligonucleotide
ctgtgaaggtagtggtagcagagaattttgatgaaatagtg

SEQ ID NO: 92172 - DNA, 47 bp, Artificial Sequence
  Description of Artificial Sequence: Synthetic oligonucleotide
tgtgaaggtagtggtagcagagaattttgatgaaatagtgaataatg

SEQ ID NO: 92173 - DNA, 46 bp, Artificial Sequence
  Description of Artificial Sequence: Synthetic oligonucleotide
gtgaaggtagtggtagcagagaattttgatgaaatagtgaataatg

SEQ ID NO: 92174 - DNA, 54 bp, Artificial Sequence
  Description of Artificial Sequence: Synthetic oligonucleotide
tgaaggtagtggtagcagagaattttgatgaaatagtgaataatgaaaataaag

SEQ ID NO: 92175 - DNA, 53 bp, Artificial Sequence
  Description of Artificial Sequence: Synthetic oligonucleotide
gaaggtagtggtagcagagaattttgatgaaatagtgaataatgaaaataaag

SEQ ID NO: 92176 - DNA, 55 bp, Artificial Sequence
  Description of Artificial Sequence: Synthetic oligonucleotide
aaggtagtggtagcagagaattttgatgaaatagtgaataatgaaaataaagatg

SEQ ID NO: 92177 - DNA, 54 bp, Artificial Sequence
  Description of Artificial Sequence: Synthetic oligonucleotide
aggtagtggtagcagagaattttgatgaaatagtgaataatgaaaataaagatg

SEQ ID NO: 92178 - DNA, 53 bp, Artificial Sequence
  Description of Artificial Sequence: Synthetic oligonucleotide
ggtagtggtagcagagaattttgatgaaatagtgaataatgaaaataaagatg

SEQ ID NO: 92179 - DNA, 54 bp, Artificial Sequence
  Description of Artificial Sequence: Synthetic oligonucleotide
gtagtggtagcagagaattttgatgaaatagtgaataatgaaaataaagatgtg

SEQ ID NO: 92180 - DNA, 54 bp, Artificial Sequence
  Description of Artificial Sequence: Synthetic oligonucleotide
tagtggtagcagagaattttgatgaaatagtgaataatgaaaataaagatgtgc

SEQ ID NO: 92181 - DNA, 53 bp, Artificial Sequence
  Description of Artificial Sequence: Synthetic oligonucleotide
agtggtagcagagaattttgatgaaatagtgaataatgaaaataaagatgtgc

SEQ ID NO: 92182 - DNA, 52 bp, Artificial Sequence
  Description of Artificial Sequence: Synthetic oligonucleotide
gtggtagcagagaattttgatgaaatagtgaataatgaaaataaagatgtgc

SEQ ID NO: 92183 - DNA, 53 bp, Artificial Sequence
  Description of Artificial Sequence: Synthetic oligonucleotide
tggtagcagagaattttgatgaaatagtgaataatgaaaataaagatgtgctg

SEQ ID NO: 92184 - DNA, 52 bp, Artificial Sequence
  Description of Artificial Sequence: Synthetic oligonucleotide
ggtagcagagaattttgatgaaatagtgaataatgaaaataaagatgtgctg

SEQ ID NO: 92185 - DNA, 55 bp, Artificial Sequence
  Description of Artificial Sequence: Synthetic oligonucleotide
gtagcagagaattttgatgaaatagtgaataatgaaaataaagatgtgctgattg

SEQ ID NO: 92186 - DNA, 60 bp, Artificial Sequence
  Description of Artificial Sequence: Synthetic oligonucleotide
tagcagagaattttgatgaaatagtgaataatgaaaataaagatgtgctgattgaatttt

SEQ ID NO: 92187 - DNA, 60 bp, Artificial Sequence
  Description of Artificial Sequence: Synthetic oligonucleotide
agcagagaattttgatgaaatagtgaataatgaaaataaagatgtgctgattgaatttta

SEQ ID NO: 92188 - DNA, 60 bp, Artificial Sequence
  Description of Artificial Sequence: Synthetic oligonucleotide
gcagagaattttgatgaaatagtgaataatgaaaataaagatgtgctgattgaattttat

SEQ ID NO: 92189 - DNA, 60 bp, Artificial Sequence
  Description of Artificial Sequence: Synthetic oligonucleotide
cagagaattttgatgaaatagtgaataatgaaaataaagatgtgctgattgaattttatg

SEQ ID NO: 92190 - DNA, 60 bp, Artificial Sequence
  Description of Artificial Sequence: Synthetic oligonucleotide
agagaattttgatgaaatagtgaataatgaaaataaagatgtgctgattgaattttatgc

SEQ ID NO: 92191 - DNA, 60 bp, Artificial Sequence
  Description of Artificial Sequence: Synthetic oligonucleotide
gagaattttgatgaaatagtgaataatgaaaataaagatgtgctgattgaattttatgcc

SEQ ID NO: 92192 - DNA, 60 bp, Artificial Sequence
  Description of Artificial Sequence: Synthetic oligonucleotide
agaattttgatgaaatagtgaataatgaaaataaagatgtgctgattgaattttatgccc

SEQ ID NO: 92193 - DNA, 59 bp, Artificial Sequence
  Description of Artificial Sequence: Synthetic oligonucleotide
gaattttgatgaaatagtgaataatgaaaataaagatgtgctgattgaattttatgccc

SEQ ID NO: 92194 - DNA, 59 bp, Artificial Sequence
  Description of Artificial Sequence: Synthetic oligonucleotide
aattttgatgaaatagtgaataatgaaaataaagatgtgctgattgaattttatgcccc

SEQ ID NO: 92195 - DNA, 58 bp, Artificial Sequence
  Description of Artificial Sequence: Synthetic oligonucleotide
attttgatgaaatagtgaataatgaaaataaagatgtgctgattgaattttatgcccc

SEQ ID NO: 92196 - DNA, 57 bp, Artificial Sequence
  Description of Artificial Sequence: Synthetic oligonucleotide
ttttgatgaaatagtgaataatgaaaataaagatgtgctgattgaattttatgcccc

SEQ ID NO: 92197 - DNA, 56 bp, Artificial Sequence
  Description of Artificial Sequence: Synthetic oligonucleotide
tttgatgaaatagtgaataatgaaaataaagatgtgctgattgaattttatgcccc

SEQ ID NO: 92198 - DNA, 55 bp, Artificial Sequence
  Description of Artificial Sequence: Synthetic oligonucleotide
ttgatgaaatagtgaataatgaaaataaagatgtgctgattgaattttatgcccc

SEQ ID NO: 92199 - DNA, 54 bp, Artificial Sequence
  Description of Artificial Sequence: Synthetic oligonucleotide
tgatgaaatagtgaataatgaaaataaagatgtgctgattgaattttatgcccc

SEQ ID NO: 92200 - DNA, 53 bp, Artificial Sequence
  Description of Artificial Sequence: Synthetic oligonucleotide
gatgaaatagtgaataatgaaaataaagatgtgctgattgaattttatgcccc

SEQ ID NO: 92201 - DNA, 55 bp, Artificial Sequence
  Description of Artificial Sequence: Synthetic oligonucleotide
atgaaatagtgaataatgaaaataaagatgtgctgattgaattttatgccccttg

SEQ ID NO: 92202 - DNA, 54 bp, Artificial Sequence
  Description of Artificial Sequence: Synthetic oligonucleotide
tgaaatagtgaataatgaaaataaagatgtgctgattgaattttatgccccttg

SEQ ID NO: 92203 - DNA, 53 bp, Artificial Sequence
  Description of Artificial Sequence: Synthetic oligonucleotide
gaaatagtgaataatgaaaataaagatgtgctgattgaattttatgccccttg

SEQ ID NO: 92204 - DNA, 53 bp, Artificial Sequence
  Description of Artificial Sequence: Synthetic oligonucleotide
aaatagtgaataatgaaaataaagatgtgctgattgaattttatgccccttgg

SEQ ID NO: 92205 - DNA, 52 bp, Artificial Sequence
  Description of Artificial Sequence: Synthetic oligonucleotide
aatagtgaataatgaaaataaagatgtgctgattgaattttatgccccttgg

SEQ ID NO: 92206 - DNA, 51 bp, Artificial Sequence
  Description of Artificial Sequence: Synthetic oligonucleotide
atagtgaataatgaaaataaagatgtgctgattgaattttatgccccttgg

SEQ ID NO: 92207 - DNA, 50 bp, Artificial Sequence
  Description of Artificial Sequence: Synthetic oligonucleotide
tagtgaataatgaaaataaagatgtgctgattgaattttatgccccttgg

SEQ ID NO: 92208 - DNA, 49 bp, Artificial Sequence
  Description of Artificial Sequence: Synthetic oligonucleotide
agtgaataatgaaaataaagatgtgctgattgaattttatgccccttgg

SEQ ID NO: 92209 - DNA, 48 bp, Artificial Sequence
  Description of Artificial Sequence: Synthetic oligonucleotide
gtgaataatgaaaataaagatgtgctgattgaattttatgccccttgg

SEQ ID NO: 92210 - DNA, 49 bp, Artificial Sequence
  Description of Artificial Sequence: Synthetic oligonucleotide
tgaataatgaaaataaagatgtgctgattgaattttatgccccttggtg

SEQ ID NO: 92211 - DNA, 48 bp, Artificial Sequence
  Description of Artificial Sequence: Synthetic oligonucleotide
gaataatgaaaataaagatgtgctgattgaattttatgccccttggtg

SEQ ID NO: 92212 - DNA, 49 bp, Artificial Sequence
  Description of Artificial Sequence: Synthetic oligonucleotide
aataatgaaaataaagatgtgctgattgaattttatgccccttggtgtg

SEQ ID NO: 92213 - DNA, 48 bp, Artificial Sequence
  Description of Artificial Sequence: Synthetic oligonucleotide
ataatgaaaataaagatgtgctgattgaattttatgccccttggtgtg

SEQ ID NO: 92214 - DNA, 47 bp, Artificial Sequence
  Description of Artificial Sequence: Synthetic oligonucleotide
taatgaaaataaagatgtgctgattgaattttatgccccttggtgtg

SEQ ID NO: 92215 - DNA, 46 bp, Artificial Sequence
  Description of Artificial Sequence: Synthetic oligonucleotide
aatgaaaataaagatgtgctgattgaattttatgccccttggtgtg

SEQ ID NO: 92216 - DNA, 45 bp, Artificial Sequence
  Description of Artificial Sequence: Synthetic oligonucleotide
atgaaaataaagatgtgctgattgaattttatgccccttggtgtg

SEQ ID NO: 92217 - DNA, 44 bp, Artificial Sequence
  Description of Artificial Sequence: Synthetic oligonucleotide
tgaaaataaagatgtgctgattgaattttatgccccttggtgtg

SEQ ID NO: 92218 - DNA, 43 bp, Artificial Sequence
  Description of Artificial Sequence: Synthetic oligonucleotide
gaaaataaagatgtgctgattgaattttatgccccttggtgtg

SEQ ID NO: 92219 - DNA, 43 bp, Artificial Sequence
  Description of Artificial Sequence: Synthetic oligonucleotide
aaaataaagatgtgctgattgaattttatgccccttggtgtgg

SEQ ID NO: 92220 - DNA, 42 bp, Artificial Sequence
  Description of Artificial Sequence: Synthetic oligonucleotide
aaataaagatgtgctgattgaattttatgccccttggtgtgg

SEQ ID NO: 92221 - DNA, 41 bp, Artificial Sequence
  Description of Artificial Sequence: Synthetic oligonucleotide
aataaagatgtgctgattgaattttatgccccttggtgtgg

SEQ ID NO: 92222 - DNA, 40 bp, Artificial Sequence
  Description of Artificial Sequence: Synthetic oligonucleotide
ataaagatgtgctgattgaattttatgccccttggtgtgg

SEQ ID NO: 92223 - DNA, 39 bp, Artificial Sequence
  Description of Artificial Sequence: Synthetic oligonucleotide
taaagatgtgctgattgaattttatgccccttggtgtgg

SEQ ID NO: 92224 - DNA, 38 bp, Artificial Sequence
  Description of Artificial Sequence: Synthetic oligonucleotide
aaagatgtgctgattgaattttatgccccttggtgtgg

SEQ ID NO: 92225 - DNA, 37 bp, Artificial Sequence
  Description of Artificial Sequence: Synthetic oligonucleotide
aagatgtgctgattgaattttatgccccttggtgtgg

SEQ ID NO: 92226 - DNA, 36 bp, Artificial Sequence
  Description of Artificial Sequence: Synthetic oligonucleotide
agatgtgctgattgaattttatgccccttggtgtgg

SEQ ID NO: 92227 - DNA, 35 bp, Artificial Sequence
  Description of Artificial Sequence: Synthetic oligonucleotide
gatgtgctgattgaattttatgccccttggtgtgg

SEQ ID NO: 92228 - DNA, 36 bp, Artificial Sequence
  Description of Artificial Sequence: Synthetic oligonucleotide
atgtgctgattgaattttatgccccttggtgtggtc

SEQ ID NO: 92229 - DNA, 35 bp, Artificial Sequence
  Description of Artificial Sequence: Synthetic oligonucleotide
tgtgctgattgaattttatgccccttggtgtggtc

SEQ ID NO: 92230 - DNA, 34 bp, Artificial Sequence
  Description of Artificial Sequence: Synthetic oligonucleotide
gtgctgattgaattttatgccccttggtgtggtc

SEQ ID NO: 92231 - DNA, 35 bp, Artificial Sequence
  Description of Artificial Sequence: Synthetic oligonucleotide
tgctgattgaattttatgccccttggtgtggtcac

SEQ ID NO: 92232 - DNA, 34 bp, Artificial Sequence
  Description of Artificial Sequence: Synthetic oligonucleotide
gctgattgaattttatgccccttggtgtggtcac

SEQ ID NO: 92233 - DNA, 35 bp, Artificial Sequence
  Description of Artificial Sequence: Synthetic oligonucleotide
ctgattgaattttatgccccttggtgtggtcactg

SEQ ID NO: 92234 - DNA, 38 bp, Artificial Sequence
  Description of Artificial Sequence: Synthetic oligonucleotide
tgattgaattttatgccccttggtgtggtcactgtaag

SEQ ID NO: 92235 - DNA, 37 bp, Artificial Sequence
  Description of Artificial Sequence: Synthetic oligonucleotide
gattgaattttatgccccttggtgtggtcactgtaag

SEQ ID NO: 92236 - DNA, 39 bp, Artificial Sequence
  Description of Artificial Sequence: Synthetic oligonucleotide
attgaattttatgccccttggtgtggtcactgtaagaac

SEQ ID NO: 92237 - DNA, 38 bp, Artificial Sequence
  Description of Artificial Sequence: Synthetic oligonucleotide
ttgaattttatgccccttggtgtggtcactgtaagaac

SEQ ID NO: 92238 - DNA, 37 bp, Artificial Sequence
  Description of Artificial Sequence: Synthetic oligonucleotide
tgaattttatgccccttggtgtggtcactgtaagaac

SEQ ID NO: 92239 - DNA, 36 bp, Artificial Sequence
  Description of Artificial Sequence: Synthetic oligonucleotide
gaattttatgccccttggtgtggtcactgtaagaac

SEQ ID NO: 92240 - DNA, 36 bp, Artificial Sequence
  Description of Artificial Sequence: Synthetic oligonucleotide
aattttatgccccttggtgtggtcactgtaagaacc

SEQ ID NO: 92241 - DNA, 35 bp, Artificial Sequence
  Description of Artificial Sequence: Synthetic oligonucleotide
attttatgccccttggtgtggtcactgtaagaacc

SEQ ID NO: 92242 - DNA, 34 bp, Artificial Sequence
  Description of Artificial Sequence: Synthetic oligonucleotide
ttttatgccccttggtgtggtcactgtaagaacc

SEQ ID NO: 92243 - DNA, 33 bp, Artificial Sequence
  Description of Artificial Sequence: Synthetic oligonucleotide
tttatgccccttggtgtggtcactgtaagaacc

SEQ ID NO: 92244 - DNA, 32 bp, Artificial Sequence
  Description of Artificial Sequence: Synthetic oligonucleotide
ttatgccccttggtgtggtcactgtaagaacc

SEQ ID NO: 92245 - DNA, 31 bp, Artificial Sequence
  Description of Artificial Sequence: Synthetic oligonucleotide
tatgccccttggtgtggtcactgtaagaacc

SEQ ID NO: 92246 - DNA, 30 bp, Artificial Sequence
  Description of Artificial Sequence: Synthetic oligonucleotide
atgccccttggtgtggtcactgtaagaacc

SEQ ID NO: 92247 - DNA, 29 bp, Artificial Sequence
  Description of Artificial Sequence: Synthetic oligonucleotide
tgccccttggtgtggtcactgtaagaacc

SEQ ID NO: 92248 - DNA, 28 bp, Artificial Sequence
  Description of Artificial Sequence: Synthetic oligonucleotide
gccccttggtgtggtcactgtaagaacc

SEQ ID NO: 92249 - DNA, 29 bp, Artificial Sequence
  Description of Artificial Sequence: Synthetic oligonucleotide
ccccttggtgtggtcactgtaagaacctg

SEQ ID NO: 92250 - DNA, 29 bp, Artificial Sequence
  Description of Artificial Sequence: Synthetic oligonucleotide
cccttggtgtggtcactgtaagaacctgg

SEQ ID NO: 92251 - DNA, 30 bp, Artificial Sequence
  Description of Artificial Sequence: Synthetic oligonucleotide
ccttggtgtggtcactgtaagaacctggag

SEQ ID NO: 92252 - DNA, 30 bp, Artificial Sequence
  Description of Artificial Sequence: Synthetic oligonucleotide
cttggtgtggtcactgtaagaacctggagc

SEQ ID NO: 92253 - DNA, 30 bp, Artificial Sequence
  Description of Artificial Sequence: Synthetic oligonucleotide
ttggtgtggtcactgtaagaacctggagcc

SEQ ID NO: 92254 - DNA, 29 bp, Artificial Sequence
  Description of Artificial Sequence: Synthetic oligonucleotide
tggtgtggtcactgtaagaacctggagcc

SEQ ID NO: 92255 - DNA, 28 bp, Artificial Sequence
  Description of Artificial Sequence: Synthetic oligonucleotide
ggtgtggtcactgtaagaacctggagcc

SEQ ID NO: 92256 - DNA, 28 bp, Artificial Sequence
  Description of Artificial Sequence: Synthetic oligonucleotide
gtgtggtcactgtaagaacctggagccc

SEQ ID NO: 92257 - DNA, 30 bp, Artificial Sequence
  Description of Artificial Sequence: Synthetic oligonucleotide
tgtggtcactgtaagaacctggagcccaag

SEQ ID NO: 92258 - DNA, 29 bp, Artificial Sequence
  Description of Artificial Sequence: Synthetic oligonucleotide
gtggtcactgtaagaacctggagcccaag

SEQ ID NO: 92259 - DNA, 35 bp, Artificial Sequence
  Description of Artificial Sequence: Synthetic oligonucleotide
tggtcactgtaagaacctggagcccaagtataaag

SEQ ID NO: 92260 - DNA, 34 bp, Artificial Sequence
  Description of Artificial Sequence: Synthetic oligonucleotide
ggtcactgtaagaacctggagcccaagtataaag

SEQ ID NO: 92261 - DNA, 36 bp, Artificial Sequence
  Description of Artificial Sequence: Synthetic oligonucleotide
gtcactgtaagaacctggagcccaagtataaagaac

SEQ ID NO: 92262 - DNA, 38 bp, Artificial Sequence
  Description of Artificial Sequence: Synthetic oligonucleotide
tcactgtaagaacctggagcccaagtataaagaacttg

SEQ ID NO: 92263 - DNA, 37 bp, Artificial Sequence
  Description of Artificial Sequence: Synthetic oligonucleotide
cactgtaagaacctggagcccaagtataaagaacttg

SEQ ID NO: 92264 - DNA, 37 bp, Artificial Sequence
  Description of Artificial Sequence: Synthetic oligonucleotide
actgtaagaacctggagcccaagtataaagaacttgg

SEQ ID NO: 92265 - DNA, 36 bp, Artificial Sequence
  Description of Artificial Sequence: Synthetic oligonucleotide
ctgtaagaacctggagcccaagtataaagaacttgg

SEQ ID NO: 92266 - DNA, 36 bp, Artificial Sequence
  Description of Artificial Sequence: Synthetic oligonucleotide
tgtaagaacctggagcccaagtataaagaacttggc

SEQ ID NO: 92267 - DNA, 35 bp, Artificial Sequence
  Description of Artificial Sequence: Synthetic oligonucleotide
gtaagaacctggagcccaagtataaagaacttggc

SEQ ID NO: 92268 - DNA, 35 bp, Artificial Sequence
  Description of Artificial Sequence: Synthetic oligonucleotide
taagaacctggagcccaagtataaagaacttggcg

SEQ ID NO: 92269 - DNA, 34 bp, Artificial Sequence
  Description of Artificial Sequence: Synthetic oligonucleotide
aagaacctggagcccaagtataaagaacttggcg

SEQ ID NO: 92270 - DNA, 33 bp, Artificial Sequence
  Description of Artificial Sequence: Synthetic oligonucleotide
agaacctggagcccaagtataaagaacttggcg

SEQ ID NO: 92271 - DNA, 32 bp, Artificial Sequence
  Description of Artificial Sequence: Synthetic oligonucleotide
gaacctggagcccaagtataaagaacttggcg

SEQ ID NO: 92272 - DNA, 33 bp, Artificial Sequence
  Description of Artificial Sequence: Synthetic oligonucleotide
aacctggagcccaagtataaagaacttggcgag

SEQ ID NO: 92273 - DNA, 32 bp, Artificial Sequence
  Description of Artificial Sequence: Synthetic oligonucleotide
acctggagcccaagtataaagaacttggcgag

SEQ ID NO: 92274 - DNA, 31 bp, Artificial Sequence
  Description of Artificial Sequence: Synthetic oligonucleotide
cctggagcccaagtataaagaacttggcgag

SEQ ID NO: 92275 - DNA, 33 bp, Artificial Sequence
  Description of Artificial Sequence: Synthetic oligonucleotide
ctggagcccaagtataaagaacttggcgagaag

SEQ ID NO: 92276 - DNA, 33 bp, Artificial Sequence
  Description of Artificial Sequence: Synthetic oligonucleotide
tggagcccaagtataaagaacttggcgagaagc

SEQ ID NO: 92277 - DNA, 32 bp, Artificial Sequence
  Description of Artificial Sequence: Synthetic oligonucleotide
ggagcccaagtataaagaacttggcgagaagc

SEQ ID NO: 92278 - DNA, 33 bp, Artificial Sequence
  Description of Artificial Sequence: Synthetic oligonucleotide
gagcccaagtataaagaacttggcgagaagctc

SEQ ID NO: 92279 - DNA, 34 bp, Artificial Sequence
  Description of Artificial Sequence: Synthetic oligonucleotide
agcccaagtataaagaacttggcgagaagctcag

SEQ ID NO: 92280 - DNA, 33 bp, Artificial Sequence
  Description of Artificial Sequence: Synthetic oligonucleotide
gcccaagtataaagaacttggcgagaagctcag

SEQ ID NO: 92281 - DNA, 33 bp, Artificial Sequence
  Description of Artificial Sequence: Synthetic oligonucleotide
cccaagtataaagaacttggcgagaagctcagc

SEQ ID NO: 92282 - DNA, 36 bp, Artificial Sequence
  Description of Artificial Sequence: Synthetic oligonucleotide
ccaagtataaagaacttggcgagaagctcagcaaag

SEQ ID NO: 92283 - DNA, 37 bp, Artificial Sequence
  Description of Artificial Sequence: Synthetic oligonucleotide
caagtataaagaacttggcgagaagctcagcaaagac

SEQ ID NO: 92284 - DNA, 37 bp, Artificial Sequence
  Description of Artificial Sequence: Synthetic oligonucleotide
aagtataaagaacttggcgagaagctcagcaaagacc

SEQ ID NO: 92285 - DNA, 36 bp, Artificial Sequence
  Description of Artificial Sequence: Synthetic oligonucleotide
agtataaagaacttggcgagaagctcagcaaagacc

SEQ ID NO: 92286 - DNA, 35 bp, Artificial Sequence
  Description of Artificial Sequence: Synthetic oligonucleotide
gtataaagaacttggcgagaagctcagcaaagacc

SEQ ID NO: 92287 - DNA, 35 bp, Artificial Sequence
  Description of Artificial Sequence: Synthetic oligonucleotide
tataaagaacttggcgagaagctcagcaaagaccc

SEQ ID NO: 92288 - DNA, 34 bp, Artificial Sequence
  Description of Artificial Sequence: Synthetic oligonucleotide
ataaagaacttggcgagaagctcagcaaagaccc

SEQ ID NO: 92289 - DNA, 33 bp, Artificial Sequence
  Description of Artificial Sequence: Synthetic oligonucleotide
taaagaacttggcgagaagctcagcaaagaccc

SEQ ID NO: 92290 - DNA, 32 bp, Artificial Sequence
  Description of Artificial Sequence: Synthetic oligonucleotide
aaagaacttggcgagaagctcagcaaagaccc

SEQ ID NO: 92291 - DNA, 31 bp, Artificial Sequence
  Description of Artificial Sequence: Synthetic oligonucleotide
aagaacttggcgagaagctcagcaaagaccc

SEQ ID NO: 92292 - DNA, 30 bp, Artificial Sequence
  Description of Artificial Sequence: Synthetic oligonucleotide
agaacttggcgagaagctcagcaaagaccc

SEQ ID NO: 92293 - DNA, 29 bp, Artificial Sequence
  Description of Artificial Sequence: Synthetic oligonucleotide
gaacttggcgagaagctcagcaaagaccc

SEQ ID NO: 92294 - DNA, 35 bp, Artificial Sequence
  Description of Artificial Sequence: Synthetic oligonucleotide
aacttggcgagaagctcagcaaagacccaaatatc

SEQ ID NO: 92295 - DNA, 34 bp, Artificial Sequence
  Description of Artificial Sequence: Synthetic oligonucleotide
acttggcgagaagctcagcaaagacccaaatatc

SEQ ID NO: 92296 - DNA, 33 bp, Artificial Sequence
  Description of Artificial Sequence: Synthetic oligonucleotide
cttggcgagaagctcagcaaagacccaaatatc

SEQ ID NO: 92297 - DNA, 33 bp, Artificial Sequence
  Description of Artificial Sequence: Synthetic oligonucleotide
ttggcgagaagctcagcaaagacccaaatatcg

SEQ ID NO: 92298 - DNA, 32 bp, Artificial Sequence
  Description of Artificial Sequence: Synthetic oligonucleotide
tggcgagaagctcagcaaagacccaaatatcg

SEQ ID NO: 92299 - DNA, 31 bp, Artificial Sequence
  Description of Artificial Sequence: Synthetic oligonucleotide
ggcgagaagctcagcaaagacccaaatatcg

SEQ ID NO: 92300 - DNA, 32 bp, Artificial Sequence
  Description of Artificial Sequence: Synthetic oligonucleotide
gcgagaagctcagcaaagacccaaatatcgtc

SEQ ID NO: 92301 - DNA, 35 bp, Artificial Sequence
  Description of Artificial Sequence: Synthetic oligonucleotide
cgagaagctcagcaaagacccaaatatcgtcatag

SEQ ID NO: 92302 - DNA, 35 bp, Artificial Sequence
  Description of Artificial Sequence: Synthetic oligonucleotide
gagaagctcagcaaagacccaaatatcgtcatagc

SEQ ID NO: 92303 - DNA, 35 bp, Artificial Sequence
  Description of Artificial Sequence: Synthetic oligonucleotide
agaagctcagcaaagacccaaatatcgtcatagcc

SEQ ID NO: 92304 - DNA, 34 bp, Artificial Sequence
  Description of Artificial Sequence: Synthetic oligonucleotide
gaagctcagcaaagacccaaatatcgtcatagcc

SEQ ID NO: 92305 - DNA, 36 bp, Artificial Sequence
  Description of Artificial Sequence: Synthetic oligonucleotide
aagctcagcaaagacccaaatatcgtcatagccaag

SEQ ID NO: 92306 - DNA, 35 bp, Artificial Sequence
  Description of Artificial Sequence: Synthetic oligonucleotide
agctcagcaaagacccaaatatcgtcatagccaag

SEQ ID NO: 92307 - DNA, 34 bp, Artificial Sequence
  Description of Artificial Sequence: Synthetic oligonucleotide
gctcagcaaagacccaaatatcgtcatagccaag

SEQ ID NO: 92308 - DNA, 36 bp, Artificial Sequence
  Description of Artificial Sequence: Synthetic oligonucleotide
ctcagcaaagacccaaatatcgtcatagccaagatg

SEQ ID NO: 92309 - DNA, 36 bp, Artificial Sequence
  Description of Artificial Sequence: Synthetic oligonucleotide
tcagcaaagacccaaatatcgtcatagccaagatgg

SEQ ID NO: 92310 - DNA, 35 bp, Artificial Sequence
  Description of Artificial Sequence: Synthetic oligonucleotide
cagcaaagacccaaatatcgtcatagccaagatgg

SEQ ID NO: 92311 - DNA, 37 bp, Artificial Sequence
  Description of Artificial Sequence: Synthetic oligonucleotide
agcaaagacccaaatatcgtcatagccaagatggatg

SEQ ID NO: 92312 - DNA, 36 bp, Artificial Sequence
  Description of Artificial Sequence: Synthetic oligonucleotide
gcaaagacccaaatatcgtcatagccaagatggatg

SEQ ID NO: 92313 - DNA, 36 bp, Artificial Sequence
  Description of Artificial Sequence: Synthetic oligonucleotide
caaagacccaaatatcgtcatagccaagatggatgc

SEQ ID NO: 92314 - DNA, 36 bp, Artificial Sequence
  Description of Artificial Sequence: Synthetic oligonucleotide
aaagacccaaatatcgtcatagccaagatggatgcc

SEQ ID NO: 92315 - DNA, 35 bp, Artificial Sequence
  Description of Artificial Sequence: Synthetic oligonucleotide
aagacccaaatatcgtcatagccaagatggatgcc

SEQ ID NO: 92316 - DNA, 34 bp, Artificial Sequence
  Description of Artificial Sequence: Synthetic oligonucleotide
agacccaaatatcgtcatagccaagatggatgcc

SEQ ID NO: 92317 - DNA, 33 bp, Artificial Sequence
  Description of Artificial Sequence: Synthetic oligonucleotide
gacccaaatatcgtcatagccaagatggatgcc

SEQ ID NO: 92318 - DNA, 34 bp, Artificial Sequence
  Description of Artificial Sequence: Synthetic oligonucleotide
acccaaatatcgtcatagccaagatggatgccac

SEQ ID NO: 92319 - DNA, 33 bp, Artificial Sequence
  Description of Artificial Sequence: Synthetic oligonucleotide
cccaaatatcgtcatagccaagatggatgccac

SEQ ID NO: 92320 - DNA, 34 bp, Artificial Sequence
  Description of Artificial Sequence: Synthetic oligonucleotide
ccaaatatcgtcatagccaagatggatgccacag

SEQ ID NO: 92321 - DNA, 34 bp, Artificial Sequence
  Description of Artificial Sequence: Synthetic oligonucleotide
caaatatcgtcatagccaagatggatgccacagc

SEQ ID NO: 92322 - DNA, 34 bp, Artificial Sequence
  Description of Artificial Sequence: Synthetic oligonucleotide
aaatatcgtcatagccaagatggatgccacagcc

SEQ ID NO: 92323 - DNA, 33 bp, Artificial Sequence
  Description of Artificial Sequence: Synthetic oligonucleotide
aatatcgtcatagccaagatggatgccacagcc

SEQ ID NO: 92324 - DNA, 32 bp, Artificial Sequence
  Description of Artificial Sequence: Synthetic oligonucleotide
atatcgtcatagccaagatggatgccacagcc

SEQ ID NO: 92325 - DNA, 31 bp, Artificial Sequence
  Description of Artificial Sequence: Synthetic oligonucleotide
tatcgtcatagccaagatggatgccacagcc

SEQ ID NO: 92326 - DNA, 30 bp, Artificial Sequence
  Description of Artificial Sequence: Synthetic oligonucleotide
atcgtcatagccaagatggatgccacagcc

SEQ ID NO: 92327 - DNA, 29 bp, Artificial Sequence
  Description of Artificial Sequence: Synthetic oligonucleotide
tcgtcatagccaagatggatgccacagcc

SEQ ID NO: 92328 - DNA, 28 bp, Artificial Sequence
  Description of Artificial Sequence: Synthetic oligonucleotide
cgtcatagccaagatggatgccacagcc

SEQ ID NO: 92329 - DNA, 31 bp, Artificial Sequence
  Description of Artificial Sequence: Synthetic oligonucleotide
gtcatagccaagatggatgccacagccaatg

SEQ ID NO: 92330 - DNA, 33 bp, Artificial Sequence
  Description of Artificial Sequence: Synthetic oligonucleotide
tcatagccaagatggatgccacagccaatgatg

SEQ ID NO: 92331 - DNA, 32 bp, Artificial Sequence
  Description of Artificial Sequence: Synthetic oligonucleotide
catagccaagatggatgccacagccaatgatg

SEQ ID NO: 92332 - DNA, 33 bp, Artificial Sequence
  Description of Artificial Sequence: Synthetic oligonucleotide
atagccaagatggatgccacagccaatgatgtg

SEQ ID NO: 92333 - DNA, 32 bp, Artificial Sequence
  Description of Artificial Sequence: Synthetic oligonucleotide
tagccaagatggatgccacagccaatgatgtg

SEQ ID NO: 92334 - DNA, 31 bp, Artificial Sequence
  Description of Artificial Sequence: Synthetic oligonucleotide
agccaagatggatgccacagccaatgatgtg

SEQ ID NO: 92335 - DNA, 30 bp, Artificial Sequence
  Description of Artificial Sequence: Synthetic oligonucleotide
gccaagatggatgccacagccaatgatgtg

SEQ ID NO: 92336 - DNA, 30 bp, Artificial Sequence
  Description of Artificial Sequence: Synthetic oligonucleotide
ccaagatggatgccacagccaatgatgtgc

SEQ ID NO: 92337 - DNA, 30 bp, Artificial Sequence
  Description of Artificial Sequence: Synthetic oligonucleotide
caagatggatgccacagccaatgatgtgcc

SEQ ID NO: 92338 - DNA, 32 bp, Artificial Sequence
  Description of Artificial Sequence: Synthetic oligonucleotide
aagatggatgccacagccaatgatgtgccttc

SEQ ID NO: 92339 - DNA, 31 bp, Artificial Sequence
  Description of Artificial Sequence: Synthetic oligonucleotide
agatggatgccacagccaatgatgtgccttc

SEQ ID NO: 92340 - DNA, 30 bp, Artificial Sequence
  Description of Artificial Sequence: Synthetic oligonucleotide
gatggatgccacagccaatgatgtgccttc

SEQ ID NO: 92341 - DNA, 31 bp, Artificial Sequence
  Description of Artificial Sequence: Synthetic oligonucleotide
atggatgccacagccaatgatgtgccttctc

SEQ ID NO: 92342 - DNA, 30 bp, Artificial Sequence
  Description of Artificial Sequence: Synthetic oligonucleotide
tggatgccacagccaatgatgtgccttctc

SEQ ID NO: 92343 - DNA, 29 bp, Artificial Sequence
  Description of Artificial Sequence: Synthetic oligonucleotide
ggatgccacagccaatgatgtgccttctc

SEQ ID NO: 92344 - DNA, 29 bp, Artificial Sequence
  Description of Artificial Sequence: Synthetic oligonucleotide
gatgccacagccaatgatgtgccttctcc

SEQ ID NO: 92345 - DNA, 33 bp, Artificial Sequence
  Description of Artificial Sequence: Synthetic oligonucleotide
atgccacagccaatgatgtgccttctccatatg

SEQ ID NO: 92346 - DNA, 32 bp, Artificial Sequence
  Description of Artificial Sequence: Synthetic oligonucleotide
tgccacagccaatgatgtgccttctccatatg

SEQ ID NO: 92347 - DNA, 31 bp, Artificial Sequence
  Description of Artificial Sequence: Synthetic oligonucleotide
gccacagccaatgatgtgccttctccatatg

SEQ ID NO: 92348 - DNA, 33 bp, Artificial Sequence
  Description of Artificial Sequence: Synthetic oligonucleotide
ccacagccaatgatgtgccttctccatatgaag

SEQ ID NO: 92349 - DNA, 34 bp, Artificial Sequence
  Description of Artificial Sequence: Synthetic oligonucleotide
cacagccaatgatgtgccttctccatatgaagtc

SEQ ID NO: 92350 - DNA, 35 bp, Artificial Sequence
  Description of Artificial Sequence: Synthetic oligonucleotide
acagccaatgatgtgccttctccatatgaagtcag

SEQ ID NO: 92351 - DNA, 34 bp, Artificial Sequence
  Description of Artificial Sequence: Synthetic oligonucleotide
cagccaatgatgtgccttctccatatgaagtcag

SEQ ID NO: 92352 - DNA, 35 bp, Artificial Sequence
  Description of Artificial Sequence: Synthetic oligonucleotide
agccaatgatgtgccttctccatatgaagtcagag

SEQ ID NO: 92353 - DNA, 34 bp, Artificial Sequence
  Description of Artificial Sequence: Synthetic oligonucleotide
gccaatgatgtgccttctccatatgaagtcagag

SEQ ID NO: 92354 - DNA, 34 bp, Artificial Sequence
  Description of Artificial Sequence: Synthetic oligonucleotide
ccaatgatgtgccttctccatatgaagtcagagg

SEQ ID NO: 92355 - DNA, 38 bp, Artificial Sequence
  Description of Artificial Sequence: Synthetic oligonucleotide
caatgatgtgccttctccatatgaagtcagaggttttc

SEQ ID NO: 92356 - DNA, 38 bp, Artificial Sequence
  Description of Artificial Sequence: Synthetic oligonucleotide
aatgatgtgccttctccatatgaagtcagaggttttcc

SEQ ID NO: 92357 - DNA, 37 bp, Artificial Sequence
  Description of Artificial Sequence: Synthetic oligonucleotide
atgatgtgccttctccatatgaagtcagaggttttcc

SEQ ID NO: 92358 - DNA, 36 bp, Artificial Sequence
  Description of Artificial Sequence: Synthetic oligonucleotide
tgatgtgccttctccatatgaagtcagaggttttcc

SEQ ID NO: 92359 - DNA, 35 bp, Artificial Sequence
  Description of Artificial Sequence: Synthetic oligonucleotide
gatgtgccttctccatatgaagtcagaggttttcc

SEQ ID NO: 92360 - DNA, 37 bp, Artificial Sequence
  Description of Artificial Sequence: Synthetic oligonucleotide
atgtgccttctccatatgaagtcagaggttttcctac

SEQ ID NO: 92361 - DNA, 36 bp, Artificial Sequence
  Description of Artificial Sequence: Synthetic oligonucleotide
tgtgccttctccatatgaagtcagaggttttcctac

SEQ ID NO: 92362 - DNA, 35 bp, Artificial Sequence
  Description of Artificial Sequence: Synthetic oligonucleotide
gtgccttctccatatgaagtcagaggttttcctac

SEQ ID NO: 92363 - DNA, 35 bp, Artificial Sequence
  Description of Artificial Sequence: Synthetic oligonucleotide
tgccttctccatatgaagtcagaggttttcctacc

SEQ ID NO: 92364 - DNA, 34 bp, Artificial Sequence
  Description of Artificial Sequence: Synthetic oligonucleotide
gccttctccatatgaagtcagaggttttcctacc

SEQ ID NO: 92365 - DNA, 39 bp, Artificial Sequence
  Description of Artificial Sequence: Synthetic oligonucleotide
ccttctccatatgaagtcagaggttttcctaccatatac

SEQ ID NO: 92366 - DNA, 41 bp, Artificial Sequence
  Description of Artificial Sequence: Synthetic oligonucleotide
cttctccatatgaagtcagaggttttcctaccatatacttc

SEQ ID NO: 92367 - DNA, 42 bp, Artificial Sequence
  Description of Artificial Sequence: Synthetic oligonucleotide
ttctccatatgaagtcagaggttttcctaccatatacttctc

SEQ ID NO: 92368 - DNA, 41 bp, Artificial Sequence
  Description of Artificial Sequence: Synthetic oligonucleotide
tctccatatgaagtcagaggttttcctaccatatacttctc

SEQ ID NO: 92369 - DNA, 40 bp, Artificial Sequence
  Description of Artificial Sequence: Synthetic oligonucleotide
ctccatatgaagtcagaggttttcctaccatatacttctc

SEQ ID NO: 92370 - DNA, 41 bp, Artificial Sequence
  Description of Artificial Sequence: Synthetic oligonucleotide
tccatatgaagtcagaggttttcctaccatatacttctctc

SEQ ID NO: 92371 - DNA, 40 bp, Artificial Sequence
  Description of Artificial Sequence: Synthetic oligonucleotide
ccatatgaagtcagaggttttcctaccatatacttctctc

SEQ ID NO: 92372 - DNA, 40 bp, Artificial Sequence
  Description of Artificial Sequence: Synthetic oligonucleotide
catatgaagtcagaggttttcctaccatatacttctctcc

SEQ ID NO: 92373 - DNA, 41 bp, Artificial Sequence
  Description of Artificial Sequence: Synthetic oligonucleotide
atatgaagtcagaggttttcctaccatatacttctctccag

SEQ ID NO: 92374 - DNA, 40 bp, Artificial Sequence
  Description of Artificial Sequence: Synthetic oligonucleotide
tatgaagtcagaggttttcctaccatatacttctctccag

SEQ ID NO: 92375 - DNA, 39 bp, Artificial Sequence
  Description of Artificial Sequence: Synthetic oligonucleotide
atgaagtcagaggttttcctaccatatacttctctccag

SEQ ID NO: 92376 - DNA, 38 bp, Artificial Sequence
  Description of Artificial Sequence: Synthetic oligonucleotide
tgaagtcagaggttttcctaccatatacttctctccag

SEQ ID NO: 92377 - DNA, 37 bp, Artificial Sequence
  Description of Artificial Sequence: Synthetic oligonucleotide
gaagtcagaggttttcctaccatatacttctctccag

SEQ ID NO: 92378 - DNA, 37 bp, Artificial Sequence
  Description of Artificial Sequence: Synthetic oligonucleotide
aagtcagaggttttcctaccatatacttctctccagc

SEQ ID NO: 92379 - DNA, 36 bp, Artificial Sequence
  Description of Artificial Sequence: Synthetic oligonucleotide
agtcagaggttttcctaccatatacttctctccagc

SEQ ID NO: 92380 - DNA, 35 bp, Artificial Sequence
  Description of Artificial Sequence: Synthetic oligonucleotide
gtcagaggttttcctaccatatacttctctccagc

SEQ ID NO: 92381 - DNA, 35 bp, Artificial Sequence
  Description of Artificial Sequence: Synthetic oligonucleotide
tcagaggttttcctaccatatacttctctccagcc

SEQ ID NO: 92382 - DNA, 34 bp, Artificial Sequence
  Description of Artificial Sequence: Synthetic oligonucleotide
cagaggttttcctaccatatacttctctccagcc

SEQ ID NO: 92383 - DNA, 36 bp, Artificial Sequence
  Description of Artificial Sequence: Synthetic oligonucleotide
agaggttttcctaccatatacttctctccagccaac

SEQ ID NO: 92384 - DNA, 35 bp, Artificial Sequence
  Description of Artificial Sequence: Synthetic oligonucleotide
gaggttttcctaccatatacttctctccagccaac

SEQ ID NO: 92385 - DNA, 37 bp, Artificial Sequence
  Description of Artificial Sequence: Synthetic oligonucleotide
aggttttcctaccatatacttctctccagccaacaag

SEQ ID NO: 92386 - DNA, 36 bp, Artificial Sequence
  Description of Artificial Sequence: Synthetic oligonucleotide
ggttttcctaccatatacttctctccagccaacaag

SEQ ID NO: 92387 - DNA, 38 bp, Artificial Sequence
  Description of Artificial Sequence: Synthetic oligonucleotide
gttttcctaccatatacttctctccagccaacaagaag

SEQ ID NO: 92388 - DNA, 38 bp, Artificial Sequence
  Description of Artificial Sequence: Synthetic oligonucleotide
ttttcctaccatatacttctctccagccaacaagaagc

SEQ ID NO: 92389 - DNA, 37 bp, Artificial Sequence
  Description of Artificial Sequence: Synthetic oligonucleotide
tttcctaccatatacttctctccagccaacaagaagc

SEQ ID NO: 92390 - DNA, 36 bp, Artificial Sequence
  Description of Artificial Sequence: Synthetic oligonucleotide
ttcctaccatatacttctctccagccaacaagaagc

SEQ ID NO: 92391 - DNA, 35 bp, Artificial Sequence
  Description of Artificial Sequence: Synthetic oligonucleotide
tcctaccatatacttctctccagccaacaagaagc

SEQ ID NO: 92392 - DNA, 34 bp, Artificial Sequence
  Description of Artificial Sequence: Synthetic oligonucleotide
cctaccatatacttctctccagccaacaagaagc

SEQ ID NO: 92393 - DNA, 39 bp, Artificial Sequence
  Description of Artificial Sequence: Synthetic oligonucleotide
ctaccatatacttctctccagccaacaagaagctaaatc

SEQ ID NO: 92394 - DNA, 39 bp, Artificial Sequence
  Description of Artificial Sequence: Synthetic oligonucleotide
taccatatacttctctccagccaacaagaagctaaatcc

SEQ ID NO: 92395 - DNA, 38 bp, Artificial Sequence
  Description of Artificial Sequence: Synthetic oligonucleotide
accatatacttctctccagccaacaagaagctaaatcc

SEQ ID NO: 92396 - DNA, 37 bp, Artificial Sequence
  Description of Artificial Sequence: Synthetic oligonucleotide
ccatatacttctctccagccaacaagaagctaaatcc

SEQ ID NO: 92397 - DNA, 40 bp, Artificial Sequence
  Description of Artificial Sequence: Synthetic oligonucleotide
catatacttctctccagccaacaagaagctaaatccaaag

SEQ ID NO: 92398 - DNA, 46 bp, Artificial Sequence
  Description of Artificial Sequence: Synthetic oligonucleotide
atatacttctctccagccaacaagaagctaaatccaaagaaatatg

SEQ ID NO: 92399 - DNA, 45 bp, Artificial Sequence
  Description of Artificial Sequence: Synthetic oligonucleotide
tatacttctctccagccaacaagaagctaaatccaaagaaatatg

SEQ ID NO: 92400 - DNA, 44 bp, Artificial Sequence
  Description of Artificial Sequence: Synthetic oligonucleotide
atacttctctccagccaacaagaagctaaatccaaagaaatatg

SEQ ID NO: 92401 - DNA, 43 bp, Artificial Sequence
  Description of Artificial Sequence: Synthetic oligonucleotide
tacttctctccagccaacaagaagctaaatccaaagaaatatg

SEQ ID NO: 92402 - DNA, 42 bp, Artificial Sequence
  Description of Artificial Sequence: Synthetic oligonucleotide
acttctctccagccaacaagaagctaaatccaaagaaatatg

SEQ ID NO: 92403 - DNA, 41 bp, Artificial Sequence
  Description of Artificial Sequence: Synthetic oligonucleotide
cttctctccagccaacaagaagctaaatccaaagaaatatg

SEQ ID NO: 92404 - DNA, 43 bp, Artificial Sequence
  Description of Artificial Sequence: Synthetic oligonucleotide
ttctctccagccaacaagaagctaaatccaaagaaatatgaag

SEQ ID NO: 92405 - DNA, 42 bp, Artificial Sequence
  Description of Artificial Sequence: Synthetic oligonucleotide
tctctccagccaacaagaagctaaatccaaagaaatatgaag

SEQ ID NO: 92406 - DNA, 41 bp, Artificial Sequence
  Description of Artificial Sequence: Synthetic oligonucleotide
ctctccagccaacaagaagctaaatccaaagaaatatgaag

SEQ ID NO: 92407 - DNA, 41 bp, Artificial Sequence
  Description of Artificial Sequence: Synthetic oligonucleotide
tctccagccaacaagaagctaaatccaaagaaatatgaagg

SEQ ID NO: 92408 - DNA, 40 bp, Artificial Sequence
  Description of Artificial Sequence: Synthetic oligonucleotide
ctccagccaacaagaagctaaatccaaagaaatatgaagg

SEQ ID NO: 92409 - DNA, 41 bp, Artificial Sequence
  Description of Artificial Sequence: Synthetic oligonucleotide
tccagccaacaagaagctaaatccaaagaaatatgaaggtg

SEQ ID NO: 92410 - DNA, 40 bp, Artificial Sequence
  Description of Artificial Sequence: Synthetic oligonucleotide
ccagccaacaagaagctaaatccaaagaaatatgaaggtg

SEQ ID NO: 92411 - DNA, 40 bp, Artificial Sequence
  Description of Artificial Sequence: Synthetic oligonucleotide
cagccaacaagaagctaaatccaaagaaatatgaaggtgg

SEQ ID NO: 92412 - DNA, 40 bp, Artificial Sequence
  Description of Artificial Sequence: Synthetic oligonucleotide
agccaacaagaagctaaatccaaagaaatatgaaggtggc

SEQ ID NO: 92413 - DNA, 39 bp, Artificial Sequence
  Description of Artificial Sequence: Synthetic oligonucleotide
gccaacaagaagctaaatccaaagaaatatgaaggtggc

SEQ ID NO: 92414 - DNA, 39 bp, Artificial Sequence
  Description of Artificial Sequence: Synthetic oligonucleotide
ccaacaagaagctaaatccaaagaaatatgaaggtggcc

SEQ ID NO: 92415 - DNA, 39 bp, Artificial Sequence
  Description of Artificial Sequence: Synthetic oligonucleotide
caacaagaagctaaatccaaagaaatatgaaggtggccg

SEQ ID NO: 92416 - DNA, 40 bp, Artificial Sequence
  Description of Artificial Sequence: Synthetic oligonucleotide
aacaagaagctaaatccaaagaaatatgaaggtggccgtg

SEQ ID NO: 92417 - DNA, 39 bp, Artificial Sequence
  Description of Artificial Sequence: Synthetic oligonucleotide
acaagaagctaaatccaaagaaatatgaaggtggccgtg

SEQ ID NO: 92418 - DNA, 38 bp, Artificial Sequence
  Description of Artificial Sequence: Synthetic oligonucleotide
caagaagctaaatccaaagaaatatgaaggtggccgtg

SEQ ID NO: 92419 - DNA, 44 bp, Artificial Sequence
  Description of Artificial Sequence: Synthetic oligonucleotide
aagaagctaaatccaaagaaatatgaaggtggccgtgaattaag

SEQ ID NO: 92420 - DNA, 43 bp, Artificial Sequence
  Description of Artificial Sequence: Synthetic oligonucleotide
agaagctaaatccaaagaaatatgaaggtggccgtgaattaag

SEQ ID NO: 92421 - DNA, 42 bp, Artificial Sequence
  Description of Artificial Sequence: Synthetic oligonucleotide
gaagctaaatccaaagaaatatgaaggtggccgtgaattaag

SEQ ID NO: 92422 - DNA, 43 bp, Artificial Sequence
  Description of Artificial Sequence: Synthetic oligonucleotide
aagctaaatccaaagaaatatgaaggtggccgtgaattaagtg

SEQ ID NO: 92423 - DNA, 42 bp, Artificial Sequence
  Description of Artificial Sequence: Synthetic oligonucleotide
agctaaatccaaagaaatatgaaggtggccgtgaattaagtg

SEQ ID NO: 92424 - DNA, 41 bp, Artificial Sequence
  Description of Artificial Sequence: Synthetic oligonucleotide
gctaaatccaaagaaatatgaaggtggccgtgaattaagtg

SEQ ID NO: 92425 - DNA, 50 bp, Artificial Sequence
  Description of Artificial Sequence: Synthetic oligonucleotide
ctaaatccaaagaaatatgaaggtggccgtgaattaagtgattttattag

SEQ ID NO: 92426 - DNA, 50 bp, Artificial Sequence
  Description of Artificial Sequence: Synthetic oligonucleotide
taaatccaaagaaatatgaaggtggccgtgaattaagtgattttattagc

SEQ ID NO: 92427 - DNA, 49 bp, Artificial Sequence
  Description of Artificial Sequence: Synthetic oligonucleotide
aaatccaaagaaatatgaaggtggccgtgaattaagtgattttattagc

SEQ ID NO: 92428 - DNA, 48 bp, Artificial Sequence
  Description of Artificial Sequence: Synthetic oligonucleotide
aatccaaagaaatatgaaggtggccgtgaattaagtgattttattagc

SEQ ID NO: 92429 - DNA, 47 bp, Artificial Sequence
  Description of Artificial Sequence: Synthetic oligonucleotide
atccaaagaaatatgaaggtggccgtgaattaagtgattttattagc

SEQ ID NO: 92430 - DNA, 46 bp, Artificial Sequence
  Description of Artificial Sequence: Synthetic oligonucleotide
tccaaagaaatatgaaggtggccgtgaattaagtgattttattagc

SEQ ID NO: 92431 - DNA, 45 bp, Artificial Sequence
  Description of Artificial Sequence: Synthetic oligonucleotide
ccaaagaaatatgaaggtggccgtgaattaagtgattttattagc

SEQ ID NO: 92432 - DNA, 48 bp, Artificial Sequence
  Description of Artificial Sequence: Synthetic oligonucleotide
caaagaaatatgaaggtggccgtgaattaagtgattttattagctatc

SEQ ID NO: 92433 - DNA, 50 bp, Artificial Sequence
  Description of Artificial Sequence: Synthetic oligonucleotide
aaagaaatatgaaggtggccgtgaattaagtgattttattagctatctac

SEQ ID NO: 92434 - DNA, 49 bp, Artificial Sequence
  Description of Artificial Sequence: Synthetic oligonucleotide
aagaaatatgaaggtggccgtgaattaagtgattttattagctatctac

SEQ ID NO: 92435 - DNA, 48 bp, Artificial Sequence
  Description of Artificial Sequence: Synthetic oligonucleotide
agaaatatgaaggtggccgtgaattaagtgattttattagctatctac

SEQ ID NO: 92436 - DNA, 47 bp, Artificial Sequence
  Description of Artificial Sequence: Synthetic oligonucleotide
gaaatatgaaggtggccgtgaattaagtgattttattagctatctac

SEQ ID NO: 92437 - DNA, 50 bp, Artificial Sequence
  Description of Artificial Sequence: Synthetic oligonucleotide
aaatatgaaggtggccgtgaattaagtgattttattagctatctacaaag

SEQ ID NO: 92438 - DNA, 49 bp, Artificial Sequence
  Description of Artificial Sequence: Synthetic oligonucleotide
aatatgaaggtggccgtgaattaagtgattttattagctatctacaaag

SEQ ID NO: 92439 - DNA, 48 bp, Artificial Sequence
  Description of Artificial Sequence: Synthetic oligonucleotide
atatgaaggtggccgtgaattaagtgattttattagctatctacaaag

SEQ ID NO: 92440 - DNA, 47 bp, Artificial Sequence
  Description of Artificial Sequence: Synthetic oligonucleotide
tatgaaggtggccgtgaattaagtgattttattagctatctacaaag

SEQ ID NO: 92441 - DNA, 46 bp, Artificial Sequence
  Description of Artificial Sequence: Synthetic oligonucleotide
atgaaggtggccgtgaattaagtgattttattagctatctacaaag

SEQ ID NO: 92442 - DNA, 45 bp, Artificial Sequence
  Description of Artificial Sequence: Synthetic oligonucleotide
tgaaggtggccgtgaattaagtgattttattagctatctacaaag

SEQ ID NO: 92443 - DNA, 44 bp, Artificial Sequence
  Description of Artificial Sequence: Synthetic oligonucleotide
gaaggtggccgtgaattaagtgattttattagctatctacaaag

SEQ ID NO: 92444 - DNA, 45 bp, Artificial Sequence
  Description of Artificial Sequence: Synthetic oligonucleotide
aaggtggccgtgaattaagtgattttattagctatctacaaagag

SEQ ID NO: 92445 - DNA, 44 bp, Artificial Sequence
  Description of Artificial Sequence: Synthetic oligonucleotide
aggtggccgtgaattaagtgattttattagctatctacaaagag

SEQ ID NO: 92446 - DNA, 43 bp, Artificial Sequence
  Description of Artificial Sequence: Synthetic oligonucleotide
ggtggccgtgaattaagtgattttattagctatctacaaagag

SEQ ID NO: 92447 - DNA, 45 bp, Artificial Sequence
  Description of Artificial Sequence: Synthetic oligonucleotide
gtggccgtgaattaagtgattttattagctatctacaaagagaag

SEQ ID NO: 92448 - DNA, 45 bp, Artificial Sequence
  Description of Artificial Sequence: Synthetic oligonucleotide
tggccgtgaattaagtgattttattagctatctacaaagagaagc

SEQ ID NO: 92449 - DNA, 44 bp, Artificial Sequence
  Description of Artificial Sequence: Synthetic oligonucleotide
ggccgtgaattaagtgattttattagctatctacaaagagaagc

SEQ ID NO: 92450 - DNA, 46 bp, Artificial Sequence
  Description of Artificial Sequence: Synthetic oligonucleotide
gccgtgaattaagtgattttattagctatctacaaagagaagctac

SEQ ID NO: 92451 - DNA, 49 bp, Artificial Sequence
  Description of Artificial Sequence: Synthetic oligonucleotide
ccgtgaattaagtgattttattagctatctacaaagagaagctacaaac

SEQ ID NO: 92452 - DNA, 49 bp, Artificial Sequence
  Description of Artificial Sequence: Synthetic oligonucleotide
cgtgaattaagtgattttattagctatctacaaagagaagctacaaacc

SEQ ID NO: 92453 - DNA, 49 bp, Artificial Sequence
  Description of Artificial Sequence: Synthetic oligonucleotide
gtgaattaagtgattttattagctatctacaaagagaagctacaaaccc

SEQ ID NO: 92454 - DNA, 49 bp, Artificial Sequence
  Description of Artificial Sequence: Synthetic oligonucleotide
tgaattaagtgattttattagctatctacaaagagaagctacaaacccc

SEQ ID NO: 92455 - DNA, 48 bp, Artificial Sequence
  Description of Artificial Sequence: Synthetic oligonucleotide
gaattaagtgattttattagctatctacaaagagaagctacaaacccc

SEQ ID NO: 92456 - DNA, 48 bp, Artificial Sequence
  Description of Artificial Sequence: Synthetic oligonucleotide
aattaagtgattttattagctatctacaaagagaagctacaaaccccc

SEQ ID NO: 92457 - DNA, 47 bp, Artificial Sequence
  Description of Artificial Sequence: Synthetic oligonucleotide
attaagtgattttattagctatctacaaagagaagctacaaaccccc

SEQ ID NO: 92458 - DNA, 46 bp, Artificial Sequence
  Description of Artificial Sequence: Synthetic oligonucleotide
ttaagtgattttattagctatctacaaagagaagctacaaaccccc

SEQ ID NO: 92459 - DNA, 45 bp, Artificial Sequence
  Description of Artificial Sequence: Synthetic oligonucleotide
taagtgattttattagctatctacaaagagaagctacaaaccccc

SEQ ID NO: 92460 - DNA, 44 bp, Artificial Sequence
  Description of Artificial Sequence: Synthetic oligonucleotide
aagtgattttattagctatctacaaagagaagctacaaaccccc

SEQ ID NO: 92461 - DNA, 43 bp, Artificial Sequence
  Description of Artificial Sequence: Synthetic oligonucleotide
agtgattttattagctatctacaaagagaagctacaaaccccc

SEQ ID NO: 92462 - DNA, 42 bp, Artificial Sequence
  Description of Artificial Sequence: Synthetic oligonucleotide
gtgattttattagctatctacaaagagaagctacaaaccccc

SEQ ID NO: 92463 - DNA, 42 bp, Artificial Sequence
  Description of Artificial Sequence: Synthetic oligonucleotide
tgattttattagctatctacaaagagaagctacaaacccccc

SEQ ID NO: 92464 - DNA, 41 bp, Artificial Sequence
  Description of Artificial Sequence: Synthetic oligonucleotide
gattttattagctatctacaaagagaagctacaaacccccc

SEQ ID NO: 92465 - DNA, 42 bp, Artificial Sequence
  Description of Artificial Sequence: Synthetic oligonucleotide
attttattagctatctacaaagagaagctacaaacccccctg

SEQ ID NO: 92466 - DNA, 41 bp, Artificial Sequence
  Description of Artificial Sequence: Synthetic oligonucleotide
ttttattagctatctacaaagagaagctacaaacccccctg

SEQ ID NO: 92467 - DNA, 40 bp, Artificial Sequence
  Description of Artificial Sequence: Synthetic oligonucleotide
tttattagctatctacaaagagaagctacaaacccccctg

SEQ ID NO: 92468 - DNA, 39 bp, Artificial Sequence
  Description of Artificial Sequence: Synthetic oligonucleotide
ttattagctatctacaaagagaagctacaaacccccctg

SEQ ID NO: 92469 - DNA, 38 bp, Artificial Sequence
  Description of Artificial Sequence: Synthetic oligonucleotide
tattagctatctacaaagagaagctacaaacccccctg

SEQ ID NO: 92470 - DNA, 37 bp, Artificial Sequence
  Description of Artificial Sequence: Synthetic oligonucleotide
attagctatctacaaagagaagctacaaacccccctg

SEQ ID NO: 92471 - DNA, 36 bp, Artificial Sequence
  Description of Artificial Sequence: Synthetic oligonucleotide
ttagctatctacaaagagaagctacaaacccccctg

SEQ ID NO: 92472 - DNA, 35 bp, Artificial Sequence
  Description of Artificial Sequence: Synthetic oligonucleotide
tagctatctacaaagagaagctacaaacccccctg

SEQ ID NO: 92473 - DNA, 34 bp, Artificial Sequence
  Description of Artificial Sequence: Synthetic oligonucleotide
agctatctacaaagagaagctacaaacccccctg

SEQ ID NO: 92474 - DNA, 33 bp, Artificial Sequence
  Description of Artificial Sequence: Synthetic oligonucleotide
gctatctacaaagagaagctacaaacccccctg

SEQ ID NO: 92475 - DNA, 38 bp, Artificial Sequence
  Description of Artificial Sequence: Synthetic oligonucleotide
ctatctacaaagagaagctacaaacccccctgtaattc

SEQ ID NO: 92476 - DNA, 40 bp, Artificial Sequence
  Description of Artificial Sequence: Synthetic oligonucleotide
tatctacaaagagaagctacaaacccccctgtaattcaag

SEQ ID NO: 92477 - DNA, 39 bp, Artificial Sequence
  Description of Artificial Sequence: Synthetic oligonucleotide
atctacaaagagaagctacaaacccccctgtaattcaag

SEQ ID NO: 92478 - DNA, 38 bp, Artificial Sequence
  Description of Artificial Sequence: Synthetic oligonucleotide
tctacaaagagaagctacaaacccccctgtaattcaag

SEQ ID NO: 92479 - DNA, 37 bp, Artificial Sequence
  Description of Artificial Sequence: Synthetic oligonucleotide
ctacaaagagaagctacaaacccccctgtaattcaag

SEQ ID NO: 92480 - DNA, 39 bp, Artificial Sequence
  Description of Artificial Sequence: Synthetic oligonucleotide
tacaaagagaagctacaaacccccctgtaattcaagaag

SEQ ID NO: 92481 - DNA, 38 bp, Artificial Sequence
  Description of Artificial Sequence: Synthetic oligonucleotide
acaaagagaagctacaaacccccctgtaattcaagaag

SEQ ID NO: 92482 - DNA, 37 bp, Artificial Sequence
  Description of Artificial Sequence: Synthetic oligonucleotide
caaagagaagctacaaacccccctgtaattcaagaag

SEQ ID NO: 92483 - DNA, 42 bp, Artificial Sequence
  Description of Artificial Sequence: Synthetic oligonucleotide
aaagagaagctacaaacccccctgtaattcaagaagaaaaac

SEQ ID NO: 92484 - DNA, 41 bp, Artificial Sequence
  Description of Artificial Sequence: Synthetic oligonucleotide
aagagaagctacaaacccccctgtaattcaagaagaaaaac

SEQ ID NO: 92485 - DNA, 40 bp, Artificial Sequence
  Description of Artificial Sequence: Synthetic oligonucleotide
agagaagctacaaacccccctgtaattcaagaagaaaaac

SEQ ID NO: 92486 - DNA, 39 bp, Artificial Sequence
  Description of Artificial Sequence: Synthetic oligonucleotide
gagaagctacaaacccccctgtaattcaagaagaaaaac

SEQ ID NO: 92487 - DNA, 39 bp, Artificial Sequence
  Description of Artificial Sequence: Synthetic oligonucleotide
agaagctacaaacccccctgtaattcaagaagaaaaacc

SEQ ID NO: 92488 - DNA, 38 bp, Artificial Sequence
  Description of Artificial Sequence: Synthetic oligonucleotide
gaagctacaaacccccctgtaattcaagaagaaaaacc

SEQ ID NO: 92489 - DNA, 38 bp, Artificial Sequence
  Description of Artificial Sequence: Synthetic oligonucleotide
aagctacaaacccccctgtaattcaagaagaaaaaccc

SEQ ID NO: 92490 - DNA, 37 bp, Artificial Sequence
  Description of Artificial Sequence: Synthetic oligonucleotide
agctacaaacccccctgtaattcaagaagaaaaaccc

SEQ ID NO: 92491 - DNA, 36 bp, Artificial Sequence
  Description of Artificial Sequence: Synthetic oligonucleotide
gctacaaacccccctgtaattcaagaagaaaaaccc

SEQ ID NO: 92492 - DNA, 38 bp, Artificial Sequence
  Description of Artificial Sequence: Synthetic oligonucleotide
ctacaaacccccctgtaattcaagaagaaaaacccaag

SEQ ID NO: 92493 - DNA, 40 bp, Artificial Sequence
  Description of Artificial Sequence: Synthetic oligonucleotide
tacaaacccccctgtaattcaagaagaaaaacccaagaag

SEQ ID NO: 92494 - DNA, 39 bp, Artificial Sequence
  Description of Artificial Sequence: Synthetic oligonucleotide
acaaacccccctgtaattcaagaagaaaaacccaagaag

SEQ ID NO: 92495 - DNA, 38 bp, Artificial Sequence
  Description of Artificial Sequence: Synthetic oligonucleotide
caaacccccctgtaattcaagaagaaaaacccaagaag

SEQ ID NO: 92496 - DNA, 40 bp, Artificial Sequence
  Description of Artificial Sequence: Synthetic oligonucleotide
aaacccccctgtaattcaagaagaaaaacccaagaagaag

SEQ ID NO: 92497 - DNA, 39 bp, Artificial Sequence
  Description of Artificial Sequence: Synthetic oligonucleotide
aacccccctgtaattcaagaagaaaaacccaagaagaag

SEQ ID NO: 92498 - DNA, 38 bp, Artificial Sequence
  Description of Artificial Sequence: Synthetic oligonucleotide
acccccctgtaattcaagaagaaaaacccaagaagaag

SEQ ID NO: 92499 - DNA, 37 bp, Artificial Sequence
  Description of Artificial Sequence: Synthetic oligonucleotide
cccccctgtaattcaagaagaaaaacccaagaagaag

SEQ ID NO: 92500 - DNA, 39 bp, Artificial Sequence
  Description of Artificial Sequence: Synthetic oligonucleotide
ccccctgtaattcaagaagaaaaacccaagaagaagaag

SEQ ID NO: 92501 - DNA, 41 bp, Artificial Sequence
  Description of Artificial Sequence: Synthetic oligonucleotide
cccctgtaattcaagaagaaaaacccaagaagaagaagaag

SEQ ID NO: 92502 - DNA, 41 bp, Artificial Sequence
  Description of Artificial Sequence: Synthetic oligonucleotide
ccctgtaattcaagaagaaaaacccaagaagaagaagaagg

SEQ ID NO: 92503 - DNA, 41 bp, Artificial Sequence
  Description of Artificial Sequence: Synthetic oligonucleotide
cctgtaattcaagaagaaaaacccaagaagaagaagaaggc

SEQ ID NO: 92504 - DNA, 42 bp, Artificial Sequence
  Description of Artificial Sequence: Synthetic oligonucleotide
ctgtaattcaagaagaaaaacccaagaagaagaagaaggcac

SEQ ID NO: 92505 - DNA, 43 bp, Artificial Sequence
  Description of Artificial Sequence: Synthetic oligonucleotide
tgtaattcaagaagaaaaacccaagaagaagaagaaggcacag

SEQ ID NO: 92506 - DNA, 42 bp, Artificial Sequence
  Description of Artificial Sequence: Synthetic oligonucleotide
gtaattcaagaagaaaaacccaagaagaagaagaaggcacag

SEQ ID NO: 92507 - DNA, 42 bp, Artificial Sequence
  Description of Artificial Sequence: Synthetic oligonucleotide
taattcaagaagaaaaacccaagaagaagaagaaggcacagg

SEQ ID NO: 92508 - DNA, 41 bp, Artificial Sequence
  Description of Artificial Sequence: Synthetic oligonucleotide
aattcaagaagaaaaacccaagaagaagaagaaggcacagg

SEQ ID NO: 92509 - DNA, 40 bp, Artificial Sequence
  Description of Artificial Sequence: Synthetic oligonucleotide
attcaagaagaaaaacccaagaagaagaagaaggcacagg

SEQ ID NO: 92510 - DNA, 39 bp, Artificial Sequence
  Description of Artificial Sequence: Synthetic oligonucleotide
ttcaagaagaaaaacccaagaagaagaagaaggcacagg

SEQ ID NO: 92511 - DNA, 38 bp, Artificial Sequence
  Description of Artificial Sequence: Synthetic oligonucleotide
tcaagaagaaaaacccaagaagaagaagaaggcacagg

SEQ ID NO: 92512 - DNA, 37 bp, Artificial Sequence
  Description of Artificial Sequence: Synthetic oligonucleotide
caagaagaaaaacccaagaagaagaagaaggcacagg

SEQ ID NO: 92513 - DNA, 38 bp, Artificial Sequence
  Description of Artificial Sequence: Synthetic oligonucleotide
aagaagaaaaacccaagaagaagaagaaggcacaggag

SEQ ID NO: 92514 - DNA, 37 bp, Artificial Sequence
  Description of Artificial Sequence: Synthetic oligonucleotide
agaagaaaaacccaagaagaagaagaaggcacaggag

SEQ ID NO: 92515 - DNA, 36 bp, Artificial Sequence
  Description of Artificial Sequence: Synthetic oligonucleotide
gaagaaaaacccaagaagaagaagaaggcacaggag

SEQ ID NO: 92516 - DNA, 36 bp, Artificial Sequence
  Description of Artificial Sequence: Synthetic oligonucleotide
aagaaaaacccaagaagaagaagaaggcacaggagg

SEQ ID NO: 92517 - DNA, 35 bp, Artificial Sequence
  Description of Artificial Sequence: Synthetic oligonucleotide
agaaaaacccaagaagaagaagaaggcacaggagg

SEQ ID NO: 92518 - DNA, 34 bp, Artificial Sequence
  Description of Artificial Sequence: Synthetic oligonucleotide
gaaaaacccaagaagaagaagaaggcacaggagg

SEQ ID NO: 92519 - DNA, 36 bp, Artificial Sequence
  Description of Artificial Sequence: Synthetic oligonucleotide
aaaaacccaagaagaagaagaaggcacaggaggatc

SEQ ID NO: 92520 - DNA, 35 bp, Artificial Sequence
  Description of Artificial Sequence: Synthetic oligonucleotide
aaaacccaagaagaagaagaaggcacaggaggatc

SEQ ID NO: 92521 - DNA, 34 bp, Artificial Sequence
  Description of Artificial Sequence: Synthetic oligonucleotide
aaacccaagaagaagaagaaggcacaggaggatc

SEQ ID NO: 92522 - DNA, 33 bp, Artificial Sequence
  Description of Artificial Sequence: Synthetic oligonucleotide
aacccaagaagaagaagaaggcacaggaggatc

SEQ ID NO: 92523 - DNA, 32 bp, Artificial Sequence
  Description of Artificial Sequence: Synthetic oligonucleotide
acccaagaagaagaagaaggcacaggaggatc

SEQ ID NO: 92524 - DNA, 31 bp, Artificial Sequence
  Description of Artificial Sequence: Synthetic oligonucleotide
cccaagaagaagaagaaggcacaggaggatc

SEQ ID NO: 92525 - DNA, 32 bp, Artificial Sequence
  Description of Artificial Sequence: Synthetic oligonucleotide
ccaagaagaagaagaaggcacaggaggatctc

SEQ ID NO: 92526 - DNA, 45 bp, Artificial Sequence
  Description of Artificial Sequence: Synthetic oligonucleotide
atgttccattcttctgcaatggttaattcacacagaaaaccaatg

SEQ ID NO: 92527 - DNA, 44 bp, Artificial Sequence
  Description of Artificial Sequence: Synthetic oligonucleotide
tgttccattcttctgcaatggttaattcacacagaaaaccaatg

SEQ ID NO: 92528 - DNA, 43 bp, Artificial Sequence
  Description of Artificial Sequence: Synthetic oligonucleotide
gttccattcttctgcaatggttaattcacacagaaaaccaatg

SEQ ID NO: 92529 - DNA, 48 bp, Artificial Sequence
  Description of Artificial Sequence: Synthetic oligonucleotide
ttccattcttctgcaatggttaattcacacagaaaaccaatgtttaac

SEQ ID NO: 92530 - DNA, 47 bp, Artificial Sequence
  Description of Artificial Sequence: Synthetic oligonucleotide
tccattcttctgcaatggttaattcacacagaaaaccaatgtttaac

SEQ ID NO: 92531 - DNA, 46 bp, Artificial Sequence
  Description of Artificial Sequence: Synthetic oligonucleotide
ccattcttctgcaatggttaattcacacagaaaaccaatgtttaac

SEQ ID NO: 92532 - DNA, 49 bp, Artificial Sequence
  Description of Artificial Sequence: Synthetic oligonucleotide
cattcttctgcaatggttaattcacacagaaaaccaatgtttaacattc

SEQ ID NO: 92533 - DNA, 50 bp, Artificial Sequence
  Description of Artificial Sequence: Synthetic oligonucleotide
attcttctgcaatggttaattcacacagaaaaccaatgtttaacattcac

SEQ ID NO: 92534 - DNA, 49 bp, Artificial Sequence
  Description of Artificial Sequence: Synthetic oligonucleotide
ttcttctgcaatggttaattcacacagaaaaccaatgtttaacattcac

SEQ ID NO: 92535 - DNA, 48 bp, Artificial Sequence
  Description of Artificial Sequence: Synthetic oligonucleotide
tcttctgcaatggttaattcacacagaaaaccaatgtttaacattcac

SEQ ID NO: 92536 - DNA, 47 bp, Artificial Sequence
  Description of Artificial Sequence: Synthetic oligonucleotide
cttctgcaatggttaattcacacagaaaaccaatgtttaacattcac

SEQ ID NO: 92537 - DNA, 48 bp, Artificial Sequence
  Description of Artificial Sequence: Synthetic oligonucleotide
ttctgcaatggttaattcacacagaaaaccaatgtttaacattcacag

SEQ ID NO: 92538 - DNA, 47 bp, Artificial Sequence
  Description of Artificial Sequence: Synthetic oligonucleotide
tctgcaatggttaattcacacagaaaaccaatgtttaacattcacag

SEQ ID NO: 92539 - DNA, 46 bp, Artificial Sequence
  Description of Artificial Sequence: Synthetic oligonucleotide
ctgcaatggttaattcacacagaaaaccaatgtttaacattcacag

SEQ ID NO: 92540 - DNA, 47 bp, Artificial Sequence
  Description of Artificial Sequence: Synthetic oligonucleotide
tgcaatggttaattcacacagaaaaccaatgtttaacattcacagag

SEQ ID NO: 92541 - DNA, 46 bp, Artificial Sequence
  Description of Artificial Sequence: Synthetic oligonucleotide
gcaatggttaattcacacagaaaaccaatgtttaacattcacagag

SEQ ID NO: 92542 - DNA, 46 bp, Artificial Sequence
  Description of Artificial Sequence: Synthetic oligonucleotide
caatggttaattcacacagaaaaccaatgtttaacattcacagagg

SEQ ID NO: 92543 - DNA, 52 bp, Artificial Sequence
  Description of Artificial Sequence: Synthetic oligonucleotide
aatggttaattcacacagaaaaccaatgtttaacattcacagaggattttac

SEQ ID NO: 92544 - DNA, 51 bp, Artificial Sequence
  Description of Artificial Sequence: Synthetic oligonucleotide
atggttaattcacacagaaaaccaatgtttaacattcacagaggattttac

SEQ ID NO: 92545 - DNA, 50 bp, Artificial Sequence
  Description of Artificial Sequence: Synthetic oligonucleotide
tggttaattcacacagaaaaccaatgtttaacattcacagaggattttac

SEQ ID NO: 92546 - DNA, 49 bp, Artificial Sequence
  Description of Artificial Sequence: Synthetic oligonucleotide
ggttaattcacacagaaaaccaatgtttaacattcacagaggattttac

SEQ ID NO: 92547 - DNA, 50 bp, Artificial Sequence
  Description of Artificial Sequence: Synthetic oligonucleotide
gttaattcacacagaaaaccaatgtttaacattcacagaggattttactg

SEQ ID NO: 92548 - DNA, 50 bp, Artificial Sequence
  Description of Artificial Sequence: Synthetic oligonucleotide
ttaattcacacagaaaaccaatgtttaacattcacagaggattttactgc

SEQ ID NO: 92549 - DNA, 49 bp, Artificial Sequence
  Description of Artificial Sequence: Synthetic oligonucleotide
taattcacacagaaaaccaatgtttaacattcacagaggattttactgc

SEQ ID NO: 92550 - DNA, 48 bp, Artificial Sequence
  Description of Artificial Sequence: Synthetic oligonucleotide
aattcacacagaaaaccaatgtttaacattcacagaggattttactgc

SEQ ID NO: 92551 - DNA, 47 bp, Artificial Sequence
  Description of Artificial Sequence: Synthetic oligonucleotide
attcacacagaaaaccaatgtttaacattcacagaggattttactgc

SEQ ID NO: 92552 - DNA, 46 bp, Artificial Sequence
  Description of Artificial Sequence: Synthetic oligonucleotide
ttcacacagaaaaccaatgtttaacattcacagaggattttactgc

SEQ ID NO: 92553 - DNA, 45 bp, Artificial Sequence
  Description of Artificial Sequence: Synthetic oligonucleotide
tcacacagaaaaccaatgtttaacattcacagaggattttactgc

SEQ ID NO: 92554 - DNA, 44 bp, Artificial Sequence
  Description of Artificial Sequence: Synthetic oligonucleotide
cacacagaaaaccaatgtttaacattcacagaggattttactgc

SEQ ID NO: 92555 - DNA, 48 bp, Artificial Sequence
  Description of Artificial Sequence: Synthetic oligonucleotide
acacagaaaaccaatgtttaacattcacagaggattttactgcttaac

SEQ ID NO: 92556 - DNA, 47 bp, Artificial Sequence
  Description of Artificial Sequence: Synthetic oligonucleotide
cacagaaaaccaatgtttaacattcacagaggattttactgcttaac

SEQ ID NO: 92557 - DNA, 48 bp, Artificial Sequence
  Description of Artificial Sequence: Synthetic oligonucleotide
acagaaaaccaatgtttaacattcacagaggattttactgcttaacag

SEQ ID NO: 92558 - DNA, 47 bp, Artificial Sequence
  Description of Artificial Sequence: Synthetic oligonucleotide
cagaaaaccaatgtttaacattcacagaggattttactgcttaacag

SEQ ID NO: 92559 - DNA, 47 bp, Artificial Sequence
  Description of Artificial Sequence: Synthetic oligonucleotide
agaaaaccaatgtttaacattcacagaggattttactgcttaacagc

SEQ ID NO: 92560 - DNA, 46 bp, Artificial Sequence
  Description of Artificial Sequence: Synthetic oligonucleotide
gaaaaccaatgtttaacattcacagaggattttactgcttaacagc

SEQ ID NO: 92561 - DNA, 46 bp, Artificial Sequence
  Description of Artificial Sequence: Synthetic oligonucleotide
aaaaccaatgtttaacattcacagaggattttactgcttaacagcc

SEQ ID NO: 92562 - DNA, 45 bp, Artificial Sequence
  Description of Artificial Sequence: Synthetic oligonucleotide
aaaccaatgtttaacattcacagaggattttactgcttaacagcc

SEQ ID NO: 92563 - DNA, 44 bp, Artificial Sequence
  Description of Artificial Sequence: Synthetic oligonucleotide
aaccaatgtttaacattcacagaggattttactgcttaacagcc

SEQ ID NO: 92564 - DNA, 43 bp, Artificial Sequence
  Description of Artificial Sequence: Synthetic oligonucleotide
accaatgtttaacattcacagaggattttactgcttaacagcc

SEQ ID NO: 92565 - DNA, 42 bp, Artificial Sequence
  Description of Artificial Sequence: Synthetic oligonucleotide
ccaatgtttaacattcacagaggattttactgcttaacagcc

SEQ ID NO: 92566 - DNA, 44 bp, Artificial Sequence
  Description of Artificial Sequence: Synthetic oligonucleotide
caatgtttaacattcacagaggattttactgcttaacagccatc

SEQ ID NO: 92567 - DNA, 46 bp, Artificial Sequence
  Description of Artificial Sequence: Synthetic oligonucleotide
aatgtttaacattcacagaggattttactgcttaacagccatcttg

SEQ ID NO: 92568 - DNA, 45 bp, Artificial Sequence
  Description of Artificial Sequence: Synthetic oligonucleotide
atgtttaacattcacagaggattttactgcttaacagccatcttg

SEQ ID NO: 92569 - DNA, 44 bp, Artificial Sequence
  Description of Artificial Sequence: Synthetic oligonucleotide
tgtttaacattcacagaggattttactgcttaacagccatcttg

SEQ ID NO: 92570 - DNA, 43 bp, Artificial Sequence
  Description of Artificial Sequence: Synthetic oligonucleotide
gtttaacattcacagaggattttactgcttaacagccatcttg

SEQ ID NO: 92571 - DNA, 43 bp, Artificial Sequence
  Description of Artificial Sequence: Synthetic oligonucleotide
tttaacattcacagaggattttactgcttaacagccatcttgc

SEQ ID NO: 92572 - DNA, 42 bp, Artificial Sequence
  Description of Artificial Sequence: Synthetic oligonucleotide
ttaacattcacagaggattttactgcttaacagccatcttgc

SEQ ID NO: 92573 - DNA, 41 bp, Artificial Sequence
  Description of Artificial Sequence: Synthetic oligonucleotide
taacattcacagaggattttactgcttaacagccatcttgc

SEQ ID NO: 92574 - DNA, 40 bp, Artificial Sequence
  Description of Artificial Sequence: Synthetic oligonucleotide
aacattcacagaggattttactgcttaacagccatcttgc

SEQ ID NO: 92575 - DNA, 39 bp, Artificial Sequence
  Description of Artificial Sequence: Synthetic oligonucleotide
acattcacagaggattttactgcttaacagccatcttgc

SEQ ID NO: 92576 - DNA, 38 bp, Artificial Sequence
  Description of Artificial Sequence: Synthetic oligonucleotide
cattcacagaggattttactgcttaacagccatcttgc

SEQ ID NO: 92577 - DNA, 38 bp, Artificial Sequence
  Description of Artificial Sequence: Synthetic oligonucleotide
attcacagaggattttactgcttaacagccatcttgcc

SEQ ID NO: 92578 - DNA, 37 bp, Artificial Sequence
  Description of Artificial Sequence: Synthetic oligonucleotide
ttcacagaggattttactgcttaacagccatcttgcc

SEQ ID NO: 92579 - DNA, 36 bp, Artificial Sequence
  Description of Artificial Sequence: Synthetic oligonucleotide
tcacagaggattttactgcttaacagccatcttgcc

SEQ ID NO: 92580 - DNA, 35 bp, Artificial Sequence
  Description of Artificial Sequence: Synthetic oligonucleotide
cacagaggattttactgcttaacagccatcttgcc

SEQ ID NO: 92581 - DNA, 35 bp, Artificial Sequence
  Description of Artificial Sequence: Synthetic oligonucleotide
acagaggattttactgcttaacagccatcttgccc

SEQ ID NO: 92582 - DNA, 34 bp, Artificial Sequence
  Description of Artificial Sequence: Synthetic oligonucleotide
cagaggattttactgcttaacagccatcttgccc

SEQ ID NO: 92583 - DNA, 34 bp, Artificial Sequence
  Description of Artificial Sequence: Synthetic oligonucleotide
agaggattttactgcttaacagccatcttgcccc

SEQ ID NO: 92584 - DNA, 33 bp, Artificial Sequence
  Description of Artificial Sequence: Synthetic oligonucleotide
gaggattttactgcttaacagccatcttgcccc

SEQ ID NO: 92585 - DNA, 39 bp, Artificial Sequence
  Description of Artificial Sequence: Synthetic oligonucleotide
aggattttactgcttaacagccatcttgccccaaatatg

SEQ ID NO: 92586 - DNA, 38 bp, Artificial Sequence
  Description of Artificial Sequence: Synthetic oligonucleotide
ggattttactgcttaacagccatcttgccccaaatatg

SEQ ID NO: 92587 - DNA, 38 bp, Artificial Sequence
  Description of Artificial Sequence: Synthetic oligonucleotide
gattttactgcttaacagccatcttgccccaaatatgc

SEQ ID NO: 92588 - DNA, 42 bp, Artificial Sequence
  Description of Artificial Sequence: Synthetic oligonucleotide
attttactgcttaacagccatcttgccccaaatatgcatttg

SEQ ID NO: 92589 - DNA, 41 bp, Artificial Sequence
  Description of Artificial Sequence: Synthetic oligonucleotide
ttttactgcttaacagccatcttgccccaaatatgcatttg

SEQ ID NO: 92590 - DNA, 40 bp, Artificial Sequence
  Description of Artificial Sequence: Synthetic oligonucleotide
tttactgcttaacagccatcttgccccaaatatgcatttg

SEQ ID NO: 92591 - DNA, 39 bp, Artificial Sequence
  Description of Artificial Sequence: Synthetic oligonucleotide
ttactgcttaacagccatcttgccccaaatatgcatttg

SEQ ID NO: 92592 - DNA, 38 bp, Artificial Sequence
  Description of Artificial Sequence: Synthetic oligonucleotide
tactgcttaacagccatcttgccccaaatatgcatttg

SEQ ID NO: 92593 - DNA, 37 bp, Artificial Sequence
  Description of Artificial Sequence: Synthetic oligonucleotide
actgcttaacagccatcttgccccaaatatgcatttg

SEQ ID NO: 92594 - DNA, 36 bp, Artificial Sequence
  Description of Artificial Sequence: Synthetic oligonucleotide
ctgcttaacagccatcttgccccaaatatgcatttg

SEQ ID NO: 92595 - DNA, 38 bp, Artificial Sequence
  Description of Artificial Sequence: Synthetic oligonucleotide
tgcttaacagccatcttgccccaaatatgcatttgttc

SEQ ID NO: 92596 - DNA, 37 bp, Artificial Sequence
  Description of Artificial Sequence: Synthetic oligonucleotide
gcttaacagccatcttgccccaaatatgcatttgttc

SEQ ID NO: 92597 - DNA, 38 bp, Artificial Sequence
  Description of Artificial Sequence: Synthetic oligonucleotide
cttaacagccatcttgccccaaatatgcatttgttctc

SEQ ID NO: 92598 - DNA, 39 bp, Artificial Sequence
  Description of Artificial Sequence: Synthetic oligonucleotide
ttaacagccatcttgccccaaatatgcatttgttctcag

SEQ ID NO: 92599 - DNA, 38 bp, Artificial Sequence
  Description of Artificial Sequence: Synthetic oligonucleotide
taacagccatcttgccccaaatatgcatttgttctcag

SEQ ID NO: 92600 - DNA, 37 bp, Artificial Sequence
  Description of Artificial Sequence: Synthetic oligonucleotide
aacagccatcttgccccaaatatgcatttgttctcag

SEQ ID NO: 92601 - DNA, 36 bp, Artificial Sequence
  Description of Artificial Sequence: Synthetic oligonucleotide
acagccatcttgccccaaatatgcatttgttctcag

SEQ ID NO: 92602 - DNA, 35 bp, Artificial Sequence
  Description of Artificial Sequence: Synthetic oligonucleotide
cagccatcttgccccaaatatgcatttgttctcag

SEQ ID NO: 92603 - DNA, 37 bp, Artificial Sequence
  Description of Artificial Sequence: Synthetic oligonucleotide
agccatcttgccccaaatatgcatttgttctcagttc

SEQ ID NO: 92604 - DNA, 36 bp, Artificial Sequence
  Description of Artificial Sequence: Synthetic oligonucleotide
gccatcttgccccaaatatgcatttgttctcagttc

SEQ ID NO: 92605 - DNA, 37 bp, Artificial Sequence
  Description of Artificial Sequence: Synthetic oligonucleotide
ccatcttgccccaaatatgcatttgttctcagttctc

SEQ ID NO: 92606 - DNA, 38 bp, Artificial Sequence
  Description of Artificial Sequence: Synthetic oligonucleotide
catcttgccccaaatatgcatttgttctcagttctcag

SEQ ID NO: 92607 - DNA, 39 bp, Artificial Sequence
  Description of Artificial Sequence: Synthetic oligonucleotide
atcttgccccaaatatgcatttgttctcagttctcagtg

SEQ ID NO: 92608 - DNA, 38 bp, Artificial Sequence
  Description of Artificial Sequence: Synthetic oligonucleotide
tcttgccccaaatatgcatttgttctcagttctcagtg

SEQ ID NO: 92609 - DNA, 37 bp, Artificial Sequence
  Description of Artificial Sequence: Synthetic oligonucleotide
cttgccccaaatatgcatttgttctcagttctcagtg

SEQ ID NO: 92610 - DNA, 37 bp, Artificial Sequence
  Description of Artificial Sequence: Synthetic oligonucleotide
ttgccccaaatatgcatttgttctcagttctcagtgc

SEQ ID NO: 92611 - DNA, 36 bp, Artificial Sequence
  Description of Artificial Sequence: Synthetic oligonucleotide
tgccccaaatatgcatttgttctcagttctcagtgc

SEQ ID NO: 92612 - DNA, 35 bp, Artificial Sequence
  Description of Artificial Sequence: Synthetic oligonucleotide
gccccaaatatgcatttgttctcagttctcagtgc

SEQ ID NO: 92613 - DNA, 35 bp, Artificial Sequence
  Description of Artificial Sequence: Synthetic oligonucleotide
ccccaaatatgcatttgttctcagttctcagtgcc

SEQ ID NO: 92614 - DNA, 37 bp, Artificial Sequence
  Description of Artificial Sequence: Synthetic oligonucleotide
cccaaatatgcatttgttctcagttctcagtgccatc

SEQ ID NO: 92615 - DNA, 39 bp, Artificial Sequence
  Description of Artificial Sequence: Synthetic oligonucleotide
ccaaatatgcatttgttctcagttctcagtgccatctag

SEQ ID NO: 92616 - DNA, 43 bp, Artificial Sequence
  Description of Artificial Sequence: Synthetic oligonucleotide
caaatatgcatttgttctcagttctcagtgccatctagttatc

SEQ ID NO: 92617 - DNA, 44 bp, Artificial Sequence
  Description of Artificial Sequence: Synthetic oligonucleotide
aaatatgcatttgttctcagttctcagtgccatctagttatcac

SEQ ID NO: 92618 - DNA, 43 bp, Artificial Sequence
  Description of Artificial Sequence: Synthetic oligonucleotide
aatatgcatttgttctcagttctcagtgccatctagttatcac

SEQ ID NO: 92619 - DNA, 42 bp, Artificial Sequence
  Description of Artificial Sequence: Synthetic oligonucleotide
atatgcatttgttctcagttctcagtgccatctagttatcac

SEQ ID NO: 92620 - DNA, 41 bp, Artificial Sequence
  Description of Artificial Sequence: Synthetic oligonucleotide
tatgcatttgttctcagttctcagtgccatctagttatcac

SEQ ID NO: 92621 - DNA, 40 bp, Artificial Sequence
  Description of Artificial Sequence: Synthetic oligonucleotide
atgcatttgttctcagttctcagtgccatctagttatcac

SEQ ID NO: 92622 - DNA, 39 bp, Artificial Sequence
  Description of Artificial Sequence: Synthetic oligonucleotide
tgcatttgttctcagttctcagtgccatctagttatcac

SEQ ID NO: 92623 - DNA, 38 bp, Artificial Sequence
  Description of Artificial Sequence: Synthetic oligonucleotide
gcatttgttctcagttctcagtgccatctagttatcac

SEQ ID NO: 92624 - DNA, 40 bp, Artificial Sequence
  Description of Artificial Sequence: Synthetic oligonucleotide
catttgttctcagttctcagtgccatctagttatcacttc

SEQ ID NO: 92625 - DNA, 41 bp, Artificial Sequence
  Description of Artificial Sequence: Synthetic oligonucleotide
atttgttctcagttctcagtgccatctagttatcacttcac

SEQ ID NO: 92626 - DNA, 40 bp, Artificial Sequence
  Description of Artificial Sequence: Synthetic oligonucleotide
tttgttctcagttctcagtgccatctagttatcacttcac

SEQ ID NO: 92627 - DNA, 39 bp, Artificial Sequence
  Description of Artificial Sequence: Synthetic oligonucleotide
ttgttctcagttctcagtgccatctagttatcacttcac

SEQ ID NO: 92628 - DNA, 38 bp, Artificial Sequence
  Description of Artificial Sequence: Synthetic oligonucleotide
tgttctcagttctcagtgccatctagttatcacttcac

SEQ ID NO: 92629 - DNA, 37 bp, Artificial Sequence
  Description of Artificial Sequence: Synthetic oligonucleotide
gttctcagttctcagtgccatctagttatcacttcac

SEQ ID NO: 92630 - DNA, 38 bp, Artificial Sequence
  Description of Artificial Sequence: Synthetic oligonucleotide
ttctcagttctcagtgccatctagttatcacttcactg

SEQ ID NO: 92631 - DNA, 37 bp, Artificial Sequence
  Description of Artificial Sequence: Synthetic oligonucleotide
tctcagttctcagtgccatctagttatcacttcactg

SEQ ID NO: 92632 - DNA, 36 bp, Artificial Sequence
  Description of Artificial Sequence: Synthetic oligonucleotide
ctcagttctcagtgccatctagttatcacttcactg

SEQ ID NO: 92633 - DNA, 37 bp, Artificial Sequence
  Description of Artificial Sequence: Synthetic oligonucleotide
tcagttctcagtgccatctagttatcacttcactgag

SEQ ID NO: 92634 - DNA, 36 bp, Artificial Sequence
  Description of Artificial Sequence: Synthetic oligonucleotide
cagttctcagtgccatctagttatcacttcactgag

SEQ ID NO: 92635 - DNA, 36 bp, Artificial Sequence
  Description of Artificial Sequence: Synthetic oligonucleotide
agttctcagtgccatctagttatcacttcactgagg

SEQ ID NO: 92636 - DNA, 35 bp, Artificial Sequence
  Description of Artificial Sequence: Synthetic oligonucleotide
gttctcagtgccatctagttatcacttcactgagg

SEQ ID NO: 92637 - DNA, 37 bp, Artificial Sequence
  Description of Artificial Sequence: Synthetic oligonucleotide
ttctcagtgccatctagttatcacttcactgaggatc

SEQ ID NO: 92638 - DNA, 36 bp, Artificial Sequence
  Description of Artificial Sequence: Synthetic oligonucleotide
tctcagtgccatctagttatcacttcactgaggatc

SEQ ID NO: 92639 - DNA, 35 bp, Artificial Sequence
  Description of Artificial Sequence: Synthetic oligonucleotide
ctcagtgccatctagttatcacttcactgaggatc

SEQ ID NO: 92640 - DNA, 35 bp, Artificial Sequence
  Description of Artificial Sequence: Synthetic oligonucleotide
tcagtgccatctagttatcacttcactgaggatcc

SEQ ID NO: 92641 - DNA, 34 bp, Artificial Sequence
  Description of Artificial Sequence: Synthetic oligonucleotide
cagtgccatctagttatcacttcactgaggatcc

SEQ ID NO: 92642 - DNA, 35 bp, Artificial Sequence
  Description of Artificial Sequence: Synthetic oligonucleotide
agtgccatctagttatcacttcactgaggatcctg

SEQ ID NO: 92643 - DNA, 34 bp, Artificial Sequence
  Description of Artificial Sequence: Synthetic oligonucleotide
gtgccatctagttatcacttcactgaggatcctg

SEQ ID NO: 92644 - DNA, 34 bp, Artificial Sequence
  Description of Artificial Sequence: Synthetic oligonucleotide
tgccatctagttatcacttcactgaggatcctgg

SEQ ID NO: 92645 - DNA, 33 bp, Artificial Sequence
  Description of Artificial Sequence: Synthetic oligonucleotide
gccatctagttatcacttcactgaggatcctgg

SEQ ID NO: 92646 - DNA, 33 bp, Artificial Sequence
  Description of Artificial Sequence: Synthetic oligonucleotide
ccatctagttatcacttcactgaggatcctggg

SEQ ID NO: 92647 - DNA, 33 bp, Artificial Sequence
  Description of Artificial Sequence: Synthetic oligonucleotide
catctagttatcacttcactgaggatcctgggg

SEQ ID NO: 92648 - DNA, 33 bp, Artificial Sequence
  Description of Artificial Sequence: Synthetic oligonucleotide
atctagttatcacttcactgaggatcctggggc

SEQ ID NO: 92649 - DNA, 32 bp, Artificial Sequence
  Description of Artificial Sequence: Synthetic oligonucleotide
tctagttatcacttcactgaggatcctggggc

SEQ ID NO: 92650 - DNA, 31 bp, Artificial Sequence
  Description of Artificial Sequence: Synthetic oligonucleotide
ctagttatcacttcactgaggatcctggggc

SEQ ID NO: 92651 - DNA, 34 bp, Artificial Sequence
  Description of Artificial Sequence: Synthetic oligonucleotide
tagttatcacttcactgaggatcctggggctttc

SEQ ID NO: 92652 - DNA, 33 bp, Artificial Sequence
  Description of Artificial Sequence: Synthetic oligonucleotide
agttatcacttcactgaggatcctggggctttc

SEQ ID NO: 92653 - DNA, 32 bp, Artificial Sequence
  Description of Artificial Sequence: Synthetic oligonucleotide
gttatcacttcactgaggatcctggggctttc

SEQ ID NO: 92654 - DNA, 32 bp, Artificial Sequence
  Description of Artificial Sequence: Synthetic oligonucleotide
ttatcacttcactgaggatcctggggctttcc

SEQ ID NO: 92655 - DNA, 31 bp, Artificial Sequence
  Description of Artificial Sequence: Synthetic oligonucleotide
tatcacttcactgaggatcctggggctttcc

SEQ ID NO: 92656 - DNA, 30 bp, Artificial Sequence
  Description of Artificial Sequence: Synthetic oligonucleotide
atcacttcactgaggatcctggggctttcc

SEQ ID NO: 92657 - DNA, 29 bp, Artificial Sequence
  Description of Artificial Sequence: Synthetic oligonucleotide
tcacttcactgaggatcctggggctttcc

SEQ ID NO: 92658 - DNA, 28 bp, Artificial Sequence
  Description of Artificial Sequence: Synthetic oligonucleotide
cacttcactgaggatcctggggctttcc

SEQ ID NO: 92659 - DNA, 28 bp, Artificial Sequence
  Description of Artificial Sequence: Synthetic oligonucleotide
acttcactgaggatcctggggctttccc

SEQ ID NO: 92660 - DNA, 27 bp, Artificial Sequence
  Description of Artificial Sequence: Synthetic oligonucleotide
cttcactgaggatcctggggctttccc

SEQ ID NO: 92661 - DNA, 28 bp, Artificial Sequence
  Description of Artificial Sequence: Synthetic oligonucleotide
ttcactgaggatcctggggctttcccag

SEQ ID NO: 92662 - DNA, 27 bp, Artificial Sequence
  Description of Artificial Sequence: Synthetic oligonucleotide
tcactgaggatcctggggctttcccag

SEQ ID NO: 92663 - DNA, 27 bp, Artificial Sequence
  Description of Artificial Sequence: Synthetic oligonucleotide
cactgaggatcctggggctttcccagt

SEQ ID NO: 92664 - DNA, 28 bp, Artificial Sequence
  Description of Artificial Sequence: Synthetic oligonucleotide
actgaggatcctggggctttcccagtag

SEQ ID NO: 92665 - DNA, 27 bp, Artificial Sequence
  Description of Artificial Sequence: Synthetic oligonucleotide
ctgaggatcctggggctttcccagtag

SEQ ID NO: 92666 - DNA, 27 bp, Artificial Sequence
  Description of Artificial Sequence: Synthetic oligonucleotide
tgaggatcctggggctttcccagtagc

SEQ ID NO: 92667 - DNA, 26 bp, Artificial Sequence
  Description of Artificial Sequence: Synthetic oligonucleotide
gaggatcctggggctttcccagtagc

SEQ ID NO: 92668 - DNA, 27 bp, Artificial Sequence
  Description of Artificial Sequence: Synthetic oligonucleotide
aggatcctggggctttcccagtagcca

SEQ ID NO: 92669 - DNA, 26 bp, Artificial Sequence
  Description of Artificial Sequence: Synthetic oligonucleotide
ggatcctggggctttcccagtagcca

SEQ ID NO: 92670 - DNA, 27 bp, Artificial Sequence
  Description of Artificial Sequence: Synthetic oligonucleotide
gatcctggggctttcccagtagccact

SEQ ID NO: 92671 - DNA, 30 bp, Artificial Sequence
  Description of Artificial Sequence: Synthetic oligonucleotide
atcctggggctttcccagtagccactaatg

SEQ ID NO: 92672 - DNA, 29 bp, Artificial Sequence
  Description of Artificial Sequence: Synthetic oligonucleotide
tcctggggctttcccagtagccactaatg

SEQ ID NO: 92673 - DNA, 28 bp, Artificial Sequence
  Description of Artificial Sequence: Synthetic oligonucleotide
cctggggctttcccagtagccactaatg

SEQ ID NO: 92674 - DNA, 28 bp, Artificial Sequence
  Description of Artificial Sequence: Synthetic oligonucleotide
ctggggctttcccagtagccactaatgg

SEQ ID NO: 92675 - DNA, 28 bp, Artificial Sequence
  Description of Artificial Sequence: Synthetic oligonucleotide
tggggctttcccagtagccactaatggg

SEQ ID NO: 92676 - DNA, 27 bp, Artificial Sequence
  Description of Artificial Sequence: Synthetic oligonucleotide
ggggctttcccagtagccactaatggg

SEQ ID NO: 92677 - DNA, 27 bp, Artificial Sequence
  Description of Artificial Sequence: Synthetic oligonucleotide
gggctttcccagtagccactaatgggg

SEQ ID NO: 92678 - DNA, 29 bp, Artificial Sequence
  Description of Artificial Sequence: Synthetic oligonucleotide
ggctttcccagtagccactaatggggaac

SEQ ID NO: 92679 - DNA, 29 bp, Artificial Sequence
  Description of Artificial Sequence: Synthetic oligonucleotide
gctttcccagtagccactaatggggaacg

SEQ ID NO: 92680 - DNA, 33 bp, Artificial Sequence
  Description of Artificial Sequence: Synthetic oligonucleotide
ctttcccagtagccactaatggggaacgatttc

SEQ ID NO: 92681 - DNA, 33 bp, Artificial Sequence
  Description of Artificial Sequence: Synthetic oligonucleotide
tttcccagtagccactaatggggaacgatttcc

SEQ ID NO: 92682 - DNA, 32 bp, Artificial Sequence
  Description of Artificial Sequence: Synthetic oligonucleotide
ttcccagtagccactaatggggaacgatttcc

SEQ ID NO: 92683 - DNA, 31 bp, Artificial Sequence
  Description of Artificial Sequence: Synthetic oligonucleotide
tcccagtagccactaatggggaacgatttcc

SEQ ID NO: 92684 - DNA, 30 bp, Artificial Sequence
  Description of Artificial Sequence: Synthetic oligonucleotide
cccagtagccactaatggggaacgatttcc

SEQ ID NO: 92685 - DNA, 32 bp, Artificial Sequence
  Description of Artificial Sequence: Synthetic oligonucleotide
ccagtagccactaatggggaacgatttccttg

SEQ ID NO: 92686 - DNA, 32 bp, Artificial Sequence
  Description of Artificial Sequence: Synthetic oligonucleotide
cagtagccactaatggggaacgatttccttgg

SEQ ID NO: 92687 - DNA, 32 bp, Artificial Sequence
  Description of Artificial Sequence: Synthetic oligonucleotide
agtagccactaatggggaacgatttccttggc

SEQ ID NO: 92688 - DNA, 31 bp, Artificial Sequence
  Description of Artificial Sequence: Synthetic oligonucleotide
gtagccactaatggggaacgatttccttggc

SEQ ID NO: 92689 - DNA, 32 bp, Artificial Sequence
  Description of Artificial Sequence: Synthetic oligonucleotide
tagccactaatggggaacgatttccttggcag

SEQ ID NO: 92690 - DNA, 31 bp, Artificial Sequence
  Description of Artificial Sequence: Synthetic oligonucleotide
agccactaatggggaacgatttccttggcag

SEQ ID NO: 92691 - DNA, 30 bp, Artificial Sequence
  Description of Artificial Sequence: Synthetic oligonucleotide
gccactaatggggaacgatttccttggcag

SEQ ID NO: 92692 - DNA, 30 bp, Artificial Sequence
  Description of Artificial Sequence: Synthetic oligonucleotide
ccactaatggggaacgatttccttggcagg

SEQ ID NO: 92693 - DNA, 31 bp, Artificial Sequence
  Description of Artificial Sequence: Synthetic oligonucleotide
cactaatggggaacgatttccttggcaggag

SEQ ID NO: 92694 - DNA, 31 bp, Artificial Sequence
  Description of Artificial Sequence: Synthetic oligonucleotide
actaatggggaacgatttccttggcaggagc

SEQ ID NO: 92695 - DNA, 30 bp, Artificial Sequence
  Description of Artificial Sequence: Synthetic oligonucleotide
ctaatggggaacgatttccttggcaggagc

SEQ ID NO: 92696 - DNA, 33 bp, Artificial Sequence
  Description of Artificial Sequence: Synthetic oligonucleotide
taatggggaacgatttccttggcaggagctaag

SEQ ID NO: 92697 - DNA, 32 bp, Artificial Sequence
  Description of Artificial Sequence: Synthetic oligonucleotide
aatggggaacgatttccttggcaggagctaag

SEQ ID NO: 92698 - DNA, 31 bp, Artificial Sequence
  Description of Artificial Sequence: Synthetic oligonucleotide
atggggaacgatttccttggcaggagctaag

SEQ ID NO: 92699 - DNA, 30 bp, Artificial Sequence
  Description of Artificial Sequence: Synthetic oligonucleotide
tggggaacgatttccttggcaggagctaag

SEQ ID NO: 92700 - DNA, 29 bp, Artificial Sequence
  Description of Artificial Sequence: Synthetic oligonucleotide
ggggaacgatttccttggcaggagctaag

SEQ ID NO: 92701 - DNA, 29 bp, Artificial Sequence
  Description of Artificial Sequence: Synthetic oligonucleotide
gggaacgatttccttggcaggagctaagg

SEQ ID NO: 92702 - DNA, 29 bp, Artificial Sequence
  Description of Artificial Sequence: Synthetic oligonucleotide
ggaacgatttccttggcaggagctaaggc

SEQ ID NO: 92703 - DNA, 30 bp, Artificial Sequence
  Description of Artificial Sequence: Synthetic oligonucleotide
gaacgatttccttggcaggagctaaggctc

SEQ ID NO: 92704 - DNA, 30 bp, Artificial Sequence
  Description of Artificial Sequence: Synthetic oligonucleotide
aacgatttccttggcaggagctaaggctcc

SEQ ID NO: 92705 - DNA, 29 bp, Artificial Sequence
  Description of Artificial Sequence: Synthetic oligonucleotide
acgatttccttggcaggagctaaggctcc

SEQ ID NO: 92706 - DNA, 28 bp, Artificial Sequence
  Description of Artificial Sequence: Synthetic oligonucleotide
cgatttccttggcaggagctaaggctcc

SEQ ID NO: 92707 - DNA, 28 bp, Artificial Sequence
  Description of Artificial Sequence: Synthetic oligonucleotide
gatttccttggcaggagctaaggctccc

SEQ ID NO: 92708 - DNA, 28 bp, Artificial Sequence
  Description of Artificial Sequence: Synthetic oligonucleotide
atttccttggcaggagctaaggctcccc

SEQ ID NO: 92709 - DNA, 27 bp, Artificial Sequence
  Description of Artificial Sequence: Synthetic oligonucleotide
tttccttggcaggagctaaggctcccc

SEQ ID NO: 92710 - DNA, 27 bp, Artificial Sequence
  Description of Artificial Sequence: Synthetic oligonucleotide
ttccttggcaggagctaaggctcccca

SEQ ID NO: 92711 - DNA, 26 bp, Artificial Sequence
  Description of Artificial Sequence: Synthetic oligonucleotide
tccttggcaggagctaaggctcccca

SEQ ID NO: 92712 - DNA, 25 bp, Artificial Sequence
  Description of Artificial Sequence: Synthetic oligonucleotide
ccttggcaggagctaaggctcccca

SEQ ID NO: 92713 - DNA, 26 bp, Artificial Sequence
  Description of Artificial Sequence: Synthetic oligonucleotide
cttggcaggagctaaggctccccagt

SEQ ID NO: 92714 - DNA, 27 bp, Artificial Sequence
  Description of Artificial Sequence: Synthetic oligonucleotide
ttggcaggagctaaggctccccagtgt

SEQ ID NO: 92715 - DNA, 26 bp, Artificial Sequence
  Description of Artificial Sequence: Synthetic oligonucleotide
tggcaggagctaaggctccccagtgt

SEQ ID NO: 92716 - DNA, 25 bp, Artificial Sequence
  Description of Artificial Sequence: Synthetic oligonucleotide
ggcaggagctaaggctccccagtgt

SEQ ID NO: 92717 - DNA, 25 bp, Artificial Sequence
  Description of Artificial Sequence: Synthetic oligonucleotide
gcaggagctaaggctccccagtgtg

SEQ ID NO: 92718 - DNA, 26 bp, Artificial Sequence
  Description of Artificial Sequence: Synthetic oligonucleotide
caggagctaaggctccccagtgtggt

SEQ ID NO: 92719 - DNA, 27 bp, Artificial Sequence
  Description of Artificial Sequence: Synthetic oligonucleotide
aggagctaaggctccccagtgtggtca

SEQ ID NO: 92720 - DNA, 27 bp, Artificial Sequence
  Description of Artificial Sequence: Synthetic oligonucleotide
ggagctaaggctccccagtgtggtcat

SEQ ID NO: 92721 - DNA, 28 bp, Artificial Sequence
  Description of Artificial Sequence: Synthetic oligonucleotide
gagctaaggctccccagtgtggtcattc

SEQ ID NO: 92722 - DNA, 28 bp, Artificial Sequence
  Description of Artificial Sequence: Synthetic oligonucleotide
agctaaggctccccagtgtggtcattcc

SEQ ID NO: 92723 - DNA, 27 bp, Artificial Sequence
  Description of Artificial Sequence: Synthetic oligonucleotide
gctaaggctccccagtgtggtcattcc

SEQ ID NO: 92724 - DNA, 28 bp, Artificial Sequence
  Description of Artificial Sequence: Synthetic oligonucleotide
ctaaggctccccagtgtggtcattcctc

SEQ ID NO: 92725 - DNA, 29 bp, Artificial Sequence
  Description of Artificial Sequence: Synthetic oligonucleotide
taaggctccccagtgtggtcattcctctc

SEQ ID NO: 92726 - DNA, 28 bp, Artificial Sequence
  Description of Artificial Sequence: Synthetic oligonucleotide
aaggctccccagtgtggtcattcctctc

SEQ ID NO: 92727 - DNA, 27 bp, Artificial Sequence
  Description of Artificial Sequence: Synthetic oligonucleotide
aggctccccagtgtggtcattcctctc

SEQ ID NO: 92728 - DNA, 26 bp, Artificial Sequence
  Description of Artificial Sequence: Synthetic oligonucleotide
ggctccccagtgtggtcattcctctc

SEQ ID NO: 92729 - DNA, 27 bp, Artificial Sequence
  Description of Artificial Sequence: Synthetic oligonucleotide
gctccccagtgtggtcattcctctcca

SEQ ID NO: 92730 - DNA, 31 bp, Artificial Sequence
  Description of Artificial Sequence: Synthetic oligonucleotide
ctccccagtgtggtcattcctctccattatg

SEQ ID NO: 92731 - DNA, 32 bp, Artificial Sequence
  Description of Artificial Sequence: Synthetic oligonucleotide
tccccagtgtggtcattcctctccattatgac

SEQ ID NO: 92732 - DNA, 31 bp, Artificial Sequence
  Description of Artificial Sequence: Synthetic oligonucleotide
ccccagtgtggtcattcctctccattatgac

SEQ ID NO: 92733 - DNA, 31 bp, Artificial Sequence
  Description of Artificial Sequence: Synthetic oligonucleotide
cccagtgtggtcattcctctccattatgacc

SEQ ID NO: 92734 - DNA, 32 bp, Artificial Sequence
  Description of Artificial Sequence: Synthetic oligonucleotide
ccagtgtggtcattcctctccattatgacctc

SEQ ID NO: 92735 - DNA, 35 bp, Artificial Sequence
  Description of Artificial Sequence: Synthetic oligonucleotide
cagtgtggtcattcctctccattatgacctctttg

SEQ ID NO: 92736 - DNA, 36 bp, Artificial Sequence
  Description of Artificial Sequence: Synthetic oligonucleotide
agtgtggtcattcctctccattatgacctctttgtc

SEQ ID NO: 92737 - DNA, 35 bp, Artificial Sequence
  Description of Artificial Sequence: Synthetic oligonucleotide
gtgtggtcattcctctccattatgacctctttgtc

SEQ ID NO: 92738 - DNA, 35 bp, Artificial Sequence
  Description of Artificial Sequence: Synthetic oligonucleotide
tgtggtcattcctctccattatgacctctttgtcc

SEQ ID NO: 92739 - DNA, 34 bp, Artificial Sequence
  Description of Artificial Sequence: Synthetic oligonucleotide
gtggtcattcctctccattatgacctctttgtcc

SEQ ID NO: 92740 - DNA, 35 bp, Artificial Sequence
  Description of Artificial Sequence: Synthetic oligonucleotide
tggtcattcctctccattatgacctctttgtccac

SEQ ID NO: 92741 - DNA, 34 bp, Artificial Sequence
  Description of Artificial Sequence: Synthetic oligonucleotide
ggtcattcctctccattatgacctctttgtccac

SEQ ID NO: 92742 - DNA, 34 bp, Artificial Sequence
  Description of Artificial Sequence: Synthetic oligonucleotide
gtcattcctctccattatgacctctttgtccacc

SEQ ID NO: 92743 - DNA, 34 bp, Artificial Sequence
  Description of Artificial Sequence: Synthetic oligonucleotide
tcattcctctccattatgacctctttgtccaccc

SEQ ID NO: 92744 - DNA, 33 bp, Artificial Sequence
  Description of Artificial Sequence: Synthetic oligonucleotide
cattcctctccattatgacctctttgtccaccc

SEQ ID NO: 92745 - DNA, 33 bp, Artificial Sequence
  Description of Artificial Sequence: Synthetic oligonucleotide
attcctctccattatgacctctttgtccacccc

SEQ ID NO: 92746 - DNA, 32 bp, Artificial Sequence
  Description of Artificial Sequence: Synthetic oligonucleotide
ttcctctccattatgacctctttgtccacccc

SEQ ID NO: 92747 - DNA, 31 bp, Artificial Sequence
  Description of Artificial Sequence: Synthetic oligonucleotide
tcctctccattatgacctctttgtccacccc

SEQ ID NO: 92748 - DNA, 30 bp, Artificial Sequence
  Description of Artificial Sequence: Synthetic oligonucleotide
cctctccattatgacctctttgtccacccc

SEQ ID NO: 92749 - DNA, 33 bp, Artificial Sequence
  Description of Artificial Sequence: Synthetic oligonucleotide
ctctccattatgacctctttgtccaccccaatc

SEQ ID NO: 92750 - DNA, 34 bp, Artificial Sequence
  Description of Artificial Sequence: Synthetic oligonucleotide
tctccattatgacctctttgtccaccccaatctc

SEQ ID NO: 92751 - DNA, 33 bp, Artificial Sequence
  Description of Artificial Sequence: Synthetic oligonucleotide
ctccattatgacctctttgtccaccccaatctc

SEQ ID NO: 92752 - DNA, 34 bp, Artificial Sequence
  Description of Artificial Sequence: Synthetic oligonucleotide
tccattatgacctctttgtccaccccaatctcac

SEQ ID NO: 92753 - DNA, 33 bp, Artificial Sequence
  Description of Artificial Sequence: Synthetic oligonucleotide
ccattatgacctctttgtccaccccaatctcac

SEQ ID NO: 92754 - DNA, 33 bp, Artificial Sequence
  Description of Artificial Sequence: Synthetic oligonucleotide
cattatgacctctttgtccaccccaatctcacc

SEQ ID NO: 92755 - DNA, 34 bp, Artificial Sequence
  Description of Artificial Sequence: Synthetic oligonucleotide
attatgacctctttgtccaccccaatctcacctc

SEQ ID NO: 92756 - DNA, 33 bp, Artificial Sequence
  Description of Artificial Sequence: Synthetic oligonucleotide
ttatgacctctttgtccaccccaatctcacctc

SEQ ID NO: 92757 - DNA, 32 bp, Artificial Sequence
  Description of Artificial Sequence: Synthetic oligonucleotide
tatgacctctttgtccaccccaatctcacctc

SEQ ID NO: 92758 - DNA, 31 bp, Artificial Sequence
  Description of Artificial Sequence: Synthetic oligonucleotide
atgacctctttgtccaccccaatctcacctc

SEQ ID NO: 92759 - DNA, 30 bp, Artificial Sequence
  Description of Artificial Sequence: Synthetic oligonucleotide
tgacctctttgtccaccccaatctcacctc

SEQ ID NO: 92760 - DNA, 29 bp, Artificial Sequence
  Description of Artificial Sequence: Synthetic oligonucleotide
gacctctttgtccaccccaatctcacctc

SEQ ID NO: 92761 - DNA, 30 bp, Artificial Sequence
  Description of Artificial Sequence: Synthetic oligonucleotide
acctctttgtccaccccaatctcacctctc

SEQ ID NO: 92762 - DNA, 29 bp, Artificial Sequence
  Description of Artificial Sequence: Synthetic oligonucleotide
cctctttgtccaccccaatctcacctctc

SEQ ID NO: 92763 - DNA, 30 bp, Artificial Sequence
  Description of Artificial Sequence: Synthetic oligonucleotide
ctctttgtccaccccaatctcacctctctg

SEQ ID NO: 92764 - DNA, 30 bp, Artificial Sequence
  Description of Artificial Sequence: Synthetic oligonucleotide
tctttgtccaccccaatctcacctctctgg

SEQ ID NO: 92765 - DNA, 29 bp, Artificial Sequence
  Description of Artificial Sequence: Synthetic oligonucleotide
ctttgtccaccccaatctcacctctctgg

SEQ ID NO: 92766 - DNA, 30 bp, Artificial Sequence
  Description of Artificial Sequence: Synthetic oligonucleotide
tttgtccaccccaatctcacctctctggac

SEQ ID NO: 92767 - DNA, 29 bp, Artificial Sequence
  Description of Artificial Sequence: Synthetic oligonucleotide
ttgtccaccccaatctcacctctctggac

SEQ ID NO: 92768 - DNA, 28 bp, Artificial Sequence
  Description of Artificial Sequence: Synthetic oligonucleotide
tgtccaccccaatctcacctctctggac

SEQ ID NO: 92769 - DNA, 27 bp, Artificial Sequence
  Description of Artificial Sequence: Synthetic oligonucleotide
gtccaccccaatctcacctctctggac

SEQ ID NO: 92770 - DNA, 30 bp, Artificial Sequence
  Description of Artificial Sequence: Synthetic oligonucleotide
tccaccccaatctcacctctctggactttg

SEQ ID NO: 92771 - DNA, 29 bp, Artificial Sequence
  Description of Artificial Sequence: Synthetic oligonucleotide
ccaccccaatctcacctctctggactttg

SEQ ID NO: 92772 - DNA, 31 bp, Artificial Sequence
  Description of Artificial Sequence: Synthetic oligonucleotide
caccccaatctcacctctctggactttgttg

SEQ ID NO: 92773 - DNA, 31 bp, Artificial Sequence
  Description of Artificial Sequence: Synthetic oligonucleotide
accccaatctcacctctctggactttgttgc

SEQ ID NO: 92774 - DNA, 30 bp, Artificial Sequence
  Description of Artificial Sequence: Synthetic oligonucleotide
ccccaatctcacctctctggactttgttgc

SEQ ID NO: 92775 - DNA, 32 bp, Artificial Sequence
  Description of Artificial Sequence: Synthetic oligonucleotide
cccaatctcacctctctggactttgttgcatc

SEQ ID NO: 92776 - DNA, 33 bp, Artificial Sequence
  Description of Artificial Sequence: Synthetic oligonucleotide
ccaatctcacctctctggactttgttgcatctg

SEQ ID NO: 92777 - DNA, 34 bp, Artificial Sequence
  Description of Artificial Sequence: Synthetic oligonucleotide
caatctcacctctctggactttgttgcatctgag

SEQ ID NO: 92778 - DNA, 36 bp, Artificial Sequence
  Description of Artificial Sequence: Synthetic oligonucleotide
aatctcacctctctggactttgttgcatctgagaag

SEQ ID NO: 92779 - DNA, 35 bp, Artificial Sequence
  Description of Artificial Sequence: Synthetic oligonucleotide
atctcacctctctggactttgttgcatctgagaag

SEQ ID NO: 92780 - DNA, 34 bp, Artificial Sequence
  Description of Artificial Sequence: Synthetic oligonucleotide
tctcacctctctggactttgttgcatctgagaag

SEQ ID NO: 92781 - DNA, 33 bp, Artificial Sequence
  Description of Artificial Sequence: Synthetic oligonucleotide
ctcacctctctggactttgttgcatctgagaag

SEQ ID NO: 92782 - DNA, 35 bp, Artificial Sequence
  Description of Artificial Sequence: Synthetic oligonucleotide
tcacctctctggactttgttgcatctgagaagatc

SEQ ID NO: 92783 - DNA, 34 bp, Artificial Sequence
  Description of Artificial Sequence: Synthetic oligonucleotide
cacctctctggactttgttgcatctgagaagatc

SEQ ID NO: 92784 - DNA, 34 bp, Artificial Sequence
  Description of Artificial Sequence: Synthetic oligonucleotide
acctctctggactttgttgcatctgagaagatcg

SEQ ID NO: 92785 - DNA, 33 bp, Artificial Sequence
  Description of Artificial Sequence: Synthetic oligonucleotide
cctctctggactttgttgcatctgagaagatcg

SEQ ID NO: 92786 - DNA, 35 bp, Artificial Sequence
  Description of Artificial Sequence: Synthetic oligonucleotide
ctctctggactttgttgcatctgagaagatcgaag

SEQ ID NO: 92787 - DNA, 36 bp, Artificial Sequence
  Description of Artificial Sequence: Synthetic oligonucleotide
tctctggactttgttgcatctgagaagatcgaagtc

SEQ ID NO: 92788 - DNA, 35 bp, Artificial Sequence
  Description of Artificial Sequence: Synthetic oligonucleotide
ctctggactttgttgcatctgagaagatcgaagtc

SEQ ID NO: 92789 - DNA, 37 bp, Artificial Sequence
  Description of Artificial Sequence: Synthetic oligonucleotide
tctggactttgttgcatctgagaagatcgaagtcttg

SEQ ID NO: 92790 - DNA, 36 bp, Artificial Sequence
  Description of Artificial Sequence: Synthetic oligonucleotide
ctggactttgttgcatctgagaagatcgaagtcttg

SEQ ID NO: 92791 - DNA, 36 bp, Artificial Sequence
  Description of Artificial Sequence: Synthetic oligonucleotide
tggactttgttgcatctgagaagatcgaagtcttgg

SEQ ID NO: 92792 - DNA, 35 bp, Artificial Sequence
  Description of Artificial Sequence: Synthetic oligonucleotide
ggactttgttgcatctgagaagatcgaagtcttgg

SEQ ID NO: 92793 - DNA, 36 bp, Artificial Sequence
  Description of Artificial Sequence: Synthetic oligonucleotide
gactttgttgcatctgagaagatcgaagtcttggtc

SEQ ID NO: 92794 - DNA, 37 bp, Artificial Sequence
  Description of Artificial Sequence: Synthetic oligonucleotide
actttgttgcatctgagaagatcgaagtcttggtcag

SEQ ID NO: 92795 - DNA, 36 bp, Artificial Sequence
  Description of Artificial Sequence: Synthetic oligonucleotide
ctttgttgcatctgagaagatcgaagtcttggtcag

SEQ ID NO: 92796 - DNA, 36 bp, Artificial Sequence
  Description of Artificial Sequence: Synthetic oligonucleotide
tttgttgcatctgagaagatcgaagtcttggtcagc

SEQ ID NO: 92797 - DNA, 35 bp, Artificial Sequence
  Description of Artificial Sequence: Synthetic oligonucleotide
ttgttgcatctgagaagatcgaagtcttggtcagc

SEQ ID NO: 92798 - DNA, 34 bp, Artificial Sequence
  Description of Artificial Sequence: Synthetic oligonucleotide
tgttgcatctgagaagatcgaagtcttggtcagc

SEQ ID NO: 92799 - DNA, 33 bp, Artificial Sequence
  Description of Artificial Sequence: Synthetic oligonucleotide
gttgcatctgagaagatcgaagtcttggtcagc

SEQ ID NO: 92800 - DNA, 36 bp, Artificial Sequence
  Description of Artificial Sequence: Synthetic oligonucleotide
ttgcatctgagaagatcgaagtcttggtcagcaatg

SEQ ID NO: 92801 - DNA, 35 bp, Artificial Sequence
  Description of Artificial Sequence: Synthetic oligonucleotide
tgcatctgagaagatcgaagtcttggtcagcaatg

SEQ ID NO: 92802 - DNA, 34 bp, Artificial Sequence
  Description of Artificial Sequence: Synthetic oligonucleotide
gcatctgagaagatcgaagtcttggtcagcaatg

SEQ ID NO: 92803 - DNA, 34 bp, Artificial Sequence
  Description of Artificial Sequence: Synthetic oligonucleotide
catctgagaagatcgaagtcttggtcagcaatgc

SEQ ID NO: 92804 - DNA, 36 bp, Artificial Sequence
  Description of Artificial Sequence: Synthetic oligonucleotide
atctgagaagatcgaagtcttggtcagcaatgctac

SEQ ID NO: 92805 - DNA, 35 bp, Artificial Sequence
  Description of Artificial Sequence: Synthetic oligonucleotide
tctgagaagatcgaagtcttggtcagcaatgctac

SEQ ID NO: 92806 - DNA, 34 bp, Artificial Sequence
  Description of Artificial Sequence: Synthetic oligonucleotide
ctgagaagatcgaagtcttggtcagcaatgctac

SEQ ID NO: 92807 - DNA, 34 bp, Artificial Sequence
  Description of Artificial Sequence: Synthetic oligonucleotide
tgagaagatcgaagtcttggtcagcaatgctacc

SEQ ID NO: 92808 - DNA, 33 bp, Artificial Sequence
  Description of Artificial Sequence: Synthetic oligonucleotide
gagaagatcgaagtcttggtcagcaatgctacc

SEQ ID NO: 92809 - DNA, 33 bp, Artificial Sequence
  Description of Artificial Sequence: Synthetic oligonucleotide
agaagatcgaagtcttggtcagcaatgctaccc

SEQ ID NO: 92810 - DNA, 32 bp, Artificial Sequence
  Description of Artificial Sequence: Synthetic oligonucleotide
gaagatcgaagtcttggtcagcaatgctaccc

SEQ ID NO: 92811 - DNA, 33 bp, Artificial Sequence
  Description of Artificial Sequence: Synthetic oligonucleotide
aagatcgaagtcttggtcagcaatgctacccag

SEQ ID NO: 92812 - DNA, 32 bp, Artificial Sequence
  Description of Artificial Sequence: Synthetic oligonucleotide
agatcgaagtcttggtcagcaatgctacccag

SEQ ID NO: 92813 - DNA, 31 bp, Artificial Sequence
  Description of Artificial Sequence: Synthetic oligonucleotide
gatcgaagtcttggtcagcaatgctacccag

SEQ ID NO: 92814 - DNA, 36 bp, Artificial Sequence
  Description of Artificial Sequence: Synthetic oligonucleotide
atcgaagtcttggtcagcaatgctacccagtttatc

SEQ ID NO: 92815 - DNA, 35 bp, Artificial Sequence
  Description of Artificial Sequence: Synthetic oligonucleotide
tcgaagtcttggtcagcaatgctacccagtttatc

SEQ ID NO: 92816 - DNA, 34 bp, Artificial Sequence
  Description of Artificial Sequence: Synthetic oligonucleotide
cgaagtcttggtcagcaatgctacccagtttatc

SEQ ID NO: 92817 - DNA, 36 bp, Artificial Sequence
  Description of Artificial Sequence: Synthetic oligonucleotide
gaagtcttggtcagcaatgctacccagtttatcatc

SEQ ID NO: 92818 - DNA, 38 bp, Artificial Sequence
  Description of Artificial Sequence: Synthetic oligonucleotide
aagtcttggtcagcaatgctacccagtttatcatcttg

SEQ ID NO: 92819 - DNA, 37 bp, Artificial Sequence
  Description of Artificial Sequence: Synthetic oligonucleotide
agtcttggtcagcaatgctacccagtttatcatcttg

SEQ ID NO: 92820 - DNA, 36 bp, Artificial Sequence
  Description of Artificial Sequence: Synthetic oligonucleotide
gtcttggtcagcaatgctacccagtttatcatcttg

SEQ ID NO: 92821 - DNA, 36 bp, Artificial Sequence
  Description of Artificial Sequence: Synthetic oligonucleotide
tcttggtcagcaatgctacccagtttatcatcttgc

SEQ ID NO: 92822 - DNA, 35 bp, Artificial Sequence
  Description of Artificial Sequence: Synthetic oligonucleotide
cttggtcagcaatgctacccagtttatcatcttgc

SEQ ID NO: 92823 - DNA, 36 bp, Artificial Sequence
  Description of Artificial Sequence: Synthetic oligonucleotide
ttggtcagcaatgctacccagtttatcatcttgcac

SEQ ID NO: 92824 - DNA, 35 bp, Artificial Sequence
  Description of Artificial Sequence: Synthetic oligonucleotide
tggtcagcaatgctacccagtttatcatcttgcac

SEQ ID NO: 92825 - DNA, 34 bp, Artificial Sequence
  Description of Artificial Sequence: Synthetic oligonucleotide
ggtcagcaatgctacccagtttatcatcttgcac

SEQ ID NO: 92826 - DNA, 35 bp, Artificial Sequence
  Description of Artificial Sequence: Synthetic oligonucleotide
gtcagcaatgctacccagtttatcatcttgcacag

SEQ ID NO: 92827 - DNA, 35 bp, Artificial Sequence
  Description of Artificial Sequence: Synthetic oligonucleotide
tcagcaatgctacccagtttatcatcttgcacagc

SEQ ID NO: 92828 - DNA, 34 bp, Artificial Sequence
  Description of Artificial Sequence: Synthetic oligonucleotide
cagcaatgctacccagtttatcatcttgcacagc

SEQ ID NO: 92829 - DNA, 37 bp, Artificial Sequence
  Description of Artificial Sequence: Synthetic oligonucleotide
agcaatgctacccagtttatcatcttgcacagcaaag

SEQ ID NO: 92830 - DNA, 36 bp, Artificial Sequence
  Description of Artificial Sequence: Synthetic oligonucleotide
gcaatgctacccagtttatcatcttgcacagcaaag

SEQ ID NO: 92831 - DNA, 38 bp, Artificial Sequence
  Description of Artificial Sequence: Synthetic oligonucleotide
caatgctacccagtttatcatcttgcacagcaaagatc

SEQ ID NO: 92832 - DNA, 40 bp, Artificial Sequence
  Description of Artificial Sequence: Synthetic oligonucleotide
aatgctacccagtttatcatcttgcacagcaaagatcttg

SEQ ID NO: 92833 - DNA, 39 bp, Artificial Sequence
  Description of Artificial Sequence: Synthetic oligonucleotide
atgctacccagtttatcatcttgcacagcaaagatcttg

SEQ ID NO: 92834 - DNA, 38 bp, Artificial Sequence
  Description of Artificial Sequence: Synthetic oligonucleotide
tgctacccagtttatcatcttgcacagcaaagatcttg

SEQ ID NO: 92835 - DNA, 37 bp, Artificial Sequence
  Description of Artificial Sequence: Synthetic oligonucleotide
gctacccagtttatcatcttgcacagcaaagatcttg

SEQ ID NO: 92836 - DNA, 41 bp, Artificial Sequence
  Description of Artificial Sequence: Synthetic oligonucleotide
ctacccagtttatcatcttgcacagcaaagatcttgaaatc

SEQ ID NO: 92837 - DNA, 42 bp, Artificial Sequence
  Description of Artificial Sequence: Synthetic oligonucleotide
tacccagtttatcatcttgcacagcaaagatcttgaaatcac

SEQ ID NO: 92838 - DNA, 41 bp, Artificial Sequence
  Description of Artificial Sequence: Synthetic oligonucleotide
acccagtttatcatcttgcacagcaaagatcttgaaatcac

SEQ ID NO: 92839 - DNA, 40 bp, Artificial Sequence
  Description of Artificial Sequence: Synthetic oligonucleotide
cccagtttatcatcttgcacagcaaagatcttgaaatcac

SEQ ID NO: 92840 - DNA, 40 bp, Artificial Sequence
  Description of Artificial Sequence: Synthetic oligonucleotide
ccagtttatcatcttgcacagcaaagatcttgaaatcacg

SEQ ID NO: 92841 - DNA, 43 bp, Artificial Sequence
  Description of Artificial Sequence: Synthetic oligonucleotide
cagtttatcatcttgcacagcaaagatcttgaaatcacgaatg

SEQ ID NO: 92842 - DNA, 43 bp, Artificial Sequence
  Description of Artificial Sequence: Synthetic oligonucleotide
agtttatcatcttgcacagcaaagatcttgaaatcacgaatgc

SEQ ID NO: 92843 - DNA, 42 bp, Artificial Sequence
  Description of Artificial Sequence: Synthetic oligonucleotide
gtttatcatcttgcacagcaaagatcttgaaatcacgaatgc

SEQ ID NO: 92844 - DNA, 42 bp, Artificial Sequence
  Description of Artificial Sequence: Synthetic oligonucleotide
tttatcatcttgcacagcaaagatcttgaaatcacgaatgcc

SEQ ID NO: 92845 - DNA, 41 bp, Artificial Sequence
  Description of Artificial Sequence: Synthetic oligonucleotide
ttatcatcttgcacagcaaagatcttgaaatcacgaatgcc

SEQ ID NO: 92846 - DNA, 40 bp, Artificial Sequence
  Description of Artificial Sequence: Synthetic oligonucleotide
tatcatcttgcacagcaaagatcttgaaatcacgaatgcc

SEQ ID NO: 92847 - DNA, 39 bp, Artificial Sequence
  Description of Artificial Sequence: Synthetic oligonucleotide
atcatcttgcacagcaaagatcttgaaatcacgaatgcc

SEQ ID NO: 92848 - DNA, 38 bp, Artificial Sequence
  Description of Artificial Sequence: Synthetic oligonucleotide
tcatcttgcacagcaaagatcttgaaatcacgaatgcc

SEQ ID NO: 92849 - DNA, 37 bp, Artificial Sequence
  Description of Artificial Sequence: Synthetic oligonucleotide
catcttgcacagcaaagatcttgaaatcacgaatgcc

SEQ ID NO: 92850 - DNA, 38 bp, Artificial Sequence
  Description of Artificial Sequence: Synthetic oligonucleotide
atcttgcacagcaaagatcttgaaatcacgaatgccac

SEQ ID NO: 92851 - DNA, 37 bp, Artificial Sequence
  Description of Artificial Sequence: Synthetic oligonucleotide
tcttgcacagcaaagatcttgaaatcacgaatgccac

SEQ ID NO: 92852 - DNA, 36 bp, Artificial Sequence
  Description of Artificial Sequence: Synthetic oligonucleotide
cttgcacagcaaagatcttgaaatcacgaatgccac

SEQ ID NO: 92853 - DNA, 36 bp, Artificial Sequence
  Description of Artificial Sequence: Synthetic oligonucleotide
ttgcacagcaaagatcttgaaatcacgaatgccacc

SEQ ID NO: 92854 - DNA, 35 bp, Artificial Sequence
  Description of Artificial Sequence: Synthetic oligonucleotide
tgcacagcaaagatcttgaaatcacgaatgccacc

SEQ ID NO: 92855 - DNA, 34 bp, Artificial Sequence
  Description of Artificial Sequence: Synthetic oligonucleotide
gcacagcaaagatcttgaaatcacgaatgccacc

SEQ ID NO: 92856 - DNA, 34 bp, Artificial Sequence
  Description of Artificial Sequence: Synthetic oligonucleotide
cacagcaaagatcttgaaatcacgaatgccaccc

SEQ ID NO: 92857 - DNA, 36 bp, Artificial Sequence
  Description of Artificial Sequence: Synthetic oligonucleotide
acagcaaagatcttgaaatcacgaatgccacccttc

SEQ ID NO: 92858 - DNA, 35 bp, Artificial Sequence
  Description of Artificial Sequence: Synthetic oligonucleotide
cagcaaagatcttgaaatcacgaatgccacccttc

SEQ ID NO: 92859 - DNA, 36 bp, Artificial Sequence
  Description of Artificial Sequence: Synthetic oligonucleotide
agcaaagatcttgaaatcacgaatgccacccttcag

SEQ ID NO: 92860 - DNA, 35 bp, Artificial Sequence
  Description of Artificial Sequence: Synthetic oligonucleotide
gcaaagatcttgaaatcacgaatgccacccttcag

SEQ ID NO: 92861 - DNA, 36 bp, Artificial Sequence
  Description of Artificial Sequence: Synthetic oligonucleotide
caaagatcttgaaatcacgaatgccacccttcagtc

SEQ ID NO: 92862 - DNA, 37 bp, Artificial Sequence
  Description of Artificial Sequence: Synthetic oligonucleotide
aaagatcttgaaatcacgaatgccacccttcagtcag

SEQ ID NO: 92863 - DNA, 36 bp, Artificial Sequence
  Description of Artificial Sequence: Synthetic oligonucleotide
aagatcttgaaatcacgaatgccacccttcagtcag

SEQ ID NO: 92864 - DNA, 35 bp, Artificial Sequence
  Description of Artificial Sequence: Synthetic oligonucleotide
agatcttgaaatcacgaatgccacccttcagtcag

SEQ ID NO: 92865 - DNA, 34 bp, Artificial Sequence
  Description of Artificial Sequence: Synthetic oligonucleotide
gatcttgaaatcacgaatgccacccttcagtcag

SEQ ID NO: 92866 - DNA, 35 bp, Artificial Sequence
  Description of Artificial Sequence: Synthetic oligonucleotide
atcttgaaatcacgaatgccacccttcagtcagag

SEQ ID NO: 92867 - DNA, 34 bp, Artificial Sequence
  Description of Artificial Sequence: Synthetic oligonucleotide
tcttgaaatcacgaatgccacccttcagtcagag

SEQ ID NO: 92868 - DNA, 33 bp, Artificial Sequence
  Description of Artificial Sequence: Synthetic oligonucleotide
cttgaaatcacgaatgccacccttcagtcagag

SEQ ID NO: 92869 - DNA, 33 bp, Artificial Sequence
  Description of Artificial Sequence: Synthetic oligonucleotide
ttgaaatcacgaatgccacccttcagtcagagg

SEQ ID NO: 92870 - DNA, 32 bp, Artificial Sequence
  Description of Artificial Sequence: Synthetic oligonucleotide
tgaaatcacgaatgccacccttcagtcagagg

SEQ ID NO: 92871 - DNA, 31 bp, Artificial Sequence
  Description of Artificial Sequence: Synthetic oligonucleotide
gaaatcacgaatgccacccttcagtcagagg

SEQ ID NO: 92872 - DNA, 33 bp, Artificial Sequence
  Description of Artificial Sequence: Synthetic oligonucleotide
aaatcacgaatgccacccttcagtcagaggaag

SEQ ID NO: 92873 - DNA, 32 bp, Artificial Sequence
  Description of Artificial Sequence: Synthetic oligonucleotide
aatcacgaatgccacccttcagtcagaggaag

SEQ ID NO: 92874 - DNA, 31 bp, Artificial Sequence
  Description of Artificial Sequence: Synthetic oligonucleotide
atcacgaatgccacccttcagtcagaggaag

SEQ ID NO: 92875 - DNA, 30 bp, Artificial Sequence
  Description of Artificial Sequence: Synthetic oligonucleotide
tcacgaatgccacccttcagtcagaggaag

SEQ ID NO: 92876 - DNA, 29 bp, Artificial Sequence
  Description of Artificial Sequence: Synthetic oligonucleotide
cacgaatgccacccttcagtcagaggaag

SEQ ID NO: 92877 - DNA, 32 bp, Artificial Sequence
  Description of Artificial Sequence: Synthetic oligonucleotide
acgaatgccacccttcagtcagaggaagattc

SEQ ID NO: 92878 - DNA, 31 bp, Artificial Sequence
  Description of Artificial Sequence: Synthetic oligonucleotide
cgaatgccacccttcagtcagaggaagattc

SEQ ID NO: 92879 - DNA, 33 bp, Artificial Sequence
  Description of Artificial Sequence: Synthetic oligonucleotide
gaatgccacccttcagtcagaggaagattcaag

SEQ ID NO: 92880 - DNA, 36 bp, Artificial Sequence
  Description of Artificial Sequence: Synthetic oligonucleotide
aatgccacccttcagtcagaggaagattcaagatac

SEQ ID NO: 92881 - DNA, 35 bp, Artificial Sequence
  Description of Artificial Sequence: Synthetic oligonucleotide
atgccacccttcagtcagaggaagattcaagatac

SEQ ID NO: 92882 - DNA, 34 bp, Artificial Sequence
  Description of Artificial Sequence: Synthetic oligonucleotide
tgccacccttcagtcagaggaagattcaagatac

SEQ ID NO: 92883 - DNA, 33 bp, Artificial Sequence
  Description of Artificial Sequence: Synthetic oligonucleotide
gccacccttcagtcagaggaagattcaagatac

SEQ ID NO: 92884 - DNA, 35 bp, Artificial Sequence
  Description of Artificial Sequence: Synthetic oligonucleotide
ccacccttcagtcagaggaagattcaagatacatg

SEQ ID NO: 92885 - DNA, 38 bp, Artificial Sequence
  Description of Artificial Sequence: Synthetic oligonucleotide
cacccttcagtcagaggaagattcaagatacatgaaac

SEQ ID NO: 92886 - DNA, 38 bp, Artificial Sequence
  Description of Artificial Sequence: Synthetic oligonucleotide
acccttcagtcagaggaagattcaagatacatgaaacc

SEQ ID NO: 92887 - DNA, 37 bp, Artificial Sequence
  Description of Artificial Sequence: Synthetic oligonucleotide
cccttcagtcagaggaagattcaagatacatgaaacc

SEQ ID NO: 92888 - DNA, 38 bp, Artificial Sequence
  Description of Artificial Sequence: Synthetic oligonucleotide
ccttcagtcagaggaagattcaagatacatgaaaccag

SEQ ID NO: 92889 - DNA, 38 bp, Artificial Sequence
  Description of Artificial Sequence: Synthetic oligonucleotide
cttcagtcagaggaagattcaagatacatgaaaccagg

SEQ ID NO: 92890 - DNA, 42 bp, Artificial Sequence
  Description of Artificial Sequence: Synthetic oligonucleotide
ttcagtcagaggaagattcaagatacatgaaaccaggaaaag

SEQ ID NO: 92891 - DNA, 41 bp, Artificial Sequence
  Description of Artificial Sequence: Synthetic oligonucleotide
tcagtcagaggaagattcaagatacatgaaaccaggaaaag

SEQ ID NO: 92892 - DNA, 40 bp, Artificial Sequence
  Description of Artificial Sequence: Synthetic oligonucleotide
cagtcagaggaagattcaagatacatgaaaccaggaaaag

SEQ ID NO: 92893 - DNA, 42 bp, Artificial Sequence
  Description of Artificial Sequence: Synthetic oligonucleotide
agtcagaggaagattcaagatacatgaaaccaggaaaagaac

SEQ ID NO: 92894 - DNA, 41 bp, Artificial Sequence
  Description of Artificial Sequence: Synthetic oligonucleotide
gtcagaggaagattcaagatacatgaaaccaggaaaagaac

SEQ ID NO: 92895 - DNA, 42 bp, Artificial Sequence
  Description of Artificial Sequence: Synthetic oligonucleotide
tcagaggaagattcaagatacatgaaaccaggaaaagaactg

SEQ ID NO: 92896 - DNA, 41 bp, Artificial Sequence
  Description of Artificial Sequence: Synthetic oligonucleotide
cagaggaagattcaagatacatgaaaccaggaaaagaactg

SEQ ID NO: 92897 - DNA, 44 bp, Artificial Sequence
  Description of Artificial Sequence: Synthetic oligonucleotide
agaggaagattcaagatacatgaaaccaggaaaagaactgaaag

SEQ ID NO: 92898 - DNA, 43 bp, Artificial Sequence
  Description of Artificial Sequence: Synthetic oligonucleotide
gaggaagattcaagatacatgaaaccaggaaaagaactgaaag

SEQ ID NO: 92899 - DNA, 47 bp, Artificial Sequence
  Description of Artificial Sequence: Synthetic oligonucleotide
aggaagattcaagatacatgaaaccaggaaaagaactgaaagttttg

SEQ ID NO: 92900 - DNA, 46 bp, Artificial Sequence
  Description of Artificial Sequence: Synthetic oligonucleotide
ggaagattcaagatacatgaaaccaggaaaagaactgaaagttttg

SEQ ID NO: 92901 - DNA, 47 bp, Artificial Sequence
  Description of Artificial Sequence: Synthetic oligonucleotide
gaagattcaagatacatgaaaccaggaaaagaactgaaagttttgag

SEQ ID NO: 92902 - DNA, 50 bp, Artificial Sequence
  Description of Artificial Sequence: Synthetic oligonucleotide
aagattcaagatacatgaaaccaggaaaagaactgaaagttttgagttac

SEQ ID NO: 92903 - DNA, 49 bp, Artificial Sequence
  Description of Artificial Sequence: Synthetic oligonucleotide
agattcaagatacatgaaaccaggaaaagaactgaaagttttgagttac

SEQ ID NO: 92904 - DNA, 48 bp, Artificial Sequence
  Description of Artificial Sequence: Synthetic oligonucleotide
gattcaagatacatgaaaccaggaaaagaactgaaagttttgagttac

SEQ ID NO: 92905 - DNA, 48 bp, Artificial Sequence
  Description of Artificial Sequence: Synthetic oligonucleotide
attcaagatacatgaaaccaggaaaagaactgaaagttttgagttacc

SEQ ID NO: 92906 - DNA, 47 bp, Artificial Sequence
  Description of Artificial Sequence: Synthetic oligonucleotide
ttcaagatacatgaaaccaggaaaagaactgaaagttttgagttacc

SEQ ID NO: 92907 - DNA, 46 bp, Artificial Sequence
  Description of Artificial Sequence: Synthetic oligonucleotide
tcaagatacatgaaaccaggaaaagaactgaaagttttgagttacc

SEQ ID NO: 92908 - DNA, 45 bp, Artificial Sequence
  Description of Artificial Sequence: Synthetic oligonucleotide
caagatacatgaaaccaggaaaagaactgaaagttttgagttacc

SEQ ID NO: 92909 - DNA, 45 bp, Artificial Sequence
  Description of Artificial Sequence: Synthetic oligonucleotide
aagatacatgaaaccaggaaaagaactgaaagttttgagttaccc

SEQ ID NO: 92910 - DNA, 44 bp, Artificial Sequence
  Description of Artificial Sequence: Synthetic oligonucleotide
agatacatgaaaccaggaaaagaactgaaagttttgagttaccc

SEQ ID NO: 92911 - DNA, 43 bp, Artificial Sequence
  Description of Artificial Sequence: Synthetic oligonucleotide
gatacatgaaaccaggaaaagaactgaaagttttgagttaccc

SEQ ID NO: 92912 - DNA, 44 bp, Artificial Sequence
  Description of Artificial Sequence: Synthetic oligonucleotide
atacatgaaaccaggaaaagaactgaaagttttgagttaccctg

SEQ ID NO: 92913 - DNA, 43 bp, Artificial Sequence
  Description of Artificial Sequence: Synthetic oligonucleotide
tacatgaaaccaggaaaagaactgaaagttttgagttaccctg

SEQ ID NO: 92914 - DNA, 42 bp, Artificial Sequence
  Description of Artificial Sequence: Synthetic oligonucleotide
acatgaaaccaggaaaagaactgaaagttttgagttaccctg

SEQ ID NO: 92915 - DNA, 41 bp, Artificial Sequence
  Description of Artificial Sequence: Synthetic oligonucleotide
catgaaaccaggaaaagaactgaaagttttgagttaccctg

SEQ ID NO: 92916 - DNA, 41 bp, Artificial Sequence
  Description of Artificial Sequence: Synthetic oligonucleotide
atgaaaccaggaaaagaactgaaagttttgagttaccctgc

SEQ ID NO: 92917 - DNA, 40 bp, Artificial Sequence
  Description of Artificial Sequence: Synthetic oligonucleotide
tgaaaccaggaaaagaactgaaagttttgagttaccctgc

SEQ ID NO: 92918 - DNA, 39 bp, Artificial Sequence
  Description of Artificial Sequence: Synthetic oligonucleotide
gaaaccaggaaaagaactgaaagttttgagttaccctgc

SEQ ID NO: 92919 - DNA, 40 bp, Artificial Sequence
  Description of Artificial Sequence: Synthetic oligonucleotide
aaaccaggaaaagaactgaaagttttgagttaccctgctc

SEQ ID NO: 92920 - DNA, 39 bp, Artificial Sequence
  Description of Artificial Sequence: Synthetic oligonucleotide
aaccaggaaaagaactgaaagttttgagttaccctgctc

SEQ ID NO: 92921 - DNA, 38 bp, Artificial Sequence
  Description of Artificial Sequence: Synthetic oligonucleotide
accaggaaaagaactgaaagttttgagttaccctgctc

SEQ ID NO: 92922 - DNA, 37 bp, Artificial Sequence
  Description of Artificial Sequence: Synthetic oligonucleotide
ccaggaaaagaactgaaagttttgagttaccctgctc

SEQ ID NO: 92923 - DNA, 39 bp, Artificial Sequence
  Description of Artificial Sequence: Synthetic oligonucleotide
caggaaaagaactgaaagttttgagttaccctgctcatg

SEQ ID NO: 92924 - DNA, 41 bp, Artificial Sequence
  Description of Artificial Sequence: Synthetic oligonucleotide
aggaaaagaactgaaagttttgagttaccctgctcatgaac

SEQ ID NO: 92925 - DNA, 40 bp, Artificial Sequence
  Description of Artificial Sequence: Synthetic oligonucleotide
ggaaaagaactgaaagttttgagttaccctgctcatgaac

SEQ ID NO: 92926 - DNA, 45 bp, Artificial Sequence
  Description of Artificial Sequence: Synthetic oligonucleotide
gaaaagaactgaaagttttgagttaccctgctcatgaacaaattg

SEQ ID NO: 92927 - DNA, 45 bp, Artificial Sequence
  Description of Artificial Sequence: Synthetic oligonucleotide
aaaagaactgaaagttttgagttaccctgctcatgaacaaattgc

SEQ ID NO: 92928 - DNA, 44 bp, Artificial Sequence
  Description of Artificial Sequence: Synthetic oligonucleotide
aaagaactgaaagttttgagttaccctgctcatgaacaaattgc

SEQ ID NO: 92929 - DNA, 43 bp, Artificial Sequence
  Description of Artificial Sequence: Synthetic oligonucleotide
aagaactgaaagttttgagttaccctgctcatgaacaaattgc

SEQ ID NO: 92930 - DNA, 42 bp, Artificial Sequence
  Description of Artificial Sequence: Synthetic oligonucleotide
agaactgaaagttttgagttaccctgctcatgaacaaattgc

SEQ ID NO: 92931 - DNA, 41 bp, Artificial Sequence
  Description of Artificial Sequence: Synthetic oligonucleotide
gaactgaaagttttgagttaccctgctcatgaacaaattgc

SEQ ID NO: 92932 - DNA, 42 bp, Artificial Sequence
  Description of Artificial Sequence: Synthetic oligonucleotide
aactgaaagttttgagttaccctgctcatgaacaaattgcac

SEQ ID NO: 92933 - DNA, 41 bp, Artificial Sequence
  Description of Artificial Sequence: Synthetic oligonucleotide
actgaaagttttgagttaccctgctcatgaacaaattgcac

SEQ ID NO: 92934 - DNA, 40 bp, Artificial Sequence
  Description of Artificial Sequence: Synthetic oligonucleotide
ctgaaagttttgagttaccctgctcatgaacaaattgcac

SEQ ID NO: 92935 - DNA, 41 bp, Artificial Sequence
  Description of Artificial Sequence: Synthetic oligonucleotide
tgaaagttttgagttaccctgctcatgaacaaattgcactg

SEQ ID NO: 92936 - DNA, 40 bp, Artificial Sequence
  Description of Artificial Sequence: Synthetic oligonucleotide
gaaagttttgagttaccctgctcatgaacaaattgcactg

SEQ ID NO: 92937 - DNA, 40 bp, Artificial Sequence
  Description of Artificial Sequence: Synthetic oligonucleotide
aaagttttgagttaccctgctcatgaacaaattgcactgc

SEQ ID NO: 92938 - DNA, 39 bp, Artificial Sequence
  Description of Artificial Sequence: Synthetic oligonucleotide
aagttttgagttaccctgctcatgaacaaattgcactgc

SEQ ID NO: 92939 - DNA, 38 bp, Artificial Sequence
  Description of Artificial Sequence: Synthetic oligonucleotide
agttttgagttaccctgctcatgaacaaattgcactgc

SEQ ID NO: 92940 - DNA, 37 bp, Artificial Sequence
  Description of Artificial Sequence: Synthetic oligonucleotide
gttttgagttaccctgctcatgaacaaattgcactgc

SEQ ID NO: 92941 - DNA, 38 bp, Artificial Sequence
  Description of Artificial Sequence: Synthetic oligonucleotide
ttttgagttaccctgctcatgaacaaattgcactgctg

SEQ ID NO: 92942 - DNA, 37 bp, Artificial Sequence
  Description of Artificial Sequence: Synthetic oligonucleotide
tttgagttaccctgctcatgaacaaattgcactgctg

SEQ ID NO: 92943 - DNA, 36 bp, Artificial Sequence
  Description of Artificial Sequence: Synthetic oligonucleotide
ttgagttaccctgctcatgaacaaattgcactgctg

SEQ ID NO: 92944 - DNA, 35 bp, Artificial Sequence
  Description of Artificial Sequence: Synthetic oligonucleotide
tgagttaccctgctcatgaacaaattgcactgctg

SEQ ID NO: 92945 - DNA, 34 bp, Artificial Sequence
  Description of Artificial Sequence: Synthetic oligonucleotide
gagttaccctgctcatgaacaaattgcactgctg

SEQ ID NO: 92946 - DNA, 34 bp, Artificial Sequence
  Description of Artificial Sequence: Synthetic oligonucleotide
agttaccctgctcatgaacaaattgcactgctgg

SEQ ID NO: 92947 - DNA, 33 bp, Artificial Sequence
  Description of Artificial Sequence: Synthetic oligonucleotide
gttaccctgctcatgaacaaattgcactgctgg

SEQ ID NO: 92948 - DNA, 35 bp, Artificial Sequence
  Description of Artificial Sequence: Synthetic oligonucleotide
ttaccctgctcatgaacaaattgcactgctggttc

SEQ ID NO: 92949 - DNA, 34 bp, Artificial Sequence
  Description of Artificial Sequence: Synthetic oligonucleotide
taccctgctcatgaacaaattgcactgctggttc

SEQ ID NO: 92950 - DNA, 33 bp, Artificial Sequence
  Description of Artificial Sequence: Synthetic oligonucleotide
accctgctcatgaacaaattgcactgctggttc

SEQ ID NO: 92951 - DNA, 32 bp, Artificial Sequence
  Description of Artificial Sequence: Synthetic oligonucleotide
ccctgctcatgaacaaattgcactgctggttc

SEQ ID NO: 92952 - DNA, 32 bp, Artificial Sequence
  Description of Artificial Sequence: Synthetic oligonucleotide
cctgctcatgaacaaattgcactgctggttcc

SEQ ID NO: 92953 - DNA, 33 bp, Artificial Sequence
  Description of Artificial Sequence: Synthetic oligonucleotide
ctgctcatgaacaaattgcactgctggttccag

SEQ ID NO: 92954 - DNA, 34 bp, Artificial Sequence
  Description of Artificial Sequence: Synthetic oligonucleotide
tgctcatgaacaaattgcactgctggttccagag

SEQ ID NO: 92955 - DNA, 33 bp, Artificial Sequence
  Description of Artificial Sequence: Synthetic oligonucleotide
gctcatgaacaaattgcactgctggttccagag

SEQ ID NO: 92956 - DNA, 36 bp, Artificial Sequence
  Description of Artificial Sequence: Synthetic oligonucleotide
ctcatgaacaaattgcactgctggttccagagaaac

SEQ ID NO: 92957 - DNA, 39 bp, Artificial Sequence
  Description of Artificial Sequence: Synthetic oligonucleotide
tcatgaacaaattgcactgctggttccagagaaacttac

SEQ ID NO: 92958 - DNA, 38 bp, Artificial Sequence
  Description of Artificial Sequence: Synthetic oligonucleotide
catgaacaaattgcactgctggttccagagaaacttac

SEQ ID NO: 92959 - DNA, 38 bp, Artificial Sequence
  Description of Artificial Sequence: Synthetic oligonucleotide
atgaacaaattgcactgctggttccagagaaacttacg

SEQ ID NO: 92960 - DNA, 37 bp, Artificial Sequence
  Description of Artificial Sequence: Synthetic oligonucleotide
tgaacaaattgcactgctggttccagagaaacttacg

SEQ ID NO: 92961 - DNA, 36 bp, Artificial Sequence
  Description of Artificial Sequence: Synthetic oligonucleotide
gaacaaattgcactgctggttccagagaaacttacg

SEQ ID NO: 92962 - DNA, 36 bp, Artificial Sequence
  Description of Artificial Sequence: Synthetic oligonucleotide
aacaaattgcactgctggttccagagaaacttacgc

SEQ ID NO: 92963 - DNA, 35 bp, Artificial Sequence
  Description of Artificial Sequence: Synthetic oligonucleotide
acaaattgcactgctggttccagagaaacttacgc

SEQ ID NO: 92964 - DNA, 34 bp, Artificial Sequence
  Description of Artificial Sequence: Synthetic oligonucleotide
caaattgcactgctggttccagagaaacttacgc

SEQ ID NO: 92965 - DNA, 34 bp, Artificial Sequence
  Description of Artificial Sequence: Synthetic oligonucleotide
aaattgcactgctggttccagagaaacttacgcc

SEQ ID NO: 92966 - DNA, 33 bp, Artificial Sequence
  Description of Artificial Sequence: Synthetic oligonucleotide
aattgcactgctggttccagagaaacttacgcc

SEQ ID NO: 92967 - DNA, 32 bp, Artificial Sequence
  Description of Artificial Sequence: Synthetic oligonucleotide
attgcactgctggttccagagaaacttacgcc

SEQ ID NO: 92968 - DNA, 31 bp, Artificial Sequence
  Description of Artificial Sequence: Synthetic oligonucleotide
ttgcactgctggttccagagaaacttacgcc

SEQ ID NO: 92969 - DNA, 30 bp, Artificial Sequence
  Description of Artificial Sequence: Synthetic oligonucleotide
tgcactgctggttccagagaaacttacgcc

SEQ ID NO: 92970 - DNA, 29 bp, Artificial Sequence
  Description of Artificial Sequence: Synthetic oligonucleotide
gcactgctggttccagagaaacttacgcc

SEQ ID NO: 92971 - DNA, 30 bp, Artificial Sequence
  Description of Artificial Sequence: Synthetic oligonucleotide
cactgctggttccagagaaacttacgcctc

SEQ ID NO: 92972 - DNA, 31 bp, Artificial Sequence
  Description of Artificial Sequence: Synthetic oligonucleotide
actgctggttccagagaaacttacgcctcac

SEQ ID NO: 92973 - DNA, 30 bp, Artificial Sequence
  Description of Artificial Sequence: Synthetic oligonucleotide
ctgctggttccagagaaacttacgcctcac

SEQ ID NO: 92974 - DNA, 30 bp, Artificial Sequence
  Description of Artificial Sequence: Synthetic oligonucleotide
tgctggttccagagaaacttacgcctcacc

SEQ ID NO: 92975 - DNA, 29 bp, Artificial Sequence
  Description of Artificial Sequence: Synthetic oligonucleotide
gctggttccagagaaacttacgcctcacc

SEQ ID NO: 92976 - DNA, 30 bp, Artificial Sequence
  Description of Artificial Sequence: Synthetic oligonucleotide
ctggttccagagaaacttacgcctcacctg

SEQ ID NO: 92977 - DNA, 35 bp, Artificial Sequence
  Description of Artificial Sequence: Synthetic oligonucleotide
tggttccagagaaacttacgcctcacctgaaatac

SEQ ID NO: 92978 - DNA, 34 bp, Artificial Sequence
  Description of Artificial Sequence: Synthetic oligonucleotide
ggttccagagaaacttacgcctcacctgaaatac

SEQ ID NO: 92979 - DNA, 37 bp, Artificial Sequence
  Description of Artificial Sequence: Synthetic oligonucleotide
gttccagagaaacttacgcctcacctgaaatactatg

SEQ ID NO: 92980 - DNA, 38 bp, Artificial Sequence
  Description of Artificial Sequence: Synthetic oligonucleotide
ttccagagaaacttacgcctcacctgaaatactatgtg

SEQ ID NO: 92981 - DNA, 37 bp, Artificial Sequence
  Description of Artificial Sequence: Synthetic oligonucleotide
tccagagaaacttacgcctcacctgaaatactatgtg

SEQ ID NO: 92982 - DNA, 36 bp, Artificial Sequence
  Description of Artificial Sequence: Synthetic oligonucleotide
ccagagaaacttacgcctcacctgaaatactatgtg

SEQ ID NO: 92983 - DNA, 36 bp, Artificial Sequence
  Description of Artificial Sequence: Synthetic oligonucleotide
cagagaaacttacgcctcacctgaaatactatgtgg

SEQ ID NO: 92984 - DNA, 36 bp, Artificial Sequence
  Description of Artificial Sequence: Synthetic oligonucleotide
agagaaacttacgcctcacctgaaatactatgtggc

SEQ ID NO: 92985 - DNA, 35 bp, Artificial Sequence
  Description of Artificial Sequence: Synthetic oligonucleotide
gagaaacttacgcctcacctgaaatactatgtggc

SEQ ID NO: 92986 - DNA, 38 bp, Artificial Sequence
  Description of Artificial Sequence: Synthetic oligonucleotide
agaaacttacgcctcacctgaaatactatgtggctatg

SEQ ID NO: 92987 - DNA, 37 bp, Artificial Sequence
  Description of Artificial Sequence: Synthetic oligonucleotide
gaaacttacgcctcacctgaaatactatgtggctatg

SEQ ID NO: 92988 - DNA, 37 bp, Artificial Sequence
  Description of Artificial Sequence: Synthetic oligonucleotide
aaacttacgcctcacctgaaatactatgtggctatgg

SEQ ID NO: 92989 - DNA, 36 bp, Artificial Sequence
  Description of Artificial Sequence: Synthetic oligonucleotide
aacttacgcctcacctgaaatactatgtggctatgg

SEQ ID NO: 92990 - DNA, 35 bp, Artificial Sequence
  Description of Artificial Sequence: Synthetic oligonucleotide
acttacgcctcacctgaaatactatgtggctatgg

SEQ ID NO: 92991 - DNA, 34 bp, Artificial Sequence
  Description of Artificial Sequence: Synthetic oligonucleotide
cttacgcctcacctgaaatactatgtggctatgg

SEQ ID NO: 92992 - DNA, 35 bp, Artificial Sequence
  Description of Artificial Sequence: Synthetic oligonucleotide
ttacgcctcacctgaaatactatgtggctatggac

SEQ ID NO: 92993 - DNA, 34 bp, Artificial Sequence
  Description of Artificial Sequence: Synthetic oligonucleotide
tacgcctcacctgaaatactatgtggctatggac

SEQ ID NO: 92994 - DNA, 33 bp, Artificial Sequence
  Description of Artificial Sequence: Synthetic oligonucleotide
acgcctcacctgaaatactatgtggctatggac

SEQ ID NO: 92995 - DNA, 32 bp, Artificial Sequence
  Description of Artificial Sequence: Synthetic oligonucleotide
cgcctcacctgaaatactatgtggctatggac

SEQ ID NO: 92996 - DNA, 34 bp, Artificial Sequence
  Description of Artificial Sequence: Synthetic oligonucleotide
gcctcacctgaaatactatgtggctatggacttc

SEQ ID NO: 92997 - DNA, 34 bp, Artificial Sequence
  Description of Artificial Sequence: Synthetic oligonucleotide
cctcacctgaaatactatgtggctatggacttcc

SEQ ID NO: 92998 - DNA, 36 bp, Artificial Sequence
  Description of Artificial Sequence: Synthetic oligonucleotide
ctcacctgaaatactatgtggctatggacttccaag

SEQ ID NO: 92999 - DNA, 36 bp, Artificial Sequence
  Description of Artificial Sequence: Synthetic oligonucleotide
tcacctgaaatactatgtggctatggacttccaagc

SEQ ID NO: 93000 - DNA, 35 bp, Artificial Sequence
  Description of Artificial Sequence: Synthetic oligonucleotide
cacctgaaatactatgtggctatggacttccaagc

SEQ ID NO: 93001 - DNA, 35 bp, Artificial Sequence
  Description of Artificial Sequence: Synthetic oligonucleotide
acctgaaatactatgtggctatggacttccaagcc

SEQ ID NO: 93002 - DNA, 34 bp, Artificial Sequence
  Description of Artificial Sequence: Synthetic oligonucleotide
cctgaaatactatgtggctatggacttccaagcc

SEQ ID NO: 93003 - DNA, 36 bp, Artificial Sequence
  Description of Artificial Sequence: Synthetic oligonucleotide
ctgaaatactatgtggctatggacttccaagccaag

SEQ ID NO: 93004 - DNA, 39 bp, Artificial Sequence
  Description of Artificial Sequence: Synthetic oligonucleotide
tgaaatactatgtggctatggacttccaagccaagttag

SEQ ID NO: 93005 - DNA, 38 bp, Artificial Sequence
  Description of Artificial Sequence: Synthetic oligonucleotide
gaaatactatgtggctatggacttccaagccaagttag

SEQ ID NO: 93006 - DNA, 38 bp, Artificial Sequence
  Description of Artificial Sequence: Synthetic oligonucleotide
aaatactatgtggctatggacttccaagccaagttagg

SEQ ID NO: 93007 - DNA, 37 bp, Artificial Sequence
  Description of Artificial Sequence: Synthetic oligonucleotide
aatactatgtggctatggacttccaagccaagttagg

SEQ ID NO: 93008 - DNA, 36 bp, Artificial Sequence
  Description of Artificial Sequence: Synthetic oligonucleotide
atactatgtggctatggacttccaagccaagttagg

SEQ ID NO: 93009 - DNA, 35 bp, Artificial Sequence
  Description of Artificial Sequence: Synthetic oligonucleotide
tactatgtggctatggacttccaagccaagttagg

SEQ ID NO: 93010 - DNA, 34 bp, Artificial Sequence
  Description of Artificial Sequence: Synthetic oligonucleotide
actatgtggctatggacttccaagccaagttagg

SEQ ID NO: 93011 - DNA, 33 bp, Artificial Sequence
  Description of Artificial Sequence: Synthetic oligonucleotide
ctatgtggctatggacttccaagccaagttagg

SEQ ID NO: 93012 - DNA, 34 bp, Artificial Sequence
  Description of Artificial Sequence: Synthetic oligonucleotide
tatgtggctatggacttccaagccaagttaggtg

SEQ ID NO: 93013 - DNA, 33 bp, Artificial Sequence
  Description of Artificial Sequence: Synthetic oligonucleotide
atgtggctatggacttccaagccaagttaggtg

SEQ ID NO: 93014 - DNA, 32 bp, Artificial Sequence
  Description of Artificial Sequence: Synthetic oligonucleotide
tgtggctatggacttccaagccaagttaggtg

SEQ ID NO: 93015 - DNA, 31 bp, Artificial Sequence
  Description of Artificial Sequence: Synthetic oligonucleotide
gtggctatggacttccaagccaagttaggtg

SEQ ID NO: 93016 - DNA, 33 bp, Artificial Sequence
  Description of Artificial Sequence: Synthetic oligonucleotide
tggctatggacttccaagccaagttaggtgatg

SEQ ID NO: 93017 - DNA, 32 bp, Artificial Sequence
  Description of Artificial Sequence: Synthetic oligonucleotide
ggctatggacttccaagccaagttaggtgatg

SEQ ID NO: 93018 - DNA, 32 bp, Artificial Sequence
  Description of Artificial Sequence: Synthetic oligonucleotide
gctatggacttccaagccaagttaggtgatgg

SEQ ID NO: 93019 - DNA, 32 bp, Artificial Sequence
  Description of Artificial Sequence: Synthetic oligonucleotide
ctatggacttccaagccaagttaggtgatggc

SEQ ID NO: 93020 - DNA, 35 bp, Artificial Sequence
  Description of Artificial Sequence: Synthetic oligonucleotide
tatggacttccaagccaagttaggtgatggctttg

SEQ ID NO: 93021 - DNA, 34 bp, Artificial Sequence
  Description of Artificial Sequence: Synthetic oligonucleotide
atggacttccaagccaagttaggtgatggctttg

SEQ ID NO: 93022 - DNA, 33 bp, Artificial Sequence
  Description of Artificial Sequence: Synthetic oligonucleotide
tggacttccaagccaagttaggtgatggctttg

SEQ ID NO: 93023 - DNA, 32 bp, Artificial Sequence
  Description of Artificial Sequence: Synthetic oligonucleotide
ggacttccaagccaagttaggtgatggctttg

SEQ ID NO: 93024 - DNA, 34 bp, Artificial Sequence
  Description of Artificial Sequence: Synthetic oligonucleotide
gacttccaagccaagttaggtgatggctttgaag

SEQ ID NO: 93025 - DNA, 34 bp, Artificial Sequence
  Description of Artificial Sequence: Synthetic oligonucleotide
acttccaagccaagttaggtgatggctttgaagg

SEQ ID NO: 93026 - DNA, 33 bp, Artificial Sequence
  Description of Artificial Sequence: Synthetic oligonucleotide
cttccaagccaagttaggtgatggctttgaagg

SEQ ID NO: 93027 - DNA, 33 bp, Artificial Sequence
  Description of Artificial Sequence: Synthetic oligonucleotide
ttccaagccaagttaggtgatggctttgaaggg

SEQ ID NO: 93028 - DNA, 32 bp, Artificial Sequence
  Description of Artificial Sequence: Synthetic oligonucleotide
tccaagccaagttaggtgatggctttgaaggg

SEQ ID NO: 93029 - DNA, 31 bp, Artificial Sequence
  Description of Artificial Sequence: Synthetic oligonucleotide
ccaagccaagttaggtgatggctttgaaggg

SEQ ID NO: 93030 - DNA, 41 bp, Artificial Sequence
  Description of Artificial Sequence: Synthetic oligonucleotide
caagccaagttaggtgatggctttgaagggttttataaaag

SEQ ID NO: 93031 - DNA, 41 bp, Artificial Sequence
  Description of Artificial Sequence: Synthetic oligonucleotide
aagccaagttaggtgatggctttgaagggttttataaaagc

SEQ ID NO: 93032 - DNA, 40 bp, Artificial Sequence
  Description of Artificial Sequence: Synthetic oligonucleotide
agccaagttaggtgatggctttgaagggttttataaaagc

SEQ ID NO: 93033 - DNA, 39 bp, Artificial Sequence
  Description of Artificial Sequence: Synthetic oligonucleotide
gccaagttaggtgatggctttgaagggttttataaaagc

SEQ ID NO: 93034 - DNA, 40 bp, Artificial Sequence
  Description of Artificial Sequence: Synthetic oligonucleotide
ccaagttaggtgatggctttgaagggttttataaaagcac

SEQ ID NO: 93035 - DNA, 43 bp, Artificial Sequence
  Description of Artificial Sequence: Synthetic oligonucleotide
caagttaggtgatggctttgaagggttttataaaagcacatac

SEQ ID NO: 93036 - DNA, 44 bp, Artificial Sequence
  Description of Artificial Sequence: Synthetic oligonucleotide
aagttaggtgatggctttgaagggttttataaaagcacatacag

SEQ ID NO: 93037 - DNA, 43 bp, Artificial Sequence
  Description of Artificial Sequence: Synthetic oligonucleotide
agttaggtgatggctttgaagggttttataaaagcacatacag

SEQ ID NO: 93038 - DNA, 42 bp, Artificial Sequence
  Description of Artificial Sequence: Synthetic oligonucleotide
gttaggtgatggctttgaagggttttataaaagcacatacag

SEQ ID NO: 93039 - DNA, 44 bp, Artificial Sequence
  Description of Artificial Sequence: Synthetic oligonucleotide
ttaggtgatggctttgaagggttttataaaagcacatacagaac

SEQ ID NO: 93040 - DNA, 43 bp, Artificial Sequence
  Description of Artificial Sequence: Synthetic oligonucleotide
taggtgatggctttgaagggttttataaaagcacatacagaac

SEQ ID NO: 93041 - DNA, 42 bp, Artificial Sequence
  Description of Artificial Sequence: Synthetic oligonucleotide
aggtgatggctttgaagggttttataaaagcacatacagaac

SEQ ID NO: 93042 - DNA, 41 bp, Artificial Sequence
  Description of Artificial Sequence: Synthetic oligonucleotide
ggtgatggctttgaagggttttataaaagcacatacagaac

SEQ ID NO: 93043 - DNA, 42 bp, Artificial Sequence
  Description of Artificial Sequence: Synthetic oligonucleotide
gtgatggctttgaagggttttataaaagcacatacagaactc

SEQ ID NO: 93044 - DNA, 44 bp, Artificial Sequence
  Description of Artificial Sequence: Synthetic oligonucleotide
tgatggctttgaagggttttataaaagcacatacagaactcttg

SEQ ID NO: 93045 - DNA, 43 bp, Artificial Sequence
  Description of Artificial Sequence: Synthetic oligonucleotide
gatggctttgaagggttttataaaagcacatacagaactcttg

SEQ ID NO: 93046 - DNA, 43 bp, Artificial Sequence
  Description of Artificial Sequence: Synthetic oligonucleotide
atggctttgaagggttttataaaagcacatacagaactcttgg

SEQ ID NO: 93047 - DNA, 42 bp, Artificial Sequence
  Description of Artificial Sequence: Synthetic oligonucleotide
tggctttgaagggttttataaaagcacatacagaactcttgg

SEQ ID NO: 93048 - DNA, 41 bp, Artificial Sequence
  Description of Artificial Sequence: Synthetic oligonucleotide
ggctttgaagggttttataaaagcacatacagaactcttgg

SEQ ID NO: 93049 - DNA, 42 bp, Artificial Sequence
  Description of Artificial Sequence: Synthetic oligonucleotide
gctttgaagggttttataaaagcacatacagaactcttggtg

SEQ ID NO: 93050 - DNA, 42 bp, Artificial Sequence
  Description of Artificial Sequence: Synthetic oligonucleotide
ctttgaagggttttataaaagcacatacagaactcttggtgg

SEQ ID NO: 93051 - DNA, 43 bp, Artificial Sequence
  Description of Artificial Sequence: Synthetic oligonucleotide
tttgaagggttttataaaagcacatacagaactcttggtggtg

SEQ ID NO: 93052 - DNA, 42 bp, Artificial Sequence
  Description of Artificial Sequence: Synthetic oligonucleotide
ttgaagggttttataaaagcacatacagaactcttggtggtg

SEQ ID NO: 93053 - DNA, 41 bp, Artificial Sequence
  Description of Artificial Sequence: Synthetic oligonucleotide
tgaagggttttataaaagcacatacagaactcttggtggtg

SEQ ID NO: 93054 - DNA, 40 bp, Artificial Sequence
  Description of Artificial Sequence: Synthetic oligonucleotide
gaagggttttataaaagcacatacagaactcttggtggtg

SEQ ID NO: 93055 - DNA, 43 bp, Artificial Sequence
  Description of Artificial Sequence: Synthetic oligonucleotide
aagggttttataaaagcacatacagaactcttggtggtgaaac

SEQ ID NO: 93056 - DNA, 42 bp, Artificial Sequence
  Description of Artificial Sequence: Synthetic oligonucleotide
agggttttataaaagcacatacagaactcttggtggtgaaac

SEQ ID NO: 93057 - DNA, 41 bp, Artificial Sequence
  Description of Artificial Sequence: Synthetic oligonucleotide
gggttttataaaagcacatacagaactcttggtggtgaaac

SEQ ID NO: 93058 - DNA, 43 bp, Artificial Sequence
  Description of Artificial Sequence: Synthetic oligonucleotide
ggttttataaaagcacatacagaactcttggtggtgaaacaag

SEQ ID NO: 93059 - DNA, 47 bp, Artificial Sequence
  Description of Artificial Sequence: Synthetic oligonucleotide
gttttataaaagcacatacagaactcttggtggtgaaacaagaattc

SEQ ID NO: 93060 - DNA, 49 bp, Artificial Sequence
  Description of Artificial Sequence: Synthetic oligonucleotide
ttttataaaagcacatacagaactcttggtggtgaaacaagaattcttg

SEQ ID NO: 93061 - DNA, 48 bp, Artificial Sequence
  Description of Artificial Sequence: Synthetic oligonucleotide
tttataaaagcacatacagaactcttggtggtgaaacaagaattcttg

SEQ ID NO: 93062 - DNA, 47 bp, Artificial Sequence
  Description of Artificial Sequence: Synthetic oligonucleotide
ttataaaagcacatacagaactcttggtggtgaaacaagaattcttg

SEQ ID NO: 93063 - DNA, 46 bp, Artificial Sequence
  Description of Artificial Sequence: Synthetic oligonucleotide
tataaaagcacatacagaactcttggtggtgaaacaagaattcttg

SEQ ID NO: 93064 - DNA, 45 bp, Artificial Sequence
  Description of Artificial Sequence: Synthetic oligonucleotide
ataaaagcacatacagaactcttggtggtgaaacaagaattcttg

SEQ ID NO: 93065 - DNA, 44 bp, Artificial Sequence
  Description of Artificial Sequence: Synthetic oligonucleotide
taaaagcacatacagaactcttggtggtgaaacaagaattcttg

SEQ ID NO: 93066 - DNA, 43 bp, Artificial Sequence
  Description of Artificial Sequence: Synthetic oligonucleotide
aaaagcacatacagaactcttggtggtgaaacaagaattcttg

SEQ ID NO: 93067 - DNA, 42 bp, Artificial Sequence
  Description of Artificial Sequence: Synthetic oligonucleotide
aaagcacatacagaactcttggtggtgaaacaagaattcttg

SEQ ID NO: 93068 - DNA, 41 bp, Artificial Sequence
  Description of Artificial Sequence: Synthetic oligonucleotide
aagcacatacagaactcttggtggtgaaacaagaattcttg

SEQ ID NO: 93069 - DNA, 40 bp, Artificial Sequence
  Description of Artificial Sequence: Synthetic oligonucleotide
agcacatacagaactcttggtggtgaaacaagaattcttg

SEQ ID NO: 93070 - DNA, 39 bp, Artificial Sequence
  Description of Artificial Sequence: Synthetic oligonucleotide
gcacatacagaactcttggtggtgaaacaagaattcttg

SEQ ID NO: 93071 - DNA, 39 bp, Artificial Sequence
  Description of Artificial Sequence: Synthetic oligonucleotide
cacatacagaactcttggtggtgaaacaagaattcttgc

SEQ ID NO: 93072 - DNA, 40 bp, Artificial Sequence
  Description of Artificial Sequence: Synthetic oligonucleotide
acatacagaactcttggtggtgaaacaagaattcttgcag

SEQ ID NO: 93073 - DNA, 39 bp, Artificial Sequence
  Description of Artificial Sequence: Synthetic oligonucleotide
catacagaactcttggtggtgaaacaagaattcttgcag

SEQ ID NO: 93074 - DNA, 42 bp, Artificial Sequence
  Description of Artificial Sequence: Synthetic oligonucleotide
atacagaactcttggtggtgaaacaagaattcttgcagtaac

SEQ ID NO: 93075 - DNA, 41 bp, Artificial Sequence
  Description of Artificial Sequence: Synthetic oligonucleotide
tacagaactcttggtggtgaaacaagaattcttgcagtaac

SEQ ID NO: 93076 - DNA, 40 bp, Artificial Sequence
  Description of Artificial Sequence: Synthetic oligonucleotide
acagaactcttggtggtgaaacaagaattcttgcagtaac

SEQ ID NO: 93077 - DNA, 39 bp, Artificial Sequence
  Description of Artificial Sequence: Synthetic oligonucleotide
cagaactcttggtggtgaaacaagaattcttgcagtaac

SEQ ID NO: 93078 - DNA, 40 bp, Artificial Sequence
  Description of Artificial Sequence: Synthetic oligonucleotide
agaactcttggtggtgaaacaagaattcttgcagtaacag

SEQ ID NO: 93079 - DNA, 39 bp, Artificial Sequence
  Description of Artificial Sequence: Synthetic oligonucleotide
gaactcttggtggtgaaacaagaattcttgcagtaacag

SEQ ID NO: 93080 - DNA, 44 bp, Artificial Sequence
  Description of Artificial Sequence: Synthetic oligonucleotide
aactcttggtggtgaaacaagaattcttgcagtaacagattttg

SEQ ID NO: 93081 - DNA, 43 bp, Artificial Sequence
  Description of Artificial Sequence: Synthetic oligonucleotide
actcttggtggtgaaacaagaattcttgcagtaacagattttg

SEQ ID NO: 93082 - DNA, 42 bp, Artificial Sequence
  Description of Artificial Sequence: Synthetic oligonucleotide
ctcttggtggtgaaacaagaattcttgcagtaacagattttg

SEQ ID NO: 93083 - DNA, 43 bp, Artificial Sequence
  Description of Artificial Sequence: Synthetic oligonucleotide
tcttggtggtgaaacaagaattcttgcagtaacagattttgag

SEQ ID NO: 93084 - DNA, 42 bp, Artificial Sequence
  Description of Artificial Sequence: Synthetic oligonucleotide
cttggtggtgaaacaagaattcttgcagtaacagattttgag

SEQ ID NO: 93085 - DNA, 42 bp, Artificial Sequence
  Description of Artificial Sequence: Synthetic oligonucleotide
ttggtggtgaaacaagaattcttgcagtaacagattttgagc

SEQ ID NO: 93086 - DNA, 41 bp, Artificial Sequence
  Description of Artificial Sequence: Synthetic oligonucleotide
tggtggtgaaacaagaattcttgcagtaacagattttgagc

SEQ ID NO: 93087 - DNA, 40 bp, Artificial Sequence
  Description of Artificial Sequence: Synthetic oligonucleotide
ggtggtgaaacaagaattcttgcagtaacagattttgagc

SEQ ID NO: 93088 - DNA, 40 bp, Artificial Sequence
  Description of Artificial Sequence: Synthetic oligonucleotide
gtggtgaaacaagaattcttgcagtaacagattttgagcc

SEQ ID NO: 93089 - DNA, 42 bp, Artificial Sequence
  Description of Artificial Sequence: Synthetic oligonucleotide
tggtgaaacaagaattcttgcagtaacagattttgagccaac

SEQ ID NO: 93090 - DNA, 41 bp, Artificial Sequence
  Description of Artificial Sequence: Synthetic oligonucleotide
ggtgaaacaagaattcttgcagtaacagattttgagccaac

SEQ ID NO: 93091 - DNA, 41 bp, Artificial Sequence
  Description of Artificial Sequence: Synthetic oligonucleotide
gtgaaacaagaattcttgcagtaacagattttgagccaacc

SEQ ID NO: 93092 - DNA, 41 bp, Artificial Sequence
  Description of Artificial Sequence: Synthetic oligonucleotide
tgaaacaagaattcttgcagtaacagattttgagccaaccc

SEQ ID NO: 93093 - DNA, 40 bp, Artificial Sequence
  Description of Artificial Sequence: Synthetic oligonucleotide
gaaacaagaattcttgcagtaacagattttgagccaaccc

SEQ ID NO: 93094 - DNA, 41 bp, Artificial Sequence
  Description of Artificial Sequence: Synthetic oligonucleotide
aaacaagaattcttgcagtaacagattttgagccaacccag

SEQ ID NO: 93095 - DNA, 40 bp, Artificial Sequence
  Description of Artificial Sequence: Synthetic oligonucleotide
aacaagaattcttgcagtaacagattttgagccaacccag

SEQ ID NO: 93096 - DNA, 39 bp, Artificial Sequence
  Description of Artificial Sequence: Synthetic oligonucleotide
acaagaattcttgcagtaacagattttgagccaacccag

SEQ ID NO: 93097 - DNA, 38 bp, Artificial Sequence
  Description of Artificial Sequence: Synthetic oligonucleotide
caagaattcttgcagtaacagattttgagccaacccag

SEQ ID NO: 93098 - DNA, 38 bp, Artificial Sequence
  Description of Artificial Sequence: Synthetic oligonucleotide
aagaattcttgcagtaacagattttgagccaacccagg

SEQ ID NO: 93099 - DNA, 37 bp, Artificial Sequence
  Description of Artificial Sequence: Synthetic oligonucleotide
agaattcttgcagtaacagattttgagccaacccagg

SEQ ID NO: 93100 - DNA, 36 bp, Artificial Sequence
  Description of Artificial Sequence: Synthetic oligonucleotide
gaattcttgcagtaacagattttgagccaacccagg

SEQ ID NO: 93101 - DNA, 36 bp, Artificial Sequence
  Description of Artificial Sequence: Synthetic oligonucleotide
aattcttgcagtaacagattttgagccaacccaggc

SEQ ID NO: 93102 - DNA, 35 bp, Artificial Sequence
  Description of Artificial Sequence: Synthetic oligonucleotide
attcttgcagtaacagattttgagccaacccaggc

SEQ ID NO: 93103 - DNA, 34 bp, Artificial Sequence
  Description of Artificial Sequence: Synthetic oligonucleotide
ttcttgcagtaacagattttgagccaacccaggc

SEQ ID NO: 93104 - DNA, 33 bp, Artificial Sequence
  Description of Artificial Sequence: Synthetic oligonucleotide
tcttgcagtaacagattttgagccaacccaggc

SEQ ID NO: 93105 - DNA, 32 bp, Artificial Sequence
  Description of Artificial Sequence: Synthetic oligonucleotide
cttgcagtaacagattttgagccaacccaggc

SEQ ID NO: 93106 - DNA, 33 bp, Artificial Sequence
  Description of Artificial Sequence: Synthetic oligonucleotide
ttgcagtaacagattttgagccaacccaggcac

SEQ ID NO: 93107 - DNA, 32 bp, Artificial Sequence
  Description of Artificial Sequence: Synthetic oligonucleotide
tgcagtaacagattttgagccaacccaggcac

SEQ ID NO: 93108 - DNA, 31 bp, Artificial Sequence
  Description of Artificial Sequence: Synthetic oligonucleotide
gcagtaacagattttgagccaacccaggcac

SEQ ID NO: 93109 - DNA, 31 bp, Artificial Sequence
  Description of Artificial Sequence: Synthetic oligonucleotide
cagtaacagattttgagccaacccaggcacg

SEQ ID NO: 93110 - DNA, 31 bp, Artificial Sequence
  Description of Artificial Sequence: Synthetic oligonucleotide
agtaacagattttgagccaacccaggcacgc

SEQ ID NO: 93111 - DNA, 30 bp, Artificial Sequence
  Description of Artificial Sequence: Synthetic oligonucleotide
gtaacagattttgagccaacccaggcacgc

SEQ ID NO: 93112 - DNA, 32 bp, Artificial Sequence
  Description of Artificial Sequence: Synthetic oligonucleotide
taacagattttgagccaacccaggcacgcatg

SEQ ID NO: 93113 - DNA, 31 bp, Artificial Sequence
  Description of Artificial Sequence: Synthetic oligonucleotide
aacagattttgagccaacccaggcacgcatg

SEQ ID NO: 93114 - DNA, 30 bp, Artificial Sequence
  Description of Artificial Sequence: Synthetic oligonucleotide
acagattttgagccaacccaggcacgcatg

SEQ ID NO: 93115 - DNA, 29 bp, Artificial Sequence
  Description of Artificial Sequence: Synthetic oligonucleotide
cagattttgagccaacccaggcacgcatg

SEQ ID NO: 93116 - DNA, 29 bp, Artificial Sequence
  Description of Artificial Sequence: Synthetic oligonucleotide
agattttgagccaacccaggcacgcatgg

SEQ ID NO: 93117 - DNA, 28 bp, Artificial Sequence
  Description of Artificial Sequence: Synthetic oligonucleotide
gattttgagccaacccaggcacgcatgg

SEQ ID NO: 93118 - DNA, 28 bp, Artificial Sequence
  Description of Artificial Sequence: Synthetic oligonucleotide
attttgagccaacccaggcacgcatggc

SEQ ID NO: 93119 - DNA, 27 bp, Artificial Sequence
  Description of Artificial Sequence: Synthetic oligonucleotide
ttttgagccaacccaggcacgcatggc

SEQ ID NO: 93120 - DNA, 27 bp, Artificial Sequence
  Description of Artificial Sequence: Synthetic oligonucleotide
tttgagccaacccaggcacgcatggct

SEQ ID NO: 93121 - DNA, 27 bp, Artificial Sequence
  Description of Artificial Sequence: Synthetic oligonucleotide
ttgagccaacccaggcacgcatggctt

SEQ ID NO: 93122 - DNA, 27 bp, Artificial Sequence
  Description of Artificial Sequence: Synthetic oligonucleotide
tgagccaacccaggcacgcatggcttt

SEQ ID NO: 93123 - DNA, 26 bp, Artificial Sequence
  Description of Artificial Sequence: Synthetic oligonucleotide
gagccaacccaggcacgcatggcttt

SEQ ID NO: 93124 - DNA, 26 bp, Artificial Sequence
  Description of Artificial Sequence: Synthetic oligonucleotide
agccaacccaggcacgcatggctttc

SEQ ID NO: 93125 - DNA, 25 bp, Artificial Sequence
  Description of Artificial Sequence: Synthetic oligonucleotide
gccaacccaggcacgcatggctttc

SEQ ID NO: 93126 - DNA, 25 bp, Artificial Sequence
  Description of Artificial Sequence: Synthetic oligonucleotide
ccaacccaggcacgcatggctttcc

SEQ ID NO: 93127 - DNA, 27 bp, Artificial Sequence
  Description of Artificial Sequence: Synthetic oligonucleotide
caacccaggcacgcatggctttccctt

SEQ ID NO: 93128 - DNA, 27 bp, Artificial Sequence
  Description of Artificial Sequence: Synthetic oligonucleotide
aacccaggcacgcatggctttcccttg

SEQ ID NO: 93129 - DNA, 26 bp, Artificial Sequence
  Description of Artificial Sequence: Synthetic oligonucleotide
acccaggcacgcatggctttcccttg

SEQ ID NO: 93130 - DNA, 25 bp, Artificial Sequence
  Description of Artificial Sequence: Synthetic oligonucleotide
cccaggcacgcatggctttcccttg

SEQ ID NO: 93131 - DNA, 27 bp, Artificial Sequence
  Description of Artificial Sequence: Synthetic oligonucleotide
ccaggcacgcatggctttcccttgctt

SEQ ID NO: 93132 - DNA, 28 bp, Artificial Sequence
  Description of Artificial Sequence: Synthetic oligonucleotide
caggcacgcatggctttcccttgctttg

SEQ ID NO: 93133 - DNA, 30 bp, Artificial Sequence
  Description of Artificial Sequence: Synthetic oligonucleotide
aggcacgcatggctttcccttgctttgatg

SEQ ID NO: 93134 - DNA, 29 bp, Artificial Sequence
  Description of Artificial Sequence: Synthetic oligonucleotide
ggcacgcatggctttcccttgctttgatg

SEQ ID NO: 93135 - DNA, 31 bp, Artificial Sequence
  Description of Artificial Sequence: Synthetic oligonucleotide
gcacgcatggctttcccttgctttgatgaac

SEQ ID NO: 93136 - DNA, 31 bp, Artificial Sequence
  Description of Artificial Sequence: Synthetic oligonucleotide
cacgcatggctttcccttgctttgatgaacc

SEQ ID NO: 93137 - DNA, 31 bp, Artificial Sequence
  Description of Artificial Sequence: Synthetic oligonucleotide
acgcatggctttcccttgctttgatgaaccg

SEQ ID NO: 93138 - DNA, 30 bp, Artificial Sequence
  Description of Artificial Sequence: Synthetic oligonucleotide
cgcatggctttcccttgctttgatgaaccg

SEQ ID NO: 93139 - DNA, 32 bp, Artificial Sequence
  Description of Artificial Sequence: Synthetic oligonucleotide
gcatggctttcccttgctttgatgaaccgttg

SEQ ID NO: 93140 - DNA, 34 bp, Artificial Sequence
  Description of Artificial Sequence: Synthetic oligonucleotide
catggctttcccttgctttgatgaaccgttgttc

SEQ ID NO: 93141 - DNA, 37 bp, Artificial Sequence
  Description of Artificial Sequence: Synthetic oligonucleotide
atggctttcccttgctttgatgaaccgttgttcaaag

SEQ ID NO: 93142 - DNA, 36 bp, Artificial Sequence
  Description of Artificial Sequence: Synthetic oligonucleotide
tggctttcccttgctttgatgaaccgttgttcaaag

SEQ ID NO: 93143 - DNA, 35 bp, Artificial Sequence
  Description of Artificial Sequence: Synthetic oligonucleotide
ggctttcccttgctttgatgaaccgttgttcaaag

SEQ ID NO: 93144 - DNA, 35 bp, Artificial Sequence
  Description of Artificial Sequence: Synthetic oligonucleotide
gctttcccttgctttgatgaaccgttgttcaaagc

SEQ ID NO: 93145 - DNA, 35 bp, Artificial Sequence
  Description of Artificial Sequence: Synthetic oligonucleotide
ctttcccttgctttgatgaaccgttgttcaaagcc

SEQ ID NO: 93146 - DNA, 37 bp, Artificial Sequence
  Description of Artificial Sequence: Synthetic oligonucleotide
tttcccttgctttgatgaaccgttgttcaaagccaac

SEQ ID NO: 93147 - DNA, 36 bp, Artificial Sequence
  Description of Artificial Sequence: Synthetic oligonucleotide
ttcccttgctttgatgaaccgttgttcaaagccaac

SEQ ID NO: 93148 - DNA, 35 bp, Artificial Sequence
  Description of Artificial Sequence: Synthetic oligonucleotide
tcccttgctttgatgaaccgttgttcaaagccaac

SEQ ID NO: 93149 - DNA, 34 bp, Artificial Sequence
  Description of Artificial Sequence: Synthetic oligonucleotide
cccttgctttgatgaaccgttgttcaaagccaac

SEQ ID NO: 93150 - DNA, 38 bp, Artificial Sequence
  Description of Artificial Sequence: Synthetic oligonucleotide
ccttgctttgatgaaccgttgttcaaagccaacttttc

SEQ ID NO: 93151 - DNA, 41 bp, Artificial Sequence
  Description of Artificial Sequence: Synthetic oligonucleotide
cttgctttgatgaaccgttgttcaaagccaacttttcaatc

SEQ ID NO: 93152 - DNA, 43 bp, Artificial Sequence
  Description of Artificial Sequence: Synthetic oligonucleotide
ttgctttgatgaaccgttgttcaaagccaacttttcaatcaag

SEQ ID NO: 93153 - DNA, 42 bp, Artificial Sequence
  Description of Artificial Sequence: Synthetic oligonucleotide
tgctttgatgaaccgttgttcaaagccaacttttcaatcaag

SEQ ID NO: 93154 - DNA, 41 bp, Artificial Sequence
  Description of Artificial Sequence: Synthetic oligonucleotide
gctttgatgaaccgttgttcaaagccaacttttcaatcaag

SEQ ID NO: 93155 - DNA, 44 bp, Artificial Sequence
  Description of Artificial Sequence: Synthetic oligonucleotide
ctttgatgaaccgttgttcaaagccaacttttcaatcaagatac

SEQ ID NO: 93156 - DNA, 44 bp, Artificial Sequence
  Description of Artificial Sequence: Synthetic oligonucleotide
tttgatgaaccgttgttcaaagccaacttttcaatcaagatacg

SEQ ID NO: 93157 - DNA, 43 bp, Artificial Sequence
  Description of Artificial Sequence: Synthetic oligonucleotide
ttgatgaaccgttgttcaaagccaacttttcaatcaagatacg

SEQ ID NO: 93158 - DNA, 42 bp, Artificial Sequence
  Description of Artificial Sequence: Synthetic oligonucleotide
tgatgaaccgttgttcaaagccaacttttcaatcaagatacg

SEQ ID NO: 93159 - DNA, 41 bp, Artificial Sequence
  Description of Artificial Sequence: Synthetic oligonucleotide
gatgaaccgttgttcaaagccaacttttcaatcaagatacg

SEQ ID NO: 93160 - DNA, 43 bp, Artificial Sequence
  Description of Artificial Sequence: Synthetic oligonucleotide
atgaaccgttgttcaaagccaacttttcaatcaagatacgaag

SEQ ID NO: 93161 - DNA, 42 bp, Artificial Sequence
  Description of Artificial Sequence: Synthetic oligonucleotide
tgaaccgttgttcaaagccaacttttcaatcaagatacgaag

SEQ ID NO: 93162 - DNA, 41 bp, Artificial Sequence
  Description of Artificial Sequence: Synthetic oligonucleotide
gaaccgttgttcaaagccaacttttcaatcaagatacgaag

SEQ ID NO: 93163 - DNA, 42 bp, Artificial Sequence
  Description of Artificial Sequence: Synthetic oligonucleotide
aaccgttgttcaaagccaacttttcaatcaagatacgaagag

SEQ ID NO: 93164 - DNA, 41 bp, Artificial Sequence
  Description of Artificial Sequence: Synthetic oligonucleotide
accgttgttcaaagccaacttttcaatcaagatacgaagag

SEQ ID NO: 93165 - DNA, 40 bp, Artificial Sequence
  Description of Artificial Sequence: Synthetic oligonucleotide
ccgttgttcaaagccaacttttcaatcaagatacgaagag

SEQ ID NO: 93166 - DNA, 41 bp, Artificial Sequence
  Description of Artificial Sequence: Synthetic oligonucleotide
cgttgttcaaagccaacttttcaatcaagatacgaagagag

SEQ ID NO: 93167 - DNA, 42 bp, Artificial Sequence
  Description of Artificial Sequence: Synthetic oligonucleotide
gttgttcaaagccaacttttcaatcaagatacgaagagagag

SEQ ID NO: 93168 - DNA, 42 bp, Artificial Sequence
  Description of Artificial Sequence: Synthetic oligonucleotide
ttgttcaaagccaacttttcaatcaagatacgaagagagagc

SEQ ID NO: 93169 - DNA, 41 bp, Artificial Sequence
  Description of Artificial Sequence: Synthetic oligonucleotide
tgttcaaagccaacttttcaatcaagatacgaagagagagc

SEQ ID NO: 93170 - DNA, 40 bp, Artificial Sequence
  Description of Artificial Sequence: Synthetic oligonucleotide
gttcaaagccaacttttcaatcaagatacgaagagagagc

SEQ ID NO: 93171 - DNA, 41 bp, Artificial Sequence
  Description of Artificial Sequence: Synthetic oligonucleotide
ttcaaagccaacttttcaatcaagatacgaagagagagcag

SEQ ID NO: 93172 - DNA, 40 bp, Artificial Sequence
  Description of Artificial Sequence: Synthetic oligonucleotide
tcaaagccaacttttcaatcaagatacgaagagagagcag

SEQ ID NO: 93173 - DNA, 39 bp, Artificial Sequence
  Description of Artificial Sequence: Synthetic oligonucleotide
caaagccaacttttcaatcaagatacgaagagagagcag

SEQ ID NO: 93174 - DNA, 39 bp, Artificial Sequence
  Description of Artificial Sequence: Synthetic oligonucleotide
aaagccaacttttcaatcaagatacgaagagagagcagg

SEQ ID NO: 93175 - DNA, 38 bp, Artificial Sequence
  Description of Artificial Sequence: Synthetic oligonucleotide
aagccaacttttcaatcaagatacgaagagagagcagg

SEQ ID NO: 93176 - DNA, 37 bp, Artificial Sequence
  Description of Artificial Sequence: Synthetic oligonucleotide
agccaacttttcaatcaagatacgaagagagagcagg

SEQ ID NO: 93177 - DNA, 36 bp, Artificial Sequence
  Description of Artificial Sequence: Synthetic oligonucleotide
gccaacttttcaatcaagatacgaagagagagcagg

SEQ ID NO: 93178 - DNA, 36 bp, Artificial Sequence
  Description of Artificial Sequence: Synthetic oligonucleotide
ccaacttttcaatcaagatacgaagagagagcaggc

SEQ ID NO: 93179 - DNA, 41 bp, Artificial Sequence
  Description of Artificial Sequence: Synthetic oligonucleotide
caacttttcaatcaagatacgaagagagagcaggcatattg

SEQ ID NO: 93180 - DNA, 41 bp, Artificial Sequence
  Description of Artificial Sequence: Synthetic oligonucleotide
aacttttcaatcaagatacgaagagagagcaggcatattgc

SEQ ID NO: 93181 - DNA, 40 bp, Artificial Sequence
  Description of Artificial Sequence: Synthetic oligonucleotide
acttttcaatcaagatacgaagagagagcaggcatattgc

SEQ ID NO: 93182 - DNA, 39 bp, Artificial Sequence
  Description of Artificial Sequence: Synthetic oligonucleotide
cttttcaatcaagatacgaagagagagcaggcatattgc

SEQ ID NO: 93183 - DNA, 40 bp, Artificial Sequence
  Description of Artificial Sequence: Synthetic oligonucleotide
ttttcaatcaagatacgaagagagagcaggcatattgcac

SEQ ID NO: 93184 - DNA, 39 bp, Artificial Sequence
  Description of Artificial Sequence: Synthetic oligonucleotide
tttcaatcaagatacgaagagagagcaggcatattgcac

SEQ ID NO: 93185 - DNA, 38 bp, Artificial Sequence
  Description of Artificial Sequence: Synthetic oligonucleotide
ttcaatcaagatacgaagagagagcaggcatattgcac

SEQ ID NO: 93186 - DNA, 37 bp, Artificial Sequence
  Description of Artificial Sequence: Synthetic oligonucleotide
tcaatcaagatacgaagagagagcaggcatattgcac

SEQ ID NO: 93187 - DNA, 36 bp, Artificial Sequence
  Description of Artificial Sequence: Synthetic oligonucleotide
caatcaagatacgaagagagagcaggcatattgcac

SEQ ID NO: 93188 - DNA, 39 bp, Artificial Sequence
  Description of Artificial Sequence: Synthetic oligonucleotide
aatcaagatacgaagagagagcaggcatattgcactatc

SEQ ID NO: 93189 - DNA, 38 bp, Artificial Sequence
  Description of Artificial Sequence: Synthetic oligonucleotide
atcaagatacgaagagagagcaggcatattgcactatc

SEQ ID NO: 93190 - DNA, 37 bp, Artificial Sequence
  Description of Artificial Sequence: Synthetic oligonucleotide
tcaagatacgaagagagagcaggcatattgcactatc

SEQ ID NO: 93191 - DNA, 36 bp, Artificial Sequence
  Description of Artificial Sequence: Synthetic oligonucleotide
caagatacgaagagagagcaggcatattgcactatc

SEQ ID NO: 93192 - DNA, 36 bp, Artificial Sequence
  Description of Artificial Sequence: Synthetic oligonucleotide
aagatacgaagagagagcaggcatattgcactatcc

SEQ ID NO: 93193 - DNA, 35 bp, Artificial Sequence
  Description of Artificial Sequence: Synthetic oligonucleotide
agatacgaagagagagcaggcatattgcactatcc

SEQ ID NO: 93194 - DNA, 34 bp, Artificial Sequence
  Description of Artificial Sequence: Synthetic oligonucleotide
gatacgaagagagagcaggcatattgcactatcc

SEQ ID NO: 93195 - DNA, 36 bp, Artificial Sequence
  Description of Artificial Sequence: Synthetic oligonucleotide
atacgaagagagagcaggcatattgcactatccaac

SEQ ID NO: 93196 - DNA, 35 bp, Artificial Sequence
  Description of Artificial Sequence: Synthetic oligonucleotide
tacgaagagagagcaggcatattgcactatccaac

SEQ ID NO: 93197 - DNA, 34 bp, Artificial Sequence
  Description of Artificial Sequence: Synthetic oligonucleotide
acgaagagagagcaggcatattgcactatccaac

SEQ ID NO: 93198 - DNA, 33 bp, Artificial Sequence
  Description of Artificial Sequence: Synthetic oligonucleotide
cgaagagagagcaggcatattgcactatccaac

SEQ ID NO: 93199 - DNA, 35 bp, Artificial Sequence
  Description of Artificial Sequence: Synthetic oligonucleotide
gaagagagagcaggcatattgcactatccaacatg

SEQ ID NO: 93200 - DNA, 35 bp, Artificial Sequence
  Description of Artificial Sequence: Synthetic oligonucleotide
aagagagagcaggcatattgcactatccaacatgc

SEQ ID NO: 93201 - DNA, 34 bp, Artificial Sequence
  Description of Artificial Sequence: Synthetic oligonucleotide
agagagagcaggcatattgcactatccaacatgc

SEQ ID NO: 93202 - DNA, 33 bp, Artificial Sequence
  Description of Artificial Sequence: Synthetic oligonucleotide
gagagagcaggcatattgcactatccaacatgc

SEQ ID NO: 93203 - DNA, 33 bp, Artificial Sequence
  Description of Artificial Sequence: Synthetic oligonucleotide
agagagcaggcatattgcactatccaacatgcc

SEQ ID NO: 93204 - DNA, 32 bp, Artificial Sequence
  Description of Artificial Sequence: Synthetic oligonucleotide
gagagcaggcatattgcactatccaacatgcc

SEQ ID NO: 93205 - DNA, 35 bp, Artificial Sequence
  Description of Artificial Sequence: Synthetic oligonucleotide
agagcaggcatattgcactatccaacatgccaaag

SEQ ID NO: 93206 - DNA, 34 bp, Artificial Sequence
  Description of Artificial Sequence: Synthetic oligonucleotide
gagcaggcatattgcactatccaacatgccaaag

SEQ ID NO: 93207 - DNA, 34 bp, Artificial Sequence
  Description of Artificial Sequence: Synthetic oligonucleotide
agcaggcatattgcactatccaacatgccaaagg

SEQ ID NO: 93208 - DNA, 33 bp, Artificial Sequence
  Description of Artificial Sequence: Synthetic oligonucleotide
gcaggcatattgcactatccaacatgccaaagg

SEQ ID NO: 93209 - DNA, 37 bp, Artificial Sequence
  Description of Artificial Sequence: Synthetic oligonucleotide
caggcatattgcactatccaacatgccaaaggttaag

SEQ ID NO: 93210 - DNA, 38 bp, Artificial Sequence
  Description of Artificial Sequence: Synthetic oligonucleotide
aggcatattgcactatccaacatgccaaaggttaagac

SEQ ID NO: 93211 - DNA, 37 bp, Artificial Sequence
  Description of Artificial Sequence: Synthetic oligonucleotide
ggcatattgcactatccaacatgccaaaggttaagac

SEQ ID NO: 93212 - DNA, 41 bp, Artificial Sequence
  Description of Artificial Sequence: Synthetic oligonucleotide
gcatattgcactatccaacatgccaaaggttaagacaattg

SEQ ID NO: 93213 - DNA, 43 bp, Artificial Sequence
  Description of Artificial Sequence: Synthetic oligonucleotide
catattgcactatccaacatgccaaaggttaagacaattgaac

SEQ ID NO: 93214 - DNA, 45 bp, Artificial Sequence
  Description of Artificial Sequence: Synthetic oligonucleotide
atattgcactatccaacatgccaaaggttaagacaattgaacttg

SEQ ID NO: 93215 - DNA, 44 bp, Artificial Sequence
  Description of Artificial Sequence: Synthetic oligonucleotide
tattgcactatccaacatgccaaaggttaagacaattgaacttg

SEQ ID NO: 93216 - DNA, 43 bp, Artificial Sequence
  Description of Artificial Sequence: Synthetic oligonucleotide
attgcactatccaacatgccaaaggttaagacaattgaacttg

SEQ ID NO: 93217 - DNA, 42 bp, Artificial Sequence
  Description of Artificial Sequence: Synthetic oligonucleotide
ttgcactatccaacatgccaaaggttaagacaattgaacttg

SEQ ID NO: 93218 - DNA, 41 bp, Artificial Sequence
  Description of Artificial Sequence: Synthetic oligonucleotide
tgcactatccaacatgccaaaggttaagacaattgaacttg

SEQ ID NO: 93219 - DNA, 40 bp, Artificial Sequence
  Description of Artificial Sequence: Synthetic oligonucleotide
gcactatccaacatgccaaaggttaagacaattgaacttg

SEQ ID NO: 93220 - DNA, 42 bp, Artificial Sequence
  Description of Artificial Sequence: Synthetic oligonucleotide
cactatccaacatgccaaaggttaagacaattgaacttgaag

SEQ ID NO: 93221 - DNA, 42 bp, Artificial Sequence
  Description of Artificial Sequence: Synthetic oligonucleotide
actatccaacatgccaaaggttaagacaattgaacttgaagg

SEQ ID NO: 93222 - DNA, 41 bp, Artificial Sequence
  Description of Artificial Sequence: Synthetic oligonucleotide
ctatccaacatgccaaaggttaagacaattgaacttgaagg

SEQ ID NO: 93223 - DNA, 42 bp, Artificial Sequence
  Description of Artificial Sequence: Synthetic oligonucleotide
tatccaacatgccaaaggttaagacaattgaacttgaaggag

SEQ ID NO: 93224 - DNA, 41 bp, Artificial Sequence
  Description of Artificial Sequence: Synthetic oligonucleotide
atccaacatgccaaaggttaagacaattgaacttgaaggag

SEQ ID NO: 93225 - DNA, 40 bp, Artificial Sequence
  Description of Artificial Sequence: Synthetic oligonucleotide
tccaacatgccaaaggttaagacaattgaacttgaaggag

SEQ ID NO: 93226 - DNA, 39 bp, Artificial Sequence
  Description of Artificial Sequence: Synthetic oligonucleotide
ccaacatgccaaaggttaagacaattgaacttgaaggag

SEQ ID NO: 93227 - DNA, 39 bp, Artificial Sequence
  Description of Artificial Sequence: Synthetic oligonucleotide
caacatgccaaaggttaagacaattgaacttgaaggagg

SEQ ID NO: 93228 - DNA, 40 bp, Artificial Sequence
  Description of Artificial Sequence: Synthetic oligonucleotide
aacatgccaaaggttaagacaattgaacttgaaggaggtc

SEQ ID NO: 93229 - DNA, 39 bp, Artificial Sequence
  Description of Artificial Sequence: Synthetic oligonucleotide
acatgccaaaggttaagacaattgaacttgaaggaggtc

SEQ ID NO: 93230 - DNA, 38 bp, Artificial Sequence
  Description of Artificial Sequence: Synthetic oligonucleotide
catgccaaaggttaagacaattgaacttgaaggaggtc

SEQ ID NO: 93231 - DNA, 42 bp, Artificial Sequence
  Description of Artificial Sequence: Synthetic oligonucleotide
atgccaaaggttaagacaattgaacttgaaggaggtcttttg

SEQ ID NO: 93232 - DNA, 41 bp, Artificial Sequence
  Description of Artificial Sequence: Synthetic oligonucleotide
tgccaaaggttaagacaattgaacttgaaggaggtcttttg

SEQ ID NO: 93233 - DNA, 40 bp, Artificial Sequence
  Description of Artificial Sequence: Synthetic oligonucleotide
gccaaaggttaagacaattgaacttgaaggaggtcttttg

SEQ ID NO: 93234 - DNA, 40 bp, Artificial Sequence
  Description of Artificial Sequence: Synthetic oligonucleotide
ccaaaggttaagacaattgaacttgaaggaggtcttttgg

SEQ ID NO: 93235 - DNA, 42 bp, Artificial Sequence
  Description of Artificial Sequence: Synthetic oligonucleotide
caaaggttaagacaattgaacttgaaggaggtcttttggaag

SEQ ID NO: 93236 - DNA, 44 bp, Artificial Sequence
  Description of Artificial Sequence: Synthetic oligonucleotide
aaaggttaagacaattgaacttgaaggaggtcttttggaagatc

SEQ ID NO: 93237 - DNA, 43 bp, Artificial Sequence
  Description of Artificial Sequence: Synthetic oligonucleotide
aaggttaagacaattgaacttgaaggaggtcttttggaagatc

SEQ ID NO: 93238 - DNA, 42 bp, Artificial Sequence
  Description of Artificial Sequence: Synthetic oligonucleotide
aggttaagacaattgaacttgaaggaggtcttttggaagatc

SEQ ID NO: 93239 - DNA, 41 bp, Artificial Sequence
  Description of Artificial Sequence: Synthetic oligonucleotide
ggttaagacaattgaacttgaaggaggtcttttggaagatc

SEQ ID NO: 93240 - DNA, 42 bp, Artificial Sequence
  Description of Artificial Sequence: Synthetic oligonucleotide
gttaagacaattgaacttgaaggaggtcttttggaagatcac

SEQ ID NO: 93241 - DNA, 45 bp, Artificial Sequence
  Description of Artificial Sequence: Synthetic oligonucleotide
ttaagacaattgaacttgaaggaggtcttttggaagatcactttg

SEQ ID NO: 93242 - DNA, 44 bp, Artificial Sequence
  Description of Artificial Sequence: Synthetic oligonucleotide
taagacaattgaacttgaaggaggtcttttggaagatcactttg

SEQ ID NO: 93243 - DNA, 43 bp, Artificial Sequence
  Description of Artificial Sequence: Synthetic oligonucleotide
aagacaattgaacttgaaggaggtcttttggaagatcactttg

SEQ ID NO: 93244 - DNA, 42 bp, Artificial Sequence
  Description of Artificial Sequence: Synthetic oligonucleotide
agacaattgaacttgaaggaggtcttttggaagatcactttg

SEQ ID NO: 93245 - DNA, 41 bp, Artificial Sequence
  Description of Artificial Sequence: Synthetic oligonucleotide
gacaattgaacttgaaggaggtcttttggaagatcactttg

SEQ ID NO: 93246 - DNA, 44 bp, Artificial Sequence
  Description of Artificial Sequence: Synthetic oligonucleotide
acaattgaacttgaaggaggtcttttggaagatcactttgaaac

SEQ ID NO: 93247 - DNA, 43 bp, Artificial Sequence
  Description of Artificial Sequence: Synthetic oligonucleotide
caattgaacttgaaggaggtcttttggaagatcactttgaaac

SEQ ID NO: 93248 - DNA, 45 bp, Artificial Sequence
  Description of Artificial Sequence: Synthetic oligonucleotide
aattgaacttgaaggaggtcttttggaagatcactttgaaactac

SEQ ID NO: 93249 - DNA, 44 bp, Artificial Sequence
  Description of Artificial Sequence: Synthetic oligonucleotide
attgaacttgaaggaggtcttttggaagatcactttgaaactac

SEQ ID NO: 93250 - DNA, 43 bp, Artificial Sequence
  Description of Artificial Sequence: Synthetic oligonucleotide
ttgaacttgaaggaggtcttttggaagatcactttgaaactac

SEQ ID NO: 93251 - DNA, 42 bp, Artificial Sequence
  Description of Artificial Sequence: Synthetic oligonucleotide
tgaacttgaaggaggtcttttggaagatcactttgaaactac

SEQ ID NO: 93252 - DNA, 41 bp, Artificial Sequence
  Description of Artificial Sequence: Synthetic oligonucleotide
gaacttgaaggaggtcttttggaagatcactttgaaactac

SEQ ID NO: 93253 - DNA, 42 bp, Artificial Sequence
  Description of Artificial Sequence: Synthetic oligonucleotide
aacttgaaggaggtcttttggaagatcactttgaaactactg

SEQ ID NO: 93254 - DNA, 41 bp, Artificial Sequence
  Description of Artificial Sequence: Synthetic oligonucleotide
acttgaaggaggtcttttggaagatcactttgaaactactg

SEQ ID NO: 93255 - DNA, 40 bp, Artificial Sequence
  Description of Artificial Sequence: Synthetic oligonucleotide
cttgaaggaggtcttttggaagatcactttgaaactactg

SEQ ID NO: 93256 - DNA, 47 bp, Artificial Sequence
  Description of Artificial Sequence: Synthetic oligonucleotide
ttgaaggaggtcttttggaagatcactttgaaactactgtaaaaatg

SEQ ID NO: 93257 - DNA, 46 bp, Artificial Sequence
  Description of Artificial Sequence: Synthetic oligonucleotide
tgaaggaggtcttttggaagatcactttgaaactactgtaaaaatg

SEQ ID NO: 93258 - DNA, 45 bp, Artificial Sequence
  Description of Artificial Sequence: Synthetic oligonucleotide
gaaggaggtcttttggaagatcactttgaaactactgtaaaaatg

SEQ ID NO: 93259 - DNA, 46 bp, Artificial Sequence
  Description of Artificial Sequence: Synthetic oligonucleotide
aaggaggtcttttggaagatcactttgaaactactgtaaaaatgag

SEQ ID NO: 93260 - DNA, 45 bp, Artificial Sequence
  Description of Artificial Sequence: Synthetic oligonucleotide
aggaggtcttttggaagatcactttgaaactactgtaaaaatgag

SEQ ID NO: 93261 - DNA, 44 bp, Artificial Sequence
  Description of Artificial Sequence: Synthetic oligonucleotide
ggaggtcttttggaagatcactttgaaactactgtaaaaatgag

SEQ ID NO: 93262 - DNA, 46 bp, Artificial Sequence
  Description of Artificial Sequence: Synthetic oligonucleotide
gaggtcttttggaagatcactttgaaactactgtaaaaatgagtac

SEQ ID NO: 93263 - DNA, 49 bp, Artificial Sequence
  Description of Artificial Sequence: Synthetic oligonucleotide
aggtcttttggaagatcactttgaaactactgtaaaaatgagtacatac

SEQ ID NO: 93264 - DNA, 48 bp, Artificial Sequence
  Description of Artificial Sequence: Synthetic oligonucleotide
ggtcttttggaagatcactttgaaactactgtaaaaatgagtacatac

SEQ ID NO: 93265 - DNA, 48 bp, Artificial Sequence
  Description of Artificial Sequence: Synthetic oligonucleotide
gtcttttggaagatcactttgaaactactgtaaaaatgagtacatacc

SEQ ID NO: 93266 - DNA, 50 bp, Artificial Sequence
  Description of Artificial Sequence: Synthetic oligonucleotide
tcttttggaagatcactttgaaactactgtaaaaatgagtacataccttg

SEQ ID NO: 93267 - DNA, 49 bp, Artificial Sequence
  Description of Artificial Sequence: Synthetic oligonucleotide
cttttggaagatcactttgaaactactgtaaaaatgagtacataccttg

SEQ ID NO: 93268 - DNA, 51 bp, Artificial Sequence
  Description of Artificial Sequence: Synthetic oligonucleotide
ttttggaagatcactttgaaactactgtaaaaatgagtacataccttgtag

SEQ ID NO: 93269 - DNA, 50 bp, Artificial Sequence
  Description of Artificial Sequence: Synthetic oligonucleotide
tttggaagatcactttgaaactactgtaaaaatgagtacataccttgtag

SEQ ID NO: 93270 - DNA, 49 bp, Artificial Sequence
  Description of Artificial Sequence: Synthetic oligonucleotide
ttggaagatcactttgaaactactgtaaaaatgagtacataccttgtag

SEQ ID NO: 93271 - DNA, 48 bp, Artificial Sequence
  Description of Artificial Sequence: Synthetic oligonucleotide
tggaagatcactttgaaactactgtaaaaatgagtacataccttgtag

SEQ ID NO: 93272 - DNA, 47 bp, Artificial Sequence
  Description of Artificial Sequence: Synthetic oligonucleotide
ggaagatcactttgaaactactgtaaaaatgagtacataccttgtag

SEQ ID NO: 93273 - DNA, 47 bp, Artificial Sequence
  Description of Artificial Sequence: Synthetic oligonucleotide
gaagatcactttgaaactactgtaaaaatgagtacataccttgtagc

SEQ ID NO: 93274 - DNA, 47 bp, Artificial Sequence
  Description of Artificial Sequence: Synthetic oligonucleotide
aagatcactttgaaactactgtaaaaatgagtacataccttgtagcc

SEQ ID NO: 93275 - DNA, 46 bp, Artificial Sequence
  Description of Artificial Sequence: Synthetic oligonucleotide
agatcactttgaaactactgtaaaaatgagtacataccttgtagcc

SEQ ID NO: 93276 - DNA, 45 bp, Artificial Sequence
  Description of Artificial Sequence: Synthetic oligonucleotide
gatcactttgaaactactgtaaaaatgagtacataccttgtagcc

SEQ ID NO: 93277 - DNA, 47 bp, Artificial Sequence
  Description of Artificial Sequence: Synthetic oligonucleotide
atcactttgaaactactgtaaaaatgagtacataccttgtagcctac

SEQ ID NO: 93278 - DNA, 46 bp, Artificial Sequence
  Description of Artificial Sequence: Synthetic oligonucleotide
tcactttgaaactactgtaaaaatgagtacataccttgtagcctac

SEQ ID NO: 93279 - DNA, 45 bp, Artificial Sequence
  Description of Artificial Sequence: Synthetic oligonucleotide
cactttgaaactactgtaaaaatgagtacataccttgtagcctac

SEQ ID NO: 93280 - DNA, 48 bp, Artificial Sequence
  Description of Artificial Sequence: Synthetic oligonucleotide
actttgaaactactgtaaaaatgagtacataccttgtagcctacatag

SEQ ID NO: 93281 - DNA, 47 bp, Artificial Sequence
  Description of Artificial Sequence: Synthetic oligonucleotide
ctttgaaactactgtaaaaatgagtacataccttgtagcctacatag

SEQ ID NO: 93282 - DNA, 50 bp, Artificial Sequence
  Description of Artificial Sequence: Synthetic oligonucleotide
tttgaaactactgtaaaaatgagtacataccttgtagcctacatagtttg

SEQ ID NO: 93283 - DNA, 49 bp, Artificial Sequence
  Description of Artificial Sequence: Synthetic oligonucleotide
ttgaaactactgtaaaaatgagtacataccttgtagcctacatagtttg

SEQ ID NO: 93284 - DNA, 48 bp, Artificial Sequence
  Description of Artificial Sequence: Synthetic oligonucleotide
tgaaactactgtaaaaatgagtacataccttgtagcctacatagtttg

SEQ ID NO: 93285 - DNA, 47 bp, Artificial Sequence
  Description of Artificial Sequence: Synthetic oligonucleotide
gaaactactgtaaaaatgagtacataccttgtagcctacatagtttg

SEQ ID NO: 93286 - DNA, 48 bp, Artificial Sequence
  Description of Artificial Sequence: Synthetic oligonucleotide
aaactactgtaaaaatgagtacataccttgtagcctacatagtttgtg

SEQ ID NO: 93287 - DNA, 47 bp, Artificial Sequence
  Description of Artificial Sequence: Synthetic oligonucleotide
aactactgtaaaaatgagtacataccttgtagcctacatagtttgtg

SEQ ID NO: 93288 - DNA, 46 bp, Artificial Sequence
  Description of Artificial Sequence: Synthetic oligonucleotide
actactgtaaaaatgagtacataccttgtagcctacatagtttgtg

SEQ ID NO: 93289 - DNA, 45 bp, Artificial Sequence
  Description of Artificial Sequence: Synthetic oligonucleotide
ctactgtaaaaatgagtacataccttgtagcctacatagtttgtg

SEQ ID NO: 93290 - DNA, 49 bp, Artificial Sequence
  Description of Artificial Sequence: Synthetic oligonucleotide
tactgtaaaaatgagtacataccttgtagcctacatagtttgtgatttc

SEQ ID NO: 93291 - DNA, 48 bp, Artificial Sequence
  Description of Artificial Sequence: Synthetic oligonucleotide
actgtaaaaatgagtacataccttgtagcctacatagtttgtgatttc

SEQ ID NO: 93292 - DNA, 47 bp, Artificial Sequence
  Description of Artificial Sequence: Synthetic oligonucleotide
ctgtaaaaatgagtacataccttgtagcctacatagtttgtgatttc

SEQ ID NO: 93293 - DNA, 47 bp, Artificial Sequence
  Description of Artificial Sequence: Synthetic oligonucleotide
tgtaaaaatgagtacataccttgtagcctacatagtttgtgatttcc

SEQ ID NO: 93294 - DNA, 46 bp, Artificial Sequence
  Description of Artificial Sequence: Synthetic oligonucleotide
gtaaaaatgagtacataccttgtagcctacatagtttgtgatttcc

SEQ ID NO: 93295 - DNA, 47 bp, Artificial Sequence
  Description of Artificial Sequence: Synthetic oligonucleotide
taaaaatgagtacataccttgtagcctacatagtttgtgatttccac

SEQ ID NO: 93296 - DNA, 46 bp, Artificial Sequence
  Description of Artificial Sequence: Synthetic oligonucleotide
aaaaatgagtacataccttgtagcctacatagtttgtgatttccac

SEQ ID NO: 93297 - DNA, 45 bp, Artificial Sequence
  Description of Artificial Sequence: Synthetic oligonucleotide
aaaatgagtacataccttgtagcctacatagtttgtgatttccac

SEQ ID NO: 93298 - DNA, 44 bp, Artificial Sequence
  Description of Artificial Sequence: Synthetic oligonucleotide
aaatgagtacataccttgtagcctacatagtttgtgatttccac

SEQ ID NO: 93299 - DNA, 43 bp, Artificial Sequence
  Description of Artificial Sequence: Synthetic oligonucleotide
aatgagtacataccttgtagcctacatagtttgtgatttccac

SEQ ID NO: 93300 - DNA, 42 bp, Artificial Sequence
  Description of Artificial Sequence: Synthetic oligonucleotide
atgagtacataccttgtagcctacatagtttgtgatttccac

SEQ ID NO: 93301 - DNA, 41 bp, Artificial Sequence
  Description of Artificial Sequence: Synthetic oligonucleotide
tgagtacataccttgtagcctacatagtttgtgatttccac

SEQ ID NO: 93302 - DNA, 40 bp, Artificial Sequence
  Description of Artificial Sequence: Synthetic oligonucleotide
gagtacataccttgtagcctacatagtttgtgatttccac

SEQ ID NO: 93303 - DNA, 41 bp, Artificial Sequence
  Description of Artificial Sequence: Synthetic oligonucleotide
agtacataccttgtagcctacatagtttgtgatttccactc

SEQ ID NO: 93304 - DNA, 40 bp, Artificial Sequence
  Description of Artificial Sequence: Synthetic oligonucleotide
gtacataccttgtagcctacatagtttgtgatttccactc

SEQ ID NO: 93305 - DNA, 41 bp, Artificial Sequence
  Description of Artificial Sequence: Synthetic oligonucleotide
tacataccttgtagcctacatagtttgtgatttccactctc

SEQ ID NO: 93306 - DNA, 40 bp, Artificial Sequence
  Description of Artificial Sequence: Synthetic oligonucleotide
acataccttgtagcctacatagtttgtgatttccactctc

SEQ ID NO: 93307 - DNA, 39 bp, Artificial Sequence
  Description of Artificial Sequence: Synthetic oligonucleotide
cataccttgtagcctacatagtttgtgatttccactctc

SEQ ID NO: 93308 - DNA, 40 bp, Artificial Sequence
  Description of Artificial Sequence: Synthetic oligonucleotide
ataccttgtagcctacatagtttgtgatttccactctctg

SEQ ID NO: 93309 - DNA, 39 bp, Artificial Sequence
  Description of Artificial Sequence: Synthetic oligonucleotide
taccttgtagcctacatagtttgtgatttccactctctg

SEQ ID NO: 93310 - DNA, 38 bp, Artificial Sequence
  Description of Artificial Sequence: Synthetic oligonucleotide
accttgtagcctacatagtttgtgatttccactctctg

SEQ ID NO: 93311 - DNA, 37 bp, Artificial Sequence
  Description of Artificial Sequence: Synthetic oligonucleotide
ccttgtagcctacatagtttgtgatttccactctctg

SEQ ID NO: 93312 - DNA, 38 bp, Artificial Sequence
  Description of Artificial Sequence: Synthetic oligonucleotide
cttgtagcctacatagtttgtgatttccactctctgag

SEQ ID NO: 93313 - DNA, 39 bp, Artificial Sequence
  Description of Artificial Sequence: Synthetic oligonucleotide
ttgtagcctacatagtttgtgatttccactctctgagtg

SEQ ID NO: 93314 - DNA, 38 bp, Artificial Sequence
  Description of Artificial Sequence: Synthetic oligonucleotide
tgtagcctacatagtttgtgatttccactctctgagtg

SEQ ID NO: 93315 - DNA, 37 bp, Artificial Sequence
  Description of Artificial Sequence: Synthetic oligonucleotide
gtagcctacatagtttgtgatttccactctctgagtg

SEQ ID NO: 93316 - DNA, 37 bp, Artificial Sequence
  Description of Artificial Sequence: Synthetic oligonucleotide
tagcctacatagtttgtgatttccactctctgagtgg

SEQ ID NO: 93317 - DNA, 36 bp, Artificial Sequence
  Description of Artificial Sequence: Synthetic oligonucleotide
agcctacatagtttgtgatttccactctctgagtgg

SEQ ID NO: 93318 - DNA, 35 bp, Artificial Sequence
  Description of Artificial Sequence: Synthetic oligonucleotide
gcctacatagtttgtgatttccactctctgagtgg

SEQ ID NO: 93319 - DNA, 35 bp, Artificial Sequence
  Description of Artificial Sequence: Synthetic oligonucleotide
cctacatagtttgtgatttccactctctgagtggc

SEQ ID NO: 93320 - DNA, 37 bp, Artificial Sequence
  Description of Artificial Sequence: Synthetic oligonucleotide
ctacatagtttgtgatttccactctctgagtggcttc

SEQ ID NO: 93321 - DNA, 38 bp, Artificial Sequence
  Description of Artificial Sequence: Synthetic oligonucleotide
tacatagtttgtgatttccactctctgagtggcttcac

SEQ ID NO: 93322 - DNA, 37 bp, Artificial Sequence
  Description of Artificial Sequence: Synthetic oligonucleotide
acatagtttgtgatttccactctctgagtggcttcac

SEQ ID NO: 93323 - DNA, 36 bp, Artificial Sequence
  Description of Artificial Sequence: Synthetic oligonucleotide
catagtttgtgatttccactctctgagtggcttcac

SEQ ID NO: 93324 - DNA, 38 bp, Artificial Sequence
  Description of Artificial Sequence: Synthetic oligonucleotide
atagtttgtgatttccactctctgagtggcttcacttc

SEQ ID NO: 93325 - DNA, 37 bp, Artificial Sequence
  Description of Artificial Sequence: Synthetic oligonucleotide
tagtttgtgatttccactctctgagtggcttcacttc

SEQ ID NO: 93326 - DNA, 36 bp, Artificial Sequence
  Description of Artificial Sequence: Synthetic oligonucleotide
agtttgtgatttccactctctgagtggcttcacttc

SEQ ID NO: 93327 - DNA, 35 bp, Artificial Sequence
  Description of Artificial Sequence: Synthetic oligonucleotide
gtttgtgatttccactctctgagtggcttcacttc

SEQ ID NO: 93328 - DNA, 37 bp, Artificial Sequence
  Description of Artificial Sequence: Synthetic oligonucleotide
tttgtgatttccactctctgagtggcttcacttcatc

SEQ ID NO: 93329 - DNA, 36 bp, Artificial Sequence
  Description of Artificial Sequence: Synthetic oligonucleotide
ttgtgatttccactctctgagtggcttcacttcatc

SEQ ID NO: 93330 - DNA, 35 bp, Artificial Sequence
  Description of Artificial Sequence: Synthetic oligonucleotide
tgtgatttccactctctgagtggcttcacttcatc

SEQ ID NO: 93331 - DNA, 34 bp, Artificial Sequence
  Description of Artificial Sequence: Synthetic oligonucleotide
gtgatttccactctctgagtggcttcacttcatc

SEQ ID NO: 93332 - DNA, 35 bp, Artificial Sequence
  Description of Artificial Sequence: Synthetic oligonucleotide
tgatttccactctctgagtggcttcacttcatcag

SEQ ID NO: 93333 - DNA, 34 bp, Artificial Sequence
  Description of Artificial Sequence: Synthetic oligonucleotide
gatttccactctctgagtggcttcacttcatcag

SEQ ID NO: 93334 - DNA, 34 bp, Artificial Sequence
  Description of Artificial Sequence: Synthetic oligonucleotide
atttccactctctgagtggcttcacttcatcagg

SEQ ID NO: 93335 - DNA, 33 bp, Artificial Sequence
  Description of Artificial Sequence: Synthetic oligonucleotide
tttccactctctgagtggcttcacttcatcagg

SEQ ID NO: 93336 - DNA, 32 bp, Artificial Sequence
  Description of Artificial Sequence: Synthetic oligonucleotide
ttccactctctgagtggcttcacttcatcagg

SEQ ID NO: 93337 - DNA, 31 bp, Artificial Sequence
  Description of Artificial Sequence: Synthetic oligonucleotide
tccactctctgagtggcttcacttcatcagg

SEQ ID NO: 93338 - DNA, 30 bp, Artificial Sequence
  Description of Artificial Sequence: Synthetic oligonucleotide
ccactctctgagtggcttcacttcatcagg

SEQ ID NO: 93339 - DNA, 30 bp, Artificial Sequence
  Description of Artificial Sequence: Synthetic oligonucleotide
cactctctgagtggcttcacttcatcaggg

SEQ ID NO: 93340 - DNA, 30 bp, Artificial Sequence
  Description of Artificial Sequence: Synthetic oligonucleotide
actctctgagtggcttcacttcatcagggg

SEQ ID NO: 93341 - DNA, 29 bp, Artificial Sequence
  Description of Artificial Sequence: Synthetic oligonucleotide
ctctctgagtggcttcacttcatcagggg

SEQ ID NO: 93342 - DNA, 30 bp, Artificial Sequence
  Description of Artificial Sequence: Synthetic oligonucleotide
tctctgagtggcttcacttcatcaggggtc

SEQ ID NO: 93343 - DNA, 29 bp, Artificial Sequence
  Description of Artificial Sequence: Synthetic oligonucleotide
ctctgagtggcttcacttcatcaggggtc

SEQ ID NO: 93344 - DNA, 31 bp, Artificial Sequence
  Description of Artificial Sequence: Synthetic oligonucleotide
tctgagtggcttcacttcatcaggggtcaag

SEQ ID NO: 93345 - DNA, 30 bp, Artificial Sequence
  Description of Artificial Sequence: Synthetic oligonucleotide
ctgagtggcttcacttcatcaggggtcaag

SEQ ID NO: 93346 - DNA, 30 bp, Artificial Sequence
  Description of Artificial Sequence: Synthetic oligonucleotide
tgagtggcttcacttcatcaggggtcaagg

SEQ ID NO: 93347 - DNA, 29 bp, Artificial Sequence
  Description of Artificial Sequence: Synthetic oligonucleotide
gagtggcttcacttcatcaggggtcaagg

SEQ ID NO: 93348 - DNA, 30 bp, Artificial Sequence
  Description of Artificial Sequence: Synthetic oligonucleotide
agtggcttcacttcatcaggggtcaaggtg

SEQ ID NO: 93349 - DNA, 29 bp, Artificial Sequence
  Description of Artificial Sequence: Synthetic oligonucleotide
gtggcttcacttcatcaggggtcaaggtg

SEQ ID NO: 93350 - DNA, 30 bp, Artificial Sequence
  Description of Artificial Sequence: Synthetic oligonucleotide
tggcttcacttcatcaggggtcaaggtgtc

SEQ ID NO: 93351 - DNA, 29 bp, Artificial Sequence
  Description of Artificial Sequence: Synthetic oligonucleotide
ggcttcacttcatcaggggtcaaggtgtc

SEQ ID NO: 93352 - DNA, 29 bp, Artificial Sequence
  Description of Artificial Sequence: Synthetic oligonucleotide
gcttcacttcatcaggggtcaaggtgtcc

SEQ ID NO: 93353 - DNA, 31 bp, Artificial Sequence
  Description of Artificial Sequence: Synthetic oligonucleotide
cttcacttcatcaggggtcaaggtgtccatc

SEQ ID NO: 93354 - DNA, 34 bp, Artificial Sequence
  Description of Artificial Sequence: Synthetic oligonucleotide
ttcacttcatcaggggtcaaggtgtccatctatg

SEQ ID NO: 93355 - DNA, 33 bp, Artificial Sequence
  Description of Artificial Sequence: Synthetic oligonucleotide
tcacttcatcaggggtcaaggtgtccatctatg

SEQ ID NO: 93356 - DNA, 32 bp, Artificial Sequence
  Description of Artificial Sequence: Synthetic oligonucleotide
cacttcatcaggggtcaaggtgtccatctatg

SEQ ID NO: 93357 - DNA, 32 bp, Artificial Sequence
  Description of Artificial Sequence: Synthetic oligonucleotide
acttcatcaggggtcaaggtgtccatctatgc

SEQ ID NO: 93358 - DNA, 31 bp, Artificial Sequence
  Description of Artificial Sequence: Synthetic oligonucleotide
cttcatcaggggtcaaggtgtccatctatgc

SEQ ID NO: 93359 - DNA, 33 bp, Artificial Sequence
  Description of Artificial Sequence: Synthetic oligonucleotide
ttcatcaggggtcaaggtgtccatctatgcatc

SEQ ID NO: 93360 - DNA, 32 bp, Artificial Sequence
  Description of Artificial Sequence: Synthetic oligonucleotide
tcatcaggggtcaaggtgtccatctatgcatc

SEQ ID NO: 93361 - DNA, 31 bp, Artificial Sequence
  Description of Artificial Sequence: Synthetic oligonucleotide
catcaggggtcaaggtgtccatctatgcatc

SEQ ID NO: 93362 - DNA, 31 bp, Artificial Sequence
  Description of Artificial Sequence: Synthetic oligonucleotide
atcaggggtcaaggtgtccatctatgcatcc

SEQ ID NO: 93363 - DNA, 30 bp, Artificial Sequence
  Description of Artificial Sequence: Synthetic oligonucleotide
tcaggggtcaaggtgtccatctatgcatcc

SEQ ID NO: 93364 - DNA, 29 bp, Artificial Sequence
  Description of Artificial Sequence: Synthetic oligonucleotide
caggggtcaaggtgtccatctatgcatcc

SEQ ID NO: 93365 - DNA, 29 bp, Artificial Sequence
  Description of Artificial Sequence: Synthetic oligonucleotide
aggggtcaaggtgtccatctatgcatccc

SEQ ID NO: 93366 - DNA, 28 bp, Artificial Sequence
  Description of Artificial Sequence: Synthetic oligonucleotide
ggggtcaaggtgtccatctatgcatccc

SEQ ID NO: 93367 - DNA, 28 bp, Artificial Sequence
  Description of Artificial Sequence: Synthetic oligonucleotide
gggtcaaggtgtccatctatgcatcccc

SEQ ID NO: 93368 - DNA, 29 bp, Artificial Sequence
  Description of Artificial Sequence: Synthetic oligonucleotide
ggtcaaggtgtccatctatgcatccccag

SEQ ID NO: 93369 - DNA, 30 bp, Artificial Sequence
  Description of Artificial Sequence: Synthetic oligonucleotide
gtcaaggtgtccatctatgcatccccagac

SEQ ID NO: 93370 - DNA, 33 bp, Artificial Sequence
  Description of Artificial Sequence: Synthetic oligonucleotide
tcaaggtgtccatctatgcatccccagacaaac

SEQ ID NO: 93371 - DNA, 32 bp, Artificial Sequence
  Description of Artificial Sequence: Synthetic oligonucleotide
caaggtgtccatctatgcatccccagacaaac

SEQ ID NO: 93372 - DNA, 32 bp, Artificial Sequence
  Description of Artificial Sequence: Synthetic oligonucleotide
aaggtgtccatctatgcatccccagacaaacg

SEQ ID NO: 93373 - DNA, 31 bp, Artificial Sequence
  Description of Artificial Sequence: Synthetic oligonucleotide
aggtgtccatctatgcatccccagacaaacg

SEQ ID NO: 93374 - DNA, 30 bp, Artificial Sequence
  Description of Artificial Sequence: Synthetic oligonucleotide
ggtgtccatctatgcatccccagacaaacg

SEQ ID NO: 93375 - DNA, 30 bp, Artificial Sequence
  Description of Artificial Sequence: Synthetic oligonucleotide
gtgtccatctatgcatccccagacaaacgg

SEQ ID NO: 93376 - DNA, 33 bp, Artificial Sequence
  Description of Artificial Sequence: Synthetic oligonucleotide
tgtccatctatgcatccccagacaaacggaatc

SEQ ID NO: 93377 - DNA, 32 bp, Artificial Sequence
  Description of Artificial Sequence: Synthetic oligonucleotide
gtccatctatgcatccccagacaaacggaatc

SEQ ID NO: 93378 - DNA, 35 bp, Artificial Sequence
  Description of Artificial Sequence: Synthetic oligonucleotide
tccatctatgcatccccagacaaacggaatcaaac

SEQ ID NO: 93379 - DNA, 34 bp, Artificial Sequence
  Description of Artificial Sequence: Synthetic oligonucleotide
ccatctatgcatccccagacaaacggaatcaaac

SEQ ID NO: 93380 - DNA, 35 bp, Artificial Sequence
  Description of Artificial Sequence: Synthetic oligonucleotide
catctatgcatccccagacaaacggaatcaaacac

SEQ ID NO: 93381 - DNA, 40 bp, Artificial Sequence
  Description of Artificial Sequence: Synthetic oligonucleotide
atctatgcatccccagacaaacggaatcaaacacattatg

SEQ ID NO: 93382 - DNA, 39 bp, Artificial Sequence
  Description of Artificial Sequence: Synthetic oligonucleotide
tctatgcatccccagacaaacggaatcaaacacattatg

SEQ ID NO: 93383 - DNA, 38 bp, Artificial Sequence
  Description of Artificial Sequence: Synthetic oligonucleotide
ctatgcatccccagacaaacggaatcaaacacattatg

SEQ ID NO: 93384 - DNA, 38 bp, Artificial Sequence
  Description of Artificial Sequence: Synthetic oligonucleotide
tatgcatccccagacaaacggaatcaaacacattatgc

SEQ ID NO: 93385 - DNA, 37 bp, Artificial Sequence
  Description of Artificial Sequence: Synthetic oligonucleotide
atgcatccccagacaaacggaatcaaacacattatgc

SEQ ID NO: 93386 - DNA, 36 bp, Artificial Sequence
  Description of Artificial Sequence: Synthetic oligonucleotide
tgcatccccagacaaacggaatcaaacacattatgc

SEQ ID NO: 93387 - DNA, 35 bp, Artificial Sequence
  Description of Artificial Sequence: Synthetic oligonucleotide
gcatccccagacaaacggaatcaaacacattatgc

SEQ ID NO: 93388 - DNA, 38 bp, Artificial Sequence
  Description of Artificial Sequence: Synthetic oligonucleotide
catccccagacaaacggaatcaaacacattatgctttg

SEQ ID NO: 93389 - DNA, 38 bp, Artificial Sequence
  Description of Artificial Sequence: Synthetic oligonucleotide
atccccagacaaacggaatcaaacacattatgctttgc

SEQ ID NO: 93390 - DNA, 37 bp, Artificial Sequence
  Description of Artificial Sequence: Synthetic oligonucleotide
tccccagacaaacggaatcaaacacattatgctttgc

SEQ ID NO: 93391 - DNA, 36 bp, Artificial Sequence
  Description of Artificial Sequence: Synthetic oligonucleotide
ccccagacaaacggaatcaaacacattatgctttgc

SEQ ID NO: 93392 - DNA, 37 bp, Artificial Sequence
  Description of Artificial Sequence: Synthetic oligonucleotide
cccagacaaacggaatcaaacacattatgctttgcag

SEQ ID NO: 93393 - DNA, 37 bp, Artificial Sequence
  Description of Artificial Sequence: Synthetic oligonucleotide
ccagacaaacggaatcaaacacattatgctttgcagg

SEQ ID NO: 93394 - DNA, 37 bp, Artificial Sequence
  Description of Artificial Sequence: Synthetic oligonucleotide
cagacaaacggaatcaaacacattatgctttgcaggc

SEQ ID NO: 93395 - DNA, 39 bp, Artificial Sequence
  Description of Artificial Sequence: Synthetic oligonucleotide
agacaaacggaatcaaacacattatgctttgcaggcatc

SEQ ID NO: 93396 - DNA, 38 bp, Artificial Sequence
  Description of Artificial Sequence: Synthetic oligonucleotide
gacaaacggaatcaaacacattatgctttgcaggcatc

SEQ ID NO: 93397 - DNA, 39 bp, Artificial Sequence
  Description of Artificial Sequence: Synthetic oligonucleotide
acaaacggaatcaaacacattatgctttgcaggcatcac

SEQ ID NO: 93398 - DNA, 38 bp, Artificial Sequence
  Description of Artificial Sequence: Synthetic oligonucleotide
caaacggaatcaaacacattatgctttgcaggcatcac

SEQ ID NO: 93399 - DNA, 39 bp, Artificial Sequence
  Description of Artificial Sequence: Synthetic oligonucleotide
aaacggaatcaaacacattatgctttgcaggcatcactg

SEQ ID NO: 93400 - DNA, 38 bp, Artificial Sequence
  Description of Artificial Sequence: Synthetic oligonucleotide
aacggaatcaaacacattatgctttgcaggcatcactg

SEQ ID NO: 93401 - DNA, 37 bp, Artificial Sequence
  Description of Artificial Sequence: Synthetic oligonucleotide
acggaatcaaacacattatgctttgcaggcatcactg

SEQ ID NO: 93402 - DNA, 36 bp, Artificial Sequence
  Description of Artificial Sequence: Synthetic oligonucleotide
cggaatcaaacacattatgctttgcaggcatcactg

SEQ ID NO: 93403 - DNA, 38 bp, Artificial Sequence
  Description of Artificial Sequence: Synthetic oligonucleotide
ggaatcaaacacattatgctttgcaggcatcactgaag

SEQ ID NO: 93404 - DNA, 38 bp, Artificial Sequence
  Description of Artificial Sequence: Synthetic oligonucleotide
gaatcaaacacattatgctttgcaggcatcactgaagc

SEQ ID NO: 93405 - DNA, 40 bp, Artificial Sequence
  Description of Artificial Sequence: Synthetic oligonucleotide
aatcaaacacattatgctttgcaggcatcactgaagctac

SEQ ID NO: 93406 - DNA, 39 bp, Artificial Sequence
  Description of Artificial Sequence: Synthetic oligonucleotide
atcaaacacattatgctttgcaggcatcactgaagctac

SEQ ID NO: 93407 - DNA, 38 bp, Artificial Sequence
  Description of Artificial Sequence: Synthetic oligonucleotide
tcaaacacattatgctttgcaggcatcactgaagctac

SEQ ID NO: 93408 - DNA, 37 bp, Artificial Sequence
  Description of Artificial Sequence: Synthetic oligonucleotide
caaacacattatgctttgcaggcatcactgaagctac

SEQ ID NO: 93409 - DNA, 39 bp, Artificial Sequence
  Description of Artificial Sequence: Synthetic oligonucleotide
aaacacattatgctttgcaggcatcactgaagctacttg

SEQ ID NO: 93410 - DNA, 38 bp, Artificial Sequence
  Description of Artificial Sequence: Synthetic oligonucleotide
aacacattatgctttgcaggcatcactgaagctacttg

SEQ ID NO: 93411 - DNA, 37 bp, Artificial Sequence
  Description of Artificial Sequence: Synthetic oligonucleotide
acacattatgctttgcaggcatcactgaagctacttg

SEQ ID NO: 93412 - DNA, 36 bp, Artificial Sequence
  Description of Artificial Sequence: Synthetic oligonucleotide
cacattatgctttgcaggcatcactgaagctacttg

SEQ ID NO: 93413 - DNA, 44 bp, Artificial Sequence
  Description of Artificial Sequence: Synthetic oligonucleotide
acattatgctttgcaggcatcactgaagctacttgatttttatg

SEQ ID NO: 93414 - DNA, 43 bp, Artificial Sequence
  Description of Artificial Sequence: Synthetic oligonucleotide
cattatgctttgcaggcatcactgaagctacttgatttttatg

SEQ ID NO: 93415 - DNA, 47 bp, Artificial Sequence
  Description of Artificial Sequence: Synthetic oligonucleotide
attatgctttgcaggcatcactgaagctacttgatttttatgaaaag

SEQ ID NO: 93416 - DNA, 46 bp, Artificial Sequence
  Description of Artificial Sequence: Synthetic oligonucleotide
ttatgctttgcaggcatcactgaagctacttgatttttatgaaaag

SEQ ID NO: 93417 - DNA, 45 bp, Artificial Sequence
  Description of Artificial Sequence: Synthetic oligonucleotide
tatgctttgcaggcatcactgaagctacttgatttttatgaaaag

SEQ ID NO: 93418 - DNA, 44 bp, Artificial Sequence
  Description of Artificial Sequence: Synthetic oligonucleotide
atgctttgcaggcatcactgaagctacttgatttttatgaaaag

SEQ ID NO: 93419 - DNA, 43 bp, Artificial Sequence
  Description of Artificial Sequence: Synthetic oligonucleotide
tgctttgcaggcatcactgaagctacttgatttttatgaaaag

SEQ ID NO: 93420 - DNA, 42 bp, Artificial Sequence
  Description of Artificial Sequence: Synthetic oligonucleotide
gctttgcaggcatcactgaagctacttgatttttatgaaaag

SEQ ID NO: 93421 - DNA, 44 bp, Artificial Sequence
  Description of Artificial Sequence: Synthetic oligonucleotide
ctttgcaggcatcactgaagctacttgatttttatgaaaagtac

SEQ ID NO: 93422 - DNA, 47 bp, Artificial Sequence
  Description of Artificial Sequence: Synthetic oligonucleotide
tttgcaggcatcactgaagctacttgatttttatgaaaagtactttg

SEQ ID NO: 93423 - DNA, 46 bp, Artificial Sequence
  Description of Artificial Sequence: Synthetic oligonucleotide
ttgcaggcatcactgaagctacttgatttttatgaaaagtactttg

SEQ ID NO: 93424 - DNA, 45 bp, Artificial Sequence
  Description of Artificial Sequence: Synthetic oligonucleotide
tgcaggcatcactgaagctacttgatttttatgaaaagtactttg

SEQ ID NO: 93425 - DNA, 44 bp, Artificial Sequence
  Description of Artificial Sequence: Synthetic oligonucleotide
gcaggcatcactgaagctacttgatttttatgaaaagtactttg

SEQ ID NO: 93426 - DNA, 48 bp, Artificial Sequence
  Description of Artificial Sequence: Synthetic oligonucleotide
caggcatcactgaagctacttgatttttatgaaaagtactttgatatc

SEQ ID NO: 93427 - DNA, 50 bp, Artificial Sequence
  Description of Artificial Sequence: Synthetic oligonucleotide
aggcatcactgaagctacttgatttttatgaaaagtactttgatatctac

SEQ ID NO: 93428 - DNA, 49 bp, Artificial Sequence
  Description of Artificial Sequence: Synthetic oligonucleotide
ggcatcactgaagctacttgatttttatgaaaagtactttgatatctac

SEQ ID NO: 93429 - DNA, 52 bp, Artificial Sequence
  Description of Artificial Sequence: Synthetic oligonucleotide
gcatcactgaagctacttgatttttatgaaaagtactttgatatctactatc

SEQ ID NO: 93430 - DNA, 52 bp, Artificial Sequence
  Description of Artificial Sequence: Synthetic oligonucleotide
catcactgaagctacttgatttttatgaaaagtactttgatatctactatcc

SEQ ID NO: 93431 - DNA, 53 bp, Artificial Sequence
  Description of Artificial Sequence: Synthetic oligonucleotide
atcactgaagctacttgatttttatgaaaagtactttgatatctactatccac

SEQ ID NO: 93432 - DNA, 52 bp, Artificial Sequence
  Description of Artificial Sequence: Synthetic oligonucleotide
tcactgaagctacttgatttttatgaaaagtactttgatatctactatccac

SEQ ID NO: 93433 - DNA, 51 bp, Artificial Sequence
  Description of Artificial Sequence: Synthetic oligonucleotide
cactgaagctacttgatttttatgaaaagtactttgatatctactatccac

SEQ ID NO: 93434 - DNA, 52 bp, Artificial Sequence
  Description of Artificial Sequence: Synthetic oligonucleotide
actgaagctacttgatttttatgaaaagtactttgatatctactatccactc

SEQ ID NO: 93435 - DNA, 51 bp, Artificial Sequence
  Description of Artificial Sequence: Synthetic oligonucleotide
ctgaagctacttgatttttatgaaaagtactttgatatctactatccactc

SEQ ID NO: 93436 - DNA, 52 bp, Artificial Sequence
  Description of Artificial Sequence: Synthetic oligonucleotide
tgaagctacttgatttttatgaaaagtactttgatatctactatccactctc

SEQ ID NO: 93437 - DNA, 51 bp, Artificial Sequence
  Description of Artificial Sequence: Synthetic oligonucleotide
gaagctacttgatttttatgaaaagtactttgatatctactatccactctc

SEQ ID NO: 93438 - DNA, 51 bp, Artificial Sequence
  Description of Artificial Sequence: Synthetic oligonucleotide
aagctacttgatttttatgaaaagtactttgatatctactatccactctcc

SEQ ID NO: 93439 - DNA, 50 bp, Artificial Sequence
  Description of Artificial Sequence: Synthetic oligonucleotide
agctacttgatttttatgaaaagtactttgatatctactatccactctcc

SEQ ID NO: 93440 - DNA, 49 bp, Artificial Sequence
  Description of Artificial Sequence: Synthetic oligonucleotide
gctacttgatttttatgaaaagtactttgatatctactatccactctcc

SEQ ID NO: 93441 - DNA, 52 bp, Artificial Sequence
  Description of Artificial Sequence: Synthetic oligonucleotide
ctacttgatttttatgaaaagtactttgatatctactatccactctccaaac

SEQ ID NO: 93442 - DNA, 53 bp, Artificial Sequence
  Description of Artificial Sequence: Synthetic oligonucleotide
tacttgatttttatgaaaagtactttgatatctactatccactctccaaactg

SEQ ID NO: 93443 - DNA, 52 bp, Artificial Sequence
  Description of Artificial Sequence: Synthetic oligonucleotide
acttgatttttatgaaaagtactttgatatctactatccactctccaaactg

SEQ ID NO: 93444 - DNA, 51 bp, Artificial Sequence
  Description of Artificial Sequence: Synthetic oligonucleotide
cttgatttttatgaaaagtactttgatatctactatccactctccaaactg

SEQ ID NO: 93445 - DNA, 51 bp, Artificial Sequence
  Description of Artificial Sequence: Synthetic oligonucleotide
ttgatttttatgaaaagtactttgatatctactatccactctccaaactgg

SEQ ID NO: 93446 - DNA, 50 bp, Artificial Sequence
  Description of Artificial Sequence: Synthetic oligonucleotide
tgatttttatgaaaagtactttgatatctactatccactctccaaactgg

SEQ ID NO: 93447 - DNA, 49 bp, Artificial Sequence
  Description of Artificial Sequence: Synthetic oligonucleotide
gatttttatgaaaagtactttgatatctactatccactctccaaactgg

SEQ ID NO: 93448 - DNA, 57 bp, Artificial Sequence
  Description of Artificial Sequence: Synthetic oligonucleotide
atttttatgaaaagtactttgatatctactatccactctccaaactggatttaattg

SEQ ID NO: 93449 - DNA, 56 bp, Artificial Sequence
  Description of Artificial Sequence: Synthetic oligonucleotide
tttttatgaaaagtactttgatatctactatccactctccaaactggatttaattg

SEQ ID NO: 93450 - DNA, 55 bp, Artificial Sequence
  Description of Artificial Sequence: Synthetic oligonucleotide
ttttatgaaaagtactttgatatctactatccactctccaaactggatttaattg

SEQ ID NO: 93451 - DNA, 54 bp, Artificial Sequence
  Description of Artificial Sequence: Synthetic oligonucleotide
tttatgaaaagtactttgatatctactatccactctccaaactggatttaattg

SEQ ID NO: 93452 - DNA, 53 bp, Artificial Sequence
  Description of Artificial Sequence: Synthetic oligonucleotide
ttatgaaaagtactttgatatctactatccactctccaaactggatttaattg

SEQ ID NO: 93453 - DNA, 52 bp, Artificial Sequence
  Description of Artificial Sequence: Synthetic oligonucleotide
tatgaaaagtactttgatatctactatccactctccaaactggatttaattg

SEQ ID NO: 93454 - DNA, 51 bp, Artificial Sequence
  Description of Artificial Sequence: Synthetic oligonucleotide
atgaaaagtactttgatatctactatccactctccaaactggatttaattg

SEQ ID NO: 93455 - DNA, 50 bp, Artificial Sequence
  Description of Artificial Sequence: Synthetic oligonucleotide
tgaaaagtactttgatatctactatccactctccaaactggatttaattg

SEQ ID NO: 93456 - DNA, 49 bp, Artificial Sequence
  Description of Artificial Sequence: Synthetic oligonucleotide
gaaaagtactttgatatctactatccactctccaaactggatttaattg

SEQ ID NO: 93457 - DNA, 49 bp, Artificial Sequence
  Description of Artificial Sequence: Synthetic oligonucleotide
aaaagtactttgatatctactatccactctccaaactggatttaattgc

SEQ ID NO: 93458 - DNA, 48 bp, Artificial Sequence
  Description of Artificial Sequence: Synthetic oligonucleotide
aaagtactttgatatctactatccactctccaaactggatttaattgc

SEQ ID NO: 93459 - DNA, 47 bp, Artificial Sequence
  Description of Artificial Sequence: Synthetic oligonucleotide
aagtactttgatatctactatccactctccaaactggatttaattgc

SEQ ID NO: 93460 - DNA, 46 bp, Artificial Sequence
  Description of Artificial Sequence: Synthetic oligonucleotide
agtactttgatatctactatccactctccaaactggatttaattgc

SEQ ID NO: 93461 - DNA, 45 bp, Artificial Sequence
  Description of Artificial Sequence: Synthetic oligonucleotide
gtactttgatatctactatccactctccaaactggatttaattgc

SEQ ID NO: 93462 - DNA, 49 bp, Artificial Sequence
  Description of Artificial Sequence: Synthetic oligonucleotide
tactttgatatctactatccactctccaaactggatttaattgctattc

SEQ ID NO: 93463 - DNA, 48 bp, Artificial Sequence
  Description of Artificial Sequence: Synthetic oligonucleotide
actttgatatctactatccactctccaaactggatttaattgctattc

SEQ ID NO: 93464 - DNA, 47 bp, Artificial Sequence
  Description of Artificial Sequence: Synthetic oligonucleotide
ctttgatatctactatccactctccaaactggatttaattgctattc

SEQ ID NO: 93465 - DNA, 47 bp, Artificial Sequence
  Description of Artificial Sequence: Synthetic oligonucleotide
tttgatatctactatccactctccaaactggatttaattgctattcc

SEQ ID NO: 93466 - DNA, 46 bp, Artificial Sequence
  Description of Artificial Sequence: Synthetic oligonucleotide
ttgatatctactatccactctccaaactggatttaattgctattcc

SEQ ID NO: 93467 - DNA, 45 bp, Artificial Sequence
  Description of Artificial Sequence: Synthetic oligonucleotide
tgatatctactatccactctccaaactggatttaattgctattcc

SEQ ID NO: 93468 - DNA, 44 bp, Artificial Sequence
  Description of Artificial Sequence: Synthetic oligonucleotide
gatatctactatccactctccaaactggatttaattgctattcc

SEQ ID NO: 93469 - DNA, 45 bp, Artificial Sequence
  Description of Artificial Sequence: Synthetic oligonucleotide
atatctactatccactctccaaactggatttaattgctattcctg

SEQ ID NO: 93470 - DNA, 44 bp, Artificial Sequence
  Description of Artificial Sequence: Synthetic oligonucleotide
tatctactatccactctccaaactggatttaattgctattcctg

SEQ ID NO: 93471 - DNA, 43 bp, Artificial Sequence
  Description of Artificial Sequence: Synthetic oligonucleotide
atctactatccactctccaaactggatttaattgctattcctg

SEQ ID NO: 93472 - DNA, 42 bp, Artificial Sequence
  Description of Artificial Sequence: Synthetic oligonucleotide
tctactatccactctccaaactggatttaattgctattcctg

SEQ ID NO: 93473 - DNA, 41 bp, Artificial Sequence
  Description of Artificial Sequence: Synthetic oligonucleotide
ctactatccactctccaaactggatttaattgctattcctg

SEQ ID NO: 93474 - DNA, 42 bp, Artificial Sequence
  Description of Artificial Sequence: Synthetic oligonucleotide
tactatccactctccaaactggatttaattgctattcctgac

SEQ ID NO: 93475 - DNA, 41 bp, Artificial Sequence
  Description of Artificial Sequence: Synthetic oligonucleotide
actatccactctccaaactggatttaattgctattcctgac

SEQ ID NO: 93476 - DNA, 40 bp, Artificial Sequence
  Description of Artificial Sequence: Synthetic oligonucleotide
ctatccactctccaaactggatttaattgctattcctgac

SEQ ID NO: 93477 - DNA, 43 bp, Artificial Sequence
  Description of Artificial Sequence: Synthetic oligonucleotide
tatccactctccaaactggatttaattgctattcctgactttg

SEQ ID NO: 93478 - DNA, 42 bp, Artificial Sequence
  Description of Artificial Sequence: Synthetic oligonucleotide
atccactctccaaactggatttaattgctattcctgactttg

SEQ ID NO: 93479 - DNA, 41 bp, Artificial Sequence
  Description of Artificial Sequence: Synthetic oligonucleotide
tccactctccaaactggatttaattgctattcctgactttg

SEQ ID NO: 93480 - DNA, 40 bp, Artificial Sequence
  Description of Artificial Sequence: Synthetic oligonucleotide
ccactctccaaactggatttaattgctattcctgactttg

SEQ ID NO: 93481 - DNA, 40 bp, Artificial Sequence
  Description of Artificial Sequence: Synthetic oligonucleotide
cactctccaaactggatttaattgctattcctgactttgc

SEQ ID NO: 93482 - DNA, 41 bp, Artificial Sequence
  Description of Artificial Sequence: Synthetic oligonucleotide
actctccaaactggatttaattgctattcctgactttgcac

SEQ ID NO: 93483 - DNA, 40 bp, Artificial Sequence
  Description of Artificial Sequence: Synthetic oligonucleotide
ctctccaaactggatttaattgctattcctgactttgcac

SEQ ID NO: 93484 - DNA, 40 bp, Artificial Sequence
  Description of Artificial Sequence: Synthetic oligonucleotide
tctccaaactggatttaattgctattcctgactttgcacc

SEQ ID NO: 93485 - DNA, 39 bp, Artificial Sequence
  Description of Artificial Sequence: Synthetic oligonucleotide
ctccaaactggatttaattgctattcctgactttgcacc

SEQ ID NO: 93486 - DNA, 40 bp, Artificial Sequence
  Description of Artificial Sequence: Synthetic oligonucleotide
tccaaactggatttaattgctattcctgactttgcacctg

SEQ ID NO: 93487 - DNA, 39 bp, Artificial Sequence
  Description of Artificial Sequence: Synthetic oligonucleotide
ccaaactggatttaattgctattcctgactttgcacctg

SEQ ID NO: 93488 - DNA, 39 bp, Artificial Sequence
  Description of Artificial Sequence: Synthetic oligonucleotide
caaactggatttaattgctattcctgactttgcacctgg

SEQ ID NO: 93489 - DNA, 40 bp, Artificial Sequence
  Description of Artificial Sequence: Synthetic oligonucleotide
aaactggatttaattgctattcctgactttgcacctggag

SEQ ID NO: 93490 - DNA, 39 bp, Artificial Sequence
  Description of Artificial Sequence: Synthetic oligonucleotide
aactggatttaattgctattcctgactttgcacctggag

SEQ ID NO: 93491 - DNA, 38 bp, Artificial Sequence
  Description of Artificial Sequence: Synthetic oligonucleotide
actggatttaattgctattcctgactttgcacctggag

SEQ ID NO: 93492 - DNA, 37 bp, Artificial Sequence
  Description of Artificial Sequence: Synthetic oligonucleotide
ctggatttaattgctattcctgactttgcacctggag

SEQ ID NO: 93493 - DNA, 37 bp, Artificial Sequence
  Description of Artificial Sequence: Synthetic oligonucleotide
tggatttaattgctattcctgactttgcacctggagc

SEQ ID NO: 93494 - DNA, 36 bp, Artificial Sequence
  Description of Artificial Sequence: Synthetic oligonucleotide
ggatttaattgctattcctgactttgcacctggagc

SEQ ID NO: 93495 - DNA, 36 bp, Artificial Sequence
  Description of Artificial Sequence: Synthetic oligonucleotide
gatttaattgctattcctgactttgcacctggagcc

SEQ ID NO: 93496 - DNA, 38 bp, Artificial Sequence
  Description of Artificial Sequence: Synthetic oligonucleotide
atttaattgctattcctgactttgcacctggagccatg

SEQ ID NO: 93497 - DNA, 37 bp, Artificial Sequence
  Description of Artificial Sequence: Synthetic oligonucleotide
tttaattgctattcctgactttgcacctggagccatg

SEQ ID NO: 93498 - DNA, 36 bp, Artificial Sequence
  Description of Artificial Sequence: Synthetic oligonucleotide
ttaattgctattcctgactttgcacctggagccatg

SEQ ID NO: 93499 - DNA, 35 bp, Artificial Sequence
  Description of Artificial Sequence: Synthetic oligonucleotide
taattgctattcctgactttgcacctggagccatg

SEQ ID NO: 93500 - DNA, 34 bp, Artificial Sequence
  Description of Artificial Sequence: Synthetic oligonucleotide
aattgctattcctgactttgcacctggagccatg

SEQ ID NO: 93501 - DNA, 33 bp, Artificial Sequence
  Description of Artificial Sequence: Synthetic oligonucleotide
attgctattcctgactttgcacctggagccatg

SEQ ID NO: 93502 - DNA, 32 bp, Artificial Sequence
  Description of Artificial Sequence: Synthetic oligonucleotide
ttgctattcctgactttgcacctggagccatg

SEQ ID NO: 93503 - DNA, 31 bp, Artificial Sequence
  Description of Artificial Sequence: Synthetic oligonucleotide
tgctattcctgactttgcacctggagccatg

SEQ ID NO: 93504 - DNA, 30 bp, Artificial Sequence
  Description of Artificial Sequence: Synthetic oligonucleotide
gctattcctgactttgcacctggagccatg

SEQ ID NO: 93505 - DNA, 30 bp, Artificial Sequence
  Description of Artificial Sequence: Synthetic oligonucleotide
ctattcctgactttgcacctggagccatgg

SEQ ID NO: 93506 - DNA, 36 bp, Artificial Sequence
  Description of Artificial Sequence: Synthetic oligonucleotide
tattcctgactttgcacctggagccatggaaaattg

SEQ ID NO: 93507 - DNA, 35 bp, Artificial Sequence
  Description of Artificial Sequence: Synthetic oligonucleotide
attcctgactttgcacctggagccatggaaaattg

SEQ ID NO: 93508 - DNA, 34 bp, Artificial Sequence
  Description of Artificial Sequence: Synthetic oligonucleotide
ttcctgactttgcacctggagccatggaaaattg

SEQ ID NO: 93509 - DNA, 33 bp, Artificial Sequence
  Description of Artificial Sequence: Synthetic oligonucleotide
tcctgactttgcacctggagccatggaaaattg

SEQ ID NO: 93510 - DNA, 32 bp, Artificial Sequence
  Description of Artificial Sequence: Synthetic oligonucleotide
cctgactttgcacctggagccatggaaaattg

SEQ ID NO: 93511 - DNA, 32 bp, Artificial Sequence
  Description of Artificial Sequence: Synthetic oligonucleotide
ctgactttgcacctggagccatggaaaattgg

SEQ ID NO: 93512 - DNA, 32 bp, Artificial Sequence
  Description of Artificial Sequence: Synthetic oligonucleotide
tgactttgcacctggagccatggaaaattggg

SEQ ID NO: 93513 - DNA, 31 bp, Artificial Sequence
  Description of Artificial Sequence: Synthetic oligonucleotide
gactttgcacctggagccatggaaaattggg

SEQ ID NO: 93514 - DNA, 31 bp, Artificial Sequence
  Description of Artificial Sequence: Synthetic oligonucleotide
actttgcacctggagccatggaaaattgggg

SEQ ID NO: 93515 - DNA, 30 bp, Artificial Sequence
  Description of Artificial Sequence: Synthetic oligonucleotide
ctttgcacctggagccatggaaaattgggg

SEQ ID NO: 93516 - DNA, 30 bp, Artificial Sequence
  Description of Artificial Sequence: Synthetic oligonucleotide
tttgcacctggagccatggaaaattggggc

SEQ ID NO: 93517 - DNA, 29 bp, Artificial Sequence
  Description of Artificial Sequence: Synthetic oligonucleotide
ttgcacctggagccatggaaaattggggc

SEQ ID NO: 93518 - DNA, 28 bp, Artificial Sequence
  Description of Artificial Sequence: Synthetic oligonucleotide
tgcacctggagccatggaaaattggggc

SEQ ID NO: 93519 - DNA, 27 bp, Artificial Sequence
  Description of Artificial Sequence: Synthetic oligonucleotide
gcacctggagccatggaaaattggggc

SEQ ID NO: 93520 - DNA, 27 bp, Artificial Sequence
  Description of Artificial Sequence: Synthetic oligonucleotide
cacctggagccatggaaaattggggcc

SEQ ID NO: 93521 - DNA, 28 bp, Artificial Sequence
  Description of Artificial Sequence: Synthetic oligonucleotide
acctggagccatggaaaattggggcctc

SEQ ID NO: 93522 - DNA, 27 bp, Artificial Sequence
  Description of Artificial Sequence: Synthetic oligonucleotide
cctggagccatggaaaattggggcctc

SEQ ID NO: 93523 - DNA, 31 bp, Artificial Sequence
  Description of Artificial Sequence: Synthetic oligonucleotide
ctggagccatggaaaattggggcctcattac

SEQ ID NO: 93524 - DNA, 36 bp, Artificial Sequence
  Description of Artificial Sequence: Synthetic oligonucleotide
tggagccatggaaaattggggcctcattacatatag

SEQ ID NO: 93525 - DNA, 35 bp, Artificial Sequence
  Description of Artificial Sequence: Synthetic oligonucleotide
ggagccatggaaaattggggcctcattacatatag

SEQ ID NO: 93526 - DNA, 35 bp, Artificial Sequence
  Description of Artificial Sequence: Synthetic oligonucleotide
gagccatggaaaattggggcctcattacatatagg

SEQ ID NO: 93527 - DNA, 35 bp, Artificial Sequence
  Description of Artificial Sequence: Synthetic oligonucleotide
agccatggaaaattggggcctcattacatataggg

SEQ ID NO: 93528 - DNA, 34 bp, Artificial Sequence
  Description of Artificial Sequence: Synthetic oligonucleotide
gccatggaaaattggggcctcattacatataggg

SEQ ID NO: 93529 - DNA, 35 bp, Artificial Sequence
  Description of Artificial Sequence: Synthetic oligonucleotide
ccatggaaaattggggcctcattacatatagggag

SEQ ID NO: 93530 - DNA, 36 bp, Artificial Sequence
  Description of Artificial Sequence: Synthetic oligonucleotide
catggaaaattggggcctcattacatatagggagac

SEQ ID NO: 93531 - DNA, 36 bp, Artificial Sequence
  Description of Artificial Sequence: Synthetic oligonucleotide
atggaaaattggggcctcattacatatagggagacg

SEQ ID NO: 93532 - DNA, 35 bp, Artificial Sequence
  Description of Artificial Sequence: Synthetic oligonucleotide
tggaaaattggggcctcattacatatagggagacg

SEQ ID NO: 93533 - DNA, 34 bp, Artificial Sequence
  Description of Artificial Sequence: Synthetic oligonucleotide
ggaaaattggggcctcattacatatagggagacg

SEQ ID NO: 93534 - DNA, 35 bp, Artificial Sequence
  Description of Artificial Sequence: Synthetic oligonucleotide
gaaaattggggcctcattacatatagggagacgtc

SEQ ID NO: 93535 - DNA, 36 bp, Artificial Sequence
  Description of Artificial Sequence: Synthetic oligonucleotide
aaaattggggcctcattacatatagggagacgtcac

SEQ ID NO: 93536 - DNA, 35 bp, Artificial Sequence
  Description of Artificial Sequence: Synthetic oligonucleotide
aaattggggcctcattacatatagggagacgtcac

SEQ ID NO: 93537 - DNA, 34 bp, Artificial Sequence
  Description of Artificial Sequence: Synthetic oligonucleotide
aattggggcctcattacatatagggagacgtcac

SEQ ID NO: 93538 - DNA, 33 bp, Artificial Sequence
  Description of Artificial Sequence: Synthetic oligonucleotide
attggggcctcattacatatagggagacgtcac

SEQ ID NO: 93539 - DNA, 32 bp, Artificial Sequence
  Description of Artificial Sequence: Synthetic oligonucleotide
ttggggcctcattacatatagggagacgtcac

SEQ ID NO: 93540 - DNA, 31 bp, Artificial Sequence
  Description of Artificial Sequence: Synthetic oligonucleotide
tggggcctcattacatatagggagacgtcac

SEQ ID NO: 93541 - DNA, 30 bp, Artificial Sequence
  Description of Artificial Sequence: Synthetic oligonucleotide
ggggcctcattacatatagggagacgtcac

SEQ ID NO: 93542 - DNA, 31 bp, Artificial Sequence
  Description of Artificial Sequence: Synthetic oligonucleotide
gggcctcattacatatagggagacgtcactg

SEQ ID NO: 93543 - DNA, 31 bp, Artificial Sequence
  Description of Artificial Sequence: Synthetic oligonucleotide
ggcctcattacatatagggagacgtcactgc

SEQ ID NO: 93544 - DNA, 36 bp, Artificial Sequence
  Description of Artificial Sequence: Synthetic oligonucleotide
gcctcattacatatagggagacgtcactgctttttg

SEQ ID NO: 93545 - DNA, 37 bp, Artificial Sequence
  Description of Artificial Sequence: Synthetic oligonucleotide
cctcattacatatagggagacgtcactgctttttgac

SEQ ID NO: 93546 - DNA, 37 bp, Artificial Sequence
  Description of Artificial Sequence: Synthetic oligonucleotide
ctcattacatatagggagacgtcactgctttttgacc

SEQ ID NO: 93547 - DNA, 37 bp, Artificial Sequence
  Description of Artificial Sequence: Synthetic oligonucleotide
tcattacatatagggagacgtcactgctttttgaccc

SEQ ID NO: 93548 - DNA, 36 bp, Artificial Sequence
  Description of Artificial Sequence: Synthetic oligonucleotide
cattacatatagggagacgtcactgctttttgaccc

SEQ ID NO: 93549 - DNA, 36 bp, Artificial Sequence
  Description of Artificial Sequence: Synthetic oligonucleotide
attacatatagggagacgtcactgctttttgacccc

SEQ ID NO: 93550 - DNA, 35 bp, Artificial Sequence
  Description of Artificial Sequence: Synthetic oligonucleotide
ttacatatagggagacgtcactgctttttgacccc

SEQ ID NO: 93551 - DNA, 34 bp, Artificial Sequence
  Description of Artificial Sequence: Synthetic oligonucleotide
tacatatagggagacgtcactgctttttgacccc

SEQ ID NO: 93552 - DNA, 33 bp, Artificial Sequence
  Description of Artificial Sequence: Synthetic oligonucleotide
acatatagggagacgtcactgctttttgacccc

SEQ ID NO: 93553 - DNA, 32 bp, Artificial Sequence
  Description of Artificial Sequence: Synthetic oligonucleotide
catatagggagacgtcactgctttttgacccc

SEQ ID NO: 93554 - DNA, 34 bp, Artificial Sequence
  Description of Artificial Sequence: Synthetic oligonucleotide
atatagggagacgtcactgctttttgaccccaag

SEQ ID NO: 93555 - DNA, 33 bp, Artificial Sequence
  Description of Artificial Sequence: Synthetic oligonucleotide
tatagggagacgtcactgctttttgaccccaag

SEQ ID NO: 93556 - DNA, 32 bp, Artificial Sequence
  Description of Artificial Sequence: Synthetic oligonucleotide
atagggagacgtcactgctttttgaccccaag

SEQ ID NO: 93557 - DNA, 31 bp, Artificial Sequence
  Description of Artificial Sequence: Synthetic oligonucleotide
tagggagacgtcactgctttttgaccccaag

SEQ ID NO: 93558 - DNA, 30 bp, Artificial Sequence
  Description of Artificial Sequence: Synthetic oligonucleotide
agggagacgtcactgctttttgaccccaag

SEQ ID NO: 93559 - DNA, 29 bp, Artificial Sequence
  Description of Artificial Sequence: Synthetic oligonucleotide
gggagacgtcactgctttttgaccccaag

SEQ ID NO: 93560 - DNA, 30 bp, Artificial Sequence
  Description of Artificial Sequence: Synthetic oligonucleotide
ggagacgtcactgctttttgaccccaagac

SEQ ID NO: 93561 - DNA, 30 bp, Artificial Sequence
  Description of Artificial Sequence: Synthetic oligonucleotide
gagacgtcactgctttttgaccccaagacc

SEQ ID NO: 93562 - DNA, 31 bp, Artificial Sequence
  Description of Artificial Sequence: Synthetic oligonucleotide
agacgtcactgctttttgaccccaagacctc

SEQ ID NO: 93563 - DNA, 30 bp, Artificial Sequence
  Description of Artificial Sequence: Synthetic oligonucleotide
gacgtcactgctttttgaccccaagacctc

SEQ ID NO: 93564 - DNA, 32 bp, Artificial Sequence
  Description of Artificial Sequence: Synthetic oligonucleotide
acgtcactgctttttgaccccaagacctcttc

SEQ ID NO: 93565 - DNA, 31 bp, Artificial Sequence
  Description of Artificial Sequence: Synthetic oligonucleotide
cgtcactgctttttgaccccaagacctcttc

SEQ ID NO: 93566 - DNA, 32 bp, Artificial Sequence
  Description of Artificial Sequence: Synthetic oligonucleotide
gtcactgctttttgaccccaagacctcttctg

SEQ ID NO: 93567 - DNA, 32 bp, Artificial Sequence
  Description of Artificial Sequence: Synthetic oligonucleotide
tcactgctttttgaccccaagacctcttctgc

SEQ ID NO: 93568 - DNA, 31 bp, Artificial Sequence
  Description of Artificial Sequence: Synthetic oligonucleotide
cactgctttttgaccccaagacctcttctgc

SEQ ID NO: 93569 - DNA, 33 bp, Artificial Sequence
  Description of Artificial Sequence: Synthetic oligonucleotide
actgctttttgaccccaagacctcttctgcttc

SEQ ID NO: 93570 - DNA, 32 bp, Artificial Sequence
  Description of Artificial Sequence: Synthetic oligonucleotide
ctgctttttgaccccaagacctcttctgcttc

SEQ ID NO: 93571 - DNA, 32 bp, Artificial Sequence
  Description of Artificial Sequence: Synthetic oligonucleotide
tgctttttgaccccaagacctcttctgcttcc

SEQ ID NO: 93572 - DNA, 31 bp, Artificial Sequence
  Description of Artificial Sequence: Synthetic oligonucleotide
gctttttgaccccaagacctcttctgcttcc

SEQ ID NO: 93573 - DNA, 31 bp, Artificial Sequence
  Description of Artificial Sequence: Synthetic oligonucleotide
ctttttgaccccaagacctcttctgcttccg

SEQ ID NO: 93574 - DNA, 36 bp, Artificial Sequence
  Description of Artificial Sequence: Synthetic oligonucleotide
tttttgaccccaagacctcttctgcttccgataaac

SEQ ID NO: 93575 - DNA, 35 bp, Artificial Sequence
  Description of Artificial Sequence: Synthetic oligonucleotide
ttttgaccccaagacctcttctgcttccgataaac

SEQ ID NO: 93576 - DNA, 34 bp, Artificial Sequence
  Description of Artificial Sequence: Synthetic oligonucleotide
tttgaccccaagacctcttctgcttccgataaac

SEQ ID NO: 93577 - DNA, 33 bp, Artificial Sequence
  Description of Artificial Sequence: Synthetic oligonucleotide
ttgaccccaagacctcttctgcttccgataaac

SEQ ID NO: 93578 - DNA, 32 bp, Artificial Sequence
  Description of Artificial Sequence: Synthetic oligonucleotide
tgaccccaagacctcttctgcttccgataaac

SEQ ID NO: 93579 - DNA, 31 bp, Artificial Sequence
  Description of Artificial Sequence: Synthetic oligonucleotide
gaccccaagacctcttctgcttccgataaac

SEQ ID NO: 93580 - DNA, 32 bp, Artificial Sequence
  Description of Artificial Sequence: Synthetic oligonucleotide
accccaagacctcttctgcttccgataaactg

SEQ ID NO: 93581 - DNA, 31 bp, Artificial Sequence
  Description of Artificial Sequence: Synthetic oligonucleotide
ccccaagacctcttctgcttccgataaactg

SEQ ID NO: 93582 - DNA, 32 bp, Artificial Sequence
  Description of Artificial Sequence: Synthetic oligonucleotide
cccaagacctcttctgcttccgataaactgtg

SEQ ID NO: 93583 - DNA, 32 bp, Artificial Sequence
  Description of Artificial Sequence: Synthetic oligonucleotide
ccaagacctcttctgcttccgataaactgtgg

SEQ ID NO: 93584 - DNA, 32 bp, Artificial Sequence
  Description of Artificial Sequence: Synthetic oligonucleotide
caagacctcttctgcttccgataaactgtggg

SEQ ID NO: 93585 - DNA, 33 bp, Artificial Sequence
  Description of Artificial Sequence: Synthetic oligonucleotide
aagacctcttctgcttccgataaactgtgggtc

SEQ ID NO: 93586 - DNA, 32 bp, Artificial Sequence
  Description of Artificial Sequence: Synthetic oligonucleotide
agacctcttctgcttccgataaactgtgggtc

SEQ ID NO: 93587 - DNA, 31 bp, Artificial Sequence
  Description of Artificial Sequence: Synthetic oligonucleotide
gacctcttctgcttccgataaactgtgggtc

SEQ ID NO: 93588 - DNA, 32 bp, Artificial Sequence
  Description of Artificial Sequence: Synthetic oligonucleotide
acctcttctgcttccgataaactgtgggtcac

SEQ ID NO: 93589 - DNA, 31 bp, Artificial Sequence
  Description of Artificial Sequence: Synthetic oligonucleotide
cctcttctgcttccgataaactgtgggtcac

SEQ ID NO: 93590 - DNA, 31 bp, Artificial Sequence
  Description of Artificial Sequence: Synthetic oligonucleotide
ctcttctgcttccgataaactgtgggtcacc

SEQ ID NO: 93591 - DNA, 32 bp, Artificial Sequence
  Description of Artificial Sequence: Synthetic oligonucleotide
tcttctgcttccgataaactgtgggtcaccag

SEQ ID NO: 93592 - DNA, 31 bp, Artificial Sequence
  Description of Artificial Sequence: Synthetic oligonucleotide
cttctgcttccgataaactgtgggtcaccag

SEQ ID NO: 93593 - DNA, 32 bp, Artificial Sequence
  Description of Artificial Sequence: Synthetic oligonucleotide
ttctgcttccgataaactgtgggtcaccagag

SEQ ID NO: 93594 - DNA, 31 bp, Artificial Sequence
  Description of Artificial Sequence: Synthetic oligonucleotide
tctgcttccgataaactgtgggtcaccagag

SEQ ID NO: 93595 - DNA, 30 bp, Artificial Sequence
  Description of Artificial Sequence: Synthetic oligonucleotide
ctgcttccgataaactgtgggtcaccagag

SEQ ID NO: 93596 - DNA, 31 bp, Artificial Sequence
  Description of Artificial Sequence: Synthetic oligonucleotide
tgcttccgataaactgtgggtcaccagagtc

SEQ ID NO: 93597 - DNA, 30 bp, Artificial Sequence
  Description of Artificial Sequence: Synthetic oligonucleotide
gcttccgataaactgtgggtcaccagagtc

SEQ ID NO: 93598 - DNA, 33 bp, Artificial Sequence
  Description of Artificial Sequence: Synthetic oligonucleotide
cttccgataaactgtgggtcaccagagtcatag

SEQ ID NO: 93599 - DNA, 33 bp, Artificial Sequence
  Description of Artificial Sequence: Synthetic oligonucleotide
ttccgataaactgtgggtcaccagagtcatagc

SEQ ID NO: 93600 - DNA, 32 bp, Artificial Sequence
  Description of Artificial Sequence: Synthetic oligonucleotide
tccgataaactgtgggtcaccagagtcatagc

SEQ ID NO: 93601 - DNA, 31 bp, Artificial Sequence
  Description of Artificial Sequence: Synthetic oligonucleotide
ccgataaactgtgggtcaccagagtcatagc

SEQ ID NO: 93602 - DNA, 31 bp, Artificial Sequence
  Description of Artificial Sequence: Synthetic oligonucleotide
cgataaactgtgggtcaccagagtcatagcc

SEQ ID NO: 93603 - DNA, 31 bp, Artificial Sequence
  Description of Artificial Sequence: Synthetic oligonucleotide
gataaactgtgggtcaccagagtcatagccc

SEQ ID NO: 93604 - DNA, 33 bp, Artificial Sequence
  Description of Artificial Sequence: Synthetic oligonucleotide
ataaactgtgggtcaccagagtcatagcccatg

SEQ ID NO: 93605 - DNA, 32 bp, Artificial Sequence
  Description of Artificial Sequence: Synthetic oligonucleotide
taaactgtgggtcaccagagtcatagcccatg

SEQ ID NO: 93606 - DNA, 31 bp, Artificial Sequence
  Description of Artificial Sequence: Synthetic oligonucleotide
aaactgtgggtcaccagagtcatagcccatg

SEQ ID NO: 93607 - DNA, 30 bp, Artificial Sequence
  Description of Artificial Sequence: Synthetic oligonucleotide
aactgtgggtcaccagagtcatagcccatg

SEQ ID NO: 93608 - DNA, 29 bp, Artificial Sequence
  Description of Artificial Sequence: Synthetic oligonucleotide
actgtgggtcaccagagtcatagcccatg

SEQ ID NO: 93609 - DNA, 28 bp, Artificial Sequence
  Description of Artificial Sequence: Synthetic oligonucleotide
ctgtgggtcaccagagtcatagcccatg

SEQ ID NO: 93610 - DNA, 30 bp, Artificial Sequence
  Description of Artificial Sequence: Synthetic oligonucleotide
tgtgggtcaccagagtcatagcccatgaac

SEQ ID NO: 93611 - DNA, 29 bp, Artificial Sequence
  Description of Artificial Sequence: Synthetic oligonucleotide
gtgggtcaccagagtcatagcccatgaac

SEQ ID NO: 93612 - DNA, 30 bp, Artificial Sequence
  Description of Artificial Sequence: Synthetic oligonucleotide
tgggtcaccagagtcatagcccatgaactg

SEQ ID NO: 93613 - DNA, 29 bp, Artificial Sequence
  Description of Artificial Sequence: Synthetic oligonucleotide
gggtcaccagagtcatagcccatgaactg

SEQ ID NO: 93614 - DNA, 29 bp, Artificial Sequence
  Description of Artificial Sequence: Synthetic oligonucleotide
ggtcaccagagtcatagcccatgaactgg

SEQ ID NO: 93615 - DNA, 29 bp, Artificial Sequence
  Description of Artificial Sequence: Synthetic oligonucleotide
gtcaccagagtcatagcccatgaactggc

SEQ ID NO: 93616 - DNA, 29 bp, Artificial Sequence
  Description of Artificial Sequence: Synthetic oligonucleotide
tcaccagagtcatagcccatgaactggcg

SEQ ID NO: 93617 - DNA, 28 bp, Artificial Sequence
  Description of Artificial Sequence: Synthetic oligonucleotide
caccagagtcatagcccatgaactggcg

SEQ ID NO: 93618 - DNA, 28 bp, Artificial Sequence
  Description of Artificial Sequence: Synthetic oligonucleotide
accagagtcatagcccatgaactggcgc

SEQ ID NO: 93619 - DNA, 27 bp, Artificial Sequence
  Description of Artificial Sequence: Synthetic oligonucleotide
ccagagtcatagcccatgaactggcgc

SEQ ID NO: 93620 - DNA, 28 bp, Artificial Sequence
  Description of Artificial Sequence: Synthetic oligonucleotide
cagagtcatagcccatgaactggcgcac

SEQ ID NO: 93621 - DNA, 28 bp, Artificial Sequence
  Description of Artificial Sequence: Synthetic oligonucleotide
agagtcatagcccatgaactggcgcacc

SEQ ID NO: 93622 - DNA, 27 bp, Artificial Sequence
  Description of Artificial Sequence: Synthetic oligonucleotide
gagtcatagcccatgaactggcgcacc

SEQ ID NO: 93623 - DNA, 28 bp, Artificial Sequence
  Description of Artificial Sequence: Synthetic oligonucleotide
agtcatagcccatgaactggcgcaccag

SEQ ID NO: 93624 - DNA, 27 bp, Artificial Sequence
  Description of Artificial Sequence: Synthetic oligonucleotide
gtcatagcccatgaactggcgcaccag

SEQ ID NO: 93625 - DNA, 28 bp, Artificial Sequence
  Description of Artificial Sequence: Synthetic oligonucleotide
tcatagcccatgaactggcgcaccagtg

SEQ ID NO: 93626 - DNA, 27 bp, Artificial Sequence
  Description of Artificial Sequence: Synthetic oligonucleotide
catagcccatgaactggcgcaccagtg

SEQ ID NO: 93627 - DNA, 27 bp, Artificial Sequence
  Description of Artificial Sequence: Synthetic oligonucleotide
atagcccatgaactggcgcaccagtgg

SEQ ID NO: 93628 - DNA, 27 bp, Artificial Sequence
  Description of Artificial Sequence: Synthetic oligonucleotide
tagcccatgaactggcgcaccagtggt

SEQ ID NO: 93629 - DNA, 27 bp, Artificial Sequence
  Description of Artificial Sequence: Synthetic oligonucleotide
agcccatgaactggcgcaccagtggtt

SEQ ID NO: 93630 - DNA, 27 bp, Artificial Sequence
  Description of Artificial Sequence: Synthetic oligonucleotide
gcccatgaactggcgcaccagtggttt

SEQ ID NO: 93631 - DNA, 27 bp, Artificial Sequence
  Description of Artificial Sequence: Synthetic oligonucleotide
cccatgaactggcgcaccagtggtttg

SEQ ID NO: 93632 - DNA, 27 bp, Artificial Sequence
  Description of Artificial Sequence: Synthetic oligonucleotide
ccatgaactggcgcaccagtggtttgg

SEQ ID NO: 93633 - DNA, 27 bp, Artificial Sequence
  Description of Artificial Sequence: Synthetic oligonucleotide
catgaactggcgcaccagtggtttggc

SEQ ID NO: 93634 - DNA, 29 bp, Artificial Sequence
  Description of Artificial Sequence: Synthetic oligonucleotide
atgaactggcgcaccagtggtttggcaac

SEQ ID NO: 93635 - DNA, 28 bp, Artificial Sequence
  Description of Artificial Sequence: Synthetic oligonucleotide
tgaactggcgcaccagtggtttggcaac

SEQ ID NO: 93636 - DNA, 27 bp, Artificial Sequence
  Description of Artificial Sequence: Synthetic oligonucleotide
gaactggcgcaccagtggtttggcaac

SEQ ID NO: 93637 - DNA, 27 bp, Artificial Sequence
  Description of Artificial Sequence: Synthetic oligonucleotide
aactggcgcaccagtggtttggcaacc

SEQ ID NO: 93638 - DNA, 27 bp, Artificial Sequence
  Description of Artificial Sequence: Synthetic oligonucleotide
actggcgcaccagtggtttggcaacct

SEQ ID NO: 93639 - DNA, 26 bp, Artificial Sequence
  Description of Artificial Sequence: Synthetic oligonucleotide
ctggcgcaccagtggtttggcaacct

SEQ ID NO: 93640 - DNA, 26 bp, Artificial Sequence
  Description of Artificial Sequence: Synthetic oligonucleotide
tggcgcaccagtggtttggcaacctg

SEQ ID NO: 93641 - DNA, 25 bp, Artificial Sequence
  Description of Artificial Sequence: Synthetic oligonucleotide
ggcgcaccagtggtttggcaacctg

SEQ ID NO: 93642 - DNA, 26 bp, Artificial Sequence
  Description of Artificial Sequence: Synthetic oligonucleotide
gcgcaccagtggtttggcaacctggt

SEQ ID NO: 93643 - DNA, 27 bp, Artificial Sequence
  Description of Artificial Sequence: Synthetic oligonucleotide
cgcaccagtggtttggcaacctggtca

SEQ ID NO: 93644 - DNA, 27 bp, Artificial Sequence
  Description of Artificial Sequence: Synthetic oligonucleotide
gcaccagtggtttggcaacctggtcac

SEQ ID NO: 93645 - DNA, 30 bp, Artificial Sequence
  Description of Artificial Sequence: Synthetic oligonucleotide
caccagtggtttggcaacctggtcacaatg

SEQ ID NO: 93646 - DNA, 30 bp, Artificial Sequence
  Description of Artificial Sequence: Synthetic oligonucleotide
accagtggtttggcaacctggtcacaatgg

SEQ ID NO: 93647 - DNA, 29 bp, Artificial Sequence
  Description of Artificial Sequence: Synthetic oligonucleotide
ccagtggtttggcaacctggtcacaatgg

SEQ ID NO: 93648 - DNA, 32 bp, Artificial Sequence
  Description of Artificial Sequence: Synthetic oligonucleotide
cagtggtttggcaacctggtcacaatggaatg

SEQ ID NO: 93649 - DNA, 32 bp, Artificial Sequence
  Description of Artificial Sequence: Synthetic oligonucleotide
agtggtttggcaacctggtcacaatggaatgg

SEQ ID NO: 93650 - DNA, 31 bp, Artificial Sequence
  Description of Artificial Sequence: Synthetic oligonucleotide
gtggtttggcaacctggtcacaatggaatgg

SEQ ID NO: 93651 - DNA, 32 bp, Artificial Sequence
  Description of Artificial Sequence: Synthetic oligonucleotide
tggtttggcaacctggtcacaatggaatggtg

SEQ ID NO: 93652 - DNA, 31 bp, Artificial Sequence
  Description of Artificial Sequence: Synthetic oligonucleotide
ggtttggcaacctggtcacaatggaatggtg

SEQ ID NO: 93653 - DNA, 31 bp, Artificial Sequence
  Description of Artificial Sequence: Synthetic oligonucleotide
gtttggcaacctggtcacaatggaatggtgg

SEQ ID NO: 93654 - DNA, 34 bp, Artificial Sequence
  Description of Artificial Sequence: Synthetic oligonucleotide
tttggcaacctggtcacaatggaatggtggaatg

SEQ ID NO: 93655 - DNA, 33 bp, Artificial Sequence
  Description of Artificial Sequence: Synthetic oligonucleotide
ttggcaacctggtcacaatggaatggtggaatg

SEQ ID NO: 93656 - DNA, 32 bp, Artificial Sequence
  Description of Artificial Sequence: Synthetic oligonucleotide
tggcaacctggtcacaatggaatggtggaatg

SEQ ID NO: 93657 - DNA, 31 bp, Artificial Sequence
  Description of Artificial Sequence: Synthetic oligonucleotide
ggcaacctggtcacaatggaatggtggaatg

SEQ ID NO: 93658 - DNA, 37 bp, Artificial Sequence
  Description of Artificial Sequence: Synthetic oligonucleotide
gcaacctggtcacaatggaatggtggaatgatatttg

SEQ ID NO: 93659 - DNA, 37 bp, Artificial Sequence
  Description of Artificial Sequence: Synthetic oligonucleotide
caacctggtcacaatggaatggtggaatgatatttgg

SEQ ID NO: 93660 - DNA, 37 bp, Artificial Sequence
  Description of Artificial Sequence: Synthetic oligonucleotide
aacctggtcacaatggaatggtggaatgatatttggc

SEQ ID NO: 93661 - DNA, 36 bp, Artificial Sequence
  Description of Artificial Sequence: Synthetic oligonucleotide
acctggtcacaatggaatggtggaatgatatttggc

SEQ ID NO: 93662 - DNA, 35 bp, Artificial Sequence
  Description of Artificial Sequence: Synthetic oligonucleotide
cctggtcacaatggaatggtggaatgatatttggc

SEQ ID NO: 93663 - DNA, 39 bp, Artificial Sequence
  Description of Artificial Sequence: Synthetic oligonucleotide
ctggtcacaatggaatggtggaatgatatttggcttaag

SEQ ID NO: 93664 - DNA, 39 bp, Artificial Sequence
  Description of Artificial Sequence: Synthetic oligonucleotide
tggtcacaatggaatggtggaatgatatttggcttaagg

SEQ ID NO: 93665 - DNA, 38 bp, Artificial Sequence
  Description of Artificial Sequence: Synthetic oligonucleotide
ggtcacaatggaatggtggaatgatatttggcttaagg

SEQ ID NO: 93666 - DNA, 39 bp, Artificial Sequence
  Description of Artificial Sequence: Synthetic oligonucleotide
gtcacaatggaatggtggaatgatatttggcttaaggag

SEQ ID NO: 93667 - DNA, 39 bp, Artificial Sequence
  Description of Artificial Sequence: Synthetic oligonucleotide
tcacaatggaatggtggaatgatatttggcttaaggagg

SEQ ID NO: 93668 - DNA, 38 bp, Artificial Sequence
  Description of Artificial Sequence: Synthetic oligonucleotide
cacaatggaatggtggaatgatatttggcttaaggagg

SEQ ID NO: 93669 - DNA, 38 bp, Artificial Sequence
  Description of Artificial Sequence: Synthetic oligonucleotide
acaatggaatggtggaatgatatttggcttaaggaggg

SEQ ID NO: 93670 - DNA, 37 bp, Artificial Sequence
  Description of Artificial Sequence: Synthetic oligonucleotide
caatggaatggtggaatgatatttggcttaaggaggg

SEQ ID NO: 93671 - DNA, 41 bp, Artificial Sequence
  Description of Artificial Sequence: Synthetic oligonucleotide
aatggaatggtggaatgatatttggcttaaggagggttttg

SEQ ID NO: 93672 - DNA, 40 bp, Artificial Sequence
  Description of Artificial Sequence: Synthetic oligonucleotide
atggaatggtggaatgatatttggcttaaggagggttttg

SEQ ID NO: 93673 - DNA, 39 bp, Artificial Sequence
  Description of Artificial Sequence: Synthetic oligonucleotide
tggaatggtggaatgatatttggcttaaggagggttttg

SEQ ID NO: 93674 - DNA, 38 bp, Artificial Sequence
  Description of Artificial Sequence: Synthetic oligonucleotide
ggaatggtggaatgatatttggcttaaggagggttttg

SEQ ID NO: 93675 - DNA, 38 bp, Artificial Sequence
  Description of Artificial Sequence: Synthetic oligonucleotide
gaatggtggaatgatatttggcttaaggagggttttgc

SEQ ID NO: 93676 - DNA, 44 bp, Artificial Sequence
  Description of Artificial Sequence: Synthetic oligonucleotide
aatggtggaatgatatttggcttaaggagggttttgcaaaatac

SEQ ID NO: 93677 - DNA, 43 bp, Artificial Sequence
  Description of Artificial Sequence: Synthetic oligonucleotide
atggtggaatgatatttggcttaaggagggttttgcaaaatac

SEQ ID NO: 93678 - DNA, 42 bp, Artificial Sequence
  Description of Artificial Sequence: Synthetic oligonucleotide
tggtggaatgatatttggcttaaggagggttttgcaaaatac

SEQ ID NO: 93679 - DNA, 41 bp, Artificial Sequence
  Description of Artificial Sequence: Synthetic oligonucleotide
ggtggaatgatatttggcttaaggagggttttgcaaaatac

SEQ ID NO: 93680 - DNA, 43 bp, Artificial Sequence
  Description of Artificial Sequence: Synthetic oligonucleotide
gtggaatgatatttggcttaaggagggttttgcaaaatacatg

SEQ ID NO: 93681 - DNA, 43 bp, Artificial Sequence
  Description of Artificial Sequence: Synthetic oligonucleotide
tggaatgatatttggcttaaggagggttttgcaaaatacatgg

SEQ ID NO: 93682 - DNA, 42 bp, Artificial Sequence
  Description of Artificial Sequence: Synthetic oligonucleotide
ggaatgatatttggcttaaggagggttttgcaaaatacatgg

SEQ ID NO: 93683 - DNA, 44 bp, Artificial Sequence
  Description of Artificial Sequence: Synthetic oligonucleotide
gaatgatatttggcttaaggagggttttgcaaaatacatggaac

SEQ ID NO: 93684 - DNA, 48 bp, Artificial Sequence
  Description of Artificial Sequence: Synthetic oligonucleotide
aatgatatttggcttaaggagggttttgcaaaatacatggaacttatc

SEQ ID NO: 93685 - DNA, 47 bp, Artificial Sequence
  Description of Artificial Sequence: Synthetic oligonucleotide
atgatatttggcttaaggagggttttgcaaaatacatggaacttatc

SEQ ID NO: 93686 - DNA, 46 bp, Artificial Sequence
  Description of Artificial Sequence: Synthetic oligonucleotide
tgatatttggcttaaggagggttttgcaaaatacatggaacttatc

SEQ ID NO: 93687 - DNA, 45 bp, Artificial Sequence
  Description of Artificial Sequence: Synthetic oligonucleotide
gatatttggcttaaggagggttttgcaaaatacatggaacttatc

SEQ ID NO: 93688 - DNA, 45 bp, Artificial Sequence
  Description of Artificial Sequence: Synthetic oligonucleotide
atatttggcttaaggagggttttgcaaaatacatggaacttatcg

SEQ ID NO: 93689 - DNA, 44 bp, Artificial Sequence
  Description of Artificial Sequence: Synthetic oligonucleotide
tatttggcttaaggagggttttgcaaaatacatggaacttatcg

SEQ ID NO: 93690 - DNA, 43 bp, Artificial Sequence
  Description of Artificial Sequence: Synthetic oligonucleotide
atttggcttaaggagggttttgcaaaatacatggaacttatcg

SEQ ID NO: 93691 - DNA, 42 bp, Artificial Sequence
  Description of Artificial Sequence: Synthetic oligonucleotide
tttggcttaaggagggttttgcaaaatacatggaacttatcg

SEQ ID NO: 93692 - DNA, 41 bp, Artificial Sequence
  Description of Artificial Sequence: Synthetic oligonucleotide
ttggcttaaggagggttttgcaaaatacatggaacttatcg

SEQ ID NO: 93693 - DNA, 40 bp, Artificial Sequence
  Description of Artificial Sequence: Synthetic oligonucleotide
tggcttaaggagggttttgcaaaatacatggaacttatcg

SEQ ID NO: 93694 - DNA, 39 bp, Artificial Sequence
  Description of Artificial Sequence: Synthetic oligonucleotide
ggcttaaggagggttttgcaaaatacatggaacttatcg

SEQ ID NO: 93695 - DNA, 39 bp, Artificial Sequence
  Description of Artificial Sequence: Synthetic oligonucleotide
gcttaaggagggttttgcaaaatacatggaacttatcgc

SEQ ID NO: 93696 - DNA, 40 bp, Artificial Sequence
  Description of Artificial Sequence: Synthetic oligonucleotide
cttaaggagggttttgcaaaatacatggaacttatcgctg

SEQ ID NO: 93697 - DNA, 45 bp, Artificial Sequence
  Description of Artificial Sequence: Synthetic oligonucleotide
ttaaggagggttttgcaaaatacatggaacttatcgctgttaatg

SEQ ID NO: 93698 - DNA, 44 bp, Artificial Sequence
  Description of Artificial Sequence: Synthetic oligonucleotide
taaggagggttttgcaaaatacatggaacttatcgctgttaatg

SEQ ID NO: 93699 - DNA, 43 bp, Artificial Sequence
  Description of Artificial Sequence: Synthetic oligonucleotide
aaggagggttttgcaaaatacatggaacttatcgctgttaatg

SEQ ID NO: 93700 - DNA, 42 bp, Artificial Sequence
  Description of Artificial Sequence: Synthetic oligonucleotide
aggagggttttgcaaaatacatggaacttatcgctgttaatg

SEQ ID NO: 93701 - DNA, 41 bp, Artificial Sequence
  Description of Artificial Sequence: Synthetic oligonucleotide
ggagggttttgcaaaatacatggaacttatcgctgttaatg

SEQ ID NO: 93702 - DNA, 41 bp, Artificial Sequence
  Description of Artificial Sequence: Synthetic oligonucleotide
gagggttttgcaaaatacatggaacttatcgctgttaatgc

SEQ ID NO: 93703 - DNA, 43 bp, Artificial Sequence
  Description of Artificial Sequence: Synthetic oligonucleotide
agggttttgcaaaatacatggaacttatcgctgttaatgctac

SEQ ID NO: 93704 - DNA, 42 bp, Artificial Sequence
  Description of Artificial Sequence: Synthetic oligonucleotide
gggttttgcaaaatacatggaacttatcgctgttaatgctac

SEQ ID NO: 93705 - DNA, 46 bp, Artificial Sequence
  Description of Artificial Sequence: Synthetic oligonucleotide
ggttttgcaaaatacatggaacttatcgctgttaatgctacatatc

SEQ ID NO: 93706 - DNA, 46 bp, Artificial Sequence
  Description of Artificial Sequence: Synthetic oligonucleotide
gttttgcaaaatacatggaacttatcgctgttaatgctacatatcc

SEQ ID NO: 93707 - DNA, 47 bp, Artificial Sequence
  Description of Artificial Sequence: Synthetic oligonucleotide
ttttgcaaaatacatggaacttatcgctgttaatgctacatatccag

SEQ ID NO: 93708 - DNA, 46 bp, Artificial Sequence
  Description of Artificial Sequence: Synthetic oligonucleotide
tttgcaaaatacatggaacttatcgctgttaatgctacatatccag

SEQ ID NO: 93709 - DNA, 45 bp, Artificial Sequence
  Description of Artificial Sequence: Synthetic oligonucleotide
ttgcaaaatacatggaacttatcgctgttaatgctacatatccag

SEQ ID NO: 93710 - DNA, 44 bp, Artificial Sequence
  Description of Artificial Sequence: Synthetic oligonucleotide
tgcaaaatacatggaacttatcgctgttaatgctacatatccag

SEQ ID NO: 93711 - DNA, 43 bp, Artificial Sequence
  Description of Artificial Sequence: Synthetic oligonucleotide
gcaaaatacatggaacttatcgctgttaatgctacatatccag

SEQ ID NO: 93712 - DNA, 44 bp, Artificial Sequence
  Description of Artificial Sequence: Synthetic oligonucleotide
caaaatacatggaacttatcgctgttaatgctacatatccagag

SEQ ID NO: 93713 - DNA, 44 bp, Artificial Sequence
  Description of Artificial Sequence: Synthetic oligonucleotide
aaaatacatggaacttatcgctgttaatgctacatatccagagc

SEQ ID NO: 93714 - DNA, 43 bp, Artificial Sequence
  Description of Artificial Sequence: Synthetic oligonucleotide
aaatacatggaacttatcgctgttaatgctacatatccagagc

SEQ ID NO: 93715 - DNA, 42 bp, Artificial Sequence
  Description of Artificial Sequence: Synthetic oligonucleotide
aatacatggaacttatcgctgttaatgctacatatccagagc

SEQ ID NO: 93716 - DNA, 41 bp, Artificial Sequence
  Description of Artificial Sequence: Synthetic oligonucleotide
atacatggaacttatcgctgttaatgctacatatccagagc

SEQ ID NO: 93717 - DNA, 40 bp, Artificial Sequence
  Description of Artificial Sequence: Synthetic oligonucleotide
tacatggaacttatcgctgttaatgctacatatccagagc

SEQ ID NO: 93718 - DNA, 39 bp, Artificial Sequence
  Description of Artificial Sequence: Synthetic oligonucleotide
acatggaacttatcgctgttaatgctacatatccagagc

SEQ ID NO: 93719 - DNA, 38 bp, Artificial Sequence
  Description of Artificial Sequence: Synthetic oligonucleotide
catggaacttatcgctgttaatgctacatatccagagc

SEQ ID NO: 93720 - DNA, 39 bp, Artificial Sequence
  Description of Artificial Sequence: Synthetic oligonucleotide
atggaacttatcgctgttaatgctacatatccagagctg

SEQ ID NO: 93721 - DNA, 38 bp, Artificial Sequence
  Description of Artificial Sequence: Synthetic oligonucleotide
tggaacttatcgctgttaatgctacatatccagagctg

SEQ ID NO: 93722 - DNA, 37 bp, Artificial Sequence
  Description of Artificial Sequence: Synthetic oligonucleotide
ggaacttatcgctgttaatgctacatatccagagctg

SEQ ID NO: 93723 - DNA, 37 bp, Artificial Sequence
  Description of Artificial Sequence: Synthetic oligonucleotide
gaacttatcgctgttaatgctacatatccagagctgc

SEQ ID NO: 93724 - DNA, 42 bp, Artificial Sequence
  Description of Artificial Sequence: Synthetic oligonucleotide
aacttatcgctgttaatgctacatatccagagctgcaatttg

SEQ ID NO: 93725 - DNA, 41 bp, Artificial Sequence
  Description of Artificial Sequence: Synthetic oligonucleotide
acttatcgctgttaatgctacatatccagagctgcaatttg

SEQ ID NO: 93726 - DNA, 40 bp, Artificial Sequence
  Description of Artificial Sequence: Synthetic oligonucleotide
cttatcgctgttaatgctacatatccagagctgcaatttg

SEQ ID NO: 93727 - DNA, 42 bp, Artificial Sequence
  Description of Artificial Sequence: Synthetic oligonucleotide
ttatcgctgttaatgctacatatccagagctgcaatttgatg

SEQ ID NO: 93728 - DNA, 41 bp, Artificial Sequence
  Description of Artificial Sequence: Synthetic oligonucleotide
tatcgctgttaatgctacatatccagagctgcaatttgatg

SEQ ID NO: 93729 - DNA, 40 bp, Artificial Sequence
  Description of Artificial Sequence: Synthetic oligonucleotide
atcgctgttaatgctacatatccagagctgcaatttgatg

SEQ ID NO: 93730 - DNA, 39 bp, Artificial Sequence
  Description of Artificial Sequence: Synthetic oligonucleotide
tcgctgttaatgctacatatccagagctgcaatttgatg

SEQ ID NO: 93731 - DNA, 38 bp, Artificial Sequence
  Description of Artificial Sequence: Synthetic oligonucleotide
cgctgttaatgctacatatccagagctgcaatttgatg

SEQ ID NO: 93732 - DNA, 39 bp, Artificial Sequence
  Description of Artificial Sequence: Synthetic oligonucleotide
gctgttaatgctacatatccagagctgcaatttgatgac

SEQ ID NO: 93733 - DNA, 47 bp, Artificial Sequence
  Description of Artificial Sequence: Synthetic oligonucleotide
ctgttaatgctacatatccagagctgcaatttgatgactattttttg

SEQ ID NO: 93734 - DNA, 50 bp, Artificial Sequence
  Description of Artificial Sequence: Synthetic oligonucleotide
tgttaatgctacatatccagagctgcaatttgatgactattttttgaatg

SEQ ID NO: 93735 - DNA, 49 bp, Artificial Sequence
  Description of Artificial Sequence: Synthetic oligonucleotide
gttaatgctacatatccagagctgcaatttgatgactattttttgaatg

SEQ ID NO: 93736 - DNA, 50 bp, Artificial Sequence
  Description of Artificial Sequence: Synthetic oligonucleotide
ttaatgctacatatccagagctgcaatttgatgactattttttgaatgtg

SEQ ID NO: 93737 - DNA, 49 bp, Artificial Sequence
  Description of Artificial Sequence: Synthetic oligonucleotide
taatgctacatatccagagctgcaatttgatgactattttttgaatgtg

SEQ ID NO: 93738 - DNA, 48 bp, Artificial Sequence
  Description of Artificial Sequence: Synthetic oligonucleotide
aatgctacatatccagagctgcaatttgatgactattttttgaatgtg

SEQ ID NO: 93739 - DNA, 47 bp, Artificial Sequence
  Description of Artificial Sequence: Synthetic oligonucleotide
atgctacatatccagagctgcaatttgatgactattttttgaatgtg

SEQ ID NO: 93740 - DNA, 46 bp, Artificial Sequence
  Description of Artificial Sequence: Synthetic oligonucleotide
tgctacatatccagagctgcaatttgatgactattttttgaatgtg

SEQ ID NO: 93741 - DNA, 45 bp, Artificial Sequence
  Description of Artificial Sequence: Synthetic oligonucleotide
gctacatatccagagctgcaatttgatgactattttttgaatgtg

SEQ ID NO: 93742 - DNA, 46 bp, Artificial Sequence
  Description of Artificial Sequence: Synthetic oligonucleotide
ctacatatccagagctgcaatttgatgactattttttgaatgtgtg

SEQ ID NO: 93743 - DNA, 50 bp, Artificial Sequence
  Description of Artificial Sequence: Synthetic oligonucleotide
tacatatccagagctgcaatttgatgactattttttgaatgtgtgttttg

SEQ ID NO: 93744 - DNA, 49 bp, Artificial Sequence
  Description of Artificial Sequence: Synthetic oligonucleotide
acatatccagagctgcaatttgatgactattttttgaatgtgtgttttg

SEQ ID NO: 93745 - DNA, 48 bp, Artificial Sequence
  Description of Artificial Sequence: Synthetic oligonucleotide
catatccagagctgcaatttgatgactattttttgaatgtgtgttttg

SEQ ID NO: 93746 - DNA, 50 bp, Artificial Sequence
  Description of Artificial Sequence: Synthetic oligonucleotide
atatccagagctgcaatttgatgactattttttgaatgtgtgttttgaag

SEQ ID NO: 93747 - DNA, 49 bp, Artificial Sequence
  Description of Artificial Sequence: Synthetic oligonucleotide
tatccagagctgcaatttgatgactattttttgaatgtgtgttttgaag

SEQ ID NO: 93748 - DNA, 48 bp, Artificial Sequence
  Description of Artificial Sequence: Synthetic oligonucleotide
atccagagctgcaatttgatgactattttttgaatgtgtgttttgaag

SEQ ID NO: 93749 - DNA, 47 bp, Artificial Sequence
  Description of Artificial Sequence: Synthetic oligonucleotide
tccagagctgcaatttgatgactattttttgaatgtgtgttttgaag

SEQ ID NO: 93750 - DNA, 46 bp, Artificial Sequence
  Description of Artificial Sequence: Synthetic oligonucleotide
ccagagctgcaatttgatgactattttttgaatgtgtgttttgaag

SEQ ID NO: 93751 - DNA, 52 bp, Artificial Sequence
  Description of Artificial Sequence: Synthetic oligonucleotide
cagagctgcaatttgatgactattttttgaatgtgtgttttgaagtaattac

SEQ ID NO: 93752 - DNA, 56 bp, Artificial Sequence
  Description of Artificial Sequence: Synthetic oligonucleotide
agagctgcaatttgatgactattttttgaatgtgtgttttgaagtaattacaaaag

SEQ ID NO: 93753 - DNA, 55 bp, Artificial Sequence
  Description of Artificial Sequence: Synthetic oligonucleotide
gagctgcaatttgatgactattttttgaatgtgtgttttgaagtaattacaaaag

SEQ ID NO: 93754 - DNA, 58 bp, Artificial Sequence
  Description of Artificial Sequence: Synthetic oligonucleotide
agctgcaatttgatgactattttttgaatgtgtgttttgaagtaattacaaaagattc

SEQ ID NO: 93755 - DNA, 57 bp, Artificial Sequence
  Description of Artificial Sequence: Synthetic oligonucleotide
gctgcaatttgatgactattttttgaatgtgtgttttgaagtaattacaaaagattc

SEQ ID NO: 93756 - DNA, 60 bp, Artificial Sequence
  Description of Artificial Sequence: Synthetic oligonucleotide
ctgcaatttgatgactattttttgaatgtgtgttttgaagtaattacaaaagattcattg

SEQ ID NO: 93757 - DNA, 60 bp, Artificial Sequence
  Description of Artificial Sequence: Synthetic oligonucleotide
tgcaatttgatgactattttttgaatgtgtgttttgaagtaattacaaaagattcattga

SEQ ID NO: 93758 - DNA, 60 bp, Artificial Sequence
  Description of Artificial Sequence: Synthetic oligonucleotide
gcaatttgatgactattttttgaatgtgtgttttgaagtaattacaaaagattcattgaa

SEQ ID NO: 93759 - DNA, 60 bp, Artificial Sequence
  Description of Artificial Sequence: Synthetic oligonucleotide
caatttgatgactattttttgaatgtgtgttttgaagtaattacaaaagattcattgaat

SEQ ID NO: 93760 - DNA, 60 bp, Artificial Sequence
  Description of Artificial Sequence: Synthetic oligonucleotide
aatttgatgactattttttgaatgtgtgttttgaagtaattacaaaagattcattgaatt

SEQ ID NO: 93761 - DNA, 60 bp, Artificial Sequence
  Description of Artificial Sequence: Synthetic oligonucleotide
atttgatgactattttttgaatgtgtgttttgaagtaattacaaaagattcattgaattc

SEQ ID NO: 93762 - DNA, 60 bp, Artificial Sequence
  Description of Artificial Sequence: Synthetic oligonucleotide
tttgatgactattttttgaatgtgtgttttgaagtaattacaaaagattcattgaattca

SEQ ID NO: 93763 - DNA, 60 bp, Artificial Sequence
  Description of Artificial Sequence: Synthetic oligonucleotide
ttgatgactattttttgaatgtgtgttttgaagtaattacaaaagattcattgaattcat

SEQ ID NO: 93764 - DNA, 60 bp, Artificial Sequence
  Description of Artificial Sequence: Synthetic oligonucleotide
tgatgactattttttgaatgtgtgttttgaagtaattacaaaagattcattgaattcatc

SEQ ID NO: 93765 - DNA, 60 bp, Artificial Sequence
  Description of Artificial Sequence: Synthetic oligonucleotide
gatgactattttttgaatgtgtgttttgaagtaattacaaaagattcattgaattcatcc

SEQ ID NO: 93766 - DNA, 60 bp, Artificial Sequence
  Description of Artificial Sequence: Synthetic oligonucleotide
atgactattttttgaatgtgtgttttgaagtaattacaaaagattcattgaattcatccc

SEQ ID NO: 93767 - DNA, 59 bp, Artificial Sequence
  Description of Artificial Sequence: Synthetic oligonucleotide
tgactattttttgaatgtgtgttttgaagtaattacaaaagattcattgaattcatccc

SEQ ID NO: 93768 - DNA, 58 bp, Artificial Sequence
  Description of Artificial Sequence: Synthetic oligonucleotide
gactattttttgaatgtgtgttttgaagtaattacaaaagattcattgaattcatccc

SEQ ID NO: 93769 - DNA, 58 bp, Artificial Sequence
  Description of Artificial Sequence: Synthetic oligonucleotide
actattttttgaatgtgtgttttgaagtaattacaaaagattcattgaattcatcccg

SEQ ID NO: 93770 - DNA, 57 bp, Artificial Sequence
  Description of Artificial Sequence: Synthetic oligonucleotide
ctattttttgaatgtgtgttttgaagtaattacaaaagattcattgaattcatcccg

SEQ ID NO: 93771 - DNA, 57 bp, Artificial Sequence
  Description of Artificial Sequence: Synthetic oligonucleotide
tattttttgaatgtgtgttttgaagtaattacaaaagattcattgaattcatcccgc

SEQ ID NO: 93772 - DNA, 56 bp, Artificial Sequence
  Description of Artificial Sequence: Synthetic oligonucleotide
attttttgaatgtgtgttttgaagtaattacaaaagattcattgaattcatcccgc

SEQ ID NO: 93773 - DNA, 55 bp, Artificial Sequence
  Description of Artificial Sequence: Synthetic oligonucleotide
ttttttgaatgtgtgttttgaagtaattacaaaagattcattgaattcatcccgc

SEQ ID NO: 93774 - DNA, 54 bp, Artificial Sequence
  Description of Artificial Sequence: Synthetic oligonucleotide
tttttgaatgtgtgttttgaagtaattacaaaagattcattgaattcatcccgc

SEQ ID NO: 93775 - DNA, 53 bp, Artificial Sequence
  Description of Artificial Sequence: Synthetic oligonucleotide
ttttgaatgtgtgttttgaagtaattacaaaagattcattgaattcatcccgc

SEQ ID NO: 93776 - DNA, 52 bp, Artificial Sequence
  Description of Artificial Sequence: Synthetic oligonucleotide
tttgaatgtgtgttttgaagtaattacaaaagattcattgaattcatcccgc

SEQ ID NO: 93777 - DNA, 51 bp, Artificial Sequence
  Description of Artificial Sequence: Synthetic oligonucleotide
ttgaatgtgtgttttgaagtaattacaaaagattcattgaattcatcccgc

SEQ ID NO: 93778 - DNA, 50 bp, Artificial Sequence
  Description of Artificial Sequence: Synthetic oligonucleotide
tgaatgtgtgttttgaagtaattacaaaagattcattgaattcatcccgc

SEQ ID NO: 93779 - DNA, 49 bp, Artificial Sequence
  Description of Artificial Sequence: Synthetic oligonucleotide
gaatgtgtgttttgaagtaattacaaaagattcattgaattcatcccgc

SEQ ID NO: 93780 - DNA, 49 bp, Artificial Sequence
  Description of Artificial Sequence: Synthetic oligonucleotide
aatgtgtgttttgaagtaattacaaaagattcattgaattcatcccgcc

SEQ ID NO: 93781 - DNA, 48 bp, Artificial Sequence
  Description of Artificial Sequence: Synthetic oligonucleotide
atgtgtgttttgaagtaattacaaaagattcattgaattcatcccgcc

SEQ ID NO: 93782 - DNA, 47 bp, Artificial Sequence
  Description of Artificial Sequence: Synthetic oligonucleotide
tgtgtgttttgaagtaattacaaaagattcattgaattcatcccgcc

SEQ ID NO: 93783 - DNA, 46 bp, Artificial Sequence
  Description of Artificial Sequence: Synthetic oligonucleotide
gtgtgttttgaagtaattacaaaagattcattgaattcatcccgcc

SEQ ID NO: 93784 - DNA, 46 bp, Artificial Sequence
  Description of Artificial Sequence: Synthetic oligonucleotide
tgtgttttgaagtaattacaaaagattcattgaattcatcccgccc

SEQ ID NO: 93785 - DNA, 45 bp, Artificial Sequence
  Description of Artificial Sequence: Synthetic oligonucleotide
gtgttttgaagtaattacaaaagattcattgaattcatcccgccc

SEQ ID NO: 93786 - DNA, 48 bp, Artificial Sequence
  Description of Artificial Sequence: Synthetic oligonucleotide
tgttttgaagtaattacaaaagattcattgaattcatcccgccctatc

SEQ ID NO: 93787 - DNA, 47 bp, Artificial Sequence
  Description of Artificial Sequence: Synthetic oligonucleotide
gttttgaagtaattacaaaagattcattgaattcatcccgccctatc

SEQ ID NO: 93788 - DNA, 48 bp, Artificial Sequence
  Description of Artificial Sequence: Synthetic oligonucleotide
ttttgaagtaattacaaaagattcattgaattcatcccgccctatctc

SEQ ID NO: 93789 - DNA, 47 bp, Artificial Sequence
  Description of Artificial Sequence: Synthetic oligonucleotide
tttgaagtaattacaaaagattcattgaattcatcccgccctatctc

SEQ ID NO: 93790 - DNA, 46 bp, Artificial Sequence
  Description of Artificial Sequence: Synthetic oligonucleotide
ttgaagtaattacaaaagattcattgaattcatcccgccctatctc

SEQ ID NO: 93791 - DNA, 45 bp, Artificial Sequence
  Description of Artificial Sequence: Synthetic oligonucleotide
tgaagtaattacaaaagattcattgaattcatcccgccctatctc

SEQ ID NO: 93792 - DNA, 44 bp, Artificial Sequence
  Description of Artificial Sequence: Synthetic oligonucleotide
gaagtaattacaaaagattcattgaattcatcccgccctatctc

SEQ ID NO: 93793 - DNA, 44 bp, Artificial Sequence
  Description of Artificial Sequence: Synthetic oligonucleotide
aagtaattacaaaagattcattgaattcatcccgccctatctcc

SEQ ID NO: 93794 - DNA, 43 bp, Artificial Sequence
  Description of Artificial Sequence: Synthetic oligonucleotide
agtaattacaaaagattcattgaattcatcccgccctatctcc

SEQ ID NO: 93795 - DNA, 42 bp, Artificial Sequence
  Description of Artificial Sequence: Synthetic oligonucleotide
gtaattacaaaagattcattgaattcatcccgccctatctcc

SEQ ID NO: 93796 - DNA, 45 bp, Artificial Sequence
  Description of Artificial Sequence: Synthetic oligonucleotide
taattacaaaagattcattgaattcatcccgccctatctccaaac

SEQ ID NO: 93797 - DNA, 44 bp, Artificial Sequence
  Description of Artificial Sequence: Synthetic oligonucleotide
aattacaaaagattcattgaattcatcccgccctatctccaaac

SEQ ID NO: 93798 - DNA, 43 bp, Artificial Sequence
  Description of Artificial Sequence: Synthetic oligonucleotide
attacaaaagattcattgaattcatcccgccctatctccaaac

SEQ ID NO: 93799 - DNA, 42 bp, Artificial Sequence
  Description of Artificial Sequence: Synthetic oligonucleotide
ttacaaaagattcattgaattcatcccgccctatctccaaac

SEQ ID NO: 93800 - DNA, 41 bp, Artificial Sequence
  Description of Artificial Sequence: Synthetic oligonucleotide
tacaaaagattcattgaattcatcccgccctatctccaaac

SEQ ID NO: 93801 - DNA, 40 bp, Artificial Sequence
  Description of Artificial Sequence: Synthetic oligonucleotide
acaaaagattcattgaattcatcccgccctatctccaaac

SEQ ID NO: 93802 - DNA, 39 bp, Artificial Sequence
  Description of Artificial Sequence: Synthetic oligonucleotide
caaaagattcattgaattcatcccgccctatctccaaac

SEQ ID NO: 93803 - DNA, 39 bp, Artificial Sequence
  Description of Artificial Sequence: Synthetic oligonucleotide
aaaagattcattgaattcatcccgccctatctccaaacc

SEQ ID NO: 93804 - DNA, 38 bp, Artificial Sequence
  Description of Artificial Sequence: Synthetic oligonucleotide
aaagattcattgaattcatcccgccctatctccaaacc

SEQ ID NO: 93805 - DNA, 37 bp, Artificial Sequence
  Description of Artificial Sequence: Synthetic oligonucleotide
aagattcattgaattcatcccgccctatctccaaacc

SEQ ID NO: 93806 - DNA, 36 bp, Artificial Sequence
  Description of Artificial Sequence: Synthetic oligonucleotide
agattcattgaattcatcccgccctatctccaaacc

SEQ ID NO: 93807 - DNA, 35 bp, Artificial Sequence
  Description of Artificial Sequence: Synthetic oligonucleotide
gattcattgaattcatcccgccctatctccaaacc

SEQ ID NO: 93808 - DNA, 36 bp, Artificial Sequence
  Description of Artificial Sequence: Synthetic oligonucleotide
attcattgaattcatcccgccctatctccaaaccag

SEQ ID NO: 93809 - DNA, 35 bp, Artificial Sequence
  Description of Artificial Sequence: Synthetic oligonucleotide
ttcattgaattcatcccgccctatctccaaaccag

SEQ ID NO: 93810 - DNA, 34 bp, Artificial Sequence
  Description of Artificial Sequence: Synthetic oligonucleotide
tcattgaattcatcccgccctatctccaaaccag

SEQ ID NO: 93811 - DNA, 33 bp, Artificial Sequence
  Description of Artificial Sequence: Synthetic oligonucleotide
cattgaattcatcccgccctatctccaaaccag

SEQ ID NO: 93812 - DNA, 33 bp, Artificial Sequence
  Description of Artificial Sequence: Synthetic oligonucleotide
attgaattcatcccgccctatctccaaaccagc

SEQ ID NO: 93813 - DNA, 32 bp, Artificial Sequence
  Description of Artificial Sequence: Synthetic oligonucleotide
ttgaattcatcccgccctatctccaaaccagc

SEQ ID NO: 93814 - DNA, 31 bp, Artificial Sequence
  Description of Artificial Sequence: Synthetic oligonucleotide
tgaattcatcccgccctatctccaaaccagc

SEQ ID NO: 93815 - DNA, 30 bp, Artificial Sequence
  Description of Artificial Sequence: Synthetic oligonucleotide
gaattcatcccgccctatctccaaaccagc

SEQ ID NO: 93816 - DNA, 30 bp, Artificial Sequence
  Description of Artificial Sequence: Synthetic oligonucleotide
aattcatcccgccctatctccaaaccagcg

SEQ ID NO: 93817 - DNA, 29 bp, Artificial Sequence
  Description of Artificial Sequence: Synthetic oligonucleotide
attcatcccgccctatctccaaaccagcg

SEQ ID NO: 93818 - DNA, 28 bp, Artificial Sequence
  Description of Artificial Sequence: Synthetic oligonucleotide
ttcatcccgccctatctccaaaccagcg

SEQ ID NO: 93819 - DNA, 27 bp, Artificial Sequence
  Description of Artificial Sequence: Synthetic oligonucleotide
tcatcccgccctatctccaaaccagcg

SEQ ID NO: 93820 - DNA, 26 bp, Artificial Sequence
  Description of Artificial Sequence: Synthetic oligonucleotide
catcccgccctatctccaaaccagcg

SEQ ID NO: 93821 - DNA, 27 bp, Artificial Sequence
  Description of Artificial Sequence: Synthetic oligonucleotide
atcccgccctatctccaaaccagcgga

SEQ ID NO: 93822 - DNA, 27 bp, Artificial Sequence
  Description of Artificial Sequence: Synthetic oligonucleotide
tcccgccctatctccaaaccagcggaa

SEQ ID NO: 93823 - DNA, 27 bp, Artificial Sequence
  Description of Artificial Sequence: Synthetic oligonucleotide
cccgccctatctccaaaccagcggaaa

SEQ ID NO: 93824 - DNA, 27 bp, Artificial Sequence
  Description of Artificial Sequence: Synthetic oligonucleotide
ccgccctatctccaaaccagcggaaac

SEQ ID NO: 93825 - DNA, 27 bp, Artificial Sequence
  Description of Artificial Sequence: Synthetic oligonucleotide
cgccctatctccaaaccagcggaaacc

SEQ ID NO: 93826 - DNA, 27 bp, Artificial Sequence
  Description of Artificial Sequence: Synthetic oligonucleotide
gccctatctccaaaccagcggaaaccc

SEQ ID NO: 93827 - DNA, 27 bp, Artificial Sequence
  Description of Artificial Sequence: Synthetic oligonucleotide
ccctatctccaaaccagcggaaacccc

SEQ ID NO: 93828 - DNA, 27 bp, Artificial Sequence
  Description of Artificial Sequence: Synthetic oligonucleotide
cctatctccaaaccagcggaaaccccg

SEQ ID NO: 93829 - DNA, 28 bp, Artificial Sequence
  Description of Artificial Sequence: Synthetic oligonucleotide
ctatctccaaaccagcggaaaccccgac

SEQ ID NO: 93830 - DNA, 29 bp, Artificial Sequence
  Description of Artificial Sequence: Synthetic oligonucleotide
tatctccaaaccagcggaaaccccgactc

SEQ ID NO: 93831 - DNA, 28 bp, Artificial Sequence
  Description of Artificial Sequence: Synthetic oligonucleotide
atctccaaaccagcggaaaccccgactc

SEQ ID NO: 93832 - DNA, 27 bp, Artificial Sequence
  Description of Artificial Sequence: Synthetic oligonucleotide
tctccaaaccagcggaaaccccgactc

SEQ ID NO: 93833 - DNA, 27 bp, Artificial Sequence
  Description of Artificial Sequence: Synthetic oligonucleotide
ctccaaaccagcggaaaccccgactca

SEQ ID NO: 93834 - DNA, 31 bp, Artificial Sequence
  Description of Artificial Sequence: Synthetic oligonucleotide
tccaaaccagcggaaaccccgactcaaatac

SEQ ID NO: 93835 - DNA, 30 bp, Artificial Sequence
  Description of Artificial Sequence: Synthetic oligonucleotide
ccaaaccagcggaaaccccgactcaaatac

SEQ ID NO: 93836 - DNA, 31 bp, Artificial Sequence
  Description of Artificial Sequence: Synthetic oligonucleotide
caaaccagcggaaaccccgactcaaatacag

SEQ ID NO: 93837 - DNA, 31 bp, Artificial Sequence
  Description of Artificial Sequence: Synthetic oligonucleotide
aaaccagcggaaaccccgactcaaatacagg

SEQ ID NO: 93838 - DNA, 30 bp, Artificial Sequence
  Description of Artificial Sequence: Synthetic oligonucleotide
aaccagcggaaaccccgactcaaatacagg

SEQ ID NO: 93839 - DNA, 29 bp, Artificial Sequence
  Description of Artificial Sequence: Synthetic oligonucleotide
accagcggaaaccccgactcaaatacagg

SEQ ID NO: 93840 - DNA, 28 bp, Artificial Sequence
  Description of Artificial Sequence: Synthetic oligonucleotide
ccagcggaaaccccgactcaaatacagg

SEQ ID NO: 93841 - DNA, 32 bp, Artificial Sequence
  Description of Artificial Sequence: Synthetic oligonucleotide
cagcggaaaccccgactcaaatacaggaaatg

SEQ ID NO: 93842 - DNA, 35 bp, Artificial Sequence
  Description of Artificial Sequence: Synthetic oligonucleotide
agcggaaaccccgactcaaatacaggaaatgtttg

SEQ ID NO: 93843 - DNA, 34 bp, Artificial Sequence
  Description of Artificial Sequence: Synthetic oligonucleotide
gcggaaaccccgactcaaatacaggaaatgtttg

SEQ ID NO: 93844 - DNA, 36 bp, Artificial Sequence
  Description of Artificial Sequence: Synthetic oligonucleotide
cggaaaccccgactcaaatacaggaaatgtttgatg

SEQ ID NO: 93845 - DNA, 38 bp, Artificial Sequence
  Description of Artificial Sequence: Synthetic oligonucleotide
ggaaaccccgactcaaatacaggaaatgtttgatgaag

SEQ ID NO: 93846 - DNA, 41 bp, Artificial Sequence
  Description of Artificial Sequence: Synthetic oligonucleotide
gaaaccccgactcaaatacaggaaatgtttgatgaagtttc

SEQ ID NO: 93847 - DNA, 41 bp, Artificial Sequence
  Description of Artificial Sequence: Synthetic oligonucleotide
aaaccccgactcaaatacaggaaatgtttgatgaagtttcc

SEQ ID NO: 93848 - DNA, 40 bp, Artificial Sequence
  Description of Artificial Sequence: Synthetic oligonucleotide
aaccccgactcaaatacaggaaatgtttgatgaagtttcc

SEQ ID NO: 93849 - DNA, 39 bp, Artificial Sequence
  Description of Artificial Sequence: Synthetic oligonucleotide
accccgactcaaatacaggaaatgtttgatgaagtttcc

SEQ ID NO: 93850 - DNA, 38 bp, Artificial Sequence
  Description of Artificial Sequence: Synthetic oligonucleotide
ccccgactcaaatacaggaaatgtttgatgaagtttcc

SEQ ID NO: 93851 - DNA, 43 bp, Artificial Sequence
  Description of Artificial Sequence: Synthetic oligonucleotide
cccgactcaaatacaggaaatgtttgatgaagtttcctataac

SEQ ID NO: 93852 - DNA, 45 bp, Artificial Sequence
  Description of Artificial Sequence: Synthetic oligonucleotide
ccgactcaaatacaggaaatgtttgatgaagtttcctataacaag

SEQ ID NO: 93853 - DNA, 45 bp, Artificial Sequence
  Description of Artificial Sequence: Synthetic oligonucleotide
cgactcaaatacaggaaatgtttgatgaagtttcctataacaagg

SEQ ID NO: 93854 - DNA, 45 bp, Artificial Sequence
  Description of Artificial Sequence: Synthetic oligonucleotide
gactcaaatacaggaaatgtttgatgaagtttcctataacaaggg

SEQ ID NO: 93855 - DNA, 46 bp, Artificial Sequence
  Description of Artificial Sequence: Synthetic oligonucleotide
actcaaatacaggaaatgtttgatgaagtttcctataacaagggag

SEQ ID NO: 93856 - DNA, 45 bp, Artificial Sequence
  Description of Artificial Sequence: Synthetic oligonucleotide
ctcaaatacaggaaatgtttgatgaagtttcctataacaagggag

SEQ ID NO: 93857 - DNA, 45 bp, Artificial Sequence
  Description of Artificial Sequence: Synthetic oligonucleotide
tcaaatacaggaaatgtttgatgaagtttcctataacaagggagc

SEQ ID NO: 93858 - DNA, 44 bp, Artificial Sequence
  Description of Artificial Sequence: Synthetic oligonucleotide
caaatacaggaaatgtttgatgaagtttcctataacaagggagc

SEQ ID NO: 93859 - DNA, 46 bp, Artificial Sequence
  Description of Artificial Sequence: Synthetic oligonucleotide
aaatacaggaaatgtttgatgaagtttcctataacaagggagcttg

SEQ ID NO: 93860 - DNA, 45 bp, Artificial Sequence
  Description of Artificial Sequence: Synthetic oligonucleotide
aatacaggaaatgtttgatgaagtttcctataacaagggagcttg

SEQ ID NO: 93861 - DNA, 44 bp, Artificial Sequence
  Description of Artificial Sequence: Synthetic oligonucleotide
atacaggaaatgtttgatgaagtttcctataacaagggagcttg

SEQ ID NO: 93862 - DNA, 43 bp, Artificial Sequence
  Description of Artificial Sequence: Synthetic oligonucleotide
tacaggaaatgtttgatgaagtttcctataacaagggagcttg

SEQ ID NO: 93863 - DNA, 42 bp, Artificial Sequence
  Description of Artificial Sequence: Synthetic oligonucleotide
acaggaaatgtttgatgaagtttcctataacaagggagcttg

SEQ ID NO: 93864 - DNA, 41 bp, Artificial Sequence
  Description of Artificial Sequence: Synthetic oligonucleotide
caggaaatgtttgatgaagtttcctataacaagggagcttg

SEQ ID NO: 93865 - DNA, 47 bp, Artificial Sequence
  Description of Artificial Sequence: Synthetic oligonucleotide
aggaaatgtttgatgaagtttcctataacaagggagcttgtattttg

SEQ ID NO: 93866 - DNA, 46 bp, Artificial Sequence
  Description of Artificial Sequence: Synthetic oligonucleotide
ggaaatgtttgatgaagtttcctataacaagggagcttgtattttg

SEQ ID NO: 93867 - DNA, 51 bp, Artificial Sequence
  Description of Artificial Sequence: Synthetic oligonucleotide
gaaatgtttgatgaagtttcctataacaagggagcttgtattttgaatatg

SEQ ID NO: 93868 - DNA, 51 bp, Artificial Sequence
  Description of Artificial Sequence: Synthetic oligonucleotide
aaatgtttgatgaagtttcctataacaagggagcttgtattttgaatatgc

SEQ ID NO: 93869 - DNA, 50 bp, Artificial Sequence
  Description of Artificial Sequence: Synthetic oligonucleotide
aatgtttgatgaagtttcctataacaagggagcttgtattttgaatatgc

SEQ ID NO: 93870 - DNA, 49 bp, Artificial Sequence
  Description of Artificial Sequence: Synthetic oligonucleotide
atgtttgatgaagtttcctataacaagggagcttgtattttgaatatgc

SEQ ID NO: 93871 - DNA, 48 bp, Artificial Sequence
  Description of Artificial Sequence: Synthetic oligonucleotide
tgtttgatgaagtttcctataacaagggagcttgtattttgaatatgc

SEQ ID NO: 93872 - DNA, 47 bp, Artificial Sequence
  Description of Artificial Sequence: Synthetic oligonucleotide
gtttgatgaagtttcctataacaagggagcttgtattttgaatatgc

SEQ ID NO: 93873 - DNA, 48 bp, Artificial Sequence
  Description of Artificial Sequence: Synthetic oligonucleotide
tttgatgaagtttcctataacaagggagcttgtattttgaatatgctc

SEQ ID NO: 93874 - DNA, 47 bp, Artificial Sequence
  Description of Artificial Sequence: Synthetic oligonucleotide
ttgatgaagtttcctataacaagggagcttgtattttgaatatgctc

SEQ ID NO: 93875 - DNA, 46 bp, Artificial Sequence
  Description of Artificial Sequence: Synthetic oligonucleotide
tgatgaagtttcctataacaagggagcttgtattttgaatatgctc

SEQ ID NO: 93876 - DNA, 45 bp, Artificial Sequence
  Description of Artificial Sequence: Synthetic oligonucleotide
gatgaagtttcctataacaagggagcttgtattttgaatatgctc

SEQ ID NO: 93877 - DNA, 47 bp, Artificial Sequence
  Description of Artificial Sequence: Synthetic oligonucleotide
atgaagtttcctataacaagggagcttgtattttgaatatgctcaag

SEQ ID NO: 93878 - DNA, 46 bp, Artificial Sequence
  Description of Artificial Sequence: Synthetic oligonucleotide
tgaagtttcctataacaagggagcttgtattttgaatatgctcaag

SEQ ID NO: 93879 - DNA, 45 bp, Artificial Sequence
  Description of Artificial Sequence: Synthetic oligonucleotide
gaagtttcctataacaagggagcttgtattttgaatatgctcaag

SEQ ID NO: 93880 - DNA, 45 bp, Artificial Sequence
  Description of Artificial Sequence: Synthetic oligonucleotide
aagtttcctataacaagggagcttgtattttgaatatgctcaagg

SEQ ID NO: 93881 - DNA, 44 bp, Artificial Sequence
  Description of Artificial Sequence: Synthetic oligonucleotide
agtttcctataacaagggagcttgtattttgaatatgctcaagg

SEQ ID NO: 93882 - DNA, 43 bp, Artificial Sequence
  Description of Artificial Sequence: Synthetic oligonucleotide
gtttcctataacaagggagcttgtattttgaatatgctcaagg

SEQ ID NO: 93883 - DNA, 48 bp, Artificial Sequence
  Description of Artificial Sequence: Synthetic oligonucleotide
tttcctataacaagggagcttgtattttgaatatgctcaaggattttc

SEQ ID NO: 93884 - DNA, 47 bp, Artificial Sequence
  Description of Artificial Sequence: Synthetic oligonucleotide
ttcctataacaagggagcttgtattttgaatatgctcaaggattttc

SEQ ID NO: 93885 - DNA, 46 bp, Artificial Sequence
  Description of Artificial Sequence: Synthetic oligonucleotide
tcctataacaagggagcttgtattttgaatatgctcaaggattttc

SEQ ID NO: 93886 - DNA, 45 bp, Artificial Sequence
  Description of Artificial Sequence: Synthetic oligonucleotide
cctataacaagggagcttgtattttgaatatgctcaaggattttc

SEQ ID NO: 93887 - DNA, 46 bp, Artificial Sequence
  Description of Artificial Sequence: Synthetic oligonucleotide
ctataacaagggagcttgtattttgaatatgctcaaggattttctg

SEQ ID NO: 93888 - DNA, 46 bp, Artificial Sequence
  Description of Artificial Sequence: Synthetic oligonucleotide
tataacaagggagcttgtattttgaatatgctcaaggattttctgg

SEQ ID NO: 93889 - DNA, 45 bp, Artificial Sequence
  Description of Artificial Sequence: Synthetic oligonucleotide
ataacaagggagcttgtattttgaatatgctcaaggattttctgg

SEQ ID NO: 93890 - DNA, 44 bp, Artificial Sequence
  Description of Artificial Sequence: Synthetic oligonucleotide
taacaagggagcttgtattttgaatatgctcaaggattttctgg

SEQ ID NO: 93891 - DNA, 43 bp, Artificial Sequence
  Description of Artificial Sequence: Synthetic oligonucleotide
aacaagggagcttgtattttgaatatgctcaaggattttctgg

SEQ ID NO: 93892 - DNA, 42 bp, Artificial Sequence
  Description of Artificial Sequence: Synthetic oligonucleotide
acaagggagcttgtattttgaatatgctcaaggattttctgg

SEQ ID NO: 93893 - DNA, 41 bp, Artificial Sequence
  Description of Artificial Sequence: Synthetic oligonucleotide
caagggagcttgtattttgaatatgctcaaggattttctgg

SEQ ID NO: 93894 - DNA, 41 bp, Artificial Sequence
  Description of Artificial Sequence: Synthetic oligonucleotide
aagggagcttgtattttgaatatgctcaaggattttctggg

SEQ ID NO: 93895 - DNA, 40 bp, Artificial Sequence
  Description of Artificial Sequence: Synthetic oligonucleotide
agggagcttgtattttgaatatgctcaaggattttctggg

SEQ ID NO: 93896 - DNA, 39 bp, Artificial Sequence
  Description of Artificial Sequence: Synthetic oligonucleotide
gggagcttgtattttgaatatgctcaaggattttctggg

SEQ ID NO: 93897 - DNA, 40 bp, Artificial Sequence
  Description of Artificial Sequence: Synthetic oligonucleotide
ggagcttgtattttgaatatgctcaaggattttctgggtg

SEQ ID NO: 93898 - DNA, 41 bp, Artificial Sequence
  Description of Artificial Sequence: Synthetic oligonucleotide
gagcttgtattttgaatatgctcaaggattttctgggtgag

SEQ ID NO: 93899 - DNA, 41 bp, Artificial Sequence
  Description of Artificial Sequence: Synthetic oligonucleotide
agcttgtattttgaatatgctcaaggattttctgggtgagg

SEQ ID NO: 93900 - DNA, 40 bp, Artificial Sequence
  Description of Artificial Sequence: Synthetic oligonucleotide
gcttgtattttgaatatgctcaaggattttctgggtgagg

SEQ ID NO: 93901 - DNA, 41 bp, Artificial Sequence
  Description of Artificial Sequence: Synthetic oligonucleotide
cttgtattttgaatatgctcaaggattttctgggtgaggag

SEQ ID NO: 93902 - DNA, 46 bp, Artificial Sequence
  Description of Artificial Sequence: Synthetic oligonucleotide
ttgtattttgaatatgctcaaggattttctgggtgaggagaaattc

SEQ ID NO: 93903 - DNA, 45 bp, Artificial Sequence
  Description of Artificial Sequence: Synthetic oligonucleotide
tgtattttgaatatgctcaaggattttctgggtgaggagaaattc

SEQ ID NO: 93904 - DNA, 44 bp, Artificial Sequence
  Description of Artificial Sequence: Synthetic oligonucleotide
gtattttgaatatgctcaaggattttctgggtgaggagaaattc

SEQ ID NO: 93905 - DNA, 44 bp, Artificial Sequence
  Description of Artificial Sequence: Synthetic oligonucleotide
tattttgaatatgctcaaggattttctgggtgaggagaaattcc

SEQ ID NO: 93906 - DNA, 43 bp, Artificial Sequence
  Description of Artificial Sequence: Synthetic oligonucleotide
attttgaatatgctcaaggattttctgggtgaggagaaattcc

SEQ ID NO: 93907 - DNA, 42 bp, Artificial Sequence
  Description of Artificial Sequence: Synthetic oligonucleotide
ttttgaatatgctcaaggattttctgggtgaggagaaattcc

SEQ ID NO: 93908 - DNA, 41 bp, Artificial Sequence
  Description of Artificial Sequence: Synthetic oligonucleotide
tttgaatatgctcaaggattttctgggtgaggagaaattcc

SEQ ID NO: 93909 - DNA, 40 bp, Artificial Sequence
  Description of Artificial Sequence: Synthetic oligonucleotide
ttgaatatgctcaaggattttctgggtgaggagaaattcc

SEQ ID NO: 93910 - DNA, 39 bp, Artificial Sequence
  Description of Artificial Sequence: Synthetic oligonucleotide
tgaatatgctcaaggattttctgggtgaggagaaattcc

SEQ ID NO: 93911 - DNA, 38 bp, Artificial Sequence
  Description of Artificial Sequence: Synthetic oligonucleotide
gaatatgctcaaggattttctgggtgaggagaaattcc

SEQ ID NO: 93912 - DNA, 39 bp, Artificial Sequence
  Description of Artificial Sequence: Synthetic oligonucleotide
aatatgctcaaggattttctgggtgaggagaaattccag

SEQ ID NO: 93913 - DNA, 38 bp, Artificial Sequence
  Description of Artificial Sequence: Synthetic oligonucleotide
atatgctcaaggattttctgggtgaggagaaattccag

SEQ ID NO: 93914 - DNA, 37 bp, Artificial Sequence
  Description of Artificial Sequence: Synthetic oligonucleotide
tatgctcaaggattttctgggtgaggagaaattccag

SEQ ID NO: 93915 - DNA, 36 bp, Artificial Sequence
  Description of Artificial Sequence: Synthetic oligonucleotide
atgctcaaggattttctgggtgaggagaaattccag

SEQ ID NO: 93916 - DNA, 35 bp, Artificial Sequence
  Description of Artificial Sequence: Synthetic oligonucleotide
tgctcaaggattttctgggtgaggagaaattccag

SEQ ID NO: 93917 - DNA, 34 bp, Artificial Sequence
  Description of Artificial Sequence: Synthetic oligonucleotide
gctcaaggattttctgggtgaggagaaattccag

SEQ ID NO: 93918 - DNA, 37 bp, Artificial Sequence
  Description of Artificial Sequence: Synthetic oligonucleotide
ctcaaggattttctgggtgaggagaaattccagaaag

SEQ ID NO: 93919 - DNA, 37 bp, Artificial Sequence
  Description of Artificial Sequence: Synthetic oligonucleotide
tcaaggattttctgggtgaggagaaattccagaaagg

SEQ ID NO: 93920 - DNA, 36 bp, Artificial Sequence
  Description of Artificial Sequence: Synthetic oligonucleotide
caaggattttctgggtgaggagaaattccagaaagg

SEQ ID NO: 93921 - DNA, 43 bp, Artificial Sequence
  Description of Artificial Sequence: Synthetic oligonucleotide
aaggattttctgggtgaggagaaattccagaaaggaataattc

SEQ ID NO: 93922 - DNA, 42 bp, Artificial Sequence
  Description of Artificial Sequence: Synthetic oligonucleotide
aggattttctgggtgaggagaaattccagaaaggaataattc

SEQ ID NO: 93923 - DNA, 41 bp, Artificial Sequence
  Description of Artificial Sequence: Synthetic oligonucleotide
ggattttctgggtgaggagaaattccagaaaggaataattc

SEQ ID NO: 93924 - DNA, 42 bp, Artificial Sequence
  Description of Artificial Sequence: Synthetic oligonucleotide
gattttctgggtgaggagaaattccagaaaggaataattcag

SEQ ID NO: 93925 - DNA, 44 bp, Artificial Sequence
  Description of Artificial Sequence: Synthetic oligonucleotide
attttctgggtgaggagaaattccagaaaggaataattcagtac

SEQ ID NO: 93926 - DNA, 43 bp, Artificial Sequence
  Description of Artificial Sequence: Synthetic oligonucleotide
ttttctgggtgaggagaaattccagaaaggaataattcagtac

SEQ ID NO: 93927 - DNA, 42 bp, Artificial Sequence
  Description of Artificial Sequence: Synthetic oligonucleotide
tttctgggtgaggagaaattccagaaaggaataattcagtac

SEQ ID NO: 93928 - DNA, 41 bp, Artificial Sequence
  Description of Artificial Sequence: Synthetic oligonucleotide
ttctgggtgaggagaaattccagaaaggaataattcagtac

SEQ ID NO: 93929 - DNA, 40 bp, Artificial Sequence
  Description of Artificial Sequence: Synthetic oligonucleotide
tctgggtgaggagaaattccagaaaggaataattcagtac

SEQ ID NO: 93930 - DNA, 39 bp, Artificial Sequence
  Description of Artificial Sequence: Synthetic oligonucleotide
ctgggtgaggagaaattccagaaaggaataattcagtac

SEQ ID NO: 93931 - DNA, 44 bp, Artificial Sequence
  Description of Artificial Sequence: Synthetic oligonucleotide
tgggtgaggagaaattccagaaaggaataattcagtacttaaag

SEQ ID NO: 93932 - DNA, 43 bp, Artificial Sequence
  Description of Artificial Sequence: Synthetic oligonucleotide
gggtgaggagaaattccagaaaggaataattcagtacttaaag

SEQ ID NO: 93933 - DNA, 45 bp, Artificial Sequence
  Description of Artificial Sequence: Synthetic oligonucleotide
ggtgaggagaaattccagaaaggaataattcagtacttaaagaag

SEQ ID NO: 93934 - DNA, 47 bp, Artificial Sequence
  Description of Artificial Sequence: Synthetic oligonucleotide
gtgaggagaaattccagaaaggaataattcagtacttaaagaagttc

SEQ ID NO: 93935 - DNA, 48 bp, Artificial Sequence
  Description of Artificial Sequence: Synthetic oligonucleotide
tgaggagaaattccagaaaggaataattcagtacttaaagaagttcag

SEQ ID NO: 93936 - DNA, 47 bp, Artificial Sequence
  Description of Artificial Sequence: Synthetic oligonucleotide
gaggagaaattccagaaaggaataattcagtacttaaagaagttcag

SEQ ID NO: 93937 - DNA, 47 bp, Artificial Sequence
  Description of Artificial Sequence: Synthetic oligonucleotide
aggagaaattccagaaaggaataattcagtacttaaagaagttcagc

SEQ ID NO: 93938 - DNA, 46 bp, Artificial Sequence
  Description of Artificial Sequence: Synthetic oligonucleotide
ggagaaattccagaaaggaataattcagtacttaaagaagttcagc

SEQ ID NO: 93939 - DNA, 50 bp, Artificial Sequence
  Description of Artificial Sequence: Synthetic oligonucleotide
gagaaattccagaaaggaataattcagtacttaaagaagttcagctatag

SEQ ID NO: 93940 - DNA, 54 bp, Artificial Sequence
  Description of Artificial Sequence: Synthetic oligonucleotide
agaaattccagaaaggaataattcagtacttaaagaagttcagctatagaaatg

SEQ ID NO: 93941 - DNA, 53 bp, Artificial Sequence
  Description of Artificial Sequence: Synthetic oligonucleotide
gaaattccagaaaggaataattcagtacttaaagaagttcagctatagaaatg

SEQ ID NO: 93942 - DNA, 53 bp, Artificial Sequence
  Description of Artificial Sequence: Synthetic oligonucleotide
aaattccagaaaggaataattcagtacttaaagaagttcagctatagaaatgc

SEQ ID NO: 93943 - DNA, 52 bp, Artificial Sequence
  Description of Artificial Sequence: Synthetic oligonucleotide
aattccagaaaggaataattcagtacttaaagaagttcagctatagaaatgc

SEQ ID NO: 93944 - DNA, 51 bp, Artificial Sequence
  Description of Artificial Sequence: Synthetic oligonucleotide
attccagaaaggaataattcagtacttaaagaagttcagctatagaaatgc

SEQ ID NO: 93945 - DNA, 50 bp, Artificial Sequence
  Description of Artificial Sequence: Synthetic oligonucleotide
ttccagaaaggaataattcagtacttaaagaagttcagctatagaaatgc

SEQ ID NO: 93946 - DNA, 49 bp, Artificial Sequence
  Description of Artificial Sequence: Synthetic oligonucleotide
tccagaaaggaataattcagtacttaaagaagttcagctatagaaatgc

SEQ ID NO: 93947 - DNA, 48 bp, Artificial Sequence
  Description of Artificial Sequence: Synthetic oligonucleotide
ccagaaaggaataattcagtacttaaagaagttcagctatagaaatgc

SEQ ID NO: 93948 - DNA, 51 bp, Artificial Sequence
  Description of Artificial Sequence: Synthetic oligonucleotide
cagaaaggaataattcagtacttaaagaagttcagctatagaaatgctaag

SEQ ID NO: 93949 - DNA, 54 bp, Artificial Sequence
  Description of Artificial Sequence: Synthetic oligonucleotide
agaaaggaataattcagtacttaaagaagttcagctatagaaatgctaagaatg

SEQ ID NO: 93950 - DNA, 53 bp, Artificial Sequence
  Description of Artificial Sequence: Synthetic oligonucleotide
gaaaggaataattcagtacttaaagaagttcagctatagaaatgctaagaatg

SEQ ID NO: 93951 - DNA, 55 bp, Artificial Sequence
  Description of Artificial Sequence: Synthetic oligonucleotide
aaaggaataattcagtacttaaagaagttcagctatagaaatgctaagaatgatg

SEQ ID NO: 93952 - DNA, 54 bp, Artificial Sequence
  Description of Artificial Sequence: Synthetic oligonucleotide
aaggaataattcagtacttaaagaagttcagctatagaaatgctaagaatgatg

SEQ ID NO: 93953 - DNA, 53 bp, Artificial Sequence
  Description of Artificial Sequence: Synthetic oligonucleotide
aggaataattcagtacttaaagaagttcagctatagaaatgctaagaatgatg

SEQ ID NO: 93954 - DNA, 52 bp, Artificial Sequence
  Description of Artificial Sequence: Synthetic oligonucleotide
ggaataattcagtacttaaagaagttcagctatagaaatgctaagaatgatg

SEQ ID NO: 93955 - DNA, 53 bp, Artificial Sequence
  Description of Artificial Sequence: Synthetic oligonucleotide
gaataattcagtacttaaagaagttcagctatagaaatgctaagaatgatgac

SEQ ID NO: 93956 - DNA, 55 bp, Artificial Sequence
  Description of Artificial Sequence: Synthetic oligonucleotide
aataattcagtacttaaagaagttcagctatagaaatgctaagaatgatgacttg

SEQ ID NO: 93957 - DNA, 54 bp, Artificial Sequence
  Description of Artificial Sequence: Synthetic oligonucleotide
ataattcagtacttaaagaagttcagctatagaaatgctaagaatgatgacttg

SEQ ID NO: 93958 - DNA, 53 bp, Artificial Sequence
  Description of Artificial Sequence: Synthetic oligonucleotide
taattcagtacttaaagaagttcagctatagaaatgctaagaatgatgacttg

SEQ ID NO: 93959 - DNA, 52 bp, Artificial Sequence
  Description of Artificial Sequence: Synthetic oligonucleotide
aattcagtacttaaagaagttcagctatagaaatgctaagaatgatgacttg

SEQ ID NO: 93960 - DNA, 51 bp, Artificial Sequence
  Description of Artificial Sequence: Synthetic oligonucleotide
attcagtacttaaagaagttcagctatagaaatgctaagaatgatgacttg

SEQ ID NO: 93961 - DNA, 50 bp, Artificial Sequence
  Description of Artificial Sequence: Synthetic oligonucleotide
ttcagtacttaaagaagttcagctatagaaatgctaagaatgatgacttg

SEQ ID NO: 93962 - DNA, 49 bp, Artificial Sequence
  Description of Artificial Sequence: Synthetic oligonucleotide
tcagtacttaaagaagttcagctatagaaatgctaagaatgatgacttg

SEQ ID NO: 93963 - DNA, 48 bp, Artificial Sequence
  Description of Artificial Sequence: Synthetic oligonucleotide
cagtacttaaagaagttcagctatagaaatgctaagaatgatgacttg

SEQ ID NO: 93964 - DNA, 49 bp, Artificial Sequence
  Description of Artificial Sequence: Synthetic oligonucleotide
agtacttaaagaagttcagctatagaaatgctaagaatgatgacttgtg

SEQ ID NO: 93965 - DNA, 48 bp, Artificial Sequence
  Description of Artificial Sequence: Synthetic oligonucleotide
gtacttaaagaagttcagctatagaaatgctaagaatgatgacttgtg

SEQ ID NO: 93966 - DNA, 48 bp, Artificial Sequence
  Description of Artificial Sequence: Synthetic oligonucleotide
tacttaaagaagttcagctatagaaatgctaagaatgatgacttgtgg

SEQ ID NO: 93967 - DNA, 47 bp, Artificial Sequence
  Description of Artificial Sequence: Synthetic oligonucleotide
acttaaagaagttcagctatagaaatgctaagaatgatgacttgtgg

SEQ ID NO: 93968 - DNA, 46 bp, Artificial Sequence
  Description of Artificial Sequence: Synthetic oligonucleotide
cttaaagaagttcagctatagaaatgctaagaatgatgacttgtgg

SEQ ID NO: 93969 - DNA, 47 bp, Artificial Sequence
  Description of Artificial Sequence: Synthetic oligonucleotide
ttaaagaagttcagctatagaaatgctaagaatgatgacttgtggag

SEQ ID NO: 93970 - DNA, 46 bp, Artificial Sequence
  Description of Artificial Sequence: Synthetic oligonucleotide
taaagaagttcagctatagaaatgctaagaatgatgacttgtggag

SEQ ID NO: 93971 - DNA, 45 bp, Artificial Sequence
  Description of Artificial Sequence: Synthetic oligonucleotide
aaagaagttcagctatagaaatgctaagaatgatgacttgtggag

SEQ ID NO: 93972 - DNA, 44 bp, Artificial Sequence
  Description of Artificial Sequence: Synthetic oligonucleotide
aagaagttcagctatagaaatgctaagaatgatgacttgtggag

SEQ ID NO: 93973 - DNA, 43 bp, Artificial Sequence
  Description of Artificial Sequence: Synthetic oligonucleotide
agaagttcagctatagaaatgctaagaatgatgacttgtggag

SEQ ID NO: 93974 - DNA, 42 bp, Artificial Sequence
  Description of Artificial Sequence: Synthetic oligonucleotide
gaagttcagctatagaaatgctaagaatgatgacttgtggag

SEQ ID NO: 93975 - DNA, 42 bp, Artificial Sequence
  Description of Artificial Sequence: Synthetic oligonucleotide
aagttcagctatagaaatgctaagaatgatgacttgtggagc

SEQ ID NO: 93976 - DNA, 41 bp, Artificial Sequence
  Description of Artificial Sequence: Synthetic oligonucleotide
agttcagctatagaaatgctaagaatgatgacttgtggagc

SEQ ID NO: 93977 - DNA, 40 bp, Artificial Sequence
  Description of Artificial Sequence: Synthetic oligonucleotide
gttcagctatagaaatgctaagaatgatgacttgtggagc

SEQ ID NO: 93978 - DNA, 41 bp, Artificial Sequence
  Description of Artificial Sequence: Synthetic oligonucleotide
ttcagctatagaaatgctaagaatgatgacttgtggagcag

SEQ ID NO: 93979 - DNA, 40 bp, Artificial Sequence
  Description of Artificial Sequence: Synthetic oligonucleotide
tcagctatagaaatgctaagaatgatgacttgtggagcag

SEQ ID NO: 93980 - DNA, 39 bp, Artificial Sequence
  Description of Artificial Sequence: Synthetic oligonucleotide
cagctatagaaatgctaagaatgatgacttgtggagcag

SEQ ID NO: 93981 - DNA, 40 bp, Artificial Sequence
  Description of Artificial Sequence: Synthetic oligonucleotide
agctatagaaatgctaagaatgatgacttgtggagcagtc

SEQ ID NO: 93982 - DNA, 39 bp, Artificial Sequence
  Description of Artificial Sequence: Synthetic oligonucleotide
gctatagaaatgctaagaatgatgacttgtggagcagtc

SEQ ID NO: 93983 - DNA, 40 bp, Artificial Sequence
  Description of Artificial Sequence: Synthetic oligonucleotide
ctatagaaatgctaagaatgatgacttgtggagcagtctg

SEQ ID NO: 93984 - DNA, 41 bp, Artificial Sequence
  Description of Artificial Sequence: Synthetic oligonucleotide
tatagaaatgctaagaatgatgacttgtggagcagtctgtc

SEQ ID NO: 93985 - DNA, 40 bp, Artificial Sequence
  Description of Artificial Sequence: Synthetic oligonucleotide
atagaaatgctaagaatgatgacttgtggagcagtctgtc

SEQ ID NO: 93986 - DNA, 39 bp, Artificial Sequence
  Description of Artificial Sequence: Synthetic oligonucleotide
tagaaatgctaagaatgatgacttgtggagcagtctgtc

SEQ ID NO: 93987 - DNA, 38 bp, Artificial Sequence
  Description of Artificial Sequence: Synthetic oligonucleotide
agaaatgctaagaatgatgacttgtggagcagtctgtc

SEQ ID NO: 93988 - DNA, 37 bp, Artificial Sequence
  Description of Artificial Sequence: Synthetic oligonucleotide
gaaatgctaagaatgatgacttgtggagcagtctgtc

SEQ ID NO: 93989 - DNA, 42 bp, Artificial Sequence
  Description of Artificial Sequence: Synthetic oligonucleotide
aaatgctaagaatgatgacttgtggagcagtctgtcaaatag

SEQ ID NO: 93990 - DNA, 41 bp, Artificial Sequence
  Description of Artificial Sequence: Synthetic oligonucleotide
aatgctaagaatgatgacttgtggagcagtctgtcaaatag

SEQ ID NO: 93991 - DNA, 40 bp, Artificial Sequence
  Description of Artificial Sequence: Synthetic oligonucleotide
atgctaagaatgatgacttgtggagcagtctgtcaaatag

SEQ ID NO: 93992 - DNA, 39 bp, Artificial Sequence
  Description of Artificial Sequence: Synthetic oligonucleotide
tgctaagaatgatgacttgtggagcagtctgtcaaatag

SEQ ID NO: 93993 - DNA, 38 bp, Artificial Sequence
  Description of Artificial Sequence: Synthetic oligonucleotide
gctaagaatgatgacttgtggagcagtctgtcaaatag

SEQ ID NO: 93994 - DNA, 40 bp, Artificial Sequence
  Description of Artificial Sequence: Synthetic oligonucleotide
ctaagaatgatgacttgtggagcagtctgtcaaatagttg

SEQ ID NO: 93995 - DNA, 44 bp, Artificial Sequence
  Description of Artificial Sequence: Synthetic oligonucleotide
taagaatgatgacttgtggagcagtctgtcaaatagttgtttag

SEQ ID NO: 93996 - DNA, 43 bp, Artificial Sequence
  Description of Artificial Sequence: Synthetic oligonucleotide
aagaatgatgacttgtggagcagtctgtcaaatagttgtttag

SEQ ID NO: 93997 - DNA, 42 bp, Artificial Sequence
  Description of Artificial Sequence: Synthetic oligonucleotide
agaatgatgacttgtggagcagtctgtcaaatagttgtttag

SEQ ID NO: 93998 - DNA, 41 bp, Artificial Sequence
  Description of Artificial Sequence: Synthetic oligonucleotide
gaatgatgacttgtggagcagtctgtcaaatagttgtttag

SEQ ID NO: 93999 - DNA, 44 bp, Artificial Sequence
  Description of Artificial Sequence: Synthetic oligonucleotide
aatgatgacttgtggagcagtctgtcaaatagttgtttagaaag

SEQ ID NO: 94000 - DNA, 43 bp, Artificial Sequence
  Description of Artificial Sequence: Synthetic oligonucleotide
atgatgacttgtggagcagtctgtcaaatagttgtttagaaag

SEQ ID NO: 94001 - DNA, 42 bp, Artificial Sequence
  Description of Artificial Sequence: Synthetic oligonucleotide
tgatgacttgtggagcagtctgtcaaatagttgtttagaaag

SEQ ID NO: 94002 - DNA, 41 bp, Artificial Sequence
  Description of Artificial Sequence: Synthetic oligonucleotide
gatgacttgtggagcagtctgtcaaatagttgtttagaaag

SEQ ID NO: 94003 - DNA, 42 bp, Artificial Sequence
  Description of Artificial Sequence: Synthetic oligonucleotide
atgacttgtggagcagtctgtcaaatagttgtttagaaagtg

SEQ ID NO: 94004 - DNA, 41 bp, Artificial Sequence
  Description of Artificial Sequence: Synthetic oligonucleotide
tgacttgtggagcagtctgtcaaatagttgtttagaaagtg

SEQ ID NO: 94005 - DNA, 40 bp, Artificial Sequence
  Description of Artificial Sequence: Synthetic oligonucleotide
gacttgtggagcagtctgtcaaatagttgtttagaaagtg

SEQ ID NO: 94006 - DNA, 46 bp, Artificial Sequence
  Description of Artificial Sequence: Synthetic oligonucleotide
acttgtggagcagtctgtcaaatagttgtttagaaagtgattttac

SEQ ID NO: 94007 - DNA, 45 bp, Artificial Sequence
  Description of Artificial Sequence: Synthetic oligonucleotide
cttgtggagcagtctgtcaaatagttgtttagaaagtgattttac

SEQ ID NO: 94008 - DNA, 47 bp, Artificial Sequence
  Description of Artificial Sequence: Synthetic oligonucleotide
ttgtggagcagtctgtcaaatagttgtttagaaagtgattttacatc

SEQ ID NO: 94009 - DNA, 46 bp, Artificial Sequence
  Description of Artificial Sequence: Synthetic oligonucleotide
tgtggagcagtctgtcaaatagttgtttagaaagtgattttacatc

SEQ ID NO: 94010 - DNA, 45 bp, Artificial Sequence
  Description of Artificial Sequence: Synthetic oligonucleotide
gtggagcagtctgtcaaatagttgtttagaaagtgattttacatc

SEQ ID NO: 94011 - DNA, 46 bp, Artificial Sequence
  Description of Artificial Sequence: Synthetic oligonucleotide
tggagcagtctgtcaaatagttgtttagaaagtgattttacatctg

SEQ ID NO: 94012 - DNA, 45 bp, Artificial Sequence
  Description of Artificial Sequence: Synthetic oligonucleotide
ggagcagtctgtcaaatagttgtttagaaagtgattttacatctg

SEQ ID NO: 94013 - DNA, 45 bp, Artificial Sequence
  Description of Artificial Sequence: Synthetic oligonucleotide
gagcagtctgtcaaatagttgtttagaaagtgattttacatctgg

SEQ ID NO: 94014 - DNA, 46 bp, Artificial Sequence
  Description of Artificial Sequence: Synthetic oligonucleotide
agcagtctgtcaaatagttgtttagaaagtgattttacatctggtg

SEQ ID NO: 94015 - DNA, 45 bp, Artificial Sequence
  Description of Artificial Sequence: Synthetic oligonucleotide
gcagtctgtcaaatagttgtttagaaagtgattttacatctggtg

SEQ ID NO: 94016 - DNA, 45 bp, Artificial Sequence
  Description of Artificial Sequence: Synthetic oligonucleotide
cagtctgtcaaatagttgtttagaaagtgattttacatctggtgg

SEQ ID NO: 94017 - DNA, 46 bp, Artificial Sequence
  Description of Artificial Sequence: Synthetic oligonucleotide
agtctgtcaaatagttgtttagaaagtgattttacatctggtggag

SEQ ID NO: 94018 - DNA, 45 bp, Artificial Sequence
  Description of Artificial Sequence: Synthetic oligonucleotide
gtctgtcaaatagttgtttagaaagtgattttacatctggtggag

SEQ ID NO: 94019 - DNA, 48 bp, Artificial Sequence
  Description of Artificial Sequence: Synthetic oligonucleotide
tctgtcaaatagttgtttagaaagtgattttacatctggtggagtttg

SEQ ID NO: 94020 - DNA, 47 bp, Artificial Sequence
  Description of Artificial Sequence: Synthetic oligonucleotide
ctgtcaaatagttgtttagaaagtgattttacatctggtggagtttg

SEQ ID NO: 94021 - DNA, 48 bp, Artificial Sequence
  Description of Artificial Sequence: Synthetic oligonucleotide
tgtcaaatagttgtttagaaagtgattttacatctggtggagtttgtc

SEQ ID NO: 94022 - DNA, 47 bp, Artificial Sequence
  Description of Artificial Sequence: Synthetic oligonucleotide
gtcaaatagttgtttagaaagtgattttacatctggtggagtttgtc

SEQ ID NO: 94023 - DNA, 50 bp, Artificial Sequence
  Description of Artificial Sequence: Synthetic oligonucleotide
tcaaatagttgtttagaaagtgattttacatctggtggagtttgtcattc

SEQ ID NO: 94024 - DNA, 49 bp, Artificial Sequence
  Description of Artificial Sequence: Synthetic oligonucleotide
caaatagttgtttagaaagtgattttacatctggtggagtttgtcattc

SEQ ID NO: 94025 - DNA, 49 bp, Artificial Sequence
  Description of Artificial Sequence: Synthetic oligonucleotide
aaatagttgtttagaaagtgattttacatctggtggagtttgtcattcg

SEQ ID NO: 94026 - DNA, 48 bp, Artificial Sequence
  Description of Artificial Sequence: Synthetic oligonucleotide
aatagttgtttagaaagtgattttacatctggtggagtttgtcattcg

SEQ ID NO: 94027 - DNA, 47 bp, Artificial Sequence
  Description of Artificial Sequence: Synthetic oligonucleotide
atagttgtttagaaagtgattttacatctggtggagtttgtcattcg

SEQ ID NO: 94028 - DNA, 46 bp, Artificial Sequence
  Description of Artificial Sequence: Synthetic oligonucleotide
tagttgtttagaaagtgattttacatctggtggagtttgtcattcg

SEQ ID NO: 94029 - DNA, 45 bp, Artificial Sequence
  Description of Artificial Sequence: Synthetic oligonucleotide
agttgtttagaaagtgattttacatctggtggagtttgtcattcg

SEQ ID NO: 94030 - DNA, 44 bp, Artificial Sequence
  Description of Artificial Sequence: Synthetic oligonucleotide
gttgtttagaaagtgattttacatctggtggagtttgtcattcg

SEQ ID NO: 94031 - DNA, 44 bp, Artificial Sequence
  Description of Artificial Sequence: Synthetic oligonucleotide
ttgtttagaaagtgattttacatctggtggagtttgtcattcgg

SEQ ID NO: 94032 - DNA, 43 bp, Artificial Sequence
  Description of Artificial Sequence: Synthetic oligonucleotide
tgtttagaaagtgattttacatctggtggagtttgtcattcgg

SEQ ID NO: 94033 - DNA, 42 bp, Artificial Sequence
  Description of Artificial Sequence: Synthetic oligonucleotide
gtttagaaagtgattttacatctggtggagtttgtcattcgg

SEQ ID NO: 94034 - DNA, 44 bp, Artificial Sequence
  Description of Artificial Sequence: Synthetic oligonucleotide
tttagaaagtgattttacatctggtggagtttgtcattcggatc

SEQ ID NO: 94035 - DNA, 43 bp, Artificial Sequence
  Description of Artificial Sequence: Synthetic oligonucleotide
ttagaaagtgattttacatctggtggagtttgtcattcggatc

SEQ ID NO: 94036 - DNA, 42 bp, Artificial Sequence
  Description of Artificial Sequence: Synthetic oligonucleotide
tagaaagtgattttacatctggtggagtttgtcattcggatc

SEQ ID NO: 94037 - DNA, 41 bp, Artificial Sequence
  Description of Artificial Sequence: Synthetic oligonucleotide
agaaagtgattttacatctggtggagtttgtcattcggatc

SEQ ID NO: 94038 - DNA, 40 bp, Artificial Sequence
  Description of Artificial Sequence: Synthetic oligonucleotide
gaaagtgattttacatctggtggagtttgtcattcggatc

SEQ ID NO: 94039 - DNA, 40 bp, Artificial Sequence
  Description of Artificial Sequence: Synthetic oligonucleotide
aaagtgattttacatctggtggagtttgtcattcggatcc

SEQ ID NO: 94040 - DNA, 39 bp, Artificial Sequence
  Description of Artificial Sequence: Synthetic oligonucleotide
aagtgattttacatctggtggagtttgtcattcggatcc

SEQ ID NO: 94041 - DNA, 38 bp, Artificial Sequence
  Description of Artificial Sequence: Synthetic oligonucleotide
agtgattttacatctggtggagtttgtcattcggatcc

SEQ ID NO: 94042 - DNA, 37 bp, Artificial Sequence
  Description of Artificial Sequence: Synthetic oligonucleotide
gtgattttacatctggtggagtttgtcattcggatcc

SEQ ID NO: 94043 - DNA, 37 bp, Artificial Sequence
  Description of Artificial Sequence: Synthetic oligonucleotide
tgattttacatctggtggagtttgtcattcggatccc

SEQ ID NO: 94044 - DNA, 36 bp, Artificial Sequence
  Description of Artificial Sequence: Synthetic oligonucleotide
gattttacatctggtggagtttgtcattcggatccc

SEQ ID NO: 94045 - DNA, 38 bp, Artificial Sequence
  Description of Artificial Sequence: Synthetic oligonucleotide
attttacatctggtggagtttgtcattcggatcccaag

SEQ ID NO: 94046 - DNA, 37 bp, Artificial Sequence
  Description of Artificial Sequence: Synthetic oligonucleotide
ttttacatctggtggagtttgtcattcggatcccaag

SEQ ID NO: 94047 - DNA, 36 bp, Artificial Sequence
  Description of Artificial Sequence: Synthetic oligonucleotide
tttacatctggtggagtttgtcattcggatcccaag

SEQ ID NO: 94048 - DNA, 35 bp, Artificial Sequence
  Description of Artificial Sequence: Synthetic oligonucleotide
ttacatctggtggagtttgtcattcggatcccaag

SEQ ID NO: 94049 - DNA, 34 bp, Artificial Sequence
  Description of Artificial Sequence: Synthetic oligonucleotide
tacatctggtggagtttgtcattcggatcccaag

SEQ ID NO: 94050 - DNA, 33 bp, Artificial Sequence
  Description of Artificial Sequence: Synthetic oligonucleotide
acatctggtggagtttgtcattcggatcccaag

SEQ ID NO: 94051 - DNA, 32 bp, Artificial Sequence
  Description of Artificial Sequence: Synthetic oligonucleotide
catctggtggagtttgtcattcggatcccaag

SEQ ID NO: 94052 - DNA, 34 bp, Artificial Sequence
  Description of Artificial Sequence: Synthetic oligonucleotide
atctggtggagtttgtcattcggatcccaagatg

SEQ ID NO: 94053 - DNA, 33 bp, Artificial Sequence
  Description of Artificial Sequence: Synthetic oligonucleotide
tctggtggagtttgtcattcggatcccaagatg

SEQ ID NO: 94054 - DNA, 32 bp, Artificial Sequence
  Description of Artificial Sequence: Synthetic oligonucleotide
ctggtggagtttgtcattcggatcccaagatg

SEQ ID NO: 94055 - DNA, 33 bp, Artificial Sequence
  Description of Artificial Sequence: Synthetic oligonucleotide
tggtggagtttgtcattcggatcccaagatgac

SEQ ID NO: 94056 - DNA, 32 bp, Artificial Sequence
  Description of Artificial Sequence: Synthetic oligonucleotide
ggtggagtttgtcattcggatcccaagatgac

SEQ ID NO: 94057 - DNA, 34 bp, Artificial Sequence
  Description of Artificial Sequence: Synthetic oligonucleotide
gtggagtttgtcattcggatcccaagatgacaag

SEQ ID NO: 94058 - DNA, 37 bp, Artificial Sequence
  Description of Artificial Sequence: Synthetic oligonucleotide
tggagtttgtcattcggatcccaagatgacaagtaac

SEQ ID NO: 94059 - DNA, 36 bp, Artificial Sequence
  Description of Artificial Sequence: Synthetic oligonucleotide
ggagtttgtcattcggatcccaagatgacaagtaac

SEQ ID NO: 94060 - DNA, 38 bp, Artificial Sequence
  Description of Artificial Sequence: Synthetic oligonucleotide
gagtttgtcattcggatcccaagatgacaagtaacatg

SEQ ID NO: 94061 - DNA, 38 bp, Artificial Sequence
  Description of Artificial Sequence: Synthetic oligonucleotide
agtttgtcattcggatcccaagatgacaagtaacatgc

SEQ ID NO: 94062 - DNA, 37 bp, Artificial Sequence
  Description of Artificial Sequence: Synthetic oligonucleotide
gtttgtcattcggatcccaagatgacaagtaacatgc

SEQ ID NO: 94063 - DNA, 38 bp, Artificial Sequence
  Description of Artificial Sequence: Synthetic oligonucleotide
tttgtcattcggatcccaagatgacaagtaacatgctc

SEQ ID NO: 94064 - DNA, 37 bp, Artificial Sequence
  Description of Artificial Sequence: Synthetic oligonucleotide
ttgtcattcggatcccaagatgacaagtaacatgctc

SEQ ID NO: 94065 - DNA, 36 bp, Artificial Sequence
  Description of Artificial Sequence: Synthetic oligonucleotide
tgtcattcggatcccaagatgacaagtaacatgctc

SEQ ID NO: 94066 - DNA, 35 bp, Artificial Sequence
  Description of Artificial Sequence: Synthetic oligonucleotide
gtcattcggatcccaagatgacaagtaacatgctc

SEQ ID NO: 94067 - DNA, 35 bp, Artificial Sequence
  Description of Artificial Sequence: Synthetic oligonucleotide
tcattcggatcccaagatgacaagtaacatgctcg

SEQ ID NO: 94068 - DNA, 34 bp, Artificial Sequence
  Description of Artificial Sequence: Synthetic oligonucleotide
cattcggatcccaagatgacaagtaacatgctcg

SEQ ID NO: 94069 - DNA, 34 bp, Artificial Sequence
  Description of Artificial Sequence: Synthetic oligonucleotide
attcggatcccaagatgacaagtaacatgctcgc

SEQ ID NO: 94070 - DNA, 33 bp, Artificial Sequence
  Description of Artificial Sequence: Synthetic oligonucleotide
ttcggatcccaagatgacaagtaacatgctcgc

SEQ ID NO: 94071 - DNA, 32 bp, Artificial Sequence
  Description of Artificial Sequence: Synthetic oligonucleotide
tcggatcccaagatgacaagtaacatgctcgc

SEQ ID NO: 94072 - DNA, 31 bp, Artificial Sequence
  Description of Artificial Sequence: Synthetic oligonucleotide
cggatcccaagatgacaagtaacatgctcgc

SEQ ID NO: 94073 - DNA, 31 bp, Artificial Sequence
  Description of Artificial Sequence: Synthetic oligonucleotide
ggatcccaagatgacaagtaacatgctcgcc

SEQ ID NO: 94074 - DNA, 34 bp, Artificial Sequence
  Description of Artificial Sequence: Synthetic oligonucleotide
gatcccaagatgacaagtaacatgctcgcctttc

SEQ ID NO: 94075 - DNA, 35 bp, Artificial Sequence
  Description of Artificial Sequence: Synthetic oligonucleotide
atcccaagatgacaagtaacatgctcgcctttctg

SEQ ID NO: 94076 - DNA, 34 bp, Artificial Sequence
  Description of Artificial Sequence: Synthetic oligonucleotide
tcccaagatgacaagtaacatgctcgcctttctg

SEQ ID NO: 94077 - DNA, 33 bp, Artificial Sequence
  Description of Artificial Sequence: Synthetic oligonucleotide
cccaagatgacaagtaacatgctcgcctttctg

SEQ ID NO: 94078 - DNA, 33 bp, Artificial Sequence
  Description of Artificial Sequence: Synthetic oligonucleotide
ccaagatgacaagtaacatgctcgcctttctgg

SEQ ID NO: 94079 - DNA, 33 bp, Artificial Sequence
  Description of Artificial Sequence: Synthetic oligonucleotide
caagatgacaagtaacatgctcgcctttctggg

SEQ ID NO: 94080 - DNA, 33 bp, Artificial Sequence
  Description of Artificial Sequence: Synthetic oligonucleotide
aagatgacaagtaacatgctcgcctttctgggg

SEQ ID NO: 94081 - DNA, 32 bp, Artificial Sequence
  Description of Artificial Sequence: Synthetic oligonucleotide
agatgacaagtaacatgctcgcctttctgggg

SEQ ID NO: 94082 - DNA, 31 bp, Artificial Sequence
  Description of Artificial Sequence: Synthetic oligonucleotide
gatgacaagtaacatgctcgcctttctgggg

SEQ ID NO: 94083 - DNA, 31 bp, Artificial Sequence
  Description of Artificial Sequence: Synthetic oligonucleotide
atgacaagtaacatgctcgcctttctggggg

SEQ ID NO: 94084 - DNA, 30 bp, Artificial Sequence
  Description of Artificial Sequence: Synthetic oligonucleotide
tgacaagtaacatgctcgcctttctggggg

SEQ ID NO: 94085 - DNA, 29 bp, Artificial Sequence
  Description of Artificial Sequence: Synthetic oligonucleotide
gacaagtaacatgctcgcctttctggggg

SEQ ID NO: 94086 - DNA, 34 bp, Artificial Sequence
  Description of Artificial Sequence: Synthetic oligonucleotide
acaagtaacatgctcgcctttctgggggaaaatg

SEQ ID NO: 94087 - DNA, 33 bp, Artificial Sequence
  Description of Artificial Sequence: Synthetic oligonucleotide
caagtaacatgctcgcctttctgggggaaaatg

SEQ ID NO: 94088 - DNA, 33 bp, Artificial Sequence
  Description of Artificial Sequence: Synthetic oligonucleotide
aagtaacatgctcgcctttctgggggaaaatgc

SEQ ID NO: 94089 - DNA, 32 bp, Artificial Sequence
  Description of Artificial Sequence: Synthetic oligonucleotide
agtaacatgctcgcctttctgggggaaaatgc

SEQ ID NO: 94090 - DNA, 31 bp, Artificial Sequence
  Description of Artificial Sequence: Synthetic oligonucleotide
gtaacatgctcgcctttctgggggaaaatgc

SEQ ID NO: 94091 - DNA, 32 bp, Artificial Sequence
  Description of Artificial Sequence: Synthetic oligonucleotide
taacatgctcgcctttctgggggaaaatgcag

SEQ ID NO: 94092 - DNA, 31 bp, Artificial Sequence
  Description of Artificial Sequence: Synthetic oligonucleotide
aacatgctcgcctttctgggggaaaatgcag

SEQ ID NO: 94093 - DNA, 30 bp, Artificial Sequence
  Description of Artificial Sequence: Synthetic oligonucleotide
acatgctcgcctttctgggggaaaatgcag

SEQ ID NO: 94094 - DNA, 29 bp, Artificial Sequence
  Description of Artificial Sequence: Synthetic oligonucleotide
catgctcgcctttctgggggaaaatgcag

SEQ ID NO: 94095 - DNA, 30 bp, Artificial Sequence
  Description of Artificial Sequence: Synthetic oligonucleotide
atgctcgcctttctgggggaaaatgcagag

SEQ ID NO: 94096 - DNA, 29 bp, Artificial Sequence
  Description of Artificial Sequence: Synthetic oligonucleotide
tgctcgcctttctgggggaaaatgcagag

SEQ ID NO: 94097 - DNA, 28 bp, Artificial Sequence
  Description of Artificial Sequence: Synthetic oligonucleotide
gctcgcctttctgggggaaaatgcagag

SEQ ID NO: 94098 - DNA, 28 bp, Artificial Sequence
  Description of Artificial Sequence: Synthetic oligonucleotide
ctcgcctttctgggggaaaatgcagagg

SEQ ID NO: 94099 - DNA, 29 bp, Artificial Sequence
  Description of Artificial Sequence: Synthetic oligonucleotide
tcgcctttctgggggaaaatgcagaggtc

SEQ ID NO: 94100 - DNA, 28 bp, Artificial Sequence
  Description of Artificial Sequence: Synthetic oligonucleotide
cgcctttctgggggaaaatgcagaggtc

SEQ ID NO: 94101 - DNA, 31 bp, Artificial Sequence
  Description of Artificial Sequence: Synthetic oligonucleotide
gcctttctgggggaaaatgcagaggtcaaag

SEQ ID NO: 94102 - DNA, 32 bp, Artificial Sequence
  Description of Artificial Sequence: Synthetic oligonucleotide
cctttctgggggaaaatgcagaggtcaaagag

SEQ ID NO: 94103 - DNA, 34 bp, Artificial Sequence
  Description of Artificial Sequence: Synthetic oligonucleotide
ctttctgggggaaaatgcagaggtcaaagagatg

SEQ ID NO: 94104 - DNA, 36 bp, Artificial Sequence
  Description of Artificial Sequence: Synthetic oligonucleotide
tttctgggggaaaatgcagaggtcaaagagatgatg

SEQ ID NO: 94105 - DNA, 35 bp, Artificial Sequence
  Description of Artificial Sequence: Synthetic oligonucleotide
ttctgggggaaaatgcagaggtcaaagagatgatg

SEQ ID NO: 94106 - DNA, 34 bp, Artificial Sequence
  Description of Artificial Sequence: Synthetic oligonucleotide
tctgggggaaaatgcagaggtcaaagagatgatg

SEQ ID NO: 94107 - DNA, 33 bp, Artificial Sequence
  Description of Artificial Sequence: Synthetic oligonucleotide
ctgggggaaaatgcagaggtcaaagagatgatg

SEQ ID NO: 94108 - DNA, 34 bp, Artificial Sequence
  Description of Artificial Sequence: Synthetic oligonucleotide
tgggggaaaatgcagaggtcaaagagatgatgac

SEQ ID NO: 94109 - DNA, 33 bp, Artificial Sequence
  Description of Artificial Sequence: Synthetic oligonucleotide
gggggaaaatgcagaggtcaaagagatgatgac

SEQ ID NO: 94110 - DNA, 35 bp, Artificial Sequence
  Description of Artificial Sequence: Synthetic oligonucleotide
ggggaaaatgcagaggtcaaagagatgatgactac

SEQ ID NO: 94111 - DNA, 37 bp, Artificial Sequence
  Description of Artificial Sequence: Synthetic oligonucleotide
gggaaaatgcagaggtcaaagagatgatgactacatg

SEQ ID NO: 94112 - DNA, 37 bp, Artificial Sequence
  Description of Artificial Sequence: Synthetic oligonucleotide
ggaaaatgcagaggtcaaagagatgatgactacatgg

SEQ ID NO: 94113 - DNA, 38 bp, Artificial Sequence
  Description of Artificial Sequence: Synthetic oligonucleotide
gaaaatgcagaggtcaaagagatgatgactacatggac

SEQ ID NO: 94114 - DNA, 39 bp, Artificial Sequence
  Description of Artificial Sequence: Synthetic oligonucleotide
aaaatgcagaggtcaaagagatgatgactacatggactc

SEQ ID NO: 94115 - DNA, 38 bp, Artificial Sequence
  Description of Artificial Sequence: Synthetic oligonucleotide
aaatgcagaggtcaaagagatgatgactacatggactc

SEQ ID NO: 94116 - DNA, 37 bp, Artificial Sequence
  Description of Artificial Sequence: Synthetic oligonucleotide
aatgcagaggtcaaagagatgatgactacatggactc

SEQ ID NO: 94117 - DNA, 36 bp, Artificial Sequence
  Description of Artificial Sequence: Synthetic oligonucleotide
atgcagaggtcaaagagatgatgactacatggactc

SEQ ID NO: 94118 - DNA, 35 bp, Artificial Sequence
  Description of Artificial Sequence: Synthetic oligonucleotide
tgcagaggtcaaagagatgatgactacatggactc

SEQ ID NO: 94119 - DNA, 34 bp, Artificial Sequence
  Description of Artificial Sequence: Synthetic oligonucleotide
gcagaggtcaaagagatgatgactacatggactc

SEQ ID NO: 94120 - DNA, 35 bp, Artificial Sequence
  Description of Artificial Sequence: Synthetic oligonucleotide
cagaggtcaaagagatgatgactacatggactctc

SEQ ID NO: 94121 - DNA, 35 bp, Artificial Sequence
  Description of Artificial Sequence: Synthetic oligonucleotide
agaggtcaaagagatgatgactacatggactctcc

SEQ ID NO: 94122 - DNA, 34 bp, Artificial Sequence
  Description of Artificial Sequence: Synthetic oligonucleotide
gaggtcaaagagatgatgactacatggactctcc

SEQ ID NO: 94123 - DNA, 35 bp, Artificial Sequence
  Description of Artificial Sequence: Synthetic oligonucleotide
aggtcaaagagatgatgactacatggactctccag

SEQ ID NO: 94124 - DNA, 34 bp, Artificial Sequence
  Description of Artificial Sequence: Synthetic oligonucleotide
ggtcaaagagatgatgactacatggactctccag

SEQ ID NO: 94125 - DNA, 37 bp, Artificial Sequence
  Description of Artificial Sequence: Synthetic oligonucleotide
gtcaaagagatgatgactacatggactctccagaaag

SEQ ID NO: 94126 - DNA, 37 bp, Artificial Sequence
  Description of Artificial Sequence: Synthetic oligonucleotide
tcaaagagatgatgactacatggactctccagaaagg

SEQ ID NO: 94127 - DNA, 36 bp, Artificial Sequence
  Description of Artificial Sequence: Synthetic oligonucleotide
caaagagatgatgactacatggactctccagaaagg

SEQ ID NO: 94128 - DNA, 39 bp, Artificial Sequence
  Description of Artificial Sequence: Synthetic oligonucleotide
aaagagatgatgactacatggactctccagaaaggaatc

SEQ ID NO: 94129 - DNA, 38 bp, Artificial Sequence
  Description of Artificial Sequence: Synthetic oligonucleotide
aagagatgatgactacatggactctccagaaaggaatc

SEQ ID NO: 94130 - DNA, 37 bp, Artificial Sequence
  Description of Artificial Sequence: Synthetic oligonucleotide
agagatgatgactacatggactctccagaaaggaatc

SEQ ID NO: 94131 - DNA, 36 bp, Artificial Sequence
  Description of Artificial Sequence: Synthetic oligonucleotide
gagatgatgactacatggactctccagaaaggaatc

SEQ ID NO: 94132 - DNA, 36 bp, Artificial Sequence
  Description of Artificial Sequence: Synthetic oligonucleotide
agatgatgactacatggactctccagaaaggaatcc

SEQ ID NO: 94133 - DNA, 35 bp, Artificial Sequence
  Description of Artificial Sequence: Synthetic oligonucleotide
gatgatgactacatggactctccagaaaggaatcc

SEQ ID NO: 94134 - DNA, 35 bp, Artificial Sequence
  Description of Artificial Sequence: Synthetic oligonucleotide
atgatgactacatggactctccagaaaggaatccc

SEQ ID NO: 94135 - DNA, 34 bp, Artificial Sequence
  Description of Artificial Sequence: Synthetic oligonucleotide
tgatgactacatggactctccagaaaggaatccc

SEQ ID NO: 94136 - DNA, 33 bp, Artificial Sequence
  Description of Artificial Sequence: Synthetic oligonucleotide
gatgactacatggactctccagaaaggaatccc

SEQ ID NO: 94137 - DNA, 33 bp, Artificial Sequence
  Description of Artificial Sequence: Synthetic oligonucleotide
atgactacatggactctccagaaaggaatcccc

SEQ ID NO: 94138 - DNA, 32 bp, Artificial Sequence
  Description of Artificial Sequence: Synthetic oligonucleotide
tgactacatggactctccagaaaggaatcccc

SEQ ID NO: 94139 - DNA, 31 bp, Artificial Sequence
  Description of Artificial Sequence: Synthetic oligonucleotide
gactacatggactctccagaaaggaatcccc

SEQ ID NO: 94140 - DNA, 31 bp, Artificial Sequence
  Description of Artificial Sequence: Synthetic oligonucleotide
actacatggactctccagaaaggaatccccc

SEQ ID NO: 94141 - DNA, 30 bp, Artificial Sequence
  Description of Artificial Sequence: Synthetic oligonucleotide
ctacatggactctccagaaaggaatccccc

SEQ ID NO: 94142 - DNA, 31 bp, Artificial Sequence
  Description of Artificial Sequence: Synthetic oligonucleotide
tacatggactctccagaaaggaatccccctg

SEQ ID NO: 94143 - DNA, 30 bp, Artificial Sequence
  Description of Artificial Sequence: Synthetic oligonucleotide
acatggactctccagaaaggaatccccctg

SEQ ID NO: 94144 - DNA, 29 bp, Artificial Sequence
  Description of Artificial Sequence: Synthetic oligonucleotide
catggactctccagaaaggaatccccctg

SEQ ID NO: 94145 - DNA, 29 bp, Artificial Sequence
  Description of Artificial Sequence: Synthetic oligonucleotide
atggactctccagaaaggaatccccctgc

SEQ ID NO: 94146 - DNA, 28 bp, Artificial Sequence
  Description of Artificial Sequence: Synthetic oligonucleotide
tggactctccagaaaggaatccccctgc

SEQ ID NO: 94147 - DNA, 27 bp, Artificial Sequence
  Description of Artificial Sequence: Synthetic oligonucleotide
ggactctccagaaaggaatccccctgc

SEQ ID NO: 94148 - DNA, 28 bp, Artificial Sequence
  Description of Artificial Sequence: Synthetic oligonucleotide
gactctccagaaaggaatccccctgctg

SEQ ID NO: 94149 - DNA, 28 bp, Artificial Sequence
  Description of Artificial Sequence: Synthetic oligonucleotide
actctccagaaaggaatccccctgctgg

SEQ ID NO: 94150 - DNA, 27 bp, Artificial Sequence
  Description of Artificial Sequence: Synthetic oligonucleotide
ctctccagaaaggaatccccctgctgg

SEQ ID NO: 94151 - DNA, 28 bp, Artificial Sequence
  Description of Artificial Sequence: Synthetic oligonucleotide
tctccagaaaggaatccccctgctggtg

SEQ ID NO: 94152 - DNA, 27 bp, Artificial Sequence
  Description of Artificial Sequence: Synthetic oligonucleotide
ctccagaaaggaatccccctgctggtg

SEQ ID NO: 94153 - DNA, 27 bp, Artificial Sequence
  Description of Artificial Sequence: Synthetic oligonucleotide
tccagaaaggaatccccctgctggtgg

SEQ ID NO: 94154 - DNA, 27 bp, Artificial Sequence
  Description of Artificial Sequence: Synthetic oligonucleotide
ccagaaaggaatccccctgctggtggt

SEQ ID NO: 94155 - DNA, 31 bp, Artificial Sequence
  Description of Artificial Sequence: Synthetic oligonucleotide
cagaaaggaatccccctgctggtggttaaac

SEQ ID NO: 94156 - DNA, 33 bp, Artificial Sequence
  Description of Artificial Sequence: Synthetic oligonucleotide
agaaaggaatccccctgctggtggttaaacaag

SEQ ID NO: 94157 - DNA, 32 bp, Artificial Sequence
  Description of Artificial Sequence: Synthetic oligonucleotide
gaaaggaatccccctgctggtggttaaacaag

SEQ ID NO: 94158 - DNA, 33 bp, Artificial Sequence
  Description of Artificial Sequence: Synthetic oligonucleotide
aaaggaatccccctgctggtggttaaacaagac

SEQ ID NO: 94159 - DNA, 32 bp, Artificial Sequence
  Description of Artificial Sequence: Synthetic oligonucleotide
aaggaatccccctgctggtggttaaacaagac

SEQ ID NO: 94160 - DNA, 31 bp, Artificial Sequence
  Description of Artificial Sequence: Synthetic oligonucleotide
aggaatccccctgctggtggttaaacaagac

SEQ ID NO: 94161 - DNA, 30 bp, Artificial Sequence
  Description of Artificial Sequence: Synthetic oligonucleotide
ggaatccccctgctggtggttaaacaagac

SEQ ID NO: 94162 - DNA, 30 bp, Artificial Sequence
  Description of Artificial Sequence: Synthetic oligonucleotide
gaatccccctgctggtggttaaacaagacg

SEQ ID NO: 94163 - DNA, 30 bp, Artificial Sequence
  Description of Artificial Sequence: Synthetic oligonucleotide
aatccccctgctggtggttaaacaagacgg

SEQ ID NO: 94164 - DNA, 29 bp, Artificial Sequence
  Description of Artificial Sequence: Synthetic oligonucleotide
atccccctgctggtggttaaacaagacgg

SEQ ID NO: 94165 - DNA, 28 bp, Artificial Sequence
  Description of Artificial Sequence: Synthetic oligonucleotide
tccccctgctggtggttaaacaagacgg

SEQ ID NO: 94166 - DNA, 27 bp, Artificial Sequence
  Description of Artificial Sequence: Synthetic oligonucleotide
ccccctgctggtggttaaacaagacgg

SEQ ID NO: 94167 - DNA, 27 bp, Artificial Sequence
  Description of Artificial Sequence: Synthetic oligonucleotide
cccctgctggtggttaaacaagacggg

SEQ ID NO: 94168 - DNA, 28 bp, Artificial Sequence
  Description of Artificial Sequence: Synthetic oligonucleotide
ccctgctggtggttaaacaagacgggtg

SEQ ID NO: 94169 - DNA, 30 bp, Artificial Sequence
  Description of Artificial Sequence: Synthetic oligonucleotide
cctgctggtggttaaacaagacgggtgttc

SEQ ID NO: 94170 - DNA, 31 bp, Artificial Sequence
  Description of Artificial Sequence: Synthetic oligonucleotide
ctgctggtggttaaacaagacgggtgttcac

SEQ ID NO: 94171 - DNA, 32 bp, Artificial Sequence
  Description of Artificial Sequence: Synthetic oligonucleotide
tgctggtggttaaacaagacgggtgttcactc

SEQ ID NO: 94172 - DNA, 31 bp, Artificial Sequence
  Description of Artificial Sequence: Synthetic oligonucleotide
gctggtggttaaacaagacgggtgttcactc

SEQ ID NO: 94173 - DNA, 31 bp, Artificial Sequence
  Description of Artificial Sequence: Synthetic oligonucleotide
ctggtggttaaacaagacgggtgttcactcc

SEQ ID NO: 94174 - DNA, 31 bp, Artificial Sequence
  Description of Artificial Sequence: Synthetic oligonucleotide
tggtggttaaacaagacgggtgttcactccg

SEQ ID NO: 94175 - DNA, 30 bp, Artificial Sequence
  Description of Artificial Sequence: Synthetic oligonucleotide
ggtggttaaacaagacgggtgttcactccg

SEQ ID NO: 94176 - DNA, 31 bp, Artificial Sequence
  Description of Artificial Sequence: Synthetic oligonucleotide
gtggttaaacaagacgggtgttcactccgac

SEQ ID NO: 94177 - DNA, 32 bp, Artificial Sequence
  Description of Artificial Sequence: Synthetic oligonucleotide
tggttaaacaagacgggtgttcactccgactg

SEQ ID NO: 94178 - DNA, 31 bp, Artificial Sequence
  Description of Artificial Sequence: Synthetic oligonucleotide
ggttaaacaagacgggtgttcactccgactg

SEQ ID NO: 94179 - DNA, 31 bp, Artificial Sequence
  Description of Artificial Sequence: Synthetic oligonucleotide
gttaaacaagacgggtgttcactccgactgc

SEQ ID NO: 94180 - DNA, 33 bp, Artificial Sequence
  Description of Artificial Sequence: Synthetic oligonucleotide
ttaaacaagacgggtgttcactccgactgcaac

SEQ ID NO: 94181 - DNA, 32 bp, Artificial Sequence
  Description of Artificial Sequence: Synthetic oligonucleotide
taaacaagacgggtgttcactccgactgcaac

SEQ ID NO: 94182 - DNA, 31 bp, Artificial Sequence
  Description of Artificial Sequence: Synthetic oligonucleotide
aaacaagacgggtgttcactccgactgcaac

SEQ ID NO: 94183 - DNA, 30 bp, Artificial Sequence
  Description of Artificial Sequence: Synthetic oligonucleotide
aacaagacgggtgttcactccgactgcaac

SEQ ID NO: 94184 - DNA, 29 bp, Artificial Sequence
  Description of Artificial Sequence: Synthetic oligonucleotide
acaagacgggtgttcactccgactgcaac

SEQ ID NO: 94185 - DNA, 28 bp, Artificial Sequence
  Description of Artificial Sequence: Synthetic oligonucleotide
caagacgggtgttcactccgactgcaac

SEQ ID NO: 94186 - DNA, 29 bp, Artificial Sequence
  Description of Artificial Sequence: Synthetic oligonucleotide
aagacgggtgttcactccgactgcaacag

SEQ ID NO: 94187 - DNA, 28 bp, Artificial Sequence
  Description of Artificial Sequence: Synthetic oligonucleotide
agacgggtgttcactccgactgcaacag

SEQ ID NO: 94188 - DNA, 27 bp, Artificial Sequence
  Description of Artificial Sequence: Synthetic oligonucleotide
gacgggtgttcactccgactgcaacag

SEQ ID NO: 94189 - DNA, 27 bp, Artificial Sequence
  Description of Artificial Sequence: Synthetic oligonucleotide
acgggtgttcactccgactgcaacagg

SEQ ID NO: 94190 - DNA, 27 bp, Artificial Sequence
  Description of Artificial Sequence: Synthetic oligonucleotide
cgggtgttcactccgactgcaacagga

SEQ ID NO: 94191 - DNA, 27 bp, Artificial Sequence
  Description of Artificial Sequence: Synthetic oligonucleotide
gggtgttcactccgactgcaacaggag

SEQ ID NO: 94192 - DNA, 27 bp, Artificial Sequence
  Description of Artificial Sequence: Synthetic oligonucleotide
ggtgttcactccgactgcaacaggagc

SEQ ID NO: 94193 - DNA, 27 bp, Artificial Sequence
  Description of Artificial Sequence: Synthetic oligonucleotide
gtgttcactccgactgcaacaggagcg

SEQ ID NO: 94194 - DNA, 27 bp, Artificial Sequence
  Description of Artificial Sequence: Synthetic oligonucleotide
tgttcactccgactgcaacaggagcgc

SEQ ID NO: 94195 - DNA, 27 bp, Artificial Sequence
  Description of Artificial Sequence: Synthetic oligonucleotide
gttcactccgactgcaacaggagcgct

SEQ ID NO: 94196 - DNA, 28 bp, Artificial Sequence
  Description of Artificial Sequence: Synthetic oligonucleotide
ttcactccgactgcaacaggagcgcttc

SEQ ID NO: 94197 - DNA, 27 bp, Artificial Sequence
  Description of Artificial Sequence: Synthetic oligonucleotide
tcactccgactgcaacaggagcgcttc

SEQ ID NO: 94198 - DNA, 26 bp, Artificial Sequence
  Description of Artificial Sequence: Synthetic oligonucleotide
cactccgactgcaacaggagcgcttc

SEQ ID NO: 94199 - DNA, 27 bp, Artificial Sequence
  Description of Artificial Sequence: Synthetic oligonucleotide
actccgactgcaacaggagcgcttcct

SEQ ID NO: 94200 - DNA, 26 bp, Artificial Sequence
  Description of Artificial Sequence: Synthetic oligonucleotide
ctccgactgcaacaggagcgcttcct

SEQ ID NO: 94201 - DNA, 26 bp, Artificial Sequence
  Description of Artificial Sequence: Synthetic oligonucleotide
tccgactgcaacaggagcgcttcctc

SEQ ID NO: 94202 - DNA, 25 bp, Artificial Sequence
  Description of Artificial Sequence: Synthetic oligonucleotide
ccgactgcaacaggagcgcttcctc

SEQ ID NO: 94203 - DNA, 26 bp, Artificial Sequence
  Description of Artificial Sequence: Synthetic oligonucleotide
cgactgcaacaggagcgcttcctcca

SEQ ID NO: 94204 - DNA, 26 bp, Artificial Sequence
  Description of Artificial Sequence: Synthetic oligonucleotide
gactgcaacaggagcgcttcctccag

SEQ ID NO: 94205 - DNA, 26 bp, Artificial Sequence
  Description of Artificial Sequence: Synthetic oligonucleotide
actgcaacaggagcgcttcctccagg

SEQ ID NO: 94206 - DNA, 25 bp, Artificial Sequence
  Description of Artificial Sequence: Synthetic oligonucleotide
ctgcaacaggagcgcttcctccagg

SEQ ID NO: 94207 - DNA, 25 bp, Artificial Sequence
  Description of Artificial Sequence: Synthetic oligonucleotide
tgcaacaggagcgcttcctccaggg

SEQ ID NO: 94208 - DNA, 24 bp, Artificial Sequence
  Description of Artificial Sequence: Synthetic oligonucleotide
gcaacaggagcgcttcctccaggg

SEQ ID NO: 94209 - DNA, 24 bp, Artificial Sequence
  Description of Artificial Sequence: Synthetic oligonucleotide
caacaggagcgcttcctccagggg

SEQ ID NO: 94210 - DNA, 27 bp, Artificial Sequence
  Description of Artificial Sequence: Synthetic oligonucleotide
aacaggagcgcttcctccagggggttt

SEQ ID NO: 94211 - DNA, 27 bp, Artificial Sequence
  Description of Artificial Sequence: Synthetic oligonucleotide
acaggagcgcttcctccagggggtttt

SEQ ID NO: 94212 - DNA, 26 bp, Artificial Sequence
  Description of Artificial Sequence: Synthetic oligonucleotide
caggagcgcttcctccagggggtttt

SEQ ID NO: 94213 - DNA, 26 bp, Artificial Sequence
  Description of Artificial Sequence: Synthetic oligonucleotide
aggagcgcttcctccagggggttttc

SEQ ID NO: 94214 - DNA, 25 bp, Artificial Sequence
  Description of Artificial Sequence: Synthetic oligonucleotide
ggagcgcttcctccagggggttttc

SEQ ID NO: 94215 - DNA, 26 bp, Artificial Sequence
  Description of Artificial Sequence: Synthetic oligonucleotide
gagcgcttcctccagggggttttcca

SEQ ID NO: 94216 - DNA, 26 bp, Artificial Sequence
  Description of Artificial Sequence: Synthetic oligonucleotide
agcgcttcctccagggggttttccag

SEQ ID NO: 94217 - DNA, 25 bp, Artificial Sequence
  Description of Artificial Sequence: Synthetic oligonucleotide
gcgcttcctccagggggttttccag

SEQ ID NO: 94218 - DNA, 27 bp, Artificial Sequence
  Description of Artificial Sequence: Synthetic oligonucleotide
cgcttcctccagggggttttccaggaa

SEQ ID NO: 94219 - DNA, 27 bp, Artificial Sequence
  Description of Artificial Sequence: Synthetic oligonucleotide
gcttcctccagggggttttccaggaag

SEQ ID NO: 94220 - DNA, 28 bp, Artificial Sequence
  Description of Artificial Sequence: Synthetic oligonucleotide
cttcctccagggggttttccaggaagac

SEQ ID NO: 94221 - DNA, 28 bp, Artificial Sequence
  Description of Artificial Sequence: Synthetic oligonucleotide
ttcctccagggggttttccaggaagacc

SEQ ID NO: 94222 - DNA, 27 bp, Artificial Sequence
  Description of Artificial Sequence: Synthetic oligonucleotide
tcctccagggggttttccaggaagacc

SEQ ID NO: 94223 - DNA, 26 bp, Artificial Sequence
  Description of Artificial Sequence: Synthetic oligonucleotide
cctccagggggttttccaggaagacc

SEQ ID NO: 94224 - DNA, 27 bp, Artificial Sequence
  Description of Artificial Sequence: Synthetic oligonucleotide
ctccagggggttttccaggaagaccct

SEQ ID NO: 94225 - DNA, 27 bp, Artificial Sequence
  Description of Artificial Sequence: Synthetic oligonucleotide
tccagggggttttccaggaagaccctg

SEQ ID NO: 94226 - DNA, 27 bp, Artificial Sequence
  Description of Artificial Sequence: Synthetic oligonucleotide
ccagggggttttccaggaagaccctga

SEQ ID NO: 94227 - DNA, 29 bp, Artificial Sequence
  Description of Artificial Sequence: Synthetic oligonucleotide
cagggggttttccaggaagaccctgaatg

SEQ ID NO: 94228 - DNA, 29 bp, Artificial Sequence
  Description of Artificial Sequence: Synthetic oligonucleotide
agggggttttccaggaagaccctgaatgg

SEQ ID NO: 94229 - DNA, 28 bp, Artificial Sequence
  Description of Artificial Sequence: Synthetic oligonucleotide
gggggttttccaggaagaccctgaatgg

SEQ ID NO: 94230 - DNA, 29 bp, Artificial Sequence
  Description of Artificial Sequence: Synthetic oligonucleotide
ggggttttccaggaagaccctgaatggag

SEQ ID NO: 94231 - DNA, 29 bp, Artificial Sequence
  Description of Artificial Sequence: Synthetic oligonucleotide
gggttttccaggaagaccctgaatggagg

SEQ ID NO: 94232 - DNA, 29 bp, Artificial Sequence
  Description of Artificial Sequence: Synthetic oligonucleotide
ggttttccaggaagaccctgaatggaggg

SEQ ID NO: 94233 - DNA, 29 bp, Artificial Sequence
  Description of Artificial Sequence: Synthetic oligonucleotide
gttttccaggaagaccctgaatggagggc

SEQ ID NO: 94234 - DNA, 29 bp, Artificial Sequence
  Description of Artificial Sequence: Synthetic oligonucleotide
ttttccaggaagaccctgaatggagggcc

SEQ ID NO: 94235 - DNA, 28 bp, Artificial Sequence
  Description of Artificial Sequence: Synthetic oligonucleotide
tttccaggaagaccctgaatggagggcc

SEQ ID NO: 94236 - DNA, 27 bp, Artificial Sequence
  Description of Artificial Sequence: Synthetic oligonucleotide
ttccaggaagaccctgaatggagggcc

SEQ ID NO: 94237 - DNA, 26 bp, Artificial Sequence
  Description of Artificial Sequence: Synthetic oligonucleotide
tccaggaagaccctgaatggagggcc

SEQ ID NO: 94238 - DNA, 25 bp, Artificial Sequence
  Description of Artificial Sequence: Synthetic oligonucleotide
ccaggaagaccctgaatggagggcc

SEQ ID NO: 94239 - DNA, 26 bp, Artificial Sequence
  Description of Artificial Sequence: Synthetic oligonucleotide
caggaagaccctgaatggagggccct

SEQ ID NO: 94240 - DNA, 26 bp, Artificial Sequence
  Description of Artificial Sequence: Synthetic oligonucleotide
aggaagaccctgaatggagggccctg

SEQ ID NO: 94241 - DNA, 25 bp, Artificial Sequence
  Description of Artificial Sequence: Synthetic oligonucleotide
ggaagaccctgaatggagggccctg

SEQ ID NO: 94242 - DNA, 26 bp, Artificial Sequence
  Description of Artificial Sequence: Synthetic oligonucleotide
gaagaccctgaatggagggccctgca

SEQ ID NO: 94243 - DNA, 26 bp, Artificial Sequence
  Description of Artificial Sequence: Synthetic oligonucleotide
aagaccctgaatggagggccctgcag

SEQ ID NO: 94244 - DNA, 25 bp, Artificial Sequence
  Description of Artificial Sequence: Synthetic oligonucleotide
agaccctgaatggagggccctgcag

SEQ ID NO: 94245 - DNA, 24 bp, Artificial Sequence
  Description of Artificial Sequence: Synthetic oligonucleotide
gaccctgaatggagggccctgcag

SEQ ID NO: 94246 - DNA, 25 bp, Artificial Sequence
  Description of Artificial Sequence: Synthetic oligonucleotide
accctgaatggagggccctgcagga

SEQ ID NO: 94247 - DNA, 24 bp, Artificial Sequence
  Description of Artificial Sequence: Synthetic oligonucleotide
ccctgaatggagggccctgcagga

SEQ ID NO: 94248 - DNA, 25 bp, Artificial Sequence
  Description of Artificial Sequence: Synthetic oligonucleotide
cctgaatggagggccctgcaggaga

SEQ ID NO: 94249 - DNA, 25 bp, Artificial Sequence
  Description of Artificial Sequence: Synthetic oligonucleotide
ctgaatggagggccctgcaggagag

SEQ ID NO: 94250 - DNA, 27 bp, Artificial Sequence
  Description of Artificial Sequence: Synthetic oligonucleotide
tgaatggagggccctgcaggagaggta

SEQ ID NO: 94251 - DNA, 26 bp, Artificial Sequence
  Description of Artificial Sequence: Synthetic oligonucleotide
gaatggagggccctgcaggagaggta

SEQ ID NO: 94252 - DNA, 26 bp, Artificial Sequence
  Description of Artificial Sequence: Synthetic oligonucleotide
aatggagggccctgcaggagaggtac

SEQ ID NO: 94253 - DNA, 25 bp, Artificial Sequence
  Description of Artificial Sequence: Synthetic oligonucleotide
atggagggccctgcaggagaggtac

SEQ ID NO: 94254 - DNA, 24 bp, Artificial Sequence
  Description of Artificial Sequence: Synthetic oligonucleotide
tggagggccctgcaggagaggtac

SEQ ID NO: 94255 - DNA, 23 bp, Artificial Sequence
  Description of Artificial Sequence: Synthetic oligonucleotide
ggagggccctgcaggagaggtac

SEQ ID NO: 94256 - DNA, 24 bp, Artificial Sequence
  Description of Artificial Sequence: Synthetic oligonucleotide
gagggccctgcaggagaggtacct

SEQ ID NO: 94257 - DNA, 25 bp, Artificial Sequence
  Description of Artificial Sequence: Synthetic oligonucleotide
agggccctgcaggagaggtacctgt

SEQ ID NO: 94258 - DNA, 24 bp, Artificial Sequence
  Description of Artificial Sequence: Synthetic oligonucleotide
gggccctgcaggagaggtacctgt

SEQ ID NO: 94259 - DNA, 24 bp, Artificial Sequence
  Description of Artificial Sequence: Synthetic oligonucleotide
ggccctgcaggagaggtacctgtg

SEQ ID NO: 94260 - DNA, 24 bp, Artificial Sequence
  Description of Artificial Sequence: Synthetic oligonucleotide
gccctgcaggagaggtacctgtgg

SEQ ID NO: 94261 - DNA, 27 bp, Artificial Sequence
  Description of Artificial Sequence: Synthetic oligonucleotide
ccctgcaggagaggtacctgtggcata

SEQ ID NO: 94262 - DNA, 28 bp, Artificial Sequence
  Description of Artificial Sequence: Synthetic oligonucleotide
cctgcaggagaggtacctgtggcatatc

SEQ ID NO: 94263 - DNA, 28 bp, Artificial Sequence
  Description of Artificial Sequence: Synthetic oligonucleotide
ctgcaggagaggtacctgtggcatatcc

SEQ ID NO: 94264 - DNA, 28 bp, Artificial Sequence
  Description of Artificial Sequence: Synthetic oligonucleotide
tgcaggagaggtacctgtggcatatccc

SEQ ID NO: 94265 - DNA, 27 bp, Artificial Sequence
  Description of Artificial Sequence: Synthetic oligonucleotide
gcaggagaggtacctgtggcatatccc

SEQ ID NO: 94266 - DNA, 30 bp, Artificial Sequence
  Description of Artificial Sequence: Synthetic oligonucleotide
caggagaggtacctgtggcatatcccattg

SEQ ID NO: 94267 - DNA, 31 bp, Artificial Sequence
  Description of Artificial Sequence: Synthetic oligonucleotide
aggagaggtacctgtggcatatcccattgac

SEQ ID NO: 94268 - DNA, 30 bp, Artificial Sequence
  Description of Artificial Sequence: Synthetic oligonucleotide
ggagaggtacctgtggcatatcccattgac

SEQ ID NO: 94269 - DNA, 30 bp, Artificial Sequence
  Description of Artificial Sequence: Synthetic oligonucleotide
gagaggtacctgtggcatatcccattgacc

SEQ ID NO: 94270 - DNA, 32 bp, Artificial Sequence
  Description of Artificial Sequence: Synthetic oligonucleotide
agaggtacctgtggcatatcccattgacctac

SEQ ID NO: 94271 - DNA, 31 bp, Artificial Sequence
  Description of Artificial Sequence: Synthetic oligonucleotide
gaggtacctgtggcatatcccattgacctac

SEQ ID NO: 94272 - DNA, 32 bp, Artificial Sequence
  Description of Artificial Sequence: Synthetic oligonucleotide
aggtacctgtggcatatcccattgacctactc

SEQ ID NO: 94273 - DNA, 31 bp, Artificial Sequence
  Description of Artificial Sequence: Synthetic oligonucleotide
ggtacctgtggcatatcccattgacctactc

SEQ ID NO: 94274 - DNA, 31 bp, Artificial Sequence
  Description of Artificial Sequence: Synthetic oligonucleotide
gtacctgtggcatatcccattgacctactcc

SEQ ID NO: 94275 - DNA, 32 bp, Artificial Sequence
  Description of Artificial Sequence: Synthetic oligonucleotide
tacctgtggcatatcccattgacctactccac

SEQ ID NO: 94276 - DNA, 31 bp, Artificial Sequence
  Description of Artificial Sequence: Synthetic oligonucleotide
acctgtggcatatcccattgacctactccac

SEQ ID NO: 94277 - DNA, 30 bp, Artificial Sequence
  Description of Artificial Sequence: Synthetic oligonucleotide
cctgtggcatatcccattgacctactccac

SEQ ID NO: 94278 - DNA, 30 bp, Artificial Sequence
  Description of Artificial Sequence: Synthetic oligonucleotide
ctgtggcatatcccattgacctactccacg

SEQ ID NO: 94279 - DNA, 31 bp, Artificial Sequence
  Description of Artificial Sequence: Synthetic oligonucleotide
tgtggcatatcccattgacctactccacgag

SEQ ID NO: 94280 - DNA, 30 bp, Artificial Sequence
  Description of Artificial Sequence: Synthetic oligonucleotide
gtggcatatcccattgacctactccacgag

SEQ ID NO: 94281 - DNA, 32 bp, Artificial Sequence
  Description of Artificial Sequence: Synthetic oligonucleotide
tggcatatcccattgacctactccacgagttc

SEQ ID NO: 94282 - DNA, 31 bp, Artificial Sequence
  Description of Artificial Sequence: Synthetic oligonucleotide
ggcatatcccattgacctactccacgagttc

SEQ ID NO: 94283 - DNA, 33 bp, Artificial Sequence
  Description of Artificial Sequence: Synthetic oligonucleotide
gcatatcccattgacctactccacgagttcttc

SEQ ID NO: 94284 - DNA, 37 bp, Artificial Sequence
  Description of Artificial Sequence: Synthetic oligonucleotide
catatcccattgacctactccacgagttcttctaatg

SEQ ID NO: 94285 - DNA, 38 bp, Artificial Sequence
  Description of Artificial Sequence: Synthetic oligonucleotide
atatcccattgacctactccacgagttcttctaatgtg

SEQ ID NO: 94286 - DNA, 37 bp, Artificial Sequence
  Description of Artificial Sequence: Synthetic oligonucleotide
tatcccattgacctactccacgagttcttctaatgtg

SEQ ID NO: 94287 - DNA, 36 bp, Artificial Sequence
  Description of Artificial Sequence: Synthetic oligonucleotide
atcccattgacctactccacgagttcttctaatgtg

SEQ ID NO: 94288 - DNA, 35 bp, Artificial Sequence
  Description of Artificial Sequence: Synthetic oligonucleotide
tcccattgacctactccacgagttcttctaatgtg

SEQ ID NO: 94289 - DNA, 34 bp, Artificial Sequence
  Description of Artificial Sequence: Synthetic oligonucleotide
cccattgacctactccacgagttcttctaatgtg

SEQ ID NO: 94290 - DNA, 36 bp, Artificial Sequence
  Description of Artificial Sequence: Synthetic oligonucleotide
ccattgacctactccacgagttcttctaatgtgatc

SEQ ID NO: 94291 - DNA, 36 bp, Artificial Sequence
  Description of Artificial Sequence: Synthetic oligonucleotide
cattgacctactccacgagttcttctaatgtgatcc

SEQ ID NO: 94292 - DNA, 37 bp, Artificial Sequence
  Description of Artificial Sequence: Synthetic oligonucleotide
attgacctactccacgagttcttctaatgtgatccac

SEQ ID NO: 94293 - DNA, 36 bp, Artificial Sequence
  Description of Artificial Sequence: Synthetic oligonucleotide
ttgacctactccacgagttcttctaatgtgatccac

SEQ ID NO: 94294 - DNA, 35 bp, Artificial Sequence
  Description of Artificial Sequence: Synthetic oligonucleotide
tgacctactccacgagttcttctaatgtgatccac

SEQ ID NO: 94295 - DNA, 34 bp, Artificial Sequence
  Description of Artificial Sequence: Synthetic oligonucleotide
gacctactccacgagttcttctaatgtgatccac

SEQ ID NO: 94296 - DNA, 35 bp, Artificial Sequence
  Description of Artificial Sequence: Synthetic oligonucleotide
acctactccacgagttcttctaatgtgatccacag

SEQ ID NO: 94297 - DNA, 34 bp, Artificial Sequence
  Description of Artificial Sequence: Synthetic oligonucleotide
cctactccacgagttcttctaatgtgatccacag

SEQ ID NO: 94298 - DNA, 35 bp, Artificial Sequence
  Description of Artificial Sequence: Synthetic oligonucleotide
ctactccacgagttcttctaatgtgatccacagac

SEQ ID NO: 94299 - DNA, 36 bp, Artificial Sequence
  Description of Artificial Sequence: Synthetic oligonucleotide
tactccacgagttcttctaatgtgatccacagacac

SEQ ID NO: 94300 - DNA, 35 bp, Artificial Sequence
  Description of Artificial Sequence: Synthetic oligonucleotide
actccacgagttcttctaatgtgatccacagacac

SEQ ID NO: 94301 - DNA, 34 bp, Artificial Sequence
  Description of Artificial Sequence: Synthetic oligonucleotide
ctccacgagttcttctaatgtgatccacagacac

SEQ ID NO: 94302 - DNA, 37 bp, Artificial Sequence
  Description of Artificial Sequence: Synthetic oligonucleotide
tccacgagttcttctaatgtgatccacagacacattc

SEQ ID NO: 94303 - DNA, 36 bp, Artificial Sequence
  Description of Artificial Sequence: Synthetic oligonucleotide
ccacgagttcttctaatgtgatccacagacacattc

SEQ ID NO: 94304 - DNA, 42 bp, Artificial Sequence
  Description of Artificial Sequence: Synthetic oligonucleotide
cacgagttcttctaatgtgatccacagacacattctaaaatc

SEQ ID NO: 94305 - DNA, 45 bp, Artificial Sequence
  Description of Artificial Sequence: Synthetic oligonucleotide
acgagttcttctaatgtgatccacagacacattctaaaatcaaag

SEQ ID NO: 94306 - DNA, 44 bp, Artificial Sequence
  Description of Artificial Sequence: Synthetic oligonucleotide
cgagttcttctaatgtgatccacagacacattctaaaatcaaag

SEQ ID NO: 94307 - DNA, 45 bp, Artificial Sequence
  Description of Artificial Sequence: Synthetic oligonucleotide
gagttcttctaatgtgatccacagacacattctaaaatcaaagac

SEQ ID NO: 94308 - DNA, 46 bp, Artificial Sequence
  Description of Artificial Sequence: Synthetic oligonucleotide
agttcttctaatgtgatccacagacacattctaaaatcaaagacag

SEQ ID NO: 94309 - DNA, 45 bp, Artificial Sequence
  Description of Artificial Sequence: Synthetic oligonucleotide
gttcttctaatgtgatccacagacacattctaaaatcaaagacag

SEQ ID NO: 94310 - DNA, 48 bp, Artificial Sequence
  Description of Artificial Sequence: Synthetic oligonucleotide
ttcttctaatgtgatccacagacacattctaaaatcaaagacagatac

SEQ ID NO: 94311 - DNA, 47 bp, Artificial Sequence
  Description of Artificial Sequence: Synthetic oligonucleotide
tcttctaatgtgatccacagacacattctaaaatcaaagacagatac

SEQ ID NO: 94312 - DNA, 46 bp, Artificial Sequence
  Description of Artificial Sequence: Synthetic oligonucleotide
cttctaatgtgatccacagacacattctaaaatcaaagacagatac

SEQ ID NO: 94313 - DNA, 47 bp, Artificial Sequence
  Description of Artificial Sequence: Synthetic oligonucleotide
ttctaatgtgatccacagacacattctaaaatcaaagacagatactc

SEQ ID NO: 94314 - DNA, 46 bp, Artificial Sequence
  Description of Artificial Sequence: Synthetic oligonucleotide
tctaatgtgatccacagacacattctaaaatcaaagacagatactc

SEQ ID NO: 94315 - DNA, 45 bp, Artificial Sequence
  Description of Artificial Sequence: Synthetic oligonucleotide
ctaatgtgatccacagacacattctaaaatcaaagacagatactc

SEQ ID NO: 94316 - DNA, 46 bp, Artificial Sequence
  Description of Artificial Sequence: Synthetic oligonucleotide
taatgtgatccacagacacattctaaaatcaaagacagatactctg

SEQ ID NO: 94317 - DNA, 45 bp, Artificial Sequence
  Description of Artificial Sequence: Synthetic oligonucleotide
aatgtgatccacagacacattctaaaatcaaagacagatactctg

SEQ ID NO: 94318 - DNA, 44 bp, Artificial Sequence
  Description of Artificial Sequence: Synthetic oligonucleotide
atgtgatccacagacacattctaaaatcaaagacagatactctg

SEQ ID NO: 94319 - DNA, 43 bp, Artificial Sequence
  Description of Artificial Sequence: Synthetic oligonucleotide
tgtgatccacagacacattctaaaatcaaagacagatactctg

SEQ ID NO: 94320 - DNA, 42 bp, Artificial Sequence
  Description of Artificial Sequence: Synthetic oligonucleotide
gtgatccacagacacattctaaaatcaaagacagatactctg

SEQ ID NO: 94321 - DNA, 42 bp, Artificial Sequence
  Description of Artificial Sequence: Synthetic oligonucleotide
tgatccacagacacattctaaaatcaaagacagatactctgg

SEQ ID NO: 94322 - DNA, 41 bp, Artificial Sequence
  Description of Artificial Sequence: Synthetic oligonucleotide
gatccacagacacattctaaaatcaaagacagatactctgg

SEQ ID NO: 94323 - DNA, 43 bp, Artificial Sequence
  Description of Artificial Sequence: Synthetic oligonucleotide
atccacagacacattctaaaatcaaagacagatactctggatc

SEQ ID NO: 94324 - DNA, 42 bp, Artificial Sequence
  Description of Artificial Sequence: Synthetic oligonucleotide
tccacagacacattctaaaatcaaagacagatactctggatc

SEQ ID NO: 94325 - DNA, 41 bp, Artificial Sequence
  Description of Artificial Sequence: Synthetic oligonucleotide
ccacagacacattctaaaatcaaagacagatactctggatc

SEQ ID NO: 94326 - DNA, 43 bp, Artificial Sequence
  Description of Artificial Sequence: Synthetic oligonucleotide
cacagacacattctaaaatcaaagacagatactctggatctac

SEQ ID NO: 94327 - DNA, 43 bp, Artificial Sequence
  Description of Artificial Sequence: Synthetic oligonucleotide
acagacacattctaaaatcaaagacagatactctggatctacc

SEQ ID NO: 94328 - DNA, 42 bp, Artificial Sequence
  Description of Artificial Sequence: Synthetic oligonucleotide
cagacacattctaaaatcaaagacagatactctggatctacc

SEQ ID NO: 94329 - DNA, 43 bp, Artificial Sequence
  Description of Artificial Sequence: Synthetic oligonucleotide
agacacattctaaaatcaaagacagatactctggatctacctg

SEQ ID NO: 94330 - DNA, 42 bp, Artificial Sequence
  Description of Artificial Sequence: Synthetic oligonucleotide
gacacattctaaaatcaaagacagatactctggatctacctg

SEQ ID NO: 94331 - DNA, 46 bp, Artificial Sequence
  Description of Artificial Sequence: Synthetic oligonucleotide
acacattctaaaatcaaagacagatactctggatctacctgaaaag

SEQ ID NO: 94332 - DNA, 45 bp, Artificial Sequence
  Description of Artificial Sequence: Synthetic oligonucleotide
cacattctaaaatcaaagacagatactctggatctacctgaaaag

SEQ ID NO: 94333 - DNA, 46 bp, Artificial Sequence
  Description of Artificial Sequence: Synthetic oligonucleotide
acattctaaaatcaaagacagatactctggatctacctgaaaagac

SEQ ID NO: 94334 - DNA, 45 bp, Artificial Sequence
  Description of Artificial Sequence: Synthetic oligonucleotide
cattctaaaatcaaagacagatactctggatctacctgaaaagac

SEQ ID NO: 94335 - DNA, 45 bp, Artificial Sequence
  Description of Artificial Sequence: Synthetic oligonucleotide
attctaaaatcaaagacagatactctggatctacctgaaaagacc

SEQ ID NO: 94336 - DNA, 44 bp, Artificial Sequence
  Description of Artificial Sequence: Synthetic oligonucleotide
ttctaaaatcaaagacagatactctggatctacctgaaaagacc

SEQ ID NO: 94337 - DNA, 43 bp, Artificial Sequence
  Description of Artificial Sequence: Synthetic oligonucleotide
tctaaaatcaaagacagatactctggatctacctgaaaagacc

SEQ ID NO: 94338 - DNA, 42 bp, Artificial Sequence
  Description of Artificial Sequence: Synthetic oligonucleotide
ctaaaatcaaagacagatactctggatctacctgaaaagacc

SEQ ID NO: 94339 - DNA, 43 bp, Artificial Sequence
  Description of Artificial Sequence: Synthetic oligonucleotide
taaaatcaaagacagatactctggatctacctgaaaagaccag

SEQ ID NO: 94340 - DNA, 42 bp, Artificial Sequence
  Description of Artificial Sequence: Synthetic oligonucleotide
aaaatcaaagacagatactctggatctacctgaaaagaccag

SEQ ID NO: 94341 - DNA, 41 bp, Artificial Sequence
  Description of Artificial Sequence: Synthetic oligonucleotide
aaatcaaagacagatactctggatctacctgaaaagaccag

SEQ ID NO: 94342 - DNA, 40 bp, Artificial Sequence
  Description of Artificial Sequence: Synthetic oligonucleotide
aatcaaagacagatactctggatctacctgaaaagaccag

SEQ ID NO: 94343 - DNA, 39 bp, Artificial Sequence
  Description of Artificial Sequence: Synthetic oligonucleotide
atcaaagacagatactctggatctacctgaaaagaccag

SEQ ID NO: 94344 - DNA, 38 bp, Artificial Sequence
  Description of Artificial Sequence: Synthetic oligonucleotide
tcaaagacagatactctggatctacctgaaaagaccag

SEQ ID NO: 94345 - DNA, 37 bp, Artificial Sequence
  Description of Artificial Sequence: Synthetic oligonucleotide
caaagacagatactctggatctacctgaaaagaccag

SEQ ID NO: 94346 - DNA, 39 bp, Artificial Sequence
  Description of Artificial Sequence: Synthetic oligonucleotide
aaagacagatactctggatctacctgaaaagaccagttg

SEQ ID NO: 94347 - DNA, 38 bp, Artificial Sequence
  Description of Artificial Sequence: Synthetic oligonucleotide
aagacagatactctggatctacctgaaaagaccagttg

SEQ ID NO: 94348 - DNA, 37 bp, Artificial Sequence
  Description of Artificial Sequence: Synthetic oligonucleotide
agacagatactctggatctacctgaaaagaccagttg

SEQ ID NO: 94349 - DNA, 36 bp, Artificial Sequence
  Description of Artificial Sequence: Synthetic oligonucleotide
gacagatactctggatctacctgaaaagaccagttg

SEQ ID NO: 94350 - DNA, 36 bp, Artificial Sequence
  Description of Artificial Sequence: Synthetic oligonucleotide
acagatactctggatctacctgaaaagaccagttgg

SEQ ID NO: 94351 - DNA, 35 bp, Artificial Sequence
  Description of Artificial Sequence: Synthetic oligonucleotide
cagatactctggatctacctgaaaagaccagttgg

SEQ ID NO: 94352 - DNA, 35 bp, Artificial Sequence
  Description of Artificial Sequence: Synthetic oligonucleotide
agatactctggatctacctgaaaagaccagttggg

SEQ ID NO: 94353 - DNA, 34 bp, Artificial Sequence
  Description of Artificial Sequence: Synthetic oligonucleotide
gatactctggatctacctgaaaagaccagttggg

SEQ ID NO: 94354 - DNA, 35 bp, Artificial Sequence
  Description of Artificial Sequence: Synthetic oligonucleotide
atactctggatctacctgaaaagaccagttgggtg

SEQ ID NO: 94355 - DNA, 34 bp, Artificial Sequence
  Description of Artificial Sequence: Synthetic oligonucleotide
tactctggatctacctgaaaagaccagttgggtg

SEQ ID NO: 94356 - DNA, 33 bp, Artificial Sequence
  Description of Artificial Sequence: Synthetic oligonucleotide
actctggatctacctgaaaagaccagttgggtg

SEQ ID NO: 94357 - DNA, 32 bp, Artificial Sequence
  Description of Artificial Sequence: Synthetic oligonucleotide
ctctggatctacctgaaaagaccagttgggtg

SEQ ID NO: 94358 - DNA, 41 bp, Artificial Sequence
  Description of Artificial Sequence: Synthetic oligonucleotide
tctggatctacctgaaaagaccagttgggtgaaatttaatg

SEQ ID NO: 94359 - DNA, 40 bp, Artificial Sequence
  Description of Artificial Sequence: Synthetic oligonucleotide
ctggatctacctgaaaagaccagttgggtgaaatttaatg

SEQ ID NO: 94360 - DNA, 41 bp, Artificial Sequence
  Description of Artificial Sequence: Synthetic oligonucleotide
tggatctacctgaaaagaccagttgggtgaaatttaatgtg

SEQ ID NO: 94361 - DNA, 40 bp, Artificial Sequence
  Description of Artificial Sequence: Synthetic oligonucleotide
ggatctacctgaaaagaccagttgggtgaaatttaatgtg

SEQ ID NO: 94362 - DNA, 40 bp, Artificial Sequence
  Description of Artificial Sequence: Synthetic oligonucleotide
gatctacctgaaaagaccagttgggtgaaatttaatgtgg

SEQ ID NO: 94363 - DNA, 41 bp, Artificial Sequence
  Description of Artificial Sequence: Synthetic oligonucleotide
atctacctgaaaagaccagttgggtgaaatttaatgtggac

SEQ ID NO: 94364 - DNA, 40 bp, Artificial Sequence
  Description of Artificial Sequence: Synthetic oligonucleotide
tctacctgaaaagaccagttgggtgaaatttaatgtggac

SEQ ID NO: 94365 - DNA, 39 bp, Artificial Sequence
  Description of Artificial Sequence: Synthetic oligonucleotide
ctacctgaaaagaccagttgggtgaaatttaatgtggac

SEQ ID NO: 94366 - DNA, 40 bp, Artificial Sequence
  Description of Artificial Sequence: Synthetic oligonucleotide
tacctgaaaagaccagttgggtgaaatttaatgtggactc

SEQ ID NO: 94367 - DNA, 39 bp, Artificial Sequence
  Description of Artificial Sequence: Synthetic oligonucleotide
acctgaaaagaccagttgggtgaaatttaatgtggactc

SEQ ID NO: 94368 - DNA, 38 bp, Artificial Sequence
  Description of Artificial Sequence: Synthetic oligonucleotide
cctgaaaagaccagttgggtgaaatttaatgtggactc

SEQ ID NO: 94369 - DNA, 42 bp, Artificial Sequence
  Description of Artificial Sequence: Synthetic oligonucleotide
ctgaaaagaccagttgggtgaaatttaatgtggactcaaatg

SEQ ID NO: 94370 - DNA, 42 bp, Artificial Sequence
  Description of Artificial Sequence: Synthetic oligonucleotide
tgaaaagaccagttgggtgaaatttaatgtggactcaaatgg

SEQ ID NO: 94371 - DNA, 41 bp, Artificial Sequence
  Description of Artificial Sequence: Synthetic oligonucleotide
gaaaagaccagttgggtgaaatttaatgtggactcaaatgg

SEQ ID NO: 94372 - DNA, 44 bp, Artificial Sequence
  Description of Artificial Sequence: Synthetic oligonucleotide
aaaagaccagttgggtgaaatttaatgtggactcaaatggttac

SEQ ID NO: 94373 - DNA, 43 bp, Artificial Sequence
  Description of Artificial Sequence: Synthetic oligonucleotide
aaagaccagttgggtgaaatttaatgtggactcaaatggttac

SEQ ID NO: 94374 - DNA, 42 bp, Artificial Sequence
  Description of Artificial Sequence: Synthetic oligonucleotide
aagaccagttgggtgaaatttaatgtggactcaaatggttac

SEQ ID NO: 94375 - DNA, 41 bp, Artificial Sequence
  Description of Artificial Sequence: Synthetic oligonucleotide
agaccagttgggtgaaatttaatgtggactcaaatggttac

SEQ ID NO: 94376 - DNA, 40 bp, Artificial Sequence
  Description of Artificial Sequence: Synthetic oligonucleotide
gaccagttgggtgaaatttaatgtggactcaaatggttac

SEQ ID NO: 94377 - DNA, 42 bp, Artificial Sequence
  Description of Artificial Sequence: Synthetic oligonucleotide
accagttgggtgaaatttaatgtggactcaaatggttactac

SEQ ID NO: 94378 - DNA, 41 bp, Artificial Sequence
  Description of Artificial Sequence: Synthetic oligonucleotide
ccagttgggtgaaatttaatgtggactcaaatggttactac

SEQ ID NO: 94379 - DNA, 43 bp, Artificial Sequence
  Description of Artificial Sequence: Synthetic oligonucleotide
cagttgggtgaaatttaatgtggactcaaatggttactacatc

SEQ ID NO: 94380 - DNA, 43 bp, Artificial Sequence
  Description of Artificial Sequence: Synthetic oligonucleotide
agttgggtgaaatttaatgtggactcaaatggttactacatcg

SEQ ID NO: 94381 - DNA, 42 bp, Artificial Sequence
  Description of Artificial Sequence: Synthetic oligonucleotide
gttgggtgaaatttaatgtggactcaaatggttactacatcg

SEQ ID NO: 94382 - DNA, 44 bp, Artificial Sequence
  Description of Artificial Sequence: Synthetic oligonucleotide
ttgggtgaaatttaatgtggactcaaatggttactacatcgttc

SEQ ID NO: 94383 - DNA, 43 bp, Artificial Sequence
  Description of Artificial Sequence: Synthetic oligonucleotide
tgggtgaaatttaatgtggactcaaatggttactacatcgttc

SEQ ID NO: 94384 - DNA, 42 bp, Artificial Sequence
  Description of Artificial Sequence: Synthetic oligonucleotide
gggtgaaatttaatgtggactcaaatggttactacatcgttc

SEQ ID NO: 94385 - DNA, 43 bp, Artificial Sequence
  Description of Artificial Sequence: Synthetic oligonucleotide
ggtgaaatttaatgtggactcaaatggttactacatcgttcac

SEQ ID NO: 94386 - DNA, 46 bp, Artificial Sequence
  Description of Artificial Sequence: Synthetic oligonucleotide
gtgaaatttaatgtggactcaaatggttactacatcgttcactatg

SEQ ID NO: 94387 - DNA, 47 bp, Artificial Sequence
  Description of Artificial Sequence: Synthetic oligonucleotide
tgaaatttaatgtggactcaaatggttactacatcgttcactatgag

SEQ ID NO: 94388 - DNA, 46 bp, Artificial Sequence
  Description of Artificial Sequence: Synthetic oligonucleotide
gaaatttaatgtggactcaaatggttactacatcgttcactatgag

SEQ ID NO: 94389 - DNA, 46 bp, Artificial Sequence
  Description of Artificial Sequence: Synthetic oligonucleotide
aaatttaatgtggactcaaatggttactacatcgttcactatgagg

SEQ ID NO: 94390 - DNA, 45 bp, Artificial Sequence
  Description of Artificial Sequence: Synthetic oligonucleotide
aatttaatgtggactcaaatggttactacatcgttcactatgagg

SEQ ID NO: 94391 - DNA, 44 bp, Artificial Sequence
  Description of Artificial Sequence: Synthetic oligonucleotide
atttaatgtggactcaaatggttactacatcgttcactatgagg

SEQ ID NO: 94392 - DNA, 43 bp, Artificial Sequence
  Description of Artificial Sequence: Synthetic oligonucleotide
tttaatgtggactcaaatggttactacatcgttcactatgagg

SEQ ID NO: 94393 - DNA, 42 bp, Artificial Sequence
  Description of Artificial Sequence: Synthetic oligonucleotide
ttaatgtggactcaaatggttactacatcgttcactatgagg

SEQ ID NO: 94394 - DNA, 41 bp, Artificial Sequence
  Description of Artificial Sequence: Synthetic oligonucleotide
taatgtggactcaaatggttactacatcgttcactatgagg

SEQ ID NO: 94395 - DNA, 40 bp, Artificial Sequence
  Description of Artificial Sequence: Synthetic oligonucleotide
aatgtggactcaaatggttactacatcgttcactatgagg

SEQ ID NO: 94396 - DNA, 39 bp, Artificial Sequence
  Description of Artificial Sequence: Synthetic oligonucleotide
atgtggactcaaatggttactacatcgttcactatgagg

SEQ ID NO: 94397 - DNA, 38 bp, Artificial Sequence
  Description of Artificial Sequence: Synthetic oligonucleotide
tgtggactcaaatggttactacatcgttcactatgagg

SEQ ID NO: 94398 - DNA, 37 bp, Artificial Sequence
  Description of Artificial Sequence: Synthetic oligonucleotide
gtggactcaaatggttactacatcgttcactatgagg

SEQ ID NO: 94399 - DNA, 37 bp, Artificial Sequence
  Description of Artificial Sequence: Synthetic oligonucleotide
tggactcaaatggttactacatcgttcactatgaggg

SEQ ID NO: 94400 - DNA, 36 bp, Artificial Sequence
  Description of Artificial Sequence: Synthetic oligonucleotide
ggactcaaatggttactacatcgttcactatgaggg

SEQ ID NO: 94401 - DNA, 37 bp, Artificial Sequence
  Description of Artificial Sequence: Synthetic oligonucleotide
gactcaaatggttactacatcgttcactatgagggtc

SEQ ID NO: 94402 - DNA, 39 bp, Artificial Sequence
  Description of Artificial Sequence: Synthetic oligonucleotide
actcaaatggttactacatcgttcactatgagggtcatg

SEQ ID NO: 94403 - DNA, 38 bp, Artificial Sequence
  Description of Artificial Sequence: Synthetic oligonucleotide
ctcaaatggttactacatcgttcactatgagggtcatg

SEQ ID NO: 94404 - DNA, 38 bp, Artificial Sequence
  Description of Artificial Sequence: Synthetic oligonucleotide
tcaaatggttactacatcgttcactatgagggtcatgg

SEQ ID NO: 94405 - DNA, 37 bp, Artificial Sequence
  Description of Artificial Sequence: Synthetic oligonucleotide
caaatggttactacatcgttcactatgagggtcatgg

SEQ ID NO: 94406 - DNA, 39 bp, Artificial Sequence
  Description of Artificial Sequence: Synthetic oligonucleotide
aaatggttactacatcgttcactatgagggtcatggatg

SEQ ID NO: 94407 - DNA, 38 bp, Artificial Sequence
  Description of Artificial Sequence: Synthetic oligonucleotide
aatggttactacatcgttcactatgagggtcatggatg

SEQ ID NO: 94408 - DNA, 37 bp, Artificial Sequence
  Description of Artificial Sequence: Synthetic oligonucleotide
atggttactacatcgttcactatgagggtcatggatg

SEQ ID NO: 94409 - DNA, 36 bp, Artificial Sequence
  Description of Artificial Sequence: Synthetic oligonucleotide
tggttactacatcgttcactatgagggtcatggatg

SEQ ID NO: 94410 - DNA, 35 bp, Artificial Sequence
  Description of Artificial Sequence: Synthetic oligonucleotide
ggttactacatcgttcactatgagggtcatggatg

SEQ ID NO: 94411 - DNA, 35 bp, Artificial Sequence
  Description of Artificial Sequence: Synthetic oligonucleotide
gttactacatcgttcactatgagggtcatggatgg

SEQ ID NO: 94412 - DNA, 35 bp, Artificial Sequence
  Description of Artificial Sequence: Synthetic oligonucleotide
ttactacatcgttcactatgagggtcatggatggg

SEQ ID NO: 94413 - DNA, 34 bp, Artificial Sequence
  Description of Artificial Sequence: Synthetic oligonucleotide
tactacatcgttcactatgagggtcatggatggg

SEQ ID NO: 94414 - DNA, 33 bp, Artificial Sequence
  Description of Artificial Sequence: Synthetic oligonucleotide
actacatcgttcactatgagggtcatggatggg

SEQ ID NO: 94415 - DNA, 32 bp, Artificial Sequence
  Description of Artificial Sequence: Synthetic oligonucleotide
ctacatcgttcactatgagggtcatggatggg

SEQ ID NO: 94416 - DNA, 33 bp, Artificial Sequence
  Description of Artificial Sequence: Synthetic oligonucleotide
tacatcgttcactatgagggtcatggatgggac

SEQ ID NO: 94417 - DNA, 32 bp, Artificial Sequence
  Description of Artificial Sequence: Synthetic oligonucleotide
acatcgttcactatgagggtcatggatgggac

SEQ ID NO: 94418 - DNA, 31 bp, Artificial Sequence
  Description of Artificial Sequence: Synthetic oligonucleotide
catcgttcactatgagggtcatggatgggac

SEQ ID NO: 94419 - DNA, 31 bp, Artificial Sequence
  Description of Artificial Sequence: Synthetic oligonucleotide
atcgttcactatgagggtcatggatgggacc

SEQ ID NO: 94420 - DNA, 30 bp, Artificial Sequence
  Description of Artificial Sequence: Synthetic oligonucleotide
tcgttcactatgagggtcatggatgggacc

SEQ ID NO: 94421 - DNA, 29 bp, Artificial Sequence
  Description of Artificial Sequence: Synthetic oligonucleotide
cgttcactatgagggtcatggatgggacc

SEQ ID NO: 94422 - DNA, 31 bp, Artificial Sequence
  Description of Artificial Sequence: Synthetic oligonucleotide
gttcactatgagggtcatggatgggaccaac

SEQ ID NO: 94423 - DNA, 32 bp, Artificial Sequence
  Description of Artificial Sequence: Synthetic oligonucleotide
ttcactatgagggtcatggatgggaccaactc

SEQ ID NO: 94424 - DNA, 31 bp, Artificial Sequence
  Description of Artificial Sequence: Synthetic oligonucleotide
tcactatgagggtcatggatgggaccaactc

SEQ ID NO: 94425 - DNA, 30 bp, Artificial Sequence
  Description of Artificial Sequence: Synthetic oligonucleotide
cactatgagggtcatggatgggaccaactc

SEQ ID NO: 94426 - DNA, 34 bp, Artificial Sequence
  Description of Artificial Sequence: Synthetic oligonucleotide
actatgagggtcatggatgggaccaactcattac

SEQ ID NO: 94427 - DNA, 33 bp, Artificial Sequence
  Description of Artificial Sequence: Synthetic oligonucleotide
ctatgagggtcatggatgggaccaactcattac

SEQ ID NO: 94428 - DNA, 34 bp, Artificial Sequence
  Description of Artificial Sequence: Synthetic oligonucleotide
tatgagggtcatggatgggaccaactcattacac

SEQ ID NO: 94429 - DNA, 33 bp, Artificial Sequence
  Description of Artificial Sequence: Synthetic oligonucleotide
atgagggtcatggatgggaccaactcattacac

SEQ ID NO: 94430 - DNA, 32 bp, Artificial Sequence
  Description of Artificial Sequence: Synthetic oligonucleotide
tgagggtcatggatgggaccaactcattacac

SEQ ID NO: 94431 - DNA, 31 bp, Artificial Sequence
  Description of Artificial Sequence: Synthetic oligonucleotide
gagggtcatggatgggaccaactcattacac

SEQ ID NO: 94432 - DNA, 32 bp, Artificial Sequence
  Description of Artificial Sequence: Synthetic oligonucleotide
agggtcatggatgggaccaactcattacacag

SEQ ID NO: 94433 - DNA, 31 bp, Artificial Sequence
  Description of Artificial Sequence: Synthetic oligonucleotide
gggtcatggatgggaccaactcattacacag

SEQ ID NO: 94434 - DNA, 31 bp, Artificial Sequence
  Description of Artificial Sequence: Synthetic oligonucleotide
ggtcatggatgggaccaactcattacacagc

SEQ ID NO: 94435 - DNA, 32 bp, Artificial Sequence
  Description of Artificial Sequence: Synthetic oligonucleotide
gtcatggatgggaccaactcattacacagctg

SEQ ID NO: 94436 - DNA, 35 bp, Artificial Sequence
  Description of Artificial Sequence: Synthetic oligonucleotide
tcatggatgggaccaactcattacacagctgaatc

SEQ ID NO: 94437 - DNA, 34 bp, Artificial Sequence
  Description of Artificial Sequence: Synthetic oligonucleotide
catggatgggaccaactcattacacagctgaatc

SEQ ID NO: 94438 - DNA, 35 bp, Artificial Sequence
  Description of Artificial Sequence: Synthetic oligonucleotide
atggatgggaccaactcattacacagctgaatcag

SEQ ID NO: 94439 - DNA, 34 bp, Artificial Sequence
  Description of Artificial Sequence: Synthetic oligonucleotide
tggatgggaccaactcattacacagctgaatcag

SEQ ID NO: 94440 - DNA, 33 bp, Artificial Sequence
  Description of Artificial Sequence: Synthetic oligonucleotide
ggatgggaccaactcattacacagctgaatcag

SEQ ID NO: 94441 - DNA, 35 bp, Artificial Sequence
  Description of Artificial Sequence: Synthetic oligonucleotide
gatgggaccaactcattacacagctgaatcagaac

SEQ ID NO: 94442 - DNA, 35 bp, Artificial Sequence
  Description of Artificial Sequence: Synthetic oligonucleotide
atgggaccaactcattacacagctgaatcagaacc

SEQ ID NO: 94443 - DNA, 34 bp, Artificial Sequence
  Description of Artificial Sequence: Synthetic oligonucleotide
tgggaccaactcattacacagctgaatcagaacc

SEQ ID NO: 94444 - DNA, 33 bp, Artificial Sequence
  Description of Artificial Sequence: Synthetic oligonucleotide
gggaccaactcattacacagctgaatcagaacc

SEQ ID NO: 94445 - DNA, 34 bp, Artificial Sequence
  Description of Artificial Sequence: Synthetic oligonucleotide
ggaccaactcattacacagctgaatcagaaccac

SEQ ID NO: 94446 - DNA, 35 bp, Artificial Sequence
  Description of Artificial Sequence: Synthetic oligonucleotide
gaccaactcattacacagctgaatcagaaccacac

SEQ ID NO: 94447 - DNA, 36 bp, Artificial Sequence
  Description of Artificial Sequence: Synthetic oligonucleotide
accaactcattacacagctgaatcagaaccacacac

SEQ ID NO: 94448 - DNA, 35 bp, Artificial Sequence
  Description of Artificial Sequence: Synthetic oligonucleotide
ccaactcattacacagctgaatcagaaccacacac

SEQ ID NO: 94449 - DNA, 37 bp, Artificial Sequence
  Description of Artificial Sequence: Synthetic oligonucleotide
caactcattacacagctgaatcagaaccacacacttc

SEQ ID NO: 94450 - DNA, 38 bp, Artificial Sequence
  Description of Artificial Sequence: Synthetic oligonucleotide
aactcattacacagctgaatcagaaccacacacttctc

SEQ ID NO: 94451 - DNA, 37 bp, Artificial Sequence
  Description of Artificial Sequence: Synthetic oligonucleotide
actcattacacagctgaatcagaaccacacacttctc

SEQ ID NO: 94452 - DNA, 36 bp, Artificial Sequence
  Description of Artificial Sequence: Synthetic oligonucleotide
ctcattacacagctgaatcagaaccacacacttctc

SEQ ID NO: 94453 - DNA, 37 bp, Artificial Sequence
  Description of Artificial Sequence: Synthetic oligonucleotide
tcattacacagctgaatcagaaccacacacttctcag

SEQ ID NO: 94454 - DNA, 36 bp, Artificial Sequence
  Description of Artificial Sequence: Synthetic oligonucleotide
cattacacagctgaatcagaaccacacacttctcag

SEQ ID NO: 94455 - DNA, 37 bp, Artificial Sequence
  Description of Artificial Sequence: Synthetic oligonucleotide
attacacagctgaatcagaaccacacacttctcagac

SEQ ID NO: 94456 - DNA, 36 bp, Artificial Sequence
  Description of Artificial Sequence: Synthetic oligonucleotide
ttacacagctgaatcagaaccacacacttctcagac

SEQ ID NO: 94457 - DNA, 35 bp, Artificial Sequence
  Description of Artificial Sequence: Synthetic oligonucleotide
tacacagctgaatcagaaccacacacttctcagac

SEQ ID NO: 94458 - DNA, 34 bp, Artificial Sequence
  Description of Artificial Sequence: Synthetic oligonucleotide
acacagctgaatcagaaccacacacttctcagac

SEQ ID NO: 94459 - DNA, 33 bp, Artificial Sequence
  Description of Artificial Sequence: Synthetic oligonucleotide
cacagctgaatcagaaccacacacttctcagac

SEQ ID NO: 94460 - DNA, 33 bp, Artificial Sequence
  Description of Artificial Sequence: Synthetic oligonucleotide
acagctgaatcagaaccacacacttctcagacc

SEQ ID NO: 94461 - DNA, 32 bp, Artificial Sequence
  Description of Artificial Sequence: Synthetic oligonucleotide
cagctgaatcagaaccacacacttctcagacc

SEQ ID NO: 94462 - DNA, 35 bp, Artificial Sequence
  Description of Artificial Sequence: Synthetic oligonucleotide
agctgaatcagaaccacacacttctcagacctaag

SEQ ID NO: 94463 - DNA, 34 bp, Artificial Sequence
  Description of Artificial Sequence: Synthetic oligonucleotide
gctgaatcagaaccacacacttctcagacctaag

SEQ ID NO: 94464 - DNA, 34 bp, Artificial Sequence
  Description of Artificial Sequence: Synthetic oligonucleotide
ctgaatcagaaccacacacttctcagacctaagg

SEQ ID NO: 94465 - DNA, 35 bp, Artificial Sequence
  Description of Artificial Sequence: Synthetic oligonucleotide
tgaatcagaaccacacacttctcagacctaaggac

SEQ ID NO: 94466 - DNA, 34 bp, Artificial Sequence
  Description of Artificial Sequence: Synthetic oligonucleotide
gaatcagaaccacacacttctcagacctaaggac

SEQ ID NO: 94467 - DNA, 35 bp, Artificial Sequence
  Description of Artificial Sequence: Synthetic oligonucleotide
aatcagaaccacacacttctcagacctaaggacag

SEQ ID NO: 94468 - DNA, 34 bp, Artificial Sequence
  Description of Artificial Sequence: Synthetic oligonucleotide
atcagaaccacacacttctcagacctaaggacag

SEQ ID NO: 94469 - DNA, 33 bp, Artificial Sequence
  Description of Artificial Sequence: Synthetic oligonucleotide
tcagaaccacacacttctcagacctaaggacag

SEQ ID NO: 94470 - DNA, 32 bp, Artificial Sequence
  Description of Artificial Sequence: Synthetic oligonucleotide
cagaaccacacacttctcagacctaaggacag

SEQ ID NO: 94471 - DNA, 33 bp, Artificial Sequence
  Description of Artificial Sequence: Synthetic oligonucleotide
agaaccacacacttctcagacctaaggacagag

SEQ ID NO: 94472 - DNA, 32 bp, Artificial Sequence
  Description of Artificial Sequence: Synthetic oligonucleotide
gaaccacacacttctcagacctaaggacagag

SEQ ID NO: 94473 - DNA, 34 bp, Artificial Sequence
  Description of Artificial Sequence: Synthetic oligonucleotide
aaccacacacttctcagacctaaggacagagtag

SEQ ID NO: 94474 - DNA, 33 bp, Artificial Sequence
  Description of Artificial Sequence: Synthetic oligonucleotide
accacacacttctcagacctaaggacagagtag

SEQ ID NO: 94475 - DNA, 32 bp, Artificial Sequence
  Description of Artificial Sequence: Synthetic oligonucleotide
ccacacacttctcagacctaaggacagagtag

SEQ ID NO: 94476 - DNA, 32 bp, Artificial Sequence
  Description of Artificial Sequence: Synthetic oligonucleotide
cacacacttctcagacctaaggacagagtagg

SEQ ID NO: 94477 - DNA, 33 bp, Artificial Sequence
  Description of Artificial Sequence: Synthetic oligonucleotide
acacacttctcagacctaaggacagagtaggtc

SEQ ID NO: 94478 - DNA, 32 bp, Artificial Sequence
  Description of Artificial Sequence: Synthetic oligonucleotide
cacacttctcagacctaaggacagagtaggtc

SEQ ID NO: 94479 - DNA, 33 bp, Artificial Sequence
  Description of Artificial Sequence: Synthetic oligonucleotide
acacttctcagacctaaggacagagtaggtctg

SEQ ID NO: 94480 - DNA, 32 bp, Artificial Sequence
  Description of Artificial Sequence: Synthetic oligonucleotide
cacttctcagacctaaggacagagtaggtctg

SEQ ID NO: 94481 - DNA, 35 bp, Artificial Sequence
  Description of Artificial Sequence: Synthetic oligonucleotide
acttctcagacctaaggacagagtaggtctgattc

SEQ ID NO: 94482 - DNA, 34 bp, Artificial Sequence
  Description of Artificial Sequence: Synthetic oligonucleotide
cttctcagacctaaggacagagtaggtctgattc

SEQ ID NO: 94483 - DNA, 36 bp, Artificial Sequence
  Description of Artificial Sequence: Synthetic oligonucleotide
ttctcagacctaaggacagagtaggtctgattcatg

SEQ ID NO: 94484 - DNA, 35 bp, Artificial Sequence
  Description of Artificial Sequence: Synthetic oligonucleotide
tctcagacctaaggacagagtaggtctgattcatg

SEQ ID NO: 94485 - DNA, 34 bp, Artificial Sequence
  Description of Artificial Sequence: Synthetic oligonucleotide
ctcagacctaaggacagagtaggtctgattcatg

SEQ ID NO: 94486 - DNA, 36 bp, Artificial Sequence
  Description of Artificial Sequence: Synthetic oligonucleotide
tcagacctaaggacagagtaggtctgattcatgatg

SEQ ID NO: 94487 - DNA, 35 bp, Artificial Sequence
  Description of Artificial Sequence: Synthetic oligonucleotide
cagacctaaggacagagtaggtctgattcatgatg

SEQ ID NO: 94488 - DNA, 36 bp, Artificial Sequence
  Description of Artificial Sequence: Synthetic oligonucleotide
agacctaaggacagagtaggtctgattcatgatgtg

SEQ ID NO: 94489 - DNA, 35 bp, Artificial Sequence
  Description of Artificial Sequence: Synthetic oligonucleotide
gacctaaggacagagtaggtctgattcatgatgtg

SEQ ID NO: 94490 - DNA, 38 bp, Artificial Sequence
  Description of Artificial Sequence: Synthetic oligonucleotide
acctaaggacagagtaggtctgattcatgatgtgtttc

SEQ ID NO: 94491 - DNA, 37 bp, Artificial Sequence
  Description of Artificial Sequence: Synthetic oligonucleotide
cctaaggacagagtaggtctgattcatgatgtgtttc

SEQ ID NO: 94492 - DNA, 38 bp, Artificial Sequence
  Description of Artificial Sequence: Synthetic oligonucleotide
ctaaggacagagtaggtctgattcatgatgtgtttcag

SEQ ID NO: 94493 - DNA, 38 bp, Artificial Sequence
  Description of Artificial Sequence: Synthetic oligonucleotide
taaggacagagtaggtctgattcatgatgtgtttcagc

SEQ ID NO: 94494 - DNA, 37 bp, Artificial Sequence
  Description of Artificial Sequence: Synthetic oligonucleotide
aaggacagagtaggtctgattcatgatgtgtttcagc

SEQ ID NO: 94495 - DNA, 36 bp, Artificial Sequence
  Description of Artificial Sequence: Synthetic oligonucleotide
aggacagagtaggtctgattcatgatgtgtttcagc

SEQ ID NO: 94496 - DNA, 35 bp, Artificial Sequence
  Description of Artificial Sequence: Synthetic oligonucleotide
ggacagagtaggtctgattcatgatgtgtttcagc

SEQ ID NO: 94497 - DNA, 37 bp, Artificial Sequence
  Description of Artificial Sequence: Synthetic oligonucleotide
gacagagtaggtctgattcatgatgtgtttcagctag

SEQ ID NO: 94498 - DNA, 39 bp, Artificial Sequence
  Description of Artificial Sequence: Synthetic oligonucleotide
acagagtaggtctgattcatgatgtgtttcagctagttg

SEQ ID NO: 94499 - DNA, 38 bp, Artificial Sequence
  Description of Artificial Sequence: Synthetic oligonucleotide
cagagtaggtctgattcatgatgtgtttcagctagttg

SEQ ID NO: 94500 - DNA, 38 bp, Artificial Sequence
  Description of Artificial Sequence: Synthetic oligonucleotide
agagtaggtctgattcatgatgtgtttcagctagttgg

SEQ ID NO: 94501 - DNA, 37 bp, Artificial Sequence
  Description of Artificial Sequence: Synthetic oligonucleotide
gagtaggtctgattcatgatgtgtttcagctagttgg

SEQ ID NO: 94502 - DNA, 38 bp, Artificial Sequence
  Description of Artificial Sequence: Synthetic oligonucleotide
agtaggtctgattcatgatgtgtttcagctagttggtg

SEQ ID NO: 94503 - DNA, 37 bp, Artificial Sequence
  Description of Artificial Sequence: Synthetic oligonucleotide
gtaggtctgattcatgatgtgtttcagctagttggtg

SEQ ID NO: 94504 - DNA, 37 bp, Artificial Sequence
  Description of Artificial Sequence: Synthetic oligonucleotide
taggtctgattcatgatgtgtttcagctagttggtgc

SEQ ID NO: 94505 - DNA, 36 bp, Artificial Sequence
  Description of Artificial Sequence: Synthetic oligonucleotide
aggtctgattcatgatgtgtttcagctagttggtgc

SEQ ID NO: 94506 - DNA, 35 bp, Artificial Sequence
  Description of Artificial Sequence: Synthetic oligonucleotide
ggtctgattcatgatgtgtttcagctagttggtgc

SEQ ID NO: 94507 - DNA, 36 bp, Artificial Sequence
  Description of Artificial Sequence: Synthetic oligonucleotide
gtctgattcatgatgtgtttcagctagttggtgcag

SEQ ID NO: 94508 - DNA, 36 bp, Artificial Sequence
  Description of Artificial Sequence: Synthetic oligonucleotide
tctgattcatgatgtgtttcagctagttggtgcagg

SEQ ID NO: 94509 - DNA, 35 bp, Artificial Sequence
  Description of Artificial Sequence: Synthetic oligonucleotide
ctgattcatgatgtgtttcagctagttggtgcagg

SEQ ID NO: 94510 - DNA, 35 bp, Artificial Sequence
  Description of Artificial Sequence: Synthetic oligonucleotide
tgattcatgatgtgtttcagctagttggtgcaggg

SEQ ID NO: 94511 - DNA, 34 bp, Artificial Sequence
  Description of Artificial Sequence: Synthetic oligonucleotide
gattcatgatgtgtttcagctagttggtgcaggg

SEQ ID NO: 94512 - DNA, 35 bp, Artificial Sequence
  Description of Artificial Sequence: Synthetic oligonucleotide
attcatgatgtgtttcagctagttggtgcagggag

SEQ ID NO: 94513 - DNA, 34 bp, Artificial Sequence
  Description of Artificial Sequence: Synthetic oligonucleotide
ttcatgatgtgtttcagctagttggtgcagggag

SEQ ID NO: 94514 - DNA, 33 bp, Artificial Sequence
  Description of Artificial Sequence: Synthetic oligonucleotide
tcatgatgtgtttcagctagttggtgcagggag

SEQ ID NO: 94515 - DNA, 32 bp, Artificial Sequence
  Description of Artificial Sequence: Synthetic oligonucleotide
catgatgtgtttcagctagttggtgcagggag

SEQ ID NO: 94516 - DNA, 33 bp, Artificial Sequence
  Description of Artificial Sequence: Synthetic oligonucleotide
atgatgtgtttcagctagttggtgcagggagac

SEQ ID NO: 94517 - DNA, 32 bp, Artificial Sequence
  Description of Artificial Sequence: Synthetic oligonucleotide
tgatgtgtttcagctagttggtgcagggagac

SEQ ID NO: 94518 - DNA, 31 bp, Artificial Sequence
  Description of Artificial Sequence: Synthetic oligonucleotide
gatgtgtttcagctagttggtgcagggagac

SEQ ID NO: 94519 - DNA, 32 bp, Artificial Sequence
  Description of Artificial Sequence: Synthetic oligonucleotide
atgtgtttcagctagttggtgcagggagactg

SEQ ID NO: 94520 - DNA, 31 bp, Artificial Sequence
  Description of Artificial Sequence: Synthetic oligonucleotide
tgtgtttcagctagttggtgcagggagactg

SEQ ID NO: 94521 - DNA, 30 bp, Artificial Sequence
  Description of Artificial Sequence: Synthetic oligonucleotide
gtgtttcagctagttggtgcagggagactg

SEQ ID NO: 94522 - DNA, 31 bp, Artificial Sequence
  Description of Artificial Sequence: Synthetic oligonucleotide
tgtttcagctagttggtgcagggagactgac

SEQ ID NO: 94523 - DNA, 30 bp, Artificial Sequence
  Description of Artificial Sequence: Synthetic oligonucleotide
gtttcagctagttggtgcagggagactgac

SEQ ID NO: 94524 - DNA, 30 bp, Artificial Sequence
  Description of Artificial Sequence: Synthetic oligonucleotide
tttcagctagttggtgcagggagactgacc

SEQ ID NO: 94525 - DNA, 29 bp, Artificial Sequence
  Description of Artificial Sequence: Synthetic oligonucleotide
ttcagctagttggtgcagggagactgacc

SEQ ID NO: 94526 - DNA, 28 bp, Artificial Sequence
  Description of Artificial Sequence: Synthetic oligonucleotide
tcagctagttggtgcagggagactgacc

SEQ ID NO: 94527 - DNA, 27 bp, Artificial Sequence
  Description of Artificial Sequence: Synthetic oligonucleotide
cagctagttggtgcagggagactgacc

SEQ ID NO: 94528 - DNA, 27 bp, Artificial Sequence
  Description of Artificial Sequence: Synthetic oligonucleotide
agctagttggtgcagggagactgaccc

SEQ ID NO: 94529 - DNA, 27 bp, Artificial Sequence
  Description of Artificial Sequence: Synthetic oligonucleotide
gctagttggtgcagggagactgaccct

SEQ ID NO: 94530 - DNA, 28 bp, Artificial Sequence
  Description of Artificial Sequence: Synthetic oligonucleotide
ctagttggtgcagggagactgaccctag

SEQ ID NO: 94531 - DNA, 29 bp, Artificial Sequence
  Description of Artificial Sequence: Synthetic oligonucleotide
tagttggtgcagggagactgaccctagac

SEQ ID NO: 94532 - DNA, 28 bp, Artificial Sequence
  Description of Artificial Sequence: Synthetic oligonucleotide
agttggtgcagggagactgaccctagac

SEQ ID NO: 94533 - DNA, 27 bp, Artificial Sequence
  Description of Artificial Sequence: Synthetic oligonucleotide
gttggtgcagggagactgaccctagac

SEQ ID NO: 94534 - DNA, 30 bp, Artificial Sequence
  Description of Artificial Sequence: Synthetic oligonucleotide
ttggtgcagggagactgaccctagacaaag

SEQ ID NO: 94535 - DNA, 29 bp, Artificial Sequence
  Description of Artificial Sequence: Synthetic oligonucleotide
tggtgcagggagactgaccctagacaaag

SEQ ID NO: 94536 - DNA, 28 bp, Artificial Sequence
  Description of Artificial Sequence: Synthetic oligonucleotide
ggtgcagggagactgaccctagacaaag

SEQ ID NO: 94537 - DNA, 28 bp, Artificial Sequence
  Description of Artificial Sequence: Synthetic oligonucleotide
gtgcagggagactgaccctagacaaagc

SEQ ID NO: 94538 - DNA, 29 bp, Artificial Sequence
  Description of Artificial Sequence: Synthetic oligonucleotide
tgcagggagactgaccctagacaaagctc

SEQ ID NO: 94539 - DNA, 28 bp, Artificial Sequence
  Description of Artificial Sequence: Synthetic oligonucleotide
gcagggagactgaccctagacaaagctc

SEQ ID NO: 94540 - DNA, 30 bp, Artificial Sequence
  Description of Artificial Sequence: Synthetic oligonucleotide
cagggagactgaccctagacaaagctcttg

SEQ ID NO: 94541 - DNA, 31 bp, Artificial Sequence
  Description of Artificial Sequence: Synthetic oligonucleotide
agggagactgaccctagacaaagctcttgac

SEQ ID NO: 94542 - DNA, 30 bp, Artificial Sequence
  Description of Artificial Sequence: Synthetic oligonucleotide
gggagactgaccctagacaaagctcttgac

SEQ ID NO: 94543 - DNA, 32 bp, Artificial Sequence
  Description of Artificial Sequence: Synthetic oligonucleotide
ggagactgaccctagacaaagctcttgacatg

SEQ ID NO: 94544 - DNA, 33 bp, Artificial Sequence
  Description of Artificial Sequence: Synthetic oligonucleotide
gagactgaccctagacaaagctcttgacatgac

SEQ ID NO: 94545 - DNA, 36 bp, Artificial Sequence
  Description of Artificial Sequence: Synthetic oligonucleotide
agactgaccctagacaaagctcttgacatgacttac

SEQ ID NO: 94546 - DNA, 35 bp, Artificial Sequence
  Description of Artificial Sequence: Synthetic oligonucleotide
gactgaccctagacaaagctcttgacatgacttac

SEQ ID NO: 94547 - DNA, 37 bp, Artificial Sequence
  Description of Artificial Sequence: Synthetic oligonucleotide
actgaccctagacaaagctcttgacatgacttactac

SEQ ID NO: 94548 - DNA, 36 bp, Artificial Sequence
  Description of Artificial Sequence: Synthetic oligonucleotide
ctgaccctagacaaagctcttgacatgacttactac

SEQ ID NO: 94549 - DNA, 36 bp, Artificial Sequence
  Description of Artificial Sequence: Synthetic oligonucleotide
tgaccctagacaaagctcttgacatgacttactacc

SEQ ID NO: 94550 - DNA, 35 bp, Artificial Sequence
  Description of Artificial Sequence: Synthetic oligonucleotide
gaccctagacaaagctcttgacatgacttactacc

SEQ ID NO: 94551 - DNA, 36 bp, Artificial Sequence
  Description of Artificial Sequence: Synthetic oligonucleotide
accctagacaaagctcttgacatgacttactacctc

SEQ ID NO: 94552 - DNA, 35 bp, Artificial Sequence
  Description of Artificial Sequence: Synthetic oligonucleotide
ccctagacaaagctcttgacatgacttactacctc

SEQ ID NO: 94553 - DNA, 35 bp, Artificial Sequence
  Description of Artificial Sequence: Synthetic oligonucleotide
cctagacaaagctcttgacatgacttactacctcc

SEQ ID NO: 94554 - DNA, 37 bp, Artificial Sequence
  Description of Artificial Sequence: Synthetic oligonucleotide
ctagacaaagctcttgacatgacttactacctccaac

SEQ ID NO: 94555 - DNA, 39 bp, Artificial Sequence
  Description of Artificial Sequence: Synthetic oligonucleotide
tagacaaagctcttgacatgacttactacctccaacatg

SEQ ID NO: 94556 - DNA, 38 bp, Artificial Sequence
  Description of Artificial Sequence: Synthetic oligonucleotide
agacaaagctcttgacatgacttactacctccaacatg

SEQ ID NO: 94557 - DNA, 37 bp, Artificial Sequence
  Description of Artificial Sequence: Synthetic oligonucleotide
gacaaagctcttgacatgacttactacctccaacatg

SEQ ID NO: 94558 - DNA, 40 bp, Artificial Sequence
  Description of Artificial Sequence: Synthetic oligonucleotide
acaaagctcttgacatgacttactacctccaacatgaaac

SEQ ID NO: 94559 - DNA, 39 bp, Artificial Sequence
  Description of Artificial Sequence: Synthetic oligonucleotide
caaagctcttgacatgacttactacctccaacatgaaac

SEQ ID NO: 94560 - DNA, 41 bp, Artificial Sequence
  Description of Artificial Sequence: Synthetic oligonucleotide
aaagctcttgacatgacttactacctccaacatgaaacaag

SEQ ID NO: 94561 - DNA, 40 bp, Artificial Sequence
  Description of Artificial Sequence: Synthetic oligonucleotide
aagctcttgacatgacttactacctccaacatgaaacaag

SEQ ID NO: 94562 - DNA, 39 bp, Artificial Sequence
  Description of Artificial Sequence: Synthetic oligonucleotide
agctcttgacatgacttactacctccaacatgaaacaag

SEQ ID NO: 94563 - DNA, 38 bp, Artificial Sequence
  Description of Artificial Sequence: Synthetic oligonucleotide
gctcttgacatgacttactacctccaacatgaaacaag

SEQ ID NO: 94564 - DNA, 38 bp, Artificial Sequence
  Description of Artificial Sequence: Synthetic oligonucleotide
ctcttgacatgacttactacctccaacatgaaacaagc

SEQ ID NO: 94565 - DNA, 39 bp, Artificial Sequence
  Description of Artificial Sequence: Synthetic oligonucleotide
tcttgacatgacttactacctccaacatgaaacaagcag

SEQ ID NO: 94566 - DNA, 38 bp, Artificial Sequence
  Description of Artificial Sequence: Synthetic oligonucleotide
cttgacatgacttactacctccaacatgaaacaagcag

SEQ ID NO: 94567 - DNA, 38 bp, Artificial Sequence
  Description of Artificial Sequence: Synthetic oligonucleotide
ttgacatgacttactacctccaacatgaaacaagcagc

SEQ ID NO: 94568 - DNA, 37 bp, Artificial Sequence
  Description of Artificial Sequence: Synthetic oligonucleotide
tgacatgacttactacctccaacatgaaacaagcagc

SEQ ID NO: 94569 - DNA, 36 bp, Artificial Sequence
  Description of Artificial Sequence: Synthetic oligonucleotide
gacatgacttactacctccaacatgaaacaagcagc

SEQ ID NO: 94570 - DNA, 36 bp, Artificial Sequence
  Description of Artificial Sequence: Synthetic oligonucleotide
acatgacttactacctccaacatgaaacaagcagcc

SEQ ID NO: 94571 - DNA, 35 bp, Artificial Sequence
  Description of Artificial Sequence: Synthetic oligonucleotide
catgacttactacctccaacatgaaacaagcagcc

SEQ ID NO: 94572 - DNA, 35 bp, Artificial Sequence
  Description of Artificial Sequence: Synthetic oligonucleotide
atgacttactacctccaacatgaaacaagcagccc

SEQ ID NO: 94573 - DNA, 34 bp, Artificial Sequence
  Description of Artificial Sequence: Synthetic oligonucleotide
tgacttactacctccaacatgaaacaagcagccc

SEQ ID NO: 94574 - DNA, 33 bp, Artificial Sequence
  Description of Artificial Sequence: Synthetic oligonucleotide
gacttactacctccaacatgaaacaagcagccc

SEQ ID NO: 94575 - DNA, 33 bp, Artificial Sequence
  Description of Artificial Sequence: Synthetic oligonucleotide
acttactacctccaacatgaaacaagcagcccc

SEQ ID NO: 94576 - DNA, 32 bp, Artificial Sequence
  Description of Artificial Sequence: Synthetic oligonucleotide
cttactacctccaacatgaaacaagcagcccc

SEQ ID NO: 94577 - DNA, 32 bp, Artificial Sequence
  Description of Artificial Sequence: Synthetic oligonucleotide
ttactacctccaacatgaaacaagcagccccg

SEQ ID NO: 94578 - DNA, 31 bp, Artificial Sequence
  Description of Artificial Sequence: Synthetic oligonucleotide
tactacctccaacatgaaacaagcagccccg

SEQ ID NO: 94579 - DNA, 30 bp, Artificial Sequence
  Description of Artificial Sequence: Synthetic oligonucleotide
actacctccaacatgaaacaagcagccccg

SEQ ID NO: 94580 - DNA, 29 bp, Artificial Sequence
  Description of Artificial Sequence: Synthetic oligonucleotide
ctacctccaacatgaaacaagcagccccg

SEQ ID NO: 94581 - DNA, 29 bp, Artificial Sequence
  Description of Artificial Sequence: Synthetic oligonucleotide
tacctccaacatgaaacaagcagccccgc

SEQ ID NO: 94582 - DNA, 28 bp, Artificial Sequence
  Description of Artificial Sequence: Synthetic oligonucleotide
acctccaacatgaaacaagcagccccgc

SEQ ID NO: 94583 - DNA, 27 bp, Artificial Sequence
  Description of Artificial Sequence: Synthetic oligonucleotide
cctccaacatgaaacaagcagccccgc

SEQ ID NO: 94584 - DNA, 28 bp, Artificial Sequence
  Description of Artificial Sequence: Synthetic oligonucleotide
ctccaacatgaaacaagcagccccgcac

SEQ ID NO: 94585 - DNA, 30 bp, Artificial Sequence
  Description of Artificial Sequence: Synthetic oligonucleotide
tccaacatgaaacaagcagccccgcacttc

SEQ ID NO: 94586 - DNA, 29 bp, Artificial Sequence
  Description of Artificial Sequence: Synthetic oligonucleotide
ccaacatgaaacaagcagccccgcacttc

SEQ ID NO: 94587 - DNA, 30 bp, Artificial Sequence
  Description of Artificial Sequence: Synthetic oligonucleotide
caacatgaaacaagcagccccgcacttctc

SEQ ID NO: 94588 - DNA, 30 bp, Artificial Sequence
  Description of Artificial Sequence: Synthetic oligonucleotide
aacatgaaacaagcagccccgcacttctcg

SEQ ID NO: 94589 - DNA, 29 bp, Artificial Sequence
  Description of Artificial Sequence: Synthetic oligonucleotide
acatgaaacaagcagccccgcacttctcg

SEQ ID NO: 94590 - DNA, 28 bp, Artificial Sequence
  Description of Artificial Sequence: Synthetic oligonucleotide
catgaaacaagcagccccgcacttctcg

SEQ ID NO: 94591 - DNA, 30 bp, Artificial Sequence
  Description of Artificial Sequence: Synthetic oligonucleotide
atgaaacaagcagccccgcacttctcgaag

SEQ ID NO: 94592 - DNA, 29 bp, Artificial Sequence
  Description of Artificial Sequence: Synthetic oligonucleotide
tgaaacaagcagccccgcacttctcgaag

SEQ ID NO: 94593 - DNA, 28 bp, Artificial Sequence
  Description of Artificial Sequence: Synthetic oligonucleotide
gaaacaagcagccccgcacttctcgaag

SEQ ID NO: 94594 - DNA, 28 bp, Artificial Sequence
  Description of Artificial Sequence: Synthetic oligonucleotide
aaacaagcagccccgcacttctcgaagg

SEQ ID NO: 94595 - DNA, 27 bp, Artificial Sequence
  Description of Artificial Sequence: Synthetic oligonucleotide
aacaagcagccccgcacttctcgaagg

SEQ ID NO: 94596 - DNA, 27 bp, Artificial Sequence
  Description of Artificial Sequence: Synthetic oligonucleotide
acaagcagccccgcacttctcgaaggt

SEQ ID NO: 94597 - DNA, 26 bp, Artificial Sequence
  Description of Artificial Sequence: Synthetic oligonucleotide
caagcagccccgcacttctcgaaggt

SEQ ID NO: 94598 - DNA, 27 bp, Artificial Sequence
  Description of Artificial Sequence: Synthetic oligonucleotide
aagcagccccgcacttctcgaaggtct

SEQ ID NO: 94599 - DNA, 26 bp, Artificial Sequence
  Description of Artificial Sequence: Synthetic oligonucleotide
agcagccccgcacttctcgaaggtct

SEQ ID NO: 94600 - DNA, 25 bp, Artificial Sequence
  Description of Artificial Sequence: Synthetic oligonucleotide
gcagccccgcacttctcgaaggtct

SEQ ID NO: 94601 - DNA, 26 bp, Artificial Sequence
  Description of Artificial Sequence: Synthetic oligonucleotide
cagccccgcacttctcgaaggtctga

SEQ ID NO: 94602 - DNA, 27 bp, Artificial Sequence
  Description of Artificial Sequence: Synthetic oligonucleotide
agccccgcacttctcgaaggtctgagt

SEQ ID NO: 94603 - DNA, 27 bp, Artificial Sequence
  Description of Artificial Sequence: Synthetic oligonucleotide
gccccgcacttctcgaaggtctgagtt

SEQ ID NO: 94604 - DNA, 28 bp, Artificial Sequence
  Description of Artificial Sequence: Synthetic oligonucleotide
ccccgcacttctcgaaggtctgagttac

SEQ ID NO: 94605 - DNA, 30 bp, Artificial Sequence
  Description of Artificial Sequence: Synthetic oligonucleotide
cccgcacttctcgaaggtctgagttacttg

SEQ ID NO: 94606 - DNA, 30 bp, Artificial Sequence
  Description of Artificial Sequence: Synthetic oligonucleotide
ccgcacttctcgaaggtctgagttacttgg

SEQ ID NO: 94607 - DNA, 33 bp, Artificial Sequence
  Description of Artificial Sequence: Synthetic oligonucleotide
cgcacttctcgaaggtctgagttacttggaatc

SEQ ID NO: 94608 - DNA, 33 bp, Artificial Sequence
  Description of Artificial Sequence: Synthetic oligonucleotide
gcacttctcgaaggtctgagttacttggaatcg

SEQ ID NO: 94609 - DNA, 38 bp, Artificial Sequence
  Description of Artificial Sequence: Synthetic oligonucleotide
cacttctcgaaggtctgagttacttggaatcgttttac

SEQ ID NO: 94610 - DNA, 38 bp, Artificial Sequence
  Description of Artificial Sequence: Synthetic oligonucleotide
acttctcgaaggtctgagttacttggaatcgttttacc

SEQ ID NO: 94611 - DNA, 37 bp, Artificial Sequence
  Description of Artificial Sequence: Synthetic oligonucleotide
cttctcgaaggtctgagttacttggaatcgttttacc

SEQ ID NO: 94612 - DNA, 38 bp, Artificial Sequence
  Description of Artificial Sequence: Synthetic oligonucleotide
ttctcgaaggtctgagttacttggaatcgttttaccac

SEQ ID NO: 94613 - DNA, 37 bp, Artificial Sequence
  Description of Artificial Sequence: Synthetic oligonucleotide
tctcgaaggtctgagttacttggaatcgttttaccac

SEQ ID NO: 94614 - DNA, 36 bp, Artificial Sequence
  Description of Artificial Sequence: Synthetic oligonucleotide
ctcgaaggtctgagttacttggaatcgttttaccac

SEQ ID NO: 94615 - DNA, 38 bp, Artificial Sequence
  Description of Artificial Sequence: Synthetic oligonucleotide
tcgaaggtctgagttacttggaatcgttttaccacatg

SEQ ID NO: 94616 - DNA, 37 bp, Artificial Sequence
  Description of Artificial Sequence: Synthetic oligonucleotide
cgaaggtctgagttacttggaatcgttttaccacatg

SEQ ID NO: 94617 - DNA, 39 bp, Artificial Sequence
  Description of Artificial Sequence: Synthetic oligonucleotide
gaaggtctgagttacttggaatcgttttaccacatgatg

SEQ ID NO: 94618 - DNA, 39 bp, Artificial Sequence
  Description of Artificial Sequence: Synthetic oligonucleotide
aaggtctgagttacttggaatcgttttaccacatgatgg

SEQ ID NO: 94619 - DNA, 38 bp, Artificial Sequence
  Description of Artificial Sequence: Synthetic oligonucleotide
aggtctgagttacttggaatcgttttaccacatgatgg

SEQ ID NO: 94620 - DNA, 37 bp, Artificial Sequence
  Description of Artificial Sequence: Synthetic oligonucleotide
ggtctgagttacttggaatcgttttaccacatgatgg

SEQ ID NO: 94621 - DNA, 38 bp, Artificial Sequence
  Description of Artificial Sequence: Synthetic oligonucleotide
gtctgagttacttggaatcgttttaccacatgatggac

SEQ ID NO: 94622 - DNA, 39 bp, Artificial Sequence
  Description of Artificial Sequence: Synthetic oligonucleotide
tctgagttacttggaatcgttttaccacatgatggacag

SEQ ID NO: 94623 - DNA, 38 bp, Artificial Sequence
  Description of Artificial Sequence: Synthetic oligonucleotide
ctgagttacttggaatcgttttaccacatgatggacag

SEQ ID NO: 94624 - DNA, 40 bp, Artificial Sequence
  Description of Artificial Sequence: Synthetic oligonucleotide
tgagttacttggaatcgttttaccacatgatggacagaag

SEQ ID NO: 94625 - DNA, 39 bp, Artificial Sequence
  Description of Artificial Sequence: Synthetic oligonucleotide
gagttacttggaatcgttttaccacatgatggacagaag

SEQ ID NO: 94626 - DNA, 39 bp, Artificial Sequence
  Description of Artificial Sequence: Synthetic oligonucleotide
agttacttggaatcgttttaccacatgatggacagaagg

SEQ ID NO: 94627 - DNA, 38 bp, Artificial Sequence
  Description of Artificial Sequence: Synthetic oligonucleotide
gttacttggaatcgttttaccacatgatggacagaagg

SEQ ID NO: 94628 - DNA, 45 bp, Artificial Sequence
  Description of Artificial Sequence: Synthetic oligonucleotide
ttacttggaatcgttttaccacatgatggacagaaggaatatttc

SEQ ID NO: 94629 - DNA, 44 bp, Artificial Sequence
  Description of Artificial Sequence: Synthetic oligonucleotide
tacttggaatcgttttaccacatgatggacagaaggaatatttc

SEQ ID NO: 94630 - DNA, 43 bp, Artificial Sequence
  Description of Artificial Sequence: Synthetic oligonucleotide
acttggaatcgttttaccacatgatggacagaaggaatatttc

SEQ ID NO: 94631 - DNA, 42 bp, Artificial Sequence
  Description of Artificial Sequence: Synthetic oligonucleotide
cttggaatcgttttaccacatgatggacagaaggaatatttc

SEQ ID NO: 94632 - DNA, 43 bp, Artificial Sequence
  Description of Artificial Sequence: Synthetic oligonucleotide
ttggaatcgttttaccacatgatggacagaaggaatatttcag

SEQ ID NO: 94633 - DNA, 42 bp, Artificial Sequence
  Description of Artificial Sequence: Synthetic oligonucleotide
tggaatcgttttaccacatgatggacagaaggaatatttcag

SEQ ID NO: 94634 - DNA, 41 bp, Artificial Sequence
  Description of Artificial Sequence: Synthetic oligonucleotide
ggaatcgttttaccacatgatggacagaaggaatatttcag

SEQ ID NO: 94635 - DNA, 45 bp, Artificial Sequence
  Description of Artificial Sequence: Synthetic oligonucleotide
gaatcgttttaccacatgatggacagaaggaatatttcagatatc

SEQ ID NO: 94636 - DNA, 46 bp, Artificial Sequence
  Description of Artificial Sequence: Synthetic oligonucleotide
aatcgttttaccacatgatggacagaaggaatatttcagatatctc

SEQ ID NO: 94637 - DNA, 45 bp, Artificial Sequence
  Description of Artificial Sequence: Synthetic oligonucleotide
atcgttttaccacatgatggacagaaggaatatttcagatatctc

SEQ ID NO: 94638 - DNA, 44 bp, Artificial Sequence
  Description of Artificial Sequence: Synthetic oligonucleotide
tcgttttaccacatgatggacagaaggaatatttcagatatctc

SEQ ID NO: 94639 - DNA, 43 bp, Artificial Sequence
  Description of Artificial Sequence: Synthetic oligonucleotide
cgttttaccacatgatggacagaaggaatatttcagatatctc

SEQ ID NO: 94640 - DNA, 44 bp, Artificial Sequence
  Description of Artificial Sequence: Synthetic oligonucleotide
gttttaccacatgatggacagaaggaatatttcagatatctctg

SEQ ID NO: 94641 - DNA, 48 bp, Artificial Sequence
  Description of Artificial Sequence: Synthetic oligonucleotide
ttttaccacatgatggacagaaggaatatttcagatatctctgaaaac

SEQ ID NO: 94642 - DNA, 47 bp, Artificial Sequence
  Description of Artificial Sequence: Synthetic oligonucleotide
tttaccacatgatggacagaaggaatatttcagatatctctgaaaac

SEQ ID NO: 94643 - DNA, 46 bp, Artificial Sequence
  Description of Artificial Sequence: Synthetic oligonucleotide
ttaccacatgatggacagaaggaatatttcagatatctctgaaaac

SEQ ID NO: 94644 - DNA, 45 bp, Artificial Sequence
  Description of Artificial Sequence: Synthetic oligonucleotide
taccacatgatggacagaaggaatatttcagatatctctgaaaac

SEQ ID NO: 94645 - DNA, 44 bp, Artificial Sequence
  Description of Artificial Sequence: Synthetic oligonucleotide
accacatgatggacagaaggaatatttcagatatctctgaaaac

SEQ ID NO: 94646 - DNA, 43 bp, Artificial Sequence
  Description of Artificial Sequence: Synthetic oligonucleotide
ccacatgatggacagaaggaatatttcagatatctctgaaaac

SEQ ID NO: 94647 - DNA, 43 bp, Artificial Sequence
  Description of Artificial Sequence: Synthetic oligonucleotide
cacatgatggacagaaggaatatttcagatatctctgaaaacc

SEQ ID NO: 94648 - DNA, 44 bp, Artificial Sequence
  Description of Artificial Sequence: Synthetic oligonucleotide
acatgatggacagaaggaatatttcagatatctctgaaaacctc

SEQ ID NO: 94649 - DNA, 43 bp, Artificial Sequence
  Description of Artificial Sequence: Synthetic oligonucleotide
catgatggacagaaggaatatttcagatatctctgaaaacctc

SEQ ID NO: 94650 - DNA, 45 bp, Artificial Sequence
  Description of Artificial Sequence: Synthetic oligonucleotide
atgatggacagaaggaatatttcagatatctctgaaaacctcaag

SEQ ID NO: 94651 - DNA, 44 bp, Artificial Sequence
  Description of Artificial Sequence: Synthetic oligonucleotide
tgatggacagaaggaatatttcagatatctctgaaaacctcaag

SEQ ID NO: 94652 - DNA, 43 bp, Artificial Sequence
  Description of Artificial Sequence: Synthetic oligonucleotide
gatggacagaaggaatatttcagatatctctgaaaacctcaag

SEQ ID NO: 94653 - DNA, 43 bp, Artificial Sequence
  Description of Artificial Sequence: Synthetic oligonucleotide
atggacagaaggaatatttcagatatctctgaaaacctcaagc

SEQ ID NO: 94654 - DNA, 42 bp, Artificial Sequence
  Description of Artificial Sequence: Synthetic oligonucleotide
tggacagaaggaatatttcagatatctctgaaaacctcaagc

SEQ ID NO: 94655 - DNA, 41 bp, Artificial Sequence
  Description of Artificial Sequence: Synthetic oligonucleotide
ggacagaaggaatatttcagatatctctgaaaacctcaagc

SEQ ID NO: 94656 - DNA, 41 bp, Artificial Sequence
  Description of Artificial Sequence: Synthetic oligonucleotide
gacagaaggaatatttcagatatctctgaaaacctcaagcg

SEQ ID NO: 94657 - DNA, 44 bp, Artificial Sequence
  Description of Artificial Sequence: Synthetic oligonucleotide
acagaaggaatatttcagatatctctgaaaacctcaagcgttac

SEQ ID NO: 94658 - DNA, 43 bp, Artificial Sequence
  Description of Artificial Sequence: Synthetic oligonucleotide
cagaaggaatatttcagatatctctgaaaacctcaagcgttac

SEQ ID NO: 94659 - DNA, 43 bp, Artificial Sequence
  Description of Artificial Sequence: Synthetic oligonucleotide
agaaggaatatttcagatatctctgaaaacctcaagcgttacc

SEQ ID NO: 94660 - DNA, 42 bp, Artificial Sequence
  Description of Artificial Sequence: Synthetic oligonucleotide
gaaggaatatttcagatatctctgaaaacctcaagcgttacc

SEQ ID NO: 94661 - DNA, 44 bp, Artificial Sequence
  Description of Artificial Sequence: Synthetic oligonucleotide
aaggaatatttcagatatctctgaaaacctcaagcgttaccttc

SEQ ID NO: 94662 - DNA, 43 bp, Artificial Sequence
  Description of Artificial Sequence: Synthetic oligonucleotide
aggaatatttcagatatctctgaaaacctcaagcgttaccttc

SEQ ID NO: 94663 - DNA, 42 bp, Artificial Sequence
  Description of Artificial Sequence: Synthetic oligonucleotide
ggaatatttcagatatctctgaaaacctcaagcgttaccttc

SEQ ID NO: 94664 - DNA, 44 bp, Artificial Sequence
  Description of Artificial Sequence: Synthetic oligonucleotide
gaatatttcagatatctctgaaaacctcaagcgttaccttcttc

SEQ ID NO: 94665 - DNA, 45 bp, Artificial Sequence
  Description of Artificial Sequence: Synthetic oligonucleotide
aatatttcagatatctctgaaaacctcaagcgttaccttcttcag

SEQ ID NO: 94666 - DNA, 44 bp, Artificial Sequence
  Description of Artificial Sequence: Synthetic oligonucleotide
atatttcagatatctctgaaaacctcaagcgttaccttcttcag

SEQ ID NO: 94667 - DNA, 43 bp, Artificial Sequence
  Description of Artificial Sequence: Synthetic oligonucleotide
tatttcagatatctctgaaaacctcaagcgttaccttcttcag

SEQ ID NO: 94668 - DNA, 42 bp, Artificial Sequence
  Description of Artificial Sequence: Synthetic oligonucleotide
atttcagatatctctgaaaacctcaagcgttaccttcttcag

SEQ ID NO: 94669 - DNA, 41 bp, Artificial Sequence
  Description of Artificial Sequence: Synthetic oligonucleotide
tttcagatatctctgaaaacctcaagcgttaccttcttcag

SEQ ID NO: 94670 - DNA, 40 bp, Artificial Sequence
  Description of Artificial Sequence: Synthetic oligonucleotide
ttcagatatctctgaaaacctcaagcgttaccttcttcag

SEQ ID NO: 94671 - DNA, 39 bp, Artificial Sequence
  Description of Artificial Sequence: Synthetic oligonucleotide
tcagatatctctgaaaacctcaagcgttaccttcttcag

SEQ ID NO: 94672 - DNA, 38 bp, Artificial Sequence
  Description of Artificial Sequence: Synthetic oligonucleotide
cagatatctctgaaaacctcaagcgttaccttcttcag

SEQ ID NO: 94673 - DNA, 46 bp, Artificial Sequence
  Description of Artificial Sequence: Synthetic oligonucleotide
agatatctctgaaaacctcaagcgttaccttcttcagtattttaag

SEQ ID NO: 94674 - DNA, 45 bp, Artificial Sequence
  Description of Artificial Sequence: Synthetic oligonucleotide
gatatctctgaaaacctcaagcgttaccttcttcagtattttaag

SEQ ID NO: 94675 - DNA, 45 bp, Artificial Sequence
  Description of Artificial Sequence: Synthetic oligonucleotide
atatctctgaaaacctcaagcgttaccttcttcagtattttaagc

SEQ ID NO: 94676 - DNA, 44 bp, Artificial Sequence
  Description of Artificial Sequence: Synthetic oligonucleotide
tatctctgaaaacctcaagcgttaccttcttcagtattttaagc

SEQ ID NO: 94677 - DNA, 43 bp, Artificial Sequence
  Description of Artificial Sequence: Synthetic oligonucleotide
atctctgaaaacctcaagcgttaccttcttcagtattttaagc

SEQ ID NO: 94678 - DNA, 42 bp, Artificial Sequence
  Description of Artificial Sequence: Synthetic oligonucleotide
tctctgaaaacctcaagcgttaccttcttcagtattttaagc

SEQ ID NO: 94679 - DNA, 41 bp, Artificial Sequence
  Description of Artificial Sequence: Synthetic oligonucleotide
ctctgaaaacctcaagcgttaccttcttcagtattttaagc

SEQ ID NO: 94680 - DNA, 41 bp, Artificial Sequence
  Description of Artificial Sequence: Synthetic oligonucleotide
tctgaaaacctcaagcgttaccttcttcagtattttaagcc

SEQ ID NO: 94681 - DNA, 40 bp, Artificial Sequence
  Description of Artificial Sequence: Synthetic oligonucleotide
ctgaaaacctcaagcgttaccttcttcagtattttaagcc

SEQ ID NO: 94682 - DNA, 41 bp, Artificial Sequence
  Description of Artificial Sequence: Synthetic oligonucleotide
tgaaaacctcaagcgttaccttcttcagtattttaagccag

SEQ ID NO: 94683 - DNA, 40 bp, Artificial Sequence
  Description of Artificial Sequence: Synthetic oligonucleotide
gaaaacctcaagcgttaccttcttcagtattttaagccag

SEQ ID NO: 94684 - DNA, 41 bp, Artificial Sequence
  Description of Artificial Sequence: Synthetic oligonucleotide
aaaacctcaagcgttaccttcttcagtattttaagccagtg

SEQ ID NO: 94685 - DNA, 40 bp, Artificial Sequence
  Description of Artificial Sequence: Synthetic oligonucleotide
aaacctcaagcgttaccttcttcagtattttaagccagtg

SEQ ID NO: 94686 - DNA, 39 bp, Artificial Sequence
  Description of Artificial Sequence: Synthetic oligonucleotide
aacctcaagcgttaccttcttcagtattttaagccagtg

SEQ ID NO: 94687 - DNA, 38 bp, Artificial Sequence
  Description of Artificial Sequence: Synthetic oligonucleotide
acctcaagcgttaccttcttcagtattttaagccagtg

SEQ ID NO: 94688 - DNA, 37 bp, Artificial Sequence
  Description of Artificial Sequence: Synthetic oligonucleotide
cctcaagcgttaccttcttcagtattttaagccagtg

SEQ ID NO: 94689 - DNA, 40 bp, Artificial Sequence
  Description of Artificial Sequence: Synthetic oligonucleotide
ctcaagcgttaccttcttcagtattttaagccagtgattg

SEQ ID NO: 94690 - DNA, 41 bp, Artificial Sequence
  Description of Artificial Sequence: Synthetic oligonucleotide
tcaagcgttaccttcttcagtattttaagccagtgattgac

SEQ ID NO: 94691 - DNA, 40 bp, Artificial Sequence
  Description of Artificial Sequence: Synthetic oligonucleotide
caagcgttaccttcttcagtattttaagccagtgattgac

SEQ ID NO: 94692 - DNA, 41 bp, Artificial Sequence
  Description of Artificial Sequence: Synthetic oligonucleotide
aagcgttaccttcttcagtattttaagccagtgattgacag

SEQ ID NO: 94693 - DNA, 40 bp, Artificial Sequence
  Description of Artificial Sequence: Synthetic oligonucleotide
agcgttaccttcttcagtattttaagccagtgattgacag

SEQ ID NO: 94694 - DNA, 39 bp, Artificial Sequence
  Description of Artificial Sequence: Synthetic oligonucleotide
gcgttaccttcttcagtattttaagccagtgattgacag

SEQ ID NO: 94695 - DNA, 39 bp, Artificial Sequence
  Description of Artificial Sequence: Synthetic oligonucleotide
cgttaccttcttcagtattttaagccagtgattgacagg

SEQ ID NO: 94696 - DNA, 39 bp, Artificial Sequence
  Description of Artificial Sequence: Synthetic oligonucleotide
gttaccttcttcagtattttaagccagtgattgacaggc

SEQ ID NO: 94697 - DNA, 42 bp, Artificial Sequence
  Description of Artificial Sequence: Synthetic oligonucleotide
ttaccttcttcagtattttaagccagtgattgacaggcaaag

SEQ ID NO: 94698 - DNA, 41 bp, Artificial Sequence
  Description of Artificial Sequence: Synthetic oligonucleotide
taccttcttcagtattttaagccagtgattgacaggcaaag

SEQ ID NO: 94699 - DNA, 40 bp, Artificial Sequence
  Description of Artificial Sequence: Synthetic oligonucleotide
accttcttcagtattttaagccagtgattgacaggcaaag

SEQ ID NO: 94700 - DNA, 39 bp, Artificial Sequence
  Description of Artificial Sequence: Synthetic oligonucleotide
ccttcttcagtattttaagccagtgattgacaggcaaag

SEQ ID NO: 94701 - DNA, 39 bp, Artificial Sequence
  Description of Artificial Sequence: Synthetic oligonucleotide
cttcttcagtattttaagccagtgattgacaggcaaagc

SEQ ID NO: 94702 - DNA, 40 bp, Artificial Sequence
  Description of Artificial Sequence: Synthetic oligonucleotide
ttcttcagtattttaagccagtgattgacaggcaaagctg

SEQ ID NO: 94703 - DNA, 39 bp, Artificial Sequence
  Description of Artificial Sequence: Synthetic oligonucleotide
tcttcagtattttaagccagtgattgacaggcaaagctg

SEQ ID NO: 94704 - DNA, 38 bp, Artificial Sequence
  Description of Artificial Sequence: Synthetic oligonucleotide
cttcagtattttaagccagtgattgacaggcaaagctg

SEQ ID NO: 94705 - DNA, 38 bp, Artificial Sequence
  Description of Artificial Sequence: Synthetic oligonucleotide
ttcagtattttaagccagtgattgacaggcaaagctgg

SEQ ID NO: 94706 - DNA, 37 bp, Artificial Sequence
  Description of Artificial Sequence: Synthetic oligonucleotide
tcagtattttaagccagtgattgacaggcaaagctgg

SEQ ID NO: 94707 - DNA, 36 bp, Artificial Sequence
  Description of Artificial Sequence: Synthetic oligonucleotide
cagtattttaagccagtgattgacaggcaaagctgg

SEQ ID NO: 94708 - DNA, 37 bp, Artificial Sequence
  Description of Artificial Sequence: Synthetic oligonucleotide
agtattttaagccagtgattgacaggcaaagctggag

SEQ ID NO: 94709 - DNA, 36 bp, Artificial Sequence
  Description of Artificial Sequence: Synthetic oligonucleotide
gtattttaagccagtgattgacaggcaaagctggag

SEQ ID NO: 94710 - DNA, 37 bp, Artificial Sequence
  Description of Artificial Sequence: Synthetic oligonucleotide
tattttaagccagtgattgacaggcaaagctggagtg

SEQ ID NO: 94711 - DNA, 36 bp, Artificial Sequence
  Description of Artificial Sequence: Synthetic oligonucleotide
attttaagccagtgattgacaggcaaagctggagtg

SEQ ID NO: 94712 - DNA, 35 bp, Artificial Sequence
  Description of Artificial Sequence: Synthetic oligonucleotide
ttttaagccagtgattgacaggcaaagctggagtg

SEQ ID NO: 94713 - DNA, 34 bp, Artificial Sequence
  Description of Artificial Sequence: Synthetic oligonucleotide
tttaagccagtgattgacaggcaaagctggagtg

SEQ ID NO: 94714 - DNA, 33 bp, Artificial Sequence
  Description of Artificial Sequence: Synthetic oligonucleotide
ttaagccagtgattgacaggcaaagctggagtg

SEQ ID NO: 94715 - DNA, 32 bp, Artificial Sequence
  Description of Artificial Sequence: Synthetic oligonucleotide
taagccagtgattgacaggcaaagctggagtg

SEQ ID NO: 94716 - DNA, 31 bp, Artificial Sequence
  Description of Artificial Sequence: Synthetic oligonucleotide
aagccagtgattgacaggcaaagctggagtg

SEQ ID NO: 94717 - DNA, 30 bp, Artificial Sequence
  Description of Artificial Sequence: Synthetic oligonucleotide
agccagtgattgacaggcaaagctggagtg

SEQ ID NO: 94718 - DNA, 29 bp, Artificial Sequence
  Description of Artificial Sequence: Synthetic oligonucleotide
gccagtgattgacaggcaaagctggagtg

SEQ ID NO: 94719 - DNA, 30 bp, Artificial Sequence
  Description of Artificial Sequence: Synthetic oligonucleotide
ccagtgattgacaggcaaagctggagtgac

SEQ ID NO: 94720 - DNA, 32 bp, Artificial Sequence
  Description of Artificial Sequence: Synthetic oligonucleotide
cagtgattgacaggcaaagctggagtgacaag

SEQ ID NO: 94721 - DNA, 32 bp, Artificial Sequence
  Description of Artificial Sequence: Synthetic oligonucleotide
agtgattgacaggcaaagctggagtgacaagg

SEQ ID NO: 94722 - DNA, 31 bp, Artificial Sequence
  Description of Artificial Sequence: Synthetic oligonucleotide
gtgattgacaggcaaagctggagtgacaagg

SEQ ID NO: 94723 - DNA, 31 bp, Artificial Sequence
  Description of Artificial Sequence: Synthetic oligonucleotide
tgattgacaggcaaagctggagtgacaaggg

SEQ ID NO: 94724 - DNA, 30 bp, Artificial Sequence
  Description of Artificial Sequence: Synthetic oligonucleotide
gattgacaggcaaagctggagtgacaaggg

SEQ ID NO: 94725 - DNA, 30 bp, Artificial Sequence
  Description of Artificial Sequence: Synthetic oligonucleotide
attgacaggcaaagctggagtgacaagggc

SEQ ID NO: 94726 - DNA, 29 bp, Artificial Sequence
  Description of Artificial Sequence: Synthetic oligonucleotide
ttgacaggcaaagctggagtgacaagggc

SEQ ID NO: 94727 - DNA, 28 bp, Artificial Sequence
  Description of Artificial Sequence: Synthetic oligonucleotide
tgacaggcaaagctggagtgacaagggc

SEQ ID NO: 94728 - DNA, 27 bp, Artificial Sequence
  Description of Artificial Sequence: Synthetic oligonucleotide
gacaggcaaagctggagtgacaagggc

SEQ ID NO: 94729 - DNA, 28 bp, Artificial Sequence
  Description of Artificial Sequence: Synthetic oligonucleotide
acaggcaaagctggagtgacaagggctc

SEQ ID NO: 94730 - DNA, 27 bp, Artificial Sequence
  Description of Artificial Sequence: Synthetic oligonucleotide
caggcaaagctggagtgacaagggctc

SEQ ID NO: 94731 - DNA, 28 bp, Artificial Sequence
  Description of Artificial Sequence: Synthetic oligonucleotide
aggcaaagctggagtgacaagggctcag

SEQ ID NO: 94732 - DNA, 27 bp, Artificial Sequence
  Description of Artificial Sequence: Synthetic oligonucleotide
ggcaaagctggagtgacaagggctcag

SEQ ID NO: 94733 - DNA, 28 bp, Artificial Sequence
  Description of Artificial Sequence: Synthetic oligonucleotide
gcaaagctggagtgacaagggctcagtc

SEQ ID NO: 94734 - DNA, 29 bp, Artificial Sequence
  Description of Artificial Sequence: Synthetic oligonucleotide
caaagctggagtgacaagggctcagtctg

SEQ ID NO: 94735 - DNA, 29 bp, Artificial Sequence
  Description of Artificial Sequence: Synthetic oligonucleotide
aaagctggagtgacaagggctcagtctgg

SEQ ID NO: 94736 - DNA, 28 bp, Artificial Sequence
  Description of Artificial Sequence: Synthetic oligonucleotide
aagctggagtgacaagggctcagtctgg

SEQ ID NO: 94737 - DNA, 27 bp, Artificial Sequence
  Description of Artificial Sequence: Synthetic oligonucleotide
agctggagtgacaagggctcagtctgg

SEQ ID NO: 94738 - DNA, 26 bp, Artificial Sequence
  Description of Artificial Sequence: Synthetic oligonucleotide
gctggagtgacaagggctcagtctgg

SEQ ID NO: 94739 - DNA, 27 bp, Artificial Sequence
  Description of Artificial Sequence: Synthetic oligonucleotide
ctggagtgacaagggctcagtctggga

SEQ ID NO: 94740 - DNA, 27 bp, Artificial Sequence
  Description of Artificial Sequence: Synthetic oligonucleotide
tggagtgacaagggctcagtctgggac

SEQ ID NO: 94741 - DNA, 27 bp, Artificial Sequence
  Description of Artificial Sequence: Synthetic oligonucleotide
ggagtgacaagggctcagtctgggaca

SEQ ID NO: 94742 - DNA, 27 bp, Artificial Sequence
  Description of Artificial Sequence: Synthetic oligonucleotide
gagtgacaagggctcagtctgggacag

SEQ ID NO: 94743 - DNA, 27 bp, Artificial Sequence
  Description of Artificial Sequence: Synthetic oligonucleotide
agtgacaagggctcagtctgggacagg

SEQ ID NO: 94744 - DNA, 27 bp, Artificial Sequence
  Description of Artificial Sequence: Synthetic oligonucleotide
gtgacaagggctcagtctgggacagga

SEQ ID NO: 94745 - DNA, 28 bp, Artificial Sequence
  Description of Artificial Sequence: Synthetic oligonucleotide
tgacaagggctcagtctgggacaggatg

SEQ ID NO: 94746 - DNA, 27 bp, Artificial Sequence
  Description of Artificial Sequence: Synthetic oligonucleotide
gacaagggctcagtctgggacaggatg

SEQ ID NO: 94747 - DNA, 27 bp, Artificial Sequence
  Description of Artificial Sequence: Synthetic oligonucleotide
acaagggctcagtctgggacaggatgc

SEQ ID NO: 94748 - DNA, 27 bp, Artificial Sequence
  Description of Artificial Sequence: Synthetic oligonucleotide
caagggctcagtctgggacaggatgct

SEQ ID NO: 94749 - DNA, 27 bp, Artificial Sequence
  Description of Artificial Sequence: Synthetic oligonucleotide
aagggctcagtctgggacaggatgctc

SEQ ID NO: 94750 - DNA, 26 bp, Artificial Sequence
  Description of Artificial Sequence: Synthetic oligonucleotide
agggctcagtctgggacaggatgctc

SEQ ID NO: 94751 - DNA, 25 bp, Artificial Sequence
  Description of Artificial Sequence: Synthetic oligonucleotide
gggctcagtctgggacaggatgctc

SEQ ID NO: 94752 - DNA, 25 bp, Artificial Sequence
  Description of Artificial Sequence: Synthetic oligonucleotide
ggctcagtctgggacaggatgctcc

SEQ ID NO: 94753 - DNA, 25 bp, Artificial Sequence
  Description of Artificial Sequence: Synthetic oligonucleotide
gctcagtctgggacaggatgctccg

SEQ ID NO: 94754 - DNA, 26 bp, Artificial Sequence
  Description of Artificial Sequence: Synthetic oligonucleotide
ctcagtctgggacaggatgctccgct

SEQ ID NO: 94755 - DNA, 26 bp, Artificial Sequence
  Description of Artificial Sequence: Synthetic oligonucleotide
tcagtctgggacaggatgctccgctc

SEQ ID NO: 94756 - DNA, 25 bp, Artificial Sequence
  Description of Artificial Sequence: Synthetic oligonucleotide
cagtctgggacaggatgctccgctc

SEQ ID NO: 94757 - DNA, 25 bp, Artificial Sequence
  Description of Artificial Sequence: Synthetic oligonucleotide
agtctgggacaggatgctccgctcg

SEQ ID NO: 94758 - DNA, 24 bp, Artificial Sequence
  Description of Artificial Sequence: Synthetic oligonucleotide
gtctgggacaggatgctccgctcg

SEQ ID NO: 94759 - DNA, 24 bp, Artificial Sequence
  Description of Artificial Sequence: Synthetic oligonucleotide
tctgggacaggatgctccgctcgg

SEQ ID NO: 94760 - DNA, 23 bp, Artificial Sequence
  Description of Artificial Sequence: Synthetic oligonucleotide
ctgggacaggatgctccgctcgg

SEQ ID NO: 94761 - DNA, 24 bp, Artificial Sequence
  Description of Artificial Sequence: Synthetic oligonucleotide
tgggacaggatgctccgctcggct

SEQ ID NO: 94762 - DNA, 23 bp, Artificial Sequence
  Description of Artificial Sequence: Synthetic oligonucleotide
gggacaggatgctccgctcggct

SEQ ID NO: 94763 - DNA, 24 bp, Artificial Sequence
  Description of Artificial Sequence: Synthetic oligonucleotide
ggacaggatgctccgctcggctct

SEQ ID NO: 94764 - DNA, 26 bp, Artificial Sequence
  Description of Artificial Sequence: Synthetic oligonucleotide
gacaggatgctccgctcggctctctt

SEQ ID NO: 94765 - DNA, 27 bp, Artificial Sequence
  Description of Artificial Sequence: Synthetic oligonucleotide
acaggatgctccgctcggctctcttga

SEQ ID NO: 94766 - DNA, 27 bp, Artificial Sequence
  Description of Artificial Sequence: Synthetic oligonucleotide
caggatgctccgctcggctctcttgaa

SEQ ID NO: 94767 - DNA, 27 bp, Artificial Sequence
  Description of Artificial Sequence: Synthetic oligonucleotide
aggatgctccgctcggctctcttgaag

SEQ ID NO: 94768 - DNA, 26 bp, Artificial Sequence
  Description of Artificial Sequence: Synthetic oligonucleotide
ggatgctccgctcggctctcttgaag

SEQ ID NO: 94769 - DNA, 27 bp, Artificial Sequence
  Description of Artificial Sequence: Synthetic oligonucleotide
gatgctccgctcggctctcttgaagct

SEQ ID NO: 94770 - DNA, 27 bp, Artificial Sequence
  Description of Artificial Sequence: Synthetic oligonucleotide
atgctccgctcggctctcttgaagctg

SEQ ID NO: 94771 - DNA, 26 bp, Artificial Sequence
  Description of Artificial Sequence: Synthetic oligonucleotide
tgctccgctcggctctcttgaagctg

SEQ ID NO: 94772 - DNA, 25 bp, Artificial Sequence
  Description of Artificial Sequence: Synthetic oligonucleotide
gctccgctcggctctcttgaagctg

SEQ ID NO: 94773 - DNA, 25 bp, Artificial Sequence
  Description of Artificial Sequence: Synthetic oligonucleotide
ctccgctcggctctcttgaagctgg

SEQ ID NO: 94774 - DNA, 25 bp, Artificial Sequence
  Description of Artificial Sequence: Synthetic oligonucleotide
tccgctcggctctcttgaagctggc

SEQ ID NO: 94775 - DNA, 24 bp, Artificial Sequence
  Description of Artificial Sequence: Synthetic oligonucleotide
ccgctcggctctcttgaagctggc

SEQ ID NO: 94776 - DNA, 25 bp, Artificial Sequence
  Description of Artificial Sequence: Synthetic oligonucleotide
cgctcggctctcttgaagctggcct

SEQ ID NO: 94777 - DNA, 26 bp, Artificial Sequence
  Description of Artificial Sequence: Synthetic oligonucleotide
gctcggctctcttgaagctggcctgt

SEQ ID NO: 94778 - DNA, 27 bp, Artificial Sequence
  Description of Artificial Sequence: Synthetic oligonucleotide
ctcggctctcttgaagctggcctgtga

SEQ ID NO: 94779 - DNA, 27 bp, Artificial Sequence
  Description of Artificial Sequence: Synthetic oligonucleotide
tcggctctcttgaagctggcctgtgac

SEQ ID NO: 94780 - DNA, 26 bp, Artificial Sequence
  Description of Artificial Sequence: Synthetic oligonucleotide
cggctctcttgaagctggcctgtgac

SEQ ID NO: 94781 - DNA, 27 bp, Artificial Sequence
  Description of Artificial Sequence: Synthetic oligonucleotide
ggctctcttgaagctggcctgtgacct

SEQ ID NO: 94782 - DNA, 27 bp, Artificial Sequence
  Description of Artificial Sequence: Synthetic oligonucleotide
gctctcttgaagctggcctgtgacctg

SEQ ID NO: 94783 - DNA, 29 bp, Artificial Sequence
  Description of Artificial Sequence: Synthetic oligonucleotide
ctctcttgaagctggcctgtgacctgaac

SEQ ID NO: 94784 - DNA, 29 bp, Artificial Sequence
  Description of Artificial Sequence: Synthetic oligonucleotide
tctcttgaagctggcctgtgacctgaacc

SEQ ID NO: 94785 - DNA, 28 bp, Artificial Sequence
  Description of Artificial Sequence: Synthetic oligonucleotide
ctcttgaagctggcctgtgacctgaacc

SEQ ID NO: 94786 - DNA, 30 bp, Artificial Sequence
  Description of Artificial Sequence: Synthetic oligonucleotide
tcttgaagctggcctgtgacctgaaccatg

SEQ ID NO: 94787 - DNA, 29 bp, Artificial Sequence
  Description of Artificial Sequence: Synthetic oligonucleotide
cttgaagctggcctgtgacctgaaccatg

SEQ ID NO: 94788 - DNA, 29 bp, Artificial Sequence
  Description of Artificial Sequence: Synthetic oligonucleotide
ttgaagctggcctgtgacctgaaccatgc

SEQ ID NO: 94789 - DNA, 28 bp, Artificial Sequence
  Description of Artificial Sequence: Synthetic oligonucleotide
tgaagctggcctgtgacctgaaccatgc

SEQ ID NO: 94790 - DNA, 27 bp, Artificial Sequence
  Description of Artificial Sequence: Synthetic oligonucleotide
gaagctggcctgtgacctgaaccatgc

SEQ ID NO: 94791 - DNA, 28 bp, Artificial Sequence
  Description of Artificial Sequence: Synthetic oligonucleotide
aagctggcctgtgacctgaaccatgctc

SEQ ID NO: 94792 - DNA, 27 bp, Artificial Sequence
  Description of Artificial Sequence: Synthetic oligonucleotide
agctggcctgtgacctgaaccatgctc

SEQ ID NO: 94793 - DNA, 26 bp, Artificial Sequence
  Description of Artificial Sequence: Synthetic oligonucleotide
gctggcctgtgacctgaaccatgctc

SEQ ID NO: 94794 - DNA, 27 bp, Artificial Sequence
  Description of Artificial Sequence: Synthetic oligonucleotide
ctggcctgtgacctgaaccatgctcct

SEQ ID NO: 94795 - DNA, 28 bp, Artificial Sequence
  Description of Artificial Sequence: Synthetic oligonucleotide
tggcctgtgacctgaaccatgctccttg

SEQ ID NO: 94796 - DNA, 27 bp, Artificial Sequence
  Description of Artificial Sequence: Synthetic oligonucleotide
ggcctgtgacctgaaccatgctccttg

SEQ ID NO: 94797 - DNA, 27 bp, Artificial Sequence
  Description of Artificial Sequence: Synthetic oligonucleotide
gcctgtgacctgaaccatgctccttgc

SEQ ID NO: 94798 - DNA, 29 bp, Artificial Sequence
  Description of Artificial Sequence: Synthetic oligonucleotide
cctgtgacctgaaccatgctccttgcatc

SEQ ID NO: 94799 - DNA, 29 bp, Artificial Sequence
  Description of Artificial Sequence: Synthetic oligonucleotide
ctgtgacctgaaccatgctccttgcatcc

SEQ ID NO: 94800 - DNA, 30 bp, Artificial Sequence
  Description of Artificial Sequence: Synthetic oligonucleotide
tgtgacctgaaccatgctccttgcatccag

SEQ ID NO: 94801 - DNA, 29 bp, Artificial Sequence
  Description of Artificial Sequence: Synthetic oligonucleotide
gtgacctgaaccatgctccttgcatccag

SEQ ID NO: 94802 - DNA, 32 bp, Artificial Sequence
  Description of Artificial Sequence: Synthetic oligonucleotide
tgacctgaaccatgctccttgcatccagaaag

SEQ ID NO: 94803 - DNA, 31 bp, Artificial Sequence
  Description of Artificial Sequence: Synthetic oligonucleotide
gacctgaaccatgctccttgcatccagaaag

SEQ ID NO: 94804 - DNA, 31 bp, Artificial Sequence
  Description of Artificial Sequence: Synthetic oligonucleotide
acctgaaccatgctccttgcatccagaaagc

SEQ ID NO: 94805 - DNA, 30 bp, Artificial Sequence
  Description of Artificial Sequence: Synthetic oligonucleotide
cctgaaccatgctccttgcatccagaaagc

SEQ ID NO: 94806 - DNA, 31 bp, Artificial Sequence
  Description of Artificial Sequence: Synthetic oligonucleotide
ctgaaccatgctccttgcatccagaaagctg

SEQ ID NO: 94807 - DNA, 31 bp, Artificial Sequence
  Description of Artificial Sequence: Synthetic oligonucleotide
tgaaccatgctccttgcatccagaaagctgc

SEQ ID NO: 94808 - DNA, 30 bp, Artificial Sequence
  Description of Artificial Sequence: Synthetic oligonucleotide
gaaccatgctccttgcatccagaaagctgc

SEQ ID NO: 94809 - DNA, 31 bp, Artificial Sequence
  Description of Artificial Sequence: Synthetic oligonucleotide
aaccatgctccttgcatccagaaagctgctg

SEQ ID NO: 94810 - DNA, 30 bp, Artificial Sequence
  Description of Artificial Sequence: Synthetic oligonucleotide
accatgctccttgcatccagaaagctgctg

SEQ ID NO: 94811 - DNA, 29 bp, Artificial Sequence
  Description of Artificial Sequence: Synthetic oligonucleotide
ccatgctccttgcatccagaaagctgctg

SEQ ID NO: 94812 - DNA, 31 bp, Artificial Sequence
  Description of Artificial Sequence: Synthetic oligonucleotide
catgctccttgcatccagaaagctgctgaac

SEQ ID NO: 94813 - DNA, 32 bp, Artificial Sequence
  Description of Artificial Sequence: Synthetic oligonucleotide
atgctccttgcatccagaaagctgctgaactc

SEQ ID NO: 94814 - DNA, 31 bp, Artificial Sequence
  Description of Artificial Sequence: Synthetic oligonucleotide
tgctccttgcatccagaaagctgctgaactc

SEQ ID NO: 94815 - DNA, 30 bp, Artificial Sequence
  Description of Artificial Sequence: Synthetic oligonucleotide
gctccttgcatccagaaagctgctgaactc

SEQ ID NO: 94816 - DNA, 32 bp, Artificial Sequence
  Description of Artificial Sequence: Synthetic oligonucleotide
ctccttgcatccagaaagctgctgaactcttc

SEQ ID NO: 94817 - DNA, 33 bp, Artificial Sequence
  Description of Artificial Sequence: Synthetic oligonucleotide
tccttgcatccagaaagctgctgaactcttctc

SEQ ID NO: 94818 - DNA, 32 bp, Artificial Sequence
  Description of Artificial Sequence: Synthetic oligonucleotide
ccttgcatccagaaagctgctgaactcttctc

SEQ ID NO: 94819 - DNA, 32 bp, Artificial Sequence
  Description of Artificial Sequence: Synthetic oligonucleotide
cttgcatccagaaagctgctgaactcttctcc

SEQ ID NO: 94820 - DNA, 32 bp, Artificial Sequence
  Description of Artificial Sequence: Synthetic oligonucleotide
ttgcatccagaaagctgctgaactcttctccc

SEQ ID NO: 94821 - DNA, 31 bp, Artificial Sequence
  Description of Artificial Sequence: Synthetic oligonucleotide
tgcatccagaaagctgctgaactcttctccc

SEQ ID NO: 94822 - DNA, 30 bp, Artificial Sequence
  Description of Artificial Sequence: Synthetic oligonucleotide
gcatccagaaagctgctgaactcttctccc

SEQ ID NO: 94823 - DNA, 31 bp, Artificial Sequence
  Description of Artificial Sequence: Synthetic oligonucleotide
catccagaaagctgctgaactcttctcccag

SEQ ID NO: 94824 - DNA, 32 bp, Artificial Sequence
  Description of Artificial Sequence: Synthetic oligonucleotide
atccagaaagctgctgaactcttctcccagtg

SEQ ID NO: 94825 - DNA, 31 bp, Artificial Sequence
  Description of Artificial Sequence: Synthetic oligonucleotide
tccagaaagctgctgaactcttctcccagtg

SEQ ID NO: 94826 - DNA, 30 bp, Artificial Sequence
  Description of Artificial Sequence: Synthetic oligonucleotide
ccagaaagctgctgaactcttctcccagtg

SEQ ID NO: 94827 - DNA, 30 bp, Artificial Sequence
  Description of Artificial Sequence: Synthetic oligonucleotide
cagaaagctgctgaactcttctcccagtgg

SEQ ID NO: 94828 - DNA, 32 bp, Artificial Sequence
  Description of Artificial Sequence: Synthetic oligonucleotide
agaaagctgctgaactcttctcccagtggatg

SEQ ID NO: 94829 - DNA, 31 bp, Artificial Sequence
  Description of Artificial Sequence: Synthetic oligonucleotide
gaaagctgctgaactcttctcccagtggatg

SEQ ID NO: 94830 - DNA, 31 bp, Artificial Sequence
  Description of Artificial Sequence: Synthetic oligonucleotide
aaagctgctgaactcttctcccagtggatgg

SEQ ID NO: 94831 - DNA, 30 bp, Artificial Sequence
  Description of Artificial Sequence: Synthetic oligonucleotide
aagctgctgaactcttctcccagtggatgg

SEQ ID NO: 94832 - DNA, 29 bp, Artificial Sequence
  Description of Artificial Sequence: Synthetic oligonucleotide
agctgctgaactcttctcccagtggatgg

SEQ ID NO: 94833 - DNA, 28 bp, Artificial Sequence
  Description of Artificial Sequence: Synthetic oligonucleotide
gctgctgaactcttctcccagtggatgg

SEQ ID NO: 94834 - DNA, 31 bp, Artificial Sequence
  Description of Artificial Sequence: Synthetic oligonucleotide
ctgctgaactcttctcccagtggatggaatc

SEQ ID NO: 94835 - DNA, 31 bp, Artificial Sequence
  Description of Artificial Sequence: Synthetic oligonucleotide
tgctgaactcttctcccagtggatggaatcc

SEQ ID NO: 94836 - DNA, 30 bp, Artificial Sequence
  Description of Artificial Sequence: Synthetic oligonucleotide
gctgaactcttctcccagtggatggaatcc

SEQ ID NO: 94837 - DNA, 31 bp, Artificial Sequence
  Description of Artificial Sequence: Synthetic oligonucleotide
ctgaactcttctcccagtggatggaatccag

SEQ ID NO: 94838 - DNA, 32 bp, Artificial Sequence
  Description of Artificial Sequence: Synthetic oligonucleotide
tgaactcttctcccagtggatggaatccagtg

SEQ ID NO: 94839 - DNA, 31 bp, Artificial Sequence
  Description of Artificial Sequence: Synthetic oligonucleotide
gaactcttctcccagtggatggaatccagtg

SEQ ID NO: 94840 - DNA, 31 bp, Artificial Sequence
  Description of Artificial Sequence: Synthetic oligonucleotide
aactcttctcccagtggatggaatccagtgg

SEQ ID NO: 94841 - DNA, 30 bp, Artificial Sequence
  Description of Artificial Sequence: Synthetic oligonucleotide
actcttctcccagtggatggaatccagtgg

SEQ ID NO: 94842 - DNA, 29 bp, Artificial Sequence
  Description of Artificial Sequence: Synthetic oligonucleotide
ctcttctcccagtggatggaatccagtgg

SEQ ID NO: 94843 - DNA, 42 bp, Artificial Sequence
  Description of Artificial Sequence: Synthetic oligonucleotide
tcttctcccagtggatggaatccagtggaaaattaaatatac

SEQ ID NO: 94844 - DNA, 41 bp, Artificial Sequence
  Description of Artificial Sequence: Synthetic oligonucleotide
cttctcccagtggatggaatccagtggaaaattaaatatac

SEQ ID NO: 94845 - DNA, 41 bp, Artificial Sequence
  Description of Artificial Sequence: Synthetic oligonucleotide
ttctcccagtggatggaatccagtggaaaattaaatatacc

SEQ ID NO: 94846 - DNA, 40 bp, Artificial Sequence
  Description of Artificial Sequence: Synthetic oligonucleotide
tctcccagtggatggaatccagtggaaaattaaatatacc

SEQ ID NO: 94847 - DNA, 39 bp, Artificial Sequence
  Description of Artificial Sequence: Synthetic oligonucleotide
ctcccagtggatggaatccagtggaaaattaaatatacc

SEQ ID NO: 94848 - DNA, 41 bp, Artificial Sequence
  Description of Artificial Sequence: Synthetic oligonucleotide
tcccagtggatggaatccagtggaaaattaaatataccaac

SEQ ID NO: 94849 - DNA, 40 bp, Artificial Sequence
  Description of Artificial Sequence: Synthetic oligonucleotide
cccagtggatggaatccagtggaaaattaaatataccaac

SEQ ID NO: 94850 - DNA, 41 bp, Artificial Sequence
  Description of Artificial Sequence: Synthetic oligonucleotide
ccagtggatggaatccagtggaaaattaaatataccaacag

SEQ ID NO: 94851 - DNA, 43 bp, Artificial Sequence
  Description of Artificial Sequence: Synthetic oligonucleotide
cagtggatggaatccagtggaaaattaaatataccaacagatg

SEQ ID NO: 94852 - DNA, 50 bp, Artificial Sequence
  Description of Artificial Sequence: Synthetic oligonucleotide
agtggatggaatccagtggaaaattaaatataccaacagatgttttaaag

SEQ ID NO: 94853 - DNA, 49 bp, Artificial Sequence
  Description of Artificial Sequence: Synthetic oligonucleotide
gtggatggaatccagtggaaaattaaatataccaacagatgttttaaag

SEQ ID NO: 94854 - DNA, 52 bp, Artificial Sequence
  Description of Artificial Sequence: Synthetic oligonucleotide
tggatggaatccagtggaaaattaaatataccaacagatgttttaaagattg

SEQ ID NO: 94855 - DNA, 51 bp, Artificial Sequence
  Description of Artificial Sequence: Synthetic oligonucleotide
ggatggaatccagtggaaaattaaatataccaacagatgttttaaagattg

SEQ ID NO: 94856 - DNA, 52 bp, Artificial Sequence
  Description of Artificial Sequence: Synthetic oligonucleotide
gatggaatccagtggaaaattaaatataccaacagatgttttaaagattgtg

SEQ ID NO: 94857 - DNA, 56 bp, Artificial Sequence
  Description of Artificial Sequence: Synthetic oligonucleotide
atggaatccagtggaaaattaaatataccaacagatgttttaaagattgtgtattc

SEQ ID NO: 94858 - DNA, 55 bp, Artificial Sequence
  Description of Artificial Sequence: Synthetic oligonucleotide
tggaatccagtggaaaattaaatataccaacagatgttttaaagattgtgtattc

SEQ ID NO: 94859 - DNA, 54 bp, Artificial Sequence
  Description of Artificial Sequence: Synthetic oligonucleotide
ggaatccagtggaaaattaaatataccaacagatgttttaaagattgtgtattc

SEQ ID NO: 94860 - DNA, 55 bp, Artificial Sequence
  Description of Artificial Sequence: Synthetic oligonucleotide
gaatccagtggaaaattaaatataccaacagatgttttaaagattgtgtattctg

SEQ ID NO: 94861 - DNA, 56 bp, Artificial Sequence
  Description of Artificial Sequence: Synthetic oligonucleotide
aatccagtggaaaattaaatataccaacagatgttttaaagattgtgtattctgtg

SEQ ID NO: 94862 - DNA, 55 bp, Artificial Sequence
  Description of Artificial Sequence: Synthetic oligonucleotide
atccagtggaaaattaaatataccaacagatgttttaaagattgtgtattctgtg

SEQ ID NO: 94863 - DNA, 54 bp, Artificial Sequence
  Description of Artificial Sequence: Synthetic oligonucleotide
tccagtggaaaattaaatataccaacagatgttttaaagattgtgtattctgtg

SEQ ID NO: 94864 - DNA, 53 bp, Artificial Sequence
  Description of Artificial Sequence: Synthetic oligonucleotide
ccagtggaaaattaaatataccaacagatgttttaaagattgtgtattctgtg

SEQ ID NO: 94865 - DNA, 53 bp, Artificial Sequence
  Description of Artificial Sequence: Synthetic oligonucleotide
cagtggaaaattaaatataccaacagatgttttaaagattgtgtattctgtgg

SEQ ID NO: 94866 - DNA, 53 bp, Artificial Sequence
  Description of Artificial Sequence: Synthetic oligonucleotide
agtggaaaattaaatataccaacagatgttttaaagattgtgtattctgtggg

SEQ ID NO: 94867 - DNA, 52 bp, Artificial Sequence
  Description of Artificial Sequence: Synthetic oligonucleotide
gtggaaaattaaatataccaacagatgttttaaagattgtgtattctgtggg

SEQ ID NO: 94868 - DNA, 53 bp, Artificial Sequence
  Description of Artificial Sequence: Synthetic oligonucleotide
tggaaaattaaatataccaacagatgttttaaagattgtgtattctgtgggtg

SEQ ID NO: 94869 - DNA, 52 bp, Artificial Sequence
  Description of Artificial Sequence: Synthetic oligonucleotide
ggaaaattaaatataccaacagatgttttaaagattgtgtattctgtgggtg

SEQ ID NO: 94870 - DNA, 52 bp, Artificial Sequence
  Description of Artificial Sequence: Synthetic oligonucleotide
gaaaattaaatataccaacagatgttttaaagattgtgtattctgtgggtgc

SEQ ID NO: 94871 - DNA, 53 bp, Artificial Sequence
  Description of Artificial Sequence: Synthetic oligonucleotide
aaaattaaatataccaacagatgttttaaagattgtgtattctgtgggtgctc

SEQ ID NO: 94872 - DNA, 52 bp, Artificial Sequence
  Description of Artificial Sequence: Synthetic oligonucleotide
aaattaaatataccaacagatgttttaaagattgtgtattctgtgggtgctc

SEQ ID NO: 94873 - DNA, 51 bp, Artificial Sequence
  Description of Artificial Sequence: Synthetic oligonucleotide
aattaaatataccaacagatgttttaaagattgtgtattctgtgggtgctc

SEQ ID NO: 94874 - DNA, 50 bp, Artificial Sequence
  Description of Artificial Sequence: Synthetic oligonucleotide
attaaatataccaacagatgttttaaagattgtgtattctgtgggtgctc

SEQ ID NO: 94875 - DNA, 49 bp, Artificial Sequence
  Description of Artificial Sequence: Synthetic oligonucleotide
ttaaatataccaacagatgttttaaagattgtgtattctgtgggtgctc

SEQ ID NO: 94876 - DNA, 48 bp, Artificial Sequence
  Description of Artificial Sequence: Synthetic oligonucleotide
taaatataccaacagatgttttaaagattgtgtattctgtgggtgctc

SEQ ID NO: 94877 - DNA, 47 bp, Artificial Sequence
  Description of Artificial Sequence: Synthetic oligonucleotide
aaatataccaacagatgttttaaagattgtgtattctgtgggtgctc

SEQ ID NO: 94878 - DNA, 46 bp, Artificial Sequence
  Description of Artificial Sequence: Synthetic oligonucleotide
aatataccaacagatgttttaaagattgtgtattctgtgggtgctc

SEQ ID NO: 94879 - DNA, 45 bp, Artificial Sequence
  Description of Artificial Sequence: Synthetic oligonucleotide
atataccaacagatgttttaaagattgtgtattctgtgggtgctc

SEQ ID NO: 94880 - DNA, 44 bp, Artificial Sequence
  Description of Artificial Sequence: Synthetic oligonucleotide
tataccaacagatgttttaaagattgtgtattctgtgggtgctc

SEQ ID NO: 94881 - DNA, 43 bp, Artificial Sequence
  Description of Artificial Sequence: Synthetic oligonucleotide
ataccaacagatgttttaaagattgtgtattctgtgggtgctc

SEQ ID NO: 94882 - DNA, 42 bp, Artificial Sequence
  Description of Artificial Sequence: Synthetic oligonucleotide
taccaacagatgttttaaagattgtgtattctgtgggtgctc

SEQ ID NO: 94883 - DNA, 41 bp, Artificial Sequence
  Description of Artificial Sequence: Synthetic oligonucleotide
accaacagatgttttaaagattgtgtattctgtgggtgctc

SEQ ID NO: 94884 - DNA, 40 bp, Artificial Sequence
  Description of Artificial Sequence: Synthetic oligonucleotide
ccaacagatgttttaaagattgtgtattctgtgggtgctc

SEQ ID NO: 94885 - DNA, 41 bp, Artificial Sequence
  Description of Artificial Sequence: Synthetic oligonucleotide
caacagatgttttaaagattgtgtattctgtgggtgctcag

SEQ ID NO: 94886 - DNA, 42 bp, Artificial Sequence
  Description of Artificial Sequence: Synthetic oligonucleotide
aacagatgttttaaagattgtgtattctgtgggtgctcagac

SEQ ID NO: 94887 - DNA, 41 bp, Artificial Sequence
  Description of Artificial Sequence: Synthetic oligonucleotide
acagatgttttaaagattgtgtattctgtgggtgctcagac

SEQ ID NO: 94888 - DNA, 40 bp, Artificial Sequence
  Description of Artificial Sequence: Synthetic oligonucleotide
cagatgttttaaagattgtgtattctgtgggtgctcagac

SEQ ID NO: 94889 - DNA, 42 bp, Artificial Sequence
  Description of Artificial Sequence: Synthetic oligonucleotide
agatgttttaaagattgtgtattctgtgggtgctcagacaac

SEQ ID NO: 94890 - DNA, 41 bp, Artificial Sequence
  Description of Artificial Sequence: Synthetic oligonucleotide
gatgttttaaagattgtgtattctgtgggtgctcagacaac

SEQ ID NO: 94891 - DNA, 42 bp, Artificial Sequence
  Description of Artificial Sequence: Synthetic oligonucleotide
atgttttaaagattgtgtattctgtgggtgctcagacaacag

SEQ ID NO: 94892 - DNA, 41 bp, Artificial Sequence
  Description of Artificial Sequence: Synthetic oligonucleotide
tgttttaaagattgtgtattctgtgggtgctcagacaacag

SEQ ID NO: 94893 - DNA, 40 bp, Artificial Sequence
  Description of Artificial Sequence: Synthetic oligonucleotide
gttttaaagattgtgtattctgtgggtgctcagacaacag

SEQ ID NO: 94894 - DNA, 40 bp, Artificial Sequence
  Description of Artificial Sequence: Synthetic oligonucleotide
ttttaaagattgtgtattctgtgggtgctcagacaacagc

SEQ ID NO: 94895 - DNA, 39 bp, Artificial Sequence
  Description of Artificial Sequence: Synthetic oligonucleotide
tttaaagattgtgtattctgtgggtgctcagacaacagc

SEQ ID NO: 94896 - DNA, 38 bp, Artificial Sequence
  Description of Artificial Sequence: Synthetic oligonucleotide
ttaaagattgtgtattctgtgggtgctcagacaacagc

SEQ ID NO: 94897 - DNA, 37 bp, Artificial Sequence
  Description of Artificial Sequence: Synthetic oligonucleotide
taaagattgtgtattctgtgggtgctcagacaacagc

SEQ ID NO: 94898 - DNA, 36 bp, Artificial Sequence
  Description of Artificial Sequence: Synthetic oligonucleotide
aaagattgtgtattctgtgggtgctcagacaacagc

SEQ ID NO: 94899 - DNA, 35 bp, Artificial Sequence
  Description of Artificial Sequence: Synthetic oligonucleotide
aagattgtgtattctgtgggtgctcagacaacagc

SEQ ID NO: 94900 - DNA, 34 bp, Artificial Sequence
  Description of Artificial Sequence: Synthetic oligonucleotide
agattgtgtattctgtgggtgctcagacaacagc

SEQ ID NO: 94901 - DNA, 33 bp, Artificial Sequence
  Description of Artificial Sequence: Synthetic oligonucleotide
gattgtgtattctgtgggtgctcagacaacagc

SEQ ID NO: 94902 - DNA, 34 bp, Artificial Sequence
  Description of Artificial Sequence: Synthetic oligonucleotide
attgtgtattctgtgggtgctcagacaacagcag

SEQ ID NO: 94903 - DNA, 33 bp, Artificial Sequence
  Description of Artificial Sequence: Synthetic oligonucleotide
ttgtgtattctgtgggtgctcagacaacagcag

SEQ ID NO: 94904 - DNA, 32 bp, Artificial Sequence
  Description of Artificial Sequence: Synthetic oligonucleotide
tgtgtattctgtgggtgctcagacaacagcag

SEQ ID NO: 94905 - DNA, 31 bp, Artificial Sequence
  Description of Artificial Sequence: Synthetic oligonucleotide
gtgtattctgtgggtgctcagacaacagcag

SEQ ID NO: 94906 - DNA, 31 bp, Artificial Sequence
  Description of Artificial Sequence: Synthetic oligonucleotide
tgtattctgtgggtgctcagacaacagcagg

SEQ ID NO: 94907 - DNA, 30 bp, Artificial Sequence
  Description of Artificial Sequence: Synthetic oligonucleotide
gtattctgtgggtgctcagacaacagcagg

SEQ ID NO: 94908 - DNA, 32 bp, Artificial Sequence
  Description of Artificial Sequence: Synthetic oligonucleotide
tattctgtgggtgctcagacaacagcaggatg

SEQ ID NO: 94909 - DNA, 31 bp, Artificial Sequence
  Description of Artificial Sequence: Synthetic oligonucleotide
attctgtgggtgctcagacaacagcaggatg

SEQ ID NO: 94910 - DNA, 30 bp, Artificial Sequence
  Description of Artificial Sequence: Synthetic oligonucleotide
ttctgtgggtgctcagacaacagcaggatg

SEQ ID NO: 94911 - DNA, 29 bp, Artificial Sequence
  Description of Artificial Sequence: Synthetic oligonucleotide
tctgtgggtgctcagacaacagcaggatg

SEQ ID NO: 94912 - DNA, 28 bp, Artificial Sequence
  Description of Artificial Sequence: Synthetic oligonucleotide
ctgtgggtgctcagacaacagcaggatg

SEQ ID NO: 94913 - DNA, 28 bp, Artificial Sequence
  Description of Artificial Sequence: Synthetic oligonucleotide
tgtgggtgctcagacaacagcaggatgg

SEQ ID NO: 94914 - DNA, 27 bp, Artificial Sequence
  Description of Artificial Sequence: Synthetic oligonucleotide
gtgggtgctcagacaacagcaggatgg

SEQ ID NO: 94915 - DNA, 32 bp, Artificial Sequence
  Description of Artificial Sequence: Synthetic oligonucleotide
tgggtgctcagacaacagcaggatggaattac

SEQ ID NO: 94916 - DNA, 31 bp, Artificial Sequence
  Description of Artificial Sequence: Synthetic oligonucleotide
gggtgctcagacaacagcaggatggaattac

SEQ ID NO: 94917 - DNA, 31 bp, Artificial Sequence
  Description of Artificial Sequence: Synthetic oligonucleotide
ggtgctcagacaacagcaggatggaattacc

SEQ ID NO: 94918 - DNA, 36 bp, Artificial Sequence
  Description of Artificial Sequence: Synthetic oligonucleotide
gtgctcagacaacagcaggatggaattaccttttag

SEQ ID NO: 94919 - DNA, 37 bp, Artificial Sequence
  Description of Artificial Sequence: Synthetic oligonucleotide
tgctcagacaacagcaggatggaattaccttttagag

SEQ ID NO: 94920 - DNA, 36 bp, Artificial Sequence
  Description of Artificial Sequence: Synthetic oligonucleotide
gctcagacaacagcaggatggaattaccttttagag

SEQ ID NO: 94921 - DNA, 36 bp, Artificial Sequence
  Description of Artificial Sequence: Synthetic oligonucleotide
ctcagacaacagcaggatggaattaccttttagagc

SEQ ID NO: 94922 - DNA, 41 bp, Artificial Sequence
  Description of Artificial Sequence: Synthetic oligonucleotide
tcagacaacagcaggatggaattaccttttagagcaatatg

SEQ ID NO: 94923 - DNA, 40 bp, Artificial Sequence
  Description of Artificial Sequence: Synthetic oligonucleotide
cagacaacagcaggatggaattaccttttagagcaatatg

SEQ ID NO: 94924 - DNA, 42 bp, Artificial Sequence
  Description of Artificial Sequence: Synthetic oligonucleotide
agacaacagcaggatggaattaccttttagagcaatatgaac

SEQ ID NO: 94925 - DNA, 41 bp, Artificial Sequence
  Description of Artificial Sequence: Synthetic oligonucleotide
gacaacagcaggatggaattaccttttagagcaatatgaac

SEQ ID NO: 94926 - DNA, 42 bp, Artificial Sequence
  Description of Artificial Sequence: Synthetic oligonucleotide
acaacagcaggatggaattaccttttagagcaatatgaactg

SEQ ID NO: 94927 - DNA, 41 bp, Artificial Sequence
  Description of Artificial Sequence: Synthetic oligonucleotide
caacagcaggatggaattaccttttagagcaatatgaactg

SEQ ID NO: 94928 - DNA, 42 bp, Artificial Sequence
  Description of Artificial Sequence: Synthetic oligonucleotide
aacagcaggatggaattaccttttagagcaatatgaactgtc

SEQ ID NO: 94929 - DNA, 41 bp, Artificial Sequence
  Description of Artificial Sequence: Synthetic oligonucleotide
acagcaggatggaattaccttttagagcaatatgaactgtc

SEQ ID NO: 94930 - DNA, 40 bp, Artificial Sequence
  Description of Artificial Sequence: Synthetic oligonucleotide
cagcaggatggaattaccttttagagcaatatgaactgtc

SEQ ID NO: 94931 - DNA, 43 bp, Artificial Sequence
  Description of Artificial Sequence: Synthetic oligonucleotide
agcaggatggaattaccttttagagcaatatgaactgtcaatg

SEQ ID NO: 94932 - DNA, 42 bp, Artificial Sequence
  Description of Artificial Sequence: Synthetic oligonucleotide
gcaggatggaattaccttttagagcaatatgaactgtcaatg

SEQ ID NO: 94933 - DNA, 43 bp, Artificial Sequence
  Description of Artificial Sequence: Synthetic oligonucleotide
caggatggaattaccttttagagcaatatgaactgtcaatgtc

SEQ ID NO: 94934 - DNA, 45 bp, Artificial Sequence
  Description of Artificial Sequence: Synthetic oligonucleotide
aggatggaattaccttttagagcaatatgaactgtcaatgtcaag

SEQ ID NO: 94935 - DNA, 44 bp, Artificial Sequence
  Description of Artificial Sequence: Synthetic oligonucleotide
ggatggaattaccttttagagcaatatgaactgtcaatgtcaag

SEQ ID NO: 94936 - DNA, 45 bp, Artificial Sequence
  Description of Artificial Sequence: Synthetic oligonucleotide
gatggaattaccttttagagcaatatgaactgtcaatgtcaagtg

SEQ ID NO: 94937 - DNA, 45 bp, Artificial Sequence
  Description of Artificial Sequence: Synthetic oligonucleotide
atggaattaccttttagagcaatatgaactgtcaatgtcaagtgc

SEQ ID NO: 94938 - DNA, 44 bp, Artificial Sequence
  Description of Artificial Sequence: Synthetic oligonucleotide
tggaattaccttttagagcaatatgaactgtcaatgtcaagtgc

SEQ ID NO: 94939 - DNA, 43 bp, Artificial Sequence
  Description of Artificial Sequence: Synthetic oligonucleotide
ggaattaccttttagagcaatatgaactgtcaatgtcaagtgc

SEQ ID NO: 94940 - DNA, 44 bp, Artificial Sequence
  Description of Artificial Sequence: Synthetic oligonucleotide
gaattaccttttagagcaatatgaactgtcaatgtcaagtgctg

SEQ ID NO: 94941 - DNA, 46 bp, Artificial Sequence
  Description of Artificial Sequence: Synthetic oligonucleotide
aattaccttttagagcaatatgaactgtcaatgtcaagtgctgaac

SEQ ID NO: 94942 - DNA, 45 bp, Artificial Sequence
  Description of Artificial Sequence: Synthetic oligonucleotide
attaccttttagagcaatatgaactgtcaatgtcaagtgctgaac

SEQ ID NO: 94943 - DNA, 44 bp, Artificial Sequence
  Description of Artificial Sequence: Synthetic oligonucleotide
ttaccttttagagcaatatgaactgtcaatgtcaagtgctgaac

SEQ ID NO: 94944 - DNA, 43 bp, Artificial Sequence
  Description of Artificial Sequence: Synthetic oligonucleotide
taccttttagagcaatatgaactgtcaatgtcaagtgctgaac

SEQ ID NO: 94945 - DNA, 42 bp, Artificial Sequence
  Description of Artificial Sequence: Synthetic oligonucleotide
accttttagagcaatatgaactgtcaatgtcaagtgctgaac

SEQ ID NO: 94946 - DNA, 41 bp, Artificial Sequence
  Description of Artificial Sequence: Synthetic oligonucleotide
ccttttagagcaatatgaactgtcaatgtcaagtgctgaac

SEQ ID NO: 94947 - DNA, 45 bp, Artificial Sequence
  Description of Artificial Sequence: Synthetic oligonucleotide
cttttagagcaatatgaactgtcaatgtcaagtgctgaacaaaac

SEQ ID NO: 94948 - DNA, 51 bp, Artificial Sequence
  Description of Artificial Sequence: Synthetic oligonucleotide
ttttagagcaatatgaactgtcaatgtcaagtgctgaacaaaacaaaattc

SEQ ID NO: 94949 - DNA, 50 bp, Artificial Sequence
  Description of Artificial Sequence: Synthetic oligonucleotide
tttagagcaatatgaactgtcaatgtcaagtgctgaacaaaacaaaattc

SEQ ID NO: 94950 - DNA, 49 bp, Artificial Sequence
  Description of Artificial Sequence: Synthetic oligonucleotide
ttagagcaatatgaactgtcaatgtcaagtgctgaacaaaacaaaattc

SEQ ID NO: 94951 - DNA, 48 bp, Artificial Sequence
  Description of Artificial Sequence: Synthetic oligonucleotide
tagagcaatatgaactgtcaatgtcaagtgctgaacaaaacaaaattc

SEQ ID NO: 94952 - DNA, 47 bp, Artificial Sequence
  Description of Artificial Sequence: Synthetic oligonucleotide
agagcaatatgaactgtcaatgtcaagtgctgaacaaaacaaaattc

SEQ ID NO: 94953 - DNA, 46 bp, Artificial Sequence
  Description of Artificial Sequence: Synthetic oligonucleotide
gagcaatatgaactgtcaatgtcaagtgctgaacaaaacaaaattc

SEQ ID NO: 94954 - DNA, 47 bp, Artificial Sequence
  Description of Artificial Sequence: Synthetic oligonucleotide
agcaatatgaactgtcaatgtcaagtgctgaacaaaacaaaattctg

SEQ ID NO: 94955 - DNA, 46 bp, Artificial Sequence
  Description of Artificial Sequence: Synthetic oligonucleotide
gcaatatgaactgtcaatgtcaagtgctgaacaaaacaaaattctg

SEQ ID NO: 94956 - DNA, 49 bp, Artificial Sequence
  Description of Artificial Sequence: Synthetic oligonucleotide
caatatgaactgtcaatgtcaagtgctgaacaaaacaaaattctgtatg

SEQ ID NO: 94957 - DNA, 49 bp, Artificial Sequence
  Description of Artificial Sequence: Synthetic oligonucleotide
aatatgaactgtcaatgtcaagtgctgaacaaaacaaaattctgtatgc

SEQ ID NO: 94958 - DNA, 48 bp, Artificial Sequence
  Description of Artificial Sequence: Synthetic oligonucleotide
atatgaactgtcaatgtcaagtgctgaacaaaacaaaattctgtatgc

SEQ ID NO: 94959 - DNA, 47 bp, Artificial Sequence
  Description of Artificial Sequence: Synthetic oligonucleotide
tatgaactgtcaatgtcaagtgctgaacaaaacaaaattctgtatgc

SEQ ID NO: 94960 - DNA, 46 bp, Artificial Sequence
  Description of Artificial Sequence: Synthetic oligonucleotide
atgaactgtcaatgtcaagtgctgaacaaaacaaaattctgtatgc

SEQ ID NO: 94961 - DNA, 45 bp, Artificial Sequence
  Description of Artificial Sequence: Synthetic oligonucleotide
tgaactgtcaatgtcaagtgctgaacaaaacaaaattctgtatgc

SEQ ID NO: 94962 - DNA, 44 bp, Artificial Sequence
  Description of Artificial Sequence: Synthetic oligonucleotide
gaactgtcaatgtcaagtgctgaacaaaacaaaattctgtatgc

SEQ ID NO: 94963 - DNA, 47 bp, Artificial Sequence
  Description of Artificial Sequence: Synthetic oligonucleotide
aactgtcaatgtcaagtgctgaacaaaacaaaattctgtatgctttg

SEQ ID NO: 94964 - DNA, 46 bp, Artificial Sequence
  Description of Artificial Sequence: Synthetic oligonucleotide
actgtcaatgtcaagtgctgaacaaaacaaaattctgtatgctttg

SEQ ID NO: 94965 - DNA, 45 bp, Artificial Sequence
  Description of Artificial Sequence: Synthetic oligonucleotide
ctgtcaatgtcaagtgctgaacaaaacaaaattctgtatgctttg

SEQ ID NO: 94966 - DNA, 46 bp, Artificial Sequence
  Description of Artificial Sequence: Synthetic oligonucleotide
tgtcaatgtcaagtgctgaacaaaacaaaattctgtatgctttgtc

SEQ ID NO: 94967 - DNA, 45 bp, Artificial Sequence
  Description of Artificial Sequence: Synthetic oligonucleotide
gtcaatgtcaagtgctgaacaaaacaaaattctgtatgctttgtc

SEQ ID NO: 94968 - DNA, 47 bp, Artificial Sequence
  Description of Artificial Sequence: Synthetic oligonucleotide
tcaatgtcaagtgctgaacaaaacaaaattctgtatgctttgtcaac

SEQ ID NO: 94969 - DNA, 46 bp, Artificial Sequence
  Description of Artificial Sequence: Synthetic oligonucleotide
caatgtcaagtgctgaacaaaacaaaattctgtatgctttgtcaac

SEQ ID NO: 94970 - DNA, 46 bp, Artificial Sequence
  Description of Artificial Sequence: Synthetic oligonucleotide
aatgtcaagtgctgaacaaaacaaaattctgtatgctttgtcaacg

SEQ ID NO: 94971 - DNA, 45 bp, Artificial Sequence
  Description of Artificial Sequence: Synthetic oligonucleotide
atgtcaagtgctgaacaaaacaaaattctgtatgctttgtcaacg

SEQ ID NO: 94972 - DNA, 44 bp, Artificial Sequence
  Description of Artificial Sequence: Synthetic oligonucleotide
tgtcaagtgctgaacaaaacaaaattctgtatgctttgtcaacg

SEQ ID NO: 94973 - DNA, 43 bp, Artificial Sequence
  Description of Artificial Sequence: Synthetic oligonucleotide
gtcaagtgctgaacaaaacaaaattctgtatgctttgtcaacg

SEQ ID NO: 94974 - DNA, 44 bp, Artificial Sequence
  Description of Artificial Sequence: Synthetic oligonucleotide
tcaagtgctgaacaaaacaaaattctgtatgctttgtcaacgag

SEQ ID NO: 94975 - DNA, 43 bp, Artificial Sequence
  Description of Artificial Sequence: Synthetic oligonucleotide
caagtgctgaacaaaacaaaattctgtatgctttgtcaacgag

SEQ ID NO: 94976 - DNA, 43 bp, Artificial Sequence
  Description of Artificial Sequence: Synthetic oligonucleotide
aagtgctgaacaaaacaaaattctgtatgctttgtcaacgagc

SEQ ID NO: 94977 - DNA, 42 bp, Artificial Sequence
  Description of Artificial Sequence: Synthetic oligonucleotide
agtgctgaacaaaacaaaattctgtatgctttgtcaacgagc

SEQ ID NO: 94978 - DNA, 41 bp, Artificial Sequence
  Description of Artificial Sequence: Synthetic oligonucleotide
gtgctgaacaaaacaaaattctgtatgctttgtcaacgagc

SEQ ID NO: 94979 - DNA, 43 bp, Artificial Sequence
  Description of Artificial Sequence: Synthetic oligonucleotide
tgctgaacaaaacaaaattctgtatgctttgtcaacgagcaag

SEQ ID NO: 94980 - DNA, 42 bp, Artificial Sequence
  Description of Artificial Sequence: Synthetic oligonucleotide
gctgaacaaaacaaaattctgtatgctttgtcaacgagcaag

SEQ ID NO: 94981 - DNA, 42 bp, Artificial Sequence
  Description of Artificial Sequence: Synthetic oligonucleotide
ctgaacaaaacaaaattctgtatgctttgtcaacgagcaagc

SEQ ID NO: 94982 - DNA, 44 bp, Artificial Sequence
  Description of Artificial Sequence: Synthetic oligonucleotide
tgaacaaaacaaaattctgtatgctttgtcaacgagcaagcatc

SEQ ID NO: 94983 - DNA, 43 bp, Artificial Sequence
  Description of Artificial Sequence: Synthetic oligonucleotide
gaacaaaacaaaattctgtatgctttgtcaacgagcaagcatc

SEQ ID NO: 94984 - DNA, 44 bp, Artificial Sequence
  Description of Artificial Sequence: Synthetic oligonucleotide
aacaaaacaaaattctgtatgctttgtcaacgagcaagcatcag

SEQ ID NO: 94985 - DNA, 43 bp, Artificial Sequence
  Description of Artificial Sequence: Synthetic oligonucleotide
acaaaacaaaattctgtatgctttgtcaacgagcaagcatcag

SEQ ID NO: 94986 - DNA, 42 bp, Artificial Sequence
  Description of Artificial Sequence: Synthetic oligonucleotide
caaaacaaaattctgtatgctttgtcaacgagcaagcatcag

SEQ ID NO: 94987 - DNA, 42 bp, Artificial Sequence
  Description of Artificial Sequence: Synthetic oligonucleotide
aaaacaaaattctgtatgctttgtcaacgagcaagcatcagg

SEQ ID NO: 94988 - DNA, 41 bp, Artificial Sequence
  Description of Artificial Sequence: Synthetic oligonucleotide
aaacaaaattctgtatgctttgtcaacgagcaagcatcagg

SEQ ID NO: 94989 - DNA, 40 bp, Artificial Sequence
  Description of Artificial Sequence: Synthetic oligonucleotide
aacaaaattctgtatgctttgtcaacgagcaagcatcagg

SEQ ID NO: 94990 - DNA, 39 bp, Artificial Sequence
  Description of Artificial Sequence: Synthetic oligonucleotide
acaaaattctgtatgctttgtcaacgagcaagcatcagg

SEQ ID NO: 94991 - DNA, 38 bp, Artificial Sequence
  Description of Artificial Sequence: Synthetic oligonucleotide
caaaattctgtatgctttgtcaacgagcaagcatcagg

SEQ ID NO: 94992 - DNA, 42 bp, Artificial Sequence
  Description of Artificial Sequence: Synthetic oligonucleotide
aaaattctgtatgctttgtcaacgagcaagcatcaggaaaag

SEQ ID NO: 94993 - DNA, 41 bp, Artificial Sequence
  Description of Artificial Sequence: Synthetic oligonucleotide
aaattctgtatgctttgtcaacgagcaagcatcaggaaaag

SEQ ID NO: 94994 - DNA, 40 bp, Artificial Sequence
  Description of Artificial Sequence: Synthetic oligonucleotide
aattctgtatgctttgtcaacgagcaagcatcaggaaaag

SEQ ID NO: 94995 - DNA, 39 bp, Artificial Sequence
  Description of Artificial Sequence: Synthetic oligonucleotide
attctgtatgctttgtcaacgagcaagcatcaggaaaag

SEQ ID NO: 94996 - DNA, 38 bp, Artificial Sequence
  Description of Artificial Sequence: Synthetic oligonucleotide
ttctgtatgctttgtcaacgagcaagcatcaggaaaag

SEQ ID NO: 94997 - DNA, 37 bp, Artificial Sequence
  Description of Artificial Sequence: Synthetic oligonucleotide
tctgtatgctttgtcaacgagcaagcatcaggaaaag

SEQ ID NO: 94998 - DNA, 36 bp, Artificial Sequence
  Description of Artificial Sequence: Synthetic oligonucleotide
ctgtatgctttgtcaacgagcaagcatcaggaaaag

SEQ ID NO: 94999 - DNA, 39 bp, Artificial Sequence
  Description of Artificial Sequence: Synthetic oligonucleotide
tgtatgctttgtcaacgagcaagcatcaggaaaagttac

SEQ ID NO: 95000 - DNA, 38 bp, Artificial Sequence
  Description of Artificial Sequence: Synthetic oligonucleotide
gtatgctttgtcaacgagcaagcatcaggaaaagttac

SEQ ID NO: 95001 - DNA, 39 bp, Artificial Sequence
  Description of Artificial Sequence: Synthetic oligonucleotide
tatgctttgtcaacgagcaagcatcaggaaaagttactg

SEQ ID NO: 95002 - DNA, 38 bp, Artificial Sequence
  Description of Artificial Sequence: Synthetic oligonucleotide
atgctttgtcaacgagcaagcatcaggaaaagttactg

SEQ ID NO: 95003 - DNA, 37 bp, Artificial Sequence
  Description of Artificial Sequence: Synthetic oligonucleotide
tgctttgtcaacgagcaagcatcaggaaaagttactg

SEQ ID NO: 95004 - DNA, 36 bp, Artificial Sequence
  Description of Artificial Sequence: Synthetic oligonucleotide
gctttgtcaacgagcaagcatcaggaaaagttactg

SEQ ID NO: 95005 - DNA, 38 bp, Artificial Sequence
  Description of Artificial Sequence: Synthetic oligonucleotide
ctttgtcaacgagcaagcatcaggaaaagttactgaag

SEQ ID NO: 95006 - DNA, 44 bp, Artificial Sequence
  Description of Artificial Sequence: Synthetic oligonucleotide
tttgtcaacgagcaagcatcaggaaaagttactgaagttaattg

SEQ ID NO: 95007 - DNA, 43 bp, Artificial Sequence
  Description of Artificial Sequence: Synthetic oligonucleotide
ttgtcaacgagcaagcatcaggaaaagttactgaagttaattg

SEQ ID NO: 95008 - DNA, 42 bp, Artificial Sequence
  Description of Artificial Sequence: Synthetic oligonucleotide
tgtcaacgagcaagcatcaggaaaagttactgaagttaattg

SEQ ID NO: 95009 - DNA, 41 bp, Artificial Sequence
  Description of Artificial Sequence: Synthetic oligonucleotide
gtcaacgagcaagcatcaggaaaagttactgaagttaattg

SEQ ID NO: 95010 - DNA, 43 bp, Artificial Sequence
  Description of Artificial Sequence: Synthetic oligonucleotide
tcaacgagcaagcatcaggaaaagttactgaagttaattgaac

SEQ ID NO: 95011 - DNA, 42 bp, Artificial Sequence
  Description of Artificial Sequence: Synthetic oligonucleotide
caacgagcaagcatcaggaaaagttactgaagttaattgaac

SEQ ID NO: 95012 - DNA, 44 bp, Artificial Sequence
  Description of Artificial Sequence: Synthetic oligonucleotide
aacgagcaagcatcaggaaaagttactgaagttaattgaactag

SEQ ID NO: 95013 - DNA, 43 bp, Artificial Sequence
  Description of Artificial Sequence: Synthetic oligonucleotide
acgagcaagcatcaggaaaagttactgaagttaattgaactag

SEQ ID NO: 95014 - DNA, 42 bp, Artificial Sequence
  Description of Artificial Sequence: Synthetic oligonucleotide
cgagcaagcatcaggaaaagttactgaagttaattgaactag

SEQ ID NO: 95015 - DNA, 42 bp, Artificial Sequence
  Description of Artificial Sequence: Synthetic oligonucleotide
gagcaagcatcaggaaaagttactgaagttaattgaactagg

SEQ ID NO: 95016 - DNA, 45 bp, Artificial Sequence
  Description of Artificial Sequence: Synthetic oligonucleotide
agcaagcatcaggaaaagttactgaagttaattgaactaggaatg

SEQ ID NO: 95017 - DNA, 44 bp, Artificial Sequence
  Description of Artificial Sequence: Synthetic oligonucleotide
gcaagcatcaggaaaagttactgaagttaattgaactaggaatg

SEQ ID NO: 95018 - DNA, 44 bp, Artificial Sequence
  Description of Artificial Sequence: Synthetic oligonucleotide
caagcatcaggaaaagttactgaagttaattgaactaggaatgg

SEQ ID NO: 95019 - DNA, 46 bp, Artificial Sequence
  Description of Artificial Sequence: Synthetic oligonucleotide
aagcatcaggaaaagttactgaagttaattgaactaggaatggaag

SEQ ID NO: 95020 - DNA, 45 bp, Artificial Sequence
  Description of Artificial Sequence: Synthetic oligonucleotide
agcatcaggaaaagttactgaagttaattgaactaggaatggaag

SEQ ID NO: 95021 - DNA, 44 bp, Artificial Sequence
  Description of Artificial Sequence: Synthetic oligonucleotide
gcatcaggaaaagttactgaagttaattgaactaggaatggaag

SEQ ID NO: 95022 - DNA, 44 bp, Artificial Sequence
  Description of Artificial Sequence: Synthetic oligonucleotide
catcaggaaaagttactgaagttaattgaactaggaatggaagg

SEQ ID NO: 95023 - DNA, 47 bp, Artificial Sequence
  Description of Artificial Sequence: Synthetic oligonucleotide
atcaggaaaagttactgaagttaattgaactaggaatggaaggaaag

SEQ ID NO: 95024 - DNA, 46 bp, Artificial Sequence
  Description of Artificial Sequence: Synthetic oligonucleotide
tcaggaaaagttactgaagttaattgaactaggaatggaaggaaag

SEQ ID NO: 95025 - DNA, 45 bp, Artificial Sequence
  Description of Artificial Sequence: Synthetic oligonucleotide
caggaaaagttactgaagttaattgaactaggaatggaaggaaag

SEQ ID NO: 95026 - DNA, 45 bp, Artificial Sequence
  Description of Artificial Sequence: Synthetic oligonucleotide
aggaaaagttactgaagttaattgaactaggaatggaaggaaagg

SEQ ID NO: 95027 - DNA, 44 bp, Artificial Sequence
  Description of Artificial Sequence: Synthetic oligonucleotide
ggaaaagttactgaagttaattgaactaggaatggaaggaaagg

SEQ ID NO: 95028 - DNA, 48 bp, Artificial Sequence
  Description of Artificial Sequence: Synthetic oligonucleotide
gaaaagttactgaagttaattgaactaggaatggaaggaaaggttatc

SEQ ID NO: 95029 - DNA, 50 bp, Artificial Sequence
  Description of Artificial Sequence: Synthetic oligonucleotide
aaaagttactgaagttaattgaactaggaatggaaggaaaggttatcaag

SEQ ID NO: 95030 - DNA, 49 bp, Artificial Sequence
  Description of Artificial Sequence: Synthetic oligonucleotide
aaagttactgaagttaattgaactaggaatggaaggaaaggttatcaag

SEQ ID NO: 95031 - DNA, 48 bp, Artificial Sequence
  Description of Artificial Sequence: Synthetic oligonucleotide
aagttactgaagttaattgaactaggaatggaaggaaaggttatcaag

SEQ ID NO: 95032 - DNA, 47 bp, Artificial Sequence
  Description of Artificial Sequence: Synthetic oligonucleotide
agttactgaagttaattgaactaggaatggaaggaaaggttatcaag

SEQ ID NO: 95033 - DNA, 46 bp, Artificial Sequence
  Description of Artificial Sequence: Synthetic oligonucleotide
gttactgaagttaattgaactaggaatggaaggaaaggttatcaag

SEQ ID NO: 95034 - DNA, 47 bp, Artificial Sequence
  Description of Artificial Sequence: Synthetic oligonucleotide
ttactgaagttaattgaactaggaatggaaggaaaggttatcaagac

SEQ ID NO: 95035 - DNA, 46 bp, Artificial Sequence
  Description of Artificial Sequence: Synthetic oligonucleotide
tactgaagttaattgaactaggaatggaaggaaaggttatcaagac

SEQ ID NO: 95036 - DNA, 45 bp, Artificial Sequence
  Description of Artificial Sequence: Synthetic oligonucleotide
actgaagttaattgaactaggaatggaaggaaaggttatcaagac

SEQ ID NO: 95037 - DNA, 44 bp, Artificial Sequence
  Description of Artificial Sequence: Synthetic oligonucleotide
ctgaagttaattgaactaggaatggaaggaaaggttatcaagac

SEQ ID NO: 95038 - DNA, 45 bp, Artificial Sequence
  Description of Artificial Sequence: Synthetic oligonucleotide
tgaagttaattgaactaggaatggaaggaaaggttatcaagacac

SEQ ID NO: 95039 - DNA, 44 bp, Artificial Sequence
  Description of Artificial Sequence: Synthetic oligonucleotide
gaagttaattgaactaggaatggaaggaaaggttatcaagacac

SEQ ID NO: 95040 - DNA, 45 bp, Artificial Sequence
  Description of Artificial Sequence: Synthetic oligonucleotide
aagttaattgaactaggaatggaaggaaaggttatcaagacacag

SEQ ID NO: 95041 - DNA, 44 bp, Artificial Sequence
  Description of Artificial Sequence: Synthetic oligonucleotide
agttaattgaactaggaatggaaggaaaggttatcaagacacag

SEQ ID NO: 95042 - DNA, 43 bp, Artificial Sequence
  Description of Artificial Sequence: Synthetic oligonucleotide
gttaattgaactaggaatggaaggaaaggttatcaagacacag

SEQ ID NO: 95043 - DNA, 45 bp, Artificial Sequence
  Description of Artificial Sequence: Synthetic oligonucleotide
ttaattgaactaggaatggaaggaaaggttatcaagacacagaac

SEQ ID NO: 95044 - DNA, 44 bp, Artificial Sequence
  Description of Artificial Sequence: Synthetic oligonucleotide
taattgaactaggaatggaaggaaaggttatcaagacacagaac

SEQ ID NO: 95045 - DNA, 43 bp, Artificial Sequence
  Description of Artificial Sequence: Synthetic oligonucleotide
aattgaactaggaatggaaggaaaggttatcaagacacagaac

SEQ ID NO: 95046 - DNA, 42 bp, Artificial Sequence
  Description of Artificial Sequence: Synthetic oligonucleotide
attgaactaggaatggaaggaaaggttatcaagacacagaac

SEQ ID NO: 95047 - DNA, 41 bp, Artificial Sequence
  Description of Artificial Sequence: Synthetic oligonucleotide
ttgaactaggaatggaaggaaaggttatcaagacacagaac

SEQ ID NO: 95048 - DNA, 40 bp, Artificial Sequence
  Description of Artificial Sequence: Synthetic oligonucleotide
tgaactaggaatggaaggaaaggttatcaagacacagaac

SEQ ID NO: 95049 - DNA, 39 bp, Artificial Sequence
  Description of Artificial Sequence: Synthetic oligonucleotide
gaactaggaatggaaggaaaggttatcaagacacagaac

SEQ ID NO: 95050 - DNA, 41 bp, Artificial Sequence
  Description of Artificial Sequence: Synthetic oligonucleotide
aactaggaatggaaggaaaggttatcaagacacagaacttg

SEQ ID NO: 95051 - DNA, 40 bp, Artificial Sequence
  Description of Artificial Sequence: Synthetic oligonucleotide
actaggaatggaaggaaaggttatcaagacacagaacttg

SEQ ID NO: 95052 - DNA, 39 bp, Artificial Sequence
  Description of Artificial Sequence: Synthetic oligonucleotide
ctaggaatggaaggaaaggttatcaagacacagaacttg

SEQ ID NO: 95053 - DNA, 39 bp, Artificial Sequence
  Description of Artificial Sequence: Synthetic oligonucleotide
taggaatggaaggaaaggttatcaagacacagaacttgg

SEQ ID NO: 95054 - DNA, 38 bp, Artificial Sequence
  Description of Artificial Sequence: Synthetic oligonucleotide
aggaatggaaggaaaggttatcaagacacagaacttgg

SEQ ID NO: 95055 - DNA, 37 bp, Artificial Sequence
  Description of Artificial Sequence: Synthetic oligonucleotide
ggaatggaaggaaaggttatcaagacacagaacttgg

SEQ ID NO: 95056 - DNA, 37 bp, Artificial Sequence
  Description of Artificial Sequence: Synthetic oligonucleotide
gaatggaaggaaaggttatcaagacacagaacttggc

SEQ ID NO: 95057 - DNA, 38 bp, Artificial Sequence
  Description of Artificial Sequence: Synthetic oligonucleotide
aatggaaggaaaggttatcaagacacagaacttggcag

SEQ ID NO: 95058 - DNA, 37 bp, Artificial Sequence
  Description of Artificial Sequence: Synthetic oligonucleotide
atggaaggaaaggttatcaagacacagaacttggcag

SEQ ID NO: 95059 - DNA, 36 bp, Artificial Sequence
  Description of Artificial Sequence: Synthetic oligonucleotide
tggaaggaaaggttatcaagacacagaacttggcag

SEQ ID NO: 95060 - DNA, 35 bp, Artificial Sequence
  Description of Artificial Sequence: Synthetic oligonucleotide
ggaaggaaaggttatcaagacacagaacttggcag

SEQ ID NO: 95061 - DNA, 35 bp, Artificial Sequence
  Description of Artificial Sequence: Synthetic oligonucleotide
gaaggaaaggttatcaagacacagaacttggcagc

SEQ ID NO: 95062 - DNA, 36 bp, Artificial Sequence
  Description of Artificial Sequence: Synthetic oligonucleotide
aaggaaaggttatcaagacacagaacttggcagctc

SEQ ID NO: 95063 - DNA, 35 bp, Artificial Sequence
  Description of Artificial Sequence: Synthetic oligonucleotide
aggaaaggttatcaagacacagaacttggcagctc

SEQ ID NO: 95064 - DNA, 34 bp, Artificial Sequence
  Description of Artificial Sequence: Synthetic oligonucleotide
ggaaaggttatcaagacacagaacttggcagctc

SEQ ID NO: 95065 - DNA, 35 bp, Artificial Sequence
  Description of Artificial Sequence: Synthetic oligonucleotide
gaaaggttatcaagacacagaacttggcagctctc

SEQ ID NO: 95066 - DNA, 35 bp, Artificial Sequence
  Description of Artificial Sequence: Synthetic oligonucleotide
aaaggttatcaagacacagaacttggcagctctcc

SEQ ID NO: 95067 - DNA, 34 bp, Artificial Sequence
  Description of Artificial Sequence: Synthetic oligonucleotide
aaggttatcaagacacagaacttggcagctctcc

SEQ ID NO: 95068 - DNA, 33 bp, Artificial Sequence
  Description of Artificial Sequence: Synthetic oligonucleotide
aggttatcaagacacagaacttggcagctctcc

SEQ ID NO: 95069 - DNA, 32 bp, Artificial Sequence
  Description of Artificial Sequence: Synthetic oligonucleotide
ggttatcaagacacagaacttggcagctctcc

SEQ ID NO: 95070 - DNA, 34 bp, Artificial Sequence
  Description of Artificial Sequence: Synthetic oligonucleotide
gttatcaagacacagaacttggcagctctccttc

SEQ ID NO: 95071 - DNA, 36 bp, Artificial Sequence
  Description of Artificial Sequence: Synthetic oligonucleotide
ttatcaagacacagaacttggcagctctccttcatg

SEQ ID NO: 95072 - DNA, 35 bp, Artificial Sequence
  Description of Artificial Sequence: Synthetic oligonucleotide
tatcaagacacagaacttggcagctctccttcatg

SEQ ID NO: 95073 - DNA, 34 bp, Artificial Sequence
  Description of Artificial Sequence: Synthetic oligonucleotide
atcaagacacagaacttggcagctctccttcatg

SEQ ID NO: 95074 - DNA, 33 bp, Artificial Sequence
  Description of Artificial Sequence: Synthetic oligonucleotide
tcaagacacagaacttggcagctctccttcatg

SEQ ID NO: 95075 - DNA, 32 bp, Artificial Sequence
  Description of Artificial Sequence: Synthetic oligonucleotide
caagacacagaacttggcagctctccttcatg

SEQ ID NO: 95076 - DNA, 32 bp, Artificial Sequence
  Description of Artificial Sequence: Synthetic oligonucleotide
aagacacagaacttggcagctctccttcatgc

SEQ ID NO: 95077 - DNA, 31 bp, Artificial Sequence
  Description of Artificial Sequence: Synthetic oligonucleotide
agacacagaacttggcagctctccttcatgc

SEQ ID NO: 95078 - DNA, 30 bp, Artificial Sequence
  Description of Artificial Sequence: Synthetic oligonucleotide
gacacagaacttggcagctctccttcatgc

SEQ ID NO: 95079 - DNA, 30 bp, Artificial Sequence
  Description of Artificial Sequence: Synthetic oligonucleotide
acacagaacttggcagctctccttcatgcg

SEQ ID NO: 95080 - DNA, 29 bp, Artificial Sequence
  Description of Artificial Sequence: Synthetic oligonucleotide
cacagaacttggcagctctccttcatgcg

SEQ ID NO: 95081 - DNA, 32 bp, Artificial Sequence
  Description of Artificial Sequence: Synthetic oligonucleotide
acagaacttggcagctctccttcatgcgattg

SEQ ID NO: 95082 - DNA, 31 bp, Artificial Sequence
  Description of Artificial Sequence: Synthetic oligonucleotide
cagaacttggcagctctccttcatgcgattg

SEQ ID NO: 95083 - DNA, 31 bp, Artificial Sequence
  Description of Artificial Sequence: Synthetic oligonucleotide
agaacttggcagctctccttcatgcgattgc

SEQ ID NO: 95084 - DNA, 30 bp, Artificial Sequence
  Description of Artificial Sequence: Synthetic oligonucleotide
gaacttggcagctctccttcatgcgattgc

SEQ ID NO: 95085 - DNA, 30 bp, Artificial Sequence
  Description of Artificial Sequence: Synthetic oligonucleotide
aacttggcagctctccttcatgcgattgcc

SEQ ID NO: 95086 - DNA, 29 bp, Artificial Sequence
  Description of Artificial Sequence: Synthetic oligonucleotide
acttggcagctctccttcatgcgattgcc

SEQ ID NO: 95087 - DNA, 28 bp, Artificial Sequence
  Description of Artificial Sequence: Synthetic oligonucleotide
cttggcagctctccttcatgcgattgcc

SEQ ID NO: 95088 - DNA, 29 bp, Artificial Sequence
  Description of Artificial Sequence: Synthetic oligonucleotide
ttggcagctctccttcatgcgattgccag

SEQ ID NO: 95089 - DNA, 28 bp, Artificial Sequence
  Description of Artificial Sequence: Synthetic oligonucleotide
tggcagctctccttcatgcgattgccag

SEQ ID NO: 95090 - DNA, 27 bp, Artificial Sequence
  Description of Artificial Sequence: Synthetic oligonucleotide
ggcagctctccttcatgcgattgccag

SEQ ID NO: 95091 - DNA, 28 bp, Artificial Sequence
  Description of Artificial Sequence: Synthetic oligonucleotide
gcagctctccttcatgcgattgccagac

SEQ ID NO: 95092 - DNA, 28 bp, Artificial Sequence
  Description of Artificial Sequence: Synthetic oligonucleotide
cagctctccttcatgcgattgccagacg

SEQ ID NO: 95093 - DNA, 29 bp, Artificial Sequence
  Description of Artificial Sequence: Synthetic oligonucleotide
agctctccttcatgcgattgccagacgtc

SEQ ID NO: 95094 - DNA, 28 bp, Artificial Sequence
  Description of Artificial Sequence: Synthetic oligonucleotide
gctctccttcatgcgattgccagacgtc

SEQ ID NO: 95095 - DNA, 28 bp, Artificial Sequence
  Description of Artificial Sequence: Synthetic oligonucleotide
ctctccttcatgcgattgccagacgtcc

SEQ ID NO: 95096 - DNA, 31 bp, Artificial Sequence
  Description of Artificial Sequence: Synthetic oligonucleotide
tctccttcatgcgattgccagacgtccaaag

SEQ ID NO: 95097 - DNA, 30 bp, Artificial Sequence
  Description of Artificial Sequence: Synthetic oligonucleotide
ctccttcatgcgattgccagacgtccaaag

SEQ ID NO: 95098 - DNA, 30 bp, Artificial Sequence
  Description of Artificial Sequence: Synthetic oligonucleotide
tccttcatgcgattgccagacgtccaaagg

SEQ ID NO: 95099 - DNA, 29 bp, Artificial Sequence
  Description of Artificial Sequence: Synthetic oligonucleotide
ccttcatgcgattgccagacgtccaaagg

SEQ ID NO: 95100 - DNA, 29 bp, Artificial Sequence
  Description of Artificial Sequence: Synthetic oligonucleotide
cttcatgcgattgccagacgtccaaaggg

SEQ ID NO: 95101 - DNA, 29 bp, Artificial Sequence
  Description of Artificial Sequence: Synthetic oligonucleotide
ttcatgcgattgccagacgtccaaagggg

SEQ ID NO: 95102 - DNA, 28 bp, Artificial Sequence
  Description of Artificial Sequence: Synthetic oligonucleotide
tcatgcgattgccagacgtccaaagggg

SEQ ID NO: 95103 - DNA, 27 bp, Artificial Sequence
  Description of Artificial Sequence: Synthetic oligonucleotide
catgcgattgccagacgtccaaagggg

SEQ ID NO: 95104 - DNA, 27 bp, Artificial Sequence
  Description of Artificial Sequence: Synthetic oligonucleotide
atgcgattgccagacgtccaaaggggc

SEQ ID NO: 95105 - DNA, 27 bp, Artificial Sequence
  Description of Artificial Sequence: Synthetic oligonucleotide
tgcgattgccagacgtccaaaggggca

SEQ ID NO: 95106 - DNA, 26 bp, Artificial Sequence
  Description of Artificial Sequence: Synthetic oligonucleotide
gcgattgccagacgtccaaaggggca

SEQ ID NO: 95107 - DNA, 26 bp, Artificial Sequence
  Description of Artificial Sequence: Synthetic oligonucleotide
cgattgccagacgtccaaaggggcag

SEQ ID NO: 95108 - DNA, 27 bp, Artificial Sequence
  Description of Artificial Sequence: Synthetic oligonucleotide
gattgccagacgtccaaaggggcagca

SEQ ID NO: 95109 - DNA, 28 bp, Artificial Sequence
  Description of Artificial Sequence: Synthetic oligonucleotide
attgccagacgtccaaaggggcagcaac

SEQ ID NO: 95110 - DNA, 27 bp, Artificial Sequence
  Description of Artificial Sequence: Synthetic oligonucleotide
ttgccagacgtccaaaggggcagcaac

SEQ ID NO: 95111 - DNA, 27 bp, Artificial Sequence
  Description of Artificial Sequence: Synthetic oligonucleotide
tgccagacgtccaaaggggcagcaact

SEQ ID NO: 95112 - DNA, 27 bp, Artificial Sequence
  Description of Artificial Sequence: Synthetic oligonucleotide
gccagacgtccaaaggggcagcaacta

SEQ ID NO: 95113 - DNA, 27 bp, Artificial Sequence
  Description of Artificial Sequence: Synthetic oligonucleotide
ccagacgtccaaaggggcagcaactag

SEQ ID NO: 95114 - DNA, 27 bp, Artificial Sequence
  Description of Artificial Sequence: Synthetic oligonucleotide
cagacgtccaaaggggcagcaactagc

SEQ ID NO: 95115 - DNA, 29 bp, Artificial Sequence
  Description of Artificial Sequence: Synthetic oligonucleotide
agacgtccaaaggggcagcaactagcatg

SEQ ID NO: 95116 - DNA, 28 bp, Artificial Sequence
  Description of Artificial Sequence: Synthetic oligonucleotide
gacgtccaaaggggcagcaactagcatg

SEQ ID NO: 95117 - DNA, 28 bp, Artificial Sequence
  Description of Artificial Sequence: Synthetic oligonucleotide
acgtccaaaggggcagcaactagcatgg

SEQ ID NO: 95118 - DNA, 27 bp, Artificial Sequence
  Description of Artificial Sequence: Synthetic oligonucleotide
cgtccaaaggggcagcaactagcatgg

SEQ ID NO: 95119 - DNA, 27 bp, Artificial Sequence
  Description of Artificial Sequence: Synthetic oligonucleotide
gtccaaaggggcagcaactagcatggg

SEQ ID NO: 95120 - DNA, 32 bp, Artificial Sequence
  Description of Artificial Sequence: Synthetic oligonucleotide
tccaaaggggcagcaactagcatgggattttg

SEQ ID NO: 95121 - DNA, 31 bp, Artificial Sequence
  Description of Artificial Sequence: Synthetic oligonucleotide
ccaaaggggcagcaactagcatgggattttg

SEQ ID NO: 95122 - DNA, 34 bp, Artificial Sequence
  Description of Artificial Sequence: Synthetic oligonucleotide
caaaggggcagcaactagcatgggattttgtaag

SEQ ID NO: 95123 - DNA, 35 bp, Artificial Sequence
  Description of Artificial Sequence: Synthetic oligonucleotide
aaaggggcagcaactagcatgggattttgtaagag

SEQ ID NO: 95124 - DNA, 34 bp, Artificial Sequence
  Description of Artificial Sequence: Synthetic oligonucleotide
aaggggcagcaactagcatgggattttgtaagag

SEQ ID NO: 95125 - DNA, 33 bp, Artificial Sequence
  Description of Artificial Sequence: Synthetic oligonucleotide
aggggcagcaactagcatgggattttgtaagag

SEQ ID NO: 95126 - DNA, 32 bp, Artificial Sequence
  Description of Artificial Sequence: Synthetic oligonucleotide
ggggcagcaactagcatgggattttgtaagag

SEQ ID NO: 95127 - DNA, 38 bp, Artificial Sequence
  Description of Artificial Sequence: Synthetic oligonucleotide
gggcagcaactagcatgggattttgtaagagaaaattg

SEQ ID NO: 95128 - DNA, 38 bp, Artificial Sequence
  Description of Artificial Sequence: Synthetic oligonucleotide
ggcagcaactagcatgggattttgtaagagaaaattgg

SEQ ID NO: 95129 - DNA, 39 bp, Artificial Sequence
  Description of Artificial Sequence: Synthetic oligonucleotide
gcagcaactagcatgggattttgtaagagaaaattggac

SEQ ID NO: 95130 - DNA, 39 bp, Artificial Sequence
  Description of Artificial Sequence: Synthetic oligonucleotide
cagcaactagcatgggattttgtaagagaaaattggacc

SEQ ID NO: 95131 - DNA, 39 bp, Artificial Sequence
  Description of Artificial Sequence: Synthetic oligonucleotide
agcaactagcatgggattttgtaagagaaaattggaccc

SEQ ID NO: 95132 - DNA, 38 bp, Artificial Sequence
  Description of Artificial Sequence: Synthetic oligonucleotide
gcaactagcatgggattttgtaagagaaaattggaccc

SEQ ID NO: 95133 - DNA, 40 bp, Artificial Sequence
  Description of Artificial Sequence: Synthetic oligonucleotide
caactagcatgggattttgtaagagaaaattggacccatc

SEQ ID NO: 95134 - DNA, 42 bp, Artificial Sequence
  Description of Artificial Sequence: Synthetic oligonucleotide
aactagcatgggattttgtaagagaaaattggacccatcttc

SEQ ID NO: 95135 - DNA, 41 bp, Artificial Sequence
  Description of Artificial Sequence: Synthetic oligonucleotide
actagcatgggattttgtaagagaaaattggacccatcttc

SEQ ID NO: 95136 - DNA, 40 bp, Artificial Sequence
  Description of Artificial Sequence: Synthetic oligonucleotide
ctagcatgggattttgtaagagaaaattggacccatcttc

SEQ ID NO: 95137 - DNA, 41 bp, Artificial Sequence
  Description of Artificial Sequence: Synthetic oligonucleotide
tagcatgggattttgtaagagaaaattggacccatcttctg

SEQ ID NO: 95138 - DNA, 40 bp, Artificial Sequence
  Description of Artificial Sequence: Synthetic oligonucleotide
agcatgggattttgtaagagaaaattggacccatcttctg

SEQ ID NO: 95139 - DNA, 39 bp, Artificial Sequence
  Description of Artificial Sequence: Synthetic oligonucleotide
gcatgggattttgtaagagaaaattggacccatcttctg

SEQ ID NO: 95140 - DNA, 48 bp, Artificial Sequence
  Description of Artificial Sequence: Synthetic oligonucleotide
catgggattttgtaagagaaaattggacccatcttctgaaaaaatttg

SEQ ID NO: 95141 - DNA, 49 bp, Artificial Sequence
  Description of Artificial Sequence: Synthetic oligonucleotide
atgggattttgtaagagaaaattggacccatcttctgaaaaaatttgac

SEQ ID NO: 95142 - DNA, 48 bp, Artificial Sequence
  Description of Artificial Sequence: Synthetic oligonucleotide
tgggattttgtaagagaaaattggacccatcttctgaaaaaatttgac

SEQ ID NO: 95143 - DNA, 47 bp, Artificial Sequence
  Description of Artificial Sequence: Synthetic oligonucleotide
gggattttgtaagagaaaattggacccatcttctgaaaaaatttgac

SEQ ID NO: 95144 - DNA, 49 bp, Artificial Sequence
  Description of Artificial Sequence: Synthetic oligonucleotide
ggattttgtaagagaaaattggacccatcttctgaaaaaatttgacttg

SEQ ID NO: 95145 - DNA, 49 bp, Artificial Sequence
  Description of Artificial Sequence: Synthetic oligonucleotide
gattttgtaagagaaaattggacccatcttctgaaaaaatttgacttgg

SEQ ID NO: 95146 - DNA, 49 bp, Artificial Sequence
  Description of Artificial Sequence: Synthetic oligonucleotide
attttgtaagagaaaattggacccatcttctgaaaaaatttgacttggg

SEQ ID NO: 95147 - DNA, 48 bp, Artificial Sequence
  Description of Artificial Sequence: Synthetic oligonucleotide
ttttgtaagagaaaattggacccatcttctgaaaaaatttgacttggg

SEQ ID NO: 95148 - DNA, 47 bp, Artificial Sequence
  Description of Artificial Sequence: Synthetic oligonucleotide
tttgtaagagaaaattggacccatcttctgaaaaaatttgacttggg

SEQ ID NO: 95149 - DNA, 46 bp, Artificial Sequence
  Description of Artificial Sequence: Synthetic oligonucleotide
ttgtaagagaaaattggacccatcttctgaaaaaatttgacttggg

SEQ ID NO: 95150 - DNA, 45 bp, Artificial Sequence
  Description of Artificial Sequence: Synthetic oligonucleotide
tgtaagagaaaattggacccatcttctgaaaaaatttgacttggg

SEQ ID NO: 95151 - DNA, 44 bp, Artificial Sequence
  Description of Artificial Sequence: Synthetic oligonucleotide
gtaagagaaaattggacccatcttctgaaaaaatttgacttggg

SEQ ID NO: 95152 - DNA, 44 bp, Artificial Sequence
  Description of Artificial Sequence: Synthetic oligonucleotide
taagagaaaattggacccatcttctgaaaaaatttgacttgggc

SEQ ID NO: 95153 - DNA, 43 bp, Artificial Sequence
  Description of Artificial Sequence: Synthetic oligonucleotide
aagagaaaattggacccatcttctgaaaaaatttgacttgggc

SEQ ID NO: 95154 - DNA, 42 bp, Artificial Sequence
  Description of Artificial Sequence: Synthetic oligonucleotide
agagaaaattggacccatcttctgaaaaaatttgacttgggc

SEQ ID NO: 95155 - DNA, 41 bp, Artificial Sequence
  Description of Artificial Sequence: Synthetic oligonucleotide
gagaaaattggacccatcttctgaaaaaatttgacttgggc

SEQ ID NO: 95156 - DNA, 42 bp, Artificial Sequence
  Description of Artificial Sequence: Synthetic oligonucleotide
agaaaattggacccatcttctgaaaaaatttgacttgggctc

SEQ ID NO: 95157 - DNA, 41 bp, Artificial Sequence
  Description of Artificial Sequence: Synthetic oligonucleotide
gaaaattggacccatcttctgaaaaaatttgacttgggctc

SEQ ID NO: 95158 - DNA, 45 bp, Artificial Sequence
  Description of Artificial Sequence: Synthetic oligonucleotide
aaaattggacccatcttctgaaaaaatttgacttgggctcatatg

SEQ ID NO: 95159 - DNA, 44 bp, Artificial Sequence
  Description of Artificial Sequence: Synthetic oligonucleotide
aaattggacccatcttctgaaaaaatttgacttgggctcatatg

SEQ ID NO: 95160 - DNA, 43 bp, Artificial Sequence
  Description of Artificial Sequence: Synthetic oligonucleotide
aattggacccatcttctgaaaaaatttgacttgggctcatatg

SEQ ID NO: 95161 - DNA, 42 bp, Artificial Sequence
  Description of Artificial Sequence: Synthetic oligonucleotide
attggacccatcttctgaaaaaatttgacttgggctcatatg

SEQ ID NO: 95162 - DNA, 41 bp, Artificial Sequence
  Description of Artificial Sequence: Synthetic oligonucleotide
ttggacccatcttctgaaaaaatttgacttgggctcatatg

SEQ ID NO: 95163 - DNA, 40 bp, Artificial Sequence
  Description of Artificial Sequence: Synthetic oligonucleotide
tggacccatcttctgaaaaaatttgacttgggctcatatg

SEQ ID NO: 95164 - DNA, 39 bp, Artificial Sequence
  Description of Artificial Sequence: Synthetic oligonucleotide
ggacccatcttctgaaaaaatttgacttgggctcatatg

SEQ ID NO: 95165 - DNA, 40 bp, Artificial Sequence
  Description of Artificial Sequence: Synthetic oligonucleotide
gacccatcttctgaaaaaatttgacttgggctcatatgac

SEQ ID NO: 95166 - DNA, 44 bp, Artificial Sequence
  Description of Artificial Sequence: Synthetic oligonucleotide
acccatcttctgaaaaaatttgacttgggctcatatgacataag

SEQ ID NO: 95167 - DNA, 43 bp, Artificial Sequence
  Description of Artificial Sequence: Synthetic oligonucleotide
cccatcttctgaaaaaatttgacttgggctcatatgacataag

SEQ ID NO: 95168 - DNA, 43 bp, Artificial Sequence
  Description of Artificial Sequence: Synthetic oligonucleotide
ccatcttctgaaaaaatttgacttgggctcatatgacataagg

SEQ ID NO: 95169 - DNA, 45 bp, Artificial Sequence
  Description of Artificial Sequence: Synthetic oligonucleotide
catcttctgaaaaaatttgacttgggctcatatgacataaggatg

SEQ ID NO: 95170 - DNA, 47 bp, Artificial Sequence
  Description of Artificial Sequence: Synthetic oligonucleotide
atcttctgaaaaaatttgacttgggctcatatgacataaggatgatc

SEQ ID NO: 95171 - DNA, 46 bp, Artificial Sequence
  Description of Artificial Sequence: Synthetic oligonucleotide
tcttctgaaaaaatttgacttgggctcatatgacataaggatgatc

SEQ ID NO: 95172 - DNA, 45 bp, Artificial Sequence
  Description of Artificial Sequence: Synthetic oligonucleotide
cttctgaaaaaatttgacttgggctcatatgacataaggatgatc

SEQ ID NO: 95173 - DNA, 47 bp, Artificial Sequence
  Description of Artificial Sequence: Synthetic oligonucleotide
ttctgaaaaaatttgacttgggctcatatgacataaggatgatcatc

SEQ ID NO: 95174 - DNA, 46 bp, Artificial Sequence
  Description of Artificial Sequence: Synthetic oligonucleotide
tctgaaaaaatttgacttgggctcatatgacataaggatgatcatc

SEQ ID NO: 95175 - DNA, 45 bp, Artificial Sequence
  Description of Artificial Sequence: Synthetic oligonucleotide
ctgaaaaaatttgacttgggctcatatgacataaggatgatcatc

SEQ ID NO: 95176 - DNA, 46 bp, Artificial Sequence
  Description of Artificial Sequence: Synthetic oligonucleotide
tgaaaaaatttgacttgggctcatatgacataaggatgatcatctc

SEQ ID NO: 95177 - DNA, 45 bp, Artificial Sequence
  Description of Artificial Sequence: Synthetic oligonucleotide
gaaaaaatttgacttgggctcatatgacataaggatgatcatctc

SEQ ID NO: 95178 - DNA, 46 bp, Artificial Sequence
  Description of Artificial Sequence: Synthetic oligonucleotide
aaaaaatttgacttgggctcatatgacataaggatgatcatctctg

SEQ ID NO: 95179 - DNA, 45 bp, Artificial Sequence
  Description of Artificial Sequence: Synthetic oligonucleotide
aaaaatttgacttgggctcatatgacataaggatgatcatctctg

SEQ ID NO: 95180 - DNA, 44 bp, Artificial Sequence
  Description of Artificial Sequence: Synthetic oligonucleotide
aaaatttgacttgggctcatatgacataaggatgatcatctctg

SEQ ID NO: 95181 - DNA, 43 bp, Artificial Sequence
  Description of Artificial Sequence: Synthetic oligonucleotide
aaatttgacttgggctcatatgacataaggatgatcatctctg

SEQ ID NO: 95182 - DNA, 42 bp, Artificial Sequence
  Description of Artificial Sequence: Synthetic oligonucleotide
aatttgacttgggctcatatgacataaggatgatcatctctg

SEQ ID NO: 95183 - DNA, 41 bp, Artificial Sequence
  Description of Artificial Sequence: Synthetic oligonucleotide
atttgacttgggctcatatgacataaggatgatcatctctg

SEQ ID NO: 95184 - DNA, 40 bp, Artificial Sequence
  Description of Artificial Sequence: Synthetic oligonucleotide
tttgacttgggctcatatgacataaggatgatcatctctg

SEQ ID NO: 95185 - DNA, 39 bp, Artificial Sequence
  Description of Artificial Sequence: Synthetic oligonucleotide
ttgacttgggctcatatgacataaggatgatcatctctg

SEQ ID NO: 95186 - DNA, 38 bp, Artificial Sequence
  Description of Artificial Sequence: Synthetic oligonucleotide
tgacttgggctcatatgacataaggatgatcatctctg

SEQ ID NO: 95187 - DNA, 37 bp, Artificial Sequence
  Description of Artificial Sequence: Synthetic oligonucleotide
gacttgggctcatatgacataaggatgatcatctctg

SEQ ID NO: 95188 - DNA, 37 bp, Artificial Sequence
  Description of Artificial Sequence: Synthetic oligonucleotide
acttgggctcatatgacataaggatgatcatctctgg

SEQ ID NO: 95189 - DNA, 36 bp, Artificial Sequence
  Description of Artificial Sequence: Synthetic oligonucleotide
cttgggctcatatgacataaggatgatcatctctgg

SEQ ID NO: 95190 - DNA, 36 bp, Artificial Sequence
  Description of Artificial Sequence: Synthetic oligonucleotide
ttgggctcatatgacataaggatgatcatctctggc

SEQ ID NO: 95191 - DNA, 35 bp, Artificial Sequence
  Description of Artificial Sequence: Synthetic oligonucleotide
tgggctcatatgacataaggatgatcatctctggc

SEQ ID NO: 95192 - DNA, 34 bp, Artificial Sequence
  Description of Artificial Sequence: Synthetic oligonucleotide
gggctcatatgacataaggatgatcatctctggc

SEQ ID NO: 95193 - DNA, 35 bp, Artificial Sequence
  Description of Artificial Sequence: Synthetic oligonucleotide
ggctcatatgacataaggatgatcatctctggcac

SEQ ID NO: 95194 - DNA, 37 bp, Artificial Sequence
  Description of Artificial Sequence: Synthetic oligonucleotide
gctcatatgacataaggatgatcatctctggcacaac

SEQ ID NO: 95195 - DNA, 38 bp, Artificial Sequence
  Description of Artificial Sequence: Synthetic oligonucleotide
ctcatatgacataaggatgatcatctctggcacaacag

SEQ ID NO: 95196 - DNA, 38 bp, Artificial Sequence
  Description of Artificial Sequence: Synthetic oligonucleotide
tcatatgacataaggatgatcatctctggcacaacagc

SEQ ID NO: 95197 - DNA, 37 bp, Artificial Sequence
  Description of Artificial Sequence: Synthetic oligonucleotide
catatgacataaggatgatcatctctggcacaacagc

SEQ ID NO: 95198 - DNA, 38 bp, Artificial Sequence
  Description of Artificial Sequence: Synthetic oligonucleotide
atatgacataaggatgatcatctctggcacaacagctc

SEQ ID NO: 95199 - DNA, 37 bp, Artificial Sequence
  Description of Artificial Sequence: Synthetic oligonucleotide
tatgacataaggatgatcatctctggcacaacagctc

SEQ ID NO: 95200 - DNA, 36 bp, Artificial Sequence
  Description of Artificial Sequence: Synthetic oligonucleotide
atgacataaggatgatcatctctggcacaacagctc

SEQ ID NO: 95201 - DNA, 35 bp, Artificial Sequence
  Description of Artificial Sequence: Synthetic oligonucleotide
tgacataaggatgatcatctctggcacaacagctc

SEQ ID NO: 95202 - DNA, 34 bp, Artificial Sequence
  Description of Artificial Sequence: Synthetic oligonucleotide
gacataaggatgatcatctctggcacaacagctc

SEQ ID NO: 95203 - DNA, 35 bp, Artificial Sequence
  Description of Artificial Sequence: Synthetic oligonucleotide
acataaggatgatcatctctggcacaacagctcac

SEQ ID NO: 95204 - DNA, 34 bp, Artificial Sequence
  Description of Artificial Sequence: Synthetic oligonucleotide
cataaggatgatcatctctggcacaacagctcac

SEQ ID NO: 95205 - DNA, 38 bp, Artificial Sequence
  Description of Artificial Sequence: Synthetic oligonucleotide
ataaggatgatcatctctggcacaacagctcacttttc

SEQ ID NO: 95206 - DNA, 37 bp, Artificial Sequence
  Description of Artificial Sequence: Synthetic oligonucleotide
taaggatgatcatctctggcacaacagctcacttttc

SEQ ID NO: 95207 - DNA, 36 bp, Artificial Sequence
  Description of Artificial Sequence: Synthetic oligonucleotide
aaggatgatcatctctggcacaacagctcacttttc

SEQ ID NO: 95208 - DNA, 35 bp, Artificial Sequence
  Description of Artificial Sequence: Synthetic oligonucleotide
aggatgatcatctctggcacaacagctcacttttc

SEQ ID NO: 95209 - DNA, 34 bp, Artificial Sequence
  Description of Artificial Sequence: Synthetic oligonucleotide
ggatgatcatctctggcacaacagctcacttttc

SEQ ID NO: 95210 - DNA, 36 bp, Artificial Sequence
  Description of Artificial Sequence: Synthetic oligonucleotide
gatgatcatctctggcacaacagctcacttttcttc

SEQ ID NO: 95211 - DNA, 36 bp, Artificial Sequence
  Description of Artificial Sequence: Synthetic oligonucleotide
atgatcatctctggcacaacagctcacttttcttcc

SEQ ID NO: 95212 - DNA, 35 bp, Artificial Sequence
  Description of Artificial Sequence: Synthetic oligonucleotide
tgatcatctctggcacaacagctcacttttcttcc

SEQ ID NO: 95213 - DNA, 34 bp, Artificial Sequence
  Description of Artificial Sequence: Synthetic oligonucleotide
gatcatctctggcacaacagctcacttttcttcc

SEQ ID NO: 95214 - DNA, 36 bp, Artificial Sequence
  Description of Artificial Sequence: Synthetic oligonucleotide
atcatctctggcacaacagctcacttttcttccaag

SEQ ID NO: 95215 - DNA, 35 bp, Artificial Sequence
  Description of Artificial Sequence: Synthetic oligonucleotide
tcatctctggcacaacagctcacttttcttccaag

SEQ ID NO: 95216 - DNA, 34 bp, Artificial Sequence
  Description of Artificial Sequence: Synthetic oligonucleotide
catctctggcacaacagctcacttttcttccaag

SEQ ID NO: 95217 - DNA, 34 bp, Artificial Sequence
  Description of Artificial Sequence: Synthetic oligonucleotide
atctctggcacaacagctcacttttcttccaagg

SEQ ID NO: 95218 - DNA, 33 bp, Artificial Sequence
  Description of Artificial Sequence: Synthetic oligonucleotide
tctctggcacaacagctcacttttcttccaagg

SEQ ID NO: 95219 - DNA, 32 bp, Artificial Sequence
  Description of Artificial Sequence: Synthetic oligonucleotide
ctctggcacaacagctcacttttcttccaagg

SEQ ID NO: 95220 - DNA, 36 bp, Artificial Sequence
  Description of Artificial Sequence: Synthetic oligonucleotide
tctggcacaacagctcacttttcttccaaggataag

SEQ ID NO: 95221 - DNA, 35 bp, Artificial Sequence
  Description of Artificial Sequence: Synthetic oligonucleotide
ctggcacaacagctcacttttcttccaaggataag

SEQ ID NO: 95222 - DNA, 37 bp, Artificial Sequence
  Description of Artificial Sequence: Synthetic oligonucleotide
tggcacaacagctcacttttcttccaaggataagttg

SEQ ID NO: 95223 - DNA, 36 bp, Artificial Sequence
  Description of Artificial Sequence: Synthetic oligonucleotide
ggcacaacagctcacttttcttccaaggataagttg

SEQ ID NO: 95224 - DNA, 36 bp, Artificial Sequence
  Description of Artificial Sequence: Synthetic oligonucleotide
gcacaacagctcacttttcttccaaggataagttgc

SEQ ID NO: 95225 - DNA, 38 bp, Artificial Sequence
  Description of Artificial Sequence: Synthetic oligonucleotide
cacaacagctcacttttcttccaaggataagttgcaag

SEQ ID NO: 95226 - DNA, 39 bp, Artificial Sequence
  Description of Artificial Sequence: Synthetic oligonucleotide
acaacagctcacttttcttccaaggataagttgcaagag

SEQ ID NO: 95227 - DNA, 38 bp, Artificial Sequence
  Description of Artificial Sequence: Synthetic oligonucleotide
caacagctcacttttcttccaaggataagttgcaagag

SEQ ID NO: 95228 - DNA, 38 bp, Artificial Sequence
  Description of Artificial Sequence: Synthetic oligonucleotide
aacagctcacttttcttccaaggataagttgcaagagg

SEQ ID NO: 95229 - DNA, 37 bp, Artificial Sequence
  Description of Artificial Sequence: Synthetic oligonucleotide
acagctcacttttcttccaaggataagttgcaagagg

SEQ ID NO: 95230 - DNA, 36 bp, Artificial Sequence
  Description of Artificial Sequence: Synthetic oligonucleotide
cagctcacttttcttccaaggataagttgcaagagg

SEQ ID NO: 95231 - DNA, 37 bp, Artificial Sequence
  Description of Artificial Sequence: Synthetic oligonucleotide
agctcacttttcttccaaggataagttgcaagaggtg

SEQ ID NO: 95232 - DNA, 36 bp, Artificial Sequence
  Description of Artificial Sequence: Synthetic oligonucleotide
gctcacttttcttccaaggataagttgcaagaggtg

SEQ ID NO: 95233 - DNA, 39 bp, Artificial Sequence
  Description of Artificial Sequence: Synthetic oligonucleotide
ctcacttttcttccaaggataagttgcaagaggtgaaac

SEQ ID NO: 95234 - DNA, 47 bp, Artificial Sequence
  Description of Artificial Sequence: Synthetic oligonucleotide
tcacttttcttccaaggataagttgcaagaggtgaaactattttttg

SEQ ID NO: 95235 - DNA, 46 bp, Artificial Sequence
  Description of Artificial Sequence: Synthetic oligonucleotide
cacttttcttccaaggataagttgcaagaggtgaaactattttttg

SEQ ID NO: 95236 - DNA, 49 bp, Artificial Sequence
  Description of Artificial Sequence: Synthetic oligonucleotide
acttttcttccaaggataagttgcaagaggtgaaactattttttgaatc

SEQ ID NO: 95237 - DNA, 48 bp, Artificial Sequence
  Description of Artificial Sequence: Synthetic oligonucleotide
cttttcttccaaggataagttgcaagaggtgaaactattttttgaatc

SEQ ID NO: 95238 - DNA, 49 bp, Artificial Sequence
  Description of Artificial Sequence: Synthetic oligonucleotide
ttttcttccaaggataagttgcaagaggtgaaactattttttgaatctc

SEQ ID NO: 95239 - DNA, 48 bp, Artificial Sequence
  Description of Artificial Sequence: Synthetic oligonucleotide
tttcttccaaggataagttgcaagaggtgaaactattttttgaatctc

SEQ ID NO: 95240 - DNA, 47 bp, Artificial Sequence
  Description of Artificial Sequence: Synthetic oligonucleotide
ttcttccaaggataagttgcaagaggtgaaactattttttgaatctc

SEQ ID NO: 95241 - DNA, 46 bp, Artificial Sequence
  Description of Artificial Sequence: Synthetic oligonucleotide
tcttccaaggataagttgcaagaggtgaaactattttttgaatctc

SEQ ID NO: 95242 - DNA, 45 bp, Artificial Sequence
  Description of Artificial Sequence: Synthetic oligonucleotide
cttccaaggataagttgcaagaggtgaaactattttttgaatctc

SEQ ID NO: 95243 - DNA, 47 bp, Artificial Sequence
  Description of Artificial Sequence: Synthetic oligonucleotide
ttccaaggataagttgcaagaggtgaaactattttttgaatctcttg

SEQ ID NO: 95244 - DNA, 46 bp, Artificial Sequence
  Description of Artificial Sequence: Synthetic oligonucleotide
tccaaggataagttgcaagaggtgaaactattttttgaatctcttg

SEQ ID NO: 95245 - DNA, 45 bp, Artificial Sequence
  Description of Artificial Sequence: Synthetic oligonucleotide
ccaaggataagttgcaagaggtgaaactattttttgaatctcttg

SEQ ID NO: 95246 - DNA, 46 bp, Artificial Sequence
  Description of Artificial Sequence: Synthetic oligonucleotide
caaggataagttgcaagaggtgaaactattttttgaatctcttgag

SEQ ID NO: 95247 - DNA, 46 bp, Artificial Sequence
  Description of Artificial Sequence: Synthetic oligonucleotide
aaggataagttgcaagaggtgaaactattttttgaatctcttgagg

SEQ ID NO: 95248 - DNA, 45 bp, Artificial Sequence
  Description of Artificial Sequence: Synthetic oligonucleotide
aggataagttgcaagaggtgaaactattttttgaatctcttgagg

SEQ ID NO: 95249 - DNA, 44 bp, Artificial Sequence
  Description of Artificial Sequence: Synthetic oligonucleotide
ggataagttgcaagaggtgaaactattttttgaatctcttgagg

SEQ ID NO: 95250 - DNA, 44 bp, Artificial Sequence
  Description of Artificial Sequence: Synthetic oligonucleotide
gataagttgcaagaggtgaaactattttttgaatctcttgaggc

SEQ ID NO: 95251 - DNA, 45 bp, Artificial Sequence
  Description of Artificial Sequence: Synthetic oligonucleotide
ataagttgcaagaggtgaaactattttttgaatctcttgaggctc

SEQ ID NO: 95252 - DNA, 44 bp, Artificial Sequence
  Description of Artificial Sequence: Synthetic oligonucleotide
taagttgcaagaggtgaaactattttttgaatctcttgaggctc

SEQ ID NO: 95253 - DNA, 43 bp, Artificial Sequence
  Description of Artificial Sequence: Synthetic oligonucleotide
aagttgcaagaggtgaaactattttttgaatctcttgaggctc

SEQ ID NO: 95254 - DNA, 42 bp, Artificial Sequence
  Description of Artificial Sequence: Synthetic oligonucleotide
agttgcaagaggtgaaactattttttgaatctcttgaggctc

SEQ ID NO: 95255 - DNA, 41 bp, Artificial Sequence
  Description of Artificial Sequence: Synthetic oligonucleotide
gttgcaagaggtgaaactattttttgaatctcttgaggctc

SEQ ID NO: 95256 - DNA, 43 bp, Artificial Sequence
  Description of Artificial Sequence: Synthetic oligonucleotide
ttgcaagaggtgaaactattttttgaatctcttgaggctcaag

SEQ ID NO: 95257 - DNA, 42 bp, Artificial Sequence
  Description of Artificial Sequence: Synthetic oligonucleotide
tgcaagaggtgaaactattttttgaatctcttgaggctcaag

SEQ ID NO: 95258 - DNA, 41 bp, Artificial Sequence
  Description of Artificial Sequence: Synthetic oligonucleotide
gcaagaggtgaaactattttttgaatctcttgaggctcaag

SEQ ID NO: 95259 - DNA, 41 bp, Artificial Sequence
  Description of Artificial Sequence: Synthetic oligonucleotide
caagaggtgaaactattttttgaatctcttgaggctcaagg

SEQ ID NO: 95260 - DNA, 43 bp, Artificial Sequence
  Description of Artificial Sequence: Synthetic oligonucleotide
aagaggtgaaactattttttgaatctcttgaggctcaaggatc

SEQ ID NO: 95261 - DNA, 42 bp, Artificial Sequence
  Description of Artificial Sequence: Synthetic oligonucleotide
agaggtgaaactattttttgaatctcttgaggctcaaggatc

SEQ ID NO: 95262 - DNA, 41 bp, Artificial Sequence
  Description of Artificial Sequence: Synthetic oligonucleotide
gaggtgaaactattttttgaatctcttgaggctcaaggatc

SEQ ID NO: 95263 - DNA, 42 bp, Artificial Sequence
  Description of Artificial Sequence: Synthetic oligonucleotide
aggtgaaactattttttgaatctcttgaggctcaaggatcac

SEQ ID NO: 95264 - DNA, 41 bp, Artificial Sequence
  Description of Artificial Sequence: Synthetic oligonucleotide
ggtgaaactattttttgaatctcttgaggctcaaggatcac

SEQ ID NO: 95265 - DNA, 43 bp, Artificial Sequence
  Description of Artificial Sequence: Synthetic oligonucleotide
gtgaaactattttttgaatctcttgaggctcaaggatcacatc

SEQ ID NO: 95266 - DNA, 44 bp, Artificial Sequence
  Description of Artificial Sequence: Synthetic oligonucleotide
tgaaactattttttgaatctcttgaggctcaaggatcacatctg

SEQ ID NO: 95267 - DNA, 43 bp, Artificial Sequence
  Description of Artificial Sequence: Synthetic oligonucleotide
gaaactattttttgaatctcttgaggctcaaggatcacatctg

SEQ ID NO: 95268 - DNA, 43 bp, Artificial Sequence
  Description of Artificial Sequence: Synthetic oligonucleotide
aaactattttttgaatctcttgaggctcaaggatcacatctgg

SEQ ID NO: 95269 - DNA, 42 bp, Artificial Sequence
  Description of Artificial Sequence: Synthetic oligonucleotide
aactattttttgaatctcttgaggctcaaggatcacatctgg

SEQ ID NO: 95270 - DNA, 41 bp, Artificial Sequence
  Description of Artificial Sequence: Synthetic oligonucleotide
actattttttgaatctcttgaggctcaaggatcacatctgg

SEQ ID NO: 95271 - DNA, 40 bp, Artificial Sequence
  Description of Artificial Sequence: Synthetic oligonucleotide
ctattttttgaatctcttgaggctcaaggatcacatctgg

SEQ ID NO: 95272 - DNA, 48 bp, Artificial Sequence
  Description of Artificial Sequence: Synthetic oligonucleotide
tattttttgaatctcttgaggctcaaggatcacatctggatatttttc

SEQ ID NO: 95273 - DNA, 47 bp, Artificial Sequence
  Description of Artificial Sequence: Synthetic oligonucleotide
attttttgaatctcttgaggctcaaggatcacatctggatatttttc

SEQ ID NO: 95274 - DNA, 46 bp, Artificial Sequence
  Description of Artificial Sequence: Synthetic oligonucleotide
ttttttgaatctcttgaggctcaaggatcacatctggatatttttc

SEQ ID NO: 95275 - DNA, 45 bp, Artificial Sequence
  Description of Artificial Sequence: Synthetic oligonucleotide
tttttgaatctcttgaggctcaaggatcacatctggatatttttc

SEQ ID NO: 95276 - DNA, 44 bp, Artificial Sequence
  Description of Artificial Sequence: Synthetic oligonucleotide
ttttgaatctcttgaggctcaaggatcacatctggatatttttc

SEQ ID NO: 95277 - DNA, 43 bp, Artificial Sequence
  Description of Artificial Sequence: Synthetic oligonucleotide
tttgaatctcttgaggctcaaggatcacatctggatatttttc

SEQ ID NO: 95278 - DNA, 42 bp, Artificial Sequence
  Description of Artificial Sequence: Synthetic oligonucleotide
ttgaatctcttgaggctcaaggatcacatctggatatttttc

SEQ ID NO: 95279 - DNA, 41 bp, Artificial Sequence
  Description of Artificial Sequence: Synthetic oligonucleotide
tgaatctcttgaggctcaaggatcacatctggatatttttc

SEQ ID NO: 95280 - DNA, 40 bp, Artificial Sequence
  Description of Artificial Sequence: Synthetic oligonucleotide
gaatctcttgaggctcaaggatcacatctggatatttttc

SEQ ID NO: 95281 - DNA, 43 bp, Artificial Sequence
  Description of Artificial Sequence: Synthetic oligonucleotide
aatctcttgaggctcaaggatcacatctggatatttttcaaac

SEQ ID NO: 95282 - DNA, 42 bp, Artificial Sequence
  Description of Artificial Sequence: Synthetic oligonucleotide
atctcttgaggctcaaggatcacatctggatatttttcaaac

SEQ ID NO: 95283 - DNA, 41 bp, Artificial Sequence
  Description of Artificial Sequence: Synthetic oligonucleotide
tctcttgaggctcaaggatcacatctggatatttttcaaac

SEQ ID NO: 95284 - DNA, 40 bp, Artificial Sequence
  Description of Artificial Sequence: Synthetic oligonucleotide
ctcttgaggctcaaggatcacatctggatatttttcaaac

SEQ ID NO: 95285 - DNA, 41 bp, Artificial Sequence
  Description of Artificial Sequence: Synthetic oligonucleotide
tcttgaggctcaaggatcacatctggatatttttcaaactg

SEQ ID NO: 95286 - DNA, 40 bp, Artificial Sequence
  Description of Artificial Sequence: Synthetic oligonucleotide
cttgaggctcaaggatcacatctggatatttttcaaactg

SEQ ID NO: 95287 - DNA, 42 bp, Artificial Sequence
  Description of Artificial Sequence: Synthetic oligonucleotide
ttgaggctcaaggatcacatctggatatttttcaaactgttc

SEQ ID NO: 95288 - DNA, 41 bp, Artificial Sequence
  Description of Artificial Sequence: Synthetic oligonucleotide
tgaggctcaaggatcacatctggatatttttcaaactgttc

SEQ ID NO: 95289 - DNA, 40 bp, Artificial Sequence
  Description of Artificial Sequence: Synthetic oligonucleotide
gaggctcaaggatcacatctggatatttttcaaactgttc

SEQ ID NO: 95290 - DNA, 41 bp, Artificial Sequence
  Description of Artificial Sequence: Synthetic oligonucleotide
aggctcaaggatcacatctggatatttttcaaactgttctg

SEQ ID NO: 95291 - DNA, 40 bp, Artificial Sequence
  Description of Artificial Sequence: Synthetic oligonucleotide
ggctcaaggatcacatctggatatttttcaaactgttctg

SEQ ID NO: 95292 - DNA, 40 bp, Artificial Sequence
  Description of Artificial Sequence: Synthetic oligonucleotide
gctcaaggatcacatctggatatttttcaaactgttctgg

SEQ ID NO: 95293 - DNA, 43 bp, Artificial Sequence
  Description of Artificial Sequence: Synthetic oligonucleotide
ctcaaggatcacatctggatatttttcaaactgttctggaaac

SEQ ID NO: 95294 - DNA, 43 bp, Artificial Sequence
  Description of Artificial Sequence: Synthetic oligonucleotide
tcaaggatcacatctggatatttttcaaactgttctggaaacg

SEQ ID NO: 95295 - DNA, 42 bp, Artificial Sequence
  Description of Artificial Sequence: Synthetic oligonucleotide
caaggatcacatctggatatttttcaaactgttctggaaacg

SEQ ID NO: 95296 - DNA, 46 bp, Artificial Sequence
  Description of Artificial Sequence: Synthetic oligonucleotide
aaggatcacatctggatatttttcaaactgttctggaaacgataac

SEQ ID NO: 95297 - DNA, 45 bp, Artificial Sequence
  Description of Artificial Sequence: Synthetic oligonucleotide
aggatcacatctggatatttttcaaactgttctggaaacgataac

SEQ ID NO: 95298 - DNA, 44 bp, Artificial Sequence
  Description of Artificial Sequence: Synthetic oligonucleotide
ggatcacatctggatatttttcaaactgttctggaaacgataac

SEQ ID NO: 95299 - DNA, 44 bp, Artificial Sequence
  Description of Artificial Sequence: Synthetic oligonucleotide
gatcacatctggatatttttcaaactgttctggaaacgataacc

SEQ ID NO: 95300 - DNA, 57 bp, Artificial Sequence
  Description of Artificial Sequence: Synthetic oligonucleotide
atcacatctggatatttttcaaactgttctggaaacgataaccaaaaatataaaatg

SEQ ID NO: 95301 - DNA, 56 bp, Artificial Sequence
  Description of Artificial Sequence: Synthetic oligonucleotide
tcacatctggatatttttcaaactgttctggaaacgataaccaaaaatataaaatg

SEQ ID NO: 95302 - DNA, 55 bp, Artificial Sequence
  Description of Artificial Sequence: Synthetic oligonucleotide
cacatctggatatttttcaaactgttctggaaacgataaccaaaaatataaaatg

SEQ ID NO: 95303 - DNA, 55 bp, Artificial Sequence
  Description of Artificial Sequence: Synthetic oligonucleotide
acatctggatatttttcaaactgttctggaaacgataaccaaaaatataaaatgg

SEQ ID NO: 95304 - DNA, 54 bp, Artificial Sequence
  Description of Artificial Sequence: Synthetic oligonucleotide
catctggatatttttcaaactgttctggaaacgataaccaaaaatataaaatgg

SEQ ID NO: 95305 - DNA, 54 bp, Artificial Sequence
  Description of Artificial Sequence: Synthetic oligonucleotide
atctggatatttttcaaactgttctggaaacgataaccaaaaatataaaatggc

SEQ ID NO: 95306 - DNA, 53 bp, Artificial Sequence
  Description of Artificial Sequence: Synthetic oligonucleotide
tctggatatttttcaaactgttctggaaacgataaccaaaaatataaaatggc

SEQ ID NO: 95307 - DNA, 52 bp, Artificial Sequence
  Description of Artificial Sequence: Synthetic oligonucleotide
ctggatatttttcaaactgttctggaaacgataaccaaaaatataaaatggc

SEQ ID NO: 95308 - DNA, 53 bp, Artificial Sequence
  Description of Artificial Sequence: Synthetic oligonucleotide
tggatatttttcaaactgttctggaaacgataaccaaaaatataaaatggctg

SEQ ID NO: 95309 - DNA, 52 bp, Artificial Sequence
  Description of Artificial Sequence: Synthetic oligonucleotide
ggatatttttcaaactgttctggaaacgataaccaaaaatataaaatggctg

SEQ ID NO: 95310 - DNA, 52 bp, Artificial Sequence
  Description of Artificial Sequence: Synthetic oligonucleotide
gatatttttcaaactgttctggaaacgataaccaaaaatataaaatggctgg

SEQ ID NO: 95311 - DNA, 53 bp, Artificial Sequence
  Description of Artificial Sequence: Synthetic oligonucleotide
atatttttcaaactgttctggaaacgataaccaaaaatataaaatggctggag

SEQ ID NO: 95312 - DNA, 52 bp, Artificial Sequence
  Description of Artificial Sequence: Synthetic oligonucleotide
tatttttcaaactgttctggaaacgataaccaaaaatataaaatggctggag

SEQ ID NO: 95313 - DNA, 51 bp, Artificial Sequence
  Description of Artificial Sequence: Synthetic oligonucleotide
atttttcaaactgttctggaaacgataaccaaaaatataaaatggctggag

SEQ ID NO: 95314 - DNA, 50 bp, Artificial Sequence
  Description of Artificial Sequence: Synthetic oligonucleotide
tttttcaaactgttctggaaacgataaccaaaaatataaaatggctggag

SEQ ID NO: 95315 - DNA, 49 bp, Artificial Sequence
  Description of Artificial Sequence: Synthetic oligonucleotide
ttttcaaactgttctggaaacgataaccaaaaatataaaatggctggag

SEQ ID NO: 95316 - DNA, 48 bp, Artificial Sequence
  Description of Artificial Sequence: Synthetic oligonucleotide
tttcaaactgttctggaaacgataaccaaaaatataaaatggctggag

SEQ ID NO: 95317 - DNA, 47 bp, Artificial Sequence
  Description of Artificial Sequence: Synthetic oligonucleotide
ttcaaactgttctggaaacgataaccaaaaatataaaatggctggag

SEQ ID NO: 95318 - DNA, 46 bp, Artificial Sequence
  Description of Artificial Sequence: Synthetic oligonucleotide
tcaaactgttctggaaacgataaccaaaaatataaaatggctggag

SEQ ID NO: 95319 - DNA, 45 bp, Artificial Sequence
  Description of Artificial Sequence: Synthetic oligonucleotide
caaactgttctggaaacgataaccaaaaatataaaatggctggag

SEQ ID NO: 95320 - DNA, 47 bp, Artificial Sequence
  Description of Artificial Sequence: Synthetic oligonucleotide
aaactgttctggaaacgataaccaaaaatataaaatggctggagaag

SEQ ID NO: 95321 - DNA, 46 bp, Artificial Sequence
  Description of Artificial Sequence: Synthetic oligonucleotide
aactgttctggaaacgataaccaaaaatataaaatggctggagaag

SEQ ID NO: 95322 - DNA, 45 bp, Artificial Sequence
  Description of Artificial Sequence: Synthetic oligonucleotide
actgttctggaaacgataaccaaaaatataaaatggctggagaag

SEQ ID NO: 95323 - DNA, 44 bp, Artificial Sequence
  Description of Artificial Sequence: Synthetic oligonucleotide
ctgttctggaaacgataaccaaaaatataaaatggctggagaag

SEQ ID NO: 95324 - DNA, 47 bp, Artificial Sequence
  Description of Artificial Sequence: Synthetic oligonucleotide
tgttctggaaacgataaccaaaaatataaaatggctggagaagaatc

SEQ ID NO: 95325 - DNA, 46 bp, Artificial Sequence
  Description of Artificial Sequence: Synthetic oligonucleotide
gttctggaaacgataaccaaaaatataaaatggctggagaagaatc

SEQ ID NO: 95326 - DNA, 48 bp, Artificial Sequence
  Description of Artificial Sequence: Synthetic oligonucleotide
ttctggaaacgataaccaaaaatataaaatggctggagaagaatcttc

SEQ ID NO: 95327 - DNA, 47 bp, Artificial Sequence
  Description of Artificial Sequence: Synthetic oligonucleotide
tctggaaacgataaccaaaaatataaaatggctggagaagaatcttc

SEQ ID NO: 95328 - DNA, 46 bp, Artificial Sequence
  Description of Artificial Sequence: Synthetic oligonucleotide
ctggaaacgataaccaaaaatataaaatggctggagaagaatcttc

SEQ ID NO: 95329 - DNA, 46 bp, Artificial Sequence
  Description of Artificial Sequence: Synthetic oligonucleotide
tggaaacgataaccaaaaatataaaatggctggagaagaatcttcc

SEQ ID NO: 95330 - DNA, 45 bp, Artificial Sequence
  Description of Artificial Sequence: Synthetic oligonucleotide
ggaaacgataaccaaaaatataaaatggctggagaagaatcttcc

SEQ ID NO: 95331 - DNA, 45 bp, Artificial Sequence
  Description of Artificial Sequence: Synthetic oligonucleotide
gaaacgataaccaaaaatataaaatggctggagaagaatcttccg

SEQ ID NO: 95332 - DNA, 46 bp, Artificial Sequence
  Description of Artificial Sequence: Synthetic oligonucleotide
aaacgataaccaaaaatataaaatggctggagaagaatcttccgac

SEQ ID NO: 95333 - DNA, 45 bp, Artificial Sequence
  Description of Artificial Sequence: Synthetic oligonucleotide
aacgataaccaaaaatataaaatggctggagaagaatcttccgac

SEQ ID NO: 95334 - DNA, 44 bp, Artificial Sequence
  Description of Artificial Sequence: Synthetic oligonucleotide
acgataaccaaaaatataaaatggctggagaagaatcttccgac

SEQ ID NO: 95335 - DNA, 43 bp, Artificial Sequence
  Description of Artificial Sequence: Synthetic oligonucleotide
cgataaccaaaaatataaaatggctggagaagaatcttccgac

SEQ ID NO: 95336 - DNA, 44 bp, Artificial Sequence
  Description of Artificial Sequence: Synthetic oligonucleotide
gataaccaaaaatataaaatggctggagaagaatcttccgactc

SEQ ID NO: 95337 - DNA, 45 bp, Artificial Sequence
  Description of Artificial Sequence: Synthetic oligonucleotide
ataaccaaaaatataaaatggctggagaagaatcttccgactctg

SEQ ID NO: 95338 - DNA, 44 bp, Artificial Sequence
  Description of Artificial Sequence: Synthetic oligonucleotide
taaccaaaaatataaaatggctggagaagaatcttccgactctg

SEQ ID NO: 95339 - DNA, 43 bp, Artificial Sequence
  Description of Artificial Sequence: Synthetic oligonucleotide
aaccaaaaatataaaatggctggagaagaatcttccgactctg

SEQ ID NO: 95340 - DNA, 42 bp, Artificial Sequence
  Description of Artificial Sequence: Synthetic oligonucleotide
accaaaaatataaaatggctggagaagaatcttccgactctg

SEQ ID NO: 95341 - DNA, 41 bp, Artificial Sequence
  Description of Artificial Sequence: Synthetic oligonucleotide
ccaaaaatataaaatggctggagaagaatcttccgactctg

SEQ ID NO: 95342 - DNA, 42 bp, Artificial Sequence
  Description of Artificial Sequence: Synthetic oligonucleotide
caaaaatataaaatggctggagaagaatcttccgactctgag

SEQ ID NO: 95343 - DNA, 42 bp, Artificial Sequence
  Description of Artificial Sequence: Synthetic oligonucleotide
aaaaatataaaatggctggagaagaatcttccgactctgagg

SEQ ID NO: 95344 - DNA, 41 bp, Artificial Sequence
  Description of Artificial Sequence: Synthetic oligonucleotide
aaaatataaaatggctggagaagaatcttccgactctgagg

SEQ ID NO: 95345 - DNA, 40 bp, Artificial Sequence
  Description of Artificial Sequence: Synthetic oligonucleotide
aaatataaaatggctggagaagaatcttccgactctgagg

SEQ ID NO: 95346 - DNA, 39 bp, Artificial Sequence
  Description of Artificial Sequence: Synthetic oligonucleotide
aatataaaatggctggagaagaatcttccgactctgagg

SEQ ID NO: 95347 - DNA, 38 bp, Artificial Sequence
  Description of Artificial Sequence: Synthetic oligonucleotide
atataaaatggctggagaagaatcttccgactctgagg

SEQ ID NO: 95348 - DNA, 37 bp, Artificial Sequence
  Description of Artificial Sequence: Synthetic oligonucleotide
tataaaatggctggagaagaatcttccgactctgagg

SEQ ID NO: 95349 - DNA, 36 bp, Artificial Sequence
  Description of Artificial Sequence: Synthetic oligonucleotide
ataaaatggctggagaagaatcttccgactctgagg

SEQ ID NO: 95350 - DNA, 35 bp, Artificial Sequence
  Description of Artificial Sequence: Synthetic oligonucleotide
taaaatggctggagaagaatcttccgactctgagg

SEQ ID NO: 95351 - DNA, 34 bp, Artificial Sequence
  Description of Artificial Sequence: Synthetic oligonucleotide
aaaatggctggagaagaatcttccgactctgagg

SEQ ID NO: 95352 - DNA, 33 bp, Artificial Sequence
  Description of Artificial Sequence: Synthetic oligonucleotide
aaatggctggagaagaatcttccgactctgagg

SEQ ID NO: 95353 - DNA, 32 bp, Artificial Sequence
  Description of Artificial Sequence: Synthetic oligonucleotide
aatggctggagaagaatcttccgactctgagg

SEQ ID NO: 95354 - DNA, 31 bp, Artificial Sequence
  Description of Artificial Sequence: Synthetic oligonucleotide
atggctggagaagaatcttccgactctgagg

SEQ ID NO: 95355 - DNA, 30 bp, Artificial Sequence
  Description of Artificial Sequence: Synthetic oligonucleotide
tggctggagaagaatcttccgactctgagg

SEQ ID NO: 95356 - DNA, 29 bp, Artificial Sequence
  Description of Artificial Sequence: Synthetic oligonucleotide
ggctggagaagaatcttccgactctgagg

SEQ ID NO: 95357 - DNA, 30 bp, Artificial Sequence
  Description of Artificial Sequence: Synthetic oligonucleotide
gctggagaagaatcttccgactctgaggac

SEQ ID NO: 95358 - DNA, 32 bp, Artificial Sequence
  Description of Artificial Sequence: Synthetic oligonucleotide
ctggagaagaatcttccgactctgaggacttg

SEQ ID NO: 95359 - DNA, 32 bp, Artificial Sequence
  Description of Artificial Sequence: Synthetic oligonucleotide
tggagaagaatcttccgactctgaggacttgg

SEQ ID NO: 95360 - DNA, 31 bp, Artificial Sequence
  Description of Artificial Sequence: Synthetic oligonucleotide
ggagaagaatcttccgactctgaggacttgg

SEQ ID NO: 95361 - DNA, 31 bp, Artificial Sequence
  Description of Artificial Sequence: Synthetic oligonucleotide
gagaagaatcttccgactctgaggacttggc

SEQ ID NO: 95362 - DNA, 35 bp, Artificial Sequence
  Description of Artificial Sequence: Synthetic oligonucleotide
agaagaatcttccgactctgaggacttggctaatg

SEQ ID NO: 95363 - DNA, 34 bp, Artificial Sequence
  Description of Artificial Sequence: Synthetic oligonucleotide
gaagaatcttccgactctgaggacttggctaatg

SEQ ID NO: 95364 - DNA, 34 bp, Artificial Sequence
  Description of Artificial Sequence: Synthetic oligonucleotide
aagaatcttccgactctgaggacttggctaatgg

SEQ ID NO: 95365 - DNA, 33 bp, Artificial Sequence
  Description of Artificial Sequence: Synthetic oligonucleotide
agaatcttccgactctgaggacttggctaatgg

SEQ ID NO: 95366 - DNA, 32 bp, Artificial Sequence
  Description of Artificial Sequence: Synthetic oligonucleotide
gaatcttccgactctgaggacttggctaatgg

SEQ ID NO: 95367 - DNA, 38 bp, Artificial Sequence
  Description of Artificial Sequence: Synthetic oligonucleotide
aatcttccgactctgaggacttggctaatggttaatac

SEQ ID NO: 95368 - DNA, 37 bp, Artificial Sequence
  Description of Artificial Sequence: Synthetic oligonucleotide
atcttccgactctgaggacttggctaatggttaatac

SEQ ID NO: 95369 - DNA, 36 bp, Artificial Sequence
  Description of Artificial Sequence: Synthetic oligonucleotide
tcttccgactctgaggacttggctaatggttaatac

SEQ ID NO: 95370 - DNA, 35 bp, Artificial Sequence
  Description of Artificial Sequence: Synthetic oligonucleotide
cttccgactctgaggacttggctaatggttaatac

SEQ ID NO: 95371 - DNA, 37 bp, Artificial Sequence
  Description of Artificial Sequence: Synthetic oligonucleotide
atgcagctcagcaaggtgaagtttcgaaatcagtatg

SEQ ID NO: 95372 - DNA, 36 bp, Artificial Sequence
  Description of Artificial Sequence: Synthetic oligonucleotide
tgcagctcagcaaggtgaagtttcgaaatcagtatg

SEQ ID NO: 95373 - DNA, 35 bp, Artificial Sequence
  Description of Artificial Sequence: Synthetic oligonucleotide
gcagctcagcaaggtgaagtttcgaaatcagtatg

SEQ ID NO: 95374 - DNA, 36 bp, Artificial Sequence
  Description of Artificial Sequence: Synthetic oligonucleotide
cagctcagcaaggtgaagtttcgaaatcagtatgac

SEQ ID NO: 95375 - DNA, 39 bp, Artificial Sequence
  Description of Artificial Sequence: Synthetic oligonucleotide
agctcagcaaggtgaagtttcgaaatcagtatgacaatg

SEQ ID NO: 95376 - DNA, 38 bp, Artificial Sequence
  Description of Artificial Sequence: Synthetic oligonucleotide
gctcagcaaggtgaagtttcgaaatcagtatgacaatg

SEQ ID NO: 95377 - DNA, 40 bp, Artificial Sequence
  Description of Artificial Sequence: Synthetic oligonucleotide
ctcagcaaggtgaagtttcgaaatcagtatgacaatgatg

SEQ ID NO: 95378 - DNA, 41 bp, Artificial Sequence
  Description of Artificial Sequence: Synthetic oligonucleotide
tcagcaaggtgaagtttcgaaatcagtatgacaatgatgtc

SEQ ID NO: 95379 - DNA, 40 bp, Artificial Sequence
  Description of Artificial Sequence: Synthetic oligonucleotide
cagcaaggtgaagtttcgaaatcagtatgacaatgatgtc

SEQ ID NO: 95380 - DNA, 41 bp, Artificial Sequence
  Description of Artificial Sequence: Synthetic oligonucleotide
agcaaggtgaagtttcgaaatcagtatgacaatgatgtcac

SEQ ID NO: 95381 - DNA, 40 bp, Artificial Sequence
  Description of Artificial Sequence: Synthetic oligonucleotide
gcaaggtgaagtttcgaaatcagtatgacaatgatgtcac

SEQ ID NO: 95382 - DNA, 41 bp, Artificial Sequence
  Description of Artificial Sequence: Synthetic oligonucleotide
caaggtgaagtttcgaaatcagtatgacaatgatgtcactg

SEQ ID NO: 95383 - DNA, 44 bp, Artificial Sequence
  Description of Artificial Sequence: Synthetic oligonucleotide
aaggtgaagtttcgaaatcagtatgacaatgatgtcactgtttg

SEQ ID NO: 95384 - DNA, 43 bp, Artificial Sequence
  Description of Artificial Sequence: Synthetic oligonucleotide
aggtgaagtttcgaaatcagtatgacaatgatgtcactgtttg

SEQ ID NO: 95385 - DNA, 42 bp, Artificial Sequence
  Description of Artificial Sequence: Synthetic oligonucleotide
ggtgaagtttcgaaatcagtatgacaatgatgtcactgtttg

SEQ ID NO: 95386 - DNA, 42 bp, Artificial Sequence
  Description of Artificial Sequence: Synthetic oligonucleotide
gtgaagtttcgaaatcagtatgacaatgatgtcactgtttgg

SEQ ID NO: 95387 - DNA, 43 bp, Artificial Sequence
  Description of Artificial Sequence: Synthetic oligonucleotide
tgaagtttcgaaatcagtatgacaatgatgtcactgtttggag

SEQ ID NO: 95388 - DNA, 42 bp, Artificial Sequence
  Description of Artificial Sequence: Synthetic oligonucleotide
gaagtttcgaaatcagtatgacaatgatgtcactgtttggag

SEQ ID NO: 95389 - DNA, 42 bp, Artificial Sequence
  Description of Artificial Sequence: Synthetic oligonucleotide
aagtttcgaaatcagtatgacaatgatgtcactgtttggagc

SEQ ID NO: 95390 - DNA, 41 bp, Artificial Sequence
  Description of Artificial Sequence: Synthetic oligonucleotide
agtttcgaaatcagtatgacaatgatgtcactgtttggagc

SEQ ID NO: 95391 - DNA, 40 bp, Artificial Sequence
  Description of Artificial Sequence: Synthetic oligonucleotide
gtttcgaaatcagtatgacaatgatgtcactgtttggagc

SEQ ID NO: 95392 - DNA, 40 bp, Artificial Sequence
  Description of Artificial Sequence: Synthetic oligonucleotide
tttcgaaatcagtatgacaatgatgtcactgtttggagcc

SEQ ID NO: 95393 - DNA, 39 bp, Artificial Sequence
  Description of Artificial Sequence: Synthetic oligonucleotide
ttcgaaatcagtatgacaatgatgtcactgtttggagcc

SEQ ID NO: 95394 - DNA, 38 bp, Artificial Sequence
  Description of Artificial Sequence: Synthetic oligonucleotide
tcgaaatcagtatgacaatgatgtcactgtttggagcc

SEQ ID NO: 95395 - DNA, 37 bp, Artificial Sequence
  Description of Artificial Sequence: Synthetic oligonucleotide
cgaaatcagtatgacaatgatgtcactgtttggagcc

SEQ ID NO: 95396 - DNA, 37 bp, Artificial Sequence
  Description of Artificial Sequence: Synthetic oligonucleotide
gaaatcagtatgacaatgatgtcactgtttggagccc

SEQ ID NO: 95397 - DNA, 37 bp, Artificial Sequence
  Description of Artificial Sequence: Synthetic oligonucleotide
aaatcagtatgacaatgatgtcactgtttggagcccc

SEQ ID NO: 95398 - DNA, 36 bp, Artificial Sequence
  Description of Artificial Sequence: Synthetic oligonucleotide
aatcagtatgacaatgatgtcactgtttggagcccc

SEQ ID NO: 95399 - DNA, 35 bp, Artificial Sequence
  Description of Artificial Sequence: Synthetic oligonucleotide
atcagtatgacaatgatgtcactgtttggagcccc

SEQ ID NO: 95400 - DNA, 34 bp, Artificial Sequence
  Description of Artificial Sequence: Synthetic oligonucleotide
tcagtatgacaatgatgtcactgtttggagcccc

SEQ ID NO: 95401 - DNA, 33 bp, Artificial Sequence
  Description of Artificial Sequence: Synthetic oligonucleotide
cagtatgacaatgatgtcactgtttggagcccc

SEQ ID NO: 95402 - DNA, 33 bp, Artificial Sequence
  Description of Artificial Sequence: Synthetic oligonucleotide
agtatgacaatgatgtcactgtttggagccccc

SEQ ID NO: 95403 - DNA, 32 bp, Artificial Sequence
  Description of Artificial Sequence: Synthetic oligonucleotide
gtatgacaatgatgtcactgtttggagccccc

SEQ ID NO: 95404 - DNA, 33 bp, Artificial Sequence
  Description of Artificial Sequence: Synthetic oligonucleotide
tatgacaatgatgtcactgtttggagcccccag

SEQ ID NO: 95405 - DNA, 32 bp, Artificial Sequence
  Description of Artificial Sequence: Synthetic oligonucleotide
atgacaatgatgtcactgtttggagcccccag

SEQ ID NO: 95406 - DNA, 31 bp, Artificial Sequence
  Description of Artificial Sequence: Synthetic oligonucleotide
tgacaatgatgtcactgtttggagcccccag

SEQ ID NO: 95407 - DNA, 30 bp, Artificial Sequence
  Description of Artificial Sequence: Synthetic oligonucleotide
gacaatgatgtcactgtttggagcccccag

SEQ ID NO: 95408 - DNA, 30 bp, Artificial Sequence
  Description of Artificial Sequence: Synthetic oligonucleotide
acaatgatgtcactgtttggagcccccagg

SEQ ID NO: 95409 - DNA, 29 bp, Artificial Sequence
  Description of Artificial Sequence: Synthetic oligonucleotide
caatgatgtcactgtttggagcccccagg

SEQ ID NO: 95410 - DNA, 29 bp, Artificial Sequence
  Description of Artificial Sequence: Synthetic oligonucleotide
aatgatgtcactgtttggagcccccaggg

SEQ ID NO: 95411 - DNA, 28 bp, Artificial Sequence
  Description of Artificial Sequence: Synthetic oligonucleotide
atgatgtcactgtttggagcccccaggg

SEQ ID NO: 95412 - DNA, 27 bp, Artificial Sequence
  Description of Artificial Sequence: Synthetic oligonucleotide
tgatgtcactgtttggagcccccaggg

SEQ ID NO: 95413 - DNA, 26 bp, Artificial Sequence
  Description of Artificial Sequence: Synthetic oligonucleotide
gatgtcactgtttggagcccccaggg

SEQ ID NO: 95414 - DNA, 27 bp, Artificial Sequence
  Description of Artificial Sequence: Synthetic oligonucleotide
atgtcactgtttggagcccccagggca

SEQ ID NO: 95415 - DNA, 26 bp, Artificial Sequence
  Description of Artificial Sequence: Synthetic oligonucleotide
tgtcactgtttggagcccccagggca

SEQ ID NO: 95416 - DNA, 25 bp, Artificial Sequence
  Description of Artificial Sequence: Synthetic oligonucleotide
gtcactgtttggagcccccagggca

SEQ ID NO: 95417 - DNA, 25 bp, Artificial Sequence
  Description of Artificial Sequence: Synthetic oligonucleotide
tcactgtttggagcccccagggcag

SEQ ID NO: 95418 - DNA, 24 bp, Artificial Sequence
  Description of Artificial Sequence: Synthetic oligonucleotide
cactgtttggagcccccagggcag

SEQ ID NO: 95419 - DNA, 27 bp, Artificial Sequence
  Description of Artificial Sequence: Synthetic oligonucleotide
actgtttggagcccccagggcaggatt

SEQ ID NO: 95420 - DNA, 26 bp, Artificial Sequence
  Description of Artificial Sequence: Synthetic oligonucleotide
ctgtttggagcccccagggcaggatt

SEQ ID NO: 95421 - DNA, 27 bp, Artificial Sequence
  Description of Artificial Sequence: Synthetic oligonucleotide
tgtttggagcccccagggcaggattca

SEQ ID NO: 95422 - DNA, 27 bp, Artificial Sequence
  Description of Artificial Sequence: Synthetic oligonucleotide
gtttggagcccccagggcaggattcat

SEQ ID NO: 95423 - DNA, 27 bp, Artificial Sequence
  Description of Artificial Sequence: Synthetic oligonucleotide
tttggagcccccagggcaggattcatc

SEQ ID NO: 95424 - DNA, 27 bp, Artificial Sequence
  Description of Artificial Sequence: Synthetic oligonucleotide
ttggagcccccagggcaggattcatca

SEQ ID NO: 95425 - DNA, 27 bp, Artificial Sequence
  Description of Artificial Sequence: Synthetic oligonucleotide
tggagcccccagggcaggattcatcaa

SEQ ID NO: 95426 - DNA, 27 bp, Artificial Sequence
  Description of Artificial Sequence: Synthetic oligonucleotide
ggagcccccagggcaggattcatcaaa

SEQ ID NO: 95427 - DNA, 29 bp, Artificial Sequence
  Description of Artificial Sequence: Synthetic oligonucleotide
gagcccccagggcaggattcatcaaattg

SEQ ID NO: 95428 - DNA, 34 bp, Artificial Sequence
  Description of Artificial Sequence: Synthetic oligonucleotide
agcccccagggcaggattcatcaaattgaatatg

SEQ ID NO: 95429 - DNA, 33 bp, Artificial Sequence
  Description of Artificial Sequence: Synthetic oligonucleotide
gcccccagggcaggattcatcaaattgaatatg

SEQ ID NO: 95430 - DNA, 33 bp, Artificial Sequence
  Description of Artificial Sequence: Synthetic oligonucleotide
cccccagggcaggattcatcaaattgaatatgc

SEQ ID NO: 95431 - DNA, 36 bp, Artificial Sequence
  Description of Artificial Sequence: Synthetic oligonucleotide
ccccagggcaggattcatcaaattgaatatgcaatg

SEQ ID NO: 95432 - DNA, 36 bp, Artificial Sequence
  Description of Artificial Sequence: Synthetic oligonucleotide
cccagggcaggattcatcaaattgaatatgcaatgg

SEQ ID NO: 95433 - DNA, 38 bp, Artificial Sequence
  Description of Artificial Sequence: Synthetic oligonucleotide
ccagggcaggattcatcaaattgaatatgcaatggaag

SEQ ID NO: 95434 - DNA, 38 bp, Artificial Sequence
  Description of Artificial Sequence: Synthetic oligonucleotide
cagggcaggattcatcaaattgaatatgcaatggaagc

SEQ ID NO: 95435 - DNA, 39 bp, Artificial Sequence
  Description of Artificial Sequence: Synthetic oligonucleotide
agggcaggattcatcaaattgaatatgcaatggaagctg

SEQ ID NO: 95436 - DNA, 38 bp, Artificial Sequence
  Description of Artificial Sequence: Synthetic oligonucleotide
gggcaggattcatcaaattgaatatgcaatggaagctg

SEQ ID NO: 95437 - DNA, 43 bp, Artificial Sequence
  Description of Artificial Sequence: Synthetic oligonucleotide
ggcaggattcatcaaattgaatatgcaatggaagctgttaaac

SEQ ID NO: 95438 - DNA, 45 bp, Artificial Sequence
  Description of Artificial Sequence: Synthetic oligonucleotide
gcaggattcatcaaattgaatatgcaatggaagctgttaaacaag

SEQ ID NO: 95439 - DNA, 45 bp, Artificial Sequence
  Description of Artificial Sequence: Synthetic oligonucleotide
caggattcatcaaattgaatatgcaatggaagctgttaaacaagg

SEQ ID NO: 95440 - DNA, 47 bp, Artificial Sequence
  Description of Artificial Sequence: Synthetic oligonucleotide
aggattcatcaaattgaatatgcaatggaagctgttaaacaaggttc

SEQ ID NO: 95441 - DNA, 46 bp, Artificial Sequence
  Description of Artificial Sequence: Synthetic oligonucleotide
ggattcatcaaattgaatatgcaatggaagctgttaaacaaggttc

SEQ ID NO: 95442 - DNA, 47 bp, Artificial Sequence
  Description of Artificial Sequence: Synthetic oligonucleotide
gattcatcaaattgaatatgcaatggaagctgttaaacaaggttcag

SEQ ID NO: 95443 - DNA, 47 bp, Artificial Sequence
  Description of Artificial Sequence: Synthetic oligonucleotide
attcatcaaattgaatatgcaatggaagctgttaaacaaggttcagc

SEQ ID NO: 95444 - DNA, 46 bp, Artificial Sequence
  Description of Artificial Sequence: Synthetic oligonucleotide
ttcatcaaattgaatatgcaatggaagctgttaaacaaggttcagc

SEQ ID NO: 95445 - DNA, 45 bp, Artificial Sequence
  Description of Artificial Sequence: Synthetic oligonucleotide
tcatcaaattgaatatgcaatggaagctgttaaacaaggttcagc

SEQ ID NO: 95446 - DNA, 44 bp, Artificial Sequence
  Description of Artificial Sequence: Synthetic oligonucleotide
catcaaattgaatatgcaatggaagctgttaaacaaggttcagc

SEQ ID NO: 95447 - DNA, 44 bp, Artificial Sequence
  Description of Artificial Sequence: Synthetic oligonucleotide
atcaaattgaatatgcaatggaagctgttaaacaaggttcagcc

SEQ ID NO: 95448 - DNA, 43 bp, Artificial Sequence
  Description of Artificial Sequence: Synthetic oligonucleotide
tcaaattgaatatgcaatggaagctgttaaacaaggttcagcc

SEQ ID NO: 95449 - DNA, 42 bp, Artificial Sequence
  Description of Artificial Sequence: Synthetic oligonucleotide
caaattgaatatgcaatggaagctgttaaacaaggttcagcc

SEQ ID NO: 95450 - DNA, 43 bp, Artificial Sequence
  Description of Artificial Sequence: Synthetic oligonucleotide
aaattgaatatgcaatggaagctgttaaacaaggttcagccac

SEQ ID NO: 95451 - DNA, 42 bp, Artificial Sequence
  Description of Artificial Sequence: Synthetic oligonucleotide
aattgaatatgcaatggaagctgttaaacaaggttcagccac

SEQ ID NO: 95452 - DNA, 41 bp, Artificial Sequence
  Description of Artificial Sequence: Synthetic oligonucleotide
attgaatatgcaatggaagctgttaaacaaggttcagccac

SEQ ID NO: 95453 - DNA, 40 bp, Artificial Sequence
  Description of Artificial Sequence: Synthetic oligonucleotide
ttgaatatgcaatggaagctgttaaacaaggttcagccac

SEQ ID NO: 95454 - DNA, 39 bp, Artificial Sequence
  Description of Artificial Sequence: Synthetic oligonucleotide
tgaatatgcaatggaagctgttaaacaaggttcagccac

SEQ ID NO: 95455 - DNA, 38 bp, Artificial Sequence
  Description of Artificial Sequence: Synthetic oligonucleotide
gaatatgcaatggaagctgttaaacaaggttcagccac

SEQ ID NO: 95456 - DNA, 39 bp, Artificial Sequence
  Description of Artificial Sequence: Synthetic oligonucleotide
aatatgcaatggaagctgttaaacaaggttcagccacag

SEQ ID NO: 95457 - DNA, 38 bp, Artificial Sequence
  Description of Artificial Sequence: Synthetic oligonucleotide
atatgcaatggaagctgttaaacaaggttcagccacag

SEQ ID NO: 95458 - DNA, 37 bp, Artificial Sequence
  Description of Artificial Sequence: Synthetic oligonucleotide
tatgcaatggaagctgttaaacaaggttcagccacag

SEQ ID NO: 95459 - DNA, 36 bp, Artificial Sequence
  Description of Artificial Sequence: Synthetic oligonucleotide
atgcaatggaagctgttaaacaaggttcagccacag

SEQ ID NO: 95460 - DNA, 35 bp, Artificial Sequence
  Description of Artificial Sequence: Synthetic oligonucleotide
tgcaatggaagctgttaaacaaggttcagccacag

SEQ ID NO: 95461 - DNA, 34 bp, Artificial Sequence
  Description of Artificial Sequence: Synthetic oligonucleotide
gcaatggaagctgttaaacaaggttcagccacag

SEQ ID NO: 95462 - DNA, 36 bp, Artificial Sequence
  Description of Artificial Sequence: Synthetic oligonucleotide
caatggaagctgttaaacaaggttcagccacagttg

SEQ ID NO: 95463 - DNA, 36 bp, Artificial Sequence
  Description of Artificial Sequence: Synthetic oligonucleotide
aatggaagctgttaaacaaggttcagccacagttgg

SEQ ID NO: 95464 - DNA, 35 bp, Artificial Sequence
  Description of Artificial Sequence: Synthetic oligonucleotide
atggaagctgttaaacaaggttcagccacagttgg

SEQ ID NO: 95465 - DNA, 34 bp, Artificial Sequence
  Description of Artificial Sequence: Synthetic oligonucleotide
tggaagctgttaaacaaggttcagccacagttgg

SEQ ID NO: 95466 - DNA, 33 bp, Artificial Sequence
  Description of Artificial Sequence: Synthetic oligonucleotide
ggaagctgttaaacaaggttcagccacagttgg

SEQ ID NO: 95467 - DNA, 34 bp, Artificial Sequence
  Description of Artificial Sequence: Synthetic oligonucleotide
gaagctgttaaacaaggttcagccacagttggtc

SEQ ID NO: 95468 - DNA, 35 bp, Artificial Sequence
  Description of Artificial Sequence: Synthetic oligonucleotide
aagctgttaaacaaggttcagccacagttggtctg

SEQ ID NO: 95469 - DNA, 34 bp, Artificial Sequence
  Description of Artificial Sequence: Synthetic oligonucleotide
agctgttaaacaaggttcagccacagttggtctg

SEQ ID NO: 95470 - DNA, 33 bp, Artificial Sequence
  Description of Artificial Sequence: Synthetic oligonucleotide
gctgttaaacaaggttcagccacagttggtctg

SEQ ID NO: 95471 - DNA, 37 bp, Artificial Sequence
  Description of Artificial Sequence: Synthetic oligonucleotide
ctgttaaacaaggttcagccacagttggtctgaaatc

SEQ ID NO: 95472 - DNA, 42 bp, Artificial Sequence
  Description of Artificial Sequence: Synthetic oligonucleotide
tgttaaacaaggttcagccacagttggtctgaaatcaaaaac

SEQ ID NO: 95473 - DNA, 41 bp, Artificial Sequence
  Description of Artificial Sequence: Synthetic oligonucleotide
gttaaacaaggttcagccacagttggtctgaaatcaaaaac

SEQ ID NO: 95474 - DNA, 42 bp, Artificial Sequence
  Description of Artificial Sequence: Synthetic oligonucleotide
ttaaacaaggttcagccacagttggtctgaaatcaaaaactc

SEQ ID NO: 95475 - DNA, 41 bp, Artificial Sequence
  Description of Artificial Sequence: Synthetic oligonucleotide
taaacaaggttcagccacagttggtctgaaatcaaaaactc

SEQ ID NO: 95476 - DNA, 40 bp, Artificial Sequence
  Description of Artificial Sequence: Synthetic oligonucleotide
aaacaaggttcagccacagttggtctgaaatcaaaaactc

SEQ ID NO: 95477 - DNA, 39 bp, Artificial Sequence
  Description of Artificial Sequence: Synthetic oligonucleotide
aacaaggttcagccacagttggtctgaaatcaaaaactc

SEQ ID NO: 95478 - DNA, 38 bp, Artificial Sequence
  Description of Artificial Sequence: Synthetic oligonucleotide
acaaggttcagccacagttggtctgaaatcaaaaactc

SEQ ID NO: 95479 - DNA, 37 bp, Artificial Sequence
  Description of Artificial Sequence: Synthetic oligonucleotide
caaggttcagccacagttggtctgaaatcaaaaactc

SEQ ID NO: 95480 - DNA, 39 bp, Artificial Sequence
  Description of Artificial Sequence: Synthetic oligonucleotide
aaggttcagccacagttggtctgaaatcaaaaactcatg

SEQ ID NO: 95481 - DNA, 38 bp, Artificial Sequence
  Description of Artificial Sequence: Synthetic oligonucleotide
aggttcagccacagttggtctgaaatcaaaaactcatg

SEQ ID NO: 95482 - DNA, 37 bp, Artificial Sequence
  Description of Artificial Sequence: Synthetic oligonucleotide
ggttcagccacagttggtctgaaatcaaaaactcatg

SEQ ID NO: 95483 - DNA, 37 bp, Artificial Sequence
  Description of Artificial Sequence: Synthetic oligonucleotide
gttcagccacagttggtctgaaatcaaaaactcatgc

SEQ ID NO: 95484 - DNA, 38 bp, Artificial Sequence
  Description of Artificial Sequence: Synthetic oligonucleotide
ttcagccacagttggtctgaaatcaaaaactcatgcag

SEQ ID NO: 95485 - DNA, 37 bp, Artificial Sequence
  Description of Artificial Sequence: Synthetic oligonucleotide
tcagccacagttggtctgaaatcaaaaactcatgcag

SEQ ID NO: 95486 - DNA, 36 bp, Artificial Sequence
  Description of Artificial Sequence: Synthetic oligonucleotide
cagccacagttggtctgaaatcaaaaactcatgcag

SEQ ID NO: 95487 - DNA, 40 bp, Artificial Sequence
  Description of Artificial Sequence: Synthetic oligonucleotide
agccacagttggtctgaaatcaaaaactcatgcagttttg

SEQ ID NO: 95488 - DNA, 39 bp, Artificial Sequence
  Description of Artificial Sequence: Synthetic oligonucleotide
gccacagttggtctgaaatcaaaaactcatgcagttttg

SEQ ID NO: 95489 - DNA, 39 bp, Artificial Sequence
  Description of Artificial Sequence: Synthetic oligonucleotide
ccacagttggtctgaaatcaaaaactcatgcagttttgg

SEQ ID NO: 95490 - DNA, 41 bp, Artificial Sequence
  Description of Artificial Sequence: Synthetic oligonucleotide
cacagttggtctgaaatcaaaaactcatgcagttttggttg

SEQ ID NO: 95491 - DNA, 41 bp, Artificial Sequence
  Description of Artificial Sequence: Synthetic oligonucleotide
acagttggtctgaaatcaaaaactcatgcagttttggttgc

SEQ ID NO: 95492 - DNA, 40 bp, Artificial Sequence
  Description of Artificial Sequence: Synthetic oligonucleotide
cagttggtctgaaatcaaaaactcatgcagttttggttgc

SEQ ID NO: 95493 - DNA, 43 bp, Artificial Sequence
  Description of Artificial Sequence: Synthetic oligonucleotide
agttggtctgaaatcaaaaactcatgcagttttggttgcattg

SEQ ID NO: 95494 - DNA, 42 bp, Artificial Sequence
  Description of Artificial Sequence: Synthetic oligonucleotide
gttggtctgaaatcaaaaactcatgcagttttggttgcattg

SEQ ID NO: 95495 - DNA, 46 bp, Artificial Sequence
  Description of Artificial Sequence: Synthetic oligonucleotide
ttggtctgaaatcaaaaactcatgcagttttggttgcattgaaaag

SEQ ID NO: 95496 - DNA, 45 bp, Artificial Sequence
  Description of Artificial Sequence: Synthetic oligonucleotide
tggtctgaaatcaaaaactcatgcagttttggttgcattgaaaag

SEQ ID NO: 95497 - DNA, 44 bp, Artificial Sequence
  Description of Artificial Sequence: Synthetic oligonucleotide
ggtctgaaatcaaaaactcatgcagttttggttgcattgaaaag

SEQ ID NO: 95498 - DNA, 44 bp, Artificial Sequence
  Description of Artificial Sequence: Synthetic oligonucleotide
gtctgaaatcaaaaactcatgcagttttggttgcattgaaaagg

SEQ ID NO: 95499 - DNA, 44 bp, Artificial Sequence
  Description of Artificial Sequence: Synthetic oligonucleotide
tctgaaatcaaaaactcatgcagttttggttgcattgaaaaggg

SEQ ID NO: 95500 - DNA, 43 bp, Artificial Sequence
  Description of Artificial Sequence: Synthetic oligonucleotide
ctgaaatcaaaaactcatgcagttttggttgcattgaaaaggg

SEQ ID NO: 95501 - DNA, 43 bp, Artificial Sequence
  Description of Artificial Sequence: Synthetic oligonucleotide
tgaaatcaaaaactcatgcagttttggttgcattgaaaagggc

SEQ ID NO: 95502 - DNA, 42 bp, Artificial Sequence
  Description of Artificial Sequence: Synthetic oligonucleotide
gaaatcaaaaactcatgcagttttggttgcattgaaaagggc

SEQ ID NO: 95503 - DNA, 42 bp, Artificial Sequence
  Description of Artificial Sequence: Synthetic oligonucleotide
aaatcaaaaactcatgcagttttggttgcattgaaaagggcg

SEQ ID NO: 95504 - DNA, 41 bp, Artificial Sequence
  Description of Artificial Sequence: Synthetic oligonucleotide
aatcaaaaactcatgcagttttggttgcattgaaaagggcg

SEQ ID NO: 95505 - DNA, 40 bp, Artificial Sequence
  Description of Artificial Sequence: Synthetic oligonucleotide
atcaaaaactcatgcagttttggttgcattgaaaagggcg

SEQ ID NO: 95506 - DNA, 39 bp, Artificial Sequence
  Description of Artificial Sequence: Synthetic oligonucleotide
tcaaaaactcatgcagttttggttgcattgaaaagggcg

SEQ ID NO: 95507 - DNA, 38 bp, Artificial Sequence
  Description of Artificial Sequence: Synthetic oligonucleotide
caaaaactcatgcagttttggttgcattgaaaagggcg

SEQ ID NO: 95508 - DNA, 38 bp, Artificial Sequence
  Description of Artificial Sequence: Synthetic oligonucleotide
aaaaactcatgcagttttggttgcattgaaaagggcgc

SEQ ID NO: 95509 - DNA, 37 bp, Artificial Sequence
  Description of Artificial Sequence: Synthetic oligonucleotide
aaaactcatgcagttttggttgcattgaaaagggcgc

SEQ ID NO: 95510 - DNA, 36 bp, Artificial Sequence
  Description of Artificial Sequence: Synthetic oligonucleotide
aaactcatgcagttttggttgcattgaaaagggcgc

SEQ ID NO: 95511 - DNA, 35 bp, Artificial Sequence
  Description of Artificial Sequence: Synthetic oligonucleotide
aactcatgcagttttggttgcattgaaaagggcgc

SEQ ID NO: 95512 - DNA, 34 bp, Artificial Sequence
  Description of Artificial Sequence: Synthetic oligonucleotide
actcatgcagttttggttgcattgaaaagggcgc

SEQ ID NO: 95513 - DNA, 33 bp, Artificial Sequence
  Description of Artificial Sequence: Synthetic oligonucleotide
ctcatgcagttttggttgcattgaaaagggcgc

SEQ ID NO: 95514 - DNA, 36 bp, Artificial Sequence
  Description of Artificial Sequence: Synthetic oligonucleotide
tcatgcagttttggttgcattgaaaagggcgcaatc

SEQ ID NO: 95515 - DNA, 35 bp, Artificial Sequence
  Description of Artificial Sequence: Synthetic oligonucleotide
catgcagttttggttgcattgaaaagggcgcaatc

SEQ ID NO: 95516 - DNA, 36 bp, Artificial Sequence
  Description of Artificial Sequence: Synthetic oligonucleotide
atgcagttttggttgcattgaaaagggcgcaatcag

SEQ ID NO: 95517 - DNA, 35 bp, Artificial Sequence
  Description of Artificial Sequence: Synthetic oligonucleotide
tgcagttttggttgcattgaaaagggcgcaatcag

SEQ ID NO: 95518 - DNA, 34 bp, Artificial Sequence
  Description of Artificial Sequence: Synthetic oligonucleotide
gcagttttggttgcattgaaaagggcgcaatcag

SEQ ID NO: 95519 - DNA, 35 bp, Artificial Sequence
  Description of Artificial Sequence: Synthetic oligonucleotide
cagttttggttgcattgaaaagggcgcaatcagag

SEQ ID NO: 95520 - DNA, 35 bp, Artificial Sequence
  Description of Artificial Sequence: Synthetic oligonucleotide
agttttggttgcattgaaaagggcgcaatcagagc

SEQ ID NO: 95521 - DNA, 34 bp, Artificial Sequence
  Description of Artificial Sequence: Synthetic oligonucleotide
gttttggttgcattgaaaagggcgcaatcagagc

SEQ ID NO: 95522 - DNA, 36 bp, Artificial Sequence
  Description of Artificial Sequence: Synthetic oligonucleotide
ttttggttgcattgaaaagggcgcaatcagagcttg

SEQ ID NO: 95523 - DNA, 35 bp, Artificial Sequence
  Description of Artificial Sequence: Synthetic oligonucleotide
tttggttgcattgaaaagggcgcaatcagagcttg

SEQ ID NO: 95524 - DNA, 34 bp, Artificial Sequence
  Description of Artificial Sequence: Synthetic oligonucleotide
ttggttgcattgaaaagggcgcaatcagagcttg

SEQ ID NO: 95525 - DNA, 33 bp, Artificial Sequence
  Description of Artificial Sequence: Synthetic oligonucleotide
tggttgcattgaaaagggcgcaatcagagcttg

SEQ ID NO: 95526 - DNA, 32 bp, Artificial Sequence
  Description of Artificial Sequence: Synthetic oligonucleotide
ggttgcattgaaaagggcgcaatcagagcttg

SEQ ID NO: 95527 - DNA, 32 bp, Artificial Sequence
  Description of Artificial Sequence: Synthetic oligonucleotide
gttgcattgaaaagggcgcaatcagagcttgc

SEQ ID NO: 95528 - DNA, 33 bp, Artificial Sequence
  Description of Artificial Sequence: Synthetic oligonucleotide
ttgcattgaaaagggcgcaatcagagcttgcag

SEQ ID NO: 95529 - DNA, 32 bp, Artificial Sequence
  Description of Artificial Sequence: Synthetic oligonucleotide
tgcattgaaaagggcgcaatcagagcttgcag

SEQ ID NO: 95530 - DNA, 31 bp, Artificial Sequence
  Description of Artificial Sequence: Synthetic oligonucleotide
gcattgaaaagggcgcaatcagagcttgcag

SEQ ID NO: 95531 - DNA, 31 bp, Artificial Sequence
  Description of Artificial Sequence: Synthetic oligonucleotide
cattgaaaagggcgcaatcagagcttgcagc

SEQ ID NO: 95532 - DNA, 32 bp, Artificial Sequence
  Description of Artificial Sequence: Synthetic oligonucleotide
attgaaaagggcgcaatcagagcttgcagctc

SEQ ID NO: 95533 - DNA, 31 bp, Artificial Sequence
  Description of Artificial Sequence: Synthetic oligonucleotide
ttgaaaagggcgcaatcagagcttgcagctc

SEQ ID NO: 95534 - DNA, 30 bp, Artificial Sequence
  Description of Artificial Sequence: Synthetic oligonucleotide
tgaaaagggcgcaatcagagcttgcagctc

SEQ ID NO: 95535 - DNA, 29 bp, Artificial Sequence
  Description of Artificial Sequence: Synthetic oligonucleotide
gaaaagggcgcaatcagagcttgcagctc

SEQ ID NO: 95536 - DNA, 31 bp, Artificial Sequence
  Description of Artificial Sequence: Synthetic oligonucleotide
aaaagggcgcaatcagagcttgcagctcatc

SEQ ID NO: 95537 - DNA, 30 bp, Artificial Sequence
  Description of Artificial Sequence: Synthetic oligonucleotide
aaagggcgcaatcagagcttgcagctcatc

SEQ ID NO: 95538 - DNA, 29 bp, Artificial Sequence
  Description of Artificial Sequence: Synthetic oligonucleotide
aagggcgcaatcagagcttgcagctcatc

SEQ ID NO: 95539 - DNA, 28 bp, Artificial Sequence
  Description of Artificial Sequence: Synthetic oligonucleotide
agggcgcaatcagagcttgcagctcatc

SEQ ID NO: 95540 - DNA, 27 bp, Artificial Sequence
  Description of Artificial Sequence: Synthetic oligonucleotide
gggcgcaatcagagcttgcagctcatc

SEQ ID NO: 95541 - DNA, 28 bp, Artificial Sequence
  Description of Artificial Sequence: Synthetic oligonucleotide
ggcgcaatcagagcttgcagctcatcag

SEQ ID NO: 95542 - DNA, 37 bp, Artificial Sequence
  Description of Artificial Sequence: Synthetic oligonucleotide
gcgcaatcagagcttgcagctcatcagaaaaaaattc

SEQ ID NO: 95543 - DNA, 38 bp, Artificial Sequence
  Description of Artificial Sequence: Synthetic oligonucleotide
cgcaatcagagcttgcagctcatcagaaaaaaattctc

SEQ ID NO: 95544 - DNA, 38 bp, Artificial Sequence
  Description of Artificial Sequence: Synthetic oligonucleotide
gcaatcagagcttgcagctcatcagaaaaaaattctcc

SEQ ID NO: 95545 - DNA, 40 bp, Artificial Sequence
  Description of Artificial Sequence: Synthetic oligonucleotide
caatcagagcttgcagctcatcagaaaaaaattctccatg

SEQ ID NO: 95546 - DNA, 42 bp, Artificial Sequence
  Description of Artificial Sequence: Synthetic oligonucleotide
aatcagagcttgcagctcatcagaaaaaaattctccatgttg

SEQ ID NO: 95547 - DNA, 41 bp, Artificial Sequence
  Description of Artificial Sequence: Synthetic oligonucleotide
atcagagcttgcagctcatcagaaaaaaattctccatgttg

SEQ ID NO: 95548 - DNA, 40 bp, Artificial Sequence
  Description of Artificial Sequence: Synthetic oligonucleotide
tcagagcttgcagctcatcagaaaaaaattctccatgttg

SEQ ID NO: 95549 - DNA, 39 bp, Artificial Sequence
  Description of Artificial Sequence: Synthetic oligonucleotide
cagagcttgcagctcatcagaaaaaaattctccatgttg

SEQ ID NO: 95550 - DNA, 40 bp, Artificial Sequence
  Description of Artificial Sequence: Synthetic oligonucleotide
agagcttgcagctcatcagaaaaaaattctccatgttgac

SEQ ID NO: 95551 - DNA, 39 bp, Artificial Sequence
  Description of Artificial Sequence: Synthetic oligonucleotide
gagcttgcagctcatcagaaaaaaattctccatgttgac

SEQ ID NO: 95552 - DNA, 41 bp, Artificial Sequence
  Description of Artificial Sequence: Synthetic oligonucleotide
agcttgcagctcatcagaaaaaaattctccatgttgacaac

SEQ ID NO: 95553 - DNA, 40 bp, Artificial Sequence
  Description of Artificial Sequence: Synthetic oligonucleotide
gcttgcagctcatcagaaaaaaattctccatgttgacaac

SEQ ID NO: 95554 - DNA, 40 bp, Artificial Sequence
  Description of Artificial Sequence: Synthetic oligonucleotide
cttgcagctcatcagaaaaaaattctccatgttgacaacc

SEQ ID NO: 95555 - DNA, 45 bp, Artificial Sequence
  Description of Artificial Sequence: Synthetic oligonucleotide
ttgcagctcatcagaaaaaaattctccatgttgacaaccatattg

SEQ ID NO: 95556 - DNA, 44 bp, Artificial Sequence
  Description of Artificial Sequence: Synthetic oligonucleotide
tgcagctcatcagaaaaaaattctccatgttgacaaccatattg

SEQ ID NO: 95557 - DNA, 43 bp, Artificial Sequence
  Description of Artificial Sequence: Synthetic oligonucleotide
gcagctcatcagaaaaaaattctccatgttgacaaccatattg

SEQ ID NO: 95558 - DNA, 43 bp, Artificial Sequence
  Description of Artificial Sequence: Synthetic oligonucleotide
cagctcatcagaaaaaaattctccatgttgacaaccatattgg

SEQ ID NO: 95559 - DNA, 46 bp, Artificial Sequence
  Description of Artificial Sequence: Synthetic oligonucleotide
agctcatcagaaaaaaattctccatgttgacaaccatattggtatc

SEQ ID NO: 95560 - DNA, 45 bp, Artificial Sequence
  Description of Artificial Sequence: Synthetic oligonucleotide
gctcatcagaaaaaaattctccatgttgacaaccatattggtatc

SEQ ID NO: 95561 - DNA, 46 bp, Artificial Sequence
  Description of Artificial Sequence: Synthetic oligonucleotide
ctcatcagaaaaaaattctccatgttgacaaccatattggtatctc

SEQ ID NO: 95562 - DNA, 50 bp, Artificial Sequence
  Description of Artificial Sequence: Synthetic oligonucleotide
tcatcagaaaaaaattctccatgttgacaaccatattggtatctcaattg

SEQ ID NO: 95563 - DNA, 49 bp, Artificial Sequence
  Description of Artificial Sequence: Synthetic oligonucleotide
catcagaaaaaaattctccatgttgacaaccatattggtatctcaattg

SEQ ID NO: 95564 - DNA, 49 bp, Artificial Sequence
  Description of Artificial Sequence: Synthetic oligonucleotide
atcagaaaaaaattctccatgttgacaaccatattggtatctcaattgc

SEQ ID NO: 95565 - DNA, 48 bp, Artificial Sequence
  Description of Artificial Sequence: Synthetic oligonucleotide
tcagaaaaaaattctccatgttgacaaccatattggtatctcaattgc

SEQ ID NO: 95566 - DNA, 47 bp, Artificial Sequence
  Description of Artificial Sequence: Synthetic oligonucleotide
cagaaaaaaattctccatgttgacaaccatattggtatctcaattgc

SEQ ID NO: 95567 - DNA, 47 bp, Artificial Sequence
  Description of Artificial Sequence: Synthetic oligonucleotide
agaaaaaaattctccatgttgacaaccatattggtatctcaattgcg

SEQ ID NO: 95568 - DNA, 46 bp, Artificial Sequence
  Description of Artificial Sequence: Synthetic oligonucleotide
gaaaaaaattctccatgttgacaaccatattggtatctcaattgcg

SEQ ID NO: 95569 - DNA, 46 bp, Artificial Sequence
  Description of Artificial Sequence: Synthetic oligonucleotide
aaaaaaattctccatgttgacaaccatattggtatctcaattgcgg

SEQ ID NO: 95570 - DNA, 45 bp, Artificial Sequence
  Description of Artificial Sequence: Synthetic oligonucleotide
aaaaaattctccatgttgacaaccatattggtatctcaattgcgg

SEQ ID NO: 95571 - DNA, 44 bp, Artificial Sequence
  Description of Artificial Sequence: Synthetic oligonucleotide
aaaaattctccatgttgacaaccatattggtatctcaattgcgg

SEQ ID NO: 95572 - DNA, 43 bp, Artificial Sequence
  Description of Artificial Sequence: Synthetic oligonucleotide
aaaattctccatgttgacaaccatattggtatctcaattgcgg

SEQ ID NO: 95573 - DNA, 42 bp, Artificial Sequence
  Description of Artificial Sequence: Synthetic oligonucleotide
aaattctccatgttgacaaccatattggtatctcaattgcgg

SEQ ID NO: 95574 - DNA, 41 bp, Artificial Sequence
  Description of Artificial Sequence: Synthetic oligonucleotide
aattctccatgttgacaaccatattggtatctcaattgcgg

SEQ ID NO: 95575 - DNA, 40 bp, Artificial Sequence
  Description of Artificial Sequence: Synthetic oligonucleotide
attctccatgttgacaaccatattggtatctcaattgcgg

SEQ ID NO: 95576 - DNA, 39 bp, Artificial Sequence
  Description of Artificial Sequence: Synthetic oligonucleotide
ttctccatgttgacaaccatattggtatctcaattgcgg

SEQ ID NO: 95577 - DNA, 38 bp, Artificial Sequence
  Description of Artificial Sequence: Synthetic oligonucleotide
tctccatgttgacaaccatattggtatctcaattgcgg

SEQ ID NO: 95578 - DNA, 37 bp, Artificial Sequence
  Description of Artificial Sequence: Synthetic oligonucleotide
ctccatgttgacaaccatattggtatctcaattgcgg

SEQ ID NO: 95579 - DNA, 37 bp, Artificial Sequence
  Description of Artificial Sequence: Synthetic oligonucleotide
tccatgttgacaaccatattggtatctcaattgcggg

SEQ ID NO: 95580 - DNA, 36 bp, Artificial Sequence
  Description of Artificial Sequence: Synthetic oligonucleotide
ccatgttgacaaccatattggtatctcaattgcggg

SEQ ID NO: 95581 - DNA, 36 bp, Artificial Sequence
  Description of Artificial Sequence: Synthetic oligonucleotide
catgttgacaaccatattggtatctcaattgcgggg

SEQ ID NO: 95582 - DNA, 36 bp, Artificial Sequence
  Description of Artificial Sequence: Synthetic oligonucleotide
atgttgacaaccatattggtatctcaattgcggggc

SEQ ID NO: 95583 - DNA, 35 bp, Artificial Sequence
  Description of Artificial Sequence: Synthetic oligonucleotide
tgttgacaaccatattggtatctcaattgcggggc

SEQ ID NO: 95584 - DNA, 34 bp, Artificial Sequence
  Description of Artificial Sequence: Synthetic oligonucleotide
gttgacaaccatattggtatctcaattgcggggc

SEQ ID NO: 95585 - DNA, 37 bp, Artificial Sequence
  Description of Artificial Sequence: Synthetic oligonucleotide
ttgacaaccatattggtatctcaattgcggggcttac

SEQ ID NO: 95586 - DNA, 36 bp, Artificial Sequence
  Description of Artificial Sequence: Synthetic oligonucleotide
tgacaaccatattggtatctcaattgcggggcttac

SEQ ID NO: 95587 - DNA, 35 bp, Artificial Sequence
  Description of Artificial Sequence: Synthetic oligonucleotide
gacaaccatattggtatctcaattgcggggcttac

SEQ ID NO: 95588 - DNA, 36 bp, Artificial Sequence
  Description of Artificial Sequence: Synthetic oligonucleotide
acaaccatattggtatctcaattgcggggcttactg

SEQ ID NO: 95589 - DNA, 35 bp, Artificial Sequence
  Description of Artificial Sequence: Synthetic oligonucleotide
caaccatattggtatctcaattgcggggcttactg

SEQ ID NO: 95590 - DNA, 35 bp, Artificial Sequence
  Description of Artificial Sequence: Synthetic oligonucleotide
aaccatattggtatctcaattgcggggcttactgc

SEQ ID NO: 95591 - DNA, 34 bp, Artificial Sequence
  Description of Artificial Sequence: Synthetic oligonucleotide
accatattggtatctcaattgcggggcttactgc

SEQ ID NO: 95592 - DNA, 33 bp, Artificial Sequence
  Description of Artificial Sequence: Synthetic oligonucleotide
ccatattggtatctcaattgcggggcttactgc

SEQ ID NO: 95593 - DNA, 34 bp, Artificial Sequence
  Description of Artificial Sequence: Synthetic oligonucleotide
catattggtatctcaattgcggggcttactgctg

SEQ ID NO: 95594 - DNA, 36 bp, Artificial Sequence
  Description of Artificial Sequence: Synthetic oligonucleotide
atattggtatctcaattgcggggcttactgctgatg

SEQ ID NO: 95595 - DNA, 35 bp, Artificial Sequence
  Description of Artificial Sequence: Synthetic oligonucleotide
tattggtatctcaattgcggggcttactgctgatg

SEQ ID NO: 95596 - DNA, 34 bp, Artificial Sequence
  Description of Artificial Sequence: Synthetic oligonucleotide
attggtatctcaattgcggggcttactgctgatg

SEQ ID NO: 95597 - DNA, 33 bp, Artificial Sequence
  Description of Artificial Sequence: Synthetic oligonucleotide
ttggtatctcaattgcggggcttactgctgatg

SEQ ID NO: 95598 - DNA, 32 bp, Artificial Sequence
  Description of Artificial Sequence: Synthetic oligonucleotide
tggtatctcaattgcggggcttactgctgatg

SEQ ID NO: 95599 - DNA, 31 bp, Artificial Sequence
  Description of Artificial Sequence: Synthetic oligonucleotide
ggtatctcaattgcggggcttactgctgatg

SEQ ID NO: 95600 - DNA, 31 bp, Artificial Sequence
  Description of Artificial Sequence: Synthetic oligonucleotide
gtatctcaattgcggggcttactgctgatgc

SEQ ID NO: 95601 - DNA, 33 bp, Artificial Sequence
  Description of Artificial Sequence: Synthetic oligonucleotide
tatctcaattgcggggcttactgctgatgctag

SEQ ID NO: 95602 - DNA, 32 bp, Artificial Sequence
  Description of Artificial Sequence: Synthetic oligonucleotide
atctcaattgcggggcttactgctgatgctag

SEQ ID NO: 95603 - DNA, 31 bp, Artificial Sequence
  Description of Artificial Sequence: Synthetic oligonucleotide
tctcaattgcggggcttactgctgatgctag

SEQ ID NO: 95604 - DNA, 30 bp, Artificial Sequence
  Description of Artificial Sequence: Synthetic oligonucleotide
ctcaattgcggggcttactgctgatgctag

SEQ ID NO: 95605 - DNA, 31 bp, Artificial Sequence
  Description of Artificial Sequence: Synthetic oligonucleotide
tcaattgcggggcttactgctgatgctagac

SEQ ID NO: 95606 - DNA, 30 bp, Artificial Sequence
  Description of Artificial Sequence: Synthetic oligonucleotide
caattgcggggcttactgctgatgctagac

SEQ ID NO: 95607 - DNA, 31 bp, Artificial Sequence
  Description of Artificial Sequence: Synthetic oligonucleotide
aattgcggggcttactgctgatgctagactg

SEQ ID NO: 95608 - DNA, 30 bp, Artificial Sequence
  Description of Artificial Sequence: Synthetic oligonucleotide
attgcggggcttactgctgatgctagactg

SEQ ID NO: 95609 - DNA, 29 bp, Artificial Sequence
  Description of Artificial Sequence: Synthetic oligonucleotide
ttgcggggcttactgctgatgctagactg

SEQ ID NO: 95610 - DNA, 28 bp, Artificial Sequence
  Description of Artificial Sequence: Synthetic oligonucleotide
tgcggggcttactgctgatgctagactg

SEQ ID NO: 95611 - DNA, 27 bp, Artificial Sequence
  Description of Artificial Sequence: Synthetic oligonucleotide
gcggggcttactgctgatgctagactg

SEQ ID NO: 95612 - DNA, 31 bp, Artificial Sequence
  Description of Artificial Sequence: Synthetic oligonucleotide
cggggcttactgctgatgctagactgttatg

SEQ ID NO: 95613 - DNA, 40 bp, Artificial Sequence
  Description of Artificial Sequence: Synthetic oligonucleotide
ggggcttactgctgatgctagactgttatgtaattttatg

SEQ ID NO: 95614 - DNA, 40 bp, Artificial Sequence
  Description of Artificial Sequence: Synthetic oligonucleotide
gggcttactgctgatgctagactgttatgtaattttatgc

SEQ ID NO: 95615 - DNA, 40 bp, Artificial Sequence
  Description of Artificial Sequence: Synthetic oligonucleotide
ggcttactgctgatgctagactgttatgtaattttatgcg

SEQ ID NO: 95616 - DNA, 41 bp, Artificial Sequence
  Description of Artificial Sequence: Synthetic oligonucleotide
gcttactgctgatgctagactgttatgtaattttatgcgtc

SEQ ID NO: 95617 - DNA, 42 bp, Artificial Sequence
  Description of Artificial Sequence: Synthetic oligonucleotide
cttactgctgatgctagactgttatgtaattttatgcgtcag

SEQ ID NO: 95618 - DNA, 42 bp, Artificial Sequence
  Description of Artificial Sequence: Synthetic oligonucleotide
ttactgctgatgctagactgttatgtaattttatgcgtcagg

SEQ ID NO: 95619 - DNA, 41 bp, Artificial Sequence
  Description of Artificial Sequence: Synthetic oligonucleotide
tactgctgatgctagactgttatgtaattttatgcgtcagg

SEQ ID NO: 95620 - DNA, 40 bp, Artificial Sequence
  Description of Artificial Sequence: Synthetic oligonucleotide
actgctgatgctagactgttatgtaattttatgcgtcagg

SEQ ID NO: 95621 - DNA, 39 bp, Artificial Sequence
  Description of Artificial Sequence: Synthetic oligonucleotide
ctgctgatgctagactgttatgtaattttatgcgtcagg

SEQ ID NO: 95622 - DNA, 40 bp, Artificial Sequence
  Description of Artificial Sequence: Synthetic oligonucleotide
tgctgatgctagactgttatgtaattttatgcgtcaggag

SEQ ID NO: 95623 - DNA, 39 bp, Artificial Sequence
  Description of Artificial Sequence: Synthetic oligonucleotide
gctgatgctagactgttatgtaattttatgcgtcaggag

SEQ ID NO: 95624 - DNA, 40 bp, Artificial Sequence
  Description of Artificial Sequence: Synthetic oligonucleotide
ctgatgctagactgttatgtaattttatgcgtcaggagtg

SEQ ID NO: 95625 - DNA, 43 bp, Artificial Sequence
  Description of Artificial Sequence: Synthetic oligonucleotide
tgatgctagactgttatgtaattttatgcgtcaggagtgtttg

SEQ ID NO: 95626 - DNA, 42 bp, Artificial Sequence
  Description of Artificial Sequence: Synthetic oligonucleotide
gatgctagactgttatgtaattttatgcgtcaggagtgtttg

SEQ ID NO: 95627 - DNA, 42 bp, Artificial Sequence
  Description of Artificial Sequence: Synthetic oligonucleotide
atgctagactgttatgtaattttatgcgtcaggagtgtttgg

SEQ ID NO: 95628 - DNA, 41 bp, Artificial Sequence
  Description of Artificial Sequence: Synthetic oligonucleotide
tgctagactgttatgtaattttatgcgtcaggagtgtttgg

SEQ ID NO: 95629 - DNA, 40 bp, Artificial Sequence
  Description of Artificial Sequence: Synthetic oligonucleotide
gctagactgttatgtaattttatgcgtcaggagtgtttgg

SEQ ID NO: 95630 - DNA, 43 bp, Artificial Sequence
  Description of Artificial Sequence: Synthetic oligonucleotide
ctagactgttatgtaattttatgcgtcaggagtgtttggattc

SEQ ID NO: 95631 - DNA, 43 bp, Artificial Sequence
  Description of Artificial Sequence: Synthetic oligonucleotide
tagactgttatgtaattttatgcgtcaggagtgtttggattcc

SEQ ID NO: 95632 - DNA, 42 bp, Artificial Sequence
  Description of Artificial Sequence: Synthetic oligonucleotide
agactgttatgtaattttatgcgtcaggagtgtttggattcc

SEQ ID NO: 95633 - DNA, 41 bp, Artificial Sequence
  Description of Artificial Sequence: Synthetic oligonucleotide
gactgttatgtaattttatgcgtcaggagtgtttggattcc

SEQ ID NO: 95634 - DNA, 42 bp, Artificial Sequence
  Description of Artificial Sequence: Synthetic oligonucleotide
actgttatgtaattttatgcgtcaggagtgtttggattccag

SEQ ID NO: 95635 - DNA, 41 bp, Artificial Sequence
  Description of Artificial Sequence: Synthetic oligonucleotide
ctgttatgtaattttatgcgtcaggagtgtttggattccag

SEQ ID NO: 95636 - DNA, 45 bp, Artificial Sequence
  Description of Artificial Sequence: Synthetic oligonucleotide
tgttatgtaattttatgcgtcaggagtgtttggattccagatttg

SEQ ID NO: 95637 - DNA, 44 bp, Artificial Sequence
  Description of Artificial Sequence: Synthetic oligonucleotide
gttatgtaattttatgcgtcaggagtgtttggattccagatttg

SEQ ID NO: 95638 - DNA, 48 bp, Artificial Sequence
  Description of Artificial Sequence: Synthetic oligonucleotide
ttatgtaattttatgcgtcaggagtgtttggattccagatttgtattc

SEQ ID NO: 95639 - DNA, 47 bp, Artificial Sequence
  Description of Artificial Sequence: Synthetic oligonucleotide
tatgtaattttatgcgtcaggagtgtttggattccagatttgtattc

SEQ ID NO: 95640 - DNA, 46 bp, Artificial Sequence
  Description of Artificial Sequence: Synthetic oligonucleotide
atgtaattttatgcgtcaggagtgtttggattccagatttgtattc

SEQ ID NO: 95641 - DNA, 45 bp, Artificial Sequence
  Description of Artificial Sequence: Synthetic oligonucleotide
tgtaattttatgcgtcaggagtgtttggattccagatttgtattc

SEQ ID NO: 95642 - DNA, 44 bp, Artificial Sequence
  Description of Artificial Sequence: Synthetic oligonucleotide
gtaattttatgcgtcaggagtgtttggattccagatttgtattc

SEQ ID NO: 95643 - DNA, 44 bp, Artificial Sequence
  Description of Artificial Sequence: Synthetic oligonucleotide
taattttatgcgtcaggagtgtttggattccagatttgtattcg

SEQ ID NO: 95644 - DNA, 43 bp, Artificial Sequence
  Description of Artificial Sequence: Synthetic oligonucleotide
aattttatgcgtcaggagtgtttggattccagatttgtattcg

SEQ ID NO: 95645 - DNA, 42 bp, Artificial Sequence
  Description of Artificial Sequence: Synthetic oligonucleotide
attttatgcgtcaggagtgtttggattccagatttgtattcg

SEQ ID NO: 95646 - DNA, 41 bp, Artificial Sequence
  Description of Artificial Sequence: Synthetic oligonucleotide
ttttatgcgtcaggagtgtttggattccagatttgtattcg

SEQ ID NO: 95647 - DNA, 40 bp, Artificial Sequence
  Description of Artificial Sequence: Synthetic oligonucleotide
tttatgcgtcaggagtgtttggattccagatttgtattcg

SEQ ID NO: 95648 - DNA, 39 bp, Artificial Sequence
  Description of Artificial Sequence: Synthetic oligonucleotide
ttatgcgtcaggagtgtttggattccagatttgtattcg

SEQ ID NO: 95649 - DNA, 38 bp, Artificial Sequence
  Description of Artificial Sequence: Synthetic oligonucleotide
tatgcgtcaggagtgtttggattccagatttgtattcg

SEQ ID NO: 95650 - DNA, 37 bp, Artificial Sequence
  Description of Artificial Sequence: Synthetic oligonucleotide
atgcgtcaggagtgtttggattccagatttgtattcg

SEQ ID NO: 95651 - DNA, 36 bp, Artificial Sequence
  Description of Artificial Sequence: Synthetic oligonucleotide
tgcgtcaggagtgtttggattccagatttgtattcg

SEQ ID NO: 95652 - DNA, 35 bp, Artificial Sequence
  Description of Artificial Sequence: Synthetic oligonucleotide
gcgtcaggagtgtttggattccagatttgtattcg

SEQ ID NO: 95653 - DNA, 38 bp, Artificial Sequence
  Description of Artificial Sequence: Synthetic oligonucleotide
cgtcaggagtgtttggattccagatttgtattcgatag

SEQ ID NO: 95654 - DNA, 39 bp, Artificial Sequence
  Description of Artificial Sequence: Synthetic oligonucleotide
gtcaggagtgtttggattccagatttgtattcgatagac

SEQ ID NO: 95655 - DNA, 39 bp, Artificial Sequence
  Description of Artificial Sequence: Synthetic oligonucleotide
tcaggagtgtttggattccagatttgtattcgatagacc

SEQ ID NO: 95656 - DNA, 38 bp, Artificial Sequence
  Description of Artificial Sequence: Synthetic oligonucleotide
caggagtgtttggattccagatttgtattcgatagacc

SEQ ID NO: 95657 - DNA, 39 bp, Artificial Sequence
  Description of Artificial Sequence: Synthetic oligonucleotide
aggagtgtttggattccagatttgtattcgatagaccac

SEQ ID NO: 95658 - DNA, 38 bp, Artificial Sequence
  Description of Artificial Sequence: Synthetic oligonucleotide
ggagtgtttggattccagatttgtattcgatagaccac

SEQ ID NO: 95659 - DNA, 39 bp, Artificial Sequence
  Description of Artificial Sequence: Synthetic oligonucleotide
gagtgtttggattccagatttgtattcgatagaccactg

SEQ ID NO: 95660 - DNA, 39 bp, Artificial Sequence
  Description of Artificial Sequence: Synthetic oligonucleotide
agtgtttggattccagatttgtattcgatagaccactgc

SEQ ID NO: 95661 - DNA, 38 bp, Artificial Sequence
  Description of Artificial Sequence: Synthetic oligonucleotide
gtgtttggattccagatttgtattcgatagaccactgc

SEQ ID NO: 95662 - DNA, 38 bp, Artificial Sequence
  Description of Artificial Sequence: Synthetic oligonucleotide
tgtttggattccagatttgtattcgatagaccactgcc

SEQ ID NO: 95663 - DNA, 37 bp, Artificial Sequence
  Description of Artificial Sequence: Synthetic oligonucleotide
gtttggattccagatttgtattcgatagaccactgcc

SEQ ID NO: 95664 - DNA, 38 bp, Artificial Sequence
  Description of Artificial Sequence: Synthetic oligonucleotide
tttggattccagatttgtattcgatagaccactgcctg

SEQ ID NO: 95665 - DNA, 37 bp, Artificial Sequence
  Description of Artificial Sequence: Synthetic oligonucleotide
ttggattccagatttgtattcgatagaccactgcctg

SEQ ID NO: 95666 - DNA, 36 bp, Artificial Sequence
  Description of Artificial Sequence: Synthetic oligonucleotide
tggattccagatttgtattcgatagaccactgcctg

SEQ ID NO: 95667 - DNA, 35 bp, Artificial Sequence
  Description of Artificial Sequence: Synthetic oligonucleotide
ggattccagatttgtattcgatagaccactgcctg

SEQ ID NO: 95668 - DNA, 36 bp, Artificial Sequence
  Description of Artificial Sequence: Synthetic oligonucleotide
gattccagatttgtattcgatagaccactgcctgtg

SEQ ID NO: 95669 - DNA, 37 bp, Artificial Sequence
  Description of Artificial Sequence: Synthetic oligonucleotide
attccagatttgtattcgatagaccactgcctgtgtc

SEQ ID NO: 95670 - DNA, 36 bp, Artificial Sequence
  Description of Artificial Sequence: Synthetic oligonucleotide
ttccagatttgtattcgatagaccactgcctgtgtc

SEQ ID NO: 95671 - DNA, 35 bp, Artificial Sequence
  Description of Artificial Sequence: Synthetic oligonucleotide
tccagatttgtattcgatagaccactgcctgtgtc

SEQ ID NO: 95672 - DNA, 34 bp, Artificial Sequence
  Description of Artificial Sequence: Synthetic oligonucleotide
ccagatttgtattcgatagaccactgcctgtgtc

SEQ ID NO: 95673 - DNA, 35 bp, Artificial Sequence
  Description of Artificial Sequence: Synthetic oligonucleotide
cagatttgtattcgatagaccactgcctgtgtctc

SEQ ID NO: 95674 - DNA, 35 bp, Artificial Sequence
  Description of Artificial Sequence: Synthetic oligonucleotide
agatttgtattcgatagaccactgcctgtgtctcg

SEQ ID NO: 95675 - DNA, 34 bp, Artificial Sequence
  Description of Artificial Sequence: Synthetic oligonucleotide
gatttgtattcgatagaccactgcctgtgtctcg

SEQ ID NO: 95676 - DNA, 35 bp, Artificial Sequence
  Description of Artificial Sequence: Synthetic oligonucleotide
atttgtattcgatagaccactgcctgtgtctcgtc

SEQ ID NO: 95677 - DNA, 34 bp, Artificial Sequence
  Description of Artificial Sequence: Synthetic oligonucleotide
tttgtattcgatagaccactgcctgtgtctcgtc

SEQ ID NO: 95678 - DNA, 33 bp, Artificial Sequence
  Description of Artificial Sequence: Synthetic oligonucleotide
ttgtattcgatagaccactgcctgtgtctcgtc

SEQ ID NO: 95679 - DNA, 32 bp, Artificial Sequence
  Description of Artificial Sequence: Synthetic oligonucleotide
tgtattcgatagaccactgcctgtgtctcgtc

SEQ ID NO: 95680 - DNA, 31 bp, Artificial Sequence
  Description of Artificial Sequence: Synthetic oligonucleotide
gtattcgatagaccactgcctgtgtctcgtc

SEQ ID NO: 95681 - DNA, 33 bp, Artificial Sequence
  Description of Artificial Sequence: Synthetic oligonucleotide
tattcgatagaccactgcctgtgtctcgtcttg

SEQ ID NO: 95682 - DNA, 32 bp, Artificial Sequence
  Description of Artificial Sequence: Synthetic oligonucleotide
attcgatagaccactgcctgtgtctcgtcttg

SEQ ID NO: 95683 - DNA, 31 bp, Artificial Sequence
  Description of Artificial Sequence: Synthetic oligonucleotide
ttcgatagaccactgcctgtgtctcgtcttg

SEQ ID NO: 95684 - DNA, 30 bp, Artificial Sequence
  Description of Artificial Sequence: Synthetic oligonucleotide
tcgatagaccactgcctgtgtctcgtcttg

SEQ ID NO: 95685 - DNA, 29 bp, Artificial Sequence
  Description of Artificial Sequence: Synthetic oligonucleotide
cgatagaccactgcctgtgtctcgtcttg

SEQ ID NO: 95686 - DNA, 32 bp, Artificial Sequence
  Description of Artificial Sequence: Synthetic oligonucleotide
gatagaccactgcctgtgtctcgtcttgtatc

SEQ ID NO: 95687 - DNA, 33 bp, Artificial Sequence
  Description of Artificial Sequence: Synthetic oligonucleotide
atagaccactgcctgtgtctcgtcttgtatctc

SEQ ID NO: 95688 - DNA, 32 bp, Artificial Sequence
  Description of Artificial Sequence: Synthetic oligonucleotide
tagaccactgcctgtgtctcgtcttgtatctc

SEQ ID NO: 95689 - DNA, 31 bp, Artificial Sequence
  Description of Artificial Sequence: Synthetic oligonucleotide
agaccactgcctgtgtctcgtcttgtatctc

SEQ ID NO: 95690 - DNA, 30 bp, Artificial Sequence
  Description of Artificial Sequence: Synthetic oligonucleotide
gaccactgcctgtgtctcgtcttgtatctc

SEQ ID NO: 95691 - DNA, 35 bp, Artificial Sequence
  Description of Artificial Sequence: Synthetic oligonucleotide
accactgcctgtgtctcgtcttgtatctctaattg

SEQ ID NO: 95692 - DNA, 34 bp, Artificial Sequence
  Description of Artificial Sequence: Synthetic oligonucleotide
ccactgcctgtgtctcgtcttgtatctctaattg

SEQ ID NO: 95693 - DNA, 34 bp, Artificial Sequence
  Description of Artificial Sequence: Synthetic oligonucleotide
cactgcctgtgtctcgtcttgtatctctaattgg

SEQ ID NO: 95694 - DNA, 36 bp, Artificial Sequence
  Description of Artificial Sequence: Synthetic oligonucleotide
actgcctgtgtctcgtcttgtatctctaattggaag

SEQ ID NO: 95695 - DNA, 35 bp, Artificial Sequence
  Description of Artificial Sequence: Synthetic oligonucleotide
ctgcctgtgtctcgtcttgtatctctaattggaag

SEQ ID NO: 95696 - DNA, 35 bp, Artificial Sequence
  Description of Artificial Sequence: Synthetic oligonucleotide
tgcctgtgtctcgtcttgtatctctaattggaagc

SEQ ID NO: 95697 - DNA, 34 bp, Artificial Sequence
  Description of Artificial Sequence: Synthetic oligonucleotide
gcctgtgtctcgtcttgtatctctaattggaagc

SEQ ID NO: 95698 - DNA, 36 bp, Artificial Sequence
  Description of Artificial Sequence: Synthetic oligonucleotide
cctgtgtctcgtcttgtatctctaattggaagcaag

SEQ ID NO: 95699 - DNA, 37 bp, Artificial Sequence
  Description of Artificial Sequence: Synthetic oligonucleotide
ctgtgtctcgtcttgtatctctaattggaagcaagac

SEQ ID NO: 95700 - DNA, 37 bp, Artificial Sequence
  Description of Artificial Sequence: Synthetic oligonucleotide
tgtgtctcgtcttgtatctctaattggaagcaagacc

SEQ ID NO: 95701 - DNA, 36 bp, Artificial Sequence
  Description of Artificial Sequence: Synthetic oligonucleotide
gtgtctcgtcttgtatctctaattggaagcaagacc

SEQ ID NO: 95702 - DNA, 36 bp, Artificial Sequence
  Description of Artificial Sequence: Synthetic oligonucleotide
tgtctcgtcttgtatctctaattggaagcaagaccc

SEQ ID NO: 95703 - DNA, 35 bp, Artificial Sequence
  Description of Artificial Sequence: Synthetic oligonucleotide
gtctcgtcttgtatctctaattggaagcaagaccc

SEQ ID NO: 95704 - DNA, 36 bp, Artificial Sequence
  Description of Artificial Sequence: Synthetic oligonucleotide
tctcgtcttgtatctctaattggaagcaagacccag

SEQ ID NO: 95705 - DNA, 35 bp, Artificial Sequence
  Description of Artificial Sequence: Synthetic oligonucleotide
ctcgtcttgtatctctaattggaagcaagacccag

SEQ ID NO: 95706 - DNA, 38 bp, Artificial Sequence
  Description of Artificial Sequence: Synthetic oligonucleotide
tcgtcttgtatctctaattggaagcaagacccagatac

SEQ ID NO: 95707 - DNA, 37 bp, Artificial Sequence
  Description of Artificial Sequence: Synthetic oligonucleotide
cgtcttgtatctctaattggaagcaagacccagatac

SEQ ID NO: 95708 - DNA, 37 bp, Artificial Sequence
  Description of Artificial Sequence: Synthetic oligonucleotide
gtcttgtatctctaattggaagcaagacccagatacc

SEQ ID NO: 95709 - DNA, 39 bp, Artificial Sequence
  Description of Artificial Sequence: Synthetic oligonucleotide
tcttgtatctctaattggaagcaagacccagataccaac

SEQ ID NO: 95710 - DNA, 38 bp, Artificial Sequence
  Description of Artificial Sequence: Synthetic oligonucleotide
cttgtatctctaattggaagcaagacccagataccaac

SEQ ID NO: 95711 - DNA, 39 bp, Artificial Sequence
  Description of Artificial Sequence: Synthetic oligonucleotide
ttgtatctctaattggaagcaagacccagataccaacac

SEQ ID NO: 95712 - DNA, 38 bp, Artificial Sequence
  Description of Artificial Sequence: Synthetic oligonucleotide
tgtatctctaattggaagcaagacccagataccaacac

SEQ ID NO: 95713 - DNA, 37 bp, Artificial Sequence
  Description of Artificial Sequence: Synthetic oligonucleotide
gtatctctaattggaagcaagacccagataccaacac

SEQ ID NO: 95714 - DNA, 39 bp, Artificial Sequence
  Description of Artificial Sequence: Synthetic oligonucleotide
tatctctaattggaagcaagacccagataccaacacaac

SEQ ID NO: 95715 - DNA, 38 bp, Artificial Sequence
  Description of Artificial Sequence: Synthetic oligonucleotide
atctctaattggaagcaagacccagataccaacacaac

SEQ ID NO: 95716 - DNA, 37 bp, Artificial Sequence
  Description of Artificial Sequence: Synthetic oligonucleotide
tctctaattggaagcaagacccagataccaacacaac

SEQ ID NO: 95717 - DNA, 36 bp, Artificial Sequence
  Description of Artificial Sequence: Synthetic oligonucleotide
ctctaattggaagcaagacccagataccaacacaac

SEQ ID NO: 95718 - DNA, 36 bp, Artificial Sequence
  Description of Artificial Sequence: Synthetic oligonucleotide
tctaattggaagcaagacccagataccaacacaacg

SEQ ID NO: 95719 - DNA, 35 bp, Artificial Sequence
  Description of Artificial Sequence: Synthetic oligonucleotide
ctaattggaagcaagacccagataccaacacaacg

SEQ ID NO: 95720 - DNA, 39 bp, Artificial Sequence
  Description of Artificial Sequence: Synthetic oligonucleotide
taattggaagcaagacccagataccaacacaacgatatg

SEQ ID NO: 95721 - DNA, 38 bp, Artificial Sequence
  Description of Artificial Sequence: Synthetic oligonucleotide
aattggaagcaagacccagataccaacacaacgatatg

SEQ ID NO: 95722 - DNA, 37 bp, Artificial Sequence
  Description of Artificial Sequence: Synthetic oligonucleotide
attggaagcaagacccagataccaacacaacgatatg

SEQ ID NO: 95723 - DNA, 36 bp, Artificial Sequence
  Description of Artificial Sequence: Synthetic oligonucleotide
ttggaagcaagacccagataccaacacaacgatatg

SEQ ID NO: 95724 - DNA, 35 bp, Artificial Sequence
  Description of Artificial Sequence: Synthetic oligonucleotide
tggaagcaagacccagataccaacacaacgatatg

SEQ ID NO: 95725 - DNA, 34 bp, Artificial Sequence
  Description of Artificial Sequence: Synthetic oligonucleotide
ggaagcaagacccagataccaacacaacgatatg

SEQ ID NO: 95726 - DNA, 34 bp, Artificial Sequence
  Description of Artificial Sequence: Synthetic oligonucleotide
gaagcaagacccagataccaacacaacgatatgg

SEQ ID NO: 95727 - DNA, 34 bp, Artificial Sequence
  Description of Artificial Sequence: Synthetic oligonucleotide
aagcaagacccagataccaacacaacgatatggc

SEQ ID NO: 95728 - DNA, 33 bp, Artificial Sequence
  Description of Artificial Sequence: Synthetic oligonucleotide
agcaagacccagataccaacacaacgatatggc

SEQ ID NO: 95729 - DNA, 32 bp, Artificial Sequence
  Description of Artificial Sequence: Synthetic oligonucleotide
gcaagacccagataccaacacaacgatatggc

SEQ ID NO: 95730 - DNA, 32 bp, Artificial Sequence
  Description of Artificial Sequence: Synthetic oligonucleotide
caagacccagataccaacacaacgatatggcc

SEQ ID NO: 95731 - DNA, 32 bp, Artificial Sequence
  Description of Artificial Sequence: Synthetic oligonucleotide
aagacccagataccaacacaacgatatggccg

SEQ ID NO: 95732 - DNA, 31 bp, Artificial Sequence
  Description of Artificial Sequence: Synthetic oligonucleotide
agacccagataccaacacaacgatatggccg

SEQ ID NO: 95733 - DNA, 30 bp, Artificial Sequence
  Description of Artificial Sequence: Synthetic oligonucleotide
gacccagataccaacacaacgatatggccg

SEQ ID NO: 95734 - DNA, 30 bp, Artificial Sequence
  Description of Artificial Sequence: Synthetic oligonucleotide
acccagataccaacacaacgatatggccgg

SEQ ID NO: 95735 - DNA, 29 bp, Artificial Sequence
  Description of Artificial Sequence: Synthetic oligonucleotide
cccagataccaacacaacgatatggccgg

SEQ ID NO: 95736 - DNA, 30 bp, Artificial Sequence
  Description of Artificial Sequence: Synthetic oligonucleotide
ccagataccaacacaacgatatggccggag

SEQ ID NO: 95737 - DNA, 31 bp, Artificial Sequence
  Description of Artificial Sequence: Synthetic oligonucleotide
cagataccaacacaacgatatggccggagac

SEQ ID NO: 95738 - DNA, 31 bp, Artificial Sequence
  Description of Artificial Sequence: Synthetic oligonucleotide
agataccaacacaacgatatggccggagacc

SEQ ID NO: 95739 - DNA, 30 bp, Artificial Sequence
  Description of Artificial Sequence: Synthetic oligonucleotide
gataccaacacaacgatatggccggagacc

SEQ ID NO: 95740 - DNA, 34 bp, Artificial Sequence
  Description of Artificial Sequence: Synthetic oligonucleotide
ataccaacacaacgatatggccggagaccatatg

SEQ ID NO: 95741 - DNA, 33 bp, Artificial Sequence
  Description of Artificial Sequence: Synthetic oligonucleotide
taccaacacaacgatatggccggagaccatatg

SEQ ID NO: 95742 - DNA, 32 bp, Artificial Sequence
  Description of Artificial Sequence: Synthetic oligonucleotide
accaacacaacgatatggccggagaccatatg

SEQ ID NO: 95743 - DNA, 31 bp, Artificial Sequence
  Description of Artificial Sequence: Synthetic oligonucleotide
ccaacacaacgatatggccggagaccatatg

SEQ ID NO: 95744 - DNA, 31 bp, Artificial Sequence
  Description of Artificial Sequence: Synthetic oligonucleotide
caacacaacgatatggccggagaccatatgg

SEQ ID NO: 95745 - DNA, 32 bp, Artificial Sequence
  Description of Artificial Sequence: Synthetic oligonucleotide
aacacaacgatatggccggagaccatatggtg

SEQ ID NO: 95746 - DNA, 31 bp, Artificial Sequence
  Description of Artificial Sequence: Synthetic oligonucleotide
acacaacgatatggccggagaccatatggtg

SEQ ID NO: 95747 - DNA, 30 bp, Artificial Sequence
  Description of Artificial Sequence: Synthetic oligonucleotide
cacaacgatatggccggagaccatatggtg

SEQ ID NO: 95748 - DNA, 32 bp, Artificial Sequence
  Description of Artificial Sequence: Synthetic oligonucleotide
acaacgatatggccggagaccatatggtgttg

SEQ ID NO: 95749 - DNA, 31 bp, Artificial Sequence
  Description of Artificial Sequence: Synthetic oligonucleotide
caacgatatggccggagaccatatggtgttg

SEQ ID NO: 95750 - DNA, 31 bp, Artificial Sequence
  Description of Artificial Sequence: Synthetic oligonucleotide
aacgatatggccggagaccatatggtgttgg

SEQ ID NO: 95751 - DNA, 30 bp, Artificial Sequence
  Description of Artificial Sequence: Synthetic oligonucleotide
acgatatggccggagaccatatggtgttgg

SEQ ID NO: 95752 - DNA, 29 bp, Artificial Sequence
  Description of Artificial Sequence: Synthetic oligonucleotide
cgatatggccggagaccatatggtgttgg

SEQ ID NO: 95753 - DNA, 30 bp, Artificial Sequence
  Description of Artificial Sequence: Synthetic oligonucleotide
gatatggccggagaccatatggtgttggtc

SEQ ID NO: 95754 - DNA, 31 bp, Artificial Sequence
  Description of Artificial Sequence: Synthetic oligonucleotide
atatggccggagaccatatggtgttggtctc

SEQ ID NO: 95755 - DNA, 30 bp, Artificial Sequence
  Description of Artificial Sequence: Synthetic oligonucleotide
tatggccggagaccatatggtgttggtctc

SEQ ID NO: 95756 - DNA, 29 bp, Artificial Sequence
  Description of Artificial Sequence: Synthetic oligonucleotide
atggccggagaccatatggtgttggtctc

SEQ ID NO: 95757 - DNA, 28 bp, Artificial Sequence
  Description of Artificial Sequence: Synthetic oligonucleotide
tggccggagaccatatggtgttggtctc

SEQ ID NO: 95758 - DNA, 27 bp, Artificial Sequence
  Description of Artificial Sequence: Synthetic oligonucleotide
ggccggagaccatatggtgttggtctc

SEQ ID NO: 95759 - DNA, 27 bp, Artificial Sequence
  Description of Artificial Sequence: Synthetic oligonucleotide
gccggagaccatatggtgttggtctcc

SEQ ID NO: 95760 - DNA, 32 bp, Artificial Sequence
  Description of Artificial Sequence: Synthetic oligonucleotide
ccggagaccatatggtgttggtctccttattg

SEQ ID NO: 95761 - DNA, 32 bp, Artificial Sequence
  Description of Artificial Sequence: Synthetic oligonucleotide
cggagaccatatggtgttggtctccttattgc

SEQ ID NO: 95762 - DNA, 33 bp, Artificial Sequence
  Description of Artificial Sequence: Synthetic oligonucleotide
ggagaccatatggtgttggtctccttattgctg

SEQ ID NO: 95763 - DNA, 33 bp, Artificial Sequence
  Description of Artificial Sequence: Synthetic oligonucleotide
gagaccatatggtgttggtctccttattgctgg

SEQ ID NO: 95764 - DNA, 37 bp, Artificial Sequence
  Description of Artificial Sequence: Synthetic oligonucleotide
agaccatatggtgttggtctccttattgctggttatg

SEQ ID NO: 95765 - DNA, 36 bp, Artificial Sequence
  Description of Artificial Sequence: Synthetic oligonucleotide
gaccatatggtgttggtctccttattgctggttatg

SEQ ID NO: 95766 - DNA, 38 bp, Artificial Sequence
  Description of Artificial Sequence: Synthetic oligonucleotide
accatatggtgttggtctccttattgctggttatgatg

SEQ ID NO: 95767 - DNA, 37 bp, Artificial Sequence
  Description of Artificial Sequence: Synthetic oligonucleotide
ccatatggtgttggtctccttattgctggttatgatg

SEQ ID NO: 95768 - DNA, 41 bp, Artificial Sequence
  Description of Artificial Sequence: Synthetic oligonucleotide
catatggtgttggtctccttattgctggttatgatgatatg

SEQ ID NO: 95769 - DNA, 41 bp, Artificial Sequence
  Description of Artificial Sequence: Synthetic oligonucleotide
atatggtgttggtctccttattgctggttatgatgatatgg

SEQ ID NO: 95770 - DNA, 40 bp, Artificial Sequence
  Description of Artificial Sequence: Synthetic oligonucleotide
tatggtgttggtctccttattgctggttatgatgatatgg

SEQ ID NO: 95771 - DNA, 39 bp, Artificial Sequence
  Description of Artificial Sequence: Synthetic oligonucleotide
atggtgttggtctccttattgctggttatgatgatatgg

SEQ ID NO: 95772 - DNA, 38 bp, Artificial Sequence
  Description of Artificial Sequence: Synthetic oligonucleotide
tggtgttggtctccttattgctggttatgatgatatgg

SEQ ID NO: 95773 - DNA, 37 bp, Artificial Sequence
  Description of Artificial Sequence: Synthetic oligonucleotide
ggtgttggtctccttattgctggttatgatgatatgg

SEQ ID NO: 95774 - DNA, 37 bp, Artificial Sequence
  Description of Artificial Sequence: Synthetic oligonucleotide
gtgttggtctccttattgctggttatgatgatatggg

SEQ ID NO: 95775 - DNA, 37 bp, Artificial Sequence
  Description of Artificial Sequence: Synthetic oligonucleotide
tgttggtctccttattgctggttatgatgatatgggc

SEQ ID NO: 95776 - DNA, 36 bp, Artificial Sequence
  Description of Artificial Sequence: Synthetic oligonucleotide
gttggtctccttattgctggttatgatgatatgggc

SEQ ID NO: 95777 - DNA, 36 bp, Artificial Sequence
  Description of Artificial Sequence: Synthetic oligonucleotide
ttggtctccttattgctggttatgatgatatgggcc

SEQ ID NO: 95778 - DNA, 35 bp, Artificial Sequence
  Description of Artificial Sequence: Synthetic oligonucleotide
tggtctccttattgctggttatgatgatatgggcc

SEQ ID NO: 95779 - DNA, 34 bp, Artificial Sequence
  Description of Artificial Sequence: Synthetic oligonucleotide
ggtctccttattgctggttatgatgatatgggcc

SEQ ID NO: 95780 - DNA, 34 bp, Artificial Sequence
  Description of Artificial Sequence: Synthetic oligonucleotide
gtctccttattgctggttatgatgatatgggccc

SEQ ID NO: 95781 - DNA, 35 bp, Artificial Sequence
  Description of Artificial Sequence: Synthetic oligonucleotide
tctccttattgctggttatgatgatatgggccctc

SEQ ID NO: 95782 - DNA, 34 bp, Artificial Sequence
  Description of Artificial Sequence: Synthetic oligonucleotide
ctccttattgctggttatgatgatatgggccctc

SEQ ID NO: 95783 - DNA, 35 bp, Artificial Sequence
  Description of Artificial Sequence: Synthetic oligonucleotide
tccttattgctggttatgatgatatgggccctcac

SEQ ID NO: 95784 - DNA, 34 bp, Artificial Sequence
  Description of Artificial Sequence: Synthetic oligonucleotide
ccttattgctggttatgatgatatgggccctcac

SEQ ID NO: 95785 - DNA, 39 bp, Artificial Sequence
  Description of Artificial Sequence: Synthetic oligonucleotide
cttattgctggttatgatgatatgggccctcacattttc

SEQ ID NO: 95786 - DNA, 39 bp, Artificial Sequence
  Description of Artificial Sequence: Synthetic oligonucleotide
ttattgctggttatgatgatatgggccctcacattttcc

SEQ ID NO: 95787 - DNA, 38 bp, Artificial Sequence
  Description of Artificial Sequence: Synthetic oligonucleotide
tattgctggttatgatgatatgggccctcacattttcc

SEQ ID NO: 95788 - DNA, 37 bp, Artificial Sequence
  Description of Artificial Sequence: Synthetic oligonucleotide
attgctggttatgatgatatgggccctcacattttcc

SEQ ID NO: 95789 - DNA, 36 bp, Artificial Sequence
  Description of Artificial Sequence: Synthetic oligonucleotide
ttgctggttatgatgatatgggccctcacattttcc

SEQ ID NO: 95790 - DNA, 35 bp, Artificial Sequence
  Description of Artificial Sequence: Synthetic oligonucleotide
tgctggttatgatgatatgggccctcacattttcc

SEQ ID NO: 95791 - DNA, 34 bp, Artificial Sequence
  Description of Artificial Sequence: Synthetic oligonucleotide
gctggttatgatgatatgggccctcacattttcc

SEQ ID NO: 95792 - DNA, 37 bp, Artificial Sequence
  Description of Artificial Sequence: Synthetic oligonucleotide
ctggttatgatgatatgggccctcacattttccaaac

SEQ ID NO: 95793 - DNA, 37 bp, Artificial Sequence
  Description of Artificial Sequence: Synthetic oligonucleotide
tggttatgatgatatgggccctcacattttccaaacc

SEQ ID NO: 95794 - DNA, 36 bp, Artificial Sequence
  Description of Artificial Sequence: Synthetic oligonucleotide
ggttatgatgatatgggccctcacattttccaaacc

SEQ ID NO: 95795 - DNA, 37 bp, Artificial Sequence
  Description of Artificial Sequence: Synthetic oligonucleotide
gttatgatgatatgggccctcacattttccaaacctg

SEQ ID NO: 95796 - DNA, 38 bp, Artificial Sequence
  Description of Artificial Sequence: Synthetic oligonucleotide
ttatgatgatatgggccctcacattttccaaacctgtc

SEQ ID NO: 95797 - DNA, 37 bp, Artificial Sequence
  Description of Artificial Sequence: Synthetic oligonucleotide
tatgatgatatgggccctcacattttccaaacctgtc

SEQ ID NO: 95798 - DNA, 36 bp, Artificial Sequence
  Description of Artificial Sequence: Synthetic oligonucleotide
atgatgatatgggccctcacattttccaaacctgtc

SEQ ID NO: 95799 - DNA, 35 bp, Artificial Sequence
  Description of Artificial Sequence: Synthetic oligonucleotide
tgatgatatgggccctcacattttccaaacctgtc

SEQ ID NO: 95800 - DNA, 34 bp, Artificial Sequence
  Description of Artificial Sequence: Synthetic oligonucleotide
gatgatatgggccctcacattttccaaacctgtc

SEQ ID NO: 95801 - DNA, 34 bp, Artificial Sequence
  Description of Artificial Sequence: Synthetic oligonucleotide
atgatatgggccctcacattttccaaacctgtcc

SEQ ID NO: 95802 - DNA, 33 bp, Artificial Sequence
  Description of Artificial Sequence: Synthetic oligonucleotide
tgatatgggccctcacattttccaaacctgtcc

SEQ ID NO: 95803 - DNA, 32 bp, Artificial Sequence
  Description of Artificial Sequence: Synthetic oligonucleotide
gatatgggccctcacattttccaaacctgtcc

SEQ ID NO: 95804 - DNA, 34 bp, Artificial Sequence
  Description of Artificial Sequence: Synthetic oligonucleotide
atatgggccctcacattttccaaacctgtccatc

SEQ ID NO: 95805 - DNA, 33 bp, Artificial Sequence
  Description of Artificial Sequence: Synthetic oligonucleotide
tatgggccctcacattttccaaacctgtccatc

SEQ ID NO: 95806 - DNA, 32 bp, Artificial Sequence
  Description of Artificial Sequence: Synthetic oligonucleotide
atgggccctcacattttccaaacctgtccatc

SEQ ID NO: 95807 - DNA, 31 bp, Artificial Sequence
  Description of Artificial Sequence: Synthetic oligonucleotide
tgggccctcacattttccaaacctgtccatc

SEQ ID NO: 95808 - DNA, 30 bp, Artificial Sequence
  Description of Artificial Sequence: Synthetic oligonucleotide
gggccctcacattttccaaacctgtccatc

SEQ ID NO: 95809 - DNA, 31 bp, Artificial Sequence
  Description of Artificial Sequence: Synthetic oligonucleotide
ggccctcacattttccaaacctgtccatctg

SEQ ID NO: 95810 - DNA, 31 bp, Artificial Sequence
  Description of Artificial Sequence: Synthetic oligonucleotide
gccctcacattttccaaacctgtccatctgc

SEQ ID NO: 95811 - DNA, 34 bp, Artificial Sequence
  Description of Artificial Sequence: Synthetic oligonucleotide
ccctcacattttccaaacctgtccatctgctaac

SEQ ID NO: 95812 - DNA, 40 bp, Artificial Sequence
  Description of Artificial Sequence: Synthetic oligonucleotide
cctcacattttccaaacctgtccatctgctaactattttg

SEQ ID NO: 95813 - DNA, 41 bp, Artificial Sequence
  Description of Artificial Sequence: Synthetic oligonucleotide
ctcacattttccaaacctgtccatctgctaactattttgac

SEQ ID NO: 95814 - DNA, 42 bp, Artificial Sequence
  Description of Artificial Sequence: Synthetic oligonucleotide
tcacattttccaaacctgtccatctgctaactattttgactg

SEQ ID NO: 95815 - DNA, 41 bp, Artificial Sequence
  Description of Artificial Sequence: Synthetic oligonucleotide
cacattttccaaacctgtccatctgctaactattttgactg

SEQ ID NO: 95816 - DNA, 41 bp, Artificial Sequence
  Description of Artificial Sequence: Synthetic oligonucleotide
acattttccaaacctgtccatctgctaactattttgactgc

SEQ ID NO: 95817 - DNA, 40 bp, Artificial Sequence
  Description of Artificial Sequence: Synthetic oligonucleotide
cattttccaaacctgtccatctgctaactattttgactgc

SEQ ID NO: 95818 - DNA, 41 bp, Artificial Sequence
  Description of Artificial Sequence: Synthetic oligonucleotide
attttccaaacctgtccatctgctaactattttgactgcag

SEQ ID NO: 95819 - DNA, 40 bp, Artificial Sequence
  Description of Artificial Sequence: Synthetic oligonucleotide
ttttccaaacctgtccatctgctaactattttgactgcag

SEQ ID NO: 95820 - DNA, 39 bp, Artificial Sequence
  Description of Artificial Sequence: Synthetic oligonucleotide
tttccaaacctgtccatctgctaactattttgactgcag

SEQ ID NO: 95821 - DNA, 38 bp, Artificial Sequence
  Description of Artificial Sequence: Synthetic oligonucleotide
ttccaaacctgtccatctgctaactattttgactgcag

SEQ ID NO: 95822 - DNA, 37 bp, Artificial Sequence
  Description of Artificial Sequence: Synthetic oligonucleotide
tccaaacctgtccatctgctaactattttgactgcag

SEQ ID NO: 95823 - DNA, 36 bp, Artificial Sequence
  Description of Artificial Sequence: Synthetic oligonucleotide
ccaaacctgtccatctgctaactattttgactgcag

SEQ ID NO: 95824 - DNA, 37 bp, Artificial Sequence
  Description of Artificial Sequence: Synthetic oligonucleotide
caaacctgtccatctgctaactattttgactgcagag

SEQ ID NO: 95825 - DNA, 37 bp, Artificial Sequence
  Description of Artificial Sequence: Synthetic oligonucleotide
aaacctgtccatctgctaactattttgactgcagagc

SEQ ID NO: 95826 - DNA, 36 bp, Artificial Sequence
  Description of Artificial Sequence: Synthetic oligonucleotide
aacctgtccatctgctaactattttgactgcagagc

SEQ ID NO: 95827 - DNA, 35 bp, Artificial Sequence
  Description of Artificial Sequence: Synthetic oligonucleotide
acctgtccatctgctaactattttgactgcagagc

SEQ ID NO: 95828 - DNA, 34 bp, Artificial Sequence
  Description of Artificial Sequence: Synthetic oligonucleotide
cctgtccatctgctaactattttgactgcagagc

SEQ ID NO: 95829 - DNA, 34 bp, Artificial Sequence
  Description of Artificial Sequence: Synthetic oligonucleotide
ctgtccatctgctaactattttgactgcagagcc

SEQ ID NO: 95830 - DNA, 36 bp, Artificial Sequence
  Description of Artificial Sequence: Synthetic oligonucleotide
tgtccatctgctaactattttgactgcagagccatg

SEQ ID NO: 95831 - DNA, 35 bp, Artificial Sequence
  Description of Artificial Sequence: Synthetic oligonucleotide
gtccatctgctaactattttgactgcagagccatg

SEQ ID NO: 95832 - DNA, 36 bp, Artificial Sequence
  Description of Artificial Sequence: Synthetic oligonucleotide
tccatctgctaactattttgactgcagagccatgtc

SEQ ID NO: 95833 - DNA, 35 bp, Artificial Sequence
  Description of Artificial Sequence: Synthetic oligonucleotide
ccatctgctaactattttgactgcagagccatgtc

SEQ ID NO: 95834 - DNA, 35 bp, Artificial Sequence
  Description of Artificial Sequence: Synthetic oligonucleotide
catctgctaactattttgactgcagagccatgtcc

SEQ ID NO: 95835 - DNA, 38 bp, Artificial Sequence
  Description of Artificial Sequence: Synthetic oligonucleotide
atctgctaactattttgactgcagagccatgtccattg

SEQ ID NO: 95836 - DNA, 37 bp, Artificial Sequence
  Description of Artificial Sequence: Synthetic oligonucleotide
tctgctaactattttgactgcagagccatgtccattg

SEQ ID NO: 95837 - DNA, 36 bp, Artificial Sequence
  Description of Artificial Sequence: Synthetic oligonucleotide
ctgctaactattttgactgcagagccatgtccattg

SEQ ID NO: 95838 - DNA, 36 bp, Artificial Sequence
  Description of Artificial Sequence: Synthetic oligonucleotide
tgctaactattttgactgcagagccatgtccattgg

SEQ ID NO: 95839 - DNA, 35 bp, Artificial Sequence
  Description of Artificial Sequence: Synthetic oligonucleotide
gctaactattttgactgcagagccatgtccattgg

SEQ ID NO: 95840 - DNA, 36 bp, Artificial Sequence
  Description of Artificial Sequence: Synthetic oligonucleotide
ctaactattttgactgcagagccatgtccattggag

SEQ ID NO: 95841 - DNA, 36 bp, Artificial Sequence
  Description of Artificial Sequence: Synthetic oligonucleotide
taactattttgactgcagagccatgtccattggagc

SEQ ID NO: 95842 - DNA, 35 bp, Artificial Sequence
  Description of Artificial Sequence: Synthetic oligonucleotide
aactattttgactgcagagccatgtccattggagc

SEQ ID NO: 95843 - DNA, 34 bp, Artificial Sequence
  Description of Artificial Sequence: Synthetic oligonucleotide
actattttgactgcagagccatgtccattggagc

SEQ ID NO: 95844 - DNA, 33 bp, Artificial Sequence
  Description of Artificial Sequence: Synthetic oligonucleotide
ctattttgactgcagagccatgtccattggagc

SEQ ID NO: 95845 - DNA, 33 bp, Artificial Sequence
  Description of Artificial Sequence: Synthetic oligonucleotide
tattttgactgcagagccatgtccattggagcc

SEQ ID NO: 95846 - DNA, 32 bp, Artificial Sequence
  Description of Artificial Sequence: Synthetic oligonucleotide
attttgactgcagagccatgtccattggagcc

SEQ ID NO: 95847 - DNA, 31 bp, Artificial Sequence
  Description of Artificial Sequence: Synthetic oligonucleotide
ttttgactgcagagccatgtccattggagcc

SEQ ID NO: 95848 - DNA, 30 bp, Artificial Sequence
  Description of Artificial Sequence: Synthetic oligonucleotide
tttgactgcagagccatgtccattggagcc

SEQ ID NO: 95849 - DNA, 29 bp, Artificial Sequence
  Description of Artificial Sequence: Synthetic oligonucleotide
ttgactgcagagccatgtccattggagcc

SEQ ID NO: 95850 - DNA, 28 bp, Artificial Sequence
  Description of Artificial Sequence: Synthetic oligonucleotide
tgactgcagagccatgtccattggagcc

SEQ ID NO: 95851 - DNA, 27 bp, Artificial Sequence
  Description of Artificial Sequence: Synthetic oligonucleotide
gactgcagagccatgtccattggagcc

SEQ ID NO: 95852 - DNA, 27 bp, Artificial Sequence
  Description of Artificial Sequence: Synthetic oligonucleotide
actgcagagccatgtccattggagccc

SEQ ID NO: 95853 - DNA, 26 bp, Artificial Sequence
  Description of Artificial Sequence: Synthetic oligonucleotide
ctgcagagccatgtccattggagccc

SEQ ID NO: 95854 - DNA, 27 bp, Artificial Sequence
  Description of Artificial Sequence: Synthetic oligonucleotide
tgcagagccatgtccattggagcccgt

SEQ ID NO: 95855 - DNA, 27 bp, Artificial Sequence
  Description of Artificial Sequence: Synthetic oligonucleotide
gcagagccatgtccattggagcccgtt

SEQ ID NO: 95856 - DNA, 27 bp, Artificial Sequence
  Description of Artificial Sequence: Synthetic oligonucleotide
cagagccatgtccattggagcccgttc

SEQ ID NO: 95857 - DNA, 27 bp, Artificial Sequence
  Description of Artificial Sequence: Synthetic oligonucleotide
agagccatgtccattggagcccgttcc

SEQ ID NO: 95858 - DNA, 26 bp, Artificial Sequence
  Description of Artificial Sequence: Synthetic oligonucleotide
gagccatgtccattggagcccgttcc

SEQ ID NO: 95859 - DNA, 27 bp, Artificial Sequence
  Description of Artificial Sequence: Synthetic oligonucleotide
agccatgtccattggagcccgttccca

SEQ ID NO: 95860 - DNA, 27 bp, Artificial Sequence
  Description of Artificial Sequence: Synthetic oligonucleotide
gccatgtccattggagcccgttcccaa

SEQ ID NO: 95861 - DNA, 28 bp, Artificial Sequence
  Description of Artificial Sequence: Synthetic oligonucleotide
ccatgtccattggagcccgttcccaatc

SEQ ID NO: 95862 - DNA, 29 bp, Artificial Sequence
  Description of Artificial Sequence: Synthetic oligonucleotide
catgtccattggagcccgttcccaatcag

SEQ ID NO: 95863 - DNA, 29 bp, Artificial Sequence
  Description of Artificial Sequence: Synthetic oligonucleotide
atgtccattggagcccgttcccaatcagc

SEQ ID NO: 95864 - DNA, 28 bp, Artificial Sequence
  Description of Artificial Sequence: Synthetic oligonucleotide
tgtccattggagcccgttcccaatcagc

SEQ ID NO: 95865 - DNA, 27 bp, Artificial Sequence
  Description of Artificial Sequence: Synthetic oligonucleotide
gtccattggagcccgttcccaatcagc

SEQ ID NO: 95866 - DNA, 28 bp, Artificial Sequence
  Description of Artificial Sequence: Synthetic oligonucleotide
tccattggagcccgttcccaatcagctc

SEQ ID NO: 95867 - DNA, 27 bp, Artificial Sequence
  Description of Artificial Sequence: Synthetic oligonucleotide
ccattggagcccgttcccaatcagctc

SEQ ID NO: 95868 - DNA, 27 bp, Artificial Sequence
  Description of Artificial Sequence: Synthetic oligonucleotide
cattggagcccgttcccaatcagctcg

SEQ ID NO: 95869 - DNA, 29 bp, Artificial Sequence
  Description of Artificial Sequence: Synthetic oligonucleotide
attggagcccgttcccaatcagctcgtac

SEQ ID NO: 95870 - DNA, 28 bp, Artificial Sequence
  Description of Artificial Sequence: Synthetic oligonucleotide
ttggagcccgttcccaatcagctcgtac

SEQ ID NO: 95871 - DNA, 27 bp, Artificial Sequence
  Description of Artificial Sequence: Synthetic oligonucleotide
tggagcccgttcccaatcagctcgtac

SEQ ID NO: 95872 - DNA, 27 bp, Artificial Sequence
  Description of Artificial Sequence: Synthetic oligonucleotide
ggagcccgttcccaatcagctcgtact

SEQ ID NO: 95873 - DNA, 29 bp, Artificial Sequence
  Description of Artificial Sequence: Synthetic oligonucleotide
gagcccgttcccaatcagctcgtacttac

SEQ ID NO: 95874 - DNA, 31 bp, Artificial Sequence
  Description of Artificial Sequence: Synthetic oligonucleotide
agcccgttcccaatcagctcgtacttacttg

SEQ ID NO: 95875 - DNA, 30 bp, Artificial Sequence
  Description of Artificial Sequence: Synthetic oligonucleotide
gcccgttcccaatcagctcgtacttacttg

SEQ ID NO: 95876 - DNA, 30 bp, Artificial Sequence
  Description of Artificial Sequence: Synthetic oligonucleotide
cccgttcccaatcagctcgtacttacttgg

SEQ ID NO: 95877 - DNA, 31 bp, Artificial Sequence
  Description of Artificial Sequence: Synthetic oligonucleotide
ccgttcccaatcagctcgtacttacttggag

SEQ ID NO: 95878 - DNA, 32 bp, Artificial Sequence
  Description of Artificial Sequence: Synthetic oligonucleotide
cgttcccaatcagctcgtacttacttggagag

SEQ ID NO: 95879 - DNA, 33 bp, Artificial Sequence
  Description of Artificial Sequence: Synthetic oligonucleotide
gttcccaatcagctcgtacttacttggagagac

SEQ ID NO: 95880 - DNA, 37 bp, Artificial Sequence
  Description of Artificial Sequence: Synthetic oligonucleotide
ttcccaatcagctcgtacttacttggagagacatatg

SEQ ID NO: 95881 - DNA, 36 bp, Artificial Sequence
  Description of Artificial Sequence: Synthetic oligonucleotide
tcccaatcagctcgtacttacttggagagacatatg

SEQ ID NO: 95882 - DNA, 35 bp, Artificial Sequence
  Description of Artificial Sequence: Synthetic oligonucleotide
cccaatcagctcgtacttacttggagagacatatg

SEQ ID NO: 95883 - DNA, 36 bp, Artificial Sequence
  Description of Artificial Sequence: Synthetic oligonucleotide
ccaatcagctcgtacttacttggagagacatatgtc

SEQ ID NO: 95884 - DNA, 37 bp, Artificial Sequence
  Description of Artificial Sequence: Synthetic oligonucleotide
caatcagctcgtacttacttggagagacatatgtctg

SEQ ID NO: 95885 - DNA, 44 bp, Artificial Sequence
  Description of Artificial Sequence: Synthetic oligonucleotide
aatcagctcgtacttacttggagagacatatgtctgaatttatg

SEQ ID NO: 95886 - DNA, 43 bp, Artificial Sequence
  Description of Artificial Sequence: Synthetic oligonucleotide
atcagctcgtacttacttggagagacatatgtctgaatttatg

SEQ ID NO: 95887 - DNA, 42 bp, Artificial Sequence
  Description of Artificial Sequence: Synthetic oligonucleotide
tcagctcgtacttacttggagagacatatgtctgaatttatg

SEQ ID NO: 95888 - DNA, 41 bp, Artificial Sequence
  Description of Artificial Sequence: Synthetic oligonucleotide
cagctcgtacttacttggagagacatatgtctgaatttatg

SEQ ID NO: 95889 - DNA, 41 bp, Artificial Sequence
  Description of Artificial Sequence: Synthetic oligonucleotide
agctcgtacttacttggagagacatatgtctgaatttatgg

SEQ ID NO: 95890 - DNA, 40 bp, Artificial Sequence
  Description of Artificial Sequence: Synthetic oligonucleotide
gctcgtacttacttggagagacatatgtctgaatttatgg

SEQ ID NO: 95891 - DNA, 41 bp, Artificial Sequence
  Description of Artificial Sequence: Synthetic oligonucleotide
ctcgtacttacttggagagacatatgtctgaatttatggag

SEQ ID NO: 95892 - DNA, 42 bp, Artificial Sequence
  Description of Artificial Sequence: Synthetic oligonucleotide
tcgtacttacttggagagacatatgtctgaatttatggagtg

SEQ ID NO: 95893 - DNA, 41 bp, Artificial Sequence
  Description of Artificial Sequence: Synthetic oligonucleotide
cgtacttacttggagagacatatgtctgaatttatggagtg

SEQ ID NO: 95894 - DNA, 51 bp, Artificial Sequence
  Description of Artificial Sequence: Synthetic oligonucleotide
gtacttacttggagagacatatgtctgaatttatggagtgtaatttaaatg

SEQ ID NO: 95895 - DNA, 53 bp, Artificial Sequence
  Description of Artificial Sequence: Synthetic oligonucleotide
tacttacttggagagacatatgtctgaatttatggagtgtaatttaaatgaac

SEQ ID NO: 95896 - DNA, 52 bp, Artificial Sequence
  Description of Artificial Sequence: Synthetic oligonucleotide
acttacttggagagacatatgtctgaatttatggagtgtaatttaaatgaac

SEQ ID NO: 95897 - DNA, 51 bp, Artificial Sequence
  Description of Artificial Sequence: Synthetic oligonucleotide
cttacttggagagacatatgtctgaatttatggagtgtaatttaaatgaac

SEQ ID NO: 95898 - DNA, 53 bp, Artificial Sequence
  Description of Artificial Sequence: Synthetic oligonucleotide
ttacttggagagacatatgtctgaatttatggagtgtaatttaaatgaactag

SEQ ID NO: 95899 - DNA, 52 bp, Artificial Sequence
  Description of Artificial Sequence: Synthetic oligonucleotide
tacttggagagacatatgtctgaatttatggagtgtaatttaaatgaactag

SEQ ID NO: 95900 - DNA, 51 bp, Artificial Sequence
  Description of Artificial Sequence: Synthetic oligonucleotide
acttggagagacatatgtctgaatttatggagtgtaatttaaatgaactag

SEQ ID NO: 95901 - DNA, 50 bp, Artificial Sequence
  Description of Artificial Sequence: Synthetic oligonucleotide
cttggagagacatatgtctgaatttatggagtgtaatttaaatgaactag

SEQ ID NO: 95902 - DNA, 55 bp, Artificial Sequence
  Description of Artificial Sequence: Synthetic oligonucleotide
ttggagagacatatgtctgaatttatggagtgtaatttaaatgaactagttaaac

SEQ ID NO: 95903 - DNA, 54 bp, Artificial Sequence
  Description of Artificial Sequence: Synthetic oligonucleotide
tggagagacatatgtctgaatttatggagtgtaatttaaatgaactagttaaac

SEQ ID NO: 95904 - DNA, 53 bp, Artificial Sequence
  Description of Artificial Sequence: Synthetic oligonucleotide
ggagagacatatgtctgaatttatggagtgtaatttaaatgaactagttaaac

SEQ ID NO: 95905 - DNA, 55 bp, Artificial Sequence
  Description of Artificial Sequence: Synthetic oligonucleotide
gagagacatatgtctgaatttatggagtgtaatttaaatgaactagttaaacatg

SEQ ID NO: 95906 - DNA, 55 bp, Artificial Sequence
  Description of Artificial Sequence: Synthetic oligonucleotide
agagacatatgtctgaatttatggagtgtaatttaaatgaactagttaaacatgg

SEQ ID NO: 95907 - DNA, 54 bp, Artificial Sequence
  Description of Artificial Sequence: Synthetic oligonucleotide
gagacatatgtctgaatttatggagtgtaatttaaatgaactagttaaacatgg

SEQ ID NO: 95908 - DNA, 55 bp, Artificial Sequence
  Description of Artificial Sequence: Synthetic oligonucleotide
agacatatgtctgaatttatggagtgtaatttaaatgaactagttaaacatggtc

SEQ ID NO: 95909 - DNA, 54 bp, Artificial Sequence
  Description of Artificial Sequence: Synthetic oligonucleotide
gacatatgtctgaatttatggagtgtaatttaaatgaactagttaaacatggtc

SEQ ID NO: 95910 - DNA, 55 bp, Artificial Sequence
  Description of Artificial Sequence: Synthetic oligonucleotide
acatatgtctgaatttatggagtgtaatttaaatgaactagttaaacatggtctg

SEQ ID NO: 95911 - DNA, 54 bp, Artificial Sequence
  Description of Artificial Sequence: Synthetic oligonucleotide
catatgtctgaatttatggagtgtaatttaaatgaactagttaaacatggtctg

SEQ ID NO: 95912 - DNA, 54 bp, Artificial Sequence
  Description of Artificial Sequence: Synthetic oligonucleotide
atatgtctgaatttatggagtgtaatttaaatgaactagttaaacatggtctgc

SEQ ID NO: 95913 - DNA, 53 bp, Artificial Sequence
  Description of Artificial Sequence: Synthetic oligonucleotide
tatgtctgaatttatggagtgtaatttaaatgaactagttaaacatggtctgc

SEQ ID NO: 95914 - DNA, 52 bp, Artificial Sequence
  Description of Artificial Sequence: Synthetic oligonucleotide
atgtctgaatttatggagtgtaatttaaatgaactagttaaacatggtctgc

SEQ ID NO: 95915 - DNA, 51 bp, Artificial Sequence
  Description of Artificial Sequence: Synthetic oligonucleotide
tgtctgaatttatggagtgtaatttaaatgaactagttaaacatggtctgc

SEQ ID NO: 95916 - DNA, 50 bp, Artificial Sequence
  Description of Artificial Sequence: Synthetic oligonucleotide
gtctgaatttatggagtgtaatttaaatgaactagttaaacatggtctgc

SEQ ID NO: 95917 - DNA, 50 bp, Artificial Sequence
  Description of Artificial Sequence: Synthetic oligonucleotide
tctgaatttatggagtgtaatttaaatgaactagttaaacatggtctgcg

SEQ ID NO: 95918 - DNA, 49 bp, Artificial Sequence
  Description of Artificial Sequence: Synthetic oligonucleotide
ctgaatttatggagtgtaatttaaatgaactagttaaacatggtctgcg

SEQ ID NO: 95919 - DNA, 50 bp, Artificial Sequence
  Description of Artificial Sequence: Synthetic oligonucleotide
tgaatttatggagtgtaatttaaatgaactagttaaacatggtctgcgtg

SEQ ID NO: 95920 - DNA, 49 bp, Artificial Sequence
  Description of Artificial Sequence: Synthetic oligonucleotide
gaatttatggagtgtaatttaaatgaactagttaaacatggtctgcgtg

SEQ ID NO: 95921 - DNA, 49 bp, Artificial Sequence
  Description of Artificial Sequence: Synthetic oligonucleotide
aatttatggagtgtaatttaaatgaactagttaaacatggtctgcgtgc

SEQ ID NO: 95922 - DNA, 48 bp, Artificial Sequence
  Description of Artificial Sequence: Synthetic oligonucleotide
atttatggagtgtaatttaaatgaactagttaaacatggtctgcgtgc

SEQ ID NO: 95923 - DNA, 47 bp, Artificial Sequence
  Description of Artificial Sequence: Synthetic oligonucleotide
tttatggagtgtaatttaaatgaactagttaaacatggtctgcgtgc

SEQ ID NO: 95924 - DNA, 46 bp, Artificial Sequence
  Description of Artificial Sequence: Synthetic oligonucleotide
ttatggagtgtaatttaaatgaactagttaaacatggtctgcgtgc

SEQ ID NO: 95925 - DNA, 45 bp, Artificial Sequence
  Description of Artificial Sequence: Synthetic oligonucleotide
tatggagtgtaatttaaatgaactagttaaacatggtctgcgtgc

SEQ ID NO: 95926 - DNA, 44 bp, Artificial Sequence
  Description of Artificial Sequence: Synthetic oligonucleotide
atggagtgtaatttaaatgaactagttaaacatggtctgcgtgc

SEQ ID NO: 95927 - DNA, 43 bp, Artificial Sequence
  Description of Artificial Sequence: Synthetic oligonucleotide
tggagtgtaatttaaatgaactagttaaacatggtctgcgtgc

SEQ ID NO: 95928 - DNA, 42 bp, Artificial Sequence
  Description of Artificial Sequence: Synthetic oligonucleotide
ggagtgtaatttaaatgaactagttaaacatggtctgcgtgc

SEQ ID NO: 95929 - DNA, 42 bp, Artificial Sequence
  Description of Artificial Sequence: Synthetic oligonucleotide
gagtgtaatttaaatgaactagttaaacatggtctgcgtgcc

SEQ ID NO: 95930 - DNA, 46 bp, Artificial Sequence
  Description of Artificial Sequence: Synthetic oligonucleotide
agtgtaatttaaatgaactagttaaacatggtctgcgtgccttaag

SEQ ID NO: 95931 - DNA, 45 bp, Artificial Sequence
  Description of Artificial Sequence: Synthetic oligonucleotide
gtgtaatttaaatgaactagttaaacatggtctgcgtgccttaag

SEQ ID NO: 95932 - DNA, 46 bp, Artificial Sequence
  Description of Artificial Sequence: Synthetic oligonucleotide
tgtaatttaaatgaactagttaaacatggtctgcgtgccttaagag

SEQ ID NO: 95933 - DNA, 45 bp, Artificial Sequence
  Description of Artificial Sequence: Synthetic oligonucleotide
gtaatttaaatgaactagttaaacatggtctgcgtgccttaagag

SEQ ID NO: 95934 - DNA, 46 bp, Artificial Sequence
  Description of Artificial Sequence: Synthetic oligonucleotide
taatttaaatgaactagttaaacatggtctgcgtgccttaagagag

SEQ ID NO: 95935 - DNA, 45 bp, Artificial Sequence
  Description of Artificial Sequence: Synthetic oligonucleotide
aatttaaatgaactagttaaacatggtctgcgtgccttaagagag

SEQ ID NO: 95936 - DNA, 44 bp, Artificial Sequence
  Description of Artificial Sequence: Synthetic oligonucleotide
atttaaatgaactagttaaacatggtctgcgtgccttaagagag

SEQ ID NO: 95937 - DNA, 43 bp, Artificial Sequence
  Description of Artificial Sequence: Synthetic oligonucleotide
tttaaatgaactagttaaacatggtctgcgtgccttaagagag

SEQ ID NO: 95938 - DNA, 42 bp, Artificial Sequence
  Description of Artificial Sequence: Synthetic oligonucleotide
ttaaatgaactagttaaacatggtctgcgtgccttaagagag

SEQ ID NO: 95939 - DNA, 41 bp, Artificial Sequence
  Description of Artificial Sequence: Synthetic oligonucleotide
taaatgaactagttaaacatggtctgcgtgccttaagagag

SEQ ID NO: 95940 - DNA, 40 bp, Artificial Sequence
  Description of Artificial Sequence: Synthetic oligonucleotide
aaatgaactagttaaacatggtctgcgtgccttaagagag

SEQ ID NO: 95941 - DNA, 39 bp, Artificial Sequence
  Description of Artificial Sequence: Synthetic oligonucleotide
aatgaactagttaaacatggtctgcgtgccttaagagag

SEQ ID NO: 95942 - DNA, 38 bp, Artificial Sequence
  Description of Artificial Sequence: Synthetic oligonucleotide
atgaactagttaaacatggtctgcgtgccttaagagag

SEQ ID NO: 95943 - DNA, 37 bp, Artificial Sequence
  Description of Artificial Sequence: Synthetic oligonucleotide
tgaactagttaaacatggtctgcgtgccttaagagag

SEQ ID NO: 95944 - DNA, 36 bp, Artificial Sequence
  Description of Artificial Sequence: Synthetic oligonucleotide
gaactagttaaacatggtctgcgtgccttaagagag

SEQ ID NO: 95945 - DNA, 37 bp, Artificial Sequence
  Description of Artificial Sequence: Synthetic oligonucleotide
aactagttaaacatggtctgcgtgccttaagagagac

SEQ ID NO: 95946 - DNA, 36 bp, Artificial Sequence
  Description of Artificial Sequence: Synthetic oligonucleotide
actagttaaacatggtctgcgtgccttaagagagac

SEQ ID NO: 95947 - DNA, 35 bp, Artificial Sequence
  Description of Artificial Sequence: Synthetic oligonucleotide
ctagttaaacatggtctgcgtgccttaagagagac

SEQ ID NO: 95948 - DNA, 35 bp, Artificial Sequence
  Description of Artificial Sequence: Synthetic oligonucleotide
tagttaaacatggtctgcgtgccttaagagagacg

SEQ ID NO: 95949 - DNA, 34 bp, Artificial Sequence
  Description of Artificial Sequence: Synthetic oligonucleotide
agttaaacatggtctgcgtgccttaagagagacg

SEQ ID NO: 95950 - DNA, 33 bp, Artificial Sequence
  Description of Artificial Sequence: Synthetic oligonucleotide
gttaaacatggtctgcgtgccttaagagagacg

SEQ ID NO: 95951 - DNA, 33 bp, Artificial Sequence
  Description of Artificial Sequence: Synthetic oligonucleotide
ttaaacatggtctgcgtgccttaagagagacgc

SEQ ID NO: 95952 - DNA, 32 bp, Artificial Sequence
  Description of Artificial Sequence: Synthetic oligonucleotide
taaacatggtctgcgtgccttaagagagacgc

SEQ ID NO: 95953 - DNA, 31 bp, Artificial Sequence
  Description of Artificial Sequence: Synthetic oligonucleotide
aaacatggtctgcgtgccttaagagagacgc

SEQ ID NO: 95954 - DNA, 30 bp, Artificial Sequence
  Description of Artificial Sequence: Synthetic oligonucleotide
aacatggtctgcgtgccttaagagagacgc

SEQ ID NO: 95955 - DNA, 29 bp, Artificial Sequence
  Description of Artificial Sequence: Synthetic oligonucleotide
acatggtctgcgtgccttaagagagacgc

SEQ ID NO: 95956 - DNA, 28 bp, Artificial Sequence
  Description of Artificial Sequence: Synthetic oligonucleotide
catggtctgcgtgccttaagagagacgc

SEQ ID NO: 95957 - DNA, 30 bp, Artificial Sequence
  Description of Artificial Sequence: Synthetic oligonucleotide
atggtctgcgtgccttaagagagacgcttc

SEQ ID NO: 95958 - DNA, 29 bp, Artificial Sequence
  Description of Artificial Sequence: Synthetic oligonucleotide
tggtctgcgtgccttaagagagacgcttc

SEQ ID NO: 95959 - DNA, 28 bp, Artificial Sequence
  Description of Artificial Sequence: Synthetic oligonucleotide
ggtctgcgtgccttaagagagacgcttc

SEQ ID NO: 95960 - DNA, 28 bp, Artificial Sequence
  Description of Artificial Sequence: Synthetic oligonucleotide
gtctgcgtgccttaagagagacgcttcc

SEQ ID NO: 95961 - DNA, 29 bp, Artificial Sequence
  Description of Artificial Sequence: Synthetic oligonucleotide
tctgcgtgccttaagagagacgcttcctg

SEQ ID NO: 95962 - DNA, 28 bp, Artificial Sequence
  Description of Artificial Sequence: Synthetic oligonucleotide
ctgcgtgccttaagagagacgcttcctg

SEQ ID NO: 95963 - DNA, 28 bp, Artificial Sequence
  Description of Artificial Sequence: Synthetic oligonucleotide
tgcgtgccttaagagagacgcttcctgc

SEQ ID NO: 95964 - DNA, 27 bp, Artificial Sequence
  Description of Artificial Sequence: Synthetic oligonucleotide
gcgtgccttaagagagacgcttcctgc

SEQ ID NO: 95965 - DNA, 28 bp, Artificial Sequence
  Description of Artificial Sequence: Synthetic oligonucleotide
cgtgccttaagagagacgcttcctgcag

SEQ ID NO: 95966 - DNA, 30 bp, Artificial Sequence
  Description of Artificial Sequence: Synthetic oligonucleotide
gtgccttaagagagacgcttcctgcagaac

SEQ ID NO: 95967 - DNA, 31 bp, Artificial Sequence
  Description of Artificial Sequence: Synthetic oligonucleotide
tgccttaagagagacgcttcctgcagaacag

SEQ ID NO: 95968 - DNA, 30 bp, Artificial Sequence
  Description of Artificial Sequence: Synthetic oligonucleotide
gccttaagagagacgcttcctgcagaacag

SEQ ID NO: 95969 - DNA, 30 bp, Artificial Sequence
  Description of Artificial Sequence: Synthetic oligonucleotide
ccttaagagagacgcttcctgcagaacagg

SEQ ID NO: 95970 - DNA, 31 bp, Artificial Sequence
  Description of Artificial Sequence: Synthetic oligonucleotide
cttaagagagacgcttcctgcagaacaggac

SEQ ID NO: 95971 - DNA, 31 bp, Artificial Sequence
  Description of Artificial Sequence: Synthetic oligonucleotide
ttaagagagacgcttcctgcagaacaggacc

SEQ ID NO: 95972 - DNA, 30 bp, Artificial Sequence
  Description of Artificial Sequence: Synthetic oligonucleotide
taagagagacgcttcctgcagaacaggacc

SEQ ID NO: 95973 - DNA, 29 bp, Artificial Sequence
  Description of Artificial Sequence: Synthetic oligonucleotide
aagagagacgcttcctgcagaacaggacc

SEQ ID NO: 95974 - DNA, 28 bp, Artificial Sequence
  Description of Artificial Sequence: Synthetic oligonucleotide
agagagacgcttcctgcagaacaggacc

SEQ ID NO: 95975 - DNA, 27 bp, Artificial Sequence
  Description of Artificial Sequence: Synthetic oligonucleotide
gagagacgcttcctgcagaacaggacc

SEQ ID NO: 95976 - DNA, 28 bp, Artificial Sequence
  Description of Artificial Sequence: Synthetic oligonucleotide
agagacgcttcctgcagaacaggacctg

SEQ ID NO: 95977 - DNA, 27 bp, Artificial Sequence
  Description of Artificial Sequence: Synthetic oligonucleotide
gagacgcttcctgcagaacaggacctg

SEQ ID NO: 95978 - DNA, 28 bp, Artificial Sequence
  Description of Artificial Sequence: Synthetic oligonucleotide
agacgcttcctgcagaacaggacctgac

SEQ ID NO: 95979 - DNA, 27 bp, Artificial Sequence
  Description of Artificial Sequence: Synthetic oligonucleotide
gacgcttcctgcagaacaggacctgac

SEQ ID NO: 95980 - DNA, 29 bp, Artificial Sequence
  Description of Artificial Sequence: Synthetic oligonucleotide
acgcttcctgcagaacaggacctgactac

SEQ ID NO: 95981 - DNA, 28 bp, Artificial Sequence
  Description of Artificial Sequence: Synthetic oligonucleotide
cgcttcctgcagaacaggacctgactac

SEQ ID NO: 95982 - DNA, 31 bp, Artificial Sequence
  Description of Artificial Sequence: Synthetic oligonucleotide
gcttcctgcagaacaggacctgactacaaag

SEQ ID NO: 95983 - DNA, 34 bp, Artificial Sequence
  Description of Artificial Sequence: Synthetic oligonucleotide
cttcctgcagaacaggacctgactacaaagaatg

SEQ ID NO: 95984 - DNA, 37 bp, Artificial Sequence
  Description of Artificial Sequence: Synthetic oligonucleotide
ttcctgcagaacaggacctgactacaaagaatgtttc

SEQ ID NO: 95985 - DNA, 36 bp, Artificial Sequence
  Description of Artificial Sequence: Synthetic oligonucleotide
tcctgcagaacaggacctgactacaaagaatgtttc

SEQ ID NO: 95986 - DNA, 35 bp, Artificial Sequence
  Description of Artificial Sequence: Synthetic oligonucleotide
cctgcagaacaggacctgactacaaagaatgtttc

SEQ ID NO: 95987 - DNA, 35 bp, Artificial Sequence
  Description of Artificial Sequence: Synthetic oligonucleotide
ctgcagaacaggacctgactacaaagaatgtttcc

SEQ ID NO: 95988 - DNA, 38 bp, Artificial Sequence
  Description of Artificial Sequence: Synthetic oligonucleotide
tgcagaacaggacctgactacaaagaatgtttccattg

SEQ ID NO: 95989 - DNA, 37 bp, Artificial Sequence
  Description of Artificial Sequence: Synthetic oligonucleotide
gcagaacaggacctgactacaaagaatgtttccattg

SEQ ID NO: 95990 - DNA, 37 bp, Artificial Sequence
  Description of Artificial Sequence: Synthetic oligonucleotide
cagaacaggacctgactacaaagaatgtttccattgg

SEQ ID NO: 95991 - DNA, 41 bp, Artificial Sequence
  Description of Artificial Sequence: Synthetic oligonucleotide
agaacaggacctgactacaaagaatgtttccattggaattg

SEQ ID NO: 95992 - DNA, 40 bp, Artificial Sequence
  Description of Artificial Sequence: Synthetic oligonucleotide
gaacaggacctgactacaaagaatgtttccattggaattg

SEQ ID NO: 95993 - DNA, 42 bp, Artificial Sequence
  Description of Artificial Sequence: Synthetic oligonucleotide
aacaggacctgactacaaagaatgtttccattggaattgttg

SEQ ID NO: 95994 - DNA, 41 bp, Artificial Sequence
  Description of Artificial Sequence: Synthetic oligonucleotide
acaggacctgactacaaagaatgtttccattggaattgttg

SEQ ID NO: 95995 - DNA, 40 bp, Artificial Sequence
  Description of Artificial Sequence: Synthetic oligonucleotide
caggacctgactacaaagaatgtttccattggaattgttg

SEQ ID NO: 95996 - DNA, 40 bp, Artificial Sequence
  Description of Artificial Sequence: Synthetic oligonucleotide
aggacctgactacaaagaatgtttccattggaattgttgg

SEQ ID NO: 95997 - DNA, 39 bp, Artificial Sequence
  Description of Artificial Sequence: Synthetic oligonucleotide
ggacctgactacaaagaatgtttccattggaattgttgg

SEQ ID NO: 95998 - DNA, 43 bp, Artificial Sequence
  Description of Artificial Sequence: Synthetic oligonucleotide
gacctgactacaaagaatgtttccattggaattgttggtaaag

SEQ ID NO: 95999 - DNA, 44 bp, Artificial Sequence
  Description of Artificial Sequence: Synthetic oligonucleotide
acctgactacaaagaatgtttccattggaattgttggtaaagac

SEQ ID NO: 96000 - DNA, 43 bp, Artificial Sequence
  Description of Artificial Sequence: Synthetic oligonucleotide
cctgactacaaagaatgtttccattggaattgttggtaaagac

SEQ ID NO: 96001 - DNA, 45 bp, Artificial Sequence
  Description of Artificial Sequence: Synthetic oligonucleotide
ctgactacaaagaatgtttccattggaattgttggtaaagacttg

SEQ ID NO: 96002 - DNA, 45 bp, Artificial Sequence
  Description of Artificial Sequence: Synthetic oligonucleotide
tgactacaaagaatgtttccattggaattgttggtaaagacttgg

SEQ ID NO: 96003 - DNA, 44 bp, Artificial Sequence
  Description of Artificial Sequence: Synthetic oligonucleotide
gactacaaagaatgtttccattggaattgttggtaaagacttgg

SEQ ID NO: 96004 - DNA, 45 bp, Artificial Sequence
  Description of Artificial Sequence: Synthetic oligonucleotide
actacaaagaatgtttccattggaattgttggtaaagacttggag

SEQ ID NO: 96005 - DNA, 44 bp, Artificial Sequence
  Description of Artificial Sequence: Synthetic oligonucleotide
ctacaaagaatgtttccattggaattgttggtaaagacttggag

SEQ ID NO: 96006 - DNA, 48 bp, Artificial Sequence
  Description of Artificial Sequence: Synthetic oligonucleotide
tacaaagaatgtttccattggaattgttggtaaagacttggagtttac

SEQ ID NO: 96007 - DNA, 47 bp, Artificial Sequence
  Description of Artificial Sequence: Synthetic oligonucleotide
acaaagaatgtttccattggaattgttggtaaagacttggagtttac

SEQ ID NO: 96008 - DNA, 46 bp, Artificial Sequence
  Description of Artificial Sequence: Synthetic oligonucleotide
caaagaatgtttccattggaattgttggtaaagacttggagtttac

SEQ ID NO: 96009 - DNA, 49 bp, Artificial Sequence
  Description of Artificial Sequence: Synthetic oligonucleotide
aaagaatgtttccattggaattgttggtaaagacttggagtttacaatc

SEQ ID NO: 96010 - DNA, 48 bp, Artificial Sequence
  Description of Artificial Sequence: Synthetic oligonucleotide
aagaatgtttccattggaattgttggtaaagacttggagtttacaatc

SEQ ID NO: 96011 - DNA, 47 bp, Artificial Sequence
  Description of Artificial Sequence: Synthetic oligonucleotide
agaatgtttccattggaattgttggtaaagacttggagtttacaatc

SEQ ID NO: 96012 - DNA, 46 bp, Artificial Sequence
  Description of Artificial Sequence: Synthetic oligonucleotide
gaatgtttccattggaattgttggtaaagacttggagtttacaatc

SEQ ID NO: 96013 - DNA, 49 bp, Artificial Sequence
  Description of Artificial Sequence: Synthetic oligonucleotide
aatgtttccattggaattgttggtaaagacttggagtttacaatctatg

SEQ ID NO: 96014 - DNA, 48 bp, Artificial Sequence
  Description of Artificial Sequence: Synthetic oligonucleotide
atgtttccattggaattgttggtaaagacttggagtttacaatctatg

SEQ ID NO: 96015 - DNA, 47 bp, Artificial Sequence
  Description of Artificial Sequence: Synthetic oligonucleotide
tgtttccattggaattgttggtaaagacttggagtttacaatctatg

SEQ ID NO: 96016 - DNA, 46 bp, Artificial Sequence
  Description of Artificial Sequence: Synthetic oligonucleotide
gtttccattggaattgttggtaaagacttggagtttacaatctatg

SEQ ID NO: 96017 - DNA, 48 bp, Artificial Sequence
  Description of Artificial Sequence: Synthetic oligonucleotide
tttccattggaattgttggtaaagacttggagtttacaatctatgatg

SEQ ID NO: 96018 - DNA, 47 bp, Artificial Sequence
  Description of Artificial Sequence: Synthetic oligonucleotide
ttccattggaattgttggtaaagacttggagtttacaatctatgatg

SEQ ID NO: 96019 - DNA, 46 bp, Artificial Sequence
  Description of Artificial Sequence: Synthetic oligonucleotide
tccattggaattgttggtaaagacttggagtttacaatctatgatg

SEQ ID NO: 96020 - DNA, 45 bp, Artificial Sequence
  Description of Artificial Sequence: Synthetic oligonucleotide
ccattggaattgttggtaaagacttggagtttacaatctatgatg

SEQ ID NO: 96021 - DNA, 47 bp, Artificial Sequence
  Description of Artificial Sequence: Synthetic oligonucleotide
cattggaattgttggtaaagacttggagtttacaatctatgatgatg

SEQ ID NO: 96022 - DNA, 49 bp, Artificial Sequence
  Description of Artificial Sequence: Synthetic oligonucleotide
attggaattgttggtaaagacttggagtttacaatctatgatgatgatg

SEQ ID NO: 96023 - DNA, 48 bp, Artificial Sequence
  Description of Artificial Sequence: Synthetic oligonucleotide
ttggaattgttggtaaagacttggagtttacaatctatgatgatgatg

SEQ ID NO: 96024 - DNA, 47 bp, Artificial Sequence
  Description of Artificial Sequence: Synthetic oligonucleotide
tggaattgttggtaaagacttggagtttacaatctatgatgatgatg

SEQ ID NO: 96025 - DNA, 46 bp, Artificial Sequence
  Description of Artificial Sequence: Synthetic oligonucleotide
ggaattgttggtaaagacttggagtttacaatctatgatgatgatg

SEQ ID NO: 96026 - DNA, 48 bp, Artificial Sequence
  Description of Artificial Sequence: Synthetic oligonucleotide
gaattgttggtaaagacttggagtttacaatctatgatgatgatgatg

SEQ ID NO: 96027 - DNA, 49 bp, Artificial Sequence
  Description of Artificial Sequence: Synthetic oligonucleotide
aattgttggtaaagacttggagtttacaatctatgatgatgatgatgtg

SEQ ID NO: 96028 - DNA, 48 bp, Artificial Sequence
  Description of Artificial Sequence: Synthetic oligonucleotide
attgttggtaaagacttggagtttacaatctatgatgatgatgatgtg

SEQ ID NO: 96029 - DNA, 47 bp, Artificial Sequence
  Description of Artificial Sequence: Synthetic oligonucleotide
ttgttggtaaagacttggagtttacaatctatgatgatgatgatgtg

SEQ ID NO: 96030 - DNA, 46 bp, Artificial Sequence
  Description of Artificial Sequence: Synthetic oligonucleotide
tgttggtaaagacttggagtttacaatctatgatgatgatgatgtg

SEQ ID NO: 96031 - DNA, 45 bp, Artificial Sequence
  Description of Artificial Sequence: Synthetic oligonucleotide
gttggtaaagacttggagtttacaatctatgatgatgatgatgtg

SEQ ID NO: 96032 - DNA, 46 bp, Artificial Sequence
  Description of Artificial Sequence: Synthetic oligonucleotide
ttggtaaagacttggagtttacaatctatgatgatgatgatgtgtc

SEQ ID NO: 96033 - DNA, 45 bp, Artificial Sequence
  Description of Artificial Sequence: Synthetic oligonucleotide
tggtaaagacttggagtttacaatctatgatgatgatgatgtgtc

SEQ ID NO: 96034 - DNA, 44 bp, Artificial Sequence
  Description of Artificial Sequence: Synthetic oligonucleotide
ggtaaagacttggagtttacaatctatgatgatgatgatgtgtc

SEQ ID NO: 96035 - DNA, 45 bp, Artificial Sequence
  Description of Artificial Sequence: Synthetic oligonucleotide
gtaaagacttggagtttacaatctatgatgatgatgatgtgtctc

SEQ ID NO: 96036 - DNA, 45 bp, Artificial Sequence
  Description of Artificial Sequence: Synthetic oligonucleotide
taaagacttggagtttacaatctatgatgatgatgatgtgtctcc

SEQ ID NO: 96037 - DNA, 44 bp, Artificial Sequence
  Description of Artificial Sequence: Synthetic oligonucleotide
aaagacttggagtttacaatctatgatgatgatgatgtgtctcc

SEQ ID NO: 96038 - DNA, 43 bp, Artificial Sequence
  Description of Artificial Sequence: Synthetic oligonucleotide
aagacttggagtttacaatctatgatgatgatgatgtgtctcc

SEQ ID NO: 96039 - DNA, 42 bp, Artificial Sequence
  Description of Artificial Sequence: Synthetic oligonucleotide
agacttggagtttacaatctatgatgatgatgatgtgtctcc

SEQ ID NO: 96040 - DNA, 41 bp, Artificial Sequence
  Description of Artificial Sequence: Synthetic oligonucleotide
gacttggagtttacaatctatgatgatgatgatgtgtctcc

SEQ ID NO: 96041 - DNA, 44 bp, Artificial Sequence
  Description of Artificial Sequence: Synthetic oligonucleotide
acttggagtttacaatctatgatgatgatgatgtgtctccattc

SEQ ID NO: 96042 - DNA, 43 bp, Artificial Sequence
  Description of Artificial Sequence: Synthetic oligonucleotide
cttggagtttacaatctatgatgatgatgatgtgtctccattc

SEQ ID NO: 96043 - DNA, 43 bp, Artificial Sequence
  Description of Artificial Sequence: Synthetic oligonucleotide
ttggagtttacaatctatgatgatgatgatgtgtctccattcc

SEQ ID NO: 96044 - DNA, 42 bp, Artificial Sequence
  Description of Artificial Sequence: Synthetic oligonucleotide
tggagtttacaatctatgatgatgatgatgtgtctccattcc

SEQ ID NO: 96045 - DNA, 41 bp, Artificial Sequence
  Description of Artificial Sequence: Synthetic oligonucleotide
ggagtttacaatctatgatgatgatgatgtgtctccattcc

SEQ ID NO: 96046 - DNA, 42 bp, Artificial Sequence
  Description of Artificial Sequence: Synthetic oligonucleotide
gagtttacaatctatgatgatgatgatgtgtctccattcctg

SEQ ID NO: 96047 - DNA, 42 bp, Artificial Sequence
  Description of Artificial Sequence: Synthetic oligonucleotide
agtttacaatctatgatgatgatgatgtgtctccattcctgg

SEQ ID NO: 96048 - DNA, 41 bp, Artificial Sequence
  Description of Artificial Sequence: Synthetic oligonucleotide
gtttacaatctatgatgatgatgatgtgtctccattcctgg

SEQ ID NO: 96049 - DNA, 43 bp, Artificial Sequence
  Description of Artificial Sequence: Synthetic oligonucleotide
tttacaatctatgatgatgatgatgtgtctccattcctggaag

SEQ ID NO: 96050 - DNA, 42 bp, Artificial Sequence
  Description of Artificial Sequence: Synthetic oligonucleotide
ttacaatctatgatgatgatgatgtgtctccattcctggaag

SEQ ID NO: 96051 - DNA, 41 bp, Artificial Sequence
  Description of Artificial Sequence: Synthetic oligonucleotide
tacaatctatgatgatgatgatgtgtctccattcctggaag

SEQ ID NO: 96052 - DNA, 40 bp, Artificial Sequence
  Description of Artificial Sequence: Synthetic oligonucleotide
acaatctatgatgatgatgatgtgtctccattcctggaag

SEQ ID NO: 96053 - DNA, 39 bp, Artificial Sequence
  Description of Artificial Sequence: Synthetic oligonucleotide
caatctatgatgatgatgatgtgtctccattcctggaag

SEQ ID NO: 96054 - DNA, 39 bp, Artificial Sequence
  Description of Artificial Sequence: Synthetic oligonucleotide
aatctatgatgatgatgatgtgtctccattcctggaagg

SEQ ID NO: 96055 - DNA, 38 bp, Artificial Sequence
  Description of Artificial Sequence: Synthetic oligonucleotide
atctatgatgatgatgatgtgtctccattcctggaagg

SEQ ID NO: 96056 - DNA, 37 bp, Artificial Sequence
  Description of Artificial Sequence: Synthetic oligonucleotide
tctatgatgatgatgatgtgtctccattcctggaagg

SEQ ID NO: 96057 - DNA, 36 bp, Artificial Sequence
  Description of Artificial Sequence: Synthetic oligonucleotide
ctatgatgatgatgatgtgtctccattcctggaagg

SEQ ID NO: 96058 - DNA, 37 bp, Artificial Sequence
  Description of Artificial Sequence: Synthetic oligonucleotide
tatgatgatgatgatgtgtctccattcctggaaggtc

SEQ ID NO: 96059 - DNA, 36 bp, Artificial Sequence
  Description of Artificial Sequence: Synthetic oligonucleotide
atgatgatgatgatgtgtctccattcctggaaggtc

SEQ ID NO: 96060 - DNA, 35 bp, Artificial Sequence
  Description of Artificial Sequence: Synthetic oligonucleotide
tgatgatgatgatgtgtctccattcctggaaggtc

SEQ ID NO: 96061 - DNA, 34 bp, Artificial Sequence
  Description of Artificial Sequence: Synthetic oligonucleotide
gatgatgatgatgtgtctccattcctggaaggtc

SEQ ID NO: 96062 - DNA, 36 bp, Artificial Sequence
  Description of Artificial Sequence: Synthetic oligonucleotide
atgatgatgatgtgtctccattcctggaaggtcttg

SEQ ID NO: 96063 - DNA, 35 bp, Artificial Sequence
  Description of Artificial Sequence: Synthetic oligonucleotide
tgatgatgatgtgtctccattcctggaaggtcttg

SEQ ID NO: 96064 - DNA, 34 bp, Artificial Sequence
  Description of Artificial Sequence: Synthetic oligonucleotide
gatgatgatgtgtctccattcctggaaggtcttg

SEQ ID NO: 96065 - DNA, 36 bp, Artificial Sequence
  Description of Artificial Sequence: Synthetic oligonucleotide
atgatgatgtgtctccattcctggaaggtcttgaag

SEQ ID NO: 96066 - DNA, 35 bp, Artificial Sequence
  Description of Artificial Sequence: Synthetic oligonucleotide
tgatgatgtgtctccattcctggaaggtcttgaag

SEQ ID NO: 96067 - DNA, 34 bp, Artificial Sequence
  Description of Artificial Sequence: Synthetic oligonucleotide
gatgatgtgtctccattcctggaaggtcttgaag

SEQ ID NO: 96068 - DNA, 37 bp, Artificial Sequence
  Description of Artificial Sequence: Synthetic oligonucleotide
atgatgtgtctccattcctggaaggtcttgaagaaag

SEQ ID NO: 96069 - DNA, 36 bp, Artificial Sequence
  Description of Artificial Sequence: Synthetic oligonucleotide
tgatgtgtctccattcctggaaggtcttgaagaaag

SEQ ID NO: 96070 - DNA, 35 bp, Artificial Sequence
  Description of Artificial Sequence: Synthetic oligonucleotide
gatgtgtctccattcctggaaggtcttgaagaaag

SEQ ID NO: 96071 - DNA, 36 bp, Artificial Sequence
  Description of Artificial Sequence: Synthetic oligonucleotide
atgtgtctccattcctggaaggtcttgaagaaagac

SEQ ID NO: 96072 - DNA, 35 bp, Artificial Sequence
  Description of Artificial Sequence: Synthetic oligonucleotide
tgtgtctccattcctggaaggtcttgaagaaagac

SEQ ID NO: 96073 - DNA, 34 bp, Artificial Sequence
  Description of Artificial Sequence: Synthetic oligonucleotide
gtgtctccattcctggaaggtcttgaagaaagac

SEQ ID NO: 96074 - DNA, 34 bp, Artificial Sequence
  Description of Artificial Sequence: Synthetic oligonucleotide
tgtctccattcctggaaggtcttgaagaaagacc

SEQ ID NO: 96075 - DNA, 33 bp, Artificial Sequence
  Description of Artificial Sequence: Synthetic oligonucleotide
gtctccattcctggaaggtcttgaagaaagacc

SEQ ID NO: 96076 - DNA, 34 bp, Artificial Sequence
  Description of Artificial Sequence: Synthetic oligonucleotide
tctccattcctggaaggtcttgaagaaagaccac

SEQ ID NO: 96077 - DNA, 33 bp, Artificial Sequence
  Description of Artificial Sequence: Synthetic oligonucleotide
ctccattcctggaaggtcttgaagaaagaccac

SEQ ID NO: 96078 - DNA, 34 bp, Artificial Sequence
  Description of Artificial Sequence: Synthetic oligonucleotide
tccattcctggaaggtcttgaagaaagaccacag

SEQ ID NO: 96079 - DNA, 33 bp, Artificial Sequence
  Description of Artificial Sequence: Synthetic oligonucleotide
ccattcctggaaggtcttgaagaaagaccacag

SEQ ID NO: 96080 - DNA, 34 bp, Artificial Sequence
  Description of Artificial Sequence: Synthetic oligonucleotide
cattcctggaaggtcttgaagaaagaccacagag

SEQ ID NO: 96081 - DNA, 37 bp, Artificial Sequence
  Description of Artificial Sequence: Synthetic oligonucleotide
attcctggaaggtcttgaagaaagaccacagagaaag

SEQ ID NO: 96082 - DNA, 36 bp, Artificial Sequence
  Description of Artificial Sequence: Synthetic oligonucleotide
ttcctggaaggtcttgaagaaagaccacagagaaag

SEQ ID NO: 96083 - DNA, 35 bp, Artificial Sequence
  Description of Artificial Sequence: Synthetic oligonucleotide
tcctggaaggtcttgaagaaagaccacagagaaag

SEQ ID NO: 96084 - DNA, 34 bp, Artificial Sequence
  Description of Artificial Sequence: Synthetic oligonucleotide
cctggaaggtcttgaagaaagaccacagagaaag

SEQ ID NO: 96085 - DNA, 34 bp, Artificial Sequence
  Description of Artificial Sequence: Synthetic oligonucleotide
ctggaaggtcttgaagaaagaccacagagaaagg

SEQ ID NO: 96086 - DNA, 34 bp, Artificial Sequence
  Description of Artificial Sequence: Synthetic oligonucleotide
tggaaggtcttgaagaaagaccacagagaaaggc

SEQ ID NO: 96087 - DNA, 33 bp, Artificial Sequence
  Description of Artificial Sequence: Synthetic oligonucleotide
ggaaggtcttgaagaaagaccacagagaaaggc

SEQ ID NO: 96088 - DNA, 34 bp, Artificial Sequence
  Description of Artificial Sequence: Synthetic oligonucleotide
gaaggtcttgaagaaagaccacagagaaaggcac

SEQ ID NO: 96089 - DNA, 35 bp, Artificial Sequence
  Description of Artificial Sequence: Synthetic oligonucleotide
aaggtcttgaagaaagaccacagagaaaggcacag

SEQ ID NO: 96090 - DNA, 34 bp, Artificial Sequence
  Description of Artificial Sequence: Synthetic oligonucleotide
aggtcttgaagaaagaccacagagaaaggcacag

SEQ ID NO: 96091 - DNA, 33 bp, Artificial Sequence
  Description of Artificial Sequence: Synthetic oligonucleotide
ggtcttgaagaaagaccacagagaaaggcacag

SEQ ID NO: 96092 - DNA, 33 bp, Artificial Sequence
  Description of Artificial Sequence: Synthetic oligonucleotide
gtcttgaagaaagaccacagagaaaggcacagc

SEQ ID NO: 96093 - DNA, 33 bp, Artificial Sequence
  Description of Artificial Sequence: Synthetic oligonucleotide
tcttgaagaaagaccacagagaaaggcacagcc

SEQ ID NO: 96094 - DNA, 32 bp, Artificial Sequence
  Description of Artificial Sequence: Synthetic oligonucleotide
cttgaagaaagaccacagagaaaggcacagcc

SEQ ID NO: 96095 - DNA, 33 bp, Artificial Sequence
  Description of Artificial Sequence: Synthetic oligonucleotide
ttgaagaaagaccacagagaaaggcacagcctg

SEQ ID NO: 96096 - DNA, 32 bp, Artificial Sequence
  Description of Artificial Sequence: Synthetic oligonucleotide
tgaagaaagaccacagagaaaggcacagcctg

SEQ ID NO: 96097 - DNA, 31 bp, Artificial Sequence
  Description of Artificial Sequence: Synthetic oligonucleotide
gaagaaagaccacagagaaaggcacagcctg

SEQ ID NO: 96098 - DNA, 31 bp, Artificial Sequence
  Description of Artificial Sequence: Synthetic oligonucleotide
aagaaagaccacagagaaaggcacagcctgc

SEQ ID NO: 96099 - DNA, 30 bp, Artificial Sequence
  Description of Artificial Sequence: Synthetic oligonucleotide
agaaagaccacagagaaaggcacagcctgc

SEQ ID NO: 96100 - DNA, 29 bp, Artificial Sequence
  Description of Artificial Sequence: Synthetic oligonucleotide
gaaagaccacagagaaaggcacagcctgc

SEQ ID NO: 96101 - DNA, 30 bp, Artificial Sequence
  Description of Artificial Sequence: Synthetic oligonucleotide
aaagaccacagagaaaggcacagcctgctc

SEQ ID NO: 96102 - DNA, 29 bp, Artificial Sequence
  Description of Artificial Sequence: Synthetic oligonucleotide
aagaccacagagaaaggcacagcctgctc

SEQ ID NO: 96103 - DNA, 28 bp, Artificial Sequence
  Description of Artificial Sequence: Synthetic oligonucleotide
agaccacagagaaaggcacagcctgctc

SEQ ID NO: 96104 - DNA, 27 bp, Artificial Sequence
  Description of Artificial Sequence: Synthetic oligonucleotide
gaccacagagaaaggcacagcctgctc

SEQ ID NO: 96105 - DNA, 29 bp, Artificial Sequence
  Description of Artificial Sequence: Synthetic oligonucleotide
accacagagaaaggcacagcctgctcaac

SEQ ID NO: 96106 - DNA, 28 bp, Artificial Sequence
  Description of Artificial Sequence: Synthetic oligonucleotide
ccacagagaaaggcacagcctgctcaac

SEQ ID NO: 96107 - DNA, 28 bp, Artificial Sequence
  Description of Artificial Sequence: Synthetic oligonucleotide
cacagagaaaggcacagcctgctcaacc

SEQ ID NO: 96108 - DNA, 29 bp, Artificial Sequence
  Description of Artificial Sequence: Synthetic oligonucleotide
acagagaaaggcacagcctgctcaacctg

SEQ ID NO: 96109 - DNA, 28 bp, Artificial Sequence
  Description of Artificial Sequence: Synthetic oligonucleotide
cagagaaaggcacagcctgctcaacctg

SEQ ID NO: 96110 - DNA, 28 bp, Artificial Sequence
  Description of Artificial Sequence: Synthetic oligonucleotide
agagaaaggcacagcctgctcaacctgc

SEQ ID NO: 96111 - DNA, 27 bp, Artificial Sequence
  Description of Artificial Sequence: Synthetic oligonucleotide
gagaaaggcacagcctgctcaacctgc

SEQ ID NO: 96112 - DNA, 28 bp, Artificial Sequence
  Description of Artificial Sequence: Synthetic oligonucleotide
agaaaggcacagcctgctcaacctgctg

SEQ ID NO: 96113 - DNA, 27 bp, Artificial Sequence
  Description of Artificial Sequence: Synthetic oligonucleotide
gaaaggcacagcctgctcaacctgctg

SEQ ID NO: 96114 - DNA, 29 bp, Artificial Sequence
  Description of Artificial Sequence: Synthetic oligonucleotide
aaaggcacagcctgctcaacctgctgatg

SEQ ID NO: 96115 - DNA, 28 bp, Artificial Sequence
  Description of Artificial Sequence: Synthetic oligonucleotide
aaggcacagcctgctcaacctgctgatg

SEQ ID NO: 96116 - DNA, 27 bp, Artificial Sequence
  Description of Artificial Sequence: Synthetic oligonucleotide
aggcacagcctgctcaacctgctgatg

SEQ ID NO: 96117 - DNA, 27 bp, Artificial Sequence
  Description of Artificial Sequence: Synthetic oligonucleotide
ggcacagcctgctcaacctgctgatga

SEQ ID NO: 96118 - DNA, 28 bp, Artificial Sequence
  Description of Artificial Sequence: Synthetic oligonucleotide
gcacagcctgctcaacctgctgatgaac

SEQ ID NO: 96119 - DNA, 28 bp, Artificial Sequence
  Description of Artificial Sequence: Synthetic oligonucleotide
cacagcctgctcaacctgctgatgaacc

SEQ ID NO: 96120 - DNA, 29 bp, Artificial Sequence
  Description of Artificial Sequence: Synthetic oligonucleotide
acagcctgctcaacctgctgatgaacctg

SEQ ID NO: 96121 - DNA, 28 bp, Artificial Sequence
  Description of Artificial Sequence: Synthetic oligonucleotide
cagcctgctcaacctgctgatgaacctg

SEQ ID NO: 96122 - DNA, 28 bp, Artificial Sequence
  Description of Artificial Sequence: Synthetic oligonucleotide
agcctgctcaacctgctgatgaacctgc

SEQ ID NO: 96123 - DNA, 27 bp, Artificial Sequence
  Description of Artificial Sequence: Synthetic oligonucleotide
gcctgctcaacctgctgatgaacctgc

SEQ ID NO: 96124 - DNA, 28 bp, Artificial Sequence
  Description of Artificial Sequence: Synthetic oligonucleotide
cctgctcaacctgctgatgaacctgcag

SEQ ID NO: 96125 - DNA, 32 bp, Artificial Sequence
  Description of Artificial Sequence: Synthetic oligonucleotide
ctgctcaacctgctgatgaacctgcagaaaag

SEQ ID NO: 96126 - DNA, 32 bp, Artificial Sequence
  Description of Artificial Sequence: Synthetic oligonucleotide
tgctcaacctgctgatgaacctgcagaaaagg

SEQ ID NO: 96127 - DNA, 31 bp, Artificial Sequence
  Description of Artificial Sequence: Synthetic oligonucleotide
gctcaacctgctgatgaacctgcagaaaagg

SEQ ID NO: 96128 - DNA, 31 bp, Artificial Sequence
  Description of Artificial Sequence: Synthetic oligonucleotide
ctcaacctgctgatgaacctgcagaaaaggc

SEQ ID NO: 96129 - DNA, 32 bp, Artificial Sequence
  Description of Artificial Sequence: Synthetic oligonucleotide
tcaacctgctgatgaacctgcagaaaaggctg

SEQ ID NO: 96130 - DNA, 31 bp, Artificial Sequence
  Description of Artificial Sequence: Synthetic oligonucleotide
caacctgctgatgaacctgcagaaaaggctg

SEQ ID NO: 96131 - DNA, 33 bp, Artificial Sequence
  Description of Artificial Sequence: Synthetic oligonucleotide
aacctgctgatgaacctgcagaaaaggctgatg

SEQ ID NO: 96132 - DNA, 32 bp, Artificial Sequence
  Description of Artificial Sequence: Synthetic oligonucleotide
acctgctgatgaacctgcagaaaaggctgatg

SEQ ID NO: 96133 - DNA, 31 bp, Artificial Sequence
  Description of Artificial Sequence: Synthetic oligonucleotide
cctgctgatgaacctgcagaaaaggctgatg

SEQ ID NO: 96134 - DNA, 33 bp, Artificial Sequence
  Description of Artificial Sequence: Synthetic oligonucleotide
ctgctgatgaacctgcagaaaaggctgatgaac

SEQ ID NO: 96135 - DNA, 33 bp, Artificial Sequence
  Description of Artificial Sequence: Synthetic oligonucleotide
tgctgatgaacctgcagaaaaggctgatgaacc

SEQ ID NO: 96136 - DNA, 32 bp, Artificial Sequence
  Description of Artificial Sequence: Synthetic oligonucleotide
gctgatgaacctgcagaaaaggctgatgaacc

SEQ ID NO: 96137 - DNA, 35 bp, Artificial Sequence
  Description of Artificial Sequence: Synthetic oligonucleotide
ctgatgaacctgcagaaaaggctgatgaaccaatg

SEQ ID NO: 96138 - DNA, 35 bp, Artificial Sequence
  Description of Artificial Sequence: Synthetic oligonucleotide
tgatgaacctgcagaaaaggctgatgaaccaatgg

SEQ ID NO: 96139 - DNA, 34 bp, Artificial Sequence
  Description of Artificial Sequence: Synthetic oligonucleotide
gatgaacctgcagaaaaggctgatgaaccaatgg

SEQ ID NO: 96140 - DNA, 36 bp, Artificial Sequence
  Description of Artificial Sequence: Synthetic oligonucleotide
atgaacctgcagaaaaggctgatgaaccaatggaac

SEQ ID NO: 96141 - DNA, 35 bp, Artificial Sequence
  Description of Artificial Sequence: Synthetic oligonucleotide
tgaacctgcagaaaaggctgatgaaccaatggaac

SEQ ID NO: 96142 - DNA, 34 bp, Artificial Sequence
  Description of Artificial Sequence: Synthetic oligonucleotide
gaacctgcagaaaaggctgatgaaccaatggaac

SEQ ID NO: 96143 - DNA, 42 bp, Artificial Sequence
  Description of Artificial Sequence: Synthetic oligonucleotide
atgtttcgaaatcagtatgacaatgatgtcactgtttggagc

SEQ ID NO: 96144 - DNA, 41 bp, Artificial Sequence
  Description of Artificial Sequence: Synthetic oligonucleotide
tgtttcgaaatcagtatgacaatgatgtcactgtttggagc

SEQ ID NO: 96145 - DNA, 35 bp, Artificial Sequence
  Description of Artificial Sequence: Synthetic oligonucleotide
cctgtgtctcgtcttgtatctctaattggaagcag

SEQ ID NO: 96146 - DNA, 38 bp, Artificial Sequence
  Description of Artificial Sequence: Synthetic oligonucleotide
ctgtgtctcgtcttgtatctctaattggaagcagtatc

SEQ ID NO: 96147 - DNA, 38 bp, Artificial Sequence
  Description of Artificial Sequence: Synthetic oligonucleotide
tgtgtctcgtcttgtatctctaattggaagcagtatcc

SEQ ID NO: 96148 - DNA, 37 bp, Artificial Sequence
  Description of Artificial Sequence: Synthetic oligonucleotide
gtgtctcgtcttgtatctctaattggaagcagtatcc

SEQ ID NO: 96149 - DNA, 44 bp, Artificial Sequence
  Description of Artificial Sequence: Synthetic oligonucleotide
tgtctcgtcttgtatctctaattggaagcagtatcctttttatg

SEQ ID NO: 96150 - DNA, 43 bp, Artificial Sequence
  Description of Artificial Sequence: Synthetic oligonucleotide
gtctcgtcttgtatctctaattggaagcagtatcctttttatg

SEQ ID NO: 96151 - DNA, 46 bp, Artificial Sequence
  Description of Artificial Sequence: Synthetic oligonucleotide
tctcgtcttgtatctctaattggaagcagtatcctttttatgttag

SEQ ID NO: 96152 - DNA, 45 bp, Artificial Sequence
  Description of Artificial Sequence: Synthetic oligonucleotide
ctcgtcttgtatctctaattggaagcagtatcctttttatgttag

SEQ ID NO: 96153 - DNA, 45 bp, Artificial Sequence
  Description of Artificial Sequence: Synthetic oligonucleotide
tcgtcttgtatctctaattggaagcagtatcctttttatgttagc

SEQ ID NO: 96154 - DNA, 44 bp, Artificial Sequence
  Description of Artificial Sequence: Synthetic oligonucleotide
cgtcttgtatctctaattggaagcagtatcctttttatgttagc

SEQ ID NO: 96155 - DNA, 50 bp, Artificial Sequence
  Description of Artificial Sequence: Synthetic oligonucleotide
gtcttgtatctctaattggaagcagtatcctttttatgttagcatttatg

SEQ ID NO: 96156 - DNA, 50 bp, Artificial Sequence
  Description of Artificial Sequence: Synthetic oligonucleotide
tcttgtatctctaattggaagcagtatcctttttatgttagcatttatgg

SEQ ID NO: 96157 - DNA, 49 bp, Artificial Sequence
  Description of Artificial Sequence: Synthetic oligonucleotide
cttgtatctctaattggaagcagtatcctttttatgttagcatttatgg

SEQ ID NO: 96158 - DNA, 53 bp, Artificial Sequence
  Description of Artificial Sequence: Synthetic oligonucleotide
ttgtatctctaattggaagcagtatcctttttatgttagcatttatggatatg

SEQ ID NO: 96159 - DNA, 52 bp, Artificial Sequence
  Description of Artificial Sequence: Synthetic oligonucleotide
tgtatctctaattggaagcagtatcctttttatgttagcatttatggatatg

SEQ ID NO: 96160 - DNA, 51 bp, Artificial Sequence
  Description of Artificial Sequence: Synthetic oligonucleotide
gtatctctaattggaagcagtatcctttttatgttagcatttatggatatg

SEQ ID NO: 96161 - DNA, 53 bp, Artificial Sequence
  Description of Artificial Sequence: Synthetic oligonucleotide
tatctctaattggaagcagtatcctttttatgttagcatttatggatatgaac

SEQ ID NO: 96162 - DNA, 52 bp, Artificial Sequence
  Description of Artificial Sequence: Synthetic oligonucleotide
atctctaattggaagcagtatcctttttatgttagcatttatggatatgaac

SEQ ID NO: 96163 - DNA, 51 bp, Artificial Sequence
  Description of Artificial Sequence: Synthetic oligonucleotide
tctctaattggaagcagtatcctttttatgttagcatttatggatatgaac

SEQ ID NO: 96164 - DNA, 50 bp, Artificial Sequence
  Description of Artificial Sequence: Synthetic oligonucleotide
ctctaattggaagcagtatcctttttatgttagcatttatggatatgaac

SEQ ID NO: 96165 - DNA, 53 bp, Artificial Sequence
  Description of Artificial Sequence: Synthetic oligonucleotide
tctaattggaagcagtatcctttttatgttagcatttatggatatgaactttg

SEQ ID NO: 96166 - DNA, 52 bp, Artificial Sequence
  Description of Artificial Sequence: Synthetic oligonucleotide
ctaattggaagcagtatcctttttatgttagcatttatggatatgaactttg

SEQ ID NO: 96167 - DNA, 54 bp, Artificial Sequence
  Description of Artificial Sequence: Synthetic oligonucleotide
taattggaagcagtatcctttttatgttagcatttatggatatgaactttgaag

SEQ ID NO: 96168 - DNA, 53 bp, Artificial Sequence
  Description of Artificial Sequence: Synthetic oligonucleotide
aattggaagcagtatcctttttatgttagcatttatggatatgaactttgaag

SEQ ID NO: 96169 - DNA, 52 bp, Artificial Sequence
  Description of Artificial Sequence: Synthetic oligonucleotide
attggaagcagtatcctttttatgttagcatttatggatatgaactttgaag

SEQ ID NO: 96170 - DNA, 51 bp, Artificial Sequence
  Description of Artificial Sequence: Synthetic oligonucleotide
ttggaagcagtatcctttttatgttagcatttatggatatgaactttgaag

SEQ ID NO: 96171 - DNA, 50 bp, Artificial Sequence
  Description of Artificial Sequence: Synthetic oligonucleotide
tggaagcagtatcctttttatgttagcatttatggatatgaactttgaag

SEQ ID NO: 96172 - DNA, 49 bp, Artificial Sequence
  Description of Artificial Sequence: Synthetic oligonucleotide
ggaagcagtatcctttttatgttagcatttatggatatgaactttgaag

SEQ ID NO: 96173 - DNA, 49 bp, Artificial Sequence
  Description of Artificial Sequence: Synthetic oligonucleotide
gaagcagtatcctttttatgttagcatttatggatatgaactttgaagg

SEQ ID NO: 96174 - DNA, 49 bp, Artificial Sequence
  Description of Artificial Sequence: Synthetic oligonucleotide
aagcagtatcctttttatgttagcatttatggatatgaactttgaaggg

SEQ ID NO: 96175 - DNA, 30 bp, Artificial Sequence
  Description of Artificial Sequence: Synthetic oligonucleotide
atgagctcaatcggcactgggtatgacctg

SEQ ID NO: 96176 - DNA, 29 bp, Artificial Sequence
  Description of Artificial Sequence: Synthetic oligonucleotide
tgagctcaatcggcactgggtatgacctg

SEQ ID NO: 96177 - DNA, 28 bp, Artificial Sequence
  Description of Artificial Sequence: Synthetic oligonucleotide
gagctcaatcggcactgggtatgacctg

SEQ ID NO: 96178 - DNA, 29 bp, Artificial Sequence
  Description of Artificial Sequence: Synthetic oligonucleotide
agctcaatcggcactgggtatgacctgtc

SEQ ID NO: 96179 - DNA, 28 bp, Artificial Sequence
  Description of Artificial Sequence: Synthetic oligonucleotide
gctcaatcggcactgggtatgacctgtc

SEQ ID NO: 96180 - DNA, 29 bp, Artificial Sequence
  Description of Artificial Sequence: Synthetic oligonucleotide
ctcaatcggcactgggtatgacctgtcag

SEQ ID NO: 96181 - DNA, 29 bp, Artificial Sequence
  Description of Artificial Sequence: Synthetic oligonucleotide
tcaatcggcactgggtatgacctgtcagc

SEQ ID NO: 96182 - DNA, 28 bp, Artificial Sequence
  Description of Artificial Sequence: Synthetic oligonucleotide
caatcggcactgggtatgacctgtcagc

SEQ ID NO: 96183 - DNA, 28 bp, Artificial Sequence
  Description of Artificial Sequence: Synthetic oligonucleotide
aatcggcactgggtatgacctgtcagcc

SEQ ID NO: 96184 - DNA, 27 bp, Artificial Sequence
  Description of Artificial Sequence: Synthetic oligonucleotide
atcggcactgggtatgacctgtcagcc

SEQ ID NO: 96185 - DNA, 27 bp, Artificial Sequence
  Description of Artificial Sequence: Synthetic oligonucleotide
tcggcactgggtatgacctgtcagcct

SEQ ID NO: 96186 - DNA, 26 bp, Artificial Sequence
  Description of Artificial Sequence: Synthetic oligonucleotide
cggcactgggtatgacctgtcagcct

SEQ ID NO: 96187 - DNA, 27 bp, Artificial Sequence
  Description of Artificial Sequence: Synthetic oligonucleotide
ggcactgggtatgacctgtcagcctct

SEQ ID NO: 96188 - DNA, 28 bp, Artificial Sequence
  Description of Artificial Sequence: Synthetic oligonucleotide
gcactgggtatgacctgtcagcctctac

SEQ ID NO: 96189 - DNA, 31 bp, Artificial Sequence
  Description of Artificial Sequence: Synthetic oligonucleotide
cactgggtatgacctgtcagcctctacattc

SEQ ID NO: 96190 - DNA, 32 bp, Artificial Sequence
  Description of Artificial Sequence: Synthetic oligonucleotide
actgggtatgacctgtcagcctctacattctc

SEQ ID NO: 96191 - DNA, 31 bp, Artificial Sequence
  Description of Artificial Sequence: Synthetic oligonucleotide
ctgggtatgacctgtcagcctctacattctc

SEQ ID NO: 96192 - DNA, 32 bp, Artificial Sequence
  Description of Artificial Sequence: Synthetic oligonucleotide
tgggtatgacctgtcagcctctacattctctc

SEQ ID NO: 96193 - DNA, 31 bp, Artificial Sequence
  Description of Artificial Sequence: Synthetic oligonucleotide
gggtatgacctgtcagcctctacattctctc

SEQ ID NO: 96194 - DNA, 31 bp, Artificial Sequence
  Description of Artificial Sequence: Synthetic oligonucleotide
ggtatgacctgtcagcctctacattctctcc

SEQ ID NO: 96195 - DNA, 32 bp, Artificial Sequence
  Description of Artificial Sequence: Synthetic oligonucleotide
gtatgacctgtcagcctctacattctctcctg

SEQ ID NO: 96196 - DNA, 33 bp, Artificial Sequence
  Description of Artificial Sequence: Synthetic oligonucleotide
tatgacctgtcagcctctacattctctcctgac

SEQ ID NO: 96197 - DNA, 32 bp, Artificial Sequence
  Description of Artificial Sequence: Synthetic oligonucleotide
atgacctgtcagcctctacattctctcctgac

SEQ ID NO: 96198 - DNA, 31 bp, Artificial Sequence
  Description of Artificial Sequence: Synthetic oligonucleotide
tgacctgtcagcctctacattctctcctgac

SEQ ID NO: 96199 - DNA, 30 bp, Artificial Sequence
  Description of Artificial Sequence: Synthetic oligonucleotide
gacctgtcagcctctacattctctcctgac

SEQ ID NO: 96200 - DNA, 30 bp, Artificial Sequence
  Description of Artificial Sequence: Synthetic oligonucleotide
acctgtcagcctctacattctctcctgacg

SEQ ID NO: 96201 - DNA, 29 bp, Artificial Sequence
  Description of Artificial Sequence: Synthetic oligonucleotide
cctgtcagcctctacattctctcctgacg

SEQ ID NO: 96202 - DNA, 29 bp, Artificial Sequence
  Description of Artificial Sequence: Synthetic oligonucleotide
ctgtcagcctctacattctctcctgacgg

SEQ ID NO: 96203 - DNA, 31 bp, Artificial Sequence
  Description of Artificial Sequence: Synthetic oligonucleotide
tgtcagcctctacattctctcctgacggaag

SEQ ID NO: 96204 - DNA, 30 bp, Artificial Sequence
  Description of Artificial Sequence: Synthetic oligonucleotide
gtcagcctctacattctctcctgacggaag

SEQ ID NO: 96205 - DNA, 31 bp, Artificial Sequence
  Description of Artificial Sequence: Synthetic oligonucleotide
tcagcctctacattctctcctgacggaagag

SEQ ID NO: 96206 - DNA, 30 bp, Artificial Sequence
  Description of Artificial Sequence: Synthetic oligonucleotide
cagcctctacattctctcctgacggaagag

SEQ ID NO: 96207 - DNA, 35 bp, Artificial Sequence
  Description of Artificial Sequence: Synthetic oligonucleotide
agcctctacattctctcctgacggaagagtttttc

SEQ ID NO: 96208 - DNA, 34 bp, Artificial Sequence
  Description of Artificial Sequence: Synthetic oligonucleotide
gcctctacattctctcctgacggaagagtttttc

SEQ ID NO: 96209 - DNA, 36 bp, Artificial Sequence
  Description of Artificial Sequence: Synthetic oligonucleotide
cctctacattctctcctgacggaagagtttttcaag

SEQ ID NO: 96210 - DNA, 38 bp, Artificial Sequence
  Description of Artificial Sequence: Synthetic oligonucleotide
ctctacattctctcctgacggaagagtttttcaagttg

SEQ ID NO: 96211 - DNA, 43 bp, Artificial Sequence
  Description of Artificial Sequence: Synthetic oligonucleotide
tctacattctctcctgacggaagagtttttcaagttgaatatg

SEQ ID NO: 96212 - DNA, 42 bp, Artificial Sequence
  Description of Artificial Sequence: Synthetic oligonucleotide
ctacattctctcctgacggaagagtttttcaagttgaatatg

SEQ ID NO: 96213 - DNA, 42 bp, Artificial Sequence
  Description of Artificial Sequence: Synthetic oligonucleotide
tacattctctcctgacggaagagtttttcaagttgaatatgc

SEQ ID NO: 96214 - DNA, 41 bp, Artificial Sequence
  Description of Artificial Sequence: Synthetic oligonucleotide
acattctctcctgacggaagagtttttcaagttgaatatgc

SEQ ID NO: 96215 - DNA, 40 bp, Artificial Sequence
  Description of Artificial Sequence: Synthetic oligonucleotide
cattctctcctgacggaagagtttttcaagttgaatatgc

SEQ ID NO: 96216 - DNA, 43 bp, Artificial Sequence
  Description of Artificial Sequence: Synthetic oligonucleotide
attctctcctgacggaagagtttttcaagttgaatatgctatg

SEQ ID NO: 96217 - DNA, 42 bp, Artificial Sequence
  Description of Artificial Sequence: Synthetic oligonucleotide
ttctctcctgacggaagagtttttcaagttgaatatgctatg

SEQ ID NO: 96218 - DNA, 41 bp, Artificial Sequence
  Description of Artificial Sequence: Synthetic oligonucleotide
tctctcctgacggaagagtttttcaagttgaatatgctatg

SEQ ID NO: 96219 - DNA, 40 bp, Artificial Sequence
  Description of Artificial Sequence: Synthetic oligonucleotide
ctctcctgacggaagagtttttcaagttgaatatgctatg

SEQ ID NO: 96220 - DNA, 42 bp, Artificial Sequence
  Description of Artificial Sequence: Synthetic oligonucleotide
tctcctgacggaagagtttttcaagttgaatatgctatgaag

SEQ ID NO: 96221 - DNA, 41 bp, Artificial Sequence
  Description of Artificial Sequence: Synthetic oligonucleotide
ctcctgacggaagagtttttcaagttgaatatgctatgaag

SEQ ID NO: 96222 - DNA, 41 bp, Artificial Sequence
  Description of Artificial Sequence: Synthetic oligonucleotide
tcctgacggaagagtttttcaagttgaatatgctatgaagg

SEQ ID NO: 96223 - DNA, 40 bp, Artificial Sequence
  Description of Artificial Sequence: Synthetic oligonucleotide
cctgacggaagagtttttcaagttgaatatgctatgaagg

SEQ ID NO: 96224 - DNA, 40 bp, Artificial Sequence
  Description of Artificial Sequence: Synthetic oligonucleotide
ctgacggaagagtttttcaagttgaatatgctatgaaggc

SEQ ID NO: 96225 - DNA, 41 bp, Artificial Sequence
  Description of Artificial Sequence: Synthetic oligonucleotide
tgacggaagagtttttcaagttgaatatgctatgaaggctg

SEQ ID NO: 96226 - DNA, 40 bp, Artificial Sequence
  Description of Artificial Sequence: Synthetic oligonucleotide
gacggaagagtttttcaagttgaatatgctatgaaggctg

SEQ ID NO: 96227 - DNA, 41 bp, Artificial Sequence
  Description of Artificial Sequence: Synthetic oligonucleotide
acggaagagtttttcaagttgaatatgctatgaaggctgtg

SEQ ID NO: 96228 - DNA, 40 bp, Artificial Sequence
  Description of Artificial Sequence: Synthetic oligonucleotide
cggaagagtttttcaagttgaatatgctatgaaggctgtg

SEQ ID NO: 96229 - DNA, 40 bp, Artificial Sequence
  Description of Artificial Sequence: Synthetic oligonucleotide
ggaagagtttttcaagttgaatatgctatgaaggctgtgg

SEQ ID NO: 96230 - DNA, 46 bp, Artificial Sequence
  Description of Artificial Sequence: Synthetic oligonucleotide
gaagagtttttcaagttgaatatgctatgaaggctgtggaaaatag

SEQ ID NO: 96231 - DNA, 48 bp, Artificial Sequence
  Description of Artificial Sequence: Synthetic oligonucleotide
aagagtttttcaagttgaatatgctatgaaggctgtggaaaatagtag

SEQ ID NO: 96232 - DNA, 47 bp, Artificial Sequence
  Description of Artificial Sequence: Synthetic oligonucleotide
agagtttttcaagttgaatatgctatgaaggctgtggaaaatagtag

SEQ ID NO: 96233 - DNA, 46 bp, Artificial Sequence
  Description of Artificial Sequence: Synthetic oligonucleotide
gagtttttcaagttgaatatgctatgaaggctgtggaaaatagtag

SEQ ID NO: 96234 - DNA, 48 bp, Artificial Sequence
  Description of Artificial Sequence: Synthetic oligonucleotide
agtttttcaagttgaatatgctatgaaggctgtggaaaatagtagtac

SEQ ID NO: 96235 - DNA, 47 bp, Artificial Sequence
  Description of Artificial Sequence: Synthetic oligonucleotide
gtttttcaagttgaatatgctatgaaggctgtggaaaatagtagtac

SEQ ID NO: 96236 - DNA, 48 bp, Artificial Sequence
  Description of Artificial Sequence: Synthetic oligonucleotide
tttttcaagttgaatatgctatgaaggctgtggaaaatagtagtacag

SEQ ID NO: 96237 - DNA, 47 bp, Artificial Sequence
  Description of Artificial Sequence: Synthetic oligonucleotide
ttttcaagttgaatatgctatgaaggctgtggaaaatagtagtacag

SEQ ID NO: 96238 - DNA, 46 bp, Artificial Sequence
  Description of Artificial Sequence: Synthetic oligonucleotide
tttcaagttgaatatgctatgaaggctgtggaaaatagtagtacag

SEQ ID NO: 96239 - DNA, 45 bp, Artificial Sequence
  Description of Artificial Sequence: Synthetic oligonucleotide
ttcaagttgaatatgctatgaaggctgtggaaaatagtagtacag

SEQ ID NO: 96240 - DNA, 44 bp, Artificial Sequence
  Description of Artificial Sequence: Synthetic oligonucleotide
tcaagttgaatatgctatgaaggctgtggaaaatagtagtacag

SEQ ID NO: 96241 - DNA, 43 bp, Artificial Sequence
  Description of Artificial Sequence: Synthetic oligonucleotide
caagttgaatatgctatgaaggctgtggaaaatagtagtacag

SEQ ID NO: 96242 - DNA, 43 bp, Artificial Sequence
  Description of Artificial Sequence: Synthetic oligonucleotide
aagttgaatatgctatgaaggctgtggaaaatagtagtacagc

SEQ ID NO: 96243 - DNA, 42 bp, Artificial Sequence
  Description of Artificial Sequence: Synthetic oligonucleotide
agttgaatatgctatgaaggctgtggaaaatagtagtacagc

SEQ ID NO: 96244 - DNA, 41 bp, Artificial Sequence
  Description of Artificial Sequence: Synthetic oligonucleotide
gttgaatatgctatgaaggctgtggaaaatagtagtacagc

SEQ ID NO: 96245 - DNA, 45 bp, Artificial Sequence
  Description of Artificial Sequence: Synthetic oligonucleotide
ttgaatatgctatgaaggctgtggaaaatagtagtacagctattg

SEQ ID NO: 96246 - DNA, 44 bp, Artificial Sequence
  Description of Artificial Sequence: Synthetic oligonucleotide
tgaatatgctatgaaggctgtggaaaatagtagtacagctattg

SEQ ID NO: 96247 - DNA, 43 bp, Artificial Sequence
  Description of Artificial Sequence: Synthetic oligonucleotide
gaatatgctatgaaggctgtggaaaatagtagtacagctattg

SEQ ID NO: 96248 - DNA, 43 bp, Artificial Sequence
  Description of Artificial Sequence: Synthetic oligonucleotide
aatatgctatgaaggctgtggaaaatagtagtacagctattgg

SEQ ID NO: 96249 - DNA, 42 bp, Artificial Sequence
  Description of Artificial Sequence: Synthetic oligonucleotide
atatgctatgaaggctgtggaaaatagtagtacagctattgg

SEQ ID NO: 96250 - DNA, 41 bp, Artificial Sequence
  Description of Artificial Sequence: Synthetic oligonucleotide
tatgctatgaaggctgtggaaaatagtagtacagctattgg

SEQ ID NO: 96251 - DNA, 40 bp, Artificial Sequence
  Description of Artificial Sequence: Synthetic oligonucleotide
atgctatgaaggctgtggaaaatagtagtacagctattgg

SEQ ID NO: 96252 - DNA, 39 bp, Artificial Sequence
  Description of Artificial Sequence: Synthetic oligonucleotide
tgctatgaaggctgtggaaaatagtagtacagctattgg

SEQ ID NO: 96253 - DNA, 38 bp, Artificial Sequence
  Description of Artificial Sequence: Synthetic oligonucleotide
gctatgaaggctgtggaaaatagtagtacagctattgg

SEQ ID NO: 96254 - DNA, 41 bp, Artificial Sequence
  Description of Artificial Sequence: Synthetic oligonucleotide
ctatgaaggctgtggaaaatagtagtacagctattggaatc

SEQ ID NO: 96255 - DNA, 42 bp, Artificial Sequence
  Description of Artificial Sequence: Synthetic oligonucleotide
tatgaaggctgtggaaaatagtagtacagctattggaatcag

SEQ ID NO: 96256 - DNA, 41 bp, Artificial Sequence
  Description of Artificial Sequence: Synthetic oligonucleotide
atgaaggctgtggaaaatagtagtacagctattggaatcag

SEQ ID NO: 96257 - DNA, 40 bp, Artificial Sequence
  Description of Artificial Sequence: Synthetic oligonucleotide
tgaaggctgtggaaaatagtagtacagctattggaatcag

SEQ ID NO: 96258 - DNA, 39 bp, Artificial Sequence
  Description of Artificial Sequence: Synthetic oligonucleotide
gaaggctgtggaaaatagtagtacagctattggaatcag

SEQ ID NO: 96259 - DNA, 41 bp, Artificial Sequence
  Description of Artificial Sequence: Synthetic oligonucleotide
aaggctgtggaaaatagtagtacagctattggaatcagatg

SEQ ID NO: 96260 - DNA, 40 bp, Artificial Sequence
  Description of Artificial Sequence: Synthetic oligonucleotide
aggctgtggaaaatagtagtacagctattggaatcagatg

SEQ ID NO: 96261 - DNA, 39 bp, Artificial Sequence
  Description of Artificial Sequence: Synthetic oligonucleotide
ggctgtggaaaatagtagtacagctattggaatcagatg

SEQ ID NO: 96262 - DNA, 39 bp, Artificial Sequence
  Description of Artificial Sequence: Synthetic oligonucleotide
gctgtggaaaatagtagtacagctattggaatcagatgc

SEQ ID NO: 96263 - DNA, 42 bp, Artificial Sequence
  Description of Artificial Sequence: Synthetic oligonucleotide
ctgtggaaaatagtagtacagctattggaatcagatgcaaag

SEQ ID NO: 96264 - DNA, 44 bp, Artificial Sequence
  Description of Artificial Sequence: Synthetic oligonucleotide
tgtggaaaatagtagtacagctattggaatcagatgcaaagatg

SEQ ID NO: 96265 - DNA, 43 bp, Artificial Sequence
  Description of Artificial Sequence: Synthetic oligonucleotide
gtggaaaatagtagtacagctattggaatcagatgcaaagatg

SEQ ID NO: 96266 - DNA, 43 bp, Artificial Sequence
  Description of Artificial Sequence: Synthetic oligonucleotide
tggaaaatagtagtacagctattggaatcagatgcaaagatgg

SEQ ID NO: 96267 - DNA, 42 bp, Artificial Sequence
  Description of Artificial Sequence: Synthetic oligonucleotide
ggaaaatagtagtacagctattggaatcagatgcaaagatgg

SEQ ID NO: 96268 - DNA, 43 bp, Artificial Sequence
  Description of Artificial Sequence: Synthetic oligonucleotide
gaaaatagtagtacagctattggaatcagatgcaaagatggtg

SEQ ID NO: 96269 - DNA, 45 bp, Artificial Sequence
  Description of Artificial Sequence: Synthetic oligonucleotide
aaaatagtagtacagctattggaatcagatgcaaagatggtgttg

SEQ ID NO: 96270 - DNA, 44 bp, Artificial Sequence
  Description of Artificial Sequence: Synthetic oligonucleotide
aaatagtagtacagctattggaatcagatgcaaagatggtgttg

SEQ ID NO: 96271 - DNA, 43 bp, Artificial Sequence
  Description of Artificial Sequence: Synthetic oligonucleotide
aatagtagtacagctattggaatcagatgcaaagatggtgttg

SEQ ID NO: 96272 - DNA, 42 bp, Artificial Sequence
  Description of Artificial Sequence: Synthetic oligonucleotide
atagtagtacagctattggaatcagatgcaaagatggtgttg

SEQ ID NO: 96273 - DNA, 41 bp, Artificial Sequence
  Description of Artificial Sequence: Synthetic oligonucleotide
tagtagtacagctattggaatcagatgcaaagatggtgttg

SEQ ID NO: 96274 - DNA, 40 bp, Artificial Sequence
  Description of Artificial Sequence: Synthetic oligonucleotide
agtagtacagctattggaatcagatgcaaagatggtgttg

SEQ ID NO: 96275 - DNA, 39 bp, Artificial Sequence
  Description of Artificial Sequence: Synthetic oligonucleotide
gtagtacagctattggaatcagatgcaaagatggtgttg

SEQ ID NO: 96276 - DNA, 40 bp, Artificial Sequence
  Description of Artificial Sequence: Synthetic oligonucleotide
tagtacagctattggaatcagatgcaaagatggtgttgtc

SEQ ID NO: 96277 - DNA, 39 bp, Artificial Sequence
  Description of Artificial Sequence: Synthetic oligonucleotide
agtacagctattggaatcagatgcaaagatggtgttgtc

SEQ ID NO: 96278 - DNA, 38 bp, Artificial Sequence
  Description of Artificial Sequence: Synthetic oligonucleotide
gtacagctattggaatcagatgcaaagatggtgttgtc

SEQ ID NO: 96279 - DNA, 41 bp, Artificial Sequence
  Description of Artificial Sequence: Synthetic oligonucleotide
tacagctattggaatcagatgcaaagatggtgttgtctttg

SEQ ID NO: 96280 - DNA, 40 bp, Artificial Sequence
  Description of Artificial Sequence: Synthetic oligonucleotide
acagctattggaatcagatgcaaagatggtgttgtctttg

SEQ ID NO: 96281 - DNA, 39 bp, Artificial Sequence
  Description of Artificial Sequence: Synthetic oligonucleotide
cagctattggaatcagatgcaaagatggtgttgtctttg

SEQ ID NO: 96282 - DNA, 39 bp, Artificial Sequence
  Description of Artificial Sequence: Synthetic oligonucleotide
agctattggaatcagatgcaaagatggtgttgtctttgg

SEQ ID NO: 96283 - DNA, 38 bp, Artificial Sequence
  Description of Artificial Sequence: Synthetic oligonucleotide
gctattggaatcagatgcaaagatggtgttgtctttgg

SEQ ID NO: 96284 - DNA, 38 bp, Artificial Sequence
  Description of Artificial Sequence: Synthetic oligonucleotide
ctattggaatcagatgcaaagatggtgttgtctttggg

SEQ ID NO: 96285 - DNA, 38 bp, Artificial Sequence
  Description of Artificial Sequence: Synthetic oligonucleotide
tattggaatcagatgcaaagatggtgttgtctttgggg

SEQ ID NO: 96286 - DNA, 37 bp, Artificial Sequence
  Description of Artificial Sequence: Synthetic oligonucleotide
attggaatcagatgcaaagatggtgttgtctttgggg

SEQ ID NO: 96287 - DNA, 36 bp, Artificial Sequence
  Description of Artificial Sequence: Synthetic oligonucleotide
ttggaatcagatgcaaagatggtgttgtctttgggg

SEQ ID NO: 96288 - DNA, 35 bp, Artificial Sequence
  Description of Artificial Sequence: Synthetic oligonucleotide
tggaatcagatgcaaagatggtgttgtctttgggg

SEQ ID NO: 96289 - DNA, 34 bp, Artificial Sequence
  Description of Artificial Sequence: Synthetic oligonucleotide
ggaatcagatgcaaagatggtgttgtctttgggg

SEQ ID NO: 96290 - DNA, 36 bp, Artificial Sequence
  Description of Artificial Sequence: Synthetic oligonucleotide
gaatcagatgcaaagatggtgttgtctttggggtag

SEQ ID NO: 96291 - DNA, 44 bp, Artificial Sequence
  Description of Artificial Sequence: Synthetic oligonucleotide
aatcagatgcaaagatggtgttgtctttggggtagaaaaattag

SEQ ID NO: 96292 - DNA, 43 bp, Artificial Sequence
  Description of Artificial Sequence: Synthetic oligonucleotide
atcagatgcaaagatggtgttgtctttggggtagaaaaattag

SEQ ID NO: 96293 - DNA, 42 bp, Artificial Sequence
  Description of Artificial Sequence: Synthetic oligonucleotide
tcagatgcaaagatggtgttgtctttggggtagaaaaattag

SEQ ID NO: 96294 - DNA, 41 bp, Artificial Sequence
  Description of Artificial Sequence: Synthetic oligonucleotide
cagatgcaaagatggtgttgtctttggggtagaaaaattag

SEQ ID NO: 96295 - DNA, 42 bp, Artificial Sequence
  Description of Artificial Sequence: Synthetic oligonucleotide
agatgcaaagatggtgttgtctttggggtagaaaaattagtc

SEQ ID NO: 96296 - DNA, 41 bp, Artificial Sequence
  Description of Artificial Sequence: Synthetic oligonucleotide
gatgcaaagatggtgttgtctttggggtagaaaaattagtc

SEQ ID NO: 96297 - DNA, 41 bp, Artificial Sequence
  Description of Artificial Sequence: Synthetic oligonucleotide
atgcaaagatggtgttgtctttggggtagaaaaattagtcc

SEQ ID NO: 96298 - DNA, 40 bp, Artificial Sequence
  Description of Artificial Sequence: Synthetic oligonucleotide
tgcaaagatggtgttgtctttggggtagaaaaattagtcc

SEQ ID NO: 96299 - DNA, 39 bp, Artificial Sequence
  Description of Artificial Sequence: Synthetic oligonucleotide
gcaaagatggtgttgtctttggggtagaaaaattagtcc

SEQ ID NO: 96300 - DNA, 42 bp, Artificial Sequence
  Description of Artificial Sequence: Synthetic oligonucleotide
caaagatggtgttgtctttggggtagaaaaattagtcctttc

SEQ ID NO: 96301 - DNA, 46 bp, Artificial Sequence
  Description of Artificial Sequence: Synthetic oligonucleotide
aaagatggtgttgtctttggggtagaaaaattagtcctttctaaac

SEQ ID NO: 96302 - DNA, 45 bp, Artificial Sequence
  Description of Artificial Sequence: Synthetic oligonucleotide
aagatggtgttgtctttggggtagaaaaattagtcctttctaaac

SEQ ID NO: 96303 - DNA, 44 bp, Artificial Sequence
  Description of Artificial Sequence: Synthetic oligonucleotide
agatggtgttgtctttggggtagaaaaattagtcctttctaaac

SEQ ID NO: 96304 - DNA, 43 bp, Artificial Sequence
  Description of Artificial Sequence: Synthetic oligonucleotide
gatggtgttgtctttggggtagaaaaattagtcctttctaaac

SEQ ID NO: 96305 - DNA, 48 bp, Artificial Sequence
  Description of Artificial Sequence: Synthetic oligonucleotide
atggtgttgtctttggggtagaaaaattagtcctttctaaactttatg

SEQ ID NO: 96306 - DNA, 47 bp, Artificial Sequence
  Description of Artificial Sequence: Synthetic oligonucleotide
tggtgttgtctttggggtagaaaaattagtcctttctaaactttatg

SEQ ID NO: 96307 - DNA, 46 bp, Artificial Sequence
  Description of Artificial Sequence: Synthetic oligonucleotide
ggtgttgtctttggggtagaaaaattagtcctttctaaactttatg

SEQ ID NO: 96308 - DNA, 48 bp, Artificial Sequence
  Description of Artificial Sequence: Synthetic oligonucleotide
gtgttgtctttggggtagaaaaattagtcctttctaaactttatgaag

SEQ ID NO: 96309 - DNA, 50 bp, Artificial Sequence
  Description of Artificial Sequence: Synthetic oligonucleotide
tgttgtctttggggtagaaaaattagtcctttctaaactttatgaagaag

SEQ ID NO: 96310 - DNA, 49 bp, Artificial Sequence
  Description of Artificial Sequence: Synthetic oligonucleotide
gttgtctttggggtagaaaaattagtcctttctaaactttatgaagaag

SEQ ID NO: 96311 - DNA, 49 bp, Artificial Sequence
  Description of Artificial Sequence: Synthetic oligonucleotide
ttgtctttggggtagaaaaattagtcctttctaaactttatgaagaagg

SEQ ID NO: 96312 - DNA, 48 bp, Artificial Sequence
  Description of Artificial Sequence: Synthetic oligonucleotide
tgtctttggggtagaaaaattagtcctttctaaactttatgaagaagg

SEQ ID NO: 96313 - DNA, 47 bp, Artificial Sequence
  Description of Artificial Sequence: Synthetic oligonucleotide
gtctttggggtagaaaaattagtcctttctaaactttatgaagaagg

SEQ ID NO: 96314 - DNA, 49 bp, Artificial Sequence
  Description of Artificial Sequence: Synthetic oligonucleotide
tctttggggtagaaaaattagtcctttctaaactttatgaagaaggttc

SEQ ID NO: 96315 - DNA, 48 bp, Artificial Sequence
  Description of Artificial Sequence: Synthetic oligonucleotide
ctttggggtagaaaaattagtcctttctaaactttatgaagaaggttc

SEQ ID NO: 96316 - DNA, 48 bp, Artificial Sequence
  Description of Artificial Sequence: Synthetic oligonucleotide
tttggggtagaaaaattagtcctttctaaactttatgaagaaggttcc

SEQ ID NO: 96317 - DNA, 47 bp, Artificial Sequence
  Description of Artificial Sequence: Synthetic oligonucleotide
ttggggtagaaaaattagtcctttctaaactttatgaagaaggttcc

SEQ ID NO: 96318 - DNA, 46 bp, Artificial Sequence
  Description of Artificial Sequence: Synthetic oligonucleotide
tggggtagaaaaattagtcctttctaaactttatgaagaaggttcc

SEQ ID NO: 96319 - DNA, 45 bp, Artificial Sequence
  Description of Artificial Sequence: Synthetic oligonucleotide
ggggtagaaaaattagtcctttctaaactttatgaagaaggttcc

SEQ ID NO: 96320 - DNA, 47 bp, Artificial Sequence
  Description of Artificial Sequence: Synthetic oligonucleotide
gggtagaaaaattagtcctttctaaactttatgaagaaggttccaac

SEQ ID NO: 96321 - DNA, 51 bp, Artificial Sequence
  Description of Artificial Sequence: Synthetic oligonucleotide
ggtagaaaaattagtcctttctaaactttatgaagaaggttccaacaaaag

SEQ ID NO: 96322 - DNA, 52 bp, Artificial Sequence
  Description of Artificial Sequence: Synthetic oligonucleotide
gtagaaaaattagtcctttctaaactttatgaagaaggttccaacaaaagac

SEQ ID NO: 96323 - DNA, 60 bp, Artificial Sequence
  Description of Artificial Sequence: Synthetic oligonucleotide
tagaaaaattagtcctttctaaactttatgaagaaggttccaacaaaagactttttaatg

SEQ ID NO: 96324 - DNA, 59 bp, Artificial Sequence
  Description of Artificial Sequence: Synthetic oligonucleotide
agaaaaattagtcctttctaaactttatgaagaaggttccaacaaaagactttttaatg

SEQ ID NO: 96325 - DNA, 58 bp, Artificial Sequence
  Description of Artificial Sequence: Synthetic oligonucleotide
gaaaaattagtcctttctaaactttatgaagaaggttccaacaaaagactttttaatg

SEQ ID NO: 96326 - DNA, 60 bp, Artificial Sequence
  Description of Artificial Sequence: Synthetic oligonucleotide
aaaaattagtcctttctaaactttatgaagaaggttccaacaaaagactttttaatgttg

SEQ ID NO: 96327 - DNA, 59 bp, Artificial Sequence
  Description of Artificial Sequence: Synthetic oligonucleotide
aaaattagtcctttctaaactttatgaagaaggttccaacaaaagactttttaatgttg

SEQ ID NO: 96328 - DNA, 58 bp, Artificial Sequence
  Description of Artificial Sequence: Synthetic oligonucleotide
aaattagtcctttctaaactttatgaagaaggttccaacaaaagactttttaatgttg

SEQ ID NO: 96329 - DNA, 57 bp, Artificial Sequence
  Description of Artificial Sequence: Synthetic oligonucleotide
aattagtcctttctaaactttatgaagaaggttccaacaaaagactttttaatgttg

SEQ ID NO: 96330 - DNA, 56 bp, Artificial Sequence
  Description of Artificial Sequence: Synthetic oligonucleotide
attagtcctttctaaactttatgaagaaggttccaacaaaagactttttaatgttg

SEQ ID NO: 96331 - DNA, 55 bp, Artificial Sequence
  Description of Artificial Sequence: Synthetic oligonucleotide
ttagtcctttctaaactttatgaagaaggttccaacaaaagactttttaatgttg

SEQ ID NO: 96332 - DNA, 54 bp, Artificial Sequence
  Description of Artificial Sequence: Synthetic oligonucleotide
tagtcctttctaaactttatgaagaaggttccaacaaaagactttttaatgttg

SEQ ID NO: 96333 - DNA, 53 bp, Artificial Sequence
  Description of Artificial Sequence: Synthetic oligonucleotide
agtcctttctaaactttatgaagaaggttccaacaaaagactttttaatgttg

SEQ ID NO: 96334 - DNA, 52 bp, Artificial Sequence
  Description of Artificial Sequence: Synthetic oligonucleotide
gtcctttctaaactttatgaagaaggttccaacaaaagactttttaatgttg

SEQ ID NO: 96335 - DNA, 54 bp, Artificial Sequence
  Description of Artificial Sequence: Synthetic oligonucleotide
tcctttctaaactttatgaagaaggttccaacaaaagactttttaatgttgatc

SEQ ID NO: 96336 - DNA, 53 bp, Artificial Sequence
  Description of Artificial Sequence: Synthetic oligonucleotide
cctttctaaactttatgaagaaggttccaacaaaagactttttaatgttgatc

SEQ ID NO: 96337 - DNA, 53 bp, Artificial Sequence
  Description of Artificial Sequence: Synthetic oligonucleotide
ctttctaaactttatgaagaaggttccaacaaaagactttttaatgttgatcg

SEQ ID NO: 96338 - DNA, 53 bp, Artificial Sequence
  Description of Artificial Sequence: Synthetic oligonucleotide
tttctaaactttatgaagaaggttccaacaaaagactttttaatgttgatcgg

SEQ ID NO: 96339 - DNA, 52 bp, Artificial Sequence
  Description of Artificial Sequence: Synthetic oligonucleotide
ttctaaactttatgaagaaggttccaacaaaagactttttaatgttgatcgg

SEQ ID NO: 96340 - DNA, 51 bp, Artificial Sequence
  Description of Artificial Sequence: Synthetic oligonucleotide
tctaaactttatgaagaaggttccaacaaaagactttttaatgttgatcgg

SEQ ID NO: 96341 - DNA, 50 bp, Artificial Sequence
  Description of Artificial Sequence: Synthetic oligonucleotide
ctaaactttatgaagaaggttccaacaaaagactttttaatgttgatcgg

SEQ ID NO: 96342 - DNA, 50 bp, Artificial Sequence
  Description of Artificial Sequence: Synthetic oligonucleotide
taaactttatgaagaaggttccaacaaaagactttttaatgttgatcggc

SEQ ID NO: 96343 - DNA, 49 bp, Artificial Sequence
  Description of Artificial Sequence: Synthetic oligonucleotide
aaactttatgaagaaggttccaacaaaagactttttaatgttgatcggc

SEQ ID NO: 96344 - DNA, 48 bp, Artificial Sequence
  Description of Artificial Sequence: Synthetic oligonucleotide
aactttatgaagaaggttccaacaaaagactttttaatgttgatcggc

SEQ ID NO: 96345 - DNA, 47 bp, Artificial Sequence
  Description of Artificial Sequence: Synthetic oligonucleotide
actttatgaagaaggttccaacaaaagactttttaatgttgatcggc

SEQ ID NO: 96346 - DNA, 46 bp, Artificial Sequence
  Description of Artificial Sequence: Synthetic oligonucleotide
ctttatgaagaaggttccaacaaaagactttttaatgttgatcggc

SEQ ID NO: 96347 - DNA, 48 bp, Artificial Sequence
  Description of Artificial Sequence: Synthetic oligonucleotide
tttatgaagaaggttccaacaaaagactttttaatgttgatcggcatg

SEQ ID NO: 96348 - DNA, 47 bp, Artificial Sequence
  Description of Artificial Sequence: Synthetic oligonucleotide
ttatgaagaaggttccaacaaaagactttttaatgttgatcggcatg

SEQ ID NO: 96349 - DNA, 46 bp, Artificial Sequence
  Description of Artificial Sequence: Synthetic oligonucleotide
tatgaagaaggttccaacaaaagactttttaatgttgatcggcatg

SEQ ID NO: 96350 - DNA, 45 bp, Artificial Sequence
  Description of Artificial Sequence: Synthetic oligonucleotide
atgaagaaggttccaacaaaagactttttaatgttgatcggcatg

SEQ ID NO: 96351 - DNA, 44 bp, Artificial Sequence
  Description of Artificial Sequence: Synthetic oligonucleotide
tgaagaaggttccaacaaaagactttttaatgttgatcggcatg

SEQ ID NO: 96352 - DNA, 43 bp, Artificial Sequence
  Description of Artificial Sequence: Synthetic oligonucleotide
gaagaaggttccaacaaaagactttttaatgttgatcggcatg

SEQ ID NO: 96353 - DNA, 45 bp, Artificial Sequence
  Description of Artificial Sequence: Synthetic oligonucleotide
aagaaggttccaacaaaagactttttaatgttgatcggcatgttg

SEQ ID NO: 96354 - DNA, 44 bp, Artificial Sequence
  Description of Artificial Sequence: Synthetic oligonucleotide
agaaggttccaacaaaagactttttaatgttgatcggcatgttg

SEQ ID NO: 96355 - DNA, 43 bp, Artificial Sequence
  Description of Artificial Sequence: Synthetic oligonucleotide
gaaggttccaacaaaagactttttaatgttgatcggcatgttg

SEQ ID NO: 96356 - DNA, 43 bp, Artificial Sequence
  Description of Artificial Sequence: Synthetic oligonucleotide
aaggttccaacaaaagactttttaatgttgatcggcatgttgg

SEQ ID NO: 96357 - DNA, 42 bp, Artificial Sequence
  Description of Artificial Sequence: Synthetic oligonucleotide
aggttccaacaaaagactttttaatgttgatcggcatgttgg

SEQ ID NO: 96358 - DNA, 41 bp, Artificial Sequence
  Description of Artificial Sequence: Synthetic oligonucleotide
ggttccaacaaaagactttttaatgttgatcggcatgttgg

SEQ ID NO: 96359 - DNA, 44 bp, Artificial Sequence
  Description of Artificial Sequence: Synthetic oligonucleotide
gttccaacaaaagactttttaatgttgatcggcatgttggaatg

SEQ ID NO: 96360 - DNA, 44 bp, Artificial Sequence
  Description of Artificial Sequence: Synthetic oligonucleotide
ttccaacaaaagactttttaatgttgatcggcatgttggaatgg

SEQ ID NO: 96361 - DNA, 43 bp, Artificial Sequence
  Description of Artificial Sequence: Synthetic oligonucleotide
tccaacaaaagactttttaatgttgatcggcatgttggaatgg

SEQ ID NO: 96362 - DNA, 42 bp, Artificial Sequence
  Description of Artificial Sequence: Synthetic oligonucleotide
ccaacaaaagactttttaatgttgatcggcatgttggaatgg

SEQ ID NO: 96363 - DNA, 42 bp, Artificial Sequence
  Description of Artificial Sequence: Synthetic oligonucleotide
caacaaaagactttttaatgttgatcggcatgttggaatggc

SEQ ID NO: 96364 - DNA, 43 bp, Artificial Sequence
  Description of Artificial Sequence: Synthetic oligonucleotide
aacaaaagactttttaatgttgatcggcatgttggaatggcag

SEQ ID NO: 96365 - DNA, 42 bp, Artificial Sequence
  Description of Artificial Sequence: Synthetic oligonucleotide
acaaaagactttttaatgttgatcggcatgttggaatggcag

SEQ ID NO: 96366 - DNA, 41 bp, Artificial Sequence
  Description of Artificial Sequence: Synthetic oligonucleotide
caaaagactttttaatgttgatcggcatgttggaatggcag

SEQ ID NO: 96367 - DNA, 43 bp, Artificial Sequence
  Description of Artificial Sequence: Synthetic oligonucleotide
aaaagactttttaatgttgatcggcatgttggaatggcagtag

SEQ ID NO: 96368 - DNA, 42 bp, Artificial Sequence
  Description of Artificial Sequence: Synthetic oligonucleotide
aaagactttttaatgttgatcggcatgttggaatggcagtag

SEQ ID NO: 96369 - DNA, 41 bp, Artificial Sequence
  Description of Artificial Sequence: Synthetic oligonucleotide
aagactttttaatgttgatcggcatgttggaatggcagtag

SEQ ID NO: 96370 - DNA, 40 bp, Artificial Sequence
  Description of Artificial Sequence: Synthetic oligonucleotide
agactttttaatgttgatcggcatgttggaatggcagtag

SEQ ID NO: 96371 - DNA, 39 bp, Artificial Sequence
  Description of Artificial Sequence: Synthetic oligonucleotide
gactttttaatgttgatcggcatgttggaatggcagtag

SEQ ID NO: 96372 - DNA, 39 bp, Artificial Sequence
  Description of Artificial Sequence: Synthetic oligonucleotide
actttttaatgttgatcggcatgttggaatggcagtagc

SEQ ID NO: 96373 - DNA, 38 bp, Artificial Sequence
  Description of Artificial Sequence: Synthetic oligonucleotide
ctttttaatgttgatcggcatgttggaatggcagtagc

SEQ ID NO: 96374 - DNA, 39 bp, Artificial Sequence
  Description of Artificial Sequence: Synthetic oligonucleotide
tttttaatgttgatcggcatgttggaatggcagtagcag

SEQ ID NO: 96375 - DNA, 38 bp, Artificial Sequence
  Description of Artificial Sequence: Synthetic oligonucleotide
ttttaatgttgatcggcatgttggaatggcagtagcag

SEQ ID NO: 96376 - DNA, 37 bp, Artificial Sequence
  Description of Artificial Sequence: Synthetic oligonucleotide
tttaatgttgatcggcatgttggaatggcagtagcag

SEQ ID NO: 96377 - DNA, 36 bp, Artificial Sequence
  Description of Artificial Sequence: Synthetic oligonucleotide
ttaatgttgatcggcatgttggaatggcagtagcag

SEQ ID NO: 96378 - DNA, 35 bp, Artificial Sequence
  Description of Artificial Sequence: Synthetic oligonucleotide
taatgttgatcggcatgttggaatggcagtagcag

SEQ ID NO: 96379 - DNA, 34 bp, Artificial Sequence
  Description of Artificial Sequence: Synthetic oligonucleotide
aatgttgatcggcatgttggaatggcagtagcag

SEQ ID NO: 96380 - DNA, 33 bp, Artificial Sequence
  Description of Artificial Sequence: Synthetic oligonucleotide
atgttgatcggcatgttggaatggcagtagcag

SEQ ID NO: 96381 - DNA, 32 bp, Artificial Sequence
  Description of Artificial Sequence: Synthetic oligonucleotide
tgttgatcggcatgttggaatggcagtagcag

SEQ ID NO: 96382 - DNA, 31 bp, Artificial Sequence
  Description of Artificial Sequence: Synthetic oligonucleotide
gttgatcggcatgttggaatggcagtagcag

SEQ ID NO: 96383 - DNA, 31 bp, Artificial Sequence
  Description of Artificial Sequence: Synthetic oligonucleotide
ttgatcggcatgttggaatggcagtagcagg

SEQ ID NO: 96384 - DNA, 30 bp, Artificial Sequence
  Description of Artificial Sequence: Synthetic oligonucleotide
tgatcggcatgttggaatggcagtagcagg

SEQ ID NO: 96385 - DNA, 29 bp, Artificial Sequence
  Description of Artificial Sequence: Synthetic oligonucleotide
gatcggcatgttggaatggcagtagcagg

SEQ ID NO: 96386 - DNA, 32 bp, Artificial Sequence
  Description of Artificial Sequence: Synthetic oligonucleotide
atcggcatgttggaatggcagtagcaggtttg

SEQ ID NO: 96387 - DNA, 31 bp, Artificial Sequence
  Description of Artificial Sequence: Synthetic oligonucleotide
tcggcatgttggaatggcagtagcaggtttg

SEQ ID NO: 96388 - DNA, 30 bp, Artificial Sequence
  Description of Artificial Sequence: Synthetic oligonucleotide
cggcatgttggaatggcagtagcaggtttg

SEQ ID NO: 96389 - DNA, 32 bp, Artificial Sequence
  Description of Artificial Sequence: Synthetic oligonucleotide
ggcatgttggaatggcagtagcaggtttgttg

SEQ ID NO: 96390 - DNA, 32 bp, Artificial Sequence
  Description of Artificial Sequence: Synthetic oligonucleotide
gcatgttggaatggcagtagcaggtttgttgg

SEQ ID NO: 96391 - DNA, 32 bp, Artificial Sequence
  Description of Artificial Sequence: Synthetic oligonucleotide
catgttggaatggcagtagcaggtttgttggc

SEQ ID NO: 96392 - DNA, 33 bp, Artificial Sequence
  Description of Artificial Sequence: Synthetic oligonucleotide
atgttggaatggcagtagcaggtttgttggcag

SEQ ID NO: 96393 - DNA, 32 bp, Artificial Sequence
  Description of Artificial Sequence: Synthetic oligonucleotide
tgttggaatggcagtagcaggtttgttggcag

SEQ ID NO: 96394 - DNA, 31 bp, Artificial Sequence
  Description of Artificial Sequence: Synthetic oligonucleotide
gttggaatggcagtagcaggtttgttggcag

SEQ ID NO: 96395 - DNA, 33 bp, Artificial Sequence
  Description of Artificial Sequence: Synthetic oligonucleotide
ttggaatggcagtagcaggtttgttggcagatg

SEQ ID NO: 96396 - DNA, 32 bp, Artificial Sequence
  Description of Artificial Sequence: Synthetic oligonucleotide
tggaatggcagtagcaggtttgttggcagatg

SEQ ID NO: 96397 - DNA, 31 bp, Artificial Sequence
  Description of Artificial Sequence: Synthetic oligonucleotide
ggaatggcagtagcaggtttgttggcagatg

SEQ ID NO: 96398 - DNA, 31 bp, Artificial Sequence
  Description of Artificial Sequence: Synthetic oligonucleotide
gaatggcagtagcaggtttgttggcagatgc

SEQ ID NO: 96399 - DNA, 32 bp, Artificial Sequence
  Description of Artificial Sequence: Synthetic oligonucleotide
aatggcagtagcaggtttgttggcagatgctc

SEQ ID NO: 96400 - DNA, 31 bp, Artificial Sequence
  Description of Artificial Sequence: Synthetic oligonucleotide
atggcagtagcaggtttgttggcagatgctc

SEQ ID NO: 96401 - DNA, 30 bp, Artificial Sequence
  Description of Artificial Sequence: Synthetic oligonucleotide
tggcagtagcaggtttgttggcagatgctc

SEQ ID NO: 96402 - DNA, 29 bp, Artificial Sequence
  Description of Artificial Sequence: Synthetic oligonucleotide
ggcagtagcaggtttgttggcagatgctc

SEQ ID NO: 96403 - DNA, 29 bp, Artificial Sequence
  Description of Artificial Sequence: Synthetic oligonucleotide
gcagtagcaggtttgttggcagatgctcg

SEQ ID NO: 96404 - DNA, 31 bp, Artificial Sequence
  Description of Artificial Sequence: Synthetic oligonucleotide
cagtagcaggtttgttggcagatgctcgttc

SEQ ID NO: 96405 - DNA, 35 bp, Artificial Sequence
  Description of Artificial Sequence: Synthetic oligonucleotide
agtagcaggtttgttggcagatgctcgttctttag

SEQ ID NO: 96406 - DNA, 34 bp, Artificial Sequence
  Description of Artificial Sequence: Synthetic oligonucleotide
gtagcaggtttgttggcagatgctcgttctttag

SEQ ID NO: 96407 - DNA, 34 bp, Artificial Sequence
  Description of Artificial Sequence: Synthetic oligonucleotide
tagcaggtttgttggcagatgctcgttctttagc

SEQ ID NO: 96408 - DNA, 33 bp, Artificial Sequence
  Description of Artificial Sequence: Synthetic oligonucleotide
agcaggtttgttggcagatgctcgttctttagc

SEQ ID NO: 96409 - DNA, 32 bp, Artificial Sequence
  Description of Artificial Sequence: Synthetic oligonucleotide
gcaggtttgttggcagatgctcgttctttagc

SEQ ID NO: 96410 - DNA, 33 bp, Artificial Sequence
  Description of Artificial Sequence: Synthetic oligonucleotide
caggtttgttggcagatgctcgttctttagcag

SEQ ID NO: 96411 - DNA, 34 bp, Artificial Sequence
  Description of Artificial Sequence: Synthetic oligonucleotide
aggtttgttggcagatgctcgttctttagcagac

SEQ ID NO: 96412 - DNA, 33 bp, Artificial Sequence
  Description of Artificial Sequence: Synthetic oligonucleotide
ggtttgttggcagatgctcgttctttagcagac

SEQ ID NO: 96413 - DNA, 36 bp, Artificial Sequence
  Description of Artificial Sequence: Synthetic oligonucleotide
gtttgttggcagatgctcgttctttagcagacatag

SEQ ID NO: 96414 - DNA, 36 bp, Artificial Sequence
  Description of Artificial Sequence: Synthetic oligonucleotide
tttgttggcagatgctcgttctttagcagacatagc

SEQ ID NO: 96415 - DNA, 35 bp, Artificial Sequence
  Description of Artificial Sequence: Synthetic oligonucleotide
ttgttggcagatgctcgttctttagcagacatagc

SEQ ID NO: 96416 - DNA, 34 bp, Artificial Sequence
  Description of Artificial Sequence: Synthetic oligonucleotide
tgttggcagatgctcgttctttagcagacatagc

SEQ ID NO: 96417 - DNA, 33 bp, Artificial Sequence
  Description of Artificial Sequence: Synthetic oligonucleotide
gttggcagatgctcgttctttagcagacatagc

SEQ ID NO: 96418 - DNA, 35 bp, Artificial Sequence
  Description of Artificial Sequence: Synthetic oligonucleotide
ttggcagatgctcgttctttagcagacatagcaag

SEQ ID NO: 96419 - DNA, 34 bp, Artificial Sequence
  Description of Artificial Sequence: Synthetic oligonucleotide
tggcagatgctcgttctttagcagacatagcaag

SEQ ID NO: 96420 - DNA, 33 bp, Artificial Sequence
  Description of Artificial Sequence: Synthetic oligonucleotide
ggcagatgctcgttctttagcagacatagcaag

SEQ ID NO: 96421 - DNA, 34 bp, Artificial Sequence
  Description of Artificial Sequence: Synthetic oligonucleotide
gcagatgctcgttctttagcagacatagcaagag

SEQ ID NO: 96422 - DNA, 36 bp, Artificial Sequence
  Description of Artificial Sequence: Synthetic oligonucleotide
cagatgctcgttctttagcagacatagcaagagaag

SEQ ID NO: 96423 - DNA, 38 bp, Artificial Sequence
  Description of Artificial Sequence: Synthetic oligonucleotide
agatgctcgttctttagcagacatagcaagagaagaag

SEQ ID NO: 96424 - DNA, 37 bp, Artificial Sequence
  Description of Artificial Sequence: Synthetic oligonucleotide
gatgctcgttctttagcagacatagcaagagaagaag

SEQ ID NO: 96425 - DNA, 37 bp, Artificial Sequence
  Description of Artificial Sequence: Synthetic oligonucleotide
atgctcgttctttagcagacatagcaagagaagaagc

SEQ ID NO: 96426 - DNA, 36 bp, Artificial Sequence
  Description of Artificial Sequence: Synthetic oligonucleotide
tgctcgttctttagcagacatagcaagagaagaagc

SEQ ID NO: 96427 - DNA, 35 bp, Artificial Sequence
  Description of Artificial Sequence: Synthetic oligonucleotide
gctcgttctttagcagacatagcaagagaagaagc

SEQ ID NO: 96428 - DNA, 37 bp, Artificial Sequence
  Description of Artificial Sequence: Synthetic oligonucleotide
ctcgttctttagcagacatagcaagagaagaagcttc

SEQ ID NO: 96429 - DNA, 37 bp, Artificial Sequence
  Description of Artificial Sequence: Synthetic oligonucleotide
tcgttctttagcagacatagcaagagaagaagcttcc

SEQ ID NO: 96430 - DNA, 36 bp, Artificial Sequence
  Description of Artificial Sequence: Synthetic oligonucleotide
cgttctttagcagacatagcaagagaagaagcttcc

SEQ ID NO: 96431 - DNA, 38 bp, Artificial Sequence
  Description of Artificial Sequence: Synthetic oligonucleotide
gttctttagcagacatagcaagagaagaagcttccaac

SEQ ID NO: 96432 - DNA, 40 bp, Artificial Sequence
  Description of Artificial Sequence: Synthetic oligonucleotide
ttctttagcagacatagcaagagaagaagcttccaacttc

SEQ ID NO: 96433 - DNA, 39 bp, Artificial Sequence
  Description of Artificial Sequence: Synthetic oligonucleotide
tctttagcagacatagcaagagaagaagcttccaacttc

SEQ ID NO: 96434 - DNA, 38 bp, Artificial Sequence
  Description of Artificial Sequence: Synthetic oligonucleotide
ctttagcagacatagcaagagaagaagcttccaacttc

SEQ ID NO: 96435 - DNA, 39 bp, Artificial Sequence
  Description of Artificial Sequence: Synthetic oligonucleotide
tttagcagacatagcaagagaagaagcttccaacttcag

SEQ ID NO: 96436 - DNA, 38 bp, Artificial Sequence
  Description of Artificial Sequence: Synthetic oligonucleotide
ttagcagacatagcaagagaagaagcttccaacttcag

SEQ ID NO: 96437 - DNA, 37 bp, Artificial Sequence
  Description of Artificial Sequence: Synthetic oligonucleotide
tagcagacatagcaagagaagaagcttccaacttcag

SEQ ID NO: 96438 - DNA, 36 bp, Artificial Sequence
  Description of Artificial Sequence: Synthetic oligonucleotide
agcagacatagcaagagaagaagcttccaacttcag

SEQ ID NO: 96439 - DNA, 35 bp, Artificial Sequence
  Description of Artificial Sequence: Synthetic oligonucleotide
gcagacatagcaagagaagaagcttccaacttcag

SEQ ID NO: 96440 - DNA, 37 bp, Artificial Sequence
  Description of Artificial Sequence: Synthetic oligonucleotide
cagacatagcaagagaagaagcttccaacttcagatc

SEQ ID NO: 96441 - DNA, 40 bp, Artificial Sequence
  Description of Artificial Sequence: Synthetic oligonucleotide
agacatagcaagagaagaagcttccaacttcagatctaac

SEQ ID NO: 96442 - DNA, 39 bp, Artificial Sequence
  Description of Artificial Sequence: Synthetic oligonucleotide
gacatagcaagagaagaagcttccaacttcagatctaac

SEQ ID NO: 96443 - DNA, 42 bp, Artificial Sequence
  Description of Artificial Sequence: Synthetic oligonucleotide
acatagcaagagaagaagcttccaacttcagatctaactttg

SEQ ID NO: 96444 - DNA, 41 bp, Artificial Sequence
  Description of Artificial Sequence: Synthetic oligonucleotide
catagcaagagaagaagcttccaacttcagatctaactttg

SEQ ID NO: 96445 - DNA, 41 bp, Artificial Sequence
  Description of Artificial Sequence: Synthetic oligonucleotide
atagcaagagaagaagcttccaacttcagatctaactttgg

SEQ ID NO: 96446 - DNA, 40 bp, Artificial Sequence
  Description of Artificial Sequence: Synthetic oligonucleotide
tagcaagagaagaagcttccaacttcagatctaactttgg

SEQ ID NO: 96447 - DNA, 39 bp, Artificial Sequence
  Description of Artificial Sequence: Synthetic oligonucleotide
agcaagagaagaagcttccaacttcagatctaactttgg

SEQ ID NO: 96448 - DNA, 38 bp, Artificial Sequence
  Description of Artificial Sequence: Synthetic oligonucleotide
gcaagagaagaagcttccaacttcagatctaactttgg

SEQ ID NO: 96449 - DNA, 38 bp, Artificial Sequence
  Description of Artificial Sequence: Synthetic oligonucleotide
caagagaagaagcttccaacttcagatctaactttggc

SEQ ID NO: 96450 - DNA, 40 bp, Artificial Sequence
  Description of Artificial Sequence: Synthetic oligonucleotide
aagagaagaagcttccaacttcagatctaactttggctac

SEQ ID NO: 96451 - DNA, 39 bp, Artificial Sequence
  Description of Artificial Sequence: Synthetic oligonucleotide
agagaagaagcttccaacttcagatctaactttggctac

SEQ ID NO: 96452 - DNA, 38 bp, Artificial Sequence
  Description of Artificial Sequence: Synthetic oligonucleotide
gagaagaagcttccaacttcagatctaactttggctac

SEQ ID NO: 96453 - DNA, 40 bp, Artificial Sequence
  Description of Artificial Sequence: Synthetic oligonucleotide
agaagaagcttccaacttcagatctaactttggctacaac

SEQ ID NO: 96454 - DNA, 39 bp, Artificial Sequence
  Description of Artificial Sequence: Synthetic oligonucleotide
gaagaagcttccaacttcagatctaactttggctacaac

SEQ ID NO: 96455 - DNA, 42 bp, Artificial Sequence
  Description of Artificial Sequence: Synthetic oligonucleotide
aagaagcttccaacttcagatctaactttggctacaacattc

SEQ ID NO: 96456 - DNA, 41 bp, Artificial Sequence
  Description of Artificial Sequence: Synthetic oligonucleotide
agaagcttccaacttcagatctaactttggctacaacattc

SEQ ID NO: 96457 - DNA, 40 bp, Artificial Sequence
  Description of Artificial Sequence: Synthetic oligonucleotide
gaagcttccaacttcagatctaactttggctacaacattc

SEQ ID NO: 96458 - DNA, 40 bp, Artificial Sequence
  Description of Artificial Sequence: Synthetic oligonucleotide
aagcttccaacttcagatctaactttggctacaacattcc

SEQ ID NO: 96459 - DNA, 39 bp, Artificial Sequence
  Description of Artificial Sequence: Synthetic oligonucleotide
agcttccaacttcagatctaactttggctacaacattcc

SEQ ID NO: 96460 - DNA, 38 bp, Artificial Sequence
  Description of Artificial Sequence: Synthetic oligonucleotide
gcttccaacttcagatctaactttggctacaacattcc

SEQ ID NO: 96461 - DNA, 39 bp, Artificial Sequence
  Description of Artificial Sequence: Synthetic oligonucleotide
cttccaacttcagatctaactttggctacaacattccac

SEQ ID NO: 96462 - DNA, 44 bp, Artificial Sequence
  Description of Artificial Sequence: Synthetic oligonucleotide
ttccaacttcagatctaactttggctacaacattccactaaaac

SEQ ID NO: 96463 - DNA, 43 bp, Artificial Sequence
  Description of Artificial Sequence: Synthetic oligonucleotide
tccaacttcagatctaactttggctacaacattccactaaaac

SEQ ID NO: 96464 - DNA, 42 bp, Artificial Sequence
  Description of Artificial Sequence: Synthetic oligonucleotide
ccaacttcagatctaactttggctacaacattccactaaaac

SEQ ID NO: 96465 - DNA, 44 bp, Artificial Sequence
  Description of Artificial Sequence: Synthetic oligonucleotide
caacttcagatctaactttggctacaacattccactaaaacatc

SEQ ID NO: 96466 - DNA, 46 bp, Artificial Sequence
  Description of Artificial Sequence: Synthetic oligonucleotide
aacttcagatctaactttggctacaacattccactaaaacatcttg

SEQ ID NO: 96467 - DNA, 45 bp, Artificial Sequence
  Description of Artificial Sequence: Synthetic oligonucleotide
acttcagatctaactttggctacaacattccactaaaacatcttg

SEQ ID NO: 96468 - DNA, 44 bp, Artificial Sequence
  Description of Artificial Sequence: Synthetic oligonucleotide
cttcagatctaactttggctacaacattccactaaaacatcttg

SEQ ID NO: 96469 - DNA, 44 bp, Artificial Sequence
  Description of Artificial Sequence: Synthetic oligonucleotide
ttcagatctaactttggctacaacattccactaaaacatcttgc

SEQ ID NO: 96470 - DNA, 43 bp, Artificial Sequence
  Description of Artificial Sequence: Synthetic oligonucleotide
tcagatctaactttggctacaacattccactaaaacatcttgc

SEQ ID NO: 96471 - DNA, 42 bp, Artificial Sequence
  Description of Artificial Sequence: Synthetic oligonucleotide
cagatctaactttggctacaacattccactaaaacatcttgc

SEQ ID NO: 96472 - DNA, 43 bp, Artificial Sequence
  Description of Artificial Sequence: Synthetic oligonucleotide
agatctaactttggctacaacattccactaaaacatcttgcag

SEQ ID NO: 96473 - DNA, 42 bp, Artificial Sequence
  Description of Artificial Sequence: Synthetic oligonucleotide
gatctaactttggctacaacattccactaaaacatcttgcag

SEQ ID NO: 96474 - DNA, 43 bp, Artificial Sequence
  Description of Artificial Sequence: Synthetic oligonucleotide
atctaactttggctacaacattccactaaaacatcttgcagac

SEQ ID NO: 96475 - DNA, 42 bp, Artificial Sequence
  Description of Artificial Sequence: Synthetic oligonucleotide
tctaactttggctacaacattccactaaaacatcttgcagac

SEQ ID NO: 96476 - DNA, 41 bp, Artificial Sequence
  Description of Artificial Sequence: Synthetic oligonucleotide
ctaactttggctacaacattccactaaaacatcttgcagac

SEQ ID NO: 96477 - DNA, 42 bp, Artificial Sequence
  Description of Artificial Sequence: Synthetic oligonucleotide
taactttggctacaacattccactaaaacatcttgcagacag

SEQ ID NO: 96478 - DNA, 41 bp, Artificial Sequence
  Description of Artificial Sequence: Synthetic oligonucleotide
aactttggctacaacattccactaaaacatcttgcagacag

SEQ ID NO: 96479 - DNA, 40 bp, Artificial Sequence
  Description of Artificial Sequence: Synthetic oligonucleotide
actttggctacaacattccactaaaacatcttgcagacag

SEQ ID NO: 96480 - DNA, 39 bp, Artificial Sequence
  Description of Artificial Sequence: Synthetic oligonucleotide
ctttggctacaacattccactaaaacatcttgcagacag

SEQ ID NO: 96481 - DNA, 40 bp, Artificial Sequence
  Description of Artificial Sequence: Synthetic oligonucleotide
tttggctacaacattccactaaaacatcttgcagacagag

SEQ ID NO: 96482 - DNA, 39 bp, Artificial Sequence
  Description of Artificial Sequence: Synthetic oligonucleotide
ttggctacaacattccactaaaacatcttgcagacagag

SEQ ID NO: 96483 - DNA, 38 bp, Artificial Sequence
  Description of Artificial Sequence: Synthetic oligonucleotide
tggctacaacattccactaaaacatcttgcagacagag

SEQ ID NO: 96484 - DNA, 37 bp, Artificial Sequence
  Description of Artificial Sequence: Synthetic oligonucleotide
ggctacaacattccactaaaacatcttgcagacagag

SEQ ID NO: 96485 - DNA, 38 bp, Artificial Sequence
  Description of Artificial Sequence: Synthetic oligonucleotide
gctacaacattccactaaaacatcttgcagacagagtg

SEQ ID NO: 96486 - DNA, 38 bp, Artificial Sequence
  Description of Artificial Sequence: Synthetic oligonucleotide
ctacaacattccactaaaacatcttgcagacagagtgg

SEQ ID NO: 96487 - DNA, 38 bp, Artificial Sequence
  Description of Artificial Sequence: Synthetic oligonucleotide
tacaacattccactaaaacatcttgcagacagagtggc

SEQ ID NO: 96488 - DNA, 37 bp, Artificial Sequence
  Description of Artificial Sequence: Synthetic oligonucleotide
acaacattccactaaaacatcttgcagacagagtggc

SEQ ID NO: 96489 - DNA, 36 bp, Artificial Sequence
  Description of Artificial Sequence: Synthetic oligonucleotide
caacattccactaaaacatcttgcagacagagtggc

SEQ ID NO: 96490 - DNA, 36 bp, Artificial Sequence
  Description of Artificial Sequence: Synthetic oligonucleotide
aacattccactaaaacatcttgcagacagagtggcc

SEQ ID NO: 96491 - DNA, 35 bp, Artificial Sequence
  Description of Artificial Sequence: Synthetic oligonucleotide
acattccactaaaacatcttgcagacagagtggcc

SEQ ID NO: 96492 - DNA, 34 bp, Artificial Sequence
  Description of Artificial Sequence: Synthetic oligonucleotide
cattccactaaaacatcttgcagacagagtggcc

SEQ ID NO: 96493 - DNA, 36 bp, Artificial Sequence
  Description of Artificial Sequence: Synthetic oligonucleotide
attccactaaaacatcttgcagacagagtggccatg

SEQ ID NO: 96494 - DNA, 35 bp, Artificial Sequence
  Description of Artificial Sequence: Synthetic oligonucleotide
ttccactaaaacatcttgcagacagagtggccatg

SEQ ID NO: 96495 - DNA, 34 bp, Artificial Sequence
  Description of Artificial Sequence: Synthetic oligonucleotide
tccactaaaacatcttgcagacagagtggccatg

SEQ ID NO: 96496 - DNA, 33 bp, Artificial Sequence
  Description of Artificial Sequence: Synthetic oligonucleotide
ccactaaaacatcttgcagacagagtggccatg

SEQ ID NO: 96497 - DNA, 36 bp, Artificial Sequence
  Description of Artificial Sequence: Synthetic oligonucleotide
cactaaaacatcttgcagacagagtggccatgtatg

SEQ ID NO: 96498 - DNA, 37 bp, Artificial Sequence
  Description of Artificial Sequence: Synthetic oligonucleotide
actaaaacatcttgcagacagagtggccatgtatgtg

SEQ ID NO: 96499 - DNA, 36 bp, Artificial Sequence
  Description of Artificial Sequence: Synthetic oligonucleotide
ctaaaacatcttgcagacagagtggccatgtatgtg

SEQ ID NO: 96500 - DNA, 36 bp, Artificial Sequence
  Description of Artificial Sequence: Synthetic oligonucleotide
taaaacatcttgcagacagagtggccatgtatgtgc

SEQ ID NO: 96501 - DNA, 35 bp, Artificial Sequence
  Description of Artificial Sequence: Synthetic oligonucleotide
aaaacatcttgcagacagagtggccatgtatgtgc

SEQ ID NO: 96502 - DNA, 34 bp, Artificial Sequence
  Description of Artificial Sequence: Synthetic oligonucleotide
aaacatcttgcagacagagtggccatgtatgtgc

SEQ ID NO: 96503 - DNA, 33 bp, Artificial Sequence
  Description of Artificial Sequence: Synthetic oligonucleotide
aacatcttgcagacagagtggccatgtatgtgc

SEQ ID NO: 96504 - DNA, 32 bp, Artificial Sequence
  Description of Artificial Sequence: Synthetic oligonucleotide
acatcttgcagacagagtggccatgtatgtgc

SEQ ID NO: 96505 - DNA, 31 bp, Artificial Sequence
  Description of Artificial Sequence: Synthetic oligonucleotide
catcttgcagacagagtggccatgtatgtgc

SEQ ID NO: 96506 - DNA, 33 bp, Artificial Sequence
  Description of Artificial Sequence: Synthetic oligonucleotide
atcttgcagacagagtggccatgtatgtgcatg

SEQ ID NO: 96507 - DNA, 32 bp, Artificial Sequence
  Description of Artificial Sequence: Synthetic oligonucleotide
tcttgcagacagagtggccatgtatgtgcatg

SEQ ID NO: 96508 - DNA, 31 bp, Artificial Sequence
  Description of Artificial Sequence: Synthetic oligonucleotide
cttgcagacagagtggccatgtatgtgcatg

SEQ ID NO: 96509 - DNA, 31 bp, Artificial Sequence
  Description of Artificial Sequence: Synthetic oligonucleotide
ttgcagacagagtggccatgtatgtgcatgc

SEQ ID NO: 96510 - DNA, 30 bp, Artificial Sequence
  Description of Artificial Sequence: Synthetic oligonucleotide
tgcagacagagtggccatgtatgtgcatgc

SEQ ID NO: 96511 - DNA, 29 bp, Artificial Sequence
  Description of Artificial Sequence: Synthetic oligonucleotide
gcagacagagtggccatgtatgtgcatgc

SEQ ID NO: 96512 - DNA, 34 bp, Artificial Sequence
  Description of Artificial Sequence: Synthetic oligonucleotide
cagacagagtggccatgtatgtgcatgcatatac

SEQ ID NO: 96513 - DNA, 35 bp, Artificial Sequence
  Description of Artificial Sequence: Synthetic oligonucleotide
agacagagtggccatgtatgtgcatgcatatacac

SEQ ID NO: 96514 - DNA, 34 bp, Artificial Sequence
  Description of Artificial Sequence: Synthetic oligonucleotide
gacagagtggccatgtatgtgcatgcatatacac

SEQ ID NO: 96515 - DNA, 35 bp, Artificial Sequence
  Description of Artificial Sequence: Synthetic oligonucleotide
acagagtggccatgtatgtgcatgcatatacactc

SEQ ID NO: 96516 - DNA, 34 bp, Artificial Sequence
  Description of Artificial Sequence: Synthetic oligonucleotide
cagagtggccatgtatgtgcatgcatatacactc

SEQ ID NO: 96517 - DNA, 36 bp, Artificial Sequence
  Description of Artificial Sequence: Synthetic oligonucleotide
agagtggccatgtatgtgcatgcatatacactctac

SEQ ID NO: 96518 - DNA, 35 bp, Artificial Sequence
  Description of Artificial Sequence: Synthetic oligonucleotide
gagtggccatgtatgtgcatgcatatacactctac

SEQ ID NO: 96519 - DNA, 36 bp, Artificial Sequence
  Description of Artificial Sequence: Synthetic oligonucleotide
agtggccatgtatgtgcatgcatatacactctacag

SEQ ID NO: 96520 - DNA, 35 bp, Artificial Sequence
  Description of Artificial Sequence: Synthetic oligonucleotide
gtggccatgtatgtgcatgcatatacactctacag

SEQ ID NO: 96521 - DNA, 36 bp, Artificial Sequence
  Description of Artificial Sequence: Synthetic oligonucleotide
tggccatgtatgtgcatgcatatacactctacagtg

SEQ ID NO: 96522 - DNA, 35 bp, Artificial Sequence
  Description of Artificial Sequence: Synthetic oligonucleotide
ggccatgtatgtgcatgcatatacactctacagtg

SEQ ID NO: 96523 - DNA, 35 bp, Artificial Sequence
  Description of Artificial Sequence: Synthetic oligonucleotide
gccatgtatgtgcatgcatatacactctacagtgc

SEQ ID NO: 96524 - DNA, 36 bp, Artificial Sequence
  Description of Artificial Sequence: Synthetic oligonucleotide
ccatgtatgtgcatgcatatacactctacagtgctg

SEQ ID NO: 96525 - DNA, 39 bp, Artificial Sequence
  Description of Artificial Sequence: Synthetic oligonucleotide
catgtatgtgcatgcatatacactctacagtgctgttag

SEQ ID NO: 96526 - DNA, 40 bp, Artificial Sequence
  Description of Artificial Sequence: Synthetic oligonucleotide
atgtatgtgcatgcatatacactctacagtgctgttagac

SEQ ID NO: 96527 - DNA, 39 bp, Artificial Sequence
  Description of Artificial Sequence: Synthetic oligonucleotide
tgtatgtgcatgcatatacactctacagtgctgttagac

SEQ ID NO: 96528 - DNA, 38 bp, Artificial Sequence
  Description of Artificial Sequence: Synthetic oligonucleotide
gtatgtgcatgcatatacactctacagtgctgttagac

SEQ ID NO: 96529 - DNA, 38 bp, Artificial Sequence
  Description of Artificial Sequence: Synthetic oligonucleotide
tatgtgcatgcatatacactctacagtgctgttagacc

SEQ ID NO: 96530 - DNA, 37 bp, Artificial Sequence
  Description of Artificial Sequence: Synthetic oligonucleotide
atgtgcatgcatatacactctacagtgctgttagacc

SEQ ID NO: 96531 - DNA, 36 bp, Artificial Sequence
  Description of Artificial Sequence: Synthetic oligonucleotide
tgtgcatgcatatacactctacagtgctgttagacc

SEQ ID NO: 96532 - DNA, 35 bp, Artificial Sequence
  Description of Artificial Sequence: Synthetic oligonucleotide
gtgcatgcatatacactctacagtgctgttagacc

SEQ ID NO: 96533 - DNA, 39 bp, Artificial Sequence
  Description of Artificial Sequence: Synthetic oligonucleotide
tgcatgcatatacactctacagtgctgttagaccttttg

SEQ ID NO: 96534 - DNA, 38 bp, Artificial Sequence
  Description of Artificial Sequence: Synthetic oligonucleotide
gcatgcatatacactctacagtgctgttagaccttttg

SEQ ID NO: 96535 - DNA, 38 bp, Artificial Sequence
  Description of Artificial Sequence: Synthetic oligonucleotide
catgcatatacactctacagtgctgttagaccttttgg

SEQ ID NO: 96536 - DNA, 38 bp, Artificial Sequence
  Description of Artificial Sequence: Synthetic oligonucleotide
atgcatatacactctacagtgctgttagaccttttggc

SEQ ID NO: 96537 - DNA, 37 bp, Artificial Sequence
  Description of Artificial Sequence: Synthetic oligonucleotide
tgcatatacactctacagtgctgttagaccttttggc

SEQ ID NO: 96538 - DNA, 36 bp, Artificial Sequence
  Description of Artificial Sequence: Synthetic oligonucleotide
gcatatacactctacagtgctgttagaccttttggc

SEQ ID NO: 96539 - DNA, 37 bp, Artificial Sequence
  Description of Artificial Sequence: Synthetic oligonucleotide
catatacactctacagtgctgttagaccttttggctg

SEQ ID NO: 96540 - DNA, 37 bp, Artificial Sequence
  Description of Artificial Sequence: Synthetic oligonucleotide
atatacactctacagtgctgttagaccttttggctgc

SEQ ID NO: 96541 - DNA, 36 bp, Artificial Sequence
  Description of Artificial Sequence: Synthetic oligonucleotide
tatacactctacagtgctgttagaccttttggctgc

SEQ ID NO: 96542 - DNA, 35 bp, Artificial Sequence
  Description of Artificial Sequence: Synthetic oligonucleotide
atacactctacagtgctgttagaccttttggctgc

SEQ ID NO: 96543 - DNA, 34 bp, Artificial Sequence
  Description of Artificial Sequence: Synthetic oligonucleotide
tacactctacagtgctgttagaccttttggctgc

SEQ ID NO: 96544 - DNA, 33 bp, Artificial Sequence
  Description of Artificial Sequence: Synthetic oligonucleotide
acactctacagtgctgttagaccttttggctgc

SEQ ID NO: 96545 - DNA, 32 bp, Artificial Sequence
  Description of Artificial Sequence: Synthetic oligonucleotide
cactctacagtgctgttagaccttttggctgc

SEQ ID NO: 96546 - DNA, 33 bp, Artificial Sequence
  Description of Artificial Sequence: Synthetic oligonucleotide
actctacagtgctgttagaccttttggctgcag

SEQ ID NO: 96547 - DNA, 32 bp, Artificial Sequence
  Description of Artificial Sequence: Synthetic oligonucleotide
ctctacagtgctgttagaccttttggctgcag

SEQ ID NO: 96548 - DNA, 35 bp, Artificial Sequence
  Description of Artificial Sequence: Synthetic oligonucleotide
tctacagtgctgttagaccttttggctgcagtttc

SEQ ID NO: 96549 - DNA, 34 bp, Artificial Sequence
  Description of Artificial Sequence: Synthetic oligonucleotide
ctacagtgctgttagaccttttggctgcagtttc

SEQ ID NO: 96550 - DNA, 36 bp, Artificial Sequence
  Description of Artificial Sequence: Synthetic oligonucleotide
tacagtgctgttagaccttttggctgcagtttcatg

SEQ ID NO: 96551 - DNA, 35 bp, Artificial Sequence
  Description of Artificial Sequence: Synthetic oligonucleotide
acagtgctgttagaccttttggctgcagtttcatg

SEQ ID NO: 96552 - DNA, 34 bp, Artificial Sequence
  Description of Artificial Sequence: Synthetic oligonucleotide
cagtgctgttagaccttttggctgcagtttcatg

SEQ ID NO: 96553 - DNA, 37 bp, Artificial Sequence
  Description of Artificial Sequence: Synthetic oligonucleotide
agtgctgttagaccttttggctgcagtttcatgttag

SEQ ID NO: 96554 - DNA, 36 bp, Artificial Sequence
  Description of Artificial Sequence: Synthetic oligonucleotide
gtgctgttagaccttttggctgcagtttcatgttag

SEQ ID NO: 96555 - DNA, 36 bp, Artificial Sequence
  Description of Artificial Sequence: Synthetic oligonucleotide
tgctgttagaccttttggctgcagtttcatgttagg

SEQ ID NO: 96556 - DNA, 35 bp, Artificial Sequence
  Description of Artificial Sequence: Synthetic oligonucleotide
gctgttagaccttttggctgcagtttcatgttagg

SEQ ID NO: 96557 - DNA, 35 bp, Artificial Sequence
  Description of Artificial Sequence: Synthetic oligonucleotide
ctgttagaccttttggctgcagtttcatgttaggg

SEQ ID NO: 96558 - DNA, 36 bp, Artificial Sequence
  Description of Artificial Sequence: Synthetic oligonucleotide
tgttagaccttttggctgcagtttcatgttagggtc

SEQ ID NO: 96559 - DNA, 35 bp, Artificial Sequence
  Description of Artificial Sequence: Synthetic oligonucleotide
gttagaccttttggctgcagtttcatgttagggtc

SEQ ID NO: 96560 - DNA, 38 bp, Artificial Sequence
  Description of Artificial Sequence: Synthetic oligonucleotide
ttagaccttttggctgcagtttcatgttagggtcttac

SEQ ID NO: 96561 - DNA, 37 bp, Artificial Sequence
  Description of Artificial Sequence: Synthetic oligonucleotide
tagaccttttggctgcagtttcatgttagggtcttac

SEQ ID NO: 96562 - DNA, 36 bp, Artificial Sequence
  Description of Artificial Sequence: Synthetic oligonucleotide
agaccttttggctgcagtttcatgttagggtcttac

SEQ ID NO: 96563 - DNA, 35 bp, Artificial Sequence
  Description of Artificial Sequence: Synthetic oligonucleotide
gaccttttggctgcagtttcatgttagggtcttac

SEQ ID NO: 96564 - DNA, 36 bp, Artificial Sequence
  Description of Artificial Sequence: Synthetic oligonucleotide
accttttggctgcagtttcatgttagggtcttacag

SEQ ID NO: 96565 - DNA, 35 bp, Artificial Sequence
  Description of Artificial Sequence: Synthetic oligonucleotide
ccttttggctgcagtttcatgttagggtcttacag

SEQ ID NO: 96566 - DNA, 36 bp, Artificial Sequence
  Description of Artificial Sequence: Synthetic oligonucleotide
cttttggctgcagtttcatgttagggtcttacagtg

SEQ ID NO: 96567 - DNA, 37 bp, Artificial Sequence
  Description of Artificial Sequence: Synthetic oligonucleotide
ttttggctgcagtttcatgttagggtcttacagtgtg

SEQ ID NO: 96568 - DNA, 36 bp, Artificial Sequence
  Description of Artificial Sequence: Synthetic oligonucleotide
tttggctgcagtttcatgttagggtcttacagtgtg

SEQ ID NO: 96569 - DNA, 35 bp, Artificial Sequence
  Description of Artificial Sequence: Synthetic oligonucleotide
ttggctgcagtttcatgttagggtcttacagtgtg

SEQ ID NO: 96570 - DNA, 34 bp, Artificial Sequence
  Description of Artificial Sequence: Synthetic oligonucleotide
tggctgcagtttcatgttagggtcttacagtgtg

SEQ ID NO: 96571 - DNA, 33 bp, Artificial Sequence
  Description of Artificial Sequence: Synthetic oligonucleotide
ggctgcagtttcatgttagggtcttacagtgtg

SEQ ID NO: 96572 - DNA, 36 bp, Artificial Sequence
  Description of Artificial Sequence: Synthetic oligonucleotide
gctgcagtttcatgttagggtcttacagtgtgaatg

SEQ ID NO: 96573 - DNA, 37 bp, Artificial Sequence
  Description of Artificial Sequence: Synthetic oligonucleotide
ctgcagtttcatgttagggtcttacagtgtgaatgac

SEQ ID NO: 96574 - DNA, 37 bp, Artificial Sequence
  Description of Artificial Sequence: Synthetic oligonucleotide
tgcagtttcatgttagggtcttacagtgtgaatgacg

SEQ ID NO: 96575 - DNA, 36 bp, Artificial Sequence
  Description of Artificial Sequence: Synthetic oligonucleotide
gcagtttcatgttagggtcttacagtgtgaatgacg

SEQ ID NO: 96576 - DNA, 36 bp, Artificial Sequence
  Description of Artificial Sequence: Synthetic oligonucleotide
cagtttcatgttagggtcttacagtgtgaatgacgg

SEQ ID NO: 96577 - DNA, 37 bp, Artificial Sequence
  Description of Artificial Sequence: Synthetic oligonucleotide
agtttcatgttagggtcttacagtgtgaatgacggtg

SEQ ID NO: 96578 - DNA, 36 bp, Artificial Sequence
  Description of Artificial Sequence: Synthetic oligonucleotide
gtttcatgttagggtcttacagtgtgaatgacggtg

SEQ ID NO: 96579 - DNA, 36 bp, Artificial Sequence
  Description of Artificial Sequence: Synthetic oligonucleotide
tttcatgttagggtcttacagtgtgaatgacggtgc

SEQ ID NO: 96580 - DNA, 35 bp, Artificial Sequence
  Description of Artificial Sequence: Synthetic oligonucleotide
ttcatgttagggtcttacagtgtgaatgacggtgc

SEQ ID NO: 96581 - DNA, 34 bp, Artificial Sequence
  Description of Artificial Sequence: Synthetic oligonucleotide
tcatgttagggtcttacagtgtgaatgacggtgc

SEQ ID NO: 96582 - DNA, 33 bp, Artificial Sequence
  Description of Artificial Sequence: Synthetic oligonucleotide
catgttagggtcttacagtgtgaatgacggtgc

SEQ ID NO: 96583 - DNA, 33 bp, Artificial Sequence
  Description of Artificial Sequence: Synthetic oligonucleotide
atgttagggtcttacagtgtgaatgacggtgcg

SEQ ID NO: 96584 - DNA, 32 bp, Artificial Sequence
  Description of Artificial Sequence: Synthetic oligonucleotide
tgttagggtcttacagtgtgaatgacggtgcg

SEQ ID NO: 96585 - DNA, 31 bp, Artificial Sequence
  Description of Artificial Sequence: Synthetic oligonucleotide
gttagggtcttacagtgtgaatgacggtgcg

SEQ ID NO: 96586 - DNA, 31 bp, Artificial Sequence
  Description of Artificial Sequence: Synthetic oligonucleotide
ttagggtcttacagtgtgaatgacggtgcgc

SEQ ID NO: 96587 - DNA, 30 bp, Artificial Sequence
  Description of Artificial Sequence: Synthetic oligonucleotide
tagggtcttacagtgtgaatgacggtgcgc

SEQ ID NO: 96588 - DNA, 29 bp, Artificial Sequence
  Description of Artificial Sequence: Synthetic oligonucleotide
agggtcttacagtgtgaatgacggtgcgc

SEQ ID NO: 96589 - DNA, 28 bp, Artificial Sequence
  Description of Artificial Sequence: Synthetic oligonucleotide
gggtcttacagtgtgaatgacggtgcgc

SEQ ID NO: 96590 - DNA, 30 bp, Artificial Sequence
  Description of Artificial Sequence: Synthetic oligonucleotide
ggtcttacagtgtgaatgacggtgcgcaac

SEQ ID NO: 96591 - DNA, 31 bp, Artificial Sequence
  Description of Artificial Sequence: Synthetic oligonucleotide
gtcttacagtgtgaatgacggtgcgcaactc

SEQ ID NO: 96592 - DNA, 33 bp, Artificial Sequence
  Description of Artificial Sequence: Synthetic oligonucleotide
tcttacagtgtgaatgacggtgcgcaactctac

SEQ ID NO: 96593 - DNA, 32 bp, Artificial Sequence
  Description of Artificial Sequence: Synthetic oligonucleotide
cttacagtgtgaatgacggtgcgcaactctac

SEQ ID NO: 96594 - DNA, 34 bp, Artificial Sequence
  Description of Artificial Sequence: Synthetic oligonucleotide
ttacagtgtgaatgacggtgcgcaactctacatg

SEQ ID NO: 96595 - DNA, 33 bp, Artificial Sequence
  Description of Artificial Sequence: Synthetic oligonucleotide
tacagtgtgaatgacggtgcgcaactctacatg

SEQ ID NO: 96596 - DNA, 32 bp, Artificial Sequence
  Description of Artificial Sequence: Synthetic oligonucleotide
acagtgtgaatgacggtgcgcaactctacatg

SEQ ID NO: 96597 - DNA, 31 bp, Artificial Sequence
  Description of Artificial Sequence: Synthetic oligonucleotide
cagtgtgaatgacggtgcgcaactctacatg

SEQ ID NO: 96598 - DNA, 34 bp, Artificial Sequence
  Description of Artificial Sequence: Synthetic oligonucleotide
agtgtgaatgacggtgcgcaactctacatgattg

SEQ ID NO: 96599 - DNA, 33 bp, Artificial Sequence
  Description of Artificial Sequence: Synthetic oligonucleotide
gtgtgaatgacggtgcgcaactctacatgattg

SEQ ID NO: 96600 - DNA, 34 bp, Artificial Sequence
  Description of Artificial Sequence: Synthetic oligonucleotide
tgtgaatgacggtgcgcaactctacatgattgac

SEQ ID NO: 96601 - DNA, 33 bp, Artificial Sequence
  Description of Artificial Sequence: Synthetic oligonucleotide
gtgaatgacggtgcgcaactctacatgattgac

SEQ ID NO: 96602 - DNA, 33 bp, Artificial Sequence
  Description of Artificial Sequence: Synthetic oligonucleotide
tgaatgacggtgcgcaactctacatgattgacc

SEQ ID NO: 96603 - DNA, 32 bp, Artificial Sequence
  Description of Artificial Sequence: Synthetic oligonucleotide
gaatgacggtgcgcaactctacatgattgacc

SEQ ID NO: 96604 - DNA, 32 bp, Artificial Sequence
  Description of Artificial Sequence: Synthetic oligonucleotide
aatgacggtgcgcaactctacatgattgaccc

SEQ ID NO: 96605 - DNA, 31 bp, Artificial Sequence
  Description of Artificial Sequence: Synthetic oligonucleotide
atgacggtgcgcaactctacatgattgaccc

SEQ ID NO: 96606 - DNA, 30 bp, Artificial Sequence
  Description of Artificial Sequence: Synthetic oligonucleotide
tgacggtgcgcaactctacatgattgaccc

SEQ ID NO: 96607 - DNA, 29 bp, Artificial Sequence
  Description of Artificial Sequence: Synthetic oligonucleotide
gacggtgcgcaactctacatgattgaccc

SEQ ID NO: 96608 - DNA, 31 bp, Artificial Sequence
  Description of Artificial Sequence: Synthetic oligonucleotide
acggtgcgcaactctacatgattgacccatc

SEQ ID NO: 96609 - DNA, 30 bp, Artificial Sequence
  Description of Artificial Sequence: Synthetic oligonucleotide
cggtgcgcaactctacatgattgacccatc

SEQ ID NO: 96610 - DNA, 31 bp, Artificial Sequence
  Description of Artificial Sequence: Synthetic oligonucleotide
ggtgcgcaactctacatgattgacccatcag

SEQ ID NO: 96611 - DNA, 31 bp, Artificial Sequence
  Description of Artificial Sequence: Synthetic oligonucleotide
gtgcgcaactctacatgattgacccatcagg

SEQ ID NO: 96612 - DNA, 32 bp, Artificial Sequence
  Description of Artificial Sequence: Synthetic oligonucleotide
tgcgcaactctacatgattgacccatcaggtg

SEQ ID NO: 96613 - DNA, 31 bp, Artificial Sequence
  Description of Artificial Sequence: Synthetic oligonucleotide
gcgcaactctacatgattgacccatcaggtg

SEQ ID NO: 96614 - DNA, 34 bp, Artificial Sequence
  Description of Artificial Sequence: Synthetic oligonucleotide
cgcaactctacatgattgacccatcaggtgtttc

SEQ ID NO: 96615 - DNA, 37 bp, Artificial Sequence
  Description of Artificial Sequence: Synthetic oligonucleotide
gcaactctacatgattgacccatcaggtgtttcatac

SEQ ID NO: 96616 - DNA, 37 bp, Artificial Sequence
  Description of Artificial Sequence: Synthetic oligonucleotide
caactctacatgattgacccatcaggtgtttcatacg

SEQ ID NO: 96617 - DNA, 37 bp, Artificial Sequence
  Description of Artificial Sequence: Synthetic oligonucleotide
aactctacatgattgacccatcaggtgtttcatacgg

SEQ ID NO: 96618 - DNA, 36 bp, Artificial Sequence
  Description of Artificial Sequence: Synthetic oligonucleotide
actctacatgattgacccatcaggtgtttcatacgg

SEQ ID NO: 96619 - DNA, 35 bp, Artificial Sequence
  Description of Artificial Sequence: Synthetic oligonucleotide
ctctacatgattgacccatcaggtgtttcatacgg

SEQ ID NO: 96620 - DNA, 40 bp, Artificial Sequence
  Description of Artificial Sequence: Synthetic oligonucleotide
tctacatgattgacccatcaggtgtttcatacggttattg

SEQ ID NO: 96621 - DNA, 39 bp, Artificial Sequence
  Description of Artificial Sequence: Synthetic oligonucleotide
ctacatgattgacccatcaggtgtttcatacggttattg

SEQ ID NO: 96622 - DNA, 39 bp, Artificial Sequence
  Description of Artificial Sequence: Synthetic oligonucleotide
tacatgattgacccatcaggtgtttcatacggttattgg

SEQ ID NO: 96623 - DNA, 38 bp, Artificial Sequence
  Description of Artificial Sequence: Synthetic oligonucleotide
acatgattgacccatcaggtgtttcatacggttattgg

SEQ ID NO: 96624 - DNA, 37 bp, Artificial Sequence
  Description of Artificial Sequence: Synthetic oligonucleotide
catgattgacccatcaggtgtttcatacggttattgg

SEQ ID NO: 96625 - DNA, 37 bp, Artificial Sequence
  Description of Artificial Sequence: Synthetic oligonucleotide
atgattgacccatcaggtgtttcatacggttattggg

SEQ ID NO: 96626 - DNA, 36 bp, Artificial Sequence
  Description of Artificial Sequence: Synthetic oligonucleotide
tgattgacccatcaggtgtttcatacggttattggg

SEQ ID NO: 96627 - DNA, 35 bp, Artificial Sequence
  Description of Artificial Sequence: Synthetic oligonucleotide
gattgacccatcaggtgtttcatacggttattggg

SEQ ID NO: 96628 - DNA, 35 bp, Artificial Sequence
  Description of Artificial Sequence: Synthetic oligonucleotide
attgacccatcaggtgtttcatacggttattgggg

SEQ ID NO: 96629 - DNA, 34 bp, Artificial Sequence
  Description of Artificial Sequence: Synthetic oligonucleotide
ttgacccatcaggtgtttcatacggttattgggg

SEQ ID NO: 96630 - DNA, 33 bp, Artificial Sequence
  Description of Artificial Sequence: Synthetic oligonucleotide
tgacccatcaggtgtttcatacggttattgggg

SEQ ID NO: 96631 - DNA, 32 bp, Artificial Sequence
  Description of Artificial Sequence: Synthetic oligonucleotide
gacccatcaggtgtttcatacggttattgggg

SEQ ID NO: 96632 - DNA, 32 bp, Artificial Sequence
  Description of Artificial Sequence: Synthetic oligonucleotide
acccatcaggtgtttcatacggttattggggc

SEQ ID NO: 96633 - DNA, 31 bp, Artificial Sequence
  Description of Artificial Sequence: Synthetic oligonucleotide
cccatcaggtgtttcatacggttattggggc

SEQ ID NO: 96634 - DNA, 32 bp, Artificial Sequence
  Description of Artificial Sequence: Synthetic oligonucleotide
ccatcaggtgtttcatacggttattggggctg

SEQ ID NO: 96635 - DNA, 33 bp, Artificial Sequence
  Description of Artificial Sequence: Synthetic oligonucleotide
catcaggtgtttcatacggttattggggctgtg

SEQ ID NO: 96636 - DNA, 33 bp, Artificial Sequence
  Description of Artificial Sequence: Synthetic oligonucleotide
atcaggtgtttcatacggttattggggctgtgc

SEQ ID NO: 96637 - DNA, 32 bp, Artificial Sequence
  Description of Artificial Sequence: Synthetic oligonucleotide
tcaggtgtttcatacggttattggggctgtgc

SEQ ID NO: 96638 - DNA, 31 bp, Artificial Sequence
  Description of Artificial Sequence: Synthetic oligonucleotide
caggtgtttcatacggttattggggctgtgc

SEQ ID NO: 96639 - DNA, 31 bp, Artificial Sequence
  Description of Artificial Sequence: Synthetic oligonucleotide
aggtgtttcatacggttattggggctgtgcc

SEQ ID NO: 96640 - DNA, 30 bp, Artificial Sequence
  Description of Artificial Sequence: Synthetic oligonucleotide
ggtgtttcatacggttattggggctgtgcc

SEQ ID NO: 96641 - DNA, 32 bp, Artificial Sequence
  Description of Artificial Sequence: Synthetic oligonucleotide
gtgtttcatacggttattggggctgtgccatc

SEQ ID NO: 96642 - DNA, 32 bp, Artificial Sequence
  Description of Artificial Sequence: Synthetic oligonucleotide
tgtttcatacggttattggggctgtgccatcg

SEQ ID NO: 96643 - DNA, 31 bp, Artificial Sequence
  Description of Artificial Sequence: Synthetic oligonucleotide
gtttcatacggttattggggctgtgccatcg

SEQ ID NO: 96644 - DNA, 31 bp, Artificial Sequence
  Description of Artificial Sequence: Synthetic oligonucleotide
tttcatacggttattggggctgtgccatcgg

SEQ ID NO: 96645 - DNA, 30 bp, Artificial Sequence
  Description of Artificial Sequence: Synthetic oligonucleotide
ttcatacggttattggggctgtgccatcgg

SEQ ID NO: 96646 - DNA, 29 bp, Artificial Sequence
  Description of Artificial Sequence: Synthetic oligonucleotide
tcatacggttattggggctgtgccatcgg

SEQ ID NO: 96647 - DNA, 28 bp, Artificial Sequence
  Description of Artificial Sequence: Synthetic oligonucleotide
catacggttattggggctgtgccatcgg

SEQ ID NO: 96648 - DNA, 28 bp, Artificial Sequence
  Description of Artificial Sequence: Synthetic oligonucleotide
atacggttattggggctgtgccatcggc

SEQ ID NO: 96649 - DNA, 27 bp, Artificial Sequence
  Description of Artificial Sequence: Synthetic oligonucleotide
tacggttattggggctgtgccatcggc

SEQ ID NO: 96650 - DNA, 27 bp, Artificial Sequence
  Description of Artificial Sequence: Synthetic oligonucleotide
acggttattggggctgtgccatcggca

SEQ ID NO: 96651 - DNA, 27 bp, Artificial Sequence
  Description of Artificial Sequence: Synthetic oligonucleotide
cggttattggggctgtgccatcggcaa

SEQ ID NO: 96652 - DNA, 28 bp, Artificial Sequence
  Description of Artificial Sequence: Synthetic oligonucleotide
ggttattggggctgtgccatcggcaaag

SEQ ID NO: 96653 - DNA, 28 bp, Artificial Sequence
  Description of Artificial Sequence: Synthetic oligonucleotide
gttattggggctgtgccatcggcaaagc

SEQ ID NO: 96654 - DNA, 28 bp, Artificial Sequence
  Description of Artificial Sequence: Synthetic oligonucleotide
ttattggggctgtgccatcggcaaagcc

SEQ ID NO: 96655 - DNA, 27 bp, Artificial Sequence
  Description of Artificial Sequence: Synthetic oligonucleotide
tattggggctgtgccatcggcaaagcc

SEQ ID NO: 96656 - DNA, 27 bp, Artificial Sequence
  Description of Artificial Sequence: Synthetic oligonucleotide
attggggctgtgccatcggcaaagcca

SEQ ID NO: 96657 - DNA, 26 bp, Artificial Sequence
  Description of Artificial Sequence: Synthetic oligonucleotide
ttggggctgtgccatcggcaaagcca

SEQ ID NO: 96658 - DNA, 25 bp, Artificial Sequence
  Description of Artificial Sequence: Synthetic oligonucleotide
tggggctgtgccatcggcaaagcca

SEQ ID NO: 96659 - DNA, 24 bp, Artificial Sequence
  Description of Artificial Sequence: Synthetic oligonucleotide
ggggctgtgccatcggcaaagcca

SEQ ID NO: 96660 - DNA, 24 bp, Artificial Sequence
  Description of Artificial Sequence: Synthetic oligonucleotide
gggctgtgccatcggcaaagccag

SEQ ID NO: 96661 - DNA, 24 bp, Artificial Sequence
  Description of Artificial Sequence: Synthetic oligonucleotide
ggctgtgccatcggcaaagccagg

SEQ ID NO: 96662 - DNA, 26 bp, Artificial Sequence
  Description of Artificial Sequence: Synthetic oligonucleotide
gctgtgccatcggcaaagccaggcaa

SEQ ID NO: 96663 - DNA, 26 bp, Artificial Sequence
  Description of Artificial Sequence: Synthetic oligonucleotide
ctgtgccatcggcaaagccaggcaag

SEQ ID NO: 96664 - DNA, 27 bp, Artificial Sequence
  Description of Artificial Sequence: Synthetic oligonucleotide
tgtgccatcggcaaagccaggcaagct

SEQ ID NO: 96665 - DNA, 26 bp, Artificial Sequence
  Description of Artificial Sequence: Synthetic oligonucleotide
gtgccatcggcaaagccaggcaagct

SEQ ID NO: 96666 - DNA, 26 bp, Artificial Sequence
  Description of Artificial Sequence: Synthetic oligonucleotide
tgccatcggcaaagccaggcaagctg

SEQ ID NO: 96667 - DNA, 25 bp, Artificial Sequence
  Description of Artificial Sequence: Synthetic oligonucleotide
gccatcggcaaagccaggcaagctg

SEQ ID NO: 96668 - DNA, 27 bp, Artificial Sequence
  Description of Artificial Sequence: Synthetic oligonucleotide
ccatcggcaaagccaggcaagctgcaa

SEQ ID NO: 96669 - DNA, 28 bp, Artificial Sequence
  Description of Artificial Sequence: Synthetic oligonucleotide
catcggcaaagccaggcaagctgcaaag

SEQ ID NO: 96670 - DNA, 29 bp, Artificial Sequence
  Description of Artificial Sequence: Synthetic oligonucleotide
atcggcaaagccaggcaagctgcaaagac

SEQ ID NO: 96671 - DNA, 28 bp, Artificial Sequence
  Description of Artificial Sequence: Synthetic oligonucleotide
tcggcaaagccaggcaagctgcaaagac

SEQ ID NO: 96672 - DNA, 27 bp, Artificial Sequence
  Description of Artificial Sequence: Synthetic oligonucleotide
cggcaaagccaggcaagctgcaaagac

SEQ ID NO: 96673 - DNA, 27 bp, Artificial Sequence
  Description of Artificial Sequence: Synthetic oligonucleotide
ggcaaagccaggcaagctgcaaagacg

SEQ ID NO: 96674 - DNA, 27 bp, Artificial Sequence
  Description of Artificial Sequence: Synthetic oligonucleotide
gcaaagccaggcaagctgcaaagacgg

SEQ ID NO: 96675 - DNA, 32 bp, Artificial Sequence
  Description of Artificial Sequence: Synthetic oligonucleotide
caaagccaggcaagctgcaaagacggaaatag

SEQ ID NO: 96676 - DNA, 33 bp, Artificial Sequence
  Description of Artificial Sequence: Synthetic oligonucleotide
aaagccaggcaagctgcaaagacggaaatagag

SEQ ID NO: 96677 - DNA, 32 bp, Artificial Sequence
  Description of Artificial Sequence: Synthetic oligonucleotide
aagccaggcaagctgcaaagacggaaatagag

SEQ ID NO: 96678 - DNA, 31 bp, Artificial Sequence
  Description of Artificial Sequence: Synthetic oligonucleotide
agccaggcaagctgcaaagacggaaatagag

SEQ ID NO: 96679 - DNA, 30 bp, Artificial Sequence
  Description of Artificial Sequence: Synthetic oligonucleotide
gccaggcaagctgcaaagacggaaatagag

SEQ ID NO: 96680 - DNA, 32 bp, Artificial Sequence
  Description of Artificial Sequence: Synthetic oligonucleotide
ccaggcaagctgcaaagacggaaatagagaag

SEQ ID NO: 96681 - DNA, 32 bp, Artificial Sequence
  Description of Artificial Sequence: Synthetic oligonucleotide
caggcaagctgcaaagacggaaatagagaagc

SEQ ID NO: 96682 - DNA, 34 bp, Artificial Sequence
  Description of Artificial Sequence: Synthetic oligonucleotide
aggcaagctgcaaagacggaaatagagaagcttc

SEQ ID NO: 96683 - DNA, 33 bp, Artificial Sequence
  Description of Artificial Sequence: Synthetic oligonucleotide
ggcaagctgcaaagacggaaatagagaagcttc

SEQ ID NO: 96684 - DNA, 34 bp, Artificial Sequence
  Description of Artificial Sequence: Synthetic oligonucleotide
gcaagctgcaaagacggaaatagagaagcttcag

SEQ ID NO: 96685 - DNA, 36 bp, Artificial Sequence
  Description of Artificial Sequence: Synthetic oligonucleotide
caagctgcaaagacggaaatagagaagcttcagatg

SEQ ID NO: 96686 - DNA, 39 bp, Artificial Sequence
  Description of Artificial Sequence: Synthetic oligonucleotide
aagctgcaaagacggaaatagagaagcttcagatgaaag

SEQ ID NO: 96687 - DNA, 38 bp, Artificial Sequence
  Description of Artificial Sequence: Synthetic oligonucleotide
agctgcaaagacggaaatagagaagcttcagatgaaag

SEQ ID NO: 96688 - DNA, 37 bp, Artificial Sequence
  Description of Artificial Sequence: Synthetic oligonucleotide
gctgcaaagacggaaatagagaagcttcagatgaaag

SEQ ID NO: 96689 - DNA, 41 bp, Artificial Sequence
  Description of Artificial Sequence: Synthetic oligonucleotide
ctgcaaagacggaaatagagaagcttcagatgaaagaaatg

SEQ ID NO: 96690 - DNA, 42 bp, Artificial Sequence
  Description of Artificial Sequence: Synthetic oligonucleotide
tgcaaagacggaaatagagaagcttcagatgaaagaaatgac

SEQ ID NO: 96691 - DNA, 41 bp, Artificial Sequence
  Description of Artificial Sequence: Synthetic oligonucleotide
gcaaagacggaaatagagaagcttcagatgaaagaaatgac

SEQ ID NO: 96692 - DNA, 41 bp, Artificial Sequence
  Description of Artificial Sequence: Synthetic oligonucleotide
caaagacggaaatagagaagcttcagatgaaagaaatgacc

SEQ ID NO: 96693 - DNA, 42 bp, Artificial Sequence
  Description of Artificial Sequence: Synthetic oligonucleotide
aaagacggaaatagagaagcttcagatgaaagaaatgacctg

SEQ ID NO: 96694 - DNA, 41 bp, Artificial Sequence
  Description of Artificial Sequence: Synthetic oligonucleotide
aagacggaaatagagaagcttcagatgaaagaaatgacctg

SEQ ID NO: 96695 - DNA, 40 bp, Artificial Sequence
  Description of Artificial Sequence: Synthetic oligonucleotide
agacggaaatagagaagcttcagatgaaagaaatgacctg

SEQ ID NO: 96696 - DNA, 39 bp, Artificial Sequence
  Description of Artificial Sequence: Synthetic oligonucleotide
gacggaaatagagaagcttcagatgaaagaaatgacctg

SEQ ID NO: 96697 - DNA, 39 bp, Artificial Sequence
  Description of Artificial Sequence: Synthetic oligonucleotide
acggaaatagagaagcttcagatgaaagaaatgacctgc

SEQ ID NO: 96698 - DNA, 38 bp, Artificial Sequence
  Description of Artificial Sequence: Synthetic oligonucleotide
cggaaatagagaagcttcagatgaaagaaatgacctgc

SEQ ID NO: 96699 - DNA, 38 bp, Artificial Sequence
  Description of Artificial Sequence: Synthetic oligonucleotide
ggaaatagagaagcttcagatgaaagaaatgacctgcc

SEQ ID NO: 96700 - DNA, 38 bp, Artificial Sequence
  Description of Artificial Sequence: Synthetic oligonucleotide
gaaatagagaagcttcagatgaaagaaatgacctgccg

SEQ ID NO: 96701 - DNA, 39 bp, Artificial Sequence
  Description of Artificial Sequence: Synthetic oligonucleotide
aaatagagaagcttcagatgaaagaaatgacctgccgtg

SEQ ID NO: 96702 - DNA, 38 bp, Artificial Sequence
  Description of Artificial Sequence: Synthetic oligonucleotide
aatagagaagcttcagatgaaagaaatgacctgccgtg

SEQ ID NO: 96703 - DNA, 37 bp, Artificial Sequence
  Description of Artificial Sequence: Synthetic oligonucleotide
atagagaagcttcagatgaaagaaatgacctgccgtg

SEQ ID NO: 96704 - DNA, 36 bp, Artificial Sequence
  Description of Artificial Sequence: Synthetic oligonucleotide
tagagaagcttcagatgaaagaaatgacctgccgtg

SEQ ID NO: 96705 - DNA, 35 bp, Artificial Sequence
  Description of Artificial Sequence: Synthetic oligonucleotide
agagaagcttcagatgaaagaaatgacctgccgtg

SEQ ID NO: 96706 - DNA, 34 bp, Artificial Sequence
  Description of Artificial Sequence: Synthetic oligonucleotide
gagaagcttcagatgaaagaaatgacctgccgtg

SEQ ID NO: 96707 - DNA, 38 bp, Artificial Sequence
  Description of Artificial Sequence: Synthetic oligonucleotide
agaagcttcagatgaaagaaatgacctgccgtgatatc

SEQ ID NO: 96708 - DNA, 37 bp, Artificial Sequence
  Description of Artificial Sequence: Synthetic oligonucleotide
gaagcttcagatgaaagaaatgacctgccgtgatatc

SEQ ID NO: 96709 - DNA, 37 bp, Artificial Sequence
  Description of Artificial Sequence: Synthetic oligonucleotide
aagcttcagatgaaagaaatgacctgccgtgatatcg

SEQ ID NO: 96710 - DNA, 36 bp, Artificial Sequence
  Description of Artificial Sequence: Synthetic oligonucleotide
agcttcagatgaaagaaatgacctgccgtgatatcg

SEQ ID NO: 96711 - DNA, 35 bp, Artificial Sequence
  Description of Artificial Sequence: Synthetic oligonucleotide
gcttcagatgaaagaaatgacctgccgtgatatcg

SEQ ID NO: 96712 - DNA, 40 bp, Artificial Sequence
  Description of Artificial Sequence: Synthetic oligonucleotide
cttcagatgaaagaaatgacctgccgtgatatcgttaaag

SEQ ID NO: 96713 - DNA, 42 bp, Artificial Sequence
  Description of Artificial Sequence: Synthetic oligonucleotide
ttcagatgaaagaaatgacctgccgtgatatcgttaaagaag

SEQ ID NO: 96714 - DNA, 41 bp, Artificial Sequence
  Description of Artificial Sequence: Synthetic oligonucleotide
tcagatgaaagaaatgacctgccgtgatatcgttaaagaag

SEQ ID NO: 96715 - DNA, 40 bp, Artificial Sequence
  Description of Artificial Sequence: Synthetic oligonucleotide
cagatgaaagaaatgacctgccgtgatatcgttaaagaag

SEQ ID NO: 96716 - DNA, 42 bp, Artificial Sequence
  Description of Artificial Sequence: Synthetic oligonucleotide
agatgaaagaaatgacctgccgtgatatcgttaaagaagttg

SEQ ID NO: 96717 - DNA, 41 bp, Artificial Sequence
  Description of Artificial Sequence: Synthetic oligonucleotide
gatgaaagaaatgacctgccgtgatatcgttaaagaagttg

SEQ ID NO: 96718 - DNA, 41 bp, Artificial Sequence
  Description of Artificial Sequence: Synthetic oligonucleotide
atgaaagaaatgacctgccgtgatatcgttaaagaagttgc

SEQ ID NO: 96719 - DNA, 40 bp, Artificial Sequence
  Description of Artificial Sequence: Synthetic oligonucleotide
tgaaagaaatgacctgccgtgatatcgttaaagaagttgc

SEQ ID NO: 96720 - DNA, 39 bp, Artificial Sequence
  Description of Artificial Sequence: Synthetic oligonucleotide
gaaagaaatgacctgccgtgatatcgttaaagaagttgc

SEQ ID NO: 96721 - DNA, 51 bp, Artificial Sequence
  Description of Artificial Sequence: Synthetic oligonucleotide
aaagaaatgacctgccgtgatatcgttaaagaagttgcaaaaataatttac

SEQ ID NO: 96722 - DNA, 50 bp, Artificial Sequence
  Description of Artificial Sequence: Synthetic oligonucleotide
aagaaatgacctgccgtgatatcgttaaagaagttgcaaaaataatttac

SEQ ID NO: 96723 - DNA, 49 bp, Artificial Sequence
  Description of Artificial Sequence: Synthetic oligonucleotide
agaaatgacctgccgtgatatcgttaaagaagttgcaaaaataatttac

SEQ ID NO: 96724 - DNA, 48 bp, Artificial Sequence
  Description of Artificial Sequence: Synthetic oligonucleotide
gaaatgacctgccgtgatatcgttaaagaagttgcaaaaataatttac

SEQ ID NO: 96725 - DNA, 51 bp, Artificial Sequence
  Description of Artificial Sequence: Synthetic oligonucleotide
aaatgacctgccgtgatatcgttaaagaagttgcaaaaataatttacatag

SEQ ID NO: 96726 - DNA, 50 bp, Artificial Sequence
  Description of Artificial Sequence: Synthetic oligonucleotide
aatgacctgccgtgatatcgttaaagaagttgcaaaaataatttacatag

SEQ ID NO: 96727 - DNA, 49 bp, Artificial Sequence
  Description of Artificial Sequence: Synthetic oligonucleotide
atgacctgccgtgatatcgttaaagaagttgcaaaaataatttacatag

SEQ ID NO: 96728 - DNA, 48 bp, Artificial Sequence
  Description of Artificial Sequence: Synthetic oligonucleotide
tgacctgccgtgatatcgttaaagaagttgcaaaaataatttacatag

SEQ ID NO: 96729 - DNA, 47 bp, Artificial Sequence
  Description of Artificial Sequence: Synthetic oligonucleotide
gacctgccgtgatatcgttaaagaagttgcaaaaataatttacatag

SEQ ID NO: 96730 - DNA, 49 bp, Artificial Sequence
  Description of Artificial Sequence: Synthetic oligonucleotide
acctgccgtgatatcgttaaagaagttgcaaaaataatttacatagtac

SEQ ID NO: 96731 - DNA, 48 bp, Artificial Sequence
  Description of Artificial Sequence: Synthetic oligonucleotide
cctgccgtgatatcgttaaagaagttgcaaaaataatttacatagtac

SEQ ID NO: 96732 - DNA, 50 bp, Artificial Sequence
  Description of Artificial Sequence: Synthetic oligonucleotide
ctgccgtgatatcgttaaagaagttgcaaaaataatttacatagtacatg

SEQ ID NO: 96733 - DNA, 51 bp, Artificial Sequence
  Description of Artificial Sequence: Synthetic oligonucleotide
tgccgtgatatcgttaaagaagttgcaaaaataatttacatagtacatgac

SEQ ID NO: 96734 - DNA, 50 bp, Artificial Sequence
  Description of Artificial Sequence: Synthetic oligonucleotide
gccgtgatatcgttaaagaagttgcaaaaataatttacatagtacatgac

SEQ ID NO: 96735 - DNA, 50 bp, Artificial Sequence
  Description of Artificial Sequence: Synthetic oligonucleotide
ccgtgatatcgttaaagaagttgcaaaaataatttacatagtacatgacg

SEQ ID NO: 96736 - DNA, 52 bp, Artificial Sequence
  Description of Artificial Sequence: Synthetic oligonucleotide
cgtgatatcgttaaagaagttgcaaaaataatttacatagtacatgacgaag

SEQ ID NO: 96737 - DNA, 56 bp, Artificial Sequence
  Description of Artificial Sequence: Synthetic oligonucleotide
gtgatatcgttaaagaagttgcaaaaataatttacatagtacatgacgaagttaag

SEQ ID NO: 96738 - DNA, 56 bp, Artificial Sequence
  Description of Artificial Sequence: Synthetic oligonucleotide
tgatatcgttaaagaagttgcaaaaataatttacatagtacatgacgaagttaagg

SEQ ID NO: 96739 - DNA, 55 bp, Artificial Sequence
  Description of Artificial Sequence: Synthetic oligonucleotide
gatatcgttaaagaagttgcaaaaataatttacatagtacatgacgaagttaagg

SEQ ID NO: 96740 - DNA, 60 bp, Artificial Sequence
  Description of Artificial Sequence: Synthetic oligonucleotide
atatcgttaaagaagttgcaaaaataatttacatagtacatgacgaagttaaggataaag

SEQ ID NO: 96741 - DNA, 59 bp, Artificial Sequence
  Description of Artificial Sequence: Synthetic oligonucleotide
tatcgttaaagaagttgcaaaaataatttacatagtacatgacgaagttaaggataaag

SEQ ID NO: 96742 - DNA, 58 bp, Artificial Sequence
  Description of Artificial Sequence: Synthetic oligonucleotide
atcgttaaagaagttgcaaaaataatttacatagtacatgacgaagttaaggataaag

SEQ ID NO: 96743 - DNA, 57 bp, Artificial Sequence
  Description of Artificial Sequence: Synthetic oligonucleotide
tcgttaaagaagttgcaaaaataatttacatagtacatgacgaagttaaggataaag

SEQ ID NO: 96744 - DNA, 56 bp, Artificial Sequence
  Description of Artificial Sequence: Synthetic oligonucleotide
cgttaaagaagttgcaaaaataatttacatagtacatgacgaagttaaggataaag

SEQ ID NO: 96745 - DNA, 56 bp, Artificial Sequence
  Description of Artificial Sequence: Synthetic oligonucleotide
gttaaagaagttgcaaaaataatttacatagtacatgacgaagttaaggataaagc

SEQ ID NO: 96746 - DNA, 60 bp, Artificial Sequence
  Description of Artificial Sequence: Synthetic oligonucleotide
ttaaagaagttgcaaaaataatttacatagtacatgacgaagttaaggataaagcttttg

SEQ ID NO: 96747 - DNA, 59 bp, Artificial Sequence
  Description of Artificial Sequence: Synthetic oligonucleotide
taaagaagttgcaaaaataatttacatagtacatgacgaagttaaggataaagcttttg

SEQ ID NO: 96748 - DNA, 58 bp, Artificial Sequence
  Description of Artificial Sequence: Synthetic oligonucleotide
aaagaagttgcaaaaataatttacatagtacatgacgaagttaaggataaagcttttg

SEQ ID NO: 96749 - DNA, 57 bp, Artificial Sequence
  Description of Artificial Sequence: Synthetic oligonucleotide
aagaagttgcaaaaataatttacatagtacatgacgaagttaaggataaagcttttg

SEQ ID NO: 96750 - DNA, 56 bp, Artificial Sequence
  Description of Artificial Sequence: Synthetic oligonucleotide
agaagttgcaaaaataatttacatagtacatgacgaagttaaggataaagcttttg

SEQ ID NO: 96751 - DNA, 55 bp, Artificial Sequence
  Description of Artificial Sequence: Synthetic oligonucleotide
gaagttgcaaaaataatttacatagtacatgacgaagttaaggataaagcttttg

SEQ ID NO: 96752 - DNA, 57 bp, Artificial Sequence
  Description of Artificial Sequence: Synthetic oligonucleotide
aagttgcaaaaataatttacatagtacatgacgaagttaaggataaagcttttgaac

SEQ ID NO: 96753 - DNA, 56 bp, Artificial Sequence
  Description of Artificial Sequence: Synthetic oligonucleotide
agttgcaaaaataatttacatagtacatgacgaagttaaggataaagcttttgaac

SEQ ID NO: 96754 - DNA, 55 bp, Artificial Sequence
  Description of Artificial Sequence: Synthetic oligonucleotide
gttgcaaaaataatttacatagtacatgacgaagttaaggataaagcttttgaac

SEQ ID NO: 96755 - DNA, 57 bp, Artificial Sequence
  Description of Artificial Sequence: Synthetic oligonucleotide
ttgcaaaaataatttacatagtacatgacgaagttaaggataaagcttttgaactag

SEQ ID NO: 96756 - DNA, 56 bp, Artificial Sequence
  Description of Artificial Sequence: Synthetic oligonucleotide
tgcaaaaataatttacatagtacatgacgaagttaaggataaagcttttgaactag

SEQ ID NO: 96757 - DNA, 55 bp, Artificial Sequence
  Description of Artificial Sequence: Synthetic oligonucleotide
gcaaaaataatttacatagtacatgacgaagttaaggataaagcttttgaactag

SEQ ID NO: 96758 - DNA, 57 bp, Artificial Sequence
  Description of Artificial Sequence: Synthetic oligonucleotide
caaaaataatttacatagtacatgacgaagttaaggataaagcttttgaactagaac

SEQ ID NO: 96759 - DNA, 58 bp, Artificial Sequence
  Description of Artificial Sequence: Synthetic oligonucleotide
aaaaataatttacatagtacatgacgaagttaaggataaagcttttgaactagaactc

SEQ ID NO: 96760 - DNA, 57 bp, Artificial Sequence
  Description of Artificial Sequence: Synthetic oligonucleotide
aaaataatttacatagtacatgacgaagttaaggataaagcttttgaactagaactc

SEQ ID NO: 96761 - DNA, 56 bp, Artificial Sequence
  Description of Artificial Sequence: Synthetic oligonucleotide
aaataatttacatagtacatgacgaagttaaggataaagcttttgaactagaactc

SEQ ID NO: 96762 - DNA, 55 bp, Artificial Sequence
  Description of Artificial Sequence: Synthetic oligonucleotide
aataatttacatagtacatgacgaagttaaggataaagcttttgaactagaactc

SEQ ID NO: 96763 - DNA, 54 bp, Artificial Sequence
  Description of Artificial Sequence: Synthetic oligonucleotide
ataatttacatagtacatgacgaagttaaggataaagcttttgaactagaactc

SEQ ID NO: 96764 - DNA, 53 bp, Artificial Sequence
  Description of Artificial Sequence: Synthetic oligonucleotide
taatttacatagtacatgacgaagttaaggataaagcttttgaactagaactc

SEQ ID NO: 96765 - DNA, 52 bp, Artificial Sequence
  Description of Artificial Sequence: Synthetic oligonucleotide
aatttacatagtacatgacgaagttaaggataaagcttttgaactagaactc

SEQ ID NO: 96766 - DNA, 51 bp, Artificial Sequence
  Description of Artificial Sequence: Synthetic oligonucleotide
atttacatagtacatgacgaagttaaggataaagcttttgaactagaactc

SEQ ID NO: 96767 - DNA, 50 bp, Artificial Sequence
  Description of Artificial Sequence: Synthetic oligonucleotide
tttacatagtacatgacgaagttaaggataaagcttttgaactagaactc

SEQ ID NO: 96768 - DNA, 49 bp, Artificial Sequence
  Description of Artificial Sequence: Synthetic oligonucleotide
ttacatagtacatgacgaagttaaggataaagcttttgaactagaactc

SEQ ID NO: 96769 - DNA, 48 bp, Artificial Sequence
  Description of Artificial Sequence: Synthetic oligonucleotide
tacatagtacatgacgaagttaaggataaagcttttgaactagaactc

SEQ ID NO: 96770 - DNA, 47 bp, Artificial Sequence
  Description of Artificial Sequence: Synthetic oligonucleotide
acatagtacatgacgaagttaaggataaagcttttgaactagaactc

SEQ ID NO: 96771 - DNA, 46 bp, Artificial Sequence
  Description of Artificial Sequence: Synthetic oligonucleotide
catagtacatgacgaagttaaggataaagcttttgaactagaactc

SEQ ID NO: 96772 - DNA, 47 bp, Artificial Sequence
  Description of Artificial Sequence: Synthetic oligonucleotide
atagtacatgacgaagttaaggataaagcttttgaactagaactcag

SEQ ID NO: 96773 - DNA, 46 bp, Artificial Sequence
  Description of Artificial Sequence: Synthetic oligonucleotide
tagtacatgacgaagttaaggataaagcttttgaactagaactcag

SEQ ID NO: 96774 - DNA, 45 bp, Artificial Sequence
  Description of Artificial Sequence: Synthetic oligonucleotide
agtacatgacgaagttaaggataaagcttttgaactagaactcag

SEQ ID NO: 96775 - DNA, 44 bp, Artificial Sequence
  Description of Artificial Sequence: Synthetic oligonucleotide
gtacatgacgaagttaaggataaagcttttgaactagaactcag

SEQ ID NO: 96776 - DNA, 44 bp, Artificial Sequence
  Description of Artificial Sequence: Synthetic oligonucleotide
tacatgacgaagttaaggataaagcttttgaactagaactcagc

SEQ ID NO: 96777 - DNA, 43 bp, Artificial Sequence
  Description of Artificial Sequence: Synthetic oligonucleotide
acatgacgaagttaaggataaagcttttgaactagaactcagc

SEQ ID NO: 96778 - DNA, 42 bp, Artificial Sequence
  Description of Artificial Sequence: Synthetic oligonucleotide
catgacgaagttaaggataaagcttttgaactagaactcagc

SEQ ID NO: 96779 - DNA, 43 bp, Artificial Sequence
  Description of Artificial Sequence: Synthetic oligonucleotide
atgacgaagttaaggataaagcttttgaactagaactcagctg

SEQ ID NO: 96780 - DNA, 42 bp, Artificial Sequence
  Description of Artificial Sequence: Synthetic oligonucleotide
tgacgaagttaaggataaagcttttgaactagaactcagctg

SEQ ID NO: 96781 - DNA, 41 bp, Artificial Sequence
  Description of Artificial Sequence: Synthetic oligonucleotide
gacgaagttaaggataaagcttttgaactagaactcagctg

SEQ ID NO: 96782 - DNA, 41 bp, Artificial Sequence
  Description of Artificial Sequence: Synthetic oligonucleotide
acgaagttaaggataaagcttttgaactagaactcagctgg

SEQ ID NO: 96783 - DNA, 40 bp, Artificial Sequence
  Description of Artificial Sequence: Synthetic oligonucleotide
cgaagttaaggataaagcttttgaactagaactcagctgg

SEQ ID NO: 96784 - DNA, 40 bp, Artificial Sequence
  Description of Artificial Sequence: Synthetic oligonucleotide
gaagttaaggataaagcttttgaactagaactcagctggg

SEQ ID NO: 96785 - DNA, 42 bp, Artificial Sequence
  Description of Artificial Sequence: Synthetic oligonucleotide
aagttaaggataaagcttttgaactagaactcagctgggttg
